United States Patent 7,709,616 (MICRORNAS AND USES THEREOF) - sequence listing, part 5

SEQ ID NO: 111320 - RNA, 64 nt, hsa
ggugcucugguuuccucagcaacacuccuuguaaggggcagagacaggguccaccaacucccca

SEQ ID NO: 111321 - RNA, 64 nt, hsa
uuagcaggcagcugggcauggaggugcuggggcuggggcagaugccuaauuucgcacaaugcau

SEQ ID NO: 111322 - RNA, 64 nt, hsa
acagccuacagccagaacuucugagcauccucucggggcagacccuccccguccucguggagcu

SEQ ID NO: 111323 - RNA, 64 nt, hsa
agcagcagccuggcugccuugucauggccuccugggggcagaaggcgauguggaccacgggauu

SEQ ID NO: 111324 - RNA, 64 nt, hsa
accuuaggccacccuccucaugcccacccagcaaggggcagaggccacaggccuggaacccugg

SEQ ID NO: 111325 - RNA, 64 nt, hsa
auaaccugucaggcuggcuugguuagguuuuacuggggcagaggauagggaaucucuuauuaaa

SEQ ID NO: 111326 - RNA, 64 nt, hsa
ccagcugcugaaauuagcuacucaccaagagugaggggcagagacuuccagucacugagucucc

SEQ ID NO: 111327 - RNA, 64 nt, hsa
cucaggagguuggggcagaauugcuugaacccagggggcagagguugcagugagccgagauugc

SEQ ID NO: 111328 - RNA, 64 nt, hsa
gccugugccuguaaacccagcuacucaggagguuggggcagaauugcuugaacccagggggcag

SEQ ID NO: 111329 - RNA, 64 nt, hsa
ggcauugcucuaccucucccugacauuuugcuccggggcagauccaaccuuaccuggggcagca

SEQ ID NO: 111330 - RNA, 64 nt, hsa
aucuggaccaguagcccaucccgcaguuuucuugggggcagaggaaaacgcuucuuucuccucc

SEQ ID NO: 111331 - RNA, 64 nt, hsa
uuagccgugcaugcacuuuguggccccuuugcaaggggcagaggguacuggaagugggaggagg

SEQ ID NO: 111332 - RNA, 64 nt, hsa
aaaauauucuucugggcucaaaagcuagcuugagggggcagaugccccaggugucccagcucca

SEQ ID NO: 111333 - RNA, 64 nt, hsa
cuuuuccucuuuugugagaagaugggggcuggagggggcagaguggccugugagcaagagccag

SEQ ID NO: 111334 - RNA, 64 nt, hsa
agcaagagccaggggugucccagucccagccucuggggcagagcuuguagcccuggauggccuc

SEQ ID NO: 111335 - RNA, 57 nt, hsa
gcugcugcuccuucaugugaaucccagggggcagagaggaggcucuggaggcacaca

SEQ ID NO: 111336 - RNA, 64 nt, hsa
gauaagagauauggagaugggagggggaggacaaggggcagagaguagggucuagcuggcuauc

SEQ ID NO: 111337 - RNA, 64 nt, hsa
gagaggcagguccuaaaggagggggggucuccugggggcagaccgagggucucggaggauagaa

SEQ ID NO: 111338 - RNA, 64 nt, hsa
cacuuggcaagcggcugggccugacggaggccgaggggcagaccggggcuccagccagaccccu

SEQ ID NO: 111339 - RNA, 64 nt, hsa
cccuccaaucccaccggacccaggcccugggcuaggggcagagcaggccccgccccagggcaau

SEQ ID NO: 111340 - RNA, 64 nt, hsa
guauuuauuccccuuuagguuugcagaggggguaggggcagagucaggggcuggccagaggguc

SEQ ID NO: 111341 - RNA, 64 nt, hsa
gcccaagauuccgagagcccugcgcucuagggcaggggcagaguuuuggaaacagugcaggcuc

SEQ ID NO: 111342 - RNA, 64 nt, hsa
gaagucacuugcucaaggucaggcagcuuaggaaggggcagaucgggggcuugaacccaggugg

SEQ ID NO: 111343 - RNA, 64 nt, hsa
cccauuucuguccuuggccuugggaguagcugagggggcagacuagggaguagggcuggcaggg

SEQ ID NO: 111344 - RNA, 64 nt, hsa
gggggcagacuagggaguagggcuggcaggggagggggcagacagccucgccucgcacccuuca

SEQ ID NO: 111345 - RNA, 64 nt, hsa
cuaguuuuuagcccuuuuuguuggggguggggugggggcagaggagaggcggauacagaaacuu

SEQ ID NO: 111346 - RNA, 64 nt, hsa
ggacaucaggcaaggucuggagacauuuuugguuggggcagaggcaugcuccuggcaucgagug

SEQ ID NO: 111347 - RNA, 57 nt, hsa
cccagacaaacagcagaugaguugaguggggcagagggacagggcagccagaccaag

SEQ ID NO: 111348 - RNA, 64 nt, hsa
ccagcaggugccagggcuggugaggaagagcuggggggcagagguaaagcccugcaggggaggc

SEQ ID NO: 111349 - RNA, 64 nt, hsa
ucuccgaaaugcugucuuucuugcucccugacugggggcagacaugguggggucuccucaggac

SEQ ID NO: 111350 - RNA, 64 nt, hsa
ucccucuccagcaggcccaugggaggcuggaguuggggcagaggagaacuugcugccucggauc

SEQ ID NO: 111351 - RNA, 64 nt, hsa
ccuagcuuucaguuuucucuucugugaaacaggaagacugaaccacguaauuaauauccaaggu

SEQ ID NO: 111352 - RNA, 64 nt, hsa
auuagauuggaucucccaaguuuuaauugaaaggagacugaacgaaaaccuuucugcuuucugu

SEQ ID NO: 111353 - RNA, 64 nt, hsa
gggcaucaacauggccaacagcauugccaaccugagacugaaggccaaggaauauaguuuacag

SEQ ID NO: 111354 - RNA, 64 nt, hsa
auuaucaaguuuugaaggaacuguacaucccaacagacugaaacauucuaagugaaaugaguau

SEQ ID NO: 111355 - RNA, 64 nt, hsa
gcacaaaucucuacuccucaugacaugaagaaaaagacugaaugugaagggaguuucuguacug

SEQ ID NO: 111356 - RNA, 64 nt, hsa
aaagccggggucaaaaaaaguaguuuaagucuuaagacugaauaugcauuaaaguaugcaggua

SEQ ID NO: 111357 - RNA, 64 nt, hsa
ucaguaccaaauagucacgcuuaaaagugugugaagacugaauccaagaagucuugggauugga

SEQ ID NO: 111358 - RNA, 60 nt, hsa
uccacauaauuuugaagugaugucuuauauagacugaacuguauucaguaccaaauaguc

SEQ ID NO: 111359 - RNA, 64 nt, hsa
ucauuucauuauguuucuuccaaggaaacaggagagacugaauuaauaauucucucuuuccucu

SEQ ID NO: 111360 - RNA, 64 nt, hsa
ugaagaaccacugcugcaggugguagcccuggcuagacugaauuacacuagaaaucagccagaa

SEQ ID NO: 111361 - RNA, 64 nt, hsa
uucuugccuaaugauguuaucuaggcaccauuggagacugaaaaaaaaaaaucccugcucugua

SEQ ID NO: 111362 - RNA, 64 nt, hsa
gaccaauacaaaauaacaaaaauguaauggaaucagacugaauuaaaguaaggcuguauauuga

SEQ ID NO: 111363 - RNA, 64 nt, hsa
gaacagauuacuuaaagcuauuucauuucaaagcagacugaaugugacuucaucuaaaggcagc

SEQ ID NO: 111364 - RNA, 64 nt, hsa
acggcuuaaccccagucuugaugguauauugaacagacugaauauauuuuaccauuacagggcu

SEQ ID NO: 111365 - RNA, 64 nt, hsa
gaacuggugcagcuucucucucccucccucccacagacugaaccuuucgccagaagcuguccuu

SEQ ID NO: 111366 - RNA, 64 nt, hsa
uacuagccuaacagauuggcuuguuuuaaagcaaagacugaauugaagguuacauguuuuagga

SEQ ID NO: 111367 - RNA, 64 nt, hsa
cuccuucucagcucacuucaauaacuauuuucugagacugaaguuuuuuagacaagaauaagaa

SEQ ID NO: 111368 - RNA, 64 nt, hsa
cagucagacacgaaauccaacugaauuacccgguagacugaauaucugacgggauuucuauaug

SEQ ID NO: 111369 - RNA, 64 nt, hsa
uuuaaccuuuucauuuuauguuuuuguacucugcagacugaaaagacaaaguuuaucuuggccu

SEQ ID NO: 111370 - RNA, 64 nt, hsa
cuucuccaauacagcaaaccuaauugcacaacagagacugaaauguguuuccugaauaccagug

SEQ ID NO: 111371 - RNA, 64 nt, hsa
cugagaaguuaacccuuaaacaguuuucuggaagagacugaauuucuggguccuugcagcugug

SEQ ID NO: 111372 - RNA, 64 nt, hsa
uagauuccucuagaaaggcaucaaaaggcucaacagacugaauggccucuuggucugcgaaaau

SEQ ID NO: 111373 - RNA, 64 nt, hsa
uucaugauuuuauuucccagcagugcugaugacaagacugaauguuaccuuuucuuucugacag

SEQ ID NO: 111374 - RNA, 64 nt, hsa
ccucucauaguagguauauaugaguuuucacagaagacugaaaaauaaugcaugauauuuguuu

SEQ ID NO: 111375 - RNA, 64 nt, hsa
ugaaucugaguacacccuggcaaggcuucucuucagacugaagcagcaauucugccacuaccag

SEQ ID NO: 111376 - RNA, 52 nt, hsa
uaaaaccuuuguaucuauaagaagacugaaaaccauggagauuauuuuuauu

SEQ ID NO: 111377 - RNA, 64 nt, hsa
gguaaaugggcgaaauccaggccaggagccucagagacugaagcagaacagaguaagacucaug

SEQ ID NO: 111378 - RNA, 64 nt, hsa
caaccucgucaucauccccacuuuaaaccccaggagacugaaacucaaacaacccugggcaagu

SEQ ID NO: 111379 - RNA, 61 nt, hsa
gcuuucuuacaugguuauagagcccucaggcagacugaauucuaaaucugugaaggaucua

SEQ ID NO: 111380 - RNA, 64 nt, hsa
uaaauacaugccuucuauauggaacauggcagaaagacugaaaaauaacaguaauuaauugugu

SEQ ID NO: 111381 - RNA, 64 nt, hsa
cugucccauauuuggguuaugaugacucaaguguagacugaaguugagguagugccuuaugcca

SEQ ID NO: 111382 - RNA, 64 nt, hsa
uucugagcugcugcuuuugauauagucagacuuaagacugaaccccaguagacaggcaauagau

SEQ ID NO: 111383 - RNA, 64 nt, hsa
ugaaacucauuuaacuggguuaauuucauuucuuagacugaauauauuauuguuaagauacgug

SEQ ID NO: 111384 - RNA, 64 nt, hsa
agaucaaguuguucuccccacuuuacugcaagguagacugaaguucagaagaaauacugaauuu

SEQ ID NO: 111385 - RNA, 64 nt, hsa
ccugccauuuccacccuccagucauuucucuaugagacugaagcaggaaggcagagcaucaucu

SEQ ID NO: 111386 - RNA, 64 nt, hsa
aaagcccacaccuaacauuauacuucauggugauagacugaaggcugaauguuuuccccuuaag

SEQ ID NO: 111387 - RNA, 64 nt, hsa
ugggugacagagcgagacuccauuucaaaaaaaaagacugaaacaagcuugugcuaagauggaa

SEQ ID NO: 111388 - RNA, 64 nt, hsa
uaccugugaaugaacaaugaagucguuccucuuaagacugaaacaagcaggccagauguggugg

SEQ ID NO: 111389 - RNA, 64 nt, hsa
uugaaggaaaauacugacuuuaagauguauuuuaagacugaaauuuuguucuuuaguacuuuuc

SEQ ID NO: 111390 - RNA, 64 nt, hsa
cuaucacagacaauggaauucgucaguggugguaagacugaaauccugaugcuuuucacacuuc

SEQ ID NO: 111391 - RNA, 64 nt, hsa
uuucuagaaugucauggaagaggaacgugcaacuacuauucaaauuccuacaguuucuggcugg

SEQ ID NO: 111392 - RNA, 64 nt, hsa
gugcuguuucaaaguucucuguggcaaagcagcaacuauucacaaaauaucaccaaaaaccuau

SEQ ID NO: 111393 - RNA, 64 nt, hsa
agugaauuagaaauuucagcucaguuucuauuuuacuauucaaguuguguacuuuaaacaaaua

SEQ ID NO: 111394 - RNA, 64 nt, hsa
aacuuuaauugaaauaauauagauuuaguugaauacuauucaggaaguaauaaauuuuaauaua

SEQ ID NO: 111395 - RNA, 64 nt, hsa
uaaagagacauuugaacccuauguuuacugcagcacuauucacaauagccaagauauaggagca

SEQ ID NO: 111396 - RNA, 64 nt, hsa
gucaauaaguauauuuuuaaaaugcucaacauuaacuauucauacagaaaugcaaaucaaaacc

SEQ ID NO: 111397 - RNA, 64 nt, hsa
uuaaucuuuuggaauauugucuuucuuuguuauaacuauucauuuuuagcuuuugucuccagug

SEQ ID NO: 111398 - RNA, 64 nt, hsa
cguguagaaacuagccacuguucaaaucugauacacuauucaaccacaaaguguaaaggcacug

SEQ ID NO: 111399 - RNA, 64 nt, hsa
aagacuguaacacagcugaacuauuucagugucaacuauucagaauugaaaauguaaauuaaaa

SEQ ID NO: 111400 - RNA, 64 nt, hsa
uauuuaaccccaaacauuuggauuggugaaugggacuauucauuguucaaagauccagugcagu

SEQ ID NO: 111401 - RNA, 64 nt, hsa
acccacgcggauguugcaccucauucucccgaugacuauucaaaucagcaucuagaggcugaau

SEQ ID NO: 111402 - RNA, 64 nt, hsa
cauuaaucucuuuauccauugcugaacgacugugacuauucaguaacgaaguaauaguaauuaa

SEQ ID NO: 111403 - RNA, 61 nt, hsa
cacccagaucaccaaaguaaaaaacaacaaaacuauucaaaaacuucacucucuucccauu

SEQ ID NO: 111404 - RNA, 64 nt, hsa
gacaugguauacuacuauauuuacucaguuugaaacuauucauuucuacacacuauuuuuaaaa

SEQ ID NO: 111405 - RNA, 64 nt, hsa
gcauuugguuuguugguuagccgacugucuugaaacuauucauuuugcuucuaguuuuauuuua

SEQ ID NO: 111406 - RNA, 64 nt, hsa
ugaugaaagccaaaaccuguuuguacuguucuauacuauucagguaucuuuuuauuucugauag

SEQ ID NO: 111407 - RNA, 64 nt, hsa
augaauaucggaauaugugcacaguaacauuuggacuauucauuggagaguuuacccauacauu

SEQ ID NO: 111408 - RNA, 64 nt, hsa
uggaguuugcuaagggcaguauuuuucugucaagacuauucaagaaggcauuauuugagauucc

SEQ ID NO: 111409 - RNA, 64 nt, hsa
acaguuuaucccuguaggauaaaugauccauuuaacuauucaucagaggugcuguaauuuuaaa

SEQ ID NO: 111410 - RNA, 64 nt, hsa
agaucagggguguuucaugggaaaaucuacacaaacuauucauuaaaaaccauagagccaugga

SEQ ID NO: 111411 - RNA, 64 nt, hsa
caggaaagguuuugaaaaaggaugggucccacccucccuccagagccaccaguguuagagcgga

SEQ ID NO: 111412 - RNA, 64 nt, hsa
cagccccuggggaaaagcagccucccuucuccucucccuccacucccucgcucccucccucagc

SEQ ID NO: 111413 - RNA, 64 nt, hsa
uggugccagcuggcaaaugagggcuggacucucuucccuccagagaccaccccgcuccuugcug

SEQ ID NO: 111414 - RNA, 64 nt, hsa
guggagggacuucccucccccucuuuuccauuucucccuccaucaccaccugcccucacauccu

SEQ ID NO: 111415 - RNA, 64 nt, hsa
cccucugcuggguagagaggcacuuucagggacuucccuccagcugccucuucaucugggaaug

SEQ ID NO: 111416 - RNA, 64 nt, hsa
gccuccugcccacccagggcccuuuacucucuucucccuccagaccuuccucugacccuugcug

SEQ ID NO: 111417 - RNA, 64 nt, hsa
cacuuuccaucucugccugucaauaucguaccugucccuccaggcccaucucaaaucacaagga

SEQ ID NO: 111418 - RNA, 64 nt, hsa
gccucccuucuccuuucuaagcccuguucuccugucccuccaucccagacauugauggggacau

SEQ ID NO: 111419 - RNA, 64 nt, hsa
accugcccuagaccuccagagaccauauuuucucucccuccauuucuacccagaccuccaggcc

SEQ ID NO: 111420 - RNA, 64 nt, hsa
uuauuucccuaaacgacccuuccucacauucccuucccuccaccucuccuuaccaagcacccaa

SEQ ID NO: 111421 - RNA, 64 nt, hsa
agccugaguggugaggggccacugggccccauucucccuccauggcaggaaggcgggggauuuc

SEQ ID NO: 111422 - RNA, 64 nt, hsa
gguggggcuguacacacccuccagcacagacuguucccuccaagguccucuuaggucccgggag

SEQ ID NO: 111423 - RNA, 64 nt, hsa
cuuuucgagcucuugaccaccuccaauguguaggucccuccaggcuggggcuugggacugcuua

SEQ ID NO: 111424 - RNA, 64 nt, hsa
uucuucccacagccaaagccccauccccuucauuucccuccagucccuggaggggcuucuagua

SEQ ID NO: 111425 - RNA, 64 nt, hsa
aucaagguaguaauaauaauuuuuccuccacaggucccuccacucauauggccucucccucccc

SEQ ID NO: 111426 - RNA, 64 nt, hsa
uccugccucugugccuucucucauucuccuucucucccuccauaccccacuuuugagguucugu

SEQ ID NO: 111427 - RNA, 64 nt, hsa
ggccagaguagaguguagagugugccccgugacaucccuccaucuucuccuccauuaucaucua

SEQ ID NO: 111428 - RNA, 64 nt, hsa
acauguuacagcaaaucuggagccacagacagguucccuccauuggcagcccauuguguuugaa

SEQ ID NO: 111429 - RNA, 64 nt, hsa
gucagccucccucccuuccagcagcgacccagcuucccuccacuuccagguggugcugggcuca

SEQ ID NO: 111430 - RNA, 64 nt, hsa
aaccuugguuccuggagagugugccccuccacccucccuccagcagcccugaucacaccaugag

SEQ ID NO: 111431 - RNA, 64 nt, hsa
cacaaccccgaggcagccccaacuugcauuucccucccuccaggggcuauuccugucuuaggcg

SEQ ID NO: 111432 - RNA, 64 nt, hsa
agcaaguuaucuuuuaguuuauucugguuuggagucccuccaccaagauucaguagaagaaaua

SEQ ID NO: 111433 - RNA, 64 nt, hsa
gccccuccccgcacccaccuccugucucccucccucccuccauaggaguggggggccccuagaa

SEQ ID NO: 111434 - RNA, 64 nt, hsa
gucaccguaguggcuaccaccucagggcagccccucccuccagcuggcggggccucagcuuccc

SEQ ID NO: 111435 - RNA, 58 nt, hsa
acuacguggaggcuaucuagaggcccccucccuccauacucccgucacuccuccccac

SEQ ID NO: 111436 - RNA, 64 nt, hsa
gaggagaucaucuuguuccccuggccccccacucucccuccauguccauccaaaaaccauaaaa

SEQ ID NO: 111437 - RNA, 64 nt, hsa
ccgcacccaaccuguguuguugccgcccggcccuucccuccacagcucuccuuccucccgcccg

SEQ ID NO: 111438 - RNA, 64 nt, hsa
accugcucaucucugcccugaggucaccccguggucccuccacgugcccaucucucugcagugc

SEQ ID NO: 111439 - RNA, 64 nt, hsa
uccaccaaaucuucaucugggaauagcagcgguaucccuccacccaaguauggccaccuguuug

SEQ ID NO: 111440 - RNA, 64 nt, hsa
cccagugccuuccaguauggccccaccauguuugucccuccagccucagccaagcaacaugggg

SEQ ID NO: 111441 - RNA, 64 nt, hsa
aggcaaaacuucgagaaucaacaccuggagacagucccuccacugugaacaagcuuuugcagcu

SEQ ID NO: 111442 - RNA, 64 nt, hsa
uugagaacaacugagggccacccggucggggccaucccuccacacucugcauccuaccccaccu

SEQ ID NO: 111443 - RNA, 64 nt, hsa
guaacccugccucccugcuuccugguccagagccucccuccagugacuguggagccugagaagg

SEQ ID NO: 111444 - RNA, 64 nt, hsa
uccugcucacucaagcaaaagcagccucuggccuucccuccaccgcuuugcuccaucuggcuua

SEQ ID NO: 111445 - RNA, 64 nt, hsa
aguuuaauugucucaacgccucccccucccccauucccuccauuuuucucccaagaaaccugac

SEQ ID NO: 111446 - RNA, 64 nt, hsa
gaguuacagggaaguggucuccccaauucuccccucccuccaguauugcccccucucacuuuag

SEQ ID NO: 111447 - RNA, 64 nt, hsa
guacccaguagauaaugaaccaaauuaaguucccucccuccagccagaaguuaaacaucuggga

SEQ ID NO: 111448 - RNA, 64 nt, hsa
ggcucaacaccaaacuggacaguagacaucaugaucccuccaguuagcucuaauuacagacccc

SEQ ID NO: 111449 - RNA, 64 nt, hsa
aaggcugaggaggacaggagaagggcccagacacucccuccagugaguguccugcagcccuuau

SEQ ID NO: 111450 - RNA, 64 nt, hsa
acacucccuccagugaguguccugcagcccuuauucccuccauagaaagcauccucagagcacc

SEQ ID NO: 111451 - RNA, 64 nt, hsa
cagggccaaggucugggggugcuggaggccaugcucccuccaggcuugcggggagaacuucccu

SEQ ID NO: 111452 - RNA, 64 nt, hsa
ucacuggucccggggcuaaggaccuugcuccaagucccuccacccaugaugcugugccuuccag

SEQ ID NO: 111453 - RNA, 64 nt, hsa
auccucuccuguuucucucucuugccucccccuuucccuccauuccucugucgccucccccucu

SEQ ID NO: 111454 - RNA, 64 nt, hsa
ugguaaauuauccaucacuuuuguuuuaaaguggucccuccaagaauaauguggcauacacagu

SEQ ID NO: 111455 - RNA, 64 nt, hsa
ucugcuccagcuugcuggauguuaccuguccucuucccuccacaagucuuggcccuuaaccuuu

SEQ ID NO: 111456 - RNA, 64 nt, hsa
gaugacugacuaaagaugcuaggcgugacaccguucccuccaaaagcagaccucggaaucacug

SEQ ID NO: 111457 - RNA, 64 nt, hsa
cauguguaccaagagcagcagggcagaagggcccucccuccagccuaggucagagguggggaca

SEQ ID NO: 111458 - RNA, 64 nt, hsa
ccagccgaaccagcacucucccggaagccuggggucccuccacaccuuggcuuuuaugacccug

SEQ ID NO: 111459 - RNA, 64 nt, hsa
cucaagccccaugccgugcucauccuacccccaaucccuccaauaaaccugauucugcugccca

SEQ ID NO: 111460 - RNA, 52 nt, hsa
ggggcuucugggccugcugagcucccuccacacaccucaagccccaugccgu

SEQ ID NO: 111461 - RNA, 64 nt, hsa
ccagauccuacucuuccuuucuaaaucugagaucucccuccagggaauccgccugcagaggaca

SEQ ID NO: 111462 - RNA, 64 nt, hsa
ccuggcaugucagagccaggcucugccuggaggaucccuccauccggcuccugucauccccuac

SEQ ID NO: 111463 - RNA, 64 nt, hsa
cuccuuugucgcucucauggcugucagauccuggucccuccacacugggugcuggggagggagg

SEQ ID NO: 111464 - RNA, 64 nt, hsa
acgcuugcagacacuguuguuuuggaaaugugcuucccuccaucugaaaucucaucccuccacc

SEQ ID NO: 111465 - RNA, 64 nt, hsa
uuuggaaaugugcuucccuccaucugaaaucucaucccuccacccgcccacucgggcagcugug

SEQ ID NO: 111466 - RNA, 64 nt, hsa
cccaccccucuucccccuuccccugcgcccucccucccuccacaccuccacccguccuggggug

SEQ ID NO: 111467 - RNA, 64 nt, hsa
agggugggcgugacuucagacucucuccucucucucccuccacuccucccaacucuggccuugg

SEQ ID NO: 111468 - RNA, 64 nt, hsa; identical to SEQ ID NO: 45231

SEQ ID NO: 111469 - RNA, 64 nt, hsa; identical to SEQ ID NO: 45232

SEQ ID NO: 111470 - RNA, 64 nt, hsa; identical to SEQ ID NO: 45233

SEQ ID NO: 111471 - RNA, 64 nt, hsa; identical to SEQ ID NO: 45234

SEQ ID NO: 111472 - RNA, 64 nt, hsa; identical to SEQ ID NO: 45235

SEQ ID NO: 111473 - RNA, 64 nt, hsa; identical to SEQ ID NO: 45236

SEQ ID NO: 111474 - RNA, 64 nt, hsa; identical to SEQ ID NO: 45237

SEQ ID NO: 111475 - RNA, 64 nt, hsa; identical to SEQ ID NO: 45238

SEQ ID NO: 111476 - RNA, 64 nt, hsa; identical to SEQ ID NO: 45239

SEQ ID NO: 111477 - RNA, 64 nt, hsa; identical to SEQ ID NO: 45240

SEQ ID NO: 111478 - RNA, 64 nt, hsa; identical to SEQ ID NO: 45241

SEQ ID NO: 111479 - RNA, 64 nt, hsa; identical to SEQ ID NO: 45242

SEQ ID NO: 111480 - RNA, 64 nt, hsa; identical to SEQ ID NO: 45243

SEQ ID NO: 111481 - RNA, 64 nt, hsa; identical to SEQ ID NO: 45244

SEQ ID NO: 111482 - RNA, 64 nt, hsa; identical to SEQ ID NO: 45245

SEQ ID NO: 111483 - RNA, 64 nt, hsa; identical to SEQ ID NO: 45246

SEQ ID NO: 111484 - RNA, 64 nt, hsa; identical to SEQ ID NO: 45247

SEQ ID NO: 111485 - RNA, 64 nt, hsa; identical to SEQ ID NO: 45248

SEQ ID NO: 111486 - RNA, 64 nt, hsa; identical to SEQ ID NO: 45249

SEQ ID NO: 111487 - RNA, 64 nt, hsa; identical to SEQ ID NO: 45250

SEQ ID NO: 111488 - RNA, 64 nt, hsa; identical to SEQ ID NO: 45251

SEQ ID NO: 111489 - RNA, 64 nt, hsa; identical to SEQ ID NO: 45252

SEQ ID NO: 111490 - RNA, 64 nt, hsa; identical to SEQ ID NO: 45253

SEQ ID NO: 111491 - RNA, 64 nt, hsa; identical to SEQ ID NO: 45254

SEQ ID NO: 111492 - RNA, 64 nt, hsa; identical to SEQ ID NO: 45255

SEQ ID NO: 111493 - RNA, 64 nt, hsa; identical to SEQ ID NO: 45256

SEQ ID NO: 111494 - RNA, 64 nt, hsa; identical to SEQ ID NO: 45257

SEQ ID NO: 111495 - RNA, 64 nt, hsa; identical to SEQ ID NO: 45258

SEQ ID NO: 111496 - RNA, 64 nt, hsa; identical to SEQ ID NO: 45259

SEQ ID NO: 111497 - RNA, 64 nt, hsa; identical to SEQ ID NO: 45260

SEQ ID NO: 111498 - RNA, 64 nt, hsa; identical to SEQ ID NO: 45261

SEQ ID NO: 111499 - RNA, 64 nt, hsa; identical to SEQ ID NO: 45262

SEQ ID NO: 111500 - RNA, 64 nt, hsa; identical to SEQ ID NO: 45263

SEQ ID NO: 111501 - RNA, 64 nt, hsa; identical to SEQ ID NO: 45264

SEQ ID NO: 111502 - RNA, 64 nt, hsa; identical to SEQ ID NO: 45265

SEQ ID NO: 111503 - RNA, 64 nt, hsa; identical to SEQ ID NO: 45266

SEQ ID NO: 111504 - RNA, 64 nt, hsa; identical to SEQ ID NO: 45267

SEQ ID NO: 111505 - RNA, 64 nt, hsa; identical to SEQ ID NO: 45268

SEQ ID NO: 111506 - RNA, 64 nt, hsa; identical to SEQ ID NO: 45269

SEQ ID NO: 111507 - RNA, 64 nt, hsa; identical to SEQ ID NO: 45270

SEQ ID NO: 111508 - RNA, 64 nt, hsa; identical to SEQ ID NO: 45271

SEQ ID NO: 111509 - RNA, 64 nt, hsa; identical to SEQ ID NO: 45272

SEQ ID NO: 111510 - RNA, 64 nt, hsa; identical to SEQ ID NO: 45273

SEQ ID NO: 111511 - RNA, 64 nt, hsa; identical to SEQ ID NO: 45274

SEQ ID NO: 111512 - RNA, 64 nt, hsa; identical to SEQ ID NO: 45275

SEQ ID NO: 111513 - RNA, 64 nt, hsa; identical to SEQ ID NO: 45276

SEQ ID NO: 111514 - RNA, 64 nt, hsa; identical to SEQ ID NO: 45277

SEQ ID NO: 111515 - RNA, 64 nt, hsa; identical to SEQ ID NO: 45278

SEQ ID NO: 111516 - RNA, 64 nt, hsa; identical to SEQ ID NO: 45279

SEQ ID NO: 111517 - RNA, 64 nt, hsa; identical to SEQ ID NO: 45280

SEQ ID NO: 111518 - RNA, 64 nt, hsa
agaugggugaaggacaagaagugaguugugucaauuauuguagauacaauuuucugauuaaauc

SEQ ID NO: 111519 - RNA, 64 nt, hsa
uggaaaaauaaaaggcagccuguuuuuucugcuuuuauuguauuaacagcugagguagcuaaag

SEQ ID NO: 111520 - RNA, 64 nt, hsa
cuaaaaacuuauguuagcuucaguaaaaguacuuuuauuguaaauaaacaaucaugaacucaac

SEQ ID NO: 111521 - RNA, 64 nt, hsa
gaagcauuugaaugucauaucuuuuuaaaguauuuuauuguauacuguaucauagaaguuggag

SEQ ID NO: 111522 - RNA, 64 nt, hsa
gcuugccuauuagucugcugagcagucaugaauuuuauuguauuucuuggguaaggacaggcca

SEQ ID NO: 111523 - RNA, 64 nt, hsa
ccauauuuaauuaaauaagugucgaaugucuucuuuauuguauuuucagaagugaggcgauggc

SEQ ID NO: 111524 - RNA, 64 nt, hsa
auacccaaaagaaauucaguuauuuauuguauauuuauuguauucuaauauaauugaaauaaau

SEQ ID NO: 111525 - RNA, 64 nt, hsa
cuacuucuuacauacccaaaagaaauucaguuauuuauuguauauuuauuguauucuaauauaa

SEQ ID NO: 111526 - RNA, 64 nt, hsa
uuaucuagcacuugugacauaccaauaauagaguuuauuguauuuauguggaaacaguguuuua

SEQ ID NO: 111527 - RNA, 64 nt, hsa
ucuuauugaacuuauucuuaagaaauuguacuuuuuauuguaagaaaaauaaaaaggacuacuu

SEQ ID NO: 111528 - RNA, 64 nt, hsa
uaugucuuucaauuuaaauucacuucaguuuuuguuauuguaauauauuuacuuuuacaugguu

SEQ ID NO: 111529 - RNA, 64 nt, hsa
guucccucuuuggggcaaauucuuauaaaaauguuuauuguaaaguuauauauuuugucuacga

SEQ ID NO: 111530 - RNA, 64 nt, hsa
cucuuuguuacuugucuguuuccauuugaauuucuuauuguaaaaaucuguuuaaauccauuua

SEQ ID NO: 111531 - RNA, 64 nt, hsa
ccauaagaggguguaaacaauuaacuccaggguuuuauuguauccugcaauauuuaguauuaac

SEQ ID NO: 111532 - RNA, 64 nt, hsa
aauauugcacuucuuucaagauguuaucaauugguuauuguacuguauaguuuuaauaauuuug

SEQ ID NO: 111533 - RNA, 64 nt, hsa
uagaagaaaugugcuguauuuugauaaaauucacuuauuguauguguguuguaaucuaaaaaaa

SEQ ID NO: 111534 - RNA, 64 nt, hsa
ugcucauuuuuucuuacauaauuuuuuauucaaguuauuguacagcuguuuaagaugggcagcu

SEQ ID NO: 111535 - RNA, 64 nt, hsa
augguugccuuaaagaaagucgaauuaauagcuuuuauuguauaaacuaucaguuuguccugua

SEQ ID NO: 111536 - RNA, 64 nt, hsa
ucugaaaaauggauuucuugagcaaaagaucuguuuauuguauguaaggaaaaauuuuaccuga

SEQ ID NO: 111537 - RNA, 64 nt, hsa
caucacgauauuggcugaaaaguucuacauucuauuauuguauuguaacacacauguauugaug

SEQ ID NO: 111538 - RNA, 64 nt, hsa
auugcuuuucucuguuuauauaagucauguguacuuauuguagaaaguuuguaagaugcaaaaa

SEQ ID NO: 111539 - RNA, 64 nt, hsa
gccaagcuucuuguuauaugagauaauuacgcccuuauuguauaagacaauuuuaguuguauuu

SEQ ID NO: 111540 - RNA, 64 nt, hsa
caaauaaaacauggccuuaacaaaguuguuuguguuauuguacaauuugaaaauuaugucggga

SEQ ID NO: 111541 - RNA, 64 nt, hsa
uggguguguguuguguguauguaauacauaauguuuauuguacagaugugugggguuuguguuu

SEQ ID NO: 111542 - RNA, 64 nt, hsa
auuaaucagggugcauuuuaaguucuaacuucguuuauuguauaaugcaucauuugaaaauacc

SEQ ID NO: 111543 - RNA, 64 nt, hsa
ugcaagaguggacguaaugcuaguuggcaguauuuuauuguaagaaaucaauaaaguaauugug

SEQ ID NO: 111544 - RNA, 64 nt, hsa
uugguuguauuuaaagcucaguuuccuuuuuguuuuauuguaugcguuggguuugcagcaugaa

SEQ ID NO: 111545 - RNA, 64 nt, hsa
cuaaaacauauuucauguaaacauuguacauuuauuauuguaauauauacuauuaugcagcuua

SEQ ID NO: 111546 - RNA, 64 nt, hsa
cuccagauaacuucgcuucuuugauacuuguagcuuauuguaauuuuuuuuaagaaauucaagg

SEQ ID NO: 111547 - RNA, 64 nt, hsa
auuguaauuuuuuuuaagaaauucaaggucauuauuauuguacaaaauaagcgcuuugauuaac

SEQ ID NO: 111548 - RNA, 64 nt, hsa
guauuauauuaauauaaaaacauuuuuguauguuuuauuguaaucauaaauacugcuguauaag

SEQ ID NO: 111549 - RNA, 64 nt, hsa
auuuuaguuaacuaugauuccaauuacuacuuuguuauuguaccuaaguaaauuuucuuuaagu

SEQ ID NO: 111550 - RNA, 64 nt, hsa
cuuuagccaacugcuaauggaucgaaugugcuuuuuauuguaauucaacagcuauagagagaaa

SEQ ID NO: 111551 - RNA, 64 nt, hsa
caagcuaccuaugcauuugacccaaccuuauuuauuauuguacagaugaagcgaauugacuccc

SEQ ID NO: 111552 - RNA, 64 nt, hsa
gagccugguuucaaugugagaaccacguuuacuguuauuguauuuaauuuucuuuuccuuuuca

SEQ ID NO: 111553 - RNA, 64 nt, hsa
cuaacauguuguaaauauuacaauucaugaaauguuauuguaagucuguaacuuaauuuuuucc

SEQ ID NO: 111554 - RNA, 64 nt, hsa
ugcuucacaaaaugcacuucuauuuagccagcguuuauuguaguaaacuauucuuaauaaaacu

SEQ ID NO: 111555 - RNA, 64 nt, hsa
gacuugugugcauggaaguaauuaagguacaucauuauuguaguuugaaaguuguacaugauaa

SEQ ID NO: 111556 - RNA, 64 nt, hsa
uucuaauuuucuucacuuguuuuacacaauuuuguuauuguaguuuuuuccauuauauuuuuau

SEQ ID NO: 111557 - RNA, 64 nt, hsa
ccuuuucacaacauaauuuaggugucuacuguucuuauuguauuuuguucugcuguugaucucu

SEQ ID NO: 111558 - RNA, 64 nt, hsa
augauaaguacuacauaccucaucucuuggguuauuauuguagucuugcauucaugguuaugaa

SEQ ID NO: 111559 - RNA, 64 nt, hsa
cuacuguggcaaaugccaacuguuggaauucacuuuauuguagaaaaacccaaacugagacucu

SEQ ID NO: 111560 - RNA, 64 nt, hsa
ucucucuuugaucucaggggguccuuuuuggaguuuauuguauuuuauuguacuugguggggug

SEQ ID NO: 111561 - RNA, 64 nt, hsa
aucucaggggguccuuuuuggaguuuauuguauuuuauuguacuuggugggguguuuggggugg

SEQ ID NO: 111562 - RNA, 64 nt, hsa
agggcgggagagcgaugcuuggauuuuuguuuccuauuagaaaccaacaguuuuguucuaauuu

SEQ ID NO: 111563 - RNA, 64 nt, hsa
uuuuuuuuuuucuuuuuuuaggcauauguaguaauauuagaaacauuuaauuugggaaacuuug

SEQ ID NO: 111564 - RNA, 64 nt, hsa
ucuguuuugugucaauugguucguggcaggaagcuauuagaagucaaacguccagaugcauuac

SEQ ID NO: 111565 - RNA, 64 nt, hsa
uacucugaucgcaacuaaacauuugucuuuguuuuauuagaaacuagugaaacaaagcagguug

SEQ ID NO: 111566 - RNA, 64 nt, hsa
uuauuuguaugucaguauuuuucauuugauucccuauuagaauuaauuuuaaaacuugaagacu

SEQ ID NO: 111567 - RNA, 64 nt, hsa
uguuaaauaaauguguaaaguaaccaccaaauguuauuagaauuuuucuucuagcauuuauaau

SEQ ID NO: 111568 - RNA, 64 nt, hsa
auguggaaaauauuagaaacuucuauguggaaaauauuagaaacuacagaguuugcgauauuua

SEQ ID NO: 111569 - RNA, 64 nt, hsa
cuuggauuugcagcuguugguacuauguggaaaauauuagaaacuucuauguggaaaauauuag

SEQ ID NO: 111570 - RNA, 64 nt, hsa
uccauccuguuggugcagagaaauuuuggugauuuauuagaagacuuuuaaggaggguggauac

SEQ ID NO: 111571 - RNA, 64 nt, hsa
acccuucguugacuaucaguacuguugauacauuuauuagaauguaugucucagaagaugguuu

SEQ ID NO: 111572 - RNA, 64 nt, hsa
cacacacacacacacacacacacacgcacacagcuauuagaacuaauaagcaaguuccgcaagg

SEQ ID NO: 111573 - RNA, 64 nt, hsa
gauuaccuuguaagaccaucuggcgcaguggaccuauuagaacuuggguuaaaaauguuuaaga

SEQ ID NO: 111574 - RNA, 64 nt, hsa
accgccaccucaaugcauugucaguaggauacauuauuagaaacuguuagggucuuucccagga

SEQ ID NO: 111575 - RNA, 64 nt, hsa
accgccaccucaaugcauugucaguagaauacauuauuagaaacuguuaaggucuuucccggga

SEQ ID NO: 111576 - RNA, 64 nt, hsa
aaaauuaucuuugaaacaccucuugaagcuaauuuauuagaaaaaauauuucaguuggaaggcu

SEQ ID NO: 111577 - RNA, 64 nt, hsa
gggugaaagcuaugccauucauuaugucuggcuguauuagaaugacauuuccuaugaaugucua

SEQ ID NO: 111578 - RNA, 64 nt, hsa
cuccuacaaaagcucaagccugaagauacaagacuauuagaagaaacaugacuacccucagugu

SEQ ID NO: 111579 - RNA, 64 nt, hsa
aagacuauuagaagaaacaugacuacccucaguguauuagaaaagaggucaugcagcuuucuaa

SEQ ID NO: 111580 - RNA, 64 nt, hsa
uauguuuucuccuuuuggugcuaaaaaaugaaaauauuagaaaguagucuacacauuaaagauu

SEQ ID NO: 111581 - RNA, 64 nt, hsa
guacaaauagagguaauaguuaaguuauggcauuuauuagaaguuuuauuauuuggcuuccuuu

SEQ ID NO: 111582 - RNA, 64 nt, hsa
aggauuauaauaugguucaacaaauguugaugaguauuagaaauguacauuagaaauauuagaa

SEQ ID NO: 111583 - RNA, 64 nt, hsa
aauguugaugaguauuagaaauguacauuagaaauauuagaaauguuuaugacuauuagaaaag

SEQ ID NO: 111584 - RNA, 64 nt, hsa
aauguacauuagaaauauuagaaauguuuaugacuauuagaaaaguacaggguauugggcguuc

SEQ ID NO: 111585 - RNA, 64 nt, hsa
ucaaacaacagucugcaaaacuuugacuauggcguauuagaagacuuguauuuuuugaaacucu

SEQ ID NO: 111586 - RNA, 64 nt, hsa
cugaagaauacaaaggauggucugugggaaaauauauuagaaguuacuaugaagaaugccccaa

SEQ ID NO: 111587 - RNA, 64 nt, hsa
uaaaggcaguucugcaagauguacuaaauauguauauuagaaauuauagaaaaucauguugucc

SEQ ID NO: 111588 - RNA, 64 nt, hsa
aauacaguugucauuaauccugcacauuagaaauuauuagaaacauauuacuuuuuaacuuuaa

SEQ ID NO: 111589 - RNA, 64 nt, hsa
uguccauuugcucaaccagacaggaguuaacuuguauuagaauuguuuuuucuaaaguuauguu

SEQ ID NO: 111590 - RNA, 64 nt, hsa
uugaaacagaguuaacaggauaagguuacacuuguauuagaauuguuuuuuucuaaaguuaugu

SEQ ID NO: 111591 - RNA, 64 nt, hsa
uuacugugacagucuuaaugauaccauaaaucaauauuagaaagcuaguugacuuaaagccuga

SEQ ID NO: 111592 - RNA, 64 nt, hsa
aaagccugaaauaaugggaguuuucuccuccacuuauuagaauaaggacccucagugacuaauu

SEQ ID NO: 111593 - RNA, 64 nt, hsa
auaguuaguuuaggaaaucacuucauauugauuguauuagaauuaucuuggaauugaagauaua

SEQ ID NO: 111594 - RNA, 64 nt, hsa
guaccuucuuuguuucuauauuaugaaaccucuuuauuagaauuugugauugauucugacagug

SEQ ID NO: 111595 - RNA, 64 nt, hsa
agcagguaauaaaauuuaaaaaauaaaaauuaaauauuagaaugugagaaauuuauuaaaauau

SEQ ID NO: 111596 - RNA, 64 nt, hsa
ugugcuguaccaaaaugguaauuauaacagacaguauuagaauuacugaauuaacaaugagaaa

SEQ ID NO: 111597 - RNA, 64 nt, hsa
ucuauuucugaauuacgaaugaaauccgaguaccuauuagaaaugaguuaugcaaauuuagaug

SEQ ID NO: 111598 - RNA, 64 nt, hsa
agggcucaaacugagaaacauugaguuauauggcuauuagaaauccacauucuuacacaagaaa

SEQ ID NO: 111599 - RNA, 64 nt, hsa
auuagaaauccacauucuuacacaagaaagaccauauuagaaucuaaggaaaacaugcauauuc

SEQ ID NO: 111600 - RNA, 64 nt, hsa
gugaaagcuuguuguaaagauauuuucuuuuuguuauuagaaggaaauacaaagagaaaaauuu

SEQ ID NO: 111601 - RNA, 64 nt, hsa
agccaguauuucugauuaacuaaguugaaacucuuauuagaaacuuucaguuggugauauugua

SEQ ID NO: 111602 - RNA, 64 nt, hsa
ggcuaaugaaugcagaaagaauaauagaaaauuauauuagaaaaacuauuguguaacacauaau

SEQ ID NO: 111603 - RNA, 64 nt, hsa
ggcaaccagaaguuaaggagguaaaguucuucuuuauuagaaaauuccaggcuaaugaaugcag

SEQ ID NO: 111604 - RNA, 54 nt, hsa
gaauucauaauguaacuuaauaauuauuagaacucuuccuuugcgaauuuuaug

SEQ ID NO: 111605 - RNA, 64 nt, hsa
uugggguugccaaaaccccagcaaguugaggcuucacgcucagggaaacuucugggucagaggu

SEQ ID NO: 111606 - RNA, 64 nt, hsa
ugaccacugcccaagcccugcccgccucuccccccacgcucaaccugcccacuuguccaggccu

SEQ ID NO: 111607 - RNA, 64 nt, hsa
guccgucuccagccagccagcucauuucacuuuacacgcucauggacugaguuuauacucaccu

SEQ ID NO: 111608 - RNA, 64 nt, hsa
cguuccaccacacuguccgcccuuggccucggcacacgcucaccuuuucuguugguuacgggac

SEQ ID NO: 111609 - RNA, 64 nt, hsa
aguuugccuccguccccugcccaugcugggagcccacgcucacccccucaccccuccaagcuca

SEQ ID NO: 111610 - RNA, 64 nt, hsa
ucuaccgaaucaggaccacccugcugcuuaacuccacgcucacugccucgugaguggccuggac

SEQ ID NO: 111611 - RNA, 64 nt, hsa
caauccauccaugcauacauagacacaagacacacacgcucaaaccccuguccacauauacaac

SEQ ID NO: 111612 - RNA, 64 nt, hsa
gcccuugcugcagaguugguggagaacagaaauccacgcucaaucucaggucuucacgcggggg

SEQ ID NO: 111613 - RNA, 64 nt, hsa
cccuauucugccaugggagaguccaggccugggucacgcucaaggaaggaugccuuaucucuuc

SEQ ID NO: 111614 - RNA, 64 nt, hsa
ucaagggcagcuuacggagaugucacuggagcagcacgcucagagacagugaacuagcauuuga

SEQ ID NO: 111615 - RNA, 64 nt, hsa
gcaaaaaaauuggugcuaaaccuucaccccugagcacgcucagugagacuggucaugcaagcau

SEQ ID NO: 111616 - RNA, 64 nt, hsa
aaaaccuggccccugcaggagucaggccuggucucacgcucaauaaacuccggacugaagaugc

SEQ ID NO: 111617 - RNA, 64 nt, hsa
uuuugggaguugaccccagcaaugaccuugguggcacgcucacucccucauucucucguuuccc

SEQ ID NO: 111618 - RNA, 64 nt, hsa
cuuuugguuuuggcuaaauacacacacacacacacacgcucauauguguuuacucuguaagucu

SEQ ID NO: 111619 - RNA, 64 nt, hsa
uucaguacaccagcaaugcugaggaugccaacuucacgcucagagacagcugcaccgacuugga

SEQ ID NO: 111620 - RNA, 64 nt, hsa
aggcccccauuuuauuagucgguguguucaguaucacgcucaagacaagggccaaccuauuacu

SEQ ID NO: 111621 - RNA, 64 nt, hsa
cuuccuucggggccagucucggccgaagucuggucacgcucagacagagcugaccagaccagac

SEQ ID NO: 111622 - RNA, 64 nt, hsa
ugugggcagaaacacacacacucgcacucucgcucacgcucagacgcuacacacgcgcgcgcac

SEQ ID NO: 111623 - RNA, 64 nt, hsa
guaacagacucaagaguuauuguacauuacugaccacgcucauuuguucaaaaguuagaacauc

SEQ ID NO: 111624 - RNA, 64 nt, hsa
agauguccacggacgaaacauacggugaauaauucacgcucacgucguucuuccacaguaucuu

SEQ ID NO: 111625 - RNA, 64 nt, hsa
ggcucacaugcuccuugccucugcucugugcacucacgcucagcacacaugcauccuccccucu

SEQ ID NO: 111626 - RNA, 64 nt, hsa
acugauccuguguuuaccccaagcccggcggggacacgcucacagaugucaccacagcccugcc

SEQ ID NO: 111627 - RNA, 64 nt, hsa
caugaccguguggguggcggcguuugcugugaaccacgcucaggccacacagagacacauacuu

SEQ ID NO: 111628 - RNA, 64 nt, hsa
cuccugaguaacugggauuacagucgugugccaccacgcucagcccugaguuaguuucuaguau

SEQ ID NO: 111629 - RNA, 64 nt, hsa
gguggucucaaagauguagaacgcagcgugugcccacgcucagcaggugugccauccuuccacc

SEQ ID NO: 111630 - RNA, 64 nt, hsa
gcuguucccaacugugcccagcugcacugguacacacgcucaucaggagaaucccuacuggaag

SEQ ID NO: 111631 - RNA, 64 nt, hsa
uuucuuugucauucaguucuaggccuuuccucugcacgcucaaugcccaguaaaauuucaggau

SEQ ID NO: 111632 - RNA, 64 nt, hsa
agaggcuggggccaacuggaaccauuggcagcugcacgcucauuacuacccuccgcuccugcgc

SEQ ID NO: 111633 - RNA, 64 nt, hsa
cccauccuagcuggacucaugguuccuaaauaaccacgcucagaagcucugcuaggacuuaccc

SEQ ID NO: 111634 - RNA, 64 nt, hsa
gcagaugggcugcaugcggcgcucccuuccuucccacgcucagcggccccggccagacccuggc

SEQ ID NO: 111635 - RNA, 64 nt, hsa
uacgccuuaggaaggggacaaccaggccccgccacacgcucacacacaaaccugcucacgcagc

SEQ ID NO: 111636 - RNA, 64 nt, hsa
uggccccuucguaccugcaauaugucaggagccucacgcucacccaagauccugcaggggccag

SEQ ID NO: 111637 - RNA, 64 nt, hsa
ggccuuucucggcccuggacugaggcucagccuacacgcucauauugugcauauggcagacccu

SEQ ID NO: 111638 - RNA, 64 nt, hsa
ugaucaaggagcaccuuccuccuccagcgaaguccacgcucauccugguguguggcccgccacc

SEQ ID NO: 111639 - RNA, 64 nt, hsa
cacuccuggcccucggccccucccuagucccacccacgcucaaccuuuggcccagccaucgccg

SEQ ID NO: 111640 - RNA, 64 nt, hsa
uguuuuaucaggauaauugucucaugaccaaauccacgcucaauuagagccauucaaaauuccu

SEQ ID NO: 111641 - RNA, 64 nt, hsa
aguacuacagagaccuggcuggcaacgagcagcgcacgcucaucaaggccuauggcauccgcuu

SEQ ID NO: 111642 - RNA, 64 nt, hsa
acaaaacagaaugauaaagcugcgaaccguggcacacgcucauaguucuagcugcuugggaggu

SEQ ID NO: 111643 - RNA, 64 nt, hsa
agaaaugauccuauccaaagcugauucacaaacccacgcucaccugacagccgagggacacgag

SEQ ID NO: 111644 - RNA, 64 nt, hsa
aauuugcagcacacagcguuccacugcgggguuucacgcucaccugaaaacaccuguucccaac

SEQ ID NO: 111645 - RNA, 64 nt, hsa
gccugcugcaugcguguuaccuggcuuuuggcuccacgcucacucauagccauguccacauggg

SEQ ID NO: 111646 - RNA, 64 nt, hsa
cucccaaagugcugggcuuacaggccugagccaccacgcucagcucagcuucacccugucugca

SEQ ID NO: 111647 - RNA, 64 nt, hsa
ccaacagcuguucuguucuaucuaccccucauuucacgcucaaggagucauaccuagaauaguu

SEQ ID NO: 111648 - RNA, 64 nt, hsa
ggaggggcugguuuccuuccacucuccacggccgcacgcucagaggcuggucuccgcaugagag

SEQ ID NO: 111649 - RNA, 64 nt, hsa
cacaugcucacgcacauguucacacaugcacacucacgcucacacaugcugucacgcauacaca

SEQ ID NO: 111650 - RNA, 64 nt, hsa
gacgccaccuggcggcccuaagccacucccgccacacgcucacuccagguucguauagaaaaag

SEQ ID NO: 111651 - RNA, 64 nt, hsa
ucagcugagccuccugcccucccccaggaacaugcacgcucacucugcuuccuuguggguggcc

SEQ ID NO: 111652 - RNA, 64 nt, hsa
ccauaccaucugguacugcaggaccuccagcugacacgcucaguugaaauaacaacagacaaua

SEQ ID NO: 111653 - RNA, 64 nt, hsa
gaugugcauuugugugugauguuggauagucauccacgcucaguuuggaccauuggaggaacuu

SEQ ID NO: 111654 - RNA, 64 nt, hsa
aaugccucauaaauuagccuucgaaagaaaagugcacgcucagacaguguguggaggggcagga

SEQ ID NO: 111655 - RNA, 64 nt, hsa
acucccggccuaggcaccuccccgcucucccugucacgcucauguccuguccugguccugaugc

SEQ ID NO: 111656 - RNA, 64 nt, hsa
accuugugugucugugaucuccucugucuuaauccacgcucaggcuaaagauggggauaaugug

SEQ ID NO: 111657 - RNA, 56 nt, hsa
uggugcaguaccugacaugagccagccacgcucaguggcugaacagcauucccaca

SEQ ID NO: 111658 - RNA, 64 nt, hsa
ugacaugaacacuguacugaacuacaucuucucucacgcucaagucaccaagaagaaucuucug

SEQ ID NO: 111659 - RNA, 64 nt, hsa
ucucacccauuucuaauuucauugucuuucuucccacgcucauuucuaucauucucccccauga

SEQ ID NO: 111660 - RNA, 64 nt, hsa
gcagucccaagcggugucucuccugccccuuggacacgcucaguggggcagaggcaguaccugg

SEQ ID NO: 111661 - RNA, 64 nt, hsa
gccuucacccacggaucugcccaggcugaaggcacacgcucaaugccccacgugccuucuccag

SEQ ID NO: 111662 - RNA, 64 nt, hsa
aacucugcuucccaagggcaaccguugcuguucacacgcucagccugucugggggagcgggccu

SEQ ID NO: 111663 - RNA, 64 nt, hsa
ugcaguuguuuuccggagucugucccacggcccacacgcucacuugacucaugcugcuaagaug

SEQ ID NO: 111664 - RNA, 64 nt, hsa
ucagagaggcagauuccuuccccucccguccccucacgcucaaacccccacuuccugccccagg

SEQ ID NO: 111665 - RNA, 64 nt, hsa
guggcuuacaaauucuacagcauacagagcaggccacgcucaggcccggcaugcgggccaccaa

SEQ ID NO: 111666 - RNA, 63 nt, hsa
aagugguucuguauggcuaggaccacccuacuacacgcucagcugccaacaguggauugaguu

SEQ ID NO: 111667 - RNA, 64 nt, hsa
ucccaaauaucuugguucagacagcucugaaccccacgcucacaguggucgaccuugccucccg

SEQ ID NO: 111668 - RNA, 64 nt, hsa
auggagauugccucaaaauuguguccacauaauccacgcucaucuugcaaagcgcuauuucagg

SEQ ID NO: 111669 - RNA, 64 nt, hsa
cugcagcgggcagagugggaguuggcucacucagcacgcucacuaacccagcaugccacuucca

SEQ ID NO: 111670 - RNA, 64 nt, hsa
gcccccgccccaggcuuccgcgcccagcgcucgccacgcucagugcccguuuuaccaauaaacu

SEQ ID NO: 111671 - RNA, 64 nt, hsa
guucggggcagccugcucggcuguauguuucucgcacgcucacccgcuucagugcggcucuguc

SEQ ID NO: 111672 - RNA, 64 nt, hsa
uguguccggugggucuccacugcggggccagggccacgcucaccccucucgcggccccuccucu

SEQ ID NO: 111673 - RNA, 64 nt, hsa
ucgauagcagggagccaugaccuggcaacgauuccacgcucaaaggggcacccggggggcccug

SEQ ID NO: 111674 - RNA, 64 nt, hsa
uaggagcugccuacaucaggcuuugucugacuugcacgcucagcuucccacccuaacccacuuc

SEQ ID NO: 111675 - RNA, 64 nt, hsa
ggggaacucgccaccugcccacgcuaguuccauccacgcucaagacccgcccuuagaccaggca

SEQ ID NO: 111676 - RNA, 64 nt, hsa
ugacagcacuugcauggucacuugagcccacacacacgcucaaccccaaguccuuuaugcuuug

SEQ ID NO: 111677 - RNA, 64 nt, hsa
acggccacccgccccgcgcaccccacgcccuguucacgcucacccagucaccuccccacaucgc

SEQ ID NO: 111678 - RNA, 64 nt, hsa
ugugugagugugcgugucucugugugugcacgugcacgcucauggccaaaugugcgcacucuac

SEQ ID NO: 111679 - RNA, 64 nt, hsa
cuuccaccucgugcacagcgcucugcacagacaacacgcucaauaaaaguucagccauagcagc

SEQ ID NO: 111680 - RNA, 62 nt, hsa
uccuuaccuccaaaagcacagggacacaaagaggaaucuaaacaaacaggccucucaguuuc

SEQ ID NO: 111681 - RNA, 62 nt, hsa
uuuuaaaugcauaaaauauauaggauuacaaaggaaucuaauuauaucgaaauacaguuauu

SEQ ID NO: 111682 - RNA, 62 nt, hsa
ugcacuuuguagcuuuucacccucugucccagggaaucuaggagagaugaggcccgucagag

SEQ ID NO: 111683 - RNA, 62 nt, hsa
augagauccuuuaauugaaaacgaaguguaacggaaucuagugucuuucuaaugugguaaaa

SEQ ID NO: 111684 - RNA, 62 nt, hsa
ggaaaauucugaguuccagcacaauuuucuuuggaaucuaacaggaaucuagccugaggaag

SEQ ID NO: 111685 - RNA, 62 nt, hsa
aguuccagcacaauuuucuuuggaaucuaacaggaaucuagccugaggaagaagggaggucu

SEQ ID NO: 111686 - RNA, 62 nt, hsa
guuugguuuuguuuucuuuuuuuaaugucagaggaaucuauccaugugaaucgaaaggcaca

SEQ ID NO: 111687 - RNA, 62 nt, hsa
gaggaaucuauccaugugaaucgaaaggcacaggaaucuaggaacucugaggaauuuauugu

SEQ ID NO: 111688 - RNA, 62 nt, hsa
gagguggaaucuacaucccucuguuguauacaggaaucuacaucccucugugacugcuucgc

SEQ ID NO: 111689 - RNA, 62 nt, hsa
gcagcaguuugacacacuuucaaucaagagguggaaucuacaucccucuguuguauacagga

SEQ ID NO: 111690 - RNA, 62 nt, hsa
uugggggaauauuucacauccauccagagcucggaaucuacagcguccagccauuuccagca

SEQ ID NO: 111691 - RNA, 62 nt, hsa
cgcggcggggccagcuugccugccgguuuucaggaaucuaaacucucaucuugugcaauuua

SEQ ID NO: 111692 - RNA, 64 nt, hsa
auuuuuauuccauuuuguucugcaacacguucagguacuuaaaacucauucaugcaguuagaau

SEQ ID NO: 111693 - RNA, 64 nt, hsa
gugacuuuaauugguaaauauguuacaaaaccaaguacuuaaucuuuuacaucaugucuucagc

SEQ ID NO: 111694 - RNA, 64 nt, hsa
agaaaaaaaaagguuuggcaggccaucuuuuuuuguacuuaaaaguagccuuaagaacaauaau

SEQ ID NO: 111695 - RNA, 64 nt, hsa
gaucugcaugguuugccugagcuuugaacagucaguacuuaaaaaaaaaaaaaucaugggggug

SEQ ID NO: 111696 - RNA, 64 nt, hsa
aacugaauauuauagucaguucuugguacuuaaaguacuuaaaauaaguagugcuuuguuuaaa

SEQ ID NO: 111697 - RNA, 64 nt, hsa
uaaauuaugaacugaauauuauagucaguucuugguacuuaaaguacuuaaaauaaguagugcu

SEQ ID NO: 111698 - RNA, 64 nt, hsa
uauuauaucaguugacauguaacuaguaccaugcguacuuaaauagaugguaauuuucugagcc

SEQ ID NO: 111699 - RNA, 64 nt, hsa
agacugaguaguauucuuggauacaggcugauguguacuuaaccacuuccagauuuauacaguc

SEQ ID NO: 111700 - RNA, 64 nt, hsa
uauucuguacagcuuugucuuuuuuaaauaugaaguacuuaaauguacuuacuaugauaggaaa

SEQ ID NO: 111701 - RNA, 64 nt, hsa
uuucauaacuuuagcaguguguuuuggaacuacuguacuuaaagguuuguuuguuuguuuuugc

SEQ ID NO: 111702 - RNA, 64 nt, hsa
ucgaguacuauugaacucucuccugaugagaagauguuuagauaaguacaaguuaagaaaguag

SEQ ID NO: 111703 - RNA, 64 nt, hsa
auaccaguuaucaagauauauuaaauagcuguauuguuuagaaucuuaauaugguauaaauuag

SEQ ID NO: 111704 - RNA, 64 nt, hsa
agaaaguggagaaaaauguacauacauuuuuguauguuuagauauuaccguaaauacucaggau

SEQ ID NO: 111705 - RNA, 64 nt, hsa
caucugacuucugaucaagcauuagauuuuaacuuguuuagauuuugucuuaaacaccaguaau

SEQ ID NO: 111706 - RNA, 64 nt, hsa
caguuucuugcuuggggaacuugugucccuaauguguuuagauugcuagauugcuaaggagcug

SEQ ID NO: 111707 - RNA, 64 nt, hsa
agggugguucaacaaagaaacaaagauguuaugguguuuagauuuaugguuguuaaaaauguca

SEQ ID NO: 111708 - RNA, 64 nt, hsa
gguguaauaagguucucacggguucaaucuuuuguguuuagagaggccacgguucagacaaugg

SEQ ID NO: 111709 - RNA, 64 nt, hsa
gaagagauggggggccucaaccaacuuagugacuuguuuagaaaaaaaagacaaaaaaguaaaa

SEQ ID NO: 111710 - RNA, 64 nt, hsa
cuuguaauuucuuucugcuuagaaucuaaagauguguuuagaaccucuuguuuaaaaauaauag

SEQ ID NO: 111711 - RNA, 64 nt, hsa
uauguuucaaguuuguauuaauuuguaauagcucuguuuagaaaaaaucaaagaccaugauuua

SEQ ID NO: 111712 - RNA, 64 nt, hsa
gugagaauugauguuuguagauuaauaaucauuuuguuuagaauuacaaaauaguuuuuaaaua

SEQ ID NO: 111713 - RNA, 64 nt, hsa
guauuaguuaaaacuuuaggguuugcuuuuuugcuguuuagaucaaaguuuuuucugauucuuc

SEQ ID NO: 111714 - RNA, 64 nt, hsa
gcuuuacuaagauuuuuaaauagugaaaaccuccuguuuagacuuugguggaagaugaaucaag

SEQ ID NO: 111715 - RNA, 64 nt, hsa
uuguuaaagcaaaaacuaugcgaaagggugagucuguuuagaagaaaaagcaaagacugaggua

SEQ ID NO: 111716 - RNA, 64 nt, hsa
aauacuugaaccauaaaauguccaguaagaucacuguuuagauuugccauagaguacacugccu

SEQ ID NO: 111717 - RNA, 64 nt, hsa
cuuaaaacaucauuccuuuuuauuuauauguauguguuuagaauugaagguuuuugauagcauu

SEQ ID NO: 111718 - RNA, 64 nt, hsa
gccgcacuucauuaaaauucuucuaaaacuuguauguuuagaguuaagcaagacuuuuuuucuu

SEQ ID NO: 111719 - RNA, 64 nt, hsa
acgcugauguggcuaacaaguuuauuuuaagaauuguuuagaaaugcuguugcuucagguucuu

SEQ ID NO: 111720 - RNA, 64 nt, hsa
uucuaacucugauuuuauaaucagacuuagauuguguuuagaauauuaaaugacugggcacccu

SEQ ID NO: 111721 - RNA, 64 nt, hsa
uauacucccuaauacacauuuaugaaaaucuacuuguuuagacuuuuauuuauacucuucugau

SEQ ID NO: 111722 - RNA, 64 nt, hsa
ucucaggagcccucaccauuguguccauucacuguguauagauggcagaacuuuugaggugcaa

SEQ ID NO: 111723 - RNA, 64 nt, hsa
ggucaccaauuuucucauuucaccccauuuaccuuguauagaggauuguucauuccuuugggac

SEQ ID NO: 111724 - RNA, 64 nt, hsa
aauaguaauuauggauauaaaaaauaagaaauuuuguauagaaaugaagguuucauaaugauca

SEQ ID NO: 111725 - RNA, 64 nt, hsa
cucuuuugagauauccaagaguauauucuugcucuguauagagaauaucaucugauagugucuu

SEQ ID NO: 111726 - RNA, 64 nt, hsa
guauagauagguuugugaaagucuaaauaaugguuguauagauauguauauaugguucacauau

SEQ ID NO: 111727 - RNA, 64 nt, hsa
uacuuaagggauaguguugauagauaaauuagaauguauagauagguuugugaaagucuaaaua

SEQ ID NO: 111728 - RNA, 64 nt, hsa
guguuuuucuuuuuuugucuuauguuguaaucauuguauagagcuaaaaaaauugaaaacaaac

SEQ ID NO: 111729 - RNA, 64 nt, hsa
gauuaugcuugaauuacuauauuuaaaaugaaaauguauagauuacacagccaggaaugcuagu

SEQ ID NO: 111730 - RNA, 64 nt, hsa
ucuggacugugauaagugacguuuuauagccuguuguauagaaaaugcaaaauauaucucugcu

SEQ ID NO: 111731 - RNA, 64 nt, hsa
auuaugucugaucccaagaucuuaaauggacacuuguauagaaauagucuucauuuuaucugag

SEQ ID NO: 111732 - RNA, 64 nt, hsa
ucagaaaaggaaagcaauggucugguacaagucuuguauagaacaagaaguuuagacuuuugaa

SEQ ID NO: 111733 - RNA, 64 nt, hsa
guuagauauguuucuuucuaaggacaagcaacuauguauagacuuguuguuugaauuuuuuuuc

SEQ ID NO: 111734 - RNA, 64 nt, hsa
uaaacaguccuguaaaaaaccaaaaaggacuuuuuguauagaaagcacuacccuaagccaugaa

SEQ ID NO: 111735 - RNA, 64 nt, hsa
agagagagcagcuguuaugcaacauauagaaaaauguauagaugcuuggacagacccgguaaug

SEQ ID NO: 111736 - RNA, 64 nt, hsa
cccugccuuuuuuuuuuuuuuuuuuuuuuuuuuuuguauagaaacagauccauuucuugguaau

SEQ ID NO: 111737 - RNA, 64 nt, hsa
auuguaauuauauuaacagagcacacuaauaauuuguauagauuauauauauuagaucuugggu

SEQ ID NO: 111738 - RNA, 64 nt, hsa
uuauaucugaggaauucuguauagauuagaauucuguauagauuagagaguguugaaacggaug

SEQ ID NO: 111739 - RNA, 64 nt, hsa
acgcguugaaauuguaauuauaucugaggaauucuguauagauuagaauucuguauagauuaga

SEQ ID NO: 111740 - RNA, 64 nt, hsa
uacccaggaauggagccugcacggugaauggcuuuguauagaaccucuuugucuacaccauuau

SEQ ID NO: 111741 - RNA, 64 nt, hsa
cuuugucuuuuuuuccuaacccugaucucauacuuguauagaguaauaacaacaguuguacuuc

SEQ ID NO: 111742 - RNA, 64 nt, hsa
cuccuuucucuuccuccucuuugcaugguuuguguguauagacaguggaaccugaggaugggau

SEQ ID NO: 111743 - RNA, 64 nt, hsa
uuacuguauagaaaguuuaacuuuuccucaccccuguauagaaaaugccuugccucucaagaga

SEQ ID NO: 111744 - RNA, 64 nt, hsa
uuucucaguugggauuugggcauugcuaacuuacuguauagaaaguuuaacuuuuccucacccc

SEQ ID NO: 111745 - RNA, 64 nt, hsa
auuuugaacaaguaauuuucuugacaagaaagaauguauagaagucucccugcaauuaauuucc

SEQ ID NO: 111746 - RNA, 64 nt, hsa
aacaacuguaauacaaccuuuugaauuaguuccguguauagauaauuaaauucuucauacaaaa

SEQ ID NO: 111747 - RNA, 64 nt, hsa
acugauaaugccuauggacauuuggguaaaacccuguauagaauuaauuauccuuuuacuuugg

SEQ ID NO: 111748 - RNA, 64 nt, hsa
cauuucagcuaagauuaaauuuaaagccuaagaauguauagagcuaguuuuaaaauaaugaucu

SEQ ID NO: 111749 - RNA, 64 nt, hsa; identical to SEQ ID NO: 97841

SEQ ID NO: 111750 - RNA, 64 nt, hsa; identical to SEQ ID NO: 97842

SEQ ID NO: 111751 - RNA, 64 nt, hsa; identical to SEQ ID NO: 97843

SEQ ID NO: 111752 - RNA, 64 nt, hsa; identical to SEQ ID NO: 97844

SEQ ID NO: 111753 - RNA, 64 nt, hsa; identical to SEQ ID NO: 97845

SEQ ID NO: 111754 - RNA, 64 nt, hsa; identical to SEQ ID NO: 97846

SEQ ID NO: 111755 - RNA, 64 nt, hsa; identical to SEQ ID NO: 97847

SEQ ID NO: 111756 - RNA, 64 nt, hsa; identical to SEQ ID NO: 97848

SEQ ID NO: 111757 - RNA, 64 nt, hsa; identical to SEQ ID NO: 38988

SEQ ID NO: 111758 - RNA, 64 nt, hsa; identical to SEQ ID NO: 38989

SEQ ID NO: 111759 - RNA, 64 nt, hsa; identical to SEQ ID NO: 38990

SEQ ID NO: 111760 - RNA, 64 nt, hsa; identical to SEQ ID NO: 38991

SEQ ID NO: 111761 - RNA, 64 nt, hsa; identical to SEQ ID NO: 38992

SEQ ID NO: 111762 - RNA, 64 nt, hsa; identical to SEQ ID NO: 38993

SEQ ID NO: 111763 - RNA, 64 nt, hsa; identical to SEQ ID NO: 38994

SEQ ID NO: 111764 - RNA, 64 nt, hsa; identical to SEQ ID NO: 38995

SEQ ID NO: 111765 - RNA, 64 nt, hsa; identical to SEQ ID NO: 38996

SEQ ID NO: 111766 - RNA, 64 nt, hsa; identical to SEQ ID NO: 38997

SEQ ID NO: 111767 - RNA, 64 nt, hsa; identical to SEQ ID NO: 38998

SEQ ID NO: 111768 - RNA, 64 nt, hsa; identical to SEQ ID NO: 38999

SEQ ID NO: 111769 - RNA, 64 nt, hsa; identical to SEQ ID NO: 39000

SEQ ID NO: 111770 - RNA, 64 nt, hsa; identical to SEQ ID NO: 39001

SEQ ID NO: 111771 - RNA, 64 nt, hsa; identical to SEQ ID NO: 39002

SEQ ID NO: 111772 - RNA, 64 nt, hsa; identical to SEQ ID NO: 39003

SEQ ID NO: 111773 - RNA, 64 nt, hsa; identical to SEQ ID NO: 39004

SEQ ID NO: 111774 - RNA, 64 nt, hsa; identical to SEQ ID NO: 39005

SEQ ID NO: 111775 - RNA, 64 nt, hsa; identical to SEQ ID NO: 39006

SEQ ID NO: 111776 - RNA, 64 nt, hsa; identical to SEQ ID NO: 39007

SEQ ID NO: 111777 - RNA, 64 nt, hsa; identical to SEQ ID NO: 39008

SEQ ID NO: 111778 - RNA, 64 nt, hsa; identical to SEQ ID NO: 39009

SEQ ID NO: 111779 - RNA, 64 nt, hsa; identical to SEQ ID NO: 39010

SEQ ID NO: 111780 - RNA, 64 nt, hsa; identical to SEQ ID NO: 39011

SEQ ID NO: 111781 - RNA, 64 nt, hsa; identical to SEQ ID NO: 39012

SEQ ID NO: 111782 - RNA, 64 nt, hsa; identical to SEQ ID NO: 39013

SEQ ID NO: 111783 - RNA, 64 nt, hsa; identical to SEQ ID NO: 39014

SEQ ID NO: 111784 - RNA, 64 nt, hsa; identical to SEQ ID NO: 39015

SEQ ID NO: 111785 - RNA, 64 nt, hsa; identical to SEQ ID NO: 39016

SEQ ID NO: 111786 - RNA, 64 nt, hsa; identical to SEQ ID NO: 39017

SEQ ID NO: 111787 - RNA, 64 nt, hsa; identical to SEQ ID NO: 39018

SEQ ID NO: 111788 - RNA, 64 nt, hsa; identical to SEQ ID NO: 39019

SEQ ID NO: 111789 - RNA, 64 nt, hsa; identical to SEQ ID NO: 39020

SEQ ID NO: 111790 - RNA, 64 nt, hsa; identical to SEQ ID NO: 39021

SEQ ID NO: 111791 - RNA, 64 nt, hsa; identical to SEQ ID NO: 39022

SEQ ID NO: 111792 - RNA, 64 nt, hsa; identical to SEQ ID NO: 39023

SEQ ID NO: 111793 - RNA, 64 nt, hsa; identical to SEQ ID NO: 39024

SEQ ID NO: 111794 - RNA, 64 nt, hsa; identical to SEQ ID NO: 39025

SEQ ID NO: 111795 - RNA, 64 nt, hsa; identical to SEQ ID NO: 39026

SEQ ID NO: 111796 - RNA, 64 nt, hsa; identical to SEQ ID NO: 39027

SEQ ID NO: 111797 - RNA, 64 nt, hsa; identical to SEQ ID NO: 39028

SEQ ID NO: 111798 - RNA, 64 nt, hsa; identical to SEQ ID NO: 39029

SEQ ID NO: 111799 - RNA, 64 nt, hsa; identical to SEQ ID NO: 39030

SEQ ID NO: 111800 - RNA, 64 nt, hsa; identical to SEQ ID NO: 39031

SEQ ID NO: 111801 - RNA, 64 nt, hsa; identical to SEQ ID NO: 39032

SEQ ID NO: 111802 - RNA, 64 nt, hsa; identical to SEQ ID NO: 39033

SEQ ID NO: 111803 - RNA, 64 nt, hsa; identical to SEQ ID NO: 39034

SEQ ID NO: 111804 - RNA, 64 nt, hsa; identical to SEQ ID NO: 39035

SEQ ID NO: 111805 - RNA, 64 nt, hsa; identical to SEQ ID NO: 39036

SEQ ID NO: 111806 - RNA, 64 nt, hsa; identical to SEQ ID NO: 39037

SEQ ID NO: 111807 - RNA, 64 nt, hsa; identical to SEQ ID NO: 39038

SEQ ID NO: 111808 - RNA, 64 nt, hsa; identical to SEQ ID NO: 39039

SEQ ID NO: 111809 - RNA, 64 nt, hsa; identical to SEQ ID NO: 39040

SEQ ID NO: 111810 - RNA, 64 nt, hsa; identical to SEQ ID NO: 39041

SEQ ID NO: 111811 - RNA, 64 nt, hsa; identical to SEQ ID NO: 39042

SEQ ID NO: 111812 - RNA, 64 nt, hsa; identical to SEQ ID NO: 39043

SEQ ID NO: 111813 - RNA, 64 nt, hsa; identical to SEQ ID NO: 39044

SEQ ID NO: 111814 - RNA, 64 nt, hsa; identical to SEQ ID NO: 39045

SEQ ID NO: 111815 - RNA, 64 nt, hsa
ucaguuuuacucuaaauguacuuuuaauacuugcagauucuaagauuacauuguaaaauuccag

SEQ ID NO: 111816 - RNA, 64 nt, hsa
gacaaaguaaguauauuuuagagcugaaucaguaagauucuagagaaagcaaaacauaguaguu

SEQ ID NO: 111817 - RNA, 64 nt, hsa
agaauacgcugaagagggaaaauuucagugauggagauucuagauuaaauaucaggacugauuu

SEQ ID NO: 111818 - RNA, 64 nt, hsa
uuaacuuauguggacuguaaauguuuuauuuguaagauucuauaaauaaagcuauauucuguaa

SEQ ID NO: 111819 - RNA, 64 nt, hsa
ucuagaguucagaguccuuaaaauguaagauuauagauucuaaagauucuauaguucuagacau

SEQ ID NO: 111820 - RNA, 64 nt, hsa
cagaguccuuaaaauguaagauuauagauucuaaagauucuauaguucuagacauggagguucu

SEQ ID NO: 111821 - RNA, 64 nt, hsa
auaaggcuucaaaauguuaucuucucaaguucuaagauucuaaugaugaucaauuauaguuucu

SEQ ID NO: 111822 - RNA, 64 nt, hsa
gacuuacucuaagaucuuagauucucugugucuaagauucuagaucagaugcuccaagauucua

SEQ ID NO: 111823 - RNA, 64 nt, hsa
ucucugugucuaagauucuagaucagaugcuccaagauucuagaugauuaaauaagauucuaac

SEQ ID NO: 111824 - RNA, 64 nt, hsa
gaucagaugcuccaagauucuagaugauuaaauaagauucuaacggucuguucuguuucaaggc

SEQ ID NO: 111825 - RNA, 64 nt, hsa
uguaguucuaagacucaaauguucuaaguuucuaagauucuaaagguccacaggucuagacuau

SEQ ID NO: 111826 - RNA, 64 nt, hsa
ccugagcuugaucuuuuucugccaugaaguuuaaagauucuaugcccauuuccuugauugaaau

SEQ ID NO: 111827 - RNA, 64 nt, hsa
uugccucugaaacgucugguuaguggggacccaaagauucuagugagucaacauccauaacucu

SEQ ID NO: 111828 - RNA, 64 nt, hsa
gaaacauuuuuuggaaaggauggauuuagaggagagauucuaaauccauuuuggauguauuugu

SEQ ID NO: 111829 - RNA, 64 nt, hsa
ugccuucuaucacugauaguagcauuuaaguuucagauucuacagccuagucagcagauuuauc

SEQ ID NO: 111830 - RNA, 64 nt, hsa
cauuuacaagaaaaauguuuuaaagaugccagggguacugaaucugcaaagcaaaugagcagcc

SEQ ID NO: 111831 - RNA, 64 nt, hsa
uuaagcauguguaaugcuggauguguacaguacaguacugaacuuguaauuugaaucuaguaug

SEQ ID NO: 111832 - RNA, 64 nt, hsa
uuaagauuuugcagauuuaucaauuuggguuuuuguacugaaguugucuugcggcuuugcaagu

SEQ ID NO: 111833 - RNA, 64 nt, hsa
cacuguaauauugcuguccucuaauuaauuuuagguacugaagaacuuaauauuggcaacauuu

SEQ ID NO: 111834 - RNA, 64 nt, hsa
acauuuuuagaauguuuuuaugaguaaauuuaauguacugaaaauaaaaauuuuaaaaaaggcu

SEQ ID NO: 111835 - RNA, 64 nt, hsa
gugagucuuacgugcacaaaaagagaaggcuuugguacugaaacuggacaccuuguguacucga

SEQ ID NO: 111836 - RNA, 64 nt, hsa
aagccaaagucuuucugaagaaucugugcuggacagacauaauucccuuucucauugucuccau

SEQ ID NO: 111837 - RNA, 64 nt, hsa
uugucaguggagguccucagggcugcaaaugucaagacauaacccuguuccucaccaucaugau

SEQ ID NO: 111838 - RNA, 64 nt, hsa
agaccaauugaagcaugaacguggauuguauuuaagacauaaacaaagacauugacagcaauuc

SEQ ID NO: 111839 - RNA, 64 nt, hsa
acucccaaacugacaauuuuaccuauucugaaaaagacauaaaacagaauuugguagcacuuac

SEQ ID NO: 111840 - RNA, 64 nt, hsa
caguugauuuacaguggucacagggcccaauucuagacauaaaacaaaggauauaccugacaga

SEQ ID NO: 111841 - RNA, 64 nt, hsa
ccaaggggaaaucuaucaguauaaggaauguggaagacauaauccuuuggaaacuguuaauacu

SEQ ID NO: 111842 - RNA, 64 nt, hsa
aggggaaagggaaaucaaauuaauuuuucucguuagacauaaggaaauuuaaggaaaaacagcu

SEQ ID NO: 111843 - RNA, 64 nt, hsa
cucuggaguuguaguuugacagaaccaucaguaaagacauaagcaaauaaauggucuuggugca

SEQ ID NO: 111844 - RNA, 64 nt, hsa
gaggagcucucgacuuagagguaauaugaacagaugaacagacacuguggcuggagccccaaag

SEQ ID NO: 111845 - RNA, 64 nt, hsa
uuaaaagagaggagcucucgacuuagagguaauaugaacagaugaacagacacuguggcuggag

SEQ ID NO: 111846 - RNA, 62 nt, hsa
agguuucaaguggaaagccauucaucuuaaaagcugaacagaaaaauuaaaaaaaaaaaaaa

SEQ ID NO: 111847 - RNA, 64 nt, hsa
aagguuuuccucugugcuacccuuaacuuagggaugaacagacuauaacuaggaaaggaggaaa

SEQ ID NO: 111848 - RNA, 64 nt, hsa
uccaccagucccaccccagccuuuuccuuucaucugaacagaaugugcauuuuuggaagccucc

SEQ ID NO: 111849 - RNA, 64 nt, hsa
ccuuuaaaugguuuucuuuuugaggcaaguuggaugaacagagaagggaagagaggaagaacga

SEQ ID NO: 111850 - RNA, 64 nt, hsa
caaucugaacagagcacagaacauuuuuucagacugaacagacuguuggaccagccugucauga

SEQ ID NO: 111851 - RNA, 64 nt, hsa
acugcgcccggccaaaaagaacauuuugucaaucugaacagagcacagaacauuuuuucagacu

SEQ ID NO: 111852 - RNA, 64 nt, hsa
ccuuauaauaaaagaucaaaagauauaucuccuaugaacagauuggagauaggagaugaaaagu

SEQ ID NO: 111853 - RNA, 64 nt, hsa
cuaaugaaugacauuuagauacuucauaaaauuaugaacagauauggaggccagagcucauuug

SEQ ID NO: 111854 - RNA, 64 nt, hsa
ccuucagaguagagaaccauguaaacauuaggaaugaacagaggccuuaggaaugaauagagag

SEQ ID NO: 111855 - RNA, 64 nt, hsa
gucucuuccgagggccuucugaagacagggcucuugaacagacaaguggaagggcuguaccagg

SEQ ID NO: 111856 - RNA, 64 nt, hsa
ugaaauuuucuuuguaucuagggguauccgucacugaacagaaauucuuaauuuuggcuaggcg

SEQ ID NO: 111857 - RNA, 64 nt, hsa
agaaucacuugaacccgggagguggaggcugcagugaacagagacagugccacugcacaucagc

SEQ ID NO: 111858 - RNA, 64 nt, hsa
aguucuguccaagccaucagcuccuugggacugaugaacagagucagaagcccaaaggaauugc

SEQ ID NO: 111859 - RNA, 64 nt, hsa
guugacuuugaaucccagguacucacagaaauggugaacagacuuaguuguuacccaggcaccc

SEQ ID NO: 111860 - RNA, 64 nt, hsa
ggcuggaaauaauccaauuauuccugcuuggauucuuccacagggccuguguaagaauggguuc

SEQ ID NO: 111861 - RNA, 64 nt, hsa
uguuagacagccacaguccugucuggguuagggucuuccacauuugaggauccuuccuaucucu

SEQ ID NO: 111862 - RNA, 64 nt, hsa
uuuguuguugguuccuuuuagaccacggcugccccuuccacaccccaucuugcucuaaugauca

SEQ ID NO: 111863 - RNA, 64 nt, hsa
cuucuguggcugucuuguuucugaaguacuuaaacuuccacaagagugaauuugaccuaggcaa

SEQ ID NO: 111864 - RNA, 64 nt, hsa
uuuuccagugugguuuuuaacagauaauacauuucuuccacauucagauuaguauucggacaug

SEQ ID NO: 111865 - RNA, 64 nt, hsa
cuuuaggaaacgaaauauuuccuaaauaaccaggcuuccacauuguacagaaugagcagucaug

SEQ ID NO: 111866 - RNA, 64 nt, hsa
gcaugcccacaggccaggcccagucacagcugggcuuccacaggucagaauaugggacaggaca

SEQ ID NO: 111867 - RNA, 64 nt, hsa
aagggugggagucuggagccagacagccaagccccuuccacaucuacagggucacugucauccu

SEQ ID NO: 111868 - RNA, 64 nt, hsa
uggggcaccauuucaguguaaaagcaguccuacucuuccacacuaggaaggcuuuacuuuuuuu

SEQ ID NO: 111869 - RNA, 64 nt, hsa
aacgaugaugguuacccuucauggacgucuuaaucuuccacacacauccccuuuuuuuggaaua

SEQ ID NO: 111870 - RNA, 64 nt, hsa
ugccagauauucaguacucgaucucaauuccccucuuccacaagaguugggugaccagcugucc

SEQ ID NO: 111871 - RNA, 64 nt, hsa
cuugucuccgauagcuccccacaucucuaauugacuuccacaaaaucgaugcguugcuuuggua

SEQ ID NO: 111872 - RNA, 64 nt, hsa
cugggaucucugguaccgucacucuugcuugugccuuccacaccuucucggugcagaucccuau

SEQ ID NO: 111873 - RNA, 64 nt, hsa
ccccuggcaugcaugcuggcggcggcaugccucccuuccacaagcccaugcugcugcagaggga

SEQ ID NO: 111874 - RNA, 64 nt, hsa
auguaaccccucucucaccccggcacaaccugggcuuccacagucuggagcugcccuaccccca

SEQ ID NO: 111875 - RNA, 64 nt, hsa
aacuuuucuccccaacccccaaacccacgacucacuuccacaccgucuuccccagcgucccccg

SEQ ID NO: 111876 - RNA, 64 nt, hsa
agguugcagugagccgagauugugccacugcacuccagccuaggcgacagagugagacuccauc

SEQ ID NO: 111877 - RNA, 64 nt, hsa
ggugggcagaucacuugaggucaggaguucgcgaccagccuacccaacauggugaaaccccauc

SEQ ID NO: 111878 - RNA, 64 nt, hsa
aaugaaagaaaaugagagcagaaaguaagcauuuccagccuaucuaauuucuuuaguuuucuau

SEQ ID NO: 111879 - RNA, 64 nt, hsa
uuugccuccagugcaguccauuuccuaauguauaccagccuacuguacuauuuaaaaugcucaa

SEQ ID NO: 111880 - RNA, 64 nt, hsa
aaaccuagccagggucuguucuuguggaccagagccagccuagucauuauuugcugucggguuu

SEQ ID NO: 111881 - RNA, 64 nt, hsa
ugggcugagggggaaugaguguucuugccauuugccagccuaaugcgcaugcuuucugccucug

SEQ ID NO: 111882 - RNA, 62 nt, hsa
acaacagaaauuuauucucuuaacaguuccagagacuaaauguccagacucacaauguccca

SEQ ID NO: 111883 - RNA, 62 nt, hsa
uaaguuacuucaauuauaaaauugaauuuugcagacuaaauuauuuuauaaggcuguugcua

SEQ ID NO: 111884 - RNA, 62 nt, hsa
cauaauaagcaaauuauuggcuucuuucuucuagacuaaaagaaauuaaagagaugaaacaa

SEQ ID NO: 111885 - RNA, 62 nt, hsa
uaucauuaauuuuauaucaggauucauguaagagacuaaaaaugauccauagugguuaguac

SEQ ID NO: 111886 - RNA, 62 nt, hsa
aauuuaacuaaaggguaguuguuuuacaaugaagacuaaaacugaacaagauguugcaugcu

SEQ ID NO: 111887 - RNA, 62 nt, hsa
uauaagaaagaguaguuguugauuaaauuuucagacuaaauauaggacagguacaauuuugg

SEQ ID NO: 111888 - RNA, 62 nt, hsa
auucgucauucucaaccuuugaauuaaagcuuagacuaaauaguaauauaucgugggaagga

SEQ ID NO: 111889 - RNA, 62 nt, hsa
uuaccauaauguaagagaagguccuggaacagagacuaaaucccacgaaacugacauuguua

SEQ ID NO: 111890 - RNA, 62 nt, hsa
cauuguuauuuuuuuuuaaacucaguuuaaaaagacuaaaacguucuuucaaaagaggcauc

SEQ ID NO: 111891 - RNA, 62 nt, hsa
gacacuuugguaugaugcauauacaaguuggaagacuaaagaggugcagugugaucugagcc

SEQ ID NO: 111892 - RNA, 62 nt, hsa
acuccuggauuucagcuucacuuuuaaccugcagacuaaauuucuuucucaauuaugucaga

SEQ ID NO: 111893 - RNA, 62 nt, hsa
aauauuuuucuuaugaauucuuaaaguacuaaagacuaaaaugcaaaaagcaauacuuaaua

SEQ ID NO: 111894 - RNA, 64 nt, hsa
agguaacgcagugcgggguuagggauuccccgggagagaggacgaagcgaggagaguucuccau

SEQ ID NO: 111895 - RNA, 64 nt, hsa
acagcccgguaggcugcgucgcccgagccccgggagagaggagcgaagauccggaacucgccaa

SEQ ID NO: 111896 - RNA, 64 nt, hsa
uucaugaauaucaaaucuuuugaugcuggacccaagagaggaaaaguuguagcuaaauguugau

SEQ ID NO: 111897 - RNA, 64 nt, hsa
caguucccaaaucaauuauagguaccuguuuaggagagaggaagauuuuaccucucaaagggug

SEQ ID NO: 111898 - RNA, 64 nt, hsa
uuggaaugaaacggagugaacaugagcccagcugagagaggagcaggaaugugugaaaaacagc

SEQ ID NO: 111899 - RNA, 64 nt, hsa
cacauaugcauaucuugacauugcucuguaggugagagaggaccaugacgcccauguuugcagc

SEQ ID NO: 111900 - RNA, 64 nt, hsa
cgaccuucugaaacucacagaagucacgugauggagagaggauucaaagccagggccucagacc

SEQ ID NO: 111901 - RNA, 64 nt, hsa
gaagagcucuaaggagaagaaaccccauagcgucagagaggauaugucuggcuuccaagagaaa

SEQ ID NO: 111902 - RNA, 64 nt, hsa
cccaccauauguauuuucuaggauuugagaggaaagagaggaaaaugggggaauggguugcaaa

SEQ ID NO: 111903 - RNA, 64 nt, hsa
cuuuuugaggcaaguuggaugaacagagaagggaagagaggaagaacgagaggaagagaaggga

SEQ ID NO: 111904 - RNA, 64 nt, hsa
acuuggaaugaggccaacaggguucaccaggaugagagaggagagaggaauccacaggaccacc

SEQ ID NO: 111905 - RNA, 64 nt, hsa
augaggccaacaggguucaccaggaugagagaggagagaggaauccacaggaccaccagaaggg

SEQ ID NO: 111906 - RNA, 64 nt, hsa
augaggccuacaggguucaccaggauguaagaggagagaggaauccacaggaccaccagagagg

SEQ ID NO: 111907 - RNA, 64 nt, hsa
gauguaagaggagagaggaauccacaggaccaccagagaggagagggaaccagauaugcagauc

SEQ ID NO: 111908 - RNA, 64 nt, hsa
uauauaggcuuuguugaugaaaaacgacaauugaagagaggacguugaguggauuccuggguac

SEQ ID NO: 111909 - RNA, 64 nt, hsa
guuuccuuagaagucauaaaauauuuugaaauuuagagaggaauucaugauuaaagauuccuaa

SEQ ID NO: 111910 - RNA, 64 nt, hsa
uggagcucuucuuaccagccaccguggcucagccagagaggagcugagcccuguggagcagaac

SEQ ID NO: 111911 - RNA, 64 nt, hsa
gagaauggagcaggaggaaaagcagaguuggucuagagaggaggagggcggggcuggaggaaug

SEQ ID NO: 111912 - RNA, 64 nt, hsa
caaaagaagggaaaacuggcaugacaaaagcuacagagaggagagugaaauauagaaguguuug

SEQ ID NO: 111913 - RNA, 64 nt, hsa
gaucuacucggggccucaggcuucucagcugggaagagaggaugcaagaccagacugaagaaca

SEQ ID NO: 111914 - RNA, 64 nt, hsa
aaaagcaggcagggaaggggguaguaaaggacugagagaggagggagguggcuggagaaggaaa

SEQ ID NO: 111915 - RNA, 64 nt, hsa
gcuuccugugugauccuggcccuccggccgcuagagagaggauugggaaaccccacugucagcu

SEQ ID NO: 111916 - RNA, 64 nt, hsa
cuguggccucugccgggcuccauucccaaggaaaagagaggagcuugggcucacagaaagagaa

SEQ ID NO: 111917 - RNA, 64 nt, hsa
acaacucaccaaccuccaacccagagccccagugagagaggagcauuuggccuccugcuuccuu

SEQ ID NO: 111918 - RNA, 64 nt, hsa
caggguccuaaaacuuggauggacuuguauagugagagaggaggccuggaccgagaugugaguc

SEQ ID NO: 111919 - RNA, 64 nt, hsa
cagaugcugcugaagagaggugccggggaggggcagagaggaaguggucugucuguuaccauaa

SEQ ID NO: 111920 - RNA, 64 nt, hsa
acacagcugcagagacagagaggacgugggcggcagagaggacuguugacauccaagcuuccuu

SEQ ID NO: 111921 - RNA, 64 nt, hsa
ggucacugccauggaggcacacagcugcagagacagagaggacgugggcggcagagaggacugu

SEQ ID NO: 111922 - RNA, 64 nt, hsa
gcgcugcuuccaggauaaggagacugaggcuuagagagaggaggcagcccccuccacaccagug

SEQ ID NO: 111923 - RNA, 64 nt, hsa
ggagcccugaccuuggcugacuggggcuggggugagagaggaaagaccuacauucccucuccug

SEQ ID NO: 111924 - RNA, 64 nt, hsa
ucccaguucugcgccuuggggccagccaguacucagagaggaggaccuucucaaccacguacag

SEQ ID NO: 111925 - RNA, 64 nt, hsa
ucgggcaggugggucacguggucugcagaaccaaagagaggaaucgccaaaacaaaucacgaga

SEQ ID NO: 111926 - RNA, 64 nt, hsa
ccagggucucucagggauggagggaagaccugaaagagaggacugguucugaggccagaaaggu

SEQ ID NO: 111927 - RNA, 64 nt, hsa
agaggacugguucugaggccagaaaggugugaggagagaggaggaaaagucuuccuaauugugc

SEQ ID NO: 111928 - RNA, 64 nt, hsa; identical to SEQ ID NO: 21574

SEQ ID NO: 111929 - RNA, 64 nt, hsa; identical to SEQ ID NO: 21575

SEQ ID NO: 111930 - RNA, 64 nt, hsa; identical to SEQ ID NO: 21576

SEQ ID NO: 111931 - RNA, 64 nt, hsa; identical to SEQ ID NO: 21577

SEQ ID NO: 111932 - RNA, 64 nt, hsa; identical to SEQ ID NO: 21578

SEQ ID NO: 111933 - RNA, 64 nt, hsa; identical to SEQ ID NO: 21579

SEQ ID NO: 111934 - RNA, 64 nt, hsa; identical to SEQ ID NO: 21580

SEQ ID NO: 111935 - RNA, 64 nt, hsa; identical to SEQ ID NO: 21581

SEQ ID NO: 111936 - RNA, 64 nt, hsa; identical to SEQ ID NO: 21582

SEQ ID NO: 111937 - RNA, 64 nt, hsa; identical to SEQ ID NO: 21583

SEQ ID NO: 111938 - RNA, 64 nt, hsa; identical to SEQ ID NO: 21584

SEQ ID NO: 111939 - RNA, 64 nt, hsa; identical to SEQ ID NO: 21585

SEQ ID NO: 111940 - RNA, 64 nt, hsa; identical to SEQ ID NO: 21586

SEQ ID NO: 111941 - RNA, 64 nt, hsa; identical to SEQ ID NO: 21587

SEQ ID NO: 111942 - RNA, 64 nt, hsa; identical to SEQ ID NO: 21588

SEQ ID NO: 111943 - RNA, 64 nt, hsa; identical to SEQ ID NO: 21589

SEQ ID NO: 111944 - RNA, 64 nt, hsa; identical to SEQ ID NO: 21590

SEQ ID NO: 111945 - RNA, 64 nt, hsa; identical to SEQ ID NO: 21591

SEQ ID NO: 111946 - RNA, 64 nt, hsa; identical to SEQ ID NO: 21592

SEQ ID NO: 111947 - RNA, 64 nt, hsa; identical to SEQ ID NO: 21593

SEQ ID NO: 111948 - RNA, 64 nt, hsa; identical to SEQ ID NO: 21594

SEQ ID NO: 111949 - RNA, 64 nt, hsa; identical to SEQ ID NO: 21595

SEQ ID NO: 111950 - RNA, 64 nt, hsa; identical to SEQ ID NO: 21596

SEQ ID NO: 111951 - RNA, 64 nt, hsa; identical to SEQ ID NO: 21597

SEQ ID NO: 111952 - RNA, 64 nt, hsa; identical to SEQ ID NO: 21598

SEQ ID NO: 111953 - RNA, 64 nt, hsa; identical to SEQ ID NO: 21599

SEQ ID NO: 111954 - RNA, 64 nt, hsa; identical to SEQ ID NO: 21600

SEQ ID NO: 111955 - RNA, 64 nt, hsa; identical to SEQ ID NO: 21601

SEQ ID NO: 111956 - RNA, 64 nt, hsa; identical to SEQ ID NO: 21602

SEQ ID NO: 111957 - RNA, 64 nt, hsa; identical to SEQ ID NO: 21603

SEQ ID NO: 111958 - RNA, 64 nt, hsa; identical to SEQ ID NO: 21604

SEQ ID NO: 111959 - RNA, 64 nt, hsa; identical to SEQ ID NO: 21605

SEQ ID NO: 111960 - RNA, 64 nt, hsa; identical to SEQ ID NO: 21606

SEQ ID NO: 111961 - RNA, 64 nt, hsa; identical to SEQ ID NO: 21607

SEQ ID NO: 111962 - RNA, 64 nt, hsa; identical to SEQ ID NO: 21608

SEQ ID NO: 111963 - RNA, 64 nt, hsa; identical to SEQ ID NO: 21609

SEQ ID NO: 111964 - RNA, 64 nt, hsa; identical to SEQ ID NO: 21610

SEQ ID NO: 111965 - RNA, 64 nt, hsa; identical to SEQ ID NO: 21611

SEQ ID NO: 111966 - RNA, 64 nt, hsa; identical to SEQ ID NO: 21612

SEQ ID NO: 111967 - RNA, 64 nt, hsa; identical to SEQ ID NO: 21613

SEQ ID NO: 111968 - RNA, 64 nt, hsa; identical to SEQ ID NO: 21614

SEQ ID NO: 111969 - RNA, 64 nt, hsa; identical to SEQ ID NO: 21615

SEQ ID NO: 111970 - RNA, 64 nt, hsa; identical to SEQ ID NO: 21616

SEQ ID NO: 111971 - RNA, 64 nt, hsa; identical to SEQ ID NO: 21617

SEQ ID NO: 111972 - RNA, 64 nt, hsa; identical to SEQ ID NO: 21618

SEQ ID NO: 111973 - RNA, 64 nt, hsa; identical to SEQ ID NO: 21619

SEQ ID NO: 111974 - RNA, 64 nt, hsa; identical to SEQ ID NO: 21620

SEQ ID NO: 111975 - RNA, 64 nt, hsa; identical to SEQ ID NO: 21621

SEQ ID NO: 111976 - RNA, 64 nt, hsa; identical to SEQ ID NO: 21622

SEQ ID NO: 111977 - RNA, 64 nt, hsa; identical to SEQ ID NO: 21623

SEQ ID NO: 111978 - RNA, 64 nt, hsa; identical to SEQ ID NO: 21624

SEQ ID NO: 111979 - RNA, 64 nt, hsa; identical to SEQ ID NO: 21625

SEQ ID NO: 111980 - RNA, 64 nt, hsa; identical to SEQ ID NO: 21626

SEQ ID NO: 111981 - RNA, 64 nt, hsa; identical to SEQ ID NO: 21627

SEQ ID NO: 111982 - RNA, 64 nt, hsa; identical to SEQ ID NO: 21628

SEQ ID NO: 111983 - RNA, 64 nt, hsa; identical to SEQ ID NO: 21629

SEQ ID NO: 111984 - RNA, 64 nt, hsa; identical to SEQ ID NO: 21630

SEQ ID NO: 111985 - RNA, 57 nt, hsa; identical to SEQ ID NO: 21631

SEQ ID NO: 111986 - RNA, 64 nt, hsa; identical to SEQ ID NO: 21632

SEQ ID NO: 111987 - RNA, 64 nt, hsa; identical to SEQ ID NO: 21633

SEQ ID NO: 111988 - RNA, 64 nt, hsa; identical to SEQ ID NO: 21634

SEQ ID NO: 111989 - RNA, 64 nt, hsa; identical to SEQ ID NO: 21635

SEQ ID NO: 111990 - RNA, 64 nt, hsa; identical to SEQ ID NO: 21636

SEQ ID NO: 111991 - RNA, 64 nt, hsa; identical to SEQ ID NO: 21637

SEQ ID NO: 111992 - RNA, 64 nt, hsa; identical to SEQ ID NO: 21638

SEQ ID NO: 111993 - RNA, 64 nt, hsa; identical to SEQ ID NO: 21639

SEQ ID NO: 111994 - RNA, 64 nt, hsa; identical to SEQ ID NO: 21640

SEQ ID NO: 111995 - RNA, 64 nt, hsa; identical to SEQ ID NO: 21641

SEQ ID NO: 111996 - RNA, 64 nt, hsa; identical to SEQ ID NO: 21642

SEQ ID NO: 111997 - RNA, 64 nt, hsa; identical to SEQ ID NO: 21643

SEQ ID NO: 111998 - RNA, 64 nt, hsa; identical to SEQ ID NO: 21644

SEQ ID NO: 111999 - RNA, 64 nt, hsa; identical to SEQ ID NO: 21645

SEQ ID NO: 112000 - RNA, 64 nt, hsa; identical to SEQ ID NO: 21646

SEQ ID NO: 112001 - RNA, 64 nt, hsa; identical to SEQ ID NO: 21647

SEQ ID NO: 112002 - RNA, 64 nt, hsa; identical to SEQ ID NO: 21648

SEQ ID NO: 112003 - RNA, 64 nt, hsa; identical to SEQ ID NO: 21649

SEQ ID NO: 112004 - RNA, 64 nt, hsa; identical to SEQ ID NO: 21650

SEQ ID NO: 112005 - RNA, 64 nt, hsa; identical to SEQ ID NO: 21651

SEQ ID NO: 112006 - RNA, 64 nt, hsa; identical to SEQ ID NO: 21652

SEQ ID NO: 112007 - RNA, 64 nt, hsa; identical to SEQ ID NO: 21653

SEQ ID NO: 112008 - RNA, 64 nt, hsa; identical to SEQ ID NO: 21654

SEQ ID NO: 112009 - RNA, 64 nt, hsa; identical to SEQ ID NO: 21655

SEQ ID NO: 112010 - RNA, 64 nt, hsa; identical to SEQ ID NO: 21656

SEQ ID NO: 112011 - RNA, 64 nt, hsa; identical to SEQ ID NO: 21657

SEQ ID NO: 112012 - RNA, 64 nt, hsa; identical to SEQ ID NO: 21658

SEQ ID NO: 112013 - RNA, 64 nt, hsa; identical to SEQ ID NO: 21659

SEQ ID NO: 112014 - RNA, 64 nt, hsa; identical to SEQ ID NO: 21660

SEQ ID NO: 112015 - RNA, 64 nt, hsa; identical to SEQ ID NO: 21661

SEQ ID NO: 112016 - RNA, 64 nt, hsa; identical to SEQ ID NO: 21662

SEQ ID NO: 112017 - RNA, 64 nt, hsa; identical to SEQ ID NO: 21663

SEQ ID NO: 112018 - RNA, 64 nt, hsa; identical to SEQ ID NO: 21664

SEQ ID NO: 112019 - RNA, 64 nt, hsa; identical to SEQ ID NO: 21665

SEQ ID NO: 112020 - RNA, 64 nt, hsa; identical to SEQ ID NO: 21666

SEQ ID NO: 112021 - RNA, 64 nt, hsa; identical to SEQ ID NO: 21667

SEQ ID NO: 112022 - RNA, 64 nt, hsa; identical to SEQ ID NO: 21668

SEQ ID NO: 112023 - RNA, 64 nt, hsa; identical to SEQ ID NO: 21669

SEQ ID NO: 112024 - RNA, 64 nt, hsa; identical to SEQ ID NO: 21670

SEQ ID NO: 112025 - RNA, 64 nt, hsa; identical to SEQ ID NO: 21671

SEQ ID NO: 112026 - RNA, 64 nt, hsa; identical to SEQ ID NO: 21672

SEQ ID NO: 112027 - RNA, 64 nt, hsa; identical to SEQ ID NO: 21673

SEQ ID NO: 112028 - RNA, 64 nt, hsa; identical to SEQ ID NO: 21674

SEQ ID NO: 112029 - RNA, 64 nt, hsa; identical to SEQ ID NO: 21675

SEQ ID NO: 112030 - RNA, 64 nt, hsa; identical to SEQ ID NO: 21676

SEQ ID NO: 112031 - RNA, 64 nt, hsa; identical to SEQ ID NO: 21677

SEQ ID NO: 112032 - RNA, 64 nt, hsa; identical to SEQ ID NO: 21678

SEQ ID NO: 112033 - RNA, 64 nt, hsa; identical to SEQ ID NO: 21679

SEQ ID NO: 112034 - RNA, 64 nt, hsa; identical to SEQ ID NO: 21680

SEQ ID NO: 112035 - RNA, 64 nt, hsa; identical to SEQ ID NO: 21681

SEQ ID NO: 112036 - RNA, 64 nt, hsa; identical to SEQ ID NO: 21682

SEQ ID NO: 112037 - RNA, 64 nt, hsa
uaacucccuuaagcccagacaucuguugagaccugaccccuagucauugguuaccaguguguca

SEQ ID NO: 112038 - RNA, 64 nt, hsa
cccacaucucuuuuccggauacauuauaauucuggaccccuauuuaucucaaaacucuuaauau

SEQ ID NO: 112039 - RNA, 64 nt, hsa
uuuuuuuuuuaaugggggacaaaagagagggaaagaccccuauaaaucuauauauaacaaugua

SEQ ID NO: 112040 - RNA, 64 nt, hsa
ggcugcacacccugccccagcccagcugccuccagaccccuaagcaucuccuguccuggccucu

SEQ ID NO: 112041 - RNA, 64 nt, hsa
cucugaguggggagagguugggcagugagugagggaccccuaaugcagggacuagaagccucag

SEQ ID NO: 112042 - RNA, 64 nt, hsa
uuauuguuuuauuguauacucuuugucuuuuuaagaccccuaauagccuuuuguaacuugaugg

SEQ ID NO: 112043 - RNA, 64 nt, hsa
uuaauaaaagaaaauuacaaaaaaaaauuuuaaagaccccuaacccuuugugugcucuccauuc

SEQ ID NO: 112044 - RNA, 64 nt, hsa
guaguuccccuuaucugagcaguauauguucuaagaccccuaguagauucgcaaaccacagaua

SEQ ID NO: 112045 - RNA, 64 nt, hsa
acgcccuuagccuuuggagcuagagcacccuugggaccccuaguuccacugcacauggcccucc

SEQ ID NO: 112046 - RNA, 64 nt, hsa
cuuuugucaauugcaccaaaagaaugagugccuugaccccuaaugcugcauauguuacaauucu

SEQ ID NO: 112047 - RNA, 64 nt, hsa
gguguagggccugacaagaacauauuguuucccugaccccuaggccgucacaccacacccucca

SEQ ID NO: 112048 - RNA, 64 nt, hsa
caagccagauucuucugccucuuucuccuuuccagaccccuacucugugcagugcugaccacag

SEQ ID NO: 112049 - RNA, 64 nt, hsa
gggagagacucuggagguggugggucucucgggagaccccuaaugaggaaguugagguaaugcu

SEQ ID NO: 112050 - RNA, 64 nt, hsa
uuccucuaggacugguuuggggacgggugggaaugaccccuaggcaaggggaugagaccgcagg

SEQ ID NO: 112051 - RNA, 64 nt, hsa
gugucugcuuagaguuuacuccuacccuuccagggaccccuauccugauccccaacugaagcuu

SEQ ID NO: 112052 - RNA, 64 nt, hsa
cacacauuccacuaggccuuuucauuccaaaggggaccccuaugaaguaaagaacugcacauga

SEQ ID NO: 112053 - RNA, 64 nt, hsa
ugccccaugccugcccugcgugcugguuccuucagaccccuaacccuacuaaccagcaggcuca

SEQ ID NO: 112054 - RNA, 64 nt, hsa
uuuaauuauaaagugaaggaccaguuggaccacggaccccuagaaacucagccaaggagaccug

SEQ ID NO: 112055 - RNA, 64 nt, hsa
cagcccugguuuuucaauccccagggucggguaggaccccuacuggcagccagccucuguuucu

SEQ ID NO: 112056 - RNA, 64 nt, hsa
gauggaaggccuuggauuuauauugcacuucauagaccccuaggcugcugugcggugggacucc

SEQ ID NO: 112057 - RNA, 64 nt, hsa
augcagacuggugggguggcagauguuagccuaagaccccuagcagugccuguugcuuugugag

SEQ ID NO: 112058 - RNA, 64 nt, hsa
cgccccuccaugcgcugcguuccuccuccagaucgaccccuagaugccuacacaauaucuuuaa

SEQ ID NO: 112059 - RNA, 59 nt, hsa
ucagcuucuuccgagggugacaggugaaagaccccuacagguaauacccuuuccuuuac

SEQ ID NO: 112060 - RNA, 64 nt, hsa
uggaguuuuuaaucuggacucucuggcuugcugugaccccuaaggcaaugcuucucuucccugg

SEQ ID NO: 112061 - RNA, 64 nt, hsa
ugccccagcacugcuguggaaccaccuggcuuaugaccccuauggaugaucuuuaggaaaagca

SEQ ID NO: 112062 - RNA, 64 nt, hsa
gagccaauguuuuccacccauaauccuuucugccgaccccuaguucccucugcucagccaagcu

SEQ ID NO: 112063 - RNA, 64 nt, hsa
accuauacacuauuuuaagaaggggcuugagcaugaccccuaaagcuacauguaaaguucuugu

SEQ ID NO: 112064 - RNA, 64 nt, hsa
aggccagauggggcaggaaggcuccgcaggaccggaccccuagaccacccugccccaccugccc

SEQ ID NO: 112065 - RNA, 64 nt, hsa
cccuucucuucuaccccaaccccugaaacacacugaccccuauucuccagaugacagcacagcu

SEQ ID NO: 112066 - RNA, 54 nt, hsa
uucaagagucacccuucuaaggaggaccccuagacugcucgcuaguggaacacg

SEQ ID NO: 112067 - RNA, 64 nt, hsa
uccagcagaacuggacuaauucuguggacccucagaccccuaaauggggccgucuuggaaagua

SEQ ID NO: 112068 - RNA, 64 nt, hsa
gcaaagguagccuuuugggcuuuuuaaugaauaugaccccuauagaaaagucaagaaaaaaaaa

SEQ ID NO: 112069 - RNA, 64 nt, hsa
gcuuugagcugagcugaagcugaugcuggggucagaccccuacagagaaccagugcuuccuucg

SEQ ID NO: 112070 - RNA, 64 nt, hsa
cuaagcacguuucaaagaugaacacuuuuguuaagaccccuauugccucuucuucaugcucauu

SEQ ID NO: 112071 - RNA, 64 nt, hsa
gugggacacagauguggaauacaagaagaagcaggaccccuacuugcugaagacaggccgcuuu

SEQ ID NO: 112072 - RNA, 64 nt, hsa
cuggagccccauccuguguuaucugugguuuuuggaccccuaaugucagcuuggcuguaggacu

SEQ ID NO: 112073 - RNA, 64 nt, hsa
gugcccucacccagcccggcccccacccuguccagaccccuacagcugugucuaagcucaggag

SEQ ID NO: 112074 - RNA, 64 nt, hsa
ucucagaguccagucaaguucccuccugcagccugaccccuaggcagcucgagcaugcccugag

SEQ ID NO: 112075 - RNA, 64 nt, hsa
ugaaaacaccauuugucaaagaggccuuugaagagaccccuaagaaacacagagaguguuuagu

SEQ ID NO: 112076 - RNA, 64 nt, hsa
guugauuccauuuacucaugcuugcaaaacuagagaccccuaaggcagaacugagaauaaacau

SEQ ID NO: 112077 - RNA, 64 nt, hsa
cuggaggagaccuauggagggacaguuuugaccugaccccuagaggagacaguuuugaccucuu

SEQ ID NO: 112078 - RNA, 64 nt, hsa
ucauaacuuguuuccgaacuagaaaagucugugagaccccuacaucauucugguuuuuuugcuu

SEQ ID NO: 112079 - RNA, 64 nt, hsa
ccuucagccucagaguggaaucuuuuaaagacaggaccccuauguccaggaaaggggaaaagga

SEQ ID NO: 112080 - RNA, 64 nt, hsa
gccccuggcuacccuguuguuuucaucuaccucagaccccuaucauggggcucuacccugugac

SEQ ID NO: 112081 - RNA, 64 nt, hsa
gcaggcagccgaccugaggccugggggcaccguggaccccuaugcccgggucagcgucuccacc

SEQ ID NO: 112082 - RNA, 64 nt, hsa
caagggaggguaagggggcacccugagcccacaggaccccuacuucacagcucacaggggcagg

SEQ ID NO: 112083 - RNA, 64 nt, hsa
agucagcucccucuguccucugucagccuggccugaccccuacccuccagcauugcucuuccua

SEQ ID NO: 112084 - RNA, 64 nt, hsa
gagaaacaggggacccccucaccuccugggcagugaccccuacuaggcucccauuccagguacu

SEQ ID NO: 112085 - RNA, 64 nt, hsa
gcaucaggugcugguccuccucccuccuggccucgaccccuaagggcuucgccccucccagggg

SEQ ID NO: 112086 - RNA, 64 nt, hsa
auagaggaugccucccccacagacccuaccccaagaccccuagcccugcccccauccccccaag

SEQ ID NO: 112087 - RNA, 64 nt, hsa
caacccaacaaccaccuggcaauaugacucacuugaccccuaugggacccaaaugggcacuuuc

SEQ ID NO: 112088 - RNA, 64 nt, hsa
gaagggggaccaaugccagaagaaaggggcuguagaccccuauuccccaccccauggccacagg

SEQ ID NO: 112089 - RNA, 64 nt, hsa
uggugggcuccagucagucuuacacugcccuucugaccccuacaaauggguccuuugcuaucca

SEQ ID NO: 112090 - RNA, 64 nt, hsa
uggaagagauguccuaauaucucuuagggacccagaccccuaaauucuccuccucccccauuuu

SEQ ID NO: 112091 - RNA, 64 nt, hsa
ggccccuuguauuuuccuuaucuuccucuuucaagaccccuacccauuuugccuauccguaggc

SEQ ID NO: 112092 - RNA, 64 nt, hsa
gaucccgugcaggagccacauggguccugugcaggaccccuagcaguggugggcugagcccagg

SEQ ID NO: 112093 - RNA, 64 nt, hsa
cacuguggcuggacugccgcgccacgggcaccaggaccccuaagaccaagugacaacugggaga

SEQ ID NO: 112094 - RNA, 64 nt, hsa
gccuuuuuauacacuguccuccuccaccuugauggaccccuagugaugcauccugccuaggcug

SEQ ID NO: 112095 - RNA, 64 nt, hsa
ccuuggauagcacgggaggagaaguugacuuugugaccccuaguuuaggacccacuucagcugu

SEQ ID NO: 112096 - RNA, 64 nt, hsa
uagucuccccuuaucuguaagagauacauuccaagaccccuaguggaugccugaaaccucagau

SEQ ID NO: 112097 - RNA, 64 nt, hsa
caguuaccccuuuacccuuacaguagcaaaauaagaccccuaucuagugagggagacaggugca

SEQ ID NO: 112098 - RNA, 64 nt, hsa
ggagaugagucagugccaugacugagaaggaaccgaccccuaguugagagcaccuugcaguucc

SEQ ID NO: 112099 - RNA, 64 nt, hsa
ugcccuacugggagacugggacaccuuuaacacagaccccuagggauuuaaagggacaccccua

SEQ ID NO: 112100 - RNA, 64 nt, hsa
ugaccuggggguugccuggggaccucucccacccgaccccuacagagcuugagagccacagacg

SEQ ID NO: 112101 - RNA, 64 nt, hsa
caagaguucaagaccagccugggcaacauagcgagaccccuaucuguauuaaaaaaaaaucuga

SEQ ID NO: 112102 - RNA, 64 nt, hsa
cugcucacacaagcgacugggccggccggcccuggaccccuagaccccgagccgccugccgacu

SEQ ID NO: 112103 - RNA, 64 nt, hsa
uguggccccgcugccaggacaucuguugggcccagaccccuaugccuuguuccgagcacgaaga

SEQ ID NO: 112104 - RNA, 64 nt, hsa
caguggagacggcaguccaguuucucuccccucugaccccuagaaggggaguuguagccccaug

SEQ ID NO: 112105 - RNA, 64 nt, hsa
acuggggucaugagagcuaguuaguacucagccugaccccuaggucugguccugccagccuggg

SEQ ID NO: 112106 - RNA, 64 nt, hsa
ccucuccagcccuauggaagucucaaggucacgggaccccuaaucagaguggccaaucccugug

SEQ ID NO: 112107 - RNA, 64 nt, hsa
gaagagcuggaaaccaagaaguuugucaacagaggaccccuacuccaugcaggacagggucucc

SEQ ID NO: 112108 - RNA, 64 nt, hsa
gggaucugauugaggauaaaaaggaaggagagaugaccccuacccccucaucccccaguuuuga

SEQ ID NO: 112109 - RNA, 64 nt, hsa
aggggaggggaagaauuggagggcagcuugccuggaccccuaacggcuguucucaggaacaggu

SEQ ID NO: 112110 - RNA, 64 nt, hsa
ggcgcccuccucacgucaggagcaagcagccguggaccccuaagccgagcugguggaaggcccc

SEQ ID NO: 112111 - RNA, 64 nt, hsa
ugcaugaugggucuggggccuugcugauuccccagaccccuaauuaaauguuucuugucccagc

SEQ ID NO: 112112 - RNA, 64 nt, hsa
gugacuucugcacccucgguucugaggguacggugaccccuagugggcaguuugcaaaauguga

SEQ ID NO: 112113 - RNA, 50 nt, hsa
ugcccucuucggggccguaggaccccuaacuccaccccccucccuggcag

SEQ ID NO: 112114 - RNA, 64 nt, hsa
accccagccaaucgggacaguucaaggaggaggagaccccuauuacacagguuggaauaaaaua

SEQ ID NO: 112115 - RNA, 64 nt, hsa
gguuucagccacaaaacugucauucacucuaggggaccccuacuaaaggguaacuucaggugug

SEQ ID NO: 112116 - RNA, 64 nt, hsa
cggcgggcgggugggaggugggaguggcugcagggaccccuagugucccuggucuaucucucca

SEQ ID NO: 112117 - RNA, 64 nt, hsa
uaccccuucagccugcccuacagcgacuucccccgaccccuaccccacgcuacccagggcccag

SEQ ID NO: 112118 - RNA, 64 nt, hsa
uggcccugccccaaggacucacugcauguacccggaccccuaggccuggccuuugcagcauagu

SEQ ID NO: 112119 - RNA, 64 nt, hsa
gcugucaggacaccagccuggugcccauccucccgaccccuacccacuuccauucccguggucu

SEQ ID NO: 112120 - RNA, 64 nt, hsa
gaggacacccagccaggcagagcugggauugaaggaccccuauagagaagggcuuggcccccau

SEQ ID NO: 112121 - RNA, 64 nt, hsa
cucggacugcgggugacggcccugcccgccaccagaccccuaaaucuuggccaucguguggccg

SEQ ID NO: 112122 - RNA, 64 nt, hsa
ugaugggggcccagggacucugaacccuccugaugaccccuauggccaacaucaacccggcacc

SEQ ID NO: 112123 - RNA, 64 nt, hsa
caccuggguccccugcaaccucccaucaaaggaugaccccuaaacacagaggagcggggcaggc

SEQ ID NO: 112124 - RNA, 64 nt, hsa
uaacuggcuagccauaugcaggauauugaaacuggaccccuauccuucacgauauacaaaaauc

SEQ ID NO: 112125 - RNA, 64 nt, hsa
auauaugcaauucucccucccccagcccuucccugaccccuaaguuauugcccgcucaccucuc

SEQ ID NO: 112126 - RNA, 64 nt, hsa
guuaagcacuggaugucuccugaucccaggcugggaccccuacccccacccccuuugauccuuu

SEQ ID NO: 112127 - RNA, 64 nt, hsa
aaauucuguuuauacuugccugguacucaugauagaccccuaauuauuuuguaucuuuuuucau

SEQ ID NO: 112128 - RNA, 64 nt, hsa
ccccaguggacaccagugaaccccagucagccuggaccccuaacacagaccaugaggagacgcu

SEQ ID NO: 112129 - RNA, 64 nt, hsa
ccccaguggacaccaaugaaccccagccagccuggaccccuaacaaagaccaccaggacauccu

SEQ ID NO: 112130 - RNA, 64 nt, hsa
ccccaguggacaccaaugaaccccagucagccuggaccccuaacaaagaccaugaggagaugcu

SEQ ID NO: 112131 - RNA, 64 nt, hsa
uuaggaacagggugcugguugagggcccccagcugaccccuacugcagauccgcauguggacca

SEQ ID NO: 112132 - RNA, 64 nt, hsa
aaaggaaaggaggaggugccgggggccuggcacagaccccuaggugccucgcuccaugggauug

SEQ ID NO: 112133 - RNA, 64 nt, hsa
gccagaagaggcuggaaccuccugcucaagucuagaccccuacuucucugcugcccccacccug

SEQ ID NO: 112134 - RNA, 64 nt, hsa
aggcagguccgccugugcgggugccccugacuucgaccccuagcuuaugucacagcccgaacca

SEQ ID NO: 112135 - RNA, 64 nt, hsa
cuucaacccggagcacugcagccccaauggcaccgaccccuacaagccuaagugccccgagagc

SEQ ID NO: 112136 - RNA, 64 nt, hsa
uguaacugagacacccugccuguuagcccugggagaccccuaaccuuggcccaagaccccuuug

SEQ ID NO: 112137 - RNA, 64 nt, hsa
uccuugcacucacuuccccugccccagucacgaugaccccuaaagcuuccuuugcccuugcuuu

SEQ ID NO: 112138 - RNA, 64 nt, hsa
cuaagaggcuucuggcagcuuccauccuacccaugaccccuacuuggggcagaaaaaacccauc

SEQ ID NO: 112139 - RNA, 64 nt, hsa
uuugucuggcuguggccccuccuucuccccuccagaccccuacccuuucccaaacccuucggua

SEQ ID NO: 112140 - RNA, 64 nt, hsa
cuucaaggauagcaggaauauaaaaauucucaaagaccccuaccugcagaggaagcugcuaaag

SEQ ID NO: 112141 - RNA, 57 nt, hsa
acccaccgagacagcgccuucauauuccucagccagagccuggaguaugccaagaac

SEQ ID NO: 112142 - RNA, 57 nt, hsa
gccgcacgggaacucauggguguguuacucagccaccacccaccgcuggagccccag

SEQ ID NO: 112143 - RNA, 57 nt, hsa
cugggccuuaaaggaugcggacucauccucagccagcgcccauguugugauacaggg

SEQ ID NO: 112144 - RNA, 57 nt, hsa
gcagcugccagcacuuggucagucacucucagccauagcacuuuguucacuguccug

SEQ ID NO: 112145 - RNA, 57 nt, hsa
gggcccuuccuuguuucucagaggccccucagccacuggaaccccaucuucagccca

SEQ ID NO: 112146 - RNA, 57 nt, hsa
gagggcugggcagggaggcgccguggacucagccaggcugggggagccggacauggc

SEQ ID NO: 112147 - RNA, 57 nt, hsa
uaauguaguucucauccuccgcaugcccucagccacaagcgggugacugacuguucc

SEQ ID NO: 112148 - RNA, 57 nt, hsa
caaccugcucacucacaaaugugugcccucagccagagaguaagaaagcccaaaucu

SEQ ID NO: 112149 - RNA, 57 nt, hsa
auaagucaaguugcaguuuaagguggucucagccaauuguuacaagcuacagaauau

SEQ ID NO: 112150 - RNA, 57 nt, hsa
ccuucugaucaaauaaccauggcuucccucagccauuccugagacuugguauaaaau

SEQ ID NO: 112151 - RNA, 57 nt, hsa
ggauuaggcugaaguggcuuagaaggccucagccaugcuuggauacucacauuagga

SEQ ID NO: 112152 - RNA, 57 nt, hsa
uuuuuuucuggacaagcuuacaucuuccucagccaucuuugugaguccuucaagagc

SEQ ID NO: 112153 - RNA, 57 nt, hsa
uucauugcaagugaaggagccucccagcucagccacgugggaugugacaagaagcag

SEQ ID NO: 112154 - RNA, 57 nt, hsa
cuucuucaaacaguaguacaagcuccccucagccagccugccugcccagcgaggccc

SEQ ID NO: 112155 - RNA, 57 nt, hsa
ccgccccguguggccgcccggguguggcucagccauguccccuccccagguccuuca

SEQ ID NO: 112156 - RNA, 57 nt, hsa
uguccccccuucucuuccugagugauucucagccaaguccagacagugcucggcggg

SEQ ID NO: 112157 - RNA, 57 nt, hsa
ugugggguccccaggaaagggcaagggcucagccacaucuuggggucugggaggccc

SEQ ID NO: 112158 - RNA, 57 nt, hsa
ugcuggccacacucuggagaagcacuucucagccaaggcaccccugcccugggacug

SEQ ID NO: 112159 - RNA, 57 nt, hsa
cugcuugcccccccaggucccuccagccucagccaagcaacauggggugaaccucag

SEQ ID NO: 112160 - RNA, 57 nt, hsa
cauccccugcacccgcuaccacaccagcucagccacagcagagccaaucacagaccc

SEQ ID NO: 112161 - RNA, 57 nt, hsa
uguggagagcgccucuucccaccaguccucagccaccuucuccacggcagcgaccuc

SEQ ID NO: 112162 - RNA, 57 nt, hsa
gcagggcugcuguggcccagucguccgcucagccaaggagucagauggcaaugggua

SEQ ID NO: 112163 - RNA, 57 nt, hsa
ucuagccuaaguguggagaaggauagccucagccacaaaacucugucaggcauugaa

SEQ ID NO: 112164 - RNA, 57 nt, hsa
uuuguuuuuguuccuuaacugcugagccucagccagcguggguccugggggaaauac

SEQ ID NO: 112165 - RNA, 57 nt, hsa
cacucacccuccccuuguaguauccugcucagccaagaucugccuaagauuaugauu

SEQ ID NO: 112166 - RNA, 57 nt, hsa
gcugauggggacccaagcgcccacgugcucagccacccucuggcucagcggggccca

SEQ ID NO: 112167 - RNA, 52 nt, hsa
gggaccagucuucaguauaaaucucagccagaaaaaccaacuccucaucuug

SEQ ID NO: 112168 - RNA, 57 nt, hsa
gccaccauuucagacugagucugcacccucagccacaugaacaaucuccccuaccuc

SEQ ID NO: 112169 - RNA, 57 nt, hsa
uuucuuacacccccuccccagcgugcccucagccaagugcuuuggcccggugcuucc

SEQ ID NO: 112170 - RNA, 57 nt, hsa
agccaaaucugucugcugcucccucuccucagccaguugggugugcgcagagcuguc

SEQ ID NO: 112171 - RNA, 57 nt, hsa
ugccuuuagagugacccugcagagucacucagccaaaucugucugcugcucccucuc

SEQ ID NO: 112172 - RNA, 57 nt, hsa
auuguuuacauuccaggagacuuguagcucagccacacacgcaguaaugaccugugc

SEQ ID NO: 112173 - RNA, 57 nt, hsa
uaugaauaucuaguccuuucugugguucucagccaagacauaaaaacuaggacucag

SEQ ID NO: 112174 - RNA, 57 nt, hsa
acaaaaauacaaaaugcuuguccaggacucagccaugcacaccuugagcagcgccgg

SEQ ID NO: 112175 - RNA, 57 nt, hsa
agggucacucugggcaaagagaagguccucagccaugcccccagcaccuugcacaua

SEQ ID NO: 112176 - RNA, 57 nt, hsa
ggugccagcacgggaucccugaagugacucagccaggcagacaugagacauggcgga

SEQ ID NO: 112177 - RNA, 57 nt, hsa
ccccaugcagaggugcucuccuccuuucucagccauggccccccaucccugaccuca

SEQ ID NO: 112178 - RNA, 57 nt, hsa
cucccguccaccccagaggggaaguuccucagccagacucuucagccaaaugcccca

SEQ ID NO: 112179 - RNA, 57 nt, hsa
uauccagacuguuucagcccagcccaucucagccaacccuccuuagacugagcuguc

SEQ ID NO: 112180 - RNA, 57 nt, hsa
gcccauggcaugggcacugcccacaggcucagccagaaccucuugguguacccgaua

SEQ ID NO: 112181 - RNA, 57 nt, hsa
cgaucucccuauucccuuacccuguuacucagccacgccguguguaggcuuagccuc

SEQ ID NO: 112182 - RNA, 57 nt, hsa
ggggacggaggcggcgggcccaggagccucagccagccacgugggcauccacuccuu

SEQ ID NO: 112183 - RNA, 64 nt, hsa
auugagacagcugcaaaacaggcugauuucaauuaggcagcacuucccaaagugcacugaggaa

SEQ ID NO: 112184 - RNA, 64 nt, hsa
augugaaguaauagugaaccuaacagucagagacaggcagcaugcucuuaacuagugcucuucc

SEQ ID NO: 112185 - RNA, 64 nt, hsa
cucaauacuuucucaaggggcuacacuccccaucaggcagcaucccaccagccugcaccacagg

SEQ ID NO: 112186 - RNA, 64 nt, hsa
cuccugggacagaggccaucucucuuccagagagaggcagcauuggcccacaggauaagccuca

SEQ ID NO: 112187 - RNA, 64 nt, hsa
acacacuggcucaagcagcagagguaagaggaagaggcagcagcaucccaagaaggaaagagcu

SEQ ID NO: 112188 - RNA, 64 nt, hsa
ggcauaugcugacccaugcagccgaagaaagaagaggcagcaacaggaggaggaggacuugaac

SEQ ID NO: 112189 - RNA, 64 nt, hsa
ggaagaacguguacgacgagcuggggggcagcccaggcagcaccagcgcggccacgugcacgcg

SEQ ID NO: 112190 - RNA, 64 nt, hsa
agaagaaggcagugggaaaacuggguuuaucucaaggcagcagccugagcccaggagcagagga

SEQ ID NO: 112191 - RNA, 64 nt, hsa
cccugcccaaucccagugcagucaaggccaaccuaggcagcagccaccuucucaggaaacaagg

SEQ ID NO: 112192 - RNA, 64 nt, hsa
accucaguguccacccuuccugccucaugucucaaggcagcagcuccucucugguaaccugaug

SEQ ID NO: 112193 - RNA, 64 nt, hsa
aacuacugggauaagcuucuccuugacaauggaaaggcagcagucuucaacauuugguugcaaa

SEQ ID NO: 112194 - RNA, 64 nt, hsa
acaaaccgccccguggccugcaggccugcaggggaggcagcaaagggaccuggcaguugcaaca

SEQ ID NO: 112195 - RNA, 64 nt, hsa
aaaaugcacaccucaugagucuaccugagcauucaggcagcacugacaauaguuaugccuguac

SEQ ID NO: 112196 - RNA, 64 nt, hsa
aauauuagcaaagaagcuucaugccagguuaggaaggcagcauuccaugaccagaaacagggac

SEQ ID NO: 112197 - RNA, 64 nt, hsa
uaaagucucagucugaauauuuagcaagagaaacaggcagcagaggaacccaaaggcaguaaau

SEQ ID NO: 112198 - RNA, 64 nt, hsa
uguggcuguuugccaaggcacacaaagugcuuguaggcagcaaccauaugcuacaagaauugua

SEQ ID NO: 112199 - RNA, 64 nt, hsa
cuccagcaagagccccaggcaggacaaagggagcaggcagcagcugcagaaacagcccuagaca

SEQ ID NO: 112200 - RNA, 64 nt, hsa
gcaccucuccuccccucuuacaccuacucagaugaggcagcagcagacccaucucgcggcgggg

SEQ ID NO: 112201 - RNA, 64 nt, hsa
gugccacagccugguucggccuggcggccccaggaggcagcagcaaccuugggcuuccugcggg

SEQ ID NO: 112202 - RNA, 64 nt, hsa
cccccccccuaaggugcucguuugggggcucuucaggcagcaccucagccuggcacccccacuc

SEQ ID NO: 112203 - RNA, 64 nt, hsa
aagaaaaagggcauuccagcuggggcaugugcaaaggcagcacguaauguguaaguucuagauc

SEQ ID NO: 112204 - RNA, 64 nt, hsa
aagagaaagggcaccccagcgggggcauguguggaggcagcacggaacauguagguuauagauc

SEQ ID NO: 112205 - RNA, 64 nt, hsa
agaacaccuguaaauagauggucccgacauugagaggcagcaugguagagugggcagaccuugu

SEQ ID NO: 112206 - RNA, 64 nt, hsa
ugcuuaggugucacuuucucagcauaucaaguuuaggcagcaagggaaaggaauaugggucagu

SEQ ID NO: 112207 - RNA, 64 nt, hsa
aggggaggggaugugguaagcggaaacagaagacaggcagcagaggcauuaaaaaugcauacca

SEQ ID NO: 112208 - RNA, 64 nt, hsa
cugggagcccuugguguucugagcagcagggcccaggcagcacaugagcagugcccaggggcuc

SEQ ID NO: 112209 - RNA, 64 nt, hsa
ggaggcagaagccuggccacagaggagccuccuaaggcagcagcugcagcaagcgcacccucuc

SEQ ID NO: 112210 - RNA, 64 nt, hsa
cacacacccguaguuccagcuacuugggaggcugaggcagcauugcuugaacccgggaggugga

SEQ ID NO: 112211 - RNA, 64 nt, hsa
uguguuggcuacaaaccugcacccugggaccaagaggcagcagucaucccugccaccagccaga

SEQ ID NO: 112212 - RNA, 64 nt, hsa
acagaauauuuaaaaauauauccaggugcuaaauaggcagcagaucucaauucacacaugacua

SEQ ID NO: 112213 - RNA, 64 nt, hsa
ucccagagaaagcagacuggcuccaauagauaucaggcagcaaucccaauaaauucugacaugu

SEQ ID NO: 112214 - RNA, 64 nt, hsa
uuaacuuaaacuaaaauuuuggguauaugaaagaaggcagcaauucagaaguaaagaagauacu

SEQ ID NO: 112215 - RNA, 64 nt, hsa
auaguaauaaaucugaccagcagagggagggaucaggcagcaguguuuagagcacaccacacug

SEQ ID NO: 112216 - RNA, 64 nt, hsa
ccauccaucacccaucucacucuccccaguccucaggcagcagcuuuuccaccccaggaaucuc

SEQ ID NO: 112217 - RNA, 64 nt, hsa
cuggcaccugaguguccuugcucuagagguucaaaggcagcaaggcagugagcuaugagcccag

SEQ ID NO: 112218 - RNA, 64 nt, hsa
ggaucucuuggauaggaguuggugaauagaaggcaggcagcaucacacuggggucacugacaga

SEQ ID NO: 112219 - RNA, 64 nt, hsa
caccucagggaacccaugcaucugccuggcauuuaggcagcagagccccugaccgucccccaca

SEQ ID NO: 112220 - RNA, 64 nt, hsa
caaacccuugacucuggcaggauuugcaggcagcaggcagcaccccucugccagccgggccccg

SEQ ID NO: 112221 - RNA, 64 nt, hsa
aggaaagcaaacccuugacucuggcaggauuugcaggcagcaggcagcaccccucugccagccg

SEQ ID NO: 112222 - RNA, 64 nt, hsa
aaugugccuguaaucccaccuacucgagaggcugaggcagcagaauugcuugaacccgggaggu

SEQ ID NO: 112223 - RNA, 64 nt, hsa
ggacuucgcguuucaggggagggcccuuaaaggaaggcagcaggaaucagucuugucgaacagg

SEQ ID NO: 112224 - RNA, 64 nt, hsa
aggagcuucuguuuggcauuccagauggaaggacaggcagcacgggagccaggcgcuguggaca

SEQ ID NO: 112225 - RNA, 64 nt, hsa
ucauuggccaagggcacuguggauguuuugugggaggcagcauggcaccguggaaagggcagua

SEQ ID NO: 112226 - RNA, 64 nt, hsa
ggaaggggcuuugggaucuggaaaccagcaggccaggcagcauccacaguguuaguccaaaggg

SEQ ID NO: 112227 - RNA, 64 nt, hsa
gggcaaggugucggcgggacggugaggaagggggaggcagcaagagucacuuugggggaccaau

SEQ ID NO: 112228 - RNA, 64 nt, hsa
uaggcaccgaccuugggcugcuguuagagaacucaggcagcagcgccagugacacggggcacua

SEQ ID NO: 112229 - RNA, 64 nt, hsa
agcgggggugggugguagcgcugggggugauuuuaggcagcaagaauuggagaacucacacugc

SEQ ID NO: 112230 - RNA, 64 nt, hsa
uuacuuuugacccaugugcaaggauuguacacgcugaugagaaucaugcacuuuuucuccucug

SEQ ID NO: 112231 - RNA, 64 nt, hsa
uuuuguuuauauugcaguaguauuuauuuuuuagugaugagaauuguaugucauguuagcaaac

SEQ ID NO: 112232 - RNA, 64 nt, hsa
cuucucagaaacaaccagccuugaaggcuacaacugaugagaaagauucuguuucgaacauagc

SEQ ID NO: 112233 - RNA, 64 nt, hsa
cuucucggaaaaaaccagccuugaaggcuacaagugaugagaaggauucuuuuucgaauauaac

SEQ ID NO: 112234 - RNA, 64 nt, hsa
cuucucggaaaaaaccauccuuggaggccacaagugaugagaaggauucuuuuucgaauauaac

SEQ ID NO: 112235 - RNA, 64 nt, hsa
cuucugagaaaccaccaggcuugaaggcuacaagugaugagaaagauucuguuuugaauauagc

SEQ ID NO: 112236 - RNA, 64 nt, hsa
uguugguuuauuucacuuuucauuaaaugaacauugaugagagaagaugccacuuacccaagcu

SEQ ID NO: 112237 - RNA, 64 nt, hsa
gaauccugaccuuagguucggcauguagaccaagugaugagaagugaauacauggaagaguuuu

SEQ ID NO: 112238 - RNA, 64 nt, hsa
uaaaauguaagucucuuacagacaucaaguaguuugaugagacagucugugacuucaugauagg

SEQ ID NO: 112239 - RNA, 64 nt, hsa
agcuugaacugccagugcaccagcaguuuaggugugaugagagaauucagauauacuuuaucuu

SEQ ID NO: 112240 - RNA, 64 nt, hsa
cuucagugaagcggaagaccuuggaaccccuguuugaugagacauuugaauuuuuuguucccau

SEQ ID NO: 112241 - RNA, 64 nt, hsa
ugagcugacuccaaauggacagcccagaagcugaugaugagaauucuuaucacucaccuuuaua

SEQ ID NO: 112242 - RNA, 64 nt, hsa
gaauagcuaauggaugcugggcuucauaccugggugaugagaugaucugugcagcaaagcacca

SEQ ID NO: 112243 - RNA, 64 nt, hsa
uuuugucuauguugaaaauuuucugggagcuaaaugaugagaacacauggacacaugaugggga

SEQ ID NO: 112244 - RNA, 64 nt, hsa
auauuuugaaucccccaaguucccuuggaccuacugaugagagauaguuuuauguauggggaaa

SEQ ID NO: 112245 - RNA, 64 nt, hsa
aaucaguuguaaacaauggcaucuuugaacagugugaugagaauaggaaugugguguuuuaaag

SEQ ID NO: 112246 - RNA, 64 nt, hsa
acugcccauugaaacugacaaaauugcccuuguuugaugagaggaaugagcagagcauugaugu

SEQ ID NO: 112247 - RNA, 64 nt, hsa
cccuccauagcccugccacccacuguaaaaagguugaugagauuacuuaaugauuuccaauuaa

SEQ ID NO: 112248 - RNA, 64 nt, hsa
ggagaaaccaacaggcaaaacgugggugcaaaagugaugagaccccacacuuuacacucguggu

SEQ ID NO: 112249 - RNA, 64 nt, hsa
gcuuuggcauagccucaauauaugggagucacugugaugagaugugccuaauguuaauuugaua

SEQ ID NO: 112250 - RNA, 64 nt, hsa
aaguccuuuuuggaaguugcagaauuauuagcuuugaugagaacaacuuuugucauagauuuga

SEQ ID NO: 112251 - RNA, 64 nt, hsa
uuugaugaggucggcggagcaguucacuagccaaugaugagagcagaaaggccuagaccugcag

SEQ ID NO: 112252 - RNA, 64 nt, hsa
ggaugagugauucacccucuuacuuggcgaccacugaugagaucaacaacaggugaacuauaaa

SEQ ID NO: 112253 - RNA, 64 nt, hsa
cuuuuggcaacugaaggaccaagaagggaaacggugaugagagagacugcucauuguaacuuuc

SEQ ID NO: 112254 - RNA, 64 nt, hsa
cuuacaaggaguugaaaagauuaaugucccaaccugaugagauuacggccuugagacaauaagg

SEQ ID NO: 112255 - RNA, 64 nt, hsa
guucugaaacucuguggaggaggaagaugggagcugaugagaaucaaaguggaaugaagcucug

SEQ ID NO: 112256 - RNA, 64 nt, hsa
ugaaggaggucuaccccgacucagguucugccgaugaugagaggaucuugagguucuuggaauu

SEQ ID NO: 112257 - RNA, 64 nt, hsa
gggaaaacauacuaaugggggucuuucugugaugugaugagacauacauguaaguguauauaug

SEQ ID NO: 112258 - RNA, 64 nt, hsa
ucuugaauaucuccugcgguguauauuaacaucuugaugagacagauuuccaggcaacaaaaua

SEQ ID NO: 112259 - RNA, 64 nt, hsa
gugccaaguaaugugaaugcuaauacugcuuaagaaaauuaaguuacuuuugcaaaacagauaa

SEQ ID NO: 112260 - RNA, 64 nt, hsa
gaauucccaagugccaggaguaggauuucauuauaaaauuaauagcuaaucuuauucuaucucc

SEQ ID NO: 112261 - RNA, 64 nt, hsa
acuucagacuuucaagauuauucuaaaucaccagaaaauuaauuucaguuucuauugggaguuu

SEQ ID NO: 112262 - RNA, 64 nt, hsa
acuuuuaaauuucucuucuaccagcaacuugggaaaaauuaaauaugggugggggagaccuaaa

SEQ ID NO: 112263 - RNA, 64 nt, hsa
uuaauaggacaguaaaucuguguggggcuagaacaaaauuaagacauguuuggcaauauuucag

SEQ ID NO: 112264 - RNA, 64 nt, hsa
gaguucuuugcuuucauuaacuuggauucauuuaaaaauuaaucuucccuguuaggcugauuuc

SEQ ID NO: 112265 - RNA, 64 nt, hsa
uuaaaaaugauguuaacccaagaaguagacaucaaaaauuaaaaaaaaaaaaaggaauguguuu

SEQ ID NO: 112266 - RNA, 64 nt, hsa
ggucuagauucaguuaugaauguaggcauuaguuaaaauuaacaagaugcagaguauuaauuuc

SEQ ID NO: 112267 - RNA, 64 nt, hsa
uaaaauucaguauaguuugaaagcggcacaauuaaaaauuaauuuucuaacaaaguugggaggu

SEQ ID NO: 112268 - RNA, 64 nt, hsa
caugcacauagaugagaugaaucugcauuguaaaaaaauuaaaucacauuuagugcuguauaau

SEQ ID NO: 112269 - RNA, 64 nt, hsa
agugcuguauaauuugcaugcaauaaaauucaauaaaauuaaauguaaaauuaaaugaguuuug

SEQ ID NO: 112270 - RNA, 64 nt, hsa
acaugacgaaacuccaucucuaucaaaaauacaaaaaauuaacuagguguggugcugcacgccu

SEQ ID NO: 112271 - RNA, 64 nt, hsa
ucugggcuggguaacagagugagauccugucucaaaaauuaauuaauuaauuaauuaaaauaaa

SEQ ID NO: 112272 - RNA, 64 nt, hsa
acauuuccuauauuuugacagagauacugcuggaaaaauuaaaauuaaaaugccauaauagcua

SEQ ID NO: 112273 - RNA, 64 nt, hsa
ccuauauuuugacagagauacugcuggaaaaauuaaaauuaaaaugccauaauagcuaccuaac

SEQ ID NO: 112274 - RNA, 64 nt, hsa
ggcacuuaaaacauaaaauucauuauccuauuaaaaaauuaaauucagcuuugcuaauccagaa

SEQ ID NO: 112275 - RNA, 64 nt, hsa
ggcucucaagucuucccaaggccagaaucgaaagaaaauuaaaauuugaaugcugaauauucug

SEQ ID NO: 112276 - RNA, 64 nt, hsa
uaaugcaauaagguuauacauaguuaugaacuguaaaauuaaagucaguaugaacuauaauaaa

SEQ ID NO: 112277 - RNA, 64 nt, hsa
gugauguagcuuucuucuguaacaguuauguuuuaaaauuaagugaguuuuuuuuuugccuuag

SEQ ID NO: 112278 - RNA, 64 nt, hsa
gucaagacauggaggguguuuguaauuuuaugguaaaauuaauccuucuuacacauaauggugu

SEQ ID NO: 112279 - RNA, 64 nt, hsa
uuuucucuaacccuuaacuaaaguguaggauuuuaaaauuaaaugugagguaaaauaaguuuau

SEQ ID NO: 112280 - RNA, 64 nt, hsa
uauaaaaguaggaaacagguauaauuuuaaugugaaaauuaagucuucacuuucugugcaagua

SEQ ID NO: 112281 - RNA, 64 nt, hsa
uaaaauuaaguaauuuuuuaaagaaggcacuuuuaaaauuaacacacacaugaacugcacaccu

SEQ ID NO: 112282 - RNA, 64 nt, hsa
gucaccugaggaaguuuccccacuuuuauuuuuuaaaauuaaguaauuuuuuaaagaaggcacu

SEQ ID NO: 112283 - RNA, 64 nt, hsa
acauauuagaaacucuucuaauaaaugaaguaaaaaaauuaaaaagaauacaaauauuccagcc

SEQ ID NO: 112284 - RNA, 64 nt, hsa
acauuuaucuucaaaacaccaaauugucuuuagaaaaauuaaugugauuacagguagaggccuu

SEQ ID NO: 112285 - RNA, 64 nt, hsa
acauuuguugacuuaaauuuaauucaaggauugaaaaauuaacuggauaucuugaaauauacag

SEQ ID NO: 112286 - RNA, 64 nt, hsa
ucacaauggacacagaaugcugcugcuccucuuaaaaauuaaaugugucauauuauauucuuua

SEQ ID NO: 112287 - RNA, 64 nt, hsa
auuaacagcugagguagcuaaaguuauuuaaaauaaaauuaaauuuaugauccaaguagcuuau

SEQ ID NO: 112288 - RNA, 64 nt, hsa
ugaacagaagugcacaggcuacuuguacagagaaaaaauuaauacucaaaggaaaucuucauuu

SEQ ID NO: 112289 - RNA, 64 nt, hsa
uggaguuaggaauuucaugaaccucacuaugaccaaaauuaauuuuuugauucaguuugucugu

SEQ ID NO: 112290 - RNA, 64 nt, hsa
cuauuuuuuguauaccuuguucuuugugaucuauaaaauuaaacuggauaaaauguuaauuggg

SEQ ID NO: 112291 - RNA, 64 nt, hsa
gacaaauuuuaccuuaaaaccaaaaugaaacacaaaaauuaauccuuaauaaugauagcaagug

SEQ ID NO: 112292 - RNA, 64 nt, hsa
ucugugugaaagccuuuuucuucuuugauuuaaaaaaauuaacuauacaguuaaugguuuagaa

SEQ ID NO: 112293 - RNA, 64 nt, hsa
uuaucugugugucugacgugccaucuuuaauguuaaaauuaagguguuaaaauuaagccuaguu

SEQ ID NO: 112294 - RNA, 64 nt, hsa
gacgugccaucuuuaauguuaaaauuaagguguuaaaauuaagccuaguuauauagacgaaaua

SEQ ID NO: 112295 - RNA, 64 nt, hsa
caguuccuuucauaauaucucagcaccagaaacaaaaauuaagauuaucaaagcauuuugaaua

SEQ ID NO: 112296 - RNA, 64 nt, hsa
ucagaaccauucacauuuaauucaauucuuggaaaaaauuaaagcuuuuugcccacaauuugca

SEQ ID NO: 112297 - RNA, 64 nt, hsa
gcuuuagugucuggggcaaguccucucaauggcuaaaauuaacuuuagagauccauguguucag

SEQ ID NO: 112298 - RNA, 64 nt, hsa
uuuaauauugggaaaauuaugauaaaaugcuuuaaaaauuaauaugccagauuaaaauaacuga

SEQ ID NO: 112299 - RNA, 64 nt, hsa
ggugaaaccccgucucuauuaaaaauauuuuuuaaaaauuaacugagcgugguggugggcgccu

SEQ ID NO: 112300 - RNA, 64 nt, hsa
uugaaaucaugacaagcagucuuagaacaaaguuaaaauuaaaaagucuuuauccaagucacca

SEQ ID NO: 112301 - RNA, 64 nt, hsa
ugagaccagugguucccacuaaguauagaacauuaaaauuaauacuuuauaauaaaacacuuuu

SEQ ID NO: 112302 - RNA, 64 nt, hsa
aggggaaaaaaaacccaaaauuaugugaacaagcaaaauuaaaauuucauuuuaggcuauuggc

SEQ ID NO: 112303 - RNA, 64 nt, hsa
gcuucguugcgaacuugaucagcuucuccaggauaaaauuaaaaacccaagcauugaucugugu

SEQ ID NO: 112304 - RNA, 64 nt, hsa
augagaauuuugaggaaaaaaauuaaaaauauguaaaauuaauaauuugcaugaacacagauga

SEQ ID NO: 112305 - RNA, 64 nt, hsa
gauugccaaccaauagaugagaauuuugaggaaaaaaauuaaaaauauguaaaauuaauaauuu

SEQ ID NO: 112306 - RNA, 64 nt, hsa
aaugcugcugauaugacacaccuuugaauuuguuaaaauuaaaaacaacguauuccuuuguagu

SEQ ID NO: 112307 - RNA, 64 nt, hsa
uaauaaacugauuuaaacuuuuucuauaagaagaaaaauuaagaccacuuauuugaaaacaaag

SEQ ID NO: 112308 - RNA, 64 nt, hsa
uaaaugaagugcuggacuuuaccugaaagcugcaaaaauuaaugguuuagauauauuuauaaua

SEQ ID NO: 112309 - RNA, 64 nt, hsa
gcaacauagcaaaaucucaucucuacaaaaaguaaaaauuaaaaaaugaaauuaaaaauaaaau

SEQ ID NO: 112310 - RNA, 59 nt, hsa
uacuuagccaaaaugauuaaguguuccuuaaaauuaaguugaaaaaggaaauauucuuu

SEQ ID NO: 112311 - RNA, 64 nt, hsa
ggugacugaccacaaagaagaaaauucugucucaaaaauuaaagaauuuuguuuguuauuguug

SEQ ID NO: 112312 - RNA, 64 nt, hsa
aaucuuugacaaacaaauuauuuuuauuuguuuuaaaauuaaaauacuguguaccccccccccc

SEQ ID NO: 112313 - RNA, 64 nt, hsa
aacauacaacuuccaaaaggcaucugauuuuuaaaaaauuaaaauuucugaaaaccaaugcgac

SEQ ID NO: 112314 - RNA, 64 nt, hsa
aagaaauauggaggaagguuaaaaggggauuaguaaaauuaaugcgauagguaacauguuugua

SEQ ID NO: 112315 - RNA, 64 nt, hsa
uuugaacaucucaaaguuauauauacuggguauuaaaauuaaaagcaaguuauaucagugaagu

SEQ ID NO: 112316 - RNA, 64 nt, hsa
cuauauugaaagcauuuuuauguuuucuaauuuaaaaauuaauauuuucuuauagauauugugc

SEQ ID NO: 112317 - RNA, 64 nt, hsa
augcuuuaacagcugauaaaaauuuuacauuuguaaaauuaauauauuguacugguacaaaaua

SEQ ID NO: 112318 - RNA, 64 nt, hsa
uuugaauaaauucuuccuguagguaaugggaaacaaaauuaauaguucauaugucacucauagc

SEQ ID NO: 112319 - RNA, 64 nt, hsa
uuugaaaguagcccaauauaaaacuuuugauucuaaaauuaaaccagcagccuauuacaagcac

SEQ ID NO: 112320 - RNA, 64 nt, hsa
auaacuuaaaaaaugcuuuacuacuaaaauguaaaaaauuaaugugcucaccucggcagcacau

SEQ ID NO: 112321 - RNA, 64 nt, hsa
aauuaaugugcucaccucggcagcacauauacuaaaaauuaauaagacccagcuugaaaauuga

SEQ ID NO: 112322 - RNA, 64 nt, hsa
guuagcauauuuuccagccacaugaucaaccuacaaaauuaauaccauuucugaacaccaguaa

SEQ ID NO: 112323 - RNA, 64 nt, hsa
augaaaaauguaaaaguaccuagaaauucacaaaaaaauuaauaccucuguggagaaaacuuca

SEQ ID NO: 112324 - RNA, 64 nt, hsa
cauauaccaaaaauauaugaggcaaauuuuagcaaaaauuaaaauucuuaagaaaacuucacua

SEQ ID NO: 112325 - RNA, 64 nt, hsa
ccugaaggacauuguaaucauuucuuacaaggugaaaauuaagaaagauuguguaugagagccu

SEQ ID NO: 112326 - RNA, 64 nt, hsa
gugcuaggauaccugaaaccugaugguuaucuuuaaaauuaaugguuuuucuccugaaauguuu

SEQ ID NO: 112327 - RNA, 64 nt, hsa
aagcuuuuagguauuagaagcuguuauaaaguauaaaauuaagauauaagcagaucacauguaa

SEQ ID NO: 112328 - RNA, 64 nt, hsa
cucugggaaacuaccacucaaagaauaauuguuaaaaauuaagcuuuuagguauuagaagcugu

SEQ ID NO: 112329 - RNA, 64 nt, hsa
aacacgauaaguuuacuccuccaucucaguaauaaaaauuaagcuguaaucaaccuucuagguu

SEQ ID NO: 112330 - RNA, 64 nt, hsa
aaacaaaacccacauuuccuauccugguuagaagaaaauuaauguucugacaguugugaucgcc

SEQ ID NO: 112331 - RNA, 64 nt, hsa
ucccuguuuucauaaagcuaauacuucaguuggaaaaauuaaacaggagcacaaagucagggau

SEQ ID NO: 112332 - RNA, 64 nt, hsa
auucaggucuucugcuacauuaucuucuuugagaaaaauuaauugauuauaaaauaugugcuac

SEQ ID NO: 112333 - RNA, 64 nt, hsa
ccuuuagcuucuugaagauuuagaaguuauauaaaaaauuaauuuaaaagcaaaccaaaagagg

SEQ ID NO: 112334 - RNA, 64 nt, hsa
aggauuaaacaguuacaagccuccaaauucaaauaaaauuaaaucacaguucagaugaaacuga

SEQ ID NO: 112335 - RNA, 64 nt, hsa
uguuacuccaaaggacaugaaaaagcucaagaguaaaauuaaaauucucaaaaaaaaaccccac

SEQ ID NO: 112336 - RNA, 64 nt, hsa
auggaucuuugggccuuuccucaguguucaugcaaaaauuaaaugucuuuuuucagcauacuga

SEQ ID NO: 112337 - RNA, 64 nt, hsa
uccaaaaccaaaaaaagugccuguggauguauauaaaauuaagaugauaagaaagugcuccuga

SEQ ID NO: 112338 - RNA, 64 nt, hsa
gaaauauucaauugagacuugaggggaauaauagaaaauuaagguagauccccaauauuuugga

SEQ ID NO: 112339 - RNA, 64 nt, hsa
gaaaacuuaauaaauugcuacuguuuuauaucauaaaauuaaaauaccaugguaauauuugcaa

SEQ ID NO: 112340 - RNA, 64 nt, hsa
uuauauaggucccugcacagauuggacuugaaccaaaauuaaguccaaagaacauauguuuaga

SEQ ID NO: 112341 - RNA, 64 nt, hsa
cauuuacaaguuccaguuauguguguaaaacagaaaaauuaaguaccaaaccuauuaggaaauu

SEQ ID NO: 112342 - RNA, 64 nt, hsa
guauagauuaaaaacacucaguagaaaagaaucuaaaauuaaaugaauuuguuuugccauuaaa

SEQ ID NO: 112343 - RNA, 64 nt, hsa
gaguugcaauagccaaguauagagagaauagugaaaaauuaaucuugcccuuucaagccuuaua

SEQ ID NO: 112344 - RNA, 64 nt, hsa
uuguaucuugacacaggaaaugggaaaaaacuuaaaaauuaauaugguguauuuuuccaaauga

SEQ ID NO: 112345 - RNA, 64 nt, hsa
uaaguucuauaacuaguacucaagguuuaaccuuaaaauuaagauuuccuuaaccuuaaccuua

SEQ ID NO: 112346 - RNA, 64 nt, hsa
ucaggagaagagaaggaauuugaagagaaaaaggaaaauuaaaauuacuaauuaauuuuuagau

SEQ ID NO: 112347 - RNA, 64 nt, hsa
uuuuuguuucguuuuguuucuucuucugcauuuaaaaauuaaaagauugguuugaggaugugau

SEQ ID NO: 112348 - RNA, 64 nt, hsa
augaauuuucugcuuuaaaggcauguguguuuuuaaaauuaaugaauguagaugugugauuguc

SEQ ID NO: 112349 - RNA, 64 nt, hsa
auagagauguugucauaacuaggucuucaacgugaaaauuaauuuuuauuguaucaugucaagu

SEQ ID NO: 112350 - RNA, 64 nt, hsa
auaccuaauauuuaagugaauauuuuuaaaacucaaaauuaaugcaaaagauuuaugaugaaca

SEQ ID NO: 112351 - RNA, 64 nt, hsa
uuuuuuaagguuuaauaacuaaggggaauauuuuaaaauuaagagagcagcaaaugaaaggagu

SEQ ID NO: 112352 - RNA, 64 nt, hsa
acgacugccaccaggagaugcaguucuaguucuuaaaauuaaauuugcccagguuucugacagg

SEQ ID NO: 112353 - RNA, 64 nt, hsa
gaagugacaugucagaacaguccagacugguaagaaaauuaauggcuucacuugaauuuaaacc

SEQ ID NO: 112354 - RNA, 64 nt, hsa
uuguugguugccacagcuuggggaaaaauagaaaaaaauuaaugacuguauuugaauauuuugu

SEQ ID NO: 112355 - RNA, 64 nt, hsa
uguuuuaauuuuuaaauugagaaguaauauguggaaaauuaaaauauauucaaauguauuacaa

SEQ ID NO: 112356 - RNA, 64 nt, hsa
aacugacaaaauauuuuaaaaauauauaaaacacaaaauuaaaauaaaguugcuggucagucuu

SEQ ID NO: 112357 - RNA, 64 nt, hsa
gugugugcaaagcuuauuuucuuuuaucugggcaaaaauuaaaacacauuccuuggaacagagc

SEQ ID NO: 112358 - RNA, 64 nt, hsa
uaaguugagaaaaauuuauaagccaaagguucagaaaauuaaacuacagaauauuaaauauuau

SEQ ID NO: 112359 - RNA, 64 nt, hsa
aauauuauaaugugcccaaagcucugaauaguuaaaaauuaaauauuuauuuucuuccccaagc

SEQ ID NO: 112360 - RNA, 64 nt, hsa
caauguaucagcuuuuuuuaaaggacauuacuagaaaauuaaacaguauuuuuuaacaugugug

SEQ ID NO: 112361 - RNA, 64 nt, hsa
gcuuuuccuccauuaauacauauaugaguacugaaaaauuaaguugcauagcugcuuugcagug

SEQ ID NO: 112362 - RNA, 64 nt, hsa
aauuuauagaaccauaucaacacugacagauucuaaaauuaaguaguaaauuuaacuccaaguu

SEQ ID NO: 112363 - RNA, 64 nt, hsa
uaaagaauuaaaaauuuuaaaaauuuaaauuaaaaaaauuaaaaauuuauagaaccauaucaac

SEQ ID NO: 112364 - RNA, 64 nt, hsa
uuuaguauuuuaggaccugugaauaacuuccaacaaaauuaaugaauaccauauuaguauuaua

SEQ ID NO: 112365 - RNA, 64 nt, hsa
aaaaagaaaaacugaugauuagauuagguuagcuaaaauuaauagaggcaguagaaacuuaauc

SEQ ID NO: 112366 - RNA, 64 nt, hsa
uuuuugccacugcaaacauauaucuacagagagaaaaauuaauggcauuuuaaagguuaaaaca

SEQ ID NO: 112367 - RNA, 64 nt, hsa
aucuugaaauaguaauaguaugaaaauacuagauaaaauuaauguuuaaaauguuuuuguaaca

SEQ ID NO: 112368 - RNA, 64 nt, hsa
gaacuagaagcuauuacuaaaaauauauauagacaaaauuaaaagaaggaaugauaagaauaaa

SEQ ID NO: 112369 - RNA, 64 nt, hsa
auacuauuauaucugggaccucucuuuuagaccuaaaauuaauuaacauaucuacuuauauguu

SEQ ID NO: 112370 - RNA, 64 nt, hsa
gcaaguauggucuugauaaugcauuagaaaaauuaaaauuaauuuuucuuuuugaaauuaccau

SEQ ID NO: 112371 - RNA, 64 nt, hsa
uguuaagcaaguauggucuugauaaugcauuagaaaaauuaaaauuaauuuuucuuuuugaaau

SEQ ID NO: 112372 - RNA, 64 nt, hsa
ggcugguuacuaaggugccugcuagccauuguauaaaauuaaaacaugaagaauauuuuuuuuu

SEQ ID NO: 112373 - RNA, 64 nt, hsa
uguaacuuuauucuuuuuucuccugcugaaaaaaaaaauuaaaccaaucguaugaaaguuuggu

SEQ ID NO: 112374 - RNA, 64 nt, hsa
acaugcauuuaucaucauugagauugguuugcuuaaaauuaacuuauuuuguagaagacaaaau

SEQ ID NO: 112375 - RNA, 64 nt, hsa
uuuguguguauauaugugccucacaccugaauugaaaauuaaagacugguuuaaaagugguuua

SEQ ID NO: 112376 - RNA, 64 nt, hsa
gcauacccuuauagaauuggaauaugauuucucaaaaauuaauuugauaauuucauguaugaug

SEQ ID NO: 112377 - RNA, 64 nt, hsa
ucugaguaaaagguauuuucauauauguugggggaaaauuaacucaucuaaaaagaaucuuauu

SEQ ID NO: 112378 - RNA, 64 nt, hsa
uguuuucucuuguuuguaauuauuugcuccuuugaaaauuaaaucacuauuaauuacauuaaaa

SEQ ID NO: 112379 - RNA, 64 nt, hsa
auaaauugagagaagaagaaggugauaaguguugaaaauuaaaugugauaaccuuugaaccuug

SEQ ID NO: 112380 - RNA, 64 nt, hsa
uauuuuguaagcuauaacauauuuauugugcauuaaaauuaaauacuuuuuccccaaaggcaug

SEQ ID NO: 112381 - RNA, 64 nt, hsa
aauauaccuaccucuuccguuggaaagaacauuuaaaauuaaauaaauuuuaauuaaaaaauca

SEQ ID NO: 112382 - RNA, 64 nt, hsa
ugaauacuccuguuaguagcagaaauauauuaugaaaauuaagauuauugucugauugaaacau

SEQ ID NO: 112383 - RNA, 64 nt, hsa
agucucugaaagcagaacuauccaguguuaucuaaaaauuaaucugagcacaucaagauuuuuu

SEQ ID NO: 112384 - RNA, 64 nt, hsa
uauauuugucaaauaaaaucaugaucuuauuguuaaaauuaaugaaauauuuuccuuaaauaug

SEQ ID NO: 112385 - RNA, 64 nt, hsa
auuuaggaauuauuuaaaaguuaccauuagcucuaaaauuaagauucggaugcuuuauuuauag

SEQ ID NO: 112386 - RNA, 64 nt, hsa
uuucuuacgccucauuuuaauuuauaaugaagguaaaauuaaaauguauuuuaccacguuucuu

SEQ ID NO: 112387 - RNA, 64 nt, hsa
aaguaucaguuuaaaaauuuauauuaaauuuauuaaaauuaaaauccaguuccuuguugcaugg

SEQ ID NO: 112388 - RNA, 64 nt, hsa
caaugcugauggggaguaggggguaaucuacucuaaaauuaauagagccuuuccaucaauuguu

SEQ ID NO: 112389 - RNA, 64 nt, hsa
aaguuuuuacuucuaagauuugcauuuacaucauaaaauuaaaccauuuucaggaaaaucagau

SEQ ID NO: 112390 - RNA, 64 nt, hsa
uuauuauuuuuuuccuuuuucuaaucuuuuccuuaaaauuaauagauaacaaacuaaguuacuu

SEQ ID NO: 112391 - RNA, 64 nt, hsa
aaauuuggaaaauacagaaaauauagggaagaauaaaauuaacccacaguucugucaccuaaag

SEQ ID NO: 112392 - RNA, 64 nt, hsa
aaugugcaauugauauguuuuuagaugagagagaaaaauuaaagcuaaaauuagcugcaaagaa

SEQ ID NO: 112393 - RNA, 64 nt, hsa
uucuaaagcuauccauugugucauauuuacucuaaaaauuaaagagacucucaacauacuguuu

SEQ ID NO: 112394 - RNA, 64 nt, hsa
cuguugcucaaucuaaucuucgauggaaauucuaaaaauuaauacagagcugaucuucuugggg

SEQ ID NO: 112395 - RNA, 64 nt, hsa
aaaguuggcucuacauaaacauuguucuuauuuuaaaauuaacacuauguguucaguuuucuug

SEQ ID NO: 112396 - RNA, 64 nt, hsa
auaggcguuuuguucauaugagccugguuugugcaaaauuaaaucagaggcuucuacaacaugg

SEQ ID NO: 112397 - RNA, 64 nt, hsa
gaacgggaaaagcuuuuugcuuauuugucuuuugaaaauuaaggcugggcgcgguggcucacac

SEQ ID NO: 112398 - RNA, 64 nt, hsa
caacagagacucugucucaaaaaaaaaaaaaaaaaaaauuaaccucaaccaaacgccuauuuuu

SEQ ID NO: 112399 - RNA, 64 nt, hsa
aaaaaagcuaagaaaacugagaacuaacauuaaaaaaauuaaauuuagaauaagaaugauuucu

SEQ ID NO: 112400 - RNA, 64 nt, hsa
ucauauuauuuuuagaugauguaacauagccaucaaaauuaauauuauguaaugccuaauacuu

SEQ ID NO: 112401 - RNA, 64 nt, hsa
ugcaagugaaguaaauauaaaaauaauuuaauccaaaauuaagucuauauaaauaucagagaau

SEQ ID NO: 112402 - RNA, 64 nt, hsa
uuauaguaagagaaaaccauuuuuaaucuuaguuaaaauuaaagugaauuaguaguauaucauu

SEQ ID NO: 112403 - RNA, 64 nt, hsa
gcauuauuuaugccccuuucuguggaagaguaagaaaauuaaaauacaagaugcaugaggaaaa

SEQ ID NO: 112404 - RNA, 64 nt, hsa
auucuuuugcaguauagugagaaaaaaacauuuuaaaauuaauuaucauuuuguugauugugcu

SEQ ID NO: 112405 - RNA, 64 nt, hsa
auaaacaaaucauuguuuauuacuggucacuuagaaaauuaaaagggauagggccaggcacagu

SEQ ID NO: 112406 - RNA, 64 nt, hsa
acagagcaagacuccgucucaaagaaacaaacaaaaaauuaaaagggauagaauauaaugaaau

SEQ ID NO: 112407 - RNA, 64 nt, hsa
uacagugggcagguauuugcuuuugcuugcacugaaaauuaaauugcuaucaagaauaaaccau

SEQ ID NO: 112408 - RNA, 64 nt, hsa
gugagcagguauguguuugcuuuugcuugcacugaaaauuaaauugcuaucaagagcaaacuau

SEQ ID NO: 112409 - RNA, 64 nt, hsa
auaaaaaucauuggcacaguuacacuuaauaaaaaaaauuaaacagaagagcacccugaaaaac

SEQ ID NO: 112410 - RNA, 64 nt, hsa
aguacagcuauaauaguaucuugaaaguuguaaaaaaauuaaagcauauuuguuacguaaaguu

SEQ ID NO: 112411 - RNA, 64 nt, hsa
uucagaaucuguugugagaaaugcccaggcuuuaaaaauuaaaaauggauggaucuucucugaa

SEQ ID NO: 112412 - RNA, 64 nt, hsa
aagaaagcaggauuuucuccuguaucugaauuuuaaaauuaaaaaggcagauaagacauaaaua

SEQ ID NO: 112413 - RNA, 64 nt, hsa
ucuacauacucauuugacuggauaaacuuuacauaaaauuaacuaauuuuuuaaauaaaugcau

SEQ ID NO: 112414 - RNA, 64 nt, hsa
auuuguuaugguuacauauuuagcgcacccagagaaaauuaauuauauuucuacagagaaaaug

SEQ ID NO: 112415 - RNA, 64 nt, hsa
cuuguuucuuguuauuaccaaaacaggaggggaaaaaauuaacugcuccaaauuuaaccauaaa

SEQ ID NO: 112416 - RNA, 64 nt, hsa
uaauccauuguuugaggugcuugcaguugucuuaaaaauuaaaguguuuugguuuuuuuuuuuc

SEQ ID NO: 112417 - RNA, 64 nt, hsa
cagguugcacacaguuuuguuuaugcauuuccuuaaaauuaauuguagacuccaggauacaaac

SEQ ID NO: 112418 - RNA, 64 nt, hsa
ucacuucuguaauagugcaacagauuugguauuaaaaauuaaaugugguuuuaaaaguuccucu

SEQ ID NO: 112419 - RNA, 64 nt, hsa
auuacauucaguaagaaagaugucaacaugcuagaaaauuaauuuuaaaacuaaguuauuccaa

SEQ ID NO: 112420 - RNA, 64 nt, hsa
ugauaagcaaaaugaaagaaauaaugauuaagggaaaauuaagugacuguguuacacugcuucu

SEQ ID NO: 112421 - RNA, 64 nt, hsa
uaaccuguauugauacugacuugaauuauuuucuaaaauuaagagccguauaccuaccuguaag

SEQ ID NO: 112422 - RNA, 64 nt, hsa
uugcguacauggcaaauccugcaaauauagauuaaaaauuaaauuagcccauugaaauccuuua

SEQ ID NO: 112423 - RNA, 64 nt, hsa
ugucaguguuuccuucuauaaacuguucuuuggaaaaauuaaguuauacauaaaauucauauua

SEQ ID NO: 112424 - RNA, 64 nt, hsa
ggagccccaccccccgucucuacaaaaaaauuuaaaaauuaacugggcaugguggcugaggugg

SEQ ID NO: 112425 - RNA, 64 nt, hsa
caacuuuuuuagagacagccugucucuuaaaaaaaaaauuaauuugguagugagagcuuguguc

SEQ ID NO: 112426 - RNA, 64 nt, hsa
aaagaacaaaguaguaaaauaaaaaaaaauuuaaaaaauuaaaaaauaaaaaaaagaggucacu

SEQ ID NO: 112427 - RNA, 64 nt, hsa
ucucauuuuuagagaagucaaauagccaaccaucaaaauuaagaauaaauugaauugucacagu

SEQ ID NO: 112428 - RNA, 64 nt, hsa
acuuuaaagugaguuugagaaacaaguugaaacuaaaauuaaaauaccagccauuuaggugcuu

SEQ ID NO: 112429 - RNA, 64 nt, hsa
cuauaaugcuuauuaugguaaaauaaaauuggaaaaaauuaaaacugaccuauaagaguguuaa

SEQ ID NO: 112430 - RNA, 64 nt, hsa
ggaaaaaaauggacaaccucuugacuagguuaucaaaauuaaccucaccaauaaaggguggaug

SEQ ID NO: 112431 - RNA, 64 nt, hsa
uaaaagggguagccucuacuccagccaacauuuuaaaauuaauggauaauuuauagacaguuaa

SEQ ID NO: 112432 - RNA, 64 nt, hsa
gauuauugagaaaauguagcaguuugcauauuuaaaaauuaaucauuuugcauuuuacauuuaa

SEQ ID NO: 112433 - RNA, 64 nt, hsa
aucuuuuaaaaauauuaucuugcagauaaagaaaaaaauuaagaguguguuuacaacuguuuuc

SEQ ID NO: 112434 - RNA, 64 nt, hsa
ggaggaacugacuaagauguuuuaauauguaucaaaaauuaaaaugauuuuuuuuauugccuug

SEQ ID NO: 112435 - RNA, 64 nt, hsa
auuccugggggggaucaugcuacacucucaaaagaaaauuaagaaaucauucagaucauccccc

SEQ ID NO: 112436 - RNA, 64 nt, hsa; identical to SEQ ID NO: 112293

SEQ ID NO: 112437 - RNA, 64 nt, hsa; identical to SEQ ID NO: 112294

SEQ ID NO: 112438 - RNA, 64 nt, hsa
gaugguuaauuguugcugcuucaaaaauaaguauaaaauuaauauguaaggaagcccauucuuu

SEQ ID NO: 112439 - RNA, 64 nt, hsa
cuuuuaaaaaacccacaaaaugcugauucaguucaaaauuaaugcaaauguuucaaaacugggu

SEQ ID NO: 112440 - RNA, 64 nt, hsa; identical to SEQ ID NO: 112294

SEQ ID NO: 112441 - RNA, 64 nt, hsa; identical to SEQ ID NO: 112293

SEQ ID NO: 112442 - RNA, 64 nt, hsa
ugaguccugcuucuagcuccauuguggaauacagaaaauuaaauauaccuguuaaguucguauc

SEQ ID NO: 112443 - RNA, 64 nt, hsa
uuguauugaaauaguaacuuaucaaugccauguaaaaauuaauuccauuuucgaagccaccugg

SEQ ID NO: 112444 - RNA, 64 nt, hsa
agcaauucauaaaaacugcuuacuuaugccauagaaaauuaaacacaaaguguauacauguauu

SEQ ID NO: 112445 - RNA, 64 nt, hsa
aaaaugccccuuacugaaaaucuguauuaaaaauaaaauuaauaaaaguaaaaaauaaaaauag

SEQ ID NO: 112446 - RNA, 64 nt, hsa
auaguaagaauuuaucagauuagagcagcaggagaaaauuaauacuaaauuauaaucauuuuag

SEQ ID NO: 112447 - RNA, 64 nt, hsa
guuaagacuuaaaagccauauaauuccaccaaccaaaauuaaucccuuuugucauauuucuagu

SEQ ID NO: 112448 - RNA, 64 nt, hsa
gaggaaaacugaccaaaacagaagcaaaaauaagaaaauuaaaauaaucucuaauccuacuacc

SEQ ID NO: 112449 - RNA, 64 nt, hsa
auuggcaccucaaugauaaagaaauuuaagguauaaaauuaaauguaaaaauuaauuucagcuu

SEQ ID NO: 112450 - RNA, 64 nt, hsa
ugauaaagaaauuuaagguauaaaauuaaauguaaaaauuaauuucagcuucauuucguauuuc

SEQ ID NO: 112451 - RNA, 64 nt, hsa
cacucuacaucguucacgagucuggggagcggacaaaauuaaaagacugcgaguacccgcugau

SEQ ID NO: 112452 - RNA, 64 nt, hsa
aguuugaaaugccggugcuggacaguuuuguugaaaaauuaaaagaagaggaagaaagagaaau

SEQ ID NO: 112453 - RNA, 64 nt, hsa
aaaccaguuaggucucaauaccugaagcuaucguaaaauuaagaaaggauaaaguugguaaacc

SEQ ID NO: 112454 - RNA, 64 nt, hsa
aaauguuuuuuuuuaaagacuuuuaugauacuugaaaauuaacaugaauauuuaguguucauaa

SEQ ID NO: 112455 - RNA, 64 nt, hsa
uguucagcaaccugaaugguuauuuuuguuaauuaaaauuaaauuuuuaagagauauuuucaaa

SEQ ID NO: 112456 - RNA, 64 nt, hsa
cauuacaugauuaugaaaugacugugaagaauauaaaauuaaacuuagugacuuaauuagucac

SEQ ID NO: 112457 - RNA, 64 nt, hsa
aaaaacaaacauuauuggaguuucaguguaaaauaaaauuaaaauuggaggguugguuagauug

SEQ ID NO: 112458 - RNA, 64 nt, hsa
guagcccaggauugcuacaaaaagguccuuugagaaaauuaauuugugcuugcuuuuauccccu

SEQ ID NO: 112459 - RNA, 64 nt, hsa
gugugcagauaccaaaagaggaggaaagaagaaaaaaauuaaugugugggagcugcacguuuac

SEQ ID NO: 112460 - RNA, 64 nt, hsa
ugcugccaaagauuaaaaauaaauaaaaacauaaaaaauuaagaggggccaagaggaagacauu

SEQ ID NO: 112461 - RNA, 64 nt, hsa
ucaaaaggaagcuuguuuguaauacgugugcauaaaaauuaaauagaggugaacacaauuauuu

SEQ ID NO: 112462 - RNA, 64 nt, hsa
gccuuugcuguuguggauaggaaagacuuaaccuaaaauuaaaccagcaagaaagcauuaguaa

SEQ ID NO: 112463 - RNA, 64 nt, hsa
guuauacaugauaaacuuuucaugaaagaaaugcaaaauuaaaucacaguucguuucuucucac

SEQ ID NO: 112464 - RNA, 64 nt, hsa
cauuuugacuauaacugugcuugguuucaaaagcaaaauuaaacaaaaaucucaguccccuccg

SEQ ID NO: 112465 - RNA, 64 nt, hsa
gccugggugacagagugagacucugucucaaaaaaaaauuaaauaaauuauuauaaccuuucag

SEQ ID NO: 112466 - RNA, 64 nt, hsa
gccugggcaacagagcaagacucugccucaaaaaaaaauuaaaauaaauuuaaauacaaaaaaa

SEQ ID NO: 112467 - RNA, 64 nt, hsa
guucuccuuagaugugagagaaagagaaaucagaaaaauuaauucucuugggggaagggcuuga

SEQ ID NO: 112468 - RNA, 64 nt, hsa
aaauaagaaagcccuaaaauacuauuggagagaaaaaauuaacuagguugcuacuuuauuugcc

SEQ ID NO: 112469 - RNA, 64 nt, hsa
uaaguucugaaaauugaaaaaauuaaaauguaaaaaaauuaaagaauaaaaauacuucuauuau

SEQ ID NO: 112470 - RNA, 64 nt, hsa
caauaguucaaaaaauuaaguucugaaaauugaaaaaauuaaaauguaaaaaaauuaaagaaua

SEQ ID NO: 112471 - RNA, 64 nt, hsa
aaauccuugcuuuuaaguguuagcaauaguucaaaaaauuaaguucugaaaauugaaaaaauua

SEQ ID NO: 112472 - RNA, 64 nt, hsa
aggaaauaugucccccccuaacuuucuugcuucaaaaauuaaaauccagcaucccaagaucauu

SEQ ID NO: 112473 - RNA, 64 nt, hsa
uaauagagucacagcuuucccagguauaaaaccuaaaauuaagaaguacaauaagcagaggugg

SEQ ID NO: 112474 - RNA, 64 nt, hsa
aguguuaauagucuugugcuaugcagcagguguaaaaauuaauaaauauauuuuuuaauaaaca

SEQ ID NO: 112475 - RNA, 64 nt, hsa
uuuuaauaagacggucaacuucacacuuagggaaaaaauuaaaaugugauggccacuucuaaua

SEQ ID NO: 112476 - RNA, 64 nt, hsa
ucaguaauuuaacaaagggagccugcugaauaacaaaauuaaaaugaugaaacaaaaguuugac

SEQ ID NO: 112477 - RNA, 64 nt, hsa
cgaauccauccgcuuguaggggaaaaaaaggaaaaaaauuaaccagagagggucuguaaucucg

SEQ ID NO: 112478 - RNA, 64 nt, hsa
guaacaucucagaaauuucauccagaggaacaaaaaaauuaaaaauagaacauagcaaagcaaa

SEQ ID NO: 112479 - RNA, 64 nt, hsa
caugggcaacaugacaagaccccaucucuacaaaaaaauuaaaaaauuagccaggcaugguggc

SEQ ID NO: 112480 - RNA, 64 nt, hsa
ugaucaacuuauuccauuaaauagauacauuaaaaaaauuaaaaacugauucuucugcagagca

SEQ ID NO: 112481 - RNA, 64 nt, hsa
aucauaccuagcagguaauaaaauuuaaaaaauaaaaauuaaauauuagaaugugagaaauuua

SEQ ID NO: 112482 - RNA, 64 nt, hsa
cgguuaacuguaaaguuagggggaagaaagaaaaaaaauuaaaaggguagacacaguugagagu

SEQ ID NO: 112483 - RNA, 64 nt, hsa
aaguuugguuuuacuuuuaacaguccaugaacagaaaauuaaggccucuaaaaucagauccccu

SEQ ID NO: 112484 - RNA, 64 nt, hsa
ucuccaacuacauccuuaugauguuuuuaacaauaaaauuaaaacaacuguuaaacuaaaaacc

SEQ ID NO: 112485 - RNA, 64 nt, hsa
cuuaccacacugccacauuuuaaugagucagagaaaaauuaauuuuucuucaauacaauaauag

SEQ ID NO: 112486 - RNA, 64 nt, hsa
cccccaccaacccccuucuacugccuacuuuaaaaaaauuaauaguuuucuauggaacugaucu

SEQ ID NO: 112487 - RNA, 64 nt, hsa
uaauaguuuucuauggaacugaucuaagauuagaaaaauuaauuuucuuuaauuucauuaugaa

SEQ ID NO: 112488 - RNA, 64 nt, hsa
aagaauucaaauuuguaauaaaacuauuuguauaaaaauuaagcuuuuauuaauuuguugcuag

SEQ ID NO: 112489 - RNA, 64 nt, hsa
uuccuguggaauaaagaugguccaaaaauagucaaaaauuaaauauauauauauauuaguaauu

SEQ ID NO: 112490 - RNA, 64 nt, hsa
aaucugccuuuauguugcauaagugaaaauuuagaaaauuaaaagcaauuaucuuucagaugca

SEQ ID NO: 112491 - RNA, 64 nt, hsa
uccucuuuagagguaauuuuuguuaacauaaccaaaaauuaaauugaaacaaaaugucccaacu

SEQ ID NO: 112492 - RNA, 64 nt, hsa
caaucauuaauggaucauacacaauagguuuuuaaaaauuaauaacuuuuaguaauuacuuuua

SEQ ID NO: 112493 - RNA, 64 nt, hsa
caaccauuaaugaaucauacacaauagguuuuuuaaaauuaauauuaauaacuuuuauuaauuu

SEQ ID NO: 112494 - RNA, 64 nt, hsa
agcaaaucaguauauuuucuguauuuaauuauaaaaaauuaacuuaguuuuuaaaauuuauuug

SEQ ID NO: 112495 - RNA, 64 nt, hsa
uguauuuuggaggugcuugaucuaucuacaaagaaaaauuaauuaggaauuacuuuauuauaaa

SEQ ID NO: 112496 - RNA, 64 nt, hsa
auacuagccuagaaauauagagcauuaacaaaguaaaauuaauauauuaaguuauaauuggaau

SEQ ID NO: 112497 - RNA, 64 nt, hsa
uaugucagaaguuucuuuuuacauucauaucuuaaaaauuaaagaaacugauuuuagcucaugu

SEQ ID NO: 112498 - RNA, 64 nt, hsa
aauuaucuaugggaugugugguucugguuaacuaaaaauuaaccaguaaacacucuguaguaac

SEQ ID NO: 112499 - RNA, 64 nt, hsa
agaauucuuauuaacucaaauaacuaaauuucagaaaauuaagaagcugacuuuauauuuggug

SEQ ID NO: 112500 - RNA, 64 nt, hsa
uuucuuaguaguauauaaaagguaagaguacugaaaaauuaauaaaauugcaaguuaagaaaua

SEQ ID NO: 112501 - RNA, 64 nt, hsa
uuuuauuugccugaaauauauuuuuuucugugaaaaaauuaaaacguacuuaagccaggagaau

SEQ ID NO: 112502 - RNA, 64 nt, hsa
gacauguugggcugcaugauaaaaguuaauuauaaaaauuaaaagauuuuuuuuuuugagaugg

SEQ ID NO: 112503 - RNA, 64 nt, hsa
ugggauuauaggcguaagccaccaugccuggccaaaaauuaaaagauuuuaugaaacgaaaugg

SEQ ID NO: 112504 - RNA, 64 nt, hsa
gaacuuuugagagagaugaaaggauggucuccaaaaaauuaaugaugguuauuucuguuuuagu

SEQ ID NO: 112505 - RNA, 64 nt, hsa
agugagaugaaacuuccccuucauggaucuggcaaaaauuaagagaucuuuugcuagcuauugg

SEQ ID NO: 112506 - RNA, 64 nt, hsa
uuacuaacaugcaaaauacugcagauuuauuuugaaaauuaaaguuaacuggucacaaauguua

SEQ ID NO: 112507 - RNA, 64 nt, hsa
ccacgcauuguuuuuaaagcauugcguuaaaaaaaaaauuaacuaaaccaagaugcugugauuu

SEQ ID NO: 112508 - RNA, 64 nt, hsa
acagaauguuuuugguaauauuaauuuccacuaaaaaauuaaaugucuuuuaagaaacauucuu

SEQ ID NO: 112509 - RNA, 64 nt, hsa
gucuuuuaagaaacauucuuuuccacuuguuaaaaaaauuaaauauauuuuaaagcacuuuaag

SEQ ID NO: 112510 - RNA, 64 nt, hsa
augaaaugaagugagaagggaaguuuagagaaaaaaaauuaaaaagaaacaaagucuccaagaa

SEQ ID NO: 112511 - RNA, 64 nt, hsa
acuaaaugcccacaagagaaagcaggaaagauccaaaauuaacacccuaacaucacaauuaaaa

SEQ ID NO: 112512 - RNA, 64 nt, hsa
acucaaggaaauagagacacaaaaaaaccuucaaaaaauuaauguauccaggagcugguuuuuu

SEQ ID NO: 112513 - RNA, 64 nt, hsa
gcugaaacuggaucccuuccuuacaccuuauacaaaaauuaauucaagauggauuaaagacuua

SEQ ID NO: 112514 - RNA, 64 nt, hsa
ugcagauacauuaaauaugaaagauauucaauccaaaauuaagucuauguaaauaucagggaau

SEQ ID NO: 112515 - RNA, 64 nt, hsa
uuauuaugaaugaaaagcauucuuaauuuuaguuaaaauuaaguuagucauauguuauuuuauu

SEQ ID NO: 112516 - RNA, 64 nt, hsa
uuuaucaccucaauuaucucuuuuuuguguugagaaaauuaaaaauucauuguuccagcaguuu

SEQ ID NO: 112517 - RNA, 64 nt, hsa
agggcaacagagugagacccugucuccaaaaaaaaaaauuaaauaaauaccuuucuuuguuucu

SEQ ID NO: 112518 - RNA, 64 nt, hsa
acaccuguaugcacacaaacuagaaaaccuagaaaaaauuaauaaauuccuugaaagauauaac

SEQ ID NO: 112519 - RNA, 64 nt, hsa
ugccuguuggguacuaugcugauuaccuggggacaaaauuaacuguacaccaaacuccugcaac

SEQ ID NO: 112520 - RNA, 64 nt, hsa
gacagagcaagacugucucaaaaaaauuaaaauuaaaauuaaaaacaaauaauccugccuuuua

SEQ ID NO: 112521 - RNA, 64 nt, hsa
cugggcgacagagcaagacugucucaaaaaaauuaaaauuaaaauuaaaaacaaauaauccugc

SEQ ID NO: 112522 - RNA, 64 nt, hsa
ucuagccugggcgacagagcaagacugucucaaaaaaauuaaaauuaaaauuaaaaacaaauaa

SEQ ID NO: 112523 - RNA, 64 nt, hsa
uuauauuacauaaagucuuuauauuuuuccagagaaaauuaaauguuaugaugaauguuacauu

SEQ ID NO: 112524 - RNA, 64 nt, hsa
caauuuagcccauaacacuguguccaauucuuuuaaaauuaauguuuuuguuguaaauggacua

SEQ ID NO: 112525 - RNA, 64 nt, hsa
gauuuuuacaaguugguaaacacagccauuauaaaaaauuaaaugauuuaaauuuauaauuaag

SEQ ID NO: 112526 - RNA, 64 nt, hsa
cauacccuuuaucucuguaaaauuuauacacacaaaaauuaacaaaagauucuguaagaauuaa

SEQ ID NO: 112527 - RNA, 64 nt, hsa
uaugugacacacacacuccuaaguaccuuuaaggaaaauuaauaaaucauuaauaguuaaaaug

SEQ ID NO: 112528 - RNA, 64 nt, hsa
uauuuauuagcccuaauuguguuugauuucagacaaaauuaacccuuuucuccuguguaucuuu

SEQ ID NO: 112529 - RNA, 64 nt, hsa
agcuugagucaauuucugugccugcaaccaaaugaaaauuaauauagugaguucuuucaggagc

SEQ ID NO: 112530 - RNA, 64 nt, hsa
gucauguaucauugguuugaggugaaauagcaauaaaauuaauagaauggugccugguacuagc

SEQ ID NO: 112531 - RNA, 64 nt, hsa
cccugucucuaaagaaaaacuauagaaaauuuaaaaaauuaaaaaacggguaacaugguaaauu

SEQ ID NO: 112532 - RNA, 64 nt, hsa
uugaugcauuauaacuuaaagguacuacaaauuaaaaauuaaaguauaaaguauuuuaaguuag

SEQ ID NO: 112533 - RNA, 64 nt, hsa
uuuuuuuuuugguugaccacucccccacacuuccaaaauuaaacaguguuuucuuagcaucuug

SEQ ID NO: 112534 - RNA, 64 nt, hsa
guaugugugggguuuuuuucuuuauuuuuaaaugaaaauuaagacaccuuuuguguggacaugu

SEQ ID NO: 112535 - RNA, 64 nt, hsa
cugguuuuauaaacugaguuucuuagcauucguuaaaauuaagggguuuguuuggaauaauaua

SEQ ID NO: 112536 - RNA, 64 nt, hsa
cagguuggguuaauuaaagcuuuugguauaauuuaaaauuaaauuuauaaaugcaguugucuug

SEQ ID NO: 112537 - RNA, 64 nt, hsa
aauucaagccagcauauuccuaguagauggaagcaaaauuaaguugucuuuguagaaaaugaag

SEQ ID NO: 112538 - RNA, 64 nt, hsa
aagcauauugguguuuucucaauuagucacugagaaaauuaacacuuuaggcaguggcuauuua

SEQ ID NO: 112539 - RNA, 64 nt, hsa
accaauaugguuuucuuuaugucuuggcugcuugaaaauuaaaaaaaaaaaagguuuguucaau

SEQ ID NO: 112540 - RNA, 64 nt, hsa
cuuuacuucugggaauuuguauguaacagccuagaaaauuaaaaggagguggaugcauccaaag

SEQ ID NO: 112541 - RNA, 64 nt, hsa
cuucuuaacuuuuaacuaucagaguuugauuaauaaaauuaauuaauguuuuuucuccuucgug

SEQ ID NO: 112542 - RNA, 64 nt, hsa
gucacacacacaaaaaauccuuuucaauccugagaaaauuaaaggcguuuuacucacauggcua

SEQ ID NO: 112543 - RNA, 64 nt, hsa
aucugcucagaaaaauguaugugcacaaauaaaaaaaauuaauggcaauuguuuagugauugua

SEQ ID NO: 112544 - RNA, 64 nt, hsa
uggaaaagauguucaugguacauuguaaaaaaauaaaauuaaaauuaaaaaaaguuugcagaac

SEQ ID NO: 112545 - RNA, 64 nt, hsa
agauguucaugguacauuguaaaaaaauaaaauuaaaauuaaaaaaaguuugcagaaccgcaua

SEQ ID NO: 112546 - RNA, 64 nt, hsa
cuuuuagaaacuuaucuuacaaaguguauuuuauaaaauuaaagaaaauaaaauuaagaauguu

SEQ ID NO: 112547 - RNA, 64 nt, hsa
cuuacaaaguguauuuuauaaaauuaaagaaaauaaaauuaagaauguucucaaucaaacaucg

SEQ ID NO: 112548 - RNA, 64 nt, hsa
uauccaugagcaccaggcuuugcucacuuaaaaaaaaauuaagccacauuaaggagugagucuu

SEQ ID NO: 112549 - RNA, 64 nt, hsa
uuaaggagugagucuucuuuuuuacaauaauguaaaaauuaaacuguuuacauuuuuuuaaagc

SEQ ID NO: 112550 - RNA, 64 nt, hsa
cuguuuacauuuuuuuaaagcauuguaguuuuuaaaaauuaagcuguuuuguuuuguguuguug

SEQ ID NO: 112551 - RNA, 64 nt, hsa
ugaucauguuguugaugguuagcauauguuucugaaaauuaaauauguauuauuaaaaguuggu

SEQ ID NO: 112552 - RNA, 64 nt, hsa
auauaguuaguuuucagcucauuuaaaagaggcaaaaauuaaaagcuuggagagauaguuuccu

SEQ ID NO: 112553 - RNA, 64 nt, hsa
uaucuucuggaguuuuugggaggagagaaacuggaaaauuaaauuguauuuuugccagaagacu

SEQ ID NO: 112554 - RNA, 64 nt, hsa
accagcaucugaauuucaaguucuuaaaauuucaaaaauuaaaauuuuucauuauuagcuaucc

SEQ ID NO: 112555 - RNA, 64 nt, hsa
aucaaugcugauucugagaaaagagcaauuuaucaaaauuaaacacuguaaaagaaaggugucc

SEQ ID NO: 112556 - RNA, 64 nt, hsa
uuugugaugcagcuaccaugauucaaaaaaauuaaaaauuaaaaaaaaaaaaucugccacuuau

SEQ ID NO: 112557 - RNA, 64 nt, hsa
uggagcuuuugugaugcagcuaccaugauucaaaaaaauuaaaaauuaaaaaaaaaaaaucugc

SEQ ID NO: 112558 - RNA, 64 nt, hsa
gccuaagaauaaaaauugaaaugguguuaaucugaaaauuaaugauucucuguaagcacuguag

SEQ ID NO: 112559 - RNA, 64 nt, hsa
ccuaacccuccacauacauuugccuaucacacguaaaauuaauauuuacucuagugaagugguu

SEQ ID NO: 112560 - RNA, 64 nt, hsa
uuuuuaguuuagauugugaggcaauuauuaaaucaaaauuaauucauccaauaccccuuuacua

SEQ ID NO: 112561 - RNA, 64 nt, hsa
uuaugccugcuuuuagcaaccauaaaauugucauaaaauuaauaaauuuaggaaagaauaaaga

SEQ ID NO: 112562 - RNA, 64 nt, hsa; identical to SEQ ID NO: 112540

SEQ ID NO: 112563 - RNA, 64 nt, hsa
cuucuuaacuauuaacuaucagaguuugauuaauaaaauuaauuaauuuuuuuucuccuucgug

SEQ ID NO: 112564 - RNA, 64 nt, hsa
ucacacacacaaaaaaauccuuuucaauccugagaaaauuaaagguguuuuacucacauggaua

SEQ ID NO: 112565 - RNA, 64 nt, hsa
aucugcucagaaaaauguaugugcacaaauaaaaaaaauuaauggcaauuguuuagugacugua

SEQ ID NO: 112566 - RNA, 64 nt, hsa
aauauucuaucuggaauagggacaggggaucuuuuauuuauaaucucaucagaugagugaguug

SEQ ID NO: 112567 - RNA, 64 nt, hsa
agauauuuuauguuuuuuuaauuuucuccaagaauauuuauagaauuccaaagaaucagaauag

SEQ ID NO: 112568 - RNA, 64 nt, hsa
auagugagaugcacacuuauauauauacuguauauauuuauauauuuauauauauauuucauau

SEQ ID NO: 112569 - RNA, 64 nt, hsa
augcacacuuauauauauacuguauauauuuauauauuuauauauauauuucauauauauauau

SEQ ID NO: 112570 - RNA, 64 nt, hsa
gucuuguaauauauuuauuuacaaaacacuucauuauuuauaaagaauuuacuaacaguuuauc

SEQ ID NO: 112571 - RNA, 64 nt, hsa
cauuauuuauaaagaauuuacuaacaguuuaucuuauuuauacccauacaucugcuacuuuggg

SEQ ID NO: 112572 - RNA, 64 nt, hsa
gcauucuuuuugccaaauaugaccaaauuacuuuuauuuauaauuuuugauuuauauuucagcu

SEQ ID NO: 112573 - RNA, 64 nt, hsa
aauguucugguaucuuugaaaaauguaaauaguuuauuuauagagaacccuaccucugagguug

SEQ ID NO: 112574 - RNA, 64 nt, hsa
aggacacugagccauccgugggucaggaugcaauuauuuauaaaagucuccaggugaacauggc

SEQ ID NO: 112575 - RNA, 64 nt, hsa
uuggcauuuuuauguuuuaagaaaaacaguauuuuauuuauaauaaaaucugaauauuuguaac

SEQ ID NO: 112576 - RNA, 64 nt, hsa
guguuguguuaugccuacaugugauauaaauuaauauuuauauucauuuauauuuauauuuuug

SEQ ID NO: 112577 - RNA, 64 nt, hsa
acaugugauauaaauuaauauuuauauucauuuauauuuauauuuuugaacuuauuuauuuaaa

SEQ ID NO: 112578 - RNA, 64 nt, hsa
ugaagacucaaugaauacuuuccauauuuuggccuauuuauauaagaaaguuaauaacauugac

SEQ ID NO: 112579 - RNA, 64 nt, hsa
agaaaaguuuaauuacaguuaaaaauguauaauguauuuauaauauucaucgauaccauuauuc

SEQ ID NO: 112580 - RNA, 64 nt, hsa
ccuauguauuuaucguucuugaucauaagccgcuuauuuauaucauguaucucuaaggaccuaa

SEQ ID NO: 112581 - RNA, 64 nt, hsa
uugaaauugcugauuguucugcucccucuacagauauuuauaucaauuccuacagcuuuccccu

SEQ ID NO: 112582 - RNA, 64 nt, hsa
gacaagaauauguucacaucuugguauguggccauauuuauagaaugcugaacucaaugugcaa

SEQ ID NO: 112583 - RNA, 64 nt, hsa
aaaaugaaaaaucuuuuuuuaauaauuucaucccuauuuauaguuuuuauauuaauuuguuuuu

SEQ ID NO: 112584 - RNA, 64 nt, hsa
uauuuuuaaaucaaacgcugauuacagauaauaguauuuauauaaauaauugaaaaaaauuuuc

SEQ ID NO: 112585 - RNA, 64 nt, hsa
uauacacuuauuuuaagugaaaagcagagaauuuuauuuauagcuaauuuuagcuaucuguaac

SEQ ID NO: 112586 - RNA, 64 nt, hsa
augaaccaugucuauuaauuuaauuauuuaauaauauuuauauuaaacuccuuauguuacuuaa

SEQ ID NO: 112587 - RNA, 64 nt, hsa
acugaacuguagaagucuaaugaucauauuuauuuauuuauaugaaccaugucuauuaauuuaa

SEQ ID NO: 112588 - RNA, 64 nt, hsa
uauauaugcagagagagagcuuauauauuauuuauauuuauauuaaguuguauuagcauacucu

SEQ ID NO: 112589 - RNA, 64 nt, hsa
uauguguauauaugcagagagagagcuuauauauuauuuauauuuauauuaaguuguauuagca

SEQ ID NO: 112590 - RNA, 64 nt, hsa
gcuuuugaaugaguguaaauuguuuucuuuuguguauuuauacuuguauguaugauuugcaugu

SEQ ID NO: 112591 - RNA, 64 nt, hsa
aaaagaaaagauuacugacugugcauuguaccuguauuuauaguuuaugguuaucaggaagcuc

SEQ ID NO: 112592 - RNA, 64 nt, hsa
gauuguuuaauuguaggucaaugaaauauuugcuuauuuauauucagagauguaccauguuaaa

SEQ ID NO: 112593 - RNA, 64 nt, hsa
cgucuuguauuuucuucccauuuguaauguaucuuauuuauauaugaaguaaguucugaaaacu

SEQ ID NO: 112594 - RNA, 64 nt, hsa
gccaaagagaaaagauuaaaauuagugagauuuguauuuauauuagagugcccuuaaaauaaug

SEQ ID NO: 112595 - RNA, 64 nt, hsa
aaacaaaacuuugagagcagcacaugcauccagguauuuauagauuauugccagugucuuuucu

SEQ ID NO: 112596 - RNA, 64 nt, hsa
gauaucuaucuaucuagauuucugaaccaagauauauuuauaguucacuuuuggguuuuuauac

SEQ ID NO: 112597 - RNA, 64 nt, hsa
uuuucaccagacugaguuagugguggcuuauaccuauuuauauuuguauuaauugcuuacagau

SEQ ID NO: 112598 - RNA, 64 nt, hsa
uggauuucuguugcuugacuauuuucuuagugaauauuuauacuaagguagugacugagauuug

SEQ ID NO: 112599 - RNA, 64 nt, hsa
acacuuucauaugauugugcagaaaacuugccucuauuuauaaugaagauaacuuaaacagaaa

SEQ ID NO: 112600 - RNA, 64 nt, hsa
auuucugugaguuuuguaugaaaaucagccucauuauuuauaguugaauuuuugcacaaaauau

SEQ ID NO: 112601 - RNA, 64 nt, hsa
uauuuugcuucaggauccaagugacaaaguuauauauuuauaaaauugcuauaaaucgacaaaa

SEQ ID NO: 112602 - RNA, 64 nt, hsa
caauggaaacuuuaggucuaguuucuuuugauaguauuuauaauauaaaucaaucuuauuacug

SEQ ID NO: 112603 - RNA, 64 nt, hsa
aauuacauuuuuguaacaaaggagucuguaacuuuauuuauacuuaugaauauauccagggacu

SEQ ID NO: 112604 - RNA, 64 nt, hsa
auaacaagaaaguaucuauauauacauauguaaauauuuauauauagauauauguagcuuucua

SEQ ID NO: 112605 - RNA, 64 nt, hsa
cgaaauguuauuuuuuaauuauuauuuauauauguauuuauaaauauauuuaagauaauuauaa

SEQ ID NO: 112606 - RNA, 64 nt, hsa
gaaggcaaagcacgaaauguuauuuuuuaauuauuauuuauauauguauuuauaaauauauuua

SEQ ID NO: 112607 - RNA, 64 nt, hsa
uuucugcacuugacccuauuugaauucugagcauuauuuauaaguauaaaaugaugauauauaa

SEQ ID NO: 112608 - RNA, 64 nt, hsa
gaguaguaaaugcuuccacgugccuucaacuggauauuuauagucuuacugaugucaguuauug

SEQ ID NO: 112609 - RNA, 64 nt, hsa
uguaaaauaaaauaaaacacaucugccuucuugauauuuauagaauuagagaauaaacuuuuua

SEQ ID NO: 112610 - RNA, 64 nt, hsa
gaagugcaaucaauaggaauuagggaauguuguauauuuauauauguaaacuuuuuuuguaaga

SEQ ID NO: 112611 - RNA, 64 nt, hsa
accccuuauaguucauggagaccaaaauuugggguauuuauaauagucagcgcaggaaugcaca

SEQ ID NO: 112612 - RNA, 64 nt, hsa
uauacaaaaguguuuuccacuaauuuugcaugcguauuuauaagaaaaaugugaauuugguggu

SEQ ID NO: 112613 - RNA, 64 nt, hsa
uuuucugguuugcaccaugaauuugucaaauggauauuuauaggaauauauucacuacuuugua

SEQ ID NO: 112614 - RNA, 64 nt, hsa
uaccauagucaagguaccgccuugcugaaguauuuauuuauaaagaauauucuguagaaccucu

SEQ ID NO: 112615 - RNA, 64 nt, hsa
agguguuuuucauucacuuuaauagaagggcaaauauuuauaagcuauuucuguaccaaagugu

SEQ ID NO: 112616 - RNA, 64 nt, hsa
acaaacauguaagcauaacuuauuuuaaaauauuuauuuauauaacuugguaaucaugaaagca

SEQ ID NO: 112617 - RNA, 64 nt, hsa
ugagauaaucaauuuuaacccaaagucauuggauuauuuauaugaaguccauaauguucgagua

SEQ ID NO: 112618 - RNA, 64 nt, hsa
ucauggggaaacaaacauuauuuuguuuuugguuuauuuauacuauauucugcauacaguacuu

SEQ ID NO: 112619 - RNA, 64 nt, hsa
ccucaggauauucuuuucuccacccuaguuuauuuauuuauagauaucuguuuacaaagucugu

SEQ ID NO: 112620 - RNA, 64 nt, hsa
auagauuuuacaucuuugauauaaagcacugccauauuuauauuuuaaaaggaaauuagacauu

SEQ ID NO: 112621 - RNA, 64 nt, hsa
cuagcuuuugaguuugcuaucugguuuaauguuguauuuauaauuuaaaguggaaaucagaaac

SEQ ID NO: 112622 - RNA, 64 nt, hsa
ucuauuugcucuccuuuuucuuucuucuuaagaguauuuauauuauuuuguuaagcaaaaaugg

SEQ ID NO: 112623 - RNA, 64 nt, hsa
gugaagaugucaaaaaaagauuuuagaagugcaauauuuauaguguuauuuguuucaccuucaa

SEQ ID NO: 112624 - RNA, 64 nt, hsa
uaaaagugucaagcguugacagcuuggaagcguuuauuuauacaucucuguaaaaggauauuuu

SEQ ID NO: 112625 - RNA, 64 nt, hsa
gaggauggauuuguacaaauguauaaaaugccacuauuuauacaccaaguucauagcagcauua

SEQ ID NO: 112626 - RNA, 64 nt, hsa
uugaccucuaaauuguaaaaugccuccaaaaguuuauuuauagaacaaaaauacaugaggaugg

SEQ ID NO: 112627 - RNA, 64 nt, hsa
acccaauuagguaggaaacaugaaaaaccuuugauauuuauaaaaucauuuuuacgugcaaaau

SEQ ID NO: 112628 - RNA, 64 nt, hsa
agaguauccaaucgguauugguggagcggcucccuauuuauacaauaggaagcaugggugcuua

SEQ ID NO: 112629 - RNA, 64 nt, hsa
uuuauucuauuacuauuguuaaaaacuugaaugguauuuauauuggcugauauuuauauacuua

SEQ ID NO: 112630 - RNA, 64 nt, hsa
uguuaaaaacuugaaugguauuuauauuggcugauauuuauauacuuaauagauugaguucugu

SEQ ID NO: 112631 - RNA, 64 nt, hsa
gaguuaaauaucuuggacauuuauugguaaagcuuauuuauaaacugcagucagagcuaguuaa

SEQ ID NO: 112632 - RNA, 64 nt, hsa
acagucucuuaucaggaaauagagaugauguggauauuuauauauuacauauauaaccaccaga

SEQ ID NO: 112633 - RNA, 64 nt, hsa
agagaggcuauauuuuucugcuacaaauauuuuauauuuauagcaaaacuagacuuucagaguc

SEQ ID NO: 112634 - RNA, 64 nt, hsa
auuuuccuauuaguggaggagggagaaccauauuuauuuauaaugaagacaucuaagaucccua

SEQ ID NO: 112635 - RNA, 64 nt, hsa
auaacccccagaaaguaacaaugacaaaguauuauauuuauauauauuauuguagagaauuugu

SEQ ID NO: 112636 - RNA, 64 nt, hsa
auauuuuuaaagaugucuuaagauaucuuaauuuuauuuauaaguuuugguguuuaccuguuuu

SEQ ID NO: 112637 - RNA, 64 nt, hsa
uaaaccauuaugagccugaaggacauuuucagcauauuuauacaugagaaacagccuucaacaa

SEQ ID NO: 112638 - RNA, 64 nt, hsa
uauguuugaaaagauguuugaaacuugauuauacuauuuauaauuggcacaguacuuugaauua

SEQ ID NO: 112639 - RNA, 64 nt, hsa
uguauuccuuaugcaaaacacauguaucuuucauuauuuauaaguggccucucuuagcucaguu

SEQ ID NO: 112640 - RNA, 64 nt, hsa
gauuaacuagcauuauuuugccaccuuuauauuguauuuauaaaaaaaaaaguacuaucaauca

SEQ ID NO: 112641 - RNA, 64 nt, hsa
aaaaacuaaucuuaaacauacuauuucuaauaaauauuuauauuuuuaugaaauaaagagguau

SEQ ID NO: 112642 - RNA, 64 nt, hsa
agauguaaauaauagcacuagccacucuuauuaauauuuauaguguuagaaaaccagccacauu

SEQ ID NO: 112643 - RNA, 64 nt, hsa
aucucugcuccuaauauuacuaucccauuguaauuauuuauaacccucaagccaguugauuuuu

SEQ ID NO: 112644 - RNA, 64 nt, hsa
acuggaguaacaauacauaacagaguugccaagauauuuauacccucagcacucggggcaacac

SEQ ID NO: 112645 - RNA, 64 nt, hsa
uauuacaauaaaaauauaacauaaucuauucaucuauuuauaugcaaacauaaaaauguaaaua

SEQ ID NO: 112646 - RNA, 64 nt, hsa
auuuaacauuuuuuaaauagguaagauaccauuauauuuauaugagcuauguacugccacaaaa

SEQ ID NO: 112647 - RNA, 64 nt, hsa
uucuugguaaaaacguauguauuuauauauuauauauuuauauauaauauauauuauauauuua

SEQ ID NO: 112648 - RNA, 64 nt, hsa
agaaaaauaaaacauuucuugguaaaaacguauguauuuauauauuauauauuuauauauaaua

SEQ ID NO: 112649 - RNA, 64 nt, hsa
aaugggaauauuuuauacugacagaaaucaguaauauuuauauauuuauauuuuuaaaauauuu

SEQ ID NO: 112650 - RNA, 64 nt, hsa
uauuuuauacugacagaaaucaguaauauuuauauauuuauauuuuuaaaauauuuauuuauuu

SEQ ID NO: 112651 - RNA, 64 nt, hsa
aauuuaugaguuuuugauagcuuuauuuuuuaaguauuuauauauuuauaacucaucauaaaau

SEQ ID NO: 112652 - RNA, 64 nt, hsa
aguuuuugauagcuuuauuuuuuaaguauuuauauauuuauaacucaucauaaaauaaaguaua

SEQ ID NO: 112653 - RNA, 64 nt, hsa
auuuauauuuuuguauuuuuaugaaauaaacuaguauuuauaaaacacauuucauuuuauuuaa

SEQ ID NO: 112654 - RNA, 64 nt, hsa
uuuguguuaauucauucauauuuuuauaaauguauauuuauauuuuuguauuuuuaugaaauaa

SEQ ID NO: 112655 - RNA, 64 nt, hsa
gcuguuguaacguguaaggucaugacaauuuuuguauuuauauuugaaaucagauuucuauaac

SEQ ID NO: 112656 - RNA, 64 nt, hsa
uggagcuauuuuuguuaccacguuauaacgugaauauuuauacaguagccucuucaggcuuugu

SEQ ID NO: 112657 - RNA, 64 nt, hsa
gucaaaauguaagacauuuagaaguaauuuuuauuauuuauauuguuaauacuuaaucacugga

SEQ ID NO: 112658 - RNA, 64 nt, hsa
uuuauuaggaaauauuuaaaccugcugaaggauuuauuuauaaaaagugcaauuuuucaaaaca

SEQ ID NO: 112659 - RNA, 64 nt, hsa
gcagaguuacaucuuauucguguauuucucugaguauuuauaucccgucuccuuuuuucauucu

SEQ ID NO: 112660 - RNA, 64 nt, hsa
acauugauaauuuaguuugggcacauaaaaggaauauuuauauggcuucccaaaugcagaguua

SEQ ID NO: 112661 - RNA, 64 nt, hsa
uguugguguucaaaguguagcaaaaaaugauguauauuuauaaaucuauuuauaccacuauauc

SEQ ID NO: 112662 - RNA, 64 nt, hsa
aaguguagcaaaaaaugauguauauuuauaaaucuauuuauaccacuauaucauauguauauau

SEQ ID NO: 112663 - RNA, 64 nt, hsa
aaaucuauuuauaccacuauaucauauguauauauauuuauaaccacuuaaauugugagccaag

SEQ ID NO: 112664 - RNA, 64 nt, hsa
uaaacuagcugggaucauuuuugauccauugucauauuuauauuuaauuauuaaauguaucuga

SEQ ID NO: 112665 - RNA, 64 nt, hsa
ucauuugcaacuucauuuuguuuuuuauaaauguuauuuauacagaaaguggcuauugacuuuc

SEQ ID NO: 112666 - RNA, 64 nt, hsa
auuucuaauccugacuuggugacaguaucauguguauuuauaaaacaaggcuagccauauuuag

SEQ ID NO: 112667 - RNA, 64 nt, hsa
uuagcuggguaaacuaucuuuguaacagauaaguuauuuauaaaaauuaaaaaacuuauauucu

SEQ ID NO: 112668 - RNA, 64 nt, hsa
augacauuuaaaaauuucuuucuauguguauuuauauuuauacauacaaguuggaucauggagu

SEQ ID NO: 112669 - RNA, 64 nt, hsa
uguuguaugacauuuaaaaauuucuuucuauguguauuuauauuuauacauacaaguuggauca

SEQ ID NO: 112670 - RNA, 64 nt, hsa
augucauuuaaaauauuuugaaagcccucauaaauauuuauauuuacuaaacuaauagcauaga

SEQ ID NO: 112671 - RNA, 64 nt, hsa
aacaucaacucaguuguaugaaucuggaguguaauauuuauauuagaauguauaugucauuuaa

SEQ ID NO: 112672 - RNA, 64 nt, hsa
caauaaaaaucuuguacagauauauuuuuauaauuauuuauaauuuauauuuugauauucuauu

SEQ ID NO: 112673 - RNA, 64 nt, hsa
aauugagauaacauaguucuugaauauuuugcuguauuuauagccucauauuuaggcauuuaug

SEQ ID NO: 112674 - RNA, 64 nt, hsa
aaauaugugaagcugaguuaauuuauguaagucauauuuauauuuuuaagaaguaccacuugaa

SEQ ID NO: 112675 - RNA, 64 nt, hsa
auaaauggcuaacuuauacauauuuuuaaagaaauauuuauauuguauuuauauaauguauaaa

SEQ ID NO: 112676 - RNA, 64 nt, hsa
acuuauacauauuuuuaaagaaauauuuauauuguauuuauauaauguauaaaugguuuuuaua

SEQ ID NO: 112677 - RNA, 64 nt, hsa
aauuuuuguauagacauuccuuugguuggaagaauauuuauaggcaauacagucaaaguuucaa

SEQ ID NO: 112678 - RNA, 64 nt, hsa
cuugagaacacugcaaugugaaaaucacguuugcuauuuauaaacuuguccuuagauuaaugug

SEQ ID NO: 112679 - RNA, 64 nt, hsa
uaaguuuuaaauauuauuuauccccauccguucguauuuauauuaaagaauucuguacccugau

SEQ ID NO: 112680 - RNA, 64 nt, hsa
uuuccguguguguaugcuggugaacagucagauuuauuuauauuuuuuugcaagcauugaauaa

SEQ ID NO: 112681 - RNA, 64 nt, hsa
ccauguaccuaauccaaauaucauauaaacauuuuauuuauaguuaauaaucuaugaugaaggu

SEQ ID NO: 112682 - RNA, 64 nt, hsa
gugcauauaaauauauuuaacuuaacccagauuuuauuuauaucuuuauucaccuuuucuucaa

SEQ ID NO: 112683 - RNA, 64 nt, hsa
gauuuucuuaaacuuaaauguuguauuucauauuuauuuauauaauacaaauggaaaucaaaac

SEQ ID NO: 112684 - RNA, 64 nt, hsa
auuucacacaauaaaaaacaacauagaguacacauauuuauauguauuuuuaaagauaaagaau

SEQ ID NO: 112685 - RNA, 64 nt, hsa
uucuucugaagaaucauaggaagaguagacauuuuauuuauaaccaaugauauuucaguauaua

SEQ ID NO: 112686 - RNA, 64 nt, hsa
caagaugguucacaguuucuuuuuuuaacuagguuauuuauaauguauuucugaaccacuuggc

SEQ ID NO: 112687 - RNA, 64 nt, hsa
auuucaugucucuuuagauaaaacugacuaguuuuauuuauaaaaucuuaaguuuuggaagucu

SEQ ID NO: 112688 - RNA, 64 nt, hsa
gccauauuuauuuauaaauaaauauuuauuuauuuauuuauaaguagauguuuacauaugccca

SEQ ID NO: 112689 - RNA, 64 nt, hsa
uuacuuguuaauuuuagagguauauagccauauuuauuuauaaauaaauauuuauuuauuuauu

SEQ ID NO: 112690 - RNA, 64 nt, hsa
agaauuguaucauuugaacaacuaggcuucagcauauuuauagcaauccauguuaguuuuuacu

SEQ ID NO: 112691 - RNA, 64 nt, hsa
caggaaagacggauugcauuagaaauagacaguauauuuauagucacaagagcccagcagggcc

SEQ ID NO: 112692 - RNA, 64 nt, hsa
aaaaucuguuaauuagguaaaccacuauuauuuauauuuauaauuuacuuuuuuuuacuuuuau

SEQ ID NO: 112693 - RNA, 64 nt, hsa
aagaaaaaaaucuguuaauuagguaaaccacuauuauuuauauuuauaauuuacuuuuuuuuac

SEQ ID NO: 112694 - RNA, 64 nt, hsa
ucauagguaaugacagaugccuuaaugugaagcuuauuuauaauagcaauaaaccuaacuggau

SEQ ID NO: 112695 - RNA, 64 nt, hsa
cauuugaacuguauucagguaauauguuuaaagauauuuauauauugccauacaaaaacuuaac

SEQ ID NO: 112696 - RNA, 64 nt, hsa
gucuggguuugagaaaugaaauauuguuuccaauuauuuauaauaaaucaguauaaaauguuuu

SEQ ID NO: 112697 - RNA, 64 nt, hsa
uuacucuaaaaacugauugaaugauauauaaauauauuuauagccugaguaaaguuaaaagaau

SEQ ID NO: 112698 - RNA, 64 nt, hsa
agcaaaacuauauuugguuuaguuuucccacugguauuuauaguuuacuuugaauauuuauauu

SEQ ID NO: 112699 - RNA, 64 nt, hsa
aguuuucccacugguauuuauaguuuacuuugaauauuuauauuaauaauuagcucauaauuuu

SEQ ID NO: 112700 - RNA, 64 nt, hsa
guaaaucuguuuuuuaaggaaucauaaucauuuguauuuauacuuaaaaacacacaauguuaaa

SEQ ID NO: 112701 - RNA, 64 nt, hsa
ucucuggaguguuguauauaguguagcaaaagaguauuuauacaucccaccaaucaaaacacag

SEQ ID NO: 112702 - RNA, 64 nt, hsa
gaaaagagacguaguaaauuaaauagaagaaauauauuuauaaagcuuagugaaacacaaaauu

SEQ ID NO: 112703 - RNA, 64 nt, hsa
guuuauauauauuggccaacucauauagaaauuuuauuuauaggaagcuacuacuaaaaaaagu

SEQ ID NO: 112704 - RNA, 64 nt, hsa
auuuauuuauucuuacauuuuaucauauuuauacuauuuauauucuuauauaacaaauguuugc

SEQ ID NO: 112705 - RNA, 64 nt, hsa
uuuuuacucauuuauuuauucuuacauuuuaucauauuuauacuauuuauauucuuauauaaca

SEQ ID NO: 112706 - RNA, 64 nt, hsa
auacaaacaauacuucuuacacagaguuauccuuuauuuauaucauuaagacgugaaugaaaca

SEQ ID NO: 112707 - RNA, 64 nt, hsa
auaucugggaucccuuuuuuugguccucugcugauauuuauaaaacaagaaaugcuucuuggac

SEQ ID NO: 112708 - RNA, 64 nt, hsa; identical to SEQ ID NO: 112699

SEQ ID NO: 112709 - RNA, 64 nt, hsa; identical to SEQ ID NO: 112698

SEQ ID NO: 112710 - RNA, 64 nt, hsa
cuggguggggugaggaccacuccuguacacugaauauuuauauuucacuauuuuuauuuauauu

SEQ ID NO: 112711 - RNA, 64 nt, hsa
uccuguacacugaauauuuauauuucacuauuuuuauuuauauuuuuguaauuuuaaauaaaag

SEQ ID NO: 112712 - RNA, 64 nt, hsa
ugucccaacagcccuguaagccagcuuucuucuauauuuauaaacacgauaaaugcaugagaag

SEQ ID NO: 112713 - RNA, 60 nt, hsa
gcucuccuucacuaaauuaauuugucuaaguauuuauaaggaagaucuuaauaacagaug

SEQ ID NO: 112714 - RNA, 64 nt, hsa
uuguuuggaagaaacuguaggucuauauaaauuuuauuuauaauguauguguaauauacauaau

SEQ ID NO: 112715 - RNA, 64 nt, hsa
gguaguaaagugauuuuuaccaccuguguuugcauauuuauauaugcuguggaugaaaauaacu

SEQ ID NO: 112716 - RNA, 64 nt, hsa
auaccauauaagaauauuuucucugcaguauuuauauuuauacuauuuugcuaugaguggccuu

SEQ ID NO: 112717 - RNA, 64 nt, hsa
acuagaauaccauauaagaauauuuucucugcaguauuuauauuuauacuauuuugcuaugagu

SEQ ID NO: 112718 - RNA, 64 nt, hsa
agugcucagcaguugaaagcaaaauaauaacugcuauuuauaaaaaugccucagcagaaucugu

SEQ ID NO: 112719 - RNA, 64 nt, hsa
uaauaauuuuaugaaaguuaagaucaagaaauuauauuuauaugaaguaaaucacuugacaacu

SEQ ID NO: 112720 - RNA, 64 nt, hsa
caacauuuguuuuaggagcauuuccucccucugcuauuuauacacggaaagacuuacuacagcg

SEQ ID NO: 112721 - RNA, 64 nt, hsa
caauuuuuuauaguaauauguacuucuaauuuauuauuuauacuuaaauugugaccugaaagau

SEQ ID NO: 112722 - RNA, 64 nt, hsa
gaaauaaauauucucuuaguuauccuugaaaucauauuuauacuauuaauuugcucagugcacu

SEQ ID NO: 112723 - RNA, 64 nt, hsa
ucucccaggucacacugauucauucuuaacaagauauuuauauguuauuaaacaggugguucuu

SEQ ID NO: 112724 - RNA, 64 nt, hsa
aguuauuuuuauuauugagucuguccagauaaguuauuuauaaugggcauuacugaauuuuuaa

SEQ ID NO: 112725 - RNA, 64 nt, hsa
gggggaaauuuuagauaauuuuuaaauucaaaguuauuuauaaaaugcuagaauuuguuuuaau

SEQ ID NO: 112726 - RNA, 64 nt, hsa
uuaagcuauggauguuuuuauuuuauauuuucuuuauuuauaacugugccaaguauuauuuugc

SEQ ID NO: 112727 - RNA, 64 nt, hsa
cuuuuaaucuguaauuuuaaaauacaagucugaauauuuauaguugauucuuaacugcauaaac

SEQ ID NO: 112728 - RNA, 64 nt, hsa
auaugauagggaaggaacugaauuucuccauucauauuuauaaccauucuaguuuuaucuuccu

SEQ ID NO: 112729 - RNA, 64 nt, hsa
ugaaguaaaugggguugggggaggggacauuucauauuuauaaugugcugaagguaccauauuu

SEQ ID NO: 112730 - RNA, 64 nt, hsa
aaagccaggguguuuucauucaugcggauacuaguauuuauagaugucugacuaccuaacuuaa

SEQ ID NO: 112731 - RNA, 64 nt, hsa
uuuggaaguuugccuauccuucuauauuuauagauauuuauaaaaauguaaccccuuuuuccuu

SEQ ID NO: 112732 - RNA, 64 nt, hsa
uauuuauuuauuuggaaguuugccuauccuucuauauuuauagauauuuauaaaaauguaaccc

SEQ ID NO: 112733 - RNA, 64 nt, hsa
uguaaugaaaaugaauaucuauuaauauauguauuauuuauaauuccuauauccugugacuguc

SEQ ID NO: 112734 - RNA, 64 nt, hsa
gggaauauauuuuuagacucaucaaucaaauaaguauuuauaauagcaacuuuuguguaaugaa

SEQ ID NO: 112735 - RNA, 64 nt, hsa
uuuaaaucuaaaucuauuuauuaauauuuaacauuauuuauauggggaauauauuuuuagacuc

SEQ ID NO: 112736 - RNA, 64 nt, hsa
gcauuuuauuuauaucauuuuauuaauauggauuuauuuauagaaacaucauucgauauugcua

SEQ ID NO: 112737 - RNA, 64 nt, hsa
uaaauguauuuauuauuauuauaagacugcauuuuauuuauaucauuuuauuaauauggauuua

SEQ ID NO: 112738 - RNA, 64 nt, hsa
uaaauagcuucauguuuccauaaucaguacuuuauauuuauaaauguauuuauuauuauuauaa

SEQ ID NO: 112739 - RNA, 64 nt, hsa
gugauccugaaauguuuacuaagcauuguaaauuuauuuauaacugccaucuccaacuacaucc

SEQ ID NO: 112740 - RNA, 64 nt, hsa
uuacuuauaaugcaaggaaucaggaaacuuuaguuauuuauaguauaaucaccauuaucuguuu

SEQ ID NO: 112741 - RNA, 64 nt, hsa
acauauuguagagacuuguaugcaaagguuggcauauuuauaugaaaauuaguugcuauagaaa

SEQ ID NO: 112742 - RNA, 64 nt, hsa
cucugccugagcuuagaagguuauagaaaaaggguauuuauaaacauaaaugaccuuuuacuug

SEQ ID NO: 112743 - RNA, 64 nt, hsa
uuguagucuugguagaaccaguauuuuuguuguuuauuuauaagguaauuguguguggggaaaa

SEQ ID NO: 112744 - RNA, 64 nt, hsa
agaacucuguguuugaauucauucugcauauaauuauuuauaaguauagauugugaauuuuucc

SEQ ID NO: 112745 - RNA, 64 nt, hsa
auuuugaaacuacacacaaaaagcauacuugcauuauuuauaauaaaauugcauucaguggcuu

SEQ ID NO: 112746 - RNA, 64 nt, hsa
gcaauaauaauuaauucacacaccauauggauucuauuuauaaaucacccacaaacuuguucuu

SEQ ID NO: 112747 - RNA, 64 nt, hsa
aaagcuaguagaaaaguacagaaaauuugacuauuauuuauagauuucagguauauuuauaugu

SEQ ID NO: 112748 - RNA, 64 nt, hsa
agaaaauuugacuauuauuuauagauuucagguauauuuauauguguaaaagaaauugacaaag

SEQ ID NO: 112749 - RNA, 64 nt, hsa
gaacaucacccuauauauaauuugaguguauauauauuuauauauaugauguggacauauguau

SEQ ID NO: 112750 - RNA, 64 nt, hsa
aagccugagcagggcgaggaccaauaauuuuaauuauuuauauuuccuguauugcuuuaguaug

SEQ ID NO: 112751 - RNA, 64 nt, hsa
ucuaagauuuuuuaccucugcaucagugcauuucuauuuauaucaaaaggugcuaaaaugauuc

SEQ ID NO: 112752 - RNA, 64 nt, hsa
gaagccaaugcagaacugaugggaaaggaccaauuauuuauaguuucccaacaaaaguucuaag

SEQ ID NO: 112753 - RNA, 64 nt, hsa
uuaaucguugcuuccaauaugauucuuauuguaguauuuauauuacaaaguuggcauacagggu

SEQ ID NO: 112754 - RNA, 64 nt, hsa
cauucuuuguauucugauuuuuuaaguguuuucauauuuauagccaucacaaaauuuugcccaa

SEQ ID NO: 112755 - RNA, 64 nt, hsa
uuauuuuucuaaacacuaugcuaaauaaacuuuauauuuauacauaccuugcauugaaaauuau

SEQ ID NO: 112756 - RNA, 64 nt, hsa
agcaccuguguuguacugcuuuauaucucauguauauuuauaguaaugaaaagacuuuuuaaau

SEQ ID NO: 112757 - RNA, 64 nt, hsa
acuguuuggaguuguugccuuacuuuuuaauauguauuuauaaaguauuccagcaaaagaggau

SEQ ID NO: 112758 - RNA, 64 nt, hsa
aauuuagcuugucuuucugcuaagcuguuaaauguauuuauaguaaaggaagaaaaaaagacug

SEQ ID NO: 112759 - RNA, 64 nt, hsa
aucuauuuauauaucauaguauaaaucuaugauauauuuauaucauauauaaaagucugaguuc

SEQ ID NO: 112760 - RNA, 64 nt, hsa
uuguaguucuuagucccacagggaaauguguaucuauuuauauaucauaguauaaaucuaugau

SEQ ID NO: 112761 - RNA, 64 nt, hsa
ccaaguagcagacgucauguugcaugguuuuugauauuuauauguaaguuuuucaaauuuugcu

SEQ ID NO: 112762 - RNA, 64 nt, hsa
cuuaauuuuaaaauuuauuauuuugaucuugaauuauuuauaaacuggaaagugguuugauuau

SEQ ID NO: 112763 - RNA, 64 nt, hsa
uaguggagcuaucacacacucaaaugagcuuguauauuuauaauacaauauaguauuauaguaa

SEQ ID NO: 112764 - RNA, 64 nt, hsa
uauaucuauaccugcauauauauauugaccugaguauuuauaacugugugguguucaucuagca

SEQ ID NO: 112765 - RNA, 64 nt, hsa
cuccuucuuucccaaucccucucaaccauguauuuauuuauauauguauguauuuuuuuauuua

SEQ ID NO: 112766 - RNA, 64 nt, hsa
aucuaaaucgguaaauaaggacaugaguuaaauauauuuauauguacauacauauauauauccc

SEQ ID NO: 112767 - RNA, 64 nt, hsa
uauucacuacuuuugaacacauucugcuaugaauuauuuauauaagccaaagcuauauguugua

SEQ ID NO: 112768 - RNA, 64 nt, hsa
aacucaaauuuaaaugguguuuguuuuggguuuuuauuuauaaugcugaaguuauuccauauaa

SEQ ID NO: 112769 - RNA, 64 nt, hsa
agcacaccugcaaagauaaagugugccaagacuguauuuauauuucauacuuauauuguuucau

SEQ ID NO: 112770 - RNA, 64 nt, hsa
uauuauuaauuggcuuucuguauucuaugccuuuuauuuauaaagacacuaagaaaacccaugu

SEQ ID NO: 112771 - RNA, 64 nt, hsa
aaaacccgauuuuuauucucauaaauuuugugguuauuuauacaagggcugugcuaugcuacca

SEQ ID NO: 112772 - RNA, 64 nt, hsa
gacuagugcuucccaguacuugcaugggguucacuauuuauaguuuucuugggaguaucacagg

SEQ ID NO: 112773 - RNA, 64 nt, hsa
aggggugaccuauaucccaugugaguggucacuuuauuuauaggaucuuuaaaacauuuuuaau

SEQ ID NO: 112774 - RNA, 64 nt, hsa
uguggaauguguugcauguacuccaguguuuguguauuuauaaucuuauuugcaucaugaugau

SEQ ID NO: 112775 - RNA, 64 nt, hsa
auucuggcuugaaaaaauaggggagauuaaauauuauuuauaaaugauguaucccaugguaauu

SEQ ID NO: 112776 - RNA, 64 nt, hsa
auuauccuuaaagauauugcauuuucauauucuuuauuuauaaaggaucaaugcugcuguaaau

SEQ ID NO: 112777 - RNA, 64 nt, hsa
gucaucguaaaagcugaaaaaaucccuuuguuucuauuuauaaaaaaagugcuuuucuauaugu

SEQ ID NO: 112778 - RNA, 64 nt, hsa
ccugccugugguuuucagcucagagcuggacuucuauuuauaaguuaccuguauuuauauuuau

SEQ ID NO: 112779 - RNA, 64 nt, hsa
gcucagagcuggacuucuauuuauaaguuaccuguauuuauauuuauaugcccgcucucauggu

SEQ ID NO: 112780 - RNA, 64 nt, hsa
agcuggacuucuauuuauaaguuaccuguauuuauauuuauaugcccgcucucauggugaaggc

SEQ ID NO: 112781 - RNA, 64 nt, hsa
uuucagguguuguuugguggauaaaggaaccuuuuauuuauaaagauacuguagaaagcaugug

SEQ ID NO: 112782 - RNA, 64 nt, hsa
cuagcugauaaugcaaacacuaacugggggauuuuauuuauaagggcucuagaaaaaacgaguu

SEQ ID NO: 112783 - RNA, 64 nt, hsa
aaucccaauccaagucaaacuuugcacauauuuauauuuauauucagaaaagaaacauuucagu

SEQ ID NO: 112784 - RNA, 64 nt, hsa
caacaaaaucccaauccaagucaaacuuugcacauauuuauauuuauauucagaaaagaaacau

SEQ ID NO: 112785 - RNA, 64 nt, hsa
guuuaguuuuuauauacacagaguuaucagacauuauuuauaaaacuuaguuuaaaaaaaagac

SEQ ID NO: 112786 - RNA, 64 nt, hsa
auguuuaaaaguuaaagaaaaaagagcugcagaguauuuauaaaacugucuuuuagaaaaaaaa

SEQ ID NO: 112787 - RNA, 64 nt, hsa
aucucaaucuuaaagcaugaaucuaaaacauaaauauuuauauuacagacucaauuuuacaaaa

SEQ ID NO: 112788 - RNA, 64 nt, hsa
gcaaaauugauaagauguuagaaauuuggaccauuauuuauaaucaggguagcauuaaaaugga

SEQ ID NO: 112789 - RNA, 64 nt, hsa
uuuuggagacauuuucagugcauuguuauugccauauuuauauaauaugacuauucuaaaggcu

SEQ ID NO: 112790 - RNA, 64 nt, hsa
auguuucaugacuuauuuuagucaaugaauuuucuauuuauacuaaacauauggacauuuuaaa

SEQ ID NO: 112791 - RNA, 64 nt, hsa
guaaagaaugguacaagacagguuguuacucgauuauuuauaguaaaauaugugggaaauuaua

SEQ ID NO: 112792 - RNA, 64 nt, hsa
cuaauuguuuuuauaaaaauuauucccuauugaauauuuauauaaugagguuguaucaacaaug

SEQ ID NO: 112793 - RNA, 64 nt, hsa
uugauuuaugaguaauuguuauuuauucuuuauuuauuuauauuaauuaugaagauuaugauau

SEQ ID NO: 112794 - RNA, 64 nt, hsa
cuuuucuacauacauuauuuucuuaauuguuagcuauuuauagaaagcuucaauagaacuguuu

SEQ ID NO: 112795 - RNA, 64 nt, hsa
uaauaaucaagagccuuaaaacaucauuccuuuuuauuuauauguauguguuuagaauugaagg

SEQ ID NO: 112796 - RNA, 64 nt, hsa
guccuaauggugaugcagucuuagaucauaguuuuauuuauauuuauugacucuugaguuguuu

SEQ ID NO: 112797 - RNA, 64 nt, hsa
cuuugagaauuuacuuuauggagcguauguaaguuauuuauauacaaggaaaucuauuuuaugu

SEQ ID NO: 112798 - RNA, 64 nt, hsa
gucaagugccuaaguuuuuaauauuggacuugaguauuuauauauugugcaucaacucuguugg

SEQ ID NO: 112799 - RNA, 64 nt, hsa
uauguaagaauuuuauugcuuauguggcauacaauauuuauaacuauaaacuuuauagaaguac

SEQ ID NO: 112800 - RNA, 64 nt, hsa
uuuuucuaaaugcucaaauguuaucaaaauacuauauuuauagaaguaaucuucucuguuaaca

SEQ ID NO: 112801 - RNA, 64 nt, hsa
auauauucuuucacaaggcauccauacuguuuaauauuuauagaguucauagaaauacaucaau

SEQ ID NO: 112802 - RNA, 64 nt, hsa
agccauggugaacugauaauuuuuguuuuuaaauuauuuauauuacugaauuggcaaaauuaca

SEQ ID NO: 112803 - RNA, 64 nt, hsa
aaaaugcuuugaaaauguuuuuaagugcuaugcauauuuauagaguuauuauaguuauucaaau

SEQ ID NO: 112804 - RNA, 64 nt, hsa
uguauguguuuauucuucauaugguacuuuaccauauuuauauauuguuuuauaccuguagguu

SEQ ID NO: 112805 - RNA, 64 nt, hsa
auuauaggauagaauugucauuuuaugcaggagauauuuauacuacgaggguuguuuggaugga

SEQ ID NO: 112806 - RNA, 64 nt, hsa
cagguguugcuuguguacaucguacccauccauucggcuucaccugcagccaacggccuggaau

SEQ ID NO: 112807 - RNA, 64 nt, hsa
agcaguacgagcgcgauucucucuuuguccucgccggcuucaaguggcaggacuuuaagugguu

SEQ ID NO: 112808 - RNA, 64 nt, hsa
gcugggaccccucacuugccugccaugcucugcucggcuucagucuccaggagacaguggucac

SEQ ID NO: 112809 - RNA, 64 nt, hsa
cccccccuuuuuuuuuuuaccccugcuucucccacggcuucaccucccuaugugaacuguagac

SEQ ID NO: 112810 - RNA, 64 nt, hsa
cagcaggagcccuguccucacguucccaggagggcggcuucacccuucguaaccaggagacaag

SEQ ID NO: 112811 - RNA, 64 nt, hsa
gggccugggccccugggaggugagguguggugugcggcuucacccagggcagaacaaggcagaa

SEQ ID NO: 112812 - RNA, 64 nt, hsa
agcugacacagagccaucugccacaaaccuguggcggcuucagaucuccaaucccugccaccac

SEQ ID NO: 112813 - RNA, 64 nt, hsa
auuuccuagcaaaaucagaagauugugaagaggccggcuucaacaaaaugggauaaaaaaauaa

SEQ ID NO: 112814 - RNA, 64 nt, hsa
guccugcccaacacuguaugguuuuucucuagcacggcuucaauuuuguucucugcacaaagcc

SEQ ID NO: 112815 - RNA, 64 nt, hsa
ucccugcccucuggugccagccuccuuaccaucacggcuucacugagguguagguggguuuuuc

SEQ ID NO: 112816 - RNA, 64 nt, hsa
agaacuugcugccuugccuguggggggucccauccggcuucagagagcucuggcuggcauugac

SEQ ID NO: 112817 - RNA, 64 nt, hsa
acaagggcuacgaccuggucuacagcccccagagcggcuucaccugcguguccccgugcaguag

SEQ ID NO: 112818 - RNA, 64 nt, hsa
cagccucugcucacacccgccccagcuucugccacggcuucagucagggccaggaggaacacgu

SEQ ID NO: 112819 - RNA, 64 nt, hsa
ggaccuccaucagagccagucucaccuucaaccgcggcuucaaggcugggaggaacaugcgucg

SEQ ID NO: 112820 - RNA, 64 nt, hsa
cggcucuccuuugagaaggagaccuuagcuuccccggcuucaaguagaacagaagcccguuucc

SEQ ID NO: 112821 - RNA, 64 nt, hsa
ucuccuuuuccucucucccggagguugggugggccggcuucaugccagcuacuuccuccucccc

SEQ ID NO: 112822 - RNA, 64 nt, hsa
gaccugacauacaggcggcuccagcccugggcagcggcuucaagagccagagugggaagucagg

SEQ ID NO: 112823 - RNA, 64 nt, hsa
acauaaagcauugaaaauuccggugcuugggcuucggcuucagaguaacgucaguggcuuaggg

SEQ ID NO: 112824 - RNA, 64 nt, hsa
agggaagaaaacuuuggauuugcugggucugaaucggcuucauaaacuccacugggagcacugc

SEQ ID NO: 112825 - RNA, 64 nt, hsa
ccugcaagggccgacaacgcaggggacaccgugccggcuucagacacucccagcgcccacucuu

SEQ ID NO: 112826 - RNA, 61 nt, hsa
ggggacaccgggucuccugaggccaguugggcggcuucagccccgggccuccaaccauguc

SEQ ID NO: 112827 - RNA, 64 nt, hsa
uacaauuugccauuguuucuccuggguuaggccccggcuucacugguugaguguugcucucuag

SEQ ID NO: 112828 - RNA, 64 nt, hsa
guuuaauucuucauagcugaaagcacaaauuuaacggcuucacuggacaguuuuccuuagaagg

SEQ ID NO: 112829 - RNA, 64 nt, hsa
aagggccuuuggauccuggacaaagcuuggcugccggcuucauuuauuccugcugauggcugag

SEQ ID NO: 112830 - RNA, 64 nt, hsa
uguuuauaguaaucuaaggguugggcaguuaaaacggcuucaggauagaaagcuguuucccacc

SEQ ID NO: 112831 - RNA, 64 nt, hsa
uguuuauaguaaucuaaggguugaacaguuaaaacggcuucaggauagaaagcuguuucccacc

SEQ ID NO: 112832 - RNA, 64 nt, hsa
uggugguggaggccgcacagaaggccaaugcccacggcuucaucauggaacuccaggacggcua

SEQ ID NO: 112833 - RNA, 64 nt, hsa
acgaggacgacugacguccuccccacuucagauucggcuucaggaaaacguuuagcgaaaagaa

SEQ ID NO: 112834 - RNA, 64 nt, hsa
ugcccgggaggccugcuggccccgccucggcuuucggcuucaucacauugggagguucagagca

SEQ ID NO: 112835 - RNA, 64 nt, hsa
cugccucuucuaccugcgggacuggacugcucuccggcuucagaagcugcuacaggucagaggu

SEQ ID NO: 112836 - RNA, 64 nt, hsa
uuguggauugcauguugacauugaccgugagauucggcuucaaaccaauacugccuuuggaaua

SEQ ID NO: 112837 - RNA, 64 nt, hsa
aagcagagggucccaaccgccugcuguacaaagacggcuucagcaccauccugcaccugcugcu

SEQ ID NO: 112838 - RNA, 64 nt, hsa
acccucccccggacucgacaggagccuggaccuccggcuucauuucaccccugcugggaggcca

SEQ ID NO: 112839 - RNA, 64 nt, hsa
auuuuguuguuguuguuguuggcucuuuugcacacggcuucaugccauaaucuuccacucaagg

SEQ ID NO: 112840 - RNA, 64 nt, hsa
agugucccaagccgggagccaacgaagccggacacggcuucacugaccagcggcugcucaagcc

SEQ ID NO: 112841 - RNA, 64 nt, hsa
cccgagcaagggucgucggcauccaggccugugccggcuucacguggcgggaagacccucugca

SEQ ID NO: 112842 - RNA, 64 nt, hsa
gagguugcuauaaaacgagcauuuggagggcccacggcuucacucaggaccugcugggcuugug

SEQ ID NO: 112843 - RNA, 64 nt, hsa
aggugguggggacuaggggagccugguauacaugcggcuucauugccaauaaauuucaugcacu

SEQ ID NO: 112844 - RNA, 64 nt, hsa
gcagaagccguuccgugucucuugcaggcugggccggcuucaugccagugcgagggcgucccgu

SEQ ID NO: 112845 - RNA, 64 nt, hsa
aagugaugggauuacaggcaugagccaccgugcccggcuucacacccauuucuuuaaaaaggau

SEQ ID NO: 112846 - RNA, 64 nt, hsa
agucuucuguuuuggccaguugucuggucaaaaucggcuucagugauugugggaggggcaagaa

SEQ ID NO: 112847 - RNA, 64 nt, hsa
aggaggccgacagucacagcacugcacuguggugcggcuucaugugauaugacaguggaugcua

SEQ ID NO: 112848 - RNA, 64 nt, hsa
uaggaaccguacaucccaucugcucucuggccaacggcuucacaccuuccccugcugcaugugg

SEQ ID NO: 112849 - RNA, 64 nt, hsa
agaagggacagggagucagauccccucaaccccccggcuucagggaccccagaagugccuucca

SEQ ID NO: 112850 - RNA, 58 nt, hsa
ccauuaugaacuccucuuaagaagacgacggcuucaggcccggcuaacucuggcaccc

SEQ ID NO: 112851 - RNA, 64 nt, hsa
ggcagccgccucccuuaugcaggacaugugcucucggcuucaccaggguucugaccgggucugc

SEQ ID NO: 112852 - RNA, 64 nt, hsa
cccugcacuggaucgugaggacgcugcgggccagcggcuucagcucggaggcggacguccccac

SEQ ID NO: 112853 - RNA, 64 nt, hsa
auuucuaggucacuggggacuccggcagcacauucggcuucagaauaaagggcgcccgcggucc

SEQ ID NO: 112854 - RNA, 51 nt, hsa
ccaccaucgugaaagaguagccggcuucagugccugccuuggggugaggaa

SEQ ID NO: 112855 - RNA, 64 nt, hsa
auuucucuugaggaaacuuaccaccuugguugagcggcuucauggcagacagcagcgagccagc

SEQ ID NO: 112856 - RNA, 64 nt, hsa
cccuuucuccaguaggccccagcccagaccucuucggcuucaggaacuugccucgcccugcaac

SEQ ID NO: 112857 - RNA, 64 nt, hsa
cacuaggucuggccuuggaaaucuguuacuucuacggcuucagaucugaugauaucuuuuucau

SEQ ID NO: 112858 - RNA, 64 nt, hsa; identical to SEQ ID NO: 70892

SEQ ID NO: 112859 - RNA, 64 nt, hsa; identical to SEQ ID NO: 70893

SEQ ID NO: 112860 - RNA, 64 nt, hsa; identical to SEQ ID NO: 70894

SEQ ID NO: 112861 - RNA, 64 nt, hsa; identical to SEQ ID NO: 70895

SEQ ID NO: 112862 - RNA, 64 nt, hsa; identical to SEQ ID NO: 70896

SEQ ID NO: 112863 - RNA, 64 nt, hsa; identical to SEQ ID NO: 70897

SEQ ID NO: 112864 - RNA, 64 nt, hsa; identical to SEQ ID NO: 70898

SEQ ID NO: 112865 - RNA, 64 nt, hsa; identical to SEQ ID NO: 70899

SEQ ID NO: 112866 - RNA, 64 nt, hsa; identical to SEQ ID NO: 70900

SEQ ID NO: 112867 - RNA, 64 nt, hsa; identical to SEQ ID NO: 70901

SEQ ID NO: 112868 - RNA, 64 nt, hsa; identical to SEQ ID NO: 70902

SEQ ID NO: 112869 - RNA, 64 nt, hsa; identical to SEQ ID NO: 70903

SEQ ID NO: 112870 - RNA, 64 nt, hsa; identical to SEQ ID NO: 70904

SEQ ID NO: 112871 - RNA, 64 nt, hsa; identical to SEQ ID NO: 70905

SEQ ID NO: 112872 - RNA, 64 nt, hsa; identical to SEQ ID NO: 70906

SEQ ID NO: 112873 - RNA, 64 nt, hsa; identical to SEQ ID NO: 70907

SEQ ID NO: 112874 - RNA, 64 nt, hsa
gugaguccauguggagagagcacugugugcgcagcggcagcagcacagacguccaugaggaaaa

SEQ ID NO: 112875 - RNA, 64 nt, hsa
gaaccacuacuaucauucacuagcucauaucugccggcagcaauugaagagauccaauauuuga

SEQ ID NO: 112876 - RNA, 64 nt, hsa
ccacugaagaggucuguacagugacaacccgggccggcagcaaggacacagaugcagccacagu

SEQ ID NO: 112877 - RNA, 64 nt, hsa
agucccagggaaugaaugguggucuccccacucccggcagcacuuuaggcagcccauaagcuau

SEQ ID NO: 112878 - RNA, 64 nt, hsa
gcccugggcaucacugagcagaggggugcggcagcuucaggaggcagaaacgagagggguggga

SEQ ID NO: 112879 - RNA, 64 nt, hsa
aggcagggaggugagggcaggugccccucagacacuucaggaagguaguuugcauucuauuuaa

SEQ ID NO: 112880 - RNA, 64 nt, hsa
aguguggauucuuucuaucaacugcugauaucaucuucaggaagcaaguccauaacaugacaua

SEQ ID NO: 112881 - RNA, 56 nt, hsa
aagaauuaguuaaaugcugaagaagccuucaggaauccaaauccugaacauuugga

SEQ ID NO: 112882 - RNA, 64 nt, hsa
uguacaguuugcauuaaacaucccaggucucauccuucaggaauuuugcaguucaaugagaaga

SEQ ID NO: 112883 - RNA, 64 nt, hsa
uuuuauuugugauuuuuuuuuuuuuuuuuugguacuucaggauagcaaauaucuaucugcuauu

SEQ ID NO: 112884 - RNA, 64 nt, hsa
ggcagggcuagcaacaucguagguguuuauuaggcuucaggaucuuucccaugaacuugugaua

SEQ ID NO: 112885 - RNA, 64 nt, hsa
cuugcucuuccuuauguccaaugucuguccuccucuucaggacaugcuccauuuauuuuccaug

SEQ ID NO: 112886 - RNA, 64 nt, hsa
caacccauggagaacaagccucaacuaacaaacccuucaggaagcauauaccggggaaugugua

SEQ ID NO: 112887 - RNA, 64 nt, hsa
cccuucaggaagcauauaccggggaauguguagccuucaggaaaaaaaugccaauugacacaaa

SEQ ID NO: 112888 - RNA, 64 nt, hsa
auuuuuguuuagcauuuagaaccuguuaaacuagcuucaggaaguaauuuugauuguuuuaucu

SEQ ID NO: 112889 - RNA, 64 nt, hsa
gggaauuucacaucccuagaggcugccaaaauagcuucaggaagaaauuuuuacaaucuuauca

SEQ ID NO: 112890 - RNA, 64 nt, hsa
cugccacagggguauucugccuucaggacucugccuucaggaacacgggucuguagagggucug

SEQ ID NO: 112891 - RNA, 64 nt, hsa
ucugagcugugccacugccacagggguauucugccuucaggacucugccuucaggaacacgggu

SEQ ID NO: 112892 - RNA, 64 nt, hsa
gccagagcucaagaagcugcugcacgggcugggccuucaggacccagagggcuuccuauucaag

SEQ ID NO: 112893 - RNA, 64 nt, hsa
cugccaccagaaacuggaggacaugauccaggagcuucaggagaccccaucgcagacgucagug

SEQ ID NO: 112894 - RNA, 64 nt, hsa
agacgcaauuggaaggucgggagguuuuccaaagcuucaggagagaauaaagcugaaggcagcu

SEQ ID NO: 112895 - RNA, 64 nt, hsa
agaauacuccuuucauccaucacucagccagagucuucaggacagacuccgcaugggacuuguc

SEQ ID NO: 112896 - RNA, 64 nt, hsa
ugaagaaaaggagagguagauacagucagugucacuucaggaaagcuauuuaaaaaaacuugaa

SEQ ID NO: 112897 - RNA, 64 nt, hsa
ugaagaaaaggagagguagauacagucagugucacuucaggacacuuagguuuuuuuuguauaa

SEQ ID NO: 112898 - RNA, 64 nt, hsa
guaugucaagcaacuggacacagugcugccucugcuucaggacuuaacaugcugauccagcugu

SEQ ID NO: 112899 - RNA, 64 nt, hsa
aguuccaugaauauuaaaugagauuauuucugcucuucaggaaauuucugcaccacugguuuug

SEQ ID NO: 112900 - RNA, 64 nt, hsa
ggacacagccaaaccauaucauucuaccccuggcaccuccaaaucucauguccucacauuucaa

SEQ ID NO: 112901 - RNA, 64 nt, hsa
aaguccaaaauucagcagggcagucaaauuuuaaaccuccaaaaugaucaccuuugacuccacg

SEQ ID NO: 112902 - RNA, 64 nt, hsa
gggauuaguuccggagacugagacuguuggcuccaccuccaagcugagcuaggguggagggcag

SEQ ID NO: 112903 - RNA, 64 nt, hsa
acgugcccuauaauggcugcaucccuuuugagcaaccuccaaaaucuacauuuacacaguaggu

SEQ ID NO: 112904 - RNA, 64 nt, hsa
uggguccccuaguuaggcccagauaaaaauccaguuggcugaggguuuuggaugggaagggaag

SEQ ID NO: 112905 - RNA, 64 nt, hsa
cuccuccugggacagggcuggguccucuggcuauuuggcugagaaggggccaggccaagggccg

SEQ ID NO: 112906 - RNA, 64 nt, hsa
ugaaauacaggggugcauaccaucuugcaguggcuuggcugacauugccucuuuguccuggccu

SEQ ID NO: 112907 - RNA, 64 nt, hsa
aggaaagcaguguguaauuuuggauugccugcccuuggcugaaauacaggggugcauaccaucu

SEQ ID NO: 112908 - RNA, 64 nt, hsa
guuagaacaucuggucucgcugguuagugccucguuggcugaggacuaggugugcauuucuccu

SEQ ID NO: 112909 - RNA, 64 nt, hsa
auaaaaccaauucauuauuuguccagaaggaagcuuggcugagcuggccuuuuaacauaggaau

SEQ ID NO: 112910 - RNA, 64 nt, hsa
auaaggcuaaaaauaacuggugcgcucccuuguguuggcugacacgcgcguucaaagcacuuuu

SEQ ID NO: 112911 - RNA, 64 nt, hsa
gccucccguguuggguagaaauuugguggaucuguuggcugaaaagacggacuugcuugccucu

SEQ ID NO: 112912 - RNA, 64 nt, hsa
ccauaucaggaagggcuuugggauggcaccuauauuggcugauaauugaggaugcaaacauucc

SEQ ID NO: 112913 - RNA, 64 nt, hsa
guuuauauaagaauugcuaaagcugaaguucaacuuggcugagugaagauaaucauagguugug

SEQ ID NO: 112914 - RNA, 64 nt, hsa
gucugcugucucagaggccuuggucaggaugaaguuggcugacacagcuuagcuugguuuugcu

SEQ ID NO: 112915 - RNA, 62 nt, hsa
gagauaaaaacugauuaaaccuuuguggcugugguuggcugacauggggucuguguuucacu

SEQ ID NO: 112916 - RNA, 64 nt, hsa
ggccaggaucccgcagggcaacagccccaucugcuuggcugaccccacacccaggaccacuguc

SEQ ID NO: 112917 - RNA, 64 nt, hsa
auuggcaggacaagugggagcagauggccugccuuuggcugagagggcuaccugcccagccccu

SEQ ID NO: 112918 - RNA, 64 nt, hsa
aagacccagguacccagccauaaagccacauugaguagucuaucccauaggauugacuacugca

SEQ ID NO: 112919 - RNA, 64 nt, hsa
uagaacugugaagaaagcaggaaaguagugcacaguagucuaagauuauuaccuucauuaauac

SEQ ID NO: 112920 - RNA, 64 nt, hsa
gcccaugacuugaacaacuguguuuuaaaguacuguagucuaguagguaacuuuguggcaaaaa

SEQ ID NO: 112921 - RNA, 64 nt, hsa
aaaauaaugagaacaagcuguugcaagcucuuuuguagucuauugaauauuuuauagauauuca

SEQ ID NO: 112922 - RNA, 64 nt, hsa
ucucauuccauuucugccuuaacuuuaguuuguucacagggaggcaaagcugacaugaaccuuu

SEQ ID NO: 112923 - RNA, 64 nt, hsa
cagacaucugcuccaucagaccucuuccauuuugcacagggagugcaggaggugaauguucacu

SEQ ID NO: 112924 - RNA, 64 nt, hsa
caggagaagaagagggagaaacuguccagggccucacagggaggcauucauggagcuggagaaa

SEQ ID NO: 112925 - RNA, 64 nt, hsa
auuccagccaguuggaucucacagcacagcuauccacagggagacugggauguucacgcagcac

SEQ ID NO: 112926 - RNA, 64 nt, hsa
ugugugugucucagucccuguaagucauguccuucacagggagaauuaacccuucgauauacau

SEQ ID NO: 112927 - RNA, 64 nt, hsa
uggccugcucuucccauguuggccucugcaaccacacagggauauuucugcuaugcaccagccu

SEQ ID NO: 112928 - RNA, 64 nt, hsa
ucaucuggcacacaacuguccaagcucucagccccacagggaaccugcccagagagcuuuaccu

SEQ ID NO: 112929 - RNA, 64 nt, hsa
aggaggauuccaccauggucacugcccauccagucacagggauucuguguagggaagcaccacu

SEQ ID NO: 112930 - RNA, 64 nt, hsa
acagggacagguucugucaugggugacacgaggacacagggacagguucuaucaugggugacac

SEQ ID NO: 112931 - RNA, 64 nt, hsa
acagggacagguucugucgggggugacaccaggacacagggacagguucugucaugggugacac

SEQ ID NO: 112932 - RNA, 64 nt, hsa
agagggacagguucugucaggggugacaccaggacacagggacagguucugucgggggugacac

SEQ ID NO: 112933 - RNA, 64 nt, hsa
uugcuuugagucaggcugugggcaaguuccugaccacagggaguaaauuggccucuuugauaca

SEQ ID NO: 112934 - RNA, 64 nt, hsa
auagggaaggagcagggaugagacuggcaauggucacagggaaagauguggccuuuugugaugg

SEQ ID NO: 112935 - RNA, 64 nt, hsa
agaggucuggcauguggaaaccuuggaucucggucacagggaggaaggcagcuagaaaugggag

SEQ ID NO: 112936 - RNA, 64 nt, hsa
guccuuggcugcugccgucagaggcagcccccugcacagggaggggcugauccugccucagcug

SEQ ID NO: 112937 - RNA, 64 nt, hsa
agccggauuuaaagcagucacuucagacaggagccacagggagccugugagggaguagugcggu

SEQ ID NO: 112938 - RNA, 64 nt, hsa
gaaaccgcuucugagcggggcacuucggcugcuccacagggaaggcgacacugaaagcugaguc

SEQ ID NO: 112939 - RNA, 64 nt, hsa
gcccucuccuugaccuugagaugaaggucaagagcacagggaccaggccuugguuaggcugagc

SEQ ID NO: 112940 - RNA, 64 nt, hsa
agagccgugccacccacccucccacacagccggccacagggagaacuggugcuaaccagggugc

SEQ ID NO: 112941 - RNA, 64 nt, hsa
cuuuggucacguucaacgcacuacagagcuacgacacagggaaaccuuaggagcaaauaaaccg

SEQ ID NO: 112942 - RNA, 64 nt, hsa
ggaaacuugggucuugcugcccauccuuccucagcacagggaacccggaagcccguugcacuga

SEQ ID NO: 112943 - RNA, 64 nt, hsa
uucgugcauacaugcggggaccccagacugucagcacagggaagauggaucccauccuaauuuu

SEQ ID NO: 112944 - RNA, 64 nt, hsa
cagugcaagggagaaccugccagcccagccccaccacagggagagugcgucagcagaccugucc

SEQ ID NO: 112945 - RNA, 64 nt, hsa
cccucggagggccaggcaacaggcuagcaaggcccacagggagggagcagaauggagagggcau

SEQ ID NO: 112946 - RNA, 64 nt, hsa
gccuguggguggcacgagcaaggacugacauccgcacagggaggauugucuguuuggcugacac

SEQ ID NO: 112947 - RNA, 64 nt, hsa
acagcagcagcccuucccacccagccaccuuccucacagggacuaggaggcucaguccccaacg

SEQ ID NO: 112948 - RNA, 64 nt, hsa
cauaagugggaauugaacaaugagaauacauggacacagggaggggaacaccacacccuggggc

SEQ ID NO: 112949 - RNA, 64 nt, hsa
augcagccauagaaaaggaugaguucauauucuucacagggacauggaugaagcuggaaaccau

SEQ ID NO: 112950 - RNA, 64 nt, hsa
agagaugcacuccgcucuggaacucacucucagccacagggagcugcaugcaccacaggggcaa

SEQ ID NO: 112951 - RNA, 64 nt, hsa
aggauguaugggcaaagcuuuugugaucacacaccacagggagaaucugcauguggggacacug

SEQ ID NO: 112952 - RNA, 64 nt, hsa
ccuguuguacucuguccccucaugacuuuuuagacacagggacuaggacaucgaccacccucug

SEQ ID NO: 112953 - RNA, 64 nt, hsa
cgcuaacauguggggugcccucuguaggccuucacacagggaaggaagcccuacccuuucaacu

SEQ ID NO: 112954 - RNA, 64 nt, hsa
ccagggccaucuccucccaccaguggcccccacucacagggagcuggcaaugcccuaccugccu

SEQ ID NO: 112955 - RNA, 50 nt, hsa
gcuaccgcauccgcccaugacacagggagcagauggauccacgugcucgc

SEQ ID NO: 112956 - RNA, 64 nt, hsa
cgaugucaucuuuucuaaaagagacaaaugaagccacagggaaagugaaauaaagccuugaacc

SEQ ID NO: 112957 - RNA, 64 nt, hsa
agcugugaauggccggugauguaugucaggaggccacagggagcagaggagcggggcaggcagc

SEQ ID NO: 112958 - RNA, 64 nt, hsa
gauacaaacacuacagacaauaaauauuaggagacacagggaaguggggagagguggggaguaa

SEQ ID NO: 112959 - RNA, 64 nt, hsa
agggaaguggggagagguggggaguaauaguaaacacagggaagagcuccccuacggaccaggu

SEQ ID NO: 112960 - RNA, 64 nt, hsa
cuccaaggguguguguaugucuccguggaucagccacagggauagggauuuuguuuuuaaggga

SEQ ID NO: 112961 - RNA, 64 nt, hsa
cuaccuggcucuaucucacuggcugcauucccuacacagggaauuuacuacccuauaugugaau

SEQ ID NO: 112962 - RNA, 64 nt, hsa
guagacgggcugucuugccaggccucagccccgucuacccuaagccuggccccaaagguuucuc

SEQ ID NO: 112963 - RNA, 64 nt, hsa
agugucucagugccuucaaaacccacccccaccccuacccuaccccaccacaccccaucccaga

SEQ ID NO: 112964 - RNA, 61 nt, hsa
aucccugcuggucauaggaaaacacacgguucuaauuaagugugaagguauagcuauugca

SEQ ID NO: 112965 - RNA, 61 nt, hsa
cuguuauguauaugcuaaauguugguaaauacuaauuaauuuccaucauuuguagacuugu

SEQ ID NO: 112966 - RNA, 61 nt, hsa
ucaccccauauuguucuuaaauaaguauagacuaauuaaccuaagcuaccuuuaacaacgu

SEQ ID NO: 112967 - RNA, 61 nt, hsa
uaggcaugagccaccgugcccagccuacuuucuaauuaauuaaaaaaaaaaaaaaaaaaaa

SEQ ID NO: 112968 - RNA, 61 nt, hsa
auuaaaagcauaguguauaagugaguacacucuaauuaacuugcuucuguugcacuuuagu

SEQ ID NO: 112969 - RNA, 61 nt, hsa
auaaauuaucaauuacacauuuuuguguuaacuaauuaaaagcauaguguauaagugagua

SEQ ID NO: 112970 - RNA, 61 nt, hsa
gcaccacuguucuguucauuuccuagcuguucuaauuaagaaaacuauuaagaugagcaac

SEQ ID NO: 112971 - RNA, 61 nt, hsa
uuauugacaggucuuuucaaauaaugcuuuucuaauuaauagccaaagauuucauaucuaa

SEQ ID NO: 112972 - RNA, 61 nt, hsa
agcauguuuauaucugcaaaaaaccuaauagcuaauuaaucuggaauaugcaacauugucc

SEQ ID NO: 112973 - RNA, 61 nt, hsa
acccuguuaugucuugcuaauuuaaauuuugcuaauuaacugaaacaugcuuaccagauuc

SEQ ID NO: 112974 - RNA, 61 nt, hsa
cuuuuaucuugauaacuccuagugagggaaucuaauuaagauuucaugcuguucuuuguaa

SEQ ID NO: 112975 - RNA, 61 nt, hsa
guuuauuuccaaggcauguauuauucaauuucuaauuaaaauauaucagggcuuauauuuu

SEQ ID NO: 112976 - RNA, 61 nt, hsa
cagccuaauuaaggacauagaaaauugaccucuaauuaaguggaucauuauuauggcauuu

SEQ ID NO: 112977 - RNA, 61 nt, hsa
uacuuuuuauguaucauugcuagguuccagccuaauuaaggacauagaaaauugaccucua

SEQ ID NO: 112978 - RNA, 61 nt, hsa
gcagaugagcuuacaaguauugaaauaauuacuaauuaaucacaaaugugaaguuaugcau

SEQ ID NO: 112979 - RNA, 61 nt, hsa
aguuaugcaugauguaaaaaauacaaacauucuaauuaaaggcuuugcaacacaugccuug

SEQ ID NO: 112980 - RNA, 61 nt, hsa
ccccuccauuuuuuguguuuugccuccuguucuaauuaauuuugucuccauacauaucuga

SEQ ID NO: 112981 - RNA, 61 nt, hsa
uuccccgagaguguaaagagaucggaaauaacuaauuaaacaaauccgccacuuucaugac

SEQ ID NO: 112982 - RNA, 61 nt, hsa
cagaccaauaaugaguuccaaaauuuaaucacuaauuaaaaaucuaucaaacaaaacucug

SEQ ID NO: 112983 - RNA, 61 nt, hsa
ugcaacaaaaacaaaaauugacaagugggaccuaauuaaacuaaauaacuucugcacagca

SEQ ID NO: 112984 - RNA, 61 nt, hsa
cuguaauauaaaacuuagaaguaaaccacugcuaauuaaucauuuuaaacuuucaaaaacu

SEQ ID NO: 112985 - RNA, 61 nt, hsa
aauuaauuacaaucugguuguuuagccuaugcuaauuaagcccucuuaguaguaguauuca

SEQ ID NO: 112986 - RNA, 61 nt, hsa
accauguuaauacaucauuuuuuguuucuuccuaauuaacaaaagggcucuauaaugauua

SEQ ID NO: 112987 - RNA, 61 nt, hsa
auuucaauuuuuaaauuucuuggugcuuugucuaauuaauuacaucccauaacuugucagg

SEQ ID NO: 112988 - RNA, 64 nt, hsa
ucuaggccuuacuggaagccacugauaggggacacuucacuaccagaugugugcagugcaacag

SEQ ID NO: 112989 - RNA, 64 nt, hsa
augugaauauuuaaggucugugacuauaguuaaacuucacuaagaauuugcagaauuguuuuga

SEQ ID NO: 112990 - RNA, 64 nt, hsa
agcagcaagacaaauuagccauuucacucucaaacuucacuaaugaucacauucuuuccaaaag

SEQ ID NO: 112991 - RNA, 64 nt, hsa
aaacacagauuguguuuuucuuugguuuuguuuucuucacuaugggaucuucugugcccagcac

SEQ ID NO: 112992 - RNA, 64 nt, hsa
acuaaaaugcauuccugcaauucuguuugcagugcuucacuaaacauugaaauaaaguuguaaa

SEQ ID NO: 112993 - RNA, 64 nt, hsa
cuucuguguauuaaacuacgaauuacaaauaucacuucacuaaccacuauaauuauuuuuggcu

SEQ ID NO: 112994 - RNA, 64 nt, hsa
auuuggguagcuucaaacucaaauugaagagagucuucacuacaaucuucacuacaaccuuugg

SEQ ID NO: 112995 - RNA, 64 nt, hsa
ucaaacucaaauugaagagagucuucacuacaaucuucacuacaaccuuuggccuuccucucua

SEQ ID NO: 112996 - RNA, 64 nt, hsa
gcaugaguuaggacaaacucuaaaaauucauauucuucacuauucuuguuuuccuuugauugau

SEQ ID NO: 112997 - RNA, 64 nt, hsa
guucucuuuuugaaaugaauuugugcuuaacugucuucacuauuaauacuauuuagaaauaagc

SEQ ID NO: 112998 - RNA, 64 nt, hsa
uguaucccagcauacuuugugaaccuggcuccuucuucacuaccucagaucuaaucaauuaguc

SEQ ID NO: 112999 - RNA, 64 nt, hsa
uaucagagauuuuuauauuuauacaaaagauuacuaaaugaaggauugcuaaauguuuuugguu

SEQ ID NO: 113000 - RNA, 64 nt, hsa
aucaagcauauacuguauacaguuagaaaguuauuaaaugaacauuuuacucauugaucuguaa

SEQ ID NO: 113001 - RNA, 64 nt, hsa
gaccugacauuaaauccucuugauuagaaauaauuaaaugaauuauuuauucauuucucuccuc

SEQ ID NO: 113002 - RNA, 64 nt, hsa
uucucuugcucccucauucacuagggcaaaugucuaaaugaagaaaagucucucucaacaccuc

SEQ ID NO: 113003 - RNA, 64 nt, hsa
gugguuuccagauuggagcgagguuauucugaucuaaaugaacagcauuuuuuuccuuagccuc

SEQ ID NO: 113004 - RNA, 64 nt, hsa
ucccagaagggcacaaaaugaaugaauaaauaaauaaaugaauaaagacaaaagccaaggugua

SEQ ID NO: 113005 - RNA, 64 nt, hsa
agagaaguaauaaaccuauugauuucucugcuuauaaaugaaagauugaaacuauccaaugaca

SEQ ID NO: 113006 - RNA, 64 nt, hsa
guaucuguaaccucccacugcaucagaagcagguuaaaugaagucuugugaauuuguaauagau

SEQ ID NO: 113007 - RNA, 64 nt, hsa
uacuuuagcauugaagccacuuugaaaccugagauaaaugaaugugagguaucuuuucugcuuu

SEQ ID NO: 113008 - RNA, 64 nt, hsa
uguaauucuuguaauauguugauucaguguuuuguaaaugaagucguauguauuuucagaguau

SEQ ID NO: 113009 - RNA, 64 nt, hsa
uggaacaugccucugcauuucugaguguagaaauuaaaugaagccacucacaguccuuugauuu

SEQ ID NO: 113010 - RNA, 64 nt, hsa
caggcuuaggacucugugccaaaaaucucuauuuuaaaugaaaauauuuauauaaaaauacauu

SEQ ID NO: 113011 - RNA, 64 nt, hsa
guugguuguaacaaaauuugauuugaacuaccuauaaaugaaaagucgggguuuauuacuuuau

SEQ ID NO: 113012 - RNA, 64 nt, hsa
uuuuagaauccuuugaaucuaaguauuuguuuccuaaaugaaacauuuguacaacauuugaugu

SEQ ID NO: 113013 - RNA, 64 nt, hsa
uuccauacauacugcaaaugauugacuuguugcauaaaugaagaucuucuguugugugcuuuuc

SEQ ID NO: 113014 - RNA, 64 nt, hsa
cguucuucccccuuaacugugaaagcagagucuauaaaugaacucuuugcucuuacaagguaau

SEQ ID NO: 113015 - RNA, 64 nt, hsa
cacuuuucaucuugguaauaucaaaacaacuuuuuaaaugaacugauugauauauguuauuucu

SEQ ID NO: 113016 - RNA, 64 nt, hsa
aucugauaaucuguugguuuauuucacuuuucauuaaaugaacauugaugagagaagaugccac

SEQ ID NO: 113017 - RNA, 64 nt, hsa
uguaaaaaacaacagcaaacaaaaaggugaagucuaaaugaagugcacagccaaagucauguau

SEQ ID NO: 113018 - RNA, 64 nt, hsa
agaaaauguugugcuguauguucuugauuugacauaaaugaauagacuuuggcaagggaggaaa

SEQ ID NO: 113019 - RNA, 64 nt, hsa
gcccuaauggaggaagucgggcaaauugaaaguauaaaugaaugggccaugaguguucagaggg

SEQ ID NO: 113020 - RNA, 64 nt, hsa
caugccacaaauauuuauuuggaaaaguagucauuaaaugaacccacugccuuaaaugucuuga

SEQ ID NO: 113021 - RNA, 64 nt, hsa
uaucuauaucuauauauuuuuaaucaucuacauguaaaugaagcaauagaauucuaacauaagg

SEQ ID NO: 113022 - RNA, 64 nt, hsa
guuuagcagugaucacaucuaaacaaaguuuagguaaaugaauuaucgcagagaaaaaccacau

SEQ ID NO: 113023 - RNA, 64 nt, hsa
uuagugucaauauuuauauuuagauuaauuuuuauaaaugaaaauauuuuaaugguuuaagaaa

SEQ ID NO: 113024 - RNA, 64 nt, hsa
aucauccagcucaguguggggcguggcagggggguaaaugaagccagccaauguguuaaccugu

SEQ ID NO: 113025 - RNA, 64 nt, hsa
ggguaauuaguuuaaaaaucugugauuacauuuuuaaaugaaauuuucaaaguggccuagauug

SEQ ID NO: 113026 - RNA, 64 nt, hsa
agaaagcagaaagaaggaaagccuagaacagaaauaaaugaaauagagaauagaaaagcaauac

SEQ ID NO: 113027 - RNA, 64 nt, hsa
aauacuaugaacaauugaaugccaacaaauuagauaaaugaaauggacaaauuccuaggaagac

SEQ ID NO: 113028 - RNA, 64 nt, hsa
cuuauauaaaaucucaagauaaaaaaacacuucuuaaaugaaguauagaauuugacucauacuu

SEQ ID NO: 113029 - RNA, 64 nt, hsa
ugauaaauuauuaagauuaagauuauuuaugugauaaaugaaaucuccuaccaauccauccagc

SEQ ID NO: 113030 - RNA, 64 nt, hsa
auguuaauuucucuguagguuguaacuuuaaaaauaaaugaaauuauuuaaggguuaugcugca

SEQ ID NO: 113031 - RNA, 64 nt, hsa
uggagauguccucuccacuuuaucccacgauaucuaaaugaaaaagaaagaaaacccacacaca

SEQ ID NO: 113032 - RNA, 64 nt, hsa
uuugcaugcuaaaugaaaauucaaaacuugccaauaaaugaauagcuuauugcagacauuuuuu

SEQ ID NO: 113033 - RNA, 64 nt, hsa
uaugugguuuaucacauguagcucuuuugcaugcuaaaugaaaauucaaaacuugccaauaaau

SEQ ID NO: 113034 - RNA, 64 nt, hsa
aauagucccuccguucuccccuuugaccauguaauaaaugaaccagaagcacugagauuaaccu

SEQ ID NO: 113035 - RNA, 64 nt, hsa
ucaggcuggggagcacagaggggaggaggaggacuaaaugaaaaguuguucccagccugcacau

SEQ ID NO: 113036 - RNA, 64 nt, hsa
uugaacuaauuuauacuuuaaaguauuucuggguuaaaugaaacaaugaaauuuuuuaguaugu

SEQ ID NO: 113037 - RNA, 64 nt, hsa
uuagugaagcauaaaguuaccuacaucaauuaauuaaaugaacuuauguacagaaaacauguau

SEQ ID NO: 113038 - RNA, 64 nt, hsa
uaaagcuauaaaauucaauaacuuuuuagaauguuaaaugaagacacuguuuccuaacaucagu

SEQ ID NO: 113039 - RNA, 64 nt, hsa
aagugcugcugauaugauacaaguagacaaaauuuaaaugaaauuuugucacauucuauggaaa

SEQ ID NO: 113040 - RNA, 64 nt, hsa
caacucauugucuccaccagauaguauuuuucuguaaaugaaaugcugacuucgccucuuccug

SEQ ID NO: 113041 - RNA, 64 nt, hsa
gauugacuuacuaccuaacacugagcgcuguuuuuaaaugaaaagaaugagauuuauaaccacu

SEQ ID NO: 113042 - RNA, 64 nt, hsa
uugaccuucugauugaauauaagcacaaccauauuaaaugaaucaauacaagaaaauuauuucu

SEQ ID NO: 113043 - RNA, 64 nt, hsa
gaaaagggcaaaaucgcuucaguuaaacugaaauuaaaugaacaauaaggcaacuauauaagua

SEQ ID NO: 113044 - RNA, 64 nt, hsa
ccagaugacccuugaaguagucauuauguagcaauaaaugaagccugaaacagguuuuuuuacu

SEQ ID NO: 113045 - RNA, 64 nt, hsa
uauuuucauugacaccaguguauaaguauaaauuuaaaugaacuaauuacuuuugcauauuuua

SEQ ID NO: 113046 - RNA, 64 nt, hsa
auuaaugagacaugaauugugucucaacagaaacuaaaugaacauuucagaauaaauuauugcu

SEQ ID NO: 113047 - RNA, 64 nt, hsa
gugacugaugauacaugcauacauauuuguugaauaaaugaaaauuuauuuuuagugauaagau

SEQ ID NO: 113048 - RNA, 64 nt, hsa
uuuuucaaagaaacuuaaaguaaugcccaauuauuaaaugaacacaagagcugagaugucacau

SEQ ID NO: 113049 - RNA, 64 nt, hsa
cuuuuauguauaacuuuaaugauuuauaagaugcuaaaugaauuguuuuuguaccuaaccauug

SEQ ID NO: 113050 - RNA, 64 nt, hsa
guggcaguugcugucugcaguuuacaauguauuguaaaugaagauuuuuuaaauucuaucuugc

SEQ ID NO: 113051 - RNA, 64 nt, hsa
ccccucucauaccaaaggaugacuguauauuucuuaaaugaagagacuuucauucuuuaaauau

SEQ ID NO: 113052 - RNA, 64 nt, hsa
uugggccccaaggauaaggcuacugauuugauacuaaaugaaucagcaguggauguagggauag

SEQ ID NO: 113053 - RNA, 64 nt, hsa
uccuaaaaguugucaacuccccacccuuggacuuuaaaugaaaauuuuauucaguccagcuauu

SEQ ID NO: 113054 - RNA, 64 nt, hsa
accacaaaugagucauuuuuaaaauaugcauuuuuaaaugaauggcuuuuacagauagguuaau

SEQ ID NO: 113055 - RNA, 64 nt, hsa
cuuugauuaauaaacuuaguuuaaucugaauauguaaaugaauacauuuuaaagacaaaacuug

SEQ ID NO: 113056 - RNA, 64 nt, hsa
auuuacuucuuugagaaaucuuuccuuagaugaauaaaugaaaguuuuaauuuuucaugauaua

SEQ ID NO: 113057 - RNA, 64 nt, hsa
cagaauaauagauaaaugauuuacauuguucuuuuaaaugaagaaauuugaaaugaauguuuuu

SEQ ID NO: 113058 - RNA, 64 nt, hsa
uuuaauuuuuuaaaugaaaccauauuuuaaguguuaaaugaaucaaugcucacauuaauuugca

SEQ ID NO: 113059 - RNA, 64 nt, hsa
uaguuuuugaaguguugaaguauuuuuaauuuuuuaaaugaaaccauauuuuaaguguuaaaug

SEQ ID NO: 113060 - RNA, 64 nt, hsa
ggguaacuuagaaggauggcaucuccauguagaauaaaugaagaaagggaggcccagccgcagg

SEQ ID NO: 113061 - RNA, 64 nt, hsa
uugcaggcugagucccuccaugcaaaaguggggcuaaaugaaguguguuaaggggucggcuaag

SEQ ID NO: 113062 - RNA, 64 nt, hsa
gcuuguauuuugcgaugaagaugugauacaucuuuaaaugaaaauauaccaaaauuuaguaggc

SEQ ID NO: 113063 - RNA, 64 nt, hsa
gaggguuuuacuuccuuguuaacauauaaaguuauaaaugaaggacaaggaggagauggaaaau

SEQ ID NO: 113064 - RNA, 64 nt, hsa
ugaaaccaauuuuuauccaccaucuaguccuuauuaaaugaaaccucacggauccuuuguuccg

SEQ ID NO: 113065 - RNA, 64 nt, hsa
ccaagaugcacaucgcuauuaacagccagagucauaaaugaaaugaaauugaagaauucauuca

SEQ ID NO: 113066 - RNA, 64 nt, hsa
auagagcucaugaaauacuguaacuuggggauuguaaaugaauggauacaauagguuaaggccc

SEQ ID NO: 113067 - RNA, 64 nt, hsa
acugugccuuaacguguuucuuaaacuuuuguaguaaaugaacauuugaaauccauuuugauaa

SEQ ID NO: 113068 - RNA, 64 nt, hsa
ggacucucuuagaaugagugauucaccugcuauuuaaaugaauuauuuagauuuuugacaaaga

SEQ ID NO: 113069 - RNA, 64 nt, hsa
agucuucuuauguaaaucacaugacucauguccguaaaugaacuaugaaagauaucgaucaguu

SEQ ID NO: 113070 - RNA, 64 nt, hsa
aaguuucaaaauagcaucacacaaaacauguuuauaaaugaacaggauguaauguacauagaug

SEQ ID NO: 113071 - RNA, 64 nt, hsa
augugaacauguagauguuuuguguguauuuuuuuaaaugaaaacucaaaauaagacaaguaau

SEQ ID NO: 113072 - RNA, 64 nt, hsa
gcaaaaaaaaaaaaaucccugaaauauucuucuauaaaugaauccuauuuccccagaguguuca

SEQ ID NO: 113073 - RNA, 64 nt, hsa
uauuuccccagaguguucaaggcauuuuucuaccuaaaugaauaccuaaaucuugaguagugua

SEQ ID NO: 113074 - RNA, 64 nt, hsa
uagccuucucuagcaacaucauuuucagacuaacuaaaugaaugcaguauacucuuuucuuugu

SEQ ID NO: 113075 - RNA, 64 nt, hsa
uagaauaauucaagauaggcaagaaggacagcaguaaaugaagaccauggaagaaaagaaggaa

SEQ ID NO: 113076 - RNA, 64 nt, hsa
gaagaguaaacuuuuccuaaaacacuuuauauuauaaaugaaaauaaauugcuaguuuauauuu

SEQ ID NO: 113077 - RNA, 64 nt, hsa
uuuucaucuacauguaauguguuauuaauuuuauuaaaugaaaacuaaucaccuucauguggaa

SEQ ID NO: 113078 - RNA, 64 nt, hsa
aaaauuuguucuuuugucaugaauuuauaauuccuaaaugaagaccagaaaguacaaauugcug

SEQ ID NO: 113079 - RNA, 64 nt, hsa
uuaugaugugcauuaggcugccccaucguguauauaaaugaagcagauuugauuuuuguauucu

SEQ ID NO: 113080 - RNA, 64 nt, hsa
aaaauaaccuauuguuagaaaauauguguuuuuauaaaugaauguaaaauaauuaaaugaauug

SEQ ID NO: 113081 - RNA, 64 nt, hsa
aaauauguguuuuuauaaaugaauguaaaauaauuaaaugaauugugaaauggauguuuaagaa

SEQ ID NO: 113082 - RNA, 64 nt, hsa
gaucuuggaaaugaauaagcuuugauaauauuuguaaaugaaccaaauuauuacugcuaccacu

SEQ ID NO: 113083 - RNA, 64 nt, hsa
aguacagcauuuucaacauauuggcaacauauuuuaaaugaaaacacuaaaacaauucuuagua

SEQ ID NO: 113084 - RNA, 64 nt, hsa
guuugugugcaacugcuucauugcuauuaauaguuaaaugaaaucugcauauucuggaucauag

SEQ ID NO: 113085 - RNA, 64 nt, hsa
augagcccugaaauacuguugacauuaacuuucauaaaugaagcauaacacuuacuaguuuaga

SEQ ID NO: 113086 - RNA, 64 nt, hsa
gccagccuaugcaacaucaugaaaccccacuuaauaaaugaaugaacgacuaagucuugcucaa

SEQ ID NO: 113087 - RNA, 64 nt, hsa
guauuuaaaagguagccauguagagacacaaaaauaaaugaagaagcuggacauggugggaugg

SEQ ID NO: 113088 - RNA, 64 nt, hsa
aaauaucuucccuauaucuaaacaaugcaaaaucuaaaugaauaaguggucagacuccuuaaug

SEQ ID NO: 113089 - RNA, 64 nt, hsa
ccauguauuuuggaaaagaaaaugauuucauuuauaaaugaacauacuaaaauagucauguaua

SEQ ID NO: 113090 - RNA, 64 nt, hsa
acagguuuggugucauuauaagagaaaucauuauuaaaugaagcaaguuaacacucuaagagaa

SEQ ID NO: 113091 - RNA, 64 nt, hsa
gcugagaaauuccacacaugaguauugugaugaguaaaugaauaaaacauuugcaaagaccuuu

SEQ ID NO: 113092 - RNA, 64 nt, hsa
cucuguugucucuucauauucuucuuccuuuuccuaaaugaaauuauauuauuucaacuacuaa

SEQ ID NO: 113093 - RNA, 64 nt, hsa
ugccuggcaguguuuguucaaaacuuguauuuaauaaaugaacaucugacuuacaaccuuuguu

SEQ ID NO: 113094 - RNA, 64 nt, hsa
guccagcauaugguagauacuuguaguguuugaauaaaugaaaccagcauuagagcuuuauaua

SEQ ID NO: 113095 - RNA, 64 nt, hsa
aaucacaaccuuggggccacaguugccuuauauguaaaugaaguguuuagaauaaaauaguuaa

SEQ ID NO: 113096 - RNA, 64 nt, hsa
aacguaauuauuauuuaaaugaaagcuauuuuuuuaaaugaauugaaauuuuucaugaugcuac

SEQ ID NO: 113097 - RNA, 64 nt, hsa
auauacagagauaaagcuaaacguaauuauuauuuaaaugaaagcuauuuuuuuaaaugaauug

SEQ ID NO: 113098 - RNA, 64 nt, hsa
aaaguaguauuuuguauauuuuuguaacaaaauauaaaugaagauauuuuaccaugaagagauu

SEQ ID NO: 113099 - RNA, 64 nt, hsa
gagauugcacuuauccuugagaacagucuaaauauaaaugaagauauuuuaccaugaagagauu

SEQ ID NO: 113100 - RNA, 64 nt, hsa
ugggucucaauccccuuggaaauucuuggugcauuaaaugaagccuuaccccauuacugcgguu

SEQ ID NO: 113101 - RNA, 64 nt, hsa
uuuucuguggacugaaaaaucguguccuuuucucuaaaugaaguggcaucaaggacucaggggg

SEQ ID NO: 113102 - RNA, 64 nt, hsa
uaaaacauuuauauaccucauucuuuaguguuguuaaaugaaaaauuaaaauuuguguuuauua

SEQ ID NO: 113103 - RNA, 64 nt, hsa
aauauauaucuaccuaaaggagacuucugaauuguaaaugaacuuaaaaauagaauguggaugc

SEQ ID NO: 113104 - RNA, 64 nt, hsa
cagaaauuaaaugaauuuuucuuccugauuccuuuaaaugaauaugaaacacuacaaauuuauu

SEQ ID NO: 113105 - RNA, 64 nt, hsa
gaauuuuugaagugacugggcaggcagcagaaauuaaaugaauuuuucuuccugauuccuuuaa

SEQ ID NO: 113106 - RNA, 64 nt, hsa
auuuaagcaguaccaagacugaaaaaaaagguaauaaaugaaauguuuugaaauauacuuaaac

SEQ ID NO: 113107 - RNA, 64 nt, hsa
acuucaggaaaugaauauaaaauagguucacaguuaaaugaauaagcuuuuguuuauuuguggg

SEQ ID NO: 113108 - RNA, 64 nt, hsa
guuagcauacacauuuuauaggcuuauggguuaauaaaugaauucauggacuccuggacuacuu

SEQ ID NO: 113109 - RNA, 64 nt, hsa
aguacuuaauugaagcuuuuuaaaaauuguaaaguaaaugaaagcuauugagaucuuuuugucu

SEQ ID NO: 113110 - RNA, 64 nt, hsa
auauuaaaugaauauuuuauuuuaaaggcuuaaauaaaugaaaaugauuuuuguaauguuuggu

SEQ ID NO: 113111 - RNA, 64 nt, hsa
aaauuauguauuuuauugccucugaguaucauauuaaaugaauauuuuauuuuaaaggcuuaaa

SEQ ID NO: 113112 - RNA, 64 nt, hsa
agcugagcuuucuaaaaugauagcucucuauuuuuaaaugaauuugaaaagucgauuaaauuau

SEQ ID NO: 113113 - RNA, 64 nt, hsa
uugaaagggaaaaaguauguugaaaauuuagacauaaaugaaccaagaauauuccuuaucuggu

SEQ ID NO: 113114 - RNA, 64 nt, hsa
guugucuguuuguauagccuggauuuuuuugagguaaaugaaacuuucucauuuguauauuugg

SEQ ID NO: 113115 - RNA, 64 nt, hsa
agauucuaagguucaagauuuuuaaaauuugauuuaaaugaagaaauggauuuuucucucugcc

SEQ ID NO: 113116 - RNA, 64 nt, hsa
gguuuuuaaagacagcaagucuggucauucaguuuaaaugaaugguuauacuguuuuuaaugaa

SEQ ID NO: 113117 - RNA, 64 nt, hsa
ggcaaugacagcauuucucacagaggcauucugguaaaugaagcugaaagggguguuuuacauc

SEQ ID NO: 113118 - RNA, 64 nt, hsa
cuguuacuuuuugccuugucuggcauguuuguuuuaaaugaauacauuaaugggguuuuuaucc

SEQ ID NO: 113119 - RNA, 64 nt, hsa
agaaaguauguuuguguugguuuuuuaagaagucuaaaugaaguuauuaauaccugaagcuuua

SEQ ID NO: 113120 - RNA, 64 nt, hsa
aaaaauugacuaccuggaggaaugauuaggaaucuaaaugaagccagcccucgguaucugcagg

SEQ ID NO: 113121 - RNA, 64 nt, hsa
aaaauucuuaauauuuucauaaaauuuguauuuuuaaaugaaaauucuaaauguuguauuuuau

SEQ ID NO: 113122 - RNA, 64 nt, hsa
aauguaggacuuaugauccaauucaccaaaagauuaaaugaaaccacccuguguuuuaaaauau

SEQ ID NO: 113123 - RNA, 64 nt, hsa
ccuuugauuguugaaaauauaauguaugcuauguuaaaugaaaagaucgauugggaauuuaaaa

SEQ ID NO: 113124 - RNA, 64 nt, hsa
ggagugacagguuaugacauuuccaugucaacucuaaaugaagucuuuaugaaacuggaaggac

SEQ ID NO: 113125 - RNA, 64 nt, hsa
agcaguagcuuuugaaacucauaauucucugaaauaaaugaaagacauuuaauucaaggaucaa

SEQ ID NO: 113126 - RNA, 64 nt, hsa
gagaagagaucagagaggaaaaacugggaagacauaaaugaauuauacccagccaugaaacaau

SEQ ID NO: 113127 - RNA, 64 nt, hsa
uaugaucuucguuuauauucugugauguuguuuauaaaugaaugccucaguucucugcuacccu

SEQ ID NO: 113128 - RNA, 64 nt, hsa
auuuacauauuuuugucuuguugaucauuaccuguaaaugaaagaccuuaauaggaaaaaaaga

SEQ ID NO: 113129 - RNA, 64 nt, hsa
uucuccauaguacguagaccuucuaauacucugcuaaaugaaaccacacuuguuaucugaaagu

SEQ ID NO: 113130 - RNA, 64 nt, hsa
gaaaguuguaaauaauuaaaagcuucccaagaguuaaaugaagguuaugaugacucuugauaac

SEQ ID NO: 113131 - RNA, 64 nt, hsa
uccauugugauaugaaaacagcuauagacaaucauaaaugaaugaucauggcuauguuuuaaua

SEQ ID NO: 113132 - RNA, 64 nt, hsa
accacugugguaugaaaacagcuauagacaaucauaaaugaaugaucauggcuauguuuuaaua

SEQ ID NO: 113133 - RNA, 64 nt, hsa
gcacuguguacgauacauaauauuugguagcuuguaaaugaaauaaagaauaaaguuuuauuua

SEQ ID NO: 113134 - RNA, 64 nt, hsa
guauauuguauauuaguguauuaguaauacuagauaaaugaauuuugucuggggauuaagauug

SEQ ID NO: 113135 - RNA, 64 nt, hsa
ccaaaaauagccaguaguaucugaaaaugaaaaauaaaugaaguaucucuaggaaacagucugg

SEQ ID NO: 113136 - RNA, 64 nt, hsa
aauaaaauuuaugcuauucuuugcuuuguuuuuauaaaugaauuuuucauagaauuuacaguau

SEQ ID NO: 113137 - RNA, 64 nt, hsa
ccuucuuaaaacagaaaauuuaaguaaagucuuuuaaaugaaaccuguaaaaguauugacucuu

SEQ ID NO: 113138 - RNA, 64 nt, hsa
gucuggagauaauuuugcaacucauguuauggguuaaaugaauauuuuuguaaaaguaaaagca

SEQ ID NO: 113139 - RNA, 64 nt, hsa
uguguuuuguaucuucccuuucaagugaugauguuaaaugaagguaaguuuuucauccuuuuuu

SEQ ID NO: 113140 - RNA, 64 nt, hsa
uuacugcauagaaaucaaauguaaguuuagcuucuaaaugaaauaauauauaggagggauauca

SEQ ID NO: 113141 - RNA, 64 nt, hsa; identical to SEQ ID NO: 43695

SEQ ID NO: 113142 - RNA, 64 nt, hsa; identical to SEQ ID NO: 43696

SEQ ID NO: 113143 - RNA, 64 nt, hsa; identical to SEQ ID NO: 43697

SEQ ID NO: 113144 - RNA, 64 nt, hsa; identical to SEQ ID NO: 43698

SEQ ID NO: 113145 - RNA, 64 nt, hsa; identical to SEQ ID NO: 43699

SEQ ID NO: 113146 - RNA, 64 nt, hsa; identical to SEQ ID NO: 43700

SEQ ID NO: 113147 - RNA, 64 nt, hsa; identical to SEQ ID NO: 43701

SEQ ID NO: 113148 - RNA, 64 nt, hsa; identical to SEQ ID NO: 43702

SEQ ID NO: 113149 - RNA, 64 nt, hsa; identical to SEQ ID NO: 43703

SEQ ID NO: 113150 - RNA, 64 nt, hsa; identical to SEQ ID NO: 43704

SEQ ID NO: 113151 - RNA, 64 nt, hsa; identical to SEQ ID NO: 43705

SEQ ID NO: 113152 - RNA, 64 nt, hsa; identical to SEQ ID NO: 43706

SEQ ID NO: 113153 - RNA, 64 nt, hsa; identical to SEQ ID NO: 43707

SEQ ID NO: 113154 - RNA, 64 nt, hsa; identical to SEQ ID NO: 43708

SEQ ID NO: 113155 - RNA, 64 nt, hsa; identical to SEQ ID NO: 43709

SEQ ID NO: 113156 - RNA, 64 nt, hsa; identical to SEQ ID NO: 43710

SEQ ID NO: 113157 - RNA, 64 nt, hsa; identical to SEQ ID NO: 43711

SEQ ID NO: 113158 - RNA, 64 nt, hsa; identical to SEQ ID NO: 43712

SEQ ID NO: 113159 - RNA, 64 nt, hsa; identical to SEQ ID NO: 43713

SEQ ID NO: 113160 - RNA, 64 nt, hsa; identical to SEQ ID NO: 43714

SEQ ID NO: 113161 - RNA, 64 nt, hsa; identical to SEQ ID NO: 43715

SEQ ID NO: 113162 - RNA, 64 nt, hsa; identical to SEQ ID NO: 43716

SEQ ID NO: 113163 - RNA, 64 nt, hsa
uccaguuuacccugugcuguccagcuucucccuugggaaaaagucucuccuguuucucucuccu

SEQ ID NO: 113164 - RNA, 64 nt, hsa
uuaaccaaaguuacuguuguuuacagugaguuuggggaaaaaaaauaaaauaaaaauggcuuuc

SEQ ID NO: 113165 - RNA, 64 nt, hsa
ggaagaagcaaaauaucacaucucuagaaguguugggaaaaauauaauuucuuucuuuacuuau

SEQ ID NO: 113166 - RNA, 64 nt, hsa
auccucucguaucucaccccaaaccccaaacugggggaaaaaaaguuaacucuuugugaaugga

SEQ ID NO: 113167 - RNA, 64 nt, hsa
uuugacaagcuuuauuaaguugagagagagagaggggaaaaaaaaaagccuuucguaguucagu

SEQ ID NO: 113168 - RNA, 64 nt, hsa
ugaaaauacaaaauacccaagauuuaagaccggggggaaaaaaccacaaauugguaaauaaagg

SEQ ID NO: 113169 - RNA, 64 nt, hsa
acacuucugaaaguuuuuggaaacuuagaaaagagggaaaaaaauccaguguuacuaguaauuu

SEQ ID NO: 113170 - RNA, 64 nt, hsa
uucccacagcagcuuugcucagugauacccacaugggaaaaaucccaggggauguugcuuacuc

SEQ ID NO: 113171 - RNA, 64 nt, hsa
agcuuuugaagaaaggccagugauccagcaaagggggaaaaauaugcauuucaccccacaugac

SEQ ID NO: 113172 - RNA, 64 nt, hsa
cagccagcacaaugugacccaacuuaaaauuugggggaaaaagaaugcaggagugaaauaacca

SEQ ID NO: 113173 - RNA, 64 nt, hsa
uugguuauuggacauuuuuggaguuuuuuucucugggaaaaaucgauaguguuuucuucaaugc

SEQ ID NO: 113174 - RNA, 64 nt, hsa
ucugugucuacauguuauuuugaaguauaucugagggaaaaauaaaugaaaauuuucuuuaugu

SEQ ID NO: 113175 - RNA, 64 nt, hsa
uuuuacugggacuuuuaaaucuagcuauagaguugggaaaaaauauuuccacuuagauauuuua

SEQ ID NO: 113176 - RNA, 64 nt, hsa
gaggcugggagagacuaggaaggcuugguaggaggggaaaaaagucaggaaaauauaucaaauc

SEQ ID NO: 113177 - RNA, 64 nt, hsa
cguggccauuuauauaagcuauaacaucaaaucagggaaaaaugaggaaaaaaaauagauucug

SEQ ID NO: 113178 - RNA, 64 nt, hsa
agcuguggcuuuuagggcuugguucauaccaugggggaaaaaaaaguccuaggagaaagcgacg

SEQ ID NO: 113179 - RNA, 64 nt, hsa
ucuuuucugaaauuucccuuauucagguuucugugggaaaaaugaaagauuaaccuuccccacu

SEQ ID NO: 113180 - RNA, 64 nt, hsa
auaaagcuuuacuuagauauaacuugagugaguagggaaaaaaaucuacaguagauaaagcaaa

SEQ ID NO: 113181 - RNA, 64 nt, hsa
aaugaaaaaaggucaguugauuccagugcuaaaagggaaaaaccugugguccgcccagaagaga

SEQ ID NO: 113182 - RNA, 64 nt, hsa
cagaaaagaaaaaaagguuaagcauaaaaagaaagggaaaaagcagaaacacugcagaagacac

SEQ ID NO: 113183 - RNA, 64 nt, hsa
uggaaggcgagcuaagaggagacuuagauccagugggaaaaaaaauagcguuucacauaaaaag

SEQ ID NO: 113184 - RNA, 64 nt, hsa
agaacacaccaaaaaagugaaagagaaauugaaagggaaaaaagacaaaaagcauaaggcucca

SEQ ID NO: 113185 - RNA, 64 nt, hsa
aaagucuguaauuucaguuuuugugucggggagagggaaaaacuauuugucuguaguugcuuuu

SEQ ID NO: 113186 - RNA, 64 nt, hsa
uucuucuguaaugagaauagacuggaacaugugagggaaaaauauuuaaaaaaagauggcaguc

SEQ ID NO: 113187 - RNA, 64 nt, hsa
cgcuugaaaccuucccacacucccugcuccaggagggaaaaacagauguuguugacagauagag

SEQ ID NO: 113188 - RNA, 64 nt, hsa
ggccaggauuaaggggaggcaaucaaugcaccuagggaaaaaauuuaaggagguauucacacuc

SEQ ID NO: 113189 - RNA, 64 nt, hsa
cagagcuguauauaccugucaacugaggaauaaagggaaaaacccaaguucauucccacccaaa

SEQ ID NO: 113190 - RNA, 64 nt, hsa
agaaugaaccagaacuaguggauuccagggcugggggaaaaaaaaaaagaaaaaaccucauuac

SEQ ID NO: 113191 - RNA, 64 nt, hsa
cccuguucaauaguaugggaaaaauaagaugacugggaaaaagacacacccacaccguagaaca

SEQ ID NO: 113192 - RNA, 64 nt, hsa
uacguuaucagcaacuuccccuguucaauaguaugggaaaaauaagaugacugggaaaaagaca

SEQ ID NO: 113193 - RNA, 64 nt, hsa
augguuuucuuuuuguacuuucauucaguguagagggaaaaaagcauguauugggccaccggaa

SEQ ID NO: 113194 - RNA, 64 nt, hsa
auuugugguguugccuugccuugcaugaugcugggggaaaaagagaaaagaaaugguuuucuuu

SEQ ID NO: 113195 - RNA, 64 nt, hsa
aauuuauaagaaagaaugccauugaauuuuuuaggggaaaaacuacaaauuucuaauuuagcug

SEQ ID NO: 113196 - RNA, 64 nt, hsa
accugggcagcagagcaagacucugucucaaaaggggaaaaaaaaaauugcugaugugacccau

SEQ ID NO: 113197 - RNA, 64 nt, hsa
ccuucaauuauuucccaucuccacaaauagucgggggaaaaaauuaaaauuuuccuuuaugauu

SEQ ID NO: 113198 - RNA, 64 nt, hsa
ucuuuuagucagaaaugauucaggguuauuugaggggaaaaaaccccauagugccuugauuuua

SEQ ID NO: 113199 - RNA, 64 nt, hsa
aacucucuaucaaaaggaaaaauguggaggaaaagggaaaaaucaggagggaggauugccucau

SEQ ID NO: 113200 - RNA, 64 nt, hsa
cccauuuugccaucugucucuuaugauuuauaaggggaaaaaaacuuguuuuguuagaggggca

SEQ ID NO: 113201 - RNA, 64 nt, hsa
auguuuuuggagagcugugaaugccaauuucagagggaaaaaugguugaggggugaaagagaug

SEQ ID NO: 113202 - RNA, 64 nt, hsa
ugaagggaauagggcugguagugggugggaaaaggggaaaaacuguuucuucagugauuacaau

SEQ ID NO: 113203 - RNA, 64 nt, hsa
auuugauaccaagggcuuuuuaaaugucaugggggggaaaaacccaacuuggugaacucccagc

SEQ ID NO: 113204 - RNA, 64 nt, hsa
agaugcuuauccuuuaaauucuacuuuucuugaggggaaaaagucuucuucuggaaauacauau

SEQ ID NO: 113205 - RNA, 64 nt, hsa
acgaaaaggacagacgaagaguuuaaagagaaaagggaaaaaagaaagaaaaaguaagcagggc

SEQ ID NO: 113206 - RNA, 64 nt, hsa
ucuuaaaauucaaggccacaaaaacaauguuugggggaaaaaaaagaaaaaaucaugccagcua

SEQ ID NO: 113207 - RNA, 64 nt, hsa
ggucacucgggaagggggaaaaaguuuaaaaugggggaaaaaaagccaucuuuuuaaacaaaaa

SEQ ID NO: 113208 - RNA, 64 nt, hsa
ucagucuaacaagucauuaggucacucgggaagggggaaaaaguuuaaaaugggggaaaaaaag

SEQ ID NO: 113209 - RNA, 64 nt, hsa
auacagaagaaaagcaaaugacuaguaaacaugugggaaaaaauauuacauuuuaagggggaaa

SEQ ID NO: 113210 - RNA, 64 nt, hsa
guaaacaugugggaaaaaauauuacauuuuaagggggaaaaaaaaacccaccauucucuucucc

SEQ ID NO: 113211 - RNA, 64 nt, hsa
cuuuuauauuugaaaaaauuaaaaucuuucuuuggggaaaaauucuugguuauucugccauaac

SEQ ID NO: 113212 - RNA, 64 nt, hsa
uuauaugaaaacacucaaaaugaugcaaccaaaagggaaaaaauaaaaaucaaacaaccuucag

SEQ ID NO: 113213 - RNA, 64 nt, hsa
aaaaaguuguuugcuuaaaaaaaauuucaugugagggaaaaaaaaaaaaccuauuccagaauaa

SEQ ID NO: 113214 - RNA, 64 nt, hsa
aaaacagaaaacaauuccacgaggccaaucuaaagggaaaaaauccuacacuacuuuuacuacu

SEQ ID NO: 113215 - RNA, 64 nt, hsa
agaccuugguuugguaguucuuguuuuuaauaaggggaaaaagauaaaauaaccccuauuuuuc

SEQ ID NO: 113216 - RNA, 64 nt, hsa
uuuccguuucaagaccuuuuucuuuuauugcaaggggaaaaaaaugucaucuccccccaccuca

SEQ ID NO: 113217 - RNA, 64 nt, hsa
agucacuuuacccuccuuaggacccauuuugggggggaaaaaccaacacauuccagagcuuucc

SEQ ID NO: 113218 - RNA, 64 nt, hsa
ggaccaaaggacuuaagaauuuggggggaagugagggaaaaacguuaggugcuaaccaccugcc

SEQ ID NO: 113219 - RNA, 64 nt, hsa
cuuuucaagucuccucagucaucaauaguuccuggggaaaaacagagcugguagacuugaagag

SEQ ID NO: 113220 - RNA, 64 nt, hsa
agaaacacaagauuuaauuauuuuucuacuuggggggaaaaaaguccucauguagaagcaccca

SEQ ID NO: 113221 - RNA, 64 nt, hsa
cuccugaccccagauucaacuuugcaaacaacaggggaaaaaaauggggaaaagaaaaaccacg

SEQ ID NO: 113222 - RNA, 64 nt, hsa
ggaaaaaaauggggaaaagaaaaaccacgagagagggaaaaaaaauuauucugcaccuguaaaa

SEQ ID NO: 113223 - RNA, 64 nt, hsa
gaugaauccccacacuuagccauugaauguaaaggggaaaaauaaggugagaauuuguaaauac

SEQ ID NO: 113224 - RNA, 64 nt, hsa
gauccccugcuggggacucccagcucugaaauuugggaaaaaguagcccaugggccuuuagaau

SEQ ID NO: 113225 - RNA, 64 nt, hsa
acacauaaaguugcaguuaggaaagggaugggcagggaaaaacuaguuuugagugucuuuagau

SEQ ID NO: 113226 - RNA, 64 nt, hsa
agaauuaaaaauuuucuaaauauuaauacuaacugggaaaaaaaaacuagugugaaguuuacag

SEQ ID NO: 113227 - RNA, 64 nt, hsa
acugucuggacaaacacaauugcaaauaagggaagggaaaaaugcuuuucuauuuuucaguaac

SEQ ID NO: 113228 - RNA, 64 nt, hsa
uuuaacagaaacagcuaauuuccaauguauuguugggaaaaagcacaaacuguguuuuuaacuc

SEQ ID NO: 113229 - RNA, 64 nt, hsa
aacugggcuaccucucuacagcuguuuccucagagggaaaaaucuugagaccagaugguggagc

SEQ ID NO: 113230 - RNA, 64 nt, hsa
aguggaaguuaagaggggugagaaaacaaagaaggggaaaaacugacaacuaacaaaaccagca

SEQ ID NO: 113231 - RNA, 64 nt, hsa
cauuugauugguuugagcccagaacagccuacaggggaaaaacaagcuggauaaccacccaaag

SEQ ID NO: 113232 - RNA, 64 nt, hsa
ccaccuccuuccugaacucuaauagagguuaaaagggaaaaaaaaaauucuguagauagcaaau

SEQ ID NO: 113233 - RNA, 64 nt, hsa
ugggaugggauaucagaggaagaagcauacaagugggaaaaacugugauuagaaagggaaaaau

SEQ ID NO: 113234 - RNA, 64 nt, hsa
gaagcauacaagugggaaaaacugugauuagaaagggaaaaauaggcauuuccacaguacuauu

SEQ ID NO: 113235 - RNA, 64 nt, hsa
aagcuuaagugggaaaaaggaagaugauugucaggggaaaaacuuacaaaaugcuacaguguuu

SEQ ID NO: 113236 - RNA, 64 nt, hsa
aaugagcacuuuucauucacuugaaagcuuaagugggaaaaaggaagaugauugucaggggaaa

SEQ ID NO: 113237 - RNA, 64 nt, hsa
uuccugccccuaguauuugauuacaaggaaccaggggaaaaaaacuuucuuagacacacuggca

SEQ ID NO: 113238 - RNA, 64 nt, hsa
aguuacuuuuaggaugggggagaggggcgagaaggggaaaaaugggaaauagucugauuuuaau

SEQ ID NO: 113239 - RNA, 64 nt, hsa
uuacuaugguaacacuuugcuuucugaauuggaagggaaaaaaaauguagcgacagcauuuuaa

SEQ ID NO: 113240 - RNA, 64 nt, hsa
agcgcuuaaaaaaacaaauuggacagcuacuucugggaaaaacaacaucauuccaaaaagaaca

SEQ ID NO: 113241 - RNA, 64 nt, hsa
uaaaaaaaacaguuuagaugccuucuccuuuugagggaaaaagggugcuuuuuauuguauaaag

SEQ ID NO: 113242 - RNA, 64 nt, hsa
gagagguuucugggaagacucucuuuuugcccucgggaaaaagcaaaauaucaauguuugggug

SEQ ID NO: 113243 - RNA, 64 nt, hsa
gcuuaauuucucauuuuaucccacuuaugagauugggaaaaagaucaauaugagaaauaccaua

SEQ ID NO: 113244 - RNA, 64 nt, hsa
uauuucuacguuuuuaguaaauuuaauauucugggggaaaaaaggccuugauuuuaggguuaaa

SEQ ID NO: 113245 - RNA, 64 nt, hsa
gugcguguucagcagaaccugcacacaggacagcgggaaaaaucgaugagcgccaccucuuuaa

SEQ ID NO: 113246 - RNA, 64 nt, hsa
aucuauggaagucgugucuuacuccaggugaagggggaaaaaaaaagccuauacuuuggcaggu

SEQ ID NO: 113247 - RNA, 64 nt, hsa
uaugcagucauguggaaccuugcuuucuaguccugggaaaaaaagaugucucuaauuacuggcu

SEQ ID NO: 113248 - RNA, 64 nt, hsa
caugaauuuaauguauaaaauguugucaaaccaagggaaaaaaccacaguucaccauguggagu

SEQ ID NO: 113249 - RNA, 64 nt, hsa
ugguaauguuuuugaucagaauaaagaggguaaagggaaaaaguuacuacacaugcuaggcuuu

SEQ ID NO: 113250 - RNA, 64 nt, hsa
aaaaaguuacuacacaugcuaggcuuucucaguggggaaaaaaauggcuggauagaacugggac

SEQ ID NO: 113251 - RNA, 64 nt, hsa
auugaaacugugaguuguuuuuuuuuuaacaacugggaaaaaacaaaaacaaaaaacuauaguu

SEQ ID NO: 113252 - RNA, 64 nt, hsa
gcaaaugauaaauugaccccuuuuuauaaauggagggaaaaaaugaacagauuucagagauuaa

SEQ ID NO: 113253 - RNA, 64 nt, hsa
guauuauaugccaaaaagauccuacauuuugguagggaaaaaacaacacuguguuugacguauu

SEQ ID NO: 113254 - RNA, 64 nt, hsa
cuauacaguauaaacuaccucacuugccuuucuugggaaaaaaaaaaugaauggacuuuaacaa

SEQ ID NO: 113255 - RNA, 64 nt, hsa
ugcuuaucaucuaaagauguagcucuggcccagugggaaaaauuaggaagugauuauaaaucga

SEQ ID NO: 113256 - RNA, 64 nt, hsa
acccacugagauuuccacgccgaaggacagcgaugggaaaaaugcccuuaaaucauaggaaagu

SEQ ID NO: 113257 - RNA, 64 nt, hsa
ucaucauugcuucauacgacauggaguuaggacagggaaaaaucauucaacacuccuuaugcau

SEQ ID NO: 113258 - RNA, 64 nt, hsa
uuaucauaaaauuuucauauaugccuagauaauggggaaaaaaagucuugugauugacuuucgc

SEQ ID NO: 113259 - RNA, 64 nt, hsa
cagcagaaggucacuacucacauuauaguaagaggggaaaaaaaucuuuuaaaacuuggcuguu

SEQ ID NO: 113260 - RNA, 64 nt, hsa
uuaucuagccaggaggucccaagaguuaguuuuagggaaaaagaaugucugccuagaccucaaa

SEQ ID NO: 113261 - RNA, 64 nt, hsa
cucucagauccauaauccauacucagugaaagcagggaaaaaauauuuucacuuauuuuauuug

SEQ ID NO: 113262 - RNA, 64 nt, hsa
ccuguguaaguauugugaaaacccuuuucuuccagggaaaaauuauuggaaauuccuuaacuga

SEQ ID NO: 113263 - RNA, 64 nt, hsa
ucuuagugccucccagaacauuuuguaguuaauugggaaaaagugauacuuggauuagggggug

SEQ ID NO: 113264 - RNA, 64 nt, hsa
cuguuuacauauacagcacuuaaaauguuugugugggaaaaaaaaaacucauuggcagauccaa

SEQ ID NO: 113265 - RNA, 55 nt, hsa
acacuuccacuacucucuaagaccuccugccuaagugcagccccgugggguuccu

SEQ ID NO: 113266 - RNA, 64 nt, hsa
aucaccaaggcugauuaaaccaaggcuagaaccaccugccuauauuuuuuguuaaaugauuuca

SEQ ID NO: 113267 - RNA, 64 nt, hsa
uccuuuuggaaacuuuuauguauaauucuuucugccugccuacuuuucugcaaaaaugagaugu

SEQ ID NO: 113268 - RNA, 64 nt, hsa
aauuaagcaaauugcuuaacacuugguuccaguuccugccuaucuggaguuuaaaugcguaaua

SEQ ID NO: 113269 - RNA, 64 nt, hsa
caucaggaauuccuuccugucaucuaaccucaguccugccuacugcaguuccagccaaccugcu

SEQ ID NO: 113270 - RNA, 64 nt, hsa
aagcagcacaccggcugcagaugggacagccagcccugccuaucuggacaggccccugcagccu

SEQ ID NO: 113271 - RNA, 64 nt, hsa
ucccagggacuauuuucuccucguaagccagcgaccugccuaaagcuugggcugugccugcaaa

SEQ ID NO: 113272 - RNA, 64 nt, hsa
ugcuugucacuucccagagauugcagagguguguccugccuaccaucugccuguccagcuuggu

SEQ ID NO: 113273 - RNA, 64 nt, hsa
cagcucccugcagcccaagucucaagccuccaaaccugccuacggcaacucuccauacuggaca

SEQ ID NO: 113274 - RNA, 64 nt, hsa
caaccaguaccucguaggucccggaggacugcuuccugccuacccggugaguguauggcggaac

SEQ ID NO: 113275 - RNA, 64 nt, hsa
caagacuucugugaaugacuugaauuuuuuauucccugccuagggucugugaacgaggccuguc

SEQ ID NO: 113276 - RNA, 64 nt, hsa
ggugauuucggucacuucaggcauugacucaaggccugccuaacuggcugggucguuucuucca

SEQ ID NO: 113277 - RNA, 64 nt, hsa
aggacggcagaggccuccuggccucagggcaugcccugccuaccuucugaaauguuuaccccau

SEQ ID NO: 113278 - RNA, 64 nt, hsa
caagagauauugccccuugaugagagucaaacacccugccuacaaggagauguuuugaaaugga

SEQ ID NO: 113279 - RNA, 64 nt, hsa
ccagcuccccaguccaggacaaccauuaguccugaugagugagcugacgcuggugcuggaaccu

SEQ ID NO: 113280 - RNA, 64 nt, hsa
aggugugcagggccaauccugacgguaauugagaaugagugagguuucguacaugcagcuauuu

SEQ ID NO: 113281 - RNA, 64 nt, hsa
aggugaaaagucaaaugaaacaguacaauucuugaugagugaggugucaucuuccaaccacaca

SEQ ID NO: 113282 - RNA, 64 nt, hsa
uggcuaugaucaucugauggcaagugaaggagaaaugagugauagggcuuugcguuuucaucca

SEQ ID NO: 113283 - RNA, 64 nt, hsa
aggcuuauuauuucaaaagaagauuauuuaaaacaugagugacagguagucagaagagaacaaa

SEQ ID NO: 113284 - RNA, 64 nt, hsa
uccauuuaaaggaaugugaugauccuagguucugaugagugauagguggucuccguuuauaccc

SEQ ID NO: 113285 - RNA, 64 nt, hsa
gccagacuuucuguucugucugccauggguuuguccagcucagguagcucuaggagcaccaucc

SEQ ID NO: 113286 - RNA, 64 nt, hsa
ugguuuuaaaauuaaaaauaauuccgaagauacaccagcucacaaaugaaaacgucagccucug

SEQ ID NO: 113287 - RNA, 64 nt, hsa
ccaaacauggccugcugggcccaagugaggagugccagcucaaguuggaguugacugcucauac

SEQ ID NO: 113288 - RNA, 64 nt, hsa
gcucagcggugccacugaggacccgugugacucgccagcucauucucaccaaucgcuccccaau

SEQ ID NO: 113289 - RNA, 64 nt, hsa
uguaaaugaagguguucuuagaauucgcauuuugccagcucagcgcaccuccacaacgaaugaa

SEQ ID NO: 113290 - RNA, 64 nt, hsa
ccacgguuuucccuccuugugugcccauggggcaccagcucauggucuuuuucagucaucccag

SEQ ID NO: 113291 - RNA, 64 nt, hsa
gccugggauuggcugugaggucccuccgcaucacccagcucacgucccccaaaacgugcauggu

SEQ ID NO: 113292 - RNA, 64 nt, hsa
ucucaugccauccucaggugggaggugucagagcccagcucaugcacaucagcugguggagcag

SEQ ID NO: 113293 - RNA, 64 nt, hsa
gccaugcacaggccacaggcccuccaccucaccuccagcucaggggccgcaccccgccgcuggc

SEQ ID NO: 113294 - RNA, 64 nt, hsa
ggacagccagaugcagagcgaguggaugcacuucccagcucaucucuggaagccuuugcuacuc

SEQ ID NO: 113295 - RNA, 64 nt, hsa
gucggggagcugugcuucucucuccgguacgugcccagcucaggccggcugaccgugguggugc

SEQ ID NO: 113296 - RNA, 64 nt, hsa
gcaaccuugcccucccagagcccuacgugaagguccagcucaugcugaaccagaggaaguggaa

SEQ ID NO: 113297 - RNA, 64 nt, hsa
agggagcagccccaggccagagaggccucccgguccagcucagggaugcuccugccagcacagg

SEQ ID NO: 113298 - RNA, 64 nt, hsa
ggagcaggcacauagugagcccgggcagcccugcccagcucaggccccuuuccuuccccauuga

SEQ ID NO: 113299 - RNA, 64 nt, hsa
ugagaugcugguuuucuacccaacggcccugcagccagcucacguccagguucaacccacagcu

SEQ ID NO: 113300 - RNA, 64 nt, hsa
ugcuaauuuaaagagacuccaaaucucaaugaagccagcucacagugcugugugccccggucac

SEQ ID NO: 113301 - RNA, 64 nt, hsa
gagacaaagggagccgagacccuggauggggcuuccagcucagaacccaucccucuggugggua

SEQ ID NO: 113302 - RNA, 64 nt, hsa
acucagcccuuugggcggccucugggcuugggcaccagcucaugccagccccagagggucaggg

SEQ ID NO: 113303 - RNA, 64 nt, hsa
gugugugugugugugagagagagcccucccacugccagcucagguuguucacagauuuggaaug

SEQ ID NO: 113304 - RNA, 64 nt, hsa
gcucacccagagaggcucaaagcagccuuuugucccagcucagcuuugaucuacaccucuugcc

SEQ ID NO: 113305 - RNA, 64 nt, hsa
uuggaagggaaaaaagaaagugguaccaguguuaccagcucaacuaaaaccugcaauucugcau

SEQ ID NO: 113306 - RNA, 64 nt, hsa
uaaagagacaguaggacauuguggcugagucuacccagcucaagguaaaggagaauguugcuaa

SEQ ID NO: 113307 - RNA, 64 nt, hsa
uguccagcuuccuccaggguuccccagccaccucccagcucagggcacaguguaucgacaaucu

SEQ ID NO: 113308 - RNA, 64 nt, hsa
gaggcagaggacaccuccccaucacucagcauucccagcucagggcacaggcaggcuggggucc

SEQ ID NO: 113309 - RNA, 64 nt, hsa
gcuuugaguugcaauugcuauuuucuucucagucccagcucagaucgaauuauauauccauaua

SEQ ID NO: 113310 - RNA, 64 nt, hsa
ccugccacccacgggggcuccucccugccgggguccagcucagaaccacgggggucugugccgg

SEQ ID NO: 113311 - RNA, 64 nt, hsa
ccccacccuccacagagcccccuugcugggacagccagcucaccuccaaggacauccccuccug

SEQ ID NO: 113312 - RNA, 64 nt, hsa
acuuuucaggcacuguagggucacccauaugccuccagcucaguugacgcuuaaaaacaggugc

SEQ ID NO: 113313 - RNA, 64 nt, hsa
gggggccuuauggggaaggcucugacacuccaccccagcucaggccaugggcagcagggcucca

SEQ ID NO: 113314 - RNA, 64 nt, hsa
cuagugugcaauuggguguugccucaguuuccucccagcucaguuuuauuagaucaaagcuguu

SEQ ID NO: 113315 - RNA, 64 nt, hsa
cguaauaacauuagagaaaauguuuuuaaagaagccagcucaagcaauauuaaugaaguagguu

SEQ ID NO: 113316 - RNA, 64 nt, hsa
uugcauguggagccauguggcacaaauacucaugccagcucauuacagcaugagaacagcaguu

SEQ ID NO: 113317 - RNA, 64 nt, hsa
cagcccucugaugguggugagaccaggggaaaggccagcucagaggguggucacagcauguguc

SEQ ID NO: 113318 - RNA, 64 nt, hsa
ggguuggggugggguggggguacugacgcccuucccagcucauccagggguggagccuggccug

SEQ ID NO: 113319 - RNA, 64 nt, hsa
gaguagcugggauuacaggugggugucaccacacccagcucaguauuguauuuuuagcagagau

SEQ ID NO: 113320 - RNA, 64 nt, hsa
auccuauccccaagagugaugcccggcagcauucccagcucagggcuaaugguucacggaagcc

SEQ ID NO: 113321 - RNA, 64 nt, hsa
cugcaaugcaugggacaggcccugccuagaaacaccagcucagcauggcagcagugcggaggcc

SEQ ID NO: 113322 - RNA, 64 nt, hsa
cuggugucuccccucccccaccacccggugcugcccagcucaagccagaagcugacuuuggccg

SEQ ID NO: 113323 - RNA, 64 nt, hsa
ccuuugacggcguguguuggucccaucucucagaccagcucacugaggcagaggaguugcucag

SEQ ID NO: 113324 - RNA, 64 nt, hsa
gccgugcggaugaacuucagcacccgagucagucccagcucauccuccccaguuuaccacuuug

SEQ ID NO: 113325 - RNA, 64 nt, hsa
ccgucagguacuccugccagggaacuggccugcugcgccccaggccccgcccgucucugcucug

SEQ ID NO: 113326 - RNA, 64 nt, hsa
cucaaggugcggggagaagaagcggccaggcggggcgccccaagagcccaaaagagggcacacc

SEQ ID NO: 113327 - RNA, 64 nt, hsa
ugguucgggcugugacgggguggccagcagggacgcgccccaggugggcagcuguggcagagca

SEQ ID NO: 113328 - RNA, 64 nt, hsa
ugguucgggccgugacggggcggccagcagggacgcgccccaggugggcagcuguggcagagca

SEQ ID NO: 113329 - RNA, 64 nt, hsa
ccuggccgggcagggacagggcagaggacucugagcgccccacccaugccugccuggccuggua

SEQ ID NO: 113330 - RNA, 64 nt, hsa
ccuggccugguagagaagauggcacaggauggaggcgccccaagacggacaguguacauaagag

SEQ ID NO: 113331 - RNA, 64 nt, hsa
gcgcccugcuccaucggcacuaaugcuccacucggcgccccacuccaucggccccgcuccaucg

SEQ ID NO: 113332 - RNA, 64 nt, hsa
cggccccgcuccaucggcacuaaugccccacucggcgccccacuccaucagcacuaaugcucca

SEQ ID NO: 113333 - RNA, 64 nt, hsa
guguccccagcgcccgcugcgccccugcgccccagcgccccaccuucccccacggcucaagaga

SEQ ID NO: 113334 - RNA, 64 nt, hsa
cagcagguguguccccagcgcccgcugcgccccugcgccccagcgccccaccuucccccacggc

SEQ ID NO: 113335 - RNA, 64 nt, hsa
auggauuuauuuuuuuuccuuucaaacacgguaaggaaacaaucuauuacuuuuuuccuuaaaa

SEQ ID NO: 113336 - RNA, 64 nt, hsa
uggcguuuuuuuauacauaaccauggauguagugggaaacaauguuguuugguaaaaauaaugu

SEQ ID NO: 113337 - RNA, 64 nt, hsa
auuguuuuauaagccugcuuuaccuccccgucuuggaaacaaguuuuaguuuauugcuuuggag

SEQ ID NO: 113338 - RNA, 64 nt, hsa
aaaguaacaaccaugcuaagauggcaaacacacuggaaacaauugggccacuuggcuuucuuuu

SEQ ID NO: 113339 - RNA, 64 nt, hsa
caggugcaacuguguguacaccagggaucuguuuggaaacaaccccuugagcugccaggcucaa

SEQ ID NO: 113340 - RNA, 64 nt, hsa
uagagcauguugcugauacucuucuguuuucaagggaaacaaucacauuguuugauuccaaaug

SEQ ID NO: 113341 - RNA, 64 nt, hsa
guacaagaugugguuagaaacauuucuuuguucuggaaacaaaguacuguugaaaccagcuugg

SEQ ID NO: 113342 - RNA, 64 nt, hsa
aaaaguuuucuuaucuucugugcuuuuggucccuggaaacaaauccgccuauguaugaagcuag

SEQ ID NO: 113343 - RNA, 64 nt, hsa
cagugcucaacuauuugaacuguugagugauaaaggaaacaaauauaacuguaaaugaaucuug

SEQ ID NO: 113344 - RNA, 64 nt, hsa
aaggacucuaauaaaaaaucacuucauuguauuuggaaacaaaaacaucauucauuaauuacuu

SEQ ID NO: 113345 - RNA, 64 nt, hsa
guuugauggaaugaaucaccuggguggggaccuuggaaacaaguuuguccguccacucuacaaa

SEQ ID NO: 113346 - RNA, 64 nt, hsa
uggaaaucuaugaauuauugcaaauuguaaugcuggaaacaaaaaauaaauccuugguuaaagg

SEQ ID NO: 113347 - RNA, 64 nt, hsa
ggcuuccaggcaaggaaguucuaucuugugauacggaaacaauaaauuccugagauacauucuu

SEQ ID NO: 113348 - RNA, 64 nt, hsa
agaugauauuucagaagaguuggcugccuucucuggaaacaaggaaaacccaauaauuccgagg

SEQ ID NO: 113349 - RNA, 64 nt, hsa
ccuugcuguucugggaucuucgcugcaguucacgggaaacaagccugaguccgcucgcacccgc

SEQ ID NO: 113350 - RNA, 64 nt, hsa
ucccaguaaggaguuucccaagaggggacucacaggaaacaagucuuagugcuugggagggagg

SEQ ID NO: 113351 - RNA, 64 nt, hsa
uggcaaaggcaucucaggaacaucaccuuagugaggaaacaaaauguucugcuagcuuguuuuc

SEQ ID NO: 113352 - RNA, 64 nt, hsa
aguauccauugggacaugaaguuaaccacagucgggaaacaagcauagaaauggaagaaaguga

SEQ ID NO: 113353 - RNA, 64 nt, hsa
auuugaggggagagaaauaucuacagguauauauggaaacaaauaauguggucugcuuuauaag

SEQ ID NO: 113354 - RNA, 64 nt, hsa
uacuaagaaaggguguaggacacauuagccuucuggaaacaaguagaagccaucaccuggccca

SEQ ID NO: 113355 - RNA, 61 nt, hsa
uuuaguagcacuuucucuggaugacagaaggagcaaccacaugggcacccuuguucauacc

SEQ ID NO: 113356 - RNA, 61 nt, hsa
uuuacauccgaacaaaauuuuacauccgaaaagcaaccaacuucuucauggaacucagccc

SEQ ID NO: 113357 - RNA, 61 nt, hsa
ucaaauguaaaguuuaauugaaagaauguaaagcaaccaaaaagaaaaaaaaaaagaaaga

SEQ ID NO: 113358 - RNA, 61 nt, hsa
accuacggccacgggaacaggaccaugguuaagcaaccauauagaaagcuuuguugaaaga

SEQ ID NO: 113359 - RNA, 61 nt, hsa
ucuccugagucgaggaaucuguauuauuaauagcaaccagggccgggugucguggcucacg

SEQ ID NO: 113360 - RNA, 61 nt, hsa
gagacuccuucucaaaaguaaauaaauaaauagcaaccaguacuccaggugauuccagcau

SEQ ID NO: 113361 - RNA, 61 nt, hsa
gugauuuucuuuucuaaaugaaacuccauguagcaaccaggacgaaguugagaaggaaaac

SEQ ID NO: 113362 - RNA, 61 nt, hsa
aggcauuuggcauauuuuguggacucagucaagcaaccacagucuguuaaucauuucucua

SEQ ID NO: 113363 - RNA, 64 nt, hsa; identical to SEQ ID NO: 44425

SEQ ID NO: 113364 - RNA, 64 nt, hsa; identical to SEQ ID NO: 44426

SEQ ID NO: 113365 - RNA, 64 nt, hsa; identical to SEQ ID NO: 44427

SEQ ID NO: 113366 - RNA, 64 nt, hsa; identical to SEQ ID NO: 44428

SEQ ID NO: 113367 - RNA, 64 nt, hsa; identical to SEQ ID NO: 44429

SEQ ID NO: 113368 - RNA, 64 nt, hsa; identical to SEQ ID NO: 44430

SEQ ID NO: 113369 - RNA, 64 nt, hsa; identical to SEQ ID NO: 44431

SEQ ID NO: 113370 - RNA, 64 nt, hsa; identical to SEQ ID NO: 44432

SEQ ID NO: 113371 - RNA, 64 nt, hsa; identical to SEQ ID NO: 44433

SEQ ID NO: 113372 - RNA, 64 nt, hsa; identical to SEQ ID NO: 44434

SEQ ID NO: 113373 - RNA, 64 nt, hsa; identical to SEQ ID NO: 44435

SEQ ID NO: 113374 - RNA, 64 nt, hsa; identical to SEQ ID NO: 44436

SEQ ID NO: 113375 - RNA, 64 nt, hsa; identical to SEQ ID NO: 74844

SEQ ID NO: 113376 - RNA, 64 nt, hsa; identical to SEQ ID NO: 74845

SEQ ID NO: 113377 - RNA, 64 nt, hsa; identical to SEQ ID NO: 74846

SEQ ID NO: 113378 - RNA, 64 nt, hsa; identical to SEQ ID NO: 74847

SEQ ID NO: 113379 - RNA, 64 nt, hsa; identical to SEQ ID NO: 74848

SEQ ID NO: 113380 - RNA, 64 nt, hsa; identical to SEQ ID NO: 74849

SEQ ID NO: 113381 - RNA, 64 nt, hsa; identical to SEQ ID NO: 74850

SEQ ID NO: 113382 - RNA, 64 nt, hsa; identical to SEQ ID NO: 74851

SEQ ID NO: 113383 - RNA, 64 nt, hsa; identical to SEQ ID NO: 74852

SEQ ID NO: 113384 - RNA, 64 nt, hsa; identical to SEQ ID NO: 74853

SEQ ID NO: 113385 - RNA, 64 nt, hsa; identical to SEQ ID NO: 51621

SEQ ID NO: 113386 - RNA, 64 nt, hsa; identical to SEQ ID NO: 51622

SEQ ID NO: 113387 - RNA, 64 nt, hsa; identical to SEQ ID NO: 51623

SEQ ID NO: 113388 - RNA, 64 nt, hsa; identical to SEQ ID NO: 51624

SEQ ID NO: 113389 - RNA, 64 nt, hsa; identical to SEQ ID NO: 51625

SEQ ID NO: 113390 - RNA, 64 nt, hsa; identical to SEQ ID NO: 51626

SEQ ID NO: 113391 - RNA, 64 nt, hsa; identical to SEQ ID NO: 51627

SEQ ID NO: 113392 - RNA, 64 nt, hsa; identical to SEQ ID NO: 51628

SEQ ID NO: 113393 - RNA, 64 nt, hsa
auccuggauauguacuaacgaauauuaccaccagagaagagagcuuucuacaaaagucacuaca

SEQ ID NO: 113394 - RNA, 64 nt, hsa
uuuucucaagaccuuccucaagcauuuuaucuuuagaagagaaacugaugggcaccugauacuc

SEQ ID NO: 113395 - RNA, 64 nt, hsa
caagucucccuuucccugucuggcuucucccuuaagaagagagagauacuuguagaauugggug

SEQ ID NO: 113396 - RNA, 64 nt, hsa
gagaauaaggagccuuucuuauggaagaaaugggagaagagagacaggguucuuuucagcagag

SEQ ID NO: 113397 - RNA, 64 nt, hsa
gguaggaaaaucugaguuuucuuaucuuugaccuagaagagauucuuuuuggaccaaccugcga

SEQ ID NO: 113398 - RNA, 64 nt, hsa
acuggaagggcuggugcagaucuacuucccaugcagaagagaagucacaucuuccagggaaucg

SEQ ID NO: 113399 - RNA, 64 nt, hsa
gcccaaggucaagucuggcugucaacugacaaagagaagagaagacaagucuguggcccagaca

SEQ ID NO: 113400 - RNA, 64 nt, hsa
augaaggaugcuucaugcccuguuccccacacagagaagagaugaagagggggagguacgguca

SEQ ID NO: 113401 - RNA, 64 nt, hsa
aaauggaauauauugguuagaauuuggcuuugggagaagagaugcugccauuuaaccccuuggu

SEQ ID NO: 113402 - RNA, 64 nt, hsa
auacacugauucuagguacauuuuuuaacuuucuagaagagaaaaacuaacuagacuaagaaga

SEQ ID NO: 113403 - RNA, 64 nt, hsa
uccuauaacugugaaaggaggauuucuggaauucagaagagagcuauugaguuugcuguguuga

SEQ ID NO: 113404 - RNA, 64 nt, hsa
gauaugcauaugcaacuuauaaucaaauagaacuagaagagacuuugaagucaccugacucagc

SEQ ID NO: 113405 - RNA, 64 nt, hsa
aauuagcgcuuauaaaauaaaaauguuuaguucaagaagagacccaagcuggguaugguggugu

SEQ ID NO: 113406 - RNA, 64 nt, hsa
uagagugagaucccaucucuaaaaaaugaaaaaaagaagagagguagcuuuaaagugguuuuuc

SEQ ID NO: 113407 - RNA, 64 nt, hsa
acacuggggugagaagagauaagagaaaugaaagagaagagaaaugggacaucuaauagucccu

SEQ ID NO: 113408 - RNA, 64 nt, hsa
guaaaaaccuguagcgauucguuacacuggggugagaagagauaagagaaaugaaagagaagag

SEQ ID NO: 113409 - RNA, 64 nt, hsa
gacaaaaaguccagaacccauaaacauagcccagagaagagaggcucugaaagaaaggagggga

SEQ ID NO: 113410 - RNA, 64 nt, hsa
aacaacagugauucugaagagaaggacaagucuaagaagagaaagcuucaugaagaacuuucua

SEQ ID NO: 113411 - RNA, 64 nt, hsa
ccagugcuaaaagggaaaaaccugugguccgcccagaagagauuccuccagugccugagaaccg

SEQ ID NO: 113412 - RNA, 64 nt, hsa
gauuccuccagugccugagaaccgauuuuuacugagaagagauaugccuguuguuacugcagaa

SEQ ID NO: 113413 - RNA, 64 nt, hsa
aagcagaaacacugcagaagacacaaacaaacaaagaagagaaggauucuuauaccgucugaca

SEQ ID NO: 113414 - RNA, 64 nt, hsa
uccaggaacagucccucaggagaggcaguggaccagaagagauggcgaaacgugagcucgccgg

SEQ ID NO: 113415 - RNA, 64 nt, hsa
caaggauucuguccucauugcuggguaagcagggagaagagaaguuuuccccaugucuaauuuu

SEQ ID NO: 113416 - RNA, 64 nt, hsa
gggaaagagacccuacacauggccuagaaaugagagaagagagagguauuuacccagaggauuu

SEQ ID NO: 113417 - RNA, 64 nt, hsa
uauuaagucuuuguaucucucgacugauuaauaaagaagagaaacacguaucugucuuaguucc

SEQ ID NO: 113418 - RNA, 64 nt, hsa
ugugugaggauuucccaguacuggauggagaaugagaagagaaagucagccuuucuggggcuuu

SEQ ID NO: 113419 - RNA, 64 nt, hsa
agauaaaggcaacccaaugaaaccacagagaggcagaagagaacgggcagaaguacagaacaga

SEQ ID NO: 113420 - RNA, 64 nt, hsa
ucaguuuuuuuuaaacaugauucuaguuaaauguagaagagagaagaaagaggaaguguucacu

SEQ ID NO: 113421 - RNA, 64 nt, hsa
aaaauagcauuuagaaguuuuggauaugaaaaacagaagagagaaaaauauacauuauaaaagc

SEQ ID NO: 113422 - RNA, 58 nt, hsa
cauguacccacucacagugaugccagcaagaagagacugauugaggauacugaagacu

SEQ ID NO: 113423 - RNA, 64 nt, hsa
cauucugugaauuuuugaaagucaacaguucaggagaagagaaggaauuugaagagaaaaagga

SEQ ID NO: 113424 - RNA, 64 nt, hsa
ggagaggaguccaaggggacaaauaaaggcagagagaagagacagaacuaaaaauacgaggaaa

SEQ ID NO: 113425 - RNA, 64 nt, hsa
ccuggcuucuccaugugaggggaugggaaaggaaagaagagaaugaagacuacuuaguaauucc

SEQ ID NO: 113426 - RNA, 64 nt, hsa
cugcagcugcugcccuucucccaggcccccagacagaagagacccuguuuccccuccucucccc

SEQ ID NO: 113427 - RNA, 64 nt, hsa
auuuucuggggugaggcuugacuuggagaaaggcagaagagacgucccgcuucugugauuuggu

SEQ ID NO: 113428 - RNA, 64 nt, hsa
acuucagcugaagauuuuauauaggacuuuaaaaagaagagaagagaaagaagaaacaaugcau

SEQ ID NO: 113429 - RNA, 64 nt, hsa
agcugaagauuuuauauaggacuuuaaaaagaagagaagagaaagaagaaacaaugcauuucca

SEQ ID NO: 113430 - RNA, 64 nt, hsa
augccugaugaccuauaagaagaaaguauugaaaagaagagagauuagaacuguuagaaggagu

SEQ ID NO: 113431 - RNA, 64 nt, hsa
acuauuacauauuuuucuagaaaaucuaaaguucagaagagaauguaucacugcugacuuuuau

SEQ ID NO: 113432 - RNA, 64 nt, hsa
cugcgagaagagagagauguggaaggcaccuucuagaagagagcgugccucagguuacuugaac

SEQ ID NO: 113433 - RNA, 64 nt, hsa
gaaucucuggacggagcugcuggcagcuucugcgagaagagagagauguggaaggcaccuucua

SEQ ID NO: 113434 - RNA, 64 nt, hsa
ucuuuuagguaagagaaaagaaaaagauaaggaaagaagagagaagagagacaaagaucacuac

SEQ ID NO: 113435 - RNA, 64 nt, hsa
gguaagagaaaagaaaaagauaaggaaagaagagagaagagagacaaagaucacuacagaccaa

SEQ ID NO: 113436 - RNA, 64 nt, hsa
aacaccuuugcccugaagucaguucucacaguauagaagagaacuuaaagagggaaaaaacaau

SEQ ID NO: 113437 - RNA, 64 nt, hsa
caauuugccuuguaugcaacuuaugaggauuaguagaagagaguggguccagauuucugguggu

SEQ ID NO: 113438 - RNA, 64 nt, hsa
aucaagacugugucuacacuaucuuggcugaacgagaagagauguaaaugcuggguggucccgu

SEQ ID NO: 113439 - RNA, 64 nt, hsa
aauuccaaacccaaagccuuuguuugacugaaggagaagagagggaaguaagcuucuguucagc

SEQ ID NO: 113440 - RNA, 64 nt, hsa
aggcaaagcuacagguuuacuugggagccagcugagaagagagcagacucacaggugcuggugc

SEQ ID NO: 113441 - RNA, 64 nt, hsa
ucgacgggcagggucggccucgcaccagccagucagaagagacccgggucuggcaccgucggga

SEQ ID NO: 113442 - RNA, 64 nt, hsa
uacucuaggcauauugaucauuuuagacacugggagaagagaaccucaaacuaggaggaaaaga

SEQ ID NO: 113443 - RNA, 64 nt, hsa
aguaucuaacucuucuggaaaccaaauaggcuuuagaagagauuauccuauauuccuaucagua

SEQ ID NO: 113444 - RNA, 64 nt, hsa
ggaaagaaaaaagaaaagaaggaaagaagaauaaagaagagaaacguguaagaaugguuugcag

SEQ ID NO: 113445 - RNA, 64 nt, hsa
auuuccuaguaccggacuacuuaaaccaggaacaagaagagacccuuguucaauaugaucuugg

SEQ ID NO: 113446 - RNA, 64 nt, hsa
agaaaucauccuguuuucucugugaccugauuucagaagagacugauccaaaaauuauaacggc

SEQ ID NO: 113447 - RNA, 64 nt, hsa
gggaaaaugugaaaucucagaauuuaucucccuuagaagagagccaguaacuuauguacaagga

SEQ ID NO: 113448 - RNA, 64 nt, hsa
gccugagaacuauacaaccuuucccagacucccaagaagagaagagauuggcaaauggggcucc

SEQ ID NO: 113449 - RNA, 64 nt, hsa
agaacuauacaaccuuucccagacucccaagaagagaagagauuggcaaauggggcuccugggc

SEQ ID NO: 113450 - RNA, 64 nt, hsa
cagcccaagauaaauacuuuaauuguuaaaagucagaagagacagaauauguaggaaauguuuu

SEQ ID NO: 113451 - RNA, 64 nt, hsa
aaucaucuccuauuaagggauagaaauuguuacuagaagagaaucacauguucuguguucauua

SEQ ID NO: 113452 - RNA, 64 nt, hsa
uucacugcaaacaugcaugauucuccaagacaaaagaagagagauccuaaaggcaauucagaua

SEQ ID NO: 113453 - RNA, 64 nt, hsa
gaugaucaaccaucucaauaaaagccaggaacagagaagagauuacaccagcgguaacacugcc

SEQ ID NO: 113454 - RNA, 64 nt, hsa
uugauuaucuuuggcuuuguaccugaggcaggagagaagagauguccaaccagugagaucuuua

SEQ ID NO: 113455 - RNA, 64 nt, hsa
cuuguguauccuucugcaggaagacccgccaaauagaagagaugggacaaaaauaggaauggug

SEQ ID NO: 113456 - RNA, 64 nt, hsa
cgugagucccuggccuuuccuuuuguaauaagaaagaagagagagaacuugaugcaaaguccac

SEQ ID NO: 113457 - RNA, 64 nt, hsa
gagagagaguggaauauuugguagggaccuugacagaagagagcccugggugcuuguggugcaa

SEQ ID NO: 113458 - RNA, 64 nt, hsa
gcaucagauuggcagcugcaccaaccagaggaacagaagagaagagagaugccacugggcacug

SEQ ID NO: 113459 - RNA, 64 nt, hsa
agauuggcagcugcaccaaccagaggaacagaagagaagagagaugccacugggcacugcccug

SEQ ID NO: 113460 - RNA, 64 nt, hsa
gaaaaacuuacuuguaaugaucaugucagccuucagaagagaauccccaccaacuucugugccu

SEQ ID NO: 113461 - RNA, 64 nt, hsa
ccccagaugggcugcucuccuguaacuuucuaggagaagagacauuuucuucuuucccuuuccu

SEQ ID NO: 113462 - RNA, 64 nt, hsa
uaaccaaacaaugacuccucauuccagcggugacagaagagaaagggucauuuacaucaggaaa

SEQ ID NO: 113463 - RNA, 64 nt, hsa
auucucaguggaaagaguuugaucugcagcacccagaagagaagccaaacucggugucauucug

SEQ ID NO: 113464 - RNA, 64 nt, hsa
gugucuuucuuuauuccuuaauugguugguggaaagaagagaugcuugggaaccuuggguucuu

SEQ ID NO: 113465 - RNA, 64 nt, hsa
agaacuucuggaucuaacucacaaacaagcuuccagaagagacuagagaccuuaggccaggaga

SEQ ID NO: 113466 - RNA, 64 nt, hsa
aaaaaaaaaaagagagagagagagaagaagaagaagaagagacacaaaucucuaccucccaugu

SEQ ID NO: 113467 - RNA, 64 nt, hsa
ugaugaccaggcuuuaguggaagcccuuguuuacagaagagagggguaaaccuaugaaaacagg

SEQ ID NO: 113468 - RNA, 64 nt, hsa
guuaccgaagaggggccaagaaauuagaguccucagaagagaacuuaucuagugaggaugaaga

SEQ ID NO: 113469 - RNA, 64 nt, hsa
aauuugucaauccuagccuuccaagagaagaaaaagaagagaaacuagaaacaguuaaaguguc

SEQ ID NO: 113470 - RNA, 64 nt, hsa
cacagcugaccucuuggcagaaacucuauaagccagaagagagugggggccaauauucaacauu

SEQ ID NO: 113471 - RNA, 64 nt, hsa
gccauuauauaaugguaaauggaucaauucaacaagaagagauaacuauccuaaauauauaugc

SEQ ID NO: 113472 - RNA, 64 nt, hsa
uucagagcagccggaguuugcuggaccacaaggaagaagagaagagacuugcagugaacuguuu

SEQ ID NO: 113473 - RNA, 64 nt, hsa
agcagccggaguuugcuggaccacaaggaagaagagaagagacuugcagugaacuguuuuugug

SEQ ID NO: 113474 - RNA, 64 nt, hsa
cuuaauuuugguuuccaccauuuccuuuuaguggagaagagaggaagucagaggguagggaccu

SEQ ID NO: 113475 - RNA, 64 nt, hsa
gccguuugcugccacugacaaggauuucacaugcagaagagaaaaggccccccuccaccccccg

SEQ ID NO: 113476 - RNA, 64 nt, hsa
gucguuggaauuuguaaauuuacauuuuuuuuaaagaagagacugauguguagauagaaaaccc

SEQ ID NO: 113477 - RNA, 64 nt, hsa
cuaaucacuucacagugaccacuacagaguacuaagaagagaagaucaagggcaugaaauuggg

SEQ ID NO: 113478 - RNA, 64 nt, hsa
uggcauagcuggacuugauuaaguauugacucauagaagagacauguauguuucccggggcuac

SEQ ID NO: 113479 - RNA, 64 nt, hsa
auguuuacuuucucccaaucacaucaccugagguagaagagauuuuucaguugcuauuucucuu

SEQ ID NO: 113480 - RNA, 64 nt, hsa
cuuaagagaaaaagaaaccuacucaagaaaagacagaagagacagugauuugggaugagucuac

SEQ ID NO: 113481 - RNA, 64 nt, hsa
gcugaccaucaagcaggucauaaacagaaacaucagaagagaaaacgacaccuagaagaaggca

SEQ ID NO: 113482 - RNA, 64 nt, hsa
aaacuauuugugggcuauaggaaacuuucugaugccuccggauuguguuaguaguagccaucag

SEQ ID NO: 113483 - RNA, 64 nt, hsa
ccccgcggccuggcgcuccgacugcccucugaggccuccggacuccucucguacuugaacucac

SEQ ID NO: 113484 - RNA, 64 nt, hsa
agagccuggaguaugccaagaacucacgggccucccuccggaagugcucagucauguucauagg

SEQ ID NO: 113485 - RNA, 64 nt, hsa
cagggaagccugggagucccuucucaccccucaaccuccggaguccaggagaacccguaccccc

SEQ ID NO: 113486 - RNA, 64 nt, hsa
aaaauccaucaggaacucuccguccccccggggcccuccggagggagagagagaggaacugcug

SEQ ID NO: 113487 - RNA, 64 nt, hsa
ccugcccugugcccugggaugccuacccugcccaccuccggagguggaaccgggcugccccugg

SEQ ID NO: 113488 - RNA, 64 nt, hsa
cugcgcuugggauugugcccucuccugugucuguccuccggaccuacccaggucuccaccauca

SEQ ID NO: 113489 - RNA, 64 nt, hsa
acccuccucuggcgguccuuccaccuuccucuguccuccggauguccucuuugcccgucuucuc

SEQ ID NO: 113490 - RNA, 64 nt, hsa
cugcccguguguaaccuguaagauguacugugugccuccggaagacaccaccuuucccuucagc

SEQ ID NO: 113491 - RNA, 64 nt, hsa
auucagggagcucucccuuccuccuccuccuccuccuccggaggugggaucccagagccugcca

SEQ ID NO: 113492 - RNA, 64 nt, hsa
acccccuaagccccguuccuccgcagacccaggcccuccggaaggggugaguggggaggggcuu

SEQ ID NO: 113493 - RNA, 64 nt, hsa
uuagcuuggacuucaguccucccucggggacucaccuccggaguaaacggcucuucauuagcuu

SEQ ID NO: 113494 - RNA, 64 nt, hsa
ccagaccccugcccaccuagacuguuuucugagcccuccggaccugagacugaguuuugucuuu

SEQ ID NO: 113495 - RNA, 64 nt, hsa
caugguacuggcaucugcuugguuucuggggaggccuccggaagcuuauagucaugacagaagg

SEQ ID NO: 113496 - RNA, 64 nt, hsa
cccuccuccuaaacuccccaacccaccucucuucccuccggacucuaaacaggaacuugaauac

SEQ ID NO: 113497 - RNA, 64 nt, hsa
ucuucauaucuaaaugcuucauuaauuauccgagccuccggagaauuaacucuauuacguuugu

SEQ ID NO: 113498 - RNA, 64 nt, hsa
cccugugccuggggaagcagucccggcccccaccccuccggaaucucccaccccccacccuccu

SEQ ID NO: 113499 - RNA, 64 nt, hsa
gauggcucaauauguaagguuuucaguaguuuacccuccggaacccaaguuguauguauguaua

SEQ ID NO: 113500 - RNA, 64 nt, hsa
cgccucccaaguucacuccauucuccugccucagccuccggaguagcugggacugcaggcgccu

SEQ ID NO: 113501 - RNA, 64 nt, hsa
gaaacacacagucacauucgaauucggguggcauccuccggagagagagagaggaaggagauuc

SEQ ID NO: 113502 - RNA, 64 nt, hsa
ccagccccuaaacaagauacuucuugguuaaggcccuccggaagggaaaggcuacggggcaugu

SEQ ID NO: 113503 - RNA, 64 nt, hsa
caggugucagaacugggcaccaggacuggagcccccuccggagaccaaacucaccaucccucag

SEQ ID NO: 113504 - RNA, 64 nt, hsa
augggccacgcccccaugcauccccacccccgccccuccggacggcuuacuuaccucauacgca

SEQ ID NO: 113505 - RNA, 64 nt, hsa
cgccuccuggguucaagcaauucuguggcuucagccuccggaguagcugggauuacaggcacau

SEQ ID NO: 113506 - RNA, 64 nt, hsa
agccaucugcgacaccaccaacaggcguucucagccuccggaugacacaaauaccagagcacag

SEQ ID NO: 113507 - RNA, 64 nt, hsa
cuuuggcuccuaagaaucugggcucugcuacccaccuccggagacacaagcccacguaucuacu

SEQ ID NO: 113508 - RNA, 64 nt, hsa
cucaggaaguccagccacuugacuggcacacaccccuccggacauccagcgugacggagcccac

SEQ ID NO: 113509 - RNA, 64 nt, hsa
gaauugagagggaauagcucaccccucauucuguccuccggacuuaggaaccagugaccuuggc

SEQ ID NO: 113510 - RNA, 64 nt, hsa
gacauggagccuggcuggggcuaagcagcccccuccuccggauggcacaggcucugcuagguuc

SEQ ID NO: 113511 - RNA, 64 nt, hsa
ccagcaggugcuguccuggagugccugguguuguccuccggaaugcuggugccggaacucgcua

SEQ ID NO: 113512 - RNA, 64 nt, hsa
gacccucaacuguacacaggucccuccccggcuuccuccggaggcccggcccggccggaggaug

SEQ ID NO: 113513 - RNA, 64 nt, hsa
cgccuccuggguucaagcgauucucgugccucagccuccggaguagcugggauugcaggcaccc

SEQ ID NO: 113514 - RNA, 64 nt, hsa
uuugcauuuugagaaguguccuucccacuucagcccuccggagagacuacccuagucuuucugg

SEQ ID NO: 113515 - RNA, 64 nt, hsa
acauucaugugggcauuucuugcgagccucgcagccuccggaagcugucgacuucaugacaagc

SEQ ID NO: 113516 - RNA, 64 nt, hsa
guucccuugcccugguggugggggggccagaccaccuccggaauccugccaccugugacugucu

SEQ ID NO: 113517 - RNA, 52 nt, hsa
agagcaaggaggcgcccugacaccuccggagccccacccccgcccuucccag

SEQ ID NO: 113518 - RNA, 64 nt, hsa
ccugcuagacggccagccccacacuucgcuucagccuccggaccauuccggagcagccucacau

SEQ ID NO: 113519 - RNA, 64 nt, hsa
ucccggguuuacuuacaccacuguccugccucagccuccggaguagcugggacuacagacaccu

SEQ ID NO: 113520 - RNA, 64 nt, hsa
ucuguuccaggauggacucacugcagaagcaggaccuccggaggcccaagauccauggggcagu

SEQ ID NO: 113521 - RNA, 64 nt, hsa
uuucuggaaggcccuagcucagguggcuucagggccuccggacccccccugggagggguggcca

SEQ ID NO: 113522 - RNA, 64 nt, hsa
uggagaaugaagcucuggaaauccucaccaaagcccuccggagcuaccaguuagggaucggcag

SEQ ID NO: 113523 - RNA, 64 nt, hsa
gaacccagacucuugucuucuucaagagcaagggccuccggagauccaaacugugauugaacca

SEQ ID NO: 113524 - RNA, 64 nt, hsa
ccuuucuuucagucgucacgaccccgcagacuguccuccggauaaacagcauugagauugcucc

SEQ ID NO: 113525 - RNA, 64 nt, hsa
uaaggcugugccucacugccaccaggcacagccgccuccggaaugcacaggcgagucccugccc

SEQ ID NO: 113526 - RNA, 64 nt, hsa
aggaauuuaucuagauaaguuuguuuacuuaugcccuccggaaaucaugcaagacugcucccug

SEQ ID NO: 113527 - RNA, 64 nt, hsa
gccccacugcccaccugaaggggugguuuccagcccuccggagagugggcuuggcccuaggccc

SEQ ID NO: 113528 - RNA, 57 nt, hsa
cucccagcccuagcccgugacugccucccuccggaccgacacucccucagccucuca

SEQ ID NO: 113529 - RNA, 64 nt, hsa
aaggaugcaaauagccgucugcgauuuuggcggcccuccggauuguggugacaauauguuguac

SEQ ID NO: 113530 - RNA, 64 nt, hsa
uggugcugcaggcccauaggaaggagcuggaaggccuccggaugcgugccagcaaugaguuggc

SEQ ID NO: 113531 - RNA, 52 nt, hsa
uggaggccgaccuggagugaggccuccggacucuggcacgcuccagcagccc

SEQ ID NO: 113532 - RNA, 64 nt, hsa
ucccagcaucacaccagccaugcagccagcagguccuccggaucacugugguuggguggagguc

SEQ ID NO: 113533 - RNA, 64 nt, hsa
cuucagauguaccuccagccuuucacuccucgguccuccggagcccacaaccuggacacagcuc

SEQ ID NO: 113534 - RNA, 64 nt, hsa
cccucagccugggggaagaagagggccucgggggccuccggagcugggcuuugggccucuccug

SEQ ID NO: 113535 - RNA, 62 nt, hsa
accgucucaaggccuccuaauagcugcccuccccuccggacuggugcccuccucacucccac

SEQ ID NO: 113536 - RNA, 64 nt, hsa
gcuuuuccaagcugccacuggucggccaguacagccuccggaagcagcccuacaacaaccugaa

SEQ ID NO: 113537 - RNA, 64 nt, hsa
aaaaacaaaugaucuguuaacaaaggacugcccaccuccggaacuucugaccucuguuuccucc

SEQ ID NO: 113538 - RNA, 64 nt, hsa
cccauuucuuaccugugauguguuuuacccagcaccuccggacacucaccuucaggaccuuaau

SEQ ID NO: 113539 - RNA, 64 nt, hsa
cuccuugacgcgcucccgggccucaggguccugcccuccggaggagcagccucgaggcuggugg

SEQ ID NO: 113540 - RNA, 64 nt, hsa
auguucacucccgacccuggaaacccggauuucgccuccggacagcggcgucugggcaggguuc

SEQ ID NO: 113541 - RNA, 64 nt, hsa
ggccugcgccugcgccggacgcuccgcggccccgccuccggacccggggcugggcggggcgccg

SEQ ID NO: 113542 - RNA, 64 nt, hsa
gcugucuggugagguggcccaggcccccggcuuuccuccggagccucauguucucuucccaggc

SEQ ID NO: 113543 - RNA, 64 nt, hsa
cccgcgccccacauaccugcaucuuccgcugugaccuccggagcccugccugccccugcucccc

SEQ ID NO: 113544 - RNA, 64 nt, hsa
cucaucugguggccacagcagccaagccuagagcccuccggaucccauccaggcgcaaagagga

SEQ ID NO: 113545 - RNA, 64 nt, hsa
cuuugccuccccggcucgagcaguccugccucagccuccggaguagcugggaccacagguucau

SEQ ID NO: 113546 - RNA, 64 nt, hsa
guaucgucaggugggauaauccuuaccuguuccuccuccggagggcagauuagaacaugaugau

SEQ ID NO: 113547 - RNA, 64 nt, hsa
acccgacucagcuugagacacuccagccaaggguccuccggacccgauccugcagcucuuucug

SEQ ID NO: 113548 - RNA, 64 nt, hsa
guccuuagcgccugggaaccaggacauaaaagcgccuccggagccgcccugcggcggggucccu

SEQ ID NO: 113549 - RNA, 64 nt, hsa
caggugcuucaaagccaacagaccagcuccucuuccuccggauccucuuuugaucugcccagga

SEQ ID NO: 113550 - RNA, 64 nt, hsa
gcggagauccccuuccuucugggugcagacugcaccuccggaugcaguuuugauguccaucuuc

SEQ ID NO: 113551 - RNA, 64 nt, hsa
gccgccaugcuucugugccgaccacgccccaggaccuccggagcgcccugcagggccgggcagg

SEQ ID NO: 113552 - RNA, 64 nt, hsa
gcauguacgggccucguacugccucauggaaaauccuccggagccgcccuccauuguggguucc

SEQ ID NO: 113553 - RNA, 64 nt, hsa
ggcuggaccccgacacguaggcgccgcccuccugccuccggacccuucccgcucccggccgugg

SEQ ID NO: 113554 - RNA, 64 nt, hsa
acccccauccuggccgcaccccccuuuccaggguccuccggaccccaccuuccacacucugauc

SEQ ID NO: 113555 - RNA, 64 nt, hsa
accacccggccuuucccugcgccgugcccacccuccuccggaaucucccuucccuuccuggcca

SEQ ID NO: 113556 - RNA, 64 nt, hsa
ccgguggacagacuuaacgauccuugcugcagucccuccggagaggaucuggacuggcugggag

SEQ ID NO: 113557 - RNA, 64 nt, hsa
ccccagggucugccgucuagagggagcccaccggccuccggacacugucuucccgcuagagccc

SEQ ID NO: 113558 - RNA, 64 nt, hsa
auucacauuccccucccccugugguccagugaagccuccggaccccaggcucugcucugcccug

SEQ ID NO: 113559 - RNA, 64 nt, hsa
ggguugacccagggcugucucccuccagagccucccuccggacaaugaguccccccucuugucu

SEQ ID NO: 113560 - RNA, 64 nt, hsa
cagacuccuccuacccccaggugugcccccuuagccuccggaggcgggggcugggccuguaucu

SEQ ID NO: 113561 - RNA, 64 nt, hsa
gggaagucucagagaagccauagccccccugggaccuccggacugggaggggagcagagucccc

SEQ ID NO: 113562 - RNA, 64 nt, hsa
acacacaaaucucaggaacaaacggucccagaguccuccggaccccugcccagggucucugcag

SEQ ID NO: 113563 - RNA, 64 nt, hsa
uccuggccgagggcggggggcagcggggggucucccuccggaccuaccucagggagcugagcgu

SEQ ID NO: 113564 - RNA, 64 nt, hsa
cuugguccuccugucccugcugcaggggcuggggccuccggagcugcugcgggcuccccucagg

SEQ ID NO: 113565 - RNA, 64 nt, hsa
aggauugaagcggugcucagccaggccccuggggccuccggacaaacuugggggugaggggaag

SEQ ID NO: 113566 - RNA, 64 nt, hsa
ucacguauccccacgccucggggcccccgccgccccuccggacccgcagagcuggggacauggc

SEQ ID NO: 113567 - RNA, 64 nt, hsa
uacuggccacuuacccucuggggccucagcuuucccuccggaaggcugggaggaggugggcuag

SEQ ID NO: 113568 - RNA, 64 nt, hsa
ccaccaccaccaccaccacucaccaccaucaucaccuccggaaaguguaguccugcccuaaccc

SEQ ID NO: 113569 - RNA, 64 nt, hsa
ggggcugggagauguuccuggaggaggacacucccaucagaacuuggcagccuugaaguugggg

SEQ ID NO: 113570 - RNA, 64 nt, hsa
cugggggccugaagacauuccuggaggacacucccaucagaaccuggcagccccaaaacugggg

SEQ ID NO: 113571 - RNA, 64 nt, hsa
auaaguuagaacaagcccaaauuuaauuugcaaccaucagaauucagaaucuauagugaccagu

SEQ ID NO: 113572 - RNA, 64 nt, hsa
gauuucuaguuuuuuuucuaguuuuuaauuuuaacaucagaacugaaauaaaaaauuauggaua

SEQ ID NO: 113573 - RNA, 64 nt, hsa
gggugaucauacauacaucaacaugaaggugugacaucagaaucaugagcaccauggcugcagu

SEQ ID NO: 113574 - RNA, 64 nt, hsa
cucugugcccucagggacuggcagagcaagaggccaucagaaggacgaggugcuguuggcaauu

SEQ ID NO: 113575 - RNA, 64 nt, hsa
auauucuauugauuuaaugugaccuguuuggucucaucagaagucuuaccauugggcauuugaa

SEQ ID NO: 113576 - RNA, 64 nt, hsa
caaaugagcaaaacuaaggaugaaauguaauauucaucagaacaaggaucacugagaaaaaaua

SEQ ID NO: 113577 - RNA, 64 nt, hsa
ugccaugcaaccaccaccacgacagcccuuccuccaucagaagacaggagugagggccccgggc

SEQ ID NO: 113578 - RNA, 64 nt, hsa
ccaaaaaccuucuuagcaggacagcugugagaggcaucagaaccucacguucggacugccuuca

SEQ ID NO: 113579 - RNA, 64 nt, hsa
cuugcaguuuuaaauauuguggauauuuguccugcaucagaaacgagcuuugguuuuuacagau

SEQ ID NO: 113580 - RNA, 64 nt, hsa
agaaaaaaaaaaagaaaaaguuccgggcauuuugcaucagaaaacaacuuugucuuggggcaca

SEQ ID NO: 113581 - RNA, 64 nt, hsa
ggcuucuugaugcugcgcggucccccacucccuacaucagaaugcaucccgcauccagacucca

SEQ ID NO: 113582 - RNA, 64 nt, hsa
caagucuugaugcugcgccgucccccacucccuacaucagaacgcaucccucaucuggacucca

SEQ ID NO: 113583 - RNA, 64 nt, hsa
cucucaaauguaugucucuuacguaacauacucuaagaaugaaacugucaccacagguaaaucc

SEQ ID NO: 113584 - RNA, 64 nt, hsa
agucauuacaugucaaauucaauuuuucugccuuaagaaugaauguccuucauaaaauauugga

SEQ ID NO: 113585 - RNA, 64 nt, hsa
auagacugccugcguccuuaccacugaucuggccaagaaugaggcccucccaacacuuucacuc

SEQ ID NO: 113586 - RNA, 64 nt, hsa
gaaguuggugcuuguaugguguuuccuuagccuaaagaaugaucuguuguuugaaaccuuugua

SEQ ID NO: 113587 - RNA, 64 nt, hsa
ccagagugcacuggggggaauguucucagcagagaagaaugaggagaaguuuaauauuuugccc

SEQ ID NO: 113588 - RNA, 64 nt, hsa
uggguggcaguguuugguacugaaguugggcucuaagaaugaggggaaagagccuggggaggag

SEQ ID NO: 113589 - RNA, 64 nt, hsa
cuaauuauuuuaccguuuuguugaccuuguacacaagaaugagauuaaucuguauuauauaaga

SEQ ID NO: 113590 - RNA, 64 nt, hsa
gcuguacuuuaugacuuguuucccuauggugguaaagaaugaugccauagucaguuuuauugac

SEQ ID NO: 113591 - RNA, 64 nt, hsa
cugugacauuuucuuuguucugaaacaucauuaaaagaaugacaguacauugaauggguauaau

SEQ ID NO: 113592 - RNA, 64 nt, hsa
ugucaauucaaguacaaaacuacaugaguacuauaagaaugaauuuugcaaauauuuguaagua

SEQ ID NO: 113593 - RNA, 64 nt, hsa
ggaagagggauuuugaagagguaucucuccaagcaagaaugacuuguuuuuccauaagggacau

SEQ ID NO: 113594 - RNA, 64 nt, hsa
cacuuguaaauaaaaagguuagaaucuaaggacaaagaaugauccaaaaauacuaaggaaaaag

SEQ ID NO: 113595 - RNA, 64 nt, hsa
gagccagucacuuuucccucuuagaaaaucucagaagaaugauuaggggcacccaaaguucugg

SEQ ID NO: 113596 - RNA, 64 nt, hsa
acauaugaagguuuaaaaauacaucauguggccaaagaaugagaaaggacagaauuaaccaagg

SEQ ID NO: 113597 - RNA, 64 nt, hsa
gaugccuuauuugaaacugggcuuaaacugcaaaaagaaugaaguuggauuuaggaagcuguua

SEQ ID NO: 113598 - RNA, 64 nt, hsa
ccugaaugcaaucauuaacuugguugcuaauuacaagaaugaaaauuauaauggaaaaggacaa

SEQ ID NO: 113599 - RNA, 64 nt, hsa
ccugcucguuuccaccuuuaagaaugauuuugccaagaaugauuauaucaaaaauaguaguuga

SEQ ID NO: 113600 - RNA, 64 nt, hsa
uugcuguacuaucagccugcucguuuccaccuuuaagaaugauuuugccaagaaugauuauauc

SEQ ID NO: 113601 - RNA, 64 nt, hsa
cugcuugucauaauugucagggcugaauaguuguaagaaugacuuuucuuugaaucaguauuuu

SEQ ID NO: 113602 - RNA, 64 nt, hsa
aucuuuacuauaauuaccaaaaacauguauauaaaagaaugaaauugaaaaauaaaauauauaa

SEQ ID NO: 113603 - RNA, 64 nt, hsa
accaaaacauacccugaugaagauccugaacuucaagaaugaagaaagaauuccucaccauuca

SEQ ID NO: 113604 - RNA, 64 nt, hsa
ugggggaguauuuccgaaguucugaguaggaaaaaagaaugacucaaauguauuauugccaacc

SEQ ID NO: 113605 - RNA, 64 nt, hsa
auaagaauagucuucuagaagugaggaugcgaaaaagaaugaguuuccaauuacccugauguga

SEQ ID NO: 113606 - RNA, 64 nt, hsa
aaugaaaaaaugaaaaaaagaaggaaaaaagaauaagaaugaaaacugcugacguauuacaaaa

SEQ ID NO: 113607 - RNA, 64 nt, hsa
guaaagaaaagucucauaagguagccaaaugaaaaagaaugaaagggaaagugaaaaauuaagg

SEQ ID NO: 113608 - RNA, 64 nt, hsa
uuugcuaaugccucuauuuacuugcuuuggcauaaagaaugagccaaugaaccucuguguccug

SEQ ID NO: 113609 - RNA, 64 nt, hsa
cacagguugaccaauaaccaugcccaagaaugagaagaaugacuaugcaaccuuuggaugcacu

SEQ ID NO: 113610 - RNA, 64 nt, hsa
uagaagcaucacagguugaccaauaaccaugcccaagaaugagaagaaugacuaugcaaccuuu

SEQ ID NO: 113611 - RNA, 64 nt, hsa
gacagggcuaaaacugggcuacagaauuuucaaaaagaaugauacauucugaagguauguuuau

SEQ ID NO: 113612 - RNA, 64 nt, hsa
ggaaaaacaacuuagaggauuuagcagcuaaaagaagaaugagucagcuggugaugugcuuggu

SEQ ID NO: 113613 - RNA, 64 nt, hsa
ccuuugcuugaauaaacauuuuggaucaccuccaaagaaugaaaaccaguaguacguuuuaguc

SEQ ID NO: 113614 - RNA, 64 nt, hsa
uuuuuuauaauaagaaaacaucugacuaaagucaaagaaugauuucuuaugguuuauuuugaug

SEQ ID NO: 113615 - RNA, 64 nt, hsa
cuaccauguuuauuugcugacugaauuaagauuuaagaaugauuaaaaauaagcuuuuacuuuu

SEQ ID NO: 113616 - RNA, 64 nt, hsa
uaugucuuuucagccuguaauucuuugggccccaaagaaugacaaaggaggcacucguucucuu

SEQ ID NO: 113617 - RNA, 64 nt, hsa
cugaccaaaaaugucucaaagucaacagcccaauaagaaugaagaauggaaauggaaaagggug

SEQ ID NO: 113618 - RNA, 64 nt, hsa
ugugaagaaagaggaggaggagcgccuccggcagaagaaugaggugacccucagcauucccgug

SEQ ID NO: 113619 - RNA, 64 nt, hsa
aaaugucucugaaacaggcauacaggcucuagucaagaaugaauuagagugaaggaaagcugug

SEQ ID NO: 113620 - RNA, 64 nt, hsa
gcaggauacaguguguuucaucuguuccggugccaagaaugagcaguguacuguggcaguuccc

SEQ ID NO: 113621 - RNA, 64 nt, hsa
cuggagcagaggggcacuaacccaggcugacgccaagaaugaaguggcccacugcagcccuggc

SEQ ID NO: 113622 - RNA, 64 nt, hsa
cacccccguagcuugcacccuucagugacccuagaagaaugauuggacagaugugagccaucug

SEQ ID NO: 113623 - RNA, 64 nt, hsa
gacccugccaaaucccccucugcgagaaacacccaagaaugaucaauuaaaaaaaaaauaauau

SEQ ID NO: 113624 - RNA, 64 nt, hsa
acacugggguuaacuguauugcuggaaaaacaucaagaaugacagucuuauauuuaaggcacca

SEQ ID NO: 113625 - RNA, 64 nt, hsa
uuuugaaugugaacaaaaggaagaaaaucaaggaaagaaugagucuaauaucaagccuguacag

SEQ ID NO: 113626 - RNA, 64 nt, hsa
ccagaagaaagggccuucacaguguccuuuauguaagaaugauauaaccaaaagguauauaauu

SEQ ID NO: 113627 - RNA, 64 nt, hsa
ugucugugacagaugaacuuuugcauguguauauaagaaugaguugggaccucugucuuuaaaa

SEQ ID NO: 113628 - RNA, 64 nt, hsa
ccaguuuuuagauguagauguagugaaaaacuucaagaaugaagcagagcaauugaguauucuu

SEQ ID NO: 113629 - RNA, 64 nt, hsa
aacauagccagaccuccucucuacaaaaagaaaaaagaaugacaugcuucuuguuuuugucugu

SEQ ID NO: 113630 - RNA, 64 nt, hsa
guacaacuuuuuaagcaaugccaaacuaugacuuaagaaugaaauuauugcucauuuguauauc

SEQ ID NO: 113631 - RNA, 64 nt, hsa
auggaaaugagugacuggaaaucccauaggccacaagaaugacuuucacaagggcaggaacauu

SEQ ID NO: 113632 - RNA, 64 nt, hsa
uguuugguaaccccuauaaacuggggcagaggaaaagaaugaugguucaaggccauacuucccu

SEQ ID NO: 113633 - RNA, 64 nt, hsa
uuucagugucuuacagcggccaaaccaugacgugaagaaugagauaggagacaggagaucacca

SEQ ID NO: 113634 - RNA, 64 nt, hsa
aguugcccucaccuuguguguggagaugcauuccaagaaugaagccucaucuugcuacugagug

SEQ ID NO: 113635 - RNA, 64 nt, hsa
aaacacagacgcccaggugucagcucuccguuuaaagaaugaaaaauguaacucaugaugaucu

SEQ ID NO: 113636 - RNA, 64 nt, hsa
aucuucaagaaguugauuccaaaacugaguuaugaagaaugauauaacaguuccuucaaaauug

SEQ ID NO: 113637 - RNA, 64 nt, hsa
ucagcuuuuauuccugcccugcuguuuaucccuuaagaaugaguuucuuagacuuuuccaauau

SEQ ID NO: 113638 - RNA, 64 nt, hsa
ggugguaauaagggaaaaaucaaguauuauaaacaagaaugaagguuuuuguaaagauuucugu

SEQ ID NO: 113639 - RNA, 64 nt, hsa
ggucucaaaugcgugaucagagaauccuucaccuuugcugaaaagugagcucagauccagcacc

SEQ ID NO: 113640 - RNA, 64 nt, hsa
cuucaaaagggcaagaucuuuuuuccuucacuuauugcugaaaccaagagcacaauucccauug

SEQ ID NO: 113641 - RNA, 64 nt, hsa
caagcugcgccggccuccagcccacccacagcuguugcugaagucaggccucccuccccagcac

SEQ ID NO: 113642 - RNA, 64 nt, hsa
cucugcugugcuggcuucccaugaccaccuccucuugcugaaauauuacugcuugaaucuggag

SEQ ID NO: 113643 - RNA, 64 nt, hsa
uuuucaaaggaguaguuacuugcaaauuacauccuugcugaauucaggagguaugaaacccuau

SEQ ID NO: 113644 - RNA, 64 nt, hsa
ugugucccaguaagagagucacagcuucagguguuugcugaauccaggucugagaucacaaucc

SEQ ID NO: 113645 - RNA, 64 nt, hsa
gacugagcauugcucagaucacuguggccacacuuugcugaaagagaugcugggacauagaacc

SEQ ID NO: 113646 - RNA, 64 nt, hsa
caacugguuugauaguuacuauuuucugaccuguuugcugaagugauuugcgaauugacuuucc

SEQ ID NO: 113647 - RNA, 64 nt, hsa
guauuugacuuugaauuuuaauguauuuccacuuuugcugaagcuuuuaaucagauguguaaaa

SEQ ID NO: 113648 - RNA, 64 nt, hsa
aaacaugaguagauccaugauggauuaauaaagcuugcugaaaaaaaaaaucuguguaucaauu

SEQ ID NO: 113649 - RNA, 64 nt, hsa
cuaccccugauucuaugacauuggggcccuucuuuugcugaaacugccuuacguaaugguuuua

SEQ ID NO: 113650 - RNA, 64 nt, hsa
uguguguguggugggggaguggguauuacaugcauugcugaagagucauccugguguuccucau

SEQ ID NO: 113651 - RNA, 64 nt, hsa
uuuuacuuuuuugauauaaaaucaagauauuucuuugcugaaguauuuaaaucuuauccuugua

SEQ ID NO: 113652 - RNA, 64 nt, hsa
uuuguagaauucauuucggcagcucacuaggauuuugcugaacauuaaaaagugugauagcgau

SEQ ID NO: 113653 - RNA, 64 nt, hsa
gcuggagaucaucuuuaagggcaaaggaguuggauugcugaauuacaaugaaacaugucuuauu

SEQ ID NO: 113654 - RNA, 64 nt, hsa
cacuucugugucuuucuaauggaaaugaguagaauugcugaaagucucuauguuaaaaccuaua

SEQ ID NO: 113655 - RNA, 64 nt, hsa
gaccuauuucuaaacuguugaauaugcugcaccauugcugaaaugaaagaugacucugggggag

SEQ ID NO: 113656 - RNA, 64 nt, hsa
ucccuuuccucagugaugugaaaauaauuguguuuugcugaacuuguuaucuucauucaauuuc

SEQ ID NO: 113657 - RNA, 64 nt, hsa
aaaauccuuuagaguucagcucuaaccagaaaucuugcugaaguaugucagcaccuuuucucac

SEQ ID NO: 113658 - RNA, 64 nt, hsa
ugucuggcggggagccaggugacaucauaaauacuugcugaaugaaugcagaaaucagcgguac

SEQ ID NO: 113659 - RNA, 64 nt, hsa
uucagaaagaaagacccuucaguuuugaugcauuuugcugaacacuuggguagugagugggauc

SEQ ID NO: 113660 - RNA, 64 nt, hsa
gcuuuaucuuugguaacuuuuacuugaaugggauuugcugaauuaaugacuauugaauuuaaaa

SEQ ID NO: 113661 - RNA, 64 nt, hsa
acaaugacccaucaucucuugcuugcuugaaaucuugcugaaauguucucauuuccuguuugcu

SEQ ID NO: 113662 - RNA, 64 nt, hsa
uuauggucuauacauaaaaaaguaagacuaaguauugcugaauuugcaguuauguugucgugua

SEQ ID NO: 113663 - RNA, 64 nt, hsa
uaaauaaacaucuaugccuuuucucagaaaugauuugcugaacuauguccauauuuuacagcuu

SEQ ID NO: 113664 - RNA, 64 nt, hsa
agacacauguauacaaggcacuauuguacacacuuugcugaauauuuugucaguuguauuuaca

SEQ ID NO: 113665 - RNA, 64 nt, hsa
aagaaacuugaacaggauaaugugucuaaaaauauugcugaaguuauucuugaucagauagaau

SEQ ID NO: 113666 - RNA, 64 nt, hsa
guauagaaucuuucuucaucaucuaaaugguguguugcugaaguuauugugguauauaauccug

SEQ ID NO: 113667 - RNA, 64 nt, hsa
uuucugcccuuccucacccccacgccccaccccacucccccagaguacuccccacugugaaaag

SEQ ID NO: 113668 - RNA, 64 nt, hsa
augaggcauugucacccuagaccccucuuccucucucccccaccauagugugcaauaaaguguc

SEQ ID NO: 113669 - RNA, 64 nt, hsa
augugucuaaagacuugguguccccuucucucuccucccccacccgccacuccuggguacaucu

SEQ ID NO: 113670 - RNA, 64 nt, hsa
ccuugcaguaauuuauuuucuguauggacugucccucccccagaggcuuccccacccuccauug

SEQ ID NO: 113671 - RNA, 64 nt, hsa
gaccagccacugugggaccaacaccccucccacacucccccagacugcucgucuaucaccagga

SEQ ID NO: 113672 - RNA, 64 nt, hsa
cacccagcccugccccucaccugccugcccuccccucccccacucuauacuagggacuggaucu

SEQ ID NO: 113673 - RNA, 64 nt, hsa
cccacacacacuccuuccccuugucccuggggcacucccccaggauugugcaauagucagagug

SEQ ID NO: 113674 - RNA, 64 nt, hsa
uacccuuccucaucugugccugucuguccaaccccucccccacgucucucugccugcugggcuc

SEQ ID NO: 113675 - RNA, 64 nt, hsa
aguaacuaauauuaggcaguugauacucccccaccucccccauuuagauacacuacuguauuag

SEQ ID NO: 113676 - RNA, 64 nt, hsa
ugaaaauucaguaacuaauauuaggcaguugauacucccccaccucccccauuuagauacacua

SEQ ID NO: 113677 - RNA, 64 nt, hsa
ugauuccugggcucccagccuuaaaacucacugccucccccaagggcccccucuaaggagggug

SEQ ID NO: 113678 - RNA, 64 nt, hsa
ugacaggccuucuguacccagcguuuguacuugccucccccaacagugggccuguucuacccgu

SEQ ID NO: 113679 - RNA, 64 nt, hsa
acuuuagcagaugugguuucaaaguaaaggccuccucccccaccccuuaggccccguggugaca

SEQ ID NO: 113680 - RNA, 64 nt, hsa
ugucagcuucccagccaugcccaggacguccuaucucccccaacccaccucuggcccuguguag

SEQ ID NO: 113681 - RNA, 64 nt, hsa
gccgccacacucagugccauggggaagcgggcgucucccccaccagccccaccaggcgguguag

SEQ ID NO: 113682 - RNA, 64 nt, hsa
ucagacuucugccuuaaccagccccggggcuuggcucccccagcucugagcgugggggcauagg

SEQ ID NO: 113683 - RNA, 64 nt, hsa
gggggaugucaaguggugaugucguugugcuccccucccccagagcgggugggcggggggugaa

SEQ ID NO: 113684 - RNA, 64 nt, hsa
agaguguguuuccuuucgugucugcccaccucuucucccccaccucccgggucccuucugucgg

SEQ ID NO: 113685 - RNA, 64 nt, hsa
auaauuauuauaauuauuauaauuauuuuauccccucccccaccgccucgcugcccccgcccag

SEQ ID NO: 113686 - RNA, 64 nt, hsa
cggagcccccaucccuuaucuuacccccaccgcgcucccccaggagcgcucccucagcucucuc

SEQ ID NO: 113687 - RNA, 64 nt, hsa
gcaguuauugaccucccggucccgccugcccgcccucccccacguggccccuugacccgggcgg

SEQ ID NO: 113688 - RNA, 64 nt, hsa
cgccggagguacaguuuuuccaggugcuuaagcccucccccacugugccacccuugugaccuuc

SEQ ID NO: 113689 - RNA, 64 nt, hsa
uguucagaaaggcacaauguggagccuggggugucucccccaccccaggaccgucagguuuacc

SEQ ID NO: 113690 - RNA, 62 nt, hsa
gcaugguucagucucccugaguguccggugaccucccccagggccuccuugcccagcccagu

SEQ ID NO: 113691 - RNA, 64 nt, hsa
ccaucuguuggccaccugcaggccagucucaacccucccccaggugggcaggcacuugauggcu

SEQ ID NO: 113692 - RNA, 59 nt, hsa
ucuuuguggaugugaugugagcagggccccucccccagcuccauuccgcucccacccca

SEQ ID NO: 113693 - RNA, 64 nt, hsa
ccaggccugaaacauuucuuuucuuucuuuuuuccucccccaauuuacccugggccuggagcag

SEQ ID NO: 113694 - RNA, 64 nt, hsa
agccacccuccuccacagguccaggugccgcucccucccccaccacacaucagugucuccuccc

SEQ ID NO: 113695 - RNA, 64 nt, hsa
ggagugggaggguugguugccccucaccucagagcucccccaaaggccaguaauggauccccgg

SEQ ID NO: 113696 - RNA, 64 nt, hsa
gauggaugcacguucacuacugugacggccgcaccucccccaugcaccccacccucccccaaag

SEQ ID NO: 113697 - RNA, 64 nt, hsa
cugugacggccgcaccucccccaugcaccccacccucccccaaagcccggaucccgagaaagau

SEQ ID NO: 113698 - RNA, 64 nt, hsa
ucccagagcggggugagggggcuuaugccccccccucccccaguguguugggugggguggaauu

SEQ ID NO: 113699 - RNA, 64 nt, hsa
ggggggaacuuacucuaggaaaagccaugucucucucccccaggguggggggaccuguguugga

SEQ ID NO: 113700 - RNA, 64 nt, hsa
gugagaccccucccuuccagaauccaggccccaucucccccaacuccacagccccucccgagcc

SEQ ID NO: 113701 - RNA, 64 nt, hsa
ccuccccccaaccaccagcagcagcagggcccuccucccccaccagcucuccccacagggcccc

SEQ ID NO: 113702 - RNA, 64 nt, hsa
gccaagcugcuaagccaaagauggccccugacaccucccccagccccagcacaccagccugcac

SEQ ID NO: 113703 - RNA, 64 nt, hsa
aacgggggcuggggguaagagaaaucuaacugcgcucccccaaccccucgcccugccaucuucc

SEQ ID NO: 113704 - RNA, 64 nt, hsa
cuccggcagcucagggaguguuuuccugugaggccucccccaucaguggaccagagggagaagc

SEQ ID NO: 113705 - RNA, 64 nt, hsa
auggcacuguccagcucugggcuagccagaucaacucccccacccgucuucuuccucuguccca

SEQ ID NO: 113706 - RNA, 64 nt, hsa
caaggcuuuggugguaauccugugauuuuuuuuucucccccauccccucacuggcccaucccuc

SEQ ID NO: 113707 - RNA, 64 nt, hsa
ucagcacuccagucccaucaccugaaccuucagucucccccaucuguuacacuagagggcugca

SEQ ID NO: 113708 - RNA, 64 nt, hsa
ccauccccagcacccccugcuacaccucagcagccucccccaugcaaaaaggaaagagaaaaau

SEQ ID NO: 113709 - RNA, 64 nt, hsa
caaggguggcaggucacugucacugccgacaucccucccccagcagaauggaggcaggggacaa

SEQ ID NO: 113710 - RNA, 64 nt, hsa
ucacacaucugggugcccugaaagggcccuuccccucccccacuccucuaagacaaaguagauu

SEQ ID NO: 113711 - RNA, 64 nt, hsa
agcaccacggggucgggggaggagcacccccagccucccccaggcugcgccugcccgcccgccg

SEQ ID NO: 113712 - RNA, 64 nt, hsa
ccccuugaccccacacgccggggcuggcccugcccucccccacggccgucccugacuucccagc

SEQ ID NO: 113713 - RNA, 64 nt, hsa
acacuuuuuuaaaggggauuaaaaaacacagccucucccccaaaggguguccguucuuaauucc

SEQ ID NO: 113714 - RNA, 64 nt, hsa
gcgggaggagcagcuguguguccccggcaccucacucccccaaaaugacacccaccgucgucag

SEQ ID NO: 113715 - RNA, 64 nt, hsa
auaagugcucuuggggguggcucuaccccauuaccucccccagccacaacuccuggccuucgac

SEQ ID NO: 113716 - RNA, 64 nt, hsa
ucugcagccacucuggcucccaagacuucccugacucccccacuccccuccuugccaggggcac

SEQ ID NO: 113717 - RNA, 64 nt, hsa
uucaccccaacuugugacugcucacuuaugacgucucccccaguacccuccaucucaaauaggc

SEQ ID NO: 113718 - RNA, 64 nt, hsa
agccccuauuuuuuccaagcacgaagccaccagucucccccagggagcaucaggaagggacaug

SEQ ID NO: 113719 - RNA, 64 nt, hsa
cacagauaaguggcucuuacccagcucucagugacucccccacaaaacagcaacagccuccacc

SEQ ID NO: 113720 - RNA, 64 nt, hsa
cugcugcuggagcaggcaccuugggcugggccugcucccccagggcccagggccccccagcuua

SEQ ID NO: 113721 - RNA, 64 nt, hsa
guuugacuuuguuauaaaaauagggcucccccaccucccccauuucuguguccuuuauuguagc

SEQ ID NO: 113722 - RNA, 64 nt, hsa
cacagaucuguuugacuuuguuauaaaaauagggcucccccaccucccccauuucuguguccuu

SEQ ID NO: 113723 - RNA, 64 nt, hsa
aggagcuuugacucaggagccugugacauacccccucccccaccguugucucaugccaguaaca

SEQ ID NO: 113724 - RNA, 64 nt, hsa
ggcacccccgucaagagugaauucccucacucgucucccccaacagcuggacccugaccagcuc

SEQ ID NO: 113725 - RNA, 64 nt, hsa
cuacacucuguaaggaccuggggcaggauaucuucucccccagggaucuucuauuuaaguggcu

SEQ ID NO: 113726 - RNA, 64 nt, hsa
cccucacagcccccugucuccagugugagucaugcucccccaggaguuccaggagaacucagcc

SEQ ID NO: 113727 - RNA, 64 nt, hsa
cuggaauccugguccccagcaggagagccuaguccucccccagccccuccagccaccagggugu

SEQ ID NO: 113728 - RNA, 64 nt, hsa
uucauuuugaaaguguuuuucucauucuccauaccucccccaagcucuccuccagcccuuccca

SEQ ID NO: 113729 - RNA, 64 nt, hsa
uggaggggaccccuugggcccucuggggcuuccccucccccaccugguugggguagagcaaaag

SEQ ID NO: 113730 - RNA, 64 nt, hsa
acucuuccgaggucucccugaaaugaauguauuucucccccaaaagagcugauauuuaauguuu

SEQ ID NO: 113731 - RNA, 64 nt, hsa
cucucccccagccgcacgggcacuggaggucucgcucccccagccuccgacccgaggcagaaua

SEQ ID NO: 113732 - RNA, 64 nt, hsa
gaugacuccuacaucuaaguggccccuccacccucucccccagccgcacgggcacuggaggucu

SEQ ID NO: 113733 - RNA, 64 nt, hsa
gaaucuggggggagagaggaaggacaggucaggucucccccagccccuucugcuccugucuccu

SEQ ID NO: 113734 - RNA, 64 nt, hsa
gggguugguuccauuucggccaccaggacugccccucccccacuccucccaauuccuauggagc

SEQ ID NO: 113735 - RNA, 64 nt, hsa
guuugaugucaucagcaccauccaucaggacuggcucccccaucugcuccaagggagcgugguc

SEQ ID NO: 113736 - RNA, 64 nt, hsa
uggggaagggucagagaugccagcccccugggaccucccccauccuuuuugccuccaaguuucu

SEQ ID NO: 113737 - RNA, 64 nt, hsa
uuuuuaaauuuuaacuuauaucagucacuugccacucccccacccuccuguccacaacuccuuu

SEQ ID NO: 113738 - RNA, 64 nt, hsa
ccuaaaaaacuuucuccucuuuguccuccuuuuucucccccacucugagguuuccccaagagaa

SEQ ID NO: 113739 - RNA, 64 nt, hsa
aucucuuagggacccagaccccuaaauucuccuccucccccauuuugauguuaagguggagagg

SEQ ID NO: 113740 - RNA, 64 nt, hsa
cccuuguugcccuagagugggacccagcccucaccucccccagagcuaaccugggaggugcuga

SEQ ID NO: 113741 - RNA, 64 nt, hsa
cugaaagagccgcccucccuuccccaaggauccacucccccagcuccuuuagagaauggcuacu

SEQ ID NO: 113742 - RNA, 64 nt, hsa
acaucccaacauuugacaccccagcaaugugugacucccccaacauuccacuaugccauccugc

SEQ ID NO: 113743 - RNA, 64 nt, hsa
aggaaggacaugucccacuccaucccccuuccugcucccccauuuccuaacucccccaguguga

SEQ ID NO: 113744 - RNA, 64 nt, hsa
acuccaucccccuuccugcucccccauuuccuaacucccccagugugaauucucagggucacuu

SEQ ID NO: 113745 - RNA, 64 nt, hsa
gggaagugggcccuucccugggucucugcacugacucccccacuccugacccuggugauggucg

SEQ ID NO: 113746 - RNA, 64 nt, hsa
gaccagguccugugaggaagccuggagcaagggucucccccagcaggauggguggggccugcuc

SEQ ID NO: 113747 - RNA, 64 nt, hsa
acuccaugggcagggagcuggggggacaucucaccucccccauggcacagagcccuccacaccc

SEQ ID NO: 113748 - RNA, 64 nt, hsa
ugggccccuuuuauuuuuaccugccacccagcaucucccccaccugccccuucugggugacaca

SEQ ID NO: 113749 - RNA, 64 nt, hsa
gcagacggccccucucuucccagcacuucccugccucccccaggccucaggcccagcacccagu

SEQ ID NO: 113750 - RNA, 64 nt, hsa
gggcucccgccugugccccuucuccucaccaugucucccccacccugccucaguucuccguucc

SEQ ID NO: 113751 - RNA, 64 nt, hsa
ggcauccucauccuguaccuauagaguucgugcacucccccauccaugcuaccuaccuccccgu

SEQ ID NO: 113752 - RNA, 64 nt, hsa
uuucucagccccuuaggacgcgggucuccuugggcucccccaaggguucugcgaagaggcagug

SEQ ID NO: 113753 - RNA, 64 nt, hsa
auacuacugacguccucccugaucccacccccuccucccccaguguccccuuucuuccuauuua

SEQ ID NO: 113754 - RNA, 64 nt, hsa
uccuuggcuuucagagccagccuggcucugcccccucccccaugggcuguguccuaaggcccau

SEQ ID NO: 113755 - RNA, 64 nt, hsa
cacagcagcaagugacccuucuccggccugcagccucccccaggguggaagccguggggucccu

SEQ ID NO: 113756 - RNA, 64 nt, hsa
gccaaauguccccacuaccccagggaucccccagcucccccagccccuggcuuccugacccugc

SEQ ID NO: 113757 - RNA, 64 nt, hsa
ccucauuuuccaaaccucuuguacccuccucucccucccccagcugguauguaagugucuugaa

SEQ ID NO: 113758 - RNA, 64 nt, hsa
ccccgaggagucugcccugccuagagaagggccucucccccaacccucagccguuccuccaccu

SEQ ID NO: 113759 - RNA, 64 nt, hsa
cagacccucguacccaaaggccccugccccacuucucccccacaaagcggggucucaagccaca

SEQ ID NO: 113760 - RNA, 64 nt, hsa
cuuaauacagcugcuuuucucggugccaaccucccucccccaagcucagauccuccucuuaugc

SEQ ID NO: 113761 - RNA, 64 nt, hsa
aacuuccccuccuccccuauuuaaaccacucugucucccccacaacccuccccuggcccucuga

SEQ ID NO: 113762 - RNA, 64 nt, hsa
ggcccccugagccuucuuguaaauaccugccucccucccccaucaccgaacuuccccuccuccc

SEQ ID NO: 113763 - RNA, 64 nt, hsa
uucucccccauguucugucccuugccccccuggccucccccacuuucuuucuuucuuuaaaaaa

SEQ ID NO: 113764 - RNA, 64 nt, hsa
aggagcuccccuccccaacugaccaccuuuguuucucccccauguucugucccuugccccccug

SEQ ID NO: 113765 - RNA, 61 nt, hsa
ccccucccccaaccaacugagaagcugcucccucccccagcaagcccagcgccaggugcuc

SEQ ID NO: 113766 - RNA, 64 nt, hsa
gcucuuuuguacugccccccgcucauuaaacagccucccccagcccugagugcacugauguccg

SEQ ID NO: 113767 - RNA, 64 nt, hsa
ccauuccccagccacuucccuuccgcacuuaccacucccccagccacgccccuccccgcugacc

SEQ ID NO: 113768 - RNA, 64 nt, hsa
caucaccucugucuaguuacagaacgguuucuuucucccccaaagaaaccccaucgccaucagc

SEQ ID NO: 113769 - RNA, 64 nt, hsa
aagaaaccccaucgccaucagcacucacuccccacucccccagccccuggcaaccacaaaucuu

SEQ ID NO: 113770 - RNA, 64 nt, hsa
uugggguucucucacccucuuucucuuuccuucccucccccauucuccagaucucccucugucu

SEQ ID NO: 113771 - RNA, 64 nt, hsa
uggccccugucucucuccauguuggggguccuaacucccccaccccauaucuacguguccuccg

SEQ ID NO: 113772 - RNA, 64 nt, hsa
cugucccgggaccugcugggagggacaagaggcccucccccaggcagaagagcaugcccuuugc

SEQ ID NO: 113773 - RNA, 64 nt, hsa
ugccucuucccucgcccaccugccugcccccauacucccccagcggagagcaugauccgugccc

SEQ ID NO: 113774 - RNA, 64 nt, hsa
ggcucccccagcgcugaagcacgggguucagcggcucccccagugcugcaggugccgccaggac

SEQ ID NO: 113775 - RNA, 64 nt, hsa
ugcaugguuuguggcggaagacggggcccagcggcucccccagcgcugaagcacgggguucagc

SEQ ID NO: 113776 - RNA, 64 nt, hsa
cuccacccucacuccauccaccucggagaccacccucccccagccagauacggaauaaaacuac

SEQ ID NO: 113777 - RNA, 64 nt, hsa
cuggaagaugaagcccaaacacccacaccucugucucccccagggcucgggaugucuccagcag

SEQ ID NO: 113778 - RNA, 64 nt, hsa
cugcccccucuccccccgcaugugggugcccccacucccccaucguggggucuguguagccuuc

SEQ ID NO: 113779 - RNA, 64 nt, hsa
cugcccgccgcccacccccacugacccccgcugccucccccaacaccgacacccuccucggccu

SEQ ID NO: 113780 - RNA, 64 nt, hsa
gcuggcuggguccucugcccucucuggaguuugccucccccagcccccuccccaucaauaaaac

SEQ ID NO: 113781 - RNA, 64 nt, hsa
ggggaauggggggccacagcugcagaccuaagcccucccccaccccuggaaaggucccucccca

SEQ ID NO: 113782 - RNA, 64 nt, hsa
gcuauggcgcccccaucugacuguccagcucucucucccccaccccucccgguguuguuauuaa

SEQ ID NO: 113783 - RNA, 64 nt, hsa
cccacacagcugagggagaggcccagcccugagccucccccaccaggacugggccuccccggca

SEQ ID NO: 113784 - RNA, 64 nt, hsa
cuccuccagcuuagcugucagcuguccaucaccucucccccacuuucucauuugugcuuuuuuc

SEQ ID NO: 113785 - RNA, 64 nt, hsa
gggcugccuguuuuacucacccaccagcuuccgccucccccauccugggcgccccuccuccagc

SEQ ID NO: 113786 - RNA, 64 nt, hsa
ccaacaucccagacccguuacccacuacccuucucucccccagcucaucaucagucgcugucuc

SEQ ID NO: 113787 - RNA, 64 nt, hsa
gcacauuuugaaccugcaacuucagacauuccagcucccccacucgcccuccacuaccucugag

SEQ ID NO: 113788 - RNA, 64 nt, hsa
cugcggacgaucgcaucuugugucgcugaagcgccucccccagggaccggcggaccccagccau

SEQ ID NO: 113789 - RNA, 64 nt, hsa
ccagggggcaagaggaauuacgugcucugugggucucccccaacgcgccucgccggaucugagg

SEQ ID NO: 113790 - RNA, 64 nt, hsa
gucucccgggccuguccccaacuccuccccaccccucccccaucuccucuuugaaagccagaac

SEQ ID NO: 113791 - RNA, 64 nt, hsa
acgugcagacccugccaugcagacccaugccccccucccccaggcagcuccaagaaagcucccu

SEQ ID NO: 113792 - RNA, 64 nt, hsa
cccagggaaacagggccagcacagaggggccuuccucccccacagagcccccaugacauagucu

SEQ ID NO: 113793 - RNA, 64 nt, hsa
ggugcccccaguguccucugauccuguccggugccucccccaacccccacacccaugcagaacu

SEQ ID NO: 113794 - RNA, 64 nt, hsa
cucccccgccagguguggccccgccugcucuuuccucccccaccaguauggccccaccugcucu

SEQ ID NO: 113795 - RNA, 64 nt, hsa
gaaaagaugcagguuuauauggaacccccacccccucccccacucucccacucuguucguucug

SEQ ID NO: 113796 - RNA, 64 nt, hsa
gaaugucuucacgagcgugcaucagggcgccuggcucccccaccucagccagugagucagacac

SEQ ID NO: 113797 - RNA, 64 nt, hsa
guggggcaggcucuuugucuuggggaccaggaugcucccccaguccuucccagaugauggcugc

SEQ ID NO: 113798 - RNA, 64 nt, hsa
ucccagaugauggcugccugugggaccccagcuacucccccagacccaaguucugcagaacuaa

SEQ ID NO: 113799 - RNA, 64 nt, hsa
cguccuggccccgggcuguggcgagacagcccaacucccccagcccagcucccccagcccagag

SEQ ID NO: 113800 - RNA, 64 nt, hsa
gcuguggcgagacagcccaacucccccagcccagcucccccagcccagagccagggaagaggaa

SEQ ID NO: 113801 - RNA, 64 nt, hsa
caagaccaggagagggccaccucacugggccugccucccccaccuccugggccucucugaccuc

SEQ ID NO: 113802 - RNA, 64 nt, hsa
gccccgggcuguugggcucugcuuccucccucugcucccccaugucucccugaguucucccacc

SEQ ID NO: 113803 - RNA, 64 nt, hsa
caggaaggguauaaaugcauguuccugaggugcccucccccaaagaauguaccugcacucaaac

SEQ ID NO: 113804 - RNA, 64 nt, hsa
gaccgugcuugguggggggaugugaacuuucucucucccccagcagugucugcucaggccugac

SEQ ID NO: 113805 - RNA, 64 nt, hsa
cagacugacugagggggccugaagcuacaugcaccucccccacugcugcccuccugucgagaau

SEQ ID NO: 113806 - RNA, 64 nt, hsa
aaggcgaagguucugauggcugccuugcuccuugcucccccacccccugugaggacuucucuag

SEQ ID NO: 113807 - RNA, 64 nt, hsa
aaggaagggauuugggggggaaucuuccugccgccucccccacuccaaguguuuauuuuugaua

SEQ ID NO: 113808 - RNA, 64 nt, hsa
agccugaccuaaccuuuuagggugguuaggacaucucccccaccuccccacuuuuuuccccaag

SEQ ID NO: 113809 - RNA, 64 nt, hsa
cauggggcuaggucauuaaggccacauccacagucucccccacccuuguuccaguuguuaguua

SEQ ID NO: 113810 - RNA, 64 nt, hsa
gugccccgucuacagcucccccagcuccccccaccucccccacucccaaccacguugggacagg

SEQ ID NO: 113811 - RNA, 64 nt, hsa
cccguuuucggugccaucagugccccgucuacagcucccccagcuccccccaccucccccacuc

SEQ ID NO: 113812 - RNA, 64 nt, hsa
gacuauagaucauaaggcaaugcaugaaccacagaagcugcaugguuaaaauagcggccugugc

SEQ ID NO: 113813 - RNA, 64 nt, hsa
aauaaucaucuaaauaaaaauuauauuggcagcuaagcugcacugaauacucaacagaaauagu

SEQ ID NO: 113814 - RNA, 64 nt, hsa
cagcgcccucuacugacaaaguaugccaucaugcaagcugcaaaggaaacauuucaagagucua

SEQ ID NO: 113815 - RNA, 64 nt, hsa
aaagcuagagaagcaaguggagaaaugcuggagaaagcugcacccuacaggcaaccagcacugc

SEQ ID NO: 113816 - RNA, 64 nt, hsa
gcccucuggagggcugguggccacgagguuaaagaagcugcauguuaagugccauuacuacugu

SEQ ID NO: 113817 - RNA, 64 nt, hsa
cugugaaaccuuuaccuuuuuuguuguuguuggcaagcugcagguuuguaaugcaaaaggcuga

SEQ ID NO: 113818 - RNA, 64 nt, hsa
agaccauaagcuuuucaugccagaugucaacauuaagcugcaacauccuaaccaccauaagccg

SEQ ID NO: 113819 - RNA, 64 nt, hsa
auaugggcugguaaauuuuugguacauuaauugcaagcugcaugacaaaauuuguuuuucuggc

SEQ ID NO: 113820 - RNA, 64 nt, hsa
aaacgggcuucaggucaaacccuuaagacaucugaagcugcaaccuggccuuugguguugaaau

SEQ ID NO: 113821 - RNA, 64 nt, hsa
gcgcuaccucccccaugugaggagcugagaacggaagcugcagaaagauacgacugaggcgccu

SEQ ID NO: 113822 - RNA, 64 nt, hsa
aacacauauuuaauaugugcccagauuauucuaaaaucuuaaaaaaagaugcauauagugaaau

SEQ ID NO: 113823 - RNA, 64 nt, hsa
uguuuucauauugauagcaucuaauucuuuugacaaucuuaauauguagguucauuuaaauuuu

SEQ ID NO: 113824 - RNA, 64 nt, hsa
caaaaccuacauugacaaguuuaacauugagaagaaucuuaacaaaaauauggauaugaauuca

SEQ ID NO: 113825 - RNA, 64 nt, hsa
uuuuucaugauaacuuauuuuaagaugccuuaaaaaucuuaaagucacaaaaggaaaaagguuu

SEQ ID NO: 113826 - RNA, 64 nt, hsa
ugauucgaucgucaagacaucacuuggauuucuuaaucuuaaaugcuuauggaagaugugaagu

SEQ ID NO: 113827 - RNA, 64 nt, hsa
cuuuauuugcaaaagaaucuuuauuaaaacaaacaaucuuaacuaugcacaugaugugaccaga

SEQ ID NO: 113828 - RNA, 64 nt, hsa
guaauuuccaaacuucuguucaccaugaaaaggcaaucuuaaaguucauuauguaaaacuaauu

SEQ ID NO: 113829 - RNA, 64 nt, hsa
cagcuugccuauuaaaggacuaugguaaguauagaaucuuaaugguugccaguuaguaauucuu

SEQ ID NO: 113830 - RNA, 64 nt, hsa
uggagguguagugaacguguguacagaaguuuucaaucuuaacuauauaguguuagugugaugc

SEQ ID NO: 113831 - RNA, 64 nt, hsa
acagcuggaaacuuggacuagagcuuuaauaaaaaaucuuaaauucuuugaaauucaaguuaaa

SEQ ID NO: 113832 - RNA, 64 nt, hsa
uuugaaaaaaggauaaaaaagcuauaacuaaaaaaaucuuaaggauaacauuugguuuacuaau

SEQ ID NO: 113833 - RNA, 64 nt, hsa
agagcgagacuccaucucaaaaaaaaauaaaaagaaucuuaaaauaggaacauaauaaaagauc

SEQ ID NO: 113834 - RNA, 64 nt, hsa
auuaugaauuuuucagaacucauccaguccuuguaaucuuaaacagaugcaaauccuaccccug

SEQ ID NO: 113835 - RNA, 64 nt, hsa
ggcguugccucucacuuugaaagaaagacuccguaaucuuaaacagaugcaaauccaauuaggc

SEQ ID NO: 113836 - RNA, 64 nt, hsa
uuaucugccauuuuuuccuacuauaauaaugcugaaucuuaauuuagaggguacaaggguaugg

SEQ ID NO: 113837 - RNA, 64 nt, hsa
augcaauuuaauauaauagauuuuuuaaugaauuaaucuuaacauaguaaucuuuagcuuuuua

SEQ ID NO: 113838 - RNA, 64 nt, hsa
uaugccuuaaaggccaccugcuauacaguuguuaaaucuuaaauaugcuuuuuaaaaauuggaa

SEQ ID NO: 113839 - RNA, 64 nt, hsa
uuaauuucacauauucaacaccuuuaaauguuguaaucuuaauaugcgaagugugccucugcaa

SEQ ID NO: 113840 - RNA, 64 nt, hsa
cccuuccaaccacccuccacacugcugccagagcaaucuuaaaaauguaaacuggcccuauuac

SEQ ID NO: 113841 - RNA, 64 nt, hsa
aacuuacuuuuccauaauauugcaaauaacauaaaaucuuaaaauaauuccaagcugagucuuc

SEQ ID NO: 113842 - RNA, 64 nt, hsa
acaugguuaaaauaaaacuuuugugguucuucugaaucuuaauauuucaaagccaggugaaaau

SEQ ID NO: 113843 - RNA, 64 nt, hsa
ucuuugcacuguaacagagauuccuuuuuucaauaaucuuaauucaaaagcauuauuagacuug

SEQ ID NO: 113844 - RNA, 64 nt, hsa
ugucuacaucuguguauauaucauaggauuugagaaucuuaacacauguauaaauaaguauaua

SEQ ID NO: 113845 - RNA, 64 nt, hsa
auguauaaauaaguauauauaaacuccaauuuuaaaucuuaaaauugcugaauuuacccucaua

SEQ ID NO: 113846 - RNA, 64 nt, hsa
ugacuuggcauuuaccuuggguaagccauaagcgaaucuuaauuucuggcucuaucagaguugu

SEQ ID NO: 113847 - RNA, 64 nt, hsa
augcagaaaauguuuagagagcuuggccaacuguaaucuuaaccaagaaauugaagggagaggc

SEQ ID NO: 113848 - RNA, 64 nt, hsa
cccuucagcaacuuauuuugcuuuaauugcuuuaaaucuuaagcaauauuuuuuauucaguaaa

SEQ ID NO: 113849 - RNA, 64 nt, hsa
ucccuucucuucacuagucuaaaaacuucuuuuuaaucuuaagauucuuugugaugagggugag

SEQ ID NO: 113850 - RNA, 64 nt, hsa
aaccucuucaaaguacccuuggaaauugaaguucaaucuuaaguuuuuugcugucuuuaauuua

SEQ ID NO: 113851 - RNA, 64 nt, hsa
aaucaaguaucaauacaaaauagaacacaauuaaaaucuuaauuguuggcugggcacaguggcu

SEQ ID NO: 113852 - RNA, 64 nt, hsa
cuaccuggaggggaucagcccacugacagaccuuaaucuuaauuacugcuguggcuagagaguu

SEQ ID NO: 113853 - RNA, 64 nt, hsa
gauauauuaacaguuuuagaagucaguagaauaaaaucuuaaagcacucauaauauggcauccu

SEQ ID NO: 113854 - RNA, 64 nt, hsa
ccaccucugaaucgucgcauuauaacuguuguagaaucuuaaauguuaccaagaugauuccaau

SEQ ID NO: 113855 - RNA, 64 nt, hsa
caaaaggagugggggaaaggaauugagaaaaagaaaucuuaaguagaauucucuaaaagguuug

SEQ ID NO: 113856 - RNA, 64 nt, hsa
acagagcaagacuccaucucaaaaaaauaauaauaaucuuaaagaugagaaaagccaccccauc

SEQ ID NO: 113857 - RNA, 64 nt, hsa
ugagucaucaccagcuuccccaagagagugucagaaucuuaagagcugagaggccgggcacggu

SEQ ID NO: 113858 - RNA, 64 nt, hsa
gcuuuguuuguucuuguuuuuaaguuugcacucaaaucuuaagaaauaaauccacccauguuau

SEQ ID NO: 113859 - RNA, 64 nt, hsa
cacacuugaaccauaguuacuguaaaaugcaaaaaaucuuaauacuguuauucuuugcacuuuu

SEQ ID NO: 113860 - RNA, 64 nt, hsa
cacaagaucuguaauguuauuuccacuuauaaaggaaauaaaaaaugaaaaacauuauuuggau

SEQ ID NO: 113861 - RNA, 64 nt, hsa
agauaugugaagaaaaauguauuuuuccuaaauagaaauaaaugaucccauuuuuugguaucau

SEQ ID NO: 113862 - RNA, 64 nt, hsa
ucaaguuggagcaauugucuguguuugaaaagaugaaauaaaaauaauaaucaagggcaaagcu

SEQ ID NO: 113863 - RNA, 64 nt, hsa
auccccauuccaagaaauauaagugagugaaguugaaauaaaaucuuuaaaauuuacuauauug

SEQ ID NO: 113864 - RNA, 64 nt, hsa
uuaauuaugaagaugaaacacuagagucauauaagaaauaaaaauugggcaauaaaauaaaaug

SEQ ID NO: 113865 - RNA, 64 nt, hsa
aaguuaauguaauuguuaucccauuauuuagagcgaaauaaauguugaauauauggacuuucuc

SEQ ID NO: 113866 - RNA, 64 nt, hsa
aauguguauuuaacuuauguaaaagauaagucuggaaauaaaugucuguuuauuuuuguacuau

SEQ ID NO: 113867 - RNA, 64 nt, hsa
gaaaaaaauuuucuuuugggaagagggagaaaaugaaauaaauaucauuaaagauaacucagga

SEQ ID NO: 113868 - RNA, 64 nt, hsa
cagcauuacaaaagaguaaguaucucacaaauaggaaauaaaacuaaaacguggauuuaaaaag

SEQ ID NO: 113869 - RNA, 64 nt, hsa
aaugguuuauuauagaauaccaauguauagcuuagaaauaaaacuuugaauauuucaagaauau

SEQ ID NO: 113870 - RNA, 64 nt, hsa
guucuuuacaaauauuugcuuggcaacacgacuugaaauaaauaaaacuuuguuucuuaggaga

SEQ ID NO: 113871 - RNA, 64 nt, hsa
aacauacuuuacgcaaugaacaguaguuaaauaggaaauaaacuaguuccauauaaguauacac

SEQ ID NO: 113872 - RNA, 64 nt, hsa
ugacgacaaagauucuguuucaaauauagccacagaaauaaaggagggaccaauaucugggaca

SEQ ID NO: 113873 - RNA, 64 nt, hsa
ugacgagaaagauucuguuucaaauauagccacagaaauaaagaagggacaacaaucugggaca

SEQ ID NO: 113874 - RNA, 64 nt, hsa
ugacaagacagauucugcuuugaauauagcuacagaaauaaaggauggacuacagugugggaca

SEQ ID NO: 113875 - RNA, 64 nt, hsa
ugacgaggaagacucuguuucgaauauagccacagaaauaaaggauggagaaaaaucugggaca

SEQ ID NO: 113876 - RNA, 64 nt, hsa
ugaugagaaagauucuguuucgaacauagccacagaaauaaaggauggagaaaaaucugggaca

SEQ ID NO: 113877 - RNA, 64 nt, hsa
uuuuuaauguguuauaauugaccuugcauggugugaaauaaaaguuuaaacacugguguauuuc

SEQ ID NO: 113878 - RNA, 64 nt, hsa
guugcaguaccuuuuucugguaaauuuuguagcagaaauaaaaugacaauuccuaagagccacu

SEQ ID NO: 113879 - RNA, 64 nt, hsa
uaaagcauacauaguagagggaaaggagagaauggaaauaaaacugaauauuaugcagauuuau

SEQ ID NO: 113880 - RNA, 64 nt, hsa
ugacucuuuguuuuauuuugacauggcauguccugaaauaaauauugauucacuauggcagaug

SEQ ID NO: 113881 - RNA, 64 nt, hsa
aaucagauguauuuauuaugcuuguguaauuauagaaauaaagaaaugggugacaggcuuaacc

SEQ ID NO: 113882 - RNA, 64 nt, hsa
gccugcuguuuuggaaaugcacaguugacauguugaaauaaaaaugaauaccauuuuuaaaugu

SEQ ID NO: 113883 - RNA, 64 nt, hsa
gcaugaguauaacaauuuugauacugcucauuuagaaauaaaucaucugguuguuccuccaggg

SEQ ID NO: 113884 - RNA, 62 nt, hsa
auaaaaaauucaguaguuaggggcagggaggagaaauaaaguggugauagucugguguuaca

SEQ ID NO: 113885 - RNA, 64 nt, hsa
ugagaaucucauacaucugugaaaaagauaaugugaaauaaacaguaaaaaaaaaaaguauguu

SEQ ID NO: 113886 - RNA, 64 nt, hsa
uuuaugaauuauaaauaugaauuuaauuacuaaagaaauaaaaauaaugguguaaagccaacuc

SEQ ID NO: 113887 - RNA, 64 nt, hsa
aaucugaauaagcuuccaaaauuuuuuuuuuuaagaaauaaagggagcuguguagugggucagu

SEQ ID NO: 113888 - RNA, 64 nt, hsa
gacauaauaagagguguaaaaacuaucacaggaagaaauaaaaacagauuuuugaaggugagau

SEQ ID NO: 113889 - RNA, 64 nt, hsa
ccaaagaaagcagaaagaaggaaagccuagaacagaaauaaaugaaauagagaauagaaaagca

SEQ ID NO: 113890 - RNA, 64 nt, hsa
aaacaaaagucaagauuuuauuaccaaacuuauagaaauaaaaauuauuagaaagaaauacuau

SEQ ID NO: 113891 - RNA, 64 nt, hsa
uaaaucaaggggcuuuucagaaggucauucugaagaaauaaagaggcaaagggucacagaagug

SEQ ID NO: 113892 - RNA, 64 nt, hsa
agcucagaauuauucuggaaagaaagccugccaggaaauaaauucaaauacaguaugagcugcg

SEQ ID NO: 113893 - RNA, 64 nt, hsa
gaaacaacccaaaugucuaccaacugaugaaugggaaauaaaauguggucuguccacgcaaugg

SEQ ID NO: 113894 - RNA, 64 nt, hsa
agcuaauguuuaagaagcauuugggaaagaaaaagaaauaaauguauccagauaggaaaagaag

SEQ ID NO: 113895 - RNA, 64 nt, hsa
auucuaaguggccaauuauuuggaaauaaagaaggaaauaaagauggcuucacauggaaauuua

SEQ ID NO: 113896 - RNA, 64 nt, hsa
auguccacacuuauucuaaguggccaauuauuuggaaauaaagaaggaaauaaagauggcuuca

SEQ ID NO: 113897 - RNA, 64 nt, hsa
uuguuauaaugcguaaagauauugaaaauauaaugaaauaaaagcaucuuagguuauaccaucu

SEQ ID NO: 113898 - RNA, 64 nt, hsa
uaagaauacuaaaguauuuuuaaaaaucaaggaagaaauaaauguuacacaauuugcauuggaa

SEQ ID NO: 113899 - RNA, 64 nt, hsa
gaaggcuaauuguaaugaagacauuaauaaagaugaaauaaacuuauuacuuuaaaggaaagga

SEQ ID NO: 113900 - RNA, 64 nt, hsa
ccugcaucuuggagggaggcaggaaauuucuuuugaaauaaagugcuggagcugaauucugcau

SEQ ID NO: 113901 - RNA, 64 nt, hsa
gcuuuauaucuguuccuaaaacaguuaauccugugaaauaaauauugaacauaauccagaagaa

SEQ ID NO: 113902 - RNA, 64 nt, hsa
cuugaaaaacaaagaccuaaaaagccuuuuuuaagaaauaaauuuuuuguucacaugaccaaag

SEQ ID NO: 113903 - RNA, 64 nt, hsa
acaguggaacgcaggcugagaacgcagggaaggagaaauaaagaguaaagccagaggccauuac

SEQ ID NO: 113904 - RNA, 64 nt, hsa
acauacuauuucuaauaaauauuuauauuuuuaugaaauaaagagguauguggaaauuaauauu

SEQ ID NO: 113905 - RNA, 50 nt, hsa
augagcagauuuugaaguaggaaauaaaaugaauugcuccccagauuauu

SEQ ID NO: 113906 - RNA, 64 nt, hsa
agaggagcuuuaaauaagaugauuuuaguagauugaaauaaauaaccaguauuuaaguaaaugu

SEQ ID NO: 113907 - RNA, 64 nt, hsa
acuugguuuuaaauguugacaauauuuacaaguggaaauaaaauuuguaaauauaugaaagaug

SEQ ID NO: 113908 - RNA, 64 nt, hsa
ugauuuaaaacguuuguugagauuuucaaacauagaaauaaagcuguagcauauucacuaaaca

SEQ ID NO: 113909 - RNA, 64 nt, hsa
agucacuaucuuauguuuucuuuuggauuggaaagaaauaaagcuccuaguaaaguuauucaua

SEQ ID NO: 113910 - RNA, 64 nt, hsa
caaacauuaaaucgcacuuuuaaagugagucauugaaauaaauaguacugaaaugauucucuau

SEQ ID NO: 113911 - RNA, 64 nt, hsa
cuucuuuggugauacacuguagccacuagaaagagaaauaaacccaauggcauguguuuacagg

SEQ ID NO: 113912 - RNA, 64 nt, hsa
accuaacuuuaguagcaaaucuugauuaauugaagaaauaaaauauuucggauaagguuucaua

SEQ ID NO: 113913 - RNA, 64 nt, hsa
uuugaucacuucaaauacauacucuucaagucaagaaauaaauuucuuuacauagaaaaggaua

SEQ ID NO: 113914 - RNA, 64 nt, hsa
uaucguauucauacuacuguucaaucuuuauuuagaaauaaacuuuaucuaugauuucauuuuc

SEQ ID NO: 113915 - RNA, 64 nt, hsa
uucuaauaaaugcacggcuuuaccuuuccugucagaaauaaaccaaggcucuaaaagaugauuu

SEQ ID NO: 113916 - RNA, 64 nt, hsa
uuauauaaaaacaaugauaaagaugugaaacugugaaauaaauauaccauauuagcuacccacc

SEQ ID NO: 113917 - RNA, 64 nt, hsa
auucuacucuaaagcuucuauaaaauauaguuuggaaauaaaaauguucuuacacaaggggcaa

SEQ ID NO: 113918 - RNA, 64 nt, hsa
uuuuugcuguuaguuauaaaacuauguguucaaugaaauaaaagcacacugcuuaguauucuug

SEQ ID NO: 113919 - RNA, 64 nt, hsa
auucagccugugcuguaguuaauguuaaguugcugaaauaaaaagugagcaaguaauagauuuu

SEQ ID NO: 113920 - RNA, 64 nt, hsa
cuuagaaauccuuucugagaugcauaugagugaggaaauaaacuuuaaguaauuauuuuuaaag

SEQ ID NO: 113921 - RNA, 64 nt, hsa
aaggcacugauaaaaccgcaacaaaaacauguaagaaauaaaauagaaaugcuuuauauaauuu

SEQ ID NO: 113922 - RNA, 64 nt, hsa
cuuuuuguguuuggaguguaguccauuugcaauagaaauaaaaaaauccgucaccaaauuguaa

SEQ ID NO: 113923 - RNA, 64 nt, hsa
gaggaugauaagggaucccggacucuguaugauugaaauaaagagaaauaaacaaaucuagcag

SEQ ID NO: 113924 - RNA, 63 nt, hsa
agggaucccggacucuguaugauugaaauaaagagaaauaaacaaaucuagcagcucugaguc

SEQ ID NO: 113925 - RNA, 64 nt, hsa
acgacuuacauggucacaguauauuuugcugcaagaaauaaagaggauaugauagaagguuuuu

SEQ ID NO: 113926 - RNA, 64 nt, hsa
aauuuuauuuuuaucugaaaauaacaguugaucugaaauaaaaaggggagaccuauuagaauga

SEQ ID NO: 113927 - RNA, 64 nt, hsa
gucaaaaccugaaucagaauauuucaaaagagaggaaauaaaaguucagcuuaaaacuguucug

SEQ ID NO: 113928 - RNA, 64 nt, hsa
uaugauuuccuuuaaaggcaccaaaucuuaucuggaaauaaauuguuauggaggggcuguuuuu

SEQ ID NO: 113929 - RNA, 64 nt, hsa
cuugaucuuggacuuccagccuccaaaacuaugagaaauaaauuucuauuguuuaagucaccca

SEQ ID NO: 113930 - RNA, 64 nt, hsa
uaucaaauaaguaucacaaaucuuuuacgcagaagaaauaaaaacuacggguagaaaacauaag

SEQ ID NO: 113931 - RNA, 64 nt, hsa
cacuaaagguggaaauaaaagauuuucuauuauggaaauaaagaguuggcaugaaaguggcuac

SEQ ID NO: 113932 - RNA, 64 nt, hsa
uggucaucuauucuagcagggaacacuaaagguggaaauaaaagauuuucuauuauggaaauaa

SEQ ID NO: 113933 - RNA, 64 nt, hsa
gauacaucaaguucauuugcagaaacaaauaacugaaauaaaaaacauguuaauccuuguauca

SEQ ID NO: 113934 - RNA, 64 nt, hsa
uuuauaacacagucuuuaauuuucacucacuguggaaauaaaaacuaagguaacuucucagaaa

SEQ ID NO: 113935 - RNA, 64 nt, hsa
aaauaagauugacuuugaaucugcaacaagaucugaaauaaaugagaagccaagcucuucaagc

SEQ ID NO: 113936 - RNA, 64 nt, hsa
uucaacugcaucuccaaacauuacucaugaccuugaaauaaaauaggaaccuaugaaacuauug

SEQ ID NO: 113937 - RNA, 64 nt, hsa
uguauauaagagaaagaacgaaauaaccuuuauugaaauaaagauacuaugcaagaaaauguac

SEQ ID NO: 113938 - RNA, 64 nt, hsa
aaaaauuaaauaaaacuaauaugaacauaaagaggaaauaaaagguaccuaacuugggcacagc

SEQ ID NO: 113939 - RNA, 64 nt, hsa
cagagguaauaugcuccaccuacacacaauuuuagaaauaaauuaaaaauuaaauaaaacuaau

SEQ ID NO: 113940 - RNA, 64 nt, hsa
caugaaaauauuccuuaguagaauguauauuuaagaaauaaaacaacaaaggggaacuauauca

SEQ ID NO: 113941 - RNA, 64 nt, hsa
cugcaauucuguuugcagugcuucacuaaacauugaaauaaaguuguaaauuuuuucuucagua

SEQ ID NO: 113942 - RNA, 64 nt, hsa
uaguuguuuucuuauuuuuuuggcuuaguauguugaaauaaacuaugguaucuucaucauuuug

SEQ ID NO: 113943 - RNA, 64 nt, hsa
aagagugugaccuaaaugcuuuugucuugucacugaaauaaaagauggcauuaugugguuaaga

SEQ ID NO: 113944 - RNA, 64 nt, hsa
uuuuuuaaugacacugguuucauguaguuuucaagaaauaaaagaauucauucaagugaagcca

SEQ ID NO: 113945 - RNA, 64 nt, hsa
aaauucauuguucuacuuaguugcagcuguaccugaaauaaaaauguuauugaugacugaauuu

SEQ ID NO: 113946 - RNA, 64 nt, hsa
ugccagacagagaucagaauugaaccgucaaugugaaauaaagaguucuccuuguacuugaaua

SEQ ID NO: 113947 - RNA, 64 nt, hsa
aauuuuaaaaugcaaauauugcuauuguuuauaggaaauaaaucuaaauauaaaugaaauugaa

SEQ ID NO: 113948 - RNA, 64 nt, hsa
uuuguuuuuugaaaucgauugggaucgaaagccugaaauaaauauucauacuuuccauagaacu

SEQ ID NO: 113949 - RNA, 64 nt, hsa
ucuuuuucugcccaucugucuacuaauaaaaugugaaauaaaauaccuguauugcuacuucccc

SEQ ID NO: 113950 - RNA, 64 nt, hsa
caucuaccuucaggauugcugacagacagaauuugaaauaaaauaugcaaguuagcuaauacaa

SEQ ID NO: 113951 - RNA, 64 nt, hsa
augcagccuuuccucuguacuuuucuccaugguugaaauaaaacagggugacugggaguuacuu

SEQ ID NO: 113952 - RNA, 64 nt, hsa
cugguguuaagauauauuuugaguggauggaggagaaauaaacuuauuccuccuuaaaaaaaag

SEQ ID NO: 113953 - RNA, 64 nt, hsa
ugaccugcugugcaccuuacauuccuagagagcagaaauaaaaagcaugacuauuuccaccauc

SEQ ID NO: 113954 - RNA, 64 nt, hsa
gccaguuccucuuugauaaauauauaguuaauucgaaauaaaauccauugcaauucauuuauga

SEQ ID NO: 113955 - RNA, 64 nt, hsa
auagagcaaccauagccuuaacuuacagaccugugaaauaaagggcauuuugaccuaauacaau

SEQ ID NO: 113956 - RNA, 64 nt, hsa
uccuguuauauguauaucaggaauacaaggaugugaaauaaaacuguaaauuugcauaacugga

SEQ ID NO: 113957 - RNA, 64 nt, hsa
uaaauuugcauaacuggauguacuuagauaaugugaaauaaacauuaaagacaaggucuauuuu

SEQ ID NO: 113958 - RNA, 64 nt, hsa
aaaacauacaagccaggaugaaugaagccaauaggaaauaaaaaacaggcacacaacauuauuu

SEQ ID NO: 113959 - RNA, 64 nt, hsa
guagacaaagauguuauuucccagugcaaauaaagaaauaaagauagcaagcugauucucucca

SEQ ID NO: 113960 - RNA, 64 nt, hsa
agugcuaucuaaugcagugauaccaaaaaaaaaggaaauaaaaugcacauaaauuuggaaggag

SEQ ID NO: 113961 - RNA, 64 nt, hsa
caauuuaagaaaucuaaagugaaaauuuugcuuagaaauaaaauaugacaaguucuguuuugag

SEQ ID NO: 113962 - RNA, 64 nt, hsa
gugauauuuguauuguaaaacaauaauggugaaggaaauaaaaaggcuuuuaaaauuuuguuug

SEQ ID NO: 113963 - RNA, 64 nt, hsa
auaucauaaguucuggucuuuccagucacaucuggaaauaaagcguauuauuuucuugggaaaa

SEQ ID NO: 113964 - RNA, 64 nt, hsa
uuaauuuuuauuugagcuguuucaauagcauaaugaaauaaaauuuugaauuggccaauaacau

SEQ ID NO: 113965 - RNA, 64 nt, hsa
aaguauuuuguaauuagacuccucgugggcuugagaaauaaaaagccuguccaaagucuagcuu

SEQ ID NO: 113966 - RNA, 64 nt, hsa
auuacauuacaucaaauaaaguuuauuuguagcugaaauaaagcaacguaaguaacaauuuuua

SEQ ID NO: 113967 - RNA, 64 nt, hsa
caugauucaugauugaaagcagaacaauggagaugaaauaaacaaggcaaaauagagguggaaa

SEQ ID NO: 113968 - RNA, 64 nt, hsa
gccuagaguaguaguaugaaaacuauuuguugaagaaauaaaugaauggaaagacauagggaag

SEQ ID NO: 113969 - RNA, 64 nt, hsa
auuuccacucucacaguagaauagaaauguuugugaaauaaaacugauuuuaacuggaaggaga

SEQ ID NO: 113970 - RNA, 64 nt, hsa
cugaauuaagaguggccuaagaggcugcugcacugaaauaaacugauuucacuccagacuggug

SEQ ID NO: 113971 - RNA, 64 nt, hsa
auguacacauaagugugugugucucaggaaguaggaaauaaaaauggaagcuauuaugaccuca

SEQ ID NO: 113972 - RNA, 64 nt, hsa
aaaucaagaagacaucaggaaaucagaugcacaggaaauaaaggaaagcugugcuuugucauug

SEQ ID NO: 113973 - RNA, 64 nt, hsa
uauuccugcucgugcuuaagauugaugauuucgugaaauaaagaacaucauuucauuuaagaga

SEQ ID NO: 113974 - RNA, 64 nt, hsa
uuacuuccugcauuuagagggaguuuauuuaaaagaaauaaaugacaaucaaaccaaaucauca

SEQ ID NO: 113975 - RNA, 64 nt, hsa
cagaggaauuuuguuuuaauguagaaaguuauuugaaauaaacuaggugaaaugaaauuaacua

SEQ ID NO: 113976 - RNA, 64 nt, hsa
aaaaaucuauucacuuuaacuuauaauaguuuaugaaauaaaaacaugagucacagcuuuuguu

SEQ ID NO: 113977 - RNA, 64 nt, hsa
uggucuuaacuugaccugggauaacuacuuuaaagaaauaaaaaauuccagucaauuauuccuc

SEQ ID NO: 113978 - RNA, 64 nt, hsa
ugacucuuuguuuuauuuugacauggcauguccugaaauaaauauugauucaauauggcagaug

SEQ ID NO: 113979 - RNA, 64 nt, hsa
uaaagcauacauaguagagggaaaggagagaauggaaauaaaacucaauauuaugcagauuuau

SEQ ID NO: 113980 - RNA, 64 nt, hsa
agaaucaugugagaacucaggaagagguagagcagaaauaaaaaggaagaaaauguagauuaga

SEQ ID NO: 113981 - RNA, 64 nt, hsa
gagaauuaguagggcaagaucaaagcauacauuggaaauaaacaguagaaauaagcaaacaaua

SEQ ID NO: 113982 - RNA, 64 nt, hsa
uauauaggcuauuuucuaaagacuuguauagcaugaaauaaaauauaucuuauaaaguggaagu

SEQ ID NO: 113983 - RNA, 64 nt, hsa
ugaaaauggaaauuugggagagccauacauaaaagaaauaaaccaaaggaaaaugucuguaaua

SEQ ID NO: 113984 - RNA, 64 nt, hsa
uuuuucuauaucugaaauaaaugcuucuaccauagaaauaaauuugccuauacuaucugagaau

SEQ ID NO: 113985 - RNA, 64 nt, hsa
ucugacuuugaaauaguguuauuuuucuauaucugaaauaaaugcuucuaccauagaaauaaau

SEQ ID NO: 113986 - RNA, 64 nt, hsa
ugccuuugagccuauacuauacuguguauguguggaaauaaaaauguauuguacuuuuggagaa

SEQ ID NO: 113987 - RNA, 64 nt, hsa
agcaauuaugguggaccuauuacccuauggguaagaaauaaauggaaauaugacaucggauguu

SEQ ID NO: 113988 - RNA, 64 nt, hsa
aaaaugcaguaaucaaaaugugaucuaguguaaugaaauaaaaugugaucuaguguaauggaag

SEQ ID NO: 113989 - RNA, 64 nt, hsa
auuagaauggaagauaaugcagauauuucugugggaaauaaaauaacuaauuuugagguaccaa

SEQ ID NO: 113990 - RNA, 52 nt, hsa
augaggcugauacaacauaagagaaauaaagcucuguuagggaaugggguuu

SEQ ID NO: 113991 - RNA, 64 nt, hsa
uuuuuucauacuuugacccaaaauaugccauuuugaaauaaaauuuaagcuuugauacacucuc

SEQ ID NO: 113992 - RNA, 64 nt, hsa
cauuauuuuaaguugaauuugaauaaagauuccagaaauaaacauggagcucaguauucaggaa

SEQ ID NO: 113993 - RNA, 64 nt, hsa
aacugcgcuuugggaaucauccugggcuaaucaggaaauaaacuugacuuuucuauuuuucucu

SEQ ID NO: 113994 - RNA, 64 nt, hsa
agggauuuaauguaccuuuuuguuagugaauuuggaaauaaaaagaaaaaaaaaacaaaaacaa

SEQ ID NO: 113995 - RNA, 64 nt, hsa
ggauaugaaaugccauaagacccaaucaaaugaagaaauaaacccagcacaaccuuggacaucc

SEQ ID NO: 113996 - RNA, 64 nt, hsa
guuuacuuuuucauuccuuccuuuuuuuuguccugaaauaaaaaguggcaugcaguuuuuuuuu

SEQ ID NO: 113997 - RNA, 64 nt, hsa
aucacacaacaaggagauuuuuagcaugauacuggaaauaaaauguccaagcugacaaguauua

SEQ ID NO: 113998 - RNA, 64 nt, hsa
cauacuuuuugauccauauaugugugcaugucaagaaauaaaagaaucacacaacaaggagauu

SEQ ID NO: 113999 - RNA, 64 nt, hsa
cauaguucauacauauaaaugguggugaaauaaagaaauaaaacacaauacuuuuacuugaaau

SEQ ID NO: 114000 - RNA, 64 nt, hsa
gccuugaucauaguucauacauauaaaugguggugaaauaaagaaauaaaacacaauacuuuua

SEQ ID NO: 114001 - RNA, 64 nt, hsa
ccggccacuccugggagacagacccuuuggugaugaaauaaaccagugacuucagagccuaugg

SEQ ID NO: 114002 - RNA, 64 nt, hsa
guucagcaugcaauggaaucaugcuuguccaugugaaauaaauauggcucucucguguccuuaa

SEQ ID NO: 114003 - RNA, 64 nt, hsa
ggaaguccucgccacagcaaucaggcaagagaaagaaauaaaaggcaaccaaaaagaaaggaag

SEQ ID NO: 114004 - RNA, 64 nt, hsa
acacauagaucaauggaacagaauagagggcccagaaauaaagcuacacaccuacaaccaucua

SEQ ID NO: 114005 - RNA, 64 nt, hsa
uaauaagcacuugccuggaauaaaauauaaaacugaaauaaaccugcacugaaaccugagaugg

SEQ ID NO: 114006 - RNA, 64 nt, hsa
gaggucagcaaaggucuugaauagauuuucucuggaaauaaagaauccuuagaugccuaaaaau

SEQ ID NO: 114007 - RNA, 64 nt, hsa
uucugagacaccugaugaccuguuagaugauggugaaauaaaggaagauacuaguuuugcugaa

SEQ ID NO: 114008 - RNA, 64 nt, hsa
acaaagucuuccuggaaguaauuguaagcauccugaaauaaaaaagcaagaauaugaagaagua

SEQ ID NO: 114009 - RNA, 64 nt, hsa
ugugaauaucugugugcuguacagagugacaauagaaauaaauguuugguuucuugugaccagc

SEQ ID NO: 114010 - RNA, 64 nt, hsa
cucucuccuagacugaaaaugaaugugaaacuaggaaauaaaaugugccccucccagucuggga

SEQ ID NO: 114011 - RNA, 64 nt, hsa
cuaugcaaguucuuagaaauauuuuuuguuugcugaaauaaagcucaaucaacacacuaccuua

SEQ ID NO: 114012 - RNA, 64 nt, hsa
uuaauuagaacuaugcuggaugcuguagacagaagaaauaaaauacucaacuuggucccuaucu

SEQ ID NO: 114013 - RNA, 64 nt, hsa
auauccagccaaacuaagcuucauaagugaaggagaaauaaaauacuuuacagacaagcaaaug

SEQ ID NO: 114014 - RNA, 64 nt, hsa
ccucuucaaggagaacuacaaaccacugcuuaacgaaauaaaagaggaugcaaagaaauggaag

SEQ ID NO: 114015 - RNA, 64 nt, hsa
uuuuucaguuccaagugcaucccuuauucuauaggaaauaaacuggagacaaaucucauuuaag

SEQ ID NO: 114016 - RNA, 64 nt, hsa
aaauguuauaauguuaaaaauuaaagcugcaaaagaaauaaaaugguguuaauaaaaauuuggc

SEQ ID NO: 114017 - RNA, 64 nt, hsa
acuccaucucaaaaaaaauaaaaaaaaagaaaaagaaauaaacucuaugaauguaaaccaugug

SEQ ID NO: 114018 - RNA, 64 nt, hsa
uauuuuaccugagaaaauuaaacaaaucacauuggaaauaaacucuauggcuugggcacggugg

SEQ ID NO: 114019 - RNA, 64 nt, hsa
uugauuuuuuuuucucugucuuugcugcaauuuugaaauaaaaugccaaagaacacacauuguc

SEQ ID NO: 114020 - RNA, 64 nt, hsa
ccucccuaccaaugacucaccugaagugcaauacgaaauaaaaggccagcgggcggcgucuggg

SEQ ID NO: 114021 - RNA, 64 nt, hsa
aauaaauaaaacagcagcagcaaacaaauaaaaugaaauaaaagaaacaaaugaaauaaauauu

SEQ ID NO: 114022 - RNA, 64 nt, hsa
agcaaacaaauaaaaugaaauaaaagaaacaaaugaaauaaauauuguguugugcagcauuaaa

SEQ ID NO: 114023 - RNA, 64 nt, hsa
cuccccaguggggccccacugcaccugcuggcaggaaauaaaugaauguuuacugaguacugca

SEQ ID NO: 114024 - RNA, 64 nt, hsa
ucuuuucucagagagcagguuucuuuauaguuuggaaauaaaugguucacgguccacuggccgc

SEQ ID NO: 114025 - RNA, 64 nt, hsa
aacuccaaagcaaaaacccuuuuaauggaggugagaaauaaauuuaauguaacaacagcuagau

SEQ ID NO: 114026 - RNA, 64 nt, hsa
aauccuuauuccugguuaaucacuaugcauauuugaaauaaaagaaagcguaagccucugcaau

SEQ ID NO: 114027 - RNA, 64 nt, hsa
uuuuuacuuuaauaguuuaguguaaaguacaucagaaauaaagcuguaucugccauuuuaagcc

SEQ ID NO: 114028 - RNA, 64 nt, hsa
cacacagaacaaaaaccaucaaaaucucauauaugaaauaaaauauauucuucuaagcaaagaa

SEQ ID NO: 114029 - RNA, 64 nt, hsa
guuuucuuggcuaguaauaguaguagauacuucugaaauaaauguucucucaagauccuuaaaa

SEQ ID NO: 114030 - RNA, 64 nt, hsa
ugggauguauauauaucauugcuguuagagaaaugaaauaaaauggggcugggcucaguggcuc

SEQ ID NO: 114031 - RNA, 64 nt, hsa
agguggaaauaguuguggauguacuaagaguaaugaaauaaaauuauagcuucauucacuugcc

SEQ ID NO: 114032 - RNA, 64 nt, hsa
auaugccaucuguccucaaguguuaucuacauaggaaauaaaauggaauugauguaaaguucca

SEQ ID NO: 114033 - RNA, 64 nt, hsa
uuuuuacuuuaauaguuuaguguaaaguacaucagaaauaaaacuguaucugacauuuuaagcc

SEQ ID NO: 114034 - RNA, 64 nt, hsa; identical to SEQ ID NO: 114028

SEQ ID NO: 114035 - RNA, 64 nt, hsa
cacaauaguguuuacaaaucuuauacaucuuacuuugacagaagacuuauaauaccuugugguc

SEQ ID NO: 114036 - RNA, 64 nt, hsa
uaccugaucuuaagguuugguauucuaaccaaaguugacagacugugcgucugucuuaauggau

SEQ ID NO: 114037 - RNA, 64 nt, hsa
acaauauuggguguuugggagccagaaagcuuuguugacagaucagaaauaagauugacuuggg

SEQ ID NO: 114038 - RNA, 64 nt, hsa
cugucuagucauuguaaauauuuaucugucaguuuugacagauuggggccagcuugauguuuua

SEQ ID NO: 114039 - RNA, 64 nt, hsa
auucaauauugggguuggaacauuucaguugccauugacagaacacccaauucaaauugacuga

SEQ ID NO: 114040 - RNA, 63 nt, hsa
auaucucugauugucauguggauuugaauguagcuugacagagggaaugucuaaucuauauug

SEQ ID NO: 114041 - RNA, 64 nt, hsa
uagguuucuaggagaguuuuguuuaacuaagaaauugacagaauucauagguguggguguagag

SEQ ID NO: 114042 - RNA, 64 nt, hsa
auaauucaaagcacaauaauugaaagcacaauaauugacagaaaaauacagguucuauuaauaa

SEQ ID NO: 114043 - RNA, 64 nt, hsa
aaaaaaauccuaggaauacaguuaauaguagucuuugacagaucaucuuggacuucaggaaaug

SEQ ID NO: 114044 - RNA, 64 nt, hsa
gacauggguaccaaaaauacccaauucuaagugguugacagauguucacuuugaagugugaagu

SEQ ID NO: 114045 - RNA, 64 nt, hsa
cauaucauuuuuaaaaauaaaaaaaaacccaaaaauaaugcaugcauaauuuaaauggucaauu

SEQ ID NO: 114046 - RNA, 64 nt, hsa
cuagugaaaaaaauauuuuuaaaauuucagccaaauaaugcauuuuauuuauaaaaauacagac

SEQ ID NO: 114047 - RNA, 64 nt, hsa
acuacaugcaaggcacucugcuaguuauauucuaauaaugcagagauaauuagacaugguuccc

SEQ ID NO: 114048 - RNA, 64 nt, hsa
ccgcccucaagaagcucacaaaaguauucaggaaauaaugcagacuagugauuuugcuauaaaa

SEQ ID NO: 114049 - RNA, 64 nt, hsa
aguuauguguaauuaaucuauaaugccauaaaugauaaugcaaaaccuaaauaauaugguggcc

SEQ ID NO: 114050 - RNA, 64 nt, hsa
agggugcauuuuaaguucuaacuucguuuauuguauaaugcaucauuugaaaauaccaaggagg

SEQ ID NO: 114051 - RNA, 64 nt, hsa
uccucuuuguaauuuaaugaaaagguacaacagaauaaugcaugaugaacucaccuaauuauga

SEQ ID NO: 114052 - RNA, 64 nt, hsa
uuuguaggugagaugcaacaagcccugcuuuugcauaaugcaaucaaaaauauguguuuuuaag

SEQ ID NO: 114053 - RNA, 64 nt, hsa
auacacagcaaugaauggcacacaaguaauccacauaaugcauaagccacaccaaaaccagacu

SEQ ID NO: 114054 - RNA, 64 nt, hsa
uucaaccuuucucccuucucaaaaugcuugccucauaaugcauaacuuucacuuugacucuggu

SEQ ID NO: 114055 - RNA, 64 nt, hsa
cuacugaggaagauucauguucaauuauuuggaaauaaugcaagcauccacuaagggccuuuaa

SEQ ID NO: 114056 - RNA, 64 nt, hsa
cauucaucaaggcaugauuuuuguuucacuacaaauaaugcaaacuguuuucaauaaaaagagg

SEQ ID NO: 114057 - RNA, 64 nt, hsa
gccuacugaagauagguucucuauguauucaacaauaaugcaacuuuagaaguauuccacacug

SEQ ID NO: 114058 - RNA, 64 nt, hsa; identical to SEQ ID NO: 39289

SEQ ID NO: 114059 - RNA, 64 nt, hsa; identical to SEQ ID NO: 39290

SEQ ID NO: 114060 - RNA, 64 nt, hsa; identical to SEQ ID NO: 39291

SEQ ID NO: 114061 - RNA, 64 nt, hsa; identical to SEQ ID NO: 39292

SEQ ID NO: 114062 - RNA, 64 nt, hsa; identical to SEQ ID NO: 39293

SEQ ID NO: 114063 - RNA, 64 nt, hsa; identical to SEQ ID NO: 39294

SEQ ID NO: 114064 - RNA, 64 nt, hsa; identical to SEQ ID NO: 39295

SEQ ID NO: 114065 - RNA, 64 nt, hsa; identical to SEQ ID NO: 39296

SEQ ID NO: 114066 - RNA, 64 nt, hsa; identical to SEQ ID NO: 39297

SEQ ID NO: 114067 - RNA, 64 nt, hsa; identical to SEQ ID NO: 39298

SEQ ID NO: 114068 - RNA, 64 nt, hsa; identical to SEQ ID NO: 39299

SEQ ID NO: 114069 - RNA, 64 nt, hsa; identical to SEQ ID NO: 39300

SEQ ID NO: 114070 - RNA, 64 nt, hsa; identical to SEQ ID NO: 39301

SEQ ID NO: 114071 - RNA, 64 nt, hsa; identical to SEQ ID NO: 39302

SEQ ID NO: 114072 - RNA, 64 nt, hsa; identical to SEQ ID NO: 39303

SEQ ID NO: 114073 - RNA, 64 nt, hsa; identical to SEQ ID NO: 39304

SEQ ID NO: 114074 - RNA, 64 nt, hsa; identical to SEQ ID NO: 39305

SEQ ID NO: 114075 - RNA, 64 nt, hsa; identical to SEQ ID NO: 39306

SEQ ID NO: 114076 - RNA, 64 nt, hsa; identical to SEQ ID NO: 39307

SEQ ID NO: 114077 - RNA, 64 nt, hsa; identical to SEQ ID NO: 39308

SEQ ID NO: 114078 - RNA, 64 nt, hsa; identical to SEQ ID NO: 39309

SEQ ID NO: 114079 - RNA, 64 nt, hsa; identical to SEQ ID NO: 39310

SEQ ID NO: 114080 - RNA, 64 nt, hsa; identical to SEQ ID NO: 39311

SEQ ID NO: 114081 - RNA, 64 nt, hsa; identical to SEQ ID NO: 39312

SEQ ID NO: 114082 - RNA, 64 nt, hsa; identical to SEQ ID NO: 39313

SEQ ID NO: 114083 - RNA, 64 nt, hsa; identical to SEQ ID NO: 39314

SEQ ID NO: 114084 - RNA, 64 nt, hsa; identical to SEQ ID NO: 39315

SEQ ID NO: 114085 - RNA, 64 nt, hsa; identical to SEQ ID NO: 39316

SEQ ID NO: 114086 - RNA, 64 nt, hsa; identical to SEQ ID NO: 39317

SEQ ID NO: 114087 - RNA, 64 nt, hsa; identical to SEQ ID NO: 39318

SEQ ID NO: 114088 - RNA, 64 nt, hsa; identical to SEQ ID NO: 39319

SEQ ID NO: 114089 - RNA, 64 nt, hsa; identical to SEQ ID NO: 39320

SEQ ID NO: 114090 - RNA, 64 nt, hsa; identical to SEQ ID NO: 39321

SEQ ID NO: 114091 - RNA, 64 nt, hsa; identical to SEQ ID NO: 39322

SEQ ID NO: 114092 - RNA, 64 nt, hsa; identical to SEQ ID NO: 39323

SEQ ID NO: 114093 - RNA, 64 nt, hsa; identical to SEQ ID NO: 39324

SEQ ID NO: 114094 - RNA, 64 nt, hsa; identical to SEQ ID NO: 39325

SEQ ID NO: 114095 - RNA, 64 nt, hsa; identical to SEQ ID NO: 39326

SEQ ID NO: 114096 - RNA, 64 nt, hsa; identical to SEQ ID NO: 39327

SEQ ID NO: 114097 - RNA, 64 nt, hsa; identical to SEQ ID NO: 39328

SEQ ID NO: 114098 - RNA, 64 nt, hsa; identical to SEQ ID NO: 39329

SEQ ID NO: 114099 - RNA, 64 nt, hsa; identical to SEQ ID NO: 39330

SEQ ID NO: 114100 - RNA, 64 nt, hsa; identical to SEQ ID NO: 39331

SEQ ID NO: 114101 - RNA, 64 nt, hsa; identical to SEQ ID NO: 39332

SEQ ID NO: 114102 - RNA, 61 nt, hsa; identical to SEQ ID NO: 39333

SEQ ID NO: 114103 - RNA, 64 nt, hsa; identical to SEQ ID NO: 39334

SEQ ID NO: 114104 - RNA, 64 nt, hsa; identical to SEQ ID NO: 39335

SEQ ID NO: 114105 - RNA, 64 nt, hsa; identical to SEQ ID NO: 39336

SEQ ID NO: 114106 - RNA, 64 nt, hsa; identical to SEQ ID NO: 39337

SEQ ID NO: 114107 - RNA, 64 nt, hsa; identical to SEQ ID NO: 39338

SEQ ID NO: 114108 - RNA, 64 nt, hsa; identical to SEQ ID NO: 39339

SEQ ID NO: 114109 - RNA, 64 nt, hsa; identical to SEQ ID NO: 39340

SEQ ID NO: 114110 - RNA, 64 nt, hsa; identical to SEQ ID NO: 39341

SEQ ID NO: 114111 - RNA, 64 nt, hsa; identical to SEQ ID NO: 39342

SEQ ID NO: 114112 - RNA, 64 nt, hsa; identical to SEQ ID NO: 39343

SEQ ID NO: 114113 - RNA, 64 nt, hsa; identical to SEQ ID NO: 39344

SEQ ID NO: 114114 - RNA, 64 nt, hsa; identical to SEQ ID NO: 39345

SEQ ID NO: 114115 - RNA, 64 nt, hsa; identical to SEQ ID NO: 39346

SEQ ID NO: 114116 - RNA, 62 nt, hsa
ugaacaggagaaagacaaacagaaagaauagagaacaggaacgagguggagagcaagacuga

SEQ ID NO: 114117 - RNA, 62 nt, hsa
ggugcccguggaaagagggagaaagagaagcugaacaggagaaagacaaacagaaagaauag

SEQ ID NO: 114118 - RNA, 62 nt, hsa
cuguucaaccuguuuugaccucccaggcaucugaacaggaugacaucaucuuauuauaucuu

SEQ ID NO: 114119 - RNA, 62 nt, hsa
uaacuaacaauuuugaaauacucauauaaaaugaacaggaaaguguuagugauugggugauu

SEQ ID NO: 114120 - RNA, 62 nt, hsa
ugcaagguacaauuuucuccaauaaaucaggagaacaggaguuugaugaugcaaaguugauc

SEQ ID NO: 114121 - RNA, 61 nt, hsa
ggagaauacuuaaauaaaacaugugcaugcuugaacaggacaaaauguugacuguugcccu

SEQ ID NO: 114122 - RNA, 62 nt, hsa
guuaauauaaaacaucuuuggaggaugggagagaacaggagggaagaugggaaacaaaauag

SEQ ID NO: 114123 - RNA, 62 nt, hsa
cuuuccagaaaaauccucagaucauguaucuagaacaggaguuagaaagccugaaagcugug

SEQ ID NO: 114124 - RNA, 62 nt, hsa
ggaucuucuauuuaaguggcuucugagagggugaacaggauuguuacuuuuaagccuaccuc

SEQ ID NO: 114125 - RNA, 62 nt, hsa
cucucucugcagacaugcugggaacucgcauggaacaggagggcagcagggcacuaaccucc

SEQ ID NO: 114126 - RNA, 62 nt, hsa
uaucuuuugagaacuuuugguaagggaaaagggaacaggaaaagaaaccccaaacucaggcc

SEQ ID NO: 114127 - RNA, 62 nt, hsa
agcccuguaucaacccagaaacaccuagaucagaacaggaauccacauugccagugacauga

SEQ ID NO: 114128 - RNA, 62 nt, hsa
auuuguguagugagguccuaaucaagaaacuugaacaggauaaugugucuaaaaauauugcu

SEQ ID NO: 114129 - RNA, 62 nt, hsa
gguaguuuuaugucaaaauauuggcuuuucaagaacaggacucauaucuugauauuuaagag

SEQ ID NO: 114130 - RNA, 64 nt, hsa
aguuccaggaguacuuacuauuggucaugcaauaggagaacagagacccgagggcugcuuuggg

SEQ ID NO: 114131 - RNA, 64 nt, hsa
gauuuuagcagagacuuuagucuuuggggcaagaggagaacaggaaugcugggcuguuuacuuu

SEQ ID NO: 114132 - RNA, 64 nt, hsa
uuggaggugaaaucuaauuauuggugagagucuuggagaacaggcuguuuccagucucaaagca

SEQ ID NO: 114133 - RNA, 64 nt, hsa
uuucagagugagacauuuguacuguggcuauguaggagaacauucuuguucuuagcaaacauac

SEQ ID NO: 114134 - RNA, 64 nt, hsa
gcuuuugcucaaaggaggauucuggagccgagaaggagaacaccucuguccugcagcagaaccc

SEQ ID NO: 114135 - RNA, 64 nt, hsa
agaaccccuccuugucggguagccggaauggggaggagaacaucaucgauaacccuuaucugcg

SEQ ID NO: 114136 - RNA, 64 nt, hsa
ugggagucccggaggccaggcugcacaccuggugggagaacacacucuggaauucucuauucuc

SEQ ID NO: 114137 - RNA, 64 nt, hsa
ccccauuuccuccuucauccuguggagucugugaggagaacaggugggcgugcuggugaccccg

SEQ ID NO: 114138 - RNA, 64 nt, hsa
aggcugcugccaccuacuucuuaucaaagaagggggagaacaguucaucugagucagugcaccu

SEQ ID NO: 114139 - RNA, 64 nt, hsa
agggcggcagccugucugcugcugagugauucagggagaacaugugugcacgugcauguguguu

SEQ ID NO: 114140 - RNA, 64 nt, hsa
gcaagccuuccuccauggcccaucacucggcuguggagaacaaagaccaaugugaagacacuac

SEQ ID NO: 114141 - RNA, 64 nt, hsa
auucccagagguggggaagagagccugcccggccggagaacaucugccuugcugcaccugaggc

SEQ ID NO: 114142 - RNA, 64 nt, hsa
ucaagacagaauuggacaugcaaaagauugacugggagaacacaccucugauggacaaagguga

SEQ ID NO: 114143 - RNA, 64 nt, hsa
ccagggguucagacuuuggcugagaacagccccuggagaacauggggugacugcuaccauaggu

SEQ ID NO: 114144 - RNA, 64 nt, hsa
ugaaagcuggaaggaaaaaagcuauucucuaacaggagaacauaaagauucauuucucucccac

SEQ ID NO: 114145 - RNA, 64 nt, hsa
cuucucgaguagaggucugccuagugagugagcaggagaacaucaucuuaauagccuuuggcuc

SEQ ID NO: 114146 - RNA, 64 nt, hsa
accuuuauuccuguaaauauuucugugaaaacuaggagaacagagaugagauuugacaaaaaaa

SEQ ID NO: 114147 - RNA, 64 nt, hsa
augucuccugugggcuuuuuaccaccacugugcaggagaacagacagaggaaaugugucucccu

SEQ ID NO: 114148 - RNA, 64 nt, hsa
cuacuguaggagauagguacuguuguuuuuuauuaccgccgaagaaacaggccagauaagugaa

SEQ ID NO: 114149 - RNA, 64 nt, hsa
uucugaggggcagcggggccuggcgggaugggccaccgccgacuuuguaccccccaaccccuga

SEQ ID NO: 114150 - RNA, 64 nt, hsa
guccucugugcccacggucugagcuagcuagcgcaccgccgaguuaaagaggagaaggaaaaca

SEQ ID NO: 114151 - RNA, 64 nt, hsa
cucaacgagacccaagugaagaucugguuccagaaccgccgaaugaagcaaaagaaacgugaga

SEQ ID NO: 114152 - RNA, 64 nt, hsa
gcccagugggggcugggcaggcccauugagggccaccgccgagguuucuccuagggcuguuccu

SEQ ID NO: 114153 - RNA, 64 nt, hsa
cuagcgcucgaaagcccaacgccucccggaccggaccgccgaggggagcugggaccuccucugc

SEQ ID NO: 114154 - RNA, 64 nt, hsa
agcuggcugggcuggacccggucccuaggcugugaccgccgaacuccacugcaacagacgggcg

SEQ ID NO: 114155 - RNA, 64 nt, hsa
ccagcgagccggggacccacccaccaccccccgcaccgccgacgccgccucguucguccggccc

SEQ ID NO: 114156 - RNA, 64 nt, hsa
cugcaggaccaggugccagccacuaagggggggcaccgccgaugccagggguuuugcccacccg

SEQ ID NO: 114157 - RNA, 64 nt, hsa
aaguagggcgugugguuucccugccccuguccggaccgccgaucccaggugcgugugucucugu

SEQ ID NO: 114158 - RNA, 64 nt, hsa
cgccuacucccagcugguggccgugcuggucuacaccgccgagcgggccaaguucgccaccggg

SEQ ID NO: 114159 - RNA, 64 nt, hsa
guccccaucauucagucaccuccccccaggccccaccgccgauucugaggaugacaauuccaca

SEQ ID NO: 114160 - RNA, 64 nt, hsa; identical to SEQ ID NO: 90763

SEQ ID NO: 114161 - RNA, 64 nt, hsa; identical to SEQ ID NO: 90764

SEQ ID NO: 114162 - RNA, 64 nt, hsa; identical to SEQ ID NO: 90765

SEQ ID NO: 114163 - RNA, 64 nt, hsa; identical to SEQ ID NO: 90766

SEQ ID NO: 114164 - RNA, 64 nt, hsa; identical to SEQ ID NO: 90767

SEQ ID NO: 114165 - RNA, 64 nt, hsa; identical to SEQ ID NO: 90768

SEQ ID NO: 114166 - RNA, 64 nt, hsa; identical to SEQ ID NO: 90769

SEQ ID NO: 114167 - RNA, 64 nt, hsa; identical to SEQ ID NO: 90770

SEQ ID NO: 114168 - RNA, 64 nt, hsa; identical to SEQ ID NO: 90771

SEQ ID NO: 114169 - RNA, 64 nt, hsa; identical to SEQ ID NO: 90772

SEQ ID NO: 114170 - RNA, 64 nt, hsa; identical to SEQ ID NO: 90773

SEQ ID NO: 114171 - RNA, 64 nt, hsa; identical to SEQ ID NO: 90774

SEQ ID NO: 114172 - RNA, 64 nt, hsa; identical to SEQ ID NO: 90775

SEQ ID NO: 114173 - RNA, 64 nt, hsa; identical to SEQ ID NO: 90776

SEQ ID NO: 114174 - RNA, 64 nt, hsa; identical to SEQ ID NO: 90777

SEQ ID NO: 114175 - RNA, 64 nt, hsa; identical to SEQ ID NO: 90778

SEQ ID NO: 114176 - RNA, 64 nt, hsa; identical to SEQ ID NO: 90779

SEQ ID NO: 114177 - RNA, 64 nt, hsa; identical to SEQ ID NO: 90780

SEQ ID NO: 114178 - RNA, 64 nt, hsa; identical to SEQ ID NO: 90781

SEQ ID NO: 114179 - RNA, 64 nt, hsa; identical to SEQ ID NO: 90782

SEQ ID NO: 114180 - RNA, 64 nt, hsa; identical to SEQ ID NO: 90783

SEQ ID NO: 114181 - RNA, 64 nt, hsa; identical to SEQ ID NO: 90784

SEQ ID NO: 114182 - RNA, 64 nt, hsa; identical to SEQ ID NO: 90785

SEQ ID NO: 114183 - RNA, 64 nt, hsa; identical to SEQ ID NO: 90786

SEQ ID NO: 114184 - RNA, 64 nt, hsa; identical to SEQ ID NO: 90787

SEQ ID NO: 114185 - RNA, 64 nt, hsa; identical to SEQ ID NO: 90788

SEQ ID NO: 114186 - RNA, 64 nt, hsa; identical to SEQ ID NO: 90789

SEQ ID NO: 114187 - RNA, 64 nt, hsa; identical to SEQ ID NO: 90790

SEQ ID NO: 114188 - RNA, 64 nt, hsa; identical to SEQ ID NO: 90791

SEQ ID NO: 114189 - RNA, 64 nt, hsa; identical to SEQ ID NO: 90792

SEQ ID NO: 114190 - RNA, 64 nt, hsa; identical to SEQ ID NO: 90793

SEQ ID NO: 114191 - RNA, 64 nt, hsa; identical to SEQ ID NO: 90794

SEQ ID NO: 114192 - RNA, 64 nt, hsa; identical to SEQ ID NO: 90795

SEQ ID NO: 114193 - RNA, 64 nt, hsa; identical to SEQ ID NO: 90796

SEQ ID NO: 114194 - RNA, 64 nt, hsa; identical to SEQ ID NO: 90797

SEQ ID NO: 114195 - RNA, 64 nt, hsa; identical to SEQ ID NO: 90798

SEQ ID NO: 114196 - RNA, 64 nt, hsa; identical to SEQ ID NO: 90799

SEQ ID NO: 114197 - RNA, 64 nt, hsa; identical to SEQ ID NO: 90800

SEQ ID NO: 114198 - RNA, 64 nt, hsa; identical to SEQ ID NO: 90801

SEQ ID NO: 114199 - RNA, 64 nt, hsa; identical to SEQ ID NO: 90802

SEQ ID NO: 114200 - RNA, 64 nt, hsa; identical to SEQ ID NO: 90803

SEQ ID NO: 114201 - RNA, 64 nt, hsa; identical to SEQ ID NO: 90804

SEQ ID NO: 114202 - RNA, 64 nt, hsa; identical to SEQ ID NO: 90805

SEQ ID NO: 114203 - RNA, 64 nt, hsa; identical to SEQ ID NO: 90806

SEQ ID NO: 114204 - RNA, 64 nt, hsa; identical to SEQ ID NO: 90807

SEQ ID NO: 114205 - RNA, 64 nt, hsa; identical to SEQ ID NO: 90808

SEQ ID NO: 114206 - RNA, 64 nt, hsa; identical to SEQ ID NO: 90809

SEQ ID NO: 114207 - RNA, 64 nt, hsa; identical to SEQ ID NO: 90810

SEQ ID NO: 114208 - RNA, 64 nt, hsa; identical to SEQ ID NO: 90811

SEQ ID NO: 114209 - RNA, 64 nt, hsa; identical to SEQ ID NO: 90812

SEQ ID NO: 114210 - RNA, 64 nt, hsa; identical to SEQ ID NO: 90813

SEQ ID NO: 114211 - RNA, 64 nt, hsa; identical to SEQ ID NO: 90814

SEQ ID NO: 114212 - RNA, 64 nt, hsa; identical to SEQ ID NO: 90815

SEQ ID NO: 114213 - RNA, 64 nt, hsa; identical to SEQ ID NO: 90816

SEQ ID NO: 114214 - RNA, 64 nt, hsa; identical to SEQ ID NO: 90817

SEQ ID NO: 114215 - RNA, 64 nt, hsa; identical to SEQ ID NO: 90818

SEQ ID NO: 114216 - RNA, 64 nt, hsa; identical to SEQ ID NO: 90819

SEQ ID NO: 114217 - RNA, 64 nt, hsa; identical to SEQ ID NO: 90820

SEQ ID NO: 114218 - RNA, 64 nt, hsa; identical to SEQ ID NO: 90821

SEQ ID NO: 114219 - RNA, 64 nt, hsa; identical to SEQ ID NO: 90822

SEQ ID NO: 114220 - RNA, 64 nt, hsa; identical to SEQ ID NO: 90823

SEQ ID NO: 114221 - RNA, 64 nt, hsa; identical to SEQ ID NO: 90824

SEQ ID NO: 114222 - RNA, 64 nt, hsa; identical to SEQ ID NO: 90825

SEQ ID NO: 114223 - RNA, 64 nt, hsa; identical to SEQ ID NO: 90826

SEQ ID NO: 114224 - RNA, 64 nt, hsa; identical to SEQ ID NO: 90827

SEQ ID NO: 114225 - RNA, 64 nt, hsa; identical to SEQ ID NO: 90828

SEQ ID NO: 114226 - RNA, 64 nt, hsa; identical to SEQ ID NO: 90829

SEQ ID NO: 114227 - RNA, 64 nt, hsa; identical to SEQ ID NO: 90830

SEQ ID NO: 114228 - RNA, 64 nt, hsa; identical to SEQ ID NO: 90831

SEQ ID NO: 114229 - RNA, 64 nt, hsa; identical to SEQ ID NO: 90832

SEQ ID NO: 114230 - RNA, 64 nt, hsa; identical to SEQ ID NO: 90833

SEQ ID NO: 114231 - RNA, 64 nt, hsa; identical to SEQ ID NO: 90834

SEQ ID NO: 114232 - RNA, 64 nt, hsa; identical to SEQ ID NO: 90835

SEQ ID NO: 114233 - RNA, 64 nt, hsa; identical to SEQ ID NO: 90836

SEQ ID NO: 114234 - RNA, 64 nt, hsa; identical to SEQ ID NO: 90837

SEQ ID NO: 114235 - RNA, 64 nt, hsa; identical to SEQ ID NO: 90838

SEQ ID NO: 114236 - RNA, 64 nt, hsa; identical to SEQ ID NO: 90839

SEQ ID NO: 114237 - RNA, 64 nt, hsa; identical to SEQ ID NO: 90840

SEQ ID NO: 114238 - RNA, 64 nt, hsa; identical to SEQ ID NO: 90841

SEQ ID NO: 114239 - RNA, 64 nt, hsa; identical to SEQ ID NO: 90842

SEQ ID NO: 114240 - RNA, 64 nt, hsa; identical to SEQ ID NO: 90843

SEQ ID NO: 114241 - RNA, 64 nt, hsa; identical to SEQ ID NO: 90844

SEQ ID NO: 114242 - RNA, 64 nt, hsa; identical to SEQ ID NO: 90845

SEQ ID NO: 114243 - RNA, 64 nt, hsa; identical to SEQ ID NO: 90846

SEQ ID NO: 114244 - RNA, 64 nt, hsa; identical to SEQ ID NO: 90847

SEQ ID NO: 114245 - RNA, 64 nt, hsa; identical to SEQ ID NO: 90848

SEQ ID NO: 114246 - RNA, 64 nt, hsa; identical to SEQ ID NO: 90849

SEQ ID NO: 114247 - RNA, 64 nt, hsa; identical to SEQ ID NO: 90850

SEQ ID NO: 114248 - RNA, 64 nt, hsa; identical to SEQ ID NO: 90851

SEQ ID NO: 114249 - RNA, 64 nt, hsa; identical to SEQ ID NO: 90852

SEQ ID NO: 114250 - RNA, 64 nt, hsa; identical to SEQ ID NO: 90853

SEQ ID NO: 114251 - RNA, 64 nt, hsa; identical to SEQ ID NO: 90854

SEQ ID NO: 114252 - RNA, 64 nt, hsa; identical to SEQ ID NO: 90855

SEQ ID NO: 114253 - RNA, 64 nt, hsa; identical to SEQ ID NO: 90856

SEQ ID NO: 114254 - RNA, 64 nt, hsa; identical to SEQ ID NO: 90857

SEQ ID NO: 114255 - RNA, 64 nt, hsa; identical to SEQ ID NO: 90858

SEQ ID NO: 114256 - RNA, 64 nt, hsa; identical to SEQ ID NO: 90859

SEQ ID NO: 114257 - RNA, 64 nt, hsa; identical to SEQ ID NO: 90860

SEQ ID NO: 114258 - RNA, 64 nt, hsa; identical to SEQ ID NO: 90861

SEQ ID NO: 114259 - RNA, 64 nt, hsa; identical to SEQ ID NO: 90862

SEQ ID NO: 114260 - RNA, 64 nt, hsa; identical to SEQ ID NO: 90863

SEQ ID NO: 114261 - RNA, 64 nt, hsa; identical to SEQ ID NO: 90864

SEQ ID NO: 114262 - RNA, 64 nt, hsa; identical to SEQ ID NO: 90865

SEQ ID NO: 114263 - RNA, 64 nt, hsa; identical to SEQ ID NO: 90866

SEQ ID NO: 114264 - RNA, 64 nt, hsa; identical to SEQ ID NO: 90867

SEQ ID NO: 114265 - RNA, 64 nt, hsa; identical to SEQ ID NO: 90868

SEQ ID NO: 114266 - RNA, 64 nt, hsa; identical to SEQ ID NO: 90869

SEQ ID NO: 114267 - RNA, 64 nt, hsa; identical to SEQ ID NO: 90870

SEQ ID NO: 114268 - RNA, 64 nt, hsa; identical to SEQ ID NO: 90871

SEQ ID NO: 114269 - RNA, 64 nt, hsa; identical to SEQ ID NO: 90872

SEQ ID NO: 114270 - RNA, 64 nt, hsa; identical to SEQ ID NO: 90873

SEQ ID NO: 114271 - RNA, 64 nt, hsa; identical to SEQ ID NO: 90874

SEQ ID NO: 114272 - RNA, 64 nt, hsa; identical to SEQ ID NO: 90875

SEQ ID NO: 114273 - RNA, 64 nt, hsa; identical to SEQ ID NO: 90876

SEQ ID NO: 114274 - RNA, 64 nt, hsa; identical to SEQ ID NO: 90877

SEQ ID NO: 114275 - RNA, 64 nt, hsa; identical to SEQ ID NO: 90878

SEQ ID NO: 114276 - RNA, 64 nt, hsa; identical to SEQ ID NO: 90879

SEQ ID NO: 114277 - RNA, 64 nt, hsa; identical to SEQ ID NO: 90880

SEQ ID NO: 114278 - RNA, 64 nt, hsa; identical to SEQ ID NO: 90881

SEQ ID NO: 114279 - RNA, 64 nt, hsa; identical to SEQ ID NO: 90882

SEQ ID NO: 114280 - RNA, 64 nt, hsa; identical to SEQ ID NO: 90883

SEQ ID NO: 114281 - RNA, 64 nt, hsa; identical to SEQ ID NO: 90884

SEQ ID NO: 114282 - RNA, 64 nt, hsa; identical to SEQ ID NO: 90885

SEQ ID NO: 114283 - RNA, 64 nt, hsa; identical to SEQ ID NO: 90886

SEQ ID NO: 114284 - RNA, 64 nt, hsa; identical to SEQ ID NO: 90887

SEQ ID NO: 114285 - RNA, 64 nt, hsa; identical to SEQ ID NO: 90888

SEQ ID NO: 114286 - RNA, 64 nt, hsa; identical to SEQ ID NO: 90889

SEQ ID NO: 114287 - RNA, 64 nt, hsa; identical to SEQ ID NO: 90890

SEQ ID NO: 114288 - RNA, 64 nt, hsa; identical to SEQ ID NO: 90891

SEQ ID NO: 114289 - RNA, 64 nt, hsa; identical to SEQ ID NO: 90892

SEQ ID NO: 114290 - RNA, 64 nt, hsa; identical to SEQ ID NO: 90893

SEQ ID NO: 114291 - RNA, 64 nt, hsa; identical to SEQ ID NO: 90894

SEQ ID NO: 114292 - RNA, 64 nt, hsa; identical to SEQ ID NO: 90895

SEQ ID NO: 114293 - RNA, 64 nt, hsa; identical to SEQ ID NO: 90896

SEQ ID NO: 114294 - RNA, 64 nt, hsa; identical to SEQ ID NO: 90897

SEQ ID NO: 114295 - RNA, 64 nt, hsa; identical to SEQ ID NO: 90898

SEQ ID NO: 114296 - RNA, 64 nt, hsa; identical to SEQ ID NO: 90899

SEQ ID NO: 114297 - RNA, 54 nt, hsa; identical to SEQ ID NO: 90900

SEQ ID NO: 114298 - RNA, 64 nt, hsa; identical to SEQ ID NO: 90901

SEQ ID NO: 114299 - RNA, 64 nt, hsa; identical to SEQ ID NO: 90902

SEQ ID NO: 114300 - RNA, 64 nt, hsa; identical to SEQ ID NO: 90903

SEQ ID NO: 114301 - RNA, 64 nt, hsa; identical to SEQ ID NO: 90904

SEQ ID NO: 114302 - RNA, 64 nt, hsa; identical to SEQ ID NO: 90905

SEQ ID NO: 114303 - RNA, 64 nt, hsa; identical to SEQ ID NO: 90906

SEQ ID NO: 114304 - RNA, 64 nt, hsa; identical to SEQ ID NO: 90907

SEQ ID NO: 114305 - RNA, 64 nt, hsa; identical to SEQ ID NO: 90908

SEQ ID NO: 114306 - RNA, 64 nt, hsa; identical to SEQ ID NO: 90909

SEQ ID NO: 114307 - RNA, 64 nt, hsa; identical to SEQ ID NO: 90910

SEQ ID NO: 114308 - RNA, 64 nt, hsa; identical to SEQ ID NO: 90911

SEQ ID NO: 114309 - RNA, 64 nt, hsa; identical to SEQ ID NO: 90912

SEQ ID NO: 114310 - RNA, 64 nt, hsa; identical to SEQ ID NO: 90913

SEQ ID NO: 114311 - RNA, 64 nt, hsa; identical to SEQ ID NO: 90914

SEQ ID NO: 114312 - RNA, 64 nt, hsa; identical to SEQ ID NO: 90915

SEQ ID NO: 114313 - RNA, 64 nt, hsa; identical to SEQ ID NO: 90916

SEQ ID NO: 114314 - RNA, 64 nt, hsa; identical to SEQ ID NO: 90917

SEQ ID NO: 114315 - RNA, 64 nt, hsa; identical to SEQ ID NO: 90918

SEQ ID NO: 114316 - RNA, 64 nt, hsa; identical to SEQ ID NO: 90919

SEQ ID NO: 114317 - RNA, 64 nt, hsa; identical to SEQ ID NO: 90920

SEQ ID NO: 114318 - RNA, 64 nt, hsa; identical to SEQ ID NO: 90921

SEQ ID NO: 114319 - RNA, 64 nt, hsa; identical to SEQ ID NO: 90922

SEQ ID NO: 114320 - RNA, 64 nt, hsa; identical to SEQ ID NO: 90923

SEQ ID NO: 114321 - RNA, 64 nt, hsa; identical to SEQ ID NO: 90924

SEQ ID NO: 114322 - RNA, 64 nt, hsa; identical to SEQ ID NO: 90925

SEQ ID NO: 114323 - RNA, 64 nt, hsa; identical to SEQ ID NO: 90926

SEQ ID NO: 114324 - RNA, 64 nt, hsa; identical to SEQ ID NO: 90927

SEQ ID NO: 114325 - RNA, 64 nt, hsa; identical to SEQ ID NO: 90928

SEQ ID NO: 114326 - RNA, 64 nt, hsa; identical to SEQ ID NO: 90929

SEQ ID NO: 114327 - RNA, 64 nt, hsa; identical to SEQ ID NO: 90811

SEQ ID NO: 114328 - RNA, 64 nt, hsa; identical to SEQ ID NO: 90931

SEQ ID NO: 114329 - RNA, 64 nt, hsa; identical to SEQ ID NO: 90932

SEQ ID NO: 114330 - RNA, 64 nt, hsa; identical to SEQ ID NO: 90933

SEQ ID NO: 114331 - RNA, 64 nt, hsa; identical to SEQ ID NO: 90934

SEQ ID NO: 114332 - RNA, 64 nt, hsa; identical to SEQ ID NO: 90935

SEQ ID NO: 114333 - RNA, 64 nt, hsa; identical to SEQ ID NO: 90936

SEQ ID NO: 114334 - RNA, 64 nt, hsa; identical to SEQ ID NO: 90937

SEQ ID NO: 114335 - RNA, 64 nt, hsa; identical to SEQ ID NO: 90938

SEQ ID NO: 114336 - RNA, 64 nt, hsa; identical to SEQ ID NO: 90939

SEQ ID NO: 114337 - RNA, 64 nt, hsa; identical to SEQ ID NO: 90940

SEQ ID NO: 114338 - RNA, 64 nt, hsa; identical to SEQ ID NO: 90941

SEQ ID NO: 114339 - RNA, 64 nt, hsa; identical to SEQ ID NO: 90942

SEQ ID NO: 114340 - RNA, 64 nt, hsa; identical to SEQ ID NO: 90943

SEQ ID NO: 114341 - RNA, 64 nt, hsa; identical to SEQ ID NO: 90944

SEQ ID NO: 114342 - RNA, 64 nt, hsa; identical to SEQ ID NO: 90945

SEQ ID NO: 114343 - RNA, 64 nt, hsa; identical to SEQ ID NO: 90946

SEQ ID NO: 114344 - RNA, 64 nt, hsa; identical to SEQ ID NO: 90947

SEQ ID NO: 114345 - RNA, 64 nt, hsa; identical to SEQ ID NO: 90948

SEQ ID NO: 114346 - RNA, 64 nt, hsa; identical to SEQ ID NO: 90949

SEQ ID NO: 114347 - RNA, 64 nt, hsa; identical to SEQ ID NO: 90950

SEQ ID NO: 114348 - RNA, 64 nt, hsa; identical to SEQ ID NO: 90951

SEQ ID NO: 114349 - RNA, 64 nt, hsa; identical to SEQ ID NO: 90952

SEQ ID NO: 114350 - RNA, 64 nt, hsa; identical to SEQ ID NO: 90953

SEQ ID NO: 114351 - RNA, 64 nt, hsa; identical to SEQ ID NO: 90954

SEQ ID NO: 114352 - RNA, 64 nt, hsa; identical to SEQ ID NO: 90955

SEQ ID NO: 114353 - RNA, 64 nt, hsa; identical to SEQ ID NO: 90956

SEQ ID NO: 114354 - RNA, 64 nt, hsa; identical to SEQ ID NO: 90957

SEQ ID NO: 114355 - RNA, 64 nt, hsa; identical to SEQ ID NO: 90958

SEQ ID NO: 114356 - RNA, 64 nt, hsa; identical to SEQ ID NO: 90959

SEQ ID NO: 114357 - RNA, 64 nt, hsa; identical to SEQ ID NO: 90960

SEQ ID NO: 114358 - RNA, 64 nt, hsa; identical to SEQ ID NO: 90961

SEQ ID NO: 114359 - RNA, 64 nt, hsa; identical to SEQ ID NO: 90962

SEQ ID NO: 114360 - RNA, 64 nt, hsa; identical to SEQ ID NO: 90963

SEQ ID NO: 114361 - RNA, 64 nt, hsa; identical to SEQ ID NO: 90964

SEQ ID NO: 114362 - RNA, 64 nt, hsa; identical to SEQ ID NO: 90965

SEQ ID NO: 114363 - RNA, 64 nt, hsa; identical to SEQ ID NO: 90966

SEQ ID NO: 114364 - RNA, 64 nt, hsa; identical to SEQ ID NO: 90967

SEQ ID NO: 114365 - RNA, 64 nt, hsa; identical to SEQ ID NO: 90968

SEQ ID NO: 114366 - RNA, 64 nt, hsa; identical to SEQ ID NO: 90969

SEQ ID NO: 114367 - RNA, 64 nt, hsa; identical to SEQ ID NO: 90970

SEQ ID NO: 114368 - RNA, 64 nt, hsa; identical to SEQ ID NO: 90971

SEQ ID NO: 114369 - RNA, 64 nt, hsa; identical to SEQ ID NO: 90972

SEQ ID NO: 114370 - RNA, 64 nt, hsa; identical to SEQ ID NO: 90973

SEQ ID NO: 114371 - RNA, 64 nt, hsa; identical to SEQ ID NO: 90974

SEQ ID NO: 114372 - RNA, 64 nt, hsa; identical to SEQ ID NO: 90975

SEQ ID NO: 114373 - RNA, 64 nt, hsa; identical to SEQ ID NO: 90976

SEQ ID NO: 114374 - RNA, 64 nt, hsa; identical to SEQ ID NO: 90977

SEQ ID NO: 114375 - RNA, 64 nt, hsa; identical to SEQ ID NO: 90978

SEQ ID NO: 114376 - RNA, 64 nt, hsa; identical to SEQ ID NO: 90979

SEQ ID NO: 114377 - RNA, 64 nt, hsa; identical to SEQ ID NO: 90980

SEQ ID NO: 114378 - RNA, 64 nt, hsa; identical to SEQ ID NO: 90981

SEQ ID NO: 114379 - RNA, 64 nt, hsa; identical to SEQ ID NO: 90982

SEQ ID NO: 114380 - RNA, 64 nt, hsa; identical to SEQ ID NO: 90983

SEQ ID NO: 114381 - RNA, 64 nt, hsa; identical to SEQ ID NO: 90984

SEQ ID NO: 114382 - RNA, 64 nt, hsa; identical to SEQ ID NO: 90985

SEQ ID NO: 114383 - RNA, 64 nt, hsa; identical to SEQ ID NO: 90986

SEQ ID NO: 114384 - RNA, 64 nt, hsa; identical to SEQ ID NO: 90987

SEQ ID NO: 114385 - RNA, 64 nt, hsa; identical to SEQ ID NO: 90988

SEQ ID NO: 114386 - RNA, 64 nt, hsa; identical to SEQ ID NO: 90989

SEQ ID NO: 114387 - RNA, 64 nt, hsa; identical to SEQ ID NO: 90990

SEQ ID NO: 114388 - RNA, 64 nt, hsa; identical to SEQ ID NO: 90991

SEQ ID NO: 114389 - RNA, 64 nt, hsa; identical to SEQ ID NO: 90992

SEQ ID NO: 114390 - RNA, 64 nt, hsa; identical to SEQ ID NO: 90993

SEQ ID NO: 114391 - RNA, 64 nt, hsa; identical to SEQ ID NO: 90994

SEQ ID NO: 114392 - RNA, 64 nt, hsa; identical to SEQ ID NO: 90995

SEQ ID NO: 114393 - RNA, 64 nt, hsa; identical to SEQ ID NO: 90996

SEQ ID NO: 114394 - RNA, 64 nt, hsa; identical to SEQ ID NO: 90997

SEQ ID NO: 114395 - RNA, 64 nt, hsa; identical to SEQ ID NO: 90998

SEQ ID NO: 114396 - RNA, 64 nt, hsa; identical to SEQ ID NO: 90999

SEQ ID NO: 114397 - RNA, 64 nt, hsa; identical to SEQ ID NO: 91000

SEQ ID NO: 114398 - RNA, 64 nt, hsa; identical to SEQ ID NO: 91001

SEQ ID NO: 114399 - RNA, 64 nt, hsa; identical to SEQ ID NO: 91002

SEQ ID NO: 114400 - RNA, 64 nt, hsa; identical to SEQ ID NO: 91003

SEQ ID NO: 114401 - RNA, 64 nt, hsa; identical to SEQ ID NO: 91004

SEQ ID NO: 114402 - RNA, 64 nt, hsa; identical to SEQ ID NO: 91005

SEQ ID NO: 114403 - RNA, 64 nt, hsa; identical to SEQ ID NO: 91006

SEQ ID NO: 114404 - RNA, 64 nt, hsa; identical to SEQ ID NO: 91007

SEQ ID NO: 114405 - RNA, 64 nt, hsa; identical to SEQ ID NO: 91008

SEQ ID NO: 114406 - RNA, 64 nt, hsa; identical to SEQ ID NO: 91009

SEQ ID NO: 114407 - RNA, 64 nt, hsa; identical to SEQ ID NO: 91010

SEQ ID NO: 114408 - RNA, 64 nt, hsa; identical to SEQ ID NO: 91011

SEQ ID NO: 114409 - RNA, 64 nt, hsa; identical to SEQ ID NO: 91012

SEQ ID NO: 114410 - RNA, 64 nt, hsa; identical to SEQ ID NO: 91013

SEQ ID NO: 114411 - RNA, 64 nt, hsa; identical to SEQ ID NO: 91014

SEQ ID NO: 114412 - RNA, 64 nt, hsa; identical to SEQ ID NO: 91015

SEQ ID NO: 114413 - RNA, 64 nt, hsa; identical to SEQ ID NO: 91016

SEQ ID NO: 114414 - RNA, 64 nt, hsa; identical to SEQ ID NO: 91017

SEQ ID NO: 114415 - RNA, 64 nt, hsa; identical to SEQ ID NO: 91018

SEQ ID NO: 114416 - RNA, 64 nt, hsa; identical to SEQ ID NO: 91019

SEQ ID NO: 114417 - RNA, 64 nt, hsa; identical to SEQ ID NO: 91020

SEQ ID NO: 114418 - RNA, 64 nt, hsa; identical to SEQ ID NO: 91021

SEQ ID NO: 114419 - RNA, 64 nt, hsa; identical to SEQ ID NO: 91022

SEQ ID NO: 114420 - RNA, 64 nt, hsa; identical to SEQ ID NO: 91023

SEQ ID NO: 114421 - RNA, 64 nt, hsa; identical to SEQ ID NO: 91024

SEQ ID NO: 114422 - RNA, 64 nt, hsa; identical to SEQ ID NO: 91025

SEQ ID NO: 114423 - RNA, 64 nt, hsa; identical to SEQ ID NO: 91026

SEQ ID NO: 114424 - RNA, 64 nt, hsa; identical to SEQ ID NO: 91027

SEQ ID NO: 114425 - RNA, 64 nt, hsa; identical to SEQ ID NO: 91028

SEQ ID NO: 114426 - RNA, 64 nt, hsa; identical to SEQ ID NO: 91029

SEQ ID NO: 114427 - RNA, 64 nt, hsa; identical to SEQ ID NO: 55166

SEQ ID NO: 114428 - RNA, 64 nt, hsa; identical to SEQ ID NO: 55167

SEQ ID NO: 114429 - RNA, 64 nt, hsa; identical to SEQ ID NO: 55168

SEQ ID NO: 114430 - RNA, 64 nt, hsa; identical to SEQ ID NO: 55169

SEQ ID NO: 114431 - RNA, 64 nt, hsa; identical to SEQ ID NO: 55170

SEQ ID NO: 114432 - RNA, 64 nt, hsa; identical to SEQ ID NO: 55171

SEQ ID NO: 114433 - RNA, 64 nt, hsa; identical to SEQ ID NO: 55172

SEQ ID NO: 114434 - RNA, 64 nt, hsa; identical to SEQ ID NO: 55173

SEQ ID NO: 114435 - RNA, 64 nt, hsa; identical to SEQ ID NO: 55174

SEQ ID NO: 114436 - RNA, 64 nt, hsa; identical to SEQ ID NO: 55175

SEQ ID NO: 114437 - RNA, 64 nt, hsa; identical to SEQ ID NO: 55176

SEQ ID NO: 114438 - RNA, 64 nt, hsa; identical to SEQ ID NO: 55177

SEQ ID NO: 114439 - RNA, 64 nt, hsa
uguucuuagauaacccacauuagaugaauguguuaagugaaaugauacuuguacucccccuacc

SEQ ID NO: 114440 - RNA, 64 nt, hsa
cagacuuaauugguauuuguucuugcauuggccaaagugaaaauuuuuuuuuuucuuuugaaau

SEQ ID NO: 114441 - RNA, 64 nt, hsa
aauacuucuaauuuuuuucccuaaacauuuuuaaaagugaaauaugggaagagcuuuacagaca

SEQ ID NO: 114442 - RNA, 64 nt, hsa
cuagaguuuuaauuaccuuuauaauguuucuuaaaagugaaacuuagauacaauugugauugga

SEQ ID NO: 114443 - RNA, 64 nt, hsa
cuuagauacaauugugauuggauacuuagauacuaagugaaacuuaguguaacaauuuugaucu

SEQ ID NO: 114444 - RNA, 64 nt, hsa
cugccccugagcccauggcacucuauguucuaagaagugaaaaucuacacuccagugagacagc

SEQ ID NO: 114445 - RNA, 64 nt, hsa
uuacaacacggacgaaccuugaaaacuuuaugcuaagugaaauaagccagacaucaacagauaa

SEQ ID NO: 114446 - RNA, 64 nt, hsa
caucaaaaucaccaagaaaaacagcuucucaguuaagugaaaauaaaccaguuaaaacagaacc

SEQ ID NO: 114447 - RNA, 64 nt, hsa
ucaaaggaaaaucuuaaaagagaacacaccaaaaaagugaaagagaaauugaaagggaaaaaag

SEQ ID NO: 114448 - RNA, 64 nt, hsa
ccaggucacugguaguuauaguauggaaugggagaagugaaaguucaguuauagaacuuuccau

SEQ ID NO: 114449 - RNA, 64 nt, hsa
acugcaguaguugacuuugcuguauggaaaaauaaagugaaauugcccuaauaaaacuucucuu

SEQ ID NO: 114450 - RNA, 64 nt, hsa
guaagcaugccaacauuucguuuguuuaugcuugaagugaaauguuuuacuuuucacuggagaa

SEQ ID NO: 114451 - RNA, 64 nt, hsa
uuuuaggggugcaaguauagcuuuaaguuugugcaagugaaaauguugaaaagugaguaaccuc

SEQ ID NO: 114452 - RNA, 64 nt, hsa
uauccugaugaggcauuucuuacuagaaucccauaagugaaauauaauauuuuucaaaguugau

SEQ ID NO: 114453 - RNA, 64 nt, hsa
guuacuuuaaagcuaauacaagaaaaacaaagacaagugaaaguaaggaaacagaaauugcaaa

SEQ ID NO: 114454 - RNA, 64 nt, hsa
aguuuaauuuuuucaguuuuuuuaauguaaaagcaagugaaauuuuaauaaacuucuguaauua

SEQ ID NO: 114455 - RNA, 64 nt, hsa
ugauguuaaaugacauguauacaaauucuuccuuaagugaaaguuaugcugcaucgaauuguaa

SEQ ID NO: 114456 - RNA, 64 nt, hsa
uuguauugugauuuccuuuuagguauauugcgcuaagugaaacuugucaaauaaauccuccuuu

SEQ ID NO: 114457 - RNA, 64 nt, hsa
uguaaaacaauauaggagcugugucuacuauuaaaagugaaacauuuuggcauguuuguuaauu

SEQ ID NO: 114458 - RNA, 64 nt, hsa
aguuugaugaugcaaaguugaucucuguacauuuaagugaaaagucuuuauaacuuuucacccu

SEQ ID NO: 114459 - RNA, 64 nt, hsa
cuauugaugacuguguuaagugcaucuguauuguaagugaaauguaauuauuucuguguaccau

SEQ ID NO: 114460 - RNA, 64 nt, hsa
gcucuccucauccuauuccuaaauuaggcuaauaaagugaaauugguauacuuuccaguuaaau

SEQ ID NO: 114461 - RNA, 64 nt, hsa
uagugugaauucuggcacuuuaaaaagauuaagcaagugaaauucugcugcccuccaccauuua

SEQ ID NO: 114462 - RNA, 64 nt, hsa
aguucugucagaaacucuaaauuuccaaaaaucuaagugaaacauggaugaaacucuguuagaa

SEQ ID NO: 114463 - RNA, 64 nt, hsa
aauuucaacacugccugagacaucccucuggggaaagugaaagagaggguuuacuuaccuacug

SEQ ID NO: 114464 - RNA, 64 nt, hsa
caauguuuuuuuuaaaugugcaaauacuguauucaagugaaaaaaauacaguauuuguagauaa

SEQ ID NO: 114465 - RNA, 64 nt, hsa
caucccagugccuuuaaccuggauuucuaaucuuaagugaaaugggugcagcauuccuuuggaa

SEQ ID NO: 114466 - RNA, 64 nt, hsa
ggacaugcacaauugugcaguccuuugggauuggaagugaaacagucugugauccccuaccuuc

SEQ ID NO: 114467 - RNA, 64 nt, hsa
cuuuucucucucccaugucuagccuccaaaaguuaagugaaaauuagucaacugcacguggaag

SEQ ID NO: 114468 - RNA, 64 nt, hsa
ccuuggacauggugauggugauggguugccauccaagugaaagucuuuuccuugaccaaggggg

SEQ ID NO: 114469 - RNA, 64 nt, hsa
uaauugggauaauuuaauuaacaagauugacuagaagugaaacugcaacacuaacuuccccgug

SEQ ID NO: 114470 - RNA, 64 nt, hsa
aaaagacauauaggaacccuaaaugcuuauuguuaagugaaaaccaaucugaaaaggcuuucua

SEQ ID NO: 114471 - RNA, 64 nt, hsa
agaaaaaacagaagacaaauacugcuaauaccaaaagugaaagaggccaucauagcugauccua

SEQ ID NO: 114472 - RNA, 64 nt, hsa
cacugaggagaaaauugucaauuuaagaaaucuaaagugaaaauuuugcuuagaaauaaaauau

SEQ ID NO: 114473 - RNA, 64 nt, hsa
uggagcagccaggugaaaggccuggcggggaggaaagugaaacgccugaaucaaaagcaguuuu

SEQ ID NO: 114474 - RNA, 64 nt, hsa
gugccaugggaaccaggucugaaaaaguagagagaagugaaaguagagucugggaaguagcugc

SEQ ID NO: 114475 - RNA, 64 nt, hsa
gcaaggcugggguagcccccuccaguacaccccaaagugaaagggauaagagugcagccccaga

SEQ ID NO: 114476 - RNA, 64 nt, hsa
cuacgccaaaacagacgggaaagggaacaaaauaaagugaaauccaauacacgccugugugaga

SEQ ID NO: 114477 - RNA, 64 nt, hsa
aaugcuuuccuaaaaugauaguggauaauagacaaagugaaaacauuuaaaaaggaagagaaac

SEQ ID NO: 114478 - RNA, 64 nt, hsa
agaaagagaaaaaagauaaaguagaaaaagaaaaaagugaaaaggaaacaacuagcaaaaagaa

SEQ ID NO: 114479 - RNA, 64 nt, hsa
uuuuugacaauuuuggguucccaacuuaucuuacaagugaaaacuuaaauuguaaaacauguug

SEQ ID NO: 114480 - RNA, 64 nt, hsa
uaagagaauuuauuuacuaaaugcacuauguauaaagugaaagauaguuuacuuaucugacuuu

SEQ ID NO: 114481 - RNA, 64 nt, hsa
uuuguuugcuuaccccuucagccuccaauuuuuuaagugaaaauauagcuaauaacaugugaaa

SEQ ID NO: 114482 - RNA, 64 nt, hsa
uuaccagugccuuaaacucuguuacacuuuuuggaagugaaaacuuuguaguaugauagguuau

SEQ ID NO: 114483 - RNA, 64 nt, hsa
auacaggggucaaaaccagacuaacaguuuuagaaagugaaaaaaguuaaaaaagaaauggggg

SEQ ID NO: 114484 - RNA, 64 nt, hsa
auaucuggagaaaucgcauucauaaaacaauuggaagugaaacuauuaaaacaauagggcuuuu

SEQ ID NO: 114485 - RNA, 64 nt, hsa
uugaaaggaaguuaucuugguaaauugagacucaaagugaaauacaaaaaugaaaauauuuaua

SEQ ID NO: 114486 - RNA, 64 nt, hsa
agaucuuuuucugucuaucaaaacuauuugauccaagugaaaaaaaaaaaaaaacuagaaagcu

SEQ ID NO: 114487 - RNA, 64 nt, hsa
auggggaaaacaagcugugucuucuuaacugcccaagugaaaagcaaccaaguccaggaaauua

SEQ ID NO: 114488 - RNA, 64 nt, hsa
cagaauguaauggaaguccugaugguuacagaguaagugaaagggugccugcgcugacgugaga

SEQ ID NO: 114489 - RNA, 64 nt, hsa
auuagauaaaucaugaagugucccugugaaauugaagugaaacuaucucuguaggacuuaagag

SEQ ID NO: 114490 - RNA, 64 nt, hsa
auaaugaacaaaggugaagcugccuugaggagacaagugaaaaauuuuugcuucaaaggagcuc

SEQ ID NO: 114491 - RNA, 64 nt, hsa
cuuuucauuauaguuuauaugaaaagaucaccuuaagugaaauuauuuuccuuuaaucuuuuau

SEQ ID NO: 114492 - RNA, 64 nt, hsa
aguuacccagcuguuuaauauuccagucuucccaaagugaaaagauuuguauacaaauguuuuc

SEQ ID NO: 114493 - RNA, 64 nt, hsa
auaagugugacaacuuaaaacuuguuucuauuuaaagugaaauguaucuuucaacuguuuaguu

SEQ ID NO: 114494 - RNA, 64 nt, hsa
aauccuagugaaccaaaaugcaaacaacucacacaagugaaaagcucccugcuuugaaaacagg

SEQ ID NO: 114495 - RNA, 64 nt, hsa
agagaacucaauucugaugucguaaguucucuguaagugaaaugggguagacuguaugauuuuc

SEQ ID NO: 114496 - RNA, 64 nt, hsa
ugauuuuccaguuuuauggaauugggagucugacaagugaaaccaauuuaauguaaaguauuug

SEQ ID NO: 114497 - RNA, 64 nt, hsa
uuugguuuuguuggagagugucagacugaucuggaagugaaacacaguuuauguacagggaaaa

SEQ ID NO: 114498 - RNA, 64 nt, hsa
acugcacuuacccucaauccagccccggagaagcaagugaaaagggugggucccucauaggcua

SEQ ID NO: 114499 - RNA, 64 nt, hsa
agauagugaaaaagguguccagauaaacccaccuaagugaaauggccauccucuaaacugggua

SEQ ID NO: 114500 - RNA, 64 nt, hsa
gccucucagaaacgcggccagaagacaagcagggaagugaaaggucccaggcacacacccugcc

SEQ ID NO: 114501 - RNA, 64 nt, hsa
aauucauccuagcaaauucuaccuuauuuuacagaagugaaagugagguaucagaaguguuaag

SEQ ID NO: 114502 - RNA, 64 nt, hsa
agcuaauaaagaaaagagguuuauacugcaaaagaagugaaacuauauguauucacaguugaua

SEQ ID NO: 114503 - RNA, 64 nt, hsa
gugaaaaggggacaguuuuuacccuaaagugcaaaagugaaacauacaaaauaagacuaauuuu

SEQ ID NO: 114504 - RNA, 64 nt, hsa
aggaaaauguauuuaaaagaaauacgagaaaagaaagugaaaguuuuacaaguuagagggaugg

SEQ ID NO: 114505 - RNA, 64 nt, hsa
auagcuauuuugcuuaaauuucuacaguauguaaaagugaaaaaaugaugaagacgggugcacc

SEQ ID NO: 114506 - RNA, 64 nt, hsa
ggacugguuuuguuuuuauauauauaaaaaaaaaaagugaaaacaccaaugugugaaaugccuu

SEQ ID NO: 114507 - RNA, 64 nt, hsa
cgucccaggaaauagaagugaaauugucuuuauuaagugaaaacuuuccccuuugcccugcaau

SEQ ID NO: 114508 - RNA, 64 nt, hsa
caggguucuagggguuauucgucccaggaaauagaagugaaauugucuuuauuaagugaaaacu

SEQ ID NO: 114509 - RNA, 64 nt, hsa
aaaacucaaauauaggagcugugucuacgauucaaagugaaaacauuuggcauguuuguuaauu

SEQ ID NO: 114510 - RNA, 64 nt, hsa
uuguauugugauuuccauuuagauguauuguacuaagugaaacuuguuaaauaaaucuuccuuu

SEQ ID NO: 114511 - RNA, 64 nt, hsa
guggggaagaaaccuccccaggaaauuggaauuaaagugaaaaaucauucuggagguggcaugu

SEQ ID NO: 114512 - RNA, 64 nt, hsa
gaagcagaugaguuuguagcagggccacaaaacaaagugaaacguccaggggaacccaacaguc

SEQ ID NO: 114513 - RNA, 64 nt, hsa
ggaaauuguauaauuuaacuuggauuuaggcaggaagugaaauaugggaggaguaaagaaaacu

SEQ ID NO: 114514 - RNA, 64 nt, hsa
ucuuguggaaauauuaaaaagccuaugcuuguguaagugaaaaaaaaucacauucauuuguuua

SEQ ID NO: 114515 - RNA, 64 nt, hsa
uuuaaucaguuaacggaaauuucuuggcuuaugaaagugaaaaguccagugguauuggcauugg

SEQ ID NO: 114516 - RNA, 64 nt, hsa
uguuuguguggugccaggaaauugauuuuggaaaaagugaaauaacauuaaaggugaaugugag

SEQ ID NO: 114517 - RNA, 59 nt, hsa
aaaguaaaaagacagauauuuaagaggcauaaccaaaaaagcaaaacuuguaaacagag

SEQ ID NO: 114518 - RNA, 59 nt, hsa
gaaauacaauuagguuuuugagauuuuuauaaccaaauacauuucaguguaacauauua

SEQ ID NO: 114519 - RNA, 59 nt, hsa
gaacaugcuguuauuuagguauuuuucuuuaaccaaacaauauugcuccaugaugacuu

SEQ ID NO: 114520 - RNA, 59 nt, hsa
cgacuaaacuuaauuuaauauuuacucuauaaccaaaugaaauauauuuaaaauauauu

SEQ ID NO: 114521 - RNA, 59 nt, hsa
uuaucagggacacauuaaauauaaauguuuaaccaaagaaaguuguucuuauaauguaa

SEQ ID NO: 114522 - RNA, 59 nt, hsa
auguuuaguuacuguuuucuucucaaaguuaaccaaagcuaaauaacuuuccuauguaa

SEQ ID NO: 114523 - RNA, 59 nt, hsa
guucuuaaacuuucagauguguccuuugauaaccaaauucugucacucaagacacagac

SEQ ID NO: 114524 - RNA, 59 nt, hsa
aaguaccacacugaaaauuagacauuuauuaaccaaauuuaacgugguauuuaaaggua

SEQ ID NO: 114525 - RNA, 59 nt, hsa
gucauuacuuucaaaggaacagaaguaguuaaccaaacuaacaagcaaaaccugagguu

SEQ ID NO: 114526 - RNA, 59 nt, hsa
gaguaaccuguauuuuaauuguugaaacuuaaccaaaauaagauacugucucagcuagg

SEQ ID NO: 114527 - RNA, 59 nt, hsa
aggguggaaaaguacucgguaaacaguaguaaccaaauauuuucacuccagauuugugu

SEQ ID NO: 114528 - RNA, 59 nt, hsa
gccuuuagccuugaggugccuucugaaauuaaccaaauuucauccauauauccucuuuu

SEQ ID NO: 114529 - RNA, 59 nt, hsa
guuaaucaaaaauggggaaggggaaaugguaaccaaaaaguaaccccaugguaagguuu

SEQ ID NO: 114530 - RNA, 59 nt, hsa
caaguuugguuuaugugggcauaaaauucuaaccaaaccccagacauagggagucauuu

SEQ ID NO: 114531 - RNA, 59 nt, hsa
cauuggcaguuaccacauucuguucaauuuaaccaaacuggcuuuuuuuuuuucuagug

SEQ ID NO: 114532 - RNA, 59 nt, hsa
ucuuaaccaaaguuguacucagcauuucuuaaccaaaguugaauuuugaaaagagucag

SEQ ID NO: 114533 - RNA, 59 nt, hsa
gacucuuuauccaugaccucaguguuucuuaaccaaaguuguacucagcauuucuuaac

SEQ ID NO: 114534 - RNA, 59 nt, hsa
caugcccugaugccuaaccaaagaugaguuaaccaaaggaaaauaacauuaaaggagac

SEQ ID NO: 114535 - RNA, 59 nt, hsa
acaccaaggugugaacaugcccugaugccuaaccaaagaugaguuaaccaaaggaaaau

SEQ ID NO: 114536 - RNA, 59 nt, hsa
ggcaaaaugcuacaguucauaucuuccuuuaaccaaacugaaguacauaaagaccaugu

SEQ ID NO: 114537 - RNA, 59 nt, hsa
aguaaaaaaaccaaauaauuuguuuaaaauaaccaaagaguuguuauaaugcauaauuu

SEQ ID NO: 114538 - RNA, 59 nt, hsa
ucuguaguguuuuuacugccauaguuuuauaaccaaaaucuugacuuaaaauuuuccgg

SEQ ID NO: 114539 - RNA, 59 nt, hsa
aagacuccugaaaugauaaaucagggaacuaaccaaacggagcagaauggucaagugau

SEQ ID NO: 114540 - RNA, 59 nt, hsa
uucacaguguccuuuauguaagaaugauauaaccaaaagguauauaauuugguaaugau

SEQ ID NO: 114541 - RNA, 59 nt, hsa
uuuucaucuuaauauguaccaguggcacuuaaccaaaagauacagugauauagccaugu

SEQ ID NO: 114542 - RNA, 59 nt, hsa
ccccaaacagcaauagaaaggcauauguauaaccaaacuccaagugauaaccagaccca

SEQ ID NO: 114543 - RNA, 59 nt, hsa
agccaucagccuggcagcugcccaucccauaaccaaagagcucaaugggcuggagggug

SEQ ID NO: 114544 - RNA, 59 nt, hsa
aauuucuuuauaaaguucaccucugagaguaaccaaaucgguuucaucccauaucaaaa

SEQ ID NO: 114545 - RNA, 59 nt, hsa
uuuaucacacaaauaguacacuuauuuucuaaccaaauacuugauagguuaugcuacuc

SEQ ID NO: 114546 - RNA, 59 nt, hsa
agaucuccugguuuccauuguaagggauuuaaccaaaaucuugcucuuccauaaucuua

SEQ ID NO: 114547 - RNA, 59 nt, hsa
uucagaaugacacauuguaguggcaaagauaaccaaaugucuggcuguuugcuuuuuga

SEQ ID NO: 114548 - RNA, 59 nt, hsa
uuucugucaguagaaauaaccauaugugcuaaccaaauuucugugaagaauguuuucau

SEQ ID NO: 114549 - RNA, 59 nt, hsa
uuuucaagugauuuaaauaguuaaucauuuaaccaaagaagauguguagugccuuaaca

SEQ ID NO: 114550 - RNA, 64 nt, hsa
ucauggacaagguucucagggaaguuuuggaguuugcaaccacaguauuccuuugucugucgag

SEQ ID NO: 114551 - RNA, 64 nt, hsa
aaaaucuugauauaacuccuaguuauaauuuugaugcaaccaaguuauuuuuuauauauuuugu

SEQ ID NO: 114552 - RNA, 64 nt, hsa
acacuccccaacccaucggccaccccaagcccucugcaaccacgaaucgacugucucuguagau

SEQ ID NO: 114553 - RNA, 64 nt, hsa
uacaauuugaugacuuuugguauauucagaguugugcaaccauuaucacuagaucaauuuuaga

SEQ ID NO: 114554 - RNA, 64 nt, hsa
agaaguauauuuaugaaucagcaaauguggugccugauuauagaaauuugugauccuauauaca

SEQ ID NO: 114555 - RNA, 64 nt, hsa
ggacauuuuuucuuaauuuauguauaaauccauaugauuauacauaaaguucugaugcauuaau

SEQ ID NO: 114556 - RNA, 64 nt, hsa
aggccuguaccuguaaaacaaaaugcagguguaaugauuauacaugucuauggauuaccuggac

SEQ ID NO: 114557 - RNA, 64 nt, hsa
uucugcuacauuaucuucuuugagaaaaauuaauugauuauaaaauaugugcuacuucacuuac

SEQ ID NO: 114558 - RNA, 64 nt, hsa
auuauugaauaacucuuuuaauauuuuugagcaaugauuauacugcuuuaccuugugucacuuu

SEQ ID NO: 114559 - RNA, 64 nt, hsa
aauuaguauuuuuuuuaauauuauauggaccaucugauuauauuuuauuuauucaucuauuuau

SEQ ID NO: 114560 - RNA, 64 nt, hsa
auacaggagaaaggaagcauuuaaauuuuuauagugauuauagagaaugauuauaugauguuug

SEQ ID NO: 114561 - RNA, 64 nt, hsa
gaagcauuuaaauuuuuauagugauuauagagaaugauuauaugauguuuguaaugaauaaaau

SEQ ID NO: 114562 - RNA, 64 nt, hsa
ucacuuguauagugaccaaguacacauaaaauacugauuauaaaaauauuguaauaaaccacuu

SEQ ID NO: 114563 - RNA, 64 nt, hsa
uaaacucaagcaagaaauauguucagccaaaacaugauuauaguggcagcugaccaauccccca

SEQ ID NO: 114564 - RNA, 64 nt, hsa
uccagugugaugcaggugacuacucugaaaguauugauuauacuugaaugccaaagaacuuguc

SEQ ID NO: 114565 - RNA, 64 nt, hsa
gacguuuaaaacugugacaacagauauucacauuugauuauagaaacuuaaugucuauuaauaa

SEQ ID NO: 114566 - RNA, 64 nt, hsa
uguauuauaauaaaaugcaaacaugacuguucuaugauuauaaaaacuacugguuugugugcaa

SEQ ID NO: 114567 - RNA, 64 nt, hsa
acugccuuuauucucuccuguauauuggauuuugugauuauauuugagugaauaggagaaaaca

SEQ ID NO: 114568 - RNA, 64 nt, hsa
aaagugcuuauuaugugcaacauuaugauuaaucugauuauacaccauuuuugagcagaucuug

SEQ ID NO: 114569 - RNA, 64 nt, hsa
agagaaucaaguuuauuuuauguauauauuuuucugauuauaagaguaauauauguucauugua

SEQ ID NO: 114570 - RNA, 64 nt, hsa
cugagguuuaguaaucuaaagucccuauaguauaugauuauaaugcuauuuuaaaaaauauaua

SEQ ID NO: 114571 - RNA, 55 nt, hsa
aaacuagauuagcugguuaaagguaugauuauaagagagcuuauuguuuuaaaaa

SEQ ID NO: 114572 - RNA, 64 nt, hsa
guugauggacguuuggguuguuucuaauuuugaaugauuauaaauaaaaauucugugaguguuc

SEQ ID NO: 114573 - RNA, 64 nt, hsa
gcaggagacuauguucuacaauugcagugcaugaugauuauaaguccaccuguuuaucaacggc

SEQ ID NO: 114574 - RNA, 64 nt, hsa
uccauauaaguaucaaguuaaacacaauucauuuugauuauaaacuauuugacuuuuuaaaauc

SEQ ID NO: 114575 - RNA, 64 nt, hsa
uucauacuuauauuguuucauccuuauauuggaaugauuauauagaaaaugcucuuaaaaagau

SEQ ID NO: 114576 - RNA, 64 nt, hsa
uuuuuuagaacaacacuuggaaaauaauuugcagugauuauauuucugaacaagguucagaaaa

SEQ ID NO: 114577 - RNA, 64 nt, hsa
cagacuugaguucauuucccagcucugccacucaugauuauauaacuuaauuuucauuuuccuc

SEQ ID NO: 114578 - RNA, 64 nt, hsa
caauauaguggauaaaccugucuaucagacguauugauuauagcaguacuauaguuauucugcu

SEQ ID NO: 114579 - RNA, 64 nt, hsa
aguacuauaguuauucugcugucauuauuaaagaugauuauauucauucaaagcuuuagaugug

SEQ ID NO: 114580 - RNA, 64 nt, hsa
auaaauacaaauguuuauuucagaagggcaguuuugauuauaugugaauacacaaauuuuacug

SEQ ID NO: 114581 - RNA, 64 nt, hsa
guuucuaacaugaaacauuuaucuauaaauuuugugauuauaguaguggaauacauagaaaaaa

SEQ ID NO: 114582 - RNA, 64 nt, hsa
acgugugagugagugugcguauguaucccuucugugauuauauauauucacacaucucuauaua

SEQ ID NO: 114583 - RNA, 64 nt, hsa
aagauuuguuagagcuguuaacauucaaccuuauugauuauauugagagcgcucuucugauuca

SEQ ID NO: 114584 - RNA, 64 nt, hsa; identical to SEQ ID NO: 21150

SEQ ID NO: 114585 - RNA, 64 nt, hsa; identical to SEQ ID NO: 21151

SEQ ID NO: 114586 - RNA, 60 nt, hsa; identical to SEQ ID NO: 21152

SEQ ID NO: 114587 - RNA, 64 nt, hsa; identical to SEQ ID NO: 21153

SEQ ID NO: 114588 - RNA, 64 nt, hsa; identical to SEQ ID NO: 21154

SEQ ID NO: 114589 - RNA, 64 nt, hsa; identical to SEQ ID NO: 21155

SEQ ID NO: 114590 - RNA, 64 nt, hsa; identical to SEQ ID NO: 21156

SEQ ID NO: 114591 - RNA, 64 nt, hsa; identical to SEQ ID NO: 21157

SEQ ID NO: 114592 - RNA, 64 nt, hsa; identical to SEQ ID NO: 21158

SEQ ID NO: 114593 - RNA, 64 nt, hsa; identical to SEQ ID NO: 21159

SEQ ID NO: 114594 - RNA, 64 nt, hsa; identical to SEQ ID NO: 21160

SEQ ID NO: 114595 - RNA, 64 nt, hsa; identical to SEQ ID NO: 21161

SEQ ID NO: 114596 - RNA, 64 nt, hsa; identical to SEQ ID NO: 21162

SEQ ID NO: 114597 - RNA, 64 nt, hsa; identical to SEQ ID NO: 21163

SEQ ID NO: 114598 - RNA, 64 nt, hsa; identical to SEQ ID NO: 21164

SEQ ID NO: 114599 - RNA, 64 nt, hsa; identical to SEQ ID NO: 21165

SEQ ID NO: 114600 - RNA, 64 nt, hsa; identical to SEQ ID NO: 21166

SEQ ID NO: 114601 - RNA, 64 nt, hsa; identical to SEQ ID NO: 21167

SEQ ID NO: 114602 - RNA, 64 nt, hsa
guaguuggcgcccaauggggggucccugagacuugcauguaaaacuagucuagaugucuucuuu

SEQ ID NO: 114603 - RNA, 64 nt, hsa
cuucuuuuuuuguaaguuuuauuuuuguaauugugcauguaaagcaucauugaaucaauggauc

SEQ ID NO: 114604 - RNA, 64 nt, hsa
guagaaucaaaggugcagcugacugagacgacaugcauguaagauccacaaaaugagacaaugc

SEQ ID NO: 114605 - RNA, 64 nt, hsa
cgacaugcauguaagauccacaaaaugagacaaugcauguaaauccaugcucauguucuaaaca

SEQ ID NO: 114606 - RNA, 64 nt, hsa
ggaguggcacauuuugcagccuuuuugcuugauugcauguaauggaaaugcccuauauuuuccu

SEQ ID NO: 114607 - RNA, 64 nt, hsa
ccauuucuuacacacacugccagagauacucuaggcauguaaagcacaaacauacauauaaaau

SEQ ID NO: 114608 - RNA, 64 nt, hsa
acaaauuaaggggaaaagggaggguugcauaacagcauguaacauaacacuauuugucuaaaga

SEQ ID NO: 114609 - RNA, 64 nt, hsa
auguuuucagcagacaaaaauaagucacucuuacgcauguaaaaauauucuuucacucauaaua

SEQ ID NO: 114610 - RNA, 64 nt, hsa
ucacuuuugucuuauuuucuuuuaagguguauuggcauguaauuugcauagagaagguccucug

SEQ ID NO: 114611 - RNA, 64 nt, hsa
guuauuuugggcauuugcaguuuucuucccugcugcauguaaugucucagaaucaacauucuuu

SEQ ID NO: 114612 - RNA, 64 nt, hsa
auuucuuaaaauuuagcauuacuuuaaauagccagcauguaauacaaguaacuacacuaccuca

SEQ ID NO: 114613 - RNA, 64 nt, hsa
uugaaucuguaaauauuuuaaauguuuuauuaaggcauguaauaaacuauucuuugaaacuugu

SEQ ID NO: 114614 - RNA, 64 nt, hsa
guucaugaaaccguuuggguucauuuaaauuugucugaaucauuagucuugacuugaagugaac

SEQ ID NO: 114615 - RNA, 64 nt, hsa
cugaucaaacguugaguuccuuggguuggggaaccugaaucaaucagaaacugcuucuagaauu

SEQ ID NO: 114616 - RNA, 64 nt, hsa
accuccuuugccacuguaccccaucaagcuuacucugaaucaaagguuuuguaaaacuuuugaa

SEQ ID NO: 114617 - RNA, 64 nt, hsa
gauagccagaguaaguaagcagccacugcaagcucugaaucaguuuuuuaaaaaaaagaaaaaa

SEQ ID NO: 114618 - RNA, 64 nt, hsa
uucauugacugauggugaaauggcuggagugauucugaaucaaggugauugugauuauagugac

SEQ ID NO: 114619 - RNA, 64 nt, hsa
ugcuuaucaguaguaucaaugauuuacucaauaucugaaucaccuugauucagaaccauuucag

SEQ ID NO: 114620 - RNA, 64 nt, hsa
aaccccuucuuuaggguccagaaggaauuguggacugaaucacuagccuuaggucuuucagcaa

SEQ ID NO: 114621 - RNA, 64 nt, hsa
aaacauucagaacuuguugaaagaaaaauuauaucugaaucaagauucauguuuuuuauuuuua

SEQ ID NO: 114622 - RNA, 64 nt, hsa
aaaaaaucaagacaaguaggcccaauacaaacuacugaaucaucuucuaauuucccucuaaaau

SEQ ID NO: 114623 - RNA, 64 nt, hsa
uuauggcaagugucaaaaauaguaucugaagauacugaaucaucaugaaaugaacucuacuucu

SEQ ID NO: 114624 - RNA, 64 nt, hsa
augaaagugugugucugcuggggcagcugugccccugaaucaugggcacggagggccgcccgcc

SEQ ID NO: 114625 - RNA, 64 nt, hsa
ccgcgcucaacugcucccguggaagauuaaagggcugaaucauggugcugaccuggcucuuugu

SEQ ID NO: 114626 - RNA, 64 nt, hsa
aaagguauucagcaagagguggaauggcuagacacugaaucaagagauuucaguguuacucugg

SEQ ID NO: 114627 - RNA, 64 nt, hsa
uggcuuugucauaucuacuuaguccauccgacaccugaaucauuccauguaaaacagagcucua

SEQ ID NO: 114628 - RNA, 64 nt, hsa
cauuuuucuuucuucgguuucuuaaaaucuuugccugaaucagaacgcuggcuuuuauuuauuu

SEQ ID NO: 114629 - RNA, 64 nt, hsa
uccuccgccucuaccaagagcuucgccagugucacugaaucaacagauccaagggaaugaacaa

SEQ ID NO: 114630 - RNA, 64 nt, hsa
guguugggauuacaggcaugagacacugccuggccugaaucaaccuuuuuuaaguguaaucaga

SEQ ID NO: 114631 - RNA, 64 nt, hsa
aguagggaguuuccaccuuguacguaagcaaacacugaaucaacuuuuuuuuuuuuuucggaca

SEQ ID NO: 114632 - RNA, 64 nt, hsa
cccagcuggcagugcugaucgaucccacauccugaauaaagaauaaagaucucucagaaaauuc

SEQ ID NO: 114633 - RNA, 64 nt, hsa
ggcagugcugaucgaucccacauccugaauaaagaauaaagaucucucagaaaauuccaaguug

SEQ ID NO: 114634 - RNA, 64 nt, hsa; identical to SEQ ID NO: 114632

SEQ ID NO: 114635 - RNA, 64 nt, hsa; identical to SEQ ID NO: 114633

SEQ ID NO: 114636 - RNA, 64 nt, hsa
uuucacuuuuggaggauucuuuuuguauaacuucaauaaagauuguaagcaaagguugaggcuu

SEQ ID NO: 114637 - RNA, 64 nt, hsa
ggaauuguuacccaucugcagaauugacuucucaaauaaagaugcuaaaaaucuccuugucugg

SEQ ID NO: 114638 - RNA, 64 nt, hsa
uuaggcugugcuuuacugauaaaaccaaguauugaauaaagagaguuaauuaucuuuuuaaagu

SEQ ID NO: 114639 - RNA, 64 nt, hsa
cuauugugugaguauauugugcuaaaaucauagaaauaaagauuagauuucuucaucaaaauug

SEQ ID NO: 114640 - RNA, 64 nt, hsa
aagcuaaauauggcacacuuguucuuuacagaaaaauaaagauauuuuaaacaaaauacuaggg

SEQ ID NO: 114641 - RNA, 64 nt, hsa
guauguaauaaaauuugaaacaauaauuucaaauaauaaagauugaaaaugcuuaacccagaaa

SEQ ID NO: 114642 - RNA, 64 nt, hsa
cagaggguacauccuuuuuucuuacaaauucuucaauaaagacacauucuugagugaaauccca

SEQ ID NO: 114643 - RNA, 64 nt, hsa
uauauucuuauaaccuguuuccauucuccauucaaauaaagagcagacugcgauauaguccauu

SEQ ID NO: 114644 - RNA, 64 nt, hsa
uauuaaauaagcucaaauauauauauuugguguaaauaaagaguccaugguaaaugguuuacuu

SEQ ID NO: 114645 - RNA, 64 nt, hsa
acauuuuaaaaaacguauuuaacagaagagagcaaauaaagauauaucaggaaggauguauuag

SEQ ID NO: 114646 - RNA, 64 nt, hsa
acuccuuucauaucaagacaaguuauuuguaaaaaauaaagaagggguuuuaauacaaaccuuc

SEQ ID NO: 114647 - RNA, 64 nt, hsa
cgcaacaggcauucugucauguugaacaauuuuaaauaaagagaauaucugguguuaggagcuu

SEQ ID NO: 114648 - RNA, 64 nt, hsa
ugaaggugagaugauaaacuugcaaaacucacaaaauaaagagucaaacuuuuagaaugacaag

SEQ ID NO: 114649 - RNA, 64 nt, hsa
accuacaaaauuaauaccauuucugaacaccaguaauaaagaaacauaagggcuggggguggug

SEQ ID NO: 114650 - RNA, 64 nt, hsa
ucuaaguggccaauuauuuggaaauaaagaaggaaauaaagauggcuucacauggaaauuuaag

SEQ ID NO: 114651 - RNA, 64 nt, hsa
guccacacuuauucuaaguggccaauuauuuggaaauaaagaaggaaauaaagauggcuucaca

SEQ ID NO: 114652 - RNA, 64 nt, hsa
uccucucuuccuauagaacacugugcauaccuugaauaaagagcuuauuauacuauauuguuau

SEQ ID NO: 114653 - RNA, 64 nt, hsa
gaugguuaaagccuuuacacugaauguaauguuuaauaaagaaauuacaaauucucacuuucua

SEQ ID NO: 114654 - RNA, 64 nt, hsa
auauuuguuuaaccaaaauauuuggaaaguaacaaauaaagacauuuaaauuuucuaaaaaugg

SEQ ID NO: 114655 - RNA, 64 nt, hsa
uuauuaguagaaggcuaauuguaaugaagacauuaauaaagaugaaauaaacuuauuacuuuaa

SEQ ID NO: 114656 - RNA, 64 nt, hsa
aggcagaguaugaaauuucccaccaggcuaagcaaauaaagaaguccauugccuuauagcuaug

SEQ ID NO: 114657 - RNA, 64 nt, hsa
aacucagugguaacucaugauuuaugacauugaaaauaaagaggaacauugaccugcagacuau

SEQ ID NO: 114658 - RNA, 64 nt, hsa
agaccugaaaggguaaaggguuuauaacugcacuaauaaagagaggcucuuuuuuuuucuucca

SEQ ID NO: 114659 - RNA, 64 nt, hsa
aaagaucagaugguaaucuuucaaauaagaaaaaaauaaagacguauguuugaccaaguaguuu

SEQ ID NO: 114660 - RNA, 64 nt, hsa
cuuuuuuuuuuucucuugguaccauugguauuauaauaaagagcaauuuguaacugaguggcac

SEQ ID NO: 114661 - RNA, 64 nt, hsa
augcacugguaaaaacaaaauaaauagaugaauaaauaaagagugagagaagagagaaucaggu

SEQ ID NO: 114662 - RNA, 64 nt, hsa
auuguauuguaaaagaacuguacaauuuuaaaacaauaaagauuugaaccuguaaaugugugug

SEQ ID NO: 114663 - RNA, 64 nt, hsa
uuauaaaauguauaaauuauucagaacuauuuaaaauaaagaggaguguuauugcaugcugaua

SEQ ID NO: 114664 - RNA, 64 nt, hsa
uaauguuuuguaaauauuaaguguuuaaaugaaaaauaaagaugugcuuauaucauuguauaau

SEQ ID NO: 114665 - RNA, 64 nt, hsa
ugcagugucagggacccuauggaggcaagccaguaauaaagaagacacuaauugucacaccugg

SEQ ID NO: 114666 - RNA, 64 nt, hsa
ccagacagagaucagaauugaaccgucaaugugaaauaaagaguucuccuuguacuugaauaau

SEQ ID NO: 114667 - RNA, 64 nt, hsa
uaacaguggcaagcuaccaacuaaguuguauuuuaauaaagauuccauggguugaacaagccac

SEQ ID NO: 114668 - RNA, 64 nt, hsa
gaaauaguagacaaagauguuauuucccagugcaaauaaagaaauaaagauagcaagcugauuc

SEQ ID NO: 114669 - RNA, 64 nt, hsa
agacaaagauguuauuucccagugcaaauaaagaaauaaagauagcaagcugauucucuccauc

SEQ ID NO: 114670 - RNA, 64 nt, hsa
uuauacauauagaucacucagggagcuuuggaaaaauaaagauuugucagcccuaucucaaacu

SEQ ID NO: 114671 - RNA, 64 nt, hsa
gcuuauauaauacauggggaggauuaaauaaaggaauaaagaugaauggacaacuccugggugc

SEQ ID NO: 114672 - RNA, 64 nt, hsa
uuagaaaauaagacuucugagaaaaaguucaaggaauaaagauuguuugacucuggagaggaga

SEQ ID NO: 114673 - RNA, 64 nt, hsa
gugaguuugcugauuuuaaaaucuuaggaauauaaauaaagaucuuaauaaaagcaagcuuaau

SEQ ID NO: 114674 - RNA, 64 nt, hsa
ugaauucccuguuaguugauuuaaauccuuucugaauaaagaucagauaaacaguaacugaagg

SEQ ID NO: 114675 - RNA, 64 nt, hsa
uguuuucagucucuauguguacagcaguauuuuuaauaaagaauuacagagauaaauuuguccu

SEQ ID NO: 114676 - RNA, 64 nt, hsa
ugcuguuuaucagaggagggugacaggggcuggaaauaaagagaggggacauggugaugaaaca

SEQ ID NO: 114677 - RNA, 64 nt, hsa
gauuuuuuuuuucacaguugaguuaguuugugaaaauaaagaacucuguagcucaccaaggugg

SEQ ID NO: 114678 - RNA, 64 nt, hsa
ugacuuuuggagcacuauuccauugucaguuauuaauaaagaauuccauugcuuagcuaaccaa

SEQ ID NO: 114679 - RNA, 64 nt, hsa
uugucacuuucucaaucaaauuggccacuuaagaaauaaagagcugguagaauugcauccucag

SEQ ID NO: 114680 - RNA, 64 nt, hsa
cacugccccccuuuccugcccccuccucaucuuuaauaaagaccuggcuucucaucuuuaauaa

SEQ ID NO: 114681 - RNA, 64 nt, hsa
cucaucuuuaauaaagaccuggcuucucaucuuuaauaaagaccuguuuguaacagaaguuugg

SEQ ID NO: 114682 - RNA, 64 nt, hsa
gcuguaucaagggugggcuuagcugugccuuuccaauaaagaugugagaagcuucggugcugug

SEQ ID NO: 114683 - RNA, 64 nt, hsa
ggugggcgacccaggauucccccuccccuucccaaauaaagaugaggguacuaaaguugucuug

SEQ ID NO: 114684 - RNA, 64 nt, hsa
ugucuauauggaauuuaggauaaagaauauuuacaauaaagaauauuuacaauaaagaguuuau

SEQ ID NO: 114685 - RNA, 64 nt, hsa
aggauaaagaauauuuacaauaaagaauauuuacaauaaagaguuuauuauuauuuguaaguug

SEQ ID NO: 114686 - RNA, 64 nt, hsa
auuggcuauauggaauuuaggauagaauauuuacaauaaagaguauuuacaauaaagaguuugu

SEQ ID NO: 114687 - RNA, 64 nt, hsa
uuaggauagaauauuuacaauaaagaguauuuacaauaaagaguuuguuauuauuuguaaauug

SEQ ID NO: 114688 - RNA, 64 nt, hsa
cucuauuuuauauuucauagauuuaaaaaacccaaauaaagauggauuuaaaauucacugugga

SEQ ID NO: 114689 - RNA, 64 nt, hsa
ugcugcagugguggcacguagagaacuagaugguaauaaagauuuaaaacuaugaagaagguua

SEQ ID NO: 114690 - RNA, 64 nt, hsa
caacaugaugccagauuugagaaaggaucugcaaaauaaagauaccacaauucaucuuaaaacu

SEQ ID NO: 114691 - RNA, 64 nt, hsa
ccauuugugugugcccucuacccuuaaauucagaaauaaagacaauaaaaaauuaaaauaauug

SEQ ID NO: 114692 - RNA, 64 nt, hsa
uuccggcucauggguugccauagagucuaggaacaaggaguauaguuucuuuaucuuccaagag

SEQ ID NO: 114693 - RNA, 64 nt, hsa
cgauagccccauccaagccagcugagaaccuaggaaggaguaguaggaauaugguugauuagau

SEQ ID NO: 114694 - RNA, 64 nt, hsa
auucuucagguguugauuuaggaguguuauuuggaaggaguauuauuugcucuuccccugagaa

SEQ ID NO: 114695 - RNA, 64 nt, hsa
uauuugcucuuccccugagaacugaaagaggggaaaggaguacauuugagggcacuuaauacaa

SEQ ID NO: 114696 - RNA, 64 nt, hsa
uuuggaaucuaacaucguggcuguggagagggucaaggaguacuccaagacagagacagaggug

SEQ ID NO: 114697 - RNA, 64 nt, hsa
cucucuuuuuugacuaggguccugguccuggacaaaggaguaguagcugaauuugauucuccag

SEQ ID NO: 114698 - RNA, 64 nt, hsa
aaagaagugacauuggguauguuagaaaugaaauaaggaguaaaaaugcauuaccauuuguuua

SEQ ID NO: 114699 - RNA, 64 nt, hsa
uuucuucaaucuuuggucuuaguuuucuagaaaaaaggaguagaaaaaacaauucuggcuuuau

SEQ ID NO: 114700 - RNA, 64 nt, hsa; identical to SEQ ID NO: 76114

SEQ ID NO: 114701 - RNA, 64 nt, hsa; identical to SEQ ID NO: 76115

SEQ ID NO: 114702 - RNA, 64 nt, hsa; identical to SEQ ID NO: 76116

SEQ ID NO: 114703 - RNA, 64 nt, hsa; identical to SEQ ID NO: 76117

SEQ ID NO: 114704 - RNA, 64 nt, hsa; identical to SEQ ID NO: 76118

SEQ ID NO: 114705 - RNA, 64 nt, hsa; identical to SEQ ID NO: 76119

SEQ ID NO: 114706 - RNA, 64 nt, hsa; identical to SEQ ID NO: 76120

SEQ ID NO: 114707 - RNA, 64 nt, hsa; identical to SEQ ID NO: 76121

SEQ ID NO: 114708 - RNA, 64 nt, hsa; identical to SEQ ID NO: 76122

SEQ ID NO: 114709 - RNA, 64 nt, hsa; identical to SEQ ID NO: 76123

SEQ ID NO: 114710 - RNA, 64 nt, hsa; identical to SEQ ID NO: 76124

SEQ ID NO: 114711 - RNA, 64 nt, hsa; identical to SEQ ID NO: 76125

SEQ ID NO: 114712 - RNA, 64 nt, hsa; identical to SEQ ID NO: 76126

SEQ ID NO: 114713 - RNA, 64 nt, hsa; identical to SEQ ID NO: 76127

SEQ ID NO: 114714 - RNA, 64 nt, hsa; identical to SEQ ID NO: 76128

SEQ ID NO: 114715 - RNA, 64 nt, hsa; identical to SEQ ID NO: 76129

SEQ ID NO: 114716 - RNA, 64 nt, hsa; identical to SEQ ID NO: 76130

SEQ ID NO: 114717 - RNA, 64 nt, hsa; identical to SEQ ID NO: 76131

SEQ ID NO: 114718 - RNA, 64 nt, hsa; identical to SEQ ID NO: 76132

SEQ ID NO: 114719 - RNA, 64 nt, hsa; identical to SEQ ID NO: 76133

SEQ ID NO: 114720 - RNA, 64 nt, hsa; identical to SEQ ID NO: 76134

SEQ ID NO: 114721 - RNA, 64 nt, hsa; identical to SEQ ID NO: 76135

SEQ ID NO: 114722 - RNA, 64 nt, hsa; identical to SEQ ID NO: 76136

SEQ ID NO: 114723 - RNA, 64 nt, hsa; identical to SEQ ID NO: 76137

SEQ ID NO: 114724 - RNA, 64 nt, hsa; identical to SEQ ID NO: 76138

SEQ ID NO: 114725 - RNA, 64 nt, hsa; identical to SEQ ID NO: 76139

SEQ ID NO: 114726 - RNA, 64 nt, hsa; identical to SEQ ID NO: 76140

SEQ ID NO: 114727 - RNA, 64 nt, hsa; identical to SEQ ID NO: 76141

SEQ ID NO: 114728 - RNA, 64 nt, hsa; identical to SEQ ID NO: 76142

SEQ ID NO: 114729 - RNA, 64 nt, hsa; identical to SEQ ID NO: 76143

SEQ ID NO: 114730 - RNA, 64 nt, hsa; identical to SEQ ID NO: 76144

SEQ ID NO: 114731 - RNA, 64 nt, hsa; identical to SEQ ID NO: 76145

SEQ ID NO: 114732 - RNA, 64 nt, hsa; identical to SEQ ID NO: 76146

SEQ ID NO: 114733 - RNA, 64 nt, hsa; identical to SEQ ID NO: 76147

SEQ ID NO: 114734 - RNA, 64 nt, hsa; identical to SEQ ID NO: 76148

SEQ ID NO: 114735 - RNA, 64 nt, hsa; identical to SEQ ID NO: 76149

SEQ ID NO: 114736 - RNA, 64 nt, hsa; identical to SEQ ID NO: 76150

SEQ ID NO: 114737 - RNA, 64 nt, hsa; identical to SEQ ID NO: 76151

SEQ ID NO: 114738 - RNA, 64 nt, hsa; identical to SEQ ID NO: 76152

SEQ ID NO: 114739 - RNA, 64 nt, hsa; identical to SEQ ID NO: 76153

SEQ ID NO: 114740 - RNA, 64 nt, hsa; identical to SEQ ID NO: 76154

SEQ ID NO: 114741 - RNA, 64 nt, hsa
gaugaccugaaauuuuacauccgaacaaaauuuuacauccgaaaagcaaccaacuucuucaugg

SEQ ID NO: 114742 - RNA, 64 nt, hsa
uuuuggcauaauuuuuaugaugaccugaaauuuuacauccgaacaaaauuuuacauccgaaaag

SEQ ID NO: 114743 - RNA, 62 nt, hsa
ucauuucaaauauguuuuaauguaucucuaaugcauuugaagacuuauuacauggcuuacuu

SEQ ID NO: 114744 - RNA, 62 nt, hsa
cugguuuagauacauuagcugcaauuuuuuuugcauuugacacaauauuguaauaauccaug

SEQ ID NO: 114745 - RNA, 62 nt, hsa
caucuguugaucaggaacuacuucagcuacuugcauuugauuauuuccuuuuuuuuuuuuuu

SEQ ID NO: 114746 - RNA, 62 nt, hsa
uaacuuuaaccaauauuuucuucuguuuugcugcauuugaaagguaacaguggagcuagggc

SEQ ID NO: 114747 - RNA, 62 nt, hsa
caaagaaugcuugcauuugauuaguuucaccagcauuugagagaaggacccuuuagcucugu

SEQ ID NO: 114748 - RNA, 62 nt, hsa
gaaaaauuauuagcauguaacaaagaaugcuugcauuugauuaguuucaccagcauuugaga

SEQ ID NO: 114749 - RNA, 62 nt, hsa
aaagagauuguucugaagaccgugcucuaagggcauuugaaagacugccagguagugcgagc

SEQ ID NO: 114750 - RNA, 62 nt, hsa
caggggugggagaaacuccuuuccuucagcuggcauuugaauguuuccaaaucuauuuuauc

SEQ ID NO: 114751 - RNA, 62 nt, hsa
auauuuguaucucuacagaaaggcucuaaaaagcauuugaggaaaauauuugguucccuuuu

SEQ ID NO: 114752 - RNA, 62 nt, hsa
cuauuguacgguuucaugcauuuuuuuaaagggcauuugaggggaggauuauugcuaugaau

SEQ ID NO: 114753 - RNA, 62 nt, hsa
aaaggauaagccaagauggcuguaaacacagagcauuugagcugccacucuuggagcacauu

SEQ ID NO: 114754 - RNA, 62 nt, hsa
uccggcggucugaggccauggaggugguugcugcauuugagagggaguagggggcuagaugu

SEQ ID NO: 114755 - RNA, 62 nt, hsa
ggcaguggugguuuucuguucuuucuggcuaugcauuugaaaauuuugauguuuuaaggaug

SEQ ID NO: 114756 - RNA, 62 nt, hsa
uuccguuaaaauaccagccaguaaaugggggugcauuugaggucuguucuuuccaaaguaca

SEQ ID NO: 114757 - RNA, 62 nt, hsa
uuuaaauuaggauugcaaaccaaggaaagaacgcauuugagauuuuaagaugucacuuauaa

SEQ ID NO: 114758 - RNA, 62 nt, hsa
cagauuuugaagaaauccuguaagaugauaaagcauuugaaugguacaguagauguaaaaaa

SEQ ID NO: 114759 - RNA, 64 nt, hsa
augauggcuccaggucagugucuggaguuucauuccaucccagggcuuggaugucaggauuaua

SEQ ID NO: 114760 - RNA, 64 nt, hsa
aagaaaagucuagguuuuaaggcugugccagaacccaucccaauaaagagaccgagucugaagu

SEQ ID NO: 114761 - RNA, 64 nt, hsa
cccuucacccaccaucuacgccauauacccaucaccaucccaugaggaaaaaaaaaaaaguaaa

SEQ ID NO: 114762 - RNA, 64 nt, hsa
guacggucagcuuucaaaacaauaugccccccgcccaucccaugugugaggacauggugacucg

SEQ ID NO: 114763 - RNA, 64 nt, hsa
uccuauuuuccugggaaguccuuaaagccccuaaccaucccacacucuucacuuuccuuuccac

SEQ ID NO: 114764 - RNA, 64 nt, hsa
augacaguuggcuccccccccacccccagcaaccccaucccagaauccuauuuuccugggaagu

SEQ ID NO: 114765 - RNA, 64 nt, hsa
aggcugucaugugucucgaaaucagcagcccuccccaucccaaucccaggcagcuuguguguac

SEQ ID NO: 114766 - RNA, 64 nt, hsa
aaguaaggaaaauuggagaugcuaacauccucccccaucccaacugcaccuuaaaauaugcaug

SEQ ID NO: 114767 - RNA, 64 nt, hsa
agucuggaaagugaggagcgucucugcccggccgccaucccaucuaggaagugaggagcgccuc

SEQ ID NO: 114768 - RNA, 64 nt, hsa
caucuaggaagugaggagcgccucuucccacccgccaucccaucuaggaagugaggagcuucuc

SEQ ID NO: 114769 - RNA, 64 nt, hsa
cuuccuaucccaucccaucccaucccaucccaucccaucccaucccgcucuuuuccuacuuuuc

SEQ ID NO: 114770 - RNA, 64 nt, hsa
ccucucuuccuaucccaucccaucccaucccaucccaucccaucccaucccgcucuuuuccuac

SEQ ID NO: 114771 - RNA, 64 nt, hsa
cccagccucucuuccuaucccaucccaucccaucccaucccaucccaucccaucccgcucuuuu

SEQ ID NO: 114772 - RNA, 64 nt, hsa
cauuccccagccucucuuccuaucccaucccaucccaucccaucccaucccaucccaucccgcu

SEQ ID NO: 114773 - RNA, 64 nt, hsa
cugcccauuccccagccucucuuccuaucccaucccaucccaucccaucccaucccaucccauc

SEQ ID NO: 114774 - RNA, 64 nt, hsa
cuucucugcccauuccccagccucucuuccuaucccaucccaucccaucccaucccaucccauc

SEQ ID NO: 114775 - RNA, 64 nt, hsa
cuacaugcaucucuccacucaacuccaccccaucccaucccaccuugaaaaucacugcucugaa

SEQ ID NO: 114776 - RNA, 64 nt, hsa
ucuaacuacaugcaucucuccacucaacuccaccccaucccaucccaccuugaaaaucacugcu

SEQ ID NO: 114777 - RNA, 64 nt, hsa
cccucagcagagggcagcacuugaaugcuuagcuccaucccauaguucucuacuucauauaaau

SEQ ID NO: 114778 - RNA, 64 nt, hsa
auggggaagggucuguuccagccucucccuacucccaucccauuuccaccaacuggggaacugu

SEQ ID NO: 114779 - RNA, 64 nt, hsa
gcccacacaaagcuggacacccccaggcucuacuccaucccauuggagucucuucuuuuuuuga

SEQ ID NO: 114780 - RNA, 64 nt, hsa
caugaccagcucucugccucccuuccaggaggcuccaucccacacuguucacccaggcugcgga

SEQ ID NO: 114781 - RNA, 64 nt, hsa
cgcgaugccucccggccaccgccccagccucaccccaucccacgacccccgcaacccuucacau

SEQ ID NO: 114782 - RNA, 64 nt, hsa
ggcggcgagggcggcgagggcgccgagguccggcccaucccaguccuguggggcuggccgggca

SEQ ID NO: 114783 - RNA, 64 nt, hsa
uuuuaccaccaacuuaggggacuguuuuaaagagccaucccaaggccucuccuagcaggcagaa

SEQ ID NO: 114784 - RNA, 64 nt, hsa
cuuucuugcagacaagucacuacagaaacauaccccaucccacccaccccugccucugccccag

SEQ ID NO: 114785 - RNA, 64 nt, hsa
acccacccccaccccuacccuaccccaccacaccccaucccagaggccuugccugggcaacccu

SEQ ID NO: 114786 - RNA, 64 nt, hsa
gaaugggugaccucaaagaugcccccuguccaagccaucccacagcuggaagguaggggauggg

SEQ ID NO: 114787 - RNA, 64 nt, hsa
uuugcaggcaggaauaugcugaccuuucacccugccaucccaucccaaccccagcucacuagcc

SEQ ID NO: 114788 - RNA, 64 nt, hsa
aggcaggaauaugcugaccuuucacccugccaucccaucccaaccccagcucacuagccuucau

SEQ ID NO: 114789 - RNA, 64 nt, hsa
acuggaggaccacacucaagccgacuuaugcccaccaucccaccucuggauaauuuugcauaaa

SEQ ID NO: 114790 - RNA, 64 nt, hsa
auuuaccggcagugcgggaggaauuucugaguggccaucccaaggucuagguggagguggggca

SEQ ID NO: 114791 - RNA, 64 nt, hsa
cugggcucucuagguggcccuggucuugccccauccaucccaccugccacuaccuugggugucc

SEQ ID NO: 114792 - RNA, 64 nt, hsa
acacuggugaagucuguguacccauacugcagccccaucccauggggccccugaagacccacug

SEQ ID NO: 114793 - RNA, 64 nt, hsa
cgucuggaaagugaggagcgccucugcccggccgccaucccaucuaggaagugaggagcgccuc

SEQ ID NO: 114794 - RNA, 64 nt, hsa
caucuaggaagugaggagcgccucuucccagccgccaucccaucuaggaagugaggagcgucuc

SEQ ID NO: 114795 - RNA, 64 nt, hsa
ccauggagguccgugagcuggaacugggcacacgccaucccagagggcucaggaugccccagga

SEQ ID NO: 114796 - RNA, 64 nt, hsa
cagccugauggcagccucagaggcuuacucuaacccaucccagaauaaauggagacuucaugug

SEQ ID NO: 114797 - RNA, 64 nt, hsa
ucauccccguauuucccccucucauaacuucuccccaucccaggaggaguucucaggccugggg

SEQ ID NO: 114798 - RNA, 64 nt, hsa
ggcucacgcuuaacuccagcccccacccacacccccaucccacccaaccacaggccccacuugc

SEQ ID NO: 114799 - RNA, 64 nt, hsa
uaguuuuuauguagcaauuuguuuauaaaaauucccaucccauaaugcaugaccuuccuaaaaa

SEQ ID NO: 114800 - RNA, 64 nt, hsa
ccaccucagggauucugauccaugucauuaacgaccaucccagggugugagggccugauuaaag

SEQ ID NO: 114801 - RNA, 64 nt, hsa
cuauggcugagguggggccgggccacaccccugcccaucccagccagggugcugugcccccguc

SEQ ID NO: 114802 - RNA, 64 nt, hsa
aauuuacaaauguuugcuagggucacccucucggccaucccacgagggucgccaugaucacccc

SEQ ID NO: 114803 - RNA, 64 nt, hsa
ggguggagggugcggcccggaguuguccaucuguccaucccaacagcaagacgaggauguggcu

SEQ ID NO: 114804 - RNA, 64 nt, hsa
agaccaggaagcugugggcccuccugcuccacccccaucccacucccacccaugucugggcucc

SEQ ID NO: 114805 - RNA, 64 nt, hsa
cgaucacauggagcaguaauggagcaaagaccagccaucccaguugagauacccuacaccaacc

SEQ ID NO: 114806 - RNA, 64 nt, hsa
aauacacuggcccagauuaggaagguucugccauccaucccagccaucccaaacaacuaccaga

SEQ ID NO: 114807 - RNA, 64 nt, hsa
gcccagauuaggaagguucugccauccaucccagccaucccaaacaacuaccagaauaauggau

SEQ ID NO: 114808 - RNA, 64 nt, hsa
ccacggaaacagaacucgaugcacugaccugcuccgccaggaaagugagcguguagcguccuga

SEQ ID NO: 114809 - RNA, 64 nt, hsa
ugggggagggcaaggcucuccucccagccagggacgccaggacauagcugcuccuggucagugg

SEQ ID NO: 114810 - RNA, 64 nt, hsa
acugccgcccagaaaaggggcagggcucugcagccgccaggacagacgagcaccccaugccuau

SEQ ID NO: 114811 - RNA, 64 nt, hsa
uccuggugcucuauccacugcagggccagccacucgccaggaggccacgggccacgggaagaac

SEQ ID NO: 114812 - RNA, 64 nt, hsa
uggaauacacugugaccccaguuaagugucccuucgccaggaagcugccgcaacguccagaccu

SEQ ID NO: 114813 - RNA, 64 nt, hsa
cugcgugggaugcacacggaugacagaaucaaggcgccaggaugggcacucugcccuggauaca

SEQ ID NO: 114814 - RNA, 64 nt, hsa
gcugacaacccaggaccgaugguuguguuugccacgccaggaaugcugcacgcugggcaguccc

SEQ ID NO: 114815 - RNA, 64 nt, hsa
ggcaaagggagggcccugggcugggugcaaggcgcgccaggagucccagccaggguggccccgg

SEQ ID NO: 114816 - RNA, 64 nt, hsa
ccauccgagcuugagcugggcgcacagaggugcccgccaggaucuguggcccuguaacauuccc

SEQ ID NO: 114817 - RNA, 64 nt, hsa
ugccuggcaucugucugcugacgccucuggcuugcgccaggacuuggcgugggcaccgggcgcc

SEQ ID NO: 114818 - RNA, 64 nt, hsa
guguguggagauggcgcccuguccugccaaggggcgccaggagcagagccagggccuggcgagc

SEQ ID NO: 114819 - RNA, 64 nt, hsa
ccugccuccacuucuccccucaagaaauuuucaacgccaggaaucaugaagagacuucugcuuu

SEQ ID NO: 114820 - RNA, 64 nt, hsa
ggugggcuggggacucuggcacagugaugccgggcgccaggacagcagcacucccgcugcacac

SEQ ID NO: 114821 - RNA, 64 nt, hsa
uuauauucuuuccauuugcuaucaugucagugaacgccaggagugcuuucuuugcaacuugugu

SEQ ID NO: 114822 - RNA, 52 nt, hsa
ugggccaagcugcucaaugaaccgccaggaacugaccugcugacugcacucu

SEQ ID NO: 114823 - RNA, 64 nt, hsa
cugugagcgcagccgaggcgcaggccgagugggccgccaggaccaagcgagguggaccccgaaa

SEQ ID NO: 114824 - RNA, 64 nt, hsa
uggggaugcggggagauuugagaggggaaaaccccgccaggagggagagagaggcaccccucug

SEQ ID NO: 114825 - RNA, 64 nt, hsa
agcaccccggugcggaccacagagcagacccuggcgccaggaaggagcauguguuagcgucucg

SEQ ID NO: 114826 - RNA, 64 nt, hsa
ggagagaaacuuccagaccagccccucacaccaccgccaggagaggccuuucccaccgggagag

SEQ ID NO: 114827 - RNA, 64 nt, hsa
uggcugcucaaguacuagccccggccccagcacccgccaggauguggagaccgaggcccaucuc

SEQ ID NO: 114828 - RNA, 64 nt, hsa
ccuuccucucccaguacuuuaccaaaggaacccccgccaggacccacauggggccacguguugg

SEQ ID NO: 114829 - RNA, 64 nt, hsa
ccaaccgcacugaaggaguggggagaagagcauacgccaggagccuccugccucaaagugcucc

SEQ ID NO: 114830 - RNA, 64 nt, hsa
auugugucccauucccccagugcggccagcuccgcgccaggauggcgcaggaacucaauaaagu

SEQ ID NO: 114831 - RNA, 64 nt, hsa
uggguacucgcaccucuuggcuuuguugaugcuccgccaggaaggccacuugugugugcguguc

SEQ ID NO: 114832 - RNA, 64 nt, hsa
agcagaaguucuucggcccgggccugucgaugcccgccaggacuguuuucaugcugccugugcc

SEQ ID NO: 114833 - RNA, 64 nt, hsa
guacucugacugcaacaucuuucaccccauugaucgccaggauugauuugguugaucuggcuga

SEQ ID NO: 114834 - RNA, 64 nt, hsa
agugacaaauaagauuaauaagauuuuucaaaaucgccaggacuggugaauauaaaugaugauu

SEQ ID NO: 114835 - RNA, 64 nt, hsa
aaggagggucucuugcccaucucuccggccaccccgccaggaaacgacgagaaggccgaggaau

SEQ ID NO: 114836 - RNA, 64 nt, hsa
cucacccaccugugauagugggcuuggggcuacgcgccaggagagucuccccccacccaccuuu

SEQ ID NO: 114837 - RNA, 64 nt, hsa
ccaugagcagcaguucauuuaauugucacagcgucgccaggaagaagaucugauaaaccuaggu

SEQ ID NO: 114838 - RNA, 64 nt, hsa
ugcuuuaaugguuuuguuuucuaaugcaauaaaucgccaggauuuccaaauuauugcuucaacc

SEQ ID NO: 114839 - RNA, 64 nt, hsa
cgccagcgucgccgcgaggccucugggguggguucgccaggagggcacguucgcgccgcgccgc

SEQ ID NO: 114840 - RNA, 64 nt, hsa
cgccggccucguccagcuccaugucgcccuccgucgccaggaugcgcugcacggucugcaggac

SEQ ID NO: 114841 - RNA, 64 nt, hsa
guucugauuuccucaguccuuuagguuaaagcagcgccaggaggaagcugacagaagcagcguu

SEQ ID NO: 114842 - RNA, 64 nt, hsa
gaacucuccccauuggcaaaccggacccggccgccgccaggacuguguuuccaaagguuccccg

SEQ ID NO: 114843 - RNA, 64 nt, hsa
cccagcagcccagcccccacccuccuggcagcagcgccaggaaggcuuugacaauuaccuccgu

SEQ ID NO: 114844 - RNA, 64 nt, hsa
cuggguuucuagaggucaggacggcuccucagagcgccaggaagccagagccccaagcaggacg

SEQ ID NO: 114845 - RNA, 64 nt, hsa
gcugcagagcuggagggugggcgugguacgugugcgccaggacucgggcgcugagggccacuca

SEQ ID NO: 114846 - RNA, 64 nt, hsa
cuccucuaccccgcccugggcuggugaaggugcgcgccaggauguggacuacugagcccugaag

SEQ ID NO: 114847 - RNA, 64 nt, hsa
ucagcauggagagccccugcuaauggaguacagccgccaggagcuacucaggaaggugggagag

SEQ ID NO: 114848 - RNA, 64 nt, hsa
aaggaaggacaagaaguugucaaagaauucccaacgccaggacccacaucccuuugguauugau

SEQ ID NO: 114849 - RNA, 64 nt, hsa
agaagacccagcuggaguucaugucgcaacagugcgccaggaccgacggccagccgcugcgcuc

SEQ ID NO: 114850 - RNA, 64 nt, hsa
ucuagagauugaggugaaagcuucguccgagaaacgccaggacagacgauggcagaggagaggg

SEQ ID NO: 114851 - RNA, 64 nt, hsa
gggccgaagacccuucuucccuggcugccaggcucgccaggagcccacuggaaacgcccaccac

SEQ ID NO: 114852 - RNA, 64 nt, hsa
uuucaccugucucagucuuccgcaggcuuaccugcgccaggaagucuaaccaaggaacaagaau

SEQ ID NO: 114853 - RNA, 64 nt, hsa
cggccccacucuccggaucuggacgaugggcucacgccaggaacgccgguucccccgggcccgg

SEQ ID NO: 114854 - RNA, 64 nt, hsa
ugcccgccgugauggccuugaggcugccugcccgcgccaggauguuuggcacaaagagcagccc

SEQ ID NO: 114855 - RNA, 64 nt, hsa
uuccagggccguaggugccuuucugcacacaggccgccaggacucguggugucuccaggcugug

SEQ ID NO: 114856 - RNA, 64 nt, hsa
ugcccaggccaggggggcugcagcccucagcccccgccaggauucccgcaggcuccuggacugg

SEQ ID NO: 114857 - RNA, 64 nt, hsa
uuuccagaauccugcaugggccaugugagaagaucgccaggaucuuccugauggaagcugacuu

SEQ ID NO: 114858 - RNA, 64 nt, hsa
ggacucaggggcgaggaggaugacuggguccggucgccaggacugucucugaggcagaaacgcc

SEQ ID NO: 114859 - RNA, 64 nt, hsa
gcccagccccgggcacccgccucggacgcucgggcgccaggaggcuucgcuggaggggcugggc

SEQ ID NO: 114860 - RNA, 64 nt, hsa
ugugcuaucuucucuucuauccaaguagaauguacgccaggagcuccuucccucuagcaauuuc

SEQ ID NO: 114861 - RNA, 64 nt, hsa
acagcccguucgaaggugugcagagggcucugagcgccaggauggccagggcuguuuuugcuac

SEQ ID NO: 114862 - RNA, 64 nt, hsa
ugacaacagucuucugcccaugucugggaacacacgccaggaggaaugucugauacccucugca

SEQ ID NO: 114863 - RNA, 64 nt, hsa
uuggucuuuguucaucugaguugugcuggggcaacgccaggaagugcccuggguaccucugcug

SEQ ID NO: 114864 - RNA, 64 nt, hsa
ggggaaggccaggguggaagggcggcuugagggacgccaggagaagacugaaugccaggcuagg

SEQ ID NO: 114865 - RNA, 64 nt, hsa
ugggaaggaaggcagugccugcucugcugugagccgccaggaacccuccuccugucaauggggg

SEQ ID NO: 114866 - RNA, 64 nt, hsa
gagaaauacuaugcauagcaaggagaugcagagccgccaggaaaauucugaguuccagcacaau

SEQ ID NO: 114867 - RNA, 64 nt, hsa
cccuccuucccucucaccccuccucucccggccucgccaggagucuuggcuguuggcagcucag

SEQ ID NO: 114868 - RNA, 64 nt, hsa
cacccaacucccuuugccucuccccaaaccgggccgccaggaucccuccccgcggcggcgaugg

SEQ ID NO: 114869 - RNA, 64 nt, hsa
uugcagggguccuaagaaacuccacucuggacagcgccaggaggcccuggguuccauuccuaac

SEQ ID NO: 114870 - RNA, 64 nt, hsa
caaucaacacacugccaaugcgggugggcuaagccgccaggaugccugcagcagauggacgcug

SEQ ID NO: 114871 - RNA, 50 nt, hsa
gcccgcccucccgaauguagcgccaggagccacgucccuucucccuuccc

SEQ ID NO: 114872 - RNA, 64 nt, hsa
uccagcccgugauugacaagcuggccgaguaugucgccaggaacggccugaaguucgagaccag

SEQ ID NO: 114873 - RNA, 64 nt, hsa
gggacauuguaguucgcaugguucucuggaaacgcgccaggaaaagcuuccgugccagugauuc

SEQ ID NO: 114874 - RNA, 64 nt, hsa
ggucuccauggugcuaggccaggguggccagccccgccaggaggccuggccugggcacacgcac

SEQ ID NO: 114875 - RNA, 64 nt, hsa
gcuguaccugacaggccuucugaggaagccaagacgccaggagaggcucaggccugggagucag

SEQ ID NO: 114876 - RNA, 64 nt, hsa
cgcuuccucccgcaagcagcccggguccgcacugcgccaggagccgccugcgaccgcccgggcg

SEQ ID NO: 114877 - RNA, 64 nt, hsa
ugaucagguuauuggugacuuacuggacuggcaccgccaggagaaaauucuccugcuaacuuuu

SEQ ID NO: 114878 - RNA, 64 nt, hsa
ucuucaccaucuuucugauuccgcacccugccuacgccaggagaaguugaggggagcaugcuuc

SEQ ID NO: 114879 - RNA, 64 nt, hsa
gcggaguuugguggagcugcgggaaauguugaagcgccaggagagacuuuugcgcaacgaguaa

SEQ ID NO: 114880 - RNA, 64 nt, hsa
gaguaccgagagacacggucuggacagcccaaggcgccaggaugcaaccugcuuucaccagacu

SEQ ID NO: 114881 - RNA, 53 nt, hsa
agcggguugcccgccgcugacugcgccaggaugcacagaccgaccgacagacc

SEQ ID NO: 114882 - RNA, 64 nt, hsa
ccccccagcgacacuaugcaaauccuggagugcccgccaggaucgaagccaugacugggugcag

SEQ ID NO: 114883 - RNA, 64 nt, hsa
ucaccaaacccacccgcgcccugggacgcagccacgccaggaggaggacacggccgccgagagc

SEQ ID NO: 114884 - RNA, 64 nt, hsa
gaagacuuaaccgguggccucaucaccagagcaucgccaggauuucuaaugcacucaguuuccc

SEQ ID NO: 114885 - RNA, 64 nt, hsa
caugauggaccggugauggcggagccuugugcgucgccaggacuucucugggcuguguuuaaac

SEQ ID NO: 114886 - RNA, 64 nt, hsa
cgccgaggaacagugcugggcaccccgccuggcccgccaggacccacccugccaacaucaaguu

SEQ ID NO: 114887 - RNA, 64 nt, hsa
ccagccagguugaacuguagcgaggcccccaggccgccaggaauggaccaugcagaucacuguc

SEQ ID NO: 114888 - RNA, 64 nt, hsa
aagcugggcccucacuggccugucccugcugcagcgccaggacccccggagguagaggcgagag

SEQ ID NO: 114889 - RNA, 64 nt, hsa
cugcccagcucaccacaucuucaucaccagcaaacgccaggacuuggcucccccauccucagaa

SEQ ID NO: 114890 - RNA, 64 nt, hsa
gaacagcaggcccaccuaccuucaaagcugaagccgccaggaccgccaaagaaugccuugaaga

SEQ ID NO: 114891 - RNA, 64 nt, hsa
ggugccauaucacguacaccauaugcaaguuucccgccaggagguccuccucucucuacuugaa

SEQ ID NO: 114892 - RNA, 64 nt, hsa
aggugguuacaaaucauaacuuccugcaaaucaacgccaggagagcaacuuaccuucauuucuu

SEQ ID NO: 114893 - RNA, 64 nt, hsa
auguauccccgcaccccagaacugggcuccugaacgccaggaaccuggggucugggggggagcu

SEQ ID NO: 114894 - RNA, 58 nt, hsa
gcgcccuggcccuggccugagcccacgccgccaggaggcagggagggcuccgccgcgg

SEQ ID NO: 114895 - RNA, 54 nt, hsa
cggcgggagacgagcugugagccccgccaggacuaugcucccaggccccucugc

SEQ ID NO: 114896 - RNA, 64 nt, hsa
caacagcucccaaacccugagcaaggcaaccgaucgccaggaccaggaagcaucacccaggaga

SEQ ID NO: 114897 - RNA, 64 nt, hsa
cuggcaugucauccucagggcgcuuccucgcucacgccaggagggacuuggaguggcgagcugg

SEQ ID NO: 114898 - RNA, 64 nt, hsa
auggaccacaaagcagaaguggcuucuuagcuuccgccaggagcugcuccuguggguugaugga

SEQ ID NO: 114899 - RNA, 64 nt, hsa
acuccacgccggcagccaacgcacaggaugggggcgccaggagaggggccccucucuccucuau

SEQ ID NO: 114900 - RNA, 64 nt, hsa
cgggguucagcggcucccccagugcugcaggugccgccaggacgggccacgugggcccccagcc

SEQ ID NO: 114901 - RNA, 64 nt, hsa
aggccuguagggcccucgugcagcccacccugaccgccaggaugcuucugccauccaggggugu

SEQ ID NO: 114902 - RNA, 64 nt, hsa
aacuggccuggcaccuggugccacgugcugcugccgccaggauaugcgccuucccacaggugcc

SEQ ID NO: 114903 - RNA, 64 nt, hsa
gagaaaggagaucggacugggguucccgguggggcgccaggauggcuccugggggugcuccugc

SEQ ID NO: 114904 - RNA, 64 nt, hsa
ucccuaccucccaccaccuaguggccaaacaccccgccaggaguucaaugcugggagaggucca

SEQ ID NO: 114905 - RNA, 64 nt, hsa
cuugguccccagaagauggcggcuagggccucgccgccaggacagagaagggacgggguggcug

SEQ ID NO: 114906 - RNA, 64 nt, hsa
ccuuguggcaauuugagagucuggcaucguuuuccgccaggacccaaagauccaggaggcacuu

SEQ ID NO: 114907 - RNA, 64 nt, hsa
ucuaagcaaagugccccugcaggccggguucugccgccaggacugcccccuucccagagcccug

SEQ ID NO: 114908 - RNA, 64 nt, hsa
acaagacagaggggagcaguggccaucauccucccgccaggagcuucuucguuccugcgcauau

SEQ ID NO: 114909 - RNA, 64 nt, hsa
gggacagcugcuuugcugcccggagaguaguccgcgccaggaagagagcaacgaggaaaggaga

SEQ ID NO: 114910 - RNA, 64 nt, hsa
caaaccacccaccccauugggagaaaaacccagacgccaggaaaagaagaaacaacaaaggcag

SEQ ID NO: 114911 - RNA, 64 nt, hsa
caucaccaacgggaggugacccgcuggccgcccgcgccaggagccuggacccggccucccgggg

SEQ ID NO: 114912 - RNA, 64 nt, hsa
ggaaagugacgcgcauggacggggcccagcuaggcgccaggacuuggccucacccucuggcuga

SEQ ID NO: 114913 - RNA, 64 nt, hsa
gggacguggcucagccagcacuuguccagcugagcgccaggauggaacacggccacaucaaaga

SEQ ID NO: 114914 - RNA, 64 nt, hsa
aucgggggguggcucuccugccacccauggggagcgccaggagaggagggucauggaggauguu

SEQ ID NO: 114915 - RNA, 64 nt, hsa
guuggggcagauguuacugaaccugugaaucagacgccaggagugagggcuggggagggaccua

SEQ ID NO: 114916 - RNA, 64 nt, hsa
gcaaccugugcagccggcagugugccuggugucacgccaggaggcuguggcugcugugggcccu

SEQ ID NO: 114917 - RNA, 64 nt, hsa
gcacgccgccacccccuccccgcagcccucaccccgccaggagccacugcucucccccuugccc

SEQ ID NO: 114918 - RNA, 64 nt, hsa; identical to SEQ ID NO: 102816

SEQ ID NO: 114919 - RNA, 64 nt, hsa; identical to SEQ ID NO: 102817

SEQ ID NO: 114920 - RNA, 64 nt, hsa; identical to SEQ ID NO: 102818

SEQ ID NO: 114921 - RNA, 64 nt, hsa; identical to SEQ ID NO: 102819

SEQ ID NO: 114922 - RNA, 64 nt, hsa; identical to SEQ ID NO: 102820

SEQ ID NO: 114923 - RNA, 64 nt, hsa; identical to SEQ ID NO: 102821

SEQ ID NO: 114924 - RNA, 64 nt, hsa; identical to SEQ ID NO: 102822

SEQ ID NO: 114925 - RNA, 64 nt, hsa; identical to SEQ ID NO: 102823

SEQ ID NO: 114926 - RNA, 64 nt, hsa
uuuucaacccuuuaacuuuuuacgguguuugaagaccagcuacuccuuaauauuuaucaaugga

SEQ ID NO: 114927 - RNA, 64 nt, hsa
ugucagacuuuuguuuuugggguuuauaauuuaaaccagcuaugcuauuuuuucauaaaggcau

SEQ ID NO: 114928 - RNA, 64 nt, hsa
gagcauguuacuaaaaugcugaggauuuuguaggcuugcauaguaguuguuuuuuaacuagcug

SEQ ID NO: 114929 - RNA, 64 nt, hsa
uaguuuguaguauuaguuuccuuuuauugguauucuugcauauacuauucauucaauaaaugac

SEQ ID NO: 114930 - RNA, 65 nt, hsa
cugagagcggcugagggcugccucacugcaaauccuccccacagcgucagugaaagucguccuug

SEQ ID NO: 114931 - RNA, 65 nt, hsa
uaaacaugcccgggcuucgaugugccuggaggauuuccccacagggacccacgcaccucccugua

SEQ ID NO: 114932 - RNA, 65 nt, hsa
caacagcaccauccucuguagcagacaggccucccuccccacaggcccgcugcugcggccucuau

SEQ ID NO: 114933 - RNA, 65 nt, hsa
uggagccuuuugaggggggccuucccucagcuguuuccccacacuggggggcugggcccugccuc

SEQ ID NO: 114934 - RNA, 65 nt, hsa
gcauccccccacccuacaacugagcacaaccucuuuccccacagugcaauucagaauaugcucag

SEQ ID NO: 114935 - RNA, 65 nt, hsa
uauauaugacguuguacauugcacauacccuuggauccccacaguuugguccuccucccagcuac

SEQ ID NO: 114936 - RNA, 65 nt, hsa
ccugacuccugagcaggaccugggcccgguucagcuccccacaaggacuucucugucuggagaca

SEQ ID NO: 114937 - RNA, 65 nt, hsa
cugccacagcugcagacugagagggugggucugaguccccacaaugucugaagcugccccuggga

SEQ ID NO: 114938 - RNA, 65 nt, hsa
uucuagagcaaggaauugacuuuuaggagccguucuccccacaagacaccacaugacaaggggua

SEQ ID NO: 114939 - RNA, 65 nt, hsa
gugccucucggcucagugacagccaaccugcccccuccccacaccaaucagccaggcugagcccc

SEQ ID NO: 114940 - RNA, 65 nt, hsa
ucccucagccucaggcaguggugcucccaucuuccuccccacaacugugcucaggcuggugccag

SEQ ID NO: 114941 - RNA, 65 nt, hsa
ucaguccaucucccucaucuccauucucaguuucuuccccacaaaauuuggaaucaaagcuuuua

SEQ ID NO: 114942 - RNA, 65 nt, hsa
uggcaguuuuaaccaccaacguagaagcuuuuuuuuccccacaagaccauuguacugcaauacuu

SEQ ID NO: 114943 - RNA, 65 nt, hsa
uuugaugucaaacgccuugaaaacaagccuccacuuccccacacuucccauuuacucuugagacu

SEQ ID NO: 114944 - RNA, 65 nt, hsa
ugacaugugauggugauagucucugguucuccccauccccacaaaggcuguugaaccacagcacc

SEQ ID NO: 114945 - RNA, 65 nt, hsa
uugucaguaucugcucugaggaaccaggucccaccuccccacaaggcaaaucuagacccauuaaa

SEQ ID NO: 114946 - RNA, 65 nt, hsa
ucaaauagaugaucuuugacacgauuagacacuccuccccacaaaggcuuugaaaucauaaggau

SEQ ID NO: 114947 - RNA, 65 nt, hsa
agggccccuggacugucguggcuccccucaucagcuccccacaccagucaaggcuucucagcugg

SEQ ID NO: 114948 - RNA, 65 nt, hsa
aggugaccugcucucuuuccugggcccugccccucuccccacauguaucccucggucugaauuag

SEQ ID NO: 114949 - RNA, 65 nt, hsa
ggaagcauuguaaggauuucuucccaucguacccuuccccacacauaccaccuuggcuucuucua

SEQ ID NO: 114950 - RNA, 65 nt, hsa
uggauugcaguccccagucaccucuucugccagccuccccacauauggcacaacugucuaaugac

SEQ ID NO: 114951 - RNA, 65 nt, hsa
gccuguacauccaucccaggacacagcccagccccuccccacaccauacaagguaucagaaaagu

SEQ ID NO: 114952 - RNA, 65 nt, hsa
ucugccuuugaaaaugcuuccaaaaguagacccuguccccacacaggucaagacuacagagaagg

SEQ ID NO: 114953 - RNA, 65 nt, hsa
aaaaauauaucugaaguuucuuguguuuuuuuuuuuccccacaaaguguguuuccacuuggagca

SEQ ID NO: 114954 - RNA, 65 nt, hsa
uccucuugucaagguuugggaaugucaaagcccccuccccacacagggccuuuccugucccuugu

SEQ ID NO: 114955 - RNA, 65 nt, hsa
aucuucaccccacuuccucuacccccagguucuccuccccacagccaguccccuuuccuggauuu

SEQ ID NO: 114956 - RNA, 65 nt, hsa
aaggucuccaugcagggggaggaggccugcuucuuuccccacagcucucacgucucccuucuccc

SEQ ID NO: 114957 - RNA, 65 nt, hsa
aggaccaccuccuuccugccucauuguaauaaaauuccccacacugaggccuucuugucuucaac

SEQ ID NO: 114958 - RNA, 65 nt, hsa
cuaugguuucuguagaucaucgucaucuuguauauuccccacaaagccguucgcagcuuccggga

SEQ ID NO: 114959 - RNA, 65 nt, hsa
uguggguauguagccaagagaaaugaaaacauaucuccccacaaaaaaacuuggguaugagauuu

SEQ ID NO: 114960 - RNA, 65 nt, hsa
cacaguguuccagcugccugggaggcuuuuggugguccccacagccucugggccaagacuccugu

SEQ ID NO: 114961 - RNA, 65 nt, hsa
cuagaagugcgcaugaaggaugcuucaugcccuguuccccacacagagaagagaugaagaggggg

SEQ ID NO: 114962 - RNA, 65 nt, hsa
uuccccagcggccaccaacugaccuggggcgcugcuccccacaguccaaauaagcugaaagugca

SEQ ID NO: 114963 - RNA, 65 nt, hsa
ugggcucuuacagagccuccaugagucaagcccccuccccacaccuggacuccagaauucacccu

SEQ ID NO: 114964 - RNA, 65 nt, hsa
guggucuuccaaaaaaaauaggagcuugguugaaguccccacauuuucaagcacucaguguucug

SEQ ID NO: 114965 - RNA, 65 nt, hsa
uguggucaggacugagcaggggacuggcccuccccuccccacagcugcucuacagggaccacggc

SEQ ID NO: 114966 - RNA, 65 nt, hsa
uuuugcaguguuaccagaaucaaggcucuguuuauuccccacaagacuugcauagaaaaauaaga

SEQ ID NO: 114967 - RNA, 65 nt, hsa
uuuuuucaugaaaauuauuggugggccacugaaaguccccacacacaaagccuuuauucuauaua

SEQ ID NO: 114968 - RNA, 65 nt, hsa
uacaguaggccuuuuguuuauuaauggaagaguacuccccacaccuaagaccagauucuuauauc

SEQ ID NO: 114969 - RNA, 65 nt, hsa
ccacacacucccagcucacccucaccccagccucuuccccacauuagggguuucuuggaagcugg

SEQ ID NO: 114970 - RNA, 65 nt, hsa
uuccacaaaauuggaagcuuuuuuuaaaaauguuuuccccacaagucaucuugccuuguggcaug

SEQ ID NO: 114971 - RNA, 65 nt, hsa
aaaaucaggcucaguuccccuacucuggccucuacuccccacaccccagugccacugugggugac

SEQ ID NO: 114972 - RNA, 65 nt, hsa
gaaaaggggcauugagacuauaaagcaguagacaauccccacauaccaucuguagaguuggaacu

SEQ ID NO: 114973 - RNA, 65 nt, hsa
uaaccaggccgagaggccacacacuugcccccccauccccacaaaccagguaaugccaguuugcc

SEQ ID NO: 114974 - RNA, 65 nt, hsa
ucugcaguccugccucugccacagucucucuguuguccccacaucuacccaacuuccuguacugu

SEQ ID NO: 114975 - RNA, 65 nt, hsa
ucuugacuuuccugguuauagcuuuccaucacagcuccccacauucucucuugauguugaaagca

SEQ ID NO: 114976 - RNA, 65 nt, hsa
uguuuaguaaaucccuucaguauuuaucccuccuuuccccacagcagcuuucuuuccugucaacu

SEQ ID NO: 114977 - RNA, 58 nt, hsa
augucaucuuugccuacugacacccuuguccccacaagcagaagcacagaggggucac

SEQ ID NO: 114978 - RNA, 65 nt, hsa
guaguacauuguaccaaaguucuuaauaagaauauuccccacaauccuguucucuaaaugucaaa

SEQ ID NO: 114979 - RNA, 65 nt, hsa
uaggaauaaauguaagauuuuacaaaucuuuuauuuccccacaagaucugaaguuugguauuuuu

SEQ ID NO: 114980 - RNA, 65 nt, hsa
ggaacugccacauacagggccaggccuacccuccuuccccacaagcccccuccaacccccacccc

SEQ ID NO: 114981 - RNA, 65 nt, hsa
uuagccacaauggccccccgcgaagugagucauacuccccacaagucucugggcugggcagccgg

SEQ ID NO: 114982 - RNA, 65 nt, hsa
agagcccuugggagaccagcuguugcucccaccuuuccccacagggugcccgguccccacggcgc

SEQ ID NO: 114983 - RNA, 65 nt, hsa
ugggggucgaggguccugcauaugcaccuggggaguccccacacacccgcaccaaaggggaaaca

SEQ ID NO: 114984 - RNA, 65 nt, hsa
ucaguguuuugggucuaggugagagcaggccccucuccccacaccucgccccacagagcucuguu

SEQ ID NO: 114985 - RNA, 65 nt, hsa
cuuaccuuuuccuauucuguugccaauuuuuguuuuccccacauucuauagccauaaaccugaag

SEQ ID NO: 114986 - RNA, 65 nt, hsa
gggguacucagcuccaucuccaaagauaaaccuacuccccacaagaacuggccuuuaauguggua

SEQ ID NO: 114987 - RNA, 65 nt, hsa
agccucggugccagaguggugggcagaucugaccauccccacagaccagaaacaaggaauuucug

SEQ ID NO: 114988 - RNA, 65 nt, hsa
gcccaggcuagucuuuucuuucuucuuuuuuuuuuuccccacaguauauauuauacagcagucau

SEQ ID NO: 114989 - RNA, 65 nt, hsa
ugguggggaggggaggcagguguggguagcgcacauccccacagaucaaucucugcagaugacag

SEQ ID NO: 114990 - RNA, 65 nt, hsa
caagcuguggggaggacucugccuguguccuguguuccccacagggagaggcucuggggggaugg

SEQ ID NO: 114991 - RNA, 65 nt, hsa
ucaggcaguaguuuauucaucauuugguaagccccuccccacacuccucuaauuuaaacaaguag

SEQ ID NO: 114992 - RNA, 65 nt, hsa
cccccacuuuuagacauaccccagagcccuguggcuccccacacccugccauaggggcaguccug

SEQ ID NO: 114993 - RNA, 65 nt, hsa
ugaggugggauggccccaucuggauguucugcagauccccacaugggaggagauucccaaguaga

SEQ ID NO: 114994 - RNA, 65 nt, hsa
aggagaguagcugccuguugcaccugcuccacaccuccccacagccucccugcaggugcugugug

SEQ ID NO: 114995 - RNA, 65 nt, hsa
aaacuuacacugguuugacaguggucaguuacauguccccacaguuccaaugugccuguucacuc

SEQ ID NO: 114996 - RNA, 65 nt, hsa
uuuggggcaagucauguaaauacuguugguggucuuccccacacgccccaauuuucagguaguac

SEQ ID NO: 114997 - RNA, 65 nt, hsa
cagccagccccucacagcucuuccccagcuccgccuccccacacuccuccuugcgcacccacuca

SEQ ID NO: 114998 - RNA, 65 nt, hsa
acuucccuccuuguuugucagccuccuguucauguuccccacacaccugaaggugguagaaucuu

SEQ ID NO: 114999 - RNA, 65 nt, hsa
cuccaugaugacuuaguacaaaguuucaauuuguuuccccacaaaacaaagcaauucuuucaagu

SEQ ID NO: 115000 - RNA, 65 nt, hsa
uugugacgcguuggugacggugcccagccugcgguuccccacagcaucgcaggcgcucggaaauc

SEQ ID NO: 115001 - RNA, 65 nt, hsa
auauuuuuagcagaacaggacuuacagggucauuguccccacaaugugccagucgacuauuugca

SEQ ID NO: 115002 - RNA, 65 nt, hsa
aucaauauuuugaagugauacacagaugucuuuccuccccacaaacuuuuuuaaacaaaaaacaa

SEQ ID NO: 115003 - RNA, 65 nt, hsa
gucauugcagcucucagcaaacugggucauagcuuuccccacagcucagccuggggccugggcag

SEQ ID NO: 115004 - RNA, 65 nt, hsa
gugccuaugccugggggaggucaguaggggcccccuccccacauggcccucgcucugucuaugca

SEQ ID NO: 115005 - RNA, 65 nt, hsa
auuccaggcuauauauuucuuuuuaaugggccaccuccccacaacagaauucugcccaacacagg

SEQ ID NO: 115006 - RNA, 65 nt, hsa
guuuugacacugagcuuggggcuuuuuccaucuucuccccacagccucuggcuccacaccuccac

SEQ ID NO: 115007 - RNA, 65 nt, hsa
aaauaguuauguuggcacuguguucacacgcaugguccccacacccccagguuggguggguuuuu

SEQ ID NO: 115008 - RNA, 65 nt, hsa
accguccuccgugacacacggcccccuuccuccuguccccacacucccaggagaaacucccggug

SEQ ID NO: 115009 - RNA, 65 nt, hsa
ugcaugcugccaguuccuguucuguguucaccacauccccacaccccauugccacuuauuuauuc

SEQ ID NO: 115010 - RNA, 65 nt, hsa
augugcaccagguugguguucaccagcucaugucuuccccacaucucuucuugccaguaagcagc

SEQ ID NO: 115011 - RNA, 65 nt, hsa
agugccucugcacaccgcccauuccacuuccuccuuccccacagggcagguggggaagcaguuug

SEQ ID NO: 115012 - RNA, 65 nt, hsa
uaccuuauuuucucuuggaacauaucugaaaaccuuccccacaaauaacuugucacaccuuuugu

SEQ ID NO: 115013 - RNA, 65 nt, hsa
uccagcaggagcagauccaggagcagcucauaugauccccacagucgauccagguaugaacaggg

SEQ ID NO: 115014 - RNA, 65 nt, hsa
cccugccccagccuagcugagugugcuggcaaaguuccccacaggacucagccuucucgucuuuc

SEQ ID NO: 115015 - RNA, 65 nt, hsa
agccauggcugaacuaucagggacaaaggcccauguccccacaucccugcucccuccuuccucau

SEQ ID NO: 115016 - RNA, 65 nt, hsa
auaacuauguaaauuguuuuugaaaauaauuuguuuccccacaacuuuugaagguuuuauuuguu

SEQ ID NO: 115017 - RNA, 65 nt, hsa
aacauaucauaacugcacugugaugaagaagcuguuccccacagaggagaagcucugcuuucuuu

SEQ ID NO: 115018 - RNA, 65 nt, hsa
aucuggaaaaacccaucauucuaaucuagcuuguauccccacaucaugagaaagagggaagaaga

SEQ ID NO: 115019 - RNA, 65 nt, hsa
cagugcuguaugcggcugcagccgucucaccuguuuccccacaaagggaauuucucacucugguu

SEQ ID NO: 115020 - RNA, 65 nt, hsa
gaauuucucugauuugugggcacaguuaugaaguuuccccacaugugaagacagguacaaaauag

SEQ ID NO: 115021 - RNA, 56 nt, hsa
aagaagacacauacaaguaagaccuguccccacaacaaggacccuguguggagcca

SEQ ID NO: 115022 - RNA, 65 nt, hsa
uugagcuccagcuucucugagcauccccucugcuguccccacauccugauagccccucugggagc

SEQ ID NO: 115023 - RNA, 65 nt, hsa
agcugugcuguagccuguaauuacugacaugaagguccccacacagagucuggauggaggcugcc

SEQ ID NO: 115024 - RNA, 65 nt, hsa
uacaaaauucucauuuaauuuucuggucagcaaguuccccacacagaaaucacucugagguuuac

SEQ ID NO: 115025 - RNA, 65 nt, hsa
acugguaauauuuuuauuuccuauuggagagugaauccccacaguugcuuuuugugacuugauuc

SEQ ID NO: 115026 - RNA, 65 nt, hsa
ucagggcccagaccuuccugcucuccagcaggggauccccacaaccucacacuugucuguucuuc

SEQ ID NO: 115027 - RNA, 65 nt, hsa
caucucccuuagggacuacccauagacaugaaagguccccacagagcaagagauaagucuuucau

SEQ ID NO: 115028 - RNA, 65 nt, hsa
ugcccacaagccuggcagcuguagagccgcgaaccuccccacaccucccucaccgcgcaggaccc

SEQ ID NO: 115029 - RNA, 65 nt, hsa
ggaagccauuugcagugcugguguguccugcucccuccccacauuccccaugcucaaggcccagc

SEQ ID NO: 115030 - RNA, 65 nt, hsa
guaaaauggcugagcauugcagagaaaaaaaaaaguccccacauuuuauuuuuuaaaaaccaucc

SEQ ID NO: 115031 - RNA, 65 nt, hsa
gggcagcuuuauuccuguugggccucaguuucucuuccccacacaguuuaucuuccgucacauug

SEQ ID NO: 115032 - RNA, 65 nt, hsa
guuauccuguaacauaaauuuuauuaaauaauacuuccccacagaugagaggcacgcaacaccua

SEQ ID NO: 115033 - RNA, 65 nt, hsa
auacuguuuuccagagguuguaaaauguacauuccuccccacaguguauaagcugugccuuuacu

SEQ ID NO: 115034 - RNA, 65 nt, hsa
ggcaggugggggcuugguugcugacccggcccaaguccccacagagcaccuucuguagcuccagc

SEQ ID NO: 115035 - RNA, 52 nt, hsa
ccagaacacuagcaccaugaacuccccacacaguuuuacagaguucugaaau

SEQ ID NO: 115036 - RNA, 65 nt, hsa
ucauuugccuucccuaccucuuccucccagaguccuccccacaguuccuaagggccacuguguac

SEQ ID NO: 115037 - RNA, 65 nt, hsa
gccagacacuaggagaauuauuaacuucucauacuuccccacauugagaagcauucggaguguau

SEQ ID NO: 115038 - RNA, 65 nt, hsa
auucauuuguaaaacuuuguauuaguguaacauacuccccacagucuacuuuuacaaacgccugu

SEQ ID NO: 115039 - RNA, 65 nt, hsa
uucuuuaccuggucuccuuccuucgucuagaaccuuccccacaguagcuaauccuaacaacuuuu

SEQ ID NO: 115040 - RNA, 65 nt, hsa
aggacugaacuuuuucucaucaaaacuagcuuuuuuccccacaaauaaauuaucagguuaaacuu

SEQ ID NO: 115041 - RNA, 65 nt, hsa
cucucagagccucagcuucugggggagacaugcucuccccacaggggggaggcacuaagucaugg

SEQ ID NO: 115042 - RNA, 65 nt, hsa
cacugccuucguuuauauuuuuuuaacugugauaauccccacaggcacauuaacuguugcacuuu

SEQ ID NO: 115043 - RNA, 65 nt, hsa
agcuacuuucuguaugcacaagcuucccagcuuuguccccacaguguaccuuuuugcuaaaacac

SEQ ID NO: 115044 - RNA, 65 nt, hsa
uuaaaaaaaaauaauaauaaucuggugccucaguuuccccacaugugcaaugggauacuuauuaa

SEQ ID NO: 115045 - RNA, 65 nt, hsa
auaaaguaaaauaaugggcauuaucauuggauguuuccccacauuggcuuuuaaaauacccaucu

SEQ ID NO: 115046 - RNA, 65 nt, hsa
cacucaaaucucaucuugaauuguaguuccaauaauccccacaugucaugggaggaacccagugg

SEQ ID NO: 115047 - RNA, 65 nt, hsa
uacauguugguuucaucuucgcugucucucucauuuccccacaaaguguugucucacuuucugcc

SEQ ID NO: 115048 - RNA, 65 nt, hsa
gaacagaacauagacagaagaaacaagguuuucaguccccacagauaacugaaaauuauuuaaac

SEQ ID NO: 115049 - RNA, 65 nt, hsa
auucugcccuuguaaucggugucccuguaaaacaauccccacagauuacuuucagaaauagaugu

SEQ ID NO: 115050 - RNA, 65 nt, hsa
ccaggacucacccucauaccaucugcugccccgcuuccccacagaacugcuuacuagcccugcgg

SEQ ID NO: 115051 - RNA, 65 nt, hsa
gacaaagcccaucccaggagacggggugaagcuauuccccacacucuccugugaacacuggaguc

SEQ ID NO: 115052 - RNA, 65 nt, hsa
uagagacaugcucccugcccucuccacagugcugcuccccacaccuagccuuuguucuggaaacc

SEQ ID NO: 115053 - RNA, 65 nt, hsa
ggcagaauuucugaccccuuuggcucagcugcccuuccccacaaauaaaaaccaacaaagaggac

SEQ ID NO: 115054 - RNA, 65 nt, hsa
agggccuacaccccucccuuuuuggggggagccuguccccacacaccuuagcacaaccagaaucu

SEQ ID NO: 115055 - RNA, 65 nt, hsa
gucugccaguaacauguucccauguacagacacgguccccacacccucccagccucaggcccagg

SEQ ID NO: 115056 - RNA, 65 nt, hsa
gugagcagacuuaaccccuccgugccucagcuuuuuccccacagacaccuaccucacaggggcau

SEQ ID NO: 115057 - RNA, 65 nt, hsa
ccaccaaggacaggcagaagccggacaggggcccuuccccacaccggggagagcugcucggacag

SEQ ID NO: 115058 - RNA, 65 nt, hsa
uaccagcaggagguucugggccucugaacccccuuuccccacaccucccccugcugcugcugccc

SEQ ID NO: 115059 - RNA, 65 nt, hsa
gcugcguuucuccuuucuguccgugggcagcccaguccccacagucacggccaagccacgcagaa

SEQ ID NO: 115060 - RNA, 65 nt, hsa
ggccagcuuuuccucaccaggagcccggcuuccacuccccacauaggaauaguccauccccagau

SEQ ID NO: 115061 - RNA, 65 nt, hsa
agggcugaguguccagcacaccugccgucuucacuuccccacaggcuggcgcucggcuccacccc

SEQ ID NO: 115062 - RNA, 65 nt, hsa
ccccucgcccgccgccuccccuccgguccccucuuuccccacacuucgcgacccuccucccgcgc

SEQ ID NO: 115063 - RNA, 65 nt, hsa
agcugauuuaacagcauagagcacagcgcccuacuuccccacagacaggcugaauuagaagcccc

SEQ ID NO: 115064 - RNA, 65 nt, hsa
guuacuuuggcaauuuccuggcccuccacuccucauccccacaaucuggcuuagugccacccacc

SEQ ID NO: 115065 - RNA, 61 nt, hsa
ccuaccuuggccuugaguagcaggggccugguccccacagcccacaggauggaccaaaggg

SEQ ID NO: 115066 - RNA, 65 nt, hsa
uuccguucauugcucuccagucacaugcccccacuuccccacaggugaaaguuuuucugaaagug

SEQ ID NO: 115067 - RNA, 65 nt, hsa
gaugcccugggaagauccuuggcugccgcuuucucuccccacagccucaaggccacccuaccguc

SEQ ID NO: 115068 - RNA, 65 nt, hsa
ggcggcaaggggggaaugggaguugucuccccuucuccccacaccugaucugcucucggcugguc

SEQ ID NO: 115069 - RNA, 65 nt, hsa
gagcagcacuccauaucccuuacugucaccuucacuccccacacagcucaugagaugugugaccc

SEQ ID NO: 115070 - RNA, 65 nt, hsa
acaaaauggcguagaaugaaaugccucucacccuuuccccacagcgacuacuucccacucagagg

SEQ ID NO: 115071 - RNA, 65 nt, hsa
gaggacacggaggguucagaccccuccucagacccuccccacaucugaaacugccuccccccaac

SEQ ID NO: 115072 - RNA, 65 nt, hsa
ccagcagcagcagggcccuccucccccaccagcucuccccacagggccccucagcaucauggaga

SEQ ID NO: 115073 - RNA, 65 nt, hsa
gaguauuagcuuacccaaugggaccgugccccaccuccccacacacaggccuucuguggggcugg

SEQ ID NO: 115074 - RNA, 65 nt, hsa
ccuuccugccauugcugcaccaggacugcaaggaguccccacaccuuggcagcucagggucccca

SEQ ID NO: 115075 - RNA, 65 nt, hsa
cacaguguaauauuucuccaaguaucauccaaaauuccccacagacaaggcuuucguccucauua

SEQ ID NO: 115076 - RNA, 65 nt, hsa
agcaccaaauuuuguuguuuuuuuuuuuucuccccuccccacagaucccaucucaaaucauucug

SEQ ID NO: 115077 - RNA, 65 nt, hsa
gucgcccaacuagaguguaguggcacaaucucggcuccccacaaccucugacuccaggguucagg

SEQ ID NO: 115078 - RNA, 65 nt, hsa
ucuauacucccugcacccuucugacugacaguucauccccacaaaacacauugguuuugagaggu

SEQ ID NO: 115079 - RNA, 65 nt, hsa
ccugggaauuugcuggaaaugcaggcucaagccccuccccacaccuggugaaugagagagcccca

SEQ ID NO: 115080 - RNA, 65 nt, hsa
aauuacuuuuaagugugcuuuaaagaaaaauauuuuccccacaagagaaauuuaaauaaagaauu

SEQ ID NO: 115081 - RNA, 65 nt, hsa
cuugccacuccuagcuccagaagggcucagggccuuccccacagaucuaaggacugggcuacccu

SEQ ID NO: 115082 - RNA, 65 nt, hsa
uauccuggcgaacaccccuacccuucuauugcggguccccacaugcacacagaacucugacacag

SEQ ID NO: 115083 - RNA, 65 nt, hsa
gagacagcccacccccguguccaccgugaccccuguccccacacugaccuguguucccuccccga

SEQ ID NO: 115084 - RNA, 65 nt, hsa
gcucugagcucuccucccaucuguccccaucuuccuccccacaccuacccacccagugggcccug

SEQ ID NO: 115085 - RNA, 65 nt, hsa
guucauuuggguuugcuuacuugacccuguggagauccccacagccauugggcauccuaggugaa

SEQ ID NO: 115086 - RNA, 65 nt, hsa
cuguccucaccuuccagccccagcugagcagccccuccccacaucaucuucagcugcugcccagg

SEQ ID NO: 115087 - RNA, 65 nt, hsa
cugguggacgcagagcacuuaguuacccuggacgcuccccacauccuuccagaaggagacgagcu

SEQ ID NO: 115088 - RNA, 65 nt, hsa
ugugccuuaggaaggugugagaccggcuucccccauccccacagcaaaacacggccugucccaag

SEQ ID NO: 115089 - RNA, 65 nt, hsa
ccacagcagugaugccagcugggcacgucaggaccuccccacacacccacacgaugccacagguc

SEQ ID NO: 115090 - RNA, 65 nt, hsa
acaugucacuuuucuguuaagaaaacugagcccccuccccacagguuaaaaaacuuuaguaacuu

SEQ ID NO: 115091 - RNA, 65 nt, hsa
ggaggcugucccaucucccaguccccaucucuuuuuccccacacugucccuggccaagcccugcc

SEQ ID NO: 115092 - RNA, 65 nt, hsa
ggucuccccuaaugcgggggcuggaccaggcugaguccccacaggguccuaguggaggaugugga

SEQ ID NO: 115093 - RNA, 65 nt, hsa
uguccccuccccagguccuucauucaccccuccccuccccacaguggaauuguugaaguguggcg

SEQ ID NO: 115094 - RNA, 65 nt, hsa
acucggcagcccuuccaaacucuucccucucucacuccccacaucccaucgucucggccuucaca

SEQ ID NO: 115095 - RNA, 65 nt, hsa
cugaaucacugcauggaugucccaggaggcagcucuccccacacagcagcacagccaucacagga

SEQ ID NO: 115096 - RNA, 65 nt, hsa
cagccccacagcacccaggcuccauggggaagugcuccccacacgugcucgcagccuggcggggc

SEQ ID NO: 115097 - RNA, 65 nt, hsa
ugacccuuccuuuuuaccucauuuauuugguacuuuccccacacaguccuuuauccaccuggauu

SEQ ID NO: 115098 - RNA, 65 nt, hsa
cgccuccagcugaccugcccuguccucuccagcuguccccacaagcagagcccugaggggugggg

SEQ ID NO: 115099 - RNA, 65 nt, hsa
agagagggaagcagaaggcaggcauuuuucuauuuuccccacaaauuauuucaaaaaaaaucugu

SEQ ID NO: 115100 - RNA, 59 nt, hsa
uggagcgaaagugccccugauggcacuccuccccacacaccugcucccaagcucagaug

SEQ ID NO: 115101 - RNA, 65 nt, hsa
accugugaaauacugacaaugucuucuaccuuccuuccccacacccuguccuuauuagacaccug

SEQ ID NO: 115102 - RNA, 65 nt, hsa
caucuugucgcuuuuaggaccucccacaaccugguuccccacacauccauaguucugccucccca

SEQ ID NO: 115103 - RNA, 65 nt, hsa
ccaugcaagcuguugaccagaugacuucucaucucuccccacaccaugaugguuuaaggugccug

SEQ ID NO: 115104 - RNA, 65 nt, hsa
ccuauggccgcucuccagacccuccuccuuucuucuccccacauccgcaccugcuguucccacuc

SEQ ID NO: 115105 - RNA, 65 nt, hsa
aaggcucuucuccggggcacagugcuaguggggccuccccacaggccaccgucgcccagccuggc

SEQ ID NO: 115106 - RNA, 65 nt, hsa
gcgcccuccagagcugcggugucucccugccucauuccccacaucccacugagcaugggaccauu

SEQ ID NO: 115107 - RNA, 54 nt, hsa
caguggguauuaaaaaauaauuucuccccacauggugggccuuugagguuccag

SEQ ID NO: 115108 - RNA, 65 nt, hsa
agcagagcuguagcugacuguggcauuacuacgccuccccacacgcccagaccccucacuccaaa

SEQ ID NO: 115109 - RNA, 65 nt, hsa
accagcagaagccagcagagaggcaugggacagguuccccacaagccuuagaaggaagcauggcc

SEQ ID NO: 115110 - RNA, 65 nt, hsa
agccuggcucuaucuuccuccuugugaucgucccauccccacaucccgugcaccccccaggaccc

SEQ ID NO: 115111 - RNA, 65 nt, hsa
acugggccuggagcccugggcggaguccccgggguuccccacacagggcacugacugauagcuua

SEQ ID NO: 115112 - RNA, 65 nt, hsa
ugugaacuuuuuauucuuccaaagaauuguaauccuccccacacugaagucuagggguugcgaau

SEQ ID NO: 115113 - RNA, 65 nt, hsa
uacagcaaacaaccaugugguuggauuacauggaguccccacauacucagucaguuaucaaagua

SEQ ID NO: 115114 - RNA, 65 nt, hsa
uuuuaaacacccccaucccucgggaagcagccagcuccccacaccuuccagggcccuaggccccu

SEQ ID NO: 115115 - RNA, 65 nt, hsa
ucagcacugcagcccaaacagugccaacagcccuguccccacaggaccugggagcccugggccag

SEQ ID NO: 115116 - RNA, 65 nt, hsa
agguccugaauuuuacuuugccuuaagaagugcccuccccacaaugcaggagaggcacagagugc

SEQ ID NO: 115117 - RNA, 65 nt, hsa
cuucuacuuuugccuucuagggggagcuuucuaaguccccacauuuaccccgagucaccggaaaa

SEQ ID NO: 115118 - RNA, 65 nt, hsa
cagcagcagcagcagcacaaacauugcugccuuuguccccacacagccucuaagcgugcugacau

SEQ ID NO: 115119 - RNA, 65 nt, hsa
ugaaauccaguugccauugaguagcaaagccacgcuccccacaggacuuggacagagggcccaca

SEQ ID NO: 115120 - RNA, 65 nt, hsa
aggaaggcagacucuacacaugucagauugacauauccccacaauuuccggaaccuacauguaua

SEQ ID NO: 115121 - RNA, 65 nt, hsa
auuauacuauaauucauaugaaaucuugauauuaguccccacacggaaaaagugaacugcaguug

SEQ ID NO: 115122 - RNA, 65 nt, hsa
aaaaggauuuacuauacuucacucuucuuuuuuuuuccccacaagcuuuuguagaugcauuguag

SEQ ID NO: 115123 - RNA, 65 nt, hsa
cuucucugcccugcccuggccacuggcccuguuucuccccacacccuggaguggcaugguccugu

SEQ ID NO: 115124 - RNA, 65 nt, hsa
gcccaucgugccugccgccccuucaggucccgaccuccccacaauaaaaugugauuggaucgugu

SEQ ID NO: 115125 - RNA, 65 nt, hsa
ggaaaccagggucccgggcaggcccggcgcuuugcuccccacaccagcccccugcgcguguccac

SEQ ID NO: 115126 - RNA, 65 nt, hsa
ugucuuuggugucagaacuuugggggccgggccccuccccacaauaaagaugcucuccgaccuuc

SEQ ID NO: 115127 - RNA, 65 nt, hsa
cacccaaaucucauguugaauuguaguucccauaauccccacauguugugggagggacccagugg

SEQ ID NO: 115128 - RNA, 65 nt, hsa
uauuccccaccaagagauucagggucacagguuuuuccccacaccucugaacucagggccuagcc

SEQ ID NO: 115129 - RNA, 65 nt, hsa
aaauugaccacuaggugacagaauguuugccaguauccccacaaaacaaguuaaaacuuaaguga

SEQ ID NO: 115130 - RNA, 65 nt, hsa
ggaaaaaaaaaucuuguggauugauugcuuugccauccccacagcagcuuuugcaaauugcuuuc

SEQ ID NO: 115131 - RNA, 65 nt, hsa
ggcccguggagacugagaucacugacucugacucauccccacagcuggcucugacaagauggucc

SEQ ID NO: 115132 - RNA, 65 nt, hsa
ccuucuugcuggggaggggacgaguucuacccaccuccccacacuggcacucagccagcugccuc

SEQ ID NO: 115133 - RNA, 65 nt, hsa
ccagcccgaacaccauugagggagcugggagacccuccccacagugccacccaugcagcugcucc

SEQ ID NO: 115134 - RNA, 65 nt, hsa
cuuccccagauucucaagcagaugcccaagggagguccccacagagccagagugccugaggcuuc

SEQ ID NO: 115135 - RNA, 65 nt, hsa
uggacauggcccggccccacugcugagugcccguguccccacagccccaugugccccaccccgcg

SEQ ID NO: 115136 - RNA, 65 nt, hsa
cucugcaugcaacaguaaaaauuaauauaauauuuuccccacaaaagaaacacuuaacagaggca

SEQ ID NO: 115137 - RNA, 65 nt, hsa
aaagcaggaucucucaauguucaguguuuuguguuuccccacacgauuugucagagagaaaugaa

SEQ ID NO: 115138 - RNA, 65 nt, hsa
cagcccacuccacccugccagcagcuuccggccaguccccacagccucaucagcucucuucaccg

SEQ ID NO: 115139 - RNA, 65 nt, hsa
ucggugugaggcugcagugggugggggauggauccuccccacacaucugaggacacacaaccacu

SEQ ID NO: 115140 - RNA, 65 nt, hsa
agguggagggggaagccugacuuggccaccuccccuccccacagccuuccucacccuuggcuggc

SEQ ID NO: 115141 - RNA, 65 nt, hsa
aucccaucuuuuccuucggcagauugcagccccauuccccacaaugcauccagaaaucgcugugc

SEQ ID NO: 115142 - RNA, 65 nt, hsa
aacucuagcccugaagucacgccuuggcccugacauccccacaugcccgcagagauccucuuuga

SEQ ID NO: 115143 - RNA, 65 nt, hsa
gugacggaggaaacagacauggggagggugaacaguccccacagcagacagcuacuugggcauga

SEQ ID NO: 115144 - RNA, 65 nt, hsa
agcucccagagagacugccuucccuacacuagaaguccccacaaaggcuucugagaccacaaaau

SEQ ID NO: 115145 - RNA, 65 nt, hsa
ccugcaaaccaacaggugcauggugaguguggcaguccccacagcuccacaaugggcucccccgc

SEQ ID NO: 115146 - RNA, 65 nt, hsa
ugaaaagagggugcagaguccaggccagauagucuuccccacacacuuucaucucguuuccucca

SEQ ID NO: 115147 - RNA, 65 nt, hsa
uucccuccccuuccuccaaaacccucccucccaccuccccacacccauugagucauucacaggca

SEQ ID NO: 115148 - RNA, 65 nt, hsa
cucucaucauauuugcaacucuucucucucuuucuuccccacacccaagaggaggauugguggua

SEQ ID NO: 115149 - RNA, 65 nt, hsa
aauugaaguuggguuggcucuuugugaaccucucauccccacagcagaaucaccaacacucuccg

SEQ ID NO: 115150 - RNA, 65 nt, hsa
acugugcuguauugcugcugaacuaaaugcacuuuuccccacauauggggcacuggcuucaaaca

SEQ ID NO: 115151 - RNA, 65 nt, hsa
acucugaccacacagaaccagggcugccccuguaauccccacaguaagaaaguuguauggcauau

SEQ ID NO: 115152 - RNA, 65 nt, hsa
uuucucgaaggugcuuggcggucuugccuucccccuccccacaggcucuccuuguggggucccag

SEQ ID NO: 115153 - RNA, 65 nt, hsa
caggcggacuagccuggcuggaccaugaggcugucuccccacagcuuuauccaagccuccaaggu

SEQ ID NO: 115154 - RNA, 65 nt, hsa
augggucuuugugggggaaggcccuggcuuuguauuccccacaaguagcacugaguuucuuagga

SEQ ID NO: 115155 - RNA, 65 nt, hsa
uuucuaggaauguauccugaggaaauuauccgagauccccacaaacugcaauguuuaggaauugu

SEQ ID NO: 115156 - RNA, 65 nt, hsa
ucccacauugugucaagucugcccauggcccacccuccccacaguccaaaaccacacagcccugg

SEQ ID NO: 115157 - RNA, 65 nt, hsa
gccagccuggaggaggaaagggagccugcucucccuccccacaccccacccaaagcauacaccgc

SEQ ID NO: 115158 - RNA, 65 nt, hsa
uuuaaaacaacaaaaagggagggcguugacaccauuccccacagagauagucaugcugagugugg

SEQ ID NO: 115159 - RNA, 65 nt, hsa
gcauggagaaugggugcaaaaagcugacuucuguauccccacacuuggauuaggguuucccuccu

SEQ ID NO: 115160 - RNA, 65 nt, hsa
cguagccucuaucucguauuuuuuucuauuucuccuccccacaccaucaaugggacuauucuguu

SEQ ID NO: 115161 - RNA, 65 nt, hsa
ugggaauggggagcaagucacgucagcucugucauuccccacaguuaacaaauuggcgggguggg

SEQ ID NO: 115162 - RNA, 65 nt, hsa
gagucuuaucguuguacugauagaagggucagauauccccacauggaguugagugggagaaagag

SEQ ID NO: 115163 - RNA, 65 nt, hsa
accuaaaauaucaucuugaauuguaaucccuauaauccccacaucaagggagagaucagguggag

SEQ ID NO: 115164 - RNA, 64 nt, hsa
gggcccccgagccccgauaggugcugccuggcccuccccacaaugccagaccgcagagaggcuc

SEQ ID NO: 115165 - RNA, 65 nt, hsa
agacuugggaccuuccugaacuuggggccuaucacuccccacaguggaugccuuagaagggagag

SEQ ID NO: 115166 - RNA, 65 nt, hsa
uauuccacuuacuccaccuuccauuccucgcccuguccccacagccgaguccugcaucagcccuu

SEQ ID NO: 115167 - RNA, 65 nt, hsa
ggugaagggguaggaggagggcccucagcuggcccuccccacacacaggacggcaggggcacugu

SEQ ID NO: 115168 - RNA, 65 nt, hsa
cggcguggcugugcuuccuggggaaaugaacccccuccccacagacaccacccuggguggaucga

SEQ ID NO: 115169 - RNA, 65 nt, hsa
ccuccaugauuugggaaccagcuuaggcaaaagaguccccacaagaugaaaauaaagauccuagu

SEQ ID NO: 115170 - RNA, 65 nt, hsa
cagguaggaaacauucacagaugaagacagcagauuccccacauucucaucuuuggccuguucaa

SEQ ID NO: 115171 - RNA, 65 nt, hsa
caucaggguucucuuagcaacucagagaaaaaugcuccccacagcgucccuggcgcaggugggcu

SEQ ID NO: 115172 - RNA, 65 nt, hsa
auuccaugacuucccaccgcgcccucgcuccuaccuccccacaccucucucugaguccccaggaa

SEQ ID NO: 115173 - RNA, 65 nt, hsa
aaagcaaugugagucccagagcccgcuuuuguucuuccccacaauuccauuacuaagaaacacau

SEQ ID NO: 115174 - RNA, 65 nt, hsa
uuuccagggccccacacucacaaaggcuccaggccuccccacagaggacccugccugagcaaggg

SEQ ID NO: 115175 - RNA, 65 nt, hsa
aaauccccuggacuuucacuaacccucugacauacuccccacacccaguugauggcuuuccguaa

SEQ ID NO: 115176 - RNA, 65 nt, hsa
acugguaccugggggccugaauucuggcccccggcuccccacacagcugggacuggccuggaugg

SEQ ID NO: 115177 - RNA, 65 nt, hsa
aggguuggggcagucccaugaccccaugucccagcuccccacacagcgcugggccagagaggcau

SEQ ID NO: 115178 - RNA, 65 nt, hsa
agcugucccacagcggucgggccugggccguuaucuccccacaacccccagccaaucaggacuuu

SEQ ID NO: 115179 - RNA, 65 nt, hsa
agcagcugcuucggauccacacuguaucugugucauccccacauggguccucauaaaggauuauu

SEQ ID NO: 115180 - RNA, 65 nt, hsa
ggguuuggaccauuccccccacucccuacccuuaauccccacaugggaagaagcuaucaucacag

SEQ ID NO: 115181 - RNA, 65 nt, hsa
uguacccucaacugccuccuuuuugcagagaacgauccccacaggaacuggucuaagaacacugu

SEQ ID NO: 115182 - RNA, 65 nt, hsa
gugggcacucaccucagcagagccucaaugccaccuccccacaccacccaagccuagcugggugg

SEQ ID NO: 115183 - RNA, 65 nt, hsa
ccauaagggcuggcggcuuccuccgacgccgccccuccccacagcuucucgacugcaguggggcg

SEQ ID NO: 115184 - RNA, 65 nt, hsa
gccacccaaccuaaauguacuuaucuguccccauguccccacaccagccuguuuucauaauaaac

SEQ ID NO: 115185 - RNA, 65 nt, hsa
cuugcucucaguagcgucagccccaguucugagccuccccacauuacacuuaacaagcaguaaag

SEQ ID NO: 115186 - RNA, 65 nt, hsa
ccagguccucuuacauuugacauaagcaauuuaccuccccacauuuccaggaccucuaugacacu

SEQ ID NO: 115187 - RNA, 65 nt, hsa
acaccccaaagagaagaaggggacucuggauaggguccccacauccagggcguggggagaccauu

SEQ ID NO: 115188 - RNA, 63 nt, hsa
gugaagccagaagccaaauaaacucaaaagcugucuccccacauguagccugucaccuuucuu

SEQ ID NO: 115189 - RNA, 65 nt, hsa
gcucccuauacuuuucugucuuccagguucuacccuccccacagaccuaagcugcucccagucuc

SEQ ID NO: 115190 - RNA, 65 nt, hsa
ggucagggucuucuugcgacccggcccgcuccagauccccacagcucucggccgcggacccgggc

SEQ ID NO: 115191 - RNA, 65 nt, hsa
acacccuccuguguacccccccagggucaccgaaguccccacacgcuggcucuccacaccccucc

SEQ ID NO: 115192 - RNA, 65 nt, hsa
cagccagauccggacccuucccuuaggguccagucuccccacaccccagcagggugucuucuagc

SEQ ID NO: 115193 - RNA, 65 nt, hsa
auuuugugccauuucugggagcauuuacagaugaauccccacacuuagccauugaauguaaaggg

SEQ ID NO: 115194 - RNA, 65 nt, hsa
augcgugggggcacuacuaagaaugcuaaacuuaguccccacaacaaagaaucauccugucccau

SEQ ID NO: 115195 - RNA, 65 nt, hsa
uaacguggcucuugcccaauaccaaaucgccgcuuuccccacaagcccuucuuccuguaucaaga

SEQ ID NO: 115196 - RNA, 65 nt, hsa
ugugaaugagagaacagucaggcagggagcccuucuccccacagagcuuucaggagcagacagug

SEQ ID NO: 115197 - RNA, 65 nt, hsa
cuucugccccugcccuuccucacacugacacuuuguccccacaugggguggggagcagagugccc

SEQ ID NO: 115198 - RNA, 65 nt, hsa
ucguguugcagauggcagccuuuucuccuucauuuuccccacauuuucucuggcccucuaccuug

SEQ ID NO: 115199 - RNA, 65 nt, hsa
caaagaacugccccaucuccucccauggccuucccuccccacaguccucacagccucucccuuaa

SEQ ID NO: 115200 - RNA, 65 nt, hsa
gcgcgcccccucugcaauguaugccccuugccccuuccccacacuaauaauuuauauauauaaau

SEQ ID NO: 115201 - RNA, 65 nt, hsa
accaauguuccaaauccuuuagggagaugaggguauccccacagaaaaagaggaauaauagacca

SEQ ID NO: 115202 - RNA, 65 nt, hsa
auuuaauugugauuuuaucaccuuucccauuucuuuccccacaagcuggcauuucaguaguugcu

SEQ ID NO: 115203 - RNA, 65 nt, hsa
gcccccagcugccuccucacaucugcccuggggacuccccacacuccggggcagaucuuuccucu

SEQ ID NO: 115204 - RNA, 65 nt, hsa
uugggucuaaucuuuccccuugacccagaacuuccuccccacaaaaaugccuuuaaaaaccuucc

SEQ ID NO: 115205 - RNA, 65 nt, hsa
gugauucucuuuucuuaguggaguggaauguucuauccccacaagaaggauuauaucuuauagac

SEQ ID NO: 115206 - RNA, 65 nt, hsa
acugcuuucuaauggggagggcugagggcucccuguccccacagcagguauguugggcucugccc

SEQ ID NO: 115207 - RNA, 65 nt, hsa
cccuguuuucucuccuaacaugcugagauucugcauccccacagccuaaacugagccaguggcca

SEQ ID NO: 115208 - RNA, 65 nt, hsa
gggccuccguccccagguccccaguggggcagcccuccccacagacgagccccccacauggugcc

SEQ ID NO: 115209 - RNA, 65 nt, hsa
gguuauccuuacuugaguccauauggguuggacaguccccacacacauuaaauucuguaaaugaa

SEQ ID NO: 115210 - RNA, 54 nt, hsa
uuuaugguuucggcgguugagcuguccccacagcuucucuacagacuccaaaag

SEQ ID NO: 115211 - RNA, 65 nt, hsa
ucacuuccuucagcaucucacuucuucuucuagaauccccacagggaaauacuguauugaauauu

SEQ ID NO: 115212 - RNA, 65 nt, hsa
aggaaagcuaagucuugucucauuuaggacuggguuccccacagugacagucacuuccuucagca

SEQ ID NO: 115213 - RNA, 65 nt, hsa
acauguagaguuuguucagcuauuuuccagauaucuccccacaaaaggaggcaaaggguaccagc

SEQ ID NO: 115214 - RNA, 65 nt, hsa
guugcuguccucuuggcaucugaguccuuucccuguccccacaagcccuucuacucccuguuugc

SEQ ID NO: 115215 - RNA, 65 nt, hsa
acgcauccauccuuggguccacugguccccauucuuccccacagacuuccuuugcuucucuuuuc

SEQ ID NO: 115216 - RNA, 65 nt, hsa
uuaauauuugacauguuugguguucucugaccuguuccccacacuggggauuccuggucuguaac

SEQ ID NO: 115217 - RNA, 65 nt, hsa
ggaaaggaaugcugacuuucucuuucuuucucuuguccccacacccauucccaacccaauacugg

SEQ ID NO: 115218 - RNA, 65 nt, hsa
agguggcugggaggguuuccaggcccccugccccuuccccacaaacugggugauagggcggacuu

SEQ ID NO: 115219 - RNA, 65 nt, hsa
gccugugccagcucccuucccuccccguuguccuguccccacagccauucugggagcuggggaac

SEQ ID NO: 115220 - RNA, 65 nt, hsa
gaggaggcugcagaagcaauggagugaaccucugcuccccacacagcuggcuacacugcucaggc

SEQ ID NO: 115221 - RNA, 65 nt, hsa
ccccucguccacccaccccuggcuggcagccucccuccccacacccgccccugugcucugcuguc

SEQ ID NO: 115222 - RNA, 65 nt, hsa
caggcccuguccagcccccagugcgcucguuccgguccccacagacugccccagccaacgagauu

SEQ ID NO: 115223 - RNA, 65 nt, hsa
cacgccgugugucacgggcuagggcggcguguucauccccacaccgugugucacaacaggcuagg

SEQ ID NO: 115224 - RNA, 65 nt, hsa
ugccgcauagugcauaggcugaaaugucucaagauuccccacacuacauaucaguauuuucuauc

SEQ ID NO: 115225 - RNA, 65 nt, hsa
cagaggcucgaggggcucagggccucaggcacccguccccacacgagggccccgugggugggccu

SEQ ID NO: 115226 - RNA, 65 nt, hsa
gucccauccccacguccccucaucccgucaccucguccccacauccccuugccccgucaccucgu

SEQ ID NO: 115227 - RNA, 65 nt, hsa
uccucauccccacguccucucguccccuugucccguccccacauacccucguccccaugucccca

SEQ ID NO: 115228 - RNA, 65 nt, hsa
gaagcagagcagaugauucgagcagcauuuguuucuccccacaucuagaaauuguaguucauaug

SEQ ID NO: 115229 - RNA, 65 nt, hsa
ucccaaaagcacacaagcacauacagacauaugcauccccacacacgccuaugcacaaacgugga

SEQ ID NO: 115230 - RNA, 65 nt, hsa
uucauugaugaccauaucuccagggauguuguugauccccacacugccuuaagguauauuauaga

SEQ ID NO: 115231 - RNA, 65 nt, hsa
caaggcccagaccuggccucugccauccucccuguuccccacagguccuccaucaccccuggugg

SEQ ID NO: 115232 - RNA, 65 nt, hsa
uggcaccacgacugagggcucccggcucggcuucuuccccacagcaggcugcucagagggggugc

SEQ ID NO: 115233 - RNA, 65 nt, hsa
cugugcaauguuuuaaguucacaaguuccugcuccuccccacacugagcuccuuuguuccucccc

SEQ ID NO: 115234 - RNA, 65 nt, hsa
gaguuugaagguucucggaaagaccggagggcuucuccccacagaaggcggagagagcuggggcu

SEQ ID NO: 115235 - RNA, 65 nt, hsa
caccccacuuccagcagaguccugccuccucccaauccccacagacacacacauugauccuccuc

SEQ ID NO: 115236 - RNA, 65 nt, hsa
guuuggccucagaacuccauguuuguuucucucuauccccacagaagucuacagguaaggaaauc

SEQ ID NO: 115237 - RNA, 65 nt, hsa
guguucuucaugagaguacuagccuccuccacuccuccccacagcgcagaggaaacaggccagcc

SEQ ID NO: 115238 - RNA, 65 nt, hsa
ggcgagaugagcuggcgcagccccgcccuccauccuccccacaucccugcagccaccucccagca

SEQ ID NO: 115239 - RNA, 65 nt, hsa
cacaucccauacccucuucucccuacccaucccauuccccacaggcccuacauuaacaagguuaa

SEQ ID NO: 115240 - RNA, 65 nt, hsa
ggaaguagggauauuuuuauaaaacaauuguguccuccccacauuuugcuauguuaauauuugcu

SEQ ID NO: 115241 - RNA, 65 nt, hsa
gagaagugauaaacaccuccagcuuucuaacauccuccccacaccaucucaccauauccaucucc

SEQ ID NO: 115242 - RNA, 65 nt, hsa
uguucuggaaucuuaugcccaggguuuuucacuucuccccacaucucccuuuccacuugccagug

SEQ ID NO: 115243 - RNA, 65 nt, hsa
caccguguguccuccccuccccucccuuccucuccuccccacaggcggaauugcuuucuucugag

SEQ ID NO: 115244 - RNA, 65 nt, hsa
ccaucagcccggacagugggaacuaacuggugcauuccccacacuuaccuuccgguggguugcug

SEQ ID NO: 115245 - RNA, 65 nt, hsa
cccccacccugccuggugugcagcuaaccccucccuccccacagccagaggaggccacagacccc

SEQ ID NO: 115246 - RNA, 65 nt, hsa
agaggcuguucuggaaggcuucuugucuucugacguccccacagcccugggccccucgugucucu

SEQ ID NO: 115247 - RNA, 65 nt, hsa
auguggucuauacuauacugugguuuguuuuccuguccccacaucugagugaaggucuugcucuu

SEQ ID NO: 115248 - RNA, 65 nt, hsa
aguucucggaaccuccucccuaauucucccuuccuuccccacaaggccuuugagguugugacugu

SEQ ID NO: 115249 - RNA, 65 nt, hsa
cccccugccucuagcaccucuucugucccugucauuccccacacacguccuguucaccucgagag

SEQ ID NO: 115250 - RNA, 65 nt, hsa
gcaaaggcaaaacaagcccugauaagcaaaagcaguccccacagccacagccuggcagcucugau

SEQ ID NO: 115251 - RNA, 65 nt, hsa
accagaaucccugauguuaaugggcucugcccucauccccacagucuugggaucucagggcacaa

SEQ ID NO: 115252 - RNA, 65 nt, hsa
agauuggaaguugaaauggcugagauuuggugaucuccccacagcuggcucugcaaguuaccucu

SEQ ID NO: 115253 - RNA, 65 nt, hsa
cuucuauuucuuauggggccaucuuggccucaccauccccacacgugccgaugucagguucauug

SEQ ID NO: 115254 - RNA, 65 nt, hsa
agacacucacuauuuucaugaacaguuacccucuguccccacaaccaaagacaacucauggccuc

SEQ ID NO: 115255 - RNA, 65 nt, hsa
cuugggcucccaggacaggugaacagggagggaccuccccacaccuacuccaaagaacagcugga

SEQ ID NO: 115256 - RNA, 65 nt, hsa
ggugaaaagguacaauagugcuugucuccgauagcuccccacaucucuaauugacuuccacaaaa

SEQ ID NO: 115257 - RNA, 65 nt, hsa
cauaaaguggcagggagauacaauaucacaccccuuccccacaaggacugugaauauugggauuu

SEQ ID NO: 115258 - RNA, 65 nt, hsa
gaauggggcacuccaacaccccucagggaccacccuccccacaguaugcacucagccccacagaa

SEQ ID NO: 115259 - RNA, 65 nt, hsa
ggauuggaacuaucauggucacugcuccucuccccuccccacaaaaggaaaaaaaagcuggauuu

SEQ ID NO: 115260 - RNA, 65 nt, hsa
ccugggccucucucccgcccagcauccucccugaguccccacacagggccucacucugcacccca

SEQ ID NO: 115261 - RNA, 65 nt, hsa
aucgugggcacgggcagggcucagccgcucccaccuccccacagaagcccaggaguguguggacg

SEQ ID NO: 115262 - RNA, 65 nt, hsa
ccuguucucggcagcuucugucgcuggcccugggguccccacagcugcagcucuccugugagguu

SEQ ID NO: 115263 - RNA, 65 nt, hsa
ucagcgcauggucgugcggcaugcccgccgccugcuccccacacggacuccaggcgguccccacc

SEQ ID NO: 115264 - RNA, 65 nt, hsa
ucaccugcuguuuaauagacuuggggccaugugccuccccacacaugggcaaggacagguggaau

SEQ ID NO: 115265 - RNA, 65 nt, hsa
ccugggugugcaccugcuccgggggguggaggugcuccccacaguccgggccaggacagccucag

SEQ ID NO: 115266 - RNA, 65 nt, hsa
ggaaccugggggcaccucguucacccuguccccacuccccacaguuuuaggaucuaaaugauugc

SEQ ID NO: 115267 - RNA, 58 nt, hsa
uggaggugaugcugaagugagcagccccuccccacaccaguugaacugcaggaagaga

SEQ ID NO: 115268 - RNA, 65 nt, hsa
gcugaaaucagccauagcaguugacaaaacagcuauccccacaagugaugagauagucccuuuac

SEQ ID NO: 115269 - RNA, 65 nt, hsa
uaaaggucucaucccacaaccccugacuuccucccuccccacaucaugaaggcagaggcaugcac

SEQ ID NO: 115270 - RNA, 65 nt, hsa
uggcgacagcggggaaaugagggcugaaaauauccuccccacaagggcaauccccgggaccugcc

SEQ ID NO: 115271 - RNA, 65 nt, hsa
cucagaagugcgccgccaugcugccuaggguacuguccccacaucugucccaacccagcuggagg

SEQ ID NO: 115272 - RNA, 65 nt, hsa
aggccuccccgaggcagaaguugccugguccucuguccccacagugaccugacugggggugaggg

SEQ ID NO: 115273 - RNA, 65 nt, hsa
cugccaacugagcccgcggcucccuccgacccugcuccccacagagccucaguaaacccauggaa

SEQ ID NO: 115274 - RNA, 65 nt, hsa
acugcgcccggccauggaccuggcugucuuuaucauccccacaaacauuuugaaacuggaauauu

SEQ ID NO: 115275 - RNA, 65 nt, hsa
ucggcacugcccccggccuuccaugagaagccgacuccccacaccgaguuuuaaagcaaagcccu

SEQ ID NO: 115276 - RNA, 65 nt, hsa
cacgcccgagaaagccugggggacccagacaccuguccccacagucaaagccuggggacccagac

SEQ ID NO: 115277 - RNA, 65 nt, hsa
ccccacagucaaagccuggggacccagacauccuguccccacagucagccuccugucccugcugg

SEQ ID NO: 115278 - RNA, 65 nt, hsa
agagcccugggcuggaggcugagcugcaucccugcuccccacauggaggacccaacaggaggccg

SEQ ID NO: 115279 - RNA, 65 nt, hsa
caacaaagaggggaugaaucacccuuggcccagccuccccacaaagccugacccugggcagguga

SEQ ID NO: 115280 - RNA, 65 nt, hsa
gaccacaccccaaucucagagcuaacauccacacuuccccacauuuccugcuugccaguaaagcc

SEQ ID NO: 115281 - RNA, 65 nt, hsa
cugaguggucaggagccaguuucuccagccccuccuccccacaaccccuaguggggaggggcagc

SEQ ID NO: 115282 - RNA, 65 nt, hsa
uugcggcugcuggcaggacugagcuguccggguucuccccacacuuccagcacagcugugcucug

SEQ ID NO: 115283 - RNA, 65 nt, hsa
gugcugguggacagugccccucccaccuuccuucuuccccacaacagaagagaccagcgacuccc

SEQ ID NO: 115284 - RNA, 65 nt, hsa
aagcacucugaaaccaagaccuucccauuuccuccuccccacauggugcugaggcucccugcugc

SEQ ID NO: 115285 - RNA, 65 nt, hsa
aagccucagagcagccaagucauugguguucauuuuccccacagugauuuuuguaacuucucuuu

SEQ ID NO: 115286 - RNA, 65 nt, hsa
agccauucuggacaccaggggaccuggacggaggguccccacagcccgugccccacgccgccugg

SEQ ID NO: 115287 - RNA, 65 nt, hsa
uggucuugaagccucuggugcuguuucaaccuccauccccacaggaggguggaacucccauucuc

SEQ ID NO: 115288 - RNA, 65 nt, hsa
uuagaggguaguauaaaugagcacagugcacauuguccccacacaccugaauuuucagucacugg

SEQ ID NO: 115289 - RNA, 65 nt, hsa
cuagaucugccucuguuuugcuggucaaaaccucuuccccacaagccagauuguuucugaggaga

SEQ ID NO: 115290 - RNA, 65 nt, hsa
gucucuaggucuguucuucuucccuagcauccuccuccccacaucuccuuucacccucuuggcuu

SEQ ID NO: 115291 - RNA, 65 nt, hsa
ucuaugccuuggagcuccugacugcagggacucuguccccacacucaaaaagacucagcucacuc

SEQ ID NO: 115292 - RNA, 65 nt, hsa
gagccucccucugacacagaggagguggcuccccuuccccacaccuuagaguggcugggagggua

SEQ ID NO: 115293 - RNA, 65 nt, hsa
ccucccucuccauaucuccuuccccuacaccucccuccccacaccucccuacuccccugggcauc

SEQ ID NO: 115294 - RNA, 65 nt, hsa
uuuauuuuugugucugugaaagugccaagaaccccuccccacauuuguagauccaugacccuuuu

SEQ ID NO: 115295 - RNA, 65 nt, hsa
ucagcucagagagcaccaucccgggggucagggccuccccacaggagcccugcagugugguagcg

SEQ ID NO: 115296 - RNA, 65 nt, hsa
cuccacuccggaucgaggccuguauagggcucguuuccccacacaugccuauuucugaagaggcu

SEQ ID NO: 115297 - RNA, 65 nt, hsa
acuuuaacaccagguuuauggaaaaugucaggccuuccccacaacuccugucuaacugcugucgc

SEQ ID NO: 115298 - RNA, 65 nt, hsa
ggccugcccucagccccacuccuguucugcaacuguccccacaggaaggggcucuguucccugua

SEQ ID NO: 115299 - RNA, 65 nt, hsa
uaagggauaaaggccuuuuacagaagcuaaacccuuccccacaugugguagaaugugcucuucua

SEQ ID NO: 115300 - RNA, 65 nt, hsa
aucucagggaccaugaugucucagucacuccacgcuccccacaggccaacccuggcacaggucau

SEQ ID NO: 115301 - RNA, 65 nt, hsa
uccacggggcuccuuucccuccgaagggcugcucuuccccacaggcgcggggacagcagcccgac

SEQ ID NO: 115302 - RNA, 65 nt, hsa
cacacacaugcaggcggcguggucucccugcucuguccccacacguuccucacauacaggcaaga

SEQ ID NO: 115303 - RNA, 65 nt, hsa
aguacugaccucgucugucccuuccccuucaccgcuccccacagcuuugcaccccuuuccucccc

SEQ ID NO: 115304 - RNA, 65 nt, hsa
caaaauagcaccuuacaccccaucuuugacucaguuccccacacccaaagaucccagccuaggga

SEQ ID NO: 115305 - RNA, 56 nt, hsa
cccgagagaagaagcagugaccucucuccccacacccucaccugcacccuaggacc

SEQ ID NO: 115306 - RNA, 65 nt, hsa
cagccuggaaggaccagguucuuucacaccugcuguccccacagaucucucucgggcucacccug

SEQ ID NO: 115307 - RNA, 65 nt, hsa
agagaacacagaagaaaagcaauugccccagguccuccccacagucaagggagcucuuccuucca

SEQ ID NO: 115308 - RNA, 65 nt, hsa
gcccacaccaccugcgcaugccuggcacaccccucuccccacagagccucugcuugggucuaugu

SEQ ID NO: 115309 - RNA, 65 nt, hsa
ugccccuuugcccgccuccugcaaaccucacaggguccccacacaacagugcccuccagaagcag

SEQ ID NO: 115310 - RNA, 65 nt, hsa
gaggacagcugccuguuuccuccccaucagccuccuccccacauccccagcugccuggcuggguc

SEQ ID NO: 115311 - RNA, 65 nt, hsa
ggccccccugggggggcugccuuccccucagccucuccccacaccacccacccagcugcugucau

SEQ ID NO: 115312 - RNA, 65 nt, hsa
ggcugagauuuuucuaaauugaaaacacgccccccuccccacaccuccaggaacuccacucccag

SEQ ID NO: 115313 - RNA, 65 nt, hsa
ggccacucuccccaccacgucugugcccugcacuguccccacagccuuccacacccugugcauag

SEQ ID NO: 115314 - RNA, 65 nt, hsa
gauuucuccaauguguccugacaggucagcccugcuccccacagggccaggcuggcaggggccag

SEQ ID NO: 115315 - RNA, 65 nt, hsa
acccaggauccugaaauucuccuggccgcaagaacuccccacagaggcagaagagggucuccacc

SEQ ID NO: 115316 - RNA, 65 nt, hsa
agacuacugaccuucucaccuccacccauaccuucuccccacagccucugcugaugcacagagcu

SEQ ID NO: 115317 - RNA, 65 nt, hsa
gacccagccuucugggggugcuaugaggugauccguccccacacaugggaugggggaggcagaga

SEQ ID NO: 115318 - RNA, 65 nt, hsa
gugggggucucuaaagagagacugucaugggucauuccccacaagagccacauccucacaccuga

SEQ ID NO: 115319 - RNA, 65 nt, hsa
ugucccugagcccccuaguccuggcuccugcuuuuuccccacagcccguguucccagccgaacca

SEQ ID NO: 115320 - RNA, 65 nt, hsa
cuuggcggcaaagcccagccccuucucagaccagcuccccacauuccugaauuccacuuccaggc

SEQ ID NO: 115321 - RNA, 65 nt, hsa
gcugagaagggacguuuccaucauucacagugcccuccccacagcacuaccucaccccgaccccc

SEQ ID NO: 115322 - RNA, 65 nt, hsa
gcccuugaaaauccaauugguuucuguuauagcaguccccacaacaucaaagaaccaccacaagu

SEQ ID NO: 115323 - RNA, 65 nt, hsa
ccagucccauaaaccuggcccucuuuggggaaagauccccacagagcauccuccucucaucugug

SEQ ID NO: 115324 - RNA, 65 nt, hsa
cggcaccucagugggugggcagggcuuggucccccuccccacagcaagggaaggcagcuggcucu

SEQ ID NO: 115325 - RNA, 65 nt, hsa
gaggaggccggggcucccaggaagcggacgcccgguccccacacagcgccgcggccgccccucca

SEQ ID NO: 115326 - RNA, 65 nt, hsa
aggaggccggcuacugaggcucccagcacgcucucuccccacaucgucugcccaucuggguuuuu

SEQ ID NO: 115327 - RNA, 65 nt, hsa
gagcagagagcacccuggugugggggcgaguggguuccccacaaccccgcuucugugugauucug

SEQ ID NO: 115328 - RNA, 65 nt, hsa
cugccccucgagggggcccugccugccgcggggccuccccacaagccccucccaaagcgccggcc

SEQ ID NO: 115329 - RNA, 65 nt, hsa
ccacccugcugugcuugggaacccccacuccccacuccccacaucccaacauccuggugucuguc

SEQ ID NO: 115330 - RNA, 65 nt, hsa
gcaggggugacguauguagaaugcuuaggguguccuccccacagagcagauacuugaaccgacuc

SEQ ID NO: 115331 - RNA, 65 nt, hsa
ucacucauucugaguuaggaaaagacacaagaccuuccccacauccugucugccuggguuaggga

SEQ ID NO: 115332 - RNA, 65 nt, hsa
gagcagacuggggggcuguugccccucccuccaucuccccacacccaccccaccccacagcaggg

SEQ ID NO: 115333 - RNA, 65 nt, hsa
ugcacggggauggggggacaacuccuacccuucuuuccccacaugccccacuaaaccaucugaca

SEQ ID NO: 115334 - RNA, 65 nt, hsa
ccauggauaccucugugauucacgcugagcccaaguccccacacuggaaaacugggaaauggcca

SEQ ID NO: 115335 - RNA, 65 nt, hsa
agucugggggaggguccccaccuuccuguaccuccuccccacagcuugcuuuuguuguaccgucu

SEQ ID NO: 115336 - RNA, 65 nt, hsa
accagauucuuucccauucuguccaugaaucaucuuccccacacacaaucauucauaucuacuca

SEQ ID NO: 115337 - RNA, 65 nt, hsa
guggagcugugguuugacagcgcuggcucugcuucuccccacacacuuacauggcaaagguaaaa

SEQ ID NO: 115338 - RNA, 65 nt, hsa
ccuggagacccccagccaaacgggucagugucucauccccacauaacacaaaaagcagccugggg

SEQ ID NO: 115339 - RNA, 65 nt, hsa
ggcucccgugcacuagcuuguuacagcugccucuguccccacaugugggggcaccuucuccagua

SEQ ID NO: 115340 - RNA, 65 nt, hsa
gaacugcccagccugcuccuggcccccuggaagccuccccacagcugguaaucuggacuuaagga

SEQ ID NO: 115341 - RNA, 65 nt, hsa
cccauggcugggaggggccucugaacggaacaguguccccacagagcgaauaaagccaaggcuuc

SEQ ID NO: 115342 - RNA, 65 nt, hsa
ucccugagaaggugucaccuuaucuguccuccucuuccccacacacuggccucugggucccccuu

SEQ ID NO: 115343 - RNA, 65 nt, hsa
cagccuccuccuggaccucuuggcccccagccccuuccccacacagccccagaagggucccagag

SEQ ID NO: 115344 - RNA, 65 nt, hsa
aguuccagaaguucugaggcuggacaucggcccgcuccccacaaugaaauaaaguuauuuucuca

SEQ ID NO: 115345 - RNA, 65 nt, hsa
gucccagccaggaucccccuggaagaaaaagggcguccccacacucuaggugauaggacuuacgc

SEQ ID NO: 115346 - RNA, 65 nt, hsa
gcccaaaguugugcagagcgcuggggacuccagacuccccacagcagcagagacucgggacugag

SEQ ID NO: 115347 - RNA, 65 nt, hsa
caccuggcaggugcacaccaugugcaugagucacuuccccacagugcucagagaagcaaaccucu

SEQ ID NO: 115348 - RNA, 65 nt, hsa
cgcauccccugcuugccacuaugcgcaccaagguuuccccacauccuucccagcacccuuaggaa

SEQ ID NO: 115349 - RNA, 65 nt, hsa
ggaaacuguucccuggaaccacuccacucccugcauccccacacuucacagcaucuuccaucccc

SEQ ID NO: 115350 - RNA, 65 nt, hsa
uccaaggggacuauucccccgaccccaccccagucuccccacacggaccuuugcugaauuaaagu

SEQ ID NO: 115351 - RNA, 65 nt, hsa
agaaaaagagacaaauuacccagaaaccccucccuuccccacauggaggccuuggcaaauguuaa

SEQ ID NO: 115352 - RNA, 65 nt, hsa
cccuggggggggccaggcuccagagagggggcaccuccccacacaccccccccccaccgaggccu

SEQ ID NO: 115353 - RNA, 65 nt, hsa
ccuccugcccccucucccacuuuucccuuccucuuuccccacagccccccagccccucagcccuc

SEQ ID NO: 115354 - RNA, 65 nt, hsa
gugacguucgugauguccugcccgccgggagucuuuccccacaccccagccaucgccgcccgcuc

SEQ ID NO: 115355 - RNA, 65 nt, hsa
uuacgagcaagugccggcuggacccaagcccugcauccccacaugcggggcagaggcccuucucu

SEQ ID NO: 115356 - RNA, 65 nt, hsa
ucuccuucaagacccaacugagcacccgcucugauuccccacagccuuucucccugccaccacuc

SEQ ID NO: 115357 - RNA, 65 nt, hsa
ggugccagcuucgccaugccuggacccagacugaauccccacacccuuccugggaaacagauacg

SEQ ID NO: 115358 - RNA, 65 nt, hsa
cucucuugucucuucccugccuccucccuuuucccuccccacauuuuguauaaaacuuuaauuuc

SEQ ID NO: 115359 - RNA, 65 nt, hsa
uccccuucgaggauugcacccgcccguccuaagccuccccacaaggcgaggggaguuaccccuaa

SEQ ID NO: 115360 - RNA, 65 nt, hsa
cugccucuggcacccccuuucauugguuccauccauccccacaacagccugccaaucgaagcccg

SEQ ID NO: 115361 - RNA, 65 nt, hsa
ccgccaucucucugccccgccccgccccuccggccuccccacaccccccuugcccucacuaccug

SEQ ID NO: 115362 - RNA, 57 nt, hsa
gccuccauccuugggccugagagccccuccccacaacucaguguccuucaaauauac

SEQ ID NO: 115363 - RNA, 65 nt, hsa
cagcagucagggacagacauacauuucucauaccuuccccacaucugagagaugacagggaaaac

SEQ ID NO: 115364 - RNA, 65 nt, hsa
ucggaguuuacguguugcaccuuuucacagacgguuccccacagcauccucagacagcucuguga

SEQ ID NO: 115365 - RNA, 65 nt, hsa
ccugaguccugggaucagacaccccuucacguguauccccacacaaaugcaagcucaccaagguc

SEQ ID NO: 115366 - RNA, 65 nt, hsa
ucuggaaguguauugggcugaggugggauuuucccuccccacagugcacugagcaauggagggug

SEQ ID NO: 115367 - RNA, 65 nt, hsa
cugcucuguuugggugggagaagauucucuggggguccccacauccucccaaggcuccccucaca

SEQ ID NO: 115368 - RNA, 65 nt, hsa
aagcucagccugagagaaggagcuggcgagaaccuuccccacacucagcuccaaacgccuccucu

SEQ ID NO: 115369 - RNA, 65 nt, hsa
ucuggggucugugauggggaaggguggaugucccuuccccacaauaggcuuagugcuuggcucag

SEQ ID NO: 115370 - RNA, 65 nt, hsa
acacugucccugagugauccaggaggcugcccacauccccacaugugcacugugguuccagugua

SEQ ID NO: 115371 - RNA, 65 nt, hsa
uuguggccucagaauugaucauuuuccccccacucuccccacacuaaccuggguucccuuuccuu

SEQ ID NO: 115372 - RNA, 65 nt, hsa
acagcagcacgggccccacugugcugcucuucagguccccacagcccugccuuugguuccuggac

SEQ ID NO: 115373 - RNA, 65 nt, hsa
uuuucguugcaugugaugguucuguggacauaugauccccacaaacugugggagugauuggccag

SEQ ID NO: 115374 - RNA, 65 nt, hsa
guggguggacuuggaggaggaacggcaagggccgguccccacacucuugcuccuccugggcaucu

SEQ ID NO: 115375 - RNA, 65 nt, hsa
uuuacucucuuuuucuagccuguauaccaggcuuuuccccacauugucagguagagcaccagcuu

SEQ ID NO: 115376 - RNA, 65 nt, hsa
gaaacagacagaaaggguggaguaauuuguccaaguccccacagcuagaaagugccagagucgua

SEQ ID NO: 115377 - RNA, 65 nt, hsa
gauguuucugcaucaugucuaccagggagcaggguuccccacaguuucagaggugguccaggacc

SEQ ID NO: 115378 - RNA, 65 nt, hsa
ucacagaaauuugugaucugaaaacccggcucccuuccccacaaggcuccugggccuccgggaag

SEQ ID NO: 115379 - RNA, 65 nt, hsa
auucuugguucuuugagcucguuucagaggcugaguccccacaucagcuuuaguucuuggacuuc

SEQ ID NO: 115380 - RNA, 65 nt, hsa
uugaaucugucacucuuccacuagaaaccuuaguguccccacaugaggaaagcacuucauuaugu

SEQ ID NO: 115381 - RNA, 51 nt, hsa
ggcugaacgacuacgugugaguccccacagccugcuucuccccugggcugc

SEQ ID NO: 115382 - RNA, 65 nt, hsa
ccauaucuuagcucagagcacagaggagugccuuauccccacacuugacugggcuguggaggugg

SEQ ID NO: 115383 - RNA, 65 nt, hsa
cggaagcagguguguccagagucagcugagggcucuccccacaccacccagcaggcgcuggugcu

SEQ ID NO: 115384 - RNA, 65 nt, hsa
cccugggcaggaccagaggcccacauggaugccacuccccacacagcccccaggccugcccagcc

SEQ ID NO: 115385 - RNA, 65 nt, hsa
cagcccuuccuauuuccuuuccuauuuuuuuuuucuccccacacuuucuugggacucccaccuug

SEQ ID NO: 115386 - RNA, 65 nt, hsa
cacauugaucuaucuaaaccugguggggagaauuauccccacauugucucauggaaagacucaac

SEQ ID NO: 115387 - RNA, 65 nt, hsa
cucacggcugaguugcugcgccugcagacggaagcuccccacaggcagagcugcuuggaugugug

SEQ ID NO: 115388 - RNA, 65 nt, hsa
gggaccugugcuggccugugcucaacacgggccccuccccacagaaagcugcuccuggaugcccc

SEQ ID NO: 115389 - RNA, 65 nt, hsa
cuuguugccuuugagccagauccauggcaauggucuccccacagaccgcaggacugagccuggag

SEQ ID NO: 115390 - RNA, 65 nt, hsa
aaauuguccugcagagguucauuccccugacccuuuccccacauugguaagaguagcuggguuuu

SEQ ID NO: 115391 - RNA, 65 nt, hsa
uggcccccgaagaauggaacccacacccauagcucuccccacagcugauacggcauccugcgaga

SEQ ID NO: 115392 - RNA, 65 nt, hsa
caauauucuaguacuuucugaacauucuggaauccuccccacauucuagaauucucccaacauuu

SEQ ID NO: 115393 - RNA, 65 nt, hsa
gaccuggguauccccugccuccugccaccccuuccuccccacacuccacucugauucaccucuuc

SEQ ID NO: 115394 - RNA, 65 nt, hsa
gcaccccacgcccuguucacgcucacccagucaccuccccacaucgcacacuggggccccggguu

SEQ ID NO: 115395 - RNA, 65 nt, hsa
gugggugcuucuguugggcccaguggccccugcuauccccacagccucauuccugcagaagguuu

SEQ ID NO: 115396 - RNA, 65 nt, hsa
agcugaagguuggagaaaugccagcugcccuuucguccccacacuguggaggaagggaccugugg

SEQ ID NO: 115397 - RNA, 65 nt, hsa
ccagccucuagggaccccuccucccuuuuuccuuguccccacacuccuacaccuaacucaccuaa

SEQ ID NO: 115398 - RNA, 65 nt, hsa
uauuggcuuguguacaucuauaugcuaaaaugacuuccccacauugacauuugugcgccaccuuu

SEQ ID NO: 115399 - RNA, 65 nt, hsa
caaaaacagaaaacaaacaaacaaaaaacaaaaaauccccacaacuuugucaaauaauguacagg

SEQ ID NO: 115400 - RNA, 65 nt, hsa
agagccguauguacucagccuuuccuauugggccuuccccacaauuagaauauuuugacuuagug

SEQ ID NO: 115401 - RNA, 65 nt, hsa
guauucucuccauagaacagcacuaccuuccucucuccccacaugugacuacugagggcaguucu

SEQ ID NO: 115402 - RNA, 65 nt, hsa
ucaauacccuaccacagauccugccuccacccaguuccccacaaagcaccagagguaggagaccu

SEQ ID NO: 115403 - RNA, 65 nt, hsa
uguucagagaauuccucucauuaaggaaauauuuuuccccacaauugucugauguaugaguccuc

SEQ ID NO: 115404 - RNA, 65 nt, hsa
auucacgcuuaaacaaccaaccgguaaccaccacuuccccacaccgccgcccgguaauuauuugc

SEQ ID NO: 115405 - RNA, 64 nt, hsa
ugcucccccuucauucugaugccucccuggggaacaaggauaaugacuuugcaucugcaccugg

SEQ ID NO: 115406 - RNA, 64 nt, hsa
uuugcacgaacaugcaguuauugaagauuaggaucaaggauagacaagguauaguaguuaucuu

SEQ ID NO: 115407 - RNA, 64 nt, hsa
gggcaugugguauacugaagcaauacccguuagacaaggauauuuuacuucuuccagacaccag

SEQ ID NO: 115408 - RNA, 64 nt, hsa
cacugccaaguagaagugacucaaaacccucugacaaggauauucccuuggcuaugguccugcc

SEQ ID NO: 115409 - RNA, 64 nt, hsa
cauccagcaguuccuuaaauaaggucaccaaggacaaggauaucaaauaacuacuguucaaucu

SEQ ID NO: 115410 - RNA, 64 nt, hsa
ccaaauggugcuuaucuugauugaacauucagaacaaggauauuauuuucagugauuuugugag

SEQ ID NO: 115411 - RNA, 64 nt, hsa
gccuaguaggcugaagcuucaggacucugcaggucaaggauaugugaugagcaccggccuaagu

SEQ ID NO: 115412 - RNA, 64 nt, hsa
aaccaaaaggcuuucagaggugugaauggaucuccaaggauaaguguaacaguuggcaacaucc

SEQ ID NO: 115413 - RNA, 64 nt, hsa
guccucaugcuccucaguguccacacuucaaggccaaggauaguuucuuccucugacaugggga

SEQ ID NO: 115414 - RNA, 64 nt, hsa
uaaaugaauacuuuuacaaagucuacuuuuuguucaaggauaugcugacccauauaguuuacuc

SEQ ID NO: 115415 - RNA, 64 nt, hsa
auccuaaguguaaaucaguuauucuacccccuaccaaggauaucagccuguuuuuucccuuuuu

SEQ ID NO: 115416 - RNA, 64 nt, hsa
uauuaaaauuuacaaaaugucuuuuugaauguaucaaggauauauuuaguuugaguggaauuug

SEQ ID NO: 115417 - RNA, 64 nt, hsa
auuucauguaguauggcuaauacuauaguugaaccaaggauaugcauugauucuuugcuucgua

SEQ ID NO: 115418 - RNA, 64 nt, hsa
agccauugcccuggagaugaaauuaauggaggcucaaggauagaugagcucugaguuucucagu

SEQ ID NO: 115419 - RNA, 64 nt, hsa
uauuuucuccuuaaagcuccagccaaaaacuggacaaggauagagaggaggagggaagaacaaa

SEQ ID NO: 115420 - RNA, 64 nt, hsa
auggaaguuuaaauuuucucuaaaauuaaaaugccaaggauaaagcuggcugcuuccaggaggg

SEQ ID NO: 115421 - RNA, 64 nt, hsa
guauaauacgguauuauacccgcaugugcucuagcaaggauaccaaggcaagcauacauguagc

SEQ ID NO: 115422 - RNA, 64 nt, hsa
aucaaaugagccaucagugaggcagcaguuacuucaaggauaugauauguuaaugaauccaaag

SEQ ID NO: 115423 - RNA, 64 nt, hsa
gcuacaaguuagcucaagcaaugugacauuauuucaaggauaugugccagggaauucaggaacc

SEQ ID NO: 115424 - RNA, 64 nt, hsa
aagagaaaaaauauguguauaucauggaaaaagacaaggauauuuuaauaaaacauuacuuauu

SEQ ID NO: 115425 - RNA, 64 nt, hsa
gaagaaagaauaaauuucggcuguuuuaagccaccaaggauaauugguuacagcagcucuagga

SEQ ID NO: 115426 - RNA, 64 nt, hsa
guucuucagugaaaagcaggagaagagcccacugcaaggauagcucauuaggcacaugaccgau

SEQ ID NO: 115427 - RNA, 64 nt, hsa
uagauacaggcacugcucugaaaaccuggcuagccaaggauauucucagaauguuaucaccugu

SEQ ID NO: 115428 - RNA, 64 nt, hsa
ccccagaauauuuccucuugacuucuuuuuguaacaaggauaauuuagggauuuauaaaguugu

SEQ ID NO: 115429 - RNA, 64 nt, hsa
gcugagaaaauucuggaacuauggaucuugaccccaaggauauauuauuuuauuccaagaaaga

SEQ ID NO: 115430 - RNA, 64 nt, hsa
agcagacugguggcaugcccaguggcuuugggggcaaggauagaaaugccaucaggaaauagcu

SEQ ID NO: 115431 - RNA, 64 nt, hsa
auuaaaagguauacuuuaguagacauuuauaacucaaggauaccuucuuauuuaaucuuuucuu

SEQ ID NO: 115432 - RNA, 64 nt, hsa
auuuuuugauguuuauauuaguaacaaaauuauacaaggauagaaucucaucuagaaaaugcaa

SEQ ID NO: 115433 - RNA, 64 nt, hsa
uuuuuaaaugguugaaacuugaaggaaguucauucaaggauaaguuggaauaaagcacuauguu

SEQ ID NO: 115434 - RNA, 64 nt, hsa
ccuuuguggcuucgcugauuaaagagaguggcaccaaggauagcaaugucuggauuggccucca

SEQ ID NO: 115435 - RNA, 64 nt, hsa
aacuugacuuugaaauauuccuguuggucaugaucaaggauauuugaaaucacuacuguguuuu

SEQ ID NO: 115436 - RNA, 64 nt, hsa
aggucuacagguuuacauuuuucuguguuacacucaaggauaaaggcaaaaucaauuuuguaau

SEQ ID NO: 115437 - RNA, 64 nt, hsa
agucugucgggugggggcagaaaucaaaucagcccaaggauauaguuaggauuaauuacuuaau

SEQ ID NO: 115438 - RNA, 64 nt, hsa
gacaguuagaccccugggugggcccugccgugggcaaggauacccgguggcuucuggcaccugg

SEQ ID NO: 115439 - RNA, 64 nt, hsa
ccuuuccaauagccccaugaaaagaagcaucacccaaggauauuguaaaaaggauguaacaagg

SEQ ID NO: 115440 - RNA, 64 nt, hsa
cugaaguuauguaaaauaaaagcaucugauccuucaaggauaaaguugaggaucacaugguacg

SEQ ID NO: 115441 - RNA, 55 nt, hsa
gaaauaagucaaaaaauuaauacaccaaggauaucggcaccauuacacaaaaugc

SEQ ID NO: 115442 - RNA, 64 nt, hsa
agagcaaucuagaaucuuugagugcuuggcuuuccaaggauacugcggagacucuggccaagcu

SEQ ID NO: 115443 - RNA, 64 nt, hsa
aaaacaagguauauacuuuauuauuuuuugaaaacaaggauauugugaucaauuuuacccugua

SEQ ID NO: 115444 - RNA, 64 nt, hsa
gguugcauggcccacuuggagcugaggucucauacaaggauauuuggagugaaaugcuggccag

SEQ ID NO: 115445 - RNA, 64 nt, hsa
uaccuucuuuacaggagaggaaaggucuaaaucacaaggauagacauuuaucaaagaaguuaaa

SEQ ID NO: 115446 - RNA, 64 nt, hsa
uuucacuuuuguuauauagguuuaauccccaagccaaggauaguacuuaguauuucacuacacu

SEQ ID NO: 115447 - RNA, 64 nt, hsa
ucucccucuuucucucaagaauucaaaguaugagcaaggauaccaaaaaucacauccuacuaua

SEQ ID NO: 115448 - RNA, 64 nt, hsa
agagaaguuuccagcaaaacccucaucagcauuacaaggauauuugaacuccaugcuugauggu

SEQ ID NO: 115449 - RNA, 64 nt, hsa
uccuagaggagagauuaguaccuauucauuaacacaaggauacauaagagacuugccccuuuug

SEQ ID NO: 115450 - RNA, 64 nt, hsa
augugugucauucaugaaucucuauaaucaaggacaaggauaauucagucaugaaccuguuuuc

SEQ ID NO: 115451 - RNA, 64 nt, hsa
uggauuauauugcagcauauuuuacauuugaauacaaggauaauggguuuuaucaaaacaaaau

SEQ ID NO: 115452 - RNA, 64 nt, hsa
ccuggaucauauuccggggaucaucacaucaguccaaggauauaaaaaaauggaagauuaaaaa

SEQ ID NO: 115453 - RNA, 64 nt, hsa
uccauaucuugauggcuuuugggagcauuucacacaaggauauaaaaugcgguuuucuuaaaug

SEQ ID NO: 115454 - RNA, 64 nt, hsa
ucaguuuguaucaguuaauaggauguucauauuccaaggauauuaguuguuuuuuuaaucaucc

SEQ ID NO: 115455 - RNA, 64 nt, hsa
cacuggagccguaggaggcucuucaguugggccccaaggauaaggcuacugauuugauacuaaa

SEQ ID NO: 115456 - RNA, 64 nt, hsa
gucgcauaaccacuucuucuauccccuguacuuucaaggauaauuuaggcuacaugagauuuug

SEQ ID NO: 115457 - RNA, 64 nt, hsa
acguuaaaaaacaacaacagaucuagagauaccucaaggauaucauuuuugauuuuguguuaca

SEQ ID NO: 115458 - RNA, 64 nt, hsa
uuucuuuuuucacacaguaaaaauucuuaucauucaaggauauuggaaccacaggacuauuugg

SEQ ID NO: 115459 - RNA, 57 nt, hsa
uuaugacuggugacauuuaaagaauuacaaggauaaacacuaagaauguugcaguua

SEQ ID NO: 115460 - RNA, 64 nt, hsa
gagaucgcugauuggugacacaacuggcagaaaacaaggauaugcuuuggcaggggugugugug

SEQ ID NO: 115461 - RNA, 64 nt, hsa
ggcugaaggacaaauugaaauugucugccaauaccaaggauauucuuguauauuugaaaaauaa

SEQ ID NO: 115462 - RNA, 64 nt, hsa
cugacaaugguaccuauuagggaugagauacagacaaggauagcuaucugggacauuauuggca

SEQ ID NO: 115463 - RNA, 64 nt, hsa
uggagagcacuagaagugguuuccugauaacaagcaaggauaucagagcugggaaauucaugug

SEQ ID NO: 115464 - RNA, 64 nt, hsa
aaggugaccgcagggggccccagggcuggagccacaaggauacccucacuuugcaugaggagcu

SEQ ID NO: 115465 - RNA, 64 nt, hsa
uuaaggcauuggcuuuuaaauuaauacauauauccaaggauauguuauagcugcaguguuugaa

SEQ ID NO: 115466 - RNA, 64 nt, hsa
cacuucaaaacugguagaauauuuauucauaugacaaggauaccugaguaaaacuauccuuuuu

SEQ ID NO: 115467 - RNA, 64 nt, hsa
cugcgugacagaaacaccagcauauuugcaacgccaaggauauuggucuuaagugcaagagcac

SEQ ID NO: 115468 - RNA, 64 nt, hsa
uagguacucuugagagcaauucaaaucaugcugacaaggauacugauagaaaaagugauuucuu

SEQ ID NO: 115469 - RNA, 64 nt, hsa
uggagaauugugaauguauguacuguauugucaucaaggauacugucccuuauuugaaggcauc

SEQ ID NO: 115470 - RNA, 64 nt, hsa
acccuagauagugucacaugacaccguugucauccaaggauaauacagaccaacuaggcuacau

SEQ ID NO: 115471 - RNA, 64 nt, hsa
cuccuuuuccuuaccauaccacuuugacacgcuucaaggauauacugcagcuuuacugccuucc

SEQ ID NO: 115472 - RNA, 64 nt, hsa
aagacucccguuucucuuaaaauaaguaaaauuccaaggauauaugccccaacgaaugcugcug

SEQ ID NO: 115473 - RNA, 64 nt, hsa
agugaacauuucuccuaagauuauaaaaauaagacaaggauaucugcugucaaugauuuuauuc

SEQ ID NO: 115474 - RNA, 64 nt, hsa
aaaucuuuugguacuaccauuuggggaagccaagcaaggauaguaaauugaccagaacacaguu

SEQ ID NO: 115475 - RNA, 64 nt, hsa
gaauaaaaccuugucuuccauuacaauuaacagucaaggauaaaacaagcacgcgcacaaucaa

SEQ ID NO: 115476 - RNA, 59 nt, hsa
acuugcagaaagaaauauaaaugacauuucaaggauagaaguauaccugauuuuuuuuc

SEQ ID NO: 115477 - RNA, 64 nt, hsa
cuuuuccauauuacugugaacuuucaacuacuaucaaggauaauaaauuugacauuauuucuuu

SEQ ID NO: 115478 - RNA, 64 nt, hsa
gagagaaagacgaagggagagagaaagcaguuuccaaggauauguuucaugucccaccauuuuc

SEQ ID NO: 115479 - RNA, 64 nt, hsa
auuuuaaaauacauuauccuuguaauguauuuuacaaggauaauguauuuuaaaaugggaguug

SEQ ID NO: 115480 - RNA, 64 nt, hsa
ccacauuuggguuaacuccucagauuuggaguggcaaggauaaaagugagggcagaaguagcug

SEQ ID NO: 115481 - RNA, 64 nt, hsa
aagucguccaguagaaaugcaucuaugaggucagcaaggauaugaugagauuuugcucacaguc

SEQ ID NO: 115482 - RNA, 64 nt, hsa
aaaccuucuaccuccuaccuacuuuucucugggacaaggauaaaggaauaugauuuuccagagc

SEQ ID NO: 115483 - RNA, 64 nt, hsa
auacugcguuccuuauaggucuuacaugcauaugcaaggauauuuuaucuuauucauucauuuc

SEQ ID NO: 115484 - RNA, 64 nt, hsa
cauucagaccuguugcuaacaaauuuauauuugccaaggauauuaggcaaaagaggcuacuuga

SEQ ID NO: 115485 - RNA, 64 nt, hsa
uucgcaccaacucaaugaacaagcugaagaaauccaaggauacagucucagaggacaccauuag

SEQ ID NO: 115486 - RNA, 64 nt, hsa
auaacuucucuuuggcuuuucuucaucuguaaaacaaggauaauacugaacuguaaggguuagu

SEQ ID NO: 115487 - RNA, 64 nt, hsa
aaaaguauuucucugucaguuccccacucuauaccaaggauauuauuaaaacuagaaaugacug

SEQ ID NO: 115488 - RNA, 64 nt, hsa
accucaaaaaaaaaaaaaagaauccaauacugcccaaggauagguauuuuauagaugggcaacu

SEQ ID NO: 115489 - RNA, 64 nt, hsa
ugcacuuugcucaaaauuuuaaaaauaccaaucacaaggauaauagaguagccuaaaauuacua

SEQ ID NO: 115490 - RNA, 62 nt, hsa
uuuuacaguacaaauggugaugaucaucaggucaaggauagucuggagcaauugagauguca

SEQ ID NO: 115491 - RNA, 64 nt, hsa
auaugcaaauugcaagauuuaaaccauucugaugcaaggauaaaccuuuacuuugacuaccagc

SEQ ID NO: 115492 - RNA, 64 nt, hsa
uguugugcaaaguucaguuucuucucagcaacaucaaggauauaugaagaaaaggaaauaaaaa

SEQ ID NO: 115493 - RNA, 64 nt, hsa
aaaauagauaaaguauaaaguaguacggcuguugcaaggauauuuuuaaaugcuuucaaaucug

SEQ ID NO: 115494 - RNA, 64 nt, hsa
cauguucguggugcugaaugccucucagcaucaucaaggauaacugaaacugggucucccuggg

SEQ ID NO: 115495 - RNA, 64 nt, hsa
cacacacacacacacaccccuucuugaauggcuccaaggauacccuuuuaacuucuucccuuca

SEQ ID NO: 115496 - RNA, 64 nt, hsa
aucuuccuaaucuguuaauggucagugguguccccaaggauagugcuggcuuccauggaaaccc

SEQ ID NO: 115497 - RNA, 64 nt, hsa
accacugagcucacugcccaugauucagagcuuucaaggauaggcuuuauucugcaagcaauac

SEQ ID NO: 115498 - RNA, 64 nt, hsa
accacugagcucacugcccaugaugcagagcuuucaaggauaggcuuuauucugcaagcaauca

SEQ ID NO: 115499 - RNA, 64 nt, hsa
gaacuguuuugaauaaggauuuaaaauaccugcacaaggauagagagaaacuaugugacucauu

SEQ ID NO: 115500 - RNA, 64 nt, hsa
caggaacucugcuuccuggcccagcgcucgugaccaaggauacaccaaagcccuuaagaccuca

SEQ ID NO: 115501 - RNA, 64 nt, hsa
aauaguucuggccagaaucaaagauucagcccuacaaggauauguuuuccugugaaauuaucua

SEQ ID NO: 115502 - RNA, 64 nt, hsa
ccucuacuagguggcugugauuaaaugucccaagcaaggauagggaaggggaaugguugagccu

SEQ ID NO: 115503 - RNA, 64 nt, hsa
aaaacugaagcuuuuuauuuaggcuuuuccaaaucaaggauaaauaucuuacgcacgauaucua

SEQ ID NO: 115504 - RNA, 64 nt, hsa
cuaacagacggucacaaccagugccauggaaaaccaaggauauuagcaaaagcagaaguugcua

SEQ ID NO: 115505 - RNA, 64 nt, hsa
ggggagcacacagggcccggcagcccccaggaaucaaggauagggcuaagguuuucaccuuaac

SEQ ID NO: 115506 - RNA, 64 nt, hsa
gaagcuggaaaccaucauucugagcaaacuaucgcaaggauagaaaaccaaacacugcauauuc

SEQ ID NO: 115507 - RNA, 64 nt, hsa
aaaugguuucugaaaauguuuaaguauuaacuuacaaggauauagguuuuucucauguaucuuu

SEQ ID NO: 115508 - RNA, 64 nt, hsa
cccaagggccagcucaguuuauccuucggagagacaaggauaugcaugauucuuaaccaggcua

SEQ ID NO: 115509 - RNA, 64 nt, hsa
ggugccccaggaccagcucaggacagaugccacacaaggauagaugcuggcccagggcccagag

SEQ ID NO: 115510 - RNA, 64 nt, hsa
ccauggccuuuccucaguguuguaaggccuaugccaaggauaaaggaaggguaugccuuugggu

SEQ ID NO: 115511 - RNA, 64 nt, hsa
gcuaaugguuguuuucugugaguccuauaaaaagcaaggauaugcaugauucagggaaugaaga

SEQ ID NO: 115512 - RNA, 64 nt, hsa
accccucaauggacucucucaacccagggacacccaaggauaugucuucugaagaucaaggcaa

SEQ ID NO: 115513 - RNA, 64 nt, hsa
uaacaaaauauguauguccgaagggaaaaagcugcaaggauauauauaagaccacugcuuaucu

SEQ ID NO: 115514 - RNA, 64 nt, hsa
gauuagauguggaagggaaggauaagaaacagaccaaggauaacuuucaaauguaugcuuaagc

SEQ ID NO: 115515 - RNA, 52 nt, hsa
uccugcaaaaacugaguuaguccaaggauaaguauguaaauacggggcgggc

SEQ ID NO: 115516 - RNA, 64 nt, hsa
acccagaaaagacagaggugauggaauuaguagacaaggauauuaaaagagcuauuguaaauau

SEQ ID NO: 115517 - RNA, 64 nt, hsa
ugggauagauaacugagaggcucagaaucuuuaccaaggauauuuuuuaggauaagguagcugc

SEQ ID NO: 115518 - RNA, 64 nt, hsa
uagucucuuguuuaaaaaaucuggagcgggaaugcaaggauacaaaacuuuagcaugcuuugag

SEQ ID NO: 115519 - RNA, 64 nt, hsa
gguuucagucaucaacuacccaugaauuccugcccaaggauacuuaaucaggauuaaauuuucu

SEQ ID NO: 115520 - RNA, 64 nt, hsa
aacacauagaacugauggaggcuuuuccuaaggccaaggauaauguacuaguuguuaaaaugga

SEQ ID NO: 115521 - RNA, 64 nt, hsa
uuuuccagguacccuucucgcuuuugccauuagccaaggauagaagcugcagugguauuaauuu

SEQ ID NO: 115522 - RNA, 64 nt, hsa
gaaggcauuaaaaagaagugcaauuccuuuuuagcaaggauaaaaucauugccuuguguuacag

SEQ ID NO: 115523 - RNA, 64 nt, hsa
cccgacauggugcuaguuuccucucuuggagagccaaggauaagugacucuccaauagguucuu

SEQ ID NO: 115524 - RNA, 64 nt, hsa
aacguuuugauuuauaguaccaagugcuuaaacacaaggauaguguuagauuuucgagugacuu

SEQ ID NO: 115525 - RNA, 64 nt, hsa
uuuucuuuucuuaguucauauuugcauuuucguucaaggauaugcuuagcaauaaaauguucuu

SEQ ID NO: 115526 - RNA, 64 nt, hsa
cccagcaaauccuagaaguggagucuggauacuucaaggauagaaguguuggcacgcacagcca

SEQ ID NO: 115527 - RNA, 64 nt, hsa
aagaguuggauuggacccuacuugccuucccgggcaaggauaggaccuuucacgcaagugccau

SEQ ID NO: 115528 - RNA, 64 nt, hsa
uuuguggucuucugugauuauuuaugcugccucccaaggauagaauugaaauaaaauguuuuca

SEQ ID NO: 115529 - RNA, 64 nt, hsa
aaagaucgucugagaaaucugaaaaaaaagaaagcaaggauacuaagaaaauagaagguaaaga

SEQ ID NO: 115530 - RNA, 64 nt, hsa
uuaaguuucuaagggucuaguuguucagaauccccaaggauauuucccuaaccucacucaguca

SEQ ID NO: 115531 - RNA, 64 nt, hsa
auuuuuuguaugaucaguuuuugaaguccguauacaaggauauauuuuacaagugguuuucuua

SEQ ID NO: 115532 - RNA, 64 nt, hsa
ugcagagcccagagcccuucaucucucugagggucaaggauaccaggggucccaagucacagau

SEQ ID NO: 115533 - RNA, 64 nt, hsa
gccuggccuguccucuaagucaaguuuaggaaaacaaggauaagauucugucauaggcauagag

SEQ ID NO: 115534 - RNA, 64 nt, hsa
ugagaauguaaauaaaugugucuucuuuauggaccaaggauaugaaaucauuuuucuuuuguag

SEQ ID NO: 115535 - RNA, 64 nt, hsa
cagaggaguuuaacgcgaucuucacauuuuacgacaaggauagaagcggcuacauugacgagca

SEQ ID NO: 115536 - RNA, 64 nt, hsa
aaaaacuacauaaaaggccuaaaaguaagacccacaaggauauuccuuugcccuucuuguacuu

SEQ ID NO: 115537 - RNA, 64 nt, hsa
uuuaucuuuucuuugaauaagaaaaaguaucuagcaaggauauuacuugugccuugaggcuagc

SEQ ID NO: 115538 - RNA, 64 nt, hsa
gauuuggcccucauuuucccucagaaccccacggcaaggauauauguccccuuguucucucugc

SEQ ID NO: 115539 - RNA, 64 nt, hsa
gggguuuccccucaggaauuugucuaacacauuucaaggauagaaaauacuucacugccgggca

SEQ ID NO: 115540 - RNA, 64 nt, hsa
uuccaaccuccugcucugggacguggacaugccucaaggauacagggagccggcggccucucga

SEQ ID NO: 115541 - RNA, 64 nt, hsa
gcauacuugugaacuaccuugcuagcuagccagccaaggauaccggacacaccucugcuccaaa

SEQ ID NO: 115542 - RNA, 64 nt, hsa
ggaaaaaacccaaagaaccaaaaacaaaccaccccaaggauaauaauagcuacacugcuagcuu

SEQ ID NO: 115543 - RNA, 64 nt, hsa
aacaggcacuguuagaugaaguaaaugauuucaacaaggauauuuguaucaggguucuacuuca

SEQ ID NO: 115544 - RNA, 64 nt, hsa
cguugcugaacaagcgugugaaaucauuucagaucaaggauaagccaguguguacauauguuca

SEQ ID NO: 115545 - RNA, 64 nt, hsa
uuauugggcauuugaugagguuuggcauggacuucaaggauaaaugaaugaaaacuuugcacca

SEQ ID NO: 115546 - RNA, 64 nt, hsa
ucuuguguggucccagaaggagaagugaguuugccaaggauauggggcaggaggcucccucugc

SEQ ID NO: 115547 - RNA, 64 nt, hsa
uucagauugccauggggauuccucuauauagaaucaaggauauccguaugauguaugggguauc

SEQ ID NO: 115548 - RNA, 64 nt, hsa
gauaaaaccuuuuuaauaagugaugcagagcagccaaggauauguugacccagaugucaaccag

SEQ ID NO: 115549 - RNA, 64 nt, hsa
uaucaggggcauaaaaggcuaucuauucuuaauucaaggauaaaacagaagaagcuugugguau

SEQ ID NO: 115550 - RNA, 64 nt, hsa
cugucaacauuagaucaaugagacagaaaguuaacaaggauauccaggaauugaacacagcucu

SEQ ID NO: 115551 - RNA, 64 nt, hsa
uugcaacagcuacagucuaaaauugcuucuuuaccaaggauauuuacagaaaagacucugacca

SEQ ID NO: 115552 - RNA, 64 nt, hsa
uuuuuuguuauccuuugauuuuguuuaugaaaagcaaggauagcuuaauuuucaaaaacucaau

SEQ ID NO: 115553 - RNA, 64 nt, hsa
uuuacuuauuugcuccuuguagagcugccuuuuccaaggauaccauaaacuccugagagcaggg

SEQ ID NO: 115554 - RNA, 64 nt, hsa
uugauccuggcauucuggaagacacgaaagcaagcaaggauauauaaggcacuguggugguuau

SEQ ID NO: 115555 - RNA, 64 nt, hsa
gccccgaguuagaaaaaguagcuauggaggacuacaaggauaacccagcauuugcgugaguauc

SEQ ID NO: 115556 - RNA, 64 nt, hsa
cagcccccaggccugggggcacagauccccccagcaaggauaacauucaaaggagcucacauuu

SEQ ID NO: 115557 - RNA, 64 nt, hsa
guucagguccgcccauuacuccuugucgugcggucaaggauacaccuuggccccgauuccggau

SEQ ID NO: 115558 - RNA, 64 nt, hsa
ucucagggguagugaagcugcagacugacaguuucaaggauacccaaauuccccuaaagguucc

SEQ ID NO: 115559 - RNA, 64 nt, hsa
aaacggcagucauuuguucuccucggcucuguggcaaggauagcccuuuggagggggacucuug

SEQ ID NO: 115560 - RNA, 64 nt, hsa
ucaccagccuguuguuuuaagagagaaaaaaaaucaaggauaucugauuggagcaaaccacuuc

SEQ ID NO: 115561 - RNA, 64 nt, hsa
uuauauuguacaggaucaauauuuugcuuuuuaacaaggauauuuauguaauaagaaacuuugc

SEQ ID NO: 115562 - RNA, 64 nt, hsa
uuguuuuaugaaacuuucacguguauauauagaccaaggauaugugcugaguuuugaugucaaa

SEQ ID NO: 115563 - RNA, 64 nt, hsa
cauugcaaccucugugcuuuuauaauucaaagaacaaggauagcuuucuucgguaucuuuuaau

SEQ ID NO: 115564 - RNA, 64 nt, hsa
ggcuguuuucugucuuauuucucaguugagugagcaaggauacgaaaacaguguguuugaaaac

SEQ ID NO: 115565 - RNA, 64 nt, hsa
ugauuuuggaauucaggugcacucuauucaagugcaaggauaucagaaguuuuuuuuuauuuaa

SEQ ID NO: 115566 - RNA, 64 nt, hsa
ggggcacggggccuccgagcuccagcuccguucccaaggauacucgugaagaccccaucugugu

SEQ ID NO: 115567 - RNA, 64 nt, hsa
ucacucagcaaccaugcccuuagucugaagauaacaaggauacuuuaauauccagugccgguuc

SEQ ID NO: 115568 - RNA, 64 nt, hsa
caaauuagaaaauccuauguccuaguuuccuuaccaaggauaauuaaauauaucacuaagagcu

SEQ ID NO: 115569 - RNA, 64 nt, hsa
acaugguuagaaauuuaaagcaagaucauuuacccaaggauagguguuugguaauguugaagga

SEQ ID NO: 115570 - RNA, 64 nt, hsa
auguaaaugucuguugaauuucugaaguugaaaacaaggauauaucauuggagcaaguguugga

SEQ ID NO: 115571 - RNA, 64 nt, hsa
guuaacaggaauaaauauaugaacaaaaaagcugcaaggauaaauguggagaaaaugaugagaa

SEQ ID NO: 115572 - RNA, 64 nt, hsa
cuuuuucuccuaggagcaacuugugcaaguacuucaaggauagcaggaauauaaaaauucucaa

SEQ ID NO: 115573 - RNA, 64 nt, hsa
gagggugauucccagugguggggaaaacauuaaucaaggauacuugcauuuagccuggagcccc

SEQ ID NO: 115574 - RNA, 64 nt, hsa
cacagaaucuccugauaguaaagggggcuggagacaaggauaaguuauagagcaguuggaggaa

SEQ ID NO: 115575 - RNA, 64 nt, hsa
gugaagaaauaggaaagaagaaguuaccauuaaccaaggauaugagagaacaaggaguuaaaag

SEQ ID NO: 115576 - RNA, 64 nt, hsa
uccuuguguggcugaugugucuggaaaugauguaguucaggaaagcauuuuuuuuuucuuugaa

SEQ ID NO: 115577 - RNA, 64 nt, hsa
guccaguggccuuuggaaaggugguggggauccaguucaggagggagggguauguuugucuccc

SEQ ID NO: 115578 - RNA, 64 nt, hsa
uguccaucccauucuauucuguacugugacuuuaguucaggaaguuuuguuuuguguuuuaaau

SEQ ID NO: 115579 - RNA, 64 nt, hsa
gguuuaaguguucauguucuagugaacacagcuuguucaggaacaaacacuaaaacgauuugag

SEQ ID NO: 115580 - RNA, 64 nt, hsa
aaggaaaaaacuccaauccccugagcccaccacuguucaggaccccugcuuuugucaccuacua

SEQ ID NO: 115581 - RNA, 64 nt, hsa
gcgcccggccgaccugcuugcccucauccuccugguucaggaccucuaccccagcgagagcaca

SEQ ID NO: 115582 - RNA, 64 nt, hsa
cuuuuccuuuuguuuucauaauauaaugcaguuuguucaggaaaucagcacaaagccugauagu

SEQ ID NO: 115583 - RNA, 64 nt, hsa
auauaauuaauuuaaauuuguuacagguuuucauguucaggauaaaccauacuuccaccuuggg

SEQ ID NO: 115584 - RNA, 64 nt, hsa
gagaaaucagaaugaugcaaugugagaaacugauguucaggagacuucggauaauauagacagg

SEQ ID NO: 115585 - RNA, 64 nt, hsa
uauaaaguuguuuuuuuaaaaauauguaaauaauguucaggaaaaacgcagggaacagagucuu

SEQ ID NO: 115586 - RNA, 64 nt, hsa
uguccucgauaggccaugcaagggcuuccugagaguucaggaaaguucucuugugcaacagcaa

SEQ ID NO: 115587 - RNA, 64 nt, hsa
aaucgguacgccaugguuugaagaccaccuucuaguucaggacuccuguucuucccagcauggc

SEQ ID NO: 115588 - RNA, 64 nt, hsa
cagugccccaccuuuuaucuuaguaggcucaaauguucaggaagcacagggauggaaaccucuu

SEQ ID NO: 115589 - RNA, 64 nt, hsa
guugcuuucccaguagaagauguagcuaaaaaaaguucaggaucuggugacaaaugugcucccu

SEQ ID NO: 115590 - RNA, 64 nt, hsa
uccccuguaggaggccagggaggggaacucagcaguucaggagccaccccaaaccauucuggga

SEQ ID NO: 115591 - RNA, 64 nt, hsa
cacauugggaggccaaggcaggcacaucaccugaguucaggaguucaagaccagccuggccaac

SEQ ID NO: 115592 - RNA, 64 nt, hsa
gcugccauauccugcuggcuccuugcuugauuucccucagcaaacccuugaacuugcuaggcca

SEQ ID NO: 115593 - RNA, 64 nt, hsa
gaaggcaaguggugauggcgccacugcacuccuaccucagcaacagaguaagacucugucccaa

SEQ ID NO: 115594 - RNA, 64 nt, hsa
gcugggagugguuagccggaauacuggggccugcccucagcaucccccauagcucccagcagcc

SEQ ID NO: 115595 - RNA, 64 nt, hsa
cagccccagggugaucucaaaguaucuaauucacccucagcaugugggaagggacagguggggg

SEQ ID NO: 115596 - RNA, 64 nt, hsa
auccgaaagaauuaagagaauaccuagaacauauccucagcaagaaacaaaaccaaacuggacu

SEQ ID NO: 115597 - RNA, 64 nt, hsa
cccugcagcccuuuuggcuccccuuuucccugugccucagcacuccuuuccugguugcagauaa

SEQ ID NO: 115598 - RNA, 64 nt, hsa
ccagccucaggaagaguagaaauuggguggugcuccucagcaggggaagguggauguuuaggcu

SEQ ID NO: 115599 - RNA, 64 nt, hsa
ggacagguguagagauaaggacuggcaaccagagccucagcauccaaagauggacugaaguggg

SEQ ID NO: 115600 - RNA, 64 nt, hsa
ugccagaggccuggugcccuggcccagccuguggccucagcaucucauaacucauuugcuuugu

SEQ ID NO: 115601 - RNA, 64 nt, hsa
ggaagggggcaggccccuuuggaccugcaguuggccucagcagaaggccuugccuuguguaugu

SEQ ID NO: 115602 - RNA, 64 nt, hsa
uaaaauucugaaacagaggcuuuaaaauuuaaaaccucagcaaaauaauccaugaauuuacuga

SEQ ID NO: 115603 - RNA, 64 nt, hsa
uauucuaaguuuucauucuuugaauuauaaauggccucagcaguuuugcucaacuacugauaaa

SEQ ID NO: 115604 - RNA, 64 nt, hsa
gccagagggguuggccaguuggagccugggucagccucagcagccuauccccauguccucuaug

SEQ ID NO: 115605 - RNA, 64 nt, hsa
cggccagaccacaaggccagaagcaauaauggcaccucagcaguuccaguauggauagggguuc

SEQ ID NO: 115606 - RNA, 64 nt, hsa
cauuugcuccuccuguuccugugccacuccagaaccucagcagaucugagccaccgccugccag

SEQ ID NO: 115607 - RNA, 64 nt, hsa
cuguguguguguuucggaaagccgcuguguccugccucagcacaaagacccagugucauuugcu

SEQ ID NO: 115608 - RNA, 64 nt, hsa
uacgaacuucuccagcucugcucuguuuucucuuccucagcauccaccccgugacacguagugg

SEQ ID NO: 115609 - RNA, 64 nt, hsa
ggaaguggaggugaaugucucugccuccuguaggccucagcagggacagcacagacccucuggc

SEQ ID NO: 115610 - RNA, 64 nt, hsa
gggucauauguuuauuuuucauuguguuuugugaccucagcagggugggggucuuccuccuuac

SEQ ID NO: 115611 - RNA, 64 nt, hsa
cucccucuaauguguggugcuuuggugagcaaacccucagcaguccugaccuucgggugaccag

SEQ ID NO: 115612 - RNA, 64 nt, hsa
ccaagagcaaggaugaaaaauugaagucacagccccucagcaccaagcagaaggugaggacagg

SEQ ID NO: 115613 - RNA, 64 nt, hsa
gugcccagagacaagugaaggugucugcccugggccucagcaaggauguguacaacagguagaa

SEQ ID NO: 115614 - RNA, 64 nt, hsa
auagucuucucaaauuagaaaguuaaccccauguccucagcauuucuuuucuggccaaaagcag

SEQ ID NO: 115615 - RNA, 64 nt, hsa
cugcggagaacacccuugguggcuuaugggucccccucagcaagcccuacagagcuguggagga

SEQ ID NO: 115616 - RNA, 52 nt, hsa
cggagcugaauacagccugaggccucagcagccgccuuaagcugauccugcg

SEQ ID NO: 115617 - RNA, 64 nt, hsa
gugccaagcccuggcccccacagcgcucgauggaccucagcaagcugcccagcccuggcccagg

SEQ ID NO: 115618 - RNA, 64 nt, hsa
gaggggaccucuccacacagguguuccgugggacccucagcagcucuggcucugccucaggagg

SEQ ID NO: 115619 - RNA, 64 nt, hsa
cuguagacaaugagauuaagcuucaaucacugcuccucagcaaugugaagaaucaaagucaggg

SEQ ID NO: 115620 - RNA, 64 nt, hsa
gacacucacuggacaauaucaaaccauggcuccuccucagcauggcuuugugucuuucccaguu

SEQ ID NO: 115621 - RNA, 64 nt, hsa
uugguacuguccaugucugggugugugccuauuaccucagcauuucucacaaaguguaccaugu

SEQ ID NO: 115622 - RNA, 64 nt, hsa
ggcuuucugaguccuguuggccaccaagugucagccucagcacucccgggacuauugccaagaa

SEQ ID NO: 115623 - RNA, 64 nt, hsa
ugccaaccuuaguguuucuccagccagacagaugccucagcaugaagggcuuggggacuugugg

SEQ ID NO: 115624 - RNA, 64 nt, hsa
ccucugcaugcagcacagaagggugugaccaugcccucagcaccacucuuguccccacugaacg

SEQ ID NO: 115625 - RNA, 64 nt, hsa
aggagacagcaugaacaccugcuuguccaauuagccucagcacauuacuaaucucaguuuguuc

SEQ ID NO: 115626 - RNA, 64 nt, hsa
aaagccuuucccuuaugaucaacaaguggacucuccucagcaggucuuuagagauuauccucuc

SEQ ID NO: 115627 - RNA, 64 nt, hsa
agguacugcccauugggagauggggacauugggaccucagcaaugaagaacccuugugaaguaa

SEQ ID NO: 115628 - RNA, 64 nt, hsa
gacugggugugccaaaauaugcccaggguccugcccucagcacuagauuuaauggggccaagag

SEQ ID NO: 115629 - RNA, 64 nt, hsa
agcaauauaggccagacuugguccuaagcaccugccucagcaauugucuacauucaguuguuuu

SEQ ID NO: 115630 - RNA, 64 nt, hsa
gcgagugcacagacagcacccuccucuccgugcuccucagcaguccuccgcuacgcacagguag

SEQ ID NO: 115631 - RNA, 64 nt, hsa
cccguuugucaucugguuuggcaggacccaggacccucagcaaugagucugaguguucaaagcc

SEQ ID NO: 115632 - RNA, 64 nt, hsa
uguuuucccacuguuaaggacucuguccaaagaaccucagcaucagcucccucaagcuuaauga

SEQ ID NO: 115633 - RNA, 64 nt, hsa
gugucugggcugccccugccaaguucccccagucccucagcaccuggccccaggacugaggucc

SEQ ID NO: 115634 - RNA, 64 nt, hsa
gagaaggaugccugggugccaggcaagacaagccccucagcaggagagaggcccagaggcucca

SEQ ID NO: 115635 - RNA, 64 nt, hsa
accccucaacagagaugacuuugaugacucugccccucagcagggcuuacuaagcacuaccccu

SEQ ID NO: 115636 - RNA, 64 nt, hsa
agggaugacacagcaaggaugacucagcacugccccucagcaaggaugacucagcacugccgcu

SEQ ID NO: 115637 - RNA, 64 nt, hsa
aacagacaugacucagggauggcuuaguacugccccucagcagggaugacucagcaccgccucu

SEQ ID NO: 115638 - RNA, 64 nt, hsa; identical to SEQ ID NO: 115636

SEQ ID NO: 115639 - RNA, 64 nt, hsa
aggcaugacucugcagagaugacuuaguacugccccucagcagggaugacucaguacugccccu

SEQ ID NO: 115640 - RNA, 64 nt, hsa
uacugccccucagcagggaugacucaguacugccccucagcagggaugacucagcacugccccu

SEQ ID NO: 115641 - RNA, 64 nt, hsa
agugaugacacagcaaggaugacucagcacugccccucagcaaggaugacucagcacugccgcu

SEQ ID NO: 115642 - RNA, 64 nt, hsa
aacagacaugacucagggauggcuuaguacugccccucagcagggaugacucagcaccgccccu

SEQ ID NO: 115643 - RNA, 64 nt, hsa
aacagacaugacucagggauggcuuaguacugccccucagcagggaugacucagcagggaugac

SEQ ID NO: 115644 - RNA, 64 nt, hsa
acagggaugacugcagggaugacucagcacugccccucagcagggaugacucagcacugccccu

SEQ ID NO: 115645 - RNA, 64 nt, hsa
cacugccccucagcagggaugacucagcacugccccucagcagggaugacucagcagggaugac

SEQ ID NO: 115646 - RNA, 64 nt, hsa
aggcaugacucugcagagaugacucagcacugccccucagcagggauggcucagcagggaugac

SEQ ID NO: 115647 - RNA, 64 nt, hsa
agacaugacucagcagggaugacucagcaccgccccucagcaaggaugacucagcagggaugau

SEQ ID NO: 115648 - RNA, 64 nt, hsa
uuuggauuuaaguuacuauccuggcuuugcccaaccucagcaaccuguaagacugauaaugaaa

SEQ ID NO: 115649 - RNA, 64 nt, hsa
gcacgugacuguauuauacauggguagcuucugaccucagcauuaucuauauaguaccuuugcu

SEQ ID NO: 115650 - RNA, 64 nt, hsa
ggcugccuugaaaucaagagacaauaacuuugaaccucagcaagaccuugaaccgccgguucau

SEQ ID NO: 115651 - RNA, 64 nt, hsa
aaaaguguggcauagcuaccugcccauccccaacccucagcaaaguagaaucucuuuucuggua

SEQ ID NO: 115652 - RNA, 64 nt, hsa
uugcuucacccgcugcagagcacacgcaacccagccucagcaucacagccgcagcucuguucag

SEQ ID NO: 115653 - RNA, 64 nt, hsa
uccauuuucugagacccccagaaaggaaacugacccucagcagcugccugauuguuacgcgaau

SEQ ID NO: 115654 - RNA, 64 nt, hsa
caaagugagagguggcucccccggcccccaccacccucagcagccccaccccacucaacccuga

SEQ ID NO: 115655 - RNA, 64 nt, hsa
ggguaucaccugguggccacagucccccuucucaccucagcaaugauccccaaagugagaggug

SEQ ID NO: 115656 - RNA, 64 nt, hsa
cccaccuccaucaaacgcagacacuguagucagaccucagcaauauaggaggcaauaaucuuuu

SEQ ID NO: 115657 - RNA, 64 nt, hsa
ucuguuucagcaaaucucagucccugacuaacagccucagcacauccgacaccucccagcgugg

SEQ ID NO: 115658 - RNA, 64 nt, hsa
augaggaccuccagggcauguugcucccuucuguccucagcaaggcucgguccuggacauucua

SEQ ID NO: 115659 - RNA, 64 nt, hsa
ccucugcucagugccuguggggagcagccucuacccucagcauccuggccacaaguucuuccuu

SEQ ID NO: 115660 - RNA, 63 nt, hsa
ugugaacauugcucuucauuuuggccuguacuucucccucagggacguagaacaauggaaugu

SEQ ID NO: 115661 - RNA, 63 nt, hsa
aaacuuuuucuuuaaaauucaauuaagguacuucucccucagggacguagaacaauggaaugu

SEQ ID NO: 115662 - RNA, 63 nt, hsa
gccuuguggcaugucugucuagccucuuccucccucccucaugaugaagugccauuucuguua

SEQ ID NO: 115663 - RNA, 63 nt, hsa
aaaauuauuucaucuuguauucuuuguaaaauucucccucaccccacccugcuuuuaaaaauu

SEQ ID NO: 115664 - RNA, 63 nt, hsa
caaaacucaagucccucuuccuccgugaagcuucucccucagcugagcagugaucacuuacuc

SEQ ID NO: 115665 - RNA, 63 nt, hsa
gagggccuacggauggguccguagaggucccaccucccucauuccuccuuggccccucucccu

SEQ ID NO: 115666 - RNA, 63 nt, hsa
aguccccgaucgcugcugugagcaccucaguggcucccucagaccagaucccguaggcagccc

SEQ ID NO: 115667 - RNA, 63 nt, hsa
gagauugcccuucccuaugccacgguucccacccucccucaccaguuuggacaauuugaaauu

SEQ ID NO: 115668 - RNA, 63 nt, hsa
uugcugcucccucaaccuuccugcugucuuccccucccucaaccccaauaggaggaucccagg

SEQ ID NO: 115669 - RNA, 63 nt, hsa
uaaaguuaaucucuuggucuggccaaguugcugcucccucaaccuuccugcugucuuccccuc

SEQ ID NO: 115670 - RNA, 63 nt, hsa
agugggggaggugagacagaucuggaaagccgucucccucagaugguuucauuuaaugcuuua

SEQ ID NO: 115671 - RNA, 63 nt, hsa
cucccgugacagccggcaggcccagcccauccccucccucauccucgucuguccugucaccug

SEQ ID NO: 115672 - RNA, 63 nt, hsa
augguagcuaccucuuacuucaaauucuucugccucccucaugcucgcagccacucugugccc

SEQ ID NO: 115673 - RNA, 63 nt, hsa
uccucccuuucucagucuaccuacucuuugugacucccucauaucuuuucccccuggcaugga

SEQ ID NO: 115674 - RNA, 63 nt, hsa
ccccgacuccucaccccugagccucacccugaacucccucaucuugcaaggccauaaguguuu

SEQ ID NO: 115675 - RNA, 63 nt, hsa
cuuagcccccuguaugacccuaugcaaguccuccucccucaucucaaaggguccucaaagcuc

SEQ ID NO: 115676 - RNA, 63 nt, hsa
caaguugugauaaauuugaucccaauagaauaccucccucauuuaagaaaaaucauaacucac

SEQ ID NO: 115677 - RNA, 63 nt, hsa
uuuggaaauggagggaggaauuuucauugccuucucccucaugcaugaagauucgaacagcuu

SEQ ID NO: 115678 - RNA, 63 nt, hsa
cccuuagccgucuuacucaacugccccuuuccucucccucagaauuuguguuugcugccucua

SEQ ID NO: 115679 - RNA, 63 nt, hsa
ugucaaguggaauccuucccuuuccaacucuaccucccucacucagcuccuuuccccugauca

SEQ ID NO: 115680 - RNA, 63 nt, hsa
ucagacugggaaucccugaagauggggccgugucucccucaaaguggggcucccucaggacag

SEQ ID NO: 115681 - RNA, 63 nt, hsa
ugaagauggggccgugucucccucaaaguggggcucccucaggacagcguugugucuccccuc

SEQ ID NO: 115682 - RNA, 63 nt, hsa
ucagacugcggcucccugaggacggggcugugucucccucagacuggggcucccugaagaaag

SEQ ID NO: 115683 - RNA, 63 nt, hsa
ucagacuggggcucccugaagaaagggcugcuucucccucagacuggagcucccugaagaugg

SEQ ID NO: 115684 - RNA, 63 nt, hsa
cccguguggcagagcuguggacuuucuucucggcucccucaacccuggcucaggcacagaagg

SEQ ID NO: 115685 - RNA, 63 nt, hsa
ugccagcguugggugggacacccguggcggcugcucccucagaccucccuucuguggacugac

SEQ ID NO: 115686 - RNA, 63 nt, hsa
guuuccaucucaggcauguaucccaccaagugccucccucacagccaugcccagaagccucac

SEQ ID NO: 115687 - RNA, 63 nt, hsa
ccuggggacuggggcgcuccucccucaggcuuucucccucagucuuggcuucuccagggcucu

SEQ ID NO: 115688 - RNA, 63 nt, hsa
gcaccaggccggucccuggggacuggggcgcuccucccucaggcuuucucccucagucuuggc

SEQ ID NO: 115689 - RNA, 63 nt, hsa
acugagccuuuuuggugcucccucagaggaacucucccucacccaggacagccuguggccuuu

SEQ ID NO: 115690 - RNA, 62 nt, hsa
augaagaaacagaagacugagccuuuuuggugcucccucagaggaacucucccucacccagg

SEQ ID NO: 115691 - RNA, 63 nt, hsa
gacucucuggccaccuccuccaccgcaguccagcucccucagucuggcacccacugcuacacu

SEQ ID NO: 115692 - RNA, 63 nt, hsa
ccagcccggagcccacagugcugcccagcguaccucccucaccgucuggggcucuucugggag

SEQ ID NO: 115693 - RNA, 63 nt, hsa
ccccagacccagagguccaggucccagccccuccucccucagacccagcgguccaaugccacc

SEQ ID NO: 115694 - RNA, 63 nt, hsa
cucagacccagggguccaggcccccaaccccuccucccucagacucagagguccaggccccca

SEQ ID NO: 115695 - RNA, 63 nt, hsa
ucagacccaggaguccagaccccccagccccuccucccucagacccaggaguccagccccucc

SEQ ID NO: 115696 - RNA, 63 nt, hsa
ccuccucccucagacccaggaguccagccccuccucccucagacccaggaguccagacccccc

SEQ ID NO: 115697 - RNA, 63 nt, hsa; identical to SEQ ID NO: 115695

SEQ ID NO: 115698 - RNA, 63 nt, hsa
ccucaaaccaaggguacagauccccagccccuccucccucagacccaggaguccagacccccc

SEQ ID NO: 115699 - RNA, 63 nt, hsa
cucaggcccaggaguccaggcccccagccccuccucccucaaaccaaggguacagauccccag

SEQ ID NO: 115700 - RNA, 63 nt, hsa
aaggaauucaggaauaucuguucccagccccuccucccucaggcccaggaguccaggccccca

SEQ ID NO: 115701 - RNA, 63 nt, hsa
cucagacccgggaguccaggcccccagccccuccucccucagacccaggaguccaggccccag

SEQ ID NO: 115702 - RNA, 63 nt, hsa
cucagacccaggaguccaggcccccagccccuccucccucagacccgggaguccaggccccca

SEQ ID NO: 115703 - RNA, 63 nt, hsa
cucaggacccaggaguccaggccccagccccuccucccucagacccaggaguccaggccccca

SEQ ID NO: 115704 - RNA, 63 nt, hsa
cucagacccaggauucccgggccccaguaccuccucccucagacccaggacuccaggccccca

SEQ ID NO: 115705 - RNA, 63 nt, hsa
cucagauccaggagucuaguccuccagcuccuccucccucagacccaggauucccgggcccca

SEQ ID NO: 115706 - RNA, 63 nt, hsa
aucaacaccacuaggaaucccagaggugggauccucccucauggcucuggcacaguguaaucc

SEQ ID NO: 115707 - RNA, 63 nt, hsa
ccucucucugggcccaggggcuguggccgucuccucccucagcucucugggaccuccuuagcc

SEQ ID NO: 115708 - RNA, 63 nt, hsa
cugucccaagcccaccccuccucccaccaucaccucccucaccucgggacaguagcccuccac

SEQ ID NO: 115709 - RNA, 63 nt, hsa
gaaaaacaggucucagcccaggguccucgcucacucccucacuccccacuuugaagccaucuc

SEQ ID NO: 115710 - RNA, 63 nt, hsa
cuggggcucaagcgcugggccgcccacuccugccucccucaucugugucccgaguuccugaag

SEQ ID NO: 115711 - RNA, 63 nt, hsa
caggugguggccagagaggcuccaggggcuagacucccucaggaggcugaauugaaaaagggc

SEQ ID NO: 115712 - RNA, 63 nt, hsa
gccgcuaagacugcaagccuuacaccucaccaucucccucaugaguaagacugaaauaaaacu

SEQ ID NO: 115713 - RNA, 63 nt, hsa
augaauagaaacuucuuauaagccuuuuuccuacucccucagauuauguaauuuauuuguaag

SEQ ID NO: 115714 - RNA, 64 nt, hsa
uuccugccucagauuucagcuuaaauuuugccuccucagagagaugccuucccaaacuccccau

SEQ ID NO: 115715 - RNA, 64 nt, hsa
uucugauauacauugcuugaaaaugagugaguaccucagagaaauuugauagacucaaacagau

SEQ ID NO: 115716 - RNA, 64 nt, hsa
uggaaagcaggauuuaaccucuaguucucuuguucucagagaacagcagguugauaguagauua

SEQ ID NO: 115717 - RNA, 64 nt, hsa
gguuuucuuagccccagcuuuaaaagcuagagaucucagagaaauagcuggcuuaacaaugaca

SEQ ID NO: 115718 - RNA, 64 nt, hsa
uaaggauaauaggacaagacaaauuacagauugucucagagaaaacaaaugaguuacucucucg

SEQ ID NO: 115719 - RNA, 64 nt, hsa
ucuggaaugcgguaauaagagcuggcaaguaaggcucagagagaagcaaccaacuggaguuaau

SEQ ID NO: 115720 - RNA, 64 nt, hsa
uuuucucccugagcuguaggguggaccuggaccccucagagaugcucgacugcaggguccuggg

SEQ ID NO: 115721 - RNA, 64 nt, hsa
cuguugauuccacuucugucgaggagcuucggggcucagagaggugaugacgugcccaagguga

SEQ ID NO: 115722 - RNA, 64 nt, hsa
cugggccuucugugcaggagacuuggucucaaagcucagagagagccaguccggucccagcucc

SEQ ID NO: 115723 - RNA, 64 nt, hsa
aggagcuuggccccucuguaagcaucugacucaucucagagauaucaauucuuaaacacuguga

SEQ ID NO: 115724 - RNA, 64 nt, hsa
caaaaauacuguaagucucaauuaacagcagaaucucagagaaaagcuguuugcaauccaaauc

SEQ ID NO: 115725 - RNA, 64 nt, hsa
uuuuucuucuuuuuuaaaauauucccacucagcacucagagacacaaaaauacuguaagucuca

SEQ ID NO: 115726 - RNA, 64 nt, hsa
cccaucuguaggagauuagugaggcaaggugcugcucagagaggaggaccucauuguucuuagg

SEQ ID NO: 115727 - RNA, 64 nt, hsa
accccauuuuucccaggguaaucaugaaagaaggcucagagaaagagggaaacaaaagccuguu

SEQ ID NO: 115728 - RNA, 64 nt, hsa
augaucaucuccaguuuauagaccagaaccagagcucagagaggcuagaugauugauuaccaag

SEQ ID NO: 115729 - RNA, 64 nt, hsa
ucacagaagcacagcacccaugggaaggguccaucucagagaauuuacgagcagggaugaaggc

SEQ ID NO: 115730 - RNA, 64 nt, hsa
ccugguuaaacaaaccagaaucccucuacauggacucagagaaaagagauugagauguaagucu

SEQ ID NO: 115731 - RNA, 64 nt, hsa
cugugccucugucuccuuguugcccaacuacuaucucagagauauugugaggacaaauugagac

SEQ ID NO: 115732 - RNA, 64 nt, hsa
cucagccagcucuuuuaauugacacagaaacauccucagagaucagugggaucaacauuguggc

SEQ ID NO: 115733 - RNA, 64 nt, hsa
agcagcagggccccaugggauccauccugucucccucagagaaggagacaccuccuggaggccc

SEQ ID NO: 115734 - RNA, 64 nt, hsa
gagcccccgcauaucagcaguucacccaguacuccucagagacugguuucccucuaaacccauc

SEQ ID NO: 115735 - RNA, 64 nt, hsa
ugcgucccagccagccccgucgcucucguccauccucagagacaaagaagagggcagggaguuu

SEQ ID NO: 115736 - RNA, 64 nt, hsa
aaagggaaaacccucaggccugaggugugugccacucagagacuucaccuaacuagagacaggc

SEQ ID NO: 115737 - RNA, 64 nt, hsa
agugaauggucucucuuuggcuggaauuacaaaacucagagaaaugugucaucaggagaacauc

SEQ ID NO: 115738 - RNA, 64 nt, hsa
auuuccuacaccgcagcugucuguucaccuucagcucagagagcacuccugaccuuucguaaug

SEQ ID NO: 115739 - RNA, 64 nt, hsa
ugcuucugcaacacaaaucggaacaggagcgauccucagagaguuuacaaugugcuuuuuccgc

SEQ ID NO: 115740 - RNA, 64 nt, hsa
uaaaagcuuuuucacaguuuuaagaagacaaguggagggugaggauagugguggggggucuggc

SEQ ID NO: 115741 - RNA, 64 nt, hsa
ccgagccuuuuuguugcuccgcucccaggagagugagggugacgcaauugauuaaaaccauuuu

SEQ ID NO: 115742 - RNA, 64 nt, hsa
gucuaagaagucccauugccaaagcuuucugcaggagggugaaugccgcagcuuggcagccccu

SEQ ID NO: 115743 - RNA, 64 nt, hsa
agaacagugggacaugagcaggggugugggcuuggagggugaagaggaugugguccuaucagau

SEQ ID NO: 115744 - RNA, 64 nt, hsa
uguaugcaacacagcaauaaucuagaaugaaaaggagggugauuagccuucauaagaugaccua

SEQ ID NO: 115745 - RNA, 64 nt, hsa
cuuuaaaagaucuaacuaugggaugggagaacuugagggugaucgggaaccuccccugcugagg

SEQ ID NO: 115746 - RNA, 64 nt, hsa
gaaguggaugaugugggaguugacaggccagggagagggugaagcagguaucagagucacuccu

SEQ ID NO: 115747 - RNA, 64 nt, hsa
gugcagaacacgguguuuuaagcuugagugaaaggagggugaggcugccgaugccuuccugccc

SEQ ID NO: 115748 - RNA, 64 nt, hsa
guugcaugagucggaucccaguccauugucaguggagggugagggugaccccaucugcuauuuu

SEQ ID NO: 115749 - RNA, 64 nt, hsa
ugagucggaucccaguccauugucaguggagggugagggugaccccaucugcuauuuuugugcu

SEQ ID NO: 115750 - RNA, 64 nt, hsa
uauuugaagcauguuuucuagcgauuguguggaugagggugagcuggcugaggcaucgcucaag

SEQ ID NO: 115751 - RNA, 64 nt, hsa
auuuaugcugguggcuuccauccguuccuccucugagggugaguggagggguauauggaaacac

SEQ ID NO: 115752 - RNA, 64 nt, hsa
cccaggccacacagacggacaugggcccacaugggagggugagcaggagcaaggcugugcuugc

SEQ ID NO: 115753 - RNA, 64 nt, hsa
aggcagauugaagcucagcagggaagaggcuuuugagggugauccaggcgcuggagggauggcc

SEQ ID NO: 115754 - RNA, 64 nt, hsa
gaauggcuggagucugcuguugucagaaggcagggagggugaugaaggacugacccacauggac

SEQ ID NO: 115755 - RNA, 64 nt, hsa
ugaggaggagggacaaggaagaugacuaguuacggagggugaggguuguuuuuugccaaaaagc

SEQ ID NO: 115756 - RNA, 64 nt, hsa
cauucucuagucugugaugucuggagcuaguuuugagggugaaccacacuuuauccaacauaca

SEQ ID NO: 115757 - RNA, 64 nt, hsa
guugggagcagugacagagagucauggccguggugagggugaaucccaaguggauggcucagga

SEQ ID NO: 115758 - RNA, 64 nt, hsa
cuaaccugguagagguagacgggcgcuucguguggagggugaacuuggaugcccugacccagca

SEQ ID NO: 115759 - RNA, 64 nt, hsa
ugggaggaaagacagccaugcugcuggcacuacagagggugagccgcccaugucuggggccucc

SEQ ID NO: 115760 - RNA, 64 nt, hsa
gcacgcuucucucguggucaugccaagaacacaggagggugagucuaacaagcacaccucaagc

SEQ ID NO: 115761 - RNA, 64 nt, hsa
gugacaagggagugaccauccauccccuccacaggagggugaggaauugggacagguaauucca

SEQ ID NO: 115762 - RNA, 64 nt, hsa
aucagccucccagaccugccagcagaugcugugugagggugauggagcacggggucacaccccu

SEQ ID NO: 115763 - RNA, 64 nt, hsa
uguccacgacccaggcuggacgaaugccuggucagagggugaccugaaccagagcuggagugag

SEQ ID NO: 115764 - RNA, 64 nt, hsa
ggaaagcaugauuaguuugcagguuaugguaggagagggugagauauaagacauacauacuuua

SEQ ID NO: 115765 - RNA, 64 nt, hsa
cagcuuacauuuggauucagaguuguugucuauggagggugagagcagaaacucuuaagaaauc

SEQ ID NO: 115766 - RNA, 64 nt, hsa
uucaccccaugucccuucuacacgcuuacucacugagggugagugggaacgcuugugauggugc

SEQ ID NO: 115767 - RNA, 64 nt, hsa
gggccagggcaggcaggagcaggcacugaugcuagagggugaugacccugcccucugccaccca

SEQ ID NO: 115768 - RNA, 64 nt, hsa
aucugcuuuugccuacgugacaacacaaauuugggagggugagacacugcacagaagacagcag

SEQ ID NO: 115769 - RNA, 64 nt, hsa
gcacacgcacgcacacacacauacagagcucucugagggugauggggcugagcaggaggggggc

SEQ ID NO: 115770 - RNA, 64 nt, hsa
gggaggagaggacaagggaaaugucaggggcggggagggugacaguggccgcccaaggcccacg

SEQ ID NO: 115771 - RNA, 64 nt, hsa
aacuguucccaccugcuggagugaaggggccaaggagggugagugcaaggggcgugggaguggc

SEQ ID NO: 115772 - RNA, 64 nt, hsa
uuaaggcccacuguuuuacuggggcccauuguaugagggugaaguuuggcaguuacccaagaga

SEQ ID NO: 115773 - RNA, 64 nt, hsa
gcacaguucaugcccuguaauccuagcacuuugggagggugaggcaggaggauggcucaagccc

SEQ ID NO: 115774 - RNA, 64 nt, hsa
ccuaucugugcauuuuaccggcaccucaggaaaggagggugaccagguugucuuagcuuguacu

SEQ ID NO: 115775 - RNA, 64 nt, hsa
gugugugugccuguguguguguagagacauaaaggagggugaugugauuuucagcuaguccuuu

SEQ ID NO: 115776 - RNA, 64 nt, hsa
uagcaucauuaagaucaguuuuaagggguauagggagggugagggaagugggggguguuaggua

SEQ ID NO: 115777 - RNA, 64 nt, hsa
uaaucauuuucccccuuuuauugguucuuguuuugagggugaggacaaggguuguggggagggg

SEQ ID NO: 115778 - RNA, 64 nt, hsa
guuguuacacuuccauaguugucuuagccgaauccuuccauauucuuaugauuacuuggguuaa

SEQ ID NO: 115779 - RNA, 64 nt, hsa
caaggguaaugaccaaauuuaugugguuguuacacuuccauaguugucuuagccgaauccuucc

SEQ ID NO: 115780 - RNA, 64 nt, hsa
uagauuucagcuaugcagaaaaauuuagcuuaugcuuccauauuuuuaaauuuuguuuuuuaag

SEQ ID NO: 115781 - RNA, 64 nt, hsa
ucuuguaagcucucuuccuaacagggcacauauucuuccauaauauaaacacuuuucugcccca

SEQ ID NO: 115782 - RNA, 64 nt, hsa
ugucacaauccuaacacauuaucgggagcagugucuuccauaauguauaaagaacaagguaguu

SEQ ID NO: 115783 - RNA, 64 nt, hsa
uuuuuuaauagaauauaauuaucggaagcagugccuuccauaauuaugacaguuauacugucgg

SEQ ID NO: 115784 - RNA, 64 nt, hsa
uuucacauagcugucuagaguagcuuaccagaagcuuccauaguggugcagaggaaguggaagg

SEQ ID NO: 115785 - RNA, 64 nt, hsa
uuuagacucaucuuacuguaccuguuccuuagaccuuccauaaugcuacugucucacugaaaca

SEQ ID NO: 115786 - RNA, 64 nt, hsa
aaugucuaaauccuauacucuaguugaggaagaucuuccauaauuuuaugguauuacacaggga

SEQ ID NO: 115787 - RNA, 64 nt, hsa
uaauauauaucagugagucuuacagaaagauaugcuuccauaauaugaaauagauuauucaaua

SEQ ID NO: 115788 - RNA, 64 nt, hsa
uggaaucagugcaggcaaaauuuaggauuugccgcuuccauaaaucaaagcaugacuaauaggg

SEQ ID NO: 115789 - RNA, 64 nt, hsa
uuuugugcacaccuauauuaccuuaagaaauuuccuuccauagacagcugccucaaagggaaau

SEQ ID NO: 115790 - RNA, 64 nt, hsa
cuuuucaaaacagggugcuccuccuggcuucuggcuuccauaagaagaaauggagaaaaaaaua

SEQ ID NO: 115791 - RNA, 64 nt, hsa
gcaauuacugaaaguggcugcaacagagaaaagacuuccauaaaggacgacaaaagaauuggac

SEQ ID NO: 115792 - RNA, 64 nt, hsa
aaaucagacauggcaaaacaauaauggcuguuugcuuccauaaacaagugcaauuuuuuaaagu

SEQ ID NO: 115793 - RNA, 64 nt, hsa
ugcuaaaaauaaagaugauagcauguucuucugucuuccauaguuauuacaacuaugagagccu

SEQ ID NO: 115794 - RNA, 64 nt, hsa
uguuuuuccuagauaauucucuaaaaauaugauucuuccauauagaaugcuaagcuuauuuuua

SEQ ID NO: 115795 - RNA, 64 nt, hsa
agauggggaaccugcuagugaacuaggagggagacuuccauagccucagacuuggauaggguag

SEQ ID NO: 115796 - RNA, 64 nt, hsa
agauauuucaaauuguuuucagugaaaacaaguccuuccauaauaguaacaacuccacagauuu

SEQ ID NO: 115797 - RNA, 64 nt, hsa
cuguauaaauaguuugguccccuuaaaugccaaucuuccauauuaguuuuacuuuuuuuuuuuu

SEQ ID NO: 115798 - RNA, 61 nt, hsa
uggagcuaagaguucagaggccaucaaggagagcagcaaguuuccauuuggcauuagccca

SEQ ID NO: 115799 - RNA, 61 nt, hsa
ugucucacauggaaacagaaaacgcugggucagcagcaagcuguaguuuuuaaaaauguuu

SEQ ID NO: 115800 - RNA, 61 nt, hsa
ucaauagauuuuuaggcugaauuaauuugaaagcagcaauuugcuguucucaaccauucuu

SEQ ID NO: 115801 - RNA, 61 nt, hsa
ucagaccaacaaaccuucccccugaaaagugagcagcaacguaaaaacguaugugaagccu

SEQ ID NO: 115802 - RNA, 61 nt, hsa
gcuccguccugacugcccugugcccuggaaaagcagcaauagcauccgccccuuagagccc

SEQ ID NO: 115803 - RNA, 61 nt, hsa
ggccuuguuagacagcacuugggccuuugccagcagcaagaggugaagcgaagccacucuu

SEQ ID NO: 115804 - RNA, 61 nt, hsa
aaaaagaagaagaagaaaaaaaacaagaacaagcagcaacagcuguuuuguuggggcuaua

SEQ ID NO: 115805 - RNA, 61 nt, hsa
uuucauggguaggaaagcuuguccugaccccagcagcaaagagguggcaggucgcuaauga

SEQ ID NO: 115806 - RNA, 61 nt, hsa
uucagacugaagcagcaauucugccacuaccagcagcaaccaggacgucuguucuuugugg

SEQ ID NO: 115807 - RNA, 61 nt, hsa
uacacccuggcaaggcuucucuucagacugaagcagcaauucugccacuaccagcagcaac

SEQ ID NO: 115808 - RNA, 61 nt, hsa
ugaauccgcccagugauagccugugggcaccagcagcaagggcugccaugggauacagcac

SEQ ID NO: 115809 - RNA, 61 nt, hsa
cacaaaugaagaagaacaaagagccugagaaagcagcaagaggacaugaugaaaaauacgu

SEQ ID NO: 115810 - RNA, 61 nt, hsa
gcaguuguauuguguaacaaguacugcucccagcagcaauuagggagaaaacuagucuaaa

SEQ ID NO: 115811 - RNA, 61 nt, hsa
gcuuguaggacuguucaccaagggggauaccagcagcaagagagugcacccguuuagcccu

SEQ ID NO: 115812 - RNA, 61 nt, hsa
gaaccaucuacgggcauagaccccacagggcagcagcaaauguggugagcaucauuauacc

SEQ ID NO: 115813 - RNA, 61 nt, hsa
aaaguugcuuuucaaagaggaagaagaaaauagcagcaagaaauaucucuuucuguguuca

SEQ ID NO: 115814 - RNA, 61 nt, hsa
cuaaauuuuuguaagaaaauuuaaaaauuaaagcagcaaaggaacuuuuugcuuucugcca

SEQ ID NO: 115815 - RNA, 61 nt, hsa
aaggcccagcccugggcaaggaagcuuuggaagcagcaaggugggggucaggcuacaggug

SEQ ID NO: 115816 - RNA, 61 nt, hsa
cacccuuucagaugugaccucuuuuggacuaagcagcaaucuguucucuugcucaaauaau

SEQ ID NO: 115817 - RNA, 61 nt, hsa
caucuacucaacucugcuguugacaugcaaaagcagcaauagacaauaugcguguaaauga

SEQ ID NO: 115818 - RNA, 64 nt, hsa
gaacggccaaauucccaugugagaggaagaugaccugauccaccuagccuuuucuucuggaucu

SEQ ID NO: 115819 - RNA, 64 nt, hsa
uguuuuuuauauaaguuuuuucuauucaguuucacugauccaacuggcaguggguaaauauggc

SEQ ID NO: 115820 - RNA, 64 nt, hsa
auuuuaugguaugagaaacugaucgcaggauuuucugauccauagcuauuaauugaaaacuucu

SEQ ID NO: 115821 - RNA, 64 nt, hsa
auggauucuagccuugcccguugcgcaguauauacugauccagaugauaaaccagugaacuaug

SEQ ID NO: 115822 - RNA, 64 nt, hsa
ccaggauguauggaauguuucauacucuuaugaccugauccaucaggaucagucccuauuaugc

SEQ ID NO: 115823 - RNA, 53 nt, hsa
cuuuuggcauucucuuccagguucugauccaggaugaaaauuuggaggaaaag

SEQ ID NO: 115824 - RNA, 64 nt, hsa
cuacgcuccagcugauccagauguuaugcuccugcugauccagaugcccagaggcuccaucguc

SEQ ID NO: 115825 - RNA, 64 nt, hsa
auacgcuccaacugauccagaugcuacgcuccagcugauccagauguuaugcuccugcugaucc

SEQ ID NO: 115826 - RNA, 64 nt, hsa; identical to SEQ ID NO: 60581

SEQ ID NO: 115827 - RNA, 64 nt, hsa; identical to SEQ ID NO: 60582

SEQ ID NO: 115828 - RNA, 64 nt, hsa
ugacagacggacagacagacaugcaaacaccagacugaagcacauguaauauagaccguguaug

SEQ ID NO: 115829 - RNA, 64 nt, hsa
aguugggggguagaggcaggaaaugggaaccgagcugaagcagaggcugaguuagggggcuaga

SEQ ID NO: 115830 - RNA, 64 nt, hsa
ucacacuacccuggucccugauugcaaggagcuucugaagcaagggugaauccuucccacacuc

SEQ ID NO: 115831 - RNA, 64 nt, hsa
aggcuggagggcagggugagccuccacaugggugcugaagcaagaaaccgacagauguugagga

SEQ ID NO: 115832 - RNA, 64 nt, hsa
gaggacuucucgcccucuggcuggaagcugauaccugaagcacucccaggcucaucaugggagc

SEQ ID NO: 115833 - RNA, 64 nt, hsa
aucuuccuccccacaccuacccacccagugggcccugaagcagggccaaacccucuuccuuguc

SEQ ID NO: 115834 - RNA, 64 nt, hsa
gcaaaacuuaauaauaauucuuuuuuaaaaucugcugaagcagccccauccggcgaaguucuug

SEQ ID NO: 115835 - RNA, 64 nt, hsa
gggagugcuuuguggcuuugggguccucugggagcugaagcacacggccauguuggagagcaaa

SEQ ID NO: 115836 - RNA, 64 nt, hsa
aucugaguacacccuggcaaggcuucucuucagacugaagcagcaauucugccacuaccagcag

SEQ ID NO: 115837 - RNA, 64 nt, hsa
uuuccccuccccuccacuucuuggguaaucugaccugaagcauaguccaggagcagaguuagcc

SEQ ID NO: 115838 - RNA, 64 nt, hsa
gaaggugggacgaaugacgaugcccauccacuaccugaagcacuaggacacucuugcagggcca

SEQ ID NO: 115839 - RNA, 64 nt, hsa
gccagcugggcagccccuuaaagccaaaccccaccugaagcagaaccacuuuggccuccccugc

SEQ ID NO: 115840 - RNA, 64 nt, hsa
ccagggugccauccugcaggcccugaggaccgcgcugaagcaccggacucuagaggcgaggccu

SEQ ID NO: 115841 - RNA, 64 nt, hsa
acaaacaggacagagccaggcuguugucuugacacugaagcagcuggugugggcuggaacuggc

SEQ ID NO: 115842 - RNA, 64 nt, hsa
gcuucuagcucaauucccugaagcacgugguacucugaagcacuugaaaaugggaagcgaugac

SEQ ID NO: 115843 - RNA, 64 nt, hsa
agacagguugccaguaggcuucuagcucaauucccugaagcacgugguacucugaagcacuuga

SEQ ID NO: 115844 - RNA, 64 nt, hsa
uagggagggauuucacucuucuucccagguucuucugaagcacccacacaaaaugcacacucug

SEQ ID NO: 115845 - RNA, 64 nt, hsa
uggcacgcaccuguaguccccgcuacgcagguggcugaagcagaagaaucacuugaaccugaga

SEQ ID NO: 115846 - RNA, 64 nt, hsa
uacaguuuuuccagccauucuuuucuucccccuccugaagcaagcaaagagcguggaggcgugu

SEQ ID NO: 115847 - RNA, 64 nt, hsa
ugauggcauguccaagugugcccagcagcggaugcugaagcaccagagcucaaggccuucaccu

SEQ ID NO: 115848 - RNA, 64 nt, hsa
ggggggacugccugacucccagagggacuugaaacugaagcaagaagguugcauucuccaccaa

SEQ ID NO: 115849 - RNA, 64 nt, hsa
aguugacggagcaaguuugaccuugguucuguugcugaagcaaauuuggaacuuuucugucuca

SEQ ID NO: 115850 - RNA, 64 nt, hsa
uuucucauuuaaucugauguggcauuuucgucaucugaagcaugagugacaaguugggaaugau

SEQ ID NO: 115851 - RNA, 64 nt, hsa
agcagacaagcacccauggaggcagguuucgggccugaagcagaucagagggcuuugcaaaaga

SEQ ID NO: 115852 - RNA, 64 nt, hsa
auggauguauugauaaauagauagaaccagucaucugaagcaacuuaagaauuguagccuugac

SEQ ID NO: 115853 - RNA, 59 nt, hsa
aaaagaaaggucuuuauagaccugcacagucacuagauuaauucauuaaaaugccccca

SEQ ID NO: 115854 - RNA, 59 nt, hsa
acauuugcccugaauuugaacacucaacaucacuagauuuaaauauuuaguauauuuug

SEQ ID NO: 115855 - RNA, 59 nt, hsa
gagcuacucaggagguugaggcaggggaaucacuagaacccaggaggcacuccagccug

SEQ ID NO: 115856 - RNA, 59 nt, hsa
uuauuauauugacauuguuaugcaacauaucacuagaguguuuuuuaucuugcaaagcu

SEQ ID NO: 115857 - RNA, 64 nt, hsa
uaaaguaugcuuuucuguuacauccaccuuugaggcuggucauaccuccaggaacaauacagag

SEQ ID NO: 115858 - RNA, 64 nt, hsa
ugacccaggcugggggcagguguguuggagacaggcuggucaaagaggugacaaugauuaagag

SEQ ID NO: 115859 - RNA, 64 nt, hsa
ugugaugcacaccuacccuugcuaaauaaacgcugcuggucagccucuagcccacaagccccuc

SEQ ID NO: 115860 - RNA, 64 nt, hsa
caggcuucugcaugccugguaaaguccagccaaggcuggucaaggcaacaucuccacacagaaa

SEQ ID NO: 115861 - RNA, 64 nt, hsa; identical to SEQ ID NO: 58780

SEQ ID NO: 115862 - RNA, 64 nt, hsa; identical to SEQ ID NO: 58781

SEQ ID NO: 115863 - RNA, 64 nt, hsa; identical to SEQ ID NO: 58782

SEQ ID NO: 115864 - RNA, 54 nt, hsa; identical to SEQ ID NO: 58783

SEQ ID NO: 115865 - RNA, 64 nt, hsa; identical to SEQ ID NO: 58784

SEQ ID NO: 115866 - RNA, 64 nt, hsa; identical to SEQ ID NO: 58785

SEQ ID NO: 115867 - RNA, 64 nt, hsa; identical to SEQ ID NO: 58786

SEQ ID NO: 115868 - RNA, 64 nt, hsa; identical to SEQ ID NO: 58787

SEQ ID NO: 115869 - RNA, 64 nt, hsa; identical to SEQ ID NO: 58788

SEQ ID NO: 115870 - RNA, 64 nt, hsa; identical to SEQ ID NO: 58788

SEQ ID NO: 115871 - RNA, 64 nt, hsa; identical to SEQ ID NO: 58790

SEQ ID NO: 115872 - RNA, 64 nt, hsa; identical to SEQ ID NO: 58791

SEQ ID NO: 115873 - RNA, 64 nt, hsa; identical to SEQ ID NO: 58792

SEQ ID NO: 115874 - RNA, 64 nt, hsa; identical to SEQ ID NO: 58793

SEQ ID NO: 115875 - RNA, 64 nt, hsa; identical to SEQ ID NO: 58794

SEQ ID NO: 115876 - RNA, 64 nt, hsa; identical to SEQ ID NO: 58795

SEQ ID NO: 115877 - RNA, 64 nt, hsa; identical to SEQ ID NO: 58796

SEQ ID NO: 115878 - RNA, 64 nt, hsa
uuaagccucuaaaagaccucgggcaagucucacagaaacugagcugcagacggggaguagcuuu

SEQ ID NO: 115879 - RNA, 64 nt, hsa
agaaacugagcugcagacggggaguagcuuuguggaaacugauuugauggacacugcaccagcu

SEQ ID NO: 115880 - RNA, 64 nt, hsa
uggaaaggugguucauguucauucucaucagugugaaacugaggagucugcaauuuggaauaug

SEQ ID NO: 115881 - RNA, 64 nt, hsa
uggccacuguggaaaucuugguuagggagucaaagaaacugagccuggggcaaacgaggcuucc

SEQ ID NO: 115882 - RNA, 64 nt, hsa
ucauccagucuuacugucucaauguacauacggggaaacugaagccaggagaagaagagggaga

SEQ ID NO: 115883 - RNA, 64 nt, hsa
cauacccagcccuauacgcagacccacagguggggaaacugaggcaggaacaggguucugcccu

SEQ ID NO: 115884 - RNA, 64 nt, hsa
gugcaaaugugugcucaagcuaauaaguuauugugaaacugaguuuccuuuaacuuacaaagcu

SEQ ID NO: 115885 - RNA, 64 nt, hsa
aaaaaugggaaacagacuaaauggcuauucacaggaaacugauaagauauauguuauuuuuuua

SEQ ID NO: 115886 - RNA, 64 nt, hsa
ucguuuucacaaaacuauuugaguagaauaaauggaaacugaauuccauuugugcccguuaaac

SEQ ID NO: 115887 - RNA, 64 nt, hsa
uauuuaaagucagauuuauagacucgaggagacagaaacugaaucccacaccuggugcaauuag

SEQ ID NO: 115888 - RNA, 64 nt, hsa
gguucaaaauucuguugaaagaaaaaugcuuucugaaacugagguauaacaccagagcuugcug

SEQ ID NO: 115889 - RNA, 64 nt, hsa
uguuaagccuguaggacuggaugaaugggguugugaaacugauuugacaagagaauaauuuaca

SEQ ID NO: 115890 - RNA, 53 nt, hsa
aaaagggaaagagaaagugagaagaaacugaagauggacucuauuaugugaag

SEQ ID NO: 115891 - RNA, 64 nt, hsa
agauggacucuauuaugugaaguaguaauguucagaaacugauuauuuggaucagaaaccauug

SEQ ID NO: 115892 - RNA, 64 nt, hsa
uaggaagaaaacaugacuuuaucauuuuguuauagaaacugauauauaaagguuacacauuuuc

SEQ ID NO: 115893 - RNA, 64 nt, hsa
gagcucuaacagaccgauuugcacccaugccauagaaacugaggccauuauuucaaccgcuugc

SEQ ID NO: 115894 - RNA, 64 nt, hsa
agcagaugaaugacuccaggaagaagguuaucaugaaacugaacucaccauuucuauuaauuuc

SEQ ID NO: 115895 - RNA, 64 nt, hsa
ugaaaaaagggcaccuuugucacuugaaaggaaugaaacugaaugcaaaauaagcuaauuccau

SEQ ID NO: 115896 - RNA, 64 nt, hsa
gagcuuuaguuuguauuuucacuuuaugaaugaggaaacugaaauggccuuaagggagcaaguu

SEQ ID NO: 115897 - RNA, 64 nt, hsa
gcuuggaggaccgagccacugacagguauccccugaaacugagcugagcccaguauccaaggau

SEQ ID NO: 115898 - RNA, 64 nt, hsa
cuauggaauccaaccuccccauugcacagauggggaaacugaggcuuaggaagagaaugaaacu

SEQ ID NO: 115899 - RNA, 64 nt, hsa
cagcucuauauuuuauccccguuuuauaaaagaggaaacugaaguucugaaaaucuccuuccag

SEQ ID NO: 115900 - RNA, 64 nt, hsa
uagagagguuggaaggggugguuggaaggggagagaaacugagauggcccucugugacucgacu

SEQ ID NO: 115901 - RNA, 64 nt, hsa
acuuaaaauggggaaacugagguuccaacugacagaaacugaggguccugcccucuucucuggc

SEQ ID NO: 115902 - RNA, 64 nt, hsa
agaucaacuagccaagucacucacuuaaaauggggaaacugagguuccaacugacagaaacuga

SEQ ID NO: 115903 - RNA, 64 nt, hsa
agguuaauaccaaguauucauuucaugauguaaagaaacugaacagugaaguggcuugauugcu

SEQ ID NO: 115904 - RNA, 64 nt, hsa; identical to SEQ ID NO: 115903

SEQ ID NO: 115905 - RNA, 64 nt, hsa
acuuuuagcuaacaauaagggcugugccccaauggaaacugaguucauuuucugagaaagguuu

SEQ ID NO: 115906 - RNA, 64 nt, hsa
ccucuacagucaaggacuuuggcaugugguggcugaaacugagcuuuuuugugugggcuccagu

SEQ ID NO: 115907 - RNA, 64 nt, hsa
aacuacuggaaacugaaugcauuuagcauauuuugaaacugaagucauucauuagguaacaagg

SEQ ID NO: 115908 - RNA, 64 nt, hsa
agucuuagcauacagugugugcccagaacuacuggaaacugaaugcauuuagcauauuuugaaa

SEQ ID NO: 115909 - RNA, 64 nt, hsa
agagugucagggccgucuccauuuuaugguugaggaaacugaggucuagagaggucaagauuac

SEQ ID NO: 115910 - RNA, 64 nt, hsa
agaaguagcaccauuauccccauuuaacagaagggaaacugaggcucggcaagcauaggcgagu

SEQ ID NO: 115911 - RNA, 63 nt, hsa
gaccacccagcuuucucccagccacagccaagauucccaaagucaaggcccaaagauuuccaa

SEQ ID NO: 115912 - RNA, 63 nt, hsa
auucccaaagucaaggcccaaagauuuccaagguucccaaagucaaggccaggccaaggccug

SEQ ID NO: 115913 - RNA, 63 nt, hsa
cuaaaagugcuagagaauuuaacuaaaagcugguucccaaaugcauagcuggcauuuuaauuu

SEQ ID NO: 115914 - RNA, 63 nt, hsa
guaaaucaucuaacuggauuuuuccauuggucauucccaaacacaccuaugguccuagaaucc

SEQ ID NO: 115915 - RNA, 63 nt, hsa
gggaaguuguugacccaagaacauagguuauauuucccaaaucuuuaauuauugagugaaaga

SEQ ID NO: 115916 - RNA, 63 nt, hsa
ccaucccaggaugugagugggucugaagauacauucccaaauaaacgaccuaggcuagaagau

SEQ ID NO: 115917 - RNA, 63 nt, hsa
cugcaaaacaggcugauuucaauuaggcagcacuucccaaagugcacugaggaagguggcccc

SEQ ID NO: 115918 - RNA, 63 nt, hsa
uccugaccucaggcgauccacccccaccucggcuucccaaagugcugagauuacaggugugag

SEQ ID NO: 115919 - RNA, 63 nt, hsa
gucaucugcuuuuucguucugcgauaugcccaguucccaaaucaauuauagguaccuguuuag

SEQ ID NO: 115920 - RNA, 63 nt, hsa
aucaaccccaggaaguaauuauuuacaacgauuuucccaaauuuuguacaaucuguccuggaa

SEQ ID NO: 115921 - RNA, 63 nt, hsa
gauagaccuuaaauaaguguccuaagucagugguucccaaaucuggcuggucgggaauaccug

SEQ ID NO: 115922 - RNA, 63 nt, hsa
uccaauugagaggaaaaugagaucaaaugucauuucccaaauuucuuguaggccguuguuuca

SEQ ID NO: 115923 - RNA, 63 nt, hsa
auauacuguagccuuuuaacagcaagucuugcuuucccaaacagaaagccauucugaaacccu

SEQ ID NO: 115924 - RNA, 63 nt, hsa
aucuccacugggggcuuacgggagugagcgguuuucccaaaacaagcccuuccuggcucccac

SEQ ID NO: 115925 - RNA, 63 nt, hsa
uucuaaagaauuuaauucuaaaaguuauagacauucccaaagauauaccugcaagcaucacag

SEQ ID NO: 115926 - RNA, 63 nt, hsa
gugaguuuuguaccuucuauuuuaaaagaggcuuucccaaacugugccauuuaucaauuuauu

SEQ ID NO: 115927 - RNA, 63 nt, hsa
aaugauuugcacuuuuucacugcaugcuuacaauucccaaaggcaaaaucuguacugagguag

SEQ ID NO: 115928 - RNA, 63 nt, hsa
aaccugcuugcuuccuaccacagauucuuuauuuucccaaacacuacaaaaaaacuuuuaaaa

SEQ ID NO: 115929 - RNA, 63 nt, hsa
ggcuuuaggcggcagaugauauacauaucugacuucccaaaagcuccaggauuugugugcugu

SEQ ID NO: 115930 - RNA, 63 nt, hsa
gggucagcucuuuuuaacuucuugcugcucuuuuucccaaaagguaaaaauauagauugaaaa

SEQ ID NO: 115931 - RNA, 63 nt, hsa
uucuuuaugcauugucucaacacuuucccuuuuuucccaaaaugaguagagaauuaaagccac

SEQ ID NO: 115932 - RNA, 63 nt, hsa
cauuuuuucuuuucaccacccuguugagcaauuuucccaaaaaaagggcagcaauuauuaaau

SEQ ID NO: 115933 - RNA, 63 nt, hsa
ugcauuuggauguguaaauuacaguaaucccauuucccaaaccuaaaaucuguuuuucucauc

SEQ ID NO: 115934 - RNA, 63 nt, hsa
ucucugcaguuuuucccaaguacccugagauacuucccaaagcccuuauguuuaaucagcgau

SEQ ID NO: 115935 - RNA, 63 nt, hsa
auacacaaaucuuuacuucucuaccaauuccuauucccaaaaugaacauauuacuggggaaag

SEQ ID NO: 115936 - RNA, 63 nt, hsa
gaugcacuuaugcaguaaauuaucuugggauaguucccaaaagauugcugaaaaaguagauug

SEQ ID NO: 115937 - RNA, 63 nt, hsa
cccuaaaucugagucaguaauucucuuacauccuucccaaaaaucagugucuagggacuaguu

SEQ ID NO: 115938 - RNA, 63 nt, hsa
ccuaaaucugagucaguaauucucuaaaaauccuucccaaaaaucagugucuagggacugguu

SEQ ID NO: 115939 - RNA, 63 nt, hsa
auauaacauuaaauaauguaacguagguguagauucccaaaugcauuuggauguacagaucga

SEQ ID NO: 115940 - RNA, 63 nt, hsa
ugcaguaggcauuacuacaguacauggcuaaucuucccaaaaacuagcucauuaaagaugaaa

SEQ ID NO: 115941 - RNA, 63 nt, hsa
gacgagccuugccugaccucuucggugcugaccuucccaaagugaugccuuacugguuuugua

SEQ ID NO: 115942 - RNA, 63 nt, hsa
auguugaguuaccaauggaagccaaaaguucucuucccaaacugccaagaaugauacaggcca

SEQ ID NO: 115943 - RNA, 63 nt, hsa
cugcguccucuguccccggguuucagagacaacuucccaaagcacaaagcaguuuuucccccu

SEQ ID NO: 115944 - RNA, 63 nt, hsa
uccacaccccccuuggggccuccccuccacuccuucccaaaucugucuccccagaagacacag

SEQ ID NO: 115945 - RNA, 63 nt, hsa
cagcaucuguccccagaaucaggcagaauccacuucccaaacagagccccacgcagguucacc

SEQ ID NO: 115946 - RNA, 63 nt, hsa
uuuuuacuuggcauugguuuugaaaccagcuguuucccaaacucugcuucccaagggcaaccg

SEQ ID NO: 115947 - RNA, 63 nt, hsa
cuaacugcagcucagcuuucacuauagcagugcuucccaaacggguucuagacuuggguguuu

SEQ ID NO: 115948 - RNA, 63 nt, hsa
aggggggccugccaagggggggccuuguucuuguucccaaacucugacuuggaagaacucagc

SEQ ID NO: 115949 - RNA, 63 nt, hsa
cuguuuaggcauuugugaaggauuccagagccuuucccaaagugagaccauuucugggguauu

SEQ ID NO: 115950 - RNA, 63 nt, hsa
uuagcuuugugucaccuuugaaucugaggcaguuucccaaacaaaaaggcuggagccauuuuu

SEQ ID NO: 115951 - RNA, 63 nt, hsa
uggagccauuuuucagaaguugcuuauacccuguucccaaacuaucagccuugauuaauuucu

SEQ ID NO: 115952 - RNA, 63 nt, hsa
guuuuuggaaaaacaaaauuucuacaauuacaguucccaaagucaguuauucauguuuucauu

SEQ ID NO: 115953 - RNA, 63 nt, hsa
guucuuggauaaagaaaauuucuacaauuacaguucccaaagacacaguuguucauguuauuu

SEQ ID NO: 115954 - RNA, 63 nt, hsa
gaggaccgacuuuauaacuuuuccaguguuugauucccaaauugggucugguuuuguuuugga

SEQ ID NO: 115955 - RNA, 63 nt, hsa
gauugcuucagaugaaaacaaaucacacaccguuucccaaaccaacagucuucacauuucuau

SEQ ID NO: 115956 - RNA, 64 nt, hsa; identical to SEQ ID NO: 110360

SEQ ID NO: 115957 - RNA, 64 nt, hsa; identical to SEQ ID NO: 110361

SEQ ID NO: 115958 - RNA, 64 nt, hsa; identical to SEQ ID NO: 110362

SEQ ID NO: 115959 - RNA, 64 nt, hsa; identical to SEQ ID NO: 110363

SEQ ID NO: 115960 - RNA, 64 nt, hsa; identical to SEQ ID NO: 110364

SEQ ID NO: 115961 - RNA, 64 nt, hsa; identical to SEQ ID NO: 110365

SEQ ID NO: 115962 - RNA, 64 nt, hsa; identical to SEQ ID NO: 110366

SEQ ID NO: 115963 - RNA, 64 nt, hsa; identical to SEQ ID NO: 110367

SEQ ID NO: 115964 - RNA, 64 nt, hsa; identical to SEQ ID NO: 110368

SEQ ID NO: 115965 - RNA, 64 nt, hsa; identical to SEQ ID NO: 110369

SEQ ID NO: 115966 - RNA, 64 nt, hsa; identical to SEQ ID NO: 110370

SEQ ID NO: 115967 - RNA, 64 nt, hsa; identical to SEQ ID NO: 110371

SEQ ID NO: 115968 - RNA, 64 nt, hsa; identical to SEQ ID NO: 110372

SEQ ID NO: 115969 - RNA, 64 nt, hsa; identical to SEQ ID NO: 110373

SEQ ID NO: 115970 - RNA, 64 nt, hsa; identical to SEQ ID NO: 110374

SEQ ID NO: 115971 - RNA, 64 nt, hsa; identical to SEQ ID NO: 110375

SEQ ID NO: 115972 - RNA, 64 nt, hsa; identical to SEQ ID NO: 110376

SEQ ID NO: 115973 - RNA, 64 nt, hsa; identical to SEQ ID NO: 110377

SEQ ID NO: 115974 - RNA, 64 nt, hsa; identical to SEQ ID NO: 110378

SEQ ID NO: 115975 - RNA, 64 nt, hsa; identical to SEQ ID NO: 110379

SEQ ID NO: 115976 - RNA, 64 nt, hsa; identical to SEQ ID NO: 110380

SEQ ID NO: 115977 - RNA, 64 nt, hsa
aaacuccugaccucaggugauccgcccaccucagccucccaaagugcugggaugacagguguga

SEQ ID NO: 115978 - RNA, 64 nt, hsa
cgccucucagguucaagugguucuccuuccucagccucccaaguagcugggauuacaggcaccu

SEQ ID NO: 115979 - RNA, 64 nt, hsa
aguaugguaggggguuugaagaauccccuguccaccucccaaauccaggcccggcccccucugg

SEQ ID NO: 115980 - RNA, 64 nt, hsa
ucaaucuccugaccucgugauccacccaccucgaccucccaaagugcugagauuacaggcguga

SEQ ID NO: 115981 - RNA, 64 nt, hsa
aaacuccugaccucaagugaucugcccgccucggccucccaaagugcuggaaccacaggccuga

SEQ ID NO: 115982 - RNA, 64 nt, hsa
aggaucucuuggccucaugaucagccugccucggccucccaaagugcugggauuacagguguga

SEQ ID NO: 115983 - RNA, 64 nt, hsa
cgccuccuggguucaagcaguucucuugccucagccucccaaguagcugggaugacaggcgcac

SEQ ID NO: 115984 - RNA, 64 nt, hsa
gaacuccugaccucaggugauccacccaccuuggccucccaaagugcugggauuacagguguga

SEQ ID NO: 115985 - RNA, 64 nt, hsa
cucugccucccggguucaagccauucugccucagccucccaaguagcugggaguacaggcgucu

SEQ ID NO: 115986 - RNA, 64 nt, hsa
ucgauauccugaucucgugauccgccugccucugccucccaaagugcugggauuacagguguga

SEQ ID NO: 115987 - RNA, 64 nt, hsa
gaacuccuaaccucgggugauccacccaccuuggccucccaaaguguuaggauuacaggcauga

SEQ ID NO: 115988 - RNA, 64 nt, hsa
uugaucucuugaccucgugauccguccaccucagccucccaaagugcugggauuacagguguga

SEQ ID NO: 115989 - RNA, 64 nt, hsa
ggacuccugaccucaggucauccuccugccucggccucccaaagugcugagacuacagguguga

SEQ ID NO: 115990 - RNA, 64 nt, hsa
agaagaucucugccuacaugaaguccagccgcuuccucccaaaaccucuguacacaaggguggc

SEQ ID NO: 115991 - RNA, 64 nt, hsa
gccucagcuacccacuuuccuucaugaacaucccccucccaacacuacccuucccugcacuaaa

SEQ ID NO: 115992 - RNA, 64 nt, hsa
aaacuccuggccucaggugauccucuugucucagccucccaaagugcugggauuacaggcauga

SEQ ID NO: 115993 - RNA, 64 nt, hsa
ugccucuuggguucaagcgauucuccugccucagccucccaaguagcugggauuacaggcauac

SEQ ID NO: 115994 - RNA, 64 nt, hsa
gaacuccugaccucaaguaaucugcccaccucggccucccaaagugcuaggauuacaggaguga

SEQ ID NO: 115995 - RNA, 64 nt, hsa
ugcccuccagguucaagugauucuccucccucagccucccaaguagcugggauuacaggcaccc

SEQ ID NO: 115996 - RNA, 64 nt, hsa
gaauuccagaccucaggugauccacccgccucggccucccaaagugcugggauuacaggugcga

SEQ ID NO: 115997 - RNA, 64 nt, hsa
ugccuccugggcucaagcaauccucccacuucagccucccaaauagcuggggcuaccaugguau

SEQ ID NO: 115998 - RNA, 64 nt, hsa
aaacuccuggccucaugugaucugcccaccucagccucccaaaguacagggauuagaguuguga

SEQ ID NO: 115999 - RNA, 64 nt, hsa
gaacuccugaccucaggugauccgcccgccucggccucccaaagugcugggauuacaggcguga

SEQ ID NO: 116000 - RNA, 64 nt, hsa
caccucccggguucaagugauucuccugccucagccucccaaguagcugggauuacaggcaccc

SEQ ID NO: 116001 - RNA, 64 nt, hsa
gaacuacugagcucaagcaaucugccugcuucagccucccaaaguacugggauuuaggcaugag

SEQ ID NO: 116002 - RNA, 64 nt, hsa
aauacccaauagguuuuuuucugaucuucucccuccucccaaccuacacccucaaguagacccc

SEQ ID NO: 116003 - RNA, 64 nt, hsa
aaacuucugaccucaggugauccacccacuuugaccucccaaagugcugggauuacuagacgua

SEQ ID NO: 116004 - RNA, 64 nt, hsa
gaacuccuggccucaagugguccuccugccucagccucccaaaguguggggauuacaggugcga

SEQ ID NO: 116005 - RNA, 64 nt, hsa
gaacuccuaaccucaagugauccacccgccucagccucccaaagugcugggauuacagguguga

SEQ ID NO: 116006 - RNA, 64 nt, hsa
ucgaacuccugaccucguaaucugcccaccucggccucccaaaguucugggauuacagguguga

SEQ ID NO: 116007 - RNA, 64 nt, hsa
uccggccucugcucuccccacguucacccacccuccucccaauuguuuccccuucacacuccug

SEQ ID NO: 116008 - RNA, 64 nt, hsa
ucgaucucuugaccucgugaucugccugccuuggccucccaaagugcugggauuacaggcguga

SEQ ID NO: 116009 - RNA, 64 nt, hsa
caucacuccccacuucuuucugcugugcugcuucccucccaaacuccauuucugucacccuuuu

SEQ ID NO: 116010 - RNA, 64 nt, hsa
ucgaucuccugaccucgugauccgccugccucugccucccaaagugcugggauuacaggcguga

SEQ ID NO: 116011 - RNA, 64 nt, hsa
cgccucccagguugacaccauucuccugccucacccucccaaguagcugggacuacaggcgccu

SEQ ID NO: 116012 - RNA, 64 nt, hsa
gaacuccuggccucaagcaauccucucuccucagccucccaaagugcugggauuacaaguguga

SEQ ID NO: 116013 - RNA, 64 nt, hsa
aaacuccuggguucaagcaauccucccaccucggccucccaaagugcugggauugcaggcauga

SEQ ID NO: 116014 - RNA, 64 nt, hsa
gagguuguggaauuucuuucuucuccccuucuucccucccaaaagcuuagcuauguauaaagug

SEQ ID NO: 116015 - RNA, 64 nt, hsa
aauuaugaucugacuggaaaacaauccuguauccccucccaaagaaucaugggcuuuuuuuuug

SEQ ID NO: 116016 - RNA, 64 nt, hsa
aaacuccuaggcuuaagugauccucccgccuuagccucccaagugcuaggauuacaggcaucag

SEQ ID NO: 116017 - RNA, 64 nt, hsa
ugccucccagcuucaagcgauucuccuguaucagccucccaaguagcugggauuauaggcaugu

SEQ ID NO: 116018 - RNA, 64 nt, hsa
ugccucccggauucaagugauucuccugucucagccucccaaguagcugggauuacagugccug

SEQ ID NO: 116019 - RNA, 64 nt, hsa
ucgaacuccugaccucaugagccgcccgccuuggccucccaaagugcugggacgugacaggagu

SEQ ID NO: 116020 - RNA, 64 nt, hsa
gaacucuugagcucaagcagucuacccaccuugaccucccaaagugcugggauuacaggcuuga

SEQ ID NO: 116021 - RNA, 64 nt, hsa
ugccuucugggcucaagcaauccucccacuucaaccucccaaguagcugggacuauaggcaugc

SEQ ID NO: 116022 - RNA, 64 nt, hsa
aaacuccugggcucaagugaucccccugccuuggccucccaaacuggugagauuacaggcauga

SEQ ID NO: 116023 - RNA, 64 nt, hsa
auggcucacugaagucuugaccccgcugccucagccucccaaauaacuggggccacaggugugc

SEQ ID NO: 116024 - RNA, 64 nt, hsa
aaacucuugacuucaagugauccgcccgccucagccucccaaagugcugggauuacagguguga

SEQ ID NO: 116025 - RNA, 64 nt, hsa
caccuccuggguucaagugauucuugugccucagccucccaaguagcugggauuaaaggcacgu

SEQ ID NO: 116026 - RNA, 64 nt, hsa
aaacuccugacuucaggugaucugucugccucggccucccaaagagcugagauuacaggcguga

SEQ ID NO: 116027 - RNA, 64 nt, hsa
caccuccugaguucaagccauucuccuaccucagccucccaaguagcugggacuaugggugcac

SEQ ID NO: 116028 - RNA, 64 nt, hsa
cucccccuggguugaagcaauucucaugccucagccucccaaguagccaggacuauaggcaccu

SEQ ID NO: 116029 - RNA, 64 nt, hsa
ucgaucucuugaccuugggauccacccgccuuggccucccaaagugcugggauuacagguguga

SEQ ID NO: 116030 - RNA, 64 nt, hsa
gaaacccuuggcucaagcaauuugccugccucagccucccaaagugcugggauuacaggcguga

SEQ ID NO: 116031 - RNA, 64 nt, hsa
caccuccuggguucaugccauucuucugccucagccucccaaguagcugggacuacaggugccc

SEQ ID NO: 116032 - RNA, 64 nt, hsa
ucgaucuccugaccuugugauccaccugucucggccucccaaagugcugggauuacaggccuca

SEQ ID NO: 116033 - RNA, 64 nt, hsa
gaacuccugaccuccagugauccgccugccuugaccucccaaagugcugggauuacagacauga

SEQ ID NO: 116034 - RNA, 64 nt, hsa
aacuccuggacuuaacgccauccaccugccacagccucccaaagugcuaggaauacaggagugc

SEQ ID NO: 116035 - RNA, 64 nt, hsa
ccgccuccugggucaaaugauucuccugcuuuagccucccaaguagcugggacuacagguguac

SEQ ID NO: 116036 - RNA, 64 nt, hsa
aaacuccugagcucaagugauccucccgucucagccucccaaagggcugagauuacagguguga

SEQ ID NO: 116037 - RNA, 64 nt, hsa
aaccuccccggcucaagugauccuccugccucagccucccaaguagcugggacuacaggcguuc

SEQ ID NO: 116038 - RNA, 64 nt, hsa
gaacuccuggacucaaaguauccucccgccucggccucccaaaguguugggauuauaggaguga

SEQ ID NO: 116039 - RNA, 64 nt, hsa
cgaacuccuggccuaggugauccacccgccucgaccucccaaagugcugggauuacaggcauga

SEQ ID NO: 116040 - RNA, 64 nt, hsa
gcuaccucuaccaugagcaauucuccugccucagccucccaaguagcuggaacuacaggcucau

SEQ ID NO: 116041 - RNA, 64 nt, hsa
ucaaacuccugacuuugugauccacccgccucggccucccaaagugcugggauuacaggcauga

SEQ ID NO: 116042 - RNA, 64 nt, hsa
ucgaucuccugacgucgugauccacccgccucggccucccaaaaugcugggauuacagguguga

SEQ ID NO: 116043 - RNA, 64 nt, hsa
aaacuccugggcucaagcaauccacccaccucugccucccaaagugcugggauuacaggcguga

SEQ ID NO: 116044 - RNA, 64 nt, hsa
aaccuccugggcucaagcaauccuccugccucggccucccaaagugcugggauuacagauguga

SEQ ID NO: 116045 - RNA, 64 nt, hsa
ugccuccugggcucaagcaauucucccaccucagccucccaaauagcugggaucacuggcacaa

SEQ ID NO: 116046 - RNA, 64 nt, hsa
ccccucuccucccaaaccaaaaaccauugucuuaccucccaacuggaagacagcucgagaucca

SEQ ID NO: 116047 - RNA, 64 nt, hsa
gacaaauaaucucuuggaucugccgccccccucuccucccaaaccaaaaaccauugucuuaccu

SEQ ID NO: 116048 - RNA, 64 nt, hsa
ucgaacucuggguucaagaaauccucccaccuugccucccaaagugcugggauuacagguguga

SEQ ID NO: 116049 - RNA, 64 nt, hsa
ugccuucuggauucaagugauucuugugccuuagccucccaaguagcugggauuacaggcgugc

SEQ ID NO: 116050 - RNA, 64 nt, hsa
agguuucauuucagggcauagucaaaggcaucauccucccaacuacccacuugauuauguauuu

SEQ ID NO: 116051 - RNA, 64 nt, hsa
uugaucuccugaccucgugauccacccgccucagccucccaaagugcugggauugcaggcauga

SEQ ID NO: 116052 - RNA, 64 nt, hsa
gaacuccugaccucaggugauccaccugccucagccucccaaagugcugggauuacaggcauga

SEQ ID NO: 116053 - RNA, 64 nt, hsa
ugccucccgaguucaagcaauucuccugccucagccucccaaguagcugggacuacaggugcau

SEQ ID NO: 116054 - RNA, 64 nt, hsa
gaacuccugaccucaggugaucugcccaccuuggccucccaaagugcugggauuacaggcauga

SEQ ID NO: 116055 - RNA, 64 nt, hsa
gaacuccugaccucaacugauccgcccaccuuggccucccaagugcugggauuacaggcgcgag

SEQ ID NO: 116056 - RNA, 64 nt, hsa
caccuccuggguucaagcauuucuccugccucagccucccaaguagcugggauuacaggcagca

SEQ ID NO: 116057 - RNA, 64 nt, hsa
aaacuccugaccucaagugauccgcccuccccagccucccaaagugcugggauuacagguguga

SEQ ID NO: 116058 - RNA, 64 nt, hsa
gcaguggcgcaaucucgggucacugcaagcucugccucccaaguucaugccauucuccugccuc

SEQ ID NO: 116059 - RNA, 64 nt, hsa
ugccucccaaguucaugccauucuccugccucagccucccaaguagcugggacuacaggcaccu

SEQ ID NO: 116060 - RNA, 64 nt, hsa
gucuugaucugaccucgugauccgccgaccucggccucccaaagugcuggaauuacaggcguga

SEQ ID NO: 116061 - RNA, 64 nt, hsa
cugccucccaguucaagcaauucuucugccucagccucccaaguagcugggauuacaggcaccc

SEQ ID NO: 116062 - RNA, 64 nt, hsa
aaacuucugaccucaagugaucugcccaccuuggccucccaaagugcugggauuacagguguaa

SEQ ID NO: 116063 - RNA, 64 nt, hsa
caccucccagguucaagcaauucuucugccucagccucccaaguagcugggauuacaggugccu

SEQ ID NO: 116064 - RNA, 64 nt, hsa
aaacuccugaccucaagugauccaccugccucagccucccaaagugcugggauuauagucguga

SEQ ID NO: 116065 - RNA, 64 nt, hsa
uugaucucuugaccucgugaucugccugccucggccucccaaagugcuggcauuacaggcauga

SEQ ID NO: 116066 - RNA, 64 nt, hsa
caccucccggguucaagugauucucuggccucagccucccaaguagcugggacuacaggugugu

SEQ ID NO: 116067 - RNA, 64 nt, hsa
aaacuccugaccuccagugaucugcccaccucggccucccaaagugcugggauuacagguguga

SEQ ID NO: 116068 - RNA, 64 nt, hsa
ucaaucuccugaccuugugaaccacccgucucggccucccaaagugcugggauuacagguguga

SEQ ID NO: 116069 - RNA, 64 nt, hsa
ugcuucccagguucacgccauucuccuggcucagccucccaaguagcugggacuacaggcaccc

SEQ ID NO: 116070 - RNA, 64 nt, hsa
aaacccuugagcucaagugaucuucccacaccagccucccaaaauacugggauuacaggcuuga

SEQ ID NO: 116071 - RNA, 64 nt, hsa
gaccuccuugacucaauugauccucccaucucagccucccaaguagcuaggacuacagacaugu

SEQ ID NO: 116072 - RNA, 64 nt, hsa
uuggccucgaacucaggugaucugccagccuccgccucccaacgugcugggauuacaggcauga

SEQ ID NO: 116073 - RNA, 64 nt, hsa
ugcuuccuggguucaaacaauucucaugccucagccucccaagcagcugggacuacaggcaugu

SEQ ID NO: 116074 - RNA, 64 nt, hsa
ucgaucuccugaccucaugauccacccgccucagccucccaaaguguugggauuacaggcguga

SEQ ID NO: 116075 - RNA, 64 nt, hsa
ugccuccuggguucaagcgauucuccugccucugccucccaaguagcugggauuacaggcaccc

SEQ ID NO: 116076 - RNA, 64 nt, hsa
caccuuccugguucaagggauucuccugccucagccucccaaguagcugggauuacaggcaugc

SEQ ID NO: 116077 - RNA, 64 nt, hsa
gaacuucugaccucaggugaucugcccaccucggccucccaaagugcugggauuacaggcguga

SEQ ID NO: 116078 - RNA, 64 nt, hsa
gaacuccugggcucaagugauccuccugccuuggccucccaaaaugcugggauuacaggcauga

SEQ ID NO: 116079 - RNA, 64 nt, hsa
cgccucccggguucaagcaauucuccugccucagccucccaaguagcugggauuacaggugucu

SEQ ID NO: 116080 - RNA, 64 nt, hsa
gaacuccugaccucaggugauccacccgccucagccucccaaagugcugggauuacaggcaaaa

SEQ ID NO: 116081 - RNA, 64 nt, hsa
ucgaacuccugaccuugugaugcucccaccucggccucccaaagugcugggauuaaagcuguga

SEQ ID NO: 116082 - RNA, 64 nt, hsa
ucgaucuccugaccucaugauccucccgccucagccucccaaaaugcugggauuacaggcguga

SEQ ID NO: 116083 - RNA, 64 nt, hsa
ugccuccugggcucaacggauccuuccaccucagccucccaaguagcuuggacuauaggugcau

SEQ ID NO: 116084 - RNA, 64 nt, hsa
gaacuccugggcucaagccauccucccuccucagccucccaaaauucugggauuacaggcauaa

SEQ ID NO: 116085 - RNA, 64 nt, hsa
uuaaacucuugaccucauguuccacccgccacggccucccaaagugcugugauuaccgguguga

SEQ ID NO: 116086 - RNA, 64 nt, hsa
uaacuucugagcucaagagaugcacuccccucagccucccaaagugcugggauuacaggcggcc

SEQ ID NO: 116087 - RNA, 64 nt, hsa
aacugauguuuguuuuuuaaaggguaagaugcugccucccaaugggugaugccaucugacuggu

SEQ ID NO: 116088 - RNA, 64 nt, hsa
caccucccagguucaagugauucuccugucucagccucccaaguagcugggacuacaggcauga

SEQ ID NO: 116089 - RNA, 64 nt, hsa
aggaccugagccagaugcacaccaucucugauggccucccaaaccaaugugccuguuucucuuc

SEQ ID NO: 116090 - RNA, 64 nt, hsa
ccacauccccugcuugagcccagcgcugcaugucccucccaagaaguccagaaugccugcaaau

SEQ ID NO: 116091 - RNA, 64 nt, hsa
ggacuccugguuucaagugauccucucaucuuggccucccaaagugcugggauuacagggacga

SEQ ID NO: 116092 - RNA, 64 nt, hsa
gucucgaacucgaccucgugauccgccgccucggccucccaaagugcuaggauuacaggcguga

SEQ ID NO: 116093 - RNA, 64 nt, hsa
gaacuccuggucucgagugaucuuccuaucucagccucccaaagugcugggacuacaggcauga

SEQ ID NO: 116094 - RNA, 64 nt, hsa
caacuccugggcucaagcaauccugcugucucagccucccaaguaacuaagacuacaggcaugc

SEQ ID NO: 116095 - RNA, 64 nt, hsa
gaacuccugaccucaagugaucuuccggccucagccucccaaagugcuggauuacaggcgugag

SEQ ID NO: 116096 - RNA, 64 nt, hsa
cuuggcucauugcaaccucugccucccaggucagccucccaaguagcugggauuacaccaccau

SEQ ID NO: 116097 - RNA, 64 nt, hsa
uaacucccagguucaagcuauucuccugccucagccucccaaguagcuggauuacaggcauaca

SEQ ID NO: 116098 - RNA, 64 nt, hsa
ucgcuacagggcaccuaucuguuaucgcugcuguccucccaacagcugucuccaguucuaguuc

SEQ ID NO: 116099 - RNA, 64 nt, hsa
cgccucccagguucaagcgauucuccugccucagccucccaauuuacugggauuacaggcaccu

SEQ ID NO: 116100 - RNA, 64 nt, hsa
gaacuccugaccucaagugauucaccugccucggccucccaaagugcugggauuacaggcguga

SEQ ID NO: 116101 - RNA, 64 nt, hsa
uaccuccuggguucaagcaagucuccugucucagccucccaaguagcugggauuacaggcaugu

SEQ ID NO: 116102 - RNA, 64 nt, hsa
agcugaguggagcucagcuguguuugacccacauccucccaauuuguucuguauuuagguaguu

SEQ ID NO: 116103 - RNA, 64 nt, hsa
aacuuccugaccucagguuauccacccaccucagccucccaaagugcugggauuacagguguga

SEQ ID NO: 116104 - RNA, 64 nt, hsa
caccuccuggguucaagugauucucgugccucagccucccaaguagcugggguuacaggcgccc

SEQ ID NO: 116105 - RNA, 64 nt, hsa
ucaaucuccugaccucgugauccacccgccuuggccucccaaagugcugggauuacaggcguga

SEQ ID NO: 116106 - RNA, 64 nt, hsa
acaguggcgcgaucucagcucacugcaagcuccgccucccaaguucacuccauucuccugccuc

SEQ ID NO: 116107 - RNA, 64 nt, hsa
aaacuccugaccucaggugauccacuugccucggccucccaaagugcugagauuacaaguguga

SEQ ID NO: 116108 - RNA, 64 nt, hsa
caccuccuggguucaagcgauucuucugccucagccucccaaguagcuaggauuacaagugccu

SEQ ID NO: 116109 - RNA, 64 nt, hsa
gaacucccgaccucaggugauccacccaccccggccucccaaaaugcugggaucacaggcguga

SEQ ID NO: 116110 - RNA, 64 nt, hsa
gcucucccgggcuccagugauccucccgccucagccucccaaguagcugggauuauaggugugu

SEQ ID NO: 116111 - RNA, 64 nt, hsa
aaacucccagccucaagcgaugcucccaccuccaccucccaaagugcugggauuacaggcguga

SEQ ID NO: 116112 - RNA, 64 nt, hsa
caccucccagacucaagccauccucccaccucaaccucccaaguagcugggacuacaggcauau

SEQ ID NO: 116113 - RNA, 64 nt, hsa
gaaauucugggcuaaagcaauccuaccaccuuggccucccaaagugcugagauuacaggcauga

SEQ ID NO: 116114 - RNA, 64 nt, hsa
ugccucccagguucaagugauucuccugccucagccucccaaguagcugggauuacaggcgugc

SEQ ID NO: 116115 - RNA, 64 nt, hsa
gaacucccgaccucaggugauccgccagccucagccucccaaagugcugggauuacaggcguga

SEQ ID NO: 116116 - RNA, 64 nt, hsa
aaauuccugaccucaagugauccaccugccuuagccucccaaagugcugggauuacaggcauga

SEQ ID NO: 116117 - RNA, 64 nt, hsa
ucgaucucuugaccuuguguuccacccgccuuggccucccaaagugcuggaauuacaggcauga

SEQ ID NO: 116118 - RNA, 64 nt, hsa
ugacuccaggguucaggugauuauuuugccucagccucccaagcagcugggauuauagacaccc

SEQ ID NO: 116119 - RNA, 64 nt, hsa
gaacuccugaccucaggugauccgcccgccucggccucccaaagugcugggauuacagacguga

SEQ ID NO: 116120 - RNA, 64 nt, hsa
gaacuccuggccucaagcgauccgccuaccucagccucccaaagugcuaggauuacaggcauaa

SEQ ID NO: 116121 - RNA, 64 nt, hsa
cuccuccuggauucaagcaauucucuugcuucagccucccaaguagcugagacuacaagcaccc

SEQ ID NO: 116122 - RNA, 64 nt, hsa
ucgaucuccugaccucgugauccacccgccucggccucccaaagugcugggauuacaggcuuga

SEQ ID NO: 116123 - RNA, 64 nt, hsa
gcacaacuucaguaaaaacacugcacaugcguccccucccaagugcuggcaggccacugugcau

SEQ ID NO: 116124 - RNA, 64 nt, hsa
auaaugaguggcagcuggcgccagggaacgauggccucccaauagauaggaaacaccugaagcu

SEQ ID NO: 116125 - RNA, 64 nt, hsa
aaacuccugaguucaagcaauccaccuuccucggccucccaaaguacuaggaguacaggcauag

SEQ ID NO: 116126 - RNA, 64 nt, hsa
aacgucccccgcucaggugguccuuccaccucagccucccaaguagcugggaccacaagugugc

SEQ ID NO: 116127 - RNA, 64 nt, hsa
ccguuagagagcugagacccuuauuuaaaacucaccucccaaucaccccaaacaaauggaagag

SEQ ID NO: 116128 - RNA, 64 nt, hsa
ccaccuggaaucccacaacaucagcucugugccaccucccaagagggcuccucacuaucuaggg

SEQ ID NO: 116129 - RNA, 64 nt, hsa
ucgaucuccugaccuugugaucugcccgccucggccucccaaagugcugggauuacaggcguga

SEQ ID NO: 116130 - RNA, 64 nt, hsa
ucgaucuccuaaccuggugauccgcccgccucggccucccaaaguauugggauuacccgcguga

SEQ ID NO: 116131 - RNA, 64 nt, hsa
cgccucucggguucacgccauucuccugccucagccucccaaguagcucggacuacaggcgucc

SEQ ID NO: 116132 - RNA, 64 nt, hsa
gaauuccugaccucaggugaucugcccaccucagccucccaaagugcugggauuacaggcguga

SEQ ID NO: 116133 - RNA, 64 nt, hsa
guaggauuaauucgaaaauaggcagaauuccauuccucccaagguggcaaaaauuagcuauacu

SEQ ID NO: 116134 - RNA, 64 nt, hsa
uguuauacagaauugaaagccuucguaucuugaaccucccaacauuuuucuuauggcuguugaa

SEQ ID NO: 116135 - RNA, 64 nt, hsa
gaacuccugaccacagguaaucagcccgccucggccucccaaagugcugggauuacaggcguga

SEQ ID NO: 116136 - RNA, 64 nt, hsa
gucuugaacugaccucaugauccaccugccucagccucccaaaaugcugggauuacaggcuuga

SEQ ID NO: 116137 - RNA, 64 nt, hsa
ucgaucucuugaccucaugauccacccgccucgaccucccaaagugcugugauuacagguguga

SEQ ID NO: 116138 - RNA, 64 nt, hsa
uugcccaggucucaaacucccgaucucaagccacccucccaaaaugcugugauuauaggccaga

SEQ ID NO: 116139 - RNA, 64 nt, hsa
aaacuccugggcucaagagauccuuuugcuucagccucccaagcagcuaggacuacaggcacau

SEQ ID NO: 116140 - RNA, 64 nt, hsa
aaacuccugaccucaggugguccuucugccuuggccucccaaagugcugggauuacaggcguga

SEQ ID NO: 116141 - RNA, 64 nt, hsa
ucgaucuccugaccucgugaucugcccgccucagccucccaaagugcugggauuacaggaguga

SEQ ID NO: 116142 - RNA, 64 nt, hsa
uuuuuuuuuauuuugagcaauucuccugccucagccucccaaauagcugggauuacaggugcau

SEQ ID NO: 116143 - RNA, 64 nt, hsa
aaacuccugaccucagaugauccgccugccuuggccucccaaagugcugggauuacaggugugg

SEQ ID NO: 116144 - RNA, 64 nt, hsa
gaacuccugaccucaggugauacacccaucucggccucccaaagugcugggauuacaggcuuga

SEQ ID NO: 116145 - RNA, 64 nt, hsa
uacaggcuggccucaagugauccucuuaccuuggccucccaaacaccgggauuauaggcgugag

SEQ ID NO: 116146 - RNA, 64 nt, hsa
gaacucccgacgucaggugaucuaccugccucggccucccaaagugcugggauuacaggcguga

SEQ ID NO: 116147 - RNA, 64 nt, hsa
uuggacuccugaccucgugauccacccaccuuggccucccaaaguucuaggauuacagguguga

SEQ ID NO: 116148 - RNA, 64 nt, hsa
uugaacuccugaccucgugauccacccgccuuggccucccaaagugcugggauuacaggcauga

SEQ ID NO: 116149 - RNA, 64 nt, hsa
cugccucccggguucaagcaauucucugccucagccucccaaguaguugggauuacaggcaccu

SEQ ID NO: 116150 - RNA, 64 nt, hsa
aaggaguccuucuacagaauaggucagaucuuggccucccaaaccccuuauuuuuaaaauacuu

SEQ ID NO: 116151 - RNA, 64 nt, hsa
aaacuccugagcucaggcaaucugcccgccuuggccucccaaagugcuaggauuacagguauga

SEQ ID NO: 116152 - RNA, 64 nt, hsa
ugccucccaguuucaagugauucugcugucucagccucccaaguagcugggacuacaggcaugc

SEQ ID NO: 116153 - RNA, 64 nt, hsa
uccaucucuugacauugugauccaccugccucggccucccaaagugcugggauuacaggcauga

SEQ ID NO: 116154 - RNA, 64 nt, hsa
uuccugggcuccagggauccacagucccccuuggccucccaaaguguugggauuacaugcauga

SEQ ID NO: 116155 - RNA, 64 nt, hsa
uugaacuccugagcucaugauccacccgccucagccucccaaagugcugggauuacaggccccu

SEQ ID NO: 116156 - RNA, 64 nt, hsa
gcucacugccugggcucaagugaucuuacuccagccucccaagcagcugggacuacaccaccac

SEQ ID NO: 116157 - RNA, 64 nt, hsa
auacuccucaguucacgcauuccucccaccuccaccucccaaacugcugggauuacagguguga

SEQ ID NO: 116158 - RNA, 64 nt, hsa
guagaacaugagagacccccucccucaauuuccaccucccaagggaaguuuauguauuuuucua

SEQ ID NO: 116159 - RNA, 64 nt, hsa
gaacuccugagcucaagggauccucccgccucagccucccaaagugcugguguuacaggcauaa

SEQ ID NO: 116160 - RNA, 64 nt, hsa
gaacuccugaccucaagugauccacucaccucggccucccaaagugcugggauuacagguguga

SEQ ID NO: 116161 - RNA, 64 nt, hsa
gaaccccuaggcucaaaugaugugcccaacucggccucccaaagugcugggauuacaggcauga

SEQ ID NO: 116162 - RNA, 64 nt, hsa
ccaggcucaggcucaggugauccucacaccuuagccucccaaguaccugggacuacaggcacgc

SEQ ID NO: 116163 - RNA, 64 nt, hsa
gggugggaggggcccacaggaagcucagccuucuccucccaagguuugagucccuccaaagggc

SEQ ID NO: 116164 - RNA, 64 nt, hsa
gaacuccuggccucaagugauccaccggccucggccucccaaagugcugggaugacaggcauga

SEQ ID NO: 116165 - RNA, 64 nt, hsa
aaacuccugaccucaggugauccgcccgccucagccucccaaagugcugagauuacagguguga

SEQ ID NO: 116166 - RNA, 64 nt, hsa
caccuccuggguuccagcgauucuccugccucagccucccaaauagcugugauuacaggcgugc

SEQ ID NO: 116167 - RNA, 64 nt, hsa
gaccaggcaccaccuggacacuuucuuguugaauccucccaacacccagcacgcugucaucccc

SEQ ID NO: 116168 - RNA, 64 nt, hsa
ucugaggucaggucugaggccaguauccuccagcccucccaaugccaacccccaccccguuucc

SEQ ID NO: 116169 - RNA, 64 nt, hsa
caccucccagguucaagcaauucuccugccucagccucccaaguagcugggauuacaggcaccc

SEQ ID NO: 116170 - RNA, 64 nt, hsa
gaacuucugaccucaggugauccaccugccucagccucccaaauugcugggauuacaggcguga

SEQ ID NO: 116171 - RNA, 64 nt, hsa
caagcauuccccuuuaagagcuuccacugcacccccucccaagggacacagcgguaggaauggu

SEQ ID NO: 116172 - RNA, 64 nt, hsa
gaacuccugaccucaggugauccaccugccuuggccucccaaagcacugggauuacaagcauga

SEQ ID NO: 116173 - RNA, 64 nt, hsa
gaacuccugacuucaggugauccacccaucucagccucccaaagugcugggauuacaggcguga

SEQ ID NO: 116174 - RNA, 64 nt, hsa
acaugucuucuuucagaaugggaauauaugugugccucccaacauuuacuguuaaaguguguua

SEQ ID NO: 116175 - RNA, 64 nt, hsa
gaccuccuggguuccagugauucucaugccucauccucccaaguagcuggaacuacaggugugc

SEQ ID NO: 116176 - RNA, 64 nt, hsa
uggucuucuggcuucuggauaucgcccaccuuggccucccaaagugcugggauuacagggauga

SEQ ID NO: 116177 - RNA, 64 nt, hsa
ucgaucuccugaccucaugaucuacccgccucggccucccaaagugcugggauuacaggcguga

SEQ ID NO: 116178 - RNA, 64 nt, hsa
aaauuccuggccucaggugauccaccugccucagccucccaaagugcugggauuacaggcauga

SEQ ID NO: 116179 - RNA, 64 nt, hsa
caccucccagguucaagcgauucuccugccucagccucccaaguagcugggauuacuggcgccc

SEQ ID NO: 116180 - RNA, 64 nt, hsa
gucucaaucugaccuugugaucugcccaccucggccucccaaagugcuaggauuacuggcguga

SEQ ID NO: 116181 - RNA, 64 nt, hsa
uugaucuccugaccucgugauccgcccgccuuggccucccaaaagugcugggauuauaggcgug

SEQ ID NO: 116182 - RNA, 64 nt, hsa
aaacuccuggccucaagugguccuccugccuuggccucccaaaauguugcaauuacaggcauga

SEQ ID NO: 116183 - RNA, 64 nt, hsa
ugcuuuguugcucaggcugguuuugaacuccuggccucccaaggugcugauaguacaggcauga

SEQ ID NO: 116184 - RNA, 64 nt, hsa
cgccucccugguucaagugauucuccuaucucagccucccaaguagcugggacuauaggcacac

SEQ ID NO: 116185 - RNA, 64 nt, hsa
aaacuccugaccucaggugauccaccugccucagccucccaaagugcugggauuacaggcguga

SEQ ID NO: 116186 - RNA, 64 nt, hsa
ucaaacuucugaccucauaauccacccaccuuggccucccaaagugcuaggauuacaggcauga

SEQ ID NO: 116187 - RNA, 64 nt, hsa
gguucaugagaggucugcucucaugaccuaaucaccucccaaaggccccaccucccaauaccau

SEQ ID NO: 116188 - RNA, 64 nt, hsa
gcucucaugaccuaaucaccucccaaaggccccaccucccaauaccaucacauuagggguuagg

SEQ ID NO: 116189 - RNA, 64 nt, hsa
gaaccucugaccucaggugauccacccgccucggccucccaaagugcugggauuacaggcguga

SEQ ID NO: 116190 - RNA, 64 nt, hsa
caccucucagauucaagcaauucuccugccucagccucccaaguagcugggauuacaggugccc

SEQ ID NO: 116191 - RNA, 64 nt, hsa
ucaaacaccugaccuugugauccguccgccuuggccucccaaagugcugggauuacaggcguga

SEQ ID NO: 116192 - RNA, 64 nt, hsa
cucugccucccaggaucaagcaauucugacucagccucccaaguagcugggauuacaggcgcag

SEQ ID NO: 116193 - RNA, 64 nt, hsa
ucgaucuccugaccucgugauucgcccgccucggccucccaaagugcuggaauuacuggcguga

SEQ ID NO: 116194 - RNA, 64 nt, hsa
acugcagccugaaacuccuuggcuuccaccucagccucccaaagcauuaggauuauaggcguga

SEQ ID NO: 116195 - RNA, 64 nt, hsa
caacuccagaucucaggugaucuacccuccucggccucccaaaguacugggauuacaggccuga

SEQ ID NO: 116196 - RNA, 64 nt, hsa
gcaguggcacgaucucggcucacugcaaccuccgccucccaaguucaagcgauucuccucucuc

SEQ ID NO: 116197 - RNA, 64 nt, hsa
auaugcuggaaguaauugugcuuagacaccucauccucccaagcugucuagaaaggccauuucg

SEQ ID NO: 116198 - RNA, 64 nt, hsa
ucgaucuccugaccucgugauccaccugccuaggccucccaaaguguugggauuacaggcguga

SEQ ID NO: 116199 - RNA, 64 nt, hsa
uaccuccuggguucaagggauucuccugccucagccucccaaguagcugggauuacaggcgccu

SEQ ID NO: 116200 - RNA, 64 nt, hsa
aaacuccugaccugaggcgaucugcccaccucggccucccaaagugcugggauuacaggcguga

SEQ ID NO: 116201 - RNA, 64 nt, hsa
ugccucccggguucgcaccauucuccugccucagccucccaauuagcuuggccuacagucaucu

SEQ ID NO: 116202 - RNA, 64 nt, hsa
ucgaucuccugaccucgugauccgcccaccucggccucccaaagugcugggauuacaggcauga

SEQ ID NO: 116203 - RNA, 64 nt, hsa
ucaaacuccuaaccucgugauccgccugccucgaccucccaaagugcugggauuacaggcauga

SEQ ID NO: 116204 - RNA, 64 nt, hsa
aaaauugggcagcuaaauuuuucaguuccaugugccucccaaauaaaaaacagaaaauaaguag

SEQ ID NO: 116205 - RNA, 64 nt, hsa
ucgaucucuugaccucaugaucuacccgccuuggccucccaaagugcugagauuacaggcguga

SEQ ID NO: 116206 - RNA, 64 nt, hsa
agacuccuggguucaagcaauccuccugccucagccucccaaguagcugagacuacaggcacga

SEQ ID NO: 116207 - RNA, 64 nt, hsa
gaacucuuggccucaaguaauccuccugccucagccucccaaaguguugggauugcagauauga

SEQ ID NO: 116208 - RNA, 64 nt, hsa
cucaaccuggguucaagugauccucucaccucagccucccaaguaguugugccuccuaggcaca

SEQ ID NO: 116209 - RNA, 64 nt, hsa
gaacaccugggcucaacugauccgccugccucggccucccaaagugcugggauuacagguguga

SEQ ID NO: 116210 - RNA, 64 nt, hsa
cgccucccggguucaagugauucuccugccucagccucccaaguaggugggauuacaggcgccc

SEQ ID NO: 116211 - RNA, 64 nt, hsa
ucgaacuccugaccucgugauuggcccaccucagccucccaaagugcugguauuacagauguga

SEQ ID NO: 116212 - RNA, 64 nt, hsa
gaacuccugaccgcaagugauccacccgccuccgccucccaaagugcugggauuacaggcguga

SEQ ID NO: 116213 - RNA, 64 nt, hsa
caccuccuggguucaagugauuuuccugccucagccucccaaguagcugggaauacaggcacgc

SEQ ID NO: 116214 - RNA, 64 nt, hsa
gaacuccugaccucaagugaucugccugccucggccucccaagugcugggauuacaggcgugag

SEQ ID NO: 116215 - RNA, 64 nt, hsa
cgcccccuggguucaagcaauucuccugccucagccucccaaguagcugggauuacagucaggc

SEQ ID NO: 116216 - RNA, 64 nt, hsa
uaacuccugggcuuaagugaucugcccgccuuggccucccaaagugcugggauuacagauguga

SEQ ID NO: 116217 - RNA, 64 nt, hsa
uaacuccugaccucaggugauccaccuuucucggccucccaaagugcugggauuacggguguga

SEQ ID NO: 116218 - RNA, 64 nt, hsa
caccuccuggguuccagcaguucuccugccucagccucccaaguagcugagauuacaggcgccu

SEQ ID NO: 116219 - RNA, 64 nt, hsa
cuugaucuccugacuugugauccgccugccucggccucccaaagugcuuggauuacagguguaa

SEQ ID NO: 116220 - RNA, 64 nt, hsa
gagcuccugaccucaggugauccgccugccuuggccucccaaaguggugggaucacaggcguga

SEQ ID NO: 116221 - RNA, 64 nt, hsa
gaacuccugaccucagaugauccgcccacauuggccucccaaagugcugggauuacagguguga

SEQ ID NO: 116222 - RNA, 64 nt, hsa
ugccuccuagauucaagcaauucuccugucucagccucccaaguagcugggauuacaggugcgc

SEQ ID NO: 116223 - RNA, 64 nt, hsa
cgaacuccugaccucaaaugauccgcugucuuguccucccaaagugcugggauuauaggcguga

SEQ ID NO: 116224 - RNA, 64 nt, hsa
cgccucccagauucaagcgauuuuccugccucagccucccaaguagcugggauuacaggugccc

SEQ ID NO: 116225 - RNA, 64 nt, hsa
aaacuccuggcuucaagagauccacccaccucagccucccaaagcgcuaggauuacaaguauga

SEQ ID NO: 116226 - RNA, 64 nt, hsa
gcauguuaggagcgcuggaacguuuauucucuucccucccaauuauccacucuaauggagcaga

SEQ ID NO: 116227 - RNA, 64 nt, hsa
gaacuucugaccucagaugaucugcccgccucagccucccaaagugcugggauuacaggcauga

SEQ ID NO: 116228 - RNA, 64 nt, hsa
gaacucccgaccucagguaauccgcccgccucggccucccaaaaugcugggauuagagguguga

SEQ ID NO: 116229 - RNA, 64 nt, hsa
cgccuccuggguucaagugauucuccugccacagccucccaaguagcugggauuacaggugccu

SEQ ID NO: 116230 - RNA, 64 nt, hsa
gaacuccugaccucaguugauccgccugccucagccucccaaagugcugggcuuacaggccuga

SEQ ID NO: 116231 - RNA, 64 nt, hsa
uuccuccaggguucaagugauucucccaccucagccucccaaguagcugggacuacgggcacau

SEQ ID NO: 116232 - RNA, 64 nt, hsa
aaacuccugaccucaagcgauccacccaccuaggccucccaaagugcugggauuacaggcauga

SEQ ID NO: 116233 - RNA, 64 nt, hsa
aaacucccgaccucaggugauccgcccgccugggccucccaaagugcugggauuacaggcguga

SEQ ID NO: 116234 - RNA, 64 nt, hsa
agccuccuggauuuaagugauucuccugccucagccucccaaguagcugggauuacaggugugc

SEQ ID NO: 116235 - RNA, 64 nt, hsa
ucgaacuccugaccucgugauccgccugccucagccucccaaagugcugggauuacagguguga

SEQ ID NO: 116236 - RNA, 64 nt, hsa
ugccuccuggguucaagcaauucucccaccucagccucccaaguagcugggauuacagacgugu

SEQ ID NO: 116237 - RNA, 64 nt, hsa
gaacuccugaccucaggugauccuccugccucggccucccaaagugcugggauuacaggcauga

SEQ ID NO: 116238 - RNA, 64 nt, hsa
cgccuccuggguucaggcaauuuuccugccucagccucccaaguagcugggauuacaggcaccc

SEQ ID NO: 116239 - RNA, 64 nt, hsa
gaacuccugaccucaggugauccuccugcauuggccucccaaagugcuggaauuccaggcauga

SEQ ID NO: 116240 - RNA, 64 nt, hsa
aacuccuggggcucaagugauccuccugccuuggccucccaaaaugcuggauuacaggcaugug

SEQ ID NO: 116241 - RNA, 64 nt, hsa
gauagcuucccacuggaaaguaaacaaaaccaucccucccaaccucaaagcuaggccacacucu

SEQ ID NO: 116242 - RNA, 64 nt, hsa
ugccucccugguucaagugauucuccugccucauccucccaagaagcugagauuacagaugacc

SEQ ID NO: 116243 - RNA, 64 nt, hsa
gaacuccugaccucaggugauccaccugccucagccucccaaagugcugagauuacaggcauga

SEQ ID NO: 116244 - RNA, 64 nt, hsa
caccucgcagguucaagcaauccucccacuucagccucccaagcaccugggauuacaagcauga

SEQ ID NO: 116245 - RNA, 64 nt, hsa
uccaucucuugaccucgugauccacccgccucagccucccaaagugcugggauuaacagguaug

SEQ ID NO: 116246 - RNA, 64 nt, hsa
ugccucccagguucaagugcuucuccagccucagccucccaaguagcugagacuacaggcacac

SEQ ID NO: 116247 - RNA, 64 nt, hsa
gaacuccugaacucaagcaauccuccugccucagccucccaaagugcugggauuacugguguga

SEQ ID NO: 116248 - RNA, 64 nt, hsa
aacuuccugggcucaagugauccuuccacuucagccucccaaguagcugggacuacaggcaugu

SEQ ID NO: 116249 - RNA, 64 nt, hsa
gaacuccugaccucaggugauccacucgccucggccucccaaagugcugggauuauaggcaugu

SEQ ID NO: 116250 - RNA, 64 nt, hsa
ugccuccuggguucaagcaguucuccugccucagccucccaaguagcugggauuacaggcgucc

SEQ ID NO: 116251 - RNA, 64 nt, hsa
gaacuccugaccucaaaugacccaccugccucggccucccaaagugcuaggauuacaaguguga

SEQ ID NO: 116252 - RNA, 64 nt, hsa
uaucgcccaggcucaagugauucuccugccucaaccucccaaguagcugggauuacagaaagcc

SEQ ID NO: 116253 - RNA, 64 nt, hsa
aaacucuugaccucaggugauccacccaccucagccucccaaagugcugggauuacaagcguga

SEQ ID NO: 116254 - RNA, 64 nt, hsa
gaacuccuggccucaagugauucuccugccucagccucccaaagugcugggauuacagguguga

SEQ ID NO: 116255 - RNA, 64 nt, hsa
cuccgccucccggguucacgccauucugcgucagccucccaaguagcugggacuacaggcaccu

SEQ ID NO: 116256 - RNA, 64 nt, hsa
uugaucuccugaccgcauaauccacccaccucggccucccaaagugcugggauuacaggcguga

SEQ ID NO: 116257 - RNA, 64 nt, hsa
caacucccagguucaagugagucucgugccucagccucccaaguagcugggauuacaggcaccc

SEQ ID NO: 116258 - RNA, 64 nt, hsa
aaacuccugaccucaggugcuccaccugccuuggccucccaaagugcugggauuacaggcguga

SEQ ID NO: 116259 - RNA, 64 nt, hsa
gaacuccuguccucagguaauccgcccaccucagccucccaaagugcugggauuacaggcguga

SEQ ID NO: 116260 - RNA, 64 nt, hsa
gaccuccuggguucaagcgauucucccaccccagccucccaaguagcugggauuacaggugugu

SEQ ID NO: 116261 - RNA, 64 nt, hsa
aaacuccugggcucaagcgauccuccuggcucagccucccaaagugcugggauuacaggcguga

SEQ ID NO: 116262 - RNA, 64 nt, hsa
aaacuccugaccucaggugaugcacccaccucagccucccaaagugcagggauuacaggcauga

SEQ ID NO: 116263 - RNA, 64 nt, hsa
gaacuccugaccucaggugauccacccgccucagccucccaaagugcugggauuacaggcauga

SEQ ID NO: 116264 - RNA, 64 nt, hsa
gaaugccugaccucaggugauccacccgccuuggccucccaaagugcuggaauuacagguguga

SEQ ID NO: 116265 - RNA, 64 nt, hsa
ugccuccuggguucaauccauucuccugccucagccucccaaguagcugggauuacaggcacau

SEQ ID NO: 116266 - RNA, 64 nt, hsa
aaacuccuagccuugauugauccuccugccuuggccucccaaagugcugggacuacaggugcau

SEQ ID NO: 116267 - RNA, 64 nt, hsa
ugccucccagguucaagcaauucuccugccucagccucccaaguagcugggacuacaggcacac

SEQ ID NO: 116268 - RNA, 64 nt, hsa
uccaucucuugaccuugugauccacccaccucagccucccaaagugcugggauuacaggcauga

SEQ ID NO: 116269 - RNA, 64 nt, hsa
caacuccugaccuaaagugaucugcccgccuuggccucccaaagugcugggauuacagacauga

SEQ ID NO: 116270 - RNA, 64 nt, hsa
gaacucuugaccucaggugaucugcccgccuuggccucccaaagugcugggauuacagguguga

SEQ ID NO: 116271 - RNA, 64 nt, hsa
gaacuccugaccucaggugauccgcccaccucggccucccaaagugcugggauuacagguguga

SEQ ID NO: 116272 - RNA, 64 nt, hsa
aaaccccugggcucaagcaagccuccugccuuggccucccaaagugcugggauuacagguguga

SEQ ID NO: 116273 - RNA, 64 nt, hsa
gaccucccaagcucaagcaauccuccugccucugccucccaaguagcugggaccacaggugggc

SEQ ID NO: 116274 - RNA, 64 nt, hsa
ugcaguggugugauuacagcucauguagccuggaccucccaagcucaagcaauccuccugccuc

SEQ ID NO: 116275 - RNA, 64 nt, hsa
gaacuccugaccucaggugauccaccugccucggccucccaaagugcuaggauuacaggcguga

SEQ ID NO: 116276 - RNA, 64 nt, hsa
gaacuccugaccucaggugauccgcccaccuuggccucccaaagugcugggauuacacgcguga

SEQ ID NO: 116277 - RNA, 64 nt, hsa
gaacuccuuggcucaagcaauccugcugccuuggccucccaaguauguaggacuacagguacuc

SEQ ID NO: 116278 - RNA, 64 nt, hsa
aaacuccugggcugaaacaauccucccgccuuggccucccaaagugcugggauuauaggcacaa

SEQ ID NO: 116279 - RNA, 64 nt, hsa
ugccucccguguucaagcaguucuccugccucagccucccaaauagcugggauuacaguugccu

SEQ ID NO: 116280 - RNA, 64 nt, hsa
gaacuccugaccucaagugauccacccgccuuggccucccaaagugcugggauaauagguguca

SEQ ID NO: 116281 - RNA, 64 nt, hsa
cgccuccugcguucaagugauuguccugucucagccucccaaguagcugggauuacaggcaccc

SEQ ID NO: 116282 - RNA, 64 nt, hsa
gaacuccuaaccucaggugauccacccgccucggccucccaaagugcugggauuacaggcccgg

SEQ ID NO: 116283 - RNA, 64 nt, hsa
caccuaccgaguucaagugauuuuccugccuuggccucccaaguagcugggauuacaggugugu

SEQ ID NO: 116284 - RNA, 64 nt, hsa
aaacuccugaccucaagugaucugcccaccucagccucccaaagugcugagauuacaggcauga

SEQ ID NO: 116285 - RNA, 64 nt, hsa
caacuccugaccucaagugauauguucaccucagccucccaaagugcugggauuacaggcauga

SEQ ID NO: 116286 - RNA, 64 nt, hsa
cgccucccggguucaagcaauucuccugccucagccucccaaguagcugggauuacaggcgugu

SEQ ID NO: 116287 - RNA, 64 nt, hsa
aaccucuuggguucaagugauucuugugccucagccucccaaguagcuggaauuacaggcacau

SEQ ID NO: 116288 - RNA, 64 nt, hsa
gaacuccugaccucaggugauccacccaccuuggccucccaaagugcugagauuauaggcauga

SEQ ID NO: 116289 - RNA, 64 nt, hsa
cgccucccggguucacgccauucuccugccucagccucccaaguagcugggacuacaggcaccc

SEQ ID NO: 116290 - RNA, 64 nt, hsa
ucgaucuccugaccucgugauccgcccgccucagccucccaaagugcugggauuacaggcguga

SEQ ID NO: 116291 - RNA, 64 nt, hsa
ugccucccggguucaugccauucuccugccucagccucccaaguagcugggacuacaggcgccu

SEQ ID NO: 116292 - RNA, 64 nt, hsa
ucgaucuccugaccucgugauccacccgccucggccucccaaagugcugggauuacaggcguga

SEQ ID NO: 116293 - RNA, 64 nt, hsa
uugaucuccugaccuugugauccaccagccucagccucccaaagugcugggauuacaggcguga

SEQ ID NO: 116294 - RNA, 64 nt, hsa
caccuccuggguucaagugauucuccugcuucagccucccaaguagcugggauuacaggugugc

SEQ ID NO: 116295 - RNA, 64 nt, hsa
gaacuccuggccuccagugauccuccauccucggccucccaaagugcuggaaucacagggguga

SEQ ID NO: 116296 - RNA, 64 nt, hsa
ucgaucucuugaccucgugauucgcccgccgcguccucccaaagugcugggauuacaggccuga

SEQ ID NO: 116297 - RNA, 64 nt, hsa
gaacucccgaccucagaugaucugcccgccucggccucccaaaauugcugggauuacaggugug

SEQ ID NO: 116298 - RNA, 64 nt, hsa
uccaucuccugaguuugugaucugcccgccuuggccucccaaagugcugggauuacagguguga

SEQ ID NO: 116299 - RNA, 64 nt, hsa
uccugaccucaggugauccacccgcccgccuuggccucccaaagugcuaggauuccaggcguga

SEQ ID NO: 116300 - RNA, 64 nt, hsa
uugaucuccugaccucgugauccgcccuccucggccucccaaagugcugggauuauaggcguga

SEQ ID NO: 116301 - RNA, 64 nt, hsa
gaacuccugaccucagguaauccaccugccuuggccucccaaagugcugggauuacaggcguga

SEQ ID NO: 116302 - RNA, 64 nt, hsa
aaacucuugaccucaaaugauccacccaccuuggccucccaaauuguucguuuuacuuuuuuuu

SEQ ID NO: 116303 - RNA, 64 nt, hsa
aaacuccugaccucaggugaucugccugccucggccucccaaagugcugggauuacagguguga

SEQ ID NO: 116304 - RNA, 64 nt, hsa
cgccucccggauucaagcaauucuccugccgcagccucccaagaagcugggauuacaggcaugc

SEQ ID NO: 116305 - RNA, 64 nt, hsa
gaacuccugggcucaagugauccacccaucuccaccucccaaagugcuaggauuacaggcguga

SEQ ID NO: 116306 - RNA, 64 nt, hsa
gaacuccugaccucaagugauccaccugccuuggccucccaaaguguugggauuauaggcguga

SEQ ID NO: 116307 - RNA, 64 nt, hsa
aaacuccugaccucauaugauccaccugccucagccucccaaagugcuuggauuacaggcauaa

SEQ ID NO: 116308 - RNA, 64 nt, hsa
ugccuuccagguucaagcaauuauccugccucagccucccaaguagcugggauuacaggcaccu

SEQ ID NO: 116309 - RNA, 64 nt, hsa
gaaauccugaccucaaaugauccacccaccucagccucccaaagugcugggauuacaggcauga

SEQ ID NO: 116310 - RNA, 64 nt, hsa
cgcccccugggaucaagcgauucuccuaccucagccucccaaauagcugggacuacaaggugcc

SEQ ID NO: 116311 - RNA, 64 nt, hsa
ucgauuuccugaccuugugaucccccugccucggccucccaaagugcugggauuacaggcauga

SEQ ID NO: 116312 - RNA, 64 nt, hsa
aaacucccgaccucaggugauccacccgccucagccucccaaagugcugggauuacaggcauga

SEQ ID NO: 116313 - RNA, 64 nt, hsa
agacuccugggcucaagcaaucugcccgccucugccucccaaagugcugggauuacagacguga

SEQ ID NO: 116314 - RNA, 64 nt, hsa
aaccugccagguugaagugagccucccauuucagccucccaaguagcugggacuacaauuguga

SEQ ID NO: 116315 - RNA, 64 nt, hsa
gaacgccugaccucagaugauccacccaccuuggccucccaaagugcugggauuacaggcauga

SEQ ID NO: 116316 - RNA, 64 nt, hsa
cgccuccuggguucaagugauucucgugcuucagccucccaaguaccugggacuacaggugugc

SEQ ID NO: 116317 - RNA, 64 nt, hsa
ucgaacuccugaccucgugauccgcccgccucagccucccaaaguguuaggauuaggggcauga

SEQ ID NO: 116318 - RNA, 64 nt, hsa
ugccucccagguucaagcaauucuccugccucagccucccaaguagccaggauuacaggcacgc

SEQ ID NO: 116319 - RNA, 64 nt, hsa
gaauuccagggcucaagcgauccagccguauuggccucccaaggugcugggauuacagccauga

SEQ ID NO: 116320 - RNA, 64 nt, hsa
aguuacaaagauuuuuuaaaaagcuacauaugccccucccaaaccgggaaccucaagaucucca

SEQ ID NO: 116321 - RNA, 64 nt, hsa
caacuccugagcucaagugauccacccgccucagccucccaaagugcugggauuacagggguga

SEQ ID NO: 116322 - RNA, 64 nt, hsa
gaacucuugggcucaagugauccucccgccucagccucccaaaguguugggauuacagguguga

SEQ ID NO: 116323 - RNA, 64 nt, hsa
gaccucccaggcucaagcgauccuccugccucagccucccaaguagcugggagccugggcaugc

SEQ ID NO: 116324 - RNA, 64 nt, hsa
aaacuccugggcucaagugauccuccugccucagccucccaaagcguugggauuauaggcguga

SEQ ID NO: 116325 - RNA, 64 nt, hsa
gacuucuuaggcucaggugauccucccaccucagccucccaagcagcugggaugacagacuugc

SEQ ID NO: 116326 - RNA, 64 nt, hsa
caccuuccaggcuuaagcgauucucaugccucauccucccaaguaggugggauuacaggugccc

SEQ ID NO: 116327 - RNA, 64 nt, hsa
gaacuccugacaucaggugauccaccugccucggccucccaaagugcugggauuacagguguga

SEQ ID NO: 116328 - RNA, 64 nt, hsa
cgccucccggguucaagcgauucuccugccucagccucccaaguagcugggauuacaggcacgc

SEQ ID NO: 116329 - RNA, 64 nt, hsa
aaacucccgaccucaaguagucugccugccucaaccucccaaagugcugggauuacaggcguga

SEQ ID NO: 116330 - RNA, 64 nt, hsa
aauccaucggacaagaccccgucuaacacugcauccucccaacugggcauuacccaccauugua

SEQ ID NO: 116331 - RNA, 64 nt, hsa
uccagaaucccagaauucuaggaaauuguaucagccucccaagcauauaacccccuaaggaauc

SEQ ID NO: 116332 - RNA, 64 nt, hsa
uugaacuccugaccucgugauccacccgccuaggccucccaaaguguugggauuacaggcguga

SEQ ID NO: 116333 - RNA, 64 nt, hsa
cgccucugggguucaagugauucuccugucucagccucccaaguagcuggaauuacagggaccc

SEQ ID NO: 116334 - RNA, 64 nt, hsa
ucgaacuccugaccucgugauuugccugccugggccucccaaagugcuaggauuacaggcauga

SEQ ID NO: 116335 - RNA, 64 nt, hsa
uugaucuccugagcucgugaucugcccgccucggccucccaaagugcugggauuacagguguga

SEQ ID NO: 116336 - RNA, 64 nt, hsa
ggggcagccaauuccuaucauucagaucuuccuuccucccaaguacucaccaaccccuuccacu

SEQ ID NO: 116337 - RNA, 64 nt, hsa
accucuccagauucaagugauccucccaucucagccucccaaguagcugggacuacaguugugc

SEQ ID NO: 116338 - RNA, 64 nt, hsa
aaacuccugggcuccaacgaucugcccaccuuggccucccaaagugcugagauuacaggcguga

SEQ ID NO: 116339 - RNA, 64 nt, hsa
cacuucuuggguucaagugauucuccugucucagccucccaaguagcugggauuacaggcauga

SEQ ID NO: 116340 - RNA, 64 nt, hsa
gaacuccugaccucaggugauccacccgccuuggccucccaaagugcugggauuacaggcguga

SEQ ID NO: 116341 - RNA, 64 nt, hsa
cgccuccuggguucaagugauucucccaccucagccucccaaguaggugggauuacagguacuc

SEQ ID NO: 116342 - RNA, 64 nt, hsa
gaacuccugaccucagauggucugcccaccuccgccucccaaagugcugggauuacaggcguga

SEQ ID NO: 116343 - RNA, 64 nt, hsa
gaaauccugggcucaagugauccuccugcuuuggccucccaaaaugcugggauuauaggcauga

SEQ ID NO: 116344 - RNA, 64 nt, hsa
gucuuccucucucgcccaaguucucaugccucagccucccaaauagcugggacuacaggcacag

SEQ ID NO: 116345 - RNA, 64 nt, hsa
gaugggcuuggccaaaacaggcucaggccaaagaccucccaagcuguauguacuuccaguaucc

SEQ ID NO: 116346 - RNA, 64 nt, hsa
gaacuccuagacucaagugauccuccugucuuggccucccaaagugcugagauuacagguguga

SEQ ID NO: 116347 - RNA, 64 nt, hsa
uugaacuccugaccucgugacccacccgccuuggccucccaaagugcugggauuacagguguga

SEQ ID NO: 116348 - RNA, 64 nt, hsa
cgccuccugaguucaagcgauucuccugccucagccucccaaguagcugggacugcaggcgcgc

SEQ ID NO: 116349 - RNA, 64 nt, hsa
aacuccugacuucaggugauccacccgccuucagccucccaacgugcugggauuacagccguga

SEQ ID NO: 116350 - RNA, 64 nt, hsa
ugccucccagguugaagcgauucuccugccucagccucccaaguagcugggauuacaggcaugc

SEQ ID NO: 116351 - RNA, 64 nt, hsa
ucgaugaucugaccucgugaucugcccgccucggccucccaaagugcugggauuacaggccuga

SEQ ID NO: 116352 - RNA, 64 nt, hsa
gaacuccuggacucaaucgauccucccaccucugccucccaaguaacugggacuauagcaugcc

SEQ ID NO: 116353 - RNA, 64 nt, hsa
gaacuccuggacucaauugauccucccacuucugccucccaaguaacugggacuauagcaugcc

SEQ ID NO: 116354 - RNA, 64 nt, hsa
ugccucccguguucaagcgauucuccugccuuggccucccaaguagcugggacuacaggcgccu

SEQ ID NO: 116355 - RNA, 64 nt, hsa
ucgaucuccugaccucuugaucugcccaccuuggccucccaaagugcugggauuacaggcguga

SEQ ID NO: 116356 - RNA, 64 nt, hsa
gaacucuugaccucaagugauccacucgcuucggccucccaaagugcugggauuauaggcguga

SEQ ID NO: 116357 - RNA, 64 nt, hsa
ucgaacuccugaccucaugauccuccugccucggccucccaaagugcugggauuauaggcauga

SEQ ID NO: 116358 - RNA, 64 nt, hsa
aaacuccugaccucaagagauccacucgccuugcccucccaaagugcugggauuacaggcuuga

SEQ ID NO: 116359 - RNA, 64 nt, hsa
agucaaaacuauagccauauccaaaucuuuucccccucccaagaguucucagugucuacaugua

SEQ ID NO: 116360 - RNA, 64 nt, hsa
ugccuccugacuucaagcaauucuccugccucagccucccaaagugcugggauuacagguguga

SEQ ID NO: 116361 - RNA, 64 nt, hsa
aaacuccugaccucaguugauccacccgccucagccucccaaagugcuaggauuacaggcauga

SEQ ID NO: 116362 - RNA, 64 nt, hsa
uugaacuccugaccucgugaucugcccgccuuggccucccaaaguacugggauuacaggcguga

SEQ ID NO: 116363 - RNA, 64 nt, hsa
ccccaugcccccucccugagcaccaccggcaccgccucccaaacagggcugcugguuuccgcag

SEQ ID NO: 116364 - RNA, 64 nt, hsa
gagggaaggcggagcugaggacagccagcuccgcccucccaaggcugugcguuccugagggcca

SEQ ID NO: 116365 - RNA, 64 nt, hsa
accucccggguuccagcaaauucuccugccucagccucccaaguagcugggauugcaggcgccc

SEQ ID NO: 116366 - RNA, 64 nt, hsa
gaucuccugaccucaggugauccacccgccucggccucccaaagugcugggaugacaggcguga

SEQ ID NO: 116367 - RNA, 64 nt, hsa
gaacuccugaccucaggugauccaccugccucggccucccaaagugcugggauuacaggcuuga

SEQ ID NO: 116368 - RNA, 64 nt, hsa
ugccucccgggcucaagcgauucuccugccucagccucccaaguagcugggauuacaggcaccu

SEQ ID NO: 116369 - RNA, 64 nt, hsa
uaaguauuggaauuucacaaaagacauaggacuuaacuggaaaaugaaaaaaaaaagaaaaaga

SEQ ID NO: 116370 - RNA, 64 nt, hsa
ccccagaaagugggaauuugauuuuauccuuccgaacuggaagaacauuuuuaugaagaauuuu

SEQ ID NO: 116371 - RNA, 64 nt, hsa
aauacaaaggguauacucuguuggaugcaccagaaacuggaaacugggaccaguggcagagaug

SEQ ID NO: 116372 - RNA, 64 nt, hsa
cccagaugcccaugagcaagagaguggacaaguaaacuggaauauucacauaauagaacauuau

SEQ ID NO: 116373 - RNA, 64 nt, hsa
gagguucaacacuacguaccgcacuuuauaauuuaacuggaauugagaugaaggccagugacau

SEQ ID NO: 116374 - RNA, 64 nt, hsa
caaaagccaggcucaacuuauagaauguuuuggaaacuggaaguaaugauacauuucacuucag

SEQ ID NO: 116375 - RNA, 64 nt, hsa
gcugaugugagugugugugaugggaucuguaaggaacuggaacacacauguccuauccaaagga

SEQ ID NO: 116376 - RNA, 64 nt, hsa
aggaccuggcuuggcuuuaaccguuuuucaagaaaacuggaaaucuggauuuucagcgaacaug

SEQ ID NO: 116377 - RNA, 64 nt, hsa
aggagaguccuucucggcagagcucacugcaaacaacuggaauugagguugcacacugugauuu

SEQ ID NO: 116378 - RNA, 64 nt, hsa
agaaaacagaggaguuuguagccagcagccuguaaacuggaaacacuggucucagccaaccucc

SEQ ID NO: 116379 - RNA, 64 nt, hsa
uguaaaaugguauauucuuuaaaauaguguugauaacuggaauauuguauguaugcuuggagau

SEQ ID NO: 116380 - RNA, 64 nt, hsa
aacuccguaaaaaagacagcuguauuuuccguccaacuggaauuguugaaucacacugcauagc

SEQ ID NO: 116381 - RNA, 64 nt, hsa
uuucaguauaagcugaauaaauuuagagcuuucaaacuggaaaaaaaaaugaaacaaaacaaau

SEQ ID NO: 116382 - RNA, 64 nt, hsa
agguggauacccgcuuccauggucuugcacuauaaacuggaauggauuucucaaugcgggacca

SEQ ID NO: 116383 - RNA, 64 nt, hsa
aagcuaauuuuuuuuacaugucaauauuggcacaaacuggaaugaaagaauaguuugauucaga

SEQ ID NO: 116384 - RNA, 64 nt, hsa
acuaaauauacaggguauguccuaacauggaguuaacuggaauagcaguacacuagcaaguauc

SEQ ID NO: 116385 - RNA, 64 nt, hsa
cacccuccaauucacacugccuucuaguugugccaacuggaaccacccuuuggcugugcugcga

SEQ ID NO: 116386 - RNA, 64 nt, hsa
auugaaaguuaaacuauuuaacgugaaauccauuaacuggaauaauugaguuucuuuauuuuua

SEQ ID NO: 116387 - RNA, 64 nt, hsa
ucugcuggacacccaagaaagccaugggaacgccaacuggaaagguccccuuccccaggggagc

SEQ ID NO: 116388 - RNA, 64 nt, hsa
ucauaucaccuccaucccauaaaguuguacugugaacuggaagaugguggaauguuuuggaauu

SEQ ID NO: 116389 - RNA, 64 nt, hsa
cuccagggcgggaggcaagcccccuugccuuucaaacuggaaaccccagagaaaacggugcccc

SEQ ID NO: 116390 - RNA, 64 nt, hsa
cgguugggggcugggagcccugggcguguaguguaacuggaaucuuuugccucucccagccacc

SEQ ID NO: 116391 - RNA, 64 nt, hsa
uguauaacucuaaacgcccaugauaguagcuucaaacuggaaauagcgaaauaaaauaacucag

SEQ ID NO: 116392 - RNA, 64 nt, hsa
uugguaacuucacuagagcauacauaacaacuggaacuggaaauuauacaaaaguaaauuggga

SEQ ID NO: 116393 - RNA, 64 nt, hsa
agacuguugguaacuucacuagagcauacauaacaacuggaacuggaaauuauacaaaaguaaa

SEQ ID NO: 116394 - RNA, 64 nt, hsa
gguaguagguauuucgugagaaguucaacaccaaaacuggaacauaguucuccuucaaguguug

SEQ ID NO: 116395 - RNA, 54 nt, hsa
agcggaaucauacacucugaauugaacuggaaucacauauuucacaacagggcc

SEQ ID NO: 116396 - RNA, 64 nt, hsa
ucuaauuuuaggaggaccaaauucaguggauggcaacuggaacauugauuguaaggccagugaa

SEQ ID NO: 116397 - RNA, 64 nt, hsa
aacauugauuguaaggccagugaaguuuucacccaacuggaauuugauggaaagaagguuugug

SEQ ID NO: 116398 - RNA, 64 nt, hsa
caaaugugaaugaucgacugacugcuuguugccaaacuggaaauguucuguagggauuuacugg

SEQ ID NO: 116399 - RNA, 64 nt, hsa
caagaggcaacuugucacuuucuuucucaauauuaacuggaaugcugccucuuggguucucacc

SEQ ID NO: 116400 - RNA, 64 nt, hsa
agagucccgcagguaccccagcucugcuugccgaaacuggaaguuauuuauuuuuuaauaaccc

SEQ ID NO: 116401 - RNA, 64 nt, hsa
gccaaauucccuccucccuucuacugcuucuaccaacuggaagcacagaaaacuagaauuucau

SEQ ID NO: 116402 - RNA, 64 nt, hsa
gaacgcuugagaggcacuuuguaaagauuuguuaaacuggaaacguuuuacaugaucugauaca

SEQ ID NO: 116403 - RNA, 64 nt, hsa
gaaugcuugagaggcacugaguaaagauuuguugaacuggaaauguuuuacaugauucuuaaac

SEQ ID NO: 116404 - RNA, 64 nt, hsa
uaaaauuuauuauuuugaucuugaauuauuuauaaacuggaaagugguuugauuauugugaguc

SEQ ID NO: 116405 - RNA, 64 nt, hsa
aaacaaacaaacaaacaacguaucuuacugacuaaacuggaauggaaaucuuauaauuaguguu

SEQ ID NO: 116406 - RNA, 64 nt, hsa
ggccagccugaggacccccgccuaccaccucgagaacuggaagccaaccucuaaccuccugacc

SEQ ID NO: 116407 - RNA, 64 nt, hsa
cuucaccagugcccaagucucuauggagaaugagaacuggaagccacugcuaccgucuacccag

SEQ ID NO: 116408 - RNA, 64 nt, hsa
cagcuuuggcucgggagaguggggcugcuuguagaacuggaagugaauaacuuuuucaagcaau

SEQ ID NO: 116409 - RNA, 64 nt, hsa
gcuuggaccuuggcauuccguuugaauuccuucuaacuggaacauuuguguuguaucuguaaca

SEQ ID NO: 116410 - RNA, 64 nt, hsa
agcuguaccuggcacggcccauccuggacugagaaacuggaaccucagaggaacccgugccucu

SEQ ID NO: 116411 - RNA, 64 nt, hsa
cugcugaauggaggagccgggggucccccaggccaacuggaaaaucucccaggcuaggccaauu

SEQ ID NO: 116412 - RNA, 64 nt, hsa
auagcaguuauaacagaugugaaaauauacuugacucuaauaugauuauacaaaagagcaugga

SEQ ID NO: 116413 - RNA, 64 nt, hsa
uuucaaagcuaaaauauauaauauacuaaaccaacucuaauauugcuucuuguguuuuacuguc

SEQ ID NO: 116414 - RNA, 64 nt, hsa
aaaauggaccuuaagaaacuauuuacucuguaaucucuaauaaaauauggaauuccauauuagg

SEQ ID NO: 116415 - RNA, 64 nt, hsa
gggauuuaaauauaacaaaauguguaauuugugacucuaauauuaaauaagauauuugaacaag

SEQ ID NO: 116416 - RNA, 64 nt, hsa
augguuuuuacauuuuucucuaucguguuaaaagcucuaauaaugcuaguggagcaguugacau

SEQ ID NO: 116417 - RNA, 64 nt, hsa
agaaggagauuaacauuauaagugaaauaauaugcucuaauagauuguggagggcagguuugag

SEQ ID NO: 116418 - RNA, 64 nt, hsa
aaccuuuuuugguggcuaauuaggguuuaaauacagaaacaagauuucaaauaaaacugucuuu

SEQ ID NO: 116419 - RNA, 64 nt, hsa
guuacagaaguuucaagcuucacuuuugugcaguagaaacaaaaguaggcuacagucugugcca

SEQ ID NO: 116420 - RNA, 64 nt, hsa
uugaccucaaggucuagaggucugcaguaagccaagaaacaaaggugggguggaugaggcaagg

SEQ ID NO: 116421 - RNA, 64 nt, hsa
aaucgcugagcaaacccgcuuuuguuuccuucccagaaacaaugcaaaacaacagguggagaua

SEQ ID NO: 116422 - RNA, 64 nt, hsa
uagcaacauugucauaugcaguuugccucaaaucagaaacaagaagacaucggaaucugagaug

SEQ ID NO: 116423 - RNA, 64 nt, hsa
uggaucuaaagaaauuacccagugagcagugaggagaaacaaggagcuagaaaacauuggaaag

SEQ ID NO: 116424 - RNA, 64 nt, hsa
uuuuauuaacuuuuuucaguuucuuuuuauucaaagaaacaaaauucaaucucugauaauauuu

SEQ ID NO: 116425 - RNA, 64 nt, hsa
uaaucccuuuuagugggaaaggauauguucuaggagaaacaagcaauuuaccuucaccugggaa

SEQ ID NO: 116426 - RNA, 64 nt, hsa
aaggauucaccaccuccaggaaaagugucuucucagaaacaaccagcugagaagguaauuaaag

SEQ ID NO: 116427 - RNA, 64 nt, hsa
aaggagggaccaauaucugggacagugucuucucagaaacaaccagcugagaagguaauuaaag

SEQ ID NO: 116428 - RNA, 64 nt, hsa
aagaagggacaacaaucugggacagugucuccucagaaacaaucggccuggaagguaguuacuc

SEQ ID NO: 116429 - RNA, 64 nt, hsa
auggguggugggaaaucuggaacagugucuucucagaaacaaccagccucaaagguaauuaaac

SEQ ID NO: 116430 - RNA, 64 nt, hsa
aaggauggacuacagugugggacagugucuucucagaaacaaccagccuugaagguaauuaaac

SEQ ID NO: 116431 - RNA, 64 nt, hsa
aaggauggagaaaaaucugggacagugucuucucagaaacaaccagccuugaagguaauuaaac

SEQ ID NO: 116432 - RNA, 64 nt, hsa
uugacauuuauuuuagaaaguccuauaauguggaagaaacaaacaguugcuaccaaagauucuu

SEQ ID NO: 116433 - RNA, 64 nt, hsa
uacaaguugcuaguuuauaaugucuuacuaaugcagaaacaaggaaaaaagcaaaauuggccug

SEQ ID NO: 116434 - RNA, 64 nt, hsa
auuguauucauuuaucuuagggggaacauuguaaagaaacaaaaagguccagaugaauguaugc

SEQ ID NO: 116435 - RNA, 64 nt, hsa
aaacaaagcuuauguuagagaauaucuuacuguaagaaacaaggaaaauugcagaaacauuugc

SEQ ID NO: 116436 - RNA, 64 nt, hsa
gaguucuugaagaagaaaccagaacaaauaaaauagaaacaauaaucagaguuuaauaauuaau

SEQ ID NO: 116437 - RNA, 64 nt, hsa
augguagugcuuugguggaggacugcuuccacuuagaaacaaacucugagaaguaggcuaagag

SEQ ID NO: 116438 - RNA, 64 nt, hsa
caggagagacuuguagguacaaucuaggccuugaagaaacaaaggcuggaauaucugcccaugc

SEQ ID NO: 116439 - RNA, 64 nt, hsa
agaauuaaacuccuacugcuuccucugaauauuaagaaacaauuuaaauuguuauaacuucaua

SEQ ID NO: 116440 - RNA, 64 nt, hsa
guuuguauaccaugaugcauggaguguuugacgaagaaacaaaaaacaccaaaaauugcgagcc

SEQ ID NO: 116441 - RNA, 64 nt, hsa
ugcucucuuuaaagcgaauucauacuaugacagcagaaacaaaacuucagauuucagaauuugu

SEQ ID NO: 116442 - RNA, 64 nt, hsa
uaagacuugcaauuuuaucaaucuauuauuucuuagaaacaauuuacuagcuuagaauagaaag

SEQ ID NO: 116443 - RNA, 64 nt, hsa
uauucgaaaagaggcuuuuaaaaugugcauguuuagaaacaaaauuucuucauggaaaucauau

SEQ ID NO: 116444 - RNA, 64 nt, hsa
acaauugagauuugcccauagguuaaacaugguuagaaacaacugaaagcauaaaagaaaaauc

SEQ ID NO: 116445 - RNA, 64 nt, hsa
uuaucuuuguucuccuaaugcucugaaaggauguagaaacaauauuuaaccaaagaacguaaua

SEQ ID NO: 116446 - RNA, 64 nt, hsa
aaaguugagagacaguaacacaauuaaaugacuuagaaacaauguuugcuuuucacuggcauaa

SEQ ID NO: 116447 - RNA, 64 nt, hsa
ggaagauaguaucucagaaugaccagagcagcacagaaacaagcuacucugacauuaugggagc

SEQ ID NO: 116448 - RNA, 64 nt, hsa
acugucacuccagagauuuuagaaauuugaguaaagaaacaauaaggaccuauacaaucauaug

SEQ ID NO: 116449 - RNA, 64 nt, hsa
uaagucucacauugcuaacaugacauuagcuguaagaaacaagauagcuuuacauuugaaugcc

SEQ ID NO: 116450 - RNA, 64 nt, hsa
aagcuaaagagugauuaucuuucacaguagaacuagaaacaaaacccuaacuugugaaguugcu

SEQ ID NO: 116451 - RNA, 64 nt, hsa
guucacacccacucuaaaaccauguccucugaaaagaaacaaaaauacagugaucaucaaaugc

SEQ ID NO: 116452 - RNA, 64 nt, hsa
aacugggaaauaugacuaaauuugacguaacuagagaaacaaggcuguauccacaugguacaag

SEQ ID NO: 116453 - RNA, 64 nt, hsa
acaaauuuuaauuaaacaaucuguaacagaaucaagaaacaaauacauuuuaauuaaacaaucu

SEQ ID NO: 116454 - RNA, 64 nt, hsa
uucacaugguuucuccauguauauaacagaaucaagaaacaaauuuuaauuaaacaaucuguaa

SEQ ID NO: 116455 - RNA, 64 nt, hsa
aacuguaaaaaucauggaaaauaagggaauccugagaaacaaucacagaccacaugagacuaag

SEQ ID NO: 116456 - RNA, 64 nt, hsa
uuuacaaaaauauuuuucauacaaaugguuaaaaagaaacaaaaucuauaacaacaacuuugga

SEQ ID NO: 116457 - RNA, 64 nt, hsa
aucuugaaaguugaacucaaguagaaaaauggauagaaacaaaauucucuaguacucauccagg

SEQ ID NO: 116458 - RNA, 64 nt, hsa
ggaaggaagaaaggaaggagggagaagggaagaaagaaacaaugucuaacccaacccuaucuug

SEQ ID NO: 116459 - RNA, 64 nt, hsa
cagccuggguggacagagcaagacuccgucucaaagaaacaaacaaaaaauuaaaagggauaga

SEQ ID NO: 116460 - RNA, 64 nt, hsa
cuuuuuccacauaguuaugguguuugaguuggaaagaaacaacuauagguagcuacacguacau

SEQ ID NO: 116461 - RNA, 64 nt, hsa
acugccugcaaagaauuaacauccgucuagugggagaaacaaacacaccccacucacuaaguau

SEQ ID NO: 116462 - RNA, 64 nt, hsa
ccagccugggaacaagagugaaacucucaaaagcagaaacaaaaacccaacauauaugggcugu

SEQ ID NO: 116463 - RNA, 64 nt, hsa
gagggcgcaggggcugccgagugcugugcacggaagaaacaaagacaucccggcccaaggcgca

SEQ ID NO: 116464 - RNA, 64 nt, hsa
ugagaguucuucauuccuugcugcucacauucugagaaacaaaaagaaauaaaguuuuuauucu

SEQ ID NO: 116465 - RNA, 64 nt, hsa
uaagauguaagugaacaauucuuucuuucugccaagaaacaaaguuuuggaugagcuuuuauau

SEQ ID NO: 116466 - RNA, 64 nt, hsa
gaagugacuuccucaaaaucacaugguucaggacagaaacaagauuaaaaccuggauccacaga

SEQ ID NO: 116467 - RNA, 64 nt, hsa
augaacuguaguacauggacaauaagugugugguagaaacaaacuccauuacucugauuuuuga

SEQ ID NO: 116468 - RNA, 64 nt, hsa
aaaaagagugaaaaagagaauauacaugaagaauagaaacaagccugccauaauccuuuggaaa

SEQ ID NO: 116469 - RNA, 64 nt, hsa
cugugagauguuauugcuuccauuuuauuagaagagaaacaaauuccaugcuuuauggaauuua

SEQ ID NO: 116470 - RNA, 64 nt, hsa
cuuuuuguuuuaauaucuugcucucugacaggaaagaaacaauucacuuaccagccuccucacc

SEQ ID NO: 116471 - RNA, 64 nt, hsa
guuggggauucaguauuuuuguugugaaaauuucagaaacaauagauucuuaaagauaagcuag

SEQ ID NO: 116472 - RNA, 64 nt, hsa
ugccugcaaaaauaaaagggaaaaaaaagaaaaaagaaacaaaaaggaacuucuuauaguuguc

SEQ ID NO: 116473 - RNA, 64 nt, hsa
gugcuuuaaaaaauaaauaagaaacaacucuuugagaaacaacaauuucuacuuugaagucaua

SEQ ID NO: 116474 - RNA, 64 nt, hsa
auuccuauacgcagcgugcuuuaaaaaauaaauaagaaacaacucuuugagaaacaacaauuuc

SEQ ID NO: 116475 - RNA, 64 nt, hsa
cccagcuccuggccucacauggguggucacagggagaaacaaguacuguagcagaucuuugagu

SEQ ID NO: 116476 - RNA, 64 nt, hsa
gagcaggaaggauaaaaaauaaagaaagacagagagaaacaaauuugcugggagagggaaagac

SEQ ID NO: 116477 - RNA, 64 nt, hsa
uaaauuuuuuuauaggcccauaugcucuaucucaagaaacaagaugauuguaacauguccauga

SEQ ID NO: 116478 - RNA, 64 nt, hsa
uacguuuucuuguccuuucaaaaguguucuugaaagaaacaaagcgaauaggcaguuagcacag

SEQ ID NO: 116479 - RNA, 64 nt, hsa
uaagugggauuaugaugaguaacuggaggggcuuagaaacaaaaacuggaugaaagaguaugca

SEQ ID NO: 116480 - RNA, 64 nt, hsa
uuaaucucuuauguauagggugauaaccuuccccagaaacaacagugauugcgauuguuuucua

SEQ ID NO: 116481 - RNA, 64 nt, hsa
guacuaguacauaucuuuaaauuaccaaaaaacaagaaacaaaacauaaaaaccccaaaacuau

SEQ ID NO: 116482 - RNA, 64 nt, hsa
aaguuuaaagagcuaaagcucuaaaacuguucugagaaacaaugaauaguacauguauauguau

SEQ ID NO: 116483 - RNA, 64 nt, hsa
aauguaagauacuuuagaaagcauguaaaguacuagaaacaaugagguggcuucaauuagugcu

SEQ ID NO: 116484 - RNA, 64 nt, hsa
cauucugagaccuaaauuuaaagggucaggcauuagaaacaaaaguguuucuucauaucuagga

SEQ ID NO: 116485 - RNA, 64 nt, hsa
uguuacuuguagccaaaaagaaaccucucuuaguagaaacaaagggagaguuagguuauucaaa

SEQ ID NO: 116486 - RNA, 64 nt, hsa
uugguuagagugauauguauuuagccauagauggagaaacaaagcucaggguuuguugaauuag

SEQ ID NO: 116487 - RNA, 64 nt, hsa
ucuccuccuuuaacuccuccuaccccccaagguaagaaacaaaaaacaaacaaacaaacaaaaa

SEQ ID NO: 116488 - RNA, 64 nt, hsa
ccagcaccuaaaaagacucuuuucaaaaaaucacagaaacaaccuaggacaauuauuuguuaca

SEQ ID NO: 116489 - RNA, 64 nt, hsa
auuguucgacuccaugauacuaaaacauaaugaaagaaacaaacuccaguauggagaagagaaa

SEQ ID NO: 116490 - RNA, 64 nt, hsa
ugugggcaaaacuuuguuuuuguuuugcacaguaagaaacaauaggcaagcguuauguuuuugg

SEQ ID NO: 116491 - RNA, 64 nt, hsa
uacugucuuaggaauuauuaggaguugauuccugagaaacaacacauuuuuccccaugaacggu

SEQ ID NO: 116492 - RNA, 64 nt, hsa
uaugggagagacucagugagccagcaaaggccauagaaacaacaauuuauuaaauguauuuaug

SEQ ID NO: 116493 - RNA, 64 nt, hsa
uggucuguaugguggaauuugucagcuggaacucagaaacaacaacuugaaaaaaaaauaauaa

SEQ ID NO: 116494 - RNA, 64 nt, hsa
gauuggcucugagagaacuggcuaagauucaggaagaaacaaaaaauucagaauccuacaaggu

SEQ ID NO: 116495 - RNA, 64 nt, hsa
ccgauugcuccuguguaaagaugccuugucgugcagaaacaaauggcuguccaguuuauuaaaa

SEQ ID NO: 116496 - RNA, 64 nt, hsa
gucuuuaaauguuaaagaugcacuauccucuuagagaaacaaucaguucaacuauuguuguacu

SEQ ID NO: 116497 - RNA, 64 nt, hsa
uaugguugaguuuccauauaaguggaccagacacagaaacaaacagaaugagcuaguaagcgau

SEQ ID NO: 116498 - RNA, 64 nt, hsa
uuuucaauuuuauuuuaguucuaaauuauguuucagaaacaaaagacaaugcuguacaguuuua

SEQ ID NO: 116499 - RNA, 64 nt, hsa
uuucaguccugguuccucugauaagaucgacaaaagaaacaacaaaaugagaagaagagguucc

SEQ ID NO: 116500 - RNA, 64 nt, hsa
gcccuccacccccgucucugcacugagauacauaagaaacaaggguaguuuacugucuguuuug

SEQ ID NO: 116501 - RNA, 64 nt, hsa
ggcuuaggggcuagcagcccacggggccacacagagaaacaaccacgcagacagucacaccacg

SEQ ID NO: 116502 - RNA, 64 nt, hsa
ggaaugcgggggagcaggcaguggggcuggaagcagaaacaaaaugaaaaaaaaaggggggugg

SEQ ID NO: 116503 - RNA, 64 nt, hsa
guuuaaggagcaagacugagacucugauucagcgagaaacaaccauaggggcagaucccuucau

SEQ ID NO: 116504 - RNA, 64 nt, hsa
uguccuacccacccacccaccucuguagagucccagaaacaaaacuaugcugacaccucugcuu

SEQ ID NO: 116505 - RNA, 64 nt, hsa
aaaagggaaaaaacaauauccuuguuuacagaagagaaacaaacaagccccacucagcucaguc

SEQ ID NO: 116506 - RNA, 64 nt, hsa
ccauugggagaaaaacccagacgccaggaaaagaagaaacaacaaaggcaggagaacagccacu

SEQ ID NO: 116507 - RNA, 64 nt, hsa
cagcguaauggagaaaggggaaguaguagaauucagaaacaaaaaugcgcaucucuuucuuugu

SEQ ID NO: 116508 - RNA, 64 nt, hsa
ccacuaaugcaaacugggaugaaacuaaagcaauagaaacaacacaguuuugaccuaacauacc

SEQ ID NO: 116509 - RNA, 64 nt, hsa
ugaaauucacaaaguuaaacgugaugugcucaucagaaacaauuucuguguccuguuuuuauuc

SEQ ID NO: 116510 - RNA, 64 nt, hsa
uuauucccuucaaugcaaaauacaugaugauuucagaaacaaagcauuugacuuucugucugug

SEQ ID NO: 116511 - RNA, 64 nt, hsa
aguaugugggucagcuuaaaaauuuugauuguuaaugcccuauuuucuaauuuggcaccucuug

SEQ ID NO: 116512 - RNA, 64 nt, hsa
uuaaauacuguuggcauuuuuaugguuccuuuaaaugcccuagcuauucccagagggguuuuuu

SEQ ID NO: 116513 - RNA, 64 nt, hsa
gcaaugcuccauccccauuauauuacaaauaaagaugcccuaaaugaguguggaaauucuaaug

SEQ ID NO: 116514 - RNA, 64 nt, hsa
cuuuuuuucauuuugauuuuugaaagugaagaugaugcccuaauuccugguaaggauuuggggc

SEQ ID NO: 116515 - RNA, 64 nt, hsa
cccaguaggguuuucugaggcucgcuggugacucaugcccuaauugcaauccucugcuuuuauc

SEQ ID NO: 116516 - RNA, 64 nt, hsa
agguuggacuuacauagaggaaagaaagcaagaaaugcccuauguacaugagguuuuaccuccu

SEQ ID NO: 116517 - RNA, 57 nt, hsa
cagcacccucagggucuuaaggucuucaugcccuaucacaaauaccucuuuuaucug

SEQ ID NO: 116518 - RNA, 64 nt, hsa
augaguuuaauacugaagucuggaauguaagcucaugcccuagaggccucuccauauggcuggu

SEQ ID NO: 116519 - RNA, 64 nt, hsa
auccagcuugcaacuaauccuucuaucaucuaacaugcccuacuuggaaagaucuaagaucuga

SEQ ID NO: 116520 - RNA, 64 nt, hsa
uacuaaaagacagguagccauauacagacaguauaugcccuauuuuuuuuaacugacucuuaau

SEQ ID NO: 116521 - RNA, 64 nt, hsa
cuccaggcucugggccguguagacacuaaaccucaugcccuaaggacaggaggaaagacccucu

SEQ ID NO: 116522 - RNA, 64 nt, hsa
gccuagccagggcuuacuccaggaaucuaaauagaugcccuaguccacuuuaucuuuguuccca

SEQ ID NO: 116523 - RNA, 64 nt, hsa
guaaaguccccagagaaagcgcagaugcuagcacaugcccuaaugucuguaucacucugugucu

SEQ ID NO: 116524 - RNA, 64 nt, hsa
gggccauaaaccuauuuagucuggagccaaagggaugcccuaucugaaggaaaggggcaugggg

SEQ ID NO: 116525 - RNA, 64 nt, hsa
cugcaguguccuuggcaaauccccacuguacucaaugcccuacauucucuucuguggucucucc

SEQ ID NO: 116526 - RNA, 64 nt, hsa
uuucuugcaguuuuuuuauggcauuuuuuuaaagaugcccuaaguguugaagaagaguuugcaa

SEQ ID NO: 116527 - RNA, 64 nt, hsa
caagugugaagcuggacgugaugcaaaauaaccgaugcccuacaaaaagggcgcaucuuuaaga

SEQ ID NO: 116528 - RNA, 64 nt, hsa
cuucccccuccccagccccaaacaugcccaucacaugcccuagaagguaagucccaugaaggca

SEQ ID NO: 116529 - RNA, 64 nt, hsa
gacuguagucccaaaaaagccuugugaaaauguuaugcccuauguaacagcagaguaacauaaa

SEQ ID NO: 116530 - RNA, 64 nt, hsa
aguucuaucuguucuauuauagagacuuuuaucuaugcccuaucuggauucuacuuauuuauaa

SEQ ID NO: 116531 - RNA, 64 nt, hsa
ugcuggggucuggagugaacaucuccuccccuucaugcccuagccuguguucuagcuguccugg

SEQ ID NO: 116532 - RNA, 64 nt, hsa
caccucaacauuucaguguuuugcuuuuuaaaaaaugcccuauuguaaguuguugguuuauacu

SEQ ID NO: 116533 - RNA, 64 nt, hsa
gcaauuuugaugagaugucucuggggacacgaggaugcccuaaugaugcugacuugucaugguu

SEQ ID NO: 116534 - RNA, 64 nt, hsa
aagaaucgaagacaucccuagugcauguacacgaaugcccuacgucauccuuccagcaccacug

SEQ ID NO: 116535 - RNA, 64 nt, hsa
gcaauuggauuucagguucccuuuuugugccuucaugcccuacuucuuaaugccucucuaaagc

SEQ ID NO: 116536 - RNA, 64 nt, hsa
augaaaaagcuucauucucuucagugucuucuagaugcccuacuuaaagagaacauuuucuuau

SEQ ID NO: 116537 - RNA, 64 nt, hsa
gcuucagaccccccuggccagugagcuggaccucaugcccuacacacccccacaggugaaggug

SEQ ID NO: 116538 - RNA, 64 nt, hsa
ucuuuuacucucucuauuucuuuuuguuuuucugaugcccuacgauccuaaagaacagaugaau

SEQ ID NO: 116539 - RNA, 64 nt, hsa
aauuccuuacaaugauggcagaacccccaagcgaaugcccuauugaggagaaggacaucacugu

SEQ ID NO: 116540 - RNA, 64 nt, hsa
cagaguagagagcccccacaaaguuauuuaaaagaugcccuagcagcaauccaccaguuuuucu

SEQ ID NO: 116541 - RNA, 64 nt, hsa
guuguuguaaacuguaucaguaugaaauaugugcaugcccuagaugugaaacuccucagcagcu

SEQ ID NO: 116542 - RNA, 64 nt, hsa
gaaaagaacuauguuaauuuuuuugcacauuaaaaugcccuagcaguaucuaauuaaaaaccau

SEQ ID NO: 116543 - RNA, 64 nt, hsa
aacgccucucaccagggcuuccagugaaguuacaaugcccuagucugugaauuagucuggaaac

SEQ ID NO: 116544 - RNA, 64 nt, hsa
aggggacuguucucaccuuaacucagccagaaagaugcccuaguugugaucaaagguaacucga

SEQ ID NO: 116545 - RNA, 64 nt, hsa
uggcagguguugggaccugcugcuccauggaugcaugcccuaagagugucacugagcuguguuu

SEQ ID NO: 116546 - RNA, 64 nt, hsa
uguuucucuuuuagugguauuaugugaauuuuuuaugcccuaaguuuaaauacguaauuguccc

SEQ ID NO: 116547 - RNA, 64 nt, hsa
accccgaaucuuugcagccguucggcccugaaagaugcccuauccaugagaugccuuuucaucu

SEQ ID NO: 116548 - RNA, 64 nt, hsa
uuaauuuguuaucagguuguuucaguuguauuggaugcccuaucuaucugcuaaagcaaaaagu

SEQ ID NO: 116549 - RNA, 64 nt, hsa
uucaaacauaucugaauguauaaaauaagaguaaaugcccuacauggugugaugcugcauuaua

SEQ ID NO: 116550 - RNA, 64 nt, hsa
aauauugacuuuauguagauauucuaaaucucauaugcccuacuugaaacuugccuguauuauu

SEQ ID NO: 116551 - RNA, 64 nt, hsa
cugccugaaaccuguucuaccaauuauagaucaaaugcccuaaaauguagugacccgugaaaag

SEQ ID NO: 116552 - RNA, 64 nt, hsa
guaacuuuuauuuuaauugacauucucuuauuaaaugcccuauccaucauuaaaagguuuauua

SEQ ID NO: 116553 - RNA, 64 nt, hsa
cagugcuugucagcgcugggucuggggccucuguaugcccuaggccugugccaaaguggccaga

SEQ ID NO: 116554 - RNA, 64 nt, hsa
gcugcuacucuguagccacccccauggcuacaugaugcccuauuccuaaauaauaacaauagca

SEQ ID NO: 116555 - RNA, 64 nt, hsa
ugaugccuuccggcugaaacccucucugcuccauaugcccuaaacuuaucugggaaggcugggg

SEQ ID NO: 116556 - RNA, 64 nt, hsa
ggcacccaggccuuauaggaauucacccuggaccaugcccuaaaauaaccucaccccaaauaca

SEQ ID NO: 116557 - RNA, 64 nt, hsa
auguuagaaauacaucuuuuauaaugggggaagaaugcccuauguuucaauucaaaacaaagac

SEQ ID NO: 116558 - RNA, 64 nt, hsa
uggcugagcguuguuaucuuuuguuaucuuuuauaugcccuaggaaaguacaaccagaauugaa

SEQ ID NO: 116559 - RNA, 64 nt, hsa
gcugaaggcuccugugccaugucuuagacauugcaugcccuaucaauuacuauaauccugagcc

SEQ ID NO: 116560 - RNA, 64 nt, hsa
cuuuguucuuuuucugaagucaaacucuuaucaaaugcccuaaaauuauuaccacccaagagaa

SEQ ID NO: 116561 - RNA, 64 nt, hsa
aagcuuguccagcagaaccagcucaagaaaggagaugcccuagugguggcccagcuggcuggag

SEQ ID NO: 116562 - RNA, 64 nt, hsa
uuauuacucuaaucccagguaagucaagccuacaaugcccuagaggaagaguaaaaccagaaau

SEQ ID NO: 116563 - RNA, 64 nt, hsa
uccacauuuaauugcauuuugcucaaacuguagaaugcccuacauuccccccaccccaauuugc

SEQ ID NO: 116564 - RNA, 64 nt, hsa
uuauagaacucauuuaagcuguuuuuauuuuaauaugcccuauaaacauuuuuauauuuuuuga

SEQ ID NO: 116565 - RNA, 64 nt, hsa
agaauacagguuuucaagcaaaccccuguugaccaugcccuaauuuccuauugauuucuguucu

SEQ ID NO: 116566 - RNA, 64 nt, hsa
acauaaaauucuaucuuugauaaauuuuauuuuuaugcccuacuuaauauuugcaucaguauaa

SEQ ID NO: 116567 - RNA, 64 nt, hsa
ggguagucuuccagaagugaugcaguggugugagaugcccuacaccuuguuauuugggagacuu

SEQ ID NO: 116568 - RNA, 64 nt, hsa
uagaugauuuuugggaaagggcaaaaugugucagaugcccuaguuaaucauguaauuuaauucu

SEQ ID NO: 116569 - RNA, 64 nt, hsa
uuacacacaugaauuucuuaaaaaaaucaauuuaaugcccuaacucucuuauuaaggagaaaua

SEQ ID NO: 116570 - RNA, 64 nt, hsa
gagagggcagguggaacuggggcagaaucuagucaugcccuaaagcuaguccuguaaacaaugg

SEQ ID NO: 116571 - RNA, 64 nt, hsa
agaaagagaugaaaucuugagagcagugggaaauaugcccuauugaauguuugcauuaaaagug

SEQ ID NO: 116572 - RNA, 64 nt, hsa
gugaccaagcuguuucuccagcugccuugaggacaugcccuagggaacagugcucugaaucgua

SEQ ID NO: 116573 - RNA, 64 nt, hsa
acacacaaugccuagcuggggggucggaaggcaaaugcccuagaugguggggucacgucuuucu

SEQ ID NO: 116574 - RNA, 64 nt, hsa
gacacagaaggcagacugggugaggagaccuagcaugcccuauuggcagugcucaggagcugca

SEQ ID NO: 116575 - RNA, 53 nt, hsa
cuaaucagucuguggucuaacaaaugcccuacucucuuaugcauuaguaucac

SEQ ID NO: 116576 - RNA, 64 nt, hsa
gcgcugaagauccaugucuccucuaccaccaaggaugcccuagaugagcuaggaugcuuccagc

SEQ ID NO: 116577 - RNA, 64 nt, hsa
auccccuguccccuccccaaccccaagugccuucaugcccuagggccccccaagugccugcccc

SEQ ID NO: 116578 - RNA, 53 nt, hsa
acaacaaggcuuacuucuaguguaugcccuaugaccccccaucuuuccuccgc

SEQ ID NO: 116579 - RNA, 64 nt, hsa
cucugcugcccucccauccucccuguauccauucaugcccuaucuuucauucuccacuccuaau

SEQ ID NO: 116580 - RNA, 64 nt, hsa
gacagucaucugauaagaguaugacauggaugaaaugcccuacaggggccuuggacaucuuuaa

SEQ ID NO: 116581 - RNA, 64 nt, hsa
gcaccuucucugcaugucugcagugcuguguaaaaugcccuaccuuugcauggacuauucuuuc

SEQ ID NO: 116582 - RNA, 64 nt, hsa
uugcagccuuuuugcuugauugcauguaauggaaaugcccuauauuuuccugcaaaauaaguac

SEQ ID NO: 116583 - RNA, 64 nt, hsa
gggaucugcauuccccgcugcccaaucauuugcaaugcccuaauuagggcauccugccccucgc

SEQ ID NO: 116584 - RNA, 64 nt, hsa
aagguuuggggcagaaaggacuccuccuuuuuccaugcccuaaacagaccugacaggugagguc

SEQ ID NO: 116585 - RNA, 64 nt, hsa
aaaagcauaauguugaacauucauucaacagcugaugcccuauaaccccugccuggauuucuuc

SEQ ID NO: 116586 - RNA, 64 nt, hsa
agaaggcccugcucucucccauccaagugaccagaugcccuacucagcuuccaucaccccuagc

SEQ ID NO: 116587 - RNA, 64 nt, hsa
aggauuuccacguagacaccuaggaagagcccgcaugcccuagacucacuccagaggaaggauu

SEQ ID NO: 116588 - RNA, 64 nt, hsa
guaccacuuuccuuccacuguuaccugguacuuaaugcccuaaagauacaacuaggaguaacag

SEQ ID NO: 116589 - RNA, 64 nt, hsa
cuccaugaaguuuucccacugagucacaucagaaaugcccuacaucuuauuuccucagggcuca

SEQ ID NO: 116590 - RNA, 64 nt, hsa
accgccugcaaccucacugugcccgccccgcaccaugcccuagccccaggucuagccgggccca

SEQ ID NO: 116591 - RNA, 64 nt, hsa
cuccuggguagcuagcaccauggcaugcgccaccaugcccuauuuuuuuuuuuuaaagacaggg

SEQ ID NO: 116592 - RNA, 64 nt, hsa
aguguuccagguguaucuuagcuaaaacuagagaaugcccuaacuuagaugguuuuugaagccu

SEQ ID NO: 116593 - RNA, 64 nt, hsa
uucacugugugauuuguuuuuaaaaacuugcuucaugcccuacagaggugccagcuauuucugu

SEQ ID NO: 116594 - RNA, 64 nt, hsa
auacauaucugccccaguguuacuucacaggccuaugcccuacgggaacuccacucucccagcc

SEQ ID NO: 116595 - RNA, 64 nt, hsa
accaugaccaauaucucuaucucagcuucugcugaugcccuagcucagggcucugcauuccgug

SEQ ID NO: 116596 - RNA, 64 nt, hsa
gcuguaugccuagaaagugguugaaggauucuugaugcccuaaaaccaucuuguaagcuaaaug

SEQ ID NO: 116597 - RNA, 64 nt, hsa
ugacauauuuauuccuaguuccauaccuuugcacaugcccuacucuccacuaauuauacuuaaa

SEQ ID NO: 116598 - RNA, 64 nt, hsa
uuuugguuauguuugguuaguagauaucaccgcaaugcccuagaacagcuaugaagcagaauac

SEQ ID NO: 116599 - RNA, 64 nt, hsa
aagggagaagugagagggacaauuggguucauuuaugcccuauacaaagggcauuccagcagcu

SEQ ID NO: 116600 - RNA, 64 nt, hsa
aaaauucaaagguggauuacaagguguccucagcaugcccuauggccuaugugcgaagcaagaa

SEQ ID NO: 116601 - RNA, 64 nt, hsa
acaaggggucauccaucauuucccaagcagacgaaugcccuaauuaauugaaguuaguguucuc

SEQ ID NO: 116602 - RNA, 64 nt, hsa
auaucaacgacugugcuuguccauuauuuuacacaugcccuagaagccaaaacugaaagccacu

SEQ ID NO: 116603 - RNA, 64 nt, hsa
uuucacccagggcgacccuggguucuuuuggaaaaugcccuaagaaauguuugaaguaacgcug

SEQ ID NO: 116604 - RNA, 64 nt, hsa
uaauguauauucuaaaaagagaaugcaguaacuaaugcccuaaauguuugaucucuguuuguca

SEQ ID NO: 116605 - RNA, 64 nt, hsa
agguggccgugccucuaagcauguuuuucccaguaugcccuaggccuccccccaugguguuuuc

SEQ ID NO: 116606 - RNA, 64 nt, hsa
acuuggccugagacugaccucucccuagguccaaaugcccuagucacauggcagacccacggcc

SEQ ID NO: 116607 - RNA, 64 nt, hsa
aauuuuuguuugauauaaguuagcuuguuagcauaugcccuagagggccuccaucccuguauuc

SEQ ID NO: 116608 - RNA, 64 nt, hsa
gguaccagggguuuauuggguugcagauauauaaaugcccuaaacuuaaaaaaaaaaaaaaaag

SEQ ID NO: 116609 - RNA, 64 nt, hsa
auccccuccucccccauacacaccuaggcuugaaaugcccuacaggcccagaacuuucucacau

SEQ ID NO: 116610 - RNA, 64 nt, hsa
ccagcccgugagcugguccugcuuccucccuuccaugcccuaacuuuuaauaugcuuguucagc

SEQ ID NO: 116611 - RNA, 64 nt, hsa
uuacaggagggcccggagaaacugagguauggccaugcccuagacccuccccaaggaugaccac

SEQ ID NO: 116612 - RNA, 64 nt, hsa
uccuacugggcuuucccuaaugugguugggaguuaugcccuagacuaacuguauuguccuaguc

SEQ ID NO: 116613 - RNA, 64 nt, hsa
agaugagucaagggugaggccgauuguucugcccaugcccuaccauaccaauuucaauaacaau

SEQ ID NO: 116614 - RNA, 64 nt, hsa
ccagggucuggcugaaaaggcuuucugcaaauacaugcccuaaaguuucucagagccugucaca

SEQ ID NO: 116615 - RNA, 64 nt, hsa
uaauguauauguuuguuauaauguccauguaaacaugcccuauguuugugccuuuuaauuaguu

SEQ ID NO: 116616 - RNA, 64 nt, hsa
ugaaaauauguauaaaaucuagcaauucacaaaaaugcccuagaaauauagauuuuaaucacca

SEQ ID NO: 116617 - RNA, 64 nt, hsa
uaagcucucuucuucucgaaaaggugcuacugcaaugcccuacugagcaaccuuugagauuguc

SEQ ID NO: 116618 - RNA, 64 nt, hsa
ggcaguuggcugggcucccaacugucuguccucaaugcccuaccccaacuccacuagugacccu

SEQ ID NO: 116619 - RNA, 64 nt, hsa
auggaaaugguugacauuacacaugguauuugucaugcccuagcauggacugucucauacugcu

SEQ ID NO: 116620 - RNA, 64 nt, hsa
cuggcuccuucagcagcuagagcucaguauacuaaugcccuaucuuaguagagauuucauagcu

SEQ ID NO: 116621 - RNA, 64 nt, hsa
gccuccucuuuagcaggaauucacaacaguuuggaugcccuaaacuucuguagcucaggaacau

SEQ ID NO: 116622 - RNA, 64 nt, hsa
aaaaauuuuugguagagagaaucaggugaaagagaugcccuaaagaggacugagugggucugag

SEQ ID NO: 116623 - RNA, 64 nt, hsa
cccaccaguggcccccacucacagggagcuggcaaugcccuaccugccuguucuccagauggag

SEQ ID NO: 116624 - RNA, 64 nt, hsa
aauauuguguuuacauugaugagaacaagaguuaaugcccuacccucugcugggcuguuuguau

SEQ ID NO: 116625 - RNA, 64 nt, hsa
ucuuucuuuaaacauagagguaccaccacaagggaugcccuacucucucgcagcucuugaaagc

SEQ ID NO: 116626 - RNA, 64 nt, hsa
aaccuggcuuuugaugcccggauugcaagaauaaaugcccuaaaggagagcacauaugcaaugc

SEQ ID NO: 116627 - RNA, 64 nt, hsa
uucuguuuuaagccucagaaaaugaacuaagacaaugcccuagaugagcugccaaaaucugagc

SEQ ID NO: 116628 - RNA, 64 nt, hsa
guuucauuuaguauuugguacaaucuaauaaauacuaauccaguccaauacuaauccaauccaa

SEQ ID NO: 116629 - RNA, 64 nt, hsa
gguacaaucuaauaaauacuaauccaguccaauacuaauccaauccaauacuaauaauacuauu

SEQ ID NO: 116630 - RNA, 64 nt, hsa
uuuucaagaauaaucacgcuuuccugaauccaaacuaauccaucaccggggugguuuaguggcu

SEQ ID NO: 116631 - RNA, 64 nt, hsa
cacauggccccucccccugccaggagcuuuggaccuaauccaagcaucccuuugcccagaaaga

SEQ ID NO: 116632 - RNA, 64 nt, hsa
acuaguaaaccaaauccaucugcacaucaaaaagcuaauccaacauuaucaagcaggcuuuagu

SEQ ID NO: 116633 - RNA, 64 nt, hsa
gagaaaauguuuacaaacugcaucugacaaagaucuaauccagaaucuauaaagaacucaaaca

SEQ ID NO: 116634 - RNA, 62 nt, hsa
uugauaaauuccacuggacuugagcuuggcagcugaacuauuggagggugggagagcccagc

SEQ ID NO: 116635 - RNA, 62 nt, hsa
acucagacaguguacaaacuaagaaggccuaacugaacuaagccauauuuaucacccgugga

SEQ ID NO: 116636 - RNA, 62 nt, hsa
ccugccacuguguaacauagcugagguaaaaacugaacuauguaaaugacucuacuaaaagu

SEQ ID NO: 116637 - RNA, 62 nt, hsa
cuugcccugccaagcucccugcccuguugaugcugaacuacagccuugggacaggcaggcuu

SEQ ID NO: 116638 - RNA, 62 nt, hsa
ucauucauucagcaaauaaucugaaauccagucugaacuaaggccugagcuguggauaccau

SEQ ID NO: 116639 - RNA, 62 nt, hsa
uaagaauuuugcuuuagagaaugccacuuuggcugaacuacaaguguaggccaccauuauaa

SEQ ID NO: 116640 - RNA, 62 nt, hsa
acuagaugauuacgaagaucacaucccacucucugaacuacaaucacugugcucccuggggg

SEQ ID NO: 116641 - RNA, 62 nt, hsa
uagccaugacuguauuggacuuugaacauuuucugaacuaaaaaccucuauucuaaacuaau

SEQ ID NO: 116642 - RNA, 62 nt, hsa
aaugaccagacaccuguuugauaaauaguuuacugaacuagcagacguguggaaaaagaauc

SEQ ID NO: 116643 - RNA, 62 nt, hsa
auauacauaaauuuucagcuauuucuguuccccugaacuaauuugagauuagacccaaacau

SEQ ID NO: 116644 - RNA, 62 nt, hsa
uuuauuuuuauucgcacaucccaccccauccccugaacuacuugggagguggggagggguac

SEQ ID NO: 116645 - RNA, 62 nt, hsa
caaauuaaguagaaagugagacucaauaauaacugaacuacagcaaaaggcagagaauuaca

SEQ ID NO: 116646 - RNA, 62 nt, hsa
guuuuuugacaaucacuuccuuaaagacucuucugaacuaguuggaccugguuaaucauaga

SEQ ID NO: 116647 - RNA, 62 nt, hsa
aucagaaagacacuaaucugacuucaagaauucugaacuauuaaauagaaaauuuaaaugcu

SEQ ID NO: 116648 - RNA, 62 nt, hsa
augaggguauuuuugagugaauuuuaacugcucugaacuaaguauaagcucaugggccugca

SEQ ID NO: 116649 - RNA, 62 nt, hsa
uacauaggucuuaccauugaccuaagaucaaucugaacuaucuuagcccagucagggagcuc

SEQ ID NO: 116650 - RNA, 62 nt, hsa
cuuugccauaaugauagacucaauuuagcucucugaacuaguugguaauuuuuuuuuuuuaa

SEQ ID NO: 116651 - RNA, 62 nt, hsa
gugucuugcggcagcugcagcaaguggaggggcugaacuacuggccagcucacuggaugaug

SEQ ID NO: 116652 - RNA, 62 nt, hsa
ucuguagucaaaguauaccaaaaccaauuuaucugaacuaaauucuaaaguaugguuauaca

SEQ ID NO: 116653 - RNA, 62 nt, hsa
cuacaacaggcagguacugcugccagggggcucugaacuagugccugcuacccaggacaccc

SEQ ID NO: 116654 - RNA, 62 nt, hsa
gggggguggccacaggagauggggagaggagucugaacuaaaccccuggcuuuugugcacac

SEQ ID NO: 116655 - RNA, 62 nt, hsa
gggccacauuucaccuccuuagucccccuggucugaacuaguugagagaguaguuuugaaca

SEQ ID NO: 116656 - RNA, 62 nt, hsa
aacaaauccacagaauggguaaagaguagaaucugaacuauaucuugacaaauauuauucaa

SEQ ID NO: 116657 - RNA, 62 nt, hsa
cgcgcugccccugcccugccucuguccuggcucugaacuaguagaugauggugccagagggc

SEQ ID NO: 116658 - RNA, 62 nt, hsa
uaacuugagcauaagauaugagauacaugaaccugaacuauuaaaauaaaauauuauauuua

SEQ ID NO: 116659 - RNA, 62 nt, hsa
ugaagauuuauaccauugugguuuaagcuguacugaacuaaaucuguggaaugcauugugaa

SEQ ID NO: 116660 - RNA, 62 nt, hsa
cagugacugcugcgcugugcuggucucuaggccugaacuaggugcuggcaugucugggucgu

SEQ ID NO: 116661 - RNA, 62 nt, hsa
acccagauccucugguccaaguuguaugugcacugaacuaaucaggcaggaaaaaagcccag

SEQ ID NO: 116662 - RNA, 62 nt, hsa
guugugcaacaauaugaauauacauaacaauacugaacuauacacugaaaugguuaagaugg

SEQ ID NO: 116663 - RNA, 62 nt, hsa
uaaccucugcaugugaaaacuuuuaacaguuacugaacuauguaaauaugugaauuuuuuua

SEQ ID NO: 116664 - RNA, 62 nt, hsa
ugccugacuaagaugugaccagcucaggcagacugaacuaagcaccccucccauccugcgac

SEQ ID NO: 116665 - RNA, 62 nt, hsa
aaagagaaaagaaaacucagaaagggaugaaucugaacuauaugauuacuuguagucagaau

SEQ ID NO: 116666 - RNA, 62 nt, hsa
uuucucuggcacuccagucccaggccuugggccugaacuacuggaaaaggucuggcggcugg

SEQ ID NO: 116667 - RNA, 62 nt, hsa
gguucccuggcaggggaagcugagagccauggcugaacuaucagggacaaaggcccaugucc

SEQ ID NO: 116668 - RNA, 62 nt, hsa
gcagugcaaacccucuuccgcugagcagcugucugaacuauaggccccagugcugaagacca

SEQ ID NO: 116669 - RNA, 62 nt, hsa
agagggaguauuguauugggaagaaaauguuacugaacuauugacugaaaguaaauuuagau

SEQ ID NO: 116670 - RNA, 62 nt, hsa
auaccugucaccaugcagccgcugauaguucucugaacuaaaaggacuaauuguacuuugag

SEQ ID NO: 116671 - RNA, 62 nt, hsa
auuagaagcaauuauaauuacaucugugauuucugaacuaauggugcuaauucagagaaaug

SEQ ID NO: 116672 - RNA, 62 nt, hsa
cagaaagaacucaggacauauuaaaaaauaaacugaacuaaaacaacuuuugcccccugacu

SEQ ID NO: 116673 - RNA, 62 nt, hsa
agcugaauuagucauguccauucagacauaaccugaacuacugaaaagaucaauuuccagaa

SEQ ID NO: 116674 - RNA, 62 nt, hsa
cgguggcagugggugccuguagugugaugugucugaacuaauaaaguggcugaagaggcagg

SEQ ID NO: 116675 - RNA, 62 nt, hsa
guaaaaaguaguauuguguauuugcucaguaucugaacuauaagcccauuuauacuguucca

SEQ ID NO: 116676 - RNA, 62 nt, hsa
gggaaggacagacaucaagugccagauguugucugaacuaaucgagcacuucucaccaaacu

SEQ ID NO: 116677 - RNA, 62 nt, hsa
agggccuccacacugccuggcagaacauaccacugaacuaguaugugcuagaggagggcaca

SEQ ID NO: 116678 - RNA, 62 nt, hsa
uugccccuugcagugggacgccuucagcaugccugaacuacauaacuuccuacguauccugc

SEQ ID NO: 116679 - RNA, 62 nt, hsa
aguccuguggcugaggggcacagauugaacugcugaacuaguuggaggucuagaugaggugc

SEQ ID NO: 116680 - RNA, 62 nt, hsa
acucuaaucauuggccucaugauugaagcauccugaacuaugaauuagacaucaguuagcaa

SEQ ID NO: 116681 - RNA, 55 nt, hsa
aaaagucaagucuugucuaagaugucugaacuauuaaauuuaccauuuuguuuuu

SEQ ID NO: 116682 - RNA, 62 nt, hsa
ucugacaugaaaacuucucaccgccucagcagcugaacuaaaaaccugaauagccaugacaa

SEQ ID NO: 116683 - RNA, 62 nt, hsa
ugggaauauucagucaaggagcagacuuuggucugaacuagccauugaugauuguuaaguuu

SEQ ID NO: 116684 - RNA, 62 nt, hsa
auuguaugcaaucuuuauguguaacuccaaaacugaacuauaagauaauucauaagaauuug

SEQ ID NO: 116685 - RNA, 62 nt, hsa
ugcucuugaagaagaaaaacgaagacaacaggcugaacuagaagcuuuugaaaacagacuga

SEQ ID NO: 116686 - RNA, 62 nt, hsa
uaugacaaagccucaauuacuaauuguaaaaacugaacuauucccagaaucauguucaaaaa

SEQ ID NO: 116687 - RNA, 62 nt, hsa
auucucaaguccuuuuacaaucagugugucuccugaacuagcacacaggcuguagaaacagu

SEQ ID NO: 116688 - RNA, 62 nt, hsa
cucauaguuauuauccagaggacccaacugaacugaacuaauccuucuggcagauucaaauc

SEQ ID NO: 116689 - RNA, 62 nt, hsa
cuucaucugaaugugcucugccgccuucuuaucugaacuagaugaauuggccauaauuauga

SEQ ID NO: 116690 - RNA, 62 nt, hsa
cauuuuaguagggauucacugacuagauuuuacugaacuaugaaaauaaauacacauaauuu

SEQ ID NO: 116691 - RNA, 62 nt, hsa
uaacuguaaaacauugaaugaaacuauuuuaccugaacuagauuuuaucugaaaguagguag

SEQ ID NO: 116692 - RNA, 62 nt, hsa
ggagccccagauaaacaugauggggaaaagcacugaacuaagagucccaugguuucucuucu

SEQ ID NO: 116693 - RNA, 62 nt, hsa
guagcuggucagggacuuuuuuuucuuuucuccugaacuacaugauucuaauuggaauguuc

SEQ ID NO: 116694 - RNA, 62 nt, hsa
cauauucacaaaccaauacugucauugcuaaucugaacuauuauuuuuauacuauauauugu

SEQ ID NO: 116695 - RNA, 62 nt, hsa
gguuaaacaguuuuguguagaucuuuuuggugcugaacuaugacaugagccuuauagauugu

SEQ ID NO: 116696 - RNA, 62 nt, hsa
aggaagcuaagcaguggguaccugggaucucucugaacuauuuuuauaacuucuugugaguc

SEQ ID NO: 116697 - RNA, 62 nt, hsa
uuuaauuauuacaaguugcuccugcccccucccugaacuauuuugugcuguguauaucacug

SEQ ID NO: 116698 - RNA, 62 nt, hsa
uuuuguucauuuuuaauuugcaaaucgauaaccugaacuaauuuguucuuauuuuuugccac

SEQ ID NO: 116699 - RNA, 62 nt, hsa
ucccuuccuucuuccacuuucacagcuuuucucugaacuaggagaaccuggggguggauuug

SEQ ID NO: 116700 - RNA, 62 nt, hsa
uuuauuuauuuauuuauuuuugcauucugaggcugaacuaauaaaaacucuucuuuguaauc

SEQ ID NO: 116701 - RNA, 62 nt, hsa
gcuacauuacaaacuuuggacgagacucucaucugaacuaacuuggggaaacaauuucuagg

SEQ ID NO: 116702 - RNA, 62 nt, hsa
ggguaacucagguaaagaugcuuuucuuuuaucugaacuacuuaaugauugcuuuacuuuua

SEQ ID NO: 116703 - RNA, 62 nt, hsa
cuaucauguuauggaauggaaaguacauugggcugaacuaauccaauuguuauuaagccacu

SEQ ID NO: 116704 - RNA, 62 nt, hsa
aaaguaacaucaacacugucccauccucagcccugaacuagcuaccaucugauccccucaga

SEQ ID NO: 116705 - RNA, 62 nt, hsa
uaaaagcaaaucaacacuuuauaguuauucuucugaacuaagacaugucaauauucuuuuuu

SEQ ID NO: 116706 - RNA, 62 nt, hsa
aaaccuuuuuuaaaaaagguucacucuaaaagcugaacuacauccuuaguuuucagucuacu

SEQ ID NO: 116707 - RNA, 62 nt, hsa
ccauuaugauaaauuaagcaugaaaaauauugcugaacuacuuuuggugcuuaaaguuguca

SEQ ID NO: 116708 - RNA, 62 nt, hsa
cuuguucagauuaagaguugccaaaauaccuucugaacuacacugcauuguugugccgagaa

SEQ ID NO: 116709 - RNA, 62 nt, hsa
cauaagccuuuuauggcccucuugcagaucuucugaacuaugcacauuugugcuuuuuuugu

SEQ ID NO: 116710 - RNA, 62 nt, hsa
aaaugucauguuaagcaauuucagaacauuaacugaacuauuuucaaagcagaaaaauugac

SEQ ID NO: 116711 - RNA, 62 nt, hsa
aaguaaauauuuauuuaggaauacugugaacacugaacuaauuauuccugugucagucuaug

SEQ ID NO: 116712 - RNA, 62 nt, hsa
uuugugccugaaaauaauagagcuugagcugucugaacuauuuuacauuuuauggugucuca

SEQ ID NO: 116713 - RNA, 62 nt, hsa
guaagaaagggagaauauaguuuuagaggaagcugaacuaugacgaugcugggcgaagcggu

SEQ ID NO: 116714 - RNA, 62 nt, hsa
uagagagacaggggaguugucaacuugggcuacugaacuacaugcauaaacuaaaaacuaac

SEQ ID NO: 116715 - RNA, 62 nt, hsa
uauuuaaaacaaaguucaauuuagcuggauuucugaacuaugguuuugaauguuuaaagaag

SEQ ID NO: 116716 - RNA, 62 nt, hsa
cuuuucucuugugagggaagacuguaacacagcugaacuauuucagugucaacuauucagaa

SEQ ID NO: 116717 - RNA, 62 nt, hsa
uaaaaaucaguaaucaguacuuuauuacaucacugaacuaaaauauggagacauccucauug

SEQ ID NO: 116718 - RNA, 62 nt, hsa
cauaaagagaguguuauauaaaaauccgacagcugaacuagguugcucuuuuuuggcaggga

SEQ ID NO: 116719 - RNA, 62 nt, hsa
cacaagcgaggguagcagaggcucuccucagucugaacuaaggcuuggccuuggggagggcu

SEQ ID NO: 116720 - RNA, 60 nt, hsa
ucagcuggcagcaguggugaaaagaaauuacugaacuauugucaaauggacuuccuguca

SEQ ID NO: 116721 - RNA, 62 nt, hsa
gggccuauacuuuuauuuuucaacucuauuaacugaacuaugcuuggagagagcccugaauc

SEQ ID NO: 116722 - RNA, 62 nt, hsa
auccacuguuagaauaccuaugguuagggcuucugaacuaaaauaauggaaaauuuuaacaa

SEQ ID NO: 116723 - RNA, 62 nt, hsa
ggaauugagcuucccucccauuuuccuuguuccugaacuaauacuacuguaccuguuaugga

SEQ ID NO: 116724 - RNA, 62 nt, hsa
ugucaaaagguuuauguaaacuugaauuuuaucugaacuaaauuguaucuuaaaauucauac

SEQ ID NO: 116725 - RNA, 62 nt, hsa
ccaaauuuuugccauuaaaaacuggcauuauacugaacuauacauugagaaaucaaucaaaa

SEQ ID NO: 116726 - RNA, 62 nt, hsa
gaauucaccaagauuggguagaacugguaucacugaacuacuaaaguuuuacagaaaguagu

SEQ ID NO: 116727 - RNA, 62 nt, hsa
auuaccuagaaguuugucacugacuuguguuccugaacuaugacacaugaauaugugggcua

SEQ ID NO: 116728 - RNA, 62 nt, hsa
gucauagaauucccaaauuucauuuguagauacugaacuaagggcuaaugucaggagcugau

SEQ ID NO: 116729 - RNA, 62 nt, hsa
ccguguucugccagcaccgcccuucacccggccugaacuaaggagcaguggcagaagguggg

SEQ ID NO: 116730 - RNA, 62 nt, hsa
ccccugcucaacagagguuuaguuuacagucucugaacuaaaguaguaaccucccaaauugu

SEQ ID NO: 116731 - RNA, 62 nt, hsa
caggacuacauaugacccagagagcaagguggcugaacuauagucuggaagcccucagguaa

SEQ ID NO: 116732 - RNA, 62 nt, hsa
cucgacaauaaagauauuccgugucuuuaccccugaacuaagacacagggaguauuucagag

SEQ ID NO: 116733 - RNA, 62 nt, hsa
agauguggacagcuugauguuuuagacaaccacugaacuagaugacuguuguacuguagcuc

SEQ ID NO: 116734 - RNA, 62 nt, hsa
ucgcccccagccugaggugaucuuucccuccucugaacuauuagagcaguuacugucuguuc

SEQ ID NO: 116735 - RNA, 62 nt, hsa; identical to SEQ ID NO: 116702

SEQ ID NO: 116736 - RNA, 62 nt, hsa
cuagauuaaauuaaaauugguugcauuauuuucugaacuauaauaggguuuuucuucaggug

SEQ ID NO: 116737 - RNA, 61 nt, hsa
ggaagcuggaauucguaugacggagucuuaucugaacuacacuuacugaacagcuugaagg

SEQ ID NO: 116738 - RNA, 62 nt, hsa
gauaugcauuugacuuguuaaacagccuauuccugaacuauaacaccugccaccacuauaaa

SEQ ID NO: 116739 - RNA, 62 nt, hsa
gcacaauaucuucacacugugcuguauugcugcugaacuaaaugcacuuuuccccacauaug

SEQ ID NO: 116740 - RNA, 62 nt, hsa
ccuuaucguucuauguaccagguauuuuauuacugaacuagcaacuagccuuuuccaccuuu

SEQ ID NO: 116741 - RNA, 62 nt, hsa
agcacuauguaggaaagaccauuuuuccuccacugaacuaggguggugcauuuuuguaaguu

SEQ ID NO: 116742 - RNA, 62 nt, hsa
uucaguccuguggucccuggacuggugggaaccugaacuaggaguccugggagagcuguggu

SEQ ID NO: 116743 - RNA, 62 nt, hsa
guaaauauguuuuaggaagaaagcaaaagggacugaacuagccucugguaggauugcagggg

SEQ ID NO: 116744 - RNA, 62 nt, hsa
aauaauuuugugaauuuuuugguuguuguucccugaacuacugucuauauuuaaaauuagau

SEQ ID NO: 116745 - RNA, 62 nt, hsa
gccauaaaugaccuaacguuucccguuagucucugaacuaggugaucucaguucucuuucaa

SEQ ID NO: 116746 - RNA, 62 nt, hsa
cccuuguucuuggagggaccauuauuacaucucugaacuaccuuuguauccaacauguuuua

SEQ ID NO: 116747 - RNA, 62 nt, hsa
ccccagccaaucaggacuuuccagacuuggcccugaacuacugacguuccuaccucuuauuu

SEQ ID NO: 116748 - RNA, 62 nt, hsa
auuuugccuuagcuacugcaguggaaagagcacugaacuaggaguuggaagacaaggaugug

SEQ ID NO: 116749 - RNA, 62 nt, hsa
cagggugucuggggcaggaggaggccaacucacugaacuagugcaggguauguggguggcac

SEQ ID NO: 116750 - RNA, 62 nt, hsa
gcucgcauuaguuucuguugcugccaacagaucugaacuaaugcuaacagaucccccugagg

SEQ ID NO: 116751 - RNA, 61 nt, hsa
uguacacauuuuaauaaaauaaggguuggcuucugaacuacaaaacaaaugugcuaugcuc

SEQ ID NO: 116752 - RNA, 62 nt, hsa
cauuuagaauuagcagagcuaauauggaggggcugaacuaguagccacaucuuguucaucac

SEQ ID NO: 116753 - RNA, 62 nt, hsa
uaguuggucuaagggucuguauuggacuaauucugaacuacagacaaauuggaccucaaugu

SEQ ID NO: 116754 - RNA, 62 nt, hsa
ugaaucuuaauauuucaaagccaggugaaaaucugaacuagauauucuuuguuggaauaugc

SEQ ID NO: 116755 - RNA, 62 nt, hsa
uccuggcuguugugaaagaauuuuucuacauccugaacuauuuuuccuauuucuuuucaccu

SEQ ID NO: 116756 - RNA, 62 nt, hsa
aaauuaaguuuuggguaaguguguuguuuaaucugaacuauaguaacuuaauacucuaaaca

SEQ ID NO: 116757 - RNA, 62 nt, hsa
cagcagagcugagauuaauaucugggcuuuuccugaacuauucugguuauugagcccuuccu

SEQ ID NO: 116758 - RNA, 62 nt, hsa
acauaacuaacuuucgaggcacuggaacauaccugaacuaagaauuaaaucuuuuacuuuau

SEQ ID NO: 116759 - RNA, 62 nt, hsa
cuucggcuugugaggcuucccacuauuuauuacugaacuauuauguuaaugaagauggacau

SEQ ID NO: 116760 - RNA, 62 nt, hsa
auaguuuuaucuggguacaaauaaacaggugccugaacuaguucacagacaaggaaacuucu

SEQ ID NO: 116761 - RNA, 62 nt, hsa
cguuucaaugaaacaauguauguuuguuuuaacugaacuaaaauaaauacaugcuuaauccu

SEQ ID NO: 116762 - RNA, 62 nt, hsa
uuaaguaccugagcucucgaagcuacccagaacugaacuagacuccccuaccuuagacuggu

SEQ ID NO: 116763 - RNA, 60 nt, hsa
cucuuguucaugcccaguaagauguaaacccugaacuaaacaucacacacugagaaucuc

SEQ ID NO: 116764 - RNA, 62 nt, hsa
cuaaccaucaacaauugcaugguuaaaugacccugaacuaaaacugauggguucccuaucaa

SEQ ID NO: 116765 - RNA, 62 nt, hsa
acaguuaguauucuaaugaaaggaugaagagucugaacuagaagguagguuuaagccaucac

SEQ ID NO: 116766 - RNA, 62 nt, hsa
ucuuuauuaaaaccucagcaugucucccugaucugaacuauuugcuuucucuucaagauaag

SEQ ID NO: 116767 - RNA, 62 nt, hsa
uguguagguagauuccauauuaaugaggaacacugaacuaguuggaaauuacugcuuucucu

SEQ ID NO: 116768 - RNA, 62 nt, hsa
uauguauuuuaaagaaauuucaucugcuucuacugaacuaugcguacugcauagcaucaagu

SEQ ID NO: 116769 - RNA, 62 nt, hsa
gaauuuaacuuuuugauuuguauaauagaaaacugaacuaggaauuguuagcgggguuuuga

SEQ ID NO: 116770 - RNA, 62 nt, hsa
acccuuuuggaauuagaauucuuguucugaugcugaacuauuugguaauaaagugcuuauuu

SEQ ID NO: 116771 - RNA, 62 nt, hsa
uaugggauuuguggacacagcuguuucuguuccugaacuagaagucuuccccagcucugacg

SEQ ID NO: 116772 - RNA, 62 nt, hsa
guguuucuucauaucuaggagauuuggaaauucugaacuaaggucuuauaagaacaagaaau

SEQ ID NO: 116773 - RNA, 62 nt, hsa
aauuacuucuuguacagcugagauagcuucuucugaacuauuauuaaauaagugaauacaaa

SEQ ID NO: 116774 - RNA, 62 nt, hsa
uuuacagaucaauaaaagcaccuguucuccaucugaacuagacaauggaaauaaugcugcau

SEQ ID NO: 116775 - RNA, 62 nt, hsa
gaacucagggaacaauacuguaaacugucuuccugaacuacuguagggccucucuaagaauu

SEQ ID NO: 116776 - RNA, 62 nt, hsa
agcauuaauacuaguccaaaaaaugucauaaacugaacuaaaaugaugaacuauuuuaugua

SEQ ID NO: 116777 - RNA, 62 nt, hsa
uuacaaauugaggauuaccaauuaaacuuuaacugaacuaaggcuaccaaauacauucccug

SEQ ID NO: 116778 - RNA, 62 nt, hsa
ugucugauaagcaucuuaaagucacucaauuccugaacuaaucaauauauauguuuaaccca

SEQ ID NO: 116779 - RNA, 62 nt, hsa
ccuuuuuaaggggaggagagagcacuuaguuucugaacuagucuggggacauccuggacuug

SEQ ID NO: 116780 - RNA, 62 nt, hsa
ugccuuuguuuugaaauuauaucaccuguguucugaacuaaaaugaugggaguucauuuugu

SEQ ID NO: 116781 - RNA, 62 nt, hsa
auucuuucacaagguacaaaaucuugcauaagcugaacuaaaauaaaaaugaaaaggagaga

SEQ ID NO: 116782 - RNA, 62 nt, hsa
auauacucuugggagagagcaugaaugguauucugaacuaucaccugauucaaggacuuugc

SEQ ID NO: 116783 - RNA, 62 nt, hsa
uugccucugccugguacccacaugacuuggaacugaacuaacauuuuucuuuaaaaagcaaa

SEQ ID NO: 116784 - RNA, 62 nt, hsa
uuugccuugauaaagguaagauaaaugaaacgcugaacuaugcuaaucuggaauuuguuuuu

SEQ ID NO: 116785 - RNA, 62 nt, hsa
acaacuguccaggcugagauaaaucccgggaccugaacuauuagcacgucacuagagacugg

SEQ ID NO: 116786 - RNA, 62 nt, hsa
gcccacguggaggcccaccugccucugucucacugaacuagaagccgagccuagaaacuaac

SEQ ID NO: 116787 - RNA, 62 nt, hsa
ccaauacuccaaguccuugaguuuuguuauaucugaacuaguugaacugugacugacaggua

SEQ ID NO: 116788 - RNA, 62 nt, hsa
agggugggcaauucacagccuuucugaacugacugaacuagagcuugcagugaaguguucug

SEQ ID NO: 116789 - RNA, 62 nt, hsa
cuucguaauucuaauguguacugcugguauagcugaacuacugaccuggaucuuaguccuag

SEQ ID NO: 116790 - RNA, 62 nt, hsa
ucuuaguuucuguaaauucaugacuugucuuacugaacuacagccugguuuguagacuucca

SEQ ID NO: 116791 - RNA, 62 nt, hsa
cucccucaggccgaaggaggagucagggagagcugaacuauuagagcugccugugccuuuug

SEQ ID NO: 116792 - RNA, 62 nt, hsa
ccuaacauaaaacacagcaagaaucugguugucugaacuauuuuaaauuaaggagccagaug

SEQ ID NO: 116793 - RNA, 62 nt, hsa
auguuuauaaacuauacagaaaacuguauuugcugaacuaaggauuguauuggugauuucua

SEQ ID NO: 116794 - RNA, 62 nt, hsa
aauagaaugaaacacaaaauucaauuccucggcugaacuagccacauuucaacugcucagua

SEQ ID NO: 116795 - RNA, 62 nt, hsa
uguuuuacgcuaaagauggaaaagaacuaggacugaacuauuuuaaauaaaauauuggcaaa

SEQ ID NO: 116796 - RNA, 62 nt, hsa
uccuucgucucuccaacugccuuucccauccucugaacuaggcauuaacagcccccgugggc

SEQ ID NO: 116797 - RNA, 62 nt, hsa
uuauauacaguuuuaggggacaauugagauggcugaacuacugaauaaaaaaaaaacaacgc

SEQ ID NO: 116798 - RNA, 62 nt, hsa
cuccugcaucccaugcuaagcagggucauggucugaacuacucagauuggauuuccaaacca

SEQ ID NO: 116799 - RNA, 62 nt, hsa
gagaagagaauaaaagugacaugaacacuguacugaacuacaucuucucucacgcucaaguc

SEQ ID NO: 116800 - RNA, 62 nt, hsa
cagagggacugucaucuaaaccaggggaaccacugaacuaaagcccaauuugcuugcauuuu

SEQ ID NO: 116801 - RNA, 62 nt, hsa
guuaaccugauuucaauuuugauaccguuuuccugaacuaauaaaucuacccaaugagacuu

SEQ ID NO: 116802 - RNA, 62 nt, hsa
augagcuggguacugacugagauaagaaaagccugaacuauuuauuaaaaacaugaccacuc

SEQ ID NO: 116803 - RNA, 62 nt, hsa
auuuuggaauugguguauaucaugaagccuugcugaacuaaguuuuguguguauauauuuaa

SEQ ID NO: 116804 - RNA, 62 nt, hsa
uuauucacaccagcaucaucuuaacuaacauucugaacuaguuagugcagcuuuucauugug

SEQ ID NO: 116805 - RNA, 62 nt, hsa
ucugccuccaaacaggggacacuucgggaaugcugaacuaaugagaacugccagggaaucuu

SEQ ID NO: 116806 - RNA, 62 nt, hsa
ugauuaaacuagauagaccugguauacagucacugaacuaguagaugucaauaauuauuauu

SEQ ID NO: 116807 - RNA, 62 nt, hsa
guuuuggaauuugaagcuaauuuuuaaaaggccugaacuauacuuugaagaaaccccuauag

SEQ ID NO: 116808 - RNA, 62 nt, hsa
cagauuuauuuuuauguggaucccuguguaugcugaacuacagagcaugauguuuaaucuaa

SEQ ID NO: 116809 - RNA, 62 nt, hsa
acuuccuagaggaagggacaucgaacuaagaccugaacuaugagaaauaggcaggaagaagu

SEQ ID NO: 116810 - RNA, 62 nt, hsa
ccccucuacuuuaacuuuuacaaaaaaguaaccugaacuaaucugauguuaaccaauguauu

SEQ ID NO: 116811 - RNA, 62 nt, hsa
aacuguaugugaaggggagccagggaacguuucugaacuaagcaaggacaaauucagagacc

SEQ ID NO: 116812 - RNA, 62 nt, hsa
cagaccugagcuggcuuggacccauuugaggacugaacuaggcaggcaauggcuccagugcc

SEQ ID NO: 116813 - RNA, 62 nt, hsa
ccgcuccacggagucuuccagaacaccucccucugaacuaaucccggagcaccccaccccca

SEQ ID NO: 116814 - RNA, 62 nt, hsa
ucucaaaaaggcuacuguuugugacuuucaaccugaacuauggaucuguggcuauuuugcau

SEQ ID NO: 116815 - RNA, 62 nt, hsa
gguugcauucuccaccaagggaguuaaccuaccugaacuaaguagaaaugccagucuuccac

SEQ ID NO: 116816 - RNA, 62 nt, hsa
aauagaacacuucuuggaggcuuucuucagaacugaacuagaaacaagguuuccaggcuccc

SEQ ID NO: 116817 - RNA, 62 nt, hsa
uguaaguauuuacuuagagcuuuuucuuaaaucugaacuaacuugcuuuuagaagucuuuuu

SEQ ID NO: 116818 - RNA, 62 nt, hsa
ccucacaccuggcagcuucauggauguuguaucugaacuaaggaccagaggcugccagaugu

SEQ ID NO: 116819 - RNA, 62 nt, hsa
agaagaggccuauuaaaaaaaaaaguuguuuucugaacuagaagaggaaaaaaauggcaauu

SEQ ID NO: 116820 - RNA, 62 nt, hsa
cauuucucccuaauguucuuacccaaauguaccugaacuaaaaaauguuagauguuggugau

SEQ ID NO: 116821 - RNA, 62 nt, hsa
uuugcuuaacauuagaugucaugaggaaacuacugaacuagcaauugguuguuuaacacuuc

SEQ ID NO: 116822 - RNA, 62 nt, hsa
uccuguuuaaaaaaccacauggcacagagauucugaacuaaagugcugcacucaaaugaugg

SEQ ID NO: 116823 - RNA, 62 nt, hsa
acuuaauaaguauuccccccugcgacaccuagcugaacuaugguuuggugucugaucuugag

SEQ ID NO: 116824 - RNA, 62 nt, hsa
caccaagcucuguccaaucagguaggcugggccugaacuagccaaucagaucaacucugucu

SEQ ID NO: 116825 - RNA, 62 nt, hsa
cuuuauguacauaaucuugauggagcuauuagcugaacuauaaaauaugcucuugguaaaua

SEQ ID NO: 116826 - RNA, 62 nt, hsa
aaacaucuaugccuuuucucagaaaugauuugcugaacuauguccauauuuuacagcuuaga

SEQ ID NO: 116827 - RNA, 62 nt, hsa
gaguguuagaaaaaacuggaaacaucugauuucugaacuaucagggcaagcucauagcacau

SEQ ID NO: 116828 - RNA, 62 nt, hsa
ugaaauuuuaaaugcacaguucuauuugcuaucugaacuaauucauuuauuaaguauauuug

SEQ ID NO: 116829 - RNA, 62 nt, hsa
augguuuggccuggggaucuuagaugucugaccugaacuauuguagaacagcgcuggcuuuu

SEQ ID NO: 116830 - RNA, 62 nt, hsa
uacgguucugugcaaagagguguuuugccagccugaacuauauuuaagagacuuuguaaaaa

SEQ ID NO: 116831 - RNA, 62 nt, hsa
ucaaaaggaaaguugguuuugagcccaguauacugaacuagaauauucuagaucuuguuuua

SEQ ID NO: 116832 - RNA, 62 nt, hsa
auguaacugaccuuaguaaaguccuugacuaacugaacuagaaggaagguuuagccuucuaa

SEQ ID NO: 116833 - RNA, 62 nt, hsa
uaggguucuguggaaggagguauucugccagccugaacuauauuuaagaaacuuuguaaaaa

SEQ ID NO: 116834 - RNA, 64 nt, hsa
cuccguggccaguugaagcgcuggauguuuccuagaacaagaaccaccaaagccuguucgcaca

SEQ ID NO: 116835 - RNA, 64 nt, hsa
cccucccgucgagaagcugguagucagugagugagaacaagagaacaagaacacccugaacagu

SEQ ID NO: 116836 - RNA, 64 nt, hsa
ucgagaagcugguagucagugagugagaacaagagaacaagaacacccugaacaguccugguug

SEQ ID NO: 116837 - RNA, 64 nt, hsa
aauuuaguucaugcauuggucuuagagggugauggaacaagagaaguacuaucuuuguguugca

SEQ ID NO: 116838 - RNA, 64 nt, hsa
augucaauaaauuugcuuuuugagauguugagaggaacaagaagguggaaggcaguguuauuua

SEQ ID NO: 116839 - RNA, 64 nt, hsa
uaauuauucacauaaauuuuguuuaauauugguugaacaagaaaucugacuuuaaaagauuauu

SEQ ID NO: 116840 - RNA, 64 nt, hsa
gucauaacuuacagugaaaaagcccaauaauacagaacaagacaugaugggcaauacccuagca

SEQ ID NO: 116841 - RNA, 64 nt, hsa
uccaugcugagcuugacaacacucugggaaugaggaacaagacuuuuucuaaaaagauagugga

SEQ ID NO: 116842 - RNA, 64 nt, hsa
aaaggguaguuguuuuacaaugaagacuaaaacugaacaagauguugcaugcucuugaggccau

SEQ ID NO: 116843 - RNA, 64 nt, hsa
agaucacaccacugcacuccagccuggggugauagaacaagacccugucucaaaaaaaaaaaaa

SEQ ID NO: 116844 - RNA, 64 nt, hsa
cugauuuugguuuauucccuccagggucuaaagagaacaagaggugcuagcucuuaccaaaaca

SEQ ID NO: 116845 - RNA, 64 nt, hsa
uucuuuugugagagacacuguaaacgacacaagagaacaagaauaaaacaauaacugugugugu

SEQ ID NO: 116846 - RNA, 64 nt, hsa
ucuuuucccacccugucacucaacguggucccuagaacaagaggcuuaaaaccgggcuuucacc

SEQ ID NO: 116847 - RNA, 64 nt, hsa
ccugucuccaaagaucucccacaguguggagccugaacaagaagaggcuggggaggguuuuccc

SEQ ID NO: 116848 - RNA, 64 nt, hsa
aacgaagagcaggaagagguugcugagauuguuggaacaagacgagagguuguuggagcaagag

SEQ ID NO: 116849 - RNA, 59 nt, hsa
auggauuaaaaauugcauuguguuacagagcuagaaaauuuuauguaugaaaaacgaua

SEQ ID NO: 116850 - RNA, 59 nt, hsa
ugacuucuaguucuuuucuagaggaugcugcuagaaaaugguuuugcuuuguauuuuau

SEQ ID NO: 116851 - RNA, 59 nt, hsa
guaaauuauuuugcuuuugaccagguugugcuagaaaguagggcugcuucugugaguuc

SEQ ID NO: 116852 - RNA, 59 nt, hsa
aaaacaaaaaacaagaagcaaguuguacugcuagaaacuucucuaagauaagaggccag

SEQ ID NO: 116853 - RNA, 59 nt, hsa
ggcacaucaucauaauccauuuucucuuugcuagaaaaucagcccauagagugcauucc

SEQ ID NO: 116854 - RNA, 59 nt, hsa
gaaaaucauucugcuuuugaaucuuaaaagcuagaaaaaccauaauguaauauucuuuu

SEQ ID NO: 116855 - RNA, 59 nt, hsa
uuuuucuuacgugauuuuauguucauagagcuagaaaguagcaucucaugauggcccaa

SEQ ID NO: 116856 - RNA, 59 nt, hsa
cgucaaauuguuaucaggugccaaacacugcuagaaaggagggccuagucagaagccuc

SEQ ID NO: 116857 - RNA, 64 nt, hsa
acauucacuuucugccucugaggaaagauacagggaacaaaaaucaauuuguacagucuuaaua

SEQ ID NO: 116858 - RNA, 64 nt, hsa
cauaccgcaaauaucugugggguccuguugaaaagaacaaaauaaaggagcccaaggggucauu

SEQ ID NO: 116859 - RNA, 64 nt, hsa
uagcuuaauaggacaguaaaucuguguggggcuagaacaaaauuaagacauguuuggcaauauu

SEQ ID NO: 116860 - RNA, 64 nt, hsa
aggugcuuuaccuugagccauuauuugugucagagaacaaaagaaacagaaucaauauauaaaa

SEQ ID NO: 116861 - RNA, 64 nt, hsa
guaaugaauguaaugagagaaaauguuuugaaaagaacaaaacaucaaaaugaauagaaagaaa

SEQ ID NO: 116862 - RNA, 64 nt, hsa
uucaaauuguuaaaacauuggcauuugaagaggagaacaaaauguagcaugauguauuuaaagu

SEQ ID NO: 116863 - RNA, 64 nt, hsa
auaugaacaaaaauuacaggggaccuguuuaagagaacaaaauguuccaagcacuuuaggcaga

SEQ ID NO: 116864 - RNA, 64 nt, hsa
ugugaaagaaguuugcuaaagcaaaucaugauaugaacaaaaauuacaggggaccuguuuaaga

SEQ ID NO: 116865 - RNA, 64 nt, hsa
uggaagggaauguaaaauuugccugacuucuuaagaacaaaacccccagcucugugccccaugc

SEQ ID NO: 116866 - RNA, 64 nt, hsa
caguucuuggcugccguccuguggcagcuuaauggaacaaaaauuacagacuuuggugaaccaa

SEQ ID NO: 116867 - RNA, 64 nt, hsa
ugaacacucauuuuguuagcgagggugguaaagugaacaaaaaggggaaguaucaaacuacugc

SEQ ID NO: 116868 - RNA, 64 nt, hsa
aaauauucacaacagggcaguugugauacgaauagaacaaaaaaaaaaaaaaaacacuuaaacu

SEQ ID NO: 116869 - RNA, 64 nt, hsa
ucuuuuugagcaaaaaagucgaacuuuuucuguugaacaaaauauucacaacagggcaguugug

SEQ ID NO: 116870 - RNA, 64 nt, hsa
aaauauguuccuuuuucaaagaaacuuuauucuagaacaaaauagucuauaugguacuugaucu

SEQ ID NO: 116871 - RNA, 64 nt, hsa
auaauugucuacagaagcaagagcaaucuggaaggaacaaaaauguuuucugugauuaacagug

SEQ ID NO: 116872 - RNA, 64 nt, hsa
cuauaacagaauaccacagacuggguaacgugaugaacaaaaauuuauuuggcucacaguucug

SEQ ID NO: 116873 - RNA, 64 nt, hsa
auguuucuaaguugcacacaguuuauuaacaacugaacaaaacauuuuuaucauuuaaaaaucu

SEQ ID NO: 116874 - RNA, 64 nt, hsa
uuuauuuucacauaagucaauagauguuucucuagaacaaaauauuuaguaaagcuuuauaaau

SEQ ID NO: 116875 - RNA, 64 nt, hsa
cucagugacaaucaucauauuggagcaaaacauagaacaaaaucacuaucucagaaauaccuua

SEQ ID NO: 116876 - RNA, 64 nt, hsa
agugccuuccucucucuaccagucuauuuccacugaacaaaaccuacgcacauaccuucaugug

SEQ ID NO: 116877 - RNA, 64 nt, hsa
acugccuuccucucucuaccagucuauuuccacugaacaaaaccuacacacauaccuucaugug

SEQ ID NO: 116878 - RNA, 64 nt, hsa
uugcucagcuggcugagacacugaagaagucacugaacaaaaccuacacacguaccuucaugug

SEQ ID NO: 116879 - RNA, 64 nt, hsa
gacauaggccaugaaaaaaaugauccccaagugugaacaaaagaugcucuucuguggaccacug

SEQ ID NO: 116880 - RNA, 64 nt, hsa
uuuaaggaaacaauauaaccacaaagcacaguuugaacaaaaucuccucuuuuagcugaugaac

SEQ ID NO: 116881 - RNA, 64 nt, hsa
caucaccuuuguuucaauauuuuuuuucucucuugaacaaaacugagauaauuuagaaaacagg

SEQ ID NO: 116882 - RNA, 64 nt, hsa
aacaaugauaaauuucucagcuuguccagaccuggaacaaaauuucuggaauaagaaauuugua

SEQ ID NO: 116883 - RNA, 64 nt, hsa
ucuggaacgugaagagcuguuugguuugaaccgugaacaaaacuguguuuugaguuuagcugac

SEQ ID NO: 116884 - RNA, 64 nt, hsa
caaggggacagacaagcugggacgucagggaaaugaacaaaagggacgcagguuauuuggggug

SEQ ID NO: 116885 - RNA, 64 nt, hsa
guuacucagacacuagggaaagguaaauacaagugaacaaaauaagcaacuaaaugagaccuaa

SEQ ID NO: 116886 - RNA, 64 nt, hsa
auuagcuugcuuaaggcauacuuuuaaucaaguagaacaaaaacuauuaucaccaggauuuaua

SEQ ID NO: 116887 - RNA, 64 nt, hsa
ggauguaauccuuacauugcuuuuccaaggaagggaacaaaagucuagugauuaguaugccaac

SEQ ID NO: 116888 - RNA, 64 nt, hsa
gauuaaaaucgaacuuuauuacauacugauucuggaacaaaacaguuagaaaaacuuuaaaaaa

SEQ ID NO: 116889 - RNA, 64 nt, hsa
cugugaaauaccucuacuuucccucccauauccagaacaaaaugauacuugacauccuuccaca

SEQ ID NO: 116890 - RNA, 64 nt, hsa
auccugaggucacacaaucuguccucccagaaaugaacaaaagucaucaccuuuucugcuugcu

SEQ ID NO: 116891 - RNA, 64 nt, hsa
auguacuggcagauuaacauacaaccuauguuuugaacaaaaacaaccagcgauacguaaucaa

SEQ ID NO: 116892 - RNA, 64 nt, hsa
aaaacauacagacacucaaauuccacaagcuaaugaacaaaagggacucuugugagaagacuaa

SEQ ID NO: 116893 - RNA, 64 nt, hsa
gaaucacauucguuucccagugaaaagcaaaccagaacaaaacaaaaagccaccgcaauaauuc

SEQ ID NO: 116894 - RNA, 64 nt, hsa
uguagaucauuuaugggauuggugcugauugaaagaacaaaacaaaacaaaacaaacacaaaca

SEQ ID NO: 116895 - RNA, 64 nt, hsa
auauugagauauauuacuguuugcauaucagguugaacaaaaugcuuggaacaaaauuaagcau

SEQ ID NO: 116896 - RNA, 64 nt, hsa
uacuguuugcauaucagguugaacaaaaugcuuggaacaaaauuaagcauuauuucuagaccac

SEQ ID NO: 116897 - RNA, 64 nt, hsa
aacuuuauguaauauagcuaacuccguauuuacagaacaaaaaaacacaguucccccuccugua

SEQ ID NO: 116898 - RNA, 64 nt, hsa
agauuugauuauguauacaugacaccuaaagagggaacaaaaguuaguuuuauuuuuuuaauaa

SEQ ID NO: 116899 - RNA, 64 nt, hsa
guuuguaauauuuaagaaaugcucauucuuuguagaacaaaaauguauuaaauauuuuaaaaau

SEQ ID NO: 116900 - RNA, 64 nt, hsa
gccuuugagaacugcuugacuccaugaucuccuagaacaaaaccgcccugacuuuacaggggga

SEQ ID NO: 116901 - RNA, 64 nt, hsa
uuuuuaauuuaaccuggcaaauuaagugagacuugaacaaaauuuuguucaucuugaagaaugu

SEQ ID NO: 116902 - RNA, 64 nt, hsa
cuuuccagcacauuuuuuuuaaaaacucagguuagaacaaaaaugucauaaagggcacuaaaag

SEQ ID NO: 116903 - RNA, 64 nt, hsa
aauuaauuucagcuugauuaucaaccuguaucaagaacaaaaaugggaggagguguccacauuu

SEQ ID NO: 116904 - RNA, 64 nt, hsa
uuuaucauggcauuucuuaaaagggugagcaacagaacaaaaggcagaaaaggcauaccuaagg

SEQ ID NO: 116905 - RNA, 64 nt, hsa
ccaaaagguaccccgauggccaagcaauuccucugaacaaaauguaaagccagccaugcauugu

SEQ ID NO: 116906 - RNA, 64 nt, hsa
gcuuguuggcuccagucuuccgacaaacuaacaggaacaaaaugaauucugggaauccacagcu

SEQ ID NO: 116907 - RNA, 64 nt, hsa
aagacaagcuaaauguaguuauuuuauccuguuagaacaaaaauucuaauuaaaauaguuaacu

SEQ ID NO: 116908 - RNA, 64 nt, hsa
uacuucauuuuuucccucuaauuauuuaagauuggaacaaaaguauaaauauuauuuauuugag

SEQ ID NO: 116909 - RNA, 64 nt, hsa
uccuccaaaggaucacaacuccuugccggcaagggaacaaaacuggauagagaaugaguuugac

SEQ ID NO: 116910 - RNA, 64 nt, hsa
uuuuaagaaguggcuauauagcucuggauaaaacgaacaaaagaauuagaauuccugcggggaa

SEQ ID NO: 116911 - RNA, 64 nt, hsa
ggcuaacaccugacuuuagaaaaugcugauuugagaacaaaaggaaaggucuuuuuucacugcu

SEQ ID NO: 116912 - RNA, 64 nt, hsa
uggcgagggaguggauauagggcaugucacaaaagaacaaaauaacccgaccuuuauugcuggg

SEQ ID NO: 116913 - RNA, 64 nt, hsa
aguggaaagaaaguuugauggagcuuucagcuuugaacaaaaucccuucauuguaaacuagcac

SEQ ID NO: 116914 - RNA, 64 nt, hsa
auucaaaauuugaugugcuacaagccucaugaaagaacaaaagaaaugaagccuuuugauaugc

SEQ ID NO: 116915 - RNA, 64 nt, hsa
gcagccucuuaugcaccacaguuaaaucuagaacgaacaaaauuucagagcucaagacauggga

SEQ ID NO: 116916 - RNA, 64 nt, hsa
aagacaugggacauuuaaauccucaaggaguuuggaacaaaauaaacagaucuaaaaauuuggu

SEQ ID NO: 116917 - RNA, 64 nt, hsa; identical to SEQ ID NO: 44417

SEQ ID NO: 116918 - RNA, 64 nt, hsa; identical to SEQ ID NO: 44418

SEQ ID NO: 116919 - RNA, 64 nt, hsa; identical to SEQ ID NO: 44419

SEQ ID NO: 116920 - RNA, 64 nt, hsa; identical to SEQ ID NO: 44420

SEQ ID NO: 116921 - RNA, 62 nt, hsa; identical to SEQ ID NO: 44421

SEQ ID NO: 116922 - RNA, 64 nt, hsa; identical to SEQ ID NO: 44422

SEQ ID NO: 116923 - RNA, 64 nt, hsa; identical to SEQ ID NO: 44423

SEQ ID NO: 116924 - RNA, 64 nt, hsa; identical to SEQ ID NO: 44424

SEQ ID NO: 116925 - RNA, 64 nt, hsa
gaagagaguguuagaaaggguaggacugagaaacagccuauaaucuccaaagaaagaauaaguc

SEQ ID NO: 116926 - RNA, 64 nt, hsa
agugcugggauuacaggugugagccaccgugcccagccuauacuucccuuuuugaauaccauuu

SEQ ID NO: 116927 - RNA, 64 nt, hsa
gcucuagccccccagcuuucugguagcuucuuccagccuauacuggcaccaugugagcuggaag

SEQ ID NO: 116928 - RNA, 64 nt, hsa
aauucuccucacuauaacugggugugguaguuuaagccuauaaucucagcccuuuuggaggcca

SEQ ID NO: 116929 - RNA, 64 nt, hsa
aguugagcccuccuuugcauugacacugauaauuagccuauagggcucccuacccuuccauuaa

SEQ ID NO: 116930 - RNA, 64 nt, hsa
ucugugugucugucucucuggcguuccaccuccaagccuauaccagcuguguacagcgccaucu

SEQ ID NO: 116931 - RNA, 64 nt, hsa
auugaucuguguuaaucugaguaacuuauugccuagccuauaaauaaauuccaaaauauccaau

SEQ ID NO: 116932 - RNA, 64 nt, hsa
guacacauuagacucacccgaggaauuuuaaaacagccuauaugcccagggccuaacuuacacu

SEQ ID NO: 116933 - RNA, 64 nt, hsa
aauucuugaauacaaaacuuugccuguuguacauagccuauacaaaaugcuggguugagccuuu

SEQ ID NO: 116934 - RNA, 63 nt, hsa
agugcugggauuacaggcaugagccauugugcccagccuauauagugugaagcuuuuaggaaa

SEQ ID NO: 116935 - RNA, 64 nt, hsa
agauguauagaguuggggaaucauggagaaggaaagccuauagucgagugccugcuuaggugcu

SEQ ID NO: 116936 - RNA, 64 nt, hsa
gacuggcccucuagcuucuacccuuugucccuguagccuauacaguuuagaauauuuauuuguu

SEQ ID NO: 116937 - RNA, 64 nt, hsa
gcagaauauugcaacuuuguguuguuuuaugaugagccuauaguugugauaccaauaaaacaug

SEQ ID NO: 116938 - RNA, 64 nt, hsa
acuguugaugagcauuuuggauauucuaggagaaagccuauaauuucacauaguuucucuuuuu

SEQ ID NO: 116939 - RNA, 64 nt, hsa
cagcgcgcacuguuaacugaacgucuuuuucuucagccuauacgcggauccuuguuuugagcuc

SEQ ID NO: 116940 - RNA, 64 nt, hsa
aaaucucucccuucauuuacuuuuucuugcuauaagccuauauuuagguuucuuuucuauuuuu

SEQ ID NO: 116941 - RNA, 64 nt, hsa
gauauuaauaguugagaccaccuacccacaaugcagccuauacucccaagacuacaaaguuacc

SEQ ID NO: 116942 - RNA, 64 nt, hsa
agacucuuccacauguacaaucucaucauccugaagccuauaaugaagaaaaagaucuagaaac

SEQ ID NO: 116943 - RNA, 64 nt, hsa
uacauggcuuacuuagagcauuuaagauuaucacagccuauaugguagauuccuuuccuucuuu

SEQ ID NO: 116944 - RNA, 64 nt, hsa
agugcugggauuacaggugugagccaccaggcccagccuauaucuaggagucucuugaugagca

SEQ ID NO: 116945 - RNA, 64 nt, hsa
aaugaagcauuauuacauuuugugaaugguguucagccuauaagacgaagucucacaagaccua

SEQ ID NO: 116946 - RNA, 64 nt, hsa
aaaaugugcccuuuuggccgggcaugguagcucaagccuauaaucccagcauguugagaggcug

SEQ ID NO: 116947 - RNA, 64 nt, hsa
guggagacaguaaguuagaucccucccuuuggggagccuauauugcuggagucauacccagccu

SEQ ID NO: 116948 - RNA, 64 nt, hsa
auccuauauagaaugcugcacuaauugacaacacagccuauaggccaaugcaugaguaaaaaaa

SEQ ID NO: 116949 - RNA, 64 nt, hsa
auggacucagcacuuucuuuacuauuuguucaauagccuauauuucuagauauuaaauauuuuu

SEQ ID NO: 116950 - RNA, 64 nt, hsa
aucacuguucuuuucuuucuuuuugugauugaaaagccuauacuacaauuugaaguaaauuuuu

SEQ ID NO: 116951 - RNA, 64 nt, hsa
uuuucaagugucaggcaguguucugagaagcagcagccuauaacuguauguguguuccuugaag

SEQ ID NO: 116952 - RNA, 64 nt, hsa
gaguugcagaagcuacugugcuuccucuuuggguagccuauaccuauacuuaucuccucauaau

SEQ ID NO: 116953 - RNA, 64 nt, hsa
gauaacgguuauuaauucuuugagaccuucguauagccuauaaaauguaugggagauguuggua

SEQ ID NO: 116954 - RNA, 64 nt, hsa
cuaagaaaaauuguuucugcuuugagauguuguuagccuauaacuuuagccccaacucugugcu

SEQ ID NO: 116955 - RNA, 64 nt, hsa
uacaaggugaaaauuaagaaagauuguguaugagagccuauauaguuguuuuauccauuaucau

SEQ ID NO: 116956 - RNA, 64 nt, hsa
uugguauucuguucugaagucuaagauauuuuucagccuauaaagcccccuguuuuaugcccuu

SEQ ID NO: 116957 - RNA, 64 nt, hsa
aauucauguucaugccaaaaacaaauuguccccaagccuauauguauuaaaauguuaacuuugc

SEQ ID NO: 116958 - RNA, 64 nt, hsa
ucuccauugauauaucuggagaaaucaaugcuacagccuauagcugugaaaaaauucuaccuua

SEQ ID NO: 116959 - RNA, 64 nt, hsa
acguguagcuauaucuauauauaauucuguacauagccuauauuuacagugaaaauguaagcug

SEQ ID NO: 116960 - RNA, 64 nt, hsa
auagcucugggaauggaaugcgccccucguggagagccuauaaacggaugcauggaaggcgccu

SEQ ID NO: 116961 - RNA, 64 nt, hsa
aaugcaucuuugacaguuaucuuauuuguaaggcagccuauaaaauaguucugaaguauuuuau

SEQ ID NO: 116962 - RNA, 64 nt, hsa
cucaagaauuguuagcaaaugacagauuucuguaagccuauauauauagucaaaucgauuuagu

SEQ ID NO: 116963 - RNA, 64 nt, hsa
cauuauuuuggcagaacuccuaagaauuuaugggagccuauauaaacauaucuugcuuuuaaaa

SEQ ID NO: 116964 - RNA, 64 nt, hsa
gggcaaaaauuaccaauuaugguauacaaaaauaagccuauaaauguguuucacauugcuaacu

SEQ ID NO: 116965 - RNA, 64 nt, hsa
uggagauucuaucuugguuucucuuccuuuacuuagccuauaaaacuaguuaaaaauggaauuu

SEQ ID NO: 116966 - RNA, 64 nt, hsa
auucucaaaguucagcauucauuuugaauugagaagccuauacauuuagcugacaaagugcuua

SEQ ID NO: 116967 - RNA, 64 nt, hsa
ugcuugauaaauauuccuguaucccuuuauuuugagccuauaugugucuuugcacgugaggugg

SEQ ID NO: 116968 - RNA, 64 nt, hsa
uuuuggugguugccagcaaucccugcuguuccuuagccuauaguggcuugacuccaaucucagu

SEQ ID NO: 116969 - RNA, 64 nt, hsa
cgagagccauucagaaaagacuuccuuuguguucagccuauacuuuuccauaugguauaccuug

SEQ ID NO: 116970 - RNA, 57 nt, hsa
ccguaaccgugaaagagugacaaggacagccuauaggaaaaacaauaccacuuaaaa

SEQ ID NO: 116971 - RNA, 64 nt, hsa
agugcugggauuacaggcgugcaccacugaguccagccuauauucuuguuuaucaguucaaaaa

SEQ ID NO: 116972 - RNA, 64 nt, hsa
aggagggggugaaauaugaucuaacuuaugcaagagccuauaauuagucccagucucgacucua

SEQ ID NO: 116973 - RNA, 64 nt, hsa
aacaaagaguucaagaaauaaguuuuuguuucacagccuauaaccagacacauacucauuuuuc

SEQ ID NO: 116974 - RNA, 64 nt, hsa; identical to SEQ ID NO: 116971

SEQ ID NO: 116975 - RNA, 64 nt, hsa
ccucuuuuauaaucuuccuuaaaagaaagaguguagccuauaaauacuaaauaugauaccuuuu

SEQ ID NO: 116976 - RNA, 64 nt, hsa
uauggagcacaagaaagauaaauuucugcaggacagccuauaaaauugugguacuuuuugaugu

SEQ ID NO: 116977 - RNA, 64 nt, hsa
uuuucuuacagaaugacugaaaauuugaaagaaaagccuauaaaagugcacauacgcaacugug

SEQ ID NO: 116978 - RNA, 64 nt, hsa
uguuucgauuuuugaucaauucuuuaauuuuggaagccuauaauacaguuuucuauucuuggag

SEQ ID NO: 116979 - RNA, 64 nt, hsa
gggccugacacuucacagaguggggacccaccagagccuauagaaucaauuccuuggucucaca

SEQ ID NO: 116980 - RNA, 64 nt, hsa
ugaugaacaccuggcucauccauagaguuuucacagccuauaucgcaaauuuucuaagccacgu

SEQ ID NO: 116981 - RNA, 64 nt, hsa
ucccacuugcagucuuguagcuagaacuucucuaagccuauacguuucuguggaguaaauauug

SEQ ID NO: 116982 - RNA, 64 nt, hsa
aaugcugggauuacaggcgugagccaccacgcccagccuauaccccauguauuuucauaaaggg

SEQ ID NO: 116983 - RNA, 64 nt, hsa
cgaaaaggaggauggagccaggugccauggcuugagccuauaauccgaggcugaggugggagga

SEQ ID NO: 116984 - RNA, 64 nt, hsa
aaaaaguaguauuuucuuauuaaacaaucagcacagccuauaucuuuguucucucauguugauc

SEQ ID NO: 116985 - RNA, 64 nt, hsa
ugaacaaacgugagaaucugcugacauuaacaugagccuauagaagaagucauuuuucuuucuu

SEQ ID NO: 116986 - RNA, 64 nt, hsa
aacagaguuauaauaaaacaguguuuuaaaaucuagccuauaaacaaaaacuaguuugaggcac

SEQ ID NO: 116987 - RNA, 64 nt, hsa
aaagcagauguaugcugggcacgguggugacucaagccuauaaucccagcacuucggaaggcgg

SEQ ID NO: 116988 - RNA, 64 nt, hsa
cuuuuaaacugucaggucauuaucaggcauaggcagccuauagggcccaaagaaggcaaaaaga

SEQ ID NO: 116989 - RNA, 64 nt, hsa
agucaugagcuuuguuaauuuucaauguuuucccagccuauaaaaaaaggaagguacacguugu

SEQ ID NO: 116990 - RNA, 64 nt, hsa
aaauaaggcuccuucauguggcguauugggccauagccuauaauugguuagaaccuccuauuuu

SEQ ID NO: 116991 - RNA, 64 nt, hsa
ugaucugcacauuucaucguggcuguuucuguauagccuauacugcauuagcccaagagauugu

SEQ ID NO: 116992 - RNA, 64 nt, hsa
auauagcuugaaacauagagggagagagggagagagccuauaccccuuacuuagcaugcacaaa

SEQ ID NO: 116993 - RNA, 64 nt, hsa
ucaccugguaagaaaagaaugauaggcuugucagagccuauagccagaacucagaaaaaauuca

SEQ ID NO: 116994 - RNA, 64 nt, hsa
aucaacucuuaagagcuagacuugagagccuaacagccuauaugauuuuguguaaauugaucuc

SEQ ID NO: 116995 - RNA, 64 nt, hsa
aguucaaaugcuugacguuggcacuuaacaugaaagccuauaggucauucuugcucugggaucu

SEQ ID NO: 116996 - RNA, 64 nt, hsa
cuuucaguucguuuguauucuaccuuuguaaaacagccuauagaugaugauguguuugggauac

SEQ ID NO: 116997 - RNA, 64 nt, hsa
auggggugaaagagaggggaggcuugccuuugagagccuauauagccuuccugugagagaggau

SEQ ID NO: 116998 - RNA, 64 nt, hsa
ggugacucuuggggauauuuauuuauuuucccugagccuauaucuucaucugugaaauggggau

SEQ ID NO: 116999 - RNA, 64 nt, hsa
ggaagacucagcaggaacaagguaggcuucaaagagccuauauuccucuuuuucccacaccgau

SEQ ID NO: 117000 - RNA, 64 nt, hsa
ugucaacuauuucuuuaggccuguuuggcuccgaagccuauaugugccuggauccucugccacg

SEQ ID NO: 117001 - RNA, 64 nt, hsa
ucccuucccucuccuugagugcauuuugaauuaaagccuauauugaaaagaauggaggugagac

SEQ ID NO: 117002 - RNA, 64 nt, hsa
caaauuauuugagaaagaccauaacacagugaguagccuauaugugcauuuacugaauuguuaa

SEQ ID NO: 117003 - RNA, 64 nt, hsa
aaugugaauaucauguuuuuucaaaucuguucugagccuauaguguuugcuuugugaacaugug

SEQ ID NO: 117004 - RNA, 64 nt, hsa
guacaguauuaacgucaaccaucucuuuaaaguuagccuauaaauauuguuguauaauuuucuu

SEQ ID NO: 117005 - RNA, 64 nt, hsa
cuuugauagaaaaaaauucaaagcugugccuuugagccuauacuauacuguguauguguggaaa

SEQ ID NO: 117006 - RNA, 64 nt, hsa
aacuagagaaugcccuaacuuagaugguuuuugaagccuauacaauugguauuguuugacccuu

SEQ ID NO: 117007 - RNA, 64 nt, hsa
ugagaggcuccagaaggauuucuagaucgcuucaagccuauacugauggccuuagcuuuguuca

SEQ ID NO: 117008 - RNA, 64 nt, hsa
uuuuuggcguuugcauguacaacuuucuauuuuuagccuauauuuggaaagaaagcacuuaaca

SEQ ID NO: 117009 - RNA, 64 nt, hsa
auauuucauauuucacauuuuauauguugcacauagccuauacaguaccuacauaguuuuuaaa

SEQ ID NO: 117010 - RNA, 64 nt, hsa
aauuuuuuuuaauuggccaugucgccaaaaauacagccuauaguaaauguguuucuugcugcca

SEQ ID NO: 117011 - RNA, 64 nt, hsa
aucucagguauuucggaugucuuuuuuuuuucuaagccuauaugaaaugaaaaauauauuggca

SEQ ID NO: 117012 - RNA, 64 nt, hsa
agugcucggauuacaggugugagccacugugccuagccuauaaugaucauuuuaauguuuccca

SEQ ID NO: 117013 - RNA, 64 nt, hsa
aucaaagcacgauuuuagauaaccuaaacggcccagccuauacgaaguugauuauaucucgaug

SEQ ID NO: 117014 - RNA, 64 nt, hsa
cuucaccaauagagugcacuacuuaccugcuuauagccuauacagacgaacugaucuguccuuc

SEQ ID NO: 117015 - RNA, 64 nt, hsa
ucgugucuuacuccaggugaagggggaaaaaaaaagccuauacuuuggcagguuaugaacuuug

SEQ ID NO: 117016 - RNA, 64 nt, hsa
ggguauuauuuugaaaccagauuuuuaauuuaauagccuauauuuguagucuguuggauaggug

SEQ ID NO: 117017 - RNA, 64 nt, hsa
uguaguucaauaaaagaaaaaugaaguauucuguagccuauauuuuucauagagcucaugagca

SEQ ID NO: 117018 - RNA, 64 nt, hsa
caggaaaguucucuugugcaacagcaaguagcuaagccuauagcauggugucuuguaggaccaa

SEQ ID NO: 117019 - RNA, 64 nt, hsa
gccagccuuccuuaaacuacccuggacaccgcugagccuauagguugccaucaguuacgcugaa

SEQ ID NO: 117020 - RNA, 64 nt, hsa
uguagaggguuuagucccgagcucaggaaaugagagccuauaagugcccaguacauguuuaaaa

SEQ ID NO: 117021 - RNA, 64 nt, hsa
aacacaaaauaucuauacuucaugcuccagcccaagccuauacccuguaauagcauacuauuau

SEQ ID NO: 117022 - RNA, 64 nt, hsa
ugucagauaggucugacuaaccucuccgugcugcagccuauacuaaggugacccagggccacau

SEQ ID NO: 117023 - RNA, 64 nt, hsa
ugaagagcauuuuugugaaguggguucugcaaggagccuauaaagccaagggugguguccauuu

SEQ ID NO: 117024 - RNA, 64 nt, hsa
ucuugcuaagaggaaggaaacugucucgcauaggagccuauauaaauauaaacauauauacgug

SEQ ID NO: 117025 - RNA, 64 nt, hsa
cugugugaccuugggcaagucccuugaccuuuccagccuauauuuccucuucuguaaaaugggu

SEQ ID NO: 117026 - RNA, 64 nt, hsa
gggaaacuguauccauaaugcugaccaaauaugcagccuauaacaccuuucaccacugugaaca

SEQ ID NO: 117027 - RNA, 64 nt, hsa
ucuguauuucuaggcacaagguugguugcuaagaagccuauaagaggaauuucuuuuccuucau

SEQ ID NO: 117028 - RNA, 64 nt, hsa
ugaaugcagucaugcaaaccguuaggaaaaccagagccuauauggaguucccucuucuaaccca

SEQ ID NO: 117029 - RNA, 64 nt, hsa
guuuguuaauuuuucuaauuuuaccaaaguuugcagccuauaccucaauaaaacagggauauuu

SEQ ID NO: 117030 - RNA, 64 nt, hsa
uuaauggguuuguaauauuuguaacgguuuuagcagccuauaacuuuucagcuggugcuuuuac

SEQ ID NO: 117031 - RNA, 64 nt, hsa
uaguuguuacuuaccuaagaguuaccacuuccguagccuauaacaucaaaacguaguuuuugca

SEQ ID NO: 117032 - RNA, 64 nt, hsa
cacuguggguguuauuuuuucaugucuggaccucagccuauauccugagacuaaguggaagugg

SEQ ID NO: 117033 - RNA, 64 nt, hsa
gcaguggagcccugagcauuguaauaugcggcccagccuauaaacagccuccgugcuuagcaga

SEQ ID NO: 117034 - RNA, 64 nt, hsa
cccaagaaggacugucuaugcaugcacacccacaagccuauacaccauuuauauaccuacacgc

SEQ ID NO: 117035 - RNA, 64 nt, hsa
ggugaaaaucacauagcugucuggugccagagccagccuauaguagaguccccugaccccaagc

SEQ ID NO: 117036 - RNA, 64 nt, hsa
aggguccucuagcccacucccugccuacacacacagccuauaucaaacaugcacacgggcgagc

SEQ ID NO: 117037 - RNA, 64 nt, hsa
uguguaguacagggaagucugacacagccucuccagccuauaaacagccggggggcuguggcac

SEQ ID NO: 117038 - RNA, 64 nt, hsa
cccuucucgccgagccguggggcgcgggcggccgagccuauacauaguguacaggagacaucgc

SEQ ID NO: 117039 - RNA, 64 nt, hsa
agaguugggugagguuagucucuccugaagaaaaagccuauaaaaaguggcuaaucuuaucccu

SEQ ID NO: 117040 - RNA, 64 nt, hsa
aucaggcaccuuucccccuuauccaacuagcccuagccuauacccucugcugcccaagaaaaug

SEQ ID NO: 117041 - RNA, 64 nt, hsa
uugccauuucccaguacuucccuuuacagucugcagccuauaaacaguggugucucaaagcaaa

SEQ ID NO: 117042 - RNA, 64 nt, hsa
uucaaaaaugcuuaaccaucugaccauagugacuagccuauagugagucgaggaccaaacuuuu

SEQ ID NO: 117043 - RNA, 64 nt, hsa
uuuuguuuaugcugcuccugauauaacacuuuccagccuauagcagaagcacauuuucagacug

SEQ ID NO: 117044 - RNA, 64 nt, hsa
ccagaaauauuuuucaaaggacuaguaaucuaauagccuauaguuuauauuauuauuuuguauu

SEQ ID NO: 117045 - RNA, 64 nt, hsa
gaggaagcccugguucuauuucaccuggcaggggagccuauaaggagagcgaugcccacuccua

SEQ ID NO: 117046 - RNA, 64 nt, hsa
uugcugcauuccuaaacuguuuauuugcacuaugagccuauagacuaucaguucccuuugggcg

SEQ ID NO: 117047 - RNA, 64 nt, hsa
auugugcagugauguaaauguucauacuuuacagagccuauaauuuuuauuuuucaauuuguuu

SEQ ID NO: 117048 - RNA, 64 nt, hsa
ucgcuuuguaaaaauuugcaucuguuuagaaacuagccuauaaaauaucaccauuggauguaga

SEQ ID NO: 117049 - RNA, 64 nt, hsa
gaaaucauuuccccauugguuggaguauucccucagccuauagcaucaaagcagaccaguggcc

SEQ ID NO: 117050 - RNA, 59 nt, hsa
acuguauaguaaaaguuggucuaauaguagaacuuuaaaauuuuuucuuauugugagga

SEQ ID NO: 117051 - RNA, 59 nt, hsa
ugaauacauacaugcaugcugcuaaacuagaacuuuaauuuuuccccauaacuuuuaua

SEQ ID NO: 117052 - RNA, 59 nt, hsa
aguguuaaaacuuuucuguuuucacauuugaacuuuauggguuuuggggauuuucuugu

SEQ ID NO: 117053 - RNA, 59 nt, hsa
cugagcgagucacauuaaggaacuucacggaacuuuauagcacuccgacauuuucugag

SEQ ID NO: 117054 - RNA, 59 nt, hsa
augcacguucccuagaugcagacugcuuugaacuuuaaagcuguacaauuugguuaugu

SEQ ID NO: 117055 - RNA, 59 nt, hsa
aggcgcucuuggcccugggccuggagggagaacuuuaagcuuuuuugcucacagggacg

SEQ ID NO: 117056 - RNA, 59 nt, hsa
ggcaugcacugaccucuucuuggagcccagaacuuuauagaguugccuaccaggguuac

SEQ ID NO: 117057 - RNA, 59 nt, hsa
gugcccucaucagcugagggcagggaauggaacuuuaauggaagaaccacuuuuaucua

SEQ ID NO: 117058 - RNA, 59 nt, hsa
uuacaguugcgagccacugugcguggccagaacuuuauaauaagagacuugaagcuggg

SEQ ID NO: 117059 - RNA, 59 nt, hsa
aaaaucacauucaauuuucagaugaaggggaacuuuauaguuuuuuuuuuuuuuuuuuu

SEQ ID NO: 117060 - RNA, 59 nt, hsa
cauggaaagcccccauuugcacagauguagaacuuuaauaauccagaugcaaucauugg

SEQ ID NO: 117061 - RNA, 59 nt, hsa
uacuaaaggaagagugaguuuuuagaagagaacuuuacgagcgugacauuaugcauuac

SEQ ID NO: 117062 - RNA, 59 nt, hsa
uugauuauauuuggugaauucccaucugagaacuuuauuaugucauuuuuuuccaugac

SEQ ID NO: 117063 - RNA, 59 nt, hsa
uguacaguaaaagucagaacucauuuaaagaacuuuaagggauccuuuagaaacauuuu

SEQ ID NO: 117064 - RNA, 59 nt, hsa
uauuacaggggauaaauguuggguagcaagaacuuuaauuugcacuaccagucucccaa

SEQ ID NO: 117065 - RNA, 59 nt, hsa
aauuucaaaauaagcuuuucccacucauagaacuuuaacuugcccuuucaguuuuaucu

SEQ ID NO: 117066 - RNA, 59 nt, hsa
acagguugacaccauucagugaagguugugaacuuuauagugaauagaugagacugaca

SEQ ID NO: 117067 - RNA, 59 nt, hsa
uuaaacuuuaggaaauucauccuagaaaagaacuuuauuacaggacugaauguggaaaa

SEQ ID NO: 117068 - RNA, 59 nt, hsa
aaaaauugugcccaaaauauaaaaguguggaacuuuagaacuuggaauaauuuuauugc

SEQ ID NO: 117069 - RNA, 59 nt, hsa
cugaaauccuauauaaaagaguuuaaacugaacuuuaaggugccuccauuuaucaaggg

SEQ ID NO: 117070 - RNA, 64 nt, hsa
gagagaagauuaucaaacaaaugaaacaaguaaaggaagaaagaagguaucuggaaagaaauag

SEQ ID NO: 117071 - RNA, 64 nt, hsa
agcaaauuaaaacgauaucaugccuacaaugguuggaagaaaaaauacuuggaaacaaagaaag

SEQ ID NO: 117072 - RNA, 64 nt, hsa
aguuucuuggccacugaauuagccaaaacacuuaggaagaaaucacuuaaauaccucuggcuua

SEQ ID NO: 117073 - RNA, 64 nt, hsa
uguuggaauguaugcuaauugaacaugcaauuggggaagaaaaaauguagaaugauuuuugcua

SEQ ID NO: 117074 - RNA, 64 nt, hsa
gggccuugcucuuguggagcuuagagguugguggggaagaaaauaggcaugcaccaaggaauug

SEQ ID NO: 117075 - RNA, 64 nt, hsa
aaauagccugcucaguagagggucaugcagacaaggaagaaaacuuaggggcugcucugacggu

SEQ ID NO: 117076 - RNA, 64 nt, hsa
augggagccaagcuugaggacugcuggugaccugggaagaaaccuucuucccauccuguucagc

SEQ ID NO: 117077 - RNA, 64 nt, hsa
aaggggaagaagaucaaagaagaaaagaagaaggggaagaaaagaaggggaagaagaucaaaac

SEQ ID NO: 117078 - RNA, 64 nt, hsa
gaauuuauugcagaaauugaaaagaaggggaaggggaagaaaagaaggggaagaagaucaaaga

SEQ ID NO: 117079 - RNA, 64 nt, hsa
uguucccaaguggugaggugagauuguggcuggaggaagaaaaaggauggcaugaaagaaugac

SEQ ID NO: 117080 - RNA, 64 nt, hsa
ugauuggaggccauggccuauguacaaacauacuggaagaaaaccagcuuguuuuuaaaacuua

SEQ ID NO: 117081 - RNA, 64 nt, hsa
cugcuguguggagaagguucugagaugcagugagggaagaaaggauccugcuggggauuccauu

SEQ ID NO: 117082 - RNA, 64 nt, hsa
gugggcgugggcuucuucacauaagccuggggaaggaagaaaaaacggcuuucauuaccaaaua

SEQ ID NO: 117083 - RNA, 64 nt, hsa
ugaaagcucuccuaauacuuacuuaaauagccauggaagaaaauuaugcuugucccuucugacu

SEQ ID NO: 117084 - RNA, 64 nt, hsa
uuuuuguguguuuaaaaaaauugaagaaaauucaggaagaaacguguuaauaaacauuguacug

SEQ ID NO: 117085 - RNA, 64 nt, hsa
uuucacgcugcugauaaagacauacccgagacugggaagaaaaagugguuuaauuggacuuaaa

SEQ ID NO: 117086 - RNA, 64 nt, hsa
auuaaugcugcugauaaagacguacccgagacugggaagaaaaagagguuuacuuggacuuaca

SEQ ID NO: 117087 - RNA, 64 nt, hsa
uaaggugguauaccuuccaaauccugguucagauggaagaaauagcaggagagaggacccauua

SEQ ID NO: 117088 - RNA, 64 nt, hsa
aggagagaggacccauuagcuggcagacccagggggaagaaaggagggcugugaggagauaccu

SEQ ID NO: 117089 - RNA, 64 nt, hsa
cccauucucagugggcugcaguugcccaaccacaggaagaaagggaaggagguagagggaagaa

SEQ ID NO: 117090 - RNA, 64 nt, hsa
gcccaaccacaggaagaaagggaaggagguagagggaagaaacagaagcaguguuccauuuucu

SEQ ID NO: 117091 - RNA, 64 nt, hsa
ucuuuugguggggugggggugggcuaaagccauaggaagaaaaaugugauguauguguccagua

SEQ ID NO: 117092 - RNA, 64 nt, hsa
agacuacaaauguuuagcuguuacucauuucuagggaagaaauucuaaaucccuccuucacuuu

SEQ ID NO: 117093 - RNA, 64 nt, hsa
ugacaguugcccuuucaaagcaggaggaagaaaaggaagaaagaaaaacuguuucaucauuucu

SEQ ID NO: 117094 - RNA, 64 nt, hsa
uaucccucaugacaguugcccuuucaaagcaggaggaagaaaaggaagaaagaaaaacuguuuc

SEQ ID NO: 117095 - RNA, 64 nt, hsa
acuuccuuguuggcugauccauagagcauuacuuggaagaaaauuucacuauuugcauugaugu

SEQ ID NO: 117096 - RNA, 64 nt, hsa
aaaacuaaguauuucuucauuguaccuuaguccaggaagaaauuaauggaauauggugugcuaa

SEQ ID NO: 117097 - RNA, 64 nt, hsa
acaaauauauuagucuagggccacuuaauuuagaggaagaaaaaaaaucaacccauccauagaa

SEQ ID NO: 117098 - RNA, 64 nt, hsa
ggaacucacugauggagaugugaaauggcaguaaggaagaaaacagaauaacugaacaaauaua

SEQ ID NO: 117099 - RNA, 64 nt, hsa
agcugcccaagagaaaagaguguauguuuggaguggaagaaaaucgguuuugaaucucaugaac

SEQ ID NO: 117100 - RNA, 64 nt, hsa
caagcuuagcuuccucaacuacuguuuuucagaaggaagaaagaaucaaauggaagaagaauca

SEQ ID NO: 117101 - RNA, 64 nt, hsa
aggaaagggaaggaagaaaggaaggagggagaagggaagaaagaaacaaugucuaacccaaccc

SEQ ID NO: 117102 - RNA, 64 nt, hsa
caggaaagaagagagggagagagaggaaagggaaggaagaaaggaaggagggagaagggaagaa

SEQ ID NO: 117103 - RNA, 64 nt, hsa
cgcggaggaggcuggugacaggccaaaggccaguggaagaaacacccuuucaucucagagucca

SEQ ID NO: 117104 - RNA, 64 nt, hsa
gauuucugcuuccuuuuauuuuuauaggaauagaggaagaaaugucagaugcgugcccagcucu

SEQ ID NO: 117105 - RNA, 64 nt, hsa
guguugggaaaggauaagugcuaccguugagaagggaagaaaggcugagucuagguggagaaaa

SEQ ID NO: 117106 - RNA, 64 nt, hsa
gagacaggaaacagggaguucauuuggccacacuggaagaaaggcaagaaagaggaagacaagu

SEQ ID NO: 117107 - RNA, 64 nt, hsa
uucuuaaauaacuccauucauacaaauugggaugggaagaaaauccuuuccucuugggaaagua

SEQ ID NO: 117108 - RNA, 64 nt, hsa
uaagaccacaagucugcaggaaacucuggaaucaggaagaaaagcuauguucauacucuaaauc

SEQ ID NO: 117109 - RNA, 64 nt, hsa
ucccuuuguuuacucagauuucucuuagccauaaggaagaaaaagaacucuugcaugaaaauag

SEQ ID NO: 117110 - RNA, 64 nt, hsa
aaaaagaacucuugcaugaaaauagcaugaugcaggaagaaauugccaugcuaagaauagaacu

SEQ ID NO: 117111 - RNA, 64 nt, hsa
ucaucuugagaagcaggcggguugggugggaggaggaagaaagggaagaauuagguuugaauug

SEQ ID NO: 117112 - RNA, 64 nt, hsa
ugccacugagaagcaggcggguugggugggaggaggaagaaagggaagaauuagguuugaauug

SEQ ID NO: 117113 - RNA, 64 nt, hsa
ccaucauuuuaucgagagaaccuucugcuucugaggaagaaaaggaguuaggagaaagaagagc

SEQ ID NO: 117114 - RNA, 64 nt, hsa
cuaauugucacaccuggaagcuuggugaauaauuggaagaaagaauuucaaaaauggcuaggaa

SEQ ID NO: 117115 - RNA, 64 nt, hsa
ggacugaaaagaaauucuccauuaugaggaauugggaagaaaucugguauccaagcuuaaauuu

SEQ ID NO: 117116 - RNA, 64 nt, hsa
auguuucaugaauccauuuggcacagagacacaaggaagaaaacacuaguaaccaucuuuccac

SEQ ID NO: 117117 - RNA, 64 nt, hsa
aaucucuacuuuccuauacugccaaagaaugugaggaagaaaugggacucuuugguuauuuauu

SEQ ID NO: 117118 - RNA, 64 nt, hsa
auaggcaagaaggacagcaguaaaugaagaccauggaagaaaagaaggaaugccaaagaucgag

SEQ ID NO: 117119 - RNA, 64 nt, hsa
uccaaagacccagagucucagagccagguuaaguggaagaaacuuugagagguuucuuaaucaa

SEQ ID NO: 117120 - RNA, 64 nt, hsa
auuucauggugauggugcaagggagagaugauuaggaagaaaaugucuuacacggcuguaauug

SEQ ID NO: 117121 - RNA, 64 nt, hsa
caggaugugucacuaaugcuccaccucacccuuuggaagaaaggaaagcuguuuccuccuggug

SEQ ID NO: 117122 - RNA, 64 nt, hsa
guacgcagcugccgaacucugacucuaguucugcggaagaaaaggaugcgguauuugcuuuugc

SEQ ID NO: 117123 - RNA, 64 nt, hsa
agggcacuugcauccauugccuuuuccaggaaagggaagaaaacacucaguugauaaaccuuag

SEQ ID NO: 117124 - RNA, 64 nt, hsa
cuauacagucuauaaaaauuguuauuaugggauuggaagaaacacguggucaugaauagaaaaa

SEQ ID NO: 117125 - RNA, 64 nt, hsa
acauuuuagaaacggacagcuuauaaaaauaaagggaagaaaggaggcagcauggagagaggcc

SEQ ID NO: 117126 - RNA, 64 nt, hsa
uugguggcaguuguuuguuuuaaacugaccacuuggaagaaacaccuugguuaucugugguuuu

SEQ ID NO: 117127 - RNA, 64 nt, hsa
cgaugaugauauucagacgaagcauugauguuauggaagaaagaaagaaacaaacaaaauauau

SEQ ID NO: 117128 - RNA, 64 nt, hsa
aagaaguuuuuccuugauugugcuauguuucaguggaagaaauucuuugaaguagaugugagug

SEQ ID NO: 117129 - RNA, 64 nt, hsa
agacaaaucaacuuugaagacacaaaaguuaauuggaagaaauaaaaacugugaacgaagaaua

SEQ ID NO: 117130 - RNA, 64 nt, hsa
uuucacgcugcugauaaagacauaccugagaccaggaagaaaaagagguuuaauuggacuuaca

SEQ ID NO: 117131 - RNA, 64 nt, hsa
auacaauugacauaggaauuacauuaaaauauuaggaagaaacaaggacaaauuuagaccuuga

SEQ ID NO: 117132 - RNA, 64 nt, hsa
guuuaucucaaguaauuuggugucauuuacaaaaggaagaaauuccugccaucagaagggacag

SEQ ID NO: 117133 - RNA, 64 nt, hsa
cauaaguuuuuacugccaguauugagaaauucguggaagaaaugucagcaggaaguaaaaauuc

SEQ ID NO: 117134 - RNA, 64 nt, hsa
caccuguuacccauuaggggugauaacauuaaugggaagaaaugauggcaacuuugaaugcuag

SEQ ID NO: 117135 - RNA, 64 nt, hsa
ccaucucugggauuugaaauauccagacuuguagggaagaaaacaaugacuugacgaccuuaaa

SEQ ID NO: 117136 - RNA, 64 nt, hsa
guucagaggaggcauaagcuauggagguuggaaaggaagaaagagaagagcugaaguaaaugua

SEQ ID NO: 117137 - RNA, 64 nt, hsa
cccuguccuuccccaacuccccagcuccaagaguggaagaaauccccaagaucaucugggucuc

SEQ ID NO: 117138 - RNA, 64 nt, hsa
gucugcucucuucucuccccucugucccucuucaggaagaaagagcucauucugucucacaagc

SEQ ID NO: 117139 - RNA, 64 nt, hsa
ccccagcagugccugguucugagcaaacucccagggaagaaaacggcccugucuccauggccag

SEQ ID NO: 117140 - RNA, 64 nt, hsa
uuccaagcaccggggcgaaaaaccacaaaggaaaggaagaaaauuuauauauauauaauauaaa

SEQ ID NO: 117141 - RNA, 64 nt, hsa
ccucugcuuugucaugccauuaagcucacaauaaggaagaaauaacagauaaguccauuggugg

SEQ ID NO: 117142 - RNA, 64 nt, hsa
gcugauagcucauauuauaaauuucuaaauccuaggaagaaacgcuuggagugcuucugaauau

SEQ ID NO: 117143 - RNA, 64 nt, hsa
uaaauuuggaugucaacugagaaaggagugagaaggaagaaacaaugcgcaaaggaaagcaguc

SEQ ID NO: 117144 - RNA, 64 nt, hsa
aucaggucuuuacugaauguuagaagaggccuuuggaagaaaauuauguaaaguuuaaucuaua

SEQ ID NO: 117145 - RNA, 64 nt, hsa
uauuaaaaauugagucuuaaauuuaaaugggaagggaagaaaacaccaaauaagaaaaaaauuu

SEQ ID NO: 117146 - RNA, 64 nt, hsa
caacgacgaagugcugagaagguuauggguaccaggaagaaacaaacagaagucuuaagauuag

SEQ ID NO: 117147 - RNA, 64 nt, hsa
gcuuugggaauaguucauagggaagggacaacauggaagaaacagcgauuuaaauuguauugaa

SEQ ID NO: 117148 - RNA, 64 nt, hsa
caguuccuaaaacuaaaacuccauucuagucuugggaagaaaaguuucuacucagaacugggga

SEQ ID NO: 117149 - RNA, 64 nt, hsa
ucaaaaugguugacauaauuaaugagaagaauuuggaagaaauugguauuuuaauacugucugu

SEQ ID NO: 117150 - RNA, 64 nt, hsa
ugacauagcaagacccugucuuaaaagaaaaaugggaagaaagacaagguaacaugaagaaaga

SEQ ID NO: 117151 - RNA, 64 nt, hsa
uaggugggaggacuaacuuccagggugccaagaaggaagaaaagccccagguucucuuuucuua

SEQ ID NO: 117152 - RNA, 64 nt, hsa
agcccccacccuccugccaagcugccucugggaaggaagaaacaggagcuaggcagaagccuug

SEQ ID NO: 117153 - RNA, 64 nt, hsa
gagcuuuauucaaauuuugacaaucagagcacugggaagaaauaaauuccacaacugccuuuag

SEQ ID NO: 117154 - RNA, 64 nt, hsa
uuggucucgcugucgguuaacuguaaaguuagggggaagaaagaaaaaaaauuaaaaggguaga

SEQ ID NO: 117155 - RNA, 64 nt, hsa
cuguauaugcaguauugagcacuguaggcaagagggaagaaagagaaggagccaucuccaucuu

SEQ ID NO: 117156 - RNA, 64 nt, hsa
cacccacucuccucugccucaguaaguaucuggaggaagaaaacaggugaaagaagaaguaaaa

SEQ ID NO: 117157 - RNA, 64 nt, hsa
aggaagauguucaauagaacaugcaagaauuucuggaagaaaggcuguggaagggccaauggag

SEQ ID NO: 117158 - RNA, 64 nt, hsa
aaaagcccuaugugaaaagaucccaagauggagaggaagaaacgcuaauucagcauguguucau

SEQ ID NO: 117159 - RNA, 64 nt, hsa
gugguggucccucuucccacgugcagcccuguugggaagaaaggaagaaaacaggucccuccag

SEQ ID NO: 117160 - RNA, 64 nt, hsa
cccucuucccacgugcagcccuguugggaagaaaggaagaaaacaggucccuccaggggugcug

SEQ ID NO: 117161 - RNA, 64 nt, hsa
ugccuuauugaaaaacuaaagcaaauucuuuauaggaagaaaauaugggaauuugauuacacau

SEQ ID NO: 117162 - RNA, 64 nt, hsa
aacaggacuucuguuuacaauggaaaucugaaauggaagaaacaucuuuaaccuugugugucug

SEQ ID NO: 117163 - RNA, 64 nt, hsa
ucacaccauaacuagguaacaguuugauaacuagggaagaaagcagaacaguuaagcagccgcc

SEQ ID NO: 117164 - RNA, 64 nt, hsa
caaaaucuguagagcagggcaaguaacauggaagggaagaaaaggugaaaaauuagaaauguuc

SEQ ID NO: 117165 - RNA, 64 nt, hsa
aggccccaccaagaggguggaucacaccucagugggaagaaaaauaaaauuuccuucagguuuu

SEQ ID NO: 117166 - RNA, 64 nt, hsa
agcaugcuuugauaucugguucagacuaucaucaggaagaaaaaaaaaucccacaguaccugaa

SEQ ID NO: 117167 - RNA, 64 nt, hsa
gaaauagcuuaagaagaagugaaacauggaucuuggaagaaauuuugaaaucuucaauuugauc

SEQ ID NO: 117168 - RNA, 64 nt, hsa
guuuaaaucugagcaugcaucuuuaaacagcucaggaagaaauagcuuaagaagaagugaaaca

SEQ ID NO: 117169 - RNA, 64 nt, hsa
ugguuucagaugaugaagaaagaggaacgggcuuggaagaaaauaaucaagaagagcaaagcau

SEQ ID NO: 117170 - RNA, 64 nt, hsa
aaaguccaaaagucacuuuugaaugugaacaaaaggaagaaaaucaaggaaagaaugagucuaa

SEQ ID NO: 117171 - RNA, 64 nt, hsa
aaguuaaccacagucgggaaacaagcauagaaauggaagaaagugaacuugaugcucaguauuu

SEQ ID NO: 117172 - RNA, 64 nt, hsa
cuucuccaccaagcauuugguuuauuuagaaaaaggaagaaaaacaaaaaacaaaaaacuaaag

SEQ ID NO: 117173 - RNA, 64 nt, hsa
aaggacuggaggccgccaggcaggcguggccgagggaagaaaaagcuucuggauguccagccag

SEQ ID NO: 117174 - RNA, 64 nt, hsa
ggucccuaucuuccagcagguuagaggccuuuagggaagaaaagccugugugcagggaaagaga

SEQ ID NO: 117175 - RNA, 64 nt, hsa
uuacgaggauuucuggaagcuucuguaacuguagggaagaaagcuguaggggagcaugguuuuu

SEQ ID NO: 117176 - RNA, 64 nt, hsa
guuucucacugcuaacguugguguuucuggcgugggaagaaaugcacaggcgugcauggcaugc

SEQ ID NO: 117177 - RNA, 64 nt, hsa
gcauuguaagaguucugucaugcagucugaaaagggaagaaacaggauggcuuucuguagccac

SEQ ID NO: 117178 - RNA, 64 nt, hsa
caaaucauugaacugagggggaaaaauguaacuaggaagaaaaacccaauuuaagaaauuacau

SEQ ID NO: 117179 - RNA, 64 nt, hsa
agucauuucugcugaaaaaacagaugauccugguggaagaaaagguugaaggcagcugcccucg

SEQ ID NO: 117180 - RNA, 64 nt, hsa
aaaaguuuccauggaagcuguucagaaaaaucaaggaagaaaaaagcaaguuguucaauuuuaa

SEQ ID NO: 117181 - RNA, 64 nt, hsa
cuaaugggaaaguucauguugcugaaagcuguuuggaagaaacagguggccugggaguagauau

SEQ ID NO: 117182 - RNA, 64 nt, hsa
aaaaaaucaucucacaugcauuuuauaguuuuggggaagaaaauaucauggggaggucuaccuu

SEQ ID NO: 117183 - RNA, 64 nt, hsa
cuucaagaauuucugaggacaggagcucacaucuggaagaaacaggaagauuggaaucugccug

SEQ ID NO: 117184 - RNA, 64 nt, hsa
auaaauaaauaauuuaaauuuuauugguguuauuggaagaaaaaugcuauuaaugggcuaauaa

SEQ ID NO: 117185 - RNA, 64 nt, hsa
guguccauaugucuuuaccuaccuaaguaaaacaggaagaaaaucaguaacauuauccuuaggu

SEQ ID NO: 117186 - RNA, 64 nt, hsa
uuuuuuuuaacuuucuucuuccuguuaaaacauaggucacuaacugugauguuauuuguuuucu

SEQ ID NO: 117187 - RNA, 64 nt, hsa
gagccaggccagugcuuccccagccccugggccuggucacuacacaguggaaaacagacaagcg

SEQ ID NO: 117188 - RNA, 64 nt, hsa
gggcugucagggaucuuuucuauaccagaacugcggucacuauuuuguaauaaauguggcugga

SEQ ID NO: 117189 - RNA, 64 nt, hsa
aguaauagauacucagcacuagacuaacauaacaggucacuacacgggugcagaaucacuuuac

SEQ ID NO: 117190 - RNA, 64 nt, hsa
cuacauagaaguuugcuuuuucccugccugucuuggucacuaccaccucuucccugagaagggc

SEQ ID NO: 117191 - RNA, 64 nt, hsa
cuuguucucuugucuguggucuguuuaauaugugggucacuaggguauuuauucuuucucccau

SEQ ID NO: 117192 - RNA, 64 nt, hsa
aagugacaccuggggucaguuuaccucuguguauggucacuagagauugggacuuacccuuuag

SEQ ID NO: 117193 - RNA, 64 nt, hsa
gacacccuuguccccacaagcagaagcacagaggggucacuagcaccuuguguguaugugugug

SEQ ID NO: 117194 - RNA, 64 nt, hsa
agaaaaaaaaucgacacuguggauugacuuucccggucacuauauaaagcaaauaaacuuaaaa

SEQ ID NO: 117195 - RNA, 64 nt, hsa
gccaaauacugaaauggaagcccgucuuaccuggggucacuaacugguugguuaacugagcuaa

SEQ ID NO: 117196 - RNA, 64 nt, hsa
acuccagccugggcucaauccuggaguucugucuggucacuaucagaaggaacacuuugaggga

SEQ ID NO: 117197 - RNA, 64 nt, hsa
caacagucaguauuaucucuuaaauguauauguuggucacuaauugcacaaaaucuauaauuug

SEQ ID NO: 117198 - RNA, 64 nt, hsa
aguugcagcgugaaaauaaauacuuuaacucaggggucacuacaggaagaccccguugagccgg

SEQ ID NO: 117199 - RNA, 64 nt, hsa
ugggaaaauguaaacuuuaaacauaaugccacaaggucacuaauuucuagcagguaaaauuaua

SEQ ID NO: 117200 - RNA, 64 nt, hsa
gagagccgacuccacuuucauaguuauuguuucuggucacuauauaggcaucacauuuuugugu

SEQ ID NO: 117201 - RNA, 64 nt, hsa
gcagagccuggggaagucaugggauuaacuugagggucacuauugagccuauuaauuaauuauu

SEQ ID NO: 117202 - RNA, 64 nt, hsa
gcagcccagggcucacacugcgugggagggacugggucacuauugugguuuuuacuauaacuuu

SEQ ID NO: 117203 - RNA, 64 nt, hsa
ccauucuccaaguggaauucccacuuagggcucuggucacuagauugcaaccuguguguuuguc

SEQ ID NO: 117204 - RNA, 64 nt, hsa
uguagcucaguuucauuauugucauuguagaagcggucacuauuagcaggcauacuuuuccaca

SEQ ID NO: 117205 - RNA, 64 nt, hsa
gcuggugaccuuauuuucuagauguuacaaaucaggucacuaugcaaacuagaauauccucagc

SEQ ID NO: 117206 - RNA, 64 nt, hsa
gaauuuuuuguucccauggaagaaguaaagaagaggucacuagauguugcagugaaaaauagua

SEQ ID NO: 117207 - RNA, 64 nt, hsa
uucuuuuuuugugacuagaaauucuuaagccgauggucacuauagcucauccuuaauguauggc

SEQ ID NO: 117208 - RNA, 64 nt, hsa
ccuuucaaagucaaucuuuggaaaauauugaggaggucacuaauuaguuggugcaguuaauaua

SEQ ID NO: 117209 - RNA, 64 nt, hsa
gucuaaccuuaaaaauugaguugauguccuuauaggucacuaccccuaaauaaaccugaagcag

SEQ ID NO: 117210 - RNA, 64 nt, hsa
ugaacaccuuucauauuggagaaucaugcauuugggucacuaauuaucucaaaauauuucauac

SEQ ID NO: 117211 - RNA, 64 nt, hsa
ccucuuacuuuauccuuuuuccuuaaguauugguggucacuacuauugaguuucuuccuuaaca

SEQ ID NO: 117212 - RNA, 64 nt, hsa
cucccgagggaaguucaaaaggaccggcucauuuggucacuagucuauagaagaugacacagaa

SEQ ID NO: 117213 - RNA, 64 nt, hsa
ugcuauuuuuucacuauaggaugacuauaauucuggucacuaaauauacacuuuagauagauga

SEQ ID NO: 117214 - RNA, 64 nt, hsa
gacaauuauguuuuauagaccuacacuagugccaggucacuauuguaagauguuaaaaucucaa

SEQ ID NO: 117215 - RNA, 64 nt, hsa
cauguguaucgaccaugugccauauaucaauuauggucacuagaaagucucuuuaugauacuuu

SEQ ID NO: 117216 - RNA, 64 nt, hsa
ugccaggaugguuagauacacagcauguugauuuggucacuaaaaagaagaaaaggacuaacaa

SEQ ID NO: 117217 - RNA, 64 nt, hsa
aacuuuacuucugaaaggaacauaauuauaucuaggucacuagaacgucauuguguuuuuuguu

SEQ ID NO: 117218 - RNA, 64 nt, hsa
ucuuacagaaguucugauauugaauuaaggaaugggucacuacuuaagacuuuaucauuucagc

SEQ ID NO: 117219 - RNA, 64 nt, hsa
gggaggcauaaagacuaauuagcaaccauaauauggucacuacccuaauagacuaaaugaaauc

SEQ ID NO: 117220 - RNA, 64 nt, hsa
cauaucuuucuugacuauacugauuucuuauuuuggucacuauuacuaaaucucuguuaauauu

SEQ ID NO: 117221 - RNA, 64 nt, hsa
agcaugagaagcuggcugcuaagaugucacugggggucacuaaagcugaagccugaaggaaagc

SEQ ID NO: 117222 - RNA, 64 nt, hsa
auagucauccuucaauucaguagcaauauuuucuggucacuacuaaccuguauuguauuaaaau

SEQ ID NO: 117223 - RNA, 64 nt, hsa
aaucaacccauccauagaaauaguuugauaaacaggucacuaaaucauuggcguuuauaaagau

SEQ ID NO: 117224 - RNA, 64 nt, hsa
cugagggaauauuucccuaucccuucaaauggacggucacuacagaaacguguagagcaagacu

SEQ ID NO: 117225 - RNA, 64 nt, hsa
uuuauaaugugcaucaacaugugaaagcaaucuaggucacuagcacagaggaaguugccaggaa

SEQ ID NO: 117226 - RNA, 64 nt, hsa
cauuagaacucuucaaaaugggcucuucuaaugaggucacuacugaacaaaauuguucccucuu

SEQ ID NO: 117227 - RNA, 64 nt, hsa
augugaguaaacacaccugcgcagcccuggcugaggucacuaggcuggccagaggcaggacagg

SEQ ID NO: 117228 - RNA, 64 nt, hsa
gaggauuuugaaaacuguauaaccauaggauuuaggucacuaggacuuuggaucaaaauggugc

SEQ ID NO: 117229 - RNA, 64 nt, hsa
guuugcuaauuagaaauaucuuggaaagccucauggucacuaauuuucaacuagcaucagguau

SEQ ID NO: 117230 - RNA, 64 nt, hsa
gggucucggcacucugcuguguucuuugcaccgcggucacuauuucagaaacacgguccugaua

SEQ ID NO: 117231 - RNA, 64 nt, hsa
ccucuguccucucgcaggggcuggcucuuccaguggucacuacuuuuugguugcaagcagcaga

SEQ ID NO: 117232 - RNA, 64 nt, hsa
agcacuuugggaggccaagguggggggaucacaaggucacuagauggcgagcauccuggccaac

SEQ ID NO: 117233 - RNA, 64 nt, hsa
ggcaagaguaaaacuguagcauagcuuuugucacggucacuagcugaucccucaggucugcugc

SEQ ID NO: 117234 - RNA, 64 nt, hsa
caaaggaggaaagaauggaugacacuuagggacaggucacuaagcagaauagguauuaguuggu

SEQ ID NO: 117235 - RNA, 64 nt, hsa
augucacuaacaaguggcaaauggugaaaaaaguggucacuaugcuuuugucucucauaggcac

SEQ ID NO: 117236 - RNA, 64 nt, hsa
aaaaaauuuaaaaaauuaaaaaauaaaaaaaagaggucacuaaaagaccaagaugggaaacgua

SEQ ID NO: 117237 - RNA, 64 nt, hsa
ccaaauccuauuuaaagaccugacagcuugagaaggucacuacugcauuuauaggaccuucugg

SEQ ID NO: 117238 - RNA, 64 nt, hsa
auucagcuaauuuguuuuuaaaauugacuguaguggucacuaaacccuuuuugagagaauuucu

SEQ ID NO: 117239 - RNA, 64 nt, hsa
uugcacccagccguuggcagcaucuacucagcaaggucacuaagcucugccagcguggcagagc

SEQ ID NO: 117240 - RNA, 64 nt, hsa
aaguguuucauuaugaccagaucucugauuguauggucacuagguaugcaaucacgcauucaaa

SEQ ID NO: 117241 - RNA, 64 nt, hsa
uuugauggacagggcugccuuuaaugagugugaaggucacuaagucacuuagacaucucaccgu

SEQ ID NO: 117242 - RNA, 64 nt, hsa
aguccccugcccacucccuacgugacuuugaucaggucacuagugucucucugagccucaguuu

SEQ ID NO: 117243 - RNA, 64 nt, hsa
ucaagcuugcucuuucucuuccuuugguuauuaaggucacuaaauaaaggaagugccuuggaaa

SEQ ID NO: 117244 - RNA, 64 nt, hsa
aucaaaaguuacuggaacuggaaaagcacauuagggucacuauucaaaaaacagauaaucaggc

SEQ ID NO: 117245 - RNA, 64 nt, hsa
uuagaagacgaccauucugaucugugugugaucuggucacuaugugacugccuuuacgguuucu

SEQ ID NO: 117246 - RNA, 64 nt, hsa
caagacagcucacccgguccagaagcuccaugcuggucacuagggugcugugcucucuggcgcc

SEQ ID NO: 117247 - RNA, 64 nt, hsa
agaucagaauagacuucagaaagcuucgguggaaggucacuauuucugacugcauguuuacuua

SEQ ID NO: 117248 - RNA, 64 nt, hsa
cuuugucaucucuuucgcugccacuucuggcuguggucacuagcuuggccauagcaccucucuu

SEQ ID NO: 117249 - RNA, 64 nt, hsa
augggucuggccugugagucuccccuugcagccuggucacuaggcaucacccccgcuuugguuc

SEQ ID NO: 117250 - RNA, 64 nt, hsa
gaagaugcaggccgaucgccagcuccguggcagcggucacuaaggacagccugacugugccauc

SEQ ID NO: 117251 - RNA, 64 nt, hsa
gcaugugagaugagacuuggcaugugagacauagggucacuagagacccuucugggucagagga

SEQ ID NO: 117252 - RNA, 64 nt, hsa
aggugggucugggugagaguuauagugagggaauggucacuaaaguauccugacaaguuccuag

SEQ ID NO: 117253 - RNA, 64 nt, hsa
aauuaaaauaaaagguaacgguacacuuaagaguggucacuacagccaagcuaauugacaccca

SEQ ID NO: 117254 - RNA, 64 nt, hsa
guggucacuuucgcagggggugggaaugggguggggucacuaaggagagagggucaggagccag

SEQ ID NO: 117255 - RNA, 64 nt, hsa
gcaaacagcugcagcucugugauuaaaauguuaaggucacuagaauaguguuaggaaaauguua

SEQ ID NO: 117256 - RNA, 64 nt, hsa
agaaaaauccuggcagcuuuucuccaggcaucugggucacuaaaaacugauuuucuaaaauuau

SEQ ID NO: 117257 - RNA, 64 nt, hsa
auuucugcugcaaaagacauauacacuguacuggggucacuauuuaugaaagcaauugguuagg

SEQ ID NO: 117258 - RNA, 64 nt, hsa
gcauaguuucuuucucuuccuucauagaugacacggucacuagcucugccucagaaagcucugc

SEQ ID NO: 117259 - RNA, 64 nt, hsa
aauuacaccuuuaaagacugauaugaaucaguacggucacuauacauuuuaugauuuuucuguc

SEQ ID NO: 117260 - RNA, 64 nt, hsa
cuucaguuuguguuguguauauuuugauguauguggucacuaacaggucacuuuuauuuuuucu

SEQ ID NO: 117261 - RNA, 64 nt, hsa
uagacguaaagccuucaguuuucaaaaucuuucuggucacuauaaagaucuuggaacagcaaau

SEQ ID NO: 117262 - RNA, 64 nt, hsa
cauuaagaugaauguaauuauuauuccucuugcuggucacuaccgucgcuuucuauuucucuuu

SEQ ID NO: 117263 - RNA, 64 nt, hsa
uuucucuauaacugggauagauguccugccuuggggucacuaaaggggugaccuuguuccuugc

SEQ ID NO: 117264 - RNA, 64 nt, hsa
uugcaaacuguccucuacaucaauuaacaucgugggucacuacagggagaaaauccaggucaug

SEQ ID NO: 117265 - RNA, 64 nt, hsa
caguguagcuuaggggagcaacccauggcucacaggucacuaagcgucuccaauaugacuauua

SEQ ID NO: 117266 - RNA, 64 nt, hsa
cauucuugguaaaccagguaauugaaugaagaaaggucacuaaagggagaaaugacauguuuuc

SEQ ID NO: 117267 - RNA, 64 nt, hsa
gguuguugagcugggaaaccguggcccaggcaguggucacuacagccugauugguccuccaggu

SEQ ID NO: 117268 - RNA, 64 nt, hsa
ccgcaggucucaucccacacucuugagaagccuuggucacuacaguggucgcacauguuccucu

SEQ ID NO: 117269 - RNA, 64 nt, hsa
caaaaggcaguuacauaucaauacagagacucaaggucacuagaaaugggccagcugggucaau

SEQ ID NO: 117270 - RNA, 64 nt, hsa
cucuaugcugucaucagaccuuuggcaaugggguggucacuaccucacaaggcaaaguguugua

SEQ ID NO: 117271 - RNA, 64 nt, hsa
cacguugccaucagcuaccaggagcgaugcugguggucacuagcuucugauccucauccugggu

SEQ ID NO: 117272 - RNA, 64 nt, hsa
gaucggugugaccugaaaggguuugugauacagcggucacuauuuucucuuaacacauaggaaa

SEQ ID NO: 117273 - RNA, 64 nt, hsa
ucaacuuaaagugaauugucuuuguuauaaaugaggucacuauggacuuacccuaaagaucuuc

SEQ ID NO: 117274 - RNA, 64 nt, hsa
aacaaauggaaauaacucccaggcaguaucagguggucacuacagagacuuccacaaaaacuuu

SEQ ID NO: 117275 - RNA, 64 nt, hsa
uugucauuuaauuauauuucagguguccugaacaggucacuagacucuacauugggcagccuuu

SEQ ID NO: 117276 - RNA, 64 nt, hsa
caacagauuugcagcucauuccuuacccugguuaggucacuacuuuugcagauuuugcuggcac

SEQ ID NO: 117277 - RNA, 64 nt, hsa
agggcagcccagagguggcagcggcaggcaaucuggucacuaggucuuugugaugccaaaaaua

SEQ ID NO: 117278 - RNA, 64 nt, hsa
gcaguaccugcgaguagagacacaauuccagaauggucacuaugacaaauguguauucgcccuc

SEQ ID NO: 117279 - RNA, 64 nt, hsa
acucuucccaccucagugcccacagccaagguagggucacuaaccaagccagaaacguaacugu

SEQ ID NO: 117280 - RNA, 64 nt, hsa
uuuuauguuuuccaaguuauaacuuggaguuaauggucacuagauuaucaguuaugagcagugu

SEQ ID NO: 117281 - RNA, 64 nt, hsa
acacugaaauguuauacucaguguugauuucuucggucacuacacaacguaaaaucauuuguuu

SEQ ID NO: 117282 - RNA, 64 nt, hsa
ccguucucacugcggcugcaccggcccccgcugcggucacuauuucuuccucugcuaggugaau

SEQ ID NO: 117283 - RNA, 64 nt, hsa
aauuucaugccaaaaaugaauuucaugaaugugaggucacuaguaauacagcuguugaagaauu

SEQ ID NO: 117284 - RNA, 64 nt, hsa
uggaggcugcuuauuccagacuggguugauagaaggucacuacuucaucuguguuggauuucuu

SEQ ID NO: 117285 - RNA, 64 nt, hsa
uuugcaccaaacugucaccaucuuugcagcagaaggucacuacucacauuauaguaagagggga

SEQ ID NO: 117286 - RNA, 64 nt, hsa
acccuccaugcugcgacaaggacagggaauggucggucacuaugggccuggugucuccccuccc

SEQ ID NO: 117287 - RNA, 64 nt, hsa
aaguuugcuaccaagaugauugccuuauugaauaggucacuauuaaauuccuuuaaauguugau

SEQ ID NO: 117288 - RNA, 64 nt, hsa
uccuugcccuuugagaguguccauugcuggccauggucacuaaauuugaaguuccaguccuccc

SEQ ID NO: 117289 - RNA, 64 nt, hsa
ccuagacuucccaacagccuuagcugccagugcuggucacuaaccaacaagguuggcaccccag

SEQ ID NO: 117290 - RNA, 64 nt, hsa
aacccagcugaggccugggccuagacuguggugaggucacuagauucuacugcucuucccccac

SEQ ID NO: 117291 - RNA, 64 nt, hsa
ucccagauaagaucacuccuucuggggacaagauggucacuaguagauccagguuuacuuucua

SEQ ID NO: 117292 - RNA, 64 nt, hsa
gaacuuggcauuuuccugaugaucuuuaaaauguggucacuaaacucaggauuggcgugugcuu

SEQ ID NO: 117293 - RNA, 64 nt, hsa
cgaggucucuugaagacuugagaagcugucacaaggucacuacaagcccaaccugccccuucac

SEQ ID NO: 117294 - RNA, 64 nt, hsa
caaaggacugaucacuguccuugccucuaggaggggucacuaagcccuuaccuagggcugggug

SEQ ID NO: 117295 - RNA, 64 nt, hsa
ucuccuucauuacuuaaagauauucaugagggugggucacuacagauguuggggagcaagggcu

SEQ ID NO: 117296 - RNA, 64 nt, hsa
auuuuuuaauuuuacaccugaaacaaagaaauguggucacuaaaaauaaaaguauauauguagg

SEQ ID NO: 117297 - RNA, 64 nt, hsa
accauguuaugucgacuauuagugauaacaaaugggucacuaucuggugaaaaaauaugguauu

SEQ ID NO: 117298 - RNA, 64 nt, hsa
caggggcaguuaaggagucauggauggaacuagaggucacuauauuaagugacauaagccagaa

SEQ ID NO: 117299 - RNA, 64 nt, hsa
ucagccaguuaucaguagauacaauaucuuuaaaugaacacacgaguguaugucucacaauaua

SEQ ID NO: 117300 - RNA, 64 nt, hsa
ugaaagauccauuuuaggucuuuuucaagaauagugaacacauuuuuuaacaaaauaaguugua

SEQ ID NO: 117301 - RNA, 64 nt, hsa
cuugcucugucaccuaggcuagaguggaguggcaugaacacaacgcacugcagccucuaccucc

SEQ ID NO: 117302 - RNA, 64 nt, hsa
uuauaaagagcaagcauagauggaaagugcauauugaacacaucugugcauuugagaaggcagg

SEQ ID NO: 117303 - RNA, 64 nt, hsa
auuggugucagaugcuggaauuuauucugaccaaugaacacagcugacucaggggaguacaauc

SEQ ID NO: 117304 - RNA, 64 nt, hsa
uuaaaauuuugcagaggucuucaguaucuauauuugaacacacuguacaauaguacaaaaacca

SEQ ID NO: 117305 - RNA, 64 nt, hsa
uagauucuaacauauugccauguguggagugugcugaacacacaccaguuuacaggaaagaugc

SEQ ID NO: 117306 - RNA, 64 nt, hsa
cggcaccauuggucucuggguagugcuuuaagaaugaacacaaucacguuauaguccauggucc

SEQ ID NO: 117307 - RNA, 64 nt, hsa
cuucugagcaguuaaccucuaggauaauguggcuugaacacauuacagaacuauguuuugacuu

SEQ ID NO: 117308 - RNA, 64 nt, hsa
uuauacauguguugcuuagugaaugauuaccaagugaacacacuugguauauugcuuuaccaaa

SEQ ID NO: 117309 - RNA, 64 nt, hsa
aguagaaaggucauccaaagaacaucugcacuccugaacacacccugaagaaauccugggaauu

SEQ ID NO: 117310 - RNA, 64 nt, hsa
aagugugagaagacuggcuaguguggaagcauagugaacacacugauuagguuaugguuuaaug

SEQ ID NO: 117311 - RNA, 64 nt, hsa
uuacuuauucauucuguacuuaaauuuuuucuaaugaacacauauacuuuuguaaucagaaaau

SEQ ID NO: 117312 - RNA, 64 nt, hsa
uuuguaauacgugugcauaaaaauuaaauagaggugaacacaauuauuuuaaggcaguuaaauu

SEQ ID NO: 117313 - RNA, 64 nt, hsa
gaaguaaauucuaguuuguaguucucauuuguaaugaacacauuaacgacuagauuaaaauauu

SEQ ID NO: 117314 - RNA, 64 nt, hsa
aacuuuucuaaauguagugccuuuaaaggaaaaaugaacacagggaagugacuuugcuacaaau

SEQ ID NO: 117315 - RNA, 64 nt, hsa
uuauuuuucccaauugcccugagcaguacaaugaugaacacacguuucaagagcagacaucuug

SEQ ID NO: 117316 - RNA, 64 nt, hsa
gguggcuucaggccucgggaaucacaagacauccugaacacauugccuccucaucuucuuccug

SEQ ID NO: 117317 - RNA, 64 nt, hsa
auggaauccaucaguguuacgugaugagaauaggugaacacaccuugucagugaugauguaaac

SEQ ID NO: 117318 - RNA, 64 nt, hsa
uaaucuaucauaagcagaccuaagcacaguuuuaugaacacaauuuugcccaugacauugccua

SEQ ID NO: 117319 - RNA, 64 nt, hsa
gccagcccggggacuguccuggguggagggcaggugaacacaagcugcugccggggacuguccu

SEQ ID NO: 117320 - RNA, 64 nt, hsa
cugcugccggggacuguccuggguggacggcaggugaacacaagcggcugccgcauguagccac

SEQ ID NO: 117321 - RNA, 64 nt, hsa
cagcaacuuaggagccugaggcaggagaaugguuugaacacagggauggugaggcugcagugag

SEQ ID NO: 117322 - RNA, 64 nt, hsa
gguaagcugaaacuaauaauuaggcaaugucaagugaacacaaauucaggaugacagacugcaa

SEQ ID NO: 117323 - RNA, 64 nt, hsa
ggaaaacauggaaacuuagacuuguauaguguaaugaacacaaauaccaaaacugcauuuuggu

SEQ ID NO: 117324 - RNA, 64 nt, hsa
agguuacugcugcgauugauguaguggagaugccugaacacaauucuauauuuuaguauuuuuu

SEQ ID NO: 117325 - RNA, 64 nt, hsa
acuccuucugcucaaggcugauguuuguaacuuaugaacacacgugaaguguugaguccaaaag

SEQ ID NO: 117326 - RNA, 64 nt, hsa
cuuacuuuguugaaaaagaaaaagaaauuaaauuugaacacagugaaagcugcaaguaugccag

SEQ ID NO: 117327 - RNA, 64 nt, hsa
uuauugaaacacucaaaaauaccacuucucaguaugaacacaauugcuaagagccuaauuuggu

SEQ ID NO: 117328 - RNA, 64 nt, hsa
aacagucugagcagccaacccauuucaacaaaauugaacacaggacucuucugcucagcagcau

SEQ ID NO: 117329 - RNA, 64 nt, hsa
cugauacacacguauucaaaguuuauggguacaacaaagacauaguacauguacauaauaugua

SEQ ID NO: 117330 - RNA, 64 nt, hsa
agugugugaccuacaggcuuagaaaugguauagucaaagacauuuuauccacauuucuaauagu

SEQ ID NO: 117331 - RNA, 64 nt, hsa
gagaaggaauuugaguuggaucaucuauugcuggcaaagacagaagccucacugcaagcacugc

SEQ ID NO: 117332 - RNA, 64 nt, hsa
acaguagcauaggacccuacccucugggccaagucaaagacauucugacaucuuaguauuugca

SEQ ID NO: 117333 - RNA, 64 nt, hsa
agagagcaagcacguucauaacaaaacagcaacacaaagacauguuaagcauguuuauuuauuu

SEQ ID NO: 117334 - RNA, 64 nt, hsa
acuucgguaaaagaaaauagggaaaggccauaaacaaagacagacuuguaguuuauuuuguauu

SEQ ID NO: 117335 - RNA, 64 nt, hsa
aaaaaauguuguauucugaagacccacaaaauaucaaagacauucuguaguuuauacaccgugu

SEQ ID NO: 117336 - RNA, 64 nt, hsa
aucauacaauaaaauaaaagguaauucagggucccaaagacaaacuuacuaagaaaaaaucauu

SEQ ID NO: 117337 - RNA, 64 nt, hsa
aggguuuaagauggcauggauuugacaaagauaacaaagacagaaucaucuauauauucauuca

SEQ ID NO: 117338 - RNA, 64 nt, hsa
uugauuacaucugaagucucuucucuuuuaagagcaaagacauuguuucaguuucugagagugg

SEQ ID NO: 117339 - RNA, 64 nt, hsa
auuuagacauuagaaugucugggaaaauauuucucaaagacagcaaaaaccucucaaacugagg

SEQ ID NO: 117340 - RNA, 64 nt, hsa
auuuaauuuccucuuaaacauguuaugaguucuacaaagacaauagugaaaaaggaaggaguga

SEQ ID NO: 117341 - RNA, 64 nt, hsa
acgcuccaagcuuggaaagagcuguguuuugguucaaagacaagggaaauggcaaacaaaagac

SEQ ID NO: 117342 - RNA, 64 nt, hsa
auucugaacuccccugugaaugcaguucuuggcacaaagacaaaagcugcagugaaaauuuugg

SEQ ID NO: 117343 - RNA, 64 nt, hsa
cacaaagacauggaagauuagagguuugucaacacaaagacacaggaagaaugggcugcagaag

SEQ ID NO: 117344 - RNA, 64 nt, hsa
aacaaaaagacauggaagguuagguuugucaacacaaagacauggaagauuagagguuugucaa

SEQ ID NO: 117345 - RNA, 64 nt, hsa
ucagaugcaccacccauggagagguuugucaacacaaagacauggaagguuagagguuugucaa

SEQ ID NO: 117346 - RNA, 64 nt, hsa
uuuuguuaauaagacaaagguaauauauuggauacaaagacacaaauguauuguguguucaauu

SEQ ID NO: 117347 - RNA, 64 nt, hsa
auuuucaugaacaguuacccucuguccccacaaccaaagacaacucauggccuccuuuggcccu

SEQ ID NO: 117348 - RNA, 64 nt, hsa
cucguuuuaagaaacuagcagauuuguaugguuccaaagacacuuuugaugacgauucuuaaca

SEQ ID NO: 117349 - RNA, 64 nt, hsa
agaauccugaugguaucaauggauuuaucccccgcaaagacaucaaaccugaguaucaguacau

SEQ ID NO: 117350 - RNA, 64 nt, hsa
guuuacacccgggcagcagcaccacacaugaacccaaagacauguucuuuuuaaagcuguuuuc

SEQ ID NO: 117351 - RNA, 64 nt, hsa
agcuccauccuccacuuauucugccuguuucccccaaagacaauggcuggacccugcaugcagg

SEQ ID NO: 117352 - RNA, 64 nt, hsa
ccccuccuugagaagaccagaagucaacccaucccaaagacaaacugcaugaaaaggguacagc

SEQ ID NO: 117353 - RNA, 64 nt, hsa
cuuuccaaguccagguguucccaaagagcugaaucaaagacagcuuggccacuuccccuccuug

SEQ ID NO: 117354 - RNA, 64 nt, hsa
caggaauaaagauguucuuugaaacccaugagaacaaagacacaacauaccagaaucucuggga

SEQ ID NO: 117355 - RNA, 64 nt, hsa
aaucaauaaauguaauccagcauauaaacagaaccaaagacagaaaccacaugauuaucucaau

SEQ ID NO: 117356 - RNA, 64 nt, hsa
auguggaaaagcauuuagauacuacuacucagcucaaagacaugaaaggacucauacuggagag

SEQ ID NO: 117357 - RNA, 64 nt, hsa
augugggaaaguguucguauaucacaacucugcucaaagacaugaaaagacucauacuggagag

SEQ ID NO: 117358 - RNA, 64 nt, hsa
augugggaaagccuuuguuuauuucauuggauuucaaagacaugaaaggacucacacuagggag

SEQ ID NO: 117359 - RNA, 64 nt, hsa
augugggaaagcauuugaucaucugggaagcuuccaaagacacaugauaaggcacacuagagau

SEQ ID NO: 117360 - RNA, 64 nt, hsa
auguaggaaguccuucaauucuuugggaaaccuucaaagacacauggcagugcagcauggagau

SEQ ID NO: 117361 - RNA, 64 nt, hsa
ccuaucauuaacauuagcuuagggauucugauuucaaagacauaaagaauuggcaaaacucuuc

SEQ ID NO: 117362 - RNA, 64 nt, hsa
cuuggauaaagaaaauuucuacaauuacaguucccaaagacacaguuguucauguuauuuaaag

SEQ ID NO: 117363 - RNA, 64 nt, hsa
ucaaauaacccaugugucccugguuggggcuggggagagugagaagcugagauacugggcacag

SEQ ID NO: 117364 - RNA, 64 nt, hsa
uguggauguugcaccagaagagagugcaguguuggagagugacacugucggggcagcuggggcc

SEQ ID NO: 117365 - RNA, 64 nt, hsa
aggcauuugucuuagagagagagagagcgcgggagagagugagagagagugagagcacaaagau

SEQ ID NO: 117366 - RNA, 64 nt, hsa
cuuagagagagagagagcgcgggagagagugagagagagugagagcacaaagauaacgcaggag

SEQ ID NO: 117367 - RNA, 64 nt, hsa
cggggugacucauuucccuuguccagggcccgaggagagugagguguccagccugcaaagcuau

SEQ ID NO: 117368 - RNA, 64 nt, hsa
gaaggcacacugucccaccacaacugaaccagaagagagugaagacuccccucuucccauccuc

SEQ ID NO: 117369 - RNA, 64 nt, hsa
aguuuccagagagccagagagugagagagagaaagagagugagagagagagagaaagagagaga

SEQ ID NO: 117370 - RNA, 64 nt, hsa
gguuggaagagaguaaccaguuuccagagagccagagagugagagagagaaagagagugagaga

SEQ ID NO: 117371 - RNA, 64 nt, hsa
ccccaaauccuauugcuuaucuuggguuaaauuugagagugauucucuguauauaaauauguga

SEQ ID NO: 117372 - RNA, 64 nt, hsa
ccuacacucaaacuauagugauauaucaguguuugagagugaccucuagaaaaaagaaaagugu

SEQ ID NO: 117373 - RNA, 64 nt, hsa
aaauacuggaaauugcacaugguacaaauuuuuucuucauuacuguacagugaugauguuaaug

SEQ ID NO: 117374 - RNA, 64 nt, hsa
gauauggguuuuaaauggacauugucuguaccagcuucauuaaaauaaacaauauuuguaaaaa

SEQ ID NO: 117375 - RNA, 64 nt, hsa
cucuccacaaucaaauggaggaucccccaagcagcuucauuacagagugauauugggaaaguga

SEQ ID NO: 117376 - RNA, 64 nt, hsa
cugccuuugcauguaguaauaugacaaagugauccuucauuaucacgguacacuauuguuuacu

SEQ ID NO: 117377 - RNA, 64 nt, hsa
agaauaaaaguaauugagcagucauuugcaaaugcuucauuauaacauuuaugugcuuaagauu

SEQ ID NO: 117378 - RNA, 64 nt, hsa
auuauaagaaaucuuaguuaaucaugcuuuugggcuucauuagucaaugugauuggccuuuuau

SEQ ID NO: 117379 - RNA, 64 nt, hsa
guuccaguaaucagaaaauccucaagaaaauugacuucauuauuuggaaggaaaauuaguauuu

SEQ ID NO: 117380 - RNA, 64 nt, hsa
aaaacacaugcuuucuuaaaacagaagcucucuccuucauuaauuuaaauauuuuuaucggcuc

SEQ ID NO: 117381 - RNA, 64 nt, hsa
ccucucucccauuucccgcuguggcugagccaaacuucauuacuuuccuuaggcccucugcccc

SEQ ID NO: 117382 - RNA, 64 nt, hsa
uucuaaaccuuguuucuaacugucuaucaaauaucuucauuagacaucccacaguaauuuuaag

SEQ ID NO: 117383 - RNA, 64 nt, hsa
ugaguaaaccucuauauucauaaguucuaaaauccuucauuaugagggauucaaaguauuuaua

SEQ ID NO: 117384 - RNA, 64 nt, hsa
aucaacucacauauguucaaaaccaaaauaauaccuucauuaucaaacugguuaccaugccuua

SEQ ID NO: 117385 - RNA, 64 nt, hsa
cuucugaagcuagaaacaaucuauaguuauacaucuucauuaauacuguguuaccuuuuaaaau

SEQ ID NO: 117386 - RNA, 64 nt, hsa
gguuuccucauuuuacuaaaaucguauucuaauucuucauuauaguaaaucuaugagcaacucc

SEQ ID NO: 117387 - RNA, 64 nt, hsa
uuuuucacugccuucauuauguaucuucucuugccuucauuauuuuauuuuauuauuucuucuu

SEQ ID NO: 117388 - RNA, 64 nt, hsa
uuguuccuacauuuuguagguuuuuuuucacugccuucauuauguaucuucucuugccuucauu

SEQ ID NO: 117389 - RNA, 64 nt, hsa
uuggaaguuagggaguacugcuuucaagguucaacuucauuaucuucugcauuggaaaauauuu

SEQ ID NO: 117390 - RNA, 64 nt, hsa
cacacuuacuuugacaauuucacaugcacuuguacuucauuauuucccucuucaagagucguuu

SEQ ID NO: 117391 - RNA, 64 nt, hsa
ucaguguuauccuggaacuguuauucuauuuaaucuucauuauagcagaaaugugccaccaugg

SEQ ID NO: 117392 - RNA, 64 nt, hsa
uuuauugugucuaaaagaguugguugcuauuuuccuucauuaugaauagucaguauuuuaaaag

SEQ ID NO: 117393 - RNA, 64 nt, hsa
ucaguuguaccccaguguuccauguauagaaaaacuucauuagaacaaacuuuacuugauauga

SEQ ID NO: 117394 - RNA, 64 nt, hsa
gccacaggucccugcccugugucaccugucugcccuucauuaaggugagaaaucugcagauagc

SEQ ID NO: 117395 - RNA, 64 nt, hsa
caguuuaagcuaugaacugugugucccaguaggaggucaagaaaaccuccacagccuucuggau

SEQ ID NO: 117396 - RNA, 64 nt, hsa
agguagauuuccacaauaugcaaaguggugguggggucaagacagaugacaccagcacuuuaaa

SEQ ID NO: 117397 - RNA, 64 nt, hsa
auaaaauuaauugaaggcagcaaaaggcacaguaggucaagaagcaggucucgaucccggacca

SEQ ID NO: 117398 - RNA, 64 nt, hsa
cgaucccguucccguagucgcaaaucuuacagccggucaagaagcaggagcaggagccggagcc

SEQ ID NO: 117399 - RNA, 64 nt, hsa; identical to SEQ ID NO: 112037

SEQ ID NO: 117400 - RNA, 64 nt, hsa; identical to SEQ ID NO: 112038

SEQ ID NO: 117401 - RNA, 64 nt, hsa; identical to SEQ ID NO: 112039

SEQ ID NO: 117402 - RNA, 64 nt, hsa; identical to SEQ ID NO: 112040

SEQ ID NO: 117403 - RNA, 64 nt, hsa; identical to SEQ ID NO: 112041

SEQ ID NO: 117404 - RNA, 64 nt, hsa; identical to SEQ ID NO: 112042

SEQ ID NO: 117405 - RNA, 64 nt, hsa; identical to SEQ ID NO: 112043

SEQ ID NO: 117406 - RNA, 64 nt, hsa; identical to SEQ ID NO: 112044

SEQ ID NO: 117407 - RNA, 64 nt, hsa; identical to SEQ ID NO: 112045

SEQ ID NO: 117408 - RNA, 64 nt, hsa; identical to SEQ ID NO: 112046

SEQ ID NO: 117409 - RNA, 64 nt, hsa; identical to SEQ ID NO: 112047

SEQ ID NO: 117410 - RNA, 64 nt, hsa; identical to SEQ ID NO: 112048

SEQ ID NO: 117411 - RNA, 64 nt, hsa; identical to SEQ ID NO: 112049

SEQ ID NO: 117412 - RNA, 64 nt, hsa; identical to SEQ ID NO: 112050

SEQ ID NO: 117413 - RNA, 64 nt, hsa; identical to SEQ ID NO: 112051

SEQ ID NO: 117414 - RNA, 64 nt, hsa; identical to SEQ ID NO: 112052

SEQ ID NO: 117415 - RNA, 64 nt, hsa; identical to SEQ ID NO: 112053

SEQ ID NO: 117416 - RNA, 64 nt, hsa; identical to SEQ ID NO: 112054

SEQ ID NO: 117417 - RNA, 64 nt, hsa; identical to SEQ ID NO: 112055

SEQ ID NO: 117418 - RNA, 64 nt, hsa; identical to SEQ ID NO: 112056

SEQ ID NO: 117419 - RNA, 64 nt, hsa; identical to SEQ ID NO: 112057

SEQ ID NO: 117420 - RNA, 64 nt, hsa; identical to SEQ ID NO: 112058

SEQ ID NO: 117421 - RNA, 59 nt, hsa; identical to SEQ ID NO: 112059

SEQ ID NO: 117422 - RNA, 64 nt, hsa; identical to SEQ ID NO: 112060

SEQ ID NO: 117423 - RNA, 64 nt, hsa; identical to SEQ ID NO: 112061

SEQ ID NO: 117424 - RNA, 64 nt, hsa; identical to SEQ ID NO: 112062

SEQ ID NO: 117425 - RNA, 64 nt, hsa; identical to SEQ ID NO: 112063

SEQ ID NO: 117426 - RNA, 64 nt, hsa; identical to SEQ ID NO: 112064

SEQ ID NO: 117427 - RNA, 64 nt, hsa; identical to SEQ ID NO: 112065

SEQ ID NO: 117428 - RNA, 54 nt, hsa; identical to SEQ ID NO: 112066

SEQ ID NO: 117429 - RNA, 64 nt, hsa; identical to SEQ ID NO: 112067

SEQ ID NO: 117430 - RNA, 64 nt, hsa; identical to SEQ ID NO: 112068

SEQ ID NO: 117431 - RNA, 64 nt, hsa; identical to SEQ ID NO: 112069

SEQ ID NO: 117432 - RNA, 64 nt, hsa; identical to SEQ ID NO: 112070

SEQ ID NO: 117433 - RNA, 64 nt, hsa; identical to SEQ ID NO: 112071

SEQ ID NO: 117434 - RNA, 64 nt, hsa; identical to SEQ ID NO: 112072

SEQ ID NO: 117435 - RNA, 64 nt, hsa; identical to SEQ ID NO: 112073

SEQ ID NO: 117436 - RNA, 64 nt, hsa; identical to SEQ ID NO: 112074

SEQ ID NO: 117437 - RNA, 64 nt, hsa; identical to SEQ ID NO: 112075

SEQ ID NO: 117438 - RNA, 64 nt, hsa; identical to SEQ ID NO: 112076

SEQ ID NO: 117439 - RNA, 64 nt, hsa; identical to SEQ ID NO: 112077

SEQ ID NO: 117440 - RNA, 64 nt, hsa; identical to SEQ ID NO: 112078

SEQ ID NO: 117441 - RNA, 64 nt, hsa; identical to SEQ ID NO: 112079

SEQ ID NO: 117442 - RNA, 64 nt, hsa; identical to SEQ ID NO: 112080

SEQ ID NO: 117443 - RNA, 64 nt, hsa; identical to SEQ ID NO: 112081

SEQ ID NO: 117444 - RNA, 64 nt, hsa; identical to SEQ ID NO: 112082

SEQ ID NO: 117445 - RNA, 64 nt, hsa; identical to SEQ ID NO: 112083

SEQ ID NO: 117446 - RNA, 64 nt, hsa; identical to SEQ ID NO: 112084

SEQ ID NO: 117447 - RNA, 64 nt, hsa; identical to SEQ ID NO: 112085

SEQ ID NO: 117448 - RNA, 64 nt, hsa; identical to SEQ ID NO: 112086

SEQ ID NO: 117449 - RNA, 64 nt, hsa; identical to SEQ ID NO: 112087

SEQ ID NO: 117450 - RNA, 64 nt, hsa; identical to SEQ ID NO: 112088

SEQ ID NO: 117451 - RNA, 64 nt, hsa; identical to SEQ ID NO: 112089

SEQ ID NO: 117452 - RNA, 64 nt, hsa; identical to SEQ ID NO: 112090

SEQ ID NO: 117453 - RNA, 64 nt, hsa; identical to SEQ ID NO: 112091

SEQ ID NO: 117454 - RNA, 64 nt, hsa; identical to SEQ ID NO: 112092

SEQ ID NO: 117455 - RNA, 64 nt, hsa; identical to SEQ ID NO: 112093

SEQ ID NO: 117456 - RNA, 64 nt, hsa; identical to SEQ ID NO: 112094

SEQ ID NO: 117457 - RNA, 64 nt, hsa; identical to SEQ ID NO: 112095

SEQ ID NO: 117458 - RNA, 64 nt, hsa; identical to SEQ ID NO: 112096

SEQ ID NO: 117459 - RNA, 64 nt, hsa; identical to SEQ ID NO: 112097

SEQ ID NO: 117460 - RNA, 64 nt, hsa; identical to SEQ ID NO: 112098

SEQ ID NO: 117461 - RNA, 64 nt, hsa; identical to SEQ ID NO: 112099

SEQ ID NO: 117462 - RNA, 64 nt, hsa; identical to SEQ ID NO: 112100

SEQ ID NO: 117463 - RNA, 64 nt, hsa; identical to SEQ ID NO: 112101

SEQ ID NO: 117464 - RNA, 64 nt, hsa; identical to SEQ ID NO: 112102

SEQ ID NO: 117465 - RNA, 64 nt, hsa; identical to SEQ ID NO: 112103

SEQ ID NO: 117466 - RNA, 64 nt, hsa; identical to SEQ ID NO: 112104

SEQ ID NO: 117467 - RNA, 64 nt, hsa; identical to SEQ ID NO: 112105

SEQ ID NO: 117468 - RNA, 64 nt, hsa; identical to SEQ ID NO: 112106

SEQ ID NO: 117469 - RNA, 64 nt, hsa; identical to SEQ ID NO: 112107

SEQ ID NO: 117470 - RNA, 64 nt, hsa; identical to SEQ ID NO: 112108

SEQ ID NO: 117471 - RNA, 64 nt, hsa; identical to SEQ ID NO: 112109

SEQ ID NO: 117472 - RNA, 64 nt, hsa; identical to SEQ ID NO: 112110

SEQ ID NO: 117473 - RNA, 64 nt, hsa; identical to SEQ ID NO: 112111

SEQ ID NO: 117474 - RNA, 64 nt, hsa; identical to SEQ ID NO: 112112

SEQ ID NO: 117475 - RNA, 50 nt, hsa; identical to SEQ ID NO: 112113

SEQ ID NO: 117476 - RNA, 64 nt, hsa; identical to SEQ ID NO: 112114

SEQ ID NO: 117477 - RNA, 64 nt, hsa; identical to SEQ ID NO: 112115

SEQ ID NO: 117478 - RNA, 64 nt, hsa; identical to SEQ ID NO: 112116

SEQ ID NO: 117479 - RNA, 64 nt, hsa; identical to SEQ ID NO: 112117

SEQ ID NO: 117480 - RNA, 64 nt, hsa; identical to SEQ ID NO: 112118

SEQ ID NO: 117481 - RNA, 64 nt, hsa; identical to SEQ ID NO: 112119

SEQ ID NO: 117482 - RNA, 64 nt, hsa; identical to SEQ ID NO: 112120

SEQ ID NO: 117483 - RNA, 64 nt, hsa; identical to SEQ ID NO: 112121

SEQ ID NO: 117484 - RNA, 64 nt, hsa; identical to SEQ ID NO: 112122

SEQ ID NO: 117485 - RNA, 64 nt, hsa; identical to SEQ ID NO: 112123

SEQ ID NO: 117486 - RNA, 64 nt, hsa; identical to SEQ ID NO: 112124

SEQ ID NO: 117487 - RNA, 64 nt, hsa; identical to SEQ ID NO: 112125

SEQ ID NO: 117488 - RNA, 64 nt, hsa; identical to SEQ ID NO: 112126

SEQ ID NO: 117489 - RNA, 64 nt, hsa; identical to SEQ ID NO: 112127

SEQ ID NO: 117490 - RNA, 64 nt, hsa; identical to SEQ ID NO: 112128

SEQ ID NO: 117491 - RNA, 64 nt, hsa; identical to SEQ ID NO: 112129

SEQ ID NO: 117492 - RNA, 64 nt, hsa; identical to SEQ ID NO: 112130

SEQ ID NO: 117493 - RNA, 64 nt, hsa; identical to SEQ ID NO: 112131

SEQ ID NO: 117494 - RNA, 64 nt, hsa; identical to SEQ ID NO: 112132

SEQ ID NO: 117495 - RNA, 64 nt, hsa; identical to SEQ ID NO: 112133

SEQ ID NO: 117496 - RNA, 64 nt, hsa; identical to SEQ ID NO: 112134

SEQ ID NO: 117497 - RNA, 64 nt, hsa; identical to SEQ ID NO: 112135

SEQ ID NO: 117498 - RNA, 64 nt, hsa; identical to SEQ ID NO: 112136

SEQ ID NO: 117499 - RNA, 64 nt, hsa; identical to SEQ ID NO: 112137

SEQ ID NO: 117500 - RNA, 64 nt, hsa; identical to SEQ ID NO: 112138

SEQ ID NO: 117501 - RNA, 64 nt, hsa; identical to SEQ ID NO: 112139

SEQ ID NO: 117502 - RNA, 64 nt, hsa; identical to SEQ ID NO: 112140

SEQ ID NO: 117503 - RNA, 64 nt, hsa
ucucccuccuuaaauaaagagagggguuaaacaugcccucuaaaaguaggugguuuugaagaga

SEQ ID NO: 117504 - RNA, 64 nt, hsa
gcucagguagcacuuuauacucaggcagaucucagcccucuacugagucccuuagccaagcagu

SEQ ID NO: 117505 - RNA, 64 nt, hsa
gccuuuggaagaggucuucggagaugccagaggagcccucuagggguccgaugccugggaggac

SEQ ID NO: 117506 - RNA, 64 nt, hsa
guccaucugugaaaugaaaggaucagccuggacagcccucuaaacucccuuacagcucucagcc

SEQ ID NO: 117507 - RNA, 64 nt, hsa
aaaagcaacaggccauugugaaccaaugcaagacgcccucuaucauggugaaaagcuccaucaa

SEQ ID NO: 117508 - RNA, 64 nt, hsa
gggcuuggaccagaucuaacaucuugaauacucugcccucuagagccuucagccuuaauggaag

SEQ ID NO: 117509 - RNA, 64 nt, hsa
gggagagggaggcuuggagacagucugacccagugcccucuaggccacccacuucuaggccugc

SEQ ID NO: 117510 - RNA, 64 nt, hsa
cuggguccugugccuguccguuuuggggcaugcagcccucuaucauuuuuggcuccgagaagag

SEQ ID NO: 117511 - RNA, 64 nt, hsa
gcauuuauuauacuuuaaugggauagugcuucuugaccauuauagaacaacaaacugucaaagg

SEQ ID NO: 117512 - RNA, 64 nt, hsa
gggagagcaacuucagggcuucuccauagaccuugaccauuauaagcagaccuuauuucucccu

SEQ ID NO: 117513 - RNA, 64 nt, hsa
agaaauaggugaagugcaagcuaguuucuauaaugaccauuaaaaaaauucugcuguguaauuc

SEQ ID NO: 117514 - RNA, 64 nt, hsa
aacuucaaaguaagauuuugucagaauaaauugagaccauuaaucuaauauaauacuuguucau

SEQ ID NO: 117515 - RNA, 64 nt, hsa
uggcagcaaaugccaacauuuuguggaauagcagcaaaucuacaagagacccugguugguuuuu

SEQ ID NO: 117516 - RNA, 64 nt, hsa
agucccacuugaaccauggccaguccacuacagccaaaucuaaaagaaauauauacauacagug

SEQ ID NO: 117517 - RNA, 64 nt, hsa
auaguguacuccaccuuuuacuuuuuuccugagacaaaucuacccuuauucuuucuuccucuuc

SEQ ID NO: 117518 - RNA, 64 nt, hsa
uuuaaauagaugaaaauucuaaaugauuuucccucaaaucuaucuagauuauuuuaagaugaga

SEQ ID NO: 117519 - RNA, 64 nt, hsa
uuaauauuuaaggccuugaaauuauauuccaaggcaaaucuaaauggguguaguuguauaugca

SEQ ID NO: 117520 - RNA, 64 nt, hsa
uuguuguuguugaagacaguaaaauaaguguuuucaaaucuauaugucuccuuuuuguuggaua

SEQ ID NO: 117521 - RNA, 64 nt, hsa
uacaccucaaauucggagaaacaguuaauuugggcaaaucuacaguucuguuuuugcuacucua

SEQ ID NO: 117522 - RNA, 64 nt, hsa
auuucuaauuguguugugaaaaugauaaaugcagcaaaucuagcuuucaguauuccuaauuuuu

SEQ ID NO: 117523 - RNA, 64 nt, hsa
agugauugcaaacaggcuggauuuggacaaaaagcaaaucuagacaugcauguuucaggguuca

SEQ ID NO: 117524 - RNA, 64 nt, hsa
ugaacuagaugguauuccuuauucacuuacauuacaaaucuaagaccaugugauaagcaugacu

SEQ ID NO: 117525 - RNA, 64 nt, hsa
gcauagcauaaugagauaucuugggaaugggacccaaaucuaaacacaaaauucauuuauguuu

SEQ ID NO: 117526 - RNA, 64 nt, hsa
uuggagcaguucagauuuucagauuagggaugcucaaaucuauauagauauaaaauuauccuca

SEQ ID NO: 117527 - RNA, 64 nt, hsa
uuugcuuuucauguagaacucagcaguugacauccaaaucuagccagagcccuucacugccaug

SEQ ID NO: 117528 - RNA, 64 nt, hsa
aaauccuuuuaaccauuuuaaccuagauguuuaacaaaucuaaucucuuauucuaauaaauaua

SEQ ID NO: 117529 - RNA, 64 nt, hsa
ggaauuuaaaccuguauuuaaaaaaaagaaucaccaaaucuauuugaaaacaagucgauuugua

SEQ ID NO: 117530 - RNA, 64 nt, hsa
acugucaaugauuuuguauuauguugaauccacccaaaucuauuguugucuuaaaauuguuaau

SEQ ID NO: 117531 - RNA, 64 nt, hsa
cagauagucaucucaguccaaggaucccaaaacacaaaucuagaauugcaaagccagccuuuau

SEQ ID NO: 117532 - RNA, 64 nt, hsa
guauuugugugugugugugugugugagcaccugacaaaucuaugaaaccgagugaaaggagaaa

SEQ ID NO: 117533 - RNA, 64 nt, hsa
gacuuuugcuuccagcaaguauguuagacuagauauuauaaaacaacuagauccugaauaaaau

SEQ ID NO: 117534 - RNA, 64 nt, hsa
aaacauuggaaaguuaagagaguucgagggaagaauuauaaagacuaggaguccuagaaagaga

SEQ ID NO: 117535 - RNA, 64 nt, hsa
gaaccaucuuuguucaugaauaggaauauucaagauuauaaagguaucaggucuccuaaaauug

SEQ ID NO: 117536 - RNA, 64 nt, hsa
uuuuuuacauauuaaauauguucuacuuaaauauauuauaaaaaauaaaggcaaaguggaauga

SEQ ID NO: 117537 - RNA, 64 nt, hsa
gauuuuuauuaaaaaccuggacagaaaauuauaaauuauaaauaugacuuuauccuggcuauaa

SEQ ID NO: 117538 - RNA, 64 nt, hsa
cauuacugauuuuuauuaaaaaccuggacagaaaauuauaaauuauaaauaugacuuuauccug

SEQ ID NO: 117539 - RNA, 64 nt, hsa
auaccucuugguaucuagaaaagcuuguucauccauuauaaauauaucuuuagccacagcaaac

SEQ ID NO: 117540 - RNA, 64 nt, hsa
uucagcaaauuuuuugaaauugcugcuguuuuaaauuauaaaaccuuuauauuucugcuuugua

SEQ ID NO: 117541 - RNA, 64 nt, hsa
cucuucuucuaacuuuuaguaagaggaaaaagggauuauaaaacccuucauaaaucaagaaggc

SEQ ID NO: 117542 - RNA, 64 nt, hsa
acauugggcgguuuucuuaauuugaaguauaaaaauuauaaagaguaauuccaaagguauuaaa

SEQ ID NO: 117543 - RNA, 64 nt, hsa
cauaugcucagcuauuuuaaagaggaaauuaaauauuauaaaagaaauaguaaagauaaguuau

SEQ ID NO: 117544 - RNA, 64 nt, hsa
gaauguuaucaccuguuugucaaagcuuguuuaaauuauaaaacacuuuuaauuauauauauga

SEQ ID NO: 117545 - RNA, 64 nt, hsa
aaugucuccguauuugaagaacugagcucuguacauuauaaauuugcuuaaagauuuugauuuu

SEQ ID NO: 117546 - RNA, 64 nt, hsa
auuuuuaaaagucuugagcucuucuuaaauauacauuauaaagagcaagcauagauggaaagug

SEQ ID NO: 117547 - RNA, 64 nt, hsa
aauaaguaaauguaucaaguuguuuauauaauaaauuauaaaacucuugaggcacuugguaugu

SEQ ID NO: 117548 - RNA, 64 nt, hsa
aucuuuaauacaauauagaaauuguguaauaguuauuauaaauguuaauacacaacuuucaggu

SEQ ID NO: 117549 - RNA, 64 nt, hsa
auguugacaugcuuaauucacaaaugcuaauuucauuauaaauuguuuugcuaaaauacacuuu

SEQ ID NO: 117550 - RNA, 64 nt, hsa
acuucccguugaguaaugccaaguuguuuuuuuuauuauaaaacuugcccuucauuacauguuu

SEQ ID NO: 117551 - RNA, 64 nt, hsa
uuacacuuugaaaggaaaucuuguuucaauguuuauuauaaaagccuugcuaauuuaguaguga

SEQ ID NO: 117552 - RNA, 64 nt, hsa
agguucuuguguauauuuggggggugggggaugaauuauaaauuauauucagcccugaguggag

SEQ ID NO: 117553 - RNA, 64 nt, hsa
uuguuguuuuugagcuggcuguauauauuuuaaaauuauaaauagauaauauauuauuuuuugc

SEQ ID NO: 117554 - RNA, 64 nt, hsa
auguaguaaacuauucuaaguuuucauucuuugaauuauaaauggccucagcaguuuugcucaa

SEQ ID NO: 117555 - RNA, 64 nt, hsa
aaccaucauuauauucuuucguguuuuuucuuuuauuauaaacaaggggauuauucuuuaguuc

SEQ ID NO: 117556 - RNA, 64 nt, hsa
gcacuggcuucuauauuuuauuucauauuuaugaauuauaaauaugaauuuaauuacuaaagaa

SEQ ID NO: 117557 - RNA, 64 nt, hsa
uguacuguuuagaaauauacauauuuuauacaaaauuauaaagaaagcauagagagguaagcau

SEQ ID NO: 117558 - RNA, 64 nt, hsa
aucuguuaucccaaucauuguugccucuccguuuauuauaaacuguaugcucacaacuuagugu

SEQ ID NO: 117559 - RNA, 64 nt, hsa
auaagagcaugaaauuuuuaaaaauacacuugugauuauaaaauuaaucacaaauuucacuuau

SEQ ID NO: 117560 - RNA, 64 nt, hsa
caaauuacuugcaguucugaguuucagauaaaacauuauaaaacauuaaauucaauacauacug

SEQ ID NO: 117561 - RNA, 64 nt, hsa
ggcugggaccuauccccucacaucuaaugaaugaauuauaaaauguauaugucuaugaagcuuc

SEQ ID NO: 117562 - RNA, 64 nt, hsa
uuaagcauaauagccacaauaggacauauaaaagauuauaaauacagagcuuuauuauccugac

SEQ ID NO: 117563 - RNA, 64 nt, hsa
uuggauaugaaaaacagaagagagaaaaauauacauuauaaaagcagaacauacauguaccagu

SEQ ID NO: 117564 - RNA, 64 nt, hsa
cuguauuucuucuugucacucuugauucaacuugauuauaaauacaccugucacuaccagaacc

SEQ ID NO: 117565 - RNA, 64 nt, hsa
uuuuuuuuguaaccaugaaauugaacauuuccaaauuauaaacuauguuaauaccuauaaaaua

SEQ ID NO: 117566 - RNA, 64 nt, hsa
aaaaagcucucuugaaucuagguagcaugaacaaauuauaaaauuuguuuaaaaaagcaaacuu

SEQ ID NO: 117567 - RNA, 64 nt, hsa
ucgcacaagugguuuauggaguguuuggauuguaauuauaaaugguucuuugauaugcaaauua

SEQ ID NO: 117568 - RNA, 64 nt, hsa
uaugacauaagcaaucauuuuaugcuguuuaugaauuauaaauguguuuauagcucauuuguaa

SEQ ID NO: 117569 - RNA, 64 nt, hsa
aaaacauuauauguauacaucaguauaguguuuuauuauaaagccaauuaucugauuaagcauu

SEQ ID NO: 117570 - RNA, 64 nt, hsa
uacugacagaaguuauuuccaaguuuguguauauauuauaaaaauuacauauauaaaacuaagg

SEQ ID NO: 117571 - RNA, 64 nt, hsa
uaauagcuacguuugggaaggaggaaacauuuaaauuauaaaggacugaauaaucuaaaaagca

SEQ ID NO: 117572 - RNA, 64 nt, hsa
aucuuauuaccuauaacuauuaauuuuucauagaauuauaaaugucauuugacuaugucaaucu

SEQ ID NO: 117573 - RNA, 64 nt, hsa
agauuccaugucuuucucauauuucagaggaaagauuauaaaauauaaaauuucuuagagaaca

SEQ ID NO: 117574 - RNA, 64 nt, hsa
uguugcaccaggcugagaaagcagcaauauugauauuauaaagauaaaaauuuaucaacauucc

SEQ ID NO: 117575 - RNA, 64 nt, hsa
uauccucucauuuuuucacugcuaugauauauuuauuauaaaauagggaaugaaugaaugaaua

SEQ ID NO: 117576 - RNA, 64 nt, hsa
ggaaaaucauuauuuuagguguggagccauuuuuauuauaaaacuuucucaaaauaaaaaaaca

SEQ ID NO: 117577 - RNA, 64 nt, hsa
aaaaucauuccaaauaagaguuuaauuuuuauuaauuauaaaaaacucuguauuaguuuccuag

SEQ ID NO: 117578 - RNA, 64 nt, hsa
uucuuaauucuuacaauggugauaaguuacuucaauuauaaaauugaauuuugcagacuaaauu

SEQ ID NO: 117579 - RNA, 64 nt, hsa
cucggguucaaagcuggauuuugaacugaagaagauuauaaaauuauuuauuguuauuauaaac

SEQ ID NO: 117580 - RNA, 64 nt, hsa
ugaacugaagaagauuauaaaauuauuuauuguuauuauaaacaaaauuaacccuuugaauacu

SEQ ID NO: 117581 - RNA, 64 nt, hsa
ucuauugacauccuuuuguuuucuaauuuuaaaaauuauaaagauguaaauggaauuauaaaua

SEQ ID NO: 117582 - RNA, 64 nt, hsa
uucuaauuuuaaaaauuauaaagauguaaauggaauuauaaauacugugaccuaagaaaagacc

SEQ ID NO: 117583 - RNA, 64 nt, hsa
ucaagaccacaaauaaucaagaguugauuucaagauuauaaauacucaugaucagaaaauagua

SEQ ID NO: 117584 - RNA, 64 nt, hsa
guacuucacaggaauauugugagguguuuauaaaauuauaaaauuugaugaaauucuuacaauu

SEQ ID NO: 117585 - RNA, 64 nt, hsa
aaaaagugcacagugugauuguuuacaaaaugauauuauaaauaaauaaaauacuucuucuguc

SEQ ID NO: 117586 - RNA, 64 nt, hsa
ucuuuuuauaacuauguuuuacuguauauuuaaaauuauaaauuaauguuuucguggcauguaa

SEQ ID NO: 117587 - RNA, 64 nt, hsa
aaaauuaaugaauaccauauuaguauuauaaaauauuauaaaguaauaauuauaucaucuauau

SEQ ID NO: 117588 - RNA, 64 nt, hsa
aacuuccaacaaaauuaaugaauaccauauuaguauuauaaaauauuauaaaguaauaauuaua

SEQ ID NO: 117589 - RNA, 64 nt, hsa
uuguuggacuuggcauguuuccaugaacugcacuauuauaaacuauuaaaaugauagauugugg

SEQ ID NO: 117590 - RNA, 64 nt, hsa
acgcucccccuaucccuaccccacaagccuuucgauuauaaaauacuaccaaucuuguuauaag

SEQ ID NO: 117591 - RNA, 64 nt, hsa
aaaaauuagacacacuuuaaaccuucaaacagguauuauaaauaacaugugacuccuuaaugga

SEQ ID NO: 117592 - RNA, 64 nt, hsa
uuugaagaauuacaaaucagaagaaaaagcaagcauuauaaacaaaacuaauaacuguuuuacu

SEQ ID NO: 117593 - RNA, 64 nt, hsa
uaaagcaguaaucuuuaacuguagcauuccucuaauuauaaacagugaaaaaucaaaaucaguc

SEQ ID NO: 117594 - RNA, 64 nt, hsa
ggccauggugaaaaauaguuuuugaaaacaucagauuauaaaaucaagauaguccggacgcggu

SEQ ID NO: 117595 - RNA, 64 nt, hsa
gcacuuuaauuuggcaagccauuuuuccuguuuuauuauaaaucuauauuagauguuugaauau

SEQ ID NO: 117596 - RNA, 64 nt, hsa
auuccuagauauggaggaaacauaagucuguaguauuauaaaacugauuguaauaauucuuucc

SEQ ID NO: 117597 - RNA, 64 nt, hsa
uuccuuuucuuaauugcccagaguuaucagacagauuauaaaaauggcuuuuaauggcuuaaac

SEQ ID NO: 117598 - RNA, 64 nt, hsa
agucaccuaucaccuuuaaacgccuuuuuuuaaaauuauaaaauauuguaaagcagggucucaa

SEQ ID NO: 117599 - RNA, 64 nt, hsa
uuuuauucauucaaauguauuuuuucuugugcauauuauaaaaauauauuuuaugagcucuuac

SEQ ID NO: 117600 - RNA, 64 nt, hsa
aauagggugggucaucaauuaggagaaaucccaaauuauaaaagccaacauaugccgugaccua

SEQ ID NO: 117601 - RNA, 64 nt, hsa
ucuaauaaaugaugaaauucaguccaacaugcuuauuauaaacauagcaauucuugcucuauca

SEQ ID NO: 117602 - RNA, 64 nt, hsa
uauuuuauuuuuuaguuauuugugucaaauuauaauuauaaaagguacagcagaaaauauacca

SEQ ID NO: 117603 - RNA, 64 nt, hsa
auguuaggaacaaaagacaaaauaguaucaacacauuauaaauauuuagcuuacuaaauauuug

SEQ ID NO: 117604 - RNA, 64 nt, hsa
uuuacugaagggaacaucaaaauauuaaugguauauuauaaaauaaagacuuucuuaaaggaaa

SEQ ID NO: 117605 - RNA, 64 nt, hsa
gacuguugucauucuggagguccuauuagagaauauuauaaaagggugaccuuguaggaaggau

SEQ ID NO: 117606 - RNA, 64 nt, hsa
uagcaacucuggauauuuuuauaaaacuaguuacauuauaaacgguuucaaacauguuuaauuu

SEQ ID NO: 117607 - RNA, 64 nt, hsa
aguaggaaaaaaagaaucugaaagauacaaagugauuauaaaagaauugacaggacaauaaaua

SEQ ID NO: 117608 - RNA, 64 nt, hsa
aagaagguucacauaaauagcuucuggagugcaaauuauaaagacaucaacauuuuugaucaua

SEQ ID NO: 117609 - RNA, 64 nt, hsa
caagaaaugauacauaaucauucucuuuaagacaauuauaaauuggauggagcuauuauucacu

SEQ ID NO: 117610 - RNA, 64 nt, hsa
gcuauuauucacuacuucuuuucuuaguuugaaaauuauaaacaaauuuuaagcuuuauucaaa

SEQ ID NO: 117611 - RNA, 64 nt, hsa
acaugggcuccuauuuuuuccccuacugucuugcauuauaaaauuagaaguguauuuucagugg

SEQ ID NO: 117612 - RNA, 64 nt, hsa
auuuuuuuaaaaaaaauucuauauauacuguaaaauuauaaauuuuuuuguuuguaauuucagg

SEQ ID NO: 117613 - RNA, 64 nt, hsa
aaccugugcucuaaacagugggaguaccaaagaaauuauaaacaagauaaaugcuguggcuccu

SEQ ID NO: 117614 - RNA, 64 nt, hsa
gugacuaauuuaucuauagcugcuauagcaagcuauuauaaaacuugaauuucuacaaauggug

SEQ ID NO: 117615 - RNA, 64 nt, hsa
aaguaacuacaaauaaguguugugaauagauuuuauuauaaaucagagaacuguuuucucccug

SEQ ID NO: 117616 - RNA, 64 nt, hsa
cuugaagcacuuuaauauaacuugaauauuaucuauuauaaaaguaacuacaaauaaguguugu

SEQ ID NO: 117617 - RNA, 64 nt, hsa
ggaugugaauauauguggaaaacuaaauccauuuauuauaaaugccuuaucuuuacccuuuggg

SEQ ID NO: 117618 - RNA, 64 nt, hsa
uuccauagcaacuaaucauagugacccaaacaggauuauaaagucaagugaggaauaaauagca

SEQ ID NO: 117619 - RNA, 64 nt, hsa
ggugguucuaaaggacaccuagggucaauaacccauuauaaaaugaucugauuacacuggacac

SEQ ID NO: 117620 - RNA, 64 nt, hsa
gcugcaguagcuuuuaaguauguaucaacauuucauuauaaauuauagcuuccugguucugugu

SEQ ID NO: 117621 - RNA, 64 nt, hsa
auuacaucccuauuuauguucaaccguacaucaaauuauaaaugcaaaacagguucagauuuca

SEQ ID NO: 117622 - RNA, 64 nt, hsa
uuuugugauuuaauaauacuauuucuguggaauaauuauaaaaguaugaccuuuuuaaaucaac

SEQ ID NO: 117623 - RNA, 64 nt, hsa
auuauuauuucagaacuagcucagcccaucucuaauuauaaaacaugguuuuguuuuuuuuuuu

SEQ ID NO: 117624 - RNA, 64 nt, hsa
gaugaaauuuuuuaaagauacaaccaugauaaccauuauaaaugaucuaugaucaaaaucuaaa

SEQ ID NO: 117625 - RNA, 64 nt, hsa
uaaauuagacucuauuuugaauuaaaagaguuuuauuauaaaccguguguuuuugguuuuucua

SEQ ID NO: 117626 - RNA, 64 nt, hsa
guuccccugggauucugaauauaacauauagccuauuauaaaucccuguaucguggaccuuuug

SEQ ID NO: 117627 - RNA, 64 nt, hsa
uucauaguuuaagucuuuuaucauuauuaccucaauuauaaauauuacaaaaacauaauucugg

SEQ ID NO: 117628 - RNA, 64 nt, hsa
gucuuccacuaugucagagccacauucccgucacauuauaaaugaaggaguggauucuuaaaua

SEQ ID NO: 117629 - RNA, 64 nt, hsa
ugugauaacuacuuuuuauacuuuaucccauuuaauuauaaaaaccacucuugagaaguaauuu

SEQ ID NO: 117630 - RNA, 64 nt, hsa
uuauuuauuuuaacacuuuuuuaauaaaaucuuuauuauaaaccaugacuauuccuaaggccau

SEQ ID NO: 117631 - RNA, 64 nt, hsa
agacugcagacuauagauuuuuuuuuaauauaggauuauaaaucagcuagugaaagaccucaga

SEQ ID NO: 117632 - RNA, 64 nt, hsa
aaauuucauaguaauaguaacuuuauaaaauaauauuauaaaauacaggauuuaaaccuuucua

SEQ ID NO: 117633 - RNA, 64 nt, hsa
uagucccagcuacuugggagguggaggugggaggauuauaaauagagacuuuccuuaagacuuu

SEQ ID NO: 117634 - RNA, 64 nt, hsa
uuuuaauaauuauaaaauuaauaauuucuugauaauuauaaaaaugaagugucaaaaaaucuca

SEQ ID NO: 117635 - RNA, 64 nt, hsa
augcaaagccugaagacacugguagcuuuuaauaauuauaaaauuaauaauuucuugauaauua

SEQ ID NO: 117636 - RNA, 64 nt, hsa
cuuuuaauacccauuuauuggcuauuuaagguaaauuauaaaaccuaaaauuaguaucaguauu

SEQ ID NO: 117637 - RNA, 64 nt, hsa
uauaccuaaguguuuuuuuaaacuaugggaguguauuauaaaaucaauaauaauaugcaaacag

SEQ ID NO: 117638 - RNA, 64 nt, hsa
uuauuuuagcaaaucaguauauuuucuguauuuaauuauaaaaaauuaacuuaguuuuuaaaau

SEQ ID NO: 117639 - RNA, 64 nt, hsa
uaucuacaaagaaaaauuaauuaggaauuacuuuauuauaaaaugcuccuagaagucuuaauug

SEQ ID NO: 117640 - RNA, 64 nt, hsa
cuguguaugugauguuguuaauuucuuuuauugcauuauaaaauaaaaggauuauguauuuuua

SEQ ID NO: 117641 - RNA, 64 nt, hsa
auugcaacaaaguuaggaaguuuguuguuuguuuauuauaaacaaaaagcaugugaaagugcac

SEQ ID NO: 117642 - RNA, 64 nt, hsa
cguugccuccuugguuucagaagagaguaguuuuauuauaaauauuguauggacuuuguauauu

SEQ ID NO: 117643 - RNA, 64 nt, hsa
agacauuuuauguauuauuucgauuuacuuccuaauuauaaaagcugcuuuuuugcagaacauu

SEQ ID NO: 117644 - RNA, 64 nt, hsa
ucuuuuguuauguauauguagggaagucauagggauuauaaauucaauuugaguaaaauuuaaa

SEQ ID NO: 117645 - RNA, 64 nt, hsa
aacauuuuauguucaauccauauuugucuugcacauuauaaauauauuuuuauuuuuuaguaau

SEQ ID NO: 117646 - RNA, 64 nt, hsa
ugaauuuggaaaaacauuuuuucaaaaacuacaaauuauaaaacaccaaaguguucauacuaaa

SEQ ID NO: 117647 - RNA, 64 nt, hsa
uacuucuaugaaauaauaugcagucuauuuuuaaauuauaaauuaugugugaacuuagcuuuuc

SEQ ID NO: 117648 - RNA, 64 nt, hsa
agaaauaccauauacauagauggaaaaacccaguauuauaaaaaccucaauucugaaaaucuau

SEQ ID NO: 117649 - RNA, 64 nt, hsa
ucaacuaagaauuuucuaggaucuuucaaaaaugauuauaaaauucaugugaaauagaagugua

SEQ ID NO: 117650 - RNA, 64 nt, hsa
acucagagaaacauuuauuucggcuugcugguuuauuauaaaagcaagguuuauuauaaaagau

SEQ ID NO: 117651 - RNA, 64 nt, hsa
uucggcuugcugguuuauuauaaaagcaagguuuauuauaaaagauacuacaaaggauacagau

SEQ ID NO: 117652 - RNA, 64 nt, hsa
acuuucccuagucaaugcucugaaaaugugucacauuauaaacaauacagaaggagagauagau

SEQ ID NO: 117653 - RNA, 64 nt, hsa
cccuagucagugcucugaagaugugucacauuauauuauaaacaauacggaaggggagauaggu

SEQ ID NO: 117654 - RNA, 64 nt, hsa
uaugcuuucucucugcugugaaauuauuuuuagaauuauaaauucacgucuugucagauuucau

SEQ ID NO: 117655 - RNA, 64 nt, hsa
gucacagcuuaaaaacauucagugugacuuuaauauuauaaaaugauuucccaugccauaauuu

SEQ ID NO: 117656 - RNA, 64 nt, hsa
ugaugucuaaaaguuuccagugauuuauuaccacauuauaaacaucauguauaggcagucugca

SEQ ID NO: 117657 - RNA, 64 nt, hsa
ugucaaauuuuuuuucuuagaaguagucuucauuauuauaaauuuguacaccaaaaggccaugg

SEQ ID NO: 117658 - RNA, 64 nt, hsa
aggacugguuccuggacccauuccauuaaacuacauuauaaaccuuguugccuucacccuucag

SEQ ID NO: 117659 - RNA, 64 nt, hsa
agauucucuacaguaagcauguguuacauuuguaauuauaaaaguaaguaaacuucauuuauga

SEQ ID NO: 117660 - RNA, 64 nt, hsa
uggcuaaauaucuguugcauguacuuuaaaguuuauuauaaaauauaaacagauauauaaagau

SEQ ID NO: 117661 - RNA, 64 nt, hsa
guuugaaaugugcauagauaugcaugucuauauaauuauaaaugcauguguauauauaugcaaa

SEQ ID NO: 117662 - RNA, 64 nt, hsa
caagugcaaaagaaaaaacauuuuagaaacggacagcuuauaaaaauaaagggaagaaaggagg

SEQ ID NO: 117663 - RNA, 64 nt, hsa
cucccuuugugugcauacgccucuuguucaugucagcuuauaugugacacugcagcagaaaggc

SEQ ID NO: 117664 - RNA, 64 nt, hsa
ugugauaauagagaauuuuauuuauuuuuaugccagcuuauauugugagaacacauuuagucag

SEQ ID NO: 117665 - RNA, 64 nt, hsa
aauaucuauuccguauuagaaauagcuaguugacagcuuauacuucucaaaauucauauuguua

SEQ ID NO: 117666 - RNA, 64 nt, hsa; identical to SEQ ID NO: 38403

SEQ ID NO: 117667 - RNA, 64 nt, hsa; identical to SEQ ID NO: 38404

SEQ ID NO: 117668 - RNA, 64 nt, hsa; identical to SEQ ID NO: 38405

SEQ ID NO: 117669 - RNA, 64 nt, hsa; identical to SEQ ID NO: 38406

SEQ ID NO: 117670 - RNA, 64 nt, hsa; identical to SEQ ID NO: 38407

SEQ ID NO: 117671 - RNA, 64 nt, hsa; identical to SEQ ID NO: 38408

SEQ ID NO: 117672 - RNA, 64 nt, hsa; identical to SEQ ID NO: 38409

SEQ ID NO: 117673 - RNA, 64 nt, hsa; identical to SEQ ID NO: 38410

SEQ ID NO: 117674 - RNA, 64 nt, hsa; identical to SEQ ID NO: 38411

SEQ ID NO: 117675 - RNA, 64 nt, hsa; identical to SEQ ID NO: 38412

SEQ ID NO: 117676 - RNA, 64 nt, hsa; identical to SEQ ID NO: 38413

SEQ ID NO: 117677 - RNA, 64 nt, hsa; identical to SEQ ID NO: 38414

SEQ ID NO: 117678 - RNA, 64 nt, hsa; identical to SEQ ID NO: 38415

SEQ ID NO: 117679 - RNA, 64 nt, hsa; identical to SEQ ID NO: 38416

SEQ ID NO: 117680 - RNA, 64 nt, hsa; identical to SEQ ID NO: 38417

SEQ ID NO: 117681 - RNA, 64 nt, hsa; identical to SEQ ID NO: 38418

SEQ ID NO: 117682 - RNA, 64 nt, hsa; identical to SEQ ID NO: 38419

SEQ ID NO: 117683 - RNA, 64 nt, hsa; identical to SEQ ID NO: 38420

SEQ ID NO: 117684 - RNA, 64 nt, hsa; identical to SEQ ID NO: 38421

SEQ ID NO: 117685 - RNA, 64 nt, hsa; identical to SEQ ID NO: 38422

SEQ ID NO: 117686 - RNA, 64 nt, hsa; identical to SEQ ID NO: 38423

SEQ ID NO: 117687 - RNA, 64 nt, hsa; identical to SEQ ID NO: 38424

SEQ ID NO: 117688 - RNA, 64 nt, hsa; identical to SEQ ID NO: 38425

SEQ ID NO: 117689 - RNA, 64 nt, hsa; identical to SEQ ID NO: 38426

SEQ ID NO: 117690 - RNA, 64 nt, hsa; identical to SEQ ID NO: 38427

SEQ ID NO: 117691 - RNA, 64 nt, hsa; identical to SEQ ID NO: 38428

SEQ ID NO: 117692 - RNA, 64 nt, hsa; identical to SEQ ID NO: 38429

SEQ ID NO: 117693 - RNA, 64 nt, hsa; identical to SEQ ID NO: 38430

SEQ ID NO: 117694 - RNA, 64 nt, hsa; identical to SEQ ID NO: 38431

SEQ ID NO: 117695 - RNA, 64 nt, hsa; identical to SEQ ID NO: 38432

SEQ ID NO: 117696 - RNA, 64 nt, hsa; identical to SEQ ID NO: 38433

SEQ ID NO: 117697 - RNA, 64 nt, hsa; identical to SEQ ID NO: 38434

SEQ ID NO: 117698 - RNA, 64 nt, hsa; identical to SEQ ID NO: 38435

SEQ ID NO: 117699 - RNA, 64 nt, hsa; identical to SEQ ID NO: 38436

SEQ ID NO: 117700 - RNA, 64 nt, hsa
uuaacaaugaagauuucauggacauccuacacuucaggauuacuugacuaucucaaacacauaa

SEQ ID NO: 117701 - RNA, 64 nt, hsa
uaaccaguugaucucugugccaaauacauuauaucaggauuacacaaaaaguaucacaaaggau

SEQ ID NO: 117702 - RNA, 64 nt, hsa
agauuccacugauugacauuugauaaauaaacaucaggauuauguuuauuguuuguuuucaguc

SEQ ID NO: 117703 - RNA, 64 nt, hsa
cccaucuaaauuucuugaguuccugaauuuugaacaggauuaccuggagccuggagccacuuua

SEQ ID NO: 117704 - RNA, 64 nt, hsa
cagggauaacacuucccaaaucauuuugugaggccaggauuacccuaauaccaaagccaggcaa

SEQ ID NO: 117705 - RNA, 64 nt, hsa
agaauggaaaaggagucugagaucuguacuguuucaggauuacaaaggaaucaggauuuagccu

SEQ ID NO: 117706 - RNA, 64 nt, hsa
auccagauuguuuuuaccacaugaugacgugacucaggauuaaauccugagcuacaguuucaaa

SEQ ID NO: 117707 - RNA, 64 nt, hsa
caaugcuguuaaacaugguaagacugagguucugcaggauuaaagucagauuaaggguacagaa

SEQ ID NO: 117708 - RNA, 64 nt, hsa
gaaagucaauaaaauagauaauuuaacaaaaguacaggauuagaacaugcuuauaccuauaaau

SEQ ID NO: 117709 - RNA, 64 nt, hsa
augucaugaaggcuugaggucagccuacagauaacaggauuauuacaaggaugaauuuccacuu

SEQ ID NO: 117710 - RNA, 64 nt, hsa
agggaagauacauacauauaugagguacaguuuuugaauguacugguaaugccuaauguggucu

SEQ ID NO: 117711 - RNA, 64 nt, hsa
uaaaaacuuguauaguugucuagauuucugcaccugaauguauguuugaugcuuugauuugaaa

SEQ ID NO: 117712 - RNA, 64 nt, hsa
auguggguggaccccguccagucuguugaaggccugaauguaacaaaagggcuuauucuuccuc

SEQ ID NO: 117713 - RNA, 64 nt, hsa
ccaccucaggccucacacuuucccaugaaaagggugaauguauauaaccugagcccucuccauu

SEQ ID NO: 117714 - RNA, 64 nt, hsa
ugaagaugaaugaauguaacuccuggugugaagaugaauguaaacccuggcgacaguugagacc

SEQ ID NO: 117715 - RNA, 64 nt, hsa
ccacggcagagagcagcgccgaugugaagaugaaugaauguaacuccuggugugaagaugaaug

SEQ ID NO: 117716 - RNA, 64 nt, hsa
guuuaagauauguuuggugaccaaaacguaugugugaauguaguuauaaugcuuuugaaaaauu

SEQ ID NO: 117717 - RNA, 64 nt, hsa
cagauuuagauucuuccuggggauuacacagcuaugaauguauuugcuucuaaaaccucccaaa

SEQ ID NO: 117718 - RNA, 64 nt, hsa
gcucuaugaauguacauggaaugaccaggcucuaugaauguacauggaaaaccccuaaaaaucc

SEQ ID NO: 117719 - RNA, 64 nt, hsa
gcaacaaggacuccucgcugcugaccaggcucuaugaauguacauggaaugaccaggcucuaug

SEQ ID NO: 117720 - RNA, 64 nt, hsa
uuacauagcacuugauacguguuaaaugaacauaugaauguaauuuauauauuccuagaauuua

SEQ ID NO: 117721 - RNA, 64 nt, hsa
uagcagcucaauuuguacuacuucagccaaucugugaauguaaaaacuacacuguugccuugcu

SEQ ID NO: 117722 - RNA, 64 nt, hsa
agcgcaucaccugaaugucgugaagaaguaucucugaauguauccaggagaggaacugcauaac

SEQ ID NO: 117723 - RNA, 64 nt, hsa
gccaugcacccgcccagccaccacgucccccgcaugaauguacuguacacuuucaauccucccc

SEQ ID NO: 117724 - RNA, 64 nt, hsa
gauaucuuuguccauauacccagguguccugauuugaauguacuauuugauccucauuguguuc

SEQ ID NO: 117725 - RNA, 64 nt, hsa
uugcugucuuuuuacacuguaugcgguuuggaaaugaauguagaaacuuacugugggcauuuac

SEQ ID NO: 117726 - RNA, 64 nt, hsa
aaggaaucauuggugaacuuuccaagguuauuucugaauguaacaauuuccuuaaaaaugacuu

SEQ ID NO: 117727 - RNA, 64 nt, hsa
agaauagauuaauaaauuggcuauguuguuccaaugaauguacagcacuuccauuaacuuuuga

SEQ ID NO: 117728 - RNA, 64 nt, hsa
aaacuuuauaaucgucauuguucaaccaagauuuugaauguaauaagaugaauauauuccuuac

SEQ ID NO: 117729 - RNA, 64 nt, hsa
ggcaaauaagaauguuugagcacacugcccacaaugaauguaacuauuuucuaaacacuuuacu

SEQ ID NO: 117730 - RNA, 64 nt, hsa
cuaucagaaauuguaagagaauagauacauguuuugaauguaaaguugaaaagucugguuuacu

SEQ ID NO: 117731 - RNA, 64 nt, hsa
ccuaguaagugccacuuccacuaagaauacaguuugaauguauaaucaguaguguuuacaagau

SEQ ID NO: 117732 - RNA, 64 nt, hsa
augugauagugccgugaauguauucuacuggaaaugaauguaauaauacauuaaauuuuuaaaa

SEQ ID NO: 117733 - RNA, 64 nt, hsa
ccaguucaaaagaauaguagaugugauagugccgugaauguauucuacuggaaaugaauguaau

SEQ ID NO: 117734 - RNA, 64 nt, hsa
cuucuguuugugaagaaaaaaacaaguuaaaaacugaauguacugauuuagaaaauauauauaa

SEQ ID NO: 117735 - RNA, 64 nt, hsa
aaaaacacacauucagccaaccacuuauaugaauugaauguaucagaaguguacugaagggacu

SEQ ID NO: 117736 - RNA, 64 nt, hsa
aacacuuaaaucuaacagaggauuuucagaguagugaauguaaggaaagcuuaauggaucucuc

SEQ ID NO: 117737 - RNA, 64 nt, hsa
agcaucaaagaauucacacaggagagaaagcacaugaauguaaugaauguggaaaagcuuucag

SEQ ID NO: 117738 - RNA, 64 nt, hsa
agcaucacaaaaugcauaggaaagagaaaucguaugaauguaaugaguaugagggcaguuucag

SEQ ID NO: 117739 - RNA, 64 nt, hsa
ucaacaucagagcauucauaccaaagagaacucaugaauguaaugaagaugggaagauauuuau

SEQ ID NO: 117740 - RNA, 64 nt, hsa
gcuuauauugacaacaaaucaucucgcuaaagagugaauguaggccaggcgcgguggcucaugc

SEQ ID NO: 117741 - RNA, 64 nt, hsa
cgucucaaaaaaaaaaaaaaaaaaaaaaaaagagugaauguaauagucuugcagaaaaugaaug

SEQ ID NO: 117742 - RNA, 64 nt, hsa
uuuacaauuucaaauguuacccugauuguuuauaugaauguagaacaccuugacauuucuuuuu

SEQ ID NO: 117743 - RNA, 64 nt, hsa
gcaagccauuuaauccgguucuuggagaaacauaugaauguauucgggaggacaagggcuucca

SEQ ID NO: 117744 - RNA, 64 nt, hsa
uuugggauacuaaaguaguuuaagucuccuuuacugaauguaagggggggaucgaaaagaaggu

SEQ ID NO: 117745 - RNA, 64 nt, hsa
ggaccuagcuguuguaaagaauuggucuuaauguugaauguauuuugguugcugauguuuauaa

SEQ ID NO: 117746 - RNA, 64 nt, hsa
ucauuuggguuugaggguguguuauuuugagucaugaauguacaagcucugugaaucagaccag

SEQ ID NO: 117747 - RNA, 64 nt, hsa
cguucuggcuaacacuguuggaccugacccacacugaauguagucuuucaguacgagacaaagu

SEQ ID NO: 117748 - RNA, 64 nt, hsa
cagguaaauugucgggggagagaguuagcauguaugaauguaaggaugagggaagcgaagcaag

SEQ ID NO: 117749 - RNA, 64 nt, hsa
aagugcccacauuugauggaggguggaaauaauuugaauguauuugauuuauaaguuuuuuuuu

SEQ ID NO: 117750 - RNA, 64 nt, hsa
aaucuguugucauguuaguaaaugauuugaaaacugaauguaauacuugaguagauuuuuuuuu

SEQ ID NO: 117751 - RNA, 64 nt, hsa
gacauagaguaaacaucuuaguaauauauuaaagugaauguaaauggugguuaaaauuacauua

SEQ ID NO: 117752 - RNA, 64 nt, hsa
cuucuaaccccaguagaguagaacuaaauugcacugaauguauaguuaacucugucuugaauuc

SEQ ID NO: 117753 - RNA, 64 nt, hsa
auaauuuuuugucauuugucuuuauguccagcuaugaauguagauuuugugucccgacagcccu

SEQ ID NO: 117754 - RNA, 64 nt, hsa
aacaccagugaauuuacacugcaaagaaaaacuaugaauguauggaauuuuuuaaaaagaagua

SEQ ID NO: 117755 - RNA, 64 nt, hsa
aauacucuuguaggagaaaaagcaacuguauaaaugaauguagagugacuuucugcaauauuuc

SEQ ID NO: 117756 - RNA, 64 nt, hsa
guuacucugguucuuuguuuuaaaauaaaaauucugaauguacacgacauuaugggcuuauuua

SEQ ID NO: 117757 - RNA, 64 nt, hsa
agucaaugugcaguguagcccacacuugagaggaugaauguaugugcacugucacuuugcucug

SEQ ID NO: 117758 - RNA, 64 nt, hsa
gguuuauuuugaugaaaguucuuuuaacaugucuugaauguacacauaaaggaauccaaagcuu

SEQ ID NO: 117759 - RNA, 64 nt, hsa
acagagcuauguaaagggacuuaggagaaaaugcugaauguaagauggucccauuucaauuucc

SEQ ID NO: 117760 - RNA, 64 nt, hsa
uuuuuuuaauacauauccaauaaugccuuccaucugaauguaaaauaaguacccaugauuucua

SEQ ID NO: 117761 - RNA, 64 nt, hsa
uggcuacgcagggaugggcaguugcacgaaggcaugaauguauuguaaauaaguaacuuugacu

SEQ ID NO: 117762 - RNA, 64 nt, hsa
auaauuuguuaacacuagaaaccuauuaguauugugaauguagauuuuacugugaagcuaucug

SEQ ID NO: 117763 - RNA, 64 nt, hsa
ugccauuuuaccagcauuauuguaguuuaaugauugaauguagacagggauaugcguauaguuu

SEQ ID NO: 117764 - RNA, 64 nt, hsa
cauuagggcuugcagacaaugucaccuaaauugcugaauguacucauuauaauaugauaucuga

SEQ ID NO: 117765 - RNA, 64 nt, hsa
cuuugcaguaaguaucauguaaauaugcaaauguugaauguaauauagauuguguccucauuga

SEQ ID NO: 117766 - RNA, 64 nt, hsa
ggaaaggaguuugaaugugucuauuuuuuucuagugaauguauuuuaaccacaguguccuaaac

SEQ ID NO: 117767 - RNA, 64 nt, hsa
augaaguagaggugacucucucugugguacacauugaauguacuauguauguucaaguauucag

SEQ ID NO: 117768 - RNA, 64 nt, hsa
cugcggcucagccuugcacacccacugccccgugugaauguagcuuccaccucauggauugcca

SEQ ID NO: 117769 - RNA, 64 nt, hsa
acaucuacauuuuuuaaaacugaaucuuaaucgaugaauguaaacucgggggugcuggggccag

SEQ ID NO: 117770 - RNA, 64 nt, hsa
uucugaauagaugaaagcauaaaaugugagaaacugaauguauuauucaggaagaauacugagu

SEQ ID NO: 117771 - RNA, 64 nt, hsa
ggaagaauacugagugccuucauuuaacuaaaguugaauguaaaagucaauuugcacuucuuua

SEQ ID NO: 117772 - RNA, 64 nt, hsa
agaucuuaacaauuccaauagaagagaagacauaugaauguaaggaaugugggaaaaucuuggc

SEQ ID NO: 117773 - RNA, 64 nt, hsa
uucagcugugaucucacaagugugaaaaaucuuaugaauguaaaauguguggagauucuucuuu

SEQ ID NO: 117774 - RNA, 64 nt, hsa
uucauaaaaggacacacacuggagagaaacccugugaauguaagaaauguagaaaagcauucca

SEQ ID NO: 117775 - RNA, 64 nt, hsa
uacaugaaaggaugcacagaggagagaagcucugugaauguaagcauugugggaaagcauucau

SEQ ID NO: 117776 - RNA, 64 nt, hsa
uacaugcaagaacacacaauggagagaaacccuaugaauguaaagaaugcagaaaagcauucag

SEQ ID NO: 117777 - RNA, 64 nt, hsa
ugcauggaaggacucacacuggagaaaaacccuaugaauguaagcaguaugggaaagcguucag

SEQ ID NO: 117778 - RNA, 64 nt, hsa
uucagaccugacaagauucuuugaauacagauaaugaauguaaacaauuaacuguuuauaauaa

SEQ ID NO: 117779 - RNA, 64 nt, hsa
uuuaugaaaggacacacacuggagagaaacccuaugaauguaagaaauguggaaaagcguucca

SEQ ID NO: 117780 - RNA, 64 nt, hsa
aauacaugcaaaacacacacuggagagaaaccuaugaauguaaggaaugcaaacaagcauucaa

SEQ ID NO: 117781 - RNA, 64 nt, hsa
uacaugaaaggacucauacgagagagaauccguaugaauguaaggauugugggaaagcauucag

SEQ ID NO: 117782 - RNA, 64 nt, hsa
uagacauguaaagacacaccagaaggaaacccuaugaauguaagcaauguggcaaaagcuuuca

SEQ ID NO: 117783 - RNA, 64 nt, hsa
ugcauggaagcacucacacuuggcagaaacucuaugaauguaagcaguaugggaaagccuucag

SEQ ID NO: 117784 - RNA, 64 nt, hsa
uucagaucggcuaggauucuuugaauacaaauaaugaauguaaacaauuaacuguuuauaauaa

SEQ ID NO: 117785 - RNA, 64 nt, hsa
agcaaagccauucuuaagagucgugagguccuucugaauguaaaacuggagcccaggagaagcu

SEQ ID NO: 117786 - RNA, 64 nt, hsa
auaauuaacuuaauuggagaugcauuaggucacuugaauguauaagcaagcaccuaugguaggc

SEQ ID NO: 117787 - RNA, 59 nt, hsa; identical to SEQ ID NO: 58889

SEQ ID NO: 117788 - RNA, 64 nt, hsa
uucaugugagaagucacacaggggagaaacccuaugaauguaauaaaugugggaaagccuuuuc

SEQ ID NO: 117789 - RNA, 64 nt, hsa
uacauaugagaagucauacuggugagaaacccuuugaauguaaugaaugugggaaagcauucuc

SEQ ID NO: 117790 - RNA, 64 nt, hsa
aacacaucagaaaucucacuggagagaaacuguaugaauguagagaaucugggaauaccuuucu

SEQ ID NO: 117791 - RNA, 64 nt, hsa
ugaagacaugaaaacucacuggggagaaacccuaugaauguaaaaauguggaagcaacuuugua

SEQ ID NO: 117792 - RNA, 64 nt, hsa
uacaugaacgaauucauacuggagagaaacccuaugaauguaaagaauguggaaaacccuucag

SEQ ID NO: 117793 - RNA, 64 nt, hsa
uacaugaaagaacccacacuggagagaaaccuuaugaauguaaacagugugguaaagccuucag

SEQ ID NO: 117794 - RNA, 64 nt, hsa
gacaugaaaggaugcacacugcaaagaaacaguaugaauguaaaaaaugugggaaaacauacau

SEQ ID NO: 117795 - RNA, 64 nt, hsa
aacaugagaggaaucacacugcacagaaacacuaugaauguaaacugugugggaaaacuuacuu

SEQ ID NO: 117796 - RNA, 64 nt, hsa
cacaugaaagaacucacacuggagaaaaacccuaugaauguaaaaaaugugggaaaguguucgu

SEQ ID NO: 117797 - RNA, 64 nt, hsa
cacaugaaaggaaucacacuguacagaaacgcuaugaauguaaacaauguggaaaaaccuacau

SEQ ID NO: 117798 - RNA, 64 nt, hsa
agauagaaauaauucucauuggagauaaacccuaugaauguaaacacauaguaaagccuuaauu

SEQ ID NO: 117799 - RNA, 64 nt, hsa
uacaugaaaggauucacucuggagagaagucauaugaauguaagaaauguagaaaagcauugag

SEQ ID NO: 117800 - RNA, 64 nt, hsa
aaaaauaaaaaaaaagaaaaagaaauaaacucuaugaauguaaaccauguggugaaggcuuaag

SEQ ID NO: 117801 - RNA, 64 nt, hsa
gacaugaaagaacucauaccgcaaagaagcuaugugaauguaaggaauguggaaaagcauugag

SEQ ID NO: 117802 - RNA, 64 nt, hsa
aacaugaaaggauucacacuggagagaagccguaugaauguaaggaaugcaggaaagcauucuc

SEQ ID NO: 117803 - RNA, 64 nt, hsa
aucaugagacaacucauaugggagagaagccauaugaauguaaauaaugugggaaagcauuugg

SEQ ID NO: 117804 - RNA, 64 nt, hsa
gacgugaaaccacucacagugcagagaaaccccaugaauguaagcaaugugggaaagcauuuga

SEQ ID NO: 117805 - RNA, 64 nt, hsa
gacaugaaagaacacguacuggggagaaacuguaugaauguaagcaguguucuaaagccuuccc

SEQ ID NO: 117806 - RNA, 64 nt, hsa
ugcaugaaagaacucacucuggagagaaacuauaugaauguaagcaguguucuaaagccuuuca

SEQ ID NO: 117807 - RNA, 64 nt, hsa
acauaauuuauucuagguaaaauuuagauuguagugaauguaggaaguucuucagcacuugagc

SEQ ID NO: 117808 - RNA, 64 nt, hsa
aucuucagcaaauuccuaugagagaauaauguaaugaauguaggaaaaucuuuagccuuaucug

SEQ ID NO: 117809 - RNA, 64 nt, hsa
gaauagcauauagagaauaaucauguugacuuugugaauguagaaaagcuuuuaucuauuacac

SEQ ID NO: 117810 - RNA, 64 nt, hsa
aacaucaaagaauuccuacuggugagaaacccuaugaauguaaugaaugugagaaggccucuuc

SEQ ID NO: 117811 - RNA, 64 nt, hsa
aacaucagacaauucacacuggugacaaacccuaugaauguaaagauuguaaaaaagcuuuucu

SEQ ID NO: 117812 - RNA, 64 nt, hsa
aacaucaaagaauucauaccagugugaaacccuaugaauguaaggaauguguaaagaccuuuac

SEQ ID NO: 117813 - RNA, 64 nt, hsa
gacaucagagaauucacaguggggagaaacccuaugaauguaaugaaugugggaaugccuucau

SEQ ID NO: 117814 - RNA, 64 nt, hsa
ugagcccccuuuucuggacaccaacuguguccugugaauguaucgcuacugugagcuguucccg

SEQ ID NO: 117815 - RNA, 64 nt, hsa
cagugucggggcugagccccuugagcugcuucagugaauguacagugcccggcacgagcugaac

SEQ ID NO: 117816 - RNA, 64 nt, hsa
ccagagucguaauugaaaucuaggaagucucgcuugaauguaugcgauacauauuuucacuacg

SEQ ID NO: 117817 - RNA, 64 nt, hsa
uuaaagguagaguuaacagaauauacugguggacugaauguagguugagagaggaagcgagaag

SEQ ID NO: 117818 - RNA, 64 nt, hsa
cgcccccuccggggcugagccugggucugaagacugaauguaacaggggccgcuggcacuccug

SEQ ID NO: 117819 - RNA, 64 nt, hsa
guguuguuuuuguaucaauauguuugugcagugaugaauguauuuauuucucagacuuggggcg

SEQ ID NO: 117820 - RNA, 64 nt, hsa
ucuaacaacuguggagauuugagggaauguguggugaauguaaaauaccuaguuuacuugccag

SEQ ID NO: 117821 - RNA, 64 nt, hsa
uuuugguguuccaaugaaucugggauguaaacucugaauguauuuauaacuauuuauuucugga

SEQ ID NO: 117822 - RNA, 64 nt, hsa
cacagaaugagcuucgagcuuuguucagacuaaaugaauguaucugggaggggucgggggcacg

SEQ ID NO: 117823 - RNA, 64 nt, hsa
aucugccuuucuuucccccagcccccacccgcuuugaauguagagacccgugggcacuuuuccu

SEQ ID NO: 117824 - RNA, 64 nt, hsa
cuauagcaguacaaugauuaguaauguaaaaauuaacacagaaauuaaccuaaggaaugaaggg

SEQ ID NO: 117825 - RNA, 64 nt, hsa
uuuugaugaagacagaauuauuuuucucuguagaaacacagauaccacuuuaucagggaaguua

SEQ ID NO: 117826 - RNA, 64 nt, hsa
uuucuuucuuaguccaguuguguugacacauaugaacacagacaaagugcuaugcggaggaaag

SEQ ID NO: 117827 - RNA, 64 nt, hsa
cuugaaaggccaacagcaaguguuugugggacacaacacagauaauuuuuucuuaagucggcca

SEQ ID NO: 117828 - RNA, 64 nt, hsa
gaacagagggacagaagaauaaguaacacucccaaacacagacauacuuuuguagaaguggacc

SEQ ID NO: 117829 - RNA, 64 nt, hsa
cauugagccaaguuuguauagcaagaauuugggaaacacagauggccugagauaagcaguacaa

SEQ ID NO: 117830 - RNA, 64 nt, hsa
uggcucuggaaagcugaaagggcugcacuggaacaacacagaugagauauucuacacauuaauc

SEQ ID NO: 117831 - RNA, 64 nt, hsa
cugagauggaaaacaagcccuuuauugaauuuucaacacagacucccugcuucucaucuccuua

SEQ ID NO: 117832 - RNA, 64 nt, hsa
acuauccaugaagcagcgcugcaugucacuagguaacacagauccauccagaugguguuuacau

SEQ ID NO: 117833 - RNA, 64 nt, hsa
caguggguuggaaguuuuguauauuuauuguauuaacacagagugucauaaaauaaaaugcugu

SEQ ID NO: 117834 - RNA, 64 nt, hsa
auaagacauaaauaguuaucauuuuaauugcaauaacacagacaaguaguuaaugaugauaaca

SEQ ID NO: 117835 - RNA, 64 nt, hsa
aaaagccugcucaauuuggagaaauagaaccacaaacacagaucacaggggccuuacaaaguuu

SEQ ID NO: 117836 - RNA, 64 nt, hsa
ucaaacacugaucacaaauaaacugcuuuguuguaacacagaguacugccugguuccugaugca

SEQ ID NO: 117837 - RNA, 64 nt, hsa
agaagcuaauuccuauugaacaacaauacaguacaacacagaauguuagagaaaaagccuuuuu

SEQ ID NO: 117838 - RNA, 64 nt, hsa
aagaaaggaaaacuacagaucaauauuuccauugaacacagaugcagaaauccucaaaauauua

SEQ ID NO: 117839 - RNA, 64 nt, hsa
caaaauccaauauccauucauguuaaaaccucucaacacagaaggaauacaggagaacuuacuc

SEQ ID NO: 117840 - RNA, 64 nt, hsa
ucaaaaugcagagaauggaaaacagugaacggaaaacacagaguaaacccuagugucaacucug

SEQ ID NO: 117841 - RNA, 64 nt, hsa
caaaauccaauauccauucaugauaaaaccucucaacacagaaggaauacaggagaacuuacuc

SEQ ID NO: 117842 - RNA, 64 nt, hsa
aagaaaggaaaacuacagaucaauauuuccagugaacacagaugcagaaauccuuaaaauguua

SEQ ID NO: 117843 - RNA, 64 nt, hsa
gcaaguucuauuuguucauugcuugccagagaugaacacagaauguucuguuucauuuuacaag

SEQ ID NO: 117844 - RNA, 64 nt, hsa
aauuuuaguagaaucaggcacugcucgcagaaggaacacagauuguagagauuaacauaaauug

SEQ ID NO: 117845 - RNA, 64 nt, hsa
gcaucuggcauccaaagcaacaucagagagagagaacacagaagaaaagcaauugccccagguc

SEQ ID NO: 117846 - RNA, 64 nt, hsa
ggauugggaguaacagccuuauuaggugaggucaaacacagagcuagcuuucaggagccaaggc

SEQ ID NO: 117847 - RNA, 64 nt, hsa
ucacugcaggcaggcaauccaggcagucguuaaaaacacagagagagguguccuccugaccacc

SEQ ID NO: 117848 - RNA, 64 nt, hsa
ccaggaaccccguaccagccuguugaucaucaauaacacagaaucaaauauugaagauuuuaua

SEQ ID NO: 117849 - RNA, 64 nt, hsa
ccacaguugaaggagggagagaacacgcugugaaaacacagaagcucccagagaagccuucuca

SEQ ID NO: 117850 - RNA, 64 nt, hsa
uuuaucucuggaguagagcagacuauguugagcuaacacagaccugcugaaucagcuucuuucu

SEQ ID NO: 117851 - RNA, 64 nt, hsa
cugcaauugugguauugcaguagagaaagaguuuaacacagagcuagccaagcagaaaggcugg

SEQ ID NO: 117852 - RNA, 64 nt, hsa
gucuggcugguccaacacagauucugccugguccaacacagauucugccugagccuccuuauuu

SEQ ID NO: 117853 - RNA, 64 nt, hsa
uggccacugggcugggcuggagucuggcugguccaacacagauucugccugguccaacacagau

SEQ ID NO: 117854 - RNA, 64 nt, hsa
acauuacaguguacacauuauacacugcaucuuuaacacagagucaccugugacaggcucuagg

SEQ ID NO: 117855 - RNA, 64 nt, hsa
cuccuguuccagcuguaucagauacucguuccgcaacacagaaaugacucagaaucucagacaa

SEQ ID NO: 117856 - RNA, 64 nt, hsa
aaaaugugguacauacacaccagggaauacuauacagccauaaaaaggaacaagacugacuggg

SEQ ID NO: 117857 - RNA, 64 nt, hsa
ucucuauucaauaaaucgugcugggauaacuggccagccauauggaaaagauugaaaauggacg

SEQ ID NO: 117858 - RNA, 64 nt, hsa
cuccugucccagacaaggaagccccucuuuacaucagccauauuaggggaacgguugucagcuc

SEQ ID NO: 117859 - RNA, 64 nt, hsa
gguugucagcuccccaaaugccuacuggauccuacagccauacaggaaaacagacggacacagc

SEQ ID NO: 117860 - RNA, 64 nt, hsa
uccagauguucuucccuggguguugaugucaugacagccauacagugaguuuguucugaaacau

SEQ ID NO: 117861 - RNA, 64 nt, hsa
gaccuuguucuuuacagacaucaugaucagccuccagccauacagaacaaaugagaaauuagaa

SEQ ID NO: 117862 - RNA, 64 nt, hsa
uaucuuuccaguggcuaaaccacuuaaccucucuggguguuaccugcucauuuguuuaaaaaaa

SEQ ID NO: 117863 - RNA, 64 nt, hsa
cuuagcaucucagcucuucugcaaggaagagcuuggguguuaggccucagaggcuguagggucc

SEQ ID NO: 117864 - RNA, 64 nt, hsa
agcuuuguugacagaucagaaauaagauugacuuggguguuauauuucaucucucuccagacuc

SEQ ID NO: 117865 - RNA, 64 nt, hsa
aauuuagaaaccacaggauaguguacccacagauggguguuaucaaggccagucaugaggaugg

SEQ ID NO: 117866 - RNA, 64 nt, hsa
aggcugagaagcaggagauccaagcuccaguccuggguguuacccugaggggggaagucacuuc

SEQ ID NO: 117867 - RNA, 64 nt, hsa
uguggcaaugcagaagcugauagcauuaacagcaggguguuacagcauaauuguuaauucgcac

SEQ ID NO: 117868 - RNA, 64 nt, hsa
ugccgcacauugucaaguuagaaauacuccagguggguguuagcacugugguggucucuggucc

SEQ ID NO: 117869 - RNA, 64 nt, hsa
uuucuuagguacagcaauaguugauaggaugugaggguguuaccuuggggugaaguggagaagg

SEQ ID NO: 117870 - RNA, 64 nt, hsa
gcugacaucaauucuaagacucauccuaauugagggguguuaaaaagugugcugcuuagaauga

SEQ ID NO: 117871 - RNA, 64 nt, hsa
aauguacuacuaaagagcacuaguugugaauuuaggguguuaaacuuuuuaccaaguacaaaaa

SEQ ID NO: 117872 - RNA, 64 nt, hsa
uuauauauagauagaagacuguacaauuugagccggguguuaggccagcuauuuuccuuuuccu

SEQ ID NO: 117873 - RNA, 64 nt, hsa
uuuuucaguuaauaacauauuuggggguggggugggguguuacuuuguguucuuccuccuuagc

SEQ ID NO: 117874 - RNA, 64 nt, hsa
uuauaauaaaaaucaucuauacaaaagaaguccuggguguuaauauuuugcacaagaucuguuu

SEQ ID NO: 117875 - RNA, 64 nt, hsa
cagggaagcacacccaaagaauuuucaaaggaaaggguguuauagugcaauagcaauuaaaaua

SEQ ID NO: 117876 - RNA, 64 nt, hsa
uucacuuuuaauuugcugguguuuuaauaaauggggguguuacugaaucuuucuucccacuucc

SEQ ID NO: 117877 - RNA, 64 nt, hsa
gauugagaagcacaacugaaaccaguagccgcugggguguuaaugguagcauucuucuuuuggc

SEQ ID NO: 117878 - RNA, 64 nt, hsa
caucaccuucuggaauaucacccuggaggaugaaggguguuacaugugucucuucaauaccuuu

SEQ ID NO: 117879 - RNA, 64 nt, hsa
uugagggccaggaaagagaaggaaugucaugccaggguguuacuccucaccaaaacuuggcagu

SEQ ID NO: 117880 - RNA, 64 nt, hsa
ucauuuauuuuugauguagaauuuacauugccauggguguuaaauaagcuuugagucaaaaguc

SEQ ID NO: 117881 - RNA, 64 nt, hsa
gauacuaagacuugaauuuuuuggggacuauuaaggguguuagucuuggagaagacacagccuc

SEQ ID NO: 117882 - RNA, 64 nt, hsa
ccagcacaagguaguaaucuagugacagagaacaggguguuauggggagcauaugagaggccau

SEQ ID NO: 117883 - RNA, 64 nt, hsa
aguguauuucuuugcuuuguagaguauuuuuauuggguguuaacuuugacagcugagagugggc

SEQ ID NO: 117884 - RNA, 64 nt, hsa
cuuucuucucugcugccccauggcuaagcuuuauggguguuaauugaaauuuauacaccaauug

SEQ ID NO: 117885 - RNA, 64 nt, hsa
gacaugucauucuguagacuagaauuucuuaaaaggguguuacugaguuauaagcucacuaggc

SEQ ID NO: 117886 - RNA, 64 nt, hsa
uaagugaaaaggucauagcugagauuccugguucggguguuacgcacacguacuuaaaugaaag

SEQ ID NO: 117887 - RNA, 64 nt, hsa
agggaagccccacauguccagcaccuugugccugggguguuaguggcaccgccuccccaccucc

SEQ ID NO: 117888 - RNA, 64 nt, hsa
uauuuucaguugauuuuauuuuauauuccuaaugggguguuaaagccguuuuuuauuuuuuucu

SEQ ID NO: 117889 - RNA, 64 nt, hsa
agugaguaggccugcuguauuucuuguaacugcuggguguuacaaaauaaguuacaauguuuua

SEQ ID NO: 117890 - RNA, 64 nt, hsa
cauggucucuucucugaggauugagguuuacaaaggguguuagcagaugcgaaguaaagaacgu

SEQ ID NO: 117891 - RNA, 64 nt, hsa
uguuuuauccaaauaguaaagagaugugaugguaggguguuaaguagauuaguugagaacacua

SEQ ID NO: 117892 - RNA, 64 nt, hsa
gacuguuuaguagcagugauugucuuaauauuguggguguuaauuuuugauacuaagcauugaa

SEQ ID NO: 117893 - RNA, 64 nt, hsa
cauguuaaaaaaggaacaguauucuuuauuuucuggguguuauauuuaaaaaagcaaguuugga

SEQ ID NO: 117894 - RNA, 64 nt, hsa
guuccaguaaaauucuucugaccgaaaccaauguggguguuagaaaaauuaccauauagcuuaa

SEQ ID NO: 117895 - RNA, 64 nt, hsa
gaagaggaugcuuugcugcugcugaaguguaccuggguguuagauuucagauccugggcugagc

SEQ ID NO: 117896 - RNA, 64 nt, hsa
cuuaaggugccuuuuuaauucccuacaguuuuauggguguuaucagugcuggagaaucauguag

SEQ ID NO: 117897 - RNA, 64 nt, hsa
gcucagaagaauuuaaguucuauucagccuuccuggguguuagaaccuagauucaaaauggcuu

SEQ ID NO: 117898 - RNA, 64 nt, hsa
cuguuugugaucaguaaagcuaccacagauauaaggguguuaugcugaauccugagaagcuuuc

SEQ ID NO: 117899 - RNA, 64 nt, hsa
uguuaugguucucuuuuauugaugggcaugcaguggguguuacuuggaaauggccaauuuuuau

SEQ ID NO: 117900 - RNA, 64 nt, hsa
cagcaucucugauguugcaacauacguguaaaauggguguuacaucuauccugccauuuaaccc

SEQ ID NO: 117901 - RNA, 64 nt, hsa
uucucaguguauuuuuguaaaaaauauauaaaggggguguuaaucgguguaaaucgcuguuugg

SEQ ID NO: 117902 - RNA, 64 nt, hsa
cucuguugagaaauuuauuuaauguaaggaacuuggguguuaauaguugagagcuguuuaguaa

SEQ ID NO: 117903 - RNA, 64 nt, hsa
gaaacauaaagaggaaauuacagcacagugugguggguguuacgggaaguccaaccccagcauu

SEQ ID NO: 117904 - RNA, 64 nt, hsa
ccugccucgggaguucugaccggguuccccagcaggguguuaagccucugucucuggcccuacc

SEQ ID NO: 117905 - RNA, 64 nt, hsa
aggcccaggucaaggucuuacuccagcccuuccuggguguuaacuggggacucucuugaccucc

SEQ ID NO: 117906 - RNA, 64 nt, hsa
uaccuccccugcacuggcaaaacacuaugcuuuuggguguuagacugaaauauuuuaagaguau

SEQ ID NO: 117907 - RNA, 64 nt, hsa
aacccugucucuacuaaauauacaaaaauuaguuggguguuauggugcaugccuguaaucccag

SEQ ID NO: 117908 - RNA, 64 nt, hsa
gaagguauaaccuucaugaugaauuacuucuucaggguguuaaggcagugacuuuagaaacaaa

SEQ ID NO: 117909 - RNA, 64 nt, hsa
uaucuuauacugaaaaaaaauuccuuucagauugggguguuagaagugcaccaggucacucuga

SEQ ID NO: 117910 - RNA, 64 nt, hsa
uuuuuuuauuuuuguuuuauuaauuuggggaaagggguguuagcauuagugccaugauaucuac

SEQ ID NO: 117911 - RNA, 64 nt, hsa
uccagcaccacccuugccccaagucuuuuaaccuggguguuagcauuuuaaagagaccccacag

SEQ ID NO: 117912 - RNA, 64 nt, hsa
agagugaaucauccagacuccucauggauaggucggguguuaaaguuguuuugauuauguaccu

SEQ ID NO: 117913 - RNA, 64 nt, hsa
gcgccaaguggagguuguaccuuucagcccuuugggguguuaaaagugucaagggcuggguuug

SEQ ID NO: 117914 - RNA, 64 nt, hsa
ugaaaugaccauaaauauacaaauauaggacacuggguguuauccuuuuuuuaauuuuauucgg

SEQ ID NO: 117915 - RNA, 64 nt, hsa
caguccuugggaaaugaguuuugauggugaauugggguguuaaggaagggaaagauugucauag

SEQ ID NO: 117916 - RNA, 64 nt, hsa
ucaggguauggagcucacaucaguucaucaugguggguguuagagaauucggugacaugccuag

SEQ ID NO: 117917 - RNA, 64 nt, hsa
auuuuguauaugggaggaaauuuauaauuugcauggguguuaggugaacuguuuucauuugcuu

SEQ ID NO: 117918 - RNA, 64 nt, hsa
ucagcgcauacauuggcaugaauuuugugaauuaggguguuaaaaacuggaauugaauuuguac

SEQ ID NO: 117919 - RNA, 64 nt, hsa
gcccauuucuccagaacccauuugagggguggggggguguuaauuuaugcacuuauaagguguu

SEQ ID NO: 117920 - RNA, 64 nt, hsa
ccccuucuuggacacugaaggaaaaggccaacuaggguguuagcccucugggcaccaaggaaac

SEQ ID NO: 117921 - RNA, 64 nt, hsa
uccaguuuuaguauuucacuacaucucaguugguggguguuaagcuagaaugggcugugugaua

SEQ ID NO: 117922 - RNA, 64 nt, hsa
ugagaguugaaacuggaacugggaaaccuaagauggguguuaugguucuuucuccaaggaaaua

SEQ ID NO: 117923 - RNA, 64 nt, hsa
agccucagcucagccucccccugcugcucauccaggguguuacaaggcacuugucacuaugcua

SEQ ID NO: 117924 - RNA, 64 nt, hsa
cacccuuuagaacaggggucuggggguaccccagggguguuaaggcucaggagugggcagcagu

SEQ ID NO: 117925 - RNA, 64 nt, hsa
uguguuauuuaaucccuucaggagcccacaagauggguguuauucucauuuuacagaggaggga

SEQ ID NO: 117926 - RNA, 64 nt, hsa
uagcauuuauuaucacuguggaucucuacuuguuggguguuaugaauucuuugaagaaauauau

SEQ ID NO: 117927 - RNA, 64 nt, hsa
ggaugggcagggaaggaauccugguggaagucuuggguguuagugucagccaugggaaaugagc

SEQ ID NO: 117928 - RNA, 64 nt, hsa
cuguuccucucuuccuguugaugaaggagcgugaggguguuagcagugugagaucuuuggacac

SEQ ID NO: 117929 - RNA, 64 nt, hsa
uuuuuuacauuuggauuuauguuuuuaauaaaagggguguuacacuauuugauugcacuuaauu

SEQ ID NO: 117930 - RNA, 64 nt, hsa
ugaaacuacagaucuuuggaacacuguuuagguaggguguuaagacuuacacaguaccucguuu

SEQ ID NO: 117931 - RNA, 64 nt, hsa
ugaccauuuaaccucagaauucauaauuccugagggguguuaagaagcagucccauuggugagg

SEQ ID NO: 117932 - RNA, 64 nt, hsa
acuuuauuugugaauagugauuguggcauguuugggguguuauuuuaauauuucacgauacuaa

SEQ ID NO: 117933 - RNA, 64 nt, hsa
gcucaagggcuggcacuuuuuuaaauauaaaaauggguguuauuuuuauuuuuauuuguaaagu

SEQ ID NO: 117934 - RNA, 64 nt, hsa
agaaaccacgucuugaugcuucagaguugguuuaggguguuagcugcuaugaaccuguugcccc

SEQ ID NO: 117935 - RNA, 64 nt, hsa
cacuugagaggcgauauugucaacaguauuugaaggguguuagcagaauaaaagacagcuuuag

SEQ ID NO: 117936 - RNA, 64 nt, hsa
uaaauagguucagauuuuacugucuauggauuugggguguuacaguagccuuauucaccuuuuu

SEQ ID NO: 117937 - RNA, 64 nt, hsa
auuuaugauuuauuugaagccacacuguuugcauggguguuacuugucuguaccucagagucug

SEQ ID NO: 117938 - RNA, 64 nt, hsa
ggaggacguggacugggguaggaaaccacccugaggguguuaguaccuaguggugaaacggaug

SEQ ID NO: 117939 - RNA, 64 nt, hsa
ccugguauuuggggggaugaccagcccaggcguuggguguuagucugcaugaguuugugagagg

SEQ ID NO: 117940 - RNA, 64 nt, hsa
ggcucccuccgcagacugacuuuccucugugucuggguguuacagucugugcccacugcauccu

SEQ ID NO: 117941 - RNA, 64 nt, hsa
ccaggcuccaaggacacccucccugcacaugauuggguguuaaugguggccuggguugugucuu

SEQ ID NO: 117942 - RNA, 64 nt, hsa
guauuccuggcccagagggcccuugcuggcuacuggguguuaguuugcaguccugugugcuucc

SEQ ID NO: 117943 - RNA, 64 nt, hsa
guuuaauugaaaaguauucugagacugcaaaaugggguguuaaaaaauacugcaguuacggagc

SEQ ID NO: 117944 - RNA, 64 nt, hsa
aagacugacacaagagcaaauaagcuuuaaaaucggguguuaugugcuuuccuccauuuuugag

SEQ ID NO: 117945 - RNA, 64 nt, hsa
ggguuuccccccuuuuauagauggucacgcaccuggguguuacaaaguuguauguggcaugaau

SEQ ID NO: 117946 - RNA, 64 nt, hsa
cucauuuuuugauuuauuuuuauuuucucuuuguggguguuauauuugaucucuaaaucugaac

SEQ ID NO: 117947 - RNA, 64 nt, hsa
aagucaauccaagagucugaugauuucuugaaaaggguguuagcuaaaggaucuuaggcaugac

SEQ ID NO: 117948 - RNA, 64 nt, hsa
uuguagcauaccuggauauaaugggaaagggccuggguguuacccauguacugaaaaugaacuu

SEQ ID NO: 117949 - RNA, 64 nt, hsa
uaugcacuccccgcuuguguuuacacaagcugugggguguuacgcaugccugcuuuuuucacuu

SEQ ID NO: 117950 - RNA, 64 nt, hsa
ccgcggcacaugcuucccaagguggucccacggaggguguuacugggcaccaguggacucgccc

SEQ ID NO: 117951 - RNA, 64 nt, hsa
uccuugguugguguuuaaagccaacccaagaacaggguguuagguacuguuuuaagcaccuaga

SEQ ID NO: 117952 - RNA, 64 nt, hsa
cuucagccucagugggguuccugauguuuaucuaggguguuacucaagcccaguuugagauuuu

SEQ ID NO: 117953 - RNA, 64 nt, hsa
acaggagcuagcccaaucauacacugacucgcguggguguuaaaauguuuaucaugccuaaggg

SEQ ID NO: 117954 - RNA, 64 nt, hsa
cgugcagcccaugcugaggcugcaguggugucguggguguuacgugcaggaacguggagacccu

SEQ ID NO: 117955 - RNA, 64 nt, hsa
cgaggggagaguccucaucugcuggcauuuugugggguguuagugccaaacuugaauaggggcu

SEQ ID NO: 117956 - RNA, 64 nt, hsa
aggcuguguaugaaaccaaugcccaggguuugaaggguguuagcauccauuucaggggagugug

SEQ ID NO: 117957 - RNA, 64 nt, hsa
aggaacaagacagauccugacauagcuuuggccuggguguuaggucagaaggaguacuggugcg

SEQ ID NO: 117958 - RNA, 64 nt, hsa
aacaaagggcaugugugagggaagcugcuuggguggguguuagggcuaugaaaucuuggauuug

SEQ ID NO: 117959 - RNA, 64 nt, hsa
aaacuguguuuuauaccaguguuugcaaguaauuggguguuagcuugagaugguuaaagguggu

SEQ ID NO: 117960 - RNA, 64 nt, hsa
acagaaucagcugacauaauugacacaguuuauuggguguuaaguccgcucuauagggauagug

SEQ ID NO: 117961 - RNA, 64 nt, hsa
uauaaagacugaaggcaaaggucagauugcuuacggguguuauuuuuauaaguuguugaauucc

SEQ ID NO: 117962 - RNA, 64 nt, hsa
aaaagauaaacacaagauugguguuuuuuucuauggguguuaucaccuagcugaauguuuuucu

SEQ ID NO: 117963 - RNA, 64 nt, hsa
aaugcccaaccuccagauaccuccgauguggagaggguguuauuuagagaucaaggaaggaagu

SEQ ID NO: 117964 - RNA, 64 nt, hsa
cuccuccaaguacccaggggcaucagagcugccuggguguuacauggcccagggaacccagguu

SEQ ID NO: 117965 - RNA, 64 nt, hsa
gccugucggucagaacuugcuaguugcaggagacggguguuacacgcagucaucagaccucacc

SEQ ID NO: 117966 - RNA, 64 nt, hsa
cagcuggauuccaucaggaaagcugcauugaucaggguguuaaccgcauaugaaacaacccaua

SEQ ID NO: 117967 - RNA, 64 nt, hsa
uuugaggguaagaaguagauaaugaggccacuguggguguuauuuuuucaugucuggaccucag

SEQ ID NO: 117968 - RNA, 64 nt, hsa
cacccucccgccugucggcccguagauuuaucaaggguguuaugggcccagcuuuggggggcca

SEQ ID NO: 117969 - RNA, 64 nt, hsa
agccauaucaaguuaaagguuaaccaguuacagaggguguuagaaaacaaagggcagagagucc

SEQ ID NO: 117970 - RNA, 64 nt, hsa
agacucggcuugggcagcacuucggggggggaggggguguuaugggagggggacacauuggggc

SEQ ID NO: 117971 - RNA, 64 nt, hsa
cacugucugcauauccauaagaauugagcgcuauggguguuaacgugcaugaggaucaguuugc

SEQ ID NO: 117972 - RNA, 64 nt, hsa
uugcauuucaggggucaguauccuaugacaugauggguguuaccauccuaauuuuacaggcaag

SEQ ID NO: 117973 - RNA, 64 nt, hsa
gugucaggugugggacuccuucugccccugcaguggguguuacgggcggugugcccuggcgagc

SEQ ID NO: 117974 - RNA, 64 nt, hsa
ccucaucuuuuuagcaagguaaaaaaaccaaaauggguguuaucucugauaucuugaaaccagc

SEQ ID NO: 117975 - RNA, 64 nt, hsa
gaauauaaaacaaaccaauaaaaauaccaucugaggguguuacuguccaaaaguaaagaauaag

SEQ ID NO: 117976 - RNA, 64 nt, hsa
accuggaaggauguugugcuucugaagccccacuggguguuacugcagcagggcguggcccagg

SEQ ID NO: 117977 - RNA, 64 nt, hsa
aucuguacuccacauuccauuuuaauugauaugaggguguuaaaguaccuacuuaauggguuga

SEQ ID NO: 117978 - RNA, 64 nt, hsa
agagggcagucacuguuccaaggagugaaggacuggguguuacuggagggaacacacuguauaa

SEQ ID NO: 117979 - RNA, 64 nt, hsa
ucuuugauauguugaugaaauucuggaucaggagggguguuaaaacaucaaaaugauggcgacu

SEQ ID NO: 117980 - RNA, 64 nt, hsa
uuacugauuauuuugaaaagacgguguuaugcuuggguguuagugaggcugauaugucauguca

SEQ ID NO: 117981 - RNA, 64 nt, hsa
ugcucccaagccuaguuaucuccaguuguuuuaaggguguuaugaaaaauucuuaaaauauaua

SEQ ID NO: 117982 - RNA, 64 nt, hsa
uuuuaagggguauagggagggugagggaagugggggguguuagguaaggguuggggguagaggu

SEQ ID NO: 117983 - RNA, 62 nt, hsa
auuucauaauucucaagauuuuucuaaauacagccuuuaaauuugacucaaauggaaauugu

SEQ ID NO: 117984 - RNA, 62 nt, hsa
uuaagcaucuuugaugaauacucugcaaaguagccuuuaaaaaaauguaaauuuuuuaaaaa

SEQ ID NO: 117985 - RNA, 62 nt, hsa
ucagggauagcaguaccauuuuacuuccgcaagccuuuaacugcaagaugaagcugcaaagg

SEQ ID NO: 117986 - RNA, 62 nt, hsa
ccagugagaacucucaagaccucuucccccuugccuuuaaccuuuucugcagugaucuaaga

SEQ ID NO: 117987 - RNA, 62 nt, hsa
uuaguucccugucucuugaaaaaugcccauuugccuuuaaaaaaaaaaguuacagaaauacu

SEQ ID NO: 117988 - RNA, 62 nt, hsa
augaauguacugcauguuaccaucuuacuugagccuuuaauggacuuauuucuucaaauccu

SEQ ID NO: 117989 - RNA, 62 nt, hsa
agagaaacuucacaugugaaccguguggcaaagccuuuaaaugguccucaacccuuaaugaa

SEQ ID NO: 117990 - RNA, 62 nt, hsa
uaauuucuguugaaagacuucagaaaauauaggccuuuaaagugaagaagaguauucuuaag

SEQ ID NO: 117991 - RNA, 62 nt, hsa
uuugcauuugauuucuaaacauuccuucauaugccuuuaaugaaagccagcaauuaucccau

SEQ ID NO: 117992 - RNA, 62 nt, hsa
augagguuuuaugaauauucauguuuuugaaggccuuuaauuucugucugcauauuagcuuu

SEQ ID NO: 117993 - RNA, 62 nt, hsa
agagaaacuacaaaugugaagaauguguuaaagccuuuaacaagucuucaacuuuuucugca

SEQ ID NO: 117994 - RNA, 62 nt, hsa
aaaagccauacaaaugagaagaauguggcaaugccuuuaaucaguccucacaccuuucuaca

SEQ ID NO: 117995 - RNA, 62 nt, hsa
agaaacccuacaaauguaaaaaacguggcaaugccuuuaacugguccucacaccuugcuaca

SEQ ID NO: 117996 - RNA, 62 nt, hsa
aaaaauccuagaaaugugaaaaauaucacaaagccuuuaaaugguugucacacuugauugua

SEQ ID NO: 117997 - RNA, 62 nt, hsa
auuuuugucaagagaucuuucagaaaauauaagccuuuaaagugaagaagaggagccaguug

SEQ ID NO: 117998 - RNA, 62 nt, hsa
agaaagccuacaaaugugaagaauguggcaaagccuuuaaccaguuuucaacccuuauuaca

SEQ ID NO: 117999 - RNA, 62 nt, hsa
agaaaccccacaaauguggagaaugcggaaaagccuuuaacugguccucaacucuuauuaca

SEQ ID NO: 118000 - RNA, 62 nt, hsa
gaggugauucagaaccuuuuaaagugauuuuugccuuuaaagauacagugugaaaauuugcu

SEQ ID NO: 118001 - RNA, 62 nt, hsa
ucagugaaugcagaacaaaugaagggaaaagugccuuuaaaauuaccucacugugggcugga

SEQ ID NO: 118002 - RNA, 62 nt, hsa
auagaauaaguacaugcugcuguaauaaaauugccuuuaaucacuuaacaagccuaaccuug

SEQ ID NO: 118003 - RNA, 62 nt, hsa
ucaccuacaccagagagccauuuugguauuuugccuuuaaauaaaaagccuccuuuaucugg

SEQ ID NO: 118004 - RNA, 62 nt, hsa
aaaaauauugcuaaucuucugcuuauuuuucagccuuuaaagucugaaauacuauaaaacac

SEQ ID NO: 118005 - RNA, 62 nt, hsa
cuaauauagcuuguuuuguugaaauucugcaugccuuuaaaucacuagcaaagcaaauauua

SEQ ID NO: 118006 - RNA, 62 nt, hsa
aagcuuagaugagaaauuuuuuucauauacuggccuuuaaaucauuaauggacaauuggcua

SEQ ID NO: 118007 - RNA, 62 nt, hsa
aaagaauguauuguaaauuggcauacaauacugccuuuaauagaaaaccuaaaugcuggggc

SEQ ID NO: 118008 - RNA, 62 nt, hsa
aaaaaccccacaagugugaaaaacauggcaaagccuuuaagaagcccucaauucuuaacaga

SEQ ID NO: 118009 - RNA, 62 nt, hsa
agaaauccuagaaaucugaagagugagauaaagccuuuaaaugguugucacacuucauugua

SEQ ID NO: 118010 - RNA, 62 nt, hsa
agaaauccuagaaaugugaagaaugugacaaagccuuuaaauggcugucacacuugauugua

SEQ ID NO: 118011 - RNA, 62 nt, hsa
ggaauuccuauaauuguguggaauguggcaaagccuuuaaccaguccuuaaggcuuacuaca

SEQ ID NO: 118012 - RNA, 62 nt, hsa
ucaccuacaccagagagcuauuuugguauuuugccuuuaaauaaaaagccuccuccauaugg

SEQ ID NO: 118013 - RNA, 62 nt, hsa; identical to SEQ ID NO: 118002

SEQ ID NO: 118014 - RNA, 64 nt, hsa
gcuguauaaagcugcagcuuucaacagguuuuaaaccuggcauuaaaauguaauggcaaaacca

SEQ ID NO: 118015 - RNA, 64 nt, hsa
cugaagugaccacuuuucuucucuuugaggcacuaccuggcagcaccaucuaaaccuguaucau

SEQ ID NO: 118016 - RNA, 64 nt, hsa
gugaaggucgguggguuaacugugugccuacugaaccuggcaaauaaacaucacccugcaaagc

SEQ ID NO: 118017 - RNA, 64 nt, hsa
gggaaaggaggaacaauuaggacguggcaaugagaccuggcagggcagaguacaagcccagcac

SEQ ID NO: 118018 - RNA, 64 nt, hsa
guauuuuauaaagauuaauaacagaccuacucuuaccuggcaguuuacuuaacuuacuguuuug

SEQ ID NO: 118019 - RNA, 64 nt, hsa
aggcugcucaggucuccaagcgccguaggaggucaccuggcagugacuguagggagcuggguca

SEQ ID NO: 118020 - RNA, 64 nt, hsa
agaaccuagaagggcuagaaccuggagggcuagaaccuggcagguuagaaccuagaagggcuag

SEQ ID NO: 118021 - RNA, 64 nt, hsa
uagaacauggagagcuagaacccggcaggcuagaaccuggcaagcuagaaccuggagggaauga

SEQ ID NO: 118022 - RNA, 64 nt, hsa
agccucccaaagugcugggauuacaggccacuacaccuggcacauuugaguauuuuuuuuuuuu

SEQ ID NO: 118023 - RNA, 64 nt, hsa
caucuaucacacaggcuuucaggacagacuuguaaccuggcauguaccuauugacuguauccuc

SEQ ID NO: 118024 - RNA, 64 nt, hsa
aagguuuguaacaaggcuuuugggagugauucacaccuggcacaccauacuagaauucacacug

SEQ ID NO: 118025 - RNA, 64 nt, hsa
aagguuuaugacaagauuuuugaauauaauucauaccuggcaaaacauauuagaauucaaacug

SEQ ID NO: 118026 - RNA, 64 nt, hsa
ucucccauuuuucugaaaguggcugauguaagaacaggcagaaggaaaacccuuuuugucaaua

SEQ ID NO: 118027 - RNA, 64 nt, hsa
auugcuggagagcgaaagauggaacagccuuguccaggcagaacagucauaagccaggaaauga

SEQ ID NO: 118028 - RNA, 64 nt, hsa
accacacagagaaguggauggacacuucgccauccaggcagaacuaagccaggcauaaccacag

SEQ ID NO: 118029 - RNA, 64 nt, hsa
agccaggcauaaccacagccaagcagauuaaccccaggcagaccgauaaaaagaccuccagaua

SEQ ID NO: 118030 - RNA, 64 nt, hsa
gacagacuccuaaccaaccagauggacugccagacaggcagacaucagccacauggaauccuga

SEQ ID NO: 118031 - RNA, 64 nt, hsa
auuccccacguguguucaucugcacccaccgagccaggcagaggccagcccuccguggugcaca

SEQ ID NO: 118032 - RNA, 64 nt, hsa
gugaauaugaaauacaugugcauauuucauuccccaggcagacauuuuuuagaaaucaauacau

SEQ ID NO: 118033 - RNA, 64 nt, hsa
ggcacaggaggccacaguccuuccuggggcauuccaggcagagaaggagcagaggcucucccgg

SEQ ID NO: 118034 - RNA, 64 nt, hsa
uaagauucucagaccaaauucuagaccaaagacacaggcagaccaaguccccaggccccgccug

SEQ ID NO: 118035 - RNA, 64 nt, hsa
uuuuguggcuuuguucaaugcuuccacucuagggcaggcagagcagucuauacucucccaagcc

SEQ ID NO: 118036 - RNA, 64 nt, hsa
cguuuguuaacaucaucaggaagaugggaaaggucaggcagaauuuuucugcccuacaaagggu

SEQ ID NO: 118037 - RNA, 64 nt, hsa
gagcccucccuccaguggucacuucccaccauugcaggcagacuucccaccauugcaggcagcu

SEQ ID NO: 118038 - RNA, 64 nt, hsa
uuaugacgaaauaagucaccccugaacgccuccgcaggcagauucauggagaccagucccagua

SEQ ID NO: 118039 - RNA, 64 nt, hsa
gcaagcccuuguagcccucugagcccucauccugcaggcagagccccucagugcucugagaaac

SEQ ID NO: 118040 - RNA, 64 nt, hsa
ccuccaugguggcaugggucagcagagcauggagcaggcagaggaagccuaucuguggggcugg

SEQ ID NO: 118041 - RNA, 64 nt, hsa
cgguggccugugggugaggggaacggagcaggcucaggcagaauugaguacggugcgucugcuu

SEQ ID NO: 118042 - RNA, 64 nt, hsa
ggaguucccgagaugcucggguuugagcagggagcaggcagagcugcagucagagacauuagaa

SEQ ID NO: 118043 - RNA, 64 nt, hsa
ggcucaugccuauaagcacccugggaggccgaggcaggcagauuauuugagcucaggaguuuga

SEQ ID NO: 118044 - RNA, 64 nt, hsa
acaguuuuauuacaauguaacaaaaguugaaaaucaggcagauguguauucaguauccaauuca

SEQ ID NO: 118045 - RNA, 64 nt, hsa
ccucaugggggcuggggauccccaucagcacagccaggcagagaugauacccaccacacaccug

SEQ ID NO: 118046 - RNA, 64 nt, hsa
caguagcuggugccaggacagagcucugggacagcaggcagaggccgagccugggccacagcuc

SEQ ID NO: 118047 - RNA, 64 nt, hsa
ccuacauugcauaugggcauagcaguuuuugacccaggcagaauaaguuaauauuuaauuaaau

SEQ ID NO: 118048 - RNA, 64 nt, hsa
cauccucucagcagucuuccugucacccgccuggcaggcagaaggagcugcagucccacguggg

SEQ ID NO: 118049 - RNA, 64 nt, hsa
aauucuauuaggaauggcccaaacugaauugugacaggcagaggguguuccugacagagggaag

SEQ ID NO: 118050 - RNA, 64 nt, hsa
ggcacuuuugauaugagacaauguagcagaauaccaggcagacagaaccuugcaaacaccuuaa

SEQ ID NO: 118051 - RNA, 64 nt, hsa
cuguuuuaaagagccaucccaaggccucuccuagcaggcagaagccacuccucugauaacggcc

SEQ ID NO: 118052 - RNA, 64 nt, hsa
agcuuuaccaugaaccugcuccacugagaaaagccaggcagaucgauuuuuagaucaauuuuua

SEQ ID NO: 118053 - RNA, 64 nt, hsa
acauuugcugagcaaggagaaccgaugugaauggcaggcagauaacaugcacacaugaagcugg

SEQ ID NO: 118054 - RNA, 64 nt, hsa
gcucucauugccaauauggaacagagcccagggccaggcagacuggggcagugacuggaaaagg

SEQ ID NO: 118055 - RNA, 64 nt, hsa
ugcucucaggaccagagaagggaaaugacuucuccaggcagaggcagaucugagucuagaaccc

SEQ ID NO: 118056 - RNA, 64 nt, hsa
aaagcaaaggagaguccugggagcccacaagauccaggcagaaggagauggguuuggggcuggc

SEQ ID NO: 118057 - RNA, 64 nt, hsa
uaaacuagcuauccaaaccuuacuauuaaaagcgcaggcagauuuaauuugcuaaauagacuaa

SEQ ID NO: 118058 - RNA, 64 nt, hsa
acaaaaccaacaauuuuauuugccucuacuacgucaggcagaauucuucaauuaaguugaacua

SEQ ID NO: 118059 - RNA, 64 nt, hsa
cccagcccagcagcuucuguugucuaacguauggcaggcagacugggagcaggaaaacagaggg

SEQ ID NO: 118060 - RNA, 64 nt, hsa
ucacuuugcuccucuugcccucugucuucugguccaggcagaucaggggcucuggggaaacugc

SEQ ID NO: 118061 - RNA, 64 nt, hsa
ccgacgcagccugaaagagacccagacagagagacaggcagacacagccuaaaacagaccugga

SEQ ID NO: 118062 - RNA, 64 nt, hsa
caggcagacacagccuaaaacagaccuggacagacaggcagacguagucugaaacagaccugaa

SEQ ID NO: 118063 - RNA, 64 nt, hsa
aagccacccuguugugguaucugcuauggcugcacaggcagaaauagggacacaagugcagguu

SEQ ID NO: 118064 - RNA, 64 nt, hsa
caggccuguaaucccagcauuuggaagaccaagacaggcagaucgcuucagcucaggaguucga

SEQ ID NO: 118065 - RNA, 64 nt, hsa
aggcuggacucagcaggaacaccaaaucccggaccaggcagaaaccacccaagacugaggggcu

SEQ ID NO: 118066 - RNA, 64 nt, hsa
agacuaacggcuaaagagacugaugcaucaacaccaggcagagaauaaagcagauuuuuuuguu

SEQ ID NO: 118067 - RNA, 63 nt, hsa
aagcagaaagagcucauugaaucaugcauaccaugcagaaaguugagcuuuuagguuuugucc

SEQ ID NO: 118068 - RNA, 64 nt, hsa
auauagugaggaguagcauaauauuuuuuaauaaugcagaaaacaucacugaaaugagagucac

SEQ ID NO: 118069 - RNA, 64 nt, hsa
aucaugcggucagagugcagaaacccggucagcgugcagaaaccagcugucugcugaugaacgg

SEQ ID NO: 118070 - RNA, 64 nt, hsa
uaacaguaggacacaucccaucaugcggucagagugcagaaacccggucagcgugcagaaacca

SEQ ID NO: 118071 - RNA, 64 nt, hsa
cauugaggagacuccacagacugaaaagugaguuugcagaaaccuuggggaaaagggcccuuuc

SEQ ID NO: 118072 - RNA, 64 nt, hsa
agugggaccaguguugccacaccaguugauaaaaugcagaaacccuucuguacucguugguaaa

SEQ ID NO: 118073 - RNA, 64 nt, hsa
aaggcgggucccaaguucucuccucuacgcucauugcagaaauacuuugaaauagguucugcca

SEQ ID NO: 118074 - RNA, 64 nt, hsa
ugaauccccaauuauugaggcacacuccuuggccugcagaaaugugauugaaguaaggaguaau

SEQ ID NO: 118075 - RNA, 64 nt, hsa
accguccgaauaacagacagcccagaggagauagugcagaaauuccgcaaggcugugacagacu

SEQ ID NO: 118076 - RNA, 64 nt, hsa
caguuuuguaaucacugacuuaugugcaaacuggugcagaaauucuauaaacucuuugcuguuu

SEQ ID NO: 118077 - RNA, 64 nt, hsa
guuuggaaaaaacugcaaaucagaaagaaugauuugcagaaagaaagaaaaacuaugguguaau

SEQ ID NO: 118078 - RNA, 64 nt, hsa
uuuuuugucguguaagaaggaugcuggucagagcugcagaaaauaugaggcaauuaaaagucuu

SEQ ID NO: 118079 - RNA, 64 nt, hsa
uuagaaauauauuggcagccaagacucugaacucugcagaaacauuuguuucacccagacuuca

SEQ ID NO: 118080 - RNA, 64 nt, hsa
aaauauuuguugacuaaaauuauagcauuuuuaaugcagaaaauuauaaagaauuuggagauug

SEQ ID NO: 118081 - RNA, 64 nt, hsa
gauagugccaaaaaaaaaaucucagaaaucuuaaugcagaaauuauauagucuccucagauuuu

SEQ ID NO: 118082 - RNA, 64 nt, hsa
uauuacaaguugcuaguuuauaaugucuuacuaaugcagaaacaaggaaaaaagcaaaauuggc

SEQ ID NO: 118083 - RNA, 64 nt, hsa
caauuuauaaaccuccccuucaaaacuaaggaguugcagaaaaaaauggauuucacagagccuu

SEQ ID NO: 118084 - RNA, 64 nt, hsa
uuaaagaggaaauuaaucuuuauauauuauuucuugcagaaacauucauuauuuuauuaauauu

SEQ ID NO: 118085 - RNA, 64 nt, hsa
gcauugaagaaaaaauguugagauaaaauugcugugcagaaaaaaguguuaaugaagccgaccu

SEQ ID NO: 118086 - RNA, 64 nt, hsa
acguccuugauuaaaucaccccaauaugccccuuugcagaaaguauuggcuuuucccugaauuc

SEQ ID NO: 118087 - RNA, 64 nt, hsa
augguaaaaaaaaucuugggauugagagucuucuugcagaaacuucucagccaaaguaaaaagg

SEQ ID NO: 118088 - RNA, 64 nt, hsa
auuguuuaaauuugcuaguggauuuugucuaaugugcagaaauauauaugucuaaugugcagaa

SEQ ID NO: 118089 - RNA, 64 nt, hsa
uuugucuaaugugcagaaauauauaugucuaaugugcagaaauauauauguguguaugugugua

SEQ ID NO: 118090 - RNA, 64 nt, hsa
aagacuggauugauuguggacuuuuauacuauauugcagaaaccaauaucuguuucuugguggu

SEQ ID NO: 118091 - RNA, 64 nt, hsa
uguucaaucggguuucuuuucuuuuugccucuaaugcagaaaucaacagaaucacucacacaua

SEQ ID NO: 118092 - RNA, 64 nt, hsa
ucaauucuaauaaauaaugcugauguucaacaguugcagaaauugugcuauuauguaacugugg

SEQ ID NO: 118093 - RNA, 64 nt, hsa
acugcuguuuggucaaagaauaccuucuuagcauugcagaaagguggucagaugaccaguguag

SEQ ID NO: 118094 - RNA, 64 nt, hsa
agaauuuuuauaccaucuacaucuauccuacuuaugcagaaaaauaggcaauaagaacuucauu

SEQ ID NO: 118095 - RNA, 64 nt, hsa
cacugauucucuagaacacugggcaugaggauguugcagaaaucuagauggugggucccacaga

SEQ ID NO: 118096 - RNA, 64 nt, hsa
cauuggaggccuucaucccucucuacgauaagguugcagaaaugggaagagcuacccgugguug

SEQ ID NO: 118097 - RNA, 64 nt, hsa
gggccaaacuuacuaccuugacuucaucucuagcugcagaaacacuaagucucaagggcuucag

SEQ ID NO: 118098 - RNA, 64 nt, hsa
ucaucauagaggucuguuuugugaggguuuggggugcagaaaacuuugauuaaaucuuaauggg

SEQ ID NO: 118099 - RNA, 64 nt, hsa
gccuuuguagggacagcaaaaggggaaaauuugcugcagaaaauuccaaaagauugcuguagcu

SEQ ID NO: 118100 - RNA, 64 nt, hsa
aaacugccaaaugcuuaccugguauuuuauuagaugcagaaacagauuggaaacagcuaaauua

SEQ ID NO: 118101 - RNA, 64 nt, hsa
uauuaagggaagcgcaaacacauuuauuuuguacugcagaaaaauugcuuuuuuguaucacuuu

SEQ ID NO: 118102 - RNA, 64 nt, hsa
uuuagguuguuucuaauuuucauuauuauaaaguugcagaaauuugguguacauaaaacugucu

SEQ ID NO: 118103 - RNA, 64 nt, hsa
aaaauaauauacucaucauagaaaacuugaaaaaugcagaaauguauaaaaaagcaaaaaugau

SEQ ID NO: 118104 - RNA, 64 nt, hsa
ccuuuuagagauagguucuugauauucagacaucugcagaaauguucugguucccaaagucauu

SEQ ID NO: 118105 - RNA, 64 nt, hsa
agggauaucuuuuuuauauuuuuuuccaugaaucugcagaaaauuacugagcuguuguuacccu

SEQ ID NO: 118106 - RNA, 64 nt, hsa
gcuuuugcuuuuguuuguuucuucccccacccagugcagaaaucaggaucagggaaagauuuua

SEQ ID NO: 118107 - RNA, 64 nt, hsa
uacugaacacuuggaagucaccuuuacuugccuuugcagaaaacagaacuuagccaaaccuaag

SEQ ID NO: 118108 - RNA, 64 nt, hsa
agagaggcgggccccagacccaugugcugggaaaugcagaaaucacguugcuggugguuuuuca

SEQ ID NO: 118109 - RNA, 64 nt, hsa
uucaguugcuuugcccaagauaggaguucucugaugcagaaauuauugggcucuuuuaggguaa

SEQ ID NO: 118110 - RNA, 64 nt, hsa
cucccgauugcuccuguguaaagaugccuugucgugcagaaacaaauggcuguccaguuuauua

SEQ ID NO: 118111 - RNA, 64 nt, hsa
cucaccuuugggaguaauacugaagagaggggucugcagaaaggauguguaugaagcuuagaua

SEQ ID NO: 118112 - RNA, 64 nt, hsa
ggucacguggaggguacguucauaugaaacaaucugcagaaagugggguaagaaagggcacaug

SEQ ID NO: 118113 - RNA, 64 nt, hsa
ugugacaguguacaguggcagcuguuggccacgcugcagaaaugagcuggagcucauggguuuu

SEQ ID NO: 118114 - RNA, 64 nt, hsa
auaaacacugucuucuuucgucuucacaccaacaugcagaaaaguuucuaaucucagaucgggg

SEQ ID NO: 118115 - RNA, 64 nt, hsa
gauguuauggaaggcgugcuaggcauucaauuccugcagaaaccggaaaucuuccaugcccugc

SEQ ID NO: 118116 - RNA, 64 nt, hsa
gggaccuguuuuuuuucucauuugauuuugcuugugcagaaaauaguuuccagcacauggauug

SEQ ID NO: 118117 - RNA, 64 nt, hsa
accaacuuccuuagauuuuuuuuuuuaagcuguuugcagaaaacugggugguagcgugucugaa

SEQ ID NO: 118118 - RNA, 64 nt, hsa
gcaggaggacaauucccacagauaaucugaggaaugcagaaaaaccagggcaggacaguuaucg

SEQ ID NO: 118119 - RNA, 64 nt, hsa
augccagugcuccgagcucagacagaggaagcccugcagaaaguuccaucaggcuguuuccuaa

SEQ ID NO: 118120 - RNA, 64 nt, hsa
ucuuuccaagaugaacuugaagauuacauaaaagugcagaaagccagaggacuagagccaaaaa

SEQ ID NO: 118121 - RNA, 64 nt, hsa
ucuuaccaaaaugagugugcagauuacaucaaugugcagaaagccagaggacuagaggccaaga

SEQ ID NO: 118122 - RNA, 64 nt, hsa
ggcuauguauugcacauuggcaagugcucuggggaugaggcauggguauaggaagggagaaagg

SEQ ID NO: 118123 - RNA, 64 nt, hsa
ggaagagaacugggcugacuccaggaccuccaggaugaggcagaggcaugaugcuuccugcuca

SEQ ID NO: 118124 - RNA, 64 nt, hsa
aaauaauauuaaaguauuauuugaacuuuuuaagaugaggcaguuccccugaaaaaguuaaugc

SEQ ID NO: 118125 - RNA, 64 nt, hsa
uugcuucagaauuagauugcuuuauaauucuugaaugaggcaauuucaagauauuuguaaaaga

SEQ ID NO: 118126 - RNA, 64 nt, hsa
cuggaggcaggcccgggaaggcugcuguuuacucaucgggcagccacgugcucucuggaggaag

SEQ ID NO: 118127 - RNA, 64 nt, hsa
ucccaguuccagcuuccuaaaauagacaguggguaucgggcagcagucacuggggcucaagggc

SEQ ID NO: 118128 - RNA, 64 nt, hsa
augcugcccaucgcuugcacuggggucuuuguggaucgggcaggaguuuucaguguguugggug

SEQ ID NO: 118129 - RNA, 64 nt, hsa
uggcugcugccucagcacagagagccagaacucuaucgggcaccaggauaacaucucucaguga

SEQ ID NO: 118130 - RNA, 64 nt, hsa
agcuuccauggucacugcuaagcaguagccagccaucgggcauuaauugauuuccuacuauauu

SEQ ID NO: 118131 - RNA, 64 nt, hsa
guuggguuuggggggacggugcccccagcccaggaucgggcacucaguggagccgcacacggcc

SEQ ID NO: 118132 - RNA, 64 nt, hsa
caaugagaacuuaucauguugguguguuagguaaaucgggcaaauaugauagugucuuacauug

SEQ ID NO: 118133 - RNA, 64 nt, hsa
auugccauaaauuguaguuaagaacuguaaggcaaucgggcagugaaacuugauauuguauuaa

SEQ ID NO: 118134 - RNA, 64 nt, hsa
aaguugaggcagguugaaggauucacaggguaagaucgggcacaguggcucccgccuguaaucc

SEQ ID NO: 118135 - RNA, 64 nt, hsa
acagucuggcccuccagacaagagcagcgcuggcaucgggcaggugauuccugacaccugcugc

SEQ ID NO: 118136 - RNA, 64 nt, hsa
accauuaucuguuuaaaggauccauuuaguuaaaaucgggcacucuauauucauuaagguuuau

SEQ ID NO: 118137 - RNA, 64 nt, hsa
gaaauuaguuucaaauuuaccucagcguuuguguaucgggcaaaaaucguuuugcccgauuccg

SEQ ID NO: 118138 - RNA, 64 nt, hsa
aacuccagaaccacucuuuuugcauaaauaccucaucgggcagcuuucuaagugugauuuuccu

SEQ ID NO: 118139 - RNA, 64 nt, hsa
cuucuuggcuucucuggugaugggguuuguuuucaucgggcauacguuuucugcaaugguuuag

SEQ ID NO: 118140 - RNA, 64 nt, hsa
gggcaccaggaacaccgucuggaacaggaaggacaucgggcaggacugacacugugucuuguga

SEQ ID NO: 118141 - RNA, 64 nt, hsa
cacauauauccacucacaugucuucccucaggcuaucgggcagggggacuucaccaggggguuu

SEQ ID NO: 118142 - RNA, 64 nt, hsa
agccgggccucgccgcgacccuuccggcccaucuaucgggcaccggggcuccggcccgggaccc

SEQ ID NO: 118143 - RNA, 64 nt, hsa
ggagaagugcauugaugugagaggagcagugccaaucgggcagaaguuugcaaauaggcagaau

SEQ ID NO: 118144 - RNA, 64 nt, hsa
ggguuugggaugggugucuaaggcaggaguugacaucgggcaaccaaagaaaugaguuuugggg

SEQ ID NO: 118145 - RNA, 64 nt, hsa
cccuugagugacagcccagggacuuaauguggccaucgggcaucaagcacaaggccaugcaggu

SEQ ID NO: 118146 - RNA, 64 nt, hsa
ggggacgcagugccccagcugggaagagggcgggaucgggcacugguuccuccuuguccccgcu

SEQ ID NO: 118147 - RNA, 64 nt, hsa
uccuucaguaaauguaacacagucgaggcacgucaucgggcagccuucccugugugccaacgcc

SEQ ID NO: 118148 - RNA, 64 nt, hsa
gaagaggggccagaugacacccuaaagcaggcugaucgggcaaugggagguggccaggccugcc

SEQ ID NO: 118149 - RNA, 64 nt, hsa
gggaucuggggagggcuagcccaaaaccucccgcaucgggcaggcacccccugaaguacuuccu

SEQ ID NO: 118150 - RNA, 64 nt, hsa
uugcugcugcugaauccuuucuggggacuuucucaucgggcagggagcagagggcuucucguuc

SEQ ID NO: 118151 - RNA, 64 nt, hsa
cugauggcaccaaaucuugacuccuuuggacgcgaucgggcacuguaucaagagcaugcaaaac

SEQ ID NO: 118152 - RNA, 64 nt, hsa
uuggugggaaguaagcuggagauccaggcugcuggagauccaaugccugcugccuccagacucu

SEQ ID NO: 118153 - RNA, 64 nt, hsa
uccacuguaccaagacuuggugggaaguaagcuggagauccaggcugcuggagauccaaugccu

SEQ ID NO: 118154 - RNA, 64 nt, hsa
uccucuccucugcaggacaugcugcccaugccaggagauccaacccaggggacuggcaacuaua

SEQ ID NO: 118155 - RNA, 64 nt, hsa
gcuccacauuaaaccccagcccugucuggccagggagauccaugugcucaauguugcuggggga

SEQ ID NO: 118156 - RNA, 64 nt, hsa
ugccugggcugcuccugucccacccacccucacugagauccauguaaggggcuccucuucccac

SEQ ID NO: 118157 - RNA, 64 nt, hsa
gggggcccugaguggcaaguugcuuagcuaacaggagauccauaggcagccugcaggcuaggaa

SEQ ID NO: 118158 - RNA, 64 nt, hsa
gcuguuucugguugggaagcguaaaagccagggagagauccagagaguuuucaaguuuuugcag

SEQ ID NO: 118159 - RNA, 64 nt, hsa
aaaaacauucaaggguucugcccccagauuucgggagauccacguuccauguucugauugguuu

SEQ ID NO: 118160 - RNA, 64 nt, hsa; identical to SEQ ID NO: 118126

SEQ ID NO: 118161 - RNA, 64 nt, hsa; identical to SEQ ID NO: 118127

SEQ ID NO: 118162 - RNA, 64 nt, hsa; identical to SEQ ID NO: 118128

SEQ ID NO: 118163 - RNA, 64 nt, hsa; identical to SEQ ID NO: 118129

SEQ ID NO: 118164 - RNA, 64 nt, hsa; identical to SEQ ID NO: 118130

SEQ ID NO: 118165 - RNA, 64 nt, hsa; identical to SEQ ID NO: 118131

SEQ ID NO: 118166 - RNA, 64 nt, hsa; identical to SEQ ID NO: 118132

SEQ ID NO: 118167 - RNA, 64 nt, hsa; identical to SEQ ID NO: 118133

SEQ ID NO: 118168 - RNA, 64 nt, hsa; identical to SEQ ID NO: 118134

SEQ ID NO: 118169 - RNA, 64 nt, hsa; identical to SEQ ID NO: 118135

SEQ ID NO: 118170 - RNA, 64 nt, hsa; identical to SEQ ID NO: 118136

SEQ ID NO: 118171 - RNA, 64 nt, hsa; identical to SEQ ID NO: 118137

SEQ ID NO: 118172 - RNA, 64 nt, hsa; identical to SEQ ID NO: 118138

SEQ ID NO: 118173 - RNA, 64 nt, hsa; identical to SEQ ID NO: 118139

SEQ ID NO: 118174 - RNA, 64 nt, hsa; identical to SEQ ID NO: 118140

SEQ ID NO: 118175 - RNA, 64 nt, hsa; identical to SEQ ID NO: 118141

SEQ ID NO: 118176 - RNA, 64 nt, hsa; identical to SEQ ID NO: 118142

SEQ ID NO: 118177 - RNA, 64 nt, hsa; identical to SEQ ID NO: 118143

SEQ ID NO: 118178 - RNA, 64 nt, hsa; identical to SEQ ID NO: 118144

SEQ ID NO: 118179 - RNA, 64 nt, hsa; identical to SEQ ID NO: 118145

SEQ ID NO: 118180 - RNA, 64 nt, hsa; identical to SEQ ID NO: 118146

SEQ ID NO: 118181 - RNA, 64 nt, hsa; identical to SEQ ID NO: 118147

SEQ ID NO: 118182 - RNA, 64 nt, hsa; identical to SEQ ID NO: 118148

SEQ ID NO: 118183 - RNA, 64 nt, hsa; identical to SEQ ID NO: 118149

SEQ ID NO: 118184 - RNA, 64 nt, hsa; identical to SEQ ID NO: 118150

SEQ ID NO: 118185 - RNA, 64 nt, hsa; identical to SEQ ID NO: 118151

SEQ ID NO: 118186 - RNA, 64 nt, hsa; identical to SEQ ID NO: 118152

SEQ ID NO: 118187 - RNA, 64 nt, hsa; identical to SEQ ID NO: 118153

SEQ ID NO: 118188 - RNA, 64 nt, hsa; identical to SEQ ID NO: 118154

SEQ ID NO: 118189 - RNA, 64 nt, hsa; identical to SEQ ID NO: 118155

SEQ ID NO: 118190 - RNA, 64 nt, hsa; identical to SEQ ID NO: 118156

SEQ ID NO: 118191 - RNA, 64 nt, hsa; identical to SEQ ID NO: 118157

SEQ ID NO: 118192 - RNA, 64 nt, hsa; identical to SEQ ID NO: 118158

SEQ ID NO: 118193 - RNA, 64 nt, hsa; identical to SEQ ID NO: 118159

SEQ ID NO: 118194 - RNA, 64 nt, hsa; identical to SEQ ID NO: 118126

SEQ ID NO: 118195 - RNA, 64 nt, hsa; identical to SEQ ID NO: 118127

SEQ ID NO: 118196 - RNA, 64 nt, hsa; identical to SEQ ID NO: 118128

SEQ ID NO: 118197 - RNA, 64 nt, hsa; identical to SEQ ID NO: 118129

SEQ ID NO: 118198 - RNA, 64 nt, hsa; identical to SEQ ID NO: 118130

SEQ ID NO: 118199 - RNA, 64 nt, hsa; identical to SEQ ID NO: 118131

SEQ ID NO: 118200 - RNA, 64 nt, hsa; identical to SEQ ID NO: 118132

SEQ ID NO: 118201 - RNA, 64 nt, hsa; identical to SEQ ID NO: 118133

SEQ ID NO: 118202 - RNA, 64 nt, hsa; identical to SEQ ID NO: 118134

SEQ ID NO: 118203 - RNA, 64 nt, hsa; identical to SEQ ID NO: 118135

SEQ ID NO: 118204 - RNA, 64 nt, hsa; identical to SEQ ID NO: 118136

SEQ ID NO: 118205 - RNA, 64 nt, hsa; identical to SEQ ID NO: 118137

SEQ ID NO: 118206 - RNA, 64 nt, hsa; identical to SEQ ID NO: 118138

SEQ ID NO: 118207 - RNA, 64 nt, hsa; identical to SEQ ID NO: 118139

SEQ ID NO: 118208 - RNA, 64 nt, hsa; identical to SEQ ID NO: 118140

SEQ ID NO: 118209 - RNA, 64 nt, hsa; identical to SEQ ID NO: 118141

SEQ ID NO: 118210 - RNA, 64 nt, hsa; identical to SEQ ID NO: 118142

SEQ ID NO: 118211 - RNA, 64 nt, hsa; identical to SEQ ID NO: 118143

SEQ ID NO: 118212 - RNA, 64 nt, hsa; identical to SEQ ID NO: 118144

SEQ ID NO: 118213 - RNA, 64 nt, hsa; identical to SEQ ID NO: 118145

SEQ ID NO: 118214 - RNA, 64 nt, hsa; identical to SEQ ID NO: 118146

SEQ ID NO: 118215 - RNA, 64 nt, hsa; identical to SEQ ID NO: 118147

SEQ ID NO: 118216 - RNA, 64 nt, hsa; identical to SEQ ID NO: 118148

SEQ ID NO: 118217 - RNA, 64 nt, hsa; identical to SEQ ID NO: 118149

SEQ ID NO: 118218 - RNA, 64 nt, hsa; identical to SEQ ID NO: 118150

SEQ ID NO: 118219 - RNA, 64 nt, hsa; identical to SEQ ID NO: 118151

SEQ ID NO: 118220 - RNA, 64 nt, hsa; identical to SEQ ID NO: 118152

SEQ ID NO: 118221 - RNA, 64 nt, hsa; identical to SEQ ID NO: 118153

SEQ ID NO: 118222 - RNA, 64 nt, hsa; identical to SEQ ID NO: 118154

SEQ ID NO: 118223 - RNA, 64 nt, hsa; identical to SEQ ID NO: 118155

SEQ ID NO: 118224 - RNA, 64 nt, hsa; identical to SEQ ID NO: 118156

SEQ ID NO: 118225 - RNA, 64 nt, hsa; identical to SEQ ID NO: 118157

SEQ ID NO: 118226 - RNA, 64 nt, hsa; identical to SEQ ID NO: 118158

SEQ ID NO: 118227 - RNA, 64 nt, hsa; identical to SEQ ID NO: 118159

SEQ ID NO: 118228 - RNA, 64 nt, hsa; identical to SEQ ID NO: 118126

SEQ ID NO: 118229 - RNA, 64 nt, hsa; identical to SEQ ID NO: 118127

SEQ ID NO: 118230 - RNA, 64 nt, hsa; identical to SEQ ID NO: 118128

SEQ ID NO: 118231 - RNA, 64 nt, hsa; identical to SEQ ID NO: 118129

SEQ ID NO: 118232 - RNA, 64 nt, hsa; identical to SEQ ID NO: 118130

SEQ ID NO: 118233 - RNA, 64 nt, hsa; identical to SEQ ID NO: 118131

SEQ ID NO: 118234 - RNA, 64 nt, hsa; identical to SEQ ID NO: 118132

SEQ ID NO: 118235 - RNA, 64 nt, hsa; identical to SEQ ID NO: 118133

SEQ ID NO: 118236 - RNA, 64 nt, hsa; identical to SEQ ID NO: 118134

SEQ ID NO: 118237 - RNA, 64 nt, hsa; identical to SEQ ID NO: 118135

SEQ ID NO: 118238 - RNA, 64 nt, hsa; identical to SEQ ID NO: 118136

SEQ ID NO: 118239 - RNA, 64 nt, hsa; identical to SEQ ID NO: 118137

SEQ ID NO: 118240 - RNA, 64 nt, hsa; identical to SEQ ID NO: 118138

SEQ ID NO: 118241 - RNA, 64 nt, hsa; identical to SEQ ID NO: 118139

SEQ ID NO: 118242 - RNA, 64 nt, hsa; identical to SEQ ID NO: 118140

SEQ ID NO: 118243 - RNA, 64 nt, hsa; identical to SEQ ID NO: 118141

SEQ ID NO: 118244 - RNA, 64 nt, hsa; identical to SEQ ID NO: 118142

SEQ ID NO: 118245 - RNA, 64 nt, hsa; identical to SEQ ID NO: 118143

SEQ ID NO: 118246 - RNA, 64 nt, hsa; identical to SEQ ID NO: 118144

SEQ ID NO: 118247 - RNA, 64 nt, hsa; identical to SEQ ID NO: 118145

SEQ ID NO: 118248 - RNA, 64 nt, hsa; identical to SEQ ID NO: 118146

SEQ ID NO: 118249 - RNA, 64 nt, hsa; identical to SEQ ID NO: 118147

SEQ ID NO: 118250 - RNA, 64 nt, hsa; identical to SEQ ID NO: 118148

SEQ ID NO: 118251 - RNA, 64 nt, hsa; identical to SEQ ID NO: 118149

SEQ ID NO: 118252 - RNA, 64 nt, hsa; identical to SEQ ID NO: 118150

SEQ ID NO: 118253 - RNA, 64 nt, hsa; identical to SEQ ID NO: 118151

SEQ ID NO: 118254 - RNA, 64 nt, hsa; identical to SEQ ID NO: 118152

SEQ ID NO: 118255 - RNA, 64 nt, hsa; identical to SEQ ID NO: 118153

SEQ ID NO: 118256 - RNA, 64 nt, hsa; identical to SEQ ID NO: 118154

SEQ ID NO: 118257 - RNA, 64 nt, hsa; identical to SEQ ID NO: 118155

SEQ ID NO: 118258 - RNA, 64 nt, hsa; identical to SEQ ID NO: 118156

SEQ ID NO: 118259 - RNA, 64 nt, hsa; identical to SEQ ID NO: 118157

SEQ ID NO: 118260 - RNA, 64 nt, hsa; identical to SEQ ID NO: 118158

SEQ ID NO: 118261 - RNA, 64 nt, hsa; identical to SEQ ID NO: 118159

SEQ ID NO: 118262 - RNA, 64 nt, hsa; identical to SEQ ID NO: 118126

SEQ ID NO: 118263 - RNA, 64 nt, hsa; identical to SEQ ID NO: 118127

SEQ ID NO: 118264 - RNA, 64 nt, hsa; identical to SEQ ID NO: 118128

SEQ ID NO: 118265 - RNA, 64 nt, hsa; identical to SEQ ID NO: 118129

SEQ ID NO: 118266 - RNA, 64 nt, hsa; identical to SEQ ID NO: 118130

SEQ ID NO: 118267 - RNA, 64 nt, hsa; identical to SEQ ID NO: 118131

SEQ ID NO: 118268 - RNA, 64 nt, hsa; identical to SEQ ID NO: 118132

SEQ ID NO: 118269 - RNA, 64 nt, hsa; identical to SEQ ID NO: 118133

SEQ ID NO: 118270 - RNA, 64 nt, hsa; identical to SEQ ID NO: 118134

SEQ ID NO: 118271 - RNA, 64 nt, hsa; identical to SEQ ID NO: 118135

SEQ ID NO: 118272 - RNA, 64 nt, hsa; identical to SEQ ID NO: 118136

SEQ ID NO: 118273 - RNA, 64 nt, hsa; identical to SEQ ID NO: 118137

SEQ ID NO: 118274 - RNA, 64 nt, hsa; identical to SEQ ID NO: 118138

SEQ ID NO: 118275 - RNA, 64 nt, hsa; identical to SEQ ID NO: 118139

SEQ ID NO: 118276 - RNA, 64 nt, hsa; identical to SEQ ID NO: 118140

SEQ ID NO: 118277 - RNA, 64 nt, hsa; identical to SEQ ID NO: 118141

SEQ ID NO: 118278 - RNA, 64 nt, hsa; identical to SEQ ID NO: 118142

SEQ ID NO: 118279 - RNA, 64 nt, hsa; identical to SEQ ID NO: 118143

SEQ ID NO: 118280 - RNA, 64 nt, hsa; identical to SEQ ID NO: 118144

SEQ ID NO: 118281 - RNA, 64 nt, hsa; identical to SEQ ID NO: 118145

SEQ ID NO: 118282 - RNA, 64 nt, hsa; identical to SEQ ID NO: 118146

SEQ ID NO: 118283 - RNA, 64 nt, hsa; identical to SEQ ID NO: 118147

SEQ ID NO: 118284 - RNA, 64 nt, hsa; identical to SEQ ID NO: 118148

SEQ ID NO: 118285 - RNA, 64 nt, hsa; identical to SEQ ID NO: 118149

SEQ ID NO: 118286 - RNA, 64 nt, hsa; identical to SEQ ID NO: 118150

SEQ ID NO: 118287 - RNA, 64 nt, hsa; identical to SEQ ID NO: 118151

SEQ ID NO: 118288 - RNA, 64 nt, hsa; identical to SEQ ID NO: 118152

SEQ ID NO: 118289 - RNA, 64 nt, hsa; identical to SEQ ID NO: 118153

SEQ ID NO: 118290 - RNA, 64 nt, hsa; identical to SEQ ID NO: 118154

SEQ ID NO: 118291 - RNA, 64 nt, hsa; identical to SEQ ID NO: 118155

SEQ ID NO: 118292 - RNA, 64 nt, hsa; identical to SEQ ID NO: 118156

SEQ ID NO: 118293 - RNA, 64 nt, hsa; identical to SEQ ID NO: 118157

SEQ ID NO: 118294 - RNA, 64 nt, hsa; identical to SEQ ID NO: 118158

SEQ ID NO: 118295 - RNA, 64 nt, hsa; identical to SEQ ID NO: 118159

SEQ ID NO: 118296 - RNA, 64 nt, hsa; identical to SEQ ID NO: 118126

SEQ ID NO: 118297 - RNA, 64 nt, hsa; identical to SEQ ID NO: 118127

SEQ ID NO: 118298 - RNA, 64 nt, hsa; identical to SEQ ID NO: 118128

SEQ ID NO: 118299 - RNA, 64 nt, hsa; identical to SEQ ID NO: 118129

SEQ ID NO: 118300 - RNA, 64 nt, hsa; identical to SEQ ID NO: 118130

SEQ ID NO: 118301 - RNA, 64 nt, hsa; identical to SEQ ID NO: 118131

SEQ ID NO: 118302 - RNA, 64 nt, hsa; identical to SEQ ID NO: 118132

SEQ ID NO: 118303 - RNA, 64 nt, hsa; identical to SEQ ID NO: 118133

SEQ ID NO: 118304 - RNA, 64 nt, hsa; identical to SEQ ID NO: 118134

SEQ ID NO: 118305 - RNA, 64 nt, hsa; identical to SEQ ID NO: 118135

SEQ ID NO: 118306 - RNA, 64 nt, hsa; identical to SEQ ID NO: 118136

SEQ ID NO: 118307 - RNA, 64 nt, hsa; identical to SEQ ID NO: 118137

SEQ ID NO: 118308 - RNA, 64 nt, hsa; identical to SEQ ID NO: 118138

SEQ ID NO: 118309 - RNA, 64 nt, hsa; identical to SEQ ID NO: 118139

SEQ ID NO: 118310 - RNA, 64 nt, hsa; identical to SEQ ID NO: 118140

SEQ ID NO: 118311 - RNA, 64 nt, hsa; identical to SEQ ID NO: 118141

SEQ ID NO: 118312 - RNA, 64 nt, hsa; identical to SEQ ID NO: 118142

SEQ ID NO: 118313 - RNA, 64 nt, hsa; identical to SEQ ID NO: 118143

SEQ ID NO: 118314 - RNA, 64 nt, hsa; identical to SEQ ID NO: 118144

SEQ ID NO: 118315 - RNA, 64 nt, hsa; identical to SEQ ID NO: 118145

SEQ ID NO: 118316 - RNA, 64 nt, hsa; identical to SEQ ID NO: 118146

SEQ ID NO: 118317 - RNA, 64 nt, hsa; identical to SEQ ID NO: 118147

SEQ ID NO: 118318 - RNA, 64 nt, hsa; identical to SEQ ID NO: 118148

SEQ ID NO: 118319 - RNA, 64 nt, hsa; identical to SEQ ID NO: 118149

SEQ ID NO: 118320 - RNA, 64 nt, hsa; identical to SEQ ID NO: 118150

SEQ ID NO: 118321 - RNA, 64 nt, hsa; identical to SEQ ID NO: 118151

SEQ ID NO: 118322 - RNA, 64 nt, hsa; identical to SEQ ID NO: 118152

SEQ ID NO: 118323 - RNA, 64 nt, hsa; identical to SEQ ID NO: 118153

SEQ ID NO: 118324 - RNA, 64 nt, hsa; identical to SEQ ID NO: 118154

SEQ ID NO: 118325 - RNA, 64 nt, hsa; identical to SEQ ID NO: 118155

SEQ ID NO: 118326 - RNA, 64 nt, hsa; identical to SEQ ID NO: 118156

SEQ ID NO: 118327 - RNA, 64 nt, hsa; identical to SEQ ID NO: 118157

SEQ ID NO: 118328 - RNA, 64 nt, hsa; identical to SEQ ID NO: 118158

SEQ ID NO: 118329 - RNA, 64 nt, hsa; identical to SEQ ID NO: 118159

SEQ ID NO: 118330 - RNA, 64 nt, hsa; identical to SEQ ID NO: 118126

SEQ ID NO: 118331 - RNA, 64 nt, hsa; identical to SEQ ID NO: 118127

SEQ ID NO: 118332 - RNA, 64 nt, hsa; identical to SEQ ID NO: 118128

SEQ ID NO: 118333 - RNA, 64 nt, hsa; identical to SEQ ID NO: 118129

SEQ ID NO: 118334 - RNA, 64 nt, hsa; identical to SEQ ID NO: 118130

SEQ ID NO: 118335 - RNA, 64 nt, hsa; identical to SEQ ID NO: 118131

SEQ ID NO: 118336 - RNA, 64 nt, hsa; identical to SEQ ID NO: 118132

SEQ ID NO: 118337 - RNA, 64 nt, hsa; identical to SEQ ID NO: 118133

SEQ ID NO: 118338 - RNA, 64 nt, hsa; identical to SEQ ID NO: 118134

SEQ ID NO: 118339 - RNA, 64 nt, hsa; identical to SEQ ID NO: 118135

SEQ ID NO: 118340 - RNA, 64 nt, hsa; identical to SEQ ID NO: 118136

SEQ ID NO: 118341 - RNA, 64 nt, hsa; identical to SEQ ID NO: 118137

SEQ ID NO: 118342 - RNA, 64 nt, hsa; identical to SEQ ID NO: 118138

SEQ ID NO: 118343 - RNA, 64 nt, hsa; identical to SEQ ID NO: 118139

SEQ ID NO: 118344 - RNA, 64 nt, hsa; identical to SEQ ID NO: 118140

SEQ ID NO: 118345 - RNA, 64 nt, hsa; identical to SEQ ID NO: 118141

SEQ ID NO: 118346 - RNA, 64 nt, hsa; identical to SEQ ID NO: 118142

SEQ ID NO: 118347 - RNA, 64 nt, hsa; identical to SEQ ID NO: 118143

SEQ ID NO: 118348 - RNA, 64 nt, hsa; identical to SEQ ID NO: 118144

SEQ ID NO: 118349 - RNA, 64 nt, hsa; identical to SEQ ID NO: 118145

SEQ ID NO: 118350 - RNA, 64 nt, hsa; identical to SEQ ID NO: 118146

SEQ ID NO: 118351 - RNA, 64 nt, hsa; identical to SEQ ID NO: 118147

SEQ ID NO: 118352 - RNA, 64 nt, hsa; identical to SEQ ID NO: 118148

SEQ ID NO: 118353 - RNA, 64 nt, hsa; identical to SEQ ID NO: 118149

SEQ ID NO: 118354 - RNA, 64 nt, hsa; identical to SEQ ID NO: 118150

SEQ ID NO: 118355 - RNA, 64 nt, hsa; identical to SEQ ID NO: 118151

SEQ ID NO: 118356 - RNA, 64 nt, hsa; identical to SEQ ID NO: 118152

SEQ ID NO: 118357 - RNA, 64 nt, hsa; identical to SEQ ID NO: 118153

SEQ ID NO: 118358 - RNA, 64 nt, hsa; identical to SEQ ID NO: 118154

SEQ ID NO: 118359 - RNA, 64 nt, hsa; identical to SEQ ID NO: 118155

SEQ ID NO: 118360 - RNA, 64 nt, hsa; identical to SEQ ID NO: 118156

SEQ ID NO: 118361 - RNA, 64 nt, hsa; identical to SEQ ID NO: 118157

SEQ ID NO: 118362 - RNA, 64 nt, hsa; identical to SEQ ID NO: 118158

SEQ ID NO: 118363 - RNA, 64 nt, hsa; identical to SEQ ID NO: 118159

SEQ ID NO: 118364 - RNA, 64 nt, hsa; identical to SEQ ID NO: 118126

SEQ ID NO: 118365 - RNA, 64 nt, hsa; identical to SEQ ID NO: 118127

SEQ ID NO: 118366 - RNA, 64 nt, hsa; identical to SEQ ID NO: 118128

SEQ ID NO: 118367 - RNA, 64 nt, hsa; identical to SEQ ID NO: 118129

SEQ ID NO: 118368 - RNA, 64 nt, hsa; identical to SEQ ID NO: 118130

SEQ ID NO: 118369 - RNA, 64 nt, hsa; identical to SEQ ID NO: 118131

SEQ ID NO: 118370 - RNA, 64 nt, hsa; identical to SEQ ID NO: 118132

SEQ ID NO: 118371 - RNA, 64 nt, hsa; identical to SEQ ID NO: 118133

SEQ ID NO: 118372 - RNA, 64 nt, hsa; identical to SEQ ID NO: 118134

SEQ ID NO: 118373 - RNA, 64 nt, hsa; identical to SEQ ID NO: 118135

SEQ ID NO: 118374 - RNA, 64 nt, hsa; identical to SEQ ID NO: 118136

SEQ ID NO: 118375 - RNA, 64 nt, hsa; identical to SEQ ID NO: 118137

SEQ ID NO: 118376 - RNA, 64 nt, hsa; identical to SEQ ID NO: 118138

SEQ ID NO: 118377 - RNA, 64 nt, hsa; identical to SEQ ID NO: 118139

SEQ ID NO: 118378 - RNA, 64 nt, hsa; identical to SEQ ID NO: 118140

SEQ ID NO: 118379 - RNA, 64 nt, hsa; identical to SEQ ID NO: 118141

SEQ ID NO: 118380 - RNA, 64 nt, hsa; identical to SEQ ID NO: 118142

SEQ ID NO: 118381 - RNA, 64 nt, hsa; identical to SEQ ID NO: 118143

SEQ ID NO: 118382 - RNA, 64 nt, hsa; identical to SEQ ID NO: 118144

SEQ ID NO: 118383 - RNA, 64 nt, hsa; identical to SEQ ID NO: 118145

SEQ ID NO: 118384 - RNA, 64 nt, hsa; identical to SEQ ID NO: 118146

SEQ ID NO: 118385 - RNA, 64 nt, hsa; identical to SEQ ID NO: 118147

SEQ ID NO: 118386 - RNA, 64 nt, hsa; identical to SEQ ID NO: 118148

SEQ ID NO: 118387 - RNA, 64 nt, hsa; identical to SEQ ID NO: 118149

SEQ ID NO: 118388 - RNA, 64 nt, hsa; identical to SEQ ID NO: 118150

SEQ ID NO: 118389 - RNA, 64 nt, hsa; identical to SEQ ID NO: 118151

SEQ ID NO: 118390 - RNA, 64 nt, hsa; identical to SEQ ID NO: 118152

SEQ ID NO: 118391 - RNA, 64 nt, hsa; identical to SEQ ID NO: 118153

SEQ ID NO: 118392 - RNA, 64 nt, hsa; identical to SEQ ID NO: 118154

SEQ ID NO: 118393 - RNA, 64 nt, hsa; identical to SEQ ID NO: 118155

SEQ ID NO: 118394 - RNA, 64 nt, hsa; identical to SEQ ID NO: 118156

SEQ ID NO: 118395 - RNA, 64 nt, hsa; identical to SEQ ID NO: 118157

SEQ ID NO: 118396 - RNA, 64 nt, hsa; identical to SEQ ID NO: 118158

SEQ ID NO: 118397 - RNA, 64 nt, hsa; identical to SEQ ID NO: 118159

SEQ ID NO: 118398 - RNA, 64 nt, hsa; identical to SEQ ID NO: 118126

SEQ ID NO: 118399 - RNA, 64 nt, hsa; identical to SEQ ID NO: 118127

SEQ ID NO: 118400 - RNA, 64 nt, hsa; identical to SEQ ID NO: 118128

SEQ ID NO: 118401 - RNA, 64 nt, hsa; identical to SEQ ID NO: 118129

SEQ ID NO: 118402 - RNA, 64 nt, hsa; identical to SEQ ID NO: 118130

SEQ ID NO: 118403 - RNA, 64 nt, hsa; identical to SEQ ID NO: 118131

SEQ ID NO: 118404 - RNA, 64 nt, hsa; identical to SEQ ID NO: 118132

SEQ ID NO: 118405 - RNA, 64 nt, hsa; identical to SEQ ID NO: 118133

SEQ ID NO: 118406 - RNA, 64 nt, hsa; identical to SEQ ID NO: 118134

SEQ ID NO: 118407 - RNA, 64 nt, hsa; identical to SEQ ID NO: 118135

SEQ ID NO: 118408 - RNA, 64 nt, hsa; identical to SEQ ID NO: 118136

SEQ ID NO: 118409 - RNA, 64 nt, hsa; identical to SEQ ID NO: 118137

SEQ ID NO: 118410 - RNA, 64 nt, hsa; identical to SEQ ID NO: 118138

SEQ ID NO: 118411 - RNA, 64 nt, hsa; identical to SEQ ID NO: 118139

SEQ ID NO: 118412 - RNA, 64 nt, hsa; identical to SEQ ID NO: 118140

SEQ ID NO: 118413 - RNA, 64 nt, hsa; identical to SEQ ID NO: 118141

SEQ ID NO: 118414 - RNA, 64 nt, hsa; identical to SEQ ID NO: 118142

SEQ ID NO: 118415 - RNA, 64 nt, hsa; identical to SEQ ID NO: 118143

SEQ ID NO: 118416 - RNA, 64 nt, hsa; identical to SEQ ID NO: 118144

SEQ ID NO: 118417 - RNA, 64 nt, hsa; identical to SEQ ID NO: 118145

SEQ ID NO: 118418 - RNA, 64 nt, hsa; identical to SEQ ID NO: 118146

SEQ ID NO: 118419 - RNA, 64 nt, hsa; identical to SEQ ID NO: 118147

SEQ ID NO: 118420 - RNA, 64 nt, hsa; identical to SEQ ID NO: 118148

SEQ ID NO: 118421 - RNA, 64 nt, hsa; identical to SEQ ID NO: 118149

SEQ ID NO: 118422 - RNA, 64 nt, hsa; identical to SEQ ID NO: 118150

SEQ ID NO: 118423 - RNA, 64 nt, hsa; identical to SEQ ID NO: 118151

SEQ ID NO: 118424 - RNA, 64 nt, hsa; identical to SEQ ID NO: 118152

SEQ ID NO: 118425 - RNA, 64 nt, hsa; identical to SEQ ID NO: 118153

SEQ ID NO: 118426 - RNA, 64 nt, hsa; identical to SEQ ID NO: 118154

SEQ ID NO: 118427 - RNA, 64 nt, hsa; identical to SEQ ID NO: 118155

SEQ ID NO: 118428 - RNA, 64 nt, hsa; identical to SEQ ID NO: 118156

SEQ ID NO: 118429 - RNA, 64 nt, hsa; identical to SEQ ID NO: 118157

SEQ ID NO: 118430 - RNA, 64 nt, hsa; identical to SEQ ID NO: 118158

SEQ ID NO: 118431 - RNA, 64 nt, hsa; identical to SEQ ID NO: 118159

SEQ ID NO: 118432 - RNA, 64 nt, hsa; identical to SEQ ID NO: 118126

SEQ ID NO: 118433 - RNA, 64 nt, hsa; identical to SEQ ID NO: 118127

SEQ ID NO: 118434 - RNA, 64 nt, hsa; identical to SEQ ID NO: 118128

SEQ ID NO: 118435 - RNA, 64 nt, hsa; identical to SEQ ID NO: 118129

SEQ ID NO: 118436 - RNA, 64 nt, hsa; identical to SEQ ID NO: 118130

SEQ ID NO: 118437 - RNA, 64 nt, hsa; identical to SEQ ID NO: 118131

SEQ ID NO: 118438 - RNA, 64 nt, hsa; identical to SEQ ID NO: 118132

SEQ ID NO: 118439 - RNA, 64 nt, hsa; identical to SEQ ID NO: 118133

SEQ ID NO: 118440 - RNA, 64 nt, hsa; identical to SEQ ID NO: 118134

SEQ ID NO: 118441 - RNA, 64 nt, hsa; identical to SEQ ID NO: 118135

SEQ ID NO: 118442 - RNA, 64 nt, hsa; identical to SEQ ID NO: 118136

SEQ ID NO: 118443 - RNA, 64 nt, hsa; identical to SEQ ID NO: 118137

SEQ ID NO: 118444 - RNA, 64 nt, hsa; identical to SEQ ID NO: 118138

SEQ ID NO: 118445 - RNA, 64 nt, hsa; identical to SEQ ID NO: 118139

SEQ ID NO: 118446 - RNA, 64 nt, hsa; identical to SEQ ID NO: 118140

SEQ ID NO: 118447 - RNA, 64 nt, hsa; identical to SEQ ID NO: 118141

SEQ ID NO: 118448 - RNA, 64 nt, hsa; identical to SEQ ID NO: 118142

SEQ ID NO: 118449 - RNA, 64 nt, hsa; identical to SEQ ID NO: 118143

SEQ ID NO: 118450 - RNA, 64 nt, hsa; identical to SEQ ID NO: 118144

SEQ ID NO: 118451 - RNA, 64 nt, hsa; identical to SEQ ID NO: 118145

SEQ ID NO: 118452 - RNA, 64 nt, hsa; identical to SEQ ID NO: 118146

SEQ ID NO: 118453 - RNA, 64 nt, hsa; identical to SEQ ID NO: 118147

SEQ ID NO: 118454 - RNA, 64 nt, hsa; identical to SEQ ID NO: 118148

SEQ ID NO: 118455 - RNA, 64 nt, hsa; identical to SEQ ID NO: 118149

SEQ ID NO: 118456 - RNA, 64 nt, hsa; identical to SEQ ID NO: 118150

SEQ ID NO: 118457 - RNA, 64 nt, hsa; identical to SEQ ID NO: 118151

SEQ ID NO: 118458 - RNA, 64 nt, hsa; identical to SEQ ID NO: 118152

SEQ ID NO: 118459 - RNA, 64 nt, hsa; identical to SEQ ID NO: 118153

SEQ ID NO: 118460 - RNA, 64 nt, hsa; identical to SEQ ID NO: 118154

SEQ ID NO: 118461 - RNA, 64 nt, hsa; identical to SEQ ID NO: 118155

SEQ ID NO: 118462 - RNA, 64 nt, hsa; identical to SEQ ID NO: 118156

SEQ ID NO: 118463 - RNA, 64 nt, hsa; identical to SEQ ID NO: 118157

SEQ ID NO: 118464 - RNA, 64 nt, hsa; identical to SEQ ID NO: 118158

SEQ ID NO: 118465 - RNA, 64 nt, hsa; identical to SEQ ID NO: 118159

SEQ ID NO: 118466 - RNA, 64 nt, hsa; identical to SEQ ID NO: 118126

SEQ ID NO: 118467 - RNA, 64 nt, hsa; identical to SEQ ID NO: 118127

SEQ ID NO: 118468 - RNA, 64 nt, hsa; identical to SEQ ID NO: 118128

SEQ ID NO: 118469 - RNA, 64 nt, hsa; identical to SEQ ID NO: 118129

SEQ ID NO: 118470 - RNA, 64 nt, hsa; identical to SEQ ID NO: 118130

SEQ ID NO: 118471 - RNA, 64 nt, hsa; identical to SEQ ID NO: 118131

SEQ ID NO: 118472 - RNA, 64 nt, hsa; identical to SEQ ID NO: 118132

SEQ ID NO: 118473 - RNA, 64 nt, hsa; identical to SEQ ID NO: 118133

SEQ ID NO: 118474 - RNA, 64 nt, hsa; identical to SEQ ID NO: 118134

SEQ ID NO: 118475 - RNA, 64 nt, hsa; identical to SEQ ID NO: 118135

SEQ ID NO: 118476 - RNA, 64 nt, hsa; identical to SEQ ID NO: 118136

SEQ ID NO: 118477 - RNA, 64 nt, hsa; identical to SEQ ID NO: 118137

SEQ ID NO: 118478 - RNA, 64 nt, hsa; identical to SEQ ID NO: 118138

SEQ ID NO: 118479 - RNA, 64 nt, hsa; identical to SEQ ID NO: 118139

SEQ ID NO: 118480 - RNA, 64 nt, hsa; identical to SEQ ID NO: 118140

SEQ ID NO: 118481 - RNA, 64 nt, hsa; identical to SEQ ID NO: 118141

SEQ ID NO: 118482 - RNA, 64 nt, hsa; identical to SEQ ID NO: 118142

SEQ ID NO: 118483 - RNA, 64 nt, hsa; identical to SEQ ID NO: 118143

SEQ ID NO: 118484 - RNA, 64 nt, hsa; identical to SEQ ID NO: 118144

SEQ ID NO: 118485 - RNA, 64 nt, hsa; identical to SEQ ID NO: 118145

SEQ ID NO: 118486 - RNA, 64 nt, hsa; identical to SEQ ID NO: 118146

SEQ ID NO: 118487 - RNA, 64 nt, hsa; identical to SEQ ID NO: 118147

SEQ ID NO: 118488 - RNA, 64 nt, hsa; identical to SEQ ID NO: 118148

SEQ ID NO: 118489 - RNA, 64 nt, hsa; identical to SEQ ID NO: 118149

SEQ ID NO: 118490 - RNA, 64 nt, hsa; identical to SEQ ID NO: 118150

SEQ ID NO: 118491 - RNA, 64 nt, hsa; identical to SEQ ID NO: 118151

SEQ ID NO: 118492 - RNA, 64 nt, hsa; identical to SEQ ID NO: 118152

SEQ ID NO: 118493 - RNA, 64 nt, hsa; identical to SEQ ID NO: 118153

SEQ ID NO: 118494 - RNA, 64 nt, hsa; identical to SEQ ID NO: 118154

SEQ ID NO: 118495 - RNA, 64 nt, hsa; identical to SEQ ID NO: 118155

SEQ ID NO: 118496 - RNA, 64 nt, hsa; identical to SEQ ID NO: 118156

SEQ ID NO: 118497 - RNA, 64 nt, hsa; identical to SEQ ID NO: 118157

SEQ ID NO: 118498 - RNA, 64 nt, hsa; identical to SEQ ID NO: 118158

SEQ ID NO: 118499 - RNA, 64 nt, hsa; identical to SEQ ID NO: 118159

SEQ ID NO: 118500 - RNA, 64 nt, hsa; identical to SEQ ID NO: 118126

SEQ ID NO: 118501 - RNA, 64 nt, hsa; identical to SEQ ID NO: 118127

SEQ ID NO: 118502 - RNA, 64 nt, hsa; identical to SEQ ID NO: 118128

SEQ ID NO: 118503 - RNA, 64 nt, hsa; identical to SEQ ID NO: 118129

SEQ ID NO: 118504 - RNA, 64 nt, hsa; identical to SEQ ID NO: 118130

SEQ ID NO: 118505 - RNA, 64 nt, hsa; identical to SEQ ID NO: 118131

SEQ ID NO: 118506 - RNA, 64 nt, hsa; identical to SEQ ID NO: 118132

SEQ ID NO: 118507 - RNA, 64 nt, hsa; identical to SEQ ID NO: 118133

SEQ ID NO: 118508 - RNA, 64 nt, hsa; identical to SEQ ID NO: 118134

SEQ ID NO: 118509 - RNA, 64 nt, hsa; identical to SEQ ID NO: 118135

SEQ ID NO: 118510 - RNA, 64 nt, hsa; identical to SEQ ID NO: 118136

SEQ ID NO: 118511 - RNA, 64 nt, hsa; identical to SEQ ID NO: 118137

SEQ ID NO: 118512 - RNA, 64 nt, hsa; identical to SEQ ID NO: 118138

SEQ ID NO: 118513 - RNA, 64 nt, hsa; identical to SEQ ID NO: 118139

SEQ ID NO: 118514 - RNA, 64 nt, hsa; identical to SEQ ID NO: 118140

SEQ ID NO: 118515 - RNA, 64 nt, hsa; identical to SEQ ID NO: 118141

SEQ ID NO: 118516 - RNA, 64 nt, hsa; identical to SEQ ID NO: 118142

SEQ ID NO: 118517 - RNA, 64 nt, hsa; identical to SEQ ID NO: 118143

SEQ ID NO: 118518 - RNA, 64 nt, hsa; identical to SEQ ID NO: 118144

SEQ ID NO: 118519 - RNA, 64 nt, hsa; identical to SEQ ID NO: 118145

SEQ ID NO: 118520 - RNA, 64 nt, hsa; identical to SEQ ID NO: 118146

SEQ ID NO: 118521 - RNA, 64 nt, hsa; identical to SEQ ID NO: 118147

SEQ ID NO: 118522 - RNA, 64 nt, hsa; identical to SEQ ID NO: 118148

SEQ ID NO: 118523 - RNA, 64 nt, hsa; identical to SEQ ID NO: 118149

SEQ ID NO: 118524 - RNA, 64 nt, hsa; identical to SEQ ID NO: 118150

SEQ ID NO: 118525 - RNA, 64 nt, hsa; identical to SEQ ID NO: 118151

SEQ ID NO: 118526 - RNA, 64 nt, hsa; identical to SEQ ID NO: 118152

SEQ ID NO: 118527 - RNA, 64 nt, hsa; identical to SEQ ID NO: 118153

SEQ ID NO: 118528 - RNA, 64 nt, hsa; identical to SEQ ID NO: 118154

SEQ ID NO: 118529 - RNA, 64 nt, hsa; identical to SEQ ID NO: 118155

SEQ ID NO: 118530 - RNA, 64 nt, hsa; identical to SEQ ID NO: 118156

SEQ ID NO: 118531 - RNA, 64 nt, hsa; identical to SEQ ID NO: 118157

SEQ ID NO: 118532 - RNA, 64 nt, hsa; identical to SEQ ID NO: 118158

SEQ ID NO: 118533 - RNA, 64 nt, hsa; identical to SEQ ID NO: 118159

SEQ ID NO: 118534 - RNA, 64 nt, hsa; identical to SEQ ID NO: 118126

SEQ ID NO: 118535 - RNA, 64 nt, hsa; identical to SEQ ID NO: 118127

SEQ ID NO: 118536 - RNA, 64 nt, hsa; identical to SEQ ID NO: 118128

SEQ ID NO: 118537 - RNA, 64 nt, hsa; identical to SEQ ID NO: 118129

SEQ ID NO: 118538 - RNA, 64 nt, hsa; identical to SEQ ID NO: 118130

SEQ ID NO: 118539 - RNA, 64 nt, hsa; identical to SEQ ID NO: 118131

SEQ ID NO: 118540 - RNA, 64 nt, hsa; identical to SEQ ID NO: 118132

SEQ ID NO: 118541 - RNA, 64 nt, hsa; identical to SEQ ID NO: 118133

SEQ ID NO: 118542 - RNA, 64 nt, hsa; identical to SEQ ID NO: 118134

SEQ ID NO: 118543 - RNA, 64 nt, hsa; identical to SEQ ID NO: 118135

SEQ ID NO: 118544 - RNA, 64 nt, hsa; identical to SEQ ID NO: 118136

SEQ ID NO: 118545 - RNA, 64 nt, hsa; identical to SEQ ID NO: 118137

SEQ ID NO: 118546 - RNA, 64 nt, hsa; identical to SEQ ID NO: 118138

SEQ ID NO: 118547 - RNA, 64 nt, hsa; identical to SEQ ID NO: 118139

SEQ ID NO: 118548 - RNA, 64 nt, hsa; identical to SEQ ID NO: 118140

SEQ ID NO: 118549 - RNA, 64 nt, hsa; identical to SEQ ID NO: 118141

SEQ ID NO: 118550 - RNA, 64 nt, hsa; identical to SEQ ID NO: 118142

SEQ ID NO: 118551 - RNA, 64 nt, hsa; identical to SEQ ID NO: 118143

SEQ ID NO: 118552 - RNA, 64 nt, hsa; identical to SEQ ID NO: 118144

SEQ ID NO: 118553 - RNA, 64 nt, hsa; identical to SEQ ID NO: 118145

SEQ ID NO: 118554 - RNA, 64 nt, hsa; identical to SEQ ID NO: 118146

SEQ ID NO: 118555 - RNA, 64 nt, hsa; identical to SEQ ID NO: 118147

SEQ ID NO: 118556 - RNA, 64 nt, hsa; identical to SEQ ID NO: 118148

SEQ ID NO: 118557 - RNA, 64 nt, hsa; identical to SEQ ID NO: 118149

SEQ ID NO: 118558 - RNA, 64 nt, hsa; identical to SEQ ID NO: 118150

SEQ ID NO: 118559 - RNA, 64 nt, hsa; identical to SEQ ID NO: 118151

SEQ ID NO: 118560 - RNA, 64 nt, hsa; identical to SEQ ID NO: 118152

SEQ ID NO: 118561 - RNA, 64 nt, hsa; identical to SEQ ID NO: 118153

SEQ ID NO: 118562 - RNA, 64 nt, hsa; identical to SEQ ID NO: 118154

SEQ ID NO: 118563 - RNA, 64 nt, hsa; identical to SEQ ID NO: 118155

SEQ ID NO: 118564 - RNA, 64 nt, hsa; identical to SEQ ID NO: 118156

SEQ ID NO: 118565 - RNA, 64 nt, hsa; identical to SEQ ID NO: 118157

SEQ ID NO: 118566 - RNA, 64 nt, hsa; identical to SEQ ID NO: 118158

SEQ ID NO: 118567 - RNA, 64 nt, hsa; identical to SEQ ID NO: 118159

SEQ ID NO: 118568 - RNA, 64 nt, hsa; identical to SEQ ID NO: 118126

SEQ ID NO: 118569 - RNA, 64 nt, hsa; identical to SEQ ID NO: 118127

SEQ ID NO: 118570 - RNA, 64 nt, hsa; identical to SEQ ID NO: 118128

SEQ ID NO: 118571 - RNA, 64 nt, hsa; identical to SEQ ID NO: 118129

SEQ ID NO: 118572 - RNA, 64 nt, hsa; identical to SEQ ID NO: 118130

SEQ ID NO: 118573 - RNA, 64 nt, hsa; identical to SEQ ID NO: 118131

SEQ ID NO: 118574 - RNA, 64 nt, hsa; identical to SEQ ID NO: 118132

SEQ ID NO: 118575 - RNA, 64 nt, hsa; identical to SEQ ID NO: 118133

SEQ ID NO: 118576 - RNA, 64 nt, hsa; identical to SEQ ID NO: 118134

SEQ ID NO: 118577 - RNA, 64 nt, hsa; identical to SEQ ID NO: 118135

SEQ ID NO: 118578 - RNA, 64 nt, hsa; identical to SEQ ID NO: 118136

SEQ ID NO: 118579 - RNA, 64 nt, hsa; identical to SEQ ID NO: 118137

SEQ ID NO: 118580 - RNA, 64 nt, hsa; identical to SEQ ID NO: 118138

SEQ ID NO: 118581 - RNA, 64 nt, hsa; identical to SEQ ID NO: 118139

SEQ ID NO: 118582 - RNA, 64 nt, hsa; identical to SEQ ID NO: 118140

SEQ ID NO: 118583 - RNA, 64 nt, hsa; identical to SEQ ID NO: 118141

SEQ ID NO: 118584 - RNA, 64 nt, hsa; identical to SEQ ID NO: 118142

SEQ ID NO: 118585 - RNA, 64 nt, hsa; identical to SEQ ID NO: 118143

SEQ ID NO: 118586 - RNA, 64 nt, hsa; identical to SEQ ID NO: 118144

SEQ ID NO: 118587 - RNA, 64 nt, hsa; identical to SEQ ID NO: 118145

SEQ ID NO: 118588 - RNA, 64 nt, hsa; identical to SEQ ID NO: 118146

SEQ ID NO: 118589 - RNA, 64 nt, hsa; identical to SEQ ID NO: 118147

SEQ ID NO: 118590 - RNA, 64 nt, hsa; identical to SEQ ID NO: 118148

SEQ ID NO: 118591 - RNA, 64 nt, hsa; identical to SEQ ID NO: 118149

SEQ ID NO: 118592 - RNA, 64 nt, hsa; identical to SEQ ID NO: 118150

SEQ ID NO: 118593 - RNA, 64 nt, hsa; identical to SEQ ID NO: 118151

SEQ ID NO: 118594 - RNA, 64 nt, hsa; identical to SEQ ID NO: 118152

SEQ ID NO: 118595 - RNA, 64 nt, hsa; identical to SEQ ID NO: 118153

SEQ ID NO: 118596 - RNA, 64 nt, hsa; identical to SEQ ID NO: 118154

SEQ ID NO: 118597 - RNA, 64 nt, hsa; identical to SEQ ID NO: 118155

SEQ ID NO: 118598 - RNA, 64 nt, hsa; identical to SEQ ID NO: 118156

SEQ ID NO: 118599 - RNA, 64 nt, hsa; identical to SEQ ID NO: 118157

SEQ ID NO: 118600 - RNA, 64 nt, hsa; identical to SEQ ID NO: 118158

SEQ ID NO: 118601 - RNA, 64 nt, hsa; identical to SEQ ID NO: 118159

SEQ ID NO: 118602 - RNA, 64 nt, hsa; identical to SEQ ID NO: 118126

SEQ ID NO: 118603 - RNA, 64 nt, hsa; identical to SEQ ID NO: 118127

SEQ ID NO: 118604 - RNA, 64 nt, hsa; identical to SEQ ID NO: 118128

SEQ ID NO: 118605 - RNA, 64 nt, hsa; identical to SEQ ID NO: 118129

SEQ ID NO: 118606 - RNA, 64 nt, hsa; identical to SEQ ID NO: 118130

SEQ ID NO: 118607 - RNA, 64 nt, hsa; identical to SEQ ID NO: 118131

SEQ ID NO: 118608 - RNA, 64 nt, hsa; identical to SEQ ID NO: 118132

SEQ ID NO: 118609 - RNA, 64 nt, hsa; identical to SEQ ID NO: 118133

SEQ ID NO: 118610 - RNA, 64 nt, hsa; identical to SEQ ID NO: 118134

SEQ ID NO: 118611 - RNA, 64 nt, hsa; identical to SEQ ID NO: 118135

SEQ ID NO: 118612 - RNA, 64 nt, hsa; identical to SEQ ID NO: 118136

SEQ ID NO: 118613 - RNA, 64 nt, hsa; identical to SEQ ID NO: 118137

SEQ ID NO: 118614 - RNA, 64 nt, hsa; identical to SEQ ID NO: 118138

SEQ ID NO: 118615 - RNA, 64 nt, hsa; identical to SEQ ID NO: 118139

SEQ ID NO: 118616 - RNA, 64 nt, hsa; identical to SEQ ID NO: 118140

SEQ ID NO: 118617 - RNA, 64 nt, hsa; identical to SEQ ID NO: 118141

SEQ ID NO: 118618 - RNA, 64 nt, hsa; identical to SEQ ID NO: 118142

SEQ ID NO: 118619 - RNA, 64 nt, hsa; identical to SEQ ID NO: 118143

SEQ ID NO: 118620 - RNA, 64 nt, hsa; identical to SEQ ID NO: 118144

SEQ ID NO: 118621 - RNA, 64 nt, hsa; identical to SEQ ID NO: 118145

SEQ ID NO: 118622 - RNA, 64 nt, hsa; identical to SEQ ID NO: 118146

SEQ ID NO: 118623 - RNA, 64 nt, hsa; identical to SEQ ID NO: 118147

SEQ ID NO: 118624 - RNA, 64 nt, hsa; identical to SEQ ID NO: 118148

SEQ ID NO: 118625 - RNA, 64 nt, hsa; identical to SEQ ID NO: 118149

SEQ ID NO: 118626 - RNA, 64 nt, hsa; identical to SEQ ID NO: 118150

SEQ ID NO: 118627 - RNA, 64 nt, hsa; identical to SEQ ID NO: 118151

SEQ ID NO: 118628 - RNA, 64 nt, hsa; identical to SEQ ID NO: 118152

SEQ ID NO: 118629 - RNA, 64 nt, hsa; identical to SEQ ID NO: 118153

SEQ ID NO: 118630 - RNA, 64 nt, hsa; identical to SEQ ID NO: 118154

SEQ ID NO: 118631 - RNA, 64 nt, hsa; identical to SEQ ID NO: 118155

SEQ ID NO: 118632 - RNA, 64 nt, hsa; identical to SEQ ID NO: 118156

SEQ ID NO: 118633 - RNA, 64 nt, hsa; identical to SEQ ID NO: 118157

SEQ ID NO: 118634 - RNA, 64 nt, hsa; identical to SEQ ID NO: 118158

SEQ ID NO: 118635 - RNA, 64 nt, hsa; identical to SEQ ID NO: 118159

SEQ ID NO: 118636 - RNA, 64 nt, hsa
ccccguggcuuccugucugcuggccucuccugcuacuuaucacuucaccacgaacucucugccu

SEQ ID NO: 118637 - RNA, 64 nt, hsa
gaaacaggugguaaaguaguuuggccuguucacaacuuaucaggaccaauaucuaguguggacu

SEQ ID NO: 118638 - RNA, 64 nt, hsa
gaucagcccuauaugaaacauaaguuguguuauaacuuaucagccguauauggaacauaaauag

SEQ ID NO: 118639 - RNA, 64 nt, hsa
ugaaaaauagaaguauaauuugaaaaaacauuucacuuaucagagauuuuuauauuuauacaaa

SEQ ID NO: 118640 - RNA, 64 nt, hsa
ccauuucccccugcucccccacagccgguucugcacuuaucaccgagucgccccuggaagcaga

SEQ ID NO: 118641 - RNA, 64 nt, hsa
uugaaaaacuuuucagcaguuucuuauaagcauaacuuaucauauggcccagccauuucacuac

SEQ ID NO: 118642 - RNA, 64 nt, hsa
ugaucaauuugaagucccuguuugggaaugaggcacuuaucagcaugaagaauuuuuucucauu

SEQ ID NO: 118643 - RNA, 64 nt, hsa
guuuguguguauauauauaugccuuuguguauacacuuaucaaagcuauuuucuuaugaaaacg

SEQ ID NO: 118644 - RNA, 64 nt, hsa
aauuuuagcucuugcuucucaagcuucucucucaacuuaucagaacugccuauaguaaccaaaa

SEQ ID NO: 118645 - RNA, 64 nt, hsa
cugaaagcaaagaugcagcagcgguagugucuuuacuuaucaaaaccaucaaguccuuuuucuu

SEQ ID NO: 118646 - RNA, 64 nt, hsa
guaaaggaccagguuuuuuguuuuccaguccuucacuuaucaauaugcauuccuauugcccaug

SEQ ID NO: 118647 - RNA, 64 nt, hsa
aguuaaugcagaguuaaugaacagucuaauauugacuuaucagaauaagcuaacucuaaauuua

SEQ ID NO: 118648 - RNA, 64 nt, hsa
ugguguuagguggccuuaaguucucaguaaugacacuuaucaaauaggaacuuaguguuacuca

SEQ ID NO: 118649 - RNA, 64 nt, hsa
auugugaguauuuauuagauucguaggucauauuacuuaucaacugagccaaaugucugugugc

SEQ ID NO: 118650 - RNA, 64 nt, hsa
gaagcacucacaggcaccacacacguaucauguaacuuaucagugggguggguuacuguugaag

SEQ ID NO: 118651 - RNA, 64 nt, hsa
uauuguuuuaauggaaagcaaaaaacccccccaaacuuaucagaauccucguucuuuuucagac

SEQ ID NO: 118652 - RNA, 64 nt, hsa
uucugugaaaucaaauccaguuuuaagaggagccacuuaucaaagagauuuuaacaguaguaag

SEQ ID NO: 118653 - RNA, 64 nt, hsa
uaccucugcacuuugucaaugcuucucuuguggcacuuaucacacuguauuuuacuuguuuaca

SEQ ID NO: 118654 - RNA, 64 nt, hsa
ccccaacaaaagaagcuacaggaggaacuuucugacuuaucagcaauggaagaugcuuuggaug

SEQ ID NO: 118655 - RNA, 64 nt, hsa
aaccuccucccccaaacacuagagguuuaauaagacuuaucagaugaaaggauauuuauauagc

SEQ ID NO: 118656 - RNA, 64 nt, hsa
uuuauuuaaaagauucauuuuuaaucaugaaauuacuuaucauccacauuguuuuaaaaagaaa

SEQ ID NO: 118657 - RNA, 64 nt, hsa
ucauacagcuagcauuagaugggugauguuucuuacuuaucaucccuaacuauugcaacuugac

SEQ ID NO: 118658 - RNA, 64 nt, hsa
aauguauaaauuucacguaaauuagucacguaucacuuaucaauggggauacguucuaagaaau

SEQ ID NO: 118659 - RNA, 64 nt, hsa
aggagaggaagauuugucuacuugcuccacucgcacuuaucaaacguguuauauuccauacuua

SEQ ID NO: 118660 - RNA, 64 nt, hsa
agaguccauucaccugagaaaugugugaagacauacuuaucaguuggcuuuuagcuuuuauguu

SEQ ID NO: 118661 - RNA, 64 nt, hsa
ucuaccugggugugcccacgaagacaaccaucacacuuaucaauggcacgcuccugccuaccca

SEQ ID NO: 118662 - RNA, 64 nt, hsa
acaaaagcaggaacaagacucagagcaagaagucacuuaucaccaaggggauggcccaggccau

SEQ ID NO: 118663 - RNA, 64 nt, hsa
cacagaagaaaggaguuaggaaaaguacugauugacuuaucaaaagaagaucugauuaagggcu

SEQ ID NO: 118664 - RNA, 64 nt, hsa
uaauuacugugguaauuaaauguguucaguauguacuuaucaguacauuuagucugcaauguuu

SEQ ID NO: 118665 - RNA, 64 nt, hsa
aagucuguuacaguugcuagagguuuucauuaaaacuuaucagaugagaggcuuuuuuaggaua

SEQ ID NO: 118666 - RNA, 64 nt, hsa
uccagccuucacuccagcugguuaaaaauguugcacuuaucagcaacccuaccacuuucaucug

SEQ ID NO: 118667 - RNA, 64 nt, hsa
cugaugucucagugaaucagucuguuuauuaagcacuuaucagggcuuccacacacuuauuuau

SEQ ID NO: 118668 - RNA, 64 nt, hsa
uacuuuucuggguaugugcugauuaaggggguggacuuaucaacacuauaauuguucccuauga

SEQ ID NO: 118669 - RNA, 64 nt, hsa
uuaaggcagaaaaaaaguuacaugucgauuagguacuuaucaagaauggucaagcugagauuuu

SEQ ID NO: 118670 - RNA, 64 nt, hsa
ucauuaaaaaauaagccugccgccaaaauaaaucacuuaucaaaaugugaacuguuuuccucau

SEQ ID NO: 118671 - RNA, 64 nt, hsa
ccuccucuguaugcugucacaccuauauuauuaaacuuaucacauugcauuguaauuacuuccu

SEQ ID NO: 118672 - RNA, 64 nt, hsa
augcuauuuguuguuguauaagcuacuguaagaaacuuaucauaaggaaaaauagaaaggaaaa

SEQ ID NO: 118673 - RNA, 64 nt, hsa
aaaacauuauaaaaguaauuuuaauucaccacauacuuaucaauuucuugaugcuuccaaauga

SEQ ID NO: 118674 - RNA, 64 nt, hsa
cuuccaaccuaucuguucugucucccaauguaccacuuaucaacuaaucccucuccucucugau

SEQ ID NO: 118675 - RNA, 64 nt, hsa
ccaagaguucuagauguuugauuuucuaauuaauacuuaucagaucuacaaaaaucauuauuau

SEQ ID NO: 118676 - RNA, 64 nt, hsa
guugacaugaguggaauacuugguuucuuuucuuacuuaucaaaagacagcacuacagauauca

SEQ ID NO: 118677 - RNA, 64 nt, hsa
uacaaguacguaaggauucagggucucuugauagacuuaucauagcucuauauugaaugaaagc

SEQ ID NO: 118678 - RNA, 64 nt, hsa
uccaugguacauauauaccacauuuucuuuauccacuuaucaguugauggacacuuagguuaau

SEQ ID NO: 118679 - RNA, 64 nt, hsa
gaauauaaacauagagcuagaaucauauuaucauacuuaucauaauguucaauuugauacagua

SEQ ID NO: 118680 - RNA, 64 nt, hsa
agaaaagcuucugauggacaugggcuucugugagacuuaucacacauaguguaucguggcauga

SEQ ID NO: 118681 - RNA, 64 nt, hsa
ggucccauaggagcagccuuagcauccccugugaacuuaucaaaaaugcaaauucucaggcccc

SEQ ID NO: 118682 - RNA, 64 nt, hsa
ucaaaucguuuauuucacacgcuguucuaauggcacuuaucauuagaaucuuaccuugugcagu

SEQ ID NO: 118683 - RNA, 64 nt, hsa
agggaaacaaaauauuuauuuguuuuggaaucccacuuaucaaaucauucaaaacuuucagcug

SEQ ID NO: 118684 - RNA, 64 nt, hsa
gcuaacaacucaaucucauuaaguuggaaaaaaaacuuaucaaagagacauuuacaugguuugg

SEQ ID NO: 118685 - RNA, 64 nt, hsa
uauacauuauagauaauucuaagacagcacacaaacuuaucaauaaagccaucuccuugugggc

SEQ ID NO: 118686 - RNA, 64 nt, hsa
cagcucuuacacagugauagguuuguuccaugggacuuaucauaggccuggugauucuugaaag

SEQ ID NO: 118687 - RNA, 64 nt, hsa
uuuucccccugaaccauuuggauguuacagacauacuuaucaccgugaaaauacuucaaguauc

SEQ ID NO: 118688 - RNA, 64 nt, hsa
uuuugaaaagaauuguugauaguuacaucuucaaacuuaucauuccaguaugcaucuuuaagau

SEQ ID NO: 118689 - RNA, 64 nt, hsa
caaguucaggagccgcagagacgcacaacuuuacacuuaucauuucuaacaguuuauuguauaa

SEQ ID NO: 118690 - RNA, 64 nt, hsa
cuuugaaaggauagagcuucauuccauaccaaagacuuaucacaccaugugccuauacacccag

SEQ ID NO: 118691 - RNA, 64 nt, hsa
aaaccuugaugaaaaacacaaaauuuuuccauaaacuuaucagaagacucacuuuucuuucuuu

SEQ ID NO: 118692 - RNA, 64 nt, hsa
uagucacaauuuuuuucagcaguaacaggaaaccacuuaucacauggagaccuaauguaauaau

SEQ ID NO: 118693 - RNA, 64 nt, hsa
caagacacugaggagauacugaacauuuugcaaaacuuaucacgccuacuuaagagugcugugu

SEQ ID NO: 118694 - RNA, 64 nt, hsa
gucccagcuugucagcucugcugccgacuugcugacuuaucaacuuccucuagguguuuccacu

SEQ ID NO: 118695 - RNA, 64 nt, hsa
ugcuaguuagaaauucuuaucaauuuggcaagcuacuuaucaaccagacugaccacaagaacug

SEQ ID NO: 118696 - RNA, 64 nt, hsa
aaacuuccugaaauucuuguaauuuuuuucccauacuuaucagaaguguguuuaccaacuuauu

SEQ ID NO: 118697 - RNA, 64 nt, hsa
cuucuagagguaacuuggauagccuaggcaggcaacuuaucauguggugaaggccgccucaggg

SEQ ID NO: 118698 - RNA, 64 nt, hsa
gaaaagggggagaaauauagccccuagccuaauaacuuaucauuuguaaaaugacuuauaaaaa

SEQ ID NO: 118699 - RNA, 64 nt, hsa
uauuagauuuuccuccuuuccuauuuccccaaagacuuaucagaugcucauugcuuucuaagau

SEQ ID NO: 118700 - RNA, 64 nt, hsa
caugcucaaugaaaaggugauugucaccaugaucacuuaucaguuugcuaauguuuccauaguu

SEQ ID NO: 118701 - RNA, 64 nt, hsa
gacaaacuuucugaacaccaccaccaccaauaauacuuaucagcaucauaaaguaucucuuaaa

SEQ ID NO: 118702 - RNA, 64 nt, hsa
uuuuuccuauuuuucuucuuuuugcuuuuuuugcacuuaucagaaauauuugaugugugcauug

SEQ ID NO: 118703 - RNA, 64 nt, hsa
ccccaacaaauaauuugccaaguguccaaugagaacuuaucauguugguguguuagguaaaucg

SEQ ID NO: 118704 - RNA, 64 nt, hsa
caaaacgugcaauucaggagcccagcagugacacacuuaucacgccuaggcuccaguuugcaaa

SEQ ID NO: 118705 - RNA, 64 nt, hsa
ugcacguggccgacaugcugguuaaggugaacgcacuuaucaaggaucgggaagguuaugcucc

SEQ ID NO: 118706 - RNA, 64 nt, hsa
guuucuucacuugcagcguuuucugcuaagaaagacuuaucaucuuguaucuguuuaugccucu

SEQ ID NO: 118707 - RNA, 64 nt, hsa
uagaucagcugaaacucuaagcacaaaaauaaaaacuuaucacuguauaccacuggaguuuucu

SEQ ID NO: 118708 - RNA, 64 nt, hsa
cucuuuguuguuuagucugucauugaaucaaucuacuuaucaucuugggucuuugaguauugua

SEQ ID NO: 118709 - RNA, 64 nt, hsa
gcugccugauuuguugggaccuucugagccuucuacuuaucauguaaauguauuggcacagugc

SEQ ID NO: 118710 - RNA, 63 nt, hsa
auuucaugaaaaugacauuaaaugcaauaauuuuacuuaucauaaacauuuuguacaucauua

SEQ ID NO: 118711 - RNA, 64 nt, hsa
agggcaauucuauccguugaucuuaguggugaaaacuuaucagauguagacuuccuagaugauu

SEQ ID NO: 118712 - RNA, 64 nt, hsa
uacagcucaaaacuuuuguuucauuucaugccuuacuuaucaaaaaggcaggaaaguagguaug

SEQ ID NO: 118713 - RNA, 64 nt, hsa
gggacuuggacuggaggauacaggcuaaagugacacuuaucagaaucuuccucaagcacuugcu

SEQ ID NO: 118714 - RNA, 64 nt, hsa
cuuggaccccauguguccaucaccuagcugcaucacuuaucagcuauggucaaccugguuucau

SEQ ID NO: 118715 - RNA, 64 nt, hsa
aucaccaauauaaauuuauugccuacaauuguggacuuaucauauuuuuauauauuuuuaaauu

SEQ ID NO: 118716 - RNA, 64 nt, hsa
ccucucacuacuuuccuggcaucuaaugcaacaaacuuaucacacacacacacacacacacaca

SEQ ID NO: 118717 - RNA, 54 nt, hsa
cccgaucuccuccugccugaggccacuuaucagggccuggagcccugauggaag

SEQ ID NO: 118718 - RNA, 64 nt, hsa
guaucaauuaccaccugguuguauugaaauaguaacuuaucaaugccauguaaaaauuaauucc

SEQ ID NO: 118719 - RNA, 55 nt, hsa
caacaacagcagacuucuagcauguacuuaucaauguuguucggucagcccuucc

SEQ ID NO: 118720 - RNA, 64 nt, hsa
uauauacauauuauguaugguuguaaauucauacacuuaucacaugaauguguuacuguauaca

SEQ ID NO: 118721 - RNA, 64 nt, hsa
uggcccuauuacuccugcuuagaacccuguagugacuuaucauggccucugaaaaaucuagacu

SEQ ID NO: 118722 - RNA, 64 nt, hsa
uaucuguguuuguguuggcaugcaagauuuagguacuuaucaaagauaauggggaauuaaggca

SEQ ID NO: 118723 - RNA, 64 nt, hsa
cccuugguccuacucuaggaagugugauugucacacuuaucauguuguccagagguccagucug

SEQ ID NO: 118724 - RNA, 64 nt, hsa
cauuaucuuugucuguucacuuucuaucuuauauacuuaucagggccauacugguaagcuugcg

SEQ ID NO: 118725 - RNA, 64 nt, hsa
ccuuuaaaauuuaacauuccauguaacuuuucugacuuaucauucauaaguugcaaauauuacu

SEQ ID NO: 118726 - RNA, 64 nt, hsa
ugcaauugcauauuauguuuauacucacuucagcacuuaucagagauaauugcaguuucacaag

SEQ ID NO: 118727 - RNA, 64 nt, hsa
gaaaguuuaguggcagcacuucuauugucccuucacuuaucagcauacuauuguagaaagugua

SEQ ID NO: 118728 - RNA, 64 nt, hsa
gaaagguuucugucuuaaaaaaaaaaauccuuguacuuaucaauuuugccccuuaggcagucag

SEQ ID NO: 118729 - RNA, 64 nt, hsa
ccuccccugcccucagaaggaaaggagagggcucacuuaucacuugugccauagcaccuggucu

SEQ ID NO: 118730 - RNA, 64 nt, hsa
cugucuuucuggauggggacuuguauuuuaaauaacuuaucauuccagcuauguuggacuaggg

SEQ ID NO: 118731 - RNA, 64 nt, hsa
auuuggguggcucuuauuaaacuguguauuuuguacuuaucacuacacguaucccccaaaugcu

SEQ ID NO: 118732 - RNA, 64 nt, hsa
cuucauccuauaucagcacagcugccauacuucgacuuaucaggauucuggcugguggccugcg

SEQ ID NO: 118733 - RNA, 64 nt, hsa
uuucaagaaugacugcaguggguuuuggaaacagacuuaucauuauugauuugagguuucccag

SEQ ID NO: 118734 - RNA, 64 nt, hsa
ggaggagaccaggccucuacacaccccccacucuacuuaucaucccugcucacacacccuuguc

SEQ ID NO: 118735 - RNA, 64 nt, hsa
uuucuauaaccaaauugaucuuauuuuugauuucacuuaucauagaacaaauauguaucauuau

SEQ ID NO: 118736 - RNA, 64 nt, hsa
uuuggaugauuuuuuaagcagacucagcugcuauacuuaucacauuuuauuaaacacagggaaa

SEQ ID NO: 118737 - RNA, 64 nt, hsa
accaauaaacauuuauacuagauuuuuuauuuccacuuaucauuaaugauuuaauguuggauuu

SEQ ID NO: 118738 - RNA, 64 nt, hsa
ccaccaggaagcacagguccaaggcuggucccacacuuaucagcagcaacaacugucaguucau

SEQ ID NO: 118739 - RNA, 64 nt, hsa
acuauuugcuugugaaaagguauaaugaggugguacuuaucauuuuuacugugucucauguuuu

SEQ ID NO: 118740 - RNA, 64 nt, hsa
ugucacugcacaucaauauaaaaaagcuuauuuaacuuaucaaaacguauuuauugccaaacua

SEQ ID NO: 118741 - RNA, 64 nt, hsa
aaaaaaacuccugugucggucagaacaacuugcuacuuaucauuuuuguauaaaaaggaaauua

SEQ ID NO: 118742 - RNA, 64 nt, hsa
aauuaccacauuugccuucccuucaucagcuaacacuuaucacuuauacuaccaauaacuuguu

SEQ ID NO: 118743 - RNA, 64 nt, hsa
uuacugguuuuuccaauaaguaauagcaaagcccacuuaucauacuuaaacuacaguaaagaaa

SEQ ID NO: 118744 - RNA, 64 nt, hsa
ggacccgugggguugcuucauugagauaaagcacacuuaucacauagcacaaaggacgugccau

SEQ ID NO: 118745 - RNA, 64 nt, hsa
guaugcuuugguuuagugcaaugugugguagauuacuuaucagaaaacauauaugucaucucua

SEQ ID NO: 118746 - RNA, 64 nt, hsa
uccugagagguggugggcaggagggaggagugagacuuaucagaugggacgcuugccccaagac

SEQ ID NO: 118747 - RNA, 64 nt, hsa
guucuaaggacuagaggucucccuacaaaugaagacuuaucagggcccuagaaagugcuaggag

SEQ ID NO: 118748 - RNA, 64 nt, hsa
ggccccggcugggugagcugagauggaguccucgacuuaucaccacaccacugccccaaggacc

SEQ ID NO: 118749 - RNA, 64 nt, hsa
aagccacccccaaaugcccaagaaaaaaagaaagacuuaucaacauuuguuccaugagcagaaa

SEQ ID NO: 118750 - RNA, 64 nt, hsa
uggcugggauuauucaaaguaggguguguauguaacuuaucacuggaccacuuuaguuuaauca

SEQ ID NO: 118751 - RNA, 64 nt, hsa
aacaguagggcacagucauucugugaauccuuuuacuuaucaaaauuugguagcuauucuaagg

SEQ ID NO: 118752 - RNA, 64 nt, hsa
aagaaggaaaaaaaaagacuucuguucaaaguuaacuuaucagcuacauccucuguaacguggu

SEQ ID NO: 118753 - RNA, 64 nt, hsa
cauuccagaaccucucuuuucuaagaugcacaacacuuaucaaagauauguuuaguuuagacuu

SEQ ID NO: 118754 - RNA, 64 nt, hsa
uacuuagagucgggaugcacaacuucaaccaccgacuuaucaaugcagccgccuguguauugca

SEQ ID NO: 118755 - RNA, 64 nt, hsa
uuuucacacaucagaaaaaacugacuguauaaacacuuaucacugaccuuuuucuauguguagu

SEQ ID NO: 118756 - RNA, 64 nt, hsa
ucacccucacacuggaggaggaugucugcucuggacuuaucaccccaggagaacugaacccgga

SEQ ID NO: 118757 - RNA, 64 nt, hsa
acaguuguggaaaaguguucuagcaacagcauauacuuaucaucauugccuuuccacuacucua

SEQ ID NO: 118758 - RNA, 64 nt, hsa
acaggugugguguaauuuauaaaauuagaaagcaacuuaucagcuacuuaagagaaauggcaag

SEQ ID NO: 118759 - RNA, 64 nt, hsa
gugcugucccuuguauuuacuuuaagcacugaucacuuaucauucauucgguaugguuuucccu

SEQ ID NO: 118760 - RNA, 64 nt, hsa
gagcccaccuggcuuugaaucugggcccuacuuaacuuaucagcuaugugguuuugggcauaag

SEQ ID NO: 118761 - RNA, 64 nt, hsa
aauaauauggcauuuaagaggugaaagaguucagacuuaucaccauucuuaugucacuuuagaa

SEQ ID NO: 118762 - RNA, 64 nt, hsa
guguuuggaauuggguuuuucaaugaguggcuuuacuuaucaaucacaacagguaauagcaaua

SEQ ID NO: 118763 - RNA, 64 nt, hsa
uuuagauacucaucaggaccucacaggagcugagacuuaucagccagaauguguucuucggaca

SEQ ID NO: 118764 - RNA, 64 nt, hsa
aaaguuagaacuauuacaaccccuguuuccugguacuuaucaaauacuuaguaucauggggguu

SEQ ID NO: 118765 - RNA, 64 nt, hsa
acuagggagaccauuaacuaguuuaucauuaaccacuuaucaguguauugauguuaaagcauuu

SEQ ID NO: 118766 - RNA, 64 nt, hsa
gguaccuaugaaccuagaacuugaagugacuccuacuuaucacguaaauuuuuaugucugauau

SEQ ID NO: 118767 - RNA, 64 nt, hsa
aggagaucuggggaggcccugcccccuacaccauacuuaucaccacccuccucuuuucugccug

SEQ ID NO: 118768 - RNA, 64 nt, hsa
agcaggcccuuucugacaugcuuuagcagagauaacuuaucagggcuaguuuaaacaaaugugu

SEQ ID NO: 118769 - RNA, 64 nt, hsa
auauaaaaagaagagguugaaagauuauuaaauaacuuaucaggcaucucaaugguuacuaucu

SEQ ID NO: 118770 - RNA, 64 nt, hsa
agcugauggauucaucugcuuuggcugaaauuaaacuuaucauuagucuagcuagcauuucagc

SEQ ID NO: 118771 - RNA, 64 nt, hsa
acuaauauuuuuagaucuuuuuacuucaccucauacuuaucaccaauguauaucuccauuuauu

SEQ ID NO: 118772 - RNA, 64 nt, hsa
aaaggcuuaggcauguucaaacgccugcaaaacuacuuaucacucagcuuuaguuuuucuaauc

SEQ ID NO: 118773 - RNA, 64 nt, hsa; identical to SEQ ID NO: 118769

SEQ ID NO: 118774 - RNA, 64 nt, hsa; identical to SEQ ID NO: 100180

SEQ ID NO: 118775 - RNA, 64 nt, hsa; identical to SEQ ID NO: 100181

SEQ ID NO: 118776 - RNA, 64 nt, hsa; identical to SEQ ID NO: 100182

SEQ ID NO: 118777 - RNA, 64 nt, hsa; identical to SEQ ID NO: 100183

SEQ ID NO: 118778 - RNA, 64 nt, hsa; identical to SEQ ID NO: 100184

SEQ ID NO: 118779 - RNA, 64 nt, hsa; identical to SEQ ID NO: 100185

SEQ ID NO: 118780 - RNA, 64 nt, hsa; identical to SEQ ID NO: 100186

SEQ ID NO: 118781 - RNA, 64 nt, hsa; identical to SEQ ID NO: 100187

SEQ ID NO: 118782 - RNA, 64 nt, hsa; identical to SEQ ID NO: 100188

SEQ ID NO: 118783 - RNA, 64 nt, hsa; identical to SEQ ID NO: 100189

SEQ ID NO: 118784 - RNA, 64 nt, hsa; identical to SEQ ID NO: 100190

SEQ ID NO: 118785 - RNA, 64 nt, hsa; identical to SEQ ID NO: 100191

SEQ ID NO: 118786 - RNA, 64 nt, hsa
uccuucccagaagucucccgagagacauauuuguguggccuagaaguccucuguggucuccccu

SEQ ID NO: 118787 - RNA, 64 nt, hsa
accuuauugugagguuccauccagccaaguuuauguggccuauugucucaggacucucaucacu

SEQ ID NO: 118788 - RNA, 64 nt, hsa
ccuaauuucaugacccagugguuugcaguccagcguggccuacacggauauggggagccacuga

SEQ ID NO: 118789 - RNA, 64 nt, hsa
uuucuguuuucuguuucauaacacaaggcugguuguggccuacaaaccuaauuucaugacccag

SEQ ID NO: 118790 - RNA, 64 nt, hsa
uaucuaccaguaugagccauaccugcgggacccuguggccuacccuaaggugcaggugagaggg

SEQ ID NO: 118791 - RNA, 53 nt, hsa
agggaacgucucagguguaggugguggccuagcauugcuuacauccacccugu

SEQ ID NO: 118792 - RNA, 64 nt, hsa
uucuaccaacuaugguugccucaauauaaccuuuuauucauagauguuuuuuuuuauucaacuu

SEQ ID NO: 118793 - RNA, 64 nt, hsa
ucuagugcauuuccaugguccccaauucauaguuuauucauaaugcuaugucacuauuuuugua

SEQ ID NO: 118794 - RNA, 64 nt, hsa
aaaauuuucuuuauuguaaaguaugcaaaauauauauucauaccauuuauuaaaucagaauguu

SEQ ID NO: 118795 - RNA, 64 nt, hsa
cauaugaguugaugugauacuucuagaacaaaauuauucauagugcguuuuuuguaauuuauga

SEQ ID NO: 118796 - RNA, 64 nt, hsa
gaguaaccgacaauauauuuauuuauaaagcacauauucauaauaacgagaagaauucagaaaa

SEQ ID NO: 118797 - RNA, 64 nt, hsa
ccagcaagcaacuucccuggggaagccaaacacauauucauaaaaaaaaucaaguagcugaugu

SEQ ID NO: 118798 - RNA, 64 nt, hsa
cugaagacuaguuauauauuccuuacuagaaauauauucauaauauauaaaagaaauauaucug

SEQ ID NO: 118799 - RNA, 64 nt, hsa
uuagacugaaaaacuguugguucauccagaaguguauucauauuaccagaaaaugaguuugucu

SEQ ID NO: 118800 - RNA, 64 nt, hsa
aaaucaugguaccuguuuuaaaaugagaaguuauuauucauacuguguugcucauuugacaaaa

SEQ ID NO: 118801 - RNA, 64 nt, hsa
augaugucuuccucucucucaaaauaaacuaaccuauucauauugcugugaaugcuuuaucuug

SEQ ID NO: 118802 - RNA, 64 nt, hsa
aauucuggucucggugcaaauguuaguuaugccuuauucauaucacaguuagaucaccaugcug

SEQ ID NO: 118803 - RNA, 64 nt, hsa
gaacaauuguaaaccugacaugguacugugcaucuauucauaaaacacucaaaacugugaaaau

SEQ ID NO: 118804 - RNA, 64 nt, hsa
uucucaucugaauggaauaagucugaauaccccauauucauacuccuaaucucauuauaucuua

SEQ ID NO: 118805 - RNA, 64 nt, hsa
ucaauagcagucaacauuuuauccuuucuuuuuauauucauaauguuauuuaagugucauugau

SEQ ID NO: 118806 - RNA, 64 nt, hsa
cagagucuaccuugaaaccaauuaagcagcuugguauucauaaauauugggauuggauggccuc

SEQ ID NO: 118807 - RNA, 64 nt, hsa
caucuaaagcagcaggucuagaagaacaacgguuuauucauacuugcauucuuuuggcaguucu

SEQ ID NO: 118808 - RNA, 64 nt, hsa
uaauuugcaucucauuuugccuaaauugguucuguauucauaaacacuuuccacauagaaaaua

SEQ ID NO: 118809 - RNA, 64 nt, hsa
agggauuuuuuuuuuuuuaaugaaaaaaaauuucuauucauagcuuauccuucagagcaaugac

SEQ ID NO: 118810 - RNA, 64 nt, hsa
cccuucuaaaguguacaauucaguggugugaguauauucauaagauuuauacuuggugucuauu

SEQ ID NO: 118811 - RNA, 64 nt, hsa
ugugaguauauucauaagauuuauacuuggugucuauucauaagacuuauauccagcauauuca

SEQ ID NO: 118812 - RNA, 64 nt, hsa
acuuggugucuauucauaagacuuauauccagcauauucauaacuagagccauaucacagaugc

SEQ ID NO: 118813 - RNA, 64 nt, hsa
ccugugucacuucugacaugagccuguaaacauauauucauauauguaccugcacauguaccca

SEQ ID NO: 118814 - RNA, 64 nt, hsa
aggucuuauuccuuuaguauggacuuaaaguacuuauucauauaccuuguaacuaaaaauuaga

SEQ ID NO: 118815 - RNA, 64 nt, hsa
uuauguguaccuuggagucauccucuuggucuuguauucauauugugggacagugggaauagca

SEQ ID NO: 118816 - RNA, 64 nt, hsa
uauauugugcuuuaauuuuuuaaaaaguauucuuuauucauauguauagaaugcuuaaaauagc

SEQ ID NO: 118817 - RNA, 64 nt, hsa; identical to SEQ ID NO: 97557

SEQ ID NO: 118818 - RNA, 64 nt, hsa; identical to SEQ ID NO: 97558

SEQ ID NO: 118819 - RNA, 64 nt, hsa; identical to SEQ ID NO: 97559

SEQ ID NO: 118820 - RNA, 64 nt, hsa; identical to SEQ ID NO: 97560

SEQ ID NO: 118821 - RNA, 64 nt, hsa; identical to SEQ ID NO: 97561

SEQ ID NO: 118822 - RNA, 64 nt, hsa; identical to SEQ ID NO: 97562

SEQ ID NO: 118823 - RNA, 64 nt, hsa; identical to SEQ ID NO: 97563

SEQ ID NO: 118824 - RNA, 64 nt, hsa; identical to SEQ ID NO: 97564

SEQ ID NO: 118825 - RNA, 64 nt, hsa; identical to SEQ ID NO: 97565

SEQ ID NO: 118826 - RNA, 64 nt, hsa; identical to SEQ ID NO: 97566

SEQ ID NO: 118827 - RNA, 62 nt, hsa; identical to SEQ ID NO: 97567

SEQ ID NO: 118828 - RNA, 64 nt, hsa; identical to SEQ ID NO: 97568

SEQ ID NO: 118829 - RNA, 64 nt, hsa; identical to SEQ ID NO: 97569

SEQ ID NO: 118830 - RNA, 64 nt, hsa; identical to SEQ ID NO: 97570

SEQ ID NO: 118831 - RNA, 64 nt, hsa; identical to SEQ ID NO: 97571

SEQ ID NO: 118832 - RNA, 64 nt, hsa; identical to SEQ ID NO: 97572

SEQ ID NO: 118833 - RNA, 64 nt, hsa; identical to SEQ ID NO: 104428

SEQ ID NO: 118834 - RNA, 64 nt, hsa; identical to SEQ ID NO: 104429

SEQ ID NO: 118835 - RNA, 64 nt, hsa; identical to SEQ ID NO: 104430

SEQ ID NO: 118836 - RNA, 64 nt, hsa; identical to SEQ ID NO: 104431

SEQ ID NO: 118837 - RNA, 64 nt, hsa; identical to SEQ ID NO: 104432

SEQ ID NO: 118838 - RNA, 64 nt, hsa; identical to SEQ ID NO: 104433

SEQ ID NO: 118839 - RNA, 64 nt, hsa; identical to SEQ ID NO: 104434

SEQ ID NO: 118840 - RNA, 64 nt, hsa; identical to SEQ ID NO: 104435

SEQ ID NO: 118841 - RNA, 64 nt, hsa; identical to SEQ ID NO: 104436

SEQ ID NO: 118842 - RNA, 64 nt, hsa; identical to SEQ ID NO: 104437

SEQ ID NO: 118843 - RNA, 64 nt, hsa; identical to SEQ ID NO: 104438

SEQ ID NO: 118844 - RNA, 64 nt, hsa; identical to SEQ ID NO: 104439

SEQ ID NO: 118845 - RNA, 64 nt, hsa; identical to SEQ ID NO: 104440

SEQ ID NO: 118846 - RNA, 64 nt, hsa; identical to SEQ ID NO: 104441

SEQ ID NO: 118847 - RNA, 64 nt, hsa; identical to SEQ ID NO: 104442

SEQ ID NO: 118848 - RNA, 64 nt, hsa; identical to SEQ ID NO: 104443

SEQ ID NO: 118849 - RNA, 64 nt, hsa; identical to SEQ ID NO: 104444

SEQ ID NO: 118850 - RNA, 64 nt, hsa; identical to SEQ ID NO: 104445

SEQ ID NO: 118851 - RNA, 64 nt, hsa; identical to SEQ ID NO: 104446

SEQ ID NO: 118852 - RNA, 64 nt, hsa; identical to SEQ ID NO: 104447

SEQ ID NO: 118853 - RNA, 64 nt, hsa; identical to SEQ ID NO: 104448

SEQ ID NO: 118854 - RNA, 64 nt, hsa; identical to SEQ ID NO: 104449

SEQ ID NO: 118855 - RNA, 64 nt, hsa; identical to SEQ ID NO: 104450

SEQ ID NO: 118856 - RNA, 64 nt, hsa; identical to SEQ ID NO: 104451

SEQ ID NO: 118857 - RNA, 64 nt, hsa
cagccauaaaaacugaauuccugucauucaggacaacauggauggaauuggagggcauauguua

SEQ ID NO: 118858 - RNA, 64 nt, hsa
ugggaauguaaacuagagcagccauguggagaacaacauggacuuucuucaaaaauuacaaaua

SEQ ID NO: 118859 - RNA, 64 nt, hsa
ucguaugacccuggccucucgugaagagcagcacaacauggaaagagccaaaaugucacaguuc

SEQ ID NO: 118860 - RNA, 64 nt, hsa
aaaugcuuuuauuagccaauaggaauuuuaaaauaacauggaacuuacacaaaaggcuuuucau

SEQ ID NO: 118861 - RNA, 64 nt, hsa
cccuucaccagaaugucaaucuuuuuuucuguguaacauggaaacuugugugaccauuagcauu

SEQ ID NO: 118862 - RNA, 64 nt, hsa
uuguucuuggcucuggccuuuccuacuugucuuuaacauggacacucaugagucauccuccagg

SEQ ID NO: 118863 - RNA, 64 nt, hsa
uuccuaccuaguaacuugagacuuuaaaagaagaaacauggagaagaugugggagcgaauuuau

SEQ ID NO: 118864 - RNA, 64 nt, hsa
ucauauagagguuaauuuaaucaaaaugagcuaaaacauggaacaaucacugaauaauuuaaaa

SEQ ID NO: 118865 - RNA, 64 nt, hsa; identical to SEQ ID NO: 100778

SEQ ID NO: 118866 - RNA, 64 nt, hsa; identical to SEQ ID NO: 100779

SEQ ID NO: 118867 - RNA, 64 nt, hsa; identical to SEQ ID NO: 100780

SEQ ID NO: 118868 - RNA, 64 nt, hsa; identical to SEQ ID NO: 100781

SEQ ID NO: 118869 - RNA, 64 nt, hsa; identical to SEQ ID NO: 100782

SEQ ID NO: 118870 - RNA, 64 nt, hsa; identical to SEQ ID NO: 100783

SEQ ID NO: 118871 - RNA, 64 nt, hsa; identical to SEQ ID NO: 100784

SEQ ID NO: 118872 - RNA, 64 nt, hsa; identical to SEQ ID NO: 100785

SEQ ID NO: 118873 - RNA, 64 nt, hsa; identical to SEQ ID NO: 100786

SEQ ID NO: 118874 - RNA, 64 nt, hsa; identical to SEQ ID NO: 100787

SEQ ID NO: 118875 - RNA, 64 nt, hsa; identical to SEQ ID NO: 100788

SEQ ID NO: 118876 - RNA, 64 nt, hsa; identical to SEQ ID NO: 100789

SEQ ID NO: 118877 - RNA, 64 nt, hsa; identical to SEQ ID NO: 100790

SEQ ID NO: 118878 - RNA, 64 nt, hsa
gaccaugcucaucugcugguccgugggacggugcccaagccagaggcuggguucauuuguguaa

SEQ ID NO: 118879 - RNA, 64 nt, hsa
gaggugggccagucuguggaucagagaugcaccaccaagccaagggaaccuguguccgguauuc

SEQ ID NO: 118880 - RNA, 64 nt, hsa
uugaaauuucauccagagucugcaguccaggucaccaagccagcggcacccgucggcaacccug

SEQ ID NO: 118881 - RNA, 64 nt, hsa
uuugaaacuucuuagcugucacuuuggaaucaccccaagccaauucucuuaacucuguaaugca

SEQ ID NO: 118882 - RNA, 64 nt, hsa
gagacccugagacagugugaggggguggggacugccaagccacccuaagaccuugggaggaaaa

SEQ ID NO: 118883 - RNA, 64 nt, hsa
gcagcauuggaaggcuggggccgggcaggccaggccaagccaagcagggggccacagggugggc

SEQ ID NO: 118884 - RNA, 64 nt, hsa
uuuuuaguauguggcguaucaugcaagugcuaugccaagccaugucuaaauggcuuuaauuaua

SEQ ID NO: 118885 - RNA, 64 nt, hsa
uuccuagaggguaaauaugacuccuuucucuaucccaagccaaccaagagcacauucuuaaagg

SEQ ID NO: 118886 - RNA, 64 nt, hsa
gagacccgggagggccuuccucugaaaggccaagccaagccaugcuuggcagggugaggggcca

SEQ ID NO: 118887 - RNA, 64 nt, hsa
acucagagacccgggagggccuuccucugaaaggccaagccaagccaugcuuggcagggugagg

SEQ ID NO: 118888 - RNA, 64 nt, hsa
aaauaaaccaaaccagccacuugcacuauggcuuccaagccaauguuauugacucaauaagugc

SEQ ID NO: 118889 - RNA, 64 nt, hsa
gaaagugaucucaagagguccagggacuuaacagccaagccacaccacccgacagguucuucug

SEQ ID NO: 118890 - RNA, 64 nt, hsa
gcaggaucccaggggaagggucucucucugcaucccaagccauccagcccuucucccuguaccc

SEQ ID NO: 118891 - RNA, 56 nt, hsa
cuguucccgccguccucugaggagcuccaagccaacaaggcuacacuggugugucu

SEQ ID NO: 118892 - RNA, 63 nt, hsa
caaagaaaugccaauaugugacauuaguaugaaauuuacuacaguuccauuuaacauuccaac

SEQ ID NO: 118893 - RNA, 63 nt, hsa
auaaaauauuggcaaacaauacagcaacaaauaauuuacuaucacucaggauuauaaggcugg

SEQ ID NO: 118894 - RNA, 63 nt, hsa
acccuuuuaaaaccaucagauaucgugagacuuauuuacuaccaugagaacaguaugggggaa

SEQ ID NO: 118895 - RNA, 63 nt, hsa
caauugcauacccauauuuuaagggacaggugaauuuacuacuuucuaaaguuuauugauacu

SEQ ID NO: 118896 - RNA, 63 nt, hsa
aguaacauaaaauaaaaguacauuuuauaaaccauuuacuauggcuuuguaacaauugcauac

SEQ ID NO: 118897 - RNA, 63 nt, hsa
uauaucuauuaaaaauuucaacuucccacauauauuuacuaagaugauuaagacuuacauuuu

SEQ ID NO: 118898 - RNA, 63 nt, hsa
aaugaauaucugcaugggauuugcuaucauaauauuuacuaugcagaugaauucagugugagg

SEQ ID NO: 118899 - RNA, 63 nt, hsa
auuuuuaaaauucagaauguaaaaauuggguaaauuuacuacugaggggagugcacuuauuua

SEQ ID NO: 118900 - RNA, 63 nt, hsa
uuuuugauguuuauauauaaacucuauauccuaauuuacuaauacucaucagaugucagccuu

SEQ ID NO: 118901 - RNA, 63 nt, hsa
gauacuaaugacuacaaaaaaagguaaugccucauuuacuaguauuguuguaaaaugaggaau

SEQ ID NO: 118902 - RNA, 63 nt, hsa
ugcuagcaaggcugagcacuuuuccaugugaugauuuacuaguuguauuuccuuguguguaaa

SEQ ID NO: 118903 - RNA, 55 nt, hsa
ggcgcaugagaccauauuaaauucuauuuacuauuuguugaauuuauuuuuccgu

SEQ ID NO: 118904 - RNA, 63 nt, hsa
cuauucguggugggggugggggggaacccuaugauuuacuaugcagaugaagaggguaggaac

SEQ ID NO: 118905 - RNA, 63 nt, hsa
ccuggagggcacuguguuugguugugcaaauguauuuacuaugcguguuuccagcaguuggca

SEQ ID NO: 118906 - RNA, 63 nt, hsa
ucuaucucacuggcugcauucccuacacagggaauuuacuacccuauaugugaauaucccugu

SEQ ID NO: 118907 - RNA, 64 nt, hsa
agccugggugacagagcgagacucuggcucauaaaauaauaauaauaauaaauaaauaaaaaau

SEQ ID NO: 118908 - RNA, 64 nt, hsa
cugggugacagagcgagacucuggcucauaaaauaauaauaauaauaaauaaauaaaaaauaaa

SEQ ID NO: 118909 - RNA, 64 nt, hsa
ggugacagagcgagacucuggcucauaaaauaauaauaauaauaaauaaauaaaaaauaaaugu

SEQ ID NO: 118910 - RNA, 64 nt, hsa
gacagagcgagacucuggcucauaaaauaauaauaauaauaaauaaauaaaaaauaaauguuuu

SEQ ID NO: 118911 - RNA, 64 nt, hsa
uaccugcaaaaaauauuuuguauauauccaauuuaauaauaaaugcacucauguuaggaagguc

SEQ ID NO: 118912 - RNA, 64 nt, hsa
auguuaggaaggucaaaaaaaaggaaaaaagaaaaauaauaaaaaauaauaaaaauccuuagga

SEQ ID NO: 118913 - RNA, 64 nt, hsa
ggucaaaaaaaaggaaaaaagaaaaauaauaaaaaauaauaaaaauccuuaggauaacuugagg

SEQ ID NO: 118914 - RNA, 64 nt, hsa
cuagaaauaacaugauuuagucauaauugugaaaaauaauaauaauuuuucuuggauuuauguu

SEQ ID NO: 118915 - RNA, 64 nt, hsa
gaaauaacaugauuuagucauaauugugaaaaauaauaauaauuuuucuuggauuuauguucug

SEQ ID NO: 118916 - RNA, 64 nt, hsa
gugauuuugugagaucagcugaaccacuuaugauaauaauaauaaaaaagacugcuuugcccuc

SEQ ID NO: 118917 - RNA, 64 nt, hsa
auuuugugagaucagcugaaccacuuaugauaauaauaauaaaaaagacugcuuugcccucacg

SEQ ID NO: 118918 - RNA, 64 nt, hsa
uugaucauccagagaacauugacagacaauuaugaauaauaaagauguuaacaauccaucugua

SEQ ID NO: 118919 - RNA, 64 nt, hsa
cucuaaaauacauaaguaaauuuaaaaaaaaaagaauaauaauuugaacagugaauguugaugu

SEQ ID NO: 118920 - RNA, 64 nt, hsa
ccugggugacagagcaagacuccaucucaaaaaaaauaauaauaauaaauaaauaaaaaauccc

SEQ ID NO: 118921 - RNA, 64 nt, hsa
gggugacagagcaagacuccaucucaaaaaaaauaauaauaauaaauaaauaaaaaaucccaau

SEQ ID NO: 118922 - RNA, 64 nt, hsa
ugacagagcaagacuccaucucaaaaaaaauaauaauaauaaauaaauaaaaaaucccaauuac

SEQ ID NO: 118923 - RNA, 64 nt, hsa
guaaaggguuugggacagcaccugguauagaauaaauaauaaauguaaacuauuauuuuugguu

SEQ ID NO: 118924 - RNA, 64 nt, hsa
uagccuguaauuaugagaacaguaaacuuuaaguaauaauaaagaaucccauccauauauccaa

SEQ ID NO: 118925 - RNA, 64 nt, hsa
agagcccacauugucuguagccaucaaaaauaauaauaauaaacuggacaguuuacaaucguug

SEQ ID NO: 118926 - RNA, 64 nt, hsa
gugagagcccacauugucuguagccaucaaaaauaauaauaauaaacuggacaguuuacaaucg

SEQ ID NO: 118927 - RNA, 64 nt, hsa
ggugugagagcccacauugucuguagccaucaaaaauaauaauaauaaacuggacaguuuacaa

SEQ ID NO: 118928 - RNA, 64 nt, hsa
uucaugaaaaguauguuguuguuuugauaguaauaauaauaaauguaggcucagcucuuuccca

SEQ ID NO: 118929 - RNA, 64 nt, hsa
uucuucaugaaaaguauguuguuguuuugauaguaauaauaauaaauguaggcucagcucuuuc

SEQ ID NO: 118930 - RNA, 64 nt, hsa
gauucaaagugguaacccaaauucauaaagcaauaauaauaaaaaccuauauaguauguucucu

SEQ ID NO: 118931 - RNA, 64 nt, hsa
gaugauucaaagugguaacccaaauucauaaagcaauaauaauaaaaaccuauauaguauguuc

SEQ ID NO: 118932 - RNA, 64 nt, hsa
cuuccuaaacugaucacaacuauuaaacuuagagaauaauaauagucuuucugaugaggcugcc

SEQ ID NO: 118933 - RNA, 64 nt, hsa
acuugcuguucaaauuaaguagaaagugagacucaauaauaacugaacuacagcaaaaggcaga

SEQ ID NO: 118934 - RNA, 64 nt, hsa
uuuugggguaucaguguuugacuagggaucaugaaauaauaaacugaaaaaaacuuuagaguuc

SEQ ID NO: 118935 - RNA, 64 nt, hsa
cugggaaacauagcaagaucucauccuuacaaaaaauaauaauggugugugccugcaguccuag

SEQ ID NO: 118936 - RNA, 64 nt, hsa
uuaccaaaaaauuuuuaaguauuuucuuaauuugaauaauaaaaccagaggaaaugcauacagg

SEQ ID NO: 118937 - RNA, 64 nt, hsa
aaaaccaaaugauaucuaaguaguucucagcaauaauaauaaugacgauaauacuucuuuucca

SEQ ID NO: 118938 - RNA, 64 nt, hsa
aacaaaaccaaaugauaucuaaguaguucucagcaauaauaauaaugacgauaauacuucuuuu

SEQ ID NO: 118939 - RNA, 64 nt, hsa
ugauuuuugaagguauuuacuuuaggguucuuuuaauaauaauguccguccuaaugcuuuaaau

SEQ ID NO: 118940 - RNA, 64 nt, hsa
aaaacugaggcaguuaaccaaaguagcucauauaaauaauaaaaccaaucugaguuuagccuca

SEQ ID NO: 118941 - RNA, 64 nt, hsa
cuaauguaagauuagcuauuauuuguaggacugaaauaauaauccagauaauugguuuuugccu

SEQ ID NO: 118942 - RNA, 64 nt, hsa
uugcauuauagccaguaguaaaaauaauaauaauaauaauaaaaccaugucuauagcuguagau

SEQ ID NO: 118943 - RNA, 64 nt, hsa
gaguugcauuauagccaguaguaaaaauaauaauaauaauaauaaaaccaugucuauagcugua

SEQ ID NO: 118944 - RNA, 64 nt, hsa
caggaguugcauuauagccaguaguaaaaauaauaauaauaauaauaaaaccaugucuauagcu

SEQ ID NO: 118945 - RNA, 64 nt, hsa
auccaggaguugcauuauagccaguaguaaaaauaauaauaauaauaauaaaaccaugucuaua

SEQ ID NO: 118946 - RNA, 64 nt, hsa
auaauccaggaguugcauuauagccaguaguaaaaauaauaauaauaauaauaaaaccaugucu

SEQ ID NO: 118947 - RNA, 64 nt, hsa
uauucuauuccuuaccaguaauaagguucuuccuaauaauaauuaagagauugaaacuccaaac

SEQ ID NO: 118948 - RNA, 64 nt, hsa
uucuggucuucuuuaccaauauaaucauaauguaaauaauaauuuguauauuguguugcagaug

SEQ ID NO: 118949 - RNA, 64 nt, hsa
augucucuuccaaucaugacuuuggaacucccugaauaauaaaaaugagaguugagauaaauag

SEQ ID NO: 118950 - RNA, 64 nt, hsa
aagaaucuaaaugucgucuuugacucaaguaccaaauaauaauaaugcuauacuuaaauuacuu

SEQ ID NO: 118951 - RNA, 64 nt, hsa
aaucuaaaugucgucuuugacucaaguaccaaauaauaauaaugcuauacuuaaauuacuugug

SEQ ID NO: 118952 - RNA, 64 nt, hsa
uuuucucugucuuccaugucuugagaucucagagaauaauaauaaaaauguuacuuuauacgua

SEQ ID NO: 118953 - RNA, 64 nt, hsa
ucucugucuuccaugucuugagaucucagagaauaauaauaaaaauguuacuuuauacguauau

SEQ ID NO: 118954 - RNA, 64 nt, hsa
uccccagggccucugcucuccugggagacaaagcaauaauaaaaggaaguguuuguaaucccag

SEQ ID NO: 118955 - RNA, 64 nt, hsa
ucaaaaauaaacaaauaaauuuuaaaaauaaauaaauaauaaaaggaaguguuagacaauguaa

SEQ ID NO: 118956 - RNA, 64 nt, hsa
acugcagcgccgauuugaggguggagauauagauaauaauaauauuaauaauaauaauggccac

SEQ ID NO: 118957 - RNA, 64 nt, hsa
auuugaggguggagauauagauaauaauaauauuaauaauaauaauggccacauggaucgaaca

SEQ ID NO: 118958 - RNA, 64 nt, hsa
ugaggguggagauauagauaauaauaauauuaauaauaauaauggccacauggaucgaacacuc

SEQ ID NO: 118959 - RNA, 64 nt, hsa
auuucauuauguuggccaacagaacuugauuguaaauaauaauaaagaaaucuguuauauacuu

SEQ ID NO: 118960 - RNA, 64 nt, hsa
ucauuauguuggccaacagaacuugauuguaaauaauaauaaagaaaucuguuauauacuuuuc

SEQ ID NO: 118961 - RNA, 64 nt, hsa
agauuuuauguaguauuaagugaaaaaauacgaaaauaauaaacauugaagaaaaaaauaacuu

SEQ ID NO: 118962 - RNA, 64 nt, hsa
uaauaaaauaauuuuuauggcaauacaacugugaaauaauaaggccgauuuucauauaaaugua

SEQ ID NO: 118963 - RNA, 64 nt, hsa
uauuucucuugauucuugguuaaauuuguuuaauaauaauaauauccuaaauuuuuuauauuua

SEQ ID NO: 118964 - RNA, 64 nt, hsa
aaguauuucucuugauucuugguuaaauuuguuuaauaauaauaauauccuaaauuuuuuauau

SEQ ID NO: 118965 - RNA, 64 nt, hsa
uacuuuuuggaaacaaaucuucuguuauuuacaaaauaauaauuuuuaaaaaacauuuaaaaaa

SEQ ID NO: 118966 - RNA, 64 nt, hsa
caguauugucacuuuugcucucacuguuauguugaauaauaauuagcauauaauugucuacaga

SEQ ID NO: 118967 - RNA, 64 nt, hsa
ucacuaaucaugagaaaaacuguucuuuugcaauaauaauaaauuaaacaugcuguuaccagag

SEQ ID NO: 118968 - RNA, 64 nt, hsa
auuucacuaaucaugagaaaaacuguucuuuugcaauaauaauaaauuaaacaugcuguuacca

SEQ ID NO: 118969 - RNA, 64 nt, hsa
caugcucagauauguaucuaggauaauuauaauuaauaauaaucauaguaacaauggcuaauga

SEQ ID NO: 118970 - RNA, 64 nt, hsa
uccuuuacagguuuauuucuuuguaaaaaaaaauaauaauaauuugaaucauguaauauuuaag

SEQ ID NO: 118971 - RNA, 64 nt, hsa
ugauccuuuacagguuuauuucuuuguaaaaaaaaauaauaauaauuugaaucauguaauauuu

SEQ ID NO: 118972 - RNA, 64 nt, hsa
uuccuuaaacauccaauaauuuaaaaugauuuucaauaauaauaaucaaaugaaaaagcuucau

SEQ ID NO: 118973 - RNA, 64 nt, hsa
cuuaaacauccaauaauuuaaaaugauuuucaauaauaauaaucaaaugaaaaagcuucauucu

SEQ ID NO: 118974 - RNA, 64 nt, hsa
aaaagaaagggucuuuucagaaacugaaguaggaaauaauaacagacaaggucaaaaaauagau

SEQ ID NO: 118975 - RNA, 64 nt, hsa
cacuuccucaggugcagacccuuggacuuguaauaauaauaaguauuuucauaaucacugcagc

SEQ ID NO: 118976 - RNA, 64 nt, hsa
ggacacuuccucaggugcagacccuuggacuuguaauaauaauaaguauuuucauaaucacugc

SEQ ID NO: 118977 - RNA, 64 nt, hsa
cuuggacuugucagcaaaaaaaaaaaauaauaauaauaauaaggccugcuguguaagcugacag

SEQ ID NO: 118978 - RNA, 64 nt, hsa
caucuuggacuugucagcaaaaaaaaaaaauaauaauaauaauaaggccugcuguguaagcuga

SEQ ID NO: 118979 - RNA, 64 nt, hsa
ugccaucuuggacuugucagcaaaaaaaaaaaauaauaauaauaauaaggccugcuguguaagc

SEQ ID NO: 118980 - RNA, 64 nt, hsa
gacugccaucuuggacuugucagcaaaaaaaaaaaauaauaauaauaauaaggccugcugugua

SEQ ID NO: 118981 - RNA, 64 nt, hsa
auguauauucuuccuugauuguguagcuguccaaaauaauaacauauauagagggagcuguauu

SEQ ID NO: 118982 - RNA, 64 nt, hsa
agcugagaggugucugccacuucugggucaauggaauaauaaauuaaguacaggcaggaauuug

SEQ ID NO: 118983 - RNA, 64 nt, hsa
gucuacagcaugccaguaaauaauauguaggaccaauaauaaauuaucaauuacacauuuuugu

SEQ ID NO: 118984 - RNA, 64 nt, hsa
caugauagauaaauauguaucuacacagaguaauaauaauaaaacacaguaaacauucuauuuc

SEQ ID NO: 118985 - RNA, 64 nt, hsa
ugacaugauagauaaauauguaucuacacagaguaauaauaauaaaacacaguaaacauucuau

SEQ ID NO: 118986 - RNA, 64 nt, hsa
cagagugagacuccaucucaaaaauaauaauaauaauaauaaaguaaaaauaaaaauaaaaaag

SEQ ID NO: 118987 - RNA, 64 nt, hsa
ugacagagugagacuccaucucaaaaauaauaauaauaauaauaaaguaaaaauaaaaauaaaa

SEQ ID NO: 118988 - RNA, 64 nt, hsa
gggugacagagugagacuccaucucaaaaauaauaauaauaauaauaaaguaaaaauaaaaaua

SEQ ID NO: 118989 - RNA, 64 nt, hsa
ccugggugacagagugagacuccaucucaaaaauaauaauaauaauaauaaaguaaaaauaaaa

SEQ ID NO: 118990 - RNA, 64 nt, hsa
cagccugggugacagagugagacuccaucucaaaaauaauaauaauaauaauaaaguaaaaaua

SEQ ID NO: 118991 - RNA, 64 nt, hsa
uuuugcuaucuuuuuuaguguuaaagagauaaagaauaauaauuaaccaaccuuguuuaauaga

SEQ ID NO: 118992 - RNA, 64 nt, hsa
uaucggcagaugaugcuuuggaagaugcagaagcaauaauaaaguacuugacuaccuacuggug

SEQ ID NO: 118993 - RNA, 64 nt, hsa
ugcacuuuugaauguccaaaauuuauauuuuagaaauaauaaaaagaaagauacuuacauguuc

SEQ ID NO: 118994 - RNA, 64 nt, hsa
guugcauuucaguaaaagcagaauaaccuuucaaaauaauaacaggcugggugcaauggcucac

SEQ ID NO: 118995 - RNA, 64 nt, hsa
cuggccugggcaacagagcaagacccugucucaaaauaauaauaauauauaauuuuacaccaaa

SEQ ID NO: 118996 - RNA, 64 nt, hsa
gccugggcaacagagcaagacccugucucaaaauaauaauaauauauaauuuuacaccaaaagu

SEQ ID NO: 118997 - RNA, 64 nt, hsa
acaacguguuucugaaaaacagauuuucauaaguaauaauaaaaauaauaauaaaaaaguuuug

SEQ ID NO: 118998 - RNA, 64 nt, hsa
uucugaaaaacagauuuucauaaguaauaauaaaaauaauaauaaaaaaguuuugguaugguaa

SEQ ID NO: 118999 - RNA, 64 nt, hsa
ugaaaaacagauuuucauaaguaauaauaaaaauaauaauaaaaaaguuuugguaugguaagcc

SEQ ID NO: 119000 - RNA, 64 nt, hsa
uaccccccaauuguuuuucaauccccuuuucucaaauaauaaauuaguuaaaucaguuucugag

SEQ ID NO: 119001 - RNA, 64 nt, hsa
gugaugaaauugagacuuuuugugguuuucucucaauaauaagugaaccaauuucaaaugugau

SEQ ID NO: 119002 - RNA, 64 nt, hsa
cuuucugaauuuugaguaucuucuguuguagaauaauaauaaaaagacuauuaagagcaauaaa

SEQ ID NO: 119003 - RNA, 64 nt, hsa
uuucuuucugaauuuugaguaucuucuguuguagaauaauaauaaaaagacuauuaagagcaau

SEQ ID NO: 119004 - RNA, 64 nt, hsa
auagccuauuuauuauaaauuaugagaugaugaaaauaauaaagccaguggaaauuuucuaccu

SEQ ID NO: 119005 - RNA, 64 nt, hsa
ugauuaggggcacccaaaguucugguuaucuaugaauaauaaugaauaauuuuggcugagaaug

SEQ ID NO: 119006 - RNA, 64 nt, hsa
uaauaauaauaauaauaauaauaauaauaauaauaauaauaauauguuguuugcuuuccuuaac

SEQ ID NO: 119007 - RNA, 64 nt, hsa
ugauaauaauaauaauaauaauaauaauaauaauaauaauaauaauauguuguuugcuuuccuu

SEQ ID NO: 119008 - RNA, 64 nt, hsa
ugaugauaauaauaauaauaauaauaauaauaauaauaauaauaauaauauguuguuugcuuuc

SEQ ID NO: 119009 - RNA, 64 nt, hsa
uaaugaugauaauaauaauaauaauaauaauaauaauaauaauaauaauaauauguuguuugcu

SEQ ID NO: 119010 - RNA, 64 nt, hsa
uaauaaugaugauaauaauaauaauaauaauaauaauaauaauaauaauaauaauauguuguuu

SEQ ID NO: 119011 - RNA, 64 nt, hsa
ugauaauaaugaugauaauaauaauaauaauaauaauaauaauaauaauaauaauaauauguug

SEQ ID NO: 119012 - RNA, 64 nt, hsa
caaugauaauaaugaugauaauaauaauaauaauaauaauaauaauaauaauaauaauaauaug

SEQ ID NO: 119013 - RNA, 64 nt, hsa
acacaaugauaauaaugaugauaauaauaauaauaauaauaauaauaauaauaauaauaauaau

SEQ ID NO: 119014 - RNA, 64 nt, hsa
ugcacacaaugauaauaaugaugauaauaauaauaauaauaauaauaauaauaauaauaauaau

SEQ ID NO: 119015 - RNA, 64 nt, hsa
auuugcacacaaugauaauaaugaugauaauaauaauaauaauaauaauaauaauaauaauaau

SEQ ID NO: 119016 - RNA, 64 nt, hsa
uucauuugcacacaaugauaauaaugaugauaauaauaauaauaauaauaauaauaauaauaau

SEQ ID NO: 119017 - RNA, 64 nt, hsa
uauuucauuugcacacaaugauaauaaugaugauaauaauaauaauaauaauaauaauaauaau

SEQ ID NO: 119018 - RNA, 64 nt, hsa
cugucuaacuguagacaaaucuuuaaaaaaaaauaauaauaaucuggugccucaguuuccccac

SEQ ID NO: 119019 - RNA, 64 nt, hsa
ucccugucuaacuguagacaaaucuuuaaaaaaaaauaauaauaaucuggugccucaguuuccc

SEQ ID NO: 119020 - RNA, 64 nt, hsa
aaccaacagugaauguggagcugagagacaguaaaauaauaacugacaugccaccgaaguacaa

SEQ ID NO: 119021 - RNA, 64 nt, hsa
aauauaaauaauaauuaagcuaugauaggagaauaauaauaaagaugaaaagagaagguacccu

SEQ ID NO: 119022 - RNA, 64 nt, hsa
uuuaauauaaauaauaauuaagcuaugauaggagaauaauaauaaagaugaaaagagaagguac

SEQ ID NO: 119023 - RNA, 64 nt, hsa
aagguaguaauuuaaacagggaaaguuuaauauaaauaauaauuaagcuaugauaggagaauaa

SEQ ID NO: 119024 - RNA, 64 nt, hsa
gaaucauuggaucuuuaaauaggagugaguauauaauaauaaggcucuucuguuuucaacaucu

SEQ ID NO: 119025 - RNA, 64 nt, hsa
uuccauaaaaguaguugggaaaauuauuauguaaaauaauaagacucuuccaaagccuuaauaa

SEQ ID NO: 119026 - RNA, 64 nt, hsa
guuauauauaugaauauucccuauguuaaauaauaauaauaacuaguguuuaugaauagaauca

SEQ ID NO: 119027 - RNA, 64 nt, hsa
ccuguuauauauaugaauauucccuauguuaaauaauaauaauaacuaguguuuaugaauagaa

SEQ ID NO: 119028 - RNA, 64 nt, hsa
guaccuguuauauauaugaauauucccuauguuaaauaauaauaauaacuaguguuuaugaaua

SEQ ID NO: 119029 - RNA, 64 nt, hsa
ugugauuuuuaaaaacuuuuuuuuggaccuaaauaauaauaaaaaaaaaagcccuuuaaacuuu

SEQ ID NO: 119030 - RNA, 64 nt, hsa
uguugugauuuuuaaaaacuuuuuuuuggaccuaaauaauaauaaaaaaaaaagcccuuuaaac

SEQ ID NO: 119031 - RNA, 64 nt, hsa
gcuugcagaauaaagccaacuuuuuauugugaauaauaauaaggacauauuuuucuucagauua

SEQ ID NO: 119032 - RNA, 64 nt, hsa
caggcuugcagaauaaagccaacuuuuuauugugaauaauaauaaggacauauuuuucuucaga

SEQ ID NO: 119033 - RNA, 64 nt, hsa
uaaauucuauaggaacauaugaaaauacaacuuaaauaauaaacaguggaauauaaggaaagca

SEQ ID NO: 119034 - RNA, 64 nt, hsa
auguuuguccugaacacuuuuguuguaaaaaaauaauaauaauguuuaauauugagaaagaaac

SEQ ID NO: 119035 - RNA, 64 nt, hsa
gugauguuuguccugaacacuuuuguuguaaaaaaauaauaauaauguuuaauauugagaaaga

SEQ ID NO: 119036 - RNA, 64 nt, hsa
acacuuuugguuaagucuguuuuaugacuucauuaauaauaaauucccuggccuuucauauuuu

SEQ ID NO: 119037 - RNA, 64 nt, hsa
cuguuauauaaaugguuaaaagagguuuuucuuaaauaauaaagaucauguaaaaguaacaaau

SEQ ID NO: 119038 - RNA, 64 nt, hsa
aaaaaaaaaagaaugcucauuguaaaaauaaaaaaauaauaauaagcaaggaguaaaaugugaa

SEQ ID NO: 119039 - RNA, 64 nt, hsa
aaaaaaagaaugcucauuguaaaaauaaaaaaauaauaauaagcaaggaguaaaaugugaagug

SEQ ID NO: 119040 - RNA, 64 nt, hsa
auaaugggccuuguaagucuuuucaccauucaugaauaauaauaaauauguacugcuggcaugu

SEQ ID NO: 119041 - RNA, 64 nt, hsa
augggccuuguaagucuuuucaccauucaugaauaauaauaaauauguacugcuggcauguaau

SEQ ID NO: 119042 - RNA, 64 nt, hsa
aaauaauccaagacuucucacuggggaauaagggaauaauaaauaggguacaaacuccuaauag

SEQ ID NO: 119043 - RNA, 64 nt, hsa
aaaaaggaauuuuaaauuuaacucuucacauggaaauaauaaagcucuuuauaugagcuguccc

SEQ ID NO: 119044 - RNA, 64 nt, hsa
ugugccaagaauaaaugaaaugauguuaaagcauaauaauaacauaucuuuaaaaagcuuuuca

SEQ ID NO: 119045 - RNA, 64 nt, hsa
acuauuuaguaaaaaguuuuaguuuggugcuguuaauaauaauuugcuaaaaggccuuuuagaa

SEQ ID NO: 119046 - RNA, 64 nt, hsa
gaaaagucaaggacuaauuuuaaagaggaaaaauaauaauaacucuuguuucuuuccucccugu

SEQ ID NO: 119047 - RNA, 64 nt, hsa
uuugaaaagucaaggacuaauuuuaaagaggaaaaauaauaauaacucuuguuucuuuccuccc

SEQ ID NO: 119048 - RNA, 64 nt, hsa
aauuaaaccggaugcuaacgguguuuuaaaaaauaauaauaaaacaacuuguuuccuuuuggcc

SEQ ID NO: 119049 - RNA, 64 nt, hsa
aauaauuaaaccggaugcuaacgguguuuuaaaaaauaauaauaaaacaacuuguuuccuuuug

SEQ ID NO: 119050 - RNA, 64 nt, hsa
aaacauccuuuagaugcaaaauaauaauaauaauaauaauaaauaaauaaauaaaaauccaaac

SEQ ID NO: 119051 - RNA, 64 nt, hsa
ccaaaacauccuuuagaugcaaaauaauaauaauaauaauaauaaauaaauaaauaaaaaucca

SEQ ID NO: 119052 - RNA, 64 nt, hsa
ccuccaaaacauccuuuagaugcaaaauaauaauaauaauaauaauaaauaaauaaauaaaaau

SEQ ID NO: 119053 - RNA, 64 nt, hsa
gcuccuccaaaacauccuuuagaugcaaaauaauaauaauaauaauaauaaauaaauaaauaaa

SEQ ID NO: 119054 - RNA, 64 nt, hsa
ugugcuccuccaaaacauccuuuagaugcaaaauaauaauaauaauaauaauaaauaaauaaau

SEQ ID NO: 119055 - RNA, 64 nt, hsa
cucugugcuccuccaaaacauccuuuagaugcaaaauaauaauaauaauaauaauaaauaaaua

SEQ ID NO: 119056 - RNA, 64 nt, hsa
aagugcugcuuacaucacugaacaacaacaaaaaaauaauaauggaguagcuguugcccuucuc

SEQ ID NO: 119057 - RNA, 64 nt, hsa
uuuguuuacuuuucagguuuguacuacaagguuuaauaauaaaaacaaaguuuuuuggacauuu

SEQ ID NO: 119058 - RNA, 64 nt, hsa
uucauaauuucacccugugacuauccugaaaagaaauaauaaucauuuuaugauugaugggcca

SEQ ID NO: 119059 - RNA, 64 nt, hsa
agcaguuaacuuuacucuugguucugagucuccaaauaauaauagccgacguuuauugagcacu

SEQ ID NO: 119060 - RNA, 64 nt, hsa
ugagccccugucaagugccagucaugauaguaguaauaauaauaauaaacaucuauuggaccag

SEQ ID NO: 119061 - RNA, 64 nt, hsa
gccccugucaagugccagucaugauaguaguaauaauaauaauaaacaucuauuggaccaggcu

SEQ ID NO: 119062 - RNA, 64 nt, hsa
ccugucaagugccagucaugauaguaguaauaauaauaauaaacaucuauuggaccaggcucug

SEQ ID NO: 119063 - RNA, 64 nt, hsa
ccuccacauagauguuuuuauauuacaugaauuuaauaauaaacuaaacuuuuuuuugucuccc

SEQ ID NO: 119064 - RNA, 64 nt, hsa
acacauauaauauauaugcuaaaguauaaagaguaauaauaaugacaauaaacaaaccccugug

SEQ ID NO: 119065 - RNA, 64 nt, hsa
aaugccaacaaaauugguuguaaucaaauuuuaaaauaauaauaauuuggcccccccuuuuaaa

SEQ ID NO: 119066 - RNA, 64 nt, hsa
gccaacaaaauugguuguaaucaaauuuuaaaauaauaauaauuuggcccccccuuuuaaaaua

SEQ ID NO: 119067 - RNA, 64 nt, hsa
ucuauccuggguaacagcgagacucugucuuaaaaauaauaacaauaauaauaauaauaaagac

SEQ ID NO: 119068 - RNA, 64 nt, hsa
gguaacagcgagacucugucuuaaaaauaauaacaauaauaauaauaauaaagacuuacuuaac

SEQ ID NO: 119069 - RNA, 64 nt, hsa
aacagcgagacucugucuuaaaaauaauaacaauaauaauaauaauaaagacuuacuuaaccaa

SEQ ID NO: 119070 - RNA, 64 nt, hsa
agcgagacucugucuuaaaaauaauaacaauaauaauaauaauaaagacuuacuuaaccaauau

SEQ ID NO: 119071 - RNA, 64 nt, hsa
gagacucugucuuaaaaauaauaacaauaauaauaauaauaaagacuuacuuaaccaauauuau

SEQ ID NO: 119072 - RNA, 64 nt, hsa
gccaaagacugcuugcuaguaggaaaaaauuucaaauaauaaccaaagcugaaaaauggucugu

SEQ ID NO: 119073 - RNA, 64 nt, hsa
aaaugagagugugagagaaaguaccuucuauuuuaauaauaauauuauuauaaaaauaauaaau

SEQ ID NO: 119074 - RNA, 64 nt, hsa
guaccuucuauuuuaauaauaauauuauuauaaaaauaauaaaucuuuuuaacuuuuauauuuu

SEQ ID NO: 119075 - RNA, 64 nt, hsa
gaaaugcugcccuagaaguacaauaggaaggcuaaauaauaauaaccuguuuucugguuguugu

SEQ ID NO: 119076 - RNA, 64 nt, hsa
augcugcccuagaaguacaauaggaaggcuaaauaauaauaaccuguuuucugguuguuguugg

SEQ ID NO: 119077 - RNA, 64 nt, hsa
aauaugcagauuucuaauuggcauucauaaggugaauaauaauaagugcccaaugaaaaaaucu

SEQ ID NO: 119078 - RNA, 64 nt, hsa
augcagauuucuaauuggcauucauaaggugaauaauaauaagugcccaaugaaaaaaucuauu

SEQ ID NO: 119079 - RNA, 64 nt, hsa
caucuugugggcauuauacaaaggcauauuauaaaauaauaaugauauuuuuguauagaagagu

SEQ ID NO: 119080 - RNA, 64 nt, hsa
gacuggaccuuaguacuguaaauucuuuuuaaagaauaauaauguuaccaacugcugagauuuu

SEQ ID NO: 119081 - RNA, 64 nt, hsa
aaucaaguuucuaagaaggugucaaguggggaauaauaauaauguauaauaaucaagaaauuag

SEQ ID NO: 119082 - RNA, 64 nt, hsa
aacaaucaaguuucuaagaaggugucaaguggggaauaauaauaauguauaauaaucaagaaau

SEQ ID NO: 119083 - RNA, 64 nt, hsa
auauacuaagaauaaauaaaauauacccaugugaaauaauaauuggauuauggauaacaagaga

SEQ ID NO: 119084 - RNA, 64 nt, hsa
auguuaguauucaucucuuugaaucauuugcucaaauaauaacauuccaccuuuuccugcugua

SEQ ID NO: 119085 - RNA, 64 nt, hsa
uuccuaugauccuuccacacuuuauuuccuuaauaauaauaaacuuuuucagaaagaauugagu

SEQ ID NO: 119086 - RNA, 64 nt, hsa
uauuuccuaugauccuuccacacuuuauuuccuuaauaauaauaaacuuuuucagaaagaauug

SEQ ID NO: 119087 - RNA, 64 nt, hsa
agcugcaauuuaaggcagcaauccaagagacuugaauaauaauaauucaacaacagcuuuauuu

SEQ ID NO: 119088 - RNA, 64 nt, hsa
ugcaauuuaaggcagcaauccaagagacuugaauaauaauaauucaacaacagcuuuauuuuua

SEQ ID NO: 119089 - RNA, 64 nt, hsa
uuaauagccuugaaagcuuugauaaguuuucaguaauaauaaccuauuuaaucagaugaugaug

SEQ ID NO: 119090 - RNA, 64 nt, hsa
gccuaggccucuauuuccuugucuccaaaaugagaauaauaaaauuuaggucaggauuacuaua

SEQ ID NO: 119091 - RNA, 64 nt, hsa
guggaguauaaaggcuacacccuuauuguaaaaaaauaauaauaauaaaaugaaagaaacaauc

SEQ ID NO: 119092 - RNA, 64 nt, hsa
gaguauaaaggcuacacccuuauuguaaaaaaauaauaauaauaaaaugaaagaaacaaucacc

SEQ ID NO: 119093 - RNA, 64 nt, hsa
uauaaaggcuacacccuuauuguaaaaaaauaauaauaauaaaaugaaagaaacaaucaccacc

SEQ ID NO: 119094 - RNA, 64 nt, hsa
agguuaggaaacagguuaaaacucagagaacuccaauaauaaugguuuaaaaacaucaggggcu

SEQ ID NO: 119095 - RNA, 64 nt, hsa
aaaaaaaaguguguaaauauauuuaguugaaucaaauaauaaagaugaaucauuaugaauucac

SEQ ID NO: 119096 - RNA, 64 nt, hsa
auguguuagauggaaaaugcuauuggcagggaauaauaauaaaaaaaaaagaaaaucauucugu

SEQ ID NO: 119097 - RNA, 64 nt, hsa
uaaauguguuagauggaaaaugcuauuggcagggaauaauaauaaaaaaaaaagaaaaucauuc

SEQ ID NO: 119098 - RNA, 64 nt, hsa
ucuguuuuuagcuagaaacucuaaaaacaaaaauaauaauaaagaaaaauaaauaaaaaggaga

SEQ ID NO: 119099 - RNA, 64 nt, hsa
agcucuguuuuuagcuagaaacucuaaaaacaaaaauaauaauaaagaaaaauaaauaaaaagg

SEQ ID NO: 119100 - RNA, 64 nt, hsa
gaaguucugggauucagguuguuauuaaaauaauaauaauaauuaaaaacucugaagaaacuug

SEQ ID NO: 119101 - RNA, 64 nt, hsa
cuggaaguucugggauucagguuguuauuaaaauaauaauaauaauuaaaaacucugaagaaac

SEQ ID NO: 119102 - RNA, 64 nt, hsa
uaucuggaaguucugggauucagguuguuauuaaaauaauaauaauaauuaaaaacucugaaga

SEQ ID NO: 119103 - RNA, 64 nt, hsa
ccacaaauauaaauacaguacucaugcugacugaaauaauaagacaucuacaaauuuauaaaca

SEQ ID NO: 119104 - RNA, 64 nt, hsa
aggugcuuaaaucagaguaaaaugucagcuuuacaauaauaaaaaaaggacuuugguuuaaagu

SEQ ID NO: 119105 - RNA, 64 nt, hsa
aggaccacuugaaaagugaugcuaaacagccaguaauaauaauuuaaauauaauuuauuauuuc

SEQ ID NO: 119106 - RNA, 64 nt, hsa
cuuauaucaauuuaaaauuugcuagugguuugaaaauaauaauguacugacuacauguaugcug

SEQ ID NO: 119107 - RNA, 64 nt, hsa
gcuuuuuaaagaaacauaaccacaaaccuuuucaaauaauaauaauaauaauaauaaaaaaugu

SEQ ID NO: 119108 - RNA, 64 nt, hsa
uuuuaaagaaacauaaccacaaaccuuuucaaauaauaauaauaauaauaauaaaaaauguauu

SEQ ID NO: 119109 - RNA, 64 nt, hsa
uaaagaaacauaaccacaaaccuuuucaaauaauaauaauaauaauaauaaaaaauguauuuua

SEQ ID NO: 119110 - RNA, 64 nt, hsa
agaaacauaaccacaaaccuuuucaaauaauaauaauaauaauaauaaaaaauguauuuuaaag

SEQ ID NO: 119111 - RNA, 64 nt, hsa
aacauaaccacaaaccuuuucaaauaauaauaauaauaauaauaaaaaauguauuuuaaagaug

SEQ ID NO: 119112 - RNA, 64 nt, hsa
auaaccacaaaccuuuucaaauaauaauaauaauaauaauaaaaaauguauuuuaaagauggcc

SEQ ID NO: 119113 - RNA, 64 nt, hsa
uuuuuuaaacaaguuuuuuguagaucccuuguaaaauaauaauaauaauguugugaaucuccau

SEQ ID NO: 119114 - RNA, 64 nt, hsa
uuuaaacaaguuuuuuguagaucccuuguaaaauaauaauaauaauguugugaaucuccaugcc

SEQ ID NO: 119115 - RNA, 64 nt, hsa
aaacaaguuuuuuguagaucccuuguaaaauaauaauaauaauguugugaaucuccaugccaag

SEQ ID NO: 119116 - RNA, 64 nt, hsa
gaagccuuuggugaauuccuucuaagauaaaaauaauaauaaaguguuacguuuuauugguuuc

SEQ ID NO: 119117 - RNA, 64 nt, hsa
uaugaagccuuuggugaauuccuucuaagauaaaaauaauaauaaaguguuacguuuuauuggu

SEQ ID NO: 119118 - RNA, 64 nt, hsa
gaugagaauuguuugagguuuguugcuagagaacaauaauaaaauaauucuuuuucagaaaaua

SEQ ID NO: 119119 - RNA, 64 nt, hsa
acaucguuuacuuuuuaacuggcuucauuuuaggaauaauaaauucaucagaauccuuggcuga

SEQ ID NO: 119120 - RNA, 64 nt, hsa
ccuuacgcugggaaagcugguuuuuuaaaaaaauaauaauaaaauauuuaaucuuauuaagugu

SEQ ID NO: 119121 - RNA, 64 nt, hsa
gcuccuuacgcugggaaagcugguuuuuuaaaaaaauaauaauaaaauauuuaaucuuauuaag

SEQ ID NO: 119122 - RNA, 64 nt, hsa
cugaagcacacggccauguuggagagcaaaacuuaauaauaauucuuuuuuaaaaucugcugaa

SEQ ID NO: 119123 - RNA, 64 nt, hsa
gaaacuuaaauuuuaguucuuacugcuuaauucaaauaauaauuaguaagcuagcaaauaguaa

SEQ ID NO: 119124 - RNA, 64 nt, hsa
agaacacagcccugcuucugacauaauccaguaaaauaauaauuuuuaagaaauaaauuuauuu

SEQ ID NO: 119125 - RNA, 64 nt, hsa
ucaaaagagacuuagacucccacauaguaauaauaauaauaauggcaaacuuaacaccccacug

SEQ ID NO: 119126 - RNA, 64 nt, hsa
ugaucaaaagagacuuagacucccacauaguaauaauaauaauaauggcaaacuuaacacccca

SEQ ID NO: 119127 - RNA, 64 nt, hsa
gugugaucaaaagagacuuagacucccacauaguaauaauaauaauaauggcaaacuuaacacc

SEQ ID NO: 119128 - RNA, 64 nt, hsa
agccugggugacagagcgacccucugucucaaaaaauaauaauaauaauaaauaaaacaacaac

SEQ ID NO: 119129 - RNA, 64 nt, hsa
cugggugacagagcgacccucugucucaaaaaauaauaauaauaauaaauaaaacaacaacaaa

SEQ ID NO: 119130 - RNA, 64 nt, hsa
ggugacagagcgacccucugucucaaaaaauaauaauaauaauaaauaaaacaacaacaaaaug

SEQ ID NO: 119131 - RNA, 64 nt, hsa
gacagagcgacccucugucucaaaaaauaauaauaauaauaaauaaaacaacaacaaaaugcau

SEQ ID NO: 119132 - RNA, 64 nt, hsa
aaaccuuuacuauuuccaauguauguuuguuaaaaauaauaauaauaaaaccaaaagccuuugu

SEQ ID NO: 119133 - RNA, 64 nt, hsa
ccuuuacuauuuccaauguauguuuguuaaaaauaauaauaauaaaaccaaaagccuuugugga

SEQ ID NO: 119134 - RNA, 64 nt, hsa
uuacuauuuccaauguauguuuguuaaaaauaauaauaauaaaaccaaaagccuuuguggaaac

SEQ ID NO: 119135 - RNA, 64 nt, hsa
ccaucacccaccaucaccgcugcugcaaagaggcaauaauaaaggaacugaagacagcuguauu

SEQ ID NO: 119136 - RNA, 64 nt, hsa
cuaugaauuguuaauuaaggugccaaaaaaaauuaauaauaaagcuugguuuuuugaaaaaccc

SEQ ID NO: 119137 - RNA, 64 nt, hsa
uuacaggugccaaaaaggggacaguguugauaauaauaauaaaaugaaacaaucugauuggggc

SEQ ID NO: 119138 - RNA, 64 nt, hsa
auuuuacaggugccaaaaaggggacaguguugauaauaauaauaaaaugaaacaaucugauugg

SEQ ID NO: 119139 - RNA, 64 nt, hsa
uggguaaagagucacauugguaggaccaauaaagaauaauaaaaagacaaagcacauguuuguu

SEQ ID NO: 119140 - RNA, 64 nt, hsa
ugccaaggaaccuuuacacagacccaaacaaaaaaauaauaaucaaaugccuucaauuucugag

SEQ ID NO: 119141 - RNA, 64 nt, hsa
cugagaggccucaggaaagucauuccuuuuuaaaaauaauaauaaauguaaggggguacagugc

SEQ ID NO: 119142 - RNA, 64 nt, hsa
agaggccucaggaaagucauuccuuuuuaaaaauaauaauaaauguaaggggguacagugcagu

SEQ ID NO: 119143 - RNA, 64 nt, hsa
aagauagguuaaaguauuugacaaaagugaauacaauaauaacacuugugucaaaaugauauag

SEQ ID NO: 119144 - RNA, 64 nt, hsa
gcuuuccuucagaaaacucugaaguuauauuugcaauaauaaugaaaccagcauuuaguaccag

SEQ ID NO: 119145 - RNA, 64 nt, hsa
uuugauucuuuuucuuuugugcacauaagaaauaaauaauaauaauaaauaaagaauaaaauuu

SEQ ID NO: 119146 - RNA, 64 nt, hsa
gauucuuuuucuuuugugcacauaagaaauaaauaauaauaauaaauaaagaauaaaauuuugu

SEQ ID NO: 119147 - RNA, 64 nt, hsa
ucuuuuucuuuugugcacauaagaaauaaauaauaauaauaaauaaagaauaaaauuuuguaug

SEQ ID NO: 119148 - RNA, 64 nt, hsa
aacuuugccaaugauagugaccacagcaaaagcaaauaauaauaauauuaauaauaauaaagag

SEQ ID NO: 119149 - RNA, 64 nt, hsa
uuugccaaugauagugaccacagcaaaagcaaauaauaauaauauuaauaauaauaaagagaaa

SEQ ID NO: 119150 - RNA, 64 nt, hsa
agugaccacagcaaaagcaaauaauaauaauauuaauaauaauaaagagaaauaaaauaauaaa

SEQ ID NO: 119151 - RNA, 64 nt, hsa
gaccacagcaaaagcaaauaauaauaauauuaauaauaauaaagagaaauaaaauaauaaaaua

SEQ ID NO: 119152 - RNA, 64 nt, hsa
uaauaauaauauuaauaauaauaaagagaaauaaaauaauaaaauaaaaaacaauagcacagcc

SEQ ID NO: 119153 - RNA, 64 nt, hsa
ugacagagugagacuccaucucaauaaaauuaauaauaauaaaaccuuccaaaaaaagugccgg

SEQ ID NO: 119154 - RNA, 64 nt, hsa
gggugacagagugagacuccaucucaauaaaauuaauaauaauaaaaccuuccaaaaaaagugc

SEQ ID NO: 119155 - RNA, 64 nt, hsa
caaacacaugaacuuguuacaacaauuuaaaaauaauaauaacaaaaggaaagcaacgaaugca

SEQ ID NO: 119156 - RNA, 64 nt, hsa
ggccaaacacaugaacuuguuacaacaauuuaaaaauaauaauaacaaaaggaaagcaacgaau

SEQ ID NO: 119157 - RNA, 64 nt, hsa
uugcaugauggcuaagcuaacauaaaaaaagaauaauaauaacuuggaaguuuuaguuuacaaa

SEQ ID NO: 119158 - RNA, 64 nt, hsa
auuuugcaugauggcuaagcuaacauaaaaaaagaauaauaauaacuuggaaguuuuaguuuac

SEQ ID NO: 119159 - RNA, 64 nt, hsa
uuaugaauauuugaccaaauuauuccagcaucagaauaauaagcaaaauaacuuuguuaguguu

SEQ ID NO: 119160 - RNA, 64 nt, hsa
uugaauagaguauacuggauuggugaaagaaaauaauaauaaugagcaucuaagugguuggguu

SEQ ID NO: 119161 - RNA, 64 nt, hsa
auguugaauagaguauacuggauuggugaaagaaaauaauaauaaugagcaucuaagugguugg

SEQ ID NO: 119162 - RNA, 64 nt, hsa
ccuuggugaugcauuacaacuuguuuucuuauguaauaauaaugaugaugaugaugauaauaau

SEQ ID NO: 119163 - RNA, 64 nt, hsa
uuucuuauguaauaauaaugaugaugaugaugauaauaauaaauauuuuugagugcuuacuaug

SEQ ID NO: 119164 - RNA, 64 nt, hsa
augguuuucuaaacuccaaaauggucaucuuaucaauaauaauaauauugaccauuuccuaucu

SEQ ID NO: 119165 - RNA, 64 nt, hsa
guuuucuaaacuccaaaauggucaucuuaucaauaauaauaauauugaccauuuccuaucugcc

SEQ ID NO: 119166 - RNA, 64 nt, hsa
ggaaagagugaugaauuauauuauauuauauaaaaauaauaauaaaaauauaaagaaagcuacc

SEQ ID NO: 119167 - RNA, 64 nt, hsa
aagagugaugaauuauauuauauuauauaaaaauaauaauaaaaauauaaagaaagcuaccuuu

SEQ ID NO: 119168 - RNA, 64 nt, hsa
aauaacagucugaacuuauuuguuuauuuaaaauaauaauaaaauaauuaaaaauuuauuuauc

SEQ ID NO: 119169 - RNA, 64 nt, hsa
auaaauaacagucugaacuuauuuguuuauuuaaaauaauaauaaaauaauuaaaaauuuauuu

SEQ ID NO: 119170 - RNA, 64 nt, hsa
guauaauuugaggaguggaugguggaugaaaagaaauaauaaauuguaaucagcaguaaaggag

SEQ ID NO: 119171 - RNA, 64 nt, hsa
uccuucagaugaagaaauuugguaccaaaguaauaauaauaauauaaauauauguauuagauga

SEQ ID NO: 119172 - RNA, 64 nt, hsa
cauuccuucagaugaagaaauuugguaccaaaguaauaauaauaauauaaauauauguauuaga

SEQ ID NO: 119173 - RNA, 64 nt, hsa
ggaauuaugucugcugaauaauaaacuuuuuugaaauaauaaaucugguagaaaaaugaaaacu

SEQ ID NO: 119174 - RNA, 64 nt, hsa
ccuucuguaaagguuuuuggaauuaugucugcugaauaauaaacuuuuuugaaauaauaaaucu

SEQ ID NO: 119175 - RNA, 64 nt, hsa
cuuuaaagcauguugucaacguuuucuuaaacugaauaauaaucacucaucuucugucaaagau

SEQ ID NO: 119176 - RNA, 64 nt, hsa
aaucauaucaagucaauuaguuugguuucacacuaauaauaaugacaaaaagcacaugcagagu

SEQ ID NO: 119177 - RNA, 64 nt, hsa
aguguuagugcucagaaaucaccauaaucacgaaaauaauaauaauaaaucuuuaacauacuac

SEQ ID NO: 119178 - RNA, 64 nt, hsa
guuagugcucagaaaucaccauaaucacgaaaauaauaauaauaaaucuuuaacauacuaccua

SEQ ID NO: 119179 - RNA, 64 nt, hsa
agugcucagaaaucaccauaaucacgaaaauaauaauaauaaaucuuuaacauacuaccuaaag

SEQ ID NO: 119180 - RNA, 64 nt, hsa
gcucgaaagaaaaaaauguuaaaaauauaucuauaauaauaauuuuuugucauuugucuuuaug

SEQ ID NO: 119181 - RNA, 64 nt, hsa
gguccaaguacuuuguauuguauacgugagucauaauaauaaaaagaagaagaaaaauaauaga

SEQ ID NO: 119182 - RNA, 64 nt, hsa
agccuacaugacaaugugacacuccaucucaaaaaauaauaauaauaacaauauaagaacuagc

SEQ ID NO: 119183 - RNA, 64 nt, hsa
cuacaugacaaugugacacuccaucucaaaaaauaauaauaauaacaauauaagaacuagcugg

SEQ ID NO: 119184 - RNA, 64 nt, hsa
caugacaaugugacacuccaucucaaaaaauaauaauaauaacaauauaagaacuagcugggca

SEQ ID NO: 119185 - RNA, 64 nt, hsa
aguacaaugagccuuacuguauuuaguguggcagaauaauaacaucaguggcaggccacugauu

SEQ ID NO: 119186 - RNA, 64 nt, hsa
cugagaguuugguaaaagaauauuuucuucucugaauaauaauuauuuucacagugaaaauuuc

SEQ ID NO: 119187 - RNA, 64 nt, hsa
agugaggccaagaaaguuuccgguuaaguucuuuaauaauaauccuacaguuuaucuuaagaaa

SEQ ID NO: 119188 - RNA, 64 nt, hsa
augacugcuaucauaggcauccauauuuaauauuaauaauaauaauuaauaauaauaauaaacc

SEQ ID NO: 119189 - RNA, 64 nt, hsa
acugcuaucauaggcauccauauuuaauauuaauaauaauaauuaauaauaauaauaaacccaa

SEQ ID NO: 119190 - RNA, 64 nt, hsa
uaggcauccauauuuaauauuaauaauaauaauuaauaauaauaauaaacccaacacccauccc

SEQ ID NO: 119191 - RNA, 64 nt, hsa
gcauccauauuuaauauuaauaauaauaauuaauaauaauaauaaacccaacacccauccccca

SEQ ID NO: 119192 - RNA, 64 nt, hsa
uccauauuuaauauuaauaauaauaauuaauaauaauaauaaacccaacacccaucccccagaa

SEQ ID NO: 119193 - RNA, 64 nt, hsa
gcuguuguuuagggguaaauaacaguaaauaauuaauaauaauaauaauaauaauaaaggagcu

SEQ ID NO: 119194 - RNA, 64 nt, hsa
guuguuuagggguaaauaacaguaaauaauuaauaauaauaauaauaauaauaaaggagcugac

SEQ ID NO: 119195 - RNA, 64 nt, hsa
guuuagggguaaauaacaguaaauaauuaauaauaauaauaauaauaauaaaggagcugacguu

SEQ ID NO: 119196 - RNA, 64 nt, hsa
uagggguaaauaacaguaaauaauuaauaauaauaauaauaauaauaaaggagcugacguucuu

SEQ ID NO: 119197 - RNA, 64 nt, hsa
ggguaaauaacaguaaauaauuaauaauaauaauaauaauaauaaaggagcugacguucuuagc

SEQ ID NO: 119198 - RNA, 64 nt, hsa
uaaauaacaguaaauaauuaauaauaauaauaauaauaauaaaggagcugacguucuuagccuu

SEQ ID NO: 119199 - RNA, 64 nt, hsa
uuauagaaaugugaacacugaauuuauuuuaaaaaauaauaauaaaaauuuaaaaaaauuaaaa

SEQ ID NO: 119200 - RNA, 64 nt, hsa
uagaaaugugaacacugaauuuauuuuaaaaaauaauaauaaaaauuuaaaaaaauuaaaaaua

SEQ ID NO: 119201 - RNA, 64 nt, hsa
cauauuuauaccuuucagguacugaagauuuaauaauaauaaauguaaauacugugaagugugu

SEQ ID NO: 119202 - RNA, 64 nt, hsa
acccauauuuauaccuuucagguacugaagauuuaauaauaauaaauguaaauacugugaagug

SEQ ID NO: 119203 - RNA, 64 nt, hsa
uauaaauauuaauaauacaacuucaaugcuuaauaauaauaaacaaauuaauucuaaaggccca

SEQ ID NO: 119204 - RNA, 64 nt, hsa
uacuauaaauauuaauaauacaacuucaaugcuuaauaauaauaaacaaauuaauucuaaaggc

SEQ ID NO: 119205 - RNA, 64 nt, hsa
cagcagcaauaguagaaguagucauaauaacaauaauaauaaaugaugauaaagauguuucuga

SEQ ID NO: 119206 - RNA, 64 nt, hsa
uagcagcagcaauaguagaaguagucauaauaacaauaauaauaaaugaugauaaagauguuuc

SEQ ID NO: 119207 - RNA, 64 nt, hsa
uguuucuuaaagcucugaacaucauuaaguaguuaauaauaauuccaacaaggaauucagagua

SEQ ID NO: 119208 - RNA, 64 nt, hsa
caugcuuggcccugcauuuaauuuaagaaggauuaauaauaaugcucugaauuuuucgaaaggg

SEQ ID NO: 119209 - RNA, 64 nt, hsa
gacagagcaagacucugucucaaaaaaaaaaaauaauaauaaaauaagugagcugaacucaccu

SEQ ID NO: 119210 - RNA, 64 nt, hsa
ggcgacagagcaagacucugucucaaaaaaaaaaaauaauaauaaaauaagugagcugaacuca

SEQ ID NO: 119211 - RNA, 64 nt, hsa
uggacagaacaaggcccugucucuauuuuaaaauaauaauaacacaaaaaugccccucccccau

SEQ ID NO: 119212 - RNA, 64 nt, hsa
ggguggacagaacaaggcccugucucuauuuuaaaauaauaauaacacaaaaaugccccucccc

SEQ ID NO: 119213 - RNA, 64 nt, hsa
accaccaaucugugaaaguaaagcaaaaaauaauaauaauaaaugccaagggggagagagacac

SEQ ID NO: 119214 - RNA, 64 nt, hsa
auuaccaccaaucugugaaaguaaagcaaaaaauaauaauaauaaaugccaagggggagagaga

SEQ ID NO: 119215 - RNA, 64 nt, hsa
cucauuaccaccaaucugugaaaguaaagcaaaaaauaauaauaauaaaugccaagggggagag

SEQ ID NO: 119216 - RNA, 64 nt, hsa
auagggacgcauaugcuuuuuaaagcaaucuaaaaauaauaauaaguauagcgacuauauaccu

SEQ ID NO: 119217 - RNA, 64 nt, hsa
gggacgcauaugcuuuuuaaagcaaucuaaaaauaauaauaaguauagcgacuauauaccuacu

SEQ ID NO: 119218 - RNA, 64 nt, hsa
cuccagucugggcaacagagugagacccugucucaauaauaauaauaauaauaaugaugauacu

SEQ ID NO: 119219 - RNA, 64 nt, hsa
cagucugggcaacagagugagacccugucucaauaauaauaauaauaauaaugaugauacucua

SEQ ID NO: 119220 - RNA, 64 nt, hsa
ucugggcaacagagugagacccugucucaauaauaauaauaauaauaaugaugauacucuaaga

SEQ ID NO: 119221 - RNA, 64 nt, hsa
gggcaacagagugagacccugucucaauaauaauaauaauaauaaugaugauacucuaagaaaa

SEQ ID NO: 119222 - RNA, 64 nt, hsa
caacagagugagacccugucucaauaauaauaauaauaauaaugaugauacucuaagaaaaaaa

SEQ ID NO: 119223 - RNA, 64 nt, hsa
uacauuagaauuuauuauuaauaauaauaagugaaauaauaagugggaguccuuggaccacauc

SEQ ID NO: 119224 - RNA, 64 nt, hsa
uugugcggacgauacauuagaauuuauuauuaauaauaauaagugaaauaauaagugggagucc

SEQ ID NO: 119225 - RNA, 61 nt, hsa
uugugcggacgauacauuagaauuuauuauuaauaauaauaagugaaauaauaagugggag

SEQ ID NO: 119226 - RNA, 64 nt, hsa
uauccccauaugucuguguuuguuugagauuuuuaauaauaaauaauaaauuuuugaagaaugg

SEQ ID NO: 119227 - RNA, 64 nt, hsa
auaugucuguguuuguuugagauuuuuaauaauaaauaauaaauuuuugaagaauggaagugga

SEQ ID NO: 119228 - RNA, 64 nt, hsa
aucuguuuuuucauuugauccuaucgacaaucauaauaauaauaaauuauauauauaacccaua

SEQ ID NO: 119229 - RNA, 64 nt, hsa
uguuuuuucauuugauccuaucgacaaucauaauaauaauaaauuauauauauaacccauauaa

SEQ ID NO: 119230 - RNA, 64 nt, hsa
cgugccaagcaauaagauuuauguauauuuguuuaauaauaaccuauuucaagucugaguuuug

SEQ ID NO: 119231 - RNA, 64 nt, hsa
uugauuuuacagucuguaaugcuugauguuuuaaaauaauaacauuuuuauauuuuuuaaaaga

SEQ ID NO: 119232 - RNA, 64 nt, hsa
uuugaaaaaauuacccucuagcucuaacacugaaaauaauaauaaauuguagaucucugcaacu

SEQ ID NO: 119233 - RNA, 64 nt, hsa
gaaaaaauuacccucuagcucuaacacugaaaauaauaauaaauuguagaucucugcaacuaag

SEQ ID NO: 119234 - RNA, 64 nt, hsa
cgauuaaugguuugcugcuugacuagccuagggaaauaauaauaaagguaaaguaaacuuuuuu

SEQ ID NO: 119235 - RNA, 64 nt, hsa
uuaaugguuugcugcuugacuagccuagggaaauaauaauaaagguaaaguaaacuuuuuuaau

SEQ ID NO: 119236 - RNA, 64 nt, hsa
caauccucuuucucucucuuaaugcaugauacagaauaauaauaagaauuucaucuuuaaauga

SEQ ID NO: 119237 - RNA, 64 nt, hsa
uccucuuucucucucuuaaugcaugauacagaauaauaauaagaauuucaucuuuaaaugagua

SEQ ID NO: 119238 - RNA, 64 nt, hsa
aaauaaaagaguggaagcccuaaaaugcuagaauaauaauaaaaaggccaaaaauaaaauuguu

SEQ ID NO: 119239 - RNA, 64 nt, hsa
uaaaaauaaaagaguggaagcccuaaaaugcuagaauaauaauaaaaaggccaaaaauaaaauu

SEQ ID NO: 119240 - RNA, 64 nt, hsa
uugacuucuuuuccuugaauggaaaacacuuugaaauaauaauaaacauuguuauaaacuaaua

SEQ ID NO: 119241 - RNA, 64 nt, hsa
acuucuuuuccuugaauggaaaacacuuugaaauaauaauaaacauuguuauaaacuaauauau

SEQ ID NO: 119242 - RNA, 64 nt, hsa
aaauauuccuaucugcuuauaaaauggcugcuauaauaauaauaauacagauguuguuauauaa

SEQ ID NO: 119243 - RNA, 64 nt, hsa
uauuccuaucugcuuauaaaauggcugcuauaauaauaauaauacagauguuguuauauaaggu

SEQ ID NO: 119244 - RNA, 64 nt, hsa
ccagccugggcaacaagagcaaaacucagucucaaauaauaauaauaacaacaacuuaaugugc

SEQ ID NO: 119245 - RNA, 64 nt, hsa
gccugggcaacaagagcaaaacucagucucaaauaauaauaauaacaacaacuuaaugugcugc

SEQ ID NO: 119246 - RNA, 64 nt, hsa
ugggcaacaagagcaaaacucagucucaaauaauaauaauaacaacaacuuaaugugcugcugc

SEQ ID NO: 119247 - RNA, 64 nt, hsa; identical to SEQ ID NO: 119241

SEQ ID NO: 119248 - RNA, 64 nt, hsa; identical to SEQ ID NO: 119240

SEQ ID NO: 119249 - RNA, 64 nt, hsa
caugcuugauuuaggagagaauaaagggcuauauaauaauaaauccagauuuccggauaagaau

SEQ ID NO: 119250 - RNA, 64 nt, hsa
uuaaauuuaacuuugacauccagcuauagacagaaauaauaagccacccuggguguaaacuuga

SEQ ID NO: 119251 - RNA, 64 nt, hsa
uagucaaguaauggcuuuugaaaaaguaaaguucaauaauaacuaaggcugugauuuuuuucaa

SEQ ID NO: 119252 - RNA, 64 nt, hsa
acaagggcugugcuaugcuaccauauucuuguucaauaauaauagguuuguuguuuuuuuuaca

SEQ ID NO: 119253 - RNA, 64 nt, hsa
auaguauauguucccauuuaugugaaaugugcagaauaauaauaaaaauguauagaauagcaaa

SEQ ID NO: 119254 - RNA, 64 nt, hsa
guauauguucccauuuaugugaaaugugcagaauaauaauaaaaauguauagaauagcaaaucu

SEQ ID NO: 119255 - RNA, 64 nt, hsa
gcauagcuauuuguuuuuauuguaaaacaauaauaauaauaaaaagcaaacucuauuggugugu

SEQ ID NO: 119256 - RNA, 64 nt, hsa
agagcauagcuauuuguuuuuauuguaaaacaauaauaauaauaaaaagcaaacucuauuggug

SEQ ID NO: 119257 - RNA, 64 nt, hsa
cugagagcauagcuauuuguuuuuauuguaaaacaauaauaauaauaaaaagcaaacucuauug

SEQ ID NO: 119258 - RNA, 64 nt, hsa
caggacuaacuguguuuggguuggguguaguauaaauaauaauaauggcuaauauuuccugagc

SEQ ID NO: 119259 - RNA, 64 nt, hsa
gacuaacuguguuuggguuggguguaguauaaauaauaauaauggcuaauauuuccugagcauc

SEQ ID NO: 119260 - RNA, 64 nt, hsa
aaagccagacaacuucuguuucuucucuuggugaaauaauaaaaugcaaaugaaucauuguuaa

SEQ ID NO: 119261 - RNA, 64 nt, hsa
gaacuuugacuguugcugguaaauuagaagcuacaauaauaauuaagggcagaaauuauacuua

SEQ ID NO: 119262 - RNA, 64 nt, hsa
ccagaaacgcugaauccaauuaagagagaaaaauaauaauaacaauaaaugaucuuggacaaga

SEQ ID NO: 119263 - RNA, 64 nt, hsa
gagccagaaacgcugaauccaauuaagagagaaaaauaauaauaacaauaaaugaucuuggaca

SEQ ID NO: 119264 - RNA, 64 nt, hsa
gccucaguuuucucaucugccaaaugggaguaauaauaauaauccuuauaaaauuggguucaua

SEQ ID NO: 119265 - RNA, 64 nt, hsa
ugagccucaguuuucucaucugccaaaugggaguaauaauaauaauccuuauaaaauuggguuc

SEQ ID NO: 119266 - RNA, 64 nt, hsa
ugauggcaaaaagacaguguaauaauaacauaauaauaauaaaaauauaauacugaaaaggauu

SEQ ID NO: 119267 - RNA, 64 nt, hsa
uuuugauggcaaaaagacaguguaauaauaacauaauaauaauaaaaauauaauacugaaaagg

SEQ ID NO: 119268 - RNA, 64 nt, hsa
cacaggccucauuuugauggcaaaaagacaguguaauaauaacauaauaauaauaaaaauauaa

SEQ ID NO: 119269 - RNA, 64 nt, hsa
ugauaauaauaauaauaauaacaacaacaacaacaauaauaaagaugugaaaacucgacgcucg

SEQ ID NO: 119270 - RNA, 64 nt, hsa
ugaugaugaugaugaugaugaugauaauaauaauaauaauaacaacaacaacaacaauaauaaa

SEQ ID NO: 119271 - RNA, 64 nt, hsa
cgaugaugaugaugaugaugaugaugauaauaauaauaauaauaacaacaacaacaacaauaau

SEQ ID NO: 119272 - RNA, 64 nt, hsa
cuucgaugaugaugaugaugaugaugaugauaauaauaauaauaauaacaacaacaacaacaau

SEQ ID NO: 119273 - RNA, 64 nt, hsa
auacuucgaugaugaugaugaugaugaugaugauaauaauaauaauaauaacaacaacaacaac

SEQ ID NO: 119274 - RNA, 64 nt, hsa
uaguaaggauacauucaagcuugguuaaaaaaauaauaauaaaacaugcaucauuuuucauuug

SEQ ID NO: 119275 - RNA, 64 nt, hsa
uuauaguaaggauacauucaagcuugguuaaaaaaauaauaauaaaacaugcaucauuuuucau

SEQ ID NO: 119276 - RNA, 64 nt, hsa
gcggauagcauuugguagguagugauuaacugugaauaauaaauacacaaugaauucuucacuu

SEQ ID NO: 119277 - RNA, 64 nt, hsa
acguuuaaggccacguauaguccuagcugacgccaauaauaaaaaacaagaaaccaagugggcu

SEQ ID NO: 119278 - RNA, 64 nt, hsa
ucugguugcuuauuuuuagaaaaugaggacauuuaauaauaauaaaaaaaaagggauuaauagc

SEQ ID NO: 119279 - RNA, 64 nt, hsa
gguugcuuauuuuuagaaaaugaggacauuuaauaauaauaaaaaaaaagggauuaauagcuuu

SEQ ID NO: 119280 - RNA, 64 nt, hsa
cagccugggcaacagagugaaacucugucucaaaaauaauaauaauaaaaaaaagcuuccaucu

SEQ ID NO: 119281 - RNA, 64 nt, hsa
ccugggcaacagagugaaacucugucucaaaaauaauaauaauaaaaaaaagcuuccaucuccc

SEQ ID NO: 119282 - RNA, 64 nt, hsa
gggcaacagagugaaacucugucucaaaaauaauaauaauaaaaaaaagcuuccaucucccagc

SEQ ID NO: 119283 - RNA, 64 nt, hsa
ugucuucuuacuuugauaacucuucuuaguuuaaaauaauaauaauaacacaucuuuggucauc

SEQ ID NO: 119284 - RNA, 64 nt, hsa
cuucuuacuuugauaacucuucuuaguuuaaaauaauaauaauaacacaucuuuggucaucuau

SEQ ID NO: 119285 - RNA, 64 nt, hsa
cuuacuuugauaacucuucuuaguuuaaaauaauaauaauaacacaucuuuggucaucuauguc

SEQ ID NO: 119286 - RNA, 64 nt, hsa
gauccagaagaauugaauggugcuuaaauugagaaauaauaauaaauauaucuauauagaauag

SEQ ID NO: 119287 - RNA, 64 nt, hsa
ccagaagaauugaauggugcuuaaauugagaaauaauaauaaauauaucuauauagaauagaca

SEQ ID NO: 119288 - RNA, 64 nt, hsa
ugacagugagacucugucucaauaaauaaaaaauaauaauaaauugcucagauuucuuuguuuc

SEQ ID NO: 119289 - RNA, 64 nt, hsa
gggugacagugagacucugucucaauaaauaaaaaauaauaauaaauugcucagauuucuuugu

SEQ ID NO: 119290 - RNA, 64 nt, hsa
aagagagcaagacucugucucaaauaauaauaauaauaauaaagcuggagacuuggccacaccu

SEQ ID NO: 119291 - RNA, 64 nt, hsa
ggcaagagagcaagacucugucucaaauaauaauaauaauaauaaagcuggagacuuggccaca

SEQ ID NO: 119292 - RNA, 64 nt, hsa
cugggcaagagagcaagacucugucucaaauaauaauaauaauaauaaagcuggagacuuggcc

SEQ ID NO: 119293 - RNA, 64 nt, hsa
agccugggcaagagagcaagacucugucucaaauaauaauaauaauaauaaagcuggagacuug

SEQ ID NO: 119294 - RNA, 64 nt, hsa
uccagccugggcaagagagcaagacucugucucaaauaauaauaauaauaauaaagcuggagac

SEQ ID NO: 119295 - RNA, 64 nt, hsa
uuugcauuaauuugguuaaaaaauaaaauaaaauaauaauaauguaugaagcucuguuuuuuaa

SEQ ID NO: 119296 - RNA, 64 nt, hsa
acuuuugcauuaauuugguuaaaaaauaaaauaaaauaauaauaauguaugaagcucuguuuuu

SEQ ID NO: 119297 - RNA, 64 nt, hsa
gcaucuuguaaauuuucucuuuuuucuaaaaauaaauaauaauaaaauccuaaaucucaacaaa

SEQ ID NO: 119298 - RNA, 64 nt, hsa
ucuuguaaauuuucucuuuuuucuaaaaauaaauaauaauaaaauccuaaaucucaacaaacca

SEQ ID NO: 119299 - RNA, 64 nt, hsa
acauggugaauuaucucuacuaaaaauacaaaaaaauaauaauaauagccaggcgugguggcac

SEQ ID NO: 119300 - RNA, 64 nt, hsa
uggugaauuaucucuacuaaaaauacaaaaaaauaauaauaauagccaggcgugguggcacaug

SEQ ID NO: 119301 - RNA, 64 nt, hsa
uuauggaaauggaaauaaucuuuccuaaacuaccaauaauaacuuuaaauuuuugaucaaccau

SEQ ID NO: 119302 - RNA, 64 nt, hsa
uaaaauauuaaaaagguauuauaaagguauuuaaaauaauaauaauaaaguguuauuuuccugg

SEQ ID NO: 119303 - RNA, 64 nt, hsa
aauauuaaaaagguauuauaaagguauuuaaaauaauaauaauaaaguguuauuuuccugggau

SEQ ID NO: 119304 - RNA, 64 nt, hsa
auuaaaaagguauuauaaagguauuuaaaauaauaauaauaaaguguuauuuuccugggauuca

SEQ ID NO: 119305 - RNA, 64 nt, hsa
agaguugaaauguugagagaugauuaaaaauaauaauaauaaagugucuuccauuguuaaauga

SEQ ID NO: 119306 - RNA, 64 nt, hsa
ccaagaguugaaauguugagagaugauuaaaaauaauaauaauaaagugucuuccauuguuaaa

SEQ ID NO: 119307 - RNA, 64 nt, hsa
cuaccaagaguugaaauguugagagaugauuaaaaauaauaauaauaaagugucuuccauuguu

SEQ ID NO: 119308 - RNA, 64 nt, hsa
guuuuaagaauaucugaguaaaauaacaauaugaaauaauaaacagaagcucuaacgucaggua

SEQ ID NO: 119309 - RNA, 64 nt, hsa
uagagaguugacaaguugcuuguaguuuuaaaaaaauaauaaaguauacccuucugguauauca

SEQ ID NO: 119310 - RNA, 64 nt, hsa
uuccccaauaaauuguugugugugcuuucuaaauaauaauaaaacaacaggguuuuuuuccaga

SEQ ID NO: 119311 - RNA, 64 nt, hsa
uuuuuccccaauaaauuguugugugugcuuucuaaauaauaauaaaacaacaggguuuuuuucc

SEQ ID NO: 119312 - RNA, 64 nt, hsa
aucaggaguuuccuccauaaacuauuauuuucagaauaauaauaaaacaagaauuaugacuagc

SEQ ID NO: 119313 - RNA, 64 nt, hsa
aggaguuuccuccauaaacuauuauuuucagaauaauaauaaaacaagaauuaugacuagcauc

SEQ ID NO: 119314 - RNA, 64 nt, hsa
ugggcaacagagcaagacuccaucucaaaaaaauaauaauaaucuuaaagaugagaaaagccac

SEQ ID NO: 119315 - RNA, 64 nt, hsa
gccugggcaacagagcaagacuccaucucaaaaaaauaauaauaaucuuaaagaugagaaaagc

SEQ ID NO: 119316 - RNA, 64 nt, hsa
aaggaucugcaguuuuguuuuugaccaaaaaaauaauaauaaguuagcucugaagggcagaggg

SEQ ID NO: 119317 - RNA, 64 nt, hsa
uggaaggaucugcaguuuuguuuuugaccaaaaaaauaauaauaaguuagcucugaagggcaga

SEQ ID NO: 119318 - RNA, 64 nt, hsa
cauuuuacuuuuaauuauguaaauuugguuagaaaauaauaauaaaugguuagugcuauugugu

SEQ ID NO: 119319 - RNA, 64 nt, hsa
uuuacuuuuaauuauguaaauuugguuagaaaauaauaauaaaugguuagugcuauuguguaau

SEQ ID NO: 119320 - RNA, 64 nt, hsa
cccugcuugcuccuguguaacagcucagaugaugaauaauaauaaaacuguacuuuuuuggaug

SEQ ID NO: 119321 - RNA, 64 nt, hsa
ugcuugcuccuguguaacagcucagaugaugaauaauaauaaaacuguacuuuuuuggauggug

SEQ ID NO: 119322 - RNA, 64 nt, hsa
gacauugacccagacauauuguacucuuucuaaaaauaauaauaauaaugcuaacagaaagaag

SEQ ID NO: 119323 - RNA, 64 nt, hsa
auugacccagacauauuguacucuuucuaaaaauaauaauaauaaugcuaacagaaagaagaga

SEQ ID NO: 119324 - RNA, 64 nt, hsa
gacccagacauauuguacucuuucuaaaaauaauaauaauaaugcuaacagaaagaagagaacc

SEQ ID NO: 119325 - RNA, 64 nt, hsa
ugucaacaaacugggaaauaaaauaaaaaaaaauaauaauaaaugugucauuguuuuuugauca

SEQ ID NO: 119326 - RNA, 64 nt, hsa
aggugucaacaaacugggaaauaaaauaaaaaaaaauaauaauaaaugugucauuguuuuuuga

SEQ ID NO: 119327 - RNA, 64 nt, hsa
ggaaagauaaugaugguaacacaguaauaauaauaauaauaacaaaaauaugauaaagugaaag

SEQ ID NO: 119328 - RNA, 64 nt, hsa
agaggaaagauaaugaugguaacacaguaauaauaauaauaauaacaaaaauaugauaaaguga

SEQ ID NO: 119329 - RNA, 64 nt, hsa
ucuagaggaaagauaaugaugguaacacaguaauaauaauaauaauaacaaaaauaugauaaag

SEQ ID NO: 119330 - RNA, 64 nt, hsa
ugcucuagaggaaagauaaugaugguaacacaguaauaauaauaauaauaacaaaaauaugaua

SEQ ID NO: 119331 - RNA, 64 nt, hsa
gaauaauuaaugauaaaacauaauaauaaacauaaauaauaaacaaaauuaccgagaaccccau

SEQ ID NO: 119332 - RNA, 64 nt, hsa
auaaaaauuuauugaauaauuaaugauaaaacauaauaauaaacauaaauaauaaacaaaauua

SEQ ID NO: 119333 - RNA, 64 nt, hsa; identical to SEQ ID NO: 119318

SEQ ID NO: 119334 - RNA, 64 nt, hsa; identical to SEQ ID NO: 119319

SEQ ID NO: 119335 - RNA, 64 nt, hsa
gcaagauugcaucucaaaacaaacaauaauaauaaauaauaaaaaccugauauuuggcugggcg

SEQ ID NO: 119336 - RNA, 64 nt, hsa
ugacagagcaagauugcaucucaaaacaaacaauaauaauaaauaauaaaaaccugauauuugg

SEQ ID NO: 119337 - RNA, 64 nt, hsa
gcgugacagagcaagauugcaucucaaaacaaacaauaauaauaaauaauaaaaaccugauauu

SEQ ID NO: 119338 - RNA, 64 nt, hsa
cuuuggaacucccugaauaauaaaaaugagaguugagauaaauaggggaaaaaaaauuuuuuuc

SEQ ID NO: 119339 - RNA, 64 nt, hsa
gacuuuuagauaacaaagauuucaaauguuaaaagagauaaaagucagguuaauacuaucuuaa

SEQ ID NO: 119340 - RNA, 64 nt, hsa
aauauuugcaagcaacuuuuguacaguauuuaucgagauaaacauggcaaucaaaauguccauu

SEQ ID NO: 119341 - RNA, 64 nt, hsa
ucaacuuaaguuuuuacuccauuaugcacaguuugagauaaauaaauuuuugaaauauggacac

SEQ ID NO: 119342 - RNA, 64 nt, hsa
caguuuggguacugugcugauuuuuagauauacagagauaaaaauagccccuuuccuugcaggu

SEQ ID NO: 119343 - RNA, 64 nt, hsa
aaaguguucuucuacaaaucuuacagaguguaaagagauaaaaagaaaugauuuuuuuucuuac

SEQ ID NO: 119344 - RNA, 64 nt, hsa
gaguuugguuauccauuuauccucaaaaggaagugagauaaauccugauuaguuuuaaccagug

SEQ ID NO: 119345 - RNA, 64 nt, hsa
uauaauguuuucaacuguaucugagucagccagagagauaaauauccauguauaaaauagauag

SEQ ID NO: 119346 - RNA, 64 nt, hsa
gaguacccaaaugcuaccacuggagaaggaaugagagauaaagaaagagacaggugacaucuaa

SEQ ID NO: 119347 - RNA, 64 nt, hsa
uuguuucauuguucugucaauaauuguuaccaaagagauaaaaauaaaagcagaauguauauca

SEQ ID NO: 119348 - RNA, 64 nt, hsa
uuuuuccuuuuuuuuuaaguggaggggaaaagaagagauaaacaaggaauauuuugucaaacag

SEQ ID NO: 119349 - RNA, 64 nt, hsa
cucuguggcuacauauacacacacguauuuccuugagauaaacaagauaaacacuaggugcuuu

SEQ ID NO: 119350 - RNA, 64 nt, hsa
aaaaguaugaauggucaaaaugaauacaucgagagagauaaauggcaaauugcuuuuuuaaaag

SEQ ID NO: 119351 - RNA, 64 nt, hsa
aaaaucacaauauuccgaaaacaaaaaaaccuaggagauaaauguagagguauugacuuuucgu

SEQ ID NO: 119352 - RNA, 64 nt, hsa
aaggaaaaggagagagcuagucuagauaaaaaaagagauaaagacuacagaaggaaagagaucu

SEQ ID NO: 119353 - RNA, 64 nt, hsa
gaaaaugaugaaaagaguaguucaagaaguucuggagauaaaaaaaauacgagugauagaagua

SEQ ID NO: 119354 - RNA, 64 nt, hsa
uauacuggugagaaauccuagaaaucugaagagugagauaaagccuuuaaaugguugucacacu

SEQ ID NO: 119355 - RNA, 64 nt, hsa
cucacacuuuauugcuaggaaagcauuuauacuugagauaaauuauacaaauauaaagacugug

SEQ ID NO: 119356 - RNA, 64 nt, hsa
uuagguuuucaagcacaugaaaguacucacacuggagauaaacccuuugaguguaaaaaaugug

SEQ ID NO: 119357 - RNA, 64 nt, hsa
cguucuuuccaaauacauggaaggacucacacuggagauaaacccuuuaaguguaaagaaugug

SEQ ID NO: 119358 - RNA, 64 nt, hsa
aaaucuuaggagauaaacacauucaaaaaggaaugagauaaaaagaauaaggcaauaaauguug

SEQ ID NO: 119359 - RNA, 64 nt, hsa
aggcaucccaucuccaucacagauaaaaucuuaggagauaaacacauucaaaaaggaaugagau

SEQ ID NO: 119360 - RNA, 64 nt, hsa
ucuucuaagaccuuuuuuggauagucaaauauaagagauaaauaguuuaauuuuuucagaccuu

SEQ ID NO: 119361 - RNA, 64 nt, hsa
uuuuuucagaccuuuuuuggauaguccaauauuagagauaaauaguuuaauuuuuucagauaua

SEQ ID NO: 119362 - RNA, 64 nt, hsa
cucaaguuaguucugucacgcuucuucccauuauuuagagcacaguuuuuuaaagcaacuguac

SEQ ID NO: 119363 - RNA, 64 nt, hsa
caguuauauaaauagcaugcagcucacaucuguuuuagagcauagaagaagcggcaccugccau

SEQ ID NO: 119364 - RNA, 64 nt, hsa
ggaaggaauccccuucuuagagcagaggcacaaguuagagcaggcccagcauuugggccaacuu

SEQ ID NO: 119365 - RNA, 64 nt, hsa
uucuaggcaaggaacuaaggaaggaauccccuucuuagagcagaggcacaaguuagagcaggcc

SEQ ID NO: 119366 - RNA, 64 nt, hsa
uauuugacaacucuaaaaaauaaaaaaaaaaaacuuagagcacaauaauccuugccuauguacu

SEQ ID NO: 119367 - RNA, 64 nt, hsa
ugaaggaaagaaagaggaaggcugguagaagcaguuagagcaauguguuugaaauuauguccau

SEQ ID NO: 119368 - RNA, 64 nt, hsa
auuuaauaauaugagugaggauuugcuuucuccauuagagcauuaagcuaaaacuaucaacauu

SEQ ID NO: 119369 - RNA, 64 nt, hsa
acuugcacuuuaauuuuccuccaacugucuaaaauuagagcaaauacauuggcaauacagcugc

SEQ ID NO: 119370 - RNA, 64 nt, hsa
uauuaauccaagacuggaauuguacuucagacauuuagagcagaauuccaagaacucaaaagug

SEQ ID NO: 119371 - RNA, 64 nt, hsa
uacacuugcuuuggucaccagaggaggacagagcuuagagcagcuguggagaaucugaagcauu

SEQ ID NO: 119372 - RNA, 64 nt, hsa
ccuaaccuuccuguaaaccccuuuaguggcuucauuagagcaggcguucagcucacuguucuau

SEQ ID NO: 119373 - RNA, 64 nt, hsa
cucacuguucuauucaucucaaggaauaaugggcuuagagcaguuucuguccugcugguuaacu

SEQ ID NO: 119374 - RNA, 64 nt, hsa
gaguaaauauaagaccucuuguagcuacaauguuuuagagcauguuucaucuucauuuuuaaua

SEQ ID NO: 119375 - RNA, 64 nt, hsa
agcauggcugaaguauuaaaauguuuaauauuuuuuagagcaaaauuguuggaaagcauuuggc

SEQ ID NO: 119376 - RNA, 64 nt, hsa
uguuuugacauauuucaguuuccaccucacguuuuuagagcagaaccacacugucucccuggag

SEQ ID NO: 119377 - RNA, 64 nt, hsa
cgugcaugggacuaguucaucugccacagggauuuuagagcagacaucuaaccucauucaggaa

SEQ ID NO: 119378 - RNA, 64 nt, hsa; identical to SEQ ID NO: 76570

SEQ ID NO: 119379 - RNA, 64 nt, hsa; identical to SEQ ID NO: 76571

SEQ ID NO: 119380 - RNA, 64 nt, hsa; identical to SEQ ID NO: 76572

SEQ ID NO: 119381 - RNA, 64 nt, hsa; identical to SEQ ID NO: 76573

SEQ ID NO: 119382 - RNA, 64 nt, hsa; identical to SEQ ID NO: 76574

SEQ ID NO: 119383 - RNA, 64 nt, hsa; identical to SEQ ID NO: 76575

SEQ ID NO: 119384 - RNA, 64 nt, hsa; identical to SEQ ID NO: 76576

SEQ ID NO: 119385 - RNA, 64 nt, hsa; identical to SEQ ID NO: 76577

SEQ ID NO: 119386 - RNA, 64 nt, hsa; identical to SEQ ID NO: 76578

SEQ ID NO: 119387 - RNA, 64 nt, hsa; identical to SEQ ID NO: 76579

SEQ ID NO: 119388 - RNA, 64 nt, hsa
uaguaaauuugaaugaacuaaagauauaucucuaccuucucauuugaauaucuuuaguucauuc

SEQ ID NO: 119389 - RNA, 64 nt, hsa
ugguaaaucugaaugaacuaaagauguaucuguaccuucucauuugauguauuaaucauaaaau

SEQ ID NO: 119390 - RNA, 64 nt, hsa
gccucagagaugccuggauguggccccucccccuccuucucacccuuaaggacucccaaaccca

SEQ ID NO: 119391 - RNA, 64 nt, hsa
gcugaggggccuggaccagcuguccuuuacaccaccuucucaacacugcugaaaagaacccaag

SEQ ID NO: 119392 - RNA, 64 nt, hsa
ucggcucccguuuguuguaggcccuucccaggugccuucucagcucccucaucuguaaaccgag

SEQ ID NO: 119393 - RNA, 64 nt, hsa
ccuuucccccuaacuuccuccaagggaugcugccccuucucagcccccugcguguguauauugg

SEQ ID NO: 119394 - RNA, 64 nt, hsa
ugggucccuaacuucaagaaauucccauuaugcuccuucucaccuuucuuuuuugcuaauuaug

SEQ ID NO: 119395 - RNA, 64 nt, hsa
uauuuccuauuaagcccacugauuucuucacaauccuucucaaauuacaauuccaaagagccgc

SEQ ID NO: 119396 - RNA, 64 nt, hsa
uucucccacagcugccuacaacagagucucccagccuucucagagagcuaaaaccagaaauuuc

SEQ ID NO: 119397 - RNA, 64 nt, hsa
acagaggacacaaauacguuguuccagagcucagccuucucacucuaaaagaaagauauuuuuc

SEQ ID NO: 119398 - RNA, 64 nt, hsa
aauguaaaauucgucaucaaccuaacaaacacaaccuucucagcagcauuucuccccugugaug

SEQ ID NO: 119399 - RNA, 64 nt, hsa
caaccagguuccgacaguccagcccagaacuuuuccuucucauuuuggguuuucucuucuccug

SEQ ID NO: 119400 - RNA, 64 nt, hsa
cagcggggggacuuccaucgggcuuagcaccugcccuucucacccauggcccacccaggccugg

SEQ ID NO: 119401 - RNA, 64 nt, hsa
uggagcgggcguuguggucaaggaugcagcugccccuucucagccucugaggauccaggcucag

SEQ ID NO: 119402 - RNA, 64 nt, hsa
gccgaccugcggcccccgugguuccugcccugcaccuucucagauggcuacgucugcauucaag

SEQ ID NO: 119403 - RNA, 64 nt, hsa
gaggggagcacugagcuaacagucucuuaggcuuccuucucauuuccacuacucacucuagcuu

SEQ ID NO: 119404 - RNA, 64 nt, hsa
cugauccccugacucuccagcuuccaggaagguuccuucucagagccaaauacucuuugugcaa

SEQ ID NO: 119405 - RNA, 64 nt, hsa
cuagcaggagaugaugaauucucguggcucucggccuucucagagaaauaaaugcuuuguguaa

SEQ ID NO: 119406 - RNA, 64 nt, hsa
gauuguauuuuuuacaguuuuuuggguuuggcuuccuucucacauuucuuuagcuuugaauuuu

SEQ ID NO: 119407 - RNA, 64 nt, hsa
auuuugaaagaauacagaaaacaaacuuuuauauccuucucaugucuucuacuguaaaauucau

SEQ ID NO: 119408 - RNA, 64 nt, hsa
aauaauuccuauggacacuccguuugaaguaucaccuucucauaacuaaaagcagaaaagcuaa

SEQ ID NO: 119409 - RNA, 64 nt, hsa
gccucccugcagggccccuguuccaaugaaaaacagaacacaaaagagcagagcaccuaagccu

SEQ ID NO: 119410 - RNA, 64 nt, hsa
uugcagaaaaacaggauuagaaacacacuuaaaaagaacacacauuuagagucucucuuccucc

SEQ ID NO: 119411 - RNA, 64 nt, hsa
agcccaggaaaaagagaagcagggccaaauggaaagaacacauaauaaacaagaaaaaaacaga

SEQ ID NO: 119412 - RNA, 64 nt, hsa
agcacaaacaugggucaaaggaaaaucuuaaaagagaacacaccaaaaaagugaaagagaaauu

SEQ ID NO: 119413 - RNA, 64 nt, hsa
cuggcauuccagagggucaagaagugacuuguucagaacacauuguuuuuaacagaaaaaaaau

SEQ ID NO: 119414 - RNA, 64 nt, hsa
gucccuuucaggggcuagacacaggcuucucguaagaacacagccuuagaggcaccugagcaac

SEQ ID NO: 119415 - RNA, 64 nt, hsa
accuugugcucuacuccuuccuguuaaugaauuaagaacacauucuaacaagggucuguggcag

SEQ ID NO: 119416 - RNA, 64 nt, hsa; identical to SEQ ID NO: 119415

SEQ ID NO: 119417 - RNA, 64 nt, hsa
agaacuaaacaaucccagccccacccagcaacacagaacacaggaguuugcuuuuggcuucuca

SEQ ID NO: 119418 - RNA, 64 nt, hsa
uuuauuuuuguuucauugguuguuucacagaauuagaacacacacgacuuuuuauuccuccauu

SEQ ID NO: 119419 - RNA, 64 nt, hsa
augcaugccagugcugguuacuagucagugacagagaacacagagagggacaaacacagccaug

SEQ ID NO: 119420 - RNA, 64 nt, hsa
uuuacagaaauuuuaguuacaaucugaguaagcuagaacacacauccaaucuguuaccagcaag

SEQ ID NO: 119421 - RNA, 64 nt, hsa
acaauuucuggcuuggggaggagucccucuagguagaacacagcuucagaaacuagcuuuaaga

SEQ ID NO: 119422 - RNA, 64 nt, hsa
gaggauuuuuccagauaaauuuguacucaaggaaagaacacaagaaguaaguacaaaaguuucu

SEQ ID NO: 119423 - RNA, 64 nt, hsa
auucauaucugccaagauccuuugaauacaugcaagaacacacaauggagagaaacccuaugaa

SEQ ID NO: 119424 - RNA, 64 nt, hsa
uuucacuucuuccaguucuuuucaauaucaugaaagaacacacuagggagaaacccuaucaaug

SEQ ID NO: 119425 - RNA, 64 nt, hsa
agauagcacauacccccacccaguaccaaauuucagaacacaagaagguccaguucuucccccu

SEQ ID NO: 119426 - RNA, 64 nt, hsa
aggucaucugauaauuucacagaugcuguguaacagaacacagccaaaguaaacuguguagggg

SEQ ID NO: 119427 - RNA, 51 nt, hsa
aagccaagguagguguuugauagaacacauuuaaacaucaguauuaugaaa

SEQ ID NO: 119428 - RNA, 64 nt, hsa
cuuuuuuuuucagccauaccucuuaacaccucauagaacacacuuugggaaacaguggggguag

SEQ ID NO: 119429 - RNA, 64 nt, hsa
ucagcauuuauuauacuuuaaugggauagugcuucuugaccauuauagaacaacaaacugucaa

SEQ ID NO: 119430 - RNA, 64 nt, hsa
uuggggagagcaacuucagggcuucuccauagaccuugaccauuauaagcagaccuuauuucuc

SEQ ID NO: 119431 - RNA, 64 nt, hsa
cuguuuguaaagcuugucucuuaaucaaauuugucuugaccaaauaaguuuccugagggcugga

SEQ ID NO: 119432 - RNA, 64 nt, hsa
caaugcauggccauauuuauucauuuuccacacacuugaccaucuacuuuguauaacacauucu

SEQ ID NO: 119433 - RNA, 64 nt, hsa
aaaauauccaacucuggauucugugaauaaguaucuugaccauaaaaagucauugcuguucuug

SEQ ID NO: 119434 - RNA, 64 nt, hsa
ggacauuggcauccugggaaaguccgccuuuucccuugaccacuauaggguguauaaaucgugu

SEQ ID NO: 119435 - RNA, 64 nt, hsa
cuccuccaauuccagccacuugucaggcucuccucuugaccacuguguuaugggauaaggggag

SEQ ID NO: 119436 - RNA, 64 nt, hsa
cccgcccuggcauggcaaccugcagcaggauuaacuugaccauggugggaacugcaccagggua

SEQ ID NO: 119437 - RNA, 64 nt, hsa
uugccugccuggugugccucaguauauuuaaacucaagacaaugcaccuagcugugcaagaccu

SEQ ID NO: 119438 - RNA, 64 nt, hsa
uaaacuguuagcacuguugauguaucugaguugccaagacaaaucaacagaagcauuuguauuu

SEQ ID NO: 119439 - RNA, 64 nt, hsa
cacacccaccggccuugaauuucucugguggucucaagacaagaacaagagcugacucuagaau

SEQ ID NO: 119440 - RNA, 64 nt, hsa
cgcacaugccccagggguuuucaccaaggauuuucaagacaaacuggaguaagaauuaaagccc

SEQ ID NO: 119441 - RNA, 64 nt, hsa
caucucccccaccuccccacuuuuuuccccaagacaagacaaucgaggucuggcuugagaacga

SEQ ID NO: 119442 - RNA, 64 nt, hsa
uaggacaucucccccaccuccccacuuuuuuccccaagacaagacaaucgaggucuggcuugag

SEQ ID NO: 119443 - RNA, 64 nt, hsa
aggcugagcgcaggaggacaggcaccaccggaugccacaccaggcaggaggagguguggacagu

SEQ ID NO: 119444 - RNA, 64 nt, hsa
gaugucucgcuccaccugggucugggaccuggcuccacaccaguuaccugggaccaguaggugc

SEQ ID NO: 119445 - RNA, 64 nt, hsa
gagccuggacugacacccagugggaccaguguugccacaccaguugauaaaaugcagaaacccu

SEQ ID NO: 119446 - RNA, 64 nt, hsa
gaacccugucugccccuucccaccuguccuugggccacaccaucacacugaaccacaggacaga

SEQ ID NO: 119447 - RNA, 64 nt, hsa
cccaguuccucaccagcuacucuggccauauaucccacaccagaaggaacaaguguggcugugu

SEQ ID NO: 119448 - RNA, 64 nt, hsa
ggugcccgagugaucugaggauuuauaauccaagccacaccacccugguuguucucugggcuug

SEQ ID NO: 119449 - RNA, 64 nt, hsa
auugggcccuggacguugagcccagauguuggagccacaccagccuggauuucaaucccagaau

SEQ ID NO: 119450 - RNA, 64 nt, hsa
gaagacucaagugcaccugaucccugcgcaacagccacaccaggagaacaggcuguccuuggcg

SEQ ID NO: 119451 - RNA, 64 nt, hsa
gagaccugcggaaagcccccucccugagucgucgccacaccaggcgacaggcaccacccccucu

SEQ ID NO: 119452 - RNA, 64 nt, hsa
ucugugggagcccgggugccaggcccucccaacaccacaccacccuccaggccccccugcccuc

SEQ ID NO: 119453 - RNA, 64 nt, hsa
ggaugaucugcucagagcucuuccaugccauucuccacaccaagaagcuuuaucaguuuuccuc

SEQ ID NO: 119454 - RNA, 64 nt, hsa
cauuccaggacauucauuugcauaaggagucaaaccacaccagucuuggauuggcugugagcca

SEQ ID NO: 119455 - RNA, 64 nt, hsa
gugacuggcagcuuuagcagccucgguacugaagccacaccaguguccggauggaagucugcau

SEQ ID NO: 119456 - RNA, 64 nt, hsa
auugcuuccucagugucagggcacaugugaauuuccacaccaaacagagcaugaggaaccaguu

SEQ ID NO: 119457 - RNA, 64 nt, hsa
cguagcccucccugcaggcaucaagcagauccugccacaccagaugaccacggcagggcccgug

SEQ ID NO: 119458 - RNA, 64 nt, hsa
uagagaccaagguggccgagcugcuggcccagggccacaccaagccacccgagcgcagugccac

SEQ ID NO: 119459 - RNA, 64 nt, hsa
cccucccuccucgucugccaagccucgccuccuaccacaccacaccaggccaccccagcugcaa

SEQ ID NO: 119460 - RNA, 64 nt, hsa
ccuccucgucugccaagccucgccuccuaccacaccacaccaggccaccccagcugcaagugcc

SEQ ID NO: 119461 - RNA, 51 nt, hsa
agaccuugcuucaagaauaaaccacaccagugaacaagaaggaaaggccuu

SEQ ID NO: 119462 - RNA, 64 nt, hsa
ugucuuucuguguguuuaaaaacagugggaaaauccacaccacacucuaaguggacagcucaga

SEQ ID NO: 119463 - RNA, 64 nt, hsa
ggagugacgaccaccgccccaccaccuccugggaccacaccacuaccgcccccaaccacagcag

SEQ ID NO: 119464 - RNA, 64 nt, hsa
cgugggcuucugggcaggcucacgcagacgccggccacaccauccaccuggccgccuccaugga

SEQ ID NO: 119465 - RNA, 64 nt, hsa
ugauucucccucuggguaaccagucccaggugaaccacaccauccugcaguacuaucgcugcau

SEQ ID NO: 119466 - RNA, 64 nt, hsa
uguaacacacuaacaaaagcaugaaaaauaggaaccacaccaaugcaacauuugugcagaaauu

SEQ ID NO: 119467 - RNA, 64 nt, hsa
caacacaccucaccucacaccacagcacaccucaccacaccacaccgcacugcaccauaccuca

SEQ ID NO: 119468 - RNA, 64 nt, hsa
cacaccgcacugcaccauaccucaccacaucucaccacaccacagcacaccucaccacacaaca

SEQ ID NO: 119469 - RNA, 64 nt, hsa
cgcaccgcaccgcaccguaccucgccacaucucaccacaccacaccacaccacaccucacugcc

SEQ ID NO: 119470 - RNA, 64 nt, hsa
cgcaccgcaccguaccucgccacaucucaccacaccacaccacaccacaccucacugcccacac

SEQ ID NO: 119471 - RNA, 64 nt, hsa
cgcaccguaccucgccacaucucaccacaccacaccacaccacaccucacugcccacacacggc

SEQ ID NO: 119472 - RNA, 64 nt, hsa
ggggugaggcaaaggccucugacuuggacccuuuccacaccagacuggcagcacuucccccagg

SEQ ID NO: 119473 - RNA, 64 nt, hsa
ccagauuucagcuuugaguuauucccugaagaagccacaccaaccuugcuuucaagcaaaaugc

SEQ ID NO: 119474 - RNA, 64 nt, hsa
cugacuuuggcagugccacauuugaccaugagcaccacaccaccauuguggccacccgucacua

SEQ ID NO: 119475 - RNA, 64 nt, hsa
ucuuugcuggccugaccccugaggagcgguccuuccacaccagccgcaacccaagcagaugaca

SEQ ID NO: 119476 - RNA, 64 nt, hsa
guagugccagcacaguccuaaaagggcuggaguaccacaccaacacagguaggggugcagggcu

SEQ ID NO: 119477 - RNA, 64 nt, hsa
agcugagagcaggaagagcgaucuacuuuacaccccacaccaaaggaaaccagaugugagcugc

SEQ ID NO: 119478 - RNA, 64 nt, hsa
gugagcuccagcugcugcgcacggcggccuaccuccacaccacaaccaccuucaccuggaugug

SEQ ID NO: 119479 - RNA, 64 nt, hsa
aacaagauacgcucgccacaguccuucuuugacaccacaccaucaggccgcauccugaacugcu

SEQ ID NO: 119480 - RNA, 64 nt, hsa
ccuaaaucccaggccccuuucucagggggcguggccacaccacacacugcgccagugacacaua

SEQ ID NO: 119481 - RNA, 64 nt, hsa
guugaucuguuuucagugcacacccucaaaugcaccacaccaguuuuacgaucuaagcuuuuaa

SEQ ID NO: 119482 - RNA, 64 nt, hsa
accagacuuuuucuucuaaaaucuggaugucauugacgauaauguuuauggagauaaggucuaa

SEQ ID NO: 119483 - RNA, 64 nt, hsa
ugauaucuaaguaguucucagcaauaauaauaaugacgauaauacuucuuuuccacaucucauu

SEQ ID NO: 119484 - RNA, 64 nt, hsa
acccaacagaucuuuccagagguccaugguggaagacgauaacccugugaaauacuuuauaaaa

SEQ ID NO: 119485 - RNA, 64 nt, hsa
uuugguaauugaauucugaagaauuuaucugcaugacgauaacuaggcauucuauccauuugua

SEQ ID NO: 119486 - RNA, 64 nt, hsa
ccauuuaggauguguauuuaaugcauuuaguaaugacgauaaaguguuuuuaguaugcuuuuag

SEQ ID NO: 119487 - RNA, 64 nt, hsa
guguggggcugagguucuaaaggaauugaaaagagacgauaaacauugaaugagggugagggca

SEQ ID NO: 119488 - RNA, 64 nt, hsa
aaaaaaaugcugaaaauacacauucuccugggaagacgauaaacagcuagcuaagaagccgagg

SEQ ID NO: 119489 - RNA, 64 nt, hsa
gaggaggaaagcgaggggguggggggcuucccgggacgauaaccuggcaguggaaggaaagaag

SEQ ID NO: 119490 - RNA, 64 nt, hsa
acgaauuacguaaauuauacuuucauacaaaggagacgauaaggcaguaaacauggagacacgg

SEQ ID NO: 119491 - RNA, 64 nt, hsa
uuaaaaauuucuuguauuucuugugcauuaaucugacgauaauuucccuguauauuauguucau

SEQ ID NO: 119492 - RNA, 64 nt, hsa
uaaauaauggagcaugcagugagcacaucuagcugacgauaaucacaccuuuucccccgucuuu

SEQ ID NO: 119493 - RNA, 64 nt, hsa
cuagcucaaaggagagucaaggaaaccgcuggcagacgauaaccagucgaaacucgugacuucg

SEQ ID NO: 119494 - RNA, 64 nt, hsa
ggcugcaaaauucauuuuauaauggcuauuuugugacgauaagauguaguucauguuuuucugu

SEQ ID NO: 119495 - RNA, 64 nt, hsa
gagaaaccagcugguuuagaaaaguuuaguaugugacgauaaacuagaaauuaccuuuauauuc

SEQ ID NO: 119496 - RNA, 64 nt, hsa
cguauuuggaguuuauuuagaaguaaagugugaugacgauaacacuuaagugugaauuuuuaaa

SEQ ID NO: 119497 - RNA, 64 nt, hsa
cucaguucugucacuucuuaccucuauaaacuuggacgauaaugugccuucucugagacucagu

SEQ ID NO: 119498 - RNA, 64 nt, hsa
ugucauuccauuauauauccacaccaacaugggugacgauaauucaaagucauauuuugccucu

SEQ ID NO: 119499 - RNA, 64 nt, hsa
guuuugugaaagcuucugauuaauuuauuauauugacgauaaaacucaaaccuacccagccuuc

SEQ ID NO: 119500 - RNA, 64 nt, hsa
cccauuuggagaaugcuuuuauaucaaaaguggagacgauaauaaaguuauuuuggguuaaguc

SEQ ID NO: 119501 - RNA, 64 nt, hsa
cacauugggauuggaauauuaauuacacuauaaugacgauaauguauucaggaaguuaaaaugu

SEQ ID NO: 119502 - RNA, 64 nt, hsa
uuucgacacaucaguaccacuaauggaugauggagacgauaacacucuuuaccaucggguacgu

SEQ ID NO: 119503 - RNA, 64 nt, hsa
gccccgaucuuucacacacuggugacccugagagaggagggaggagggaaccuggcgggggugu

SEQ ID NO: 119504 - RNA, 64 nt, hsa
ucuuucacacacuggugacccugagagaggagggaggagggaaccuggcgggggugucugaggc

SEQ ID NO: 119505 - RNA, 64 nt, hsa
accggggacagacccaggggcgggcagagagggaaggagggaggaggcaucuucccugaagccc

SEQ ID NO: 119506 - RNA, 64 nt, hsa
aggugucauugugcccgaugucuggcuccccugcaggagggaggcuccaggguaagacagggcu

SEQ ID NO: 119507 - RNA, 64 nt, hsa
ccuggugccaucuggccuggcuggagccaggaacaggagggacacuuccccagaauccgcaugu

SEQ ID NO: 119508 - RNA, 64 nt, hsa
ggagcugugccacccaaauccagaggaagcaaggaggagggaggugggguagggaggaguguag

SEQ ID NO: 119509 - RNA, 64 nt, hsa
augggaaagugaggggcuugagaaagugggugggaggagggaaggauuuuuuaggagccuuaau

SEQ ID NO: 119510 - RNA, 64 nt, hsa
auggauggacggauggggugggggaaggaaggaaaggagggagaaaggagggaauacuggcucc

SEQ ID NO: 119511 - RNA, 64 nt, hsa
gauggggugggggaaggaaggaaaggagggagaaaggagggaauacuggcuccaucuuugagag

SEQ ID NO: 119512 - RNA, 64 nt, hsa
acccucucacuuuccugccuguuccccacuccacaggagggagcugacguuggcuugaaaggag

SEQ ID NO: 119513 - RNA, 64 nt, hsa
cauagagccggauggggagagucaacaggaaaaaaggagggaggaggaaaagccacaagagaca

SEQ ID NO: 119514 - RNA, 64 nt, hsa
cagagcacuggcucuccagccccaggaggagaacaggagggaggaggagaugaaagaggaggga

SEQ ID NO: 119515 - RNA, 64 nt, hsa
caggaggagaacaggagggaggaggagaugaaagaggagggacagguucuuggugcuguaccuu

SEQ ID NO: 119516 - RNA, 64 nt, hsa
gugaaccaaacuaguucucagaauucuacagagaaggagggaaucagacugaggaagcugugac

SEQ ID NO: 119517 - RNA, 64 nt, hsa
aguggccuuuggaaaggugguggggauccaguucaggagggagggguauguuugucucccaguc

SEQ ID NO: 119518 - RNA, 64 nt, hsa
aauacuccucccacacuagacacuggguuucaggaggagggagacugcccugcuuuggucccag

SEQ ID NO: 119519 - RNA, 64 nt, hsa
cagcugccaugauaaguccuuccaugaaggacugaggagggagaguggggguccagggcuggug

SEQ ID NO: 119520 - RNA, 64 nt, hsa
ugaaaaguagagaaauggauucaguauaaggauaaggagggaagguggaccagaaugaaaacug

SEQ ID NO: 119521 - RNA, 64 nt, hsa
uuuuguuugacuccuuaccaauagccugaauuugaggagggaaugauugguagcaaaggauggg

SEQ ID NO: 119522 - RNA, 64 nt, hsa
agcaucuuucuagccaaugagcccccuccccaggaggagggauggccugacugaaacaggugag

SEQ ID NO: 119523 - RNA, 64 nt, hsa
cccaccuggagacgaauguagccagagaggaggaaggagggaaacugaagacaccguggccccu

SEQ ID NO: 119524 - RNA, 64 nt, hsa
gaagcagcaggacacauuggcaagucaagcaggaaggagggagauggaaaggggauaucagauu

SEQ ID NO: 119525 - RNA, 64 nt, hsa
gaauaaggaggaggagggagaagagaaaauguaaaggagggagaucuuucccaggccgcaccau

SEQ ID NO: 119526 - RNA, 64 nt, hsa
ccucuguuggaggcacaguuuuagaauaaggaggaggagggagaagagaaaauguaaaggaggg

SEQ ID NO: 119527 - RNA, 64 nt, hsa
auuccaaaguuuugaagucaucuuagcuuuccacaggagggagagaacuuaaaaaagcaacagu

SEQ ID NO: 119528 - RNA, 64 nt, hsa
caagaauuacaaguagaauggcagcuggaauuuaaggagggacaagaaucaauggauaagcgug

SEQ ID NO: 119529 - RNA, 64 nt, hsa
cagaauuucuaauggaaguuuguugugaauguaaaggagggagcauucuuugcuuuuuaauaua

SEQ ID NO: 119530 - RNA, 64 nt, hsa
caagaaagagucagguuagggagcagugaaagugaggagggaagacaauucugugaacucugua

SEQ ID NO: 119531 - RNA, 64 nt, hsa
cugagccugcauggugccgccgagcccgggguggaggagggagccaggcuucgcuucaaggcgg

SEQ ID NO: 119532 - RNA, 64 nt, hsa
cugguggguugcaggaacagcacccaggacucugaggagggacagagaagcaagggggcugcug

SEQ ID NO: 119533 - RNA, 64 nt, hsa
uccaagagaaaggaggcuccguuuugcaaaguggaggagggacgagggacagggguuucaccag

SEQ ID NO: 119534 - RNA, 64 nt, hsa
uggaagccucccucacucuccaugcuggcagagcaggagggagacugaaguaagagauggcaga

SEQ ID NO: 119535 - RNA, 64 nt, hsa
gacuugggggcagaaguucagacacaccgugcucaggagggacccagagccgaguuucggaguu

SEQ ID NO: 119536 - RNA, 64 nt, hsa
uuguugcugucagauucuauuuucagaaagugagaggagggaccguaggucuuuucggagugac

SEQ ID NO: 119537 - RNA, 64 nt, hsa
ccaucugagaaguggcccaugugcuucaaggcccaggagggagaucugucagcucauucuugcc

SEQ ID NO: 119538 - RNA, 64 nt, hsa
caccggaguucaacgucccagcagucuugguaaaaggagggagccugcugagccaggagggaga

SEQ ID NO: 119539 - RNA, 64 nt, hsa
gcagucuugguaaaaggagggagccugcugagccaggagggagaaaagaagauugaccagcuug

SEQ ID NO: 119540 - RNA, 64 nt, hsa
uggccucugcuaagcucaaggcgugaggaugggaaggagggagguauucguaaggaugggaagg

SEQ ID NO: 119541 - RNA, 64 nt, hsa
gaugggaaggagggagguauucguaaggaugggaaggagggagguauucgugcagcauaugagg

SEQ ID NO: 119542 - RNA, 64 nt, hsa
cuuggcgccucuguuugccaccacuuccccaggaaggagggacagcauuucucuggcugguucc

SEQ ID NO: 119543 - RNA, 64 nt, hsa
cugccccaccugccaucuugguugucaaagucaaaggagggaaugaaguuaugaauugaauugg

SEQ ID NO: 119544 - RNA, 64 nt, hsa
agaggccagcccggggcuggggaggcgcaaggagaggagggauccaguggggccgugggcuggg

SEQ ID NO: 119545 - RNA, 64 nt, hsa
cauacaggcccacaccugagcuccugucugccugaggagggaaagggggaguggccaggucagg

SEQ ID NO: 119546 - RNA, 64 nt, hsa
gcuggagggaggcugggcggguacagcgcggaggaggagggaggccaggcgggcauggcgugga

SEQ ID NO: 119547 - RNA, 64 nt, hsa
ggaggagggaggccaggcgggcauggcguggaggaggagggaggccgggcggucacagcaugga

SEQ ID NO: 119548 - RNA, 64 nt, hsa
ggaggagggaggccgggcggucacagcauggaggaggagggaggcgcugcugguguucuuauuc

SEQ ID NO: 119549 - RNA, 64 nt, hsa
guugagcucucagccuuaggaaggaagcacguggaggagggacggaggagguucccuugcuggg

SEQ ID NO: 119550 - RNA, 64 nt, hsa
aguuccacccacagaguagugaaucucucagccaaggagggaaagaaaaggaagaacucuugac

SEQ ID NO: 119551 - RNA, 64 nt, hsa
gagggagagaauggcccgagggaggagggagagaaggagggaggcgcuccugggaccgugggcg

SEQ ID NO: 119552 - RNA, 64 nt, hsa
gagggagggagggagggagagaauggcccgagggaggagggagagaaggagggaggcgcuccug

SEQ ID NO: 119553 - RNA, 64 nt, hsa
ggaaaaggaaccaagaaguagaaggagucccaucaggagggaagauggugggccucagggagga

SEQ ID NO: 119554 - RNA, 64 nt, hsa
guggggaacaaaacaauuaacguaagagcuacaaaggagggaaaaggaaccaagaaguagaagg

SEQ ID NO: 119555 - RNA, 64 nt, hsa
uguaauuggggagagggagugugccccucggggcaggagggaagggcaucuggggaagggcagg

SEQ ID NO: 119556 - RNA, 64 nt, hsa
ucggggcaggagggaagggcaucuggggaagggcaggagggaagagcuguccaugcagccacgc

SEQ ID NO: 119557 - RNA, 64 nt, hsa
gauuuugcuuaaaacagcacuugccgccagugggaggagggagguuuuauuuauucccacaguu

SEQ ID NO: 119558 - RNA, 64 nt, hsa
aacuccuggcagcuuuggcccuggucaugagcagaggagggagggggagaaagggaggaagccu

SEQ ID NO: 119559 - RNA, 64 nt, hsa
ugugaugcugaaggauacugccggcagcaggcagaggagggagggggccuagggcucugaccca

SEQ ID NO: 119560 - RNA, 64 nt, hsa
gagccaguucagucacuagugcgccagccaggccaggagggagugcagagcaugucugccaagc

SEQ ID NO: 119561 - RNA, 64 nt, hsa
uggugaacagagagaaccaggaggguaacagaagaggagggaccuacugaacccagagucagga

SEQ ID NO: 119562 - RNA, 64 nt, hsa
agacccaaagugggggguggacacagaagucccuaggagggaaggagcuguuggggcaggggug

SEQ ID NO: 119563 - RNA, 64 nt, hsa
gaaagagggggcaggggcugcugggacacugagcaggagggaggccugagcacacugcuuugga

SEQ ID NO: 119564 - RNA, 64 nt, hsa
cauucccuaacucccuccugccccuggucugaggaggagggacucuggaguagcagaggggcug

SEQ ID NO: 119565 - RNA, 64 nt, hsa
gugggcaaggugggaccuccugcagccuggaaagaggagggaggccaaggccauucccuaacuc

SEQ ID NO: 119566 - RNA, 64 nt, hsa
auuaagggcccugggggagaauaaagcucagagcaggagggaguaaggaaacauuuccuuuuug

SEQ ID NO: 119567 - RNA, 64 nt, hsa
gccugcaucuuuggcucugcugugaucugauuggaggagggacaguuucugguacccauccucu

SEQ ID NO: 119568 - RNA, 64 nt, hsa
agagcuaggagcaaagccuguucauggcagauguaggagggacugucgcugcuucgugggauac

SEQ ID NO: 119569 - RNA, 64 nt, hsa
ccacccugaggagucugagguccugagcacugccaggagggacaaaggagccugugaacccagg

SEQ ID NO: 119570 - RNA, 64 nt, hsa
guugcacaggagugggauggggugugguagcaaaaggagggagaggaguccuuuuugugccaaa

SEQ ID NO: 119571 - RNA, 64 nt, hsa
ccccagccaggugucccuccuaugcacagagcagaggagggagaagcucuggggagccagcuuu

SEQ ID NO: 119572 - RNA, 64 nt, hsa
ucagaaaugcagacaccccagacgagagccucacaggagggagggggccccacaggcuccccag

SEQ ID NO: 119573 - RNA, 64 nt, hsa
aaagaaaaccauuuucagggagcucagacgucacaggagggagcgggagcaggauguggcccug

SEQ ID NO: 119574 - RNA, 64 nt, hsa
uuagcuuaugcuucuuuagauggaauaaugggaaaggagggaaaugggaaauggauggaaaugg

SEQ ID NO: 119575 - RNA, 64 nt, hsa
aaggagggaaaugggaaauggauggaaaugggaaaggagggaaaauaauagcccagugagagcu

SEQ ID NO: 119576 - RNA, 64 nt, hsa
gcacccacgggugugcuggauacuggaguuugagaggagggaggugcuggggccaaaggagaca

SEQ ID NO: 119577 - RNA, 64 nt, hsa
acucagguucgcccucugggccagguccuucacgaggagggagcuacccuucgccagaaguuug

SEQ ID NO: 119578 - RNA, 64 nt, hsa
aucaacugcuauccuuccccucaccccucagcccaggagggaaagggcauuuucuuuuucaucu

SEQ ID NO: 119579 - RNA, 64 nt, hsa
gcacuggagggcgcaucaaagaagaguccuacccaggagggagagcgcagcugcugcaggauuc

SEQ ID NO: 119580 - RNA, 64 nt, hsa
ccgaggcugcugagacccuuagaucuuugggccuaggagggagucagagagggggaugucugaa

SEQ ID NO: 119581 - RNA, 64 nt, hsa
agccuggaaaagauggggaaccugcuagugaacuaggagggagacuuccauagccucagacuug

SEQ ID NO: 119582 - RNA, 64 nt, hsa
caggcccugcucagaggucagagggucugggcagaggagggaccacauuccccugccuugcccc

SEQ ID NO: 119583 - RNA, 64 nt, hsa
cuuugcagccuggccagcagcucagagugcaccgaggagggaaggauggcuaagcugggaccgg

SEQ ID NO: 119584 - RNA, 64 nt, hsa
uggggagagggaugcuauuuauucaguuuggggcaggagggagaggagggaaaguauuucugac

SEQ ID NO: 119585 - RNA, 64 nt, hsa
ggaugcuauuuauucaguuuggggcaggagggagaggagggaaaguauuucugacccugaugcc

SEQ ID NO: 119586 - RNA, 64 nt, hsa
uuuaacugcugugaacucacuuugaggggguaggaggagggagaaacagccuguguuuuuuaug

SEQ ID NO: 119587 - RNA, 64 nt, hsa
uuugauucugaucauggggugggggagagaggaaaggagggaggggagaagcccagcagaagcu

SEQ ID NO: 119588 - RNA, 64 nt, hsa
agagucuagacagacggcacaggccuaggagacuaggagggaaucuggagggggcgcuggagga

SEQ ID NO: 119589 - RNA, 64 nt, hsa
caagaugaggcaccaggaaaggggugguagucagaggagggaggaggaauaaggggaaggaaga

SEQ ID NO: 119590 - RNA, 64 nt, hsa
gccaaagauggagaagagugccagggaccccucaaggagggagacgcuccauaucccagggcau

SEQ ID NO: 119591 - RNA, 64 nt, hsa
gcccagguaagaccucucugaagagcugucaugaaggagggagggagcacauuccuggcagaga

SEQ ID NO: 119592 - RNA, 64 nt, hsa
auggccugcuguucacauggacccugagcaaggaaggagggagggaggggcagaguggaguguc

SEQ ID NO: 119593 - RNA, 64 nt, hsa
accucuuuguagugcuuggcuacucugugauggcaggagggaaccuucagccugucuggcugcu

SEQ ID NO: 119594 - RNA, 64 nt, hsa
ugcccuucccccacccccacggcucuccugguugaggagggaggggccuggcugaccccuccag

SEQ ID NO: 119595 - RNA, 64 nt, hsa
aggaagagagagugggaggcagagugugauggggaggagggacaggaagacccuuuuaaugaug

SEQ ID NO: 119596 - RNA, 64 nt, hsa
gggcuuucuccccuuuugcuugagcaggguucccaggagggagaaagagaagacaagagccuga

SEQ ID NO: 119597 - RNA, 64 nt, hsa
agaggggagaagaaggaagggaagggcagaaggaaggagggaagaaaagaaagcaaaggaacag

SEQ ID NO: 119598 - RNA, 59 nt, hsa
cccaagccuuuggugagaagccaauucccacuugacagaaggcguccauccauucaucu

SEQ ID NO: 119599 - RNA, 59 nt, hsa
acaaguguucagagaggucccccucugccacuugacagggaccuucaaaccucgacagu

SEQ ID NO: 119600 - RNA, 59 nt, hsa
auauaauaaaguuuuaaaaauuuguauguacuugacaauuccuuagaaaaaagaggcua

SEQ ID NO: 119601 - RNA, 59 nt, hsa
gagcaaaguauuaaaaauuucucaaacuuacuugacaacaaaacccauucuuucaguua

SEQ ID NO: 119602 - RNA, 59 nt, hsa
cccuuacuggaugacucucagaggacaugacuugacauaguaacauuaguaaacugucu

SEQ ID NO: 119603 - RNA, 59 nt, hsa
caagaaauuauauuuauaugaaguaaaucacuugacaacuuuuaagggcauguuauuug

SEQ ID NO: 119604 - RNA, 59 nt, hsa
aaguaaagaaacacaaauagcugaaacaaacuugacaaagcaaguagagaagacacacu

SEQ ID NO: 119605 - RNA, 59 nt, hsa
accugaaaaaugauauuuugucugaaaagacuugacauuguaaaaauauaauuucucuc

SEQ ID NO: 119606 - RNA, 64 nt, hsa
ccagcuguucuccagggcuuggggaaacagaaaccacucacauagggauuccuggauggcuuca

SEQ ID NO: 119607 - RNA, 64 nt, hsa
gcuauuuguucuuuggaaugacugcuccacuccacacucacaccucuauucacagaccagcauc

SEQ ID NO: 119608 - RNA, 64 nt, hsa
uaaagagaaagaauacuugacagcucuaugcccacacucacauuacagcugaugugaaagagau

SEQ ID NO: 119609 - RNA, 64 nt, hsa
uuauuggcuaguuagcuuucuuuaucaaccugcucacucacaaaugugugcccucagccagaga

SEQ ID NO: 119610 - RNA, 64 nt, hsa
uucuguggaacuuggcaaauuuucagagcaccuucacucacauaaugucauuugaaccucacaa

SEQ ID NO: 119611 - RNA, 64 nt, hsa
acuauaaugcacacucacacacaauuuaugugcacacucacacaugcacacacacacacacaua

SEQ ID NO: 119612 - RNA, 64 nt, hsa
uaaaccaagagagaaagcaagaaacuauaaugcacacucacacacaauuuaugugcacacucac

SEQ ID NO: 119613 - RNA, 64 nt, hsa
uugcagaagcugauggggcaaacucaagcuucuucacucacagcacccuauauacacuuggagu

SEQ ID NO: 119614 - RNA, 64 nt, hsa
auccuuucacacauuugccuugacaaacuucuuucacucacaucuuuuucacugacuuuuuuug

SEQ ID NO: 119615 - RNA, 64 nt, hsa
cagaaaucaacagaaucacucacacauacaaguacacucacauacauaaacuaauuauuucucu

SEQ ID NO: 119616 - RNA, 64 nt, hsa
uucuuuuugccucuaaugcagaaaucaacagaaucacucacacauacaaguacacucacauaca

SEQ ID NO: 119617 - RNA, 64 nt, hsa
cacaaaacuucaaaugcuacaaaauauacacacacacucacacacacaggcauacucacacaca

SEQ ID NO: 119618 - RNA, 64 nt, hsa
agaagacaaauggcgcccacuaguggggaauccgcacucacaaaagcacaggaugcuggaaaac

SEQ ID NO: 119619 - RNA, 64 nt, hsa
cuucugauacacagccacugcacacacacacucacacucacacucccuugucugaugccccaaa

SEQ ID NO: 119620 - RNA, 64 nt, hsa
ugguugcuucugauacacagccacugcacacacacacucacacucacacucccuugucugaugc

SEQ ID NO: 119621 - RNA, 64 nt, hsa
cguacaugcacaaauacacacucaugcacacacacacucacacacaugcauacacuuagguuuc

SEQ ID NO: 119622 - RNA, 64 nt, hsa
cccuaacuuuuaauguacaucacacacacacucacacucacauacacacacacacacacacucu

SEQ ID NO: 119623 - RNA, 64 nt, hsa
gcccagcccuaacuuuuaauguacaucacacacacacucacacucacauacacacacacacaca

SEQ ID NO: 119624 - RNA, 64 nt, hsa
acucccaccauccugugagccccacuccuggccccacucacaccauccuaugagcccacgcccg

SEQ ID NO: 119625 - RNA, 64 nt, hsa
acucacaccaaccugugagccccacucccggccccacucacaacaucuuguaagacugugcccg

SEQ ID NO: 119626 - RNA, 64 nt, hsa
acucacuccauccugugagccccacucccagccccacucacaccaaccugugagccccacuccc

SEQ ID NO: 119627 - RNA, 64 nt, hsa
cacucccaccauccugugagcccaugcccggccccacucacaccaaccugugagccccacuccc

SEQ ID NO: 119628 - RNA, 64 nt, hsa
gcugggcccagaggcacagccggggccugccuagcacucacaugcuggacaggucugggagagg

SEQ ID NO: 119629 - RNA, 64 nt, hsa
ucggucuucggcauugguucccuuugcuccaccccacucacagagacacagggcauccaacuga

SEQ ID NO: 119630 - RNA, 64 nt, hsa
aacagagccugcgggaaacggggcuugccagagacacucacaguuuccuucauggccuguuuug

SEQ ID NO: 119631 - RNA, 64 nt, hsa
cuccucccuguucccguuccucccuggcccaccccacucacacuccccaaggcccacggcucaa

SEQ ID NO: 119632 - RNA, 64 nt, hsa
gacaucuuggaacucaaucuucuguuggaucacgggaaaucaagacacccaggaggaauugaaa

SEQ ID NO: 119633 - RNA, 64 nt, hsa
aguagaaaaaugucacguuuccauaucuccugcuggaaaucagaaaauauaauaaaauugcaca

SEQ ID NO: 119634 - RNA, 64 nt, hsa
aauaguacaaguuauuaucaaggauguuuuacagggaaaucaaaagaauauuaucauacuuuau

SEQ ID NO: 119635 - RNA, 64 nt, hsa
aauuaggcuuuauuaucuuccuaaaucaaggaaaggaaaucauccccagaccauuuaugcugag

SEQ ID NO: 119636 - RNA, 64 nt, hsa
uggaauaauaccuaacaggcaggcucuggaaguuggaaaucacauacacacacacacacacaca

SEQ ID NO: 119637 - RNA, 64 nt, hsa
uaucugguuuaauguuguauuuauaauuuaaaguggaaaucagaaacuguuucaagaaccugua

SEQ ID NO: 119638 - RNA, 64 nt, hsa
agaaugccaaaccacauuuuuaucacacuucuuuggaaaucaaugccuuugcauagaaaaucaa

SEQ ID NO: 119639 - RNA, 64 nt, hsa
agguaugggugaaauuggaaauuacuaaucuauuggaaaucaguuccugacauaguaaaguuug

SEQ ID NO: 119640 - RNA, 64 nt, hsa
caaaguguagacaucuguaggaacuaaauaucaaggaaaucaagacauuuauuuucaaagcgag

SEQ ID NO: 119641 - RNA, 64 nt, hsa
ugaagauugaaauauccaaagguuuaaacaagauggaaaucaaugaaaaagaggccuuguuuau

SEQ ID NO: 119642 - RNA, 64 nt, hsa
aauugccuaauugcugcaaaguauaacccagauaggaaaucauauguuuuuuuccaagagucau

SEQ ID NO: 119643 - RNA, 64 nt, hsa
gagcucucucagugugaacaugccuucugugggcggaaaucaggaagccaccagcuguuaaugg

SEQ ID NO: 119644 - RNA, 64 nt, hsa
gugcuuaauuuacucuguuguaaagggauaaaguggaaaucauuuuuuuccguggaguggugau

SEQ ID NO: 119645 - RNA, 64 nt, hsa
auaaaugugaaccuaagaaaacuccaccucugaaggaaaucauuugaauuuuguuuuuguacgu

SEQ ID NO: 119646 - RNA, 64 nt, hsa
ccaacauuaauacucaggaccccaagauacagaaggaaaucaugcgugugaucggaacucaggu

SEQ ID NO: 119647 - RNA, 64 nt, hsa
gagacccaccugcauguuguuuuggcucauauuuggaaaucaagaaacagauggacaaguugga

SEQ ID NO: 119648 - RNA, 64 nt, hsa
uuuuugguuuucugauggaaauaauagaauuaggggaaaucaaaucugguugguaggugucuac

SEQ ID NO: 119649 - RNA, 64 nt, hsa
auauugggugaugucaaagguauaugauacuugaggaaaucaggccaaguguagcugagcaauu

SEQ ID NO: 119650 - RNA, 64 nt, hsa
cuugugaaaauuuauccauuuaucuucagguuggggaaaucaauuuuucuuuaaauccaaagau

SEQ ID NO: 119651 - RNA, 64 nt, hsa
auuuucuuucuuucuauauuggauugcaagcuugggaaaucaagcuaccuuuuuguuguuguug

SEQ ID NO: 119652 - RNA, 64 nt, hsa
agcugcuuagcuggugcuggccugaggcagggcaggaaaucagaauagcauuugcuucucuggg

SEQ ID NO: 119653 - RNA, 64 nt, hsa
uagcuuguggaguuuaugggccaccaggguuuggggaaaucaccaucccgcggaugcugugacc

SEQ ID NO: 119654 - RNA, 64 nt, hsa
gcagaaacugaauuaauaugcuuccuugcaaaugggaaaucacauagcaguuaccccauggcau

SEQ ID NO: 119655 - RNA, 64 nt, hsa
acucuggagcaacuuagucaaauaccguuacuugggaaaucaucuuuacggaauguggugcuga

SEQ ID NO: 119656 - RNA, 64 nt, hsa
ugaaagugacaaauuuuaaauuuucucuaauaguccucaucauaaacuuuuuaaaggaaaauaa

SEQ ID NO: 119657 - RNA, 64 nt, hsa
ggggcacugcugcaacuucugcuuucaucccaugccucaucaaugaggaaagggaacaaagugu

SEQ ID NO: 119658 - RNA, 64 nt, hsa
ccgacaaccagaggcugaaagaugaaaauggugcccucaucagagucaucagcaaacuguccaa

SEQ ID NO: 119659 - RNA, 64 nt, hsa
cccuugguucacuugagugugcaagucauuaaauccucaucauuuuaggguugccagugauauu

SEQ ID NO: 119660 - RNA, 64 nt, hsa
cacuccccgcauggggaggccgccaccaccaacaccucaucauccuucucaucgcuaacaccac

SEQ ID NO: 119661 - RNA, 64 nt, hsa
uguuggaggcugggaaccccgcagcgcgaggcugccucaucaacggcaagaggaaaggaggggu

SEQ ID NO: 119662 - RNA, 64 nt, hsa
uagaaccuuuccagguucucuuagagccauaugcccucaucaucccaggggagaacuacauugg

SEQ ID NO: 119663 - RNA, 64 nt, hsa
uguuacacauugaggcugucuuuaaggggccugcccucaucaucaacgucucagcccuucaguu

SEQ ID NO: 119664 - RNA, 64 nt, hsa
caggaucaacugugggcaaagugccugccucugaccucaucaugguucuaguucucauacagaa

SEQ ID NO: 119665 - RNA, 64 nt, hsa
gcugggcagugcguuuagucuguggccuagaagaccucaucagcccccgagaggaggccuugca

SEQ ID NO: 119666 - RNA, 64 nt, hsa
ccuugccacuggagcucucuuaauaccgucaaacccucaucaucuguggguugcuuuuuuuuuu

SEQ ID NO: 119667 - RNA, 64 nt, hsa
gaucuuugggcccuuguauccauuauccuuaugaccucaucacccucagacuuuaagacaagaa

SEQ ID NO: 119668 - RNA, 64 nt, hsa
aauauaaccaauucuaaauuuguuuuagcucuaaccucaucaaaccaaaggcacagauuugugu

SEQ ID NO: 119669 - RNA, 64 nt, hsa
acagcucucagccuaagagcgcagcacugaacagccucaucauuccacuuuucaugggaaauau

SEQ ID NO: 119670 - RNA, 64 nt, hsa
cugcuuuccaccaugaguugaagcagcaugaggcccucaucagaugggcucccugaucuuggac

SEQ ID NO: 119671 - RNA, 64 nt, hsa
ggaauguccaggucaucuucacccagaggagaagccucaucauugaauggagaaucucauuaaa

SEQ ID NO: 119672 - RNA, 64 nt, hsa
uggauaccaccaucuaagcuccuguaucagcaguccucaucaucacucaucugccaagcuccuc

SEQ ID NO: 119673 - RNA, 64 nt, hsa
caucccuccauguacucuggguaucagcaacuguccucaucagucuccauaccccuucagcuuu

SEQ ID NO: 119674 - RNA, 64 nt, hsa
uggauagaaucaucuaagcuccuguaucagcacuccucaucaucacucaucugccaagcuccuc

SEQ ID NO: 119675 - RNA, 64 nt, hsa
caucucuccauauacuuuggguaucagcaucuguccucaucagucuccauaccccuucagcuuu

SEQ ID NO: 119676 - RNA, 64 nt, hsa
cgucucaacugauuuacucacuuagcuucccuucccucaucagcauaguauaauagaauguaug

SEQ ID NO: 119677 - RNA, 64 nt, hsa
aaggucagugaagucuaucaaucauucuccccuuccucaucagcaaugguagauagaaaugucc

SEQ ID NO: 119678 - RNA, 64 nt, hsa
aauccuuaacuucuccccauuuuguuuuuuuccgccucaucacaccaugcugccuuucccucau

SEQ ID NO: 119679 - RNA, 64 nt, hsa
agacauaugagcaagaaaaaagugauuuaacuuaccucaucaagaaugugccccuacaggccgg

SEQ ID NO: 119680 - RNA, 64 nt, hsa
ucaucuugccacccacccccuaccauugagccaccaugcccagccccaaagccucuuaauugcu

SEQ ID NO: 119681 - RNA, 64 nt, hsa
uccccagagugcugggauuacacacgugagucaccaugcccagccccaaagccauuucuugaag

SEQ ID NO: 119682 - RNA, 64 nt, hsa
cucccauauagcugggauuauaggugccugccaccaugcccagcuaauuuuuguguuuuuagua

SEQ ID NO: 119683 - RNA, 64 nt, hsa
cucccaaguagcugggauuauaggcaugugccaccaugcccagcaaauuuuguauuuuuuuuug

SEQ ID NO: 119684 - RNA, 64 nt, hsa
ugucuggguucucccugcagacagcuuccuagcucaugcccauagcucaugcucccugccgaga

SEQ ID NO: 119685 - RNA, 64 nt, hsa
cucccgaguagcugggacuacaggugagccccagcaugcccagcuaauuuuuuuuaauuuuuag

SEQ ID NO: 119686 - RNA, 64 nt, hsa
cagugagugccuuaaaguuggagaaguaacugcccaugcccagaaauaaggaugccagugccca

SEQ ID NO: 119687 - RNA, 64 nt, hsa
aacacagccuguguggaaggcagaacaaagaaugcaugcccagucagaaaucuguucuauucug

SEQ ID NO: 119688 - RNA, 64 nt, hsa
cgugcugcuccuggacuggcccaccugccugccacaugcccacgccuagucccaucugggcccc

SEQ ID NO: 119689 - RNA, 64 nt, hsa
uuguuucccucauggccgaccagggcggggauagcaugcccaauuuuagcccugaagcagggcu

SEQ ID NO: 119690 - RNA, 64 nt, hsa
cugcugaguaguugggauuacaggcgcccaccaccaugcccagcuaauuuuuguguuuuuauug

SEQ ID NO: 119691 - RNA, 64 nt, hsa
cuccugaguagcugggacuacaggugugcaccaacaugcccagcuaauuuuuuauauuuuuagu

SEQ ID NO: 119692 - RNA, 64 nt, hsa
cucucaaguagcugggauuacaagcaugcgccaccaugcccagcuuauuuuguguuuuuaguag

SEQ ID NO: 119693 - RNA, 64 nt, hsa
uucccaaguagcugggacuacagguguucgccaccaugcccagcuaauuuuuuuguagagaugg

SEQ ID NO: 119694 - RNA, 64 nt, hsa
cuccagagacagcuguguggagcaaaucagaguucaugcccaaguccccagguuggaauggcug

SEQ ID NO: 119695 - RNA, 64 nt, hsa
uuucuggcagcaaucccugccuucuuuuugggcccaugcccagacuucugguuuaaggaauggu

SEQ ID NO: 119696 - RNA, 64 nt, hsa
uccgugcuauuaaucacuuguuagagcaacaugacaugcccagcaucccacuucccgaaaaugu

SEQ ID NO: 119697 - RNA, 64 nt, hsa
uggggcuggggcagaugccuaauuucgcacaaugcaugcccaccuguugaucuaaggggccgcg

SEQ ID NO: 119698 - RNA, 64 nt, hsa
acucccucagccccuggaacgguguuuucugaggcaugcccagguucaggucacuucggacacc

SEQ ID NO: 119699 - RNA, 64 nt, hsa
cucccaaagugcuaggauuacaggcgugagccaccaugcccagccuacucuaaauuauugauaa

SEQ ID NO: 119700 - RNA, 64 nt, hsa
ugaccucaccaguugagacaccuaguguauggcucaugcccagccuuccaccugggauucucca

SEQ ID NO: 119701 - RNA, 64 nt, hsa
cagagaggaucuugcucauucauggccauauccacaugcccauggccacucaguagauuguuga

SEQ ID NO: 119702 - RNA, 64 nt, hsa
acacaggcuucuuccuagagccagcccuauauaacaugcccacaagggcaacaguuaucacagu

SEQ ID NO: 119703 - RNA, 64 nt, hsa
ugugcaggacacaauccaaaucauaaaccuggcucaugcccaacacauuucugcuaauagggag

SEQ ID NO: 119704 - RNA, 64 nt, hsa
cuccccaguagcugggauuacaggcacccaccaccaugcccagcuaauuguuguauguuuagua

SEQ ID NO: 119705 - RNA, 64 nt, hsa
gugaggggcccugccuuccucaguagggagucaacaugcccaagucauuugcaccuuuaccucu

SEQ ID NO: 119706 - RNA, 64 nt, hsa
agaugcuugucugaugccugaaugucuccuuacccaugcccacggcacaggauagaugugcuau

SEQ ID NO: 119707 - RNA, 64 nt, hsa
gugucacagugccaucuccagacucaaggacucccaugcccaccugagcccugacagcaccaag

SEQ ID NO: 119708 - RNA, 64 nt, hsa
agggcugaguacaguccuggggguaaggggaugacaugcccaggugucagcucaaaggaucucu

SEQ ID NO: 119709 - RNA, 64 nt, hsa
uucucuugaacuggagaggggaagaaaugaaaggcaugcccacguccgucaccuccccaucccc

SEQ ID NO: 119710 - RNA, 64 nt, hsa
ugacccucaguuccucaaacacagacccagggugcaugcccaucuccagcccagggcagcuccc

SEQ ID NO: 119711 - RNA, 64 nt, hsa
aucugggggagcugcugauggaguccucgcugcucaugcccacagcccucccagagugcuaugc

SEQ ID NO: 119712 - RNA, 64 nt, hsa
acguugcugagcaacucgccagccuccugagcuccaugcccaucaggacucuagccucugaccu

SEQ ID NO: 119713 - RNA, 64 nt, hsa
guggcaccacugagccuagaccauggagccuuggcaugcccagggcaaguggggagguucucug

SEQ ID NO: 119714 - RNA, 64 nt, hsa
gccacauggccgcugcccacgucccgggcacugucaugcccagcuuggagugccacguggccgc

SEQ ID NO: 119715 - RNA, 64 nt, hsa
gccacguggccgcugcccacgucccgggcacugucaugcccagcuuggagugccacauggccgc

SEQ ID NO: 119716 - RNA, 64 nt, hsa
cgccacacuggccggcccacguccugggugcugucaugcccagcuuggagugccacguggccgc

SEQ ID NO: 119717 - RNA, 52 nt, hsa
cccugggcacaccuugcugaggccccaguagggguggggagggagggagagg

SEQ ID NO: 119718 - RNA, 64 nt, hsa
ugcugggauuacaggugugagcugccacgcccagccccaguacacucuucucuggaccagaucu

SEQ ID NO: 119719 - RNA, 64 nt, hsa
cuauugagguccuaugucucugauuuuuuuuuuuccccaguauugcccuggagcugucucugga

SEQ ID NO: 119720 - RNA, 64 nt, hsa
cuguaaaaugagaauucugcccccucaccucuuaccccaguacuauucuccagagguaaucuau

SEQ ID NO: 119721 - RNA, 64 nt, hsa
aauuuccaccccaguccccuccccagggaaccacccccaguaaccauccuggggaguuuaaggu

SEQ ID NO: 119722 - RNA, 64 nt, hsa
ccccuccccuggcuuugauugcccuguucuguguccccaguagcucagccuucccucuuccucu

SEQ ID NO: 119723 - RNA, 64 nt, hsa
aacggaucaaagcucccacgccaguccacuagggccccaguaguugacagccuugcuccucucc

SEQ ID NO: 119724 - RNA, 64 nt, hsa
ucccaguuacaucaaacagugacuuccaguuauuccccaguaagucugagugguuccuucaagc

SEQ ID NO: 119725 - RNA, 64 nt, hsa
gaacauucucaauuaagugauaaguccaaaugaugaaggaaauguuuuaauucacaaauggaga

SEQ ID NO: 119726 - RNA, 64 nt, hsa
uuuaccuuuuggacaguaauuucuaucacaguuagaaggaaaugauagucaaauacacguuuag

SEQ ID NO: 119727 - RNA, 64 nt, hsa
ggcucuguccuccucgacccuagugggggaucaagaaggaaacuccguugcaaaaggguauuuu

SEQ ID NO: 119728 - RNA, 64 nt, hsa
gccugcccacaggacaagaaguggguaagggcaggaaggaaaugaacggaguuagcucccaggc

SEQ ID NO: 119729 - RNA, 64 nt, hsa
gcagagguaagaggaagaggcagcagcaucccaagaaggaaagagcuggagucagcacugucca

SEQ ID NO: 119730 - RNA, 64 nt, hsa
cagaaaaagcaagaagaagaaaaggcgacaucaagaaggaaaggucucagaugaaagagagggu

SEQ ID NO: 119731 - RNA, 64 nt, hsa
auuuuucugaaaguggcugauguaagaacaggcagaaggaaaacccuuuuugucaauaacucug

SEQ ID NO: 119732 - RNA, 64 nt, hsa
cucuuggauuuuuugaaauaaucuucagaggaaggaaggaaaauccuauuuugggguaucagug

SEQ ID NO: 119733 - RNA, 64 nt, hsa
caguggcagaacaugcagcagaaaagcugugaaggaaggaaauuuacgugauuguaauggaggc

SEQ ID NO: 119734 - RNA, 64 nt, hsa
cugugcccccuaaaccaggcgguggaucaggcccgaaggaaaaugcuggaaaaccaccaccgcc

SEQ ID NO: 119735 - RNA, 64 nt, hsa
gcugaaaucaagcacauauuuugaaauggacugugaaggaaaaggggacaggaacaaaggacca

SEQ ID NO: 119736 - RNA, 64 nt, hsa
aaauaaauuaggcccaauccaagaaauugagugagaaggaaacacuuguuuuauucacagaggu

SEQ ID NO: 119737 - RNA, 64 nt, hsa
gacuuuggcuugcuugaggcugcuggccuuuuuggaaggaaaggaaggggaagacacccuaguu

SEQ ID NO: 119738 - RNA, 64 nt, hsa
gcaacaugggagagaaguucuuauuguuggccaugaaggaaaaucacccagaaugcuucugcaa

SEQ ID NO: 119739 - RNA, 64 nt, hsa
cuuuacauuauuugcugauaccaacuuuugguaggaaggaaaacagggaaggugauugcugcua

SEQ ID NO: 119740 - RNA, 64 nt, hsa
uuuauagaguauaugguauauugugucaaucuuggaaggaaagcuguugcauaucaauuguagg

SEQ ID NO: 119741 - RNA, 62 nt, hsa
augcuguggaugaacgaugaaugucaaugucagaaggaaaagagaauuuuggccaucaaaau

SEQ ID NO: 119742 - RNA, 64 nt, hsa
auguuguguucauuuguugagccauaucucagaagaaggaaagggagcuacagaaaggagguuu

SEQ ID NO: 119743 - RNA, 64 nt, hsa
accaaaacaugggaugaagcuaaaucaaugcuuagaaggaaauuuauagcuucaaauacuuaua

SEQ ID NO: 119744 - RNA, 64 nt, hsa
auaauugauaauaacaguccaaagaaagcagaaagaaggaaagccuagaacagaaauaaaugaa

SEQ ID NO: 119745 - RNA, 64 nt, hsa
cugcacagauucccaggccagggcugggucacaggaaggaaacaacauuuucuugaaaggggaa

SEQ ID NO: 119746 - RNA, 64 nt, hsa
gaggggacgggacagacgaaggcaaccauuuuuagaaggaaaaaggauuaggcaaaaauaauuu

SEQ ID NO: 119747 - RNA, 64 nt, hsa
uguuucuuuauuaccaauguaaucuaugauuauugaaggaaauuuagaaaaugcguagauacaa

SEQ ID NO: 119748 - RNA, 64 nt, hsa
cacauggggacaggggauggagcaugaggcaagggaaggaaaagcagagcuuauuuuucaccua

SEQ ID NO: 119749 - RNA, 64 nt, hsa
uucaaugugacugaaacaaaauguuuuuugauaggaaggaaacuggaauucuuuguacuaauac

SEQ ID NO: 119750 - RNA, 64 nt, hsa
uccauuuuaggugauaaaauuuuuuaaaaguuuugaaggaaaccucuggauaaauggacaaggc

SEQ ID NO: 119751 - RNA, 64 nt, hsa
ucuuaccucaauugaguaacagaauauagcuccugaaggaaacacugauuugcuuucuguuucc

SEQ ID NO: 119752 - RNA, 64 nt, hsa
uuugaucucagcuucugaaaauguuuaaaaauuggaaggaaauacuacucauaucuucauuguc

SEQ ID NO: 119753 - RNA, 64 nt, hsa
ccaugugguucacguacaaaacucuguauaaguugaaggaaaauguucauguucauauguacuu

SEQ ID NO: 119754 - RNA, 64 nt, hsa
ucugcugcaccuuguaaaugcucuaacuggacaugaaggaaaggggcgagggagggggguggga

SEQ ID NO: 119755 - RNA, 64 nt, hsa
uccaacugaccuagugaagguucagaugcaaauggaaggaaaaaggaaacuggaaggaaaacca

SEQ ID NO: 119756 - RNA, 64 nt, hsa
gguucagaugcaaauggaaggaaaaaggaaacuggaaggaaaaccauugcgguaaguucuccaa

SEQ ID NO: 119757 - RNA, 64 nt, hsa
auaugucugccaaguuguuagaaucuuugaaucagaaggaaaaaaagcagcgcugguugacaaa

SEQ ID NO: 119758 - RNA, 64 nt, hsa
ccaaccugagauuuguaguccaggauuacaaccagaaggaaaguaugacagauuucuacuuaac

SEQ ID NO: 119759 - RNA, 64 nt, hsa
uucucaucuuuaagguaaggaggaaguagagauagaaggaaauacgugauuuggugaaggccac

SEQ ID NO: 119760 - RNA, 64 nt, hsa
ugugaccaaauagucuacaggaggcagccauuuggaaggaaaacugcugugguugcugcugcuu

SEQ ID NO: 119761 - RNA, 64 nt, hsa
cacuuacuauuuucagcuuuuuaaagcaugcuuagaaggaaaagcuuaccaaaaauauauuuug

SEQ ID NO: 119762 - RNA, 64 nt, hsa
gccuauauaugauuauuugaaugaagaggaguaggaaggaaaauggaaucaauauacucuuugu

SEQ ID NO: 119763 - RNA, 64 nt, hsa
ucaaguggauaacaauauuuauaagaaaugaauggaaggaaauaugauccuccugagacuaacu

SEQ ID NO: 119764 - RNA, 64 nt, hsa
ucagugaauucuaagaaggaaggaaggaagaaaggaaggaaagaagggagggaaacagggagaa

SEQ ID NO: 119765 - RNA, 64 nt, hsa
ugagggccaugaaagccacagaggaugggcugaggaaggaaagaaaugggguuacugcucccag

SEQ ID NO: 119766 - RNA, 64 nt, hsa
uugcauuaagcuuuuucaauaaaggaaaauuacggaaggaaaauaggcaacaccagcaaauuau

SEQ ID NO: 119767 - RNA, 64 nt, hsa
agagaagaagaaauggaaaaaugaaagaaggcaggaaggaaagaaaggauauaggaagagaggg

SEQ ID NO: 119768 - RNA, 64 nt, hsa
ucaauguacauuuugaacauauuuaugugcuauggaaggaaaugcuggugacuaaaauaagguu

SEQ ID NO: 119769 - RNA, 64 nt, hsa
gggaauuuaguuacagugcuuggaaugagaaggggaaggaaagaauuaacaaaugccaagauuu

SEQ ID NO: 119770 - RNA, 64 nt, hsa
augcacaagcuaaacauaauuugaaugggucuaugaaggaaaaauaaugcuuagacuuuggugu

SEQ ID NO: 119771 - RNA, 64 nt, hsa
gggguguguuugucuccugcucuucuggagccuggaaggaaagggcuucaggaggaggcuguga

SEQ ID NO: 119772 - RNA, 64 nt, hsa
uuuugcgcaaacuccuucaggguugggggacucugaaggaaacgggacaaaaccuuaagcuguu

SEQ ID NO: 119773 - RNA, 64 nt, hsa
aauuucuaccaaauaguagagcauaccacuugaagaaggaaagaaccgaagagcaaacaaaagu

SEQ ID NO: 119774 - RNA, 64 nt, hsa
uuagaaaaggaaaacgugaacaaacuuagaaagggaaggaaaucccaucagugaauccugaaac

SEQ ID NO: 119775 - RNA, 64 nt, hsa
uuuuucauaaaaauuaaaugcuuuaagaaauggagaaggaaaaauagcuuuuaucaauuuuuuu

SEQ ID NO: 119776 - RNA, 64 nt, hsa
uaauuggacaaagagagagaaagaaagaaggaaggaaggaaaaacuuguuacugaaagagacua

SEQ ID NO: 119777 - RNA, 64 nt, hsa
cauuuaauaguuauaacgucguuacuuguacuaugaaggaaaauacucagugucagcuugagcc

SEQ ID NO: 119778 - RNA, 64 nt, hsa
gguggcggucacucccucugccacuauccccagggaaggaaaggcuccgccauuugggaaagug

SEQ ID NO: 119779 - RNA, 64 nt, hsa
uggucccaaaguacggcagcugcaaaaaguaguggaaggaaauugucuacgugucuuggaaaaa

SEQ ID NO: 119780 - RNA, 64 nt, hsa
cuccagaauuccacuucuaguuauuuauucaagagaaggaaaaacaaugaucacagcaauacuu

SEQ ID NO: 119781 - RNA, 64 nt, hsa
uucaauaaaugcaauauuauuggcagacauuguugaaggaaaaaagccagacaaacaacuacau

SEQ ID NO: 119782 - RNA, 64 nt, hsa
aucugugaggugauaggcaaggaugaaagacaaagaaggaaaagaguaucaaaggcagaaagga

SEQ ID NO: 119783 - RNA, 64 nt, hsa
cuccccacccaccaaaugccucugccuugauggagaaggaaaaggcuggcaagguggguuccag

SEQ ID NO: 119784 - RNA, 64 nt, hsa
aagaaacuguuguuugguuaaaggacacagauuugaaggaaaaaaauuuugauguaacaauuuu

SEQ ID NO: 119785 - RNA, 64 nt, hsa
uuuuugaaagagcaagaggaaagaaaaaagaaaagaaggaaagaagaauaaagaagagaaacgu

SEQ ID NO: 119786 - RNA, 64 nt, hsa
aaucggaagugcaggagcuggucagagccaaugagaaggaaaccucaucuuugcauagcccaug

SEQ ID NO: 119787 - RNA, 64 nt, hsa
gggcgacuaccccagugccccccccgcuccagaggaaggaaagcugugggggacggggggcaug

SEQ ID NO: 119788 - RNA, 64 nt, hsa
gaaacuuuguacuuuuuaauaagaugauacacucgaaggaaacuuuuaaucucugcaguuuauu

SEQ ID NO: 119789 - RNA, 64 nt, hsa
auuuugcaaacagcucuucuuagggaaaucuccugaaggaaaaaaaugugacagaauguuccau

SEQ ID NO: 119790 - RNA, 64 nt, hsa
uaucauggcaugacuuaagggaacauugguuugugaaggaaaaacagauuaucuaaagccaucu

SEQ ID NO: 119791 - RNA, 64 nt, hsa
uauuuugugauuuaugugauuucuuuugcugagugaaggaaaggagaaauuguugcuauuguca

SEQ ID NO: 119792 - RNA, 64 nt, hsa
cgcauacaggcucuagucaagaaugaauuagagugaaggaaagcugugugacaccuggcauucc

SEQ ID NO: 119793 - RNA, 64 nt, hsa
aaaauaugaauacuguaaaggaaauaaauggugggaaggaaaaguagagaaagaaaugccaauu

SEQ ID NO: 119794 - RNA, 64 nt, hsa
aaaauaugaauacuguaaaggaaauaaacggugggaaggaaaaguagagaaagaaaugccaauu

SEQ ID NO: 119795 - RNA, 64 nt, hsa
ggcauacaggcucuagucaagaaugaauuagagugaaggaaagcugugugacaccuggcauucc

SEQ ID NO: 119796 - RNA, 64 nt, hsa
auaaauccuguaguuuaaaaggaagaaauggugggaaggaaaaguagagaaagaaaugccaauu

SEQ ID NO: 119797 - RNA, 64 nt, hsa; identical to SEQ ID NO: 119795

SEQ ID NO: 119798 - RNA, 64 nt, hsa
aacuaggucugacucuggggauuuuuuuccagccgaaggaaaaucacuuccguuaugucccccu

SEQ ID NO: 119799 - RNA, 64 nt, hsa
cgaucauccuuaagcaacugaaguuaaaauuguugaaggaaaaggcacuuaaauugguuacuuu

SEQ ID NO: 119800 - RNA, 64 nt, hsa
gccgcauuccccccaauguggagaagucuaucaagaaggaaauggcucaguaugcuagcaacau

SEQ ID NO: 119801 - RNA, 64 nt, hsa
gcaucacaauuggcaauaaaaccuguguguuugagaaggaaaaugacccaucggugaugcgcuc

SEQ ID NO: 119802 - RNA, 64 nt, hsa
acugcccuucucacgggcucuaugccugcacugggaaggaaacaaauguguauaaacugcuguc

SEQ ID NO: 119803 - RNA, 64 nt, hsa
aaaucacugugaaauuucaugauuggcuuaaagugaaggaaauaaagguaaaaucacuucagau

SEQ ID NO: 119804 - RNA, 64 nt, hsa
uuuuuuuuuuuuaaaggcaaagauugacauuauugaaggaaaggggaugaggacaacugugaac

SEQ ID NO: 119805 - RNA, 64 nt, hsa
gagauacuacaugggagggggacacagaaaaagggaaggaaauuggcuagucuggcuuuuuuuu

SEQ ID NO: 119806 - RNA, 64 nt, hsa
uuuuuuaacuguuaaaccaaaggaaagcacaaaugaaggaaauccuguguaaagcauugagaag

SEQ ID NO: 119807 - RNA, 64 nt, hsa
gcacaaaugaaggaaauccuguguaaagcauugagaaggaaagaagccuggagcagccucuccu

SEQ ID NO: 119808 - RNA, 64 nt, hsa
ggaucuagggcccugggaggagguugagccuggggaaggaaaaagcaggaaacugaaggaagca

SEQ ID NO: 119809 - RNA, 64 nt, hsa
cuggauuggauucgguaaaaagaggggguugcuagaaggaaaaacaggugugaccugauccugc

SEQ ID NO: 119810 - RNA, 64 nt, hsa
ucugggcuuccuucaucucaauucugacaguguggaaggaaaucuguagguacccagguccuca

SEQ ID NO: 119811 - RNA, 64 nt, hsa
aggaguuaaggacuuccuagagaagguagucccugaaggaaaaguaggaaucuggcagugaaag

SEQ ID NO: 119812 - RNA, 64 nt, hsa
agaacuacaacaccgaaggaaaugaaagaagcaagaaggaaagcaccagaagugauuuggaaga

SEQ ID NO: 119813 - RNA, 64 nt, hsa
ugacggaauaaaaacauaauagaacuacaacaccgaaggaaaugaaagaagcaagaaggaaagc

SEQ ID NO: 119814 - RNA, 64 nt, hsa
uuuagcccuuacucaaaaucagauaauuaacaaugaaggaaacucuaaacuccccuuauggucu

SEQ ID NO: 119815 - RNA, 64 nt, hsa
uuacuagaaaauaucaucuuagaagaaaccccaugaaggaaaagaauagggaaaagcuuucagc

SEQ ID NO: 119816 - RNA, 64 nt, hsa
cccgggaggggcuuauguuacaaggugaucaagugaaggaaaaaccugagccuaucuggcuggg

SEQ ID NO: 119817 - RNA, 64 nt, hsa
cugacagccugucucuauggcgcuuccuugaguggaaggaaaugucucaagaaacaaagaucuc

SEQ ID NO: 119818 - RNA, 64 nt, hsa
cagaggagccacugaucugagugguauuuagguugaaggaaagauuucuccucucaagugccag

SEQ ID NO: 119819 - RNA, 64 nt, hsa
cacauguuagauaaauuuuugcaaguagaggaaagaaggaaauaaaacaucacauuuugguguc

SEQ ID NO: 119820 - RNA, 64 nt, hsa
aaagggacaggcaguaguguucaacagugcaugugaaggaaaguucuguuuuccaugguuuuga

SEQ ID NO: 119821 - RNA, 64 nt, hsa
uauuguaauuuauuuauaguacuuuuuuuuccuugaaggaaaauacugacuuuaagauguauuu

SEQ ID NO: 119822 - RNA, 64 nt, hsa
uggcggaggaacuccugccacgccacugugucaugaaggaaagugaaagggaacgaggaaguag

SEQ ID NO: 119823 - RNA, 64 nt, hsa
uccucaaaaucaguuuuuauauuccccaaaagaagaaggaaaccaaggaguagcuauauauuuc

SEQ ID NO: 119824 - RNA, 64 nt, hsa
uuugugucauuuuugccaucauuauuaucauacugaaggaaauuuuccagaucauuaggacaua

SEQ ID NO: 119825 - RNA, 64 nt, hsa
cucaaaggguacuuccacugauggaaacaaaguggaaggaaagaugcucagguacagagaagga

SEQ ID NO: 119826 - RNA, 64 nt, hsa
ugacaacccugugguuuccaaggagcugagaauagaaggaaacuagcuuacaugagaacagacu

SEQ ID NO: 119827 - RNA, 64 nt, hsa
guuaaaaaaaaaaaaagucugauugguuuuaauugaaggaaagauuuguacuacaguucuuuug

SEQ ID NO: 119828 - RNA, 64 nt, hsa
accggccugcuuucauaggcauugauaaagccaggaaggaaauaaagucacaaccaaauaguau

SEQ ID NO: 119829 - RNA, 64 nt, hsa
aaaagguuacacugugcaccgacauguggagcuagaaggaaaagcuuuuaagucucauguuugc

SEQ ID NO: 119830 - RNA, 64 nt, hsa
cauuuuucaggaaaguuuugaguguuauaagguggaaggaaacauaguagcaauggauacuuuu

SEQ ID NO: 119831 - RNA, 64 nt, hsa
auuuugcccagcacauggagcuguaauccagagagaaggaaacguagaaauuuauuauuaaaag

SEQ ID NO: 119832 - RNA, 64 nt, hsa
ccgcucagcaacauagaagagggaaggaaagagagaaggaaagagagagagaaagaaagucucc

SEQ ID NO: 119833 - RNA, 64 nt, hsa
ccucugcccuacccgcucagcaacauagaagagggaaggaaagagagaaggaaagagagagaga

SEQ ID NO: 119834 - RNA, 64 nt, hsa
ccagccugggugacagagugagacucugucucaagaaggaaaaaaaaaaaaaagaauguacuca

SEQ ID NO: 119835 - RNA, 64 nt, hsa
aaagcccuuuaagagucaugguaaggagaugggugaaggaaaauuuagcaacagguaauugaag

SEQ ID NO: 119836 - RNA, 64 nt, hsa
auuuucaacuuuuuaguuuuguuccuucaaaguugaaggaaaaaaaguuugguuuuauaaaauu

SEQ ID NO: 119837 - RNA, 64 nt, hsa
uuuuuuuuguauaaaaauuuaaauugaauuaaaagaaggaaaaaaaaagcccaaacuuaaccuc

SEQ ID NO: 119838 - RNA, 64 nt, hsa
cuuuuacacagcacaugaagcaguaauccagaaagaaggaaaugcagaauuuuauuaucaaagu

SEQ ID NO: 119839 - RNA, 64 nt, hsa
ucauuuucaggaaaguuuguaguauuacaaggcagaaggaaacacaguagcaaugguugcucua

SEQ ID NO: 119840 - RNA, 64 nt, hsa
acugugaucugaaaauguguguggugguaugacagcauaccauuaaauacauuuacaucacagc

SEQ ID NO: 119841 - RNA, 64 nt, hsa
uuaugcaaaugacuuuauuuuauuuuuauuuccugcauaccauuagaauaauuuuauuucauuu

SEQ ID NO: 119842 - RNA, 64 nt, hsa
aguauuugguucuaaaaaauguuagccuuccucguaaaaguagcacaagcccacuuaugaauca

SEQ ID NO: 119843 - RNA, 64 nt, hsa
cuuaccuucuaugugauggaaagacuagagcuuauaaaaguacuuccauuuuuuuauucuccug

SEQ ID NO: 119844 - RNA, 64 nt, hsa
agauggugggcggacaccgaagucaacuugacuguaaaaguaccccauaccguugacgcgcugu

SEQ ID NO: 119845 - RNA, 64 nt, hsa
aaaauguuuauagccaaauaacaaaugugccauguaaaaguaagucuggacuuaagaguuuaaa

SEQ ID NO: 119846 - RNA, 64 nt, hsa
caguccuaugguaaugacuuaggaggaaugcagauaaaaguaccuuguaagauaaauauaaauu

SEQ ID NO: 119847 - RNA, 64 nt, hsa
agcacucugacauguacauuuaaagugacaguuuuaaaaguaaaaugguguuaaaucucugaaa

SEQ ID NO: 119848 - RNA, 64 nt, hsa
guauaucuguaaucaguuguuaagugaauggcacuaaaaguaucgagaacagcuuucuuuccca

SEQ ID NO: 119849 - RNA, 64 nt, hsa
uauaaaauugaauucuacucauuagaguacuuuuuaaaaguacagcagaaagaaaagaagugga

SEQ ID NO: 119850 - RNA, 64 nt, hsa
caaaauucccuucccaaaacuaucuuggauuuucuaaaaguaggacagugguuuuggggguuau

SEQ ID NO: 119851 - RNA, 64 nt, hsa
gaaacauaagauaaguaccucucaaugaaaaauguaaaaguaccuagaaauucacaaaaaaauu

SEQ ID NO: 119852 - RNA, 64 nt, hsa
auuuauagcuucaaauacuuauauacauauuuuuuaaaaguagcuuuacauaggaaggaagugg

SEQ ID NO: 119853 - RNA, 64 nt, hsa
uggaauaguuuucuagaaaacuagucauauacaauaaaaguaucaaaaauauugggcucuaauu

SEQ ID NO: 119854 - RNA, 64 nt, hsa
uuccuaaggaagucaauuaaugcacuuuagauguuaaaaguauuugggcuaagguuauuauugc

SEQ ID NO: 119855 - RNA, 64 nt, hsa
ugcaauaacaaacauuaaugaaagcaaaacauuauaaaaguaauuuuaauucaccacauacuua

SEQ ID NO: 119856 - RNA, 64 nt, hsa
guuaauaaaaugcaauuucauguuagagcuagaauaaaaguaauugagcagucauuugcaaaug

SEQ ID NO: 119857 - RNA, 64 nt, hsa
auuccccaaaaccuugacagauguaucgauggaauaaaaguauguuuuaaagguuacuugaaug

SEQ ID NO: 119858 - RNA, 64 nt, hsa
uaucuauauuuuuauuauucaugaauuaaauuacuaaaaguauguuuauacugugaauuaauau

SEQ ID NO: 119859 - RNA, 64 nt, hsa
auuccucgguguauuaaucuaagguuucaaaguauaaaaguauaugggguaggccgggugcagu

SEQ ID NO: 119860 - RNA, 64 nt, hsa
uuuguuaacuuuuguuuuuuuuuguuuguuuucuuaaaaguaccucugcauugagcauauuuuc

SEQ ID NO: 119861 - RNA, 64 nt, hsa
uuaaaugugggagguaaggaaaaggauuuagagguaaaaguacacuaaguuugcaacauuuauu

SEQ ID NO: 119862 - RNA, 64 nt, hsa
auuacuguaaacuacauugccauagcaauuuacauaaaaguauauuguuuuuuaucuuuaacuc

SEQ ID NO: 119863 - RNA, 64 nt, hsa
auugguaaaggaaauuugaagagaugacagugccuaaaaguacaguuuacauccuuuuggaaag

SEQ ID NO: 119864 - RNA, 64 nt, hsa
uccgaauguaucauugaauaauuuuauugaguuauaaaaguaucuuauugcuauuuaauaaaaa

SEQ ID NO: 119865 - RNA, 64 nt, hsa
acauaugcuaguguuuaguuggauuaaucuuaccuaaaaguacugaaaaaugcuuuuuaguacu

SEQ ID NO: 119866 - RNA, 64 nt, hsa
ucuucuguguuuauggccaaucuauucucaaaguuaaaaguaaaauuguuucagagucacaguu

SEQ ID NO: 119867 - RNA, 64 nt, hsa
gguaaugguacauacguucacuggucucuaaguguaaaaguaguaaauuuugugaugaauaaaa

SEQ ID NO: 119868 - RNA, 64 nt, hsa
uauaaaacaauuguuuacguguacuuuuaacuuuuaaaaguacuuaauuaacauauguuguuug

SEQ ID NO: 119869 - RNA, 64 nt, hsa
uuaaaugugaaauugaucugcaucagcuuauuuauaaaaguaauguuauuuccaagaaaauguu

SEQ ID NO: 119870 - RNA, 64 nt, hsa
cuuaacucuucaagcaagauaaauucauacuuuauaaaaguaucaaugcuguagauggauggaa

SEQ ID NO: 119871 - RNA, 64 nt, hsa
auuguuacaacuaacacaaauuccuauuaaauauuaaaaguaguucugguuuauuaaucaacgg

SEQ ID NO: 119872 - RNA, 64 nt, hsa
aaauugaccuccgguauauauaaauauuuacuuauaaaaguacaaguagacguauauuguccgu

SEQ ID NO: 119873 - RNA, 64 nt, hsa
cuccaucaggcaaaauuuaaaaucacaaauuggcuaaaaguacugauccauuauccuuugaaga

SEQ ID NO: 119874 - RNA, 64 nt, hsa
aguguuuuagaaacaugaguccggacuguguaaguaaaaguacaaacauuauuuccaccauaaa

SEQ ID NO: 119875 - RNA, 64 nt, hsa
uucuaaaauaacauuccucucacuuguaccccacuaaaaguauuagacuacacauuacauugaa

SEQ ID NO: 119876 - RNA, 64 nt, hsa
uacacaugucauuuugugauauaggacucccaaauaaaaguaucagaauaaacacaacaauuaa

SEQ ID NO: 119877 - RNA, 64 nt, hsa
uucuuuccaccauucaggagguuaucagaauuaauaaaaguaucuguuaugugcacuuaagccg

SEQ ID NO: 119878 - RNA, 64 nt, hsa
acucagguuagaacaaaaaugucauaaagggcacuaaaaguaacauuuggguuucacuccauau

SEQ ID NO: 119879 - RNA, 64 nt, hsa
aauuuuuucauaauucaaacaaaaguuauuacacuaaaaguauuauaguaacguauuguccuuc

SEQ ID NO: 119880 - RNA, 64 nt, hsa
uugauacaacuaugcagauuuuauaaaugugcaauaaaaguauuuguuuuaccuuuggugugca

SEQ ID NO: 119881 - RNA, 64 nt, hsa
acaagucaucguacccggccuucuuuuuugcccuuaaaaguaagggauguggguuuguacaaaa

SEQ ID NO: 119882 - RNA, 64 nt, hsa
uuaugacuugacauuuccuugaucuguuggaggcuaaaaguagguauaaaugauauugaauguu

SEQ ID NO: 119883 - RNA, 64 nt, hsa
auuuaggcuggcaauauauauauuaaccauauuuuaaaaguaccaauuuuguuuuuacagaaaa

SEQ ID NO: 119884 - RNA, 64 nt, hsa
aaaaaggaaaaauguaauaauugauaugauuuuguaaaaguauuuuucuugaaauaaucuaaag

SEQ ID NO: 119885 - RNA, 64 nt, hsa
aaaaggaguaaaaacacauuggggagaucaugccuaaaaguaauauauucaaaaccacccagca

SEQ ID NO: 119886 - RNA, 64 nt, hsa
gaggaaaucugacagggaaauuaucuguaugaacuaaaaguaagggaaccccggggaaugggag

SEQ ID NO: 119887 - RNA, 64 nt, hsa
uuuguagagcugaguguuaauacgggccgagaaauaaaaguaucuucugcuccggcuguuucac

SEQ ID NO: 119888 - RNA, 64 nt, hsa
cacauuugaauauuguguauuucauacuauucuuuaaaaguaaucuuauguccuuuccuacaug

SEQ ID NO: 119889 - RNA, 64 nt, hsa
guuauugacuuuuguaacuuacuaauagggauguuaaaaguaacaaaaccaagucaaacuuggu

SEQ ID NO: 119890 - RNA, 64 nt, hsa
cuuuuuagucuggauuucugcccugcuuagauuuuaaaaguauaagcauggauugccaauucca

SEQ ID NO: 119891 - RNA, 64 nt, hsa
cagggcauuuauauaaagaguuguagucuucugauaaaaguagacuggauccccugggguauuu

SEQ ID NO: 119892 - RNA, 64 nt, hsa
guuccauuuucucucuuguaaguguuaaaugugauaaaaguacauauuuuaaauuguuuucagc

SEQ ID NO: 119893 - RNA, 64 nt, hsa
uaagugguguaguauuaaaauauuuucacggaauuaaaaguagcuugcugucaaagaaacaccu

SEQ ID NO: 119894 - RNA, 64 nt, hsa
cuacuuuugacaacgccucaaacuuuucuaaccauaaaaguaauuauacuggugagaaauccua

SEQ ID NO: 119895 - RNA, 64 nt, hsa
caguuauacuagaauauauuuuuuccagaugcaguaaaaguaaaauauuuaauccauaauuaag

SEQ ID NO: 119896 - RNA, 64 nt, hsa
uagagauugcaguaaagacaggcauaagaaauuauaaaaguauuaauuuggggaacuaauaaau

SEQ ID NO: 119897 - RNA, 64 nt, hsa
cuggacugauuuuaacccgcugcacaacaccaacuaaaaguaguaauaccagcauacuugucuu

SEQ ID NO: 119898 - RNA, 64 nt, hsa
uaacauacuuuuauuaaaauauauacuuauauaauaaaaguauaacauaauuuuuuuuuuucuc

SEQ ID NO: 119899 - RNA, 64 nt, hsa
aaacuaaaauugguaaaauauuuguauauaacuuuaaaaguagaaauuuuuugcaguuauugca

SEQ ID NO: 119900 - RNA, 64 nt, hsa
caauguaggugcucaguacuuuuugcuaaauaacuaaaaguauguaaagguaaaagguuugaaa

SEQ ID NO: 119901 - RNA, 64 nt, hsa
ggcuuauaaaauaugaguauggucaggaauuuaauaaaaguacagugaugagcaugccuaaauc

SEQ ID NO: 119902 - RNA, 64 nt, hsa
gaaaauuuaaguaaagucuuuuaaaugaaaccuguaaaaguauugacucuucuaccaaguuggu

SEQ ID NO: 119903 - RNA, 64 nt, hsa
gcaacucauguuauggguuaaaugaauauuuuuguaaaaguaaaagcaacaaauuuauaaauug

SEQ ID NO: 119904 - RNA, 64 nt, hsa
ugauguaauguuuauaagcuaugagaaucaguuauaaaaguauuagccauuuguuguaaaugcc

SEQ ID NO: 119905 - RNA, 64 nt, hsa
cauaauucucagguguacuguuaacauuuuaauuuaaaaguauuucucuuagcaguuuuuguuu

SEQ ID NO: 119906 - RNA, 64 nt, hsa
ugccuaaagcugugccuagaaauuucaucugucuuaaaaguaaaauauacuucaugcuguuuau

SEQ ID NO: 119907 - RNA, 64 nt, hsa
ccucuugcagaaagaagcauuagaaaaauuacuuuaaaaguagcuauauguuacuguauugcaa

SEQ ID NO: 119908 - RNA, 64 nt, hsa
guacaaacauugaacaauuaccuauaaagauuuguaaaaguaaaauuuuuccaauagauuucau

SEQ ID NO: 119909 - RNA, 64 nt, hsa
acuuuaauaccaaacuuaaaaccaaacacucauuuaaaaguagguuaagugaucauggaucauu

SEQ ID NO: 119910 - RNA, 64 nt, hsa
agggcccaggaucaagucacucaucucagaauguccccaccaauccccgccacagcaggcgccu

SEQ ID NO: 119911 - RNA, 64 nt, hsa
aggucugcccugcuugcaaauccacuagcaccgaccccaccaccugguuccggcucugcacgcu

SEQ ID NO: 119912 - RNA, 64 nt, hsa
agucgccccuggaagcagauucccauugaguuuuccccaccaaggggaccaugcacaugguaga

SEQ ID NO: 119913 - RNA, 64 nt, hsa
cgggccuguggugggaagacgggcaacaaguauaccccaccagggccugagugacuagaggaag

SEQ ID NO: 119914 - RNA, 64 nt, hsa
uccuugcuaaucugagcuacuuagaguguggucuccccaccaacuccaguuuugugcccuaagc

SEQ ID NO: 119915 - RNA, 64 nt, hsa
agagggugaaaaagagaaaugugagcauccgcucccccaccaccccgcccagccccuagcccca

SEQ ID NO: 119916 - RNA, 64 nt, hsa
agcuuucagggacagugggcaagaggacacccccccccaccaccucaguggaacacaccauucu

SEQ ID NO: 119917 - RNA, 64 nt, hsa
agagggggaugcucucauccccucuuucuguaccccccaccauuuucacuggcuggggggcucu

SEQ ID NO: 119918 - RNA, 64 nt, hsa
aggguaggagagagccuggaucucuggccccaacccccaccagaccucaugcccuggacacugc

SEQ ID NO: 119919 - RNA, 64 nt, hsa
cagagaugggagguggugaggcguccucaccuccccccaccacagcuguggcugguaaggcaac

SEQ ID NO: 119920 - RNA, 64 nt, hsa
gccacacucagugccauggggaagcgggcgucucccccaccagccccaccaggcgguguagggg

SEQ ID NO: 119921 - RNA, 64 nt, hsa
agugccauggggaagcgggcgucucccccaccagccccaccaggcgguguaggggcagcaggcu

SEQ ID NO: 119922 - RNA, 64 nt, hsa
uuucugaucaugccccuucucucccaccccaucuccccaccaccaccucuguggccuccauggu

SEQ ID NO: 119923 - RNA, 64 nt, hsa
aagggggaaaagccaauagaaauuuccuuagcuuccccaccauauguauuuucuaggauuugag

SEQ ID NO: 119924 - RNA, 64 nt, hsa
cagcaaugaggccugaccuuuuuugcuauaaccgccccaccacuccccugcccuugccaacauc

SEQ ID NO: 119925 - RNA, 64 nt, hsa
gugugcaagcacacaucacuuuagaggggcugcgccccaccagauaggaaggggaggauuuucu

SEQ ID NO: 119926 - RNA, 64 nt, hsa
guuuguggucuaaggaugucuugagcccugugugccccaccauucaugaccucuguauucucua

SEQ ID NO: 119927 - RNA, 64 nt, hsa
gcaagggggcagaucccagagccccucucaccccccccaccacaggccugcuccuuccuuagcc

SEQ ID NO: 119928 - RNA, 64 nt, hsa
agggcccguuggguagcuggggccaggcuucucuccccaccaccugcagauuucuugcugcuuc

SEQ ID NO: 119929 - RNA, 64 nt, hsa
ggauacagggagcagccaggagacucccuagugcccccaccauggcgggugucacucacgcacu

SEQ ID NO: 119930 - RNA, 64 nt, hsa
auacagcagccaacaacacccauguuuguagcucccccaccaaagacccagcggcuucuucacu

SEQ ID NO: 119931 - RNA, 64 nt, hsa
cagcaugcagccacuucacccuggggggccuccaccccaccaucuuccgccaggugugccuggc

SEQ ID NO: 119932 - RNA, 64 nt, hsa
ccccccaaccaccagcagcagcagggcccuccucccccaccagcucuccccacagggccccuca

SEQ ID NO: 119933 - RNA, 64 nt, hsa
agcuccccuuccuugcccgccucuccccccgccgccccaccaguuaaacggaugaccaaagacc

SEQ ID NO: 119934 - RNA, 64 nt, hsa
aggggcuggggagcucagcuuggucucagagucuccccaccagauacuguuuaaaaaaguagca

SEQ ID NO: 119935 - RNA, 64 nt, hsa
cccuuccuggaucuggagagagcagcugcugcugccccaccaccugccaggcccggccacugag

SEQ ID NO: 119936 - RNA, 64 nt, hsa
acccggccccuucccccaggagucacugugccagccccaccacauccuggaagaggagggggcc

SEQ ID NO: 119937 - RNA, 64 nt, hsa
cuggccugccuuucuuuggucagucccuguggucccccaccagcucccccucccauagggcugc

SEQ ID NO: 119938 - RNA, 64 nt, hsa
gcuggcaguguuggccacguaggggcucccauccccccaccauugugucacaugggcugccagg

SEQ ID NO: 119939 - RNA, 64 nt, hsa
gggauuaagaccagaauaucaguggauuuguuuuccccaccaaguggccucuuagacuagucau

SEQ ID NO: 119940 - RNA, 64 nt, hsa
cccucucucucucugucucuccuucucucucuccccccaccacccacccccacacacgucaucu

SEQ ID NO: 119941 - RNA, 64 nt, hsa
ccccuggccucgggagcggccccuggcuaugcacccccaccauuccuacacaucuugccagccc

SEQ ID NO: 119942 - RNA, 64 nt, hsa
acuacacaggcaugcccagugccuuccaguauggccccaccauguuugugaguauuucagaggg

SEQ ID NO: 119943 - RNA, 64 nt, hsa
cccuaugaccccccaucuuuccuccgccccugacccccaccacccugcugcucggacuaugcuc

SEQ ID NO: 119944 - RNA, 64 nt, hsa
uagaagagcaucagggcugcucucugaggagcugccccaccagccauccuugaagagacaauuc

SEQ ID NO: 119945 - RNA, 64 nt, hsa
acagugcucccgagagccugccuuuccugcccuuccccaccaccugcacugccccccacauucu

SEQ ID NO: 119946 - RNA, 64 nt, hsa
agugccuucaaaacccacccccaccccuacccuaccccaccacaccccaucccagaggccuugc

SEQ ID NO: 119947 - RNA, 64 nt, hsa
agcguuucuaggacagaggggccucccagucuccccccaccacccgugcacgacuuccucacca

SEQ ID NO: 119948 - RNA, 64 nt, hsa
gcucugccuggacuuggagagaugggaggcagacccccaccaccauacaugcugucuguggccc

SEQ ID NO: 119949 - RNA, 64 nt, hsa
gcacauuagcgaccaggcuugggcuuccccagcgccccaccaccaccacgugcagguggagcuc

SEQ ID NO: 119950 - RNA, 64 nt, hsa
acuccucucuuggauccgccucgguuuccuguccccccaccacccgccugccccgcggaagacc

SEQ ID NO: 119951 - RNA, 64 nt, hsa
ccauaccgaaauuuucugaaauuaaaucgcacacccccaccauuuccucucccugggaucugga

SEQ ID NO: 119952 - RNA, 64 nt, hsa
ugagccauugcagggggcagggaaguucacccccccccaccacccccccgcccccccgaagcca

SEQ ID NO: 119953 - RNA, 64 nt, hsa
gaaaaggccugggggggaugguauauggcccuuuccccaccaggcgcuaaggggaacacccccu

SEQ ID NO: 119954 - RNA, 64 nt, hsa
cccuuggaauuuucuggcacuuccucucuauugcccccaccaccaccacccccaucacugcuuu

SEQ ID NO: 119955 - RNA, 64 nt, hsa
gguaggaaugggccggcgauugggaccagcugggccccaccacggccacgccaggcaaagcgcc

SEQ ID NO: 119956 - RNA, 64 nt, hsa
cugccccccacccacccugcaccccucgcccuccccccaccacagaaucuaagaccuuucagcu

SEQ ID NO: 119957 - RNA, 64 nt, hsa
gaacuccuggaaauaucaguuacucagcccugggccccaccaccuaggccacuccuccaaagga

SEQ ID NO: 119958 - RNA, 64 nt, hsa
gacucaccucugccucaaugugaaucagacccuaccccaccacgauguggcccuggccugcugg

SEQ ID NO: 119959 - RNA, 64 nt, hsa
aggcaugggccaaucccauuccugccuuccagugccccaccacccuucugaucuuagggguugg

SEQ ID NO: 119960 - RNA, 64 nt, hsa
acucuuaucagcuuagaguguucaacugauccuuccccaccaucuucagaucuguuccucugga

SEQ ID NO: 119961 - RNA, 64 nt, hsa
cuagguuugugcuucuagccaugcccauucccgcccccaccaugccucuuugcauugcccauuu

SEQ ID NO: 119962 - RNA, 58 nt, hsa
ugaccuucucuuuuagauaaagaugagcccccaccaccaccgacucucccaacccaga

SEQ ID NO: 119963 - RNA, 64 nt, hsa
ccugugacacuggcguucuccucuccccuccuucccccaccacaggucucuccugcauaggcag

SEQ ID NO: 119964 - RNA, 64 nt, hsa
uucccuguugcaugagccugcgacaggaccucacccccaccaccaggcuucuauuugggauuca

SEQ ID NO: 119965 - RNA, 64 nt, hsa
cuuguaaugaucaugucagccuucagaagagaauccccaccaacuucugugccuccucagaugg

SEQ ID NO: 119966 - RNA, 64 nt, hsa
gauccccugccaucuugccuuaggaacagccuucccccaccagcagccauggcuggcuggggcu

SEQ ID NO: 119967 - RNA, 64 nt, hsa
gaguuggcccugagcucuauccaccaagccagcaccccaccaucccuuugcaggggagucaaag

SEQ ID NO: 119968 - RNA, 64 nt, hsa
aucucuucuccuuccccuuucugagaaacgucauccccaccaguuaacguuuccuguacacccu

SEQ ID NO: 119969 - RNA, 64 nt, hsa
agguugucuucacugggagcguggggcccccaggccccaccagcaccguccuccccuaaugagg

SEQ ID NO: 119970 - RNA, 64 nt, hsa
gaaaaggaaagcacaggcuaagcaguugaagguuccccaccauucagugagagcagaaccccca

SEQ ID NO: 119971 - RNA, 55 nt, hsa
uugguucagcacuguccugacugcuccccaccagcacgcugaccugugaacccca

SEQ ID NO: 119972 - RNA, 64 nt, hsa
ugucggggguguggggcugcccuggggcccgugcccccaccaggccagccccugcuggguucag

SEQ ID NO: 119973 - RNA, 64 nt, hsa
cucccgcguccugcaggguaguccgcccccuccuccccaccauccucccuaccuccuuaacuuu

SEQ ID NO: 119974 - RNA, 64 nt, hsa
ccaaccccauugcuaacaacaugguacauuccggccccaccacucagagccuuccgaagccaac

SEQ ID NO: 119975 - RNA, 64 nt, hsa
ccagacccuucccccaccacaucgggagcaauacccccaccaccccuuucacuccauccccugc

SEQ ID NO: 119976 - RNA, 64 nt, hsa
ggccccccccacccuucucucucccagacccuucccccaccacaucgggagcaauacccccacc

SEQ ID NO: 119977 - RNA, 64 nt, hsa
ggcccccgucagggagaggucaccagcugcugugccccaccacgucuggcucccugccccuuaa

SEQ ID NO: 119978 - RNA, 64 nt, hsa
uggagggaaggauaaagccacuucuggcuucagcccccaccaggggaaggaaggagggcacauu

SEQ ID NO: 119979 - RNA, 64 nt, hsa
gcuucucaacaaccauguuacuccacuuccccacccccaccaggccucccuccuccccuccuac

SEQ ID NO: 119980 - RNA, 64 nt, hsa
cuccuccccuccuacucccuuuucucacucucauccccaccacagaucccuggauugcugggaa

SEQ ID NO: 119981 - RNA, 64 nt, hsa
uuuaaacguggauuguuuaaagaagcucuccaggccccaccaagaggguggaucacaccucagu

SEQ ID NO: 119982 - RNA, 64 nt, hsa
gcacaacugaaauuuccccacucuguuggggcuuccccaccacauucaugucccucucccgugu

SEQ ID NO: 119983 - RNA, 64 nt, hsa
aaccauucuacucuucuggugggcuuugggguauccccaccaacuuucccuucaaaauagcacc

SEQ ID NO: 119984 - RNA, 64 nt, hsa
agcaauauacuuaaccugaaucucuacucacagcccccaccagcucugaaugucuaaccugcuc

SEQ ID NO: 119985 - RNA, 64 nt, hsa
ucccccuuucaccagaugccacccucccugaaccccccaccacuaccagcucccuggccucccu

SEQ ID NO: 119986 - RNA, 64 nt, hsa
aaaacagggaguugaaguccaaccuauuuaaaaaccccaccauuuggagaauuacaaggguuuu

SEQ ID NO: 119987 - RNA, 64 nt, hsa
cuaguaaaggaacuaugcaaaugcaggccacucuccccaccacgucugugcccugcacuguccc

SEQ ID NO: 119988 - RNA, 55 nt, hsa
aggggaaguugaaacccuagggcacccccaccaccucugcucgagagguccgugg

SEQ ID NO: 119989 - RNA, 64 nt, hsa
ccauaggucgccccagggccucugcccacccgagccccaccacucucagaacccccgcccagcg

SEQ ID NO: 119990 - RNA, 64 nt, hsa
gguuggguggauggagcucagaaggaaaccccagccccaccacggaugacaccaucccucccgu

SEQ ID NO: 119991 - RNA, 64 nt, hsa
ggccugagaccccgguugcccauucauggcugcaccccaccaugucaaacccaagaccagcccc

SEQ ID NO: 119992 - RNA, 64 nt, hsa
aguggggccugagcugagcacugcccccucacccccccaccaccccuucccauuucaucggugg

SEQ ID NO: 119993 - RNA, 64 nt, hsa
gagggcaccccauccucagugcccaaugcuguggccccaccaggcccagagccugguuggccau

SEQ ID NO: 119994 - RNA, 64 nt, hsa
ccacacugaccacccucaacccauugcgcccaguccccaccacagugaccacacccucacuggc

SEQ ID NO: 119995 - RNA, 64 nt, hsa
gggcuagcuaaaggguggggagagggaagaugggccccaccacgcucucaagagaacgcaccug

SEQ ID NO: 119996 - RNA, 64 nt, hsa
uuuuuccccuuuucuguucauuucaucuggcuccccccaccaccuccccaccccaccccccacc

SEQ ID NO: 119997 - RNA, 64 nt, hsa
uccacagggccuuggguucccugagcuguccagaccccaccaucucccggaccccagggaggug

SEQ ID NO: 119998 - RNA, 64 nt, hsa
ggcugggagccggcaggguuuggggugugggcguccccaccacgcauagcaggaauggcaggaa

SEQ ID NO: 119999 - RNA, 62 nt, hsa
agucuuccugcaauaaaaaaguggauccugcauuccccaccagcauggcgcccugucucugu

SEQ ID NO: 120000 - RNA, 64 nt, hsa
cgccccggacagaggucugccccacccacuuccuccccaccaccugugccccagagagcagggc

SEQ ID NO: 120001 - RNA, 64 nt, hsa
gggucagcagggacccacugccccaucucccucuccccaccaagacagccccagaaggagcagc

SEQ ID NO: 120002 - RNA, 64 nt, hsa
caagaguuccaaagagccucuggcccaggccccuccccaccagggcuuugcagauguccuugaa

SEQ ID NO: 120003 - RNA, 64 nt, hsa
ccugaggucuggagaaaccccuggagaaggguguccccaccagcccauacagcgugugugugga

SEQ ID NO: 120004 - RNA, 64 nt, hsa
uggcaggccccugugugugggguggugagggucuccccaccagugcugcaccccgcagcagcau

SEQ ID NO: 120005 - RNA, 64 nt, hsa
guugcagcuaggucggggccccaguuaagcugugccccaccacccuaggcaaugaggggcagga

SEQ ID NO: 120006 - RNA, 64 nt, hsa
cuccaccucaaagucauuugacugcccccauccaccccaccacccuaaucuuccaccaccucuc

SEQ ID NO: 120007 - RNA, 64 nt, hsa
uguucuccucgagggcuccagcauccucugcuucccccaccacguucccaucacccaccucauu

SEQ ID NO: 120008 - RNA, 64 nt, hsa
acuguaguggccuuuggagaugcccccaccucccccccaccaacucucgcguguuggagagaag

SEQ ID NO: 120009 - RNA, 64 nt, hsa; identical to SEQ ID NO: 76855

SEQ ID NO: 120010 - RNA, 64 nt, hsa; identical to SEQ ID NO: 76856

SEQ ID NO: 120011 - RNA, 64 nt, hsa; identical to SEQ ID NO: 76857

SEQ ID NO: 120012 - RNA, 64 nt, hsa; identical to SEQ ID NO: 76858

SEQ ID NO: 120013 - RNA, 64 nt, hsa; identical to SEQ ID NO: 76859

SEQ ID NO: 120014 - RNA, 64 nt, hsa; identical to SEQ ID NO: 76860

SEQ ID NO: 120015 - RNA, 64 nt, hsa; identical to SEQ ID NO: 76861

SEQ ID NO: 120016 - RNA, 64 nt, hsa; identical to SEQ ID NO: 76862

SEQ ID NO: 120017 - RNA, 64 nt, hsa; identical to SEQ ID NO: 76863

SEQ ID NO: 120018 - RNA, 64 nt, hsa; identical to SEQ ID NO: 76864

SEQ ID NO: 120019 - RNA, 64 nt, hsa; identical to SEQ ID NO: 76865

SEQ ID NO: 120020 - RNA, 64 nt, hsa; identical to SEQ ID NO: 76866

SEQ ID NO: 120021 - RNA, 64 nt, hsa; identical to SEQ ID NO: 76867

SEQ ID NO: 120022 - RNA, 64 nt, hsa; identical to SEQ ID NO: 76868

SEQ ID NO: 120023 - RNA, 64 nt, hsa; identical to SEQ ID NO: 76869

SEQ ID NO: 120024 - RNA, 64 nt, hsa; identical to SEQ ID NO: 76870

SEQ ID NO: 120025 - RNA, 64 nt, hsa; identical to SEQ ID NO: 101929

SEQ ID NO: 120026 - RNA, 64 nt, hsa; identical to SEQ ID NO: 101930

SEQ ID NO: 120027 - RNA, 64 nt, hsa; identical to SEQ ID NO: 101931

SEQ ID NO: 120028 - RNA, 64 nt, hsa; identical to SEQ ID NO: 101932

SEQ ID NO: 120029 - RNA, 64 nt, hsa; identical to SEQ ID NO: 101933

SEQ ID NO: 120030 - RNA, 64 nt, hsa; identical to SEQ ID NO: 101934

SEQ ID NO: 120031 - RNA, 64 nt, hsa; identical to SEQ ID NO: 101935

SEQ ID NO: 120032 - RNA, 64 nt, hsa; identical to SEQ ID NO: 101936

SEQ ID NO: 120033 - RNA, 64 nt, hsa; identical to SEQ ID NO: 101937

SEQ ID NO: 120034 - RNA, 64 nt, hsa; identical to SEQ ID NO: 101938

SEQ ID NO: 120035 - RNA, 64 nt, hsa; identical to SEQ ID NO: 101939

SEQ ID NO: 120036 - RNA, 64 nt, hsa; identical to SEQ ID NO: 101940

SEQ ID NO: 120037 - RNA, 64 nt, hsa; identical to SEQ ID NO: 101941

SEQ ID NO: 120038 - RNA, 64 nt, hsa; identical to SEQ ID NO: 101942

SEQ ID NO: 120039 - RNA, 64 nt, hsa; identical to SEQ ID NO: 101943

SEQ ID NO: 120040 - RNA, 64 nt, hsa; identical to SEQ ID NO: 101944

SEQ ID NO: 120041 - RNA, 64 nt, hsa; identical to SEQ ID NO: 101945

SEQ ID NO: 120042 - RNA, 64 nt, hsa; identical to SEQ ID NO: 101946

SEQ ID NO: 120043 - RNA, 64 nt, hsa; identical to SEQ ID NO: 101947

SEQ ID NO: 120044 - RNA, 64 nt, hsa
gccugacacugcgcucuagccccgcgcgccguggcaccccaacaccggcagggaaccuacccuc

SEQ ID NO: 120045 - RNA, 64 nt, hsa
ccuacccucggcucccgggucuccccucccucgccaccccaaccagcggcuucugcgccgcccu

SEQ ID NO: 120046 - RNA, 64 nt, hsa
aaccccaagagacuucacacaacacuuauguaugcaccccaaagacuaauggggagagggaggg

SEQ ID NO: 120047 - RNA, 64 nt, hsa
ggaagccaggaaagcuugguguuuucucuggguacaccccaagcagcgucuccuuuuggauaca

SEQ ID NO: 120048 - RNA, 64 nt, hsa
aaccuaugucacugacucagaugcagggucugcucaccccaacacaugccuucccuccccagcc

SEQ ID NO: 120049 - RNA, 64 nt, hsa
gcauggccucugcccauccugcaccuguccaccccaccccaacacccuggaagccacugucaau

SEQ ID NO: 120050 - RNA, 64 nt, hsa
cuuuuuugcaccccaaguuggcuggagcaucggccaccccaagauucaucugugaccuccaggc

SEQ ID NO: 120051 - RNA, 64 nt, hsa
gcucccgagaagaggagcgcucaugucuuuuuugcaccccaaguuggcuggagcaucggccacc

SEQ ID NO: 120052 - RNA, 64 nt, hsa
cgagagaaggaacagcuguggaacaggcuuuuuacaccccaagugcaugggguugcucgcccac

SEQ ID NO: 120053 - RNA, 64 nt, hsa
auaugcugaauuuuuuuaagcaaauggaucauggcaccccaaaaugaaaguuauagaaagcugu

SEQ ID NO: 120054 - RNA, 64 nt, hsa
cuucaccggcacccucaccugugacaccaagacccaccccaaucccagacuucacacaguauuc

SEQ ID NO: 120055 - RNA, 64 nt, hsa
uuuguugccauuuugguuugggaggcuggaaaagcaccccaagagcuauuacagagacuggagu

SEQ ID NO: 120056 - RNA, 64 nt, hsa
auaguguguguguuuuguauacacuguaugaccccaccccaaaucuuuguauuguccacauucu

SEQ ID NO: 120057 - RNA, 64 nt, hsa
aaguuucaugaaucuguaacuagaauuuaauuuucaccccaauaauguucuauauagccuuugc

SEQ ID NO: 120058 - RNA, 64 nt, hsa
uucacauccagaaauucuguuggacacucacuuccaccccaaacuccucaaaucaaaagccuuc

SEQ ID NO: 120059 - RNA, 64 nt, hsa
cuuucuuguuaugccuuccaucacagcccaggcucaccccaagaacuccaggcuccccuaaaga

SEQ ID NO: 120060 - RNA, 64 nt, hsa
uaaucauucacauguaaaaauaaccccaccuccccaccccaaaaagggcaagagcuguggaaaa

SEQ ID NO: 120061 - RNA, 64 nt, hsa
ugacuaaggacugagcccccuacccaacuacccccaccccaaucccaccuucacccucuuccuu

SEQ ID NO: 120062 - RNA, 64 nt, hsa
uacaccccaacagcacccucuccagaugagaguacaccccaacagcacccucuccagaugcagc

SEQ ID NO: 120063 - RNA, 64 nt, hsa
uacaccccaacagcacccucuccagaugagaguacaccccaacagcacccucuccagaugagag

SEQ ID NO: 120064 - RNA, 64 nt, hsa
gugcccccaacagcacccucuccagaugagaguacaccccaacagcacccucuccagaugagag

SEQ ID NO: 120065 - RNA, 64 nt, hsa
ccgcuccucuauggccccugccuucccaggaguacaccccaacagcacccucuccagaugggag

SEQ ID NO: 120066 - RNA, 64 nt, hsa
agcuuccucugacgguuacccuccccccaccuuccaccccaaccaucugaaccauuccugucuu

SEQ ID NO: 120067 - RNA, 54 nt, hsa
ggcugcugccugcgcccugacucccaccccaagcccccggccaagccuggacuc

SEQ ID NO: 120068 - RNA, 64 nt, hsa
gaggccagggaggggaacucagcaguucaggagccaccccaaaccauucugggacagggacacc

SEQ ID NO: 120069 - RNA, 64 nt, hsa
acccucucggccaucccacgagggucgccaugaucaccccaacucuagaggccgcagcagagcu

SEQ ID NO: 120070 - RNA, 64 nt, hsa
gcacccaucagccaacacuccccaacccaucggccaccccaagcccucugcaaccacgaaucga

SEQ ID NO: 120071 - RNA, 64 nt, hsa
accauuaucacuagaucaauuuuagaaaguuuaucaccccaaagagaaauccugcacccaucag

SEQ ID NO: 120072 - RNA, 64 nt, hsa
gaggugaaucuucuuugacagacuuuguauuuuccacuucuaacugggccucucuuuucucagg

SEQ ID NO: 120073 - RNA, 64 nt, hsa
uauuugcccauuucuaucacuguggaagcuaaaacacuucuacuagggccaaaaagagaaaaga

SEQ ID NO: 120074 - RNA, 64 nt, hsa
uccugaagccuucguuuucaagacuuuuaaaaagcacuucuacuugguuuuuugaucaguguag

SEQ ID NO: 120075 - RNA, 64 nt, hsa
uaucgguucauuuaaccuggugacuggcucuuaucacuucuaguuuacaggugagggaaccaag

SEQ ID NO: 120076 - RNA, 64 nt, hsa
uacuguguuuuauuuugaaaauauuuaaauauugcacuucuauaaauaguaugauaaaugcaca

SEQ ID NO: 120077 - RNA, 64 nt, hsa
gcauaaauggugacucuaguagauuugacucaagcacuucuagaaucaugcacugaauucaaaa

SEQ ID NO: 120078 - RNA, 64 nt, hsa
aaagucuuuucucaucaguagaaucuauuuuggucacuucuagucaaugaaaaauguaaacuuu

SEQ ID NO: 120079 - RNA, 64 nt, hsa
uguuugaaugaaaaaugcuuauguauugacagaacacuucuagaaugauacccaaacuccugga

SEQ ID NO: 120080 - RNA, 63 nt, hsa
aguuuauuacauuuagcuuguucacacuuugcccuaugacauuucuacaucacuggcugcucu

SEQ ID NO: 120081 - RNA, 63 nt, hsa
gcagcaggaacuuuaaauuuuuuaaguucaugucuaugacaugaacaaugugugggauaaugu

SEQ ID NO: 120082 - RNA, 63 nt, hsa
gcuaugcauagcuugggcaauagcccuaaauugcuaugacaacuaaugaaccagcuacguaua

SEQ ID NO: 120083 - RNA, 63 nt, hsa
aauuguuuaucaucuugacaugguuggucauuucuaugacaauuuacuucaaacuguguacug

SEQ ID NO: 120084 - RNA, 63 nt, hsa
uggcacugcaggugagaaccccgcccauccgugcuaugacauggaggcacugaagcccgagga

SEQ ID NO: 120085 - RNA, 63 nt, hsa
auuuaauccaaacagggguucuuagucucagcacuaugacauuuugggcugacuacuuauuug

SEQ ID NO: 120086 - RNA, 63 nt, hsa
ucaaauuuucuauugccagaaaauuuucaaacacuaugacacagaccaguccggcaccaucaa

SEQ ID NO: 120087 - RNA, 63 nt, hsa
ccccuccacaggauuccaccucaacaaccagcucuaugacaucauuaccaugcgguacgcaga

SEQ ID NO: 120088 - RNA, 63 nt, hsa
ccgggacuuuuuuucuuuuuucuuuuuuuuuugcuaugacagaguaaugcuaacguaaggaca

SEQ ID NO: 120089 - RNA, 63 nt, hsa
guucuggucuccaaguaucguuaagcacaggugcuaugacagaaaaaguucugggguggaagu

SEQ ID NO: 120090 - RNA, 64 nt, hsa
ucucccuacccauuuggcucuggaagcugcuuggcccccccagaucagggccugggugaacucc

SEQ ID NO: 120091 - RNA, 64 nt, hsa
ggagggagggcgucugaugcucucucucugccuccccccccauccugucaggcacaggugacgg

SEQ ID NO: 120092 - RNA, 64 nt, hsa
ugucaacacugcauugucuuuugagcucuuuuuucccccccaacaaaguuuuuuuguuuuuugu

SEQ ID NO: 120093 - RNA, 64 nt, hsa
uccccuuccuccuuacccucccucccuuacucuccccccccaccaccacccuccacccccaacu

SEQ ID NO: 120094 - RNA, 64 nt, hsa
ccuguaagcagaagcagcauccaagugccccuggcccccccauguguugauucaacccgguucc

SEQ ID NO: 120095 - RNA, 64 nt, hsa
agucuccccagcucccugaugaugcucacccccgcccccccaccucaggugcugcuggugugag

SEQ ID NO: 120096 - RNA, 64 nt, hsa
cugcacaaagacacauacauucaccgcccccccgcccccccaacgcgcacacacacguccucuc

SEQ ID NO: 120097 - RNA, 64 nt, hsa
aaccucauucaaauauuuacccgggacacacacccccccccacacacacacacagacacacuca

SEQ ID NO: 120098 - RNA, 64 nt, hsa
guccuggcuaccagcucucaccuacacccacgcacccccccacacacuaugcucucucaagaau

SEQ ID NO: 120099 - RNA, 64 nt, hsa
cacuaugcucucucaagaauguaauuuauuggggcccccccagcugcuuuccucaccugccccu

SEQ ID NO: 120100 - RNA, 64 nt, hsa
uccauggcccugucccaggccggcccagaugugucccccccaggccuuguccuacguccaaggu

SEQ ID NO: 120101 - RNA, 64 nt, hsa
aaagggcuggcucccccuccccaggcuggagacccccccccaacuccaggaaagagcagucaga

SEQ ID NO: 120102 - RNA, 64 nt, hsa
uccuggugccccagacgggggccgagggccugagcccccccaucccuccucugccaggguuucu

SEQ ID NO: 120103 - RNA, 64 nt, hsa
uaaccagugccuuuccuccccacuggagggcaagcccccccacccacccaggauguccuggcuc

SEQ ID NO: 120104 - RNA, 64 nt, hsa
acauuugucucaccccugauauugguuccugaugcccccccaacaaaaauaaauaaauaaauua

SEQ ID NO: 120105 - RNA, 64 nt, hsa
ugcuauacaaacauuuugcuaagucugcccaaagcccccccaaugcauuccuucaacaaaauac

SEQ ID NO: 120106 - RNA, 64 nt, hsa
gguggcaccucuccaccuguacccgcccccccaccccccccaccccugccccuuggaagaguug

SEQ ID NO: 120107 - RNA, 64 nt, hsa
ccucuucccgguggcaccucuccaccuguacccgcccccccaccccccccaccccugccccuug

SEQ ID NO: 120108 - RNA, 64 nt, hsa
acaccccgaggagggagggcuccuuucuagccugcccccccacccccacuucaccccuccccag

SEQ ID NO: 120109 - RNA, 64 nt, hsa
cuuccccgccacacccgcucugucuucccacugucccccccaucccgggcagggcccaguggga

SEQ ID NO: 120110 - RNA, 64 nt, hsa
gguucugagcccuggcugcuuguccuccucgcaacccccccaggccggagcuuccuuccuuagc

SEQ ID NO: 120111 - RNA, 64 nt, hsa
guggcacgccugccccaggaugcccccuuucccucccccccaugcccagagccccgccugccuc

SEQ ID NO: 120112 - RNA, 64 nt, hsa
uuucugucucagcgggcagugcccagagcccacgcccccccaagagcccucgauggacagccuc

SEQ ID NO: 120113 - RNA, 64 nt, hsa
gacugacggacggacgacggacaggcggaugugucccccccagccccuccccuccccauaccaa

SEQ ID NO: 120114 - RNA, 64 nt, hsa
caaacaaaaaauacaauaaauauuugaacccccucccccccagcacaacccccccaaaacaacc

SEQ ID NO: 120115 - RNA, 64 nt, hsa
aauaaauauuugaacccccucccccccagcacaacccccccaaaacaacccaacccacgaggac

SEQ ID NO: 120116 - RNA, 64 nt, hsa
aacaauuugguaacacaccacaggaaguagcucucccccccagcccccuccucccucaagggag

SEQ ID NO: 120117 - RNA, 64 nt, hsa
ccaccacucccccacccugaccgugcugaacagacccccccacacgagagaaaauaaaggagca

SEQ ID NO: 120118 - RNA, 64 nt, hsa
agagcccgaggggcaccccagccccgccucugcucccccccaccccacccacccucggggcgcc

SEQ ID NO: 120119 - RNA, 64 nt, hsa
cccaaccggcgggggggugucucccugcccccgacccccccauacccccuucucugugacacac

SEQ ID NO: 120120 - RNA, 64 nt, hsa
ccggcgggacccccagggaccaccccucagggcgcccccccacccccgcccgguccaccuagac

SEQ ID NO: 120121 - RNA, 64 nt, hsa
agagacagagagagagaaaaaaaaucacccaccacccccccaaaaacacaaaaaaagaaaaucu

SEQ ID NO: 120122 - RNA, 64 nt, hsa
aggcuccagagagggggcaccuccccacacaccccccccccaccgaggccuaggccccugccac

SEQ ID NO: 120123 - RNA, 64 nt, hsa
caccuuggcgucacggugggcuggaggcagcccccccccccacaacacuugaggccaaaggaca

SEQ ID NO: 120124 - RNA, 64 nt, hsa
gaaucuucuggaggagccucccuccccccccacccccccccacugcuccuggaguucucaucgg

SEQ ID NO: 120125 - RNA, 64 nt, hsa
cccguccuuagaaucuucuggaggagccucccuccccccccacccccccccacugcuccuggag

SEQ ID NO: 120126 - RNA, 64 nt, hsa
uugggagacaaagggguagagggucugucuugggcccccccagacucuagccugagcagugcag

SEQ ID NO: 120127 - RNA, 64 nt, hsa
cccccaccaguauggccccaccugcucuuuccuccccccccaagguguggccccaccuguucuu

SEQ ID NO: 120128 - RNA, 64 nt, hsa
ucucaggacacaggucauggagguucuucccaagcuggcagaggccauuuguggaaaguggaga

SEQ ID NO: 120129 - RNA, 64 nt, hsa
guaccucauagccagcucuacacagaggucucuccuggcagaaagcaggcgaagggcaggagga

SEQ ID NO: 120130 - RNA, 64 nt, hsa
guccauuuacgauucucacugacuccccgucuuccuggcagacacaaauaaacccagugucagg

SEQ ID NO: 120131 - RNA, 64 nt, hsa
cagagaccugggacucuguauuucuauaguucuccuggcagagccuuugagaauggggagaaac

SEQ ID NO: 120132 - RNA, 64 nt, hsa
ggcagggagaauggggagagggaccuccuugugucuggcagagaccuguggaccuggccucccc

SEQ ID NO: 120133 - RNA, 64 nt, hsa
ccccgccccugggguuggcagccucaguuggccccuggcagaggaacaaggacacagacauucc

SEQ ID NO: 120134 - RNA, 64 nt, hsa
gaccuuccuuaggacuuccagaguucaguuccuucuggcagagagguuuucuuucuccaugcca

SEQ ID NO: 120135 - RNA, 64 nt, hsa
acacccuccucuagaauuuaguggcgggucugggcuggcagagguagggggcugcuuugggcuu

SEQ ID NO: 120136 - RNA, 64 nt, hsa
ucauuuucaaaagcaauucuucggugcuguguagcuggcagaaaguucuguccaguaaacgcag

SEQ ID NO: 120137 - RNA, 64 nt, hsa
gauggaagaaauagcaggagagaggacccauuagcuggcagacccagggggaagaaaggagggc

SEQ ID NO: 120138 - RNA, 64 nt, hsa
aauucagucccucuccccaaagacuagacgugaccuggcagauuagcaggauccucuuggccuu

SEQ ID NO: 120139 - RNA, 64 nt, hsa
acaggcaaccuuguguucucugugcccucagggacuggcagagcaagaggccaucagaaggacg

SEQ ID NO: 120140 - RNA, 64 nt, hsa
cggagcaugcccgagagccuggacagcccaaccucuggcagaccagggguuaccagccucacag

SEQ ID NO: 120141 - RNA, 64 nt, hsa
cauauuuaauucaccagcaguaauccuuuaauaacuggcagagcacuuuauucuucuggugagc

SEQ ID NO: 120142 - RNA, 64 nt, hsa
gaugccccauggugggcaggcagaugaugaaguacuggcagauuugcaggcugggaaggcuaga

SEQ ID NO: 120143 - RNA, 64 nt, hsa
ccccacccuucucuccuuuccucauccuaagugccuggcagaugaaggaguuuucaggagcuuu

SEQ ID NO: 120144 - RNA, 64 nt, hsa
ccaguuggcgagggacacgaaggcugcggccgggcuggcagagggcccggccccuggggggagg

SEQ ID NO: 120145 - RNA, 64 nt, hsa
agguuccacaagugccucuggagggcccugggcucuggcagaugguccuggugccccagacggg

SEQ ID NO: 120146 - RNA, 64 nt, hsa
gcuucagagcgagcacgacagggcucagaugcugcuggcagaguugucucgggagcggggugag

SEQ ID NO: 120147 - RNA, 64 nt, hsa
ugugccccugccccggaccaagaagggcagcuggcuggcagacaaggugaagaggcugaugcgg

SEQ ID NO: 120148 - RNA, 64 nt, hsa
uggcccugugugggaccacacugucaucucgcugcuggcagaaaagccugaucccaggaggccc

SEQ ID NO: 120149 - RNA, 64 nt, hsa
gcggcacagccuggcagggaccucguccccaagccuggcagaaugagagggguugaggucccga

SEQ ID NO: 120150 - RNA, 64 nt, hsa
uccuauagcugcugcuuuuucuugguccuuggggcuggcagacccauagaccauggccuguuag

SEQ ID NO: 120151 - RNA, 64 nt, hsa
ugucccaccagcuguuucagauagauccuuacagcuggcagaguaaaaguggucccgcuaccau

SEQ ID NO: 120152 - RNA, 64 nt, hsa
ggaugaggagacagaauagagugauaggaagcgucuggcagauacuccuuuugccacugcugug

SEQ ID NO: 120153 - RNA, 64 nt, hsa
aucugcccagacagccgcagugaggaugagcguccuggcagagacgcaguugucucugggcgcu

SEQ ID NO: 120154 - RNA, 64 nt, hsa
gcgccccagcauuguguugugaggcgcacuguuccuggcagauauugugcccccuggagcagug

SEQ ID NO: 120155 - RNA, 64 nt, hsa
gaggaugaucagagaacuugggcauaggaacaaucuggcagaaguuuccagaaggaggucacuu

SEQ ID NO: 120156 - RNA, 64 nt, hsa
ggcccagggcaucgcuaaacccaaaugggggcugcuggcagaccccgagggugccuggccaguc

SEQ ID NO: 120157 - RNA, 64 nt, hsa
gggacgcuggcuggcucgacuggcagagagagcgcuggcagaucugggagcuccugucgaccga

SEQ ID NO: 120158 - RNA, 64 nt, hsa
acaguccgcgccugggggacgcuggcuggcucgacuggcagagagagcgcuggcagaucuggga

SEQ ID NO: 120159 - RNA, 64 nt, hsa; identical to SEQ ID NO: 83374

SEQ ID NO: 120160 - RNA, 64 nt, hsa; identical to SEQ ID NO: 83375

SEQ ID NO: 120161 - RNA, 64 nt, hsa; identical to SEQ ID NO: 83376

SEQ ID NO: 120162 - RNA, 64 nt, hsa; identical to SEQ ID NO: 83377

SEQ ID NO: 120163 - RNA, 64 nt, hsa; identical to SEQ ID NO: 83378

SEQ ID NO: 120164 - RNA, 64 nt, hsa; identical to SEQ ID NO: 83379

SEQ ID NO: 120165 - RNA, 64 nt, hsa; identical to SEQ ID NO: 83380

SEQ ID NO: 120166 - RNA, 64 nt, hsa; identical to SEQ ID NO: 83381

SEQ ID NO: 120167 - RNA, 64 nt, hsa; identical to SEQ ID NO: 83382

SEQ ID NO: 120168 - RNA, 64 nt, hsa; identical to SEQ ID NO: 83383

SEQ ID NO: 120169 - RNA, 64 nt, hsa; identical to SEQ ID NO: 83384

SEQ ID NO: 120170 - RNA, 64 nt, hsa; identical to SEQ ID NO: 83385

SEQ ID NO: 120171 - RNA, 64 nt, hsa; identical to SEQ ID NO: 83386

SEQ ID NO: 120172 - RNA, 64 nt, hsa; identical to SEQ ID NO: 83387

SEQ ID NO: 120173 - RNA, 64 nt, hsa; identical to SEQ ID NO: 83388

SEQ ID NO: 120174 - RNA, 64 nt, hsa; identical to SEQ ID NO: 83389

SEQ ID NO: 120175 - RNA, 64 nt, hsa; identical to SEQ ID NO: 83374

SEQ ID NO: 120176 - RNA, 64 nt, hsa; identical to SEQ ID NO: 83375

SEQ ID NO: 120177 - RNA, 64 nt, hsa; identical to SEQ ID NO: 83376

SEQ ID NO: 120178 - RNA, 64 nt, hsa; identical to SEQ ID NO: 83377

SEQ ID NO: 120179 - RNA, 64 nt, hsa; identical to SEQ ID NO: 83378

SEQ ID NO: 120180 - RNA, 64 nt, hsa; identical to SEQ ID NO: 83379

SEQ ID NO: 120181 - RNA, 64 nt, hsa; identical to SEQ ID NO: 83380

SEQ ID NO: 120182 - RNA, 64 nt, hsa; identical to SEQ ID NO: 83381

SEQ ID NO: 120183 - RNA, 64 nt, hsa; identical to SEQ ID NO: 83382

SEQ ID NO: 120184 - RNA, 64 nt, hsa; identical to SEQ ID NO: 83383

SEQ ID NO: 120185 - RNA, 64 nt, hsa; identical to SEQ ID NO: 83384

SEQ ID NO: 120186 - RNA, 64 nt, hsa; identical to SEQ ID NO: 83385

SEQ ID NO: 120187 - RNA, 64 nt, hsa; identical to SEQ ID NO: 83386

SEQ ID NO: 120188 - RNA, 64 nt, hsa; identical to SEQ ID NO: 83387

SEQ ID NO: 120189 - RNA, 64 nt, hsa; identical to SEQ ID NO: 83388

SEQ ID NO: 120190 - RNA, 64 nt, hsa; identical to SEQ ID NO: 83389

SEQ ID NO: 120191 - RNA, 64 nt, hsa; identical to SEQ ID NO: 83374

SEQ ID NO: 120192 - RNA, 64 nt, hsa; identical to SEQ ID NO: 83375

SEQ ID NO: 120193 - RNA, 64 nt, hsa; identical to SEQ ID NO: 83376

SEQ ID NO: 120194 - RNA, 64 nt, hsa; identical to SEQ ID NO: 83377

SEQ ID NO: 120195 - RNA, 64 nt, hsa; identical to SEQ ID NO: 83378

SEQ ID NO: 120196 - RNA, 64 nt, hsa; identical to SEQ ID NO: 83379

SEQ ID NO: 120197 - RNA, 64 nt, hsa; identical to SEQ ID NO: 83380

SEQ ID NO: 120198 - RNA, 64 nt, hsa; identical to SEQ ID NO: 83381

SEQ ID NO: 120199 - RNA, 64 nt, hsa; identical to SEQ ID NO: 83382

SEQ ID NO: 120200 - RNA, 64 nt, hsa; identical to SEQ ID NO: 83383

SEQ ID NO: 120201 - RNA, 64 nt, hsa; identical to SEQ ID NO: 83384

SEQ ID NO: 120202 - RNA, 64 nt, hsa; identical to SEQ ID NO: 83385

SEQ ID NO: 120203 - RNA, 64 nt, hsa; identical to SEQ ID NO: 83386

SEQ ID NO: 120204 - RNA, 64 nt, hsa; identical to SEQ ID NO: 83387

SEQ ID NO: 120205 - RNA, 64 nt, hsa; identical to SEQ ID NO: 83388

SEQ ID NO: 120206 - RNA, 64 nt, hsa; identical to SEQ ID NO: 83389

SEQ ID NO: 120207 - RNA, 64 nt, hsa; identical to SEQ ID NO: 83374

SEQ ID NO: 120208 - RNA, 64 nt, hsa; identical to SEQ ID NO: 83375

SEQ ID NO: 120209 - RNA, 64 nt, hsa; identical to SEQ ID NO: 83376

SEQ ID NO: 120210 - RNA, 64 nt, hsa; identical to SEQ ID NO: 83377

SEQ ID NO: 120211 - RNA, 64 nt, hsa; identical to SEQ ID NO: 83378

SEQ ID NO: 120212 - RNA, 64 nt, hsa; identical to SEQ ID NO: 83379

SEQ ID NO: 120213 - RNA, 64 nt, hsa; identical to SEQ ID NO: 83380

SEQ ID NO: 120214 - RNA, 64 nt, hsa; identical to SEQ ID NO: 83381

SEQ ID NO: 120215 - RNA, 64 nt, hsa; identical to SEQ ID NO: 83382

SEQ ID NO: 120216 - RNA, 64 nt, hsa; identical to SEQ ID NO: 83383

SEQ ID NO: 120217 - RNA, 64 nt, hsa; identical to SEQ ID NO: 83384

SEQ ID NO: 120218 - RNA, 64 nt, hsa; identical to SEQ ID NO: 83385

SEQ ID NO: 120219 - RNA, 64 nt, hsa; identical to SEQ ID NO: 83386

SEQ ID NO: 120220 - RNA, 64 nt, hsa; identical to SEQ ID NO: 83387

SEQ ID NO: 120221 - RNA, 64 nt, hsa; identical to SEQ ID NO: 83388

SEQ ID NO: 120222 - RNA, 64 nt, hsa; identical to SEQ ID NO: 83389

SEQ ID NO: 120223 - RNA, 64 nt, hsa; identical to SEQ ID NO: 83374

SEQ ID NO: 120224 - RNA, 64 nt, hsa; identical to SEQ ID NO: 83375

SEQ ID NO: 120225 - RNA, 64 nt, hsa; identical to SEQ ID NO: 83376

SEQ ID NO: 120226 - RNA, 64 nt, hsa; identical to SEQ ID NO: 83377

SEQ ID NO: 120227 - RNA, 64 nt, hsa; identical to SEQ ID NO: 83378

SEQ ID NO: 120228 - RNA, 64 nt, hsa; identical to SEQ ID NO: 83379

SEQ ID NO: 120229 - RNA, 64 nt, hsa; identical to SEQ ID NO: 83380

SEQ ID NO: 120230 - RNA, 64 nt, hsa; identical to SEQ ID NO: 83381

SEQ ID NO: 120231 - RNA, 64 nt, hsa; identical to SEQ ID NO: 83382

SEQ ID NO: 120232 - RNA, 64 nt, hsa; identical to SEQ ID NO: 83383

SEQ ID NO: 120233 - RNA, 64 nt, hsa; identical to SEQ ID NO: 83384

SEQ ID NO: 120234 - RNA, 64 nt, hsa; identical to SEQ ID NO: 83385

SEQ ID NO: 120235 - RNA, 64 nt, hsa; identical to SEQ ID NO: 83386

SEQ ID NO: 120236 - RNA, 64 nt, hsa; identical to SEQ ID NO: 83387

SEQ ID NO: 120237 - RNA, 64 nt, hsa; identical to SEQ ID NO: 83388

SEQ ID NO: 120238 - RNA, 64 nt, hsa; identical to SEQ ID NO: 83389

SEQ ID NO: 120239 - RNA, 62 nt, hsa
uuuuuaccaauuccaauuucaaaaugucucaauggugcuauaauaaauaaacuucaacacuc

SEQ ID NO: 120240 - RNA, 62 nt, hsa
aauauuugggaaggcuuuaaagacgcauguuauggugcuaauguacuuucacuuuuaaacuc

SEQ ID NO: 120241 - RNA, 62 nt, hsa
cugaaaggaaaaaaaguagaagccugacuacuuggugcuaacuacuaaagauuuuggcagaa

SEQ ID NO: 120242 - RNA, 62 nt, hsa
agcuucacauaccccucuccauguaugagaucuggugcuagcaaucagauucaacccgaagg

SEQ ID NO: 120243 - RNA, 62 nt, hsa
cuacccccgcugcccccuccacaguuccugaauggugcuaaggaucugcagcaguuggcaac

SEQ ID NO: 120244 - RNA, 62 nt, hsa
cuugugcagcggaccacuugcccaguuugcuguggugcuagccuuccccaucauccaccggg

SEQ ID NO: 120245 - RNA, 62 nt, hsa
acugaauaaggugcuucugcuucuucuagagauggugcuaaagaaaggacuagcauaugaga

SEQ ID NO: 120246 - RNA, 62 nt, hsa
caauggggcuggugggcaugcuguccacuguguggugcuaggacugccaaugccaggcccaa

SEQ ID NO: 120247 - RNA, 62 nt, hsa
agguaauaauaggcuugaaaauugauauccuguggugcuaaaguacaguagaaagagaggag

SEQ ID NO: 120248 - RNA, 62 nt, hsa
uaguuaauagcauugggauauagucacuguaauggugcuauuaacaaacagucaacaccauu

SEQ ID NO: 120249 - RNA, 62 nt, hsa
ucccauuuauuguuuggccagcuaugccaauguggugcuauuguuucuuuaagaaaguacuu

SEQ ID NO: 120250 - RNA, 62 nt, hsa
aacaguauguaaaacucuguuuuuuaguauaauggugcuauuuuguaguuuguuauaugaaa

SEQ ID NO: 120251 - RNA, 62 nt, hsa
cagggaggccgggugugaccucaucuuucucauggugcuauccuggugcuauuggggugggg

SEQ ID NO: 120252 - RNA, 62 nt, hsa
ggugugaccucaucuuucucauggugcuauccuggugcuauugggguggggagcucccuccc

SEQ ID NO: 120253 - RNA, 64 nt, hsa
uauuauuuuaguuagccuacuuggcauuuacuacaucggucacuucuccaggcugcccuaaauu

SEQ ID NO: 120254 - RNA, 64 nt, hsa
ggaaccgaugguggguggggcugcagagugccccaucggucaccuuguuucucaacuaccucgc

SEQ ID NO: 120255 - RNA, 64 nt, hsa
uuugggaaucuguagcugugcuuugagaauugccaucggucauguguugcaccguucucuguau

SEQ ID NO: 120256 - RNA, 64 nt, hsa
gguccggggcaccuucacgguuuucugugccaccaucggucacccauugaucggcccacucuga

SEQ ID NO: 120257 - RNA, 64 nt, hsa
augucucuggaauugaggugguagugaacagcagaucggucagcaccagaagucaacugaguua

SEQ ID NO: 120258 - RNA, 64 nt, hsa
cgacuucgguucacuucacggauguucaguggauaucggucacaugccagguccccagcuacgc

SEQ ID NO: 120259 - RNA, 64 nt, hsa
auugucgaggccaggguucgggaaguacacugccaucggucaggggacagcugccucccaccuu

SEQ ID NO: 120260 - RNA, 64 nt, hsa
ugaguuagaggaagaauucucuugcaaauuaauaaucggucauuagaaacaauugguuaauggg

SEQ ID NO: 120261 - RNA, 64 nt, hsa
uuuauuuuauuucuagugaaacuuuuauauacguaucggucauuucuauuuccuuuuuugagaa

SEQ ID NO: 120262 - RNA, 64 nt, hsa
uuuuuaauauguugacuuuauuucugagcaaagcaucggucauguguguauuuuuucauagucc

SEQ ID NO: 120263 - RNA, 64 nt, hsa
agaauacgguuuugguguccugcuacaaaaagacaucggucaguaacgagcacgauguggaaaa

SEQ ID NO: 120264 - RNA, 64 nt, hsa
cguaagucucccuucaccuguuacagaguuucagaucggucacugauaguauguauuucuuuag

SEQ ID NO: 120265 - RNA, 64 nt, hsa
ugguccggaaaggagugcugacccaugcagacagaucggucacuguagacaaucauuuguuguu

SEQ ID NO: 120266 - RNA, 64 nt, hsa
cucugugccaugaagauaagucuuccauggccaaaucggucauccgcacugcccuugggacuuc

SEQ ID NO: 120267 - RNA, 64 nt, hsa
cuuugcccuaagcugccaagugcuccccaaggagaucggucaccaggagagcagccacaaaggu

SEQ ID NO: 120268 - RNA, 64 nt, hsa
agguaacagaggacaguagucuguaaacauauaaaucggucauaacuaucguggucuuuauuuc

SEQ ID NO: 120269 - RNA, 64 nt, hsa
uuuauaaugauuuuaauagagaaagaucccagggaucggucauaauuggucuuguuugauaaug

SEQ ID NO: 120270 - RNA, 64 nt, hsa
cacucuggggacccgcugggggcuggcagagggcaucggucagcggggcagcggggcuggccau

SEQ ID NO: 120271 - RNA, 64 nt, hsa
ggggugguagaagcugcuguuuaugauaaaagucaucggucagaaaaucagcuuggauuggugc

SEQ ID NO: 120272 - RNA, 64 nt, hsa
augggcugauagauauccuuggcacauccguaccaucggucagcagggccacugaguagucauu

SEQ ID NO: 120273 - RNA, 64 nt, hsa
gcuccuccuccauuuuacccccuacccauccuugaucggucaugccuagccugacccuuuagua

SEQ ID NO: 120274 - RNA, 64 nt, hsa; identical to SEQ ID NO: 120272

SEQ ID NO: 120275 - RNA, 64 nt, hsa
cccacugacuggacuucagagucuggaggguuccaucggucaggggaauggcggccacgugacc

SEQ ID NO: 120276 - RNA, 64 nt, hsa
aauccagacggaguucugcccaggggugcugcauaucggucaccaggcacccagggccaugcca

SEQ ID NO: 120277 - RNA, 63 nt, hsa
ccgguuuauaaaacaacagaacagccaggaaaauggugcuaggagagacaguggagaggccag

SEQ ID NO: 120278 - RNA, 63 nt, hsa
gccuggaugccgaggaagcugcuggaugcuuaauggugcuagaggcucaaguguguuugaaac

SEQ ID NO: 120279 - RNA, 63 nt, hsa
ugaagaccuguuauguagaggaaauacgagggguggugcuagaagacagacaucuguggaaug

SEQ ID NO: 120280 - RNA, 63 nt, hsa
ucacuuagaaagaugggguuccuguagauuuuuuggugcuaagggauacuuugucauuaugau

SEQ ID NO: 120281 - RNA, 63 nt, hsa
uguuuauuaaaaaaauggaacuguacacuuguuuggugcuaauuaauacaucaaaauauacug

SEQ ID NO: 120282 - RNA, 63 nt, hsa
agugaugagcugagucagggauagggaguccccuggugcuaaccgugaacguagagacuuguu

SEQ ID NO: 120283 - RNA, 63 nt, hsa
gaucaaguguggcuguaggccuuuguuuuccaauggugcuauauucuguuuucaaacacuuca

SEQ ID NO: 120284 - RNA, 63 nt, hsa
uggggguucuggaccagaugaucccuuccaauguggugcuagcaggcaggaucccuucuccac

SEQ ID NO: 120285 - RNA, 63 nt, hsa
gagucucaaucuguuacccaggcuggagugcaguggugcuaucuuggcucacugcaaacccgc

SEQ ID NO: 120286 - RNA, 63 nt, hsa
ucagcuauucuuacugacauaccagucuuuagcuggugcuauggucuguucuuuaguucuagu

SEQ ID NO: 120287 - RNA, 63 nt, hsa
ggguggggggaaagaaacuauuaucugacacacuggugcuauuaauuauuucaaauuuauauu

SEQ ID NO: 120288 - RNA, 63 nt, hsa
ucuugaacaguugcaaucuuggcagcuugaaaauggugcuacacucuguuuugugugccuucc

SEQ ID NO: 120289 - RNA, 63 nt, hsa
agggagucagaauauauuuguaaguuaaaucauuggugcuaauaauaaauguggauuuuguau

SEQ ID NO: 120290 - RNA, 63 nt, hsa
uauauggcaacugcagaaggcugagccuccucauggugcuauaaccccuugggacacucaucc

SEQ ID NO: 120291 - RNA, 63 nt, hsa
aggagguggccuuuguccccuggagcagccaguuggugcuacugcuguggccagcuggggggc

SEQ ID NO: 120292 - RNA, 63 nt, hsa
ggcacagggccacuguccuccaggcaggcuuuuuggugcuaggcccugggacuggaagucgcc

SEQ ID NO: 120293 - RNA, 63 nt, hsa
aauuauaaucaaaaucaaugcagguuuguuuuuuggugcuaauaugacauaugacaauaagcc

SEQ ID NO: 120294 - RNA, 63 nt, hsa
auucuugucuuugaguguuggagcccuggauucuggugcuauagcuccuggugccaaagucug

SEQ ID NO: 120295 - RNA, 63 nt, hsa
ccccaggaggccggggcuacgaccgggaccacguggugcuaugggagccggaugaggacaggg

SEQ ID NO: 120296 - RNA, 63 nt, hsa
uuugaugauuuguuuggcauauaggaagcacgcuggugcuaaguauuuuuuaaaugguuaugu

SEQ ID NO: 120297 - RNA, 63 nt, hsa
cuuucuucagcuaaugauuacugagcaccuguuuggugcuaaggauauggucauuuacaagac

SEQ ID NO: 120298 - RNA, 63 nt, hsa
cagccgaggggacccugcucacagccuucuacauggugcuacugcucuuggaguggacaugac

SEQ ID NO: 120299 - RNA, 63 nt, hsa
uuuggaucuuaugaugcugagcauguucugcacuggugcuaaugucuaauauaauuuuauauu

SEQ ID NO: 120300 - RNA, 63 nt, hsa
gaccccaccccucugcugguccugccaacguguuggugcuauaagcugcuucagauauaaaau

SEQ ID NO: 120301 - RNA, 63 nt, hsa
ccucuccaugcugcaaucacuguccugggcuuauggugcuauggacuagggguccuuugugaa

SEQ ID NO: 120302 - RNA, 63 nt, hsa
augauggcuuggaaaagcaggcuagucuaaccauggugcuauuauuaggcuugcuuguuacac

SEQ ID NO: 120303 - RNA, 63 nt, hsa
cgcuucggagcgguccucaguggcgccaccugcuggugcuaauagggacagccacaggccucu

SEQ ID NO: 120304 - RNA, 63 nt, hsa
gaaguguuacuaucuugauuugaacaaauuuucuggugcuaagucugauguucuuuccaugaa

SEQ ID NO: 120305 - RNA, 63 nt, hsa
ggagggcccuucagagcagaguccacaggcggguggugcuacauacacaagcuuaguguacga

SEQ ID NO: 120306 - RNA, 63 nt, hsa
agggcccagugaggacauccgccucccugaaaguggugcuagacagagcugaggucauuguau

SEQ ID NO: 120307 - RNA, 63 nt, hsa
auagugagagaaaugggauuucaucacaauucauggugcuaaaaugaaaaccucugcacuuua

SEQ ID NO: 120308 - RNA, 63 nt, hsa
ggaggagcacauuuuucuugacccucaccuaccuggugcuaguuggucaacccugccugcaua

SEQ ID NO: 120309 - RNA, 63 nt, hsa
cuucauuaaugaugaucuucagauuaaacccuuuggugcuaggagcugacaauuuccaaagca

SEQ ID NO: 120310 - RNA, 63 nt, hsa
aauaccuaggaaauauuuuuccagucuacaauuuggugcuauugugcaguaacuaauaguacu

SEQ ID NO: 120311 - RNA, 63 nt, hsa
ucacucacuauugcaaggacagcaucaaagagauggugcuaaaccauucaugaugaacucacc

SEQ ID NO: 120312 - RNA, 63 nt, hsa
uuggagcucaguccacgguccucccccacuggauggugcuacugcuguggaaucuuguaaaaa

SEQ ID NO: 120313 - RNA, 63 nt, hsa
gugugaauaaagguaauuuuauugaaucuucauuggugcuaaugauggacaguuaaaaagaua

SEQ ID NO: 120314 - RNA, 63 nt, hsa
gacauuuacugaguuuuugcuucauguuagauauggugcuaaguuuuaaucauucaaggaaaa

SEQ ID NO: 120315 - RNA, 63 nt, hsa
uuuuuuaccaauuccaauuucaaaaugucucaauggugcuauaauaaauaaacuucaacacuc

SEQ ID NO: 120316 - RNA, 63 nt, hsa
uaauauuugggaaggcuuuaaagacgcauguuauggugcuaauguacuuucacuuuuaaacuc

SEQ ID NO: 120317 - RNA, 63 nt, hsa
cuaagaaaaaaacuugucuucccuucugauugauggugcuauuuuguuuguuuuguuuuguuu

SEQ ID NO: 120318 - RNA, 63 nt, hsa
uuauccuauuuucuaccauuaucuauguuuucauggugcuauuaauuacaaguuuaguucuuu

SEQ ID NO: 120319 - RNA, 63 nt, hsa
aucuacuuuuacucauaaguaaaagcccuagacuggugcuaaugucaaaccacuggccuccac

SEQ ID NO: 120320 - RNA, 63 nt, hsa
cagcuacaacaacagcugagaucacuuaauaaauggugcuaaacuagcuugucucaugcucuu

SEQ ID NO: 120321 - RNA, 63 nt, hsa
ccugggcagaugcugcagcccgcccccuucucauggugcuacuuccucugucagcuacagaaa

SEQ ID NO: 120322 - RNA, 63 nt, hsa
cugggccucacggugcuccggcagcagagcgcauggugcuagccauggccggcugcagaggac

SEQ ID NO: 120323 - RNA, 63 nt, hsa
uuaauuucuaaagauuaaaaaaagcaaaaaaauuggugcuaaaccuucaccccugagcacgcu

SEQ ID NO: 120324 - RNA, 63 nt, hsa
uuuguagacaaacaacugauaauaagcuuugaauggugcuaauaagaguaggaauucucucua

SEQ ID NO: 120325 - RNA, 63 nt, hsa
gcuaaaaagguauuauuauuuuuccuuuaaugauggugcuaaaauucuuccuauaaaauuccu

SEQ ID NO: 120326 - RNA, 63 nt, hsa
uucccuggcuuauuucauccuggucuugggguauggugcuagcuaugguaagggaaagggacc

SEQ ID NO: 120327 - RNA, 63 nt, hsa
gccucauccccaggacccccuuggcucagaguguggugcuagaaacuggcccccagcccagcc

SEQ ID NO: 120328 - RNA, 63 nt, hsa
aaacuaacaagaggcaguguuaaauauuuuaaauggugcuauagccaauguauuugaaugcuu

SEQ ID NO: 120329 - RNA, 63 nt, hsa
ggagggaacauccugcugcaugaccuaucaguauggugcuaaugugucuguggacccucgcuc

SEQ ID NO: 120330 - RNA, 63 nt, hsa
uugcaaucugguugugauuuauauuuuaaagcuuggugcuaaaccacaauauguauagcauau

SEQ ID NO: 120331 - RNA, 63 nt, hsa
ugcagcugagggauuuucacagugugcuccagauggugcuagaggaagucccagagccuguaa

SEQ ID NO: 120332 - RNA, 63 nt, hsa
cccugccccacuggggauaggagccugugucccuggugcuaagcacucucuucacuugggcca

SEQ ID NO: 120333 - RNA, 63 nt, hsa
gagucucacucuguugcucuggcuggagugcaguggugcuaucucagcucacugcaagcucca

SEQ ID NO: 120334 - RNA, 63 nt, hsa
ucucuugauuugaccucagugcuuugaauucacuggugcuacaauauguaacugugguuaauu

SEQ ID NO: 120335 - RNA, 63 nt, hsa
aaaucuggaaaagugcucauauucacagguggcuggugcuagucuaacuuaauucauguguau

SEQ ID NO: 120336 - RNA, 63 nt, hsa
cuaagaaguguguucaugcaacagccauagagauggugcuauugaaaggcaaucugcccaucc

SEQ ID NO: 120337 - RNA, 63 nt, hsa
aggugauccucccaccucagcuuccagauuagcuggugcuauaggcaugcaccaccacgucca

SEQ ID NO: 120338 - RNA, 63 nt, hsa
gcuuucucccugucuggauucaguggcucacguuggugcuacacagcuagaauagauauauuu

SEQ ID NO: 120339 - RNA, 63 nt, hsa
caauuauaauuacaucugugauuucugaacuaauggugcuaauucagagaaauggaaagugaa

SEQ ID NO: 120340 - RNA, 63 nt, hsa
caggaccccuuuugucucugggaccagacuuguuggugcuaccccuuacuccccucugcaacc

SEQ ID NO: 120341 - RNA, 63 nt, hsa
acccagcgcugcccgugccccuagcaggagcccuggugcuacccccugugaagagccaagcag

SEQ ID NO: 120342 - RNA, 63 nt, hsa
cauacuagguucagucugaaagaaaucuccuaauggugcuauagagagggagguaacagaaag

SEQ ID NO: 120343 - RNA, 63 nt, hsa
aagcagugggguugggaccucagaugggaaggguggugcuaagauccuccugaccucaaagug

SEQ ID NO: 120344 - RNA, 63 nt, hsa
ccaugaagaauguguagaugcauuacuucaacauggugcuaagugcuuacuucgggauagcag

SEQ ID NO: 120345 - RNA, 63 nt, hsa
auuuguccauuuaaaaaugaucuguaguuuuuuuggugcuauaacauucugacacauaucauu

SEQ ID NO: 120346 - RNA, 63 nt, hsa
gcugaaaggaaaaaaaguagaagccugacuacuuggugcuaacuacuaaagauuuuggcagaa

SEQ ID NO: 120347 - RNA, 63 nt, hsa
cagcuucacauaccccucuccauguaugagaucuggugcuagcaaucagauucaacccgaagg

SEQ ID NO: 120348 - RNA, 63 nt, hsa
ggggucucagcagaaccccacugucccuccccuuggugcuagaggcuugugugcacgugagcg

SEQ ID NO: 120349 - RNA, 63 nt, hsa
ucaugugaucucugggaaaaaaauaugcugccuuggugcuaauauuguauguauuuaaaugau

SEQ ID NO: 120350 - RNA, 63 nt, hsa
uugucauuuuaugaauaucauugauuuuauaauuggugcuauuugaagaaaaaaauguacauu

SEQ ID NO: 120351 - RNA, 63 nt, hsa
guaacuucagguuggauccuguguggaugaucuuggugcuaagcagaaaagaaauuuggaccu

SEQ ID NO: 120352 - RNA, 63 nt, hsa
aggaccacgucucacccagggugacaucaggaauggugcuagccucugcaacacgacacccag

SEQ ID NO: 120353 - RNA, 63 nt, hsa
aaguaaucagaagcuaaaguaaaguuccuuuccuggugcuaacuguggucuucuugacacauu

SEQ ID NO: 120354 - RNA, 63 nt, hsa
ggcauuggugucuggagaccuggauuugagucuuggugcuaucaaucaccgucuguguuugag

SEQ ID NO: 120355 - RNA, 63 nt, hsa
uguagcuaucuuugaaaucacuugacuuugcaauggugcuaagcugauagauuuaaauacaca

SEQ ID NO: 120356 - RNA, 63 nt, hsa
aaaaagagugaaaauauuuuaauuagcaguagauggugcuacuggcuuucauuugcugacuug

SEQ ID NO: 120357 - RNA, 63 nt, hsa
uaauuuuuuaaucuuaguuuaauggucucucccuggugcuaacugcugacaguggccaccucu

SEQ ID NO: 120358 - RNA, 63 nt, hsa
gaaaaaaaagauuuguuucugaaagacuucuuauggugcuauuccauaaacuuuuuuucaaac

SEQ ID NO: 120359 - RNA, 63 nt, hsa
aaugaguguuuuuuuaagggaaugagaaugucauggugcuaaaccugacaaauaagagaucau

SEQ ID NO: 120360 - RNA, 63 nt, hsa
auuauuacuguguucgcacaguucucacuuaacuggugcuaugugaagacucugcuaauauag

SEQ ID NO: 120361 - RNA, 63 nt, hsa
gagagcacuuugaaagauaacauuuuauuaugauggugcuagguaaaaaauuguaaagacugg

SEQ ID NO: 120362 - RNA, 63 nt, hsa
ugugaguccugagauggauuuaauucuugaugcuggugcuagaaguaggucuucaaauauggg

SEQ ID NO: 120363 - RNA, 63 nt, hsa
cucugacaaaaauacauguauuucauucucguauggugcuagaguuagauuaaucugcauuuu

SEQ ID NO: 120364 - RNA, 63 nt, hsa
aaauucuauuuauuaaugaaagugucacccuuuuggugcuaagcaggagaauucacaauuaaa

SEQ ID NO: 120365 - RNA, 63 nt, hsa
ggauaaaacacgucauguggauucauuuugaauuggugcuauugguauuuccucuguuauugc

SEQ ID NO: 120366 - RNA, 63 nt, hsa
ggucaaaagcugccccacccacucucccucacauggugcuaggcugggagcugcccugagagc

SEQ ID NO: 120367 - RNA, 63 nt, hsa
ugucaacccuccugcccuuuguggucuuagguauggugcuauagguugcaugcgucuuuaucu

SEQ ID NO: 120368 - RNA, 63 nt, hsa
ggcuucuuguccuucucuuugacuucuguggcauggugcuagugcauguacccugugguauug

SEQ ID NO: 120369 - RNA, 63 nt, hsa
gguauuuuaggccaagugugcacccacauccaauggugcuacaagugacugaaauaauauuug

SEQ ID NO: 120370 - RNA, 63 nt, hsa
gcuacccccgcugcccccuccacaguuccugaauggugcuaaggaucugcagcaguuggcaac

SEQ ID NO: 120371 - RNA, 63 nt, hsa
ccuugugcagcggaccacuugcccaguuugcuguggugcuagccuuccccaucauccaccggg

SEQ ID NO: 120372 - RNA, 63 nt, hsa
auucccuugcgccuuuucaaagaacaguuaacuuggugcuaaugugcccuggugaaauaaaua

SEQ ID NO: 120373 - RNA, 63 nt, hsa
uaaccagccuuguaacaauauguuuucuccuuuuggugcuaaaaaaugaaaauauuagaaagu

SEQ ID NO: 120374 - RNA, 63 nt, hsa
guauuguauuaaaaugagacuauuggaaggaaauggugcuaaaacuaauaacaucucuuacca

SEQ ID NO: 120375 - RNA, 63 nt, hsa
agaugcugccacaggaccugagacacugaugaauggugcuauuuuggacuuucaacaugcucc

SEQ ID NO: 120376 - RNA, 63 nt, hsa
gacuuugaacuuaaauauauccccuuccucaaguggugcuauuuuaaaacuaaaaaaaacuuu

SEQ ID NO: 120377 - RNA, 63 nt, hsa
gucaagacauuucucuaacuccugccauucuucuggugcuacuccaugcaggggucagugcag

SEQ ID NO: 120378 - RNA, 63 nt, hsa
agcggcgaacgccaggcucugggcuccggcgacuggugcuacgcaucccgcggagcuucugcu

SEQ ID NO: 120379 - RNA, 63 nt, hsa
uucuauuuauuuucuacaucuggccaguggcucuggugcuagaugccacuguagccagaucuc

SEQ ID NO: 120380 - RNA, 63 nt, hsa
uacugaauaaggugcuucugcuucuucuagagauggugcuaaagaaaggacuagcauaugaga

SEQ ID NO: 120381 - RNA, 63 nt, hsa
ccaauggggcuggugggcaugcuguccacuguguggugcuaggacugccaaugccaggcccaa

SEQ ID NO: 120382 - RNA, 63 nt, hsa
agaaauuaauuugcaguguuuggauuguauauauggugcuaaaaauaaauuaauuuacuuuau

SEQ ID NO: 120383 - RNA, 63 nt, hsa
uuaucccgaaaaaguguacauagaucuaaaauuuggugcuauguguauaucuugagcuuuuaa

SEQ ID NO: 120384 - RNA, 63 nt, hsa
gugcauguacauagaauucuuucuguauucagauggugcuaauucagacuccagacugaauuu

SEQ ID NO: 120385 - RNA, 63 nt, hsa
uguauuuucauugaaguaggagagauuaucagauggugcuaaagaaagugugaagaucuuaug

SEQ ID NO: 120386 - RNA, 63 nt, hsa
gcaagaaguggggccucgagcugucagucaucauggugcuauccucugaaccccucagcugcc

SEQ ID NO: 120387 - RNA, 63 nt, hsa
caguuauaccuaacauauuaugcaauuuucucuuggugcuaccugauggaauuccugcacuua

SEQ ID NO: 120388 - RNA, 63 nt, hsa
cauuccuuaacccgcugccucagugguaauaaauggugcuagauauugcuacuauuuuauaga

SEQ ID NO: 120389 - RNA, 63 nt, hsa
aguagaggccuuucugacucuuaauauucacuuuggugcuacuacccccauuaccugagggaa

SEQ ID NO: 120390 - RNA, 63 nt, hsa
uucuccccgcacauacucacggaaaggaaccaauggugcuauuuccccucucuccuccucaac

SEQ ID NO: 120391 - RNA, 63 nt, hsa
aagcuaagccagcucagagaacacggggagcgguggugcuacacggacuucggagcauagagu

SEQ ID NO: 120392 - RNA, 63 nt, hsa
cucggcucucccacaggugggcaccccccacuuuggugcuaauagcucuccaccagguggugu

SEQ ID NO: 120393 - RNA, 63 nt, hsa
acagucaugucuuaauggaucccagcucugucauggugcuaucuauguauuaaguuggguccu

SEQ ID NO: 120394 - RNA, 63 nt, hsa
aauucauuucaaacucuaaaauuagauuaaugguggugcuaagaaagaguauuaauuacuuug

SEQ ID NO: 120395 - RNA, 63 nt, hsa
uaaacccauuuuggugcaauauucuugacuccuuggugcuaaagauuguuaaauucaaugcuu

SEQ ID NO: 120396 - RNA, 63 nt, hsa
cuucucgagcaggagugauaguuaccuucacaauggugcuaccccuugcccaggcaaggaaag

SEQ ID NO: 120397 - RNA, 63 nt, hsa
augagguuuucauuuuuauucuuccuuccaacguggugcuaucucugaaacgagcguuagagu

SEQ ID NO: 120398 - RNA, 63 nt, hsa
uuaauaguauuucagauacuugaagaauguugauggugcuagaagaauuugagaagaaauacu

SEQ ID NO: 120399 - RNA, 63 nt, hsa
agagagcauagcugcuuccaucucuuacccaaguggugcuaaacaauuuuucuuccaauguuu

SEQ ID NO: 120400 - RNA, 63 nt, hsa
cagguaauaauaggcuugaaaauugauauccuguggugcuaaaguacaguagaaagagaggag

SEQ ID NO: 120401 - RNA, 63 nt, hsa
uuaguuaauagcauugggauauagucacuguaauggugcuauuaacaaacagucaacaccauu

SEQ ID NO: 120402 - RNA, 63 nt, hsa
cuauuaaugucucacuuuacuuucaaguaauauuggugcuauuuaacauuuuacaguaaaugu

SEQ ID NO: 120403 - RNA, 63 nt, hsa
ccagguugggagggggaaggugagggcuucggguggugcuauaauguggcacuggaucuugag

SEQ ID NO: 120404 - RNA, 63 nt, hsa
agacugagcaccugcuucaugcucagcccugacuggugcuauaggcuggagaagcucacccaa

SEQ ID NO: 120405 - RNA, 63 nt, hsa
agccucaggcucuccugcccugggccucccaauuggugcuaucuguuacugcccgugcucacg

SEQ ID NO: 120406 - RNA, 63 nt, hsa
ucccuggcugccugugaauggcccacauuugaguggugcuaacuugaugugaguaggcauuaa

SEQ ID NO: 120407 - RNA, 63 nt, hsa
ccuaaaugucagugcagcaguguuaaccagucauggugcuagauuguuuacuugguuuucuag

SEQ ID NO: 120408 - RNA, 63 nt, hsa
acccaauucaucaacuggaaagcaauucuaugcuggugcuaugcaauuaugcucuguguuuca

SEQ ID NO: 120409 - RNA, 63 nt, hsa
aaggccaauaguuuuagauuauuuuaucugguauggugcuaauauuuuauuugaaaaaaguua

SEQ ID NO: 120410 - RNA, 63 nt, hsa
cuauaagaaaagugaaaguaacuguuuucuucuuggugcuaugacagugugagacucagguug

SEQ ID NO: 120411 - RNA, 63 nt, hsa
gucugcuuuagcacgcacgcuccgaaugacuccuggugcuaggccaugcuggcugcugucacu

SEQ ID NO: 120412 - RNA, 63 nt, hsa
aggucauuguggcuaucugcauuuauaaauguguggugcuaacuguaugugucuuuaucagug

SEQ ID NO: 120413 - RNA, 63 nt, hsa
cauagugcugugucauccugguccauguaggacuggugcuaaccaccugccaucaugaggaug

SEQ ID NO: 120414 - RNA, 63 nt, hsa
ggugugcuuucuugagcccucauaaggaaguacuggugcuagguuuugcaagauuuuguauac

SEQ ID NO: 120415 - RNA, 63 nt, hsa
acagccugccauauuuuucacagcaugcaacaauggugcuaggauagcuauuucuuacuguaa

SEQ ID NO: 120416 - RNA, 63 nt, hsa
cgagggccgaaacuccugucugcuaucgagcccuggugcuauguggccccggagccacagcac

SEQ ID NO: 120417 - RNA, 63 nt, hsa
aguuuugcucucauugcccaggcuggagugcgguggugcuauuucagcucaccacaaccucug

SEQ ID NO: 120418 - RNA, 63 nt, hsa
cacuuucucugccacagcuguucuucacaguguuggugcuaaugaggccagggugcaggguuc

SEQ ID NO: 120419 - RNA, 63 nt, hsa
uaucuuauguauuucuuuuaaguauuaccauuauggugcuacugagcguuuucuuuugguaaa

SEQ ID NO: 120420 - RNA, 63 nt, hsa
cugacgcguaacugcccauuuuaaggaaacucuuggugcuacaaaacccugaccagacacuug

SEQ ID NO: 120421 - RNA, 63 nt, hsa
acucagaucaaagacaaaaucugauccauauauuggugcuagauucugcaggaaaccccagca

SEQ ID NO: 120422 - RNA, 63 nt, hsa
gacgcaugcaagacucagacccggggaaugguguggugcuaaucucaacaccugacauucaca

SEQ ID NO: 120423 - RNA, 63 nt, hsa
gucuugugcuggucuguuaaauccugcccuccuuggugcuagauccaguugugccucagggca

SEQ ID NO: 120424 - RNA, 63 nt, hsa
aaggagaugggccuggggugggggcuuaugaguuggugcuagagccagggccaucuggacuau

SEQ ID NO: 120425 - RNA, 63 nt, hsa
uaucaaggaguucuaucaaggcauccaugucaguggugcuaugcugguuacaacuugagauuu

SEQ ID NO: 120426 - RNA, 63 nt, hsa
gccguuuauucagguggggcugaccaugggauguggugcuaaugauaaauauuacauuuaccc

SEQ ID NO: 120427 - RNA, 63 nt, hsa
gguucaaaacuggcuuuuccucugggccuggguuggugcuauaggccaagggucauuuuauac

SEQ ID NO: 120428 - RNA, 63 nt, hsa
ccagguaaaugguaugaucaauaaaggacaggcuggugcuaacauaaaauccaauauuguaau

SEQ ID NO: 120429 - RNA, 63 nt, hsa
accuuuucagaaucauggcagaggggcguggcguggugcuacugagaagguccuccuuccucu

SEQ ID NO: 120430 - RNA, 63 nt, hsa
cacucgguugucuuuacuuuuaaaaguaauacuuggugcuaagaauuucaggauuauuguauu

SEQ ID NO: 120431 - RNA, 63 nt, hsa
acuccccagcguggccucacugucuucuggucuuggugcuacugaaauugucacccagaauuu

SEQ ID NO: 120432 - RNA, 63 nt, hsa
cuuguuguuugcgcauuuuuuuuuaaagcauauuggugcuagaaaaggcagcuaaaggaagug

SEQ ID NO: 120433 - RNA, 63 nt, hsa
cuguguuacgacauuaauugcaaauagcaaguauggugcuaaagucuacaccaauggaauuag

SEQ ID NO: 120434 - RNA, 63 nt, hsa
auuuaaucugugaggaacuaaaugacaggagauuggugcuaauacgggggaccaagcuuuguc

SEQ ID NO: 120435 - RNA, 63 nt, hsa
acuugccuaguuguacccaccccuccaggucccuggugcuagagcuucugagaagggccuuuc

SEQ ID NO: 120436 - RNA, 63 nt, hsa
aucuaagucuuccaaugccugcaucaaacuuucuggugcuaggaaaggaaaaaaauaauaauu

SEQ ID NO: 120437 - RNA, 63 nt, hsa
cggaaaggaaucuaauuccaagagucuaggaaauggugcuauugugaguucguucugacucuu

SEQ ID NO: 120438 - RNA, 63 nt, hsa
augaaaugcucuuuacauucaauuuucuguguguggugcuaauuuccauugugacuuuggaau

SEQ ID NO: 120439 - RNA, 63 nt, hsa
aggcaggaccuucggccuaagaaacacaggcccuggugcuaucugaccugggguccagcgagg

SEQ ID NO: 120440 - RNA, 63 nt, hsa
ccuuuauuuguuuagacgugcuucaucccgaaguggugcuauggucuguuaaacagggcuggc

SEQ ID NO: 120441 - RNA, 63 nt, hsa
uuuucuuauuuucugguggaggagcuuaguaaguggugcuacaauugcugugcaaagaaauuc

SEQ ID NO: 120442 - RNA, 63 nt, hsa
ggguggggguugggugggagggacuugggucuuuggugcuaggagagggccugugcuccacac

SEQ ID NO: 120443 - RNA, 63 nt, hsa
caagaagcugagcuggcagagagcuccaccauuuggugcuaaaaaaaaaaacguccugagguu

SEQ ID NO: 120444 - RNA, 63 nt, hsa
cuggggcuguauuuaucucugaggcaugguguguggugcuacagggaauuuguacguuuauac

SEQ ID NO: 120445 - RNA, 63 nt, hsa
ccacccucccacacagccggccacagggagaacuggugcuaaccagggugcuugcuuugguca

SEQ ID NO: 120446 - RNA, 63 nt, hsa
ccaguuacuaacuacggaaauagcauccucugcuggugcuaagugugauuaggaagaagccug

SEQ ID NO: 120447 - RNA, 63 nt, hsa
gagucucacuuugucacccaugcuggaguauaguggugcuaucucggcucacugcaaccauug

SEQ ID NO: 120448 - RNA, 63 nt, hsa
ggcggaagagucagaggacccugugcuugcugguggugcuaacacaauuucugguguucaacc

SEQ ID NO: 120449 - RNA, 63 nt, hsa
auugucuauguaacauguagcgcacaccucucuuggugcuauuucauuccugcuguaagagaa

SEQ ID NO: 120450 - RNA, 63 nt, hsa
uuuaauaauauauacaagcuccauaacuccuuuuggugcuaaugauuccgcuauuucacagac

SEQ ID NO: 120451 - RNA, 63 nt, hsa
gucagaucagcaucaggcuguuaucaagucuguuggugcuaaaaaguaaaagaugaaauguuc

SEQ ID NO: 120452 - RNA, 63 nt, hsa
uacuuggcagccaagaauuuggagguuuuaaaauggugcuaauucuguccucugaggucuucc

SEQ ID NO: 120453 - RNA, 63 nt, hsa
gagacagggaagagaagugcaagaauugguugcuggugcuacauggcggcagcuuugacauuu

SEQ ID NO: 120454 - RNA, 63 nt, hsa
aucaaaaucauaguaaaauauuaccuguuuucauggugcuaauauuaccuguucucccacugc

SEQ ID NO: 120455 - RNA, 63 nt, hsa
agaaaaaggggcaguuuucuuugcccaagcauuuggugcuaguuagaggcuguucacucucuc

SEQ ID NO: 120456 - RNA, 63 nt, hsa
uaaucaggccccuguuaugcuuagggggagcccuggugcuacuugcuugaaguuuucagugua

SEQ ID NO: 120457 - RNA, 63 nt, hsa
caugauuuuuuuugaguagggagcauuaguaccuggugcuagagaauagaacccucaaauaau

SEQ ID NO: 120458 - RNA, 63 nt, hsa
guauaccuuugugauuuucuaaugaguuuuccauggugcuacaaauaauccagacuaccaggu

SEQ ID NO: 120459 - RNA, 63 nt, hsa
gcaggggcaagcaggagcuagcagccgccuacuuggugcuaaccccucgauguacauagcuuu

SEQ ID NO: 120460 - RNA, 63 nt, hsa
uguuguccggagccagcucacugucuuccacacuggugcuaacuggcccaggcacuggagugg

SEQ ID NO: 120461 - RNA, 63 nt, hsa
auaacaacguauguaauuguaacauugcaguaauggugcuacgaagccauuucucuugauuuu

SEQ ID NO: 120462 - RNA, 63 nt, hsa
cugauuugucuuauuuuuuucauacuuucccacuggugcuauuuuuauuuccaauggauauuu

SEQ ID NO: 120463 - RNA, 63 nt, hsa
uuacuugaggugugccuuguauaacugaauuuauggugcuauuuaaacaauuuuuuucuaacg

SEQ ID NO: 120464 - RNA, 63 nt, hsa
gcuuuuuuuuccguuuuuguucauuuuggaugcuggugcuaaaccuccaagugucaugauuua

SEQ ID NO: 120465 - RNA, 63 nt, hsa
uagcuuaaaaauguuggggguuggggggaagaguggugcuagccaggaagaagccaguaaaca

SEQ ID NO: 120466 - RNA, 63 nt, hsa
gccgggcgcaggaacuguguguguccuacacaauggugcuauucugugucaaacaccucugua

SEQ ID NO: 120467 - RNA, 63 nt, hsa
aggccuucucuacaaccuaguccaucucacuucuggugcuaccugaguuggacagaauucuag

SEQ ID NO: 120468 - RNA, 63 nt, hsa
guacuggacgugcucagggucuagggucacagauggugcuauuaauugaacuggaacacagca

SEQ ID NO: 120469 - RNA, 63 nt, hsa
auuuggguauuauugaaaauauuuuccaugccuuggugcuagcauauaaguuuggaaguuugc

SEQ ID NO: 120470 - RNA, 63 nt, hsa
uucccauuuauuguuuggccagcuaugccaauguggugcuauuguuucuuuaagaaaguacuu

SEQ ID NO: 120471 - RNA, 63 nt, hsa
aaacaguauguaaaacucuguuuuuuaguauaauggugcuauuuuguaguuuguuauaugaaa

SEQ ID NO: 120472 - RNA, 63 nt, hsa
guagggcaccgugagugcagcgcggggucuccauggugcuaggccaggguggccagccccgcc

SEQ ID NO: 120473 - RNA, 63 nt, hsa
uaacacuccuaagaaauguugauggcuauuuuguggugcuaacauguaguuggggcaccuaua

SEQ ID NO: 120474 - RNA, 63 nt, hsa
aggagcacuccacagucggagguguaaucauauuggugcuauuucuuggaagagaaguuauug

SEQ ID NO: 120475 - RNA, 63 nt, hsa
uaugaauaacccacagauguacugaauuacuuuuggugcuaucuuguacucuucaaucuguaa

SEQ ID NO: 120476 - RNA, 63 nt, hsa
ggaaagagaaugcuucccauagaaagcccgacauggugcuaguuuccucucuuggagagccaa

SEQ ID NO: 120477 - RNA, 63 nt, hsa
aagucuccugauucggacaaccaugagggguaguggugcuagggagaaggcaaccuucacugg

SEQ ID NO: 120478 - RNA, 63 nt, hsa
auaaugaagccugacucagcuaaugucacaacauggugcuacuucuucuucuuuuuguuaaca

SEQ ID NO: 120479 - RNA, 63 nt, hsa
gaaauuuacauaucaaguacugcaaauaaaagguggugcuaugauauaugcuuaggaggacag

SEQ ID NO: 120480 - RNA, 63 nt, hsa
uguucuagucuguugcgcuguuacaaucuguauuggugcuagucagaaaauuccuagcucaca

SEQ ID NO: 120481 - RNA, 63 nt, hsa
gggaagcuagauggacuaggagagacuugauuuuggugcuaaaguuccccaguucauauguga

SEQ ID NO: 120482 - RNA, 63 nt, hsa
agaaaaaccaaaacccaacccugcauggucaaguggugcuaacccaagacuguaacagggaga

SEQ ID NO: 120483 - RNA, 63 nt, hsa
cuucuuuucuuuugcaugcauuuuuccccuguuuggugcuauguuuauguauuaugcuugaaa

SEQ ID NO: 120484 - RNA, 63 nt, hsa
ggaccucugaaacccuggaccaguggucucacauggugcuacgccugcauguaaacacgccug

SEQ ID NO: 120485 - RNA, 63 nt, hsa
uuccucuguucaaagcugccugucccuaccccauggugcuaggaagaggaguggggugguguc

SEQ ID NO: 120486 - RNA, 63 nt, hsa
auuaagugacuggauauguaaagucguuuaauguggugcuaaaaaguaaaggacuuuuaauca

SEQ ID NO: 120487 - RNA, 63 nt, hsa
ccucgugaaauagugugcaguggaggucucuuguggugcuagauguguguuuagagcuaaacc

SEQ ID NO: 120488 - RNA, 63 nt, hsa
augaaaucuucuugauuuuaaauaauauacgaauggugcuauuaauauugcuaaaaucaacgu

SEQ ID NO: 120489 - RNA, 63 nt, hsa
cagccugggugcacaguagcugcaacuccccauuggugcuaccuggcucuccugucucugcag

SEQ ID NO: 120490 - RNA, 63 nt, hsa
aguugcaggaggagagguggauggcaaugugauuggugcuauaacucaggcagccugggaguc

SEQ ID NO: 120491 - RNA, 63 nt, hsa
uauaacuuuugcauaugugagaaaagacaacauuggugcuaacagugaaguaaggcccaaagg

SEQ ID NO: 120492 - RNA, 63 nt, hsa
caaguacuagguuguccauuuaugguaccuauuuggugcuaguaaauuuucaaacuagauuua

SEQ ID NO: 120493 - RNA, 63 nt, hsa
gcuguggcggagcucccgcccccugcgcccuaauggugcuaacccccucucacuacccagcag

SEQ ID NO: 120494 - RNA, 63 nt, hsa
ugaagcucauuucucccagagauuuuguggacuuggugcuagucaagagauaugaggauggga

SEQ ID NO: 120495 - RNA, 63 nt, hsa
aaguucuacauaauaaagguaaaacuuaaguaauggugcuacuucauuuuuuaaguauuucua

SEQ ID NO: 120496 - RNA, 63 nt, hsa
gggcccucagguguguguacuuuggacaauaaauggugcuaugacugccuuccgccaucccca

SEQ ID NO: 120497 - RNA, 63 nt, hsa
agcuuugcucugagugccuacaaagcuaaugcuuggugcuagaaacaucaucauuauuaaacu

SEQ ID NO: 120498 - RNA, 63 nt, hsa
agaugcucacugagcugcugcuuuuaugugugcuggugcuauguguguucauguccgcggcag

SEQ ID NO: 120499 - RNA, 63 nt, hsa
ucgauccugaagaucgugugaaggaagcguucuuggugcuacacacagucuggaaaagcagcc

SEQ ID NO: 120500 - RNA, 63 nt, hsa
cuuggggagaccaaaagucggacaggaaacaucuggugcuauuaucugggacuuggccugacc

SEQ ID NO: 120501 - RNA, 63 nt, hsa
ggcagccccagcccagcccgccgggagcaaggauggugcuaggucauucauggcuggccuccc

SEQ ID NO: 120502 - RNA, 63 nt, hsa
gggacugcugugcagacccaagcaaucccaaccuggugcuaggucauuucacuuuucugaaaa

SEQ ID NO: 120503 - RNA, 63 nt, hsa
gaaaguuugccaggaggaacaaagagauugugguggugcuaaaggaggccauaagcuacacag

SEQ ID NO: 120504 - RNA, 63 nt, hsa
acaagagcucucugccuccggucacucuugcuguggugcuacguggaagugaauggagacuga

SEQ ID NO: 120505 - RNA, 63 nt, hsa
cacuaucuuaauuuugcgauacacugcauuugcuggugcuauuuuuauacagugaagcaacag

SEQ ID NO: 120506 - RNA, 63 nt, hsa
agacccuugggagguggcccuaucccuaggcaguggugcuaggaggacagaaggcuauauggg

SEQ ID NO: 120507 - RNA, 63 nt, hsa
auguugugugugcuggggagggguccuucuguuuggugcuacccuugucuacucugccccugg

SEQ ID NO: 120508 - RNA, 63 nt, hsa
aaaugagaaaucagugacaacaagucuuugaaauggugcuauggauuuaccauuccuuauuau

SEQ ID NO: 120509 - RNA, 63 nt, hsa
ccaccgagagccaggcagcuuugaguggcagcguggugcuagcagcuucagcggaacagggug

SEQ ID NO: 120510 - RNA, 63 nt, hsa
ucuaugugaugggugggguggggagggaaucacuggugcuauagaaauugagaugccccccca

SEQ ID NO: 120511 - RNA, 63 nt, hsa
cuacucuuugcaccugacuuuuccuaguuguccuggugcuaacacaggagcuacaccuugauc

SEQ ID NO: 120512 - RNA, 63 nt, hsa
ggagggaacagaaguuaggaggcaacuuugggauggugcuagagcauggaaagcacagagaau

SEQ ID NO: 120513 - RNA, 63 nt, hsa
guuacuacaauaauacauguauuguguuuuccauggugcuacaguuacacaauauggaggcaa

SEQ ID NO: 120514 - RNA, 63 nt, hsa
uguguuuuccucacacacuuugauuuggagaauuggugcuaguuggcaauagauaacucagcg

SEQ ID NO: 120515 - RNA, 63 nt, hsa
gagcucccgcccccacugggcccuccuuccuccuggugcuaauuuggggaccccaggggccgc

SEQ ID NO: 120516 - RNA, 63 nt, hsa
ggccgucuuggugucucguggcacgcgucacaguggugcuagucuguuuuuaacaaaagagga

SEQ ID NO: 120517 - RNA, 63 nt, hsa
cugcagacagggucggagguguuagcgagccuuuggugcuagaagccugcggggucaugugcu

SEQ ID NO: 120518 - RNA, 63 nt, hsa
accccaugaucaagaauccugcuccacuaagaauggugcuaaaguaaaacuaguuuaauaagc

SEQ ID NO: 120519 - RNA, 63 nt, hsa
cacacucucaccuaggugagcgcauugagccaguggugcuaaaugcuacauacuccaacugaa

SEQ ID NO: 120520 - RNA, 63 nt, hsa
ccugaagcgcucucgagcuguucuguaaauaccuggugcuaacaucccaugccgcucccuccu

SEQ ID NO: 120521 - RNA, 63 nt, hsa
uucagggaugucgugggcgggggaggggguucuuggugcuacagcccucuccccaccccuaaa

SEQ ID NO: 120522 - RNA, 63 nt, hsa
ucagggaggccgggugugaccucaucuuucucauggugcuauccuggugcuauuggggugggg

SEQ ID NO: 120523 - RNA, 63 nt, hsa
gggugugaccucaucuuucucauggugcuauccuggugcuauugggguggggagcucccuccc

SEQ ID NO: 120524 - RNA, 63 nt, hsa
cacaaacccuucacagacugcucuggugccugguggugcuagcuccucccaccucagcaccug

SEQ ID NO: 120525 - RNA, 63 nt, hsa
caggggcaccccgacauccaggccacccccucauggugcuacagacccugcccuggggcccac

SEQ ID NO: 120526 - RNA, 63 nt, hsa
ccucacuccuccgucgcugcccuucacaccuuuuggugcuaccccuccccagaguuaagcacu

SEQ ID NO: 120527 - RNA, 63 nt, hsa
cugcacgaacccuacagcgagagugacgaugauuggugcuaagcccgggcgagguggcgcccg

SEQ ID NO: 120528 - RNA, 63 nt, hsa
cugguggcauuguuuacagcuagaaagcugcacuggugcuaaugccccuuggggaaauggggc

SEQ ID NO: 120529 - RNA, 63 nt, hsa
gccuggccucugucuguuugccauggagccugguggugcuaacggcccuuuccccaggaaucc

SEQ ID NO: 120530 - RNA, 63 nt, hsa
uuaauguuaauguauggaaauucaacuaauuuuuggugcuauuauucuauucugcaaauacac

SEQ ID NO: 120531 - RNA, 63 nt, hsa
cugcaguauacagcgggaaaaacugaggcacuuuggugcuagggguuugggacugaggcgugg

SEQ ID NO: 120532 - RNA, 63 nt, hsa
aaacgcccuccgcucccucugcucccaacccuguggugcuaggaccacuccccgccuucccua

SEQ ID NO: 120533 - RNA, 63 nt, hsa
auaaugguuuuuaacaccuuuuacucuucuuacuggugcuauuuuguagaauaaggaacaacg

SEQ ID NO: 120534 - RNA, 63 nt, hsa
aaugcaaguaacuagccauuguucaaaugacaguggugcuauuucucuuuuguggccuuuuag

SEQ ID NO: 120535 - RNA, 63 nt, hsa
gcccuguugccgagcccagcugugggcggcuccuggugcuaacaacaaaguuccacuuccagg

SEQ ID NO: 120536 - RNA, 63 nt, hsa
uuuuuugaaccccauucuuuccuucucugaaaguggugcuauaaguuuuagaaucuuuuaaau

SEQ ID NO: 120537 - RNA, 63 nt, hsa
auuucuauuuuuguuauccugugauuauuuugauggugcuagugacuaguuucuuugcuuuuu

SEQ ID NO: 120538 - RNA, 63 nt, hsa
ccagucaggcugcagaggcaccucaacauuccauggugcuagugggcccucucucugggccca

SEQ ID NO: 120539 - RNA, 63 nt, hsa
uggaaaagacacagaagccaaccugagaaccccuggugcuauuuuaaaggagacauauugcug

SEQ ID NO: 120540 - RNA, 63 nt, hsa
ggagaaaauaauuuuuauggguuuuuuugguuauggugcuauuccuaagguuaacuuugaaua

SEQ ID NO: 120541 - RNA, 63 nt, hsa
ugagugaccguuugaauccauauguagucccauuggugcuaaugagaguagcugcugugaaac

SEQ ID NO: 120542 - RNA, 63 nt, hsa
uaugucagaaaaggaugaguuuguggugacaguuggugcuaauaagaauuugccugggcagua

SEQ ID NO: 120543 - RNA, 63 nt, hsa
gaguccagcugcagccacguggccaucuggagcuggugcuauaggugaccaucugguacauug

SEQ ID NO: 120544 - RNA, 63 nt, hsa
ugcuguccauccuuuuucagggcguggacucccuggugcuagaaagcgugauguucgccauac

SEQ ID NO: 120545 - RNA, 63 nt, hsa
guaucuaguuguauuauucauagaaaaucaaucuggugcuaaugguuggcccugguguuguug

SEQ ID NO: 120546 - RNA, 63 nt, hsa
guaacaaauauaagguuuacgagcuaugagaauuggugcuaucaccauuagcuauuugcugua

SEQ ID NO: 120547 - RNA, 63 nt, hsa
aggugcacuugacaguauugaggucauuuguuauggugcuauuucaauuagucuagguuuagg

SEQ ID NO: 120548 - RNA, 63 nt, hsa
cauuguccccaacuuuacuacugcugccgucaauggugcuacuauauaugaucaagauaacau

SEQ ID NO: 120549 - RNA, 63 nt, hsa
acaguauguuacaugcauucuaccacuacauuuuggugcuauuuaaggugugcaauuuucuau

SEQ ID NO: 120550 - RNA, 63 nt, hsa
uuuauuuuauaaguuagaacuuugaagaggaaauggugcuauauguuuauuguuauuacuuug

SEQ ID NO: 120551 - RNA, 63 nt, hsa
aucaccguguggcaaaacauuccccuuccaaucuggugcuaguagaguauaugcuaucuaggc

SEQ ID NO: 120552 - RNA, 63 nt, hsa
aagcuguugucaauuaucuaaagcauguuaguuuggugcuacacaguguugauuuuugugaug

SEQ ID NO: 120553 - RNA, 63 nt, hsa
cugcugagaucugcuguccuguuucugucaagcuggugcuacuguuugauuuggaugauugug

SEQ ID NO: 120554 - RNA, 63 nt, hsa
uugugaucuuaguguauauaguuuuuacguuguuggugcuaaagugcuuuuuugaaguuuauu

SEQ ID NO: 120555 - RNA, 63 nt, hsa
cucuauccagcuaaauaggcuuggggaaagcuguggugcuacagaaaguacccuagacuuaga

SEQ ID NO: 120556 - RNA, 63 nt, hsa
cauguccaggaguggccguugcuacaagucaccuggugcuacgaccagggugagaauaaagac

SEQ ID NO: 120557 - RNA, 64 nt, hsa
accgguuuauaaaacaacagaacagccaggaaaauggugcuaggagagacaguggagaggccag

SEQ ID NO: 120558 - RNA, 64 nt, hsa
agccuggaugccgaggaagcugcuggaugcuuaauggugcuagaggcucaaguguguuugaaac

SEQ ID NO: 120559 - RNA, 64 nt, hsa
cugaagaccuguuauguagaggaaauacgagggguggugcuagaagacagacaucuguggaaug

SEQ ID NO: 120560 - RNA, 64 nt, hsa
gucacuuagaaagaugggguuccuguagauuuuuuggugcuaagggauacuuugucauuaugau

SEQ ID NO: 120561 - RNA, 64 nt, hsa
uuguuuauuaaaaaaauggaacuguacacuuguuuggugcuaauuaauacaucaaaauauacug

SEQ ID NO: 120562 - RNA, 64 nt, hsa
gagugaugagcugagucagggauagggaguccccuggugcuaaccgugaacguagagacuuguu

SEQ ID NO: 120563 - RNA, 64 nt, hsa
ugaucaaguguggcuguaggccuuuguuuuccaauggugcuauauucuguuuucaaacacuuca

SEQ ID NO: 120564 - RNA, 64 nt, hsa
auggggguucuggaccagaugaucccuuccaauguggugcuagcaggcaggaucccuucuccac

SEQ ID NO: 120565 - RNA, 64 nt, hsa
agagucucaaucuguuacccaggcuggagugcaguggugcuaucuuggcucacugcaaacccgc

SEQ ID NO: 120566 - RNA, 64 nt, hsa
uucagcuauucuuacugacauaccagucuuuagcuggugcuauggucuguucuuuaguucuagu

SEQ ID NO: 120567 - RNA, 64 nt, hsa
gggguggggggaaagaaacuauuaucugacacacuggugcuauuaauuauuucaaauuuauauu

SEQ ID NO: 120568 - RNA, 64 nt, hsa
cucuugaacaguugcaaucuuggcagcuugaaaauggugcuacacucuguuuugugugccuucc

SEQ ID NO: 120569 - RNA, 64 nt, hsa
cagggagucagaauauauuuguaaguuaaaucauuggugcuaauaauaaauguggauuuuguau

SEQ ID NO: 120570 - RNA, 64 nt, hsa
uuauauggcaacugcagaaggcugagccuccucauggugcuauaaccccuugggacacucaucc

SEQ ID NO: 120571 - RNA, 64 nt, hsa
gaggagguggccuuuguccccuggagcagccaguuggugcuacugcuguggccagcuggggggc

SEQ ID NO: 120572 - RNA, 64 nt, hsa
aggcacagggccacuguccuccaggcaggcuuuuuggugcuaggcccugggacuggaagucgcc

SEQ ID NO: 120573 - RNA, 64 nt, hsa
uaauuauaaucaaaaucaaugcagguuuguuuuuuggugcuaauaugacauaugacaauaagcc

SEQ ID NO: 120574 - RNA, 64 nt, hsa
aauucuugucuuugaguguuggagcccuggauucuggugcuauagcuccuggugccaaagucug

SEQ ID NO: 120575 - RNA, 64 nt, hsa
cccccaggaggccggggcuacgaccgggaccacguggugcuaugggagccggaugaggacaggg

SEQ ID NO: 120576 - RNA, 64 nt, hsa
guuugaugauuuguuuggcauauaggaagcacgcuggugcuaaguauuuuuuaaaugguuaugu

SEQ ID NO: 120577 - RNA, 64 nt, hsa
ccuuucuucagcuaaugauuacugagcaccuguuuggugcuaaggauauggucauuuacaagac

SEQ ID NO: 120578 - RNA, 64 nt, hsa
ucagccgaggggacccugcucacagccuucuacauggugcuacugcucuuggaguggacaugac

SEQ ID NO: 120579 - RNA, 64 nt, hsa
uuuuggaucuuaugaugcugagcauguucugcacuggugcuaaugucuaauauaauuuuauauu

SEQ ID NO: 120580 - RNA, 64 nt, hsa
agaccccaccccucugcugguccugccaacguguuggugcuauaagcugcuucagauauaaaau

SEQ ID NO: 120581 - RNA, 64 nt, hsa
uccucuccaugcugcaaucacuguccugggcuuauggugcuauggacuagggguccuuugugaa

SEQ ID NO: 120582 - RNA, 64 nt, hsa
aaugauggcuuggaaaagcaggcuagucuaaccauggugcuauuauuaggcuugcuuguuacac

SEQ ID NO: 120583 - RNA, 64 nt, hsa
gcgcuucggagcgguccucaguggcgccaccugcuggugcuaauagggacagccacaggccucu

SEQ ID NO: 120584 - RNA, 64 nt, hsa
ggaaguguuacuaucuugauuugaacaaauuuucuggugcuaagucugauguucuuuccaugaa

SEQ ID NO: 120585 - RNA, 64 nt, hsa
gggagggcccuucagagcagaguccacaggcggguggugcuacauacacaagcuuaguguacga

SEQ ID NO: 120586 - RNA, 64 nt, hsa
gagggcccagugaggacauccgccucccugaaaguggugcuagacagagcugaggucauuguau

SEQ ID NO: 120587 - RNA, 64 nt, hsa
cauagugagagaaaugggauuucaucacaauucauggugcuaaaaugaaaaccucugcacuuua

SEQ ID NO: 120588 - RNA, 64 nt, hsa
gggaggagcacauuuuucuugacccucaccuaccuggugcuaguuggucaacccugccugcaua

SEQ ID NO: 120589 - RNA, 64 nt, hsa
ccuucauuaaugaugaucuucagauuaaacccuuuggugcuaggagcugacaauuuccaaagca

SEQ ID NO: 120590 - RNA, 64 nt, hsa
aaauaccuaggaaauauuuuuccagucuacaauuuggugcuauugugcaguaacuaauaguacu

SEQ ID NO: 120591 - RNA, 64 nt, hsa
gucacucacuauugcaaggacagcaucaaagagauggugcuaaaccauucaugaugaacucacc

SEQ ID NO: 120592 - RNA, 64 nt, hsa
uuuggagcucaguccacgguccucccccacuggauggugcuacugcuguggaaucuuguaaaaa

SEQ ID NO: 120593 - RNA, 64 nt, hsa
ugugugaauaaagguaauuuuauugaaucuucauuggugcuaaugauggacaguuaaaaagaua

SEQ ID NO: 120594 - RNA, 64 nt, hsa
ugacauuuacugaguuuuugcuucauguuagauauggugcuaaguuuuaaucauucaaggaaaa

SEQ ID NO: 120595 - RNA, 64 nt, hsa
uuuuuuuaccaauuccaauuucaaaaugucucaauggugcuauaauaaauaaacuucaacacuc

SEQ ID NO: 120596 - RNA, 64 nt, hsa
cuaauauuugggaaggcuuuaaagacgcauguuauggugcuaauguacuuucacuuuuaaacuc

SEQ ID NO: 120597 - RNA, 64 nt, hsa
acuaagaaaaaaacuugucuucccuucugauugauggugcuauuuuguuuguuuuguuuuguuu

SEQ ID NO: 120598 - RNA, 64 nt, hsa
auuauccuauuuucuaccauuaucuauguuuucauggugcuauuaauuacaaguuuaguucuuu

SEQ ID NO: 120599 - RNA, 64 nt, hsa
uaucuacuuuuacucauaaguaaaagcccuagacuggugcuaaugucaaaccacuggccuccac

SEQ ID NO: 120600 - RNA, 64 nt, hsa
gcagcuacaacaacagcugagaucacuuaauaaauggugcuaaacuagcuugucucaugcucuu

SEQ ID NO: 120601 - RNA, 64 nt, hsa
cccugggcagaugcugcagcccgcccccuucucauggugcuacuuccucugucagcuacagaaa

SEQ ID NO: 120602 - RNA, 64 nt, hsa
ucugggccucacggugcuccggcagcagagcgcauggugcuagccauggccggcugcagaggac

SEQ ID NO: 120603 - RNA, 64 nt, hsa
uuuaauuucuaaagauuaaaaaaagcaaaaaaauuggugcuaaaccuucaccccugagcacgcu

SEQ ID NO: 120604 - RNA, 64 nt, hsa
guuuguagacaaacaacugauaauaagcuuugaauggugcuaauaagaguaggaauucucucua

SEQ ID NO: 120605 - RNA, 64 nt, hsa
ggcuaaaaagguauuauuauuuuuccuuuaaugauggugcuaaaauucuuccuauaaaauuccu

SEQ ID NO: 120606 - RNA, 64 nt, hsa
uuucccuggcuuauuucauccuggucuugggguauggugcuagcuaugguaagggaaagggacc

SEQ ID NO: 120607 - RNA, 64 nt, hsa
agccucauccccaggacccccuuggcucagaguguggugcuagaaacuggcccccagcccagcc

SEQ ID NO: 120608 - RNA, 64 nt, hsa
caaacuaacaagaggcaguguuaaauauuuuaaauggugcuauagccaauguauuugaaugcuu

SEQ ID NO: 120609 - RNA, 64 nt, hsa
gggagggaacauccugcugcaugaccuaucaguauggugcuaaugugucuguggacccucgcuc

SEQ ID NO: 120610 - RNA, 64 nt, hsa
guugcaaucugguugugauuuauauuuuaaagcuuggugcuaaaccacaauauguauagcauau

SEQ ID NO: 120611 - RNA, 64 nt, hsa
uugcagcugagggauuuucacagugugcuccagauggugcuagaggaagucccagagccuguaa

SEQ ID NO: 120612 - RNA, 64 nt, hsa
ccccugccccacuggggauaggagccugugucccuggugcuaagcacucucuucacuugggcca

SEQ ID NO: 120613 - RNA, 64 nt, hsa
agagucucacucuguugcucuggcuggagugcaguggugcuaucucagcucacugcaagcucca

SEQ ID NO: 120614 - RNA, 64 nt, hsa
uucucuugauuugaccucagugcuuugaauucacuggugcuacaauauguaacugugguuaauu

SEQ ID NO: 120615 - RNA, 64 nt, hsa
aaaaucuggaaaagugcucauauucacagguggcuggugcuagucuaacuuaauucauguguau

SEQ ID NO: 120616 - RNA, 64 nt, hsa
ucuaagaaguguguucaugcaacagccauagagauggugcuauugaaaggcaaucugcccaucc

SEQ ID NO: 120617 - RNA, 64 nt, hsa
caggugauccucccaccucagcuuccagauuagcuggugcuauaggcaugcaccaccacgucca

SEQ ID NO: 120618 - RNA, 64 nt, hsa
ggcuuucucccugucuggauucaguggcucacguuggugcuacacagcuagaauagauauauuu

SEQ ID NO: 120619 - RNA, 64 nt, hsa
gcaauuauaauuacaucugugauuucugaacuaauggugcuaauucagagaaauggaaagugaa

SEQ ID NO: 120620 - RNA, 64 nt, hsa
ccaggaccccuuuugucucugggaccagacuuguuggugcuaccccuuacuccccucugcaacc

SEQ ID NO: 120621 - RNA, 64 nt, hsa
gacccagcgcugcccgugccccuagcaggagcccuggugcuacccccugugaagagccaagcag

SEQ ID NO: 120622 - RNA, 64 nt, hsa
ccauacuagguucagucugaaagaaaucuccuaauggugcuauagagagggagguaacagaaag

SEQ ID NO: 120623 - RNA, 64 nt, hsa
uaagcagugggguugggaccucagaugggaaggguggugcuaagauccuccugaccucaaagug

SEQ ID NO: 120624 - RNA, 64 nt, hsa
gccaugaagaauguguagaugcauuacuucaacauggugcuaagugcuuacuucgggauagcag

SEQ ID NO: 120625 - RNA, 64 nt, hsa
aauuuguccauuuaaaaaugaucuguaguuuuuuuggugcuauaacauucugacacauaucauu

SEQ ID NO: 120626 - RNA, 64 nt, hsa
agcugaaaggaaaaaaaguagaagccugacuacuuggugcuaacuacuaaagauuuuggcagaa

SEQ ID NO: 120627 - RNA, 64 nt, hsa
ucagcuucacauaccccucuccauguaugagaucuggugcuagcaaucagauucaacccgaagg

SEQ ID NO: 120628 - RNA, 64 nt, hsa
cggggucucagcagaaccccacugucccuccccuuggugcuagaggcuugugugcacgugagcg

SEQ ID NO: 120629 - RNA, 64 nt, hsa
uucaugugaucucugggaaaaaaauaugcugccuuggugcuaauauuguauguauuuaaaugau

SEQ ID NO: 120630 - RNA, 64 nt, hsa
uuugucauuuuaugaauaucauugauuuuauaauuggugcuauuugaagaaaaaaauguacauu

SEQ ID NO: 120631 - RNA, 64 nt, hsa
aguaacuucagguuggauccuguguggaugaucuuggugcuaagcagaaaagaaauuuggaccu

SEQ ID NO: 120632 - RNA, 64 nt, hsa
gaggaccacgucucacccagggugacaucaggaauggugcuagccucugcaacacgacacccag

SEQ ID NO: 120633 - RNA, 64 nt, hsa
aaaguaaucagaagcuaaaguaaaguuccuuuccuggugcuaacuguggucuucuugacacauu

SEQ ID NO: 120634 - RNA, 64 nt, hsa
uggcauuggugucuggagaccuggauuugagucuuggugcuaucaaucaccgucuguguuugag

SEQ ID NO: 120635 - RNA, 64 nt, hsa
uuguagcuaucuuugaaaucacuugacuuugcaauggugcuaagcugauagauuuaaauacaca

SEQ ID NO: 120636 - RNA, 64 nt, hsa
caaaaagagugaaaauauuuuaauuagcaguagauggugcuacuggcuuucauuugcugacuug

SEQ ID NO: 120637 - RNA, 64 nt, hsa
uuaauuuuuuaaucuuaguuuaauggucucucccuggugcuaacugcugacaguggccaccucu

SEQ ID NO: 120638 - RNA, 64 nt, hsa
ggaaaaaaaagauuuguuucugaaagacuucuuauggugcuauuccauaaacuuuuuuucaaac

SEQ ID NO: 120639 - RNA, 64 nt, hsa
gaaugaguguuuuuuuaagggaaugagaaugucauggugcuaaaccugacaaauaagagaucau

SEQ ID NO: 120640 - RNA, 64 nt, hsa
aauuauuacuguguucgcacaguucucacuuaacuggugcuaugugaagacucugcuaauauag

SEQ ID NO: 120641 - RNA, 64 nt, hsa
agagagcacuuugaaagauaacauuuuauuaugauggugcuagguaaaaaauuguaaagacugg

SEQ ID NO: 120642 - RNA, 64 nt, hsa
cugugaguccugagauggauuuaauucuugaugcuggugcuagaaguaggucuucaaauauggg

SEQ ID NO: 120643 - RNA, 64 nt, hsa
gcucugacaaaaauacauguauuucauucucguauggugcuagaguuagauuaaucugcauuuu

SEQ ID NO: 120644 - RNA, 64 nt, hsa
gaaauucuauuuauuaaugaaagugucacccuuuuggugcuaagcaggagaauucacaauuaaa

SEQ ID NO: 120645 - RNA, 64 nt, hsa
aggauaaaacacgucauguggauucauuuugaauuggugcuauugguauuuccucuguuauugc

SEQ ID NO: 120646 - RNA, 64 nt, hsa
gggucaaaagcugccccacccacucucccucacauggugcuaggcugggagcugcccugagagc

SEQ ID NO: 120647 - RNA, 64 nt, hsa
cugucaacccuccugcccuuuguggucuuagguauggugcuauagguugcaugcgucuuuaucu

SEQ ID NO: 120648 - RNA, 64 nt, hsa
uggcuucuuguccuucucuuugacuucuguggcauggugcuagugcauguacccugugguauug

SEQ ID NO: 120649 - RNA, 64 nt, hsa
ugguauuuuaggccaagugugcacccacauccaauggugcuacaagugacugaaauaauauuug

SEQ ID NO: 120650 - RNA, 64 nt, hsa
ugcuacccccgcugcccccuccacaguuccugaauggugcuaaggaucugcagcaguuggcaac

SEQ ID NO: 120651 - RNA, 64 nt, hsa
cccuugugcagcggaccacuugcccaguuugcuguggugcuagccuuccccaucauccaccggg

SEQ ID NO: 120652 - RNA, 64 nt, hsa
aauucccuugcgccuuuucaaagaacaguuaacuuggugcuaaugugcccuggugaaauaaaua

SEQ ID NO: 120653 - RNA, 64 nt, hsa
auaaccagccuuguaacaauauguuuucuccuuuuggugcuaaaaaaugaaaauauuagaaagu

SEQ ID NO: 120654 - RNA, 64 nt, hsa
uguauuguauuaaaaugagacuauuggaaggaaauggugcuaaaacuaauaacaucucuuacca

SEQ ID NO: 120655 - RNA, 64 nt, hsa
gagaugcugccacaggaccugagacacugaugaauggugcuauuuuggacuuucaacaugcucc

SEQ ID NO: 120656 - RNA, 64 nt, hsa
ggacuuugaacuuaaauauauccccuuccucaaguggugcuauuuuaaaacuaaaaaaaacuuu

SEQ ID NO: 120657 - RNA, 64 nt, hsa
ugucaagacauuucucuaacuccugccauucuucuggugcuacuccaugcaggggucagugcag

SEQ ID NO: 120658 - RNA, 64 nt, hsa
cagcggcgaacgccaggcucugggcuccggcgacuggugcuacgcaucccgcggagcuucugcu

SEQ ID NO: 120659 - RNA, 64 nt, hsa
uuucuauuuauuuucuacaucuggccaguggcucuggugcuagaugccacuguagccagaucuc

SEQ ID NO: 120660 - RNA, 64 nt, hsa
uuacugaauaaggugcuucugcuucuucuagagauggugcuaaagaaaggacuagcauaugaga

SEQ ID NO: 120661 - RNA, 64 nt, hsa
accaauggggcuggugggcaugcuguccacuguguggugcuaggacugccaaugccaggcccaa

SEQ ID NO: 120662 - RNA, 64 nt, hsa
aagaaauuaauuugcaguguuuggauuguauauauggugcuaaaaauaaauuaauuuacuuuau

SEQ ID NO: 120663 - RNA, 64 nt, hsa
uuuaucccgaaaaaguguacauagaucuaaaauuuggugcuauguguauaucuugagcuuuuaa

SEQ ID NO: 120664 - RNA, 64 nt, hsa
ugugcauguacauagaauucuuucuguauucagauggugcuaauucagacuccagacugaauuu

SEQ ID NO: 120665 - RNA, 64 nt, hsa
uuguauuuucauugaaguaggagagauuaucagauggugcuaaagaaagugugaagaucuuaug

SEQ ID NO: 120666 - RNA, 64 nt, hsa
ugcaagaaguggggccucgagcugucagucaucauggugcuauccucugaaccccucagcugcc

SEQ ID NO: 120667 - RNA, 64 nt, hsa
gcaguuauaccuaacauauuaugcaauuuucucuuggugcuaccugauggaauuccugcacuua

SEQ ID NO: 120668 - RNA, 64 nt, hsa
acauuccuuaacccgcugccucagugguaauaaauggugcuagauauugcuacuauuuuauaga

SEQ ID NO: 120669 - RNA, 64 nt, hsa
aaguagaggccuuucugacucuuaauauucacuuuggugcuacuacccccauuaccugagggaa

SEQ ID NO: 120670 - RNA, 64 nt, hsa
cuucuccccgcacauacucacggaaaggaaccaauggugcuauuuccccucucuccuccucaac

SEQ ID NO: 120671 - RNA, 64 nt, hsa
caagcuaagccagcucagagaacacggggagcgguggugcuacacggacuucggagcauagagu

SEQ ID NO: 120672 - RNA, 64 nt, hsa
ccucggcucucccacaggugggcaccccccacuuuggugcuaauagcucuccaccagguggugu

SEQ ID NO: 120673 - RNA, 64 nt, hsa
uacagucaugucuuaauggaucccagcucugucauggugcuaucuauguauuaaguuggguccu

SEQ ID NO: 120674 - RNA, 64 nt, hsa
uaauucauuucaaacucuaaaauuagauuaaugguggugcuaagaaagaguauuaauuacuuug

SEQ ID NO: 120675 - RNA, 64 nt, hsa
auaaacccauuuuggugcaauauucuugacuccuuggugcuaaagauuguuaaauucaaugcuu

SEQ ID NO: 120676 - RNA, 64 nt, hsa
ucuucucgagcaggagugauaguuaccuucacaauggugcuaccccuugcccaggcaaggaaag

SEQ ID NO: 120677 - RNA, 64 nt, hsa
caugagguuuucauuuuuauucuuccuuccaacguggugcuaucucugaaacgagcguuagagu

SEQ ID NO: 120678 - RNA, 64 nt, hsa
auuaauaguauuucagauacuugaagaauguugauggugcuagaagaauuugagaagaaauacu

SEQ ID NO: 120679 - RNA, 64 nt, hsa
cagagagcauagcugcuuccaucucuuacccaaguggugcuaaacaauuuuucuuccaauguuu

SEQ ID NO: 120680 - RNA, 64 nt, hsa
ucagguaauaauaggcuugaaaauugauauccuguggugcuaaaguacaguagaaagagaggag

SEQ ID NO: 120681 - RNA, 64 nt, hsa
guuaguuaauagcauugggauauagucacuguaauggugcuauuaacaaacagucaacaccauu

SEQ ID NO: 120682 - RNA, 64 nt, hsa
ccuauuaaugucucacuuuacuuucaaguaauauuggugcuauuuaacauuuuacaguaaaugu

SEQ ID NO: 120683 - RNA, 64 nt, hsa
gccagguugggagggggaaggugagggcuucggguggugcuauaauguggcacuggaucuugag

SEQ ID NO: 120684 - RNA, 64 nt, hsa
aagacugagcaccugcuucaugcucagcccugacuggugcuauaggcuggagaagcucacccaa

SEQ ID NO: 120685 - RNA, 64 nt, hsa
gagccucaggcucuccugcccugggccucccaauuggugcuaucuguuacugcccgugcucacg

SEQ ID NO: 120686 - RNA, 64 nt, hsa
aucccuggcugccugugaauggcccacauuugaguggugcuaacuugaugugaguaggcauuaa

SEQ ID NO: 120687 - RNA, 64 nt, hsa
cccuaaaugucagugcagcaguguuaaccagucauggugcuagauuguuuacuugguuuucuag

SEQ ID NO: 120688 - RNA, 64 nt, hsa
gacccaauucaucaacuggaaagcaauucuaugcuggugcuaugcaauuaugcucuguguuuca

SEQ ID NO: 120689 - RNA, 64 nt, hsa
gaaggccaauaguuuuagauuauuuuaucugguauggugcuaauauuuuauuugaaaaaaguua

SEQ ID NO: 120690 - RNA, 64 nt, hsa
gcuauaagaaaagugaaaguaacuguuuucuucuuggugcuaugacagugugagacucagguug

SEQ ID NO: 120691 - RNA, 64 nt, hsa
ugucugcuuuagcacgcacgcuccgaaugacuccuggugcuaggccaugcuggcugcugucacu

SEQ ID NO: 120692 - RNA, 64 nt, hsa
aaggucauuguggcuaucugcauuuauaaauguguggugcuaacuguaugugucuuuaucagug

SEQ ID NO: 120693 - RNA, 64 nt, hsa
gcauagugcugugucauccugguccauguaggacuggugcuaaccaccugccaucaugaggaug

SEQ ID NO: 120694 - RNA, 64 nt, hsa
aggugugcuuucuugagcccucauaaggaaguacuggugcuagguuuugcaagauuuuguauac

SEQ ID NO: 120695 - RNA, 64 nt, hsa
cacagccugccauauuuuucacagcaugcaacaauggugcuaggauagcuauuucuuacuguaa

SEQ ID NO: 120696 - RNA, 64 nt, hsa
acgagggccgaaacuccugucugcuaucgagcccuggugcuauguggccccggagccacagcac

SEQ ID NO: 120697 - RNA, 64 nt, hsa
gaguuuugcucucauugcccaggcuggagugcgguggugcuauuucagcucaccacaaccucug

SEQ ID NO: 120698 - RNA, 64 nt, hsa
gcacuuucucugccacagcuguucuucacaguguuggugcuaaugaggccagggugcaggguuc

SEQ ID NO: 120699 - RNA, 64 nt, hsa
cuaucuuauguauuucuuuuaaguauuaccauuauggugcuacugagcguuuucuuuugguaaa

SEQ ID NO: 120700 - RNA, 64 nt, hsa
ucugacgcguaacugcccauuuuaaggaaacucuuggugcuacaaaacccugaccagacacuug

SEQ ID NO: 120701 - RNA, 64 nt, hsa
gacucagaucaaagacaaaaucugauccauauauuggugcuagauucugcaggaaaccccagca

SEQ ID NO: 120702 - RNA, 64 nt, hsa
agacgcaugcaagacucagacccggggaaugguguggugcuaaucucaacaccugacauucaca

SEQ ID NO: 120703 - RNA, 64 nt, hsa
ugucuugugcuggucuguuaaauccugcccuccuuggugcuagauccaguugugccucagggca

SEQ ID NO: 120704 - RNA, 64 nt, hsa
uaaggagaugggccuggggugggggcuuaugaguuggugcuagagccagggccaucuggacuau

SEQ ID NO: 120705 - RNA, 64 nt, hsa
cuaucaaggaguucuaucaaggcauccaugucaguggugcuaugcugguuacaacuugagauuu

SEQ ID NO: 120706 - RNA, 64 nt, hsa
ugccguuuauucagguggggcugaccaugggauguggugcuaaugauaaauauuacauuuaccc

SEQ ID NO: 120707 - RNA, 64 nt, hsa
agguucaaaacuggcuuuuccucugggccuggguuggugcuauaggccaagggucauuuuauac

SEQ ID NO: 120708 - RNA, 64 nt, hsa
uccagguaaaugguaugaucaauaaaggacaggcuggugcuaacauaaaauccaauauuguaau

SEQ ID NO: 120709 - RNA, 64 nt, hsa
aaccuuuucagaaucauggcagaggggcguggcguggugcuacugagaagguccuccuuccucu

SEQ ID NO: 120710 - RNA, 64 nt, hsa
gcacucgguugucuuuacuuuuaaaaguaauacuuggugcuaagaauuucaggauuauuguauu

SEQ ID NO: 120711 - RNA, 64 nt, hsa
cacuccccagcguggccucacugucuucuggucuuggugcuacugaaauugucacccagaauuu

SEQ ID NO: 120712 - RNA, 64 nt, hsa
gcuuguuguuugcgcauuuuuuuuuaaagcauauuggugcuagaaaaggcagcuaaaggaagug

SEQ ID NO: 120713 - RNA, 64 nt, hsa
ucuguguuacgacauuaauugcaaauagcaaguauggugcuaaagucuacaccaauggaauuag

SEQ ID NO: 120714 - RNA, 64 nt, hsa
aauuuaaucugugaggaacuaaaugacaggagauuggugcuaauacgggggaccaagcuuuguc

SEQ ID NO: 120715 - RNA, 64 nt, hsa
gacuugccuaguuguacccaccccuccaggucccuggugcuagagcuucugagaagggccuuuc

SEQ ID NO: 120716 - RNA, 64 nt, hsa
aaucuaagucuuccaaugccugcaucaaacuuucuggugcuaggaaaggaaaaaaauaauaauu

SEQ ID NO: 120717 - RNA, 64 nt, hsa
acggaaaggaaucuaauuccaagagucuaggaaauggugcuauugugaguucguucugacucuu

SEQ ID NO: 120718 - RNA, 64 nt, hsa
gaugaaaugcucuuuacauucaauuuucuguguguggugcuaauuuccauugugacuuuggaau

SEQ ID NO: 120719 - RNA, 64 nt, hsa
gaggcaggaccuucggccuaagaaacacaggcccuggugcuaucugaccugggguccagcgagg

SEQ ID NO: 120720 - RNA, 64 nt, hsa
uccuuuauuuguuuagacgugcuucaucccgaaguggugcuauggucuguuaaacagggcuggc

SEQ ID NO: 120721 - RNA, 64 nt, hsa
auuuucuuauuuucugguggaggagcuuaguaaguggugcuacaauugcugugcaaagaaauuc

SEQ ID NO: 120722 - RNA, 64 nt, hsa
uggguggggguugggugggagggacuugggucuuuggugcuaggagagggccugugcuccacac

SEQ ID NO: 120723 - RNA, 64 nt, hsa
ccaagaagcugagcuggcagagagcuccaccauuuggugcuaaaaaaaaaaacguccugagguu

SEQ ID NO: 120724 - RNA, 64 nt, hsa
ccuggggcuguauuuaucucugaggcaugguguguggugcuacagggaauuuguacguuuauac

SEQ ID NO: 120725 - RNA, 64 nt, hsa
cccacccucccacacagccggccacagggagaacuggugcuaaccagggugcuugcuuugguca

SEQ ID NO: 120726 - RNA, 64 nt, hsa
cccaguuacuaacuacggaaauagcauccucugcuggugcuaagugugauuaggaagaagccug

SEQ ID NO: 120727 - RNA, 64 nt, hsa
agagucucacuuugucacccaugcuggaguauaguggugcuaucucggcucacugcaaccauug

SEQ ID NO: 120728 - RNA, 64 nt, hsa
gggcggaagagucagaggacccugugcuugcugguggugcuaacacaauuucugguguucaacc

SEQ ID NO: 120729 - RNA, 64 nt, hsa
gauugucuauguaacauguagcgcacaccucucuuggugcuauuucauuccugcuguaagagaa

SEQ ID NO: 120730 - RNA, 64 nt, hsa
uuuuaauaauauauacaagcuccauaacuccuuuuggugcuaaugauuccgcuauuucacagac

SEQ ID NO: 120731 - RNA, 64 nt, hsa
ugucagaucagcaucaggcuguuaucaagucuguuggugcuaaaaaguaaaagaugaaauguuc

SEQ ID NO: 120732 - RNA, 64 nt, hsa
uuacuuggcagccaagaauuuggagguuuuaaaauggugcuaauucuguccucugaggucuucc

SEQ ID NO: 120733 - RNA, 64 nt, hsa
ugagacagggaagagaagugcaagaauugguugcuggugcuacauggcggcagcuuugacauuu

SEQ ID NO: 120734 - RNA, 64 nt, hsa
aaucaaaaucauaguaaaauauuaccuguuuucauggugcuaauauuaccuguucucccacugc

SEQ ID NO: 120735 - RNA, 64 nt, hsa
aagaaaaaggggcaguuuucuuugcccaagcauuuggugcuaguuagaggcuguucacucucuc

SEQ ID NO: 120736 - RNA, 64 nt, hsa
cuaaucaggccccuguuaugcuuagggggagcccuggugcuacuugcuugaaguuuucagugua

SEQ ID NO: 120737 - RNA, 64 nt, hsa
acaugauuuuuuuugaguagggagcauuaguaccuggugcuagagaauagaacccucaaauaau

SEQ ID NO: 120738 - RNA, 64 nt, hsa
uguauaccuuugugauuuucuaaugaguuuuccauggugcuacaaauaauccagacuaccaggu

SEQ ID NO: 120739 - RNA, 64 nt, hsa
ugcaggggcaagcaggagcuagcagccgccuacuuggugcuaaccccucgauguacauagcuuu

SEQ ID NO: 120740 - RNA, 64 nt, hsa
cuguuguccggagccagcucacugucuuccacacuggugcuaacuggcccaggcacuggagugg

SEQ ID NO: 120741 - RNA, 64 nt, hsa
aauaacaacguauguaauuguaacauugcaguaauggugcuacgaagccauuucucuugauuuu

SEQ ID NO: 120742 - RNA, 64 nt, hsa
gcugauuugucuuauuuuuuucauacuuucccacuggugcuauuuuuauuuccaauggauauuu

SEQ ID NO: 120743 - RNA, 64 nt, hsa
auuacuugaggugugccuuguauaacugaauuuauggugcuauuuaaacaauuuuuuucuaacg

SEQ ID NO: 120744 - RNA, 64 nt, hsa
ugcuuuuuuuuccguuuuuguucauuuuggaugcuggugcuaaaccuccaagugucaugauuua

SEQ ID NO: 120745 - RNA, 64 nt, hsa
guagcuuaaaaauguuggggguuggggggaagaguggugcuagccaggaagaagccaguaaaca

SEQ ID NO: 120746 - RNA, 64 nt, hsa
ugccgggcgcaggaacuguguguguccuacacaauggugcuauucugugucaaacaccucugua

SEQ ID NO: 120747 - RNA, 64 nt, hsa
aaggccuucucuacaaccuaguccaucucacuucuggugcuaccugaguuggacagaauucuag

SEQ ID NO: 120748 - RNA, 64 nt, hsa
aguacuggacgugcucagggucuagggucacagauggugcuauuaauugaacuggaacacagca

SEQ ID NO: 120749 - RNA, 64 nt, hsa
aauuuggguauuauugaaaauauuuuccaugccuuggugcuagcauauaaguuuggaaguuugc

SEQ ID NO: 120750 - RNA, 64 nt, hsa
uuucccauuuauuguuuggccagcuaugccaauguggugcuauuguuucuuuaagaaaguacuu

SEQ ID NO: 120751 - RNA, 64 nt, hsa
caaacaguauguaaaacucuguuuuuuaguauaauggugcuauuuuguaguuuguuauaugaaa

SEQ ID NO: 120752 - RNA, 64 nt, hsa
aguagggcaccgugagugcagcgcggggucuccauggugcuaggccaggguggccagccccgcc

SEQ ID NO: 120753 - RNA, 64 nt, hsa
auaacacuccuaagaaauguugauggcuauuuuguggugcuaacauguaguuggggcaccuaua

SEQ ID NO: 120754 - RNA, 64 nt, hsa
aaggagcacuccacagucggagguguaaucauauuggugcuauuucuuggaagagaaguuauug

SEQ ID NO: 120755 - RNA, 64 nt, hsa
auaugaauaacccacagauguacugaauuacuuuuggugcuaucuuguacucuucaaucuguaa

SEQ ID NO: 120756 - RNA, 64 nt, hsa
uggaaagagaaugcuucccauagaaagcccgacauggugcuaguuuccucucuuggagagccaa

SEQ ID NO: 120757 - RNA, 64 nt, hsa
gaagucuccugauucggacaaccaugagggguaguggugcuagggagaaggcaaccuucacugg

SEQ ID NO: 120758 - RNA, 64 nt, hsa
cauaaugaagccugacucagcuaaugucacaacauggugcuacuucuucuucuuuuuguuaaca

SEQ ID NO: 120759 - RNA, 64 nt, hsa
ugaaauuuacauaucaaguacugcaaauaaaagguggugcuaugauauaugcuuaggaggacag

SEQ ID NO: 120760 - RNA, 64 nt, hsa
auguucuagucuguugcgcuguuacaaucuguauuggugcuagucagaaaauuccuagcucaca

SEQ ID NO: 120761 - RNA, 64 nt, hsa
ggggaagcuagauggacuaggagagacuugauuuuggugcuaaaguuccccaguucauauguga

SEQ ID NO: 120762 - RNA, 64 nt, hsa
aagaaaaaccaaaacccaacccugcauggucaaguggugcuaacccaagacuguaacagggaga

SEQ ID NO: 120763 - RNA, 64 nt, hsa
ucuucuuuucuuuugcaugcauuuuuccccuguuuggugcuauguuuauguauuaugcuugaaa

SEQ ID NO: 120764 - RNA, 64 nt, hsa
aggaccucugaaacccuggaccaguggucucacauggugcuacgccugcauguaaacacgccug

SEQ ID NO: 120765 - RNA, 64 nt, hsa
uuuccucuguucaaagcugccugucccuaccccauggugcuaggaagaggaguggggugguguc

SEQ ID NO: 120766 - RNA, 64 nt, hsa
cauuaagugacuggauauguaaagucguuuaauguggugcuaaaaaguaaaggacuuuuaauca

SEQ ID NO: 120767 - RNA, 64 nt, hsa
cccucgugaaauagugugcaguggaggucucuuguggugcuagauguguguuuagagcuaaacc

SEQ ID NO: 120768 - RNA, 64 nt, hsa
aaugaaaucuucuugauuuuaaauaauauacgaauggugcuauuaauauugcuaaaaucaacgu

SEQ ID NO: 120769 - RNA, 64 nt, hsa
ccagccugggugcacaguagcugcaacuccccauuggugcuaccuggcucuccugucucugcag

SEQ ID NO: 120770 - RNA, 64 nt, hsa
aaguugcaggaggagagguggauggcaaugugauuggugcuauaacucaggcagccugggaguc

SEQ ID NO: 120771 - RNA, 64 nt, hsa
uuauaacuuuugcauaugugagaaaagacaacauuggugcuaacagugaaguaaggcccaaagg

SEQ ID NO: 120772 - RNA, 64 nt, hsa
acaaguacuagguuguccauuuaugguaccuauuuggugcuaguaaauuuucaaacuagauuua

SEQ ID NO: 120773 - RNA, 64 nt, hsa
ggcuguggcggagcucccgcccccugcgcccuaauggugcuaacccccucucacuacccagcag

SEQ ID NO: 120774 - RNA, 64 nt, hsa
augaagcucauuucucccagagauuuuguggacuuggugcuagucaagagauaugaggauggga

SEQ ID NO: 120775 - RNA, 64 nt, hsa
aaaguucuacauaauaaagguaaaacuuaaguaauggugcuacuucauuuuuuaaguauuucua

SEQ ID NO: 120776 - RNA, 64 nt, hsa
ggggcccucagguguguguacuuuggacaauaaauggugcuaugacugccuuccgccaucccca

SEQ ID NO: 120777 - RNA, 64 nt, hsa
cagcuuugcucugagugccuacaaagcuaaugcuuggugcuagaaacaucaucauuauuaaacu

SEQ ID NO: 120778 - RNA, 64 nt, hsa
gagaugcucacugagcugcugcuuuuaugugugcuggugcuauguguguucauguccgcggcag

SEQ ID NO: 120779 - RNA, 64 nt, hsa
cucgauccugaagaucgugugaaggaagcguucuuggugcuacacacagucuggaaaagcagcc

SEQ ID NO: 120780 - RNA, 64 nt, hsa
ccuuggggagaccaaaagucggacaggaaacaucuggugcuauuaucugggacuuggccugacc

SEQ ID NO: 120781 - RNA, 64 nt, hsa
gggcagccccagcccagcccgccgggagcaaggauggugcuaggucauucauggcuggccuccc

SEQ ID NO: 120782 - RNA, 64 nt, hsa
agggacugcugugcagacccaagcaaucccaaccuggugcuaggucauuucacuuuucugaaaa

SEQ ID NO: 120783 - RNA, 64 nt, hsa
ggaaaguuugccaggaggaacaaagagauugugguggugcuaaaggaggccauaagcuacacag

SEQ ID NO: 120784 - RNA, 64 nt, hsa
aacaagagcucucugccuccggucacucuugcuguggugcuacguggaagugaauggagacuga

SEQ ID NO: 120785 - RNA, 64 nt, hsa
ccacuaucuuaauuuugcgauacacugcauuugcuggugcuauuuuuauacagugaagcaacag

SEQ ID NO: 120786 - RNA, 64 nt, hsa
cagacccuugggagguggcccuaucccuaggcaguggugcuaggaggacagaaggcuauauggg

SEQ ID NO: 120787 - RNA, 64 nt, hsa
gauguugugugugcuggggagggguccuucuguuuggugcuacccuugucuacucugccccugg

SEQ ID NO: 120788 - RNA, 64 nt, hsa
uaaaugagaaaucagugacaacaagucuuugaaauggugcuauggauuuaccauuccuuauuau

SEQ ID NO: 120789 - RNA, 64 nt, hsa
cccaccgagagccaggcagcuuugaguggcagcguggugcuagcagcuucagcggaacagggug

SEQ ID NO: 120790 - RNA, 64 nt, hsa
aucuaugugaugggugggguggggagggaaucacuggugcuauagaaauugagaugccccccca

SEQ ID NO: 120791 - RNA, 64 nt, hsa
ccuacucuuugcaccugacuuuuccuaguuguccuggugcuaacacaggagcuacaccuugauc

SEQ ID NO: 120792 - RNA, 64 nt, hsa
gggagggaacagaaguuaggaggcaacuuugggauggugcuagagcauggaaagcacagagaau

SEQ ID NO: 120793 - RNA, 64 nt, hsa
uguuacuacaauaauacauguauuguguuuuccauggugcuacaguuacacaauauggaggcaa

SEQ ID NO: 120794 - RNA, 64 nt, hsa
guguguuuuccucacacacuuugauuuggagaauuggugcuaguuggcaauagauaacucagcg

SEQ ID NO: 120795 - RNA, 64 nt, hsa
cgagcucccgcccccacugggcccuccuuccuccuggugcuaauuuggggaccccaggggccgc

SEQ ID NO: 120796 - RNA, 64 nt, hsa
gggccgucuuggugucucguggcacgcgucacaguggugcuagucuguuuuuaacaaaagagga

SEQ ID NO: 120797 - RNA, 64 nt, hsa
ccugcagacagggucggagguguuagcgagccuuuggugcuagaagccugcggggucaugugcu

SEQ ID NO: 120798 - RNA, 64 nt, hsa
caccccaugaucaagaauccugcuccacuaagaauggugcuaaaguaaaacuaguuuaauaagc

SEQ ID NO: 120799 - RNA, 64 nt, hsa
ucacacucucaccuaggugagcgcauugagccaguggugcuaaaugcuacauacuccaacugaa

SEQ ID NO: 120800 - RNA, 64 nt, hsa
uccugaagcgcucucgagcuguucuguaaauaccuggugcuaacaucccaugccgcucccuccu

SEQ ID NO: 120801 - RNA, 64 nt, hsa
uuucagggaugucgugggcgggggaggggguucuuggugcuacagcccucuccccaccccuaaa

SEQ ID NO: 120802 - RNA, 64 nt, hsa
cucagggaggccgggugugaccucaucuuucucauggugcuauccuggugcuauuggggugggg

SEQ ID NO: 120803 - RNA, 64 nt, hsa
cgggugugaccucaucuuucucauggugcuauccuggugcuauugggguggggagcucccuccc

SEQ ID NO: 120804 - RNA, 64 nt, hsa
acacaaacccuucacagacugcucuggugccugguggugcuagcuccucccaccucagcaccug

SEQ ID NO: 120805 - RNA, 64 nt, hsa
ccaggggcaccccgacauccaggccacccccucauggugcuacagacccugcccuggggcccac

SEQ ID NO: 120806 - RNA, 64 nt, hsa
uccucacuccuccgucgcugcccuucacaccuuuuggugcuaccccuccccagaguuaagcacu

SEQ ID NO: 120807 - RNA, 64 nt, hsa
ccugcacgaacccuacagcgagagugacgaugauuggugcuaagcccgggcgagguggcgcccg

SEQ ID NO: 120808 - RNA, 64 nt, hsa
gcugguggcauuguuuacagcuagaaagcugcacuggugcuaaugccccuuggggaaauggggc

SEQ ID NO: 120809 - RNA, 64 nt, hsa
ggccuggccucugucuguuugccauggagccugguggugcuaacggcccuuuccccaggaaucc

SEQ ID NO: 120810 - RNA, 64 nt, hsa
uuuaauguuaauguauggaaauucaacuaauuuuuggugcuauuauucuauucugcaaauacac

SEQ ID NO: 120811 - RNA, 64 nt, hsa
gcugcaguauacagcgggaaaaacugaggcacuuuggugcuagggguuugggacugaggcgugg

SEQ ID NO: 120812 - RNA, 64 nt, hsa
caaacgcccuccgcucccucugcucccaacccuguggugcuaggaccacuccccgccuucccua

SEQ ID NO: 120813 - RNA, 64 nt, hsa
cauaaugguuuuuaacaccuuuuacucuucuuacuggugcuauuuuguagaauaaggaacaacg

SEQ ID NO: 120814 - RNA, 64 nt, hsa
aaaugcaaguaacuagccauuguucaaaugacaguggugcuauuucucuuuuguggccuuuuag

SEQ ID NO: 120815 - RNA, 64 nt, hsa
ugcccuguugccgagcccagcugugggcggcuccuggugcuaacaacaaaguuccacuuccagg

SEQ ID NO: 120816 - RNA, 64 nt, hsa
uuuuuuugaaccccauucuuuccuucucugaaaguggugcuauaaguuuuagaaucuuuuaaau

SEQ ID NO: 120817 - RNA, 64 nt, hsa
cauuucuauuuuuguuauccugugauuauuuugauggugcuagugacuaguuucuuugcuuuuu

SEQ ID NO: 120818 - RNA, 64 nt, hsa
gccagucaggcugcagaggcaccucaacauuccauggugcuagugggcccucucucugggccca

SEQ ID NO: 120819 - RNA, 64 nt, hsa
cuggaaaagacacagaagccaaccugagaaccccuggugcuauuuuaaaggagacauauugcug

SEQ ID NO: 120820 - RNA, 64 nt, hsa
uggagaaaauaauuuuuauggguuuuuuugguuauggugcuauuccuaagguuaacuuugaaua

SEQ ID NO: 120821 - RNA, 64 nt, hsa
augagugaccguuugaauccauauguagucccauuggugcuaaugagaguagcugcugugaaac

SEQ ID NO: 120822 - RNA, 64 nt, hsa
guaugucagaaaaggaugaguuuguggugacaguuggugcuaauaagaauuugccugggcagua

SEQ ID NO: 120823 - RNA, 64 nt, hsa
ugaguccagcugcagccacguggccaucuggagcuggugcuauaggugaccaucugguacauug

SEQ ID NO: 120824 - RNA, 64 nt, hsa
uugcuguccauccuuuuucagggcguggacucccuggugcuagaaagcgugauguucgccauac

SEQ ID NO: 120825 - RNA, 64 nt, hsa
uguaucuaguuguauuauucauagaaaaucaaucuggugcuaaugguuggcccugguguuguug

SEQ ID NO: 120826 - RNA, 64 nt, hsa
uguaacaaauauaagguuuacgagcuaugagaauuggugcuaucaccauuagcuauuugcugua

SEQ ID NO: 120827 - RNA, 64 nt, hsa
uaggugcacuugacaguauugaggucauuuguuauggugcuauuucaauuagucuagguuuagg

SEQ ID NO: 120828 - RNA, 64 nt, hsa
ucauuguccccaacuuuacuacugcugccgucaauggugcuacuauauaugaucaagauaacau

SEQ ID NO: 120829 - RNA, 64 nt, hsa
cacaguauguuacaugcauucuaccacuacauuuuggugcuauuuaaggugugcaauuuucuau

SEQ ID NO: 120830 - RNA, 64 nt, hsa
cuuuauuuuauaaguuagaacuuugaagaggaaauggugcuauauguuuauuguuauuacuuug

SEQ ID NO: 120831 - RNA, 64 nt, hsa
aaucaccguguggcaaaacauuccccuuccaaucuggugcuaguagaguauaugcuaucuaggc

SEQ ID NO: 120832 - RNA, 64 nt, hsa
uaagcuguugucaauuaucuaaagcauguuaguuuggugcuacacaguguugauuuuugugaug

SEQ ID NO: 120833 - RNA, 64 nt, hsa
ccugcugagaucugcuguccuguuucugucaagcuggugcuacuguuugauuuggaugauugug

SEQ ID NO: 120834 - RNA, 64 nt, hsa
auugugaucuuaguguauauaguuuuuacguuguuggugcuaaagugcuuuuuugaaguuuauu

SEQ ID NO: 120835 - RNA, 64 nt, hsa
ucucuauccagcuaaauaggcuuggggaaagcuguggugcuacagaaaguacccuagacuuaga

SEQ ID NO: 120836 - RNA, 64 nt, hsa
acauguccaggaguggccguugcuacaagucaccuggugcuacgaccagggugagaauaaagac

SEQ ID NO: 120837 - RNA, 64 nt, hsa; identical to SEQ ID NO: 78230

SEQ ID NO: 120838 - RNA, 64 nt, hsa; identical to SEQ ID NO: 78231

SEQ ID NO: 120839 - RNA, 64 nt, hsa; identical to SEQ ID NO: 78232

SEQ ID NO: 120840 - RNA, 64 nt, hsa; identical to SEQ ID NO: 78233

SEQ ID NO: 120841 - RNA, 64 nt, hsa; identical to SEQ ID NO: 78234

SEQ ID NO: 120842 - RNA, 64 nt, hsa; identical to SEQ ID NO: 78235

SEQ ID NO: 120843 - RNA, 64 nt, hsa; identical to SEQ ID NO: 78236

SEQ ID NO: 120844 - RNA, 64 nt, hsa; identical to SEQ ID NO: 78237

SEQ ID NO: 120845 - RNA, 64 nt, hsa; identical to SEQ ID NO: 78238

SEQ ID NO: 120846 - RNA, 64 nt, hsa; identical to SEQ ID NO: 78239

SEQ ID NO: 120847 - RNA, 64 nt, hsa; identical to SEQ ID NO: 78240

SEQ ID NO: 120848 - RNA, 64 nt, hsa; identical to SEQ ID NO: 78241

SEQ ID NO: 120849 - RNA, 64 nt, hsa
gaagccaccaucgguuccagcgucucccagacuucucguacaguuaauuugugucaucccauca

SEQ ID NO: 120850 - RNA, 64 nt, hsa
uuuaaacuuucugaagugcugauguacauacuuucucguacacacuuuugugaagauuucaagg

SEQ ID NO: 120851 - RNA, 64 nt, hsa
aucucacacagaggucaaccgaugagcccacucacucguacaugccuucuuccacagugggaag

SEQ ID NO: 120852 - RNA, 64 nt, hsa
ugcacuauugcaaaacggguguauuauccagguacucguacacuauuuuuuuguacugcugguc

SEQ ID NO: 120853 - RNA, 64 nt, hsa
uugaaacucaucuugguaaauaaauugcaaauuacucguacaguuuuacaaggaucucauggca

SEQ ID NO: 120854 - RNA, 64 nt, hsa
uguguaaguuuuaguugccuacccuagcucuuuucucguacaauuuugccaauaccaaguuuca

SEQ ID NO: 120855 - RNA, 64 nt, hsa
uuccuucuguuaaucuuuuguauucacuuaugcucucguacauugaguacuuuuauuccaaaac

SEQ ID NO: 120856 - RNA, 64 nt, hsa
aaaucuuacuguaccgccuguuguaucugggagccucguacagaggcucgcacagcagugauca

SEQ ID NO: 120857 - RNA, 64 nt, hsa
ccugcuccuggccacccaaaacuccauauggcuucucguacacugacauccucucucuacccau

SEQ ID NO: 120858 - RNA, 64 nt, hsa
uuaacuuaguaaauuugaagugcagcucuguuagcucguacauguggguucuuauccugauccu

SEQ ID NO: 120859 - RNA, 64 nt, hsa
uauuugcaguguauuugcuucucaugaacuauuucucguacaaaucauuaaauaguucauugga

SEQ ID NO: 120860 - RNA, 64 nt, hsa
gagcagugaucuccaaggccagcugcagggccugcucguacacuugcucaaccuggaccagccc

SEQ ID NO: 120861 - RNA, 64 nt, hsa
gcaccccucuuccccagcuguccugccagcccuucucguacaggguggcuccuuugaaguggag

SEQ ID NO: 120862 - RNA, 64 nt, hsa
ugaauacaucauccgcagccugggaaccuucucccucguacagcacaggaaccugacacauagu

SEQ ID NO: 120863 - RNA, 64 nt, hsa
aggcauuuuguuauucuguuaaaaaccacacacacucguacaugcagacaccuccaaugagaua

SEQ ID NO: 120864 - RNA, 64 nt, hsa
ccauuauuacaguaauuuuauuauaggacuuugccucguacaauuaauagugauauuuuggaca

SEQ ID NO: 120865 - RNA, 64 nt, hsa
cagggcacagucccuaaauuacugaucaugugcacucguacaguauauuacugugaccacaagg

SEQ ID NO: 120866 - RNA, 59 nt, hsa
accccuucaccuuugagugaucuuacucccucguacaugcacaaauacacacucaugca

SEQ ID NO: 120867 - RNA, 64 nt, hsa
cauuuuuuucuugaauuuuauauccguuuguucacucguacaugccuagccuacagaaggggau

SEQ ID NO: 120868 - RNA, 64 nt, hsa
agaaucuagugcgugggacaguaaaggauccuuucucguacagaauaaaaggucucagccugua

SEQ ID NO: 120869 - RNA, 64 nt, hsa
uuccaaucacaaggaaagauuuauuuaaaauauacucguacauuucaccuguggaugucuauaa

SEQ ID NO: 120870 - RNA, 64 nt, hsa
ggagcacuguuacaaauccuucuuguuuuggcaucucguacaacauuauuaagacacagcugag

SEQ ID NO: 120871 - RNA, 64 nt, hsa
caucaacagugagcaaaucuggcaugguguuugucucguacaguugggauaggaggccauucau

SEQ ID NO: 120872 - RNA, 64 nt, hsa
agaucuccuucccguggaaugaaauccgaaacaucucguacagugacaaggagguaggacaugu

SEQ ID NO: 120873 - RNA, 64 nt, hsa
ugaaauuuuuuagcaguacuuuagcuugaaaguacucguacaaauacuguuagauuuaguugca

SEQ ID NO: 120874 - RNA, 64 nt, hsa; identical to SEQ ID NO: 71901

SEQ ID NO: 120875 - RNA, 64 nt, hsa; identical to SEQ ID NO: 71902

SEQ ID NO: 120876 - RNA, 64 nt, hsa; identical to SEQ ID NO: 71903

SEQ ID NO: 120877 - RNA, 64 nt, hsa; identical to SEQ ID NO: 71904

SEQ ID NO: 120878 - RNA, 64 nt, hsa; identical to SEQ ID NO: 71905

SEQ ID NO: 120879 - RNA, 64 nt, hsa; identical to SEQ ID NO: 71906

SEQ ID NO: 120880 - RNA, 64 nt, hsa; identical to SEQ ID NO: 71907

SEQ ID NO: 120881 - RNA, 64 nt, hsa; identical to SEQ ID NO: 71908

SEQ ID NO: 120882 - RNA, 64 nt, hsa; identical to SEQ ID NO: 71909

SEQ ID NO: 120883 - RNA, 64 nt, hsa; identical to SEQ ID NO: 71910

SEQ ID NO: 120884 - RNA, 64 nt, hsa; identical to SEQ ID NO: 71911

SEQ ID NO: 120885 - RNA, 64 nt, hsa; identical to SEQ ID NO: 71912

SEQ ID NO: 120886 - RNA, 64 nt, hsa; identical to SEQ ID NO: 71913

SEQ ID NO: 120887 - RNA, 64 nt, hsa; identical to SEQ ID NO: 71914

SEQ ID NO: 120888 - RNA, 64 nt, hsa; identical to SEQ ID NO: 71915

SEQ ID NO: 120889 - RNA, 64 nt, hsa; identical to SEQ ID NO: 71916

SEQ ID NO: 120890 - RNA, 64 nt, hsa; identical to SEQ ID NO: 71917

SEQ ID NO: 120891 - RNA, 64 nt, hsa; identical to SEQ ID NO: 71918

SEQ ID NO: 120892 - RNA, 64 nt, hsa; identical to SEQ ID NO: 71919

SEQ ID NO: 120893 - RNA, 64 nt, hsa; identical to SEQ ID NO: 71920

SEQ ID NO: 120894 - RNA, 64 nt, hsa; identical to SEQ ID NO: 71921

SEQ ID NO: 120895 - RNA, 64 nt, hsa; identical to SEQ ID NO: 71922

SEQ ID NO: 120896 - RNA, 64 nt, hsa; identical to SEQ ID NO: 71923

SEQ ID NO: 120897 - RNA, 64 nt, hsa; identical to SEQ ID NO: 71924

SEQ ID NO: 120898 - RNA, 64 nt, hsa; identical to SEQ ID NO: 71925

SEQ ID NO: 120899 - RNA, 64 nt, hsa; identical to SEQ ID NO: 71926

SEQ ID NO: 120900 - RNA, 64 nt, hsa; identical to SEQ ID NO: 71927

SEQ ID NO: 120901 - RNA, 64 nt, hsa; identical to SEQ ID NO: 71928

SEQ ID NO: 120902 - RNA, 64 nt, hsa; identical to SEQ ID NO: 71929

SEQ ID NO: 120903 - RNA, 64 nt, hsa; identical to SEQ ID NO: 71930

SEQ ID NO: 120904 - RNA, 64 nt, hsa; identical to SEQ ID NO: 71931

SEQ ID NO: 120905 - RNA, 64 nt, hsa; identical to SEQ ID NO: 71932

SEQ ID NO: 120906 - RNA, 64 nt, hsa; identical to SEQ ID NO: 71933

SEQ ID NO: 120907 - RNA, 64 nt, hsa; identical to SEQ ID NO: 71934

SEQ ID NO: 120908 - RNA, 64 nt, hsa; identical to SEQ ID NO: 71935

SEQ ID NO: 120909 - RNA, 64 nt, hsa; identical to SEQ ID NO: 71936

SEQ ID NO: 120910 - RNA, 64 nt, hsa; identical to SEQ ID NO: 71937

SEQ ID NO: 120911 - RNA, 64 nt, hsa; identical to SEQ ID NO: 71938

SEQ ID NO: 120912 - RNA, 64 nt, hsa; identical to SEQ ID NO: 71939

SEQ ID NO: 120913 - RNA, 64 nt, hsa; identical to SEQ ID NO: 71940

SEQ ID NO: 120914 - RNA, 64 nt, hsa
cuuuccaaaaccgcaaggguagacugguuuauccacccacaacaucuacgaaucguacuucuuu

SEQ ID NO: 120915 - RNA, 64 nt, hsa
ccagaugaguuuaucaugucagugaaaaauaauuacccacaaaugccaccagaacuuacgauuc

SEQ ID NO: 120916 - RNA, 64 nt, hsa
uugagcccuagggcaguucuugguagguucugcugggcagaacauauggguuaaaucucgguag

SEQ ID NO: 120917 - RNA, 64 nt, hsa
gcagccuucuguacaacagaugggagggugaagggggcagaaugaaaaucgaaccaaccuuuua

SEQ ID NO: 120918 - RNA, 64 nt, hsa
uaggaagugcccuggagggggccagcaggucacggggcagaaucucucagguugcugugggauc

SEQ ID NO: 120919 - RNA, 64 nt, hsa
auuuugccaaauguaucuuuucugcuuuugaauugggcagaagauuuuagcaacuauauucuac

SEQ ID NO: 120920 - RNA, 64 nt, hsa
ucuuagcagaugggaggaacugcugagagaagaugggcagaaagcuggagccccuggaguuggc

SEQ ID NO: 120921 - RNA, 64 nt, hsa
guguuugugacugauuacuggcugugucuugggugggcagaaacucgaacuugcuauguaauuu

SEQ ID NO: 120922 - RNA, 64 nt, hsa
uuggcuauuugaguaaccuaggauuagugagaaggggcagaaggagauacaacuccacugcaag

SEQ ID NO: 120923 - RNA, 64 nt, hsa
ccuugacaauguagcaauaaauagaugcugccaagggcagaaaauggggagguuagcucagagc

SEQ ID NO: 120924 - RNA, 64 nt, hsa
uaaccuauaugugauggagaucacccaaugccaagggcagaaagcaaaccuaguuaaauaggug

SEQ ID NO: 120925 - RNA, 64 nt, hsa
gcuucagugacauugucaacaggaguccaauuaugggcagaaucugcucucugugaccaaaaga

SEQ ID NO: 120926 - RNA, 64 nt, hsa
aaauguuuaaaaauaaaugguuaaaagguuuuauguuauguauauuuuaccacaauaaaugcaa

SEQ ID NO: 120927 - RNA, 64 nt, hsa
uguacccauaaaaaugguuaaaaugguaaauuuuguuauguauauuuuaucauaauuuaaaaaa

SEQ ID NO: 120928 - RNA, 64 nt, hsa
acacugccaguuguauaaaaguacagcacauucaguuauguacaguauguaauacugauaauga

SEQ ID NO: 120929 - RNA, 64 nt, hsa
ugguuagauuugacugguuuugcagaagauuacaguuauguacugcauaaugacauauacaaua

SEQ ID NO: 120930 - RNA, 64 nt, hsa
cuauauugcagaaaccaauaucuguuucuuggugguuauguaaaagaccugaagaauuacuauc

SEQ ID NO: 120931 - RNA, 64 nt, hsa
aaaaggcuugguggugggauuuuuuuaaauguguguuauguacauauauauauauauauaauau

SEQ ID NO: 120932 - RNA, 64 nt, hsa
cuuuaacuauauacuauguaacaggguaaacaguguuauguagaauagaauuguguaaacuaga

SEQ ID NO: 120933 - RNA, 64 nt, hsa
uauuugagugauugcugggaagugugaaaauauuguuauguaucauaucaaagagaaacauguu

SEQ ID NO: 120934 - RNA, 64 nt, hsa
uaaaaacaacacagaaaucuccugcucugauauaguuauguaacugaucucuuaaucuguagca

SEQ ID NO: 120935 - RNA, 64 nt, hsa
guaaauguacaguuuucuuuuuuuuuuuuuuuugguuauguauacaaaaguuuuaacuacuuuu

SEQ ID NO: 120936 - RNA, 64 nt, hsa
gccaagguagcacugugagaaaucucacuuggauguuauguaaggggugagacacaacagucug

SEQ ID NO: 120937 - RNA, 64 nt, hsa
cgucuuuggaguugacauggaacagcagguaguuguuauguagagcuaguucucaaagcugccc

SEQ ID NO: 120938 - RNA, 64 nt, hsa
ucagaaacagaaccagagagaaguuaaacaaaagguuauguaacuguuccuuuaauguuguaau

SEQ ID NO: 120939 - RNA, 64 nt, hsa
aaaaagaaaaauaauugaaauguugagagagaugguuauguaaguuaguccucugcuguuuacu

SEQ ID NO: 120940 - RNA, 64 nt, hsa
aguucaaauacuauagcugucaguugaugaauuuguuauguaguaaaauguaugacuuuguaug

SEQ ID NO: 120941 - RNA, 64 nt, hsa
gcauuaugggucaaaaaucaaacauuccucucauguuauguauauuuuguuccuguuauauugg

SEQ ID NO: 120942 - RNA, 64 nt, hsa
ucuguuccucucuuucacuaaguuaguucuucuucacccucacuuccucuaaaguaacuccuua

SEQ ID NO: 120943 - RNA, 64 nt, hsa
ggugucgcgccgccuccacgcucgacauccugcacacccucagccuggcgcugcugagccucaa

SEQ ID NO: 120944 - RNA, 64 nt, hsa
agggguuucuuggaagcuggcucucacuccccuccacccucagcuagagguaggauaucccuga

SEQ ID NO: 120945 - RNA, 64 nt, hsa
gagagccgcaggggccugccacacacucccagcucacccucaccccagccucuuccccacauua

SEQ ID NO: 120946 - RNA, 64 nt, hsa
gaccccuaguuccacugcacauggcccuccuccccacccucaugacugggaaggaagccuguga

SEQ ID NO: 120947 - RNA, 64 nt, hsa
gaggccagaaaguuguuaggccugccgcaggccccacccucaagcauuccucaggaagcgucuc

SEQ ID NO: 120948 - RNA, 64 nt, hsa
gagucaaaaaaucucaauucuucccuaucuuugccacccucaugcugugugacucaaaccaaau

SEQ ID NO: 120949 - RNA, 64 nt, hsa
cauggaaauucccuucaucuggaaccaucagaaacacccucacacugggacuugcaaaaagggu

SEQ ID NO: 120950 - RNA, 64 nt, hsa
ggggacccucaucccaggaacaacauuccagccccacccucaggcuggagggcgucccagccua

SEQ ID NO: 120951 - RNA, 64 nt, hsa
gccugagugucccugaucgggucucccuccugugcacccucaggucccuccuuuuccugcuggc

SEQ ID NO: 120952 - RNA, 64 nt, hsa
uuugcuguccagcugccugucguuuggcccagaccacccucagaaaaaaaccagcugccucucc

SEQ ID NO: 120953 - RNA, 64 nt, hsa
ggccuuauuugacauuuucacugauaacugaucgcacccucauguugcaguguucguccccuau

SEQ ID NO: 120954 - RNA, 64 nt, hsa
uggugcaaagcuggggccagccugucuucaccggcacccucaccugugacaccaagacccaccc

SEQ ID NO: 120955 - RNA, 64 nt, hsa
ccuugcugcugaccauccuaggcugggcuggccccacccucacccccacccccagggugcccug

SEQ ID NO: 120956 - RNA, 64 nt, hsa
cuuauccggccuggccuggagggugacaccaugucacccucaccaggacucgucucuccauucc

SEQ ID NO: 120957 - RNA, 64 nt, hsa
aaaguaguggcuauuuuugugccacucugcgccccacccucacuguuggccgcuccuuauccgg

SEQ ID NO: 120958 - RNA, 64 nt, hsa
auugagcugacugagggaagaugcaccuugaucucacccucacuccaaggcacauagcaggauc

SEQ ID NO: 120959 - RNA, 64 nt, hsa
cccauucccaguaucgcuguuccuacgcccauuucacccucauuaccuucugcuuccaaggaau

SEQ ID NO: 120960 - RNA, 64 nt, hsa
gcagggucacaggcaucccgggagaaugggccuccacccucagccagcccucacugcugacagg

SEQ ID NO: 120961 - RNA, 64 nt, hsa
gaaacgucauccccaccaguuaacguuuccuguacacccucacccucucucguccaucucuguu

SEQ ID NO: 120962 - RNA, 64 nt, hsa
gugcacacacacagacccacauguggguggggggcacccucacgugcuuggccucaaugcaggc

SEQ ID NO: 120963 - RNA, 64 nt, hsa
cacagauaguggcggcaauggccucagcccagcccacccucaccugcuuuuccagcccacaaag

SEQ ID NO: 120964 - RNA, 64 nt, hsa
caaggcaucacucccagccccucgccuucuagggcacccucagcaaaggggcagguggggacac

SEQ ID NO: 120965 - RNA, 62 nt, hsa
cccgagagaagaagcagugaccucucuccccacacccucaccugcacccuaggaccucacug

SEQ ID NO: 120966 - RNA, 64 nt, hsa
ccucgccgcucgaccccgcccucaccacacugaccacccucaacccauugcgcccaguccccac

SEQ ID NO: 120967 - RNA, 64 nt, hsa
aacccauugcgcccaguccccaccacagugaccacacccucacuggcucggcccugcccccagu

SEQ ID NO: 120968 - RNA, 64 nt, hsa
gugugagguugggugauagccguuccuuccccgacacccucaauuuccccaucucugauccucu

SEQ ID NO: 120969 - RNA, 64 nt, hsa
auccucuaaucugccucugaacccauucacccuucacccucacuccugguccccauacccagca

SEQ ID NO: 120970 - RNA, 64 nt, hsa
ccugagccauuucugcuguuucaggugcccacaucacccucauuuccuccucgcaguagcccug

SEQ ID NO: 120971 - RNA, 64 nt, hsa
ugggaguaaggcccccagggacaccccaucauuucacccucacauucaaggcccuuccugucuu

SEQ ID NO: 120972 - RNA, 64 nt, hsa
acuagaucuagaaucagagcuggauucaauuccuguccuucacauuuacuagcugugcaaccuu

SEQ ID NO: 120973 - RNA, 64 nt, hsa
cucuccucuucuagcauuucuuccaauuauuacaguccuucaagauuccauuucuuaacagucu

SEQ ID NO: 120974 - RNA, 64 nt, hsa
aagagucuugcagggggacccacagauaugccauguccuucacacgugcuugggcuccuuaacc

SEQ ID NO: 120975 - RNA, 64 nt, hsa
cuagaagcaccauguuuuuucuaugaccuuuucaguccuucaggucauuuuaagguccacugca

SEQ ID NO: 120976 - RNA, 64 nt, hsa
gacaagcuuacaucuuccucagccaucuuugugaguccuucaagagcaguuaucaauuguuagu

SEQ ID NO: 120977 - RNA, 64 nt, hsa
aauaugugugugugucucagucccuguaagucauguccuucacagggagaauuaacccuucgau

SEQ ID NO: 120978 - RNA, 64 nt, hsa
gccuuuguuggccugaugugcugcugugaugcugguccuucaucuuagguguucaugcaguucu

SEQ ID NO: 120979 - RNA, 64 nt, hsa
uuucacaagcucuugccucacaaccccugcagaaguccuucaacaaaacuaauaauagacuagu

SEQ ID NO: 120980 - RNA, 64 nt, hsa
aacguuacuuguauauugguaagugguuucaauuguccuucagauaauucauguggagauuuuu

SEQ ID NO: 120981 - RNA, 64 nt, hsa
acucugggguuauuucucugucuagagcauuguuguccuucacugcaguccaguugggauuauu

SEQ ID NO: 120982 - RNA, 64 nt, hsa
auacuuauggcagauaaguaaggcaugucacuguguccuucaguaaccucucucaguaacuggu

SEQ ID NO: 120983 - RNA, 64 nt, hsa
cuagaaagggauuuggcauuuuauguccuucuguguccuucauguaucugaucaaugaagaccu

SEQ ID NO: 120984 - RNA, 64 nt, hsa
uaccacgacauccaacagcuggaacuuccauccaguccuucacaugaugggcaccugugggaaa

SEQ ID NO: 120985 - RNA, 64 nt, hsa
guucuagguaaugaguacaugaaacacguuaaauguccuucagccucccuaccacgacauccaa

SEQ ID NO: 120986 - RNA, 64 nt, hsa
cagaaguacauauugaagaggacaauauggcaauguccuucaaaauuauaaaagcacuaacucu

SEQ ID NO: 120987 - RNA, 64 nt, hsa
caacugggacagaggcuacaucugcccuagggagguccuucagaaucuguggagcaagaaagga

SEQ ID NO: 120988 - RNA, 64 nt, hsa
uacccucugggaaagcccuugugucccucccagaguccuucagguaggcccucgcagaugcugc

SEQ ID NO: 120989 - RNA, 64 nt, hsa
aggccggaaugcucauggccccuguggucugcuuguccuucagcccaugcccagcagauaccuc

SEQ ID NO: 120990 - RNA, 64 nt, hsa
auguauuuugcugguaagcucauccauuagcugcguccuucagcuauuccuuuagauuggagga

SEQ ID NO: 120991 - RNA, 64 nt, hsa
ucacauggugguuaaguagugacuaacugugcauguccuucaugguaggugagcaccagucucc

SEQ ID NO: 120992 - RNA, 64 nt, hsa
aagguaccaggacucaggcuucucauccccuccucccgcaaagcgguuuucugacccucagggc

SEQ ID NO: 120993 - RNA, 64 nt, hsa
auugcuucccugcuauuucccuccuugggcucuucccgcaaaucaacacuuucugcacuuaucu

SEQ ID NO: 120994 - RNA, 64 nt, hsa
auucaaaaaguacaucuucccccccccccccccccccgcaaaauaauucuguggcagggcaagg

SEQ ID NO: 120995 - RNA, 64 nt, hsa
cugcacucggucgggccuccacaggcauggaguccccgcaaaaaccuggccccugcaggaguca

SEQ ID NO: 120996 - RNA, 64 nt, hsa
auuaagauagguucuuucuguauaugaaacgcuccccgcaaauucacuggcagcucagaauuau

SEQ ID NO: 120997 - RNA, 64 nt, hsa
gcuguuggaguuucuguuuagggcauuaaaaauucccgcaaacuauaaagagcaauguuuucag

SEQ ID NO: 120998 - RNA, 64 nt, hsa
ucagguugcugguugcugugugguuugguguguucccgcaaacccccuuugugcuguggggcug

SEQ ID NO: 120999 - RNA, 64 nt, hsa
auacaugcaaagcaauaucuuguucagguuaguacccgcaaaacgggacauaguaugugacaau

SEQ ID NO: 121000 - RNA, 64 nt, hsa
aacauguuuagcaaaaaccaauucaguuccauuccccgcaaaaaaccccuaacuuuacucugaa

SEQ ID NO: 121001 - RNA, 64 nt, hsa
uauuggaaggcagcucccgcauaccaggauaacccccgcaaaccacauagcagacccccgccau

SEQ ID NO: 121002 - RNA, 64 nt, hsa
gugcaguccuugcucauauuuccuucaucuuaaccccgcaaacaagaauuaagaugaucccaau

SEQ ID NO: 121003 - RNA, 64 nt, hsa
caaguagcuaggacuacaggcguucaccacugcgcccgcaaaguuuuuuuguuguuuuuuuuuu

SEQ ID NO: 121004 - RNA, 64 nt, hsa
acauguguacauucuucaccuccuggugcccuaucccgcaaaaugggcuuccugccugguuuuu

SEQ ID NO: 121005 - RNA, 64 nt, hsa
gccagaguagggguuggggggaguguggacaaaccccgcaaaucagaguggggaaggugagugg

SEQ ID NO: 121006 - RNA, 64 nt, hsa
ucucagcugugguacugcccuguaagaaccugcccccgcaaaacucuggagucccugggacaca

SEQ ID NO: 121007 - RNA, 64 nt, hsa
ccauuaggugauacauagauaagggcuuuuucuccccgcaaacaccccuaagaaugguucugug

SEQ ID NO: 121008 - RNA, 64 nt, hsa
uagaaaccagguuauuucucccugcuuauggcuccccgcaaagggacuugcagcguguccugca

SEQ ID NO: 121009 - RNA, 64 nt, hsa
guuuuaaaguucaugguaagauuugaccucaucucccgcaaauaaauguauuggugauuuggag

SEQ ID NO: 121010 - RNA, 64 nt, hsa
uucucuuuuugccaaaauuaacuguuuggugaagcccgcaaaaccuccucgcuuugcaugcaug

SEQ ID NO: 121011 - RNA, 64 nt, hsa
gcugggcggcugggaauuccaccugagaacaagucccgcaaaccggggacggaaggacauuuga

SEQ ID NO: 121012 - RNA, 64 nt, hsa
ggcaaaguccucagccagugcuuuagagcaacuucccgcaaaucagaaacucacugugauucca

SEQ ID NO: 121013 - RNA, 64 nt, hsa
caagccccccagccucccacccuggucccaguuucccgcaaagugccucugggggaccccccag

SEQ ID NO: 121014 - RNA, 64 nt, hsa
guucuagucaauucugaaccaccaccccccgccccccgcaaaaaaguaaaagucaaaccaaacu

SEQ ID NO: 121015 - RNA, 64 nt, hsa
acaaaggcuggccuguguguaagucaaagucacucccgcaaaccugaaucucgagcuaccuauu

SEQ ID NO: 121016 - RNA, 64 nt, hsa
ucauccuaggcaacagagcgagacucugucuccccccgcaaaaaaaaaaaagaaagaaagaaag

SEQ ID NO: 121017 - RNA, 64 nt, hsa
cugccacugucagggaccagccggccaacgcccacccgcaaaggugucuaaaaacuucagcuuu

SEQ ID NO: 121018 - RNA, 64 nt, hsa
gaccaggaagcugccaucagggaucuuccccugccccgcaaagcuaggcuccagcugcaggcgg

SEQ ID NO: 121019 - RNA, 64 nt, hsa
accuuccauucccaccacacagacucugggccuccccgcaaaauggcuccagaauuagaguaau

SEQ ID NO: 121020 - RNA, 64 nt, hsa
gccgcccuggcuuggcagcccugcccacgcugcccccgcaaacaauggugugugcguuuuuaca

SEQ ID NO: 121021 - RNA, 64 nt, hsa
ucuuguuuguuacaaccuuugugagucagccaugcccgcaaagcgugcuguguuuuaguccugg

SEQ ID NO: 121022 - RNA, 64 nt, hsa
auuguaacuaaaaucuuccucaggacuauuaacccccgcaaaguuucuauagggaacugccuag

SEQ ID NO: 121023 - RNA, 64 nt, hsa
ggggagaaaaacucucaucccugacccuuccccccccgcaaauguuagaccagagcuguugauc

SEQ ID NO: 121024 - RNA, 64 nt, hsa
cugccccucaaguucaaccccgggaccgcccagccccgcaaagcaaagacccugacuucuccug

SEQ ID NO: 121025 - RNA, 64 nt, hsa
gcagguaaggugaaccagcugcacggaccagguucccgcaaaacauugccagcuagugaggcau

SEQ ID NO: 121026 - RNA, 64 nt, hsa
cccuugagaauguacuuugugagauccaccccugcccgcaaaacauugcuccaaacuccaccac

SEQ ID NO: 121027 - RNA, 64 nt, hsa
guuuucccggggacucuauaggcagcugcuccugcccgcaaagcaagagcaucauuccuauucu

SEQ ID NO: 121028 - RNA, 64 nt, hsa
gaggaucuuuaggccugaguugugaagcgcaacccccgcaaaacgcauuugccaucacaguugg

SEQ ID NO: 121029 - RNA, 64 nt, hsa
gccuuccucugcucugggaccagugguuuauuuucccgcaaacgcugagugacucggggccgga

SEQ ID NO: 121030 - RNA, 64 nt, hsa
uccuucuuccccacaacagaagagaccagcgacucccgcaaagggacaagguuccucccucucc

SEQ ID NO: 121031 - RNA, 64 nt, hsa
cacacagacacguaauaccagaccaaccucaauccccgcaaacuaaagcaaagcuaauugcaaa

SEQ ID NO: 121032 - RNA, 64 nt, hsa
cuccagaauccugaugguaucaauggauuuaucccccgcaaagacaucaaaccugaguaucagu

SEQ ID NO: 121033 - RNA, 64 nt, hsa
ccagagcugggugaguggggagacaccucagagccccgcaaaacccacugaccggaggcaaaag

SEQ ID NO: 121034 - RNA, 64 nt, hsa
acaugggaugggggaggcagagacugguccagagcccgcaaauggacucggagccgagggccuc

SEQ ID NO: 121035 - RNA, 51 nt, hsa
uguaccuggugagcugcugaacccgcaaaugcugcugccccagcucuacac

SEQ ID NO: 121036 - RNA, 64 nt, hsa
acagggacacagccagagcccacggagggcccuucccgcaaagcagaagccgccagggcagggg

SEQ ID NO: 121037 - RNA, 64 nt, hsa
auauaaguuauuuguugcagcauaacaaaugauccccgcaaauuuuguggcuucaaacacgaaa

SEQ ID NO: 121038 - RNA, 64 nt, hsa
gugagcagagaccccgugcagugcauucagacaccccgcaaagcaggacucuguggaaauugac

SEQ ID NO: 121039 - RNA, 64 nt, hsa; identical to SEQ ID NO: 119503

SEQ ID NO: 121040 - RNA, 64 nt, hsa; identical to SEQ ID NO: 119504

SEQ ID NO: 121041 - RNA, 64 nt, hsa; identical to SEQ ID NO: 119505

SEQ ID NO: 121042 - RNA, 64 nt, hsa; identical to SEQ ID NO: 119506

SEQ ID NO: 121043 - RNA, 64 nt, hsa; identical to SEQ ID NO: 119507

SEQ ID NO: 121044 - RNA, 64 nt, hsa; identical to SEQ ID NO: 119508

SEQ ID NO: 121045 - RNA, 64 nt, hsa; identical to SEQ ID NO: 119509

SEQ ID NO: 121046 - RNA, 64 nt, hsa; identical to SEQ ID NO: 119510

SEQ ID NO: 121047 - RNA, 64 nt, hsa; identical to SEQ ID NO: 119511

SEQ ID NO: 121048 - RNA, 64 nt, hsa; identical to SEQ ID NO: 119512

SEQ ID NO: 121049 - RNA, 64 nt, hsa; identical to SEQ ID NO: 119513

SEQ ID NO: 121050 - RNA, 64 nt, hsa; identical to SEQ ID NO: 119514

SEQ ID NO: 121051 - RNA, 64 nt, hsa; identical to SEQ ID NO: 119515

SEQ ID NO: 121052 - RNA, 64 nt, hsa; identical to SEQ ID NO: 119516

SEQ ID NO: 121053 - RNA, 64 nt, hsa; identical to SEQ ID NO: 119517

SEQ ID NO: 121054 - RNA, 64 nt, hsa; identical to SEQ ID NO: 119518

SEQ ID NO: 121055 - RNA, 64 nt, hsa; identical to SEQ ID NO: 119519

SEQ ID NO: 121056 - RNA, 64 nt, hsa; identical to SEQ ID NO: 119520

SEQ ID NO: 121057 - RNA, 64 nt, hsa; identical to SEQ ID NO: 119521

SEQ ID NO: 121058 - RNA, 64 nt, hsa; identical to SEQ ID NO: 119522

SEQ ID NO: 121059 - RNA, 64 nt, hsa; identical to SEQ ID NO: 119523

SEQ ID NO: 121060 - RNA, 64 nt, hsa; identical to SEQ ID NO: 119524

SEQ ID NO: 121061 - RNA, 64 nt, hsa; identical to SEQ ID NO: 119525

SEQ ID NO: 121062 - RNA, 64 nt, hsa; identical to SEQ ID NO: 119526

SEQ ID NO: 121063 - RNA, 64 nt, hsa; identical to SEQ ID NO: 119527

SEQ ID NO: 121064 - RNA, 64 nt, hsa; identical to SEQ ID NO: 119528

SEQ ID NO: 121065 - RNA, 64 nt, hsa; identical to SEQ ID NO: 119529

SEQ ID NO: 121066 - RNA, 64 nt, hsa; identical to SEQ ID NO: 119530

SEQ ID NO: 121067 - RNA, 64 nt, hsa; identical to SEQ ID NO: 119531

SEQ ID NO: 121068 - RNA, 64 nt, hsa; identical to SEQ ID NO: 119532

SEQ ID NO: 121069 - RNA, 64 nt, hsa; identical to SEQ ID NO: 119533

SEQ ID NO: 121070 - RNA, 64 nt, hsa; identical to SEQ ID NO: 119534

SEQ ID NO: 121071 - RNA, 64 nt, hsa; identical to SEQ ID NO: 119535

SEQ ID NO: 121072 - RNA, 64 nt, hsa; identical to SEQ ID NO: 119536

SEQ ID NO: 121073 - RNA, 64 nt, hsa; identical to SEQ ID NO: 119537

SEQ ID NO: 121074 - RNA, 64 nt, hsa; identical to SEQ ID NO: 119538

SEQ ID NO: 121075 - RNA, 64 nt, hsa; identical to SEQ ID NO: 119539

SEQ ID NO: 121076 - RNA, 64 nt, hsa; identical to SEQ ID NO: 119540

SEQ ID NO: 121077 - RNA, 64 nt, hsa; identical to SEQ ID NO: 119541

SEQ ID NO: 121078 - RNA, 64 nt, hsa; identical to SEQ ID NO: 119542

SEQ ID NO: 121079 - RNA, 64 nt, hsa; identical to SEQ ID NO: 119543

SEQ ID NO: 121080 - RNA, 64 nt, hsa; identical to SEQ ID NO: 119544

SEQ ID NO: 121081 - RNA, 64 nt, hsa; identical to SEQ ID NO: 119545

SEQ ID NO: 121082 - RNA, 64 nt, hsa; identical to SEQ ID NO: 119546

SEQ ID NO: 121083 - RNA, 64 nt, hsa; identical to SEQ ID NO: 119547

SEQ ID NO: 121084 - RNA, 64 nt, hsa; identical to SEQ ID NO: 119548

SEQ ID NO: 121085 - RNA, 64 nt, hsa; identical to SEQ ID NO: 119549

SEQ ID NO: 121086 - RNA, 64 nt, hsa; identical to SEQ ID NO: 119550

SEQ ID NO: 121087 - RNA, 64 nt, hsa; identical to SEQ ID NO: 119551

SEQ ID NO: 121088 - RNA, 64 nt, hsa; identical to SEQ ID NO: 119552

SEQ ID NO: 121089 - RNA, 64 nt, hsa; identical to SEQ ID NO: 119553

SEQ ID NO: 121090 - RNA, 64 nt, hsa; identical to SEQ ID NO: 119554

SEQ ID NO: 121091 - RNA, 64 nt, hsa; identical to SEQ ID NO: 119555

SEQ ID NO: 121092 - RNA, 64 nt, hsa; identical to SEQ ID NO: 119556

SEQ ID NO: 121093 - RNA, 64 nt, hsa; identical to SEQ ID NO: 119557

SEQ ID NO: 121094 - RNA, 64 nt, hsa; identical to SEQ ID NO: 119558

SEQ ID NO: 121095 - RNA, 64 nt, hsa; identical to SEQ ID NO: 119559

SEQ ID NO: 121096 - RNA, 64 nt, hsa; identical to SEQ ID NO: 119560

SEQ ID NO: 121097 - RNA, 64 nt, hsa; identical to SEQ ID NO: 119561

SEQ ID NO: 121098 - RNA, 64 nt, hsa; identical to SEQ ID NO: 119562

SEQ ID NO: 121099 - RNA, 64 nt, hsa; identical to SEQ ID NO: 119563

SEQ ID NO: 121100 - RNA, 64 nt, hsa; identical to SEQ ID NO: 119564

SEQ ID NO: 121101 - RNA, 64 nt, hsa; identical to SEQ ID NO: 119565

SEQ ID NO: 121102 - RNA, 64 nt, hsa; identical to SEQ ID NO: 119566

SEQ ID NO: 121103 - RNA, 64 nt, hsa; identical to SEQ ID NO: 119567

SEQ ID NO: 121104 - RNA, 64 nt, hsa; identical to SEQ ID NO: 119568

SEQ ID NO: 121105 - RNA, 64 nt, hsa; identical to SEQ ID NO: 119569

SEQ ID NO: 121106 - RNA, 64 nt, hsa; identical to SEQ ID NO: 119570

SEQ ID NO: 121107 - RNA, 64 nt, hsa; identical to SEQ ID NO: 119571

SEQ ID NO: 121108 - RNA, 64 nt, hsa; identical to SEQ ID NO: 119572

SEQ ID NO: 121109 - RNA, 64 nt, hsa; identical to SEQ ID NO: 119573

SEQ ID NO: 121110 - RNA, 64 nt, hsa; identical to SEQ ID NO: 119574

SEQ ID NO: 121111 - RNA, 64 nt, hsa; identical to SEQ ID NO: 119575

SEQ ID NO: 121112 - RNA, 64 nt, hsa; identical to SEQ ID NO: 119576

SEQ ID NO: 121113 - RNA, 64 nt, hsa; identical to SEQ ID NO: 119577

SEQ ID NO: 121114 - RNA, 64 nt, hsa; identical to SEQ ID NO: 119578

SEQ ID NO: 121115 - RNA, 64 nt, hsa; identical to SEQ ID NO: 119579

SEQ ID NO: 121116 - RNA, 64 nt, hsa; identical to SEQ ID NO: 119580

SEQ ID NO: 121117 - RNA, 64 nt, hsa; identical to SEQ ID NO: 119581

SEQ ID NO: 121118 - RNA, 64 nt, hsa; identical to SEQ ID NO: 119582

SEQ ID NO: 121119 - RNA, 64 nt, hsa; identical to SEQ ID NO: 119583

SEQ ID NO: 121120 - RNA, 64 nt, hsa; identical to SEQ ID NO: 119584

SEQ ID NO: 121121 - RNA, 64 nt, hsa; identical to SEQ ID NO: 119585

SEQ ID NO: 121122 - RNA, 64 nt, hsa; identical to SEQ ID NO: 119586

SEQ ID NO: 121123 - RNA, 64 nt, hsa; identical to SEQ ID NO: 119587

SEQ ID NO: 121124 - RNA, 64 nt, hsa; identical to SEQ ID NO: 119588

SEQ ID NO: 121125 - RNA, 64 nt, hsa; identical to SEQ ID NO: 119589

SEQ ID NO: 121126 - RNA, 64 nt, hsa; identical to SEQ ID NO: 119590

SEQ ID NO: 121127 - RNA, 64 nt, hsa; identical to SEQ ID NO: 119591

SEQ ID NO: 121128 - RNA, 64 nt, hsa; identical to SEQ ID NO: 119592

SEQ ID NO: 121129 - RNA, 64 nt, hsa; identical to SEQ ID NO: 119593

SEQ ID NO: 121130 - RNA, 64 nt, hsa; identical to SEQ ID NO: 119594

SEQ ID NO: 121131 - RNA, 64 nt, hsa; identical to SEQ ID NO: 119595

SEQ ID NO: 121132 - RNA, 64 nt, hsa; identical to SEQ ID NO: 119596

SEQ ID NO: 121133 - RNA, 64 nt, hsa; identical to SEQ ID NO: 119597

SEQ ID NO: 121134 - RNA, 64 nt, hsa
ccucauuuguguggaaagucagaggaaaaaugauccaguggacacuuggggauuaucugucauu

SEQ ID NO: 121135 - RNA, 64 nt, hsa
aacaccaccuuccuccuggcuuccagggggcagcccaguggaauggaaagaaugugggauuugg

SEQ ID NO: 121136 - RNA, 64 nt, hsa
ucugcuccucccaccucaucccuaggaggacccaccaguggagcacaugcagccucaguggaga

SEQ ID NO: 121137 - RNA, 64 nt, hsa
ccucagccuugcccuggcugggguuguggugacuccaguggaacauucccugaugggggacaug

SEQ ID NO: 121138 - RNA, 64 nt, hsa
ugauggggaagaugaauauuacaaaucucugucaccaguggacuguaucccugaggagaacaac

SEQ ID NO: 121139 - RNA, 64 nt, hsa
aucaaguuacuuuucaauccauucagaaucugccccaguggagacccaggaguuccuuuccugc

SEQ ID NO: 121140 - RNA, 64 nt, hsa
auguggucuucucuaccccucuaccccacauuggccaguggacucauccauucuuuggaacaaa

SEQ ID NO: 121141 - RNA, 64 nt, hsa
cucagccuacacaagggaggggaacauuccauccccaguggagucucuuccuauguggucuucu

SEQ ID NO: 121142 - RNA, 64 nt, hsa
aaccuucuaccuuguaauauguaacuauucuaauccaguggaaucuuacggaaaacacagagaa

SEQ ID NO: 121143 - RNA, 64 nt, hsa
cucaacugccaguaauuuuuuaaaaagcacugucccaguggauugauguuguuuuuaauggaua

SEQ ID NO: 121144 - RNA, 64 nt, hsa
agggugucaggaaggcaggggugccgggucccacccaguggaguaacaaacuguggguggcguu

SEQ ID NO: 121145 - RNA, 64 nt, hsa
auaccucucagccuccagcguugcaagugcaaggccaguggaguuaaucugcaacgugcacgag

SEQ ID NO: 121146 - RNA, 64 nt, hsa
cuucagguguaguaguucuguguugacccuuuguccaguggaauuggugauucugaauuguccu

SEQ ID NO: 121147 - RNA, 64 nt, hsa
auuguugauuucaguaagcuguguggugaggcuaccaguggaagagacaucccuugacuuuugu

SEQ ID NO: 121148 - RNA, 64 nt, hsa
aaugugacauugcuuuucagacuguuuucauuucuguuuuuagcagagacaugcaacaacaaca

SEQ ID NO: 121149 - RNA, 64 nt, hsa
uauuuccacauaaugaggagccaaagaaaucugauguuuuuaacaauuaaacugcuaauguuaa

SEQ ID NO: 121150 - RNA, 64 nt, hsa
accuguacauuuguaaacugaccugacuccauuuuguuuuuaaauguguggguuauguugcagc

SEQ ID NO: 121151 - RNA, 64 nt, hsa
ucuuacccagugcuguugcccuuuugaguauuuuuguuuuuaaaauaaugauuguaaaauguuu

SEQ ID NO: 121152 - RNA, 64 nt, hsa
uuguuucaacugaauuuguaauuaacucugaauuuguuuuuaaucauuaguaauauuucaguug

SEQ ID NO: 121153 - RNA, 64 nt, hsa
uggaacuuuauugcauucuuuauuuuaaaaagcuuguuuuuacguaaucauagagcuugcuauu

SEQ ID NO: 121154 - RNA, 64 nt, hsa
ugaaacucaaauauuuucauuuuggauauucuccuguuuuuauuaaaccagugauuacaccugg

SEQ ID NO: 121155 - RNA, 64 nt, hsa
guccuugcaucaacgggaugccacauuucauaacuguuuuuaaugguaaaaaaaaaaaaaaaaa

SEQ ID NO: 121156 - RNA, 64 nt, hsa
cgcugggucagcagcaagcuguaguuuuuaaaaauguuuuuaguuaaacguugaggagaaaaaa

SEQ ID NO: 121157 - RNA, 64 nt, hsa
uauuucuguccuggcagcauguuccagcucuugauguuuuuaaacuuuuuuuuagaagaaaaau

SEQ ID NO: 121158 - RNA, 64 nt, hsa
uuucuuaaaacacugaaugaauuuugaagcuuaauguuuuuaaaggcauaguuuuaucuuugac

SEQ ID NO: 121159 - RNA, 64 nt, hsa
ccaaugccuuuuuaaaauaaagcuucuguggucuuguuuuuaauggcucaacugucugauguaa

SEQ ID NO: 121160 - RNA, 64 nt, hsa
auccuagcucuuugucaaagauggucuguagaaauguuuuuaaagauuagggaugcuguacuuu

SEQ ID NO: 121161 - RNA, 64 nt, hsa
cauuuuacucucaaaggucuccuuaaauugggcuuguuuuuacuuguccuauuuaauuccccac

SEQ ID NO: 121162 - RNA, 64 nt, hsa
gcaaaagaaccaagacagaauguauaugaagaauuguuuuuaauuuuguaaauuaaaaaaaaau

SEQ ID NO: 121163 - RNA, 64 nt, hsa
aauguaccaucaagagucauguauguuuuauuuuuguuuuuauuuuuuauuuuuugagauggag

SEQ ID NO: 121164 - RNA, 64 nt, hsa
acaggugcacgccaccacgcccggcuaauuuuuguguuuuuagcagagacaggguuucaccacg

SEQ ID NO: 121165 - RNA, 64 nt, hsa
ugaacucaaaauguauuugaucacaguucuauaauguuuuuaccuaccuauuauggaauaauca

SEQ ID NO: 121166 - RNA, 64 nt, hsa
auaaucuucagugagaucuuuuuauaaaacuucuuguuuuuaggauucccuuugcuucuuccuu

SEQ ID NO: 121167 - RNA, 64 nt, hsa
gcucuaucaugucuagcauaauuuaaaaaaucaguguuuuuaggauuugggaaaauaaacugua

SEQ ID NO: 121168 - RNA, 64 nt, hsa
auacacaauaaacacuaauccuccaaacuuucacuguuuuuauuaguaugaauauaaaauuuga

SEQ ID NO: 121169 - RNA, 64 nt, hsa
uuauaacuuauugagcacuuuuaguagugauaacuguuuuuaaacuugccuaauaccuuucuug

SEQ ID NO: 121170 - RNA, 64 nt, hsa
uuuuuauugucuacaaaccauuaaauguaaauauuguuuuuagagucagucauuggcuuuguca

SEQ ID NO: 121171 - RNA, 64 nt, hsa
uauuuuauacauacguauuauauagagaaacaaauguuuuuauuaaauguuucauugacccaag

SEQ ID NO: 121172 - RNA, 64 nt, hsa
auuuuuuaccauuuuauggaaaauauuuaaaaucuguuuuuacaggguuuuuuuuuuuuuuuuu

SEQ ID NO: 121173 - RNA, 64 nt, hsa
ugugacuauaagcuuugugcuuagagaauguauguguuuuuaucugucaguaugggaggauaua

SEQ ID NO: 121174 - RNA, 64 nt, hsa
uuucaagugaaucuaaaagcuuuugcuuuuccuuuguuuuuaugaagaaaaaauacauuuuaua

SEQ ID NO: 121175 - RNA, 64 nt, hsa
uuauauuagaaguguuaacuuagcuugaaggaucuguuuuuaaaaaucauaaacugugugcaga

SEQ ID NO: 121176 - RNA, 64 nt, hsa
auauguuaugagaaguugcugauuaaaucagugcuguuuuuacaccacuucuggccaacucaga

SEQ ID NO: 121177 - RNA, 64 nt, hsa
auuuuuuuauuauggugcagcuuuuuuuuaauuauguuuuuaaaauuauacaguugaaaaauau

SEQ ID NO: 121178 - RNA, 64 nt, hsa
agagcugaguaaaaugaaggaaaagcauguuauguguuuuuaaggaaaaugugcacacauauac

SEQ ID NO: 121179 - RNA, 64 nt, hsa
ugcuauaccaugcgucugucguugugcuuuuuucuguuuuuagaccaauuuuuuacaguucuuu

SEQ ID NO: 121180 - RNA, 64 nt, hsa
gguaacgagggcaacagggagcaccugucuggauuguuuuuaaaccuccauacucaagcugucu

SEQ ID NO: 121181 - RNA, 64 nt, hsa
uugaaccaacaucuuuuuuauuauauucagaguauguuuuuaaguguaucuuaauauauacauu

SEQ ID NO: 121182 - RNA, 64 nt, hsa
auuucuucgugaacauagaguuuggggccgaaaauguuuuuaaaguauguguuugaguuaaaua

SEQ ID NO: 121183 - RNA, 64 nt, hsa
guuugauuucaaagcaagucaaccugcuuuuuucuguuuuuacaguggaaucuaggaggccacu

SEQ ID NO: 121184 - RNA, 64 nt, hsa
caggugcccgccaccacacccggcuaauuuuuuguguuuuuacaaaauacaaaaaaguagagac

SEQ ID NO: 121185 - RNA, 64 nt, hsa
uuuuacaauucugagugaucuuagaaaucauuucuguuuuuacaaacaaggaaacugaggucca

SEQ ID NO: 121186 - RNA, 64 nt, hsa
aaacaaaguggacuugauuuuuauuaaggcuguuuguuuuuaaguguugauagugaacgaaaag

SEQ ID NO: 121187 - RNA, 64 nt, hsa
auuacaggcaugaaccaccacgccuggccuaaaauguuuuuaaauaacuguacuuguacucacu

SEQ ID NO: 121188 - RNA, 64 nt, hsa
gcguccgccaccaugccuggcuaauuuuuuuguguguuuuuaguauagacacgguuucaccaug

SEQ ID NO: 121189 - RNA, 64 nt, hsa
uuuuccacuuuugaucuauuuauauauauguauguguuuuuaaaauauguguauauuuuaucag

SEQ ID NO: 121190 - RNA, 64 nt, hsa
gagcacauaacaauagaugauaccaaauacuuuuuguuuuuaacacagcuauccaguaaggcua

SEQ ID NO: 121191 - RNA, 64 nt, hsa
uauuuugauaauauuuuuacagugagcuuucccauguuuuuaugucuuaaguuucuuugcugcg

SEQ ID NO: 121192 - RNA, 64 nt, hsa
aagauauuucauagacaaaccaaacaaaaauauauguuuuuacuuuaaagugaauguuuuucuc

SEQ ID NO: 121193 - RNA, 64 nt, hsa
uuuacauguuuauaaaucuuaugcucucacuguuuguuuuuauuuaaauuacaauuuuaucugu

SEQ ID NO: 121194 - RNA, 64 nt, hsa
uggaacaaauuauuuuuggugugugugacaauucuguuuuuaaugcuauuugaacaagugggcc

SEQ ID NO: 121195 - RNA, 64 nt, hsa
ggagcaauaaccagcccuuuuuuuucugaaggcuuguuuuuaguccucauuguacaaaauauaa

SEQ ID NO: 121196 - RNA, 64 nt, hsa
aauaggauauaaaagggacaaaaaauaaguagacuguuuuuaugugugaauuauauuucuacua

SEQ ID NO: 121197 - RNA, 64 nt, hsa
uuaaucacaaaguguguggguuuggguuauuucuuguuuuuauuuuucuguccagaagagcuuu

SEQ ID NO: 121198 - RNA, 64 nt, hsa
aaugguaugaaagguaaugugauuauugcagggguguuuuuaaaucuuggguauaaauucuagg

SEQ ID NO: 121199 - RNA, 64 nt, hsa
aauuuuaucuugccuugucucuugccauauuugcuguuuuuauggauaaauaagauuuaugguu

SEQ ID NO: 121200 - RNA, 64 nt, hsa
acgggugcgugccaccaugccuggcuaauuuuuguguuuuuaguagagacaggguuucaccaug

SEQ ID NO: 121201 - RNA, 64 nt, hsa
cuacaccccacagggcccccuacuucuucggauguguuuuuaauaaugucagcuaugugcccca

SEQ ID NO: 121202 - RNA, 64 nt, hsa
acauugacagauugaauuugccuaauaugaugacuguuuuuaauauggaucuguauguguucua

SEQ ID NO: 121203 - RNA, 64 nt, hsa
guaaaaaaugguguuuuaucuucuauauaauuccuguuuuuauuauuaacaaaacaguccuaaa

SEQ ID NO: 121204 - RNA, 64 nt, hsa
gauacuuauuuaaauagaugacauugacuauuuuuguuuuuauuaaaaggaagcuuacaugccu

SEQ ID NO: 121205 - RNA, 64 nt, hsa
auucuuaauaucaacuguuugguaagaguacaguuguuuuuauacacucuaagaaauguguuua

SEQ ID NO: 121206 - RNA, 64 nt, hsa
aguguuucacuaggaacaccucuacuugaaccaauguuuuuauuucauauauuuuauaguuuug

SEQ ID NO: 121207 - RNA, 64 nt, hsa
gucagugagaaaaauuuaucaaugcuuuuuaauguguuuuuacccuugccucacugugugugug

SEQ ID NO: 121208 - RNA, 64 nt, hsa
guaaugaaaauucuauuuuuuuuagaauugguuuuguuuuuauucuauuauccuuuauuuccag

SEQ ID NO: 121209 - RNA, 64 nt, hsa
uuuuuuuuuuuuuuuuuuuuuuugaguuguuguuuguuuuuagauccacaguacaugagaaucc

SEQ ID NO: 121210 - RNA, 64 nt, hsa
ccauggcaaccauaacuuuugaaccaaaaaaaauuguuuuuacaucuuuaugcugaaaaugugu

SEQ ID NO: 121211 - RNA, 64 nt, hsa
uuguuuuguuacucauagaacugguguuguuugcuguuuuuauuucucuaauuguugcagaguu

SEQ ID NO: 121212 - RNA, 64 nt, hsa
gaguucugccuguuacaaagcuacagaacuguauuguuuuuauuuuccuucuugagcacauguu

SEQ ID NO: 121213 - RNA, 64 nt, hsa
auuuuaaaauuuaugaaaucuauauuccagguauuguuuuuagucugaaaaacaaacuccccca

SEQ ID NO: 121214 - RNA, 64 nt, hsa
uaggugaugguugguugaaaggaauuguuauugcuguuuuuauuuuuuacuuuuuuugagacag

SEQ ID NO: 121215 - RNA, 64 nt, hsa
caggcaugagccaccgcgcccggccccaaucaucuguuuuuaaacaaucguuuuugagcagaua

SEQ ID NO: 121216 - RNA, 64 nt, hsa
uucaccccucucugguacuuguggcuugcuaguauguuuuuaugauaaucucgggcauuguuug

SEQ ID NO: 121217 - RNA, 64 nt, hsa
ggcauuguuugcauuguguuuauuaauaggguuuuguuuuuauuguuuccuuuuuuacaguaaa

SEQ ID NO: 121218 - RNA, 64 nt, hsa
aguuaauaaaaaacagaguauuuuauguaauuucuguuuuuaaaaagacauuauuaaauggguc

SEQ ID NO: 121219 - RNA, 64 nt, hsa
gcuuuccuauaaauguuuggguuguguuugguauuguuuuuagugguuaauaguuuuccaguug

SEQ ID NO: 121220 - RNA, 64 nt, hsa
uuaauguauuuucauacuacauacugaauuuguauguuuuuaaaauuguuacaucuagacaacu

SEQ ID NO: 121221 - RNA, 64 nt, hsa
auauauuguuacuuuaacagaacuugcauuauuuuguuuuuaauaaauauaaacaugaaauuuu

SEQ ID NO: 121222 - RNA, 64 nt, hsa
uguuuccuaaaugaaacauuuguacaacauuugauguuuuuacuuaugaaauauucuccucccc

SEQ ID NO: 121223 - RNA, 64 nt, hsa
caugcuuaauugugaucacuuucuugcacugugauguuuuuacgugaauauguugaaguagaag

SEQ ID NO: 121224 - RNA, 64 nt, hsa
cauuuaaugaagccuauuuuucuguuccagcaacuguuuuuaugaaagaaaaacuugaaaugcu

SEQ ID NO: 121225 - RNA, 64 nt, hsa
auaggugccugccaccaugcccagcuaauuuuuguguuuuuaguagagauggagucucaccaca

SEQ ID NO: 121226 - RNA, 64 nt, hsa
gacuuuucuauuucaaguaaagcuuugaguuacuuguuuuuauacauauucaucauguacccuu

SEQ ID NO: 121227 - RNA, 64 nt, hsa
guuuuuucuuaaaauuuauuuuaacuugacaguauguuuuuaguucccccaauuuaauuaaugg

SEQ ID NO: 121228 - RNA, 64 nt, hsa
auugacucugaguguaagagaguauguguuuuuuuguuuuuaguucugcucuagaucauaauug

SEQ ID NO: 121229 - RNA, 64 nt, hsa
ucuuuccagcuugccuguuuuugaguauguuugauguuuuuaaaauuuugucuucucuguggaa

SEQ ID NO: 121230 - RNA, 64 nt, hsa
gugucucccccuaggugcaauuagguuguuucuuuguuuuuaguuucaauucuaugugcauagc

SEQ ID NO: 121231 - RNA, 64 nt, hsa
agugaugcaauuuauugauuagugaguaagauacuguuuuuauugagagauuugauuuuuauaa

SEQ ID NO: 121232 - RNA, 64 nt, hsa
uuccugcauuacaagguaaaaauuuguuaauguuuguuuuuauucagcuugggaaagcuuugug

SEQ ID NO: 121233 - RNA, 64 nt, hsa
uuauuugcuuuaaauuugcuggcuacccuagauguguuuuuauuccugguaaagacauuuguga

SEQ ID NO: 121234 - RNA, 64 nt, hsa
guuauaucaaugucagccuauuuugauuaacaaauguuuuuaaaguauuauugguuauagaaac

SEQ ID NO: 121235 - RNA, 64 nt, hsa
uccuguugaacuugcaucuuuccacaggacuuucuguuuuuagggaugagacuauucucugcuu

SEQ ID NO: 121236 - RNA, 64 nt, hsa
aaagaccgcaacaccugaauccuggguuuuguaauguuuuuauguccugacucacauucuguca

SEQ ID NO: 121237 - RNA, 64 nt, hsa
caaauaguugcauagcaguauauguuaauuuguguguuuuuagcugugacacaacugugugauu

SEQ ID NO: 121238 - RNA, 64 nt, hsa
cauuaugucaaccagguccagaugugcuauaaucuguuuuuacguauguaggcccagucgucau

SEQ ID NO: 121239 - RNA, 64 nt, hsa
aaauaugauuuuaaugcuuuaaucucauguaguuuguuuuuaauuucaagcaaaaucuuacugu

SEQ ID NO: 121240 - RNA, 64 nt, hsa
aauuuuguacagauaccaacuucugaaaagcugguguuuuuacaacuagcauugaaugcagucc

SEQ ID NO: 121241 - RNA, 64 nt, hsa
acagaggcacuuaauuugaucuuuuauuuuucuuuguuuuuauuuuuuuuuuuauuuagaugac

SEQ ID NO: 121242 - RNA, 64 nt, hsa
ugugcuauuuguguuaacauggaagaggauucauuguuuuuauuuuuauuuuuuuaauuuuuuc

SEQ ID NO: 121243 - RNA, 64 nt, hsa
uagauuaucuauuuuucucccaugauaacuaaucuguuuuuaguaucagcagcauuuggcaagu

SEQ ID NO: 121244 - RNA, 64 nt, hsa
caaauucauacuaauuacccgcgugaaagguguuuguuuuuaacaacauugaagauaaucagga

SEQ ID NO: 121245 - RNA, 64 nt, hsa
uauuuuauuuccuuuuauuaaaaaauuacuucuauguuuuuauugucucuugagccuuaguuaa

SEQ ID NO: 121246 - RNA, 64 nt, hsa
cagauaacauuuuaguuucaaguuuguaugguaguguuuuuauagauaagauacgucuauuuuu

SEQ ID NO: 121247 - RNA, 64 nt, hsa
aguacaguagccaaggaauacaaacauaauugcauguuuuuaaaaauuccuuggaggcuggaag

SEQ ID NO: 121248 - RNA, 64 nt, hsa
ggcaaaaugugaguaaauugaaaccaagaaaacuuguuuuuagaauauuucgucugaauaagua

SEQ ID NO: 121249 - RNA, 64 nt, hsa
ccagugugacuuuaucuucugggugguuugauaguguuuuuaaaaguaauauauaauguggggu

SEQ ID NO: 121250 - RNA, 64 nt, hsa
ugugaauaggcuggcugugccuguagagcucuuguguuuuuagugaugacaugaaauacaaaga

SEQ ID NO: 121251 - RNA, 64 nt, hsa
ucugugcaccuuauuugaccacacuccaaaauucuguuuuuauuuuaacccuugaaucugcuuu

SEQ ID NO: 121252 - RNA, 64 nt, hsa
ugggguuuauguuuuuuaagguaaauacggguauuguuuuuaauuauuaccauguauuaaauug

SEQ ID NO: 121253 - RNA, 64 nt, hsa
guaaagauaacaggaaaauaaguuuugauugcauuguuuuuaaaauaagcuaguuuucugaggu

SEQ ID NO: 121254 - RNA, 64 nt, hsa
gugaagaguaauuugguacaaugaaggcaguguuuguuuuuaaguuaaaggaaaugggcuaaac

SEQ ID NO: 121255 - RNA, 64 nt, hsa
ggcuguagugauuccuggggccagaguggcauuauguuuuuacaaaauaaugacauaugucaca

SEQ ID NO: 121256 - RNA, 64 nt, hsa
caggauaguuuuguuuaaauucuugcagauuacauguuuuuacaguggccugcuauugaggaaa

SEQ ID NO: 121257 - RNA, 64 nt, hsa
augaaugggacccggauuugggggguuguuuguuuguuuuuagaacauagaguggcauggccgu

SEQ ID NO: 121258 - RNA, 64 nt, hsa
uuuauuucaguuaacaagauacuuugacuugaaguguuuuuaguguaucccuaugaaaaucauu

SEQ ID NO: 121259 - RNA, 64 nt, hsa
gaaauuaggaacacugcuauuuuuuucuuaaaaauguuuuuaagaauauguucguuucuuugac

SEQ ID NO: 121260 - RNA, 64 nt, hsa
ggagcaaaagcugacuuuuaaacuugaccccugcuguuuuuaaacagcuuuuccuuuuggucuc

SEQ ID NO: 121261 - RNA, 64 nt, hsa
aaagcaccugaugcugcaucacaacugcaauguuuguuuuuauuuuuggcuuuaugucuauacu

SEQ ID NO: 121262 - RNA, 64 nt, hsa
guauuuucaaaaugaauuuuaaguagauauuugguguuuuuaucuugucaaagacaguuucaaa

SEQ ID NO: 121263 - RNA, 64 nt, hsa
gaugagguuuuaaccauuauucaggguggucuuuuguuuuuaaaucuuuuuuuaacuaauaaga

SEQ ID NO: 121264 - RNA, 64 nt, hsa
acgguguguauuuuauacagaaaugcauuauaaauguuuuuaauuguguucuguuuuuugcagu

SEQ ID NO: 121265 - RNA, 64 nt, hsa
augcuuguucagugccgguacauuuacuuaaaucuguuuuuauuuuugucauguagaauacuac

SEQ ID NO: 121266 - RNA, 64 nt, hsa
uuuauuaucugcaagguuuuuuuguguguguuuuuguuuuuauuuucaauaugcaaguuaggcu

SEQ ID NO: 121267 - RNA, 64 nt, hsa
agcaauuucauucaaaaugccaacuggagaagucuguuuuuaaauacauuuuguuguuauuuuu

SEQ ID NO: 121268 - RNA, 64 nt, hsa
caauccuauaaggcacagggaacaagcauucuccuguuuuuacagauuguauccugaggcugag

SEQ ID NO: 121269 - RNA, 64 nt, hsa
cacauauaaagcuuugucuuuuuguuguuguuguuguuuuuaagauggaguuucccucuguugc

SEQ ID NO: 121270 - RNA, 64 nt, hsa
caaugcgaauuuccccuucuacauugucuaucccuguuuuuauaugucuccauucuuuuuaaaa

SEQ ID NO: 121271 - RNA, 64 nt, hsa
aaaguuguuuuguuuguuuucaguaauauuuugcuguuuuuaagacuuggaaaacuaagugcag

SEQ ID NO: 121272 - RNA, 64 nt, hsa
aaaccacuggaacucuuguccaguuuuuaaauuauguuuuuacuggaauguuuuugugucagug

SEQ ID NO: 121273 - RNA, 64 nt, hsa
cucuuagagguuaaucagaguaucugaagggaauuguuuuuauaaaaacauugaaauauuaguu

SEQ ID NO: 121274 - RNA, 64 nt, hsa
aguguuuaaaagcaaauacugauuuucaaaaaaauguuuuuaaaaaccuauuuugaaaggucag

SEQ ID NO: 121275 - RNA, 64 nt, hsa
uggcuaugaaaacagcuauuuuguuacagcuggcuguuuuuauaaguguaucacaauuuucuuu

SEQ ID NO: 121276 - RNA, 64 nt, hsa
ccuuguauuauauggcacugccguaauucaaauuuguuuuuauuuuggaaauaaaaguucacug

SEQ ID NO: 121277 - RNA, 64 nt, hsa
uuaauugggagauaaugaaaccaaucauggaugcuguuuuuauugggcaugucaucuaagagag

SEQ ID NO: 121278 - RNA, 64 nt, hsa
aauggagauuuuggugggaggaggagaaaacaauuguuuuuaaaucacacagcucaacgguuga

SEQ ID NO: 121279 - RNA, 64 nt, hsa
aauguugaagauguagaacuuuguuuuuaaauaauguuuuuauaauuucauucguauaccuaag

SEQ ID NO: 121280 - RNA, 64 nt, hsa
ccuuuuuuggcccaauguugaagauguagaacuuuguuuuuaaauaauguuuuuauaauuucau

SEQ ID NO: 121281 - RNA, 64 nt, hsa
auuuggauauauagcuaucacauuuguaagauucuguuuuuagcauaaaaaucaauagggauga

SEQ ID NO: 121282 - RNA, 64 nt, hsa
agcaacgccagacuauauuaagguaaguagaaaguguuuuuauagggcuucaauacccaggugg

SEQ ID NO: 121283 - RNA, 64 nt, hsa
ccucucacaaaggaaaaugacuucaguauagauuuguuuuuauuaaaaugcauuuuuuauucuu

SEQ ID NO: 121284 - RNA, 64 nt, hsa
uugagauauuuaaaguuuuggcaguaaaauacucuguuuuuaaguaugaauguauuucauucau

SEQ ID NO: 121285 - RNA, 64 nt, hsa
aauuuugguuuaucuuggcauauauccuucaguuuguuuuuauuuuuaauuuuuccuuuuuuuc

SEQ ID NO: 121286 - RNA, 64 nt, hsa
aaguuuucuguaccuugugaugaauguuaauagguguuuuuauuauacaaagcugaaugucauu

SEQ ID NO: 121287 - RNA, 64 nt, hsa
uuaaggaaguuugauuuuuguuuuuguaaugcacuguuuuuaaucucucucucuuuuuuuuuuu

SEQ ID NO: 121288 - RNA, 64 nt, hsa
aaguaauuauaaauacguauuacaaacaaguggauguuuuuaaugaccaauugaguaagaacau

SEQ ID NO: 121289 - RNA, 64 nt, hsa
augccaccuaugagugccagugacuuauuuuacuuguuuuuaauuauucauucauggcaauuua

SEQ ID NO: 121290 - RNA, 64 nt, hsa
aaguagcuauaccguagucaaaccaaugcaguauuguuuuuacauugaaucucaguaaagauuu

SEQ ID NO: 121291 - RNA, 64 nt, hsa
gauuguaaaauagugaaauuuuaauguguucauuuguuuuuaauguauauaugucuugcucaga

SEQ ID NO: 121292 - RNA, 64 nt, hsa
cuggauuuuuuuuaauaauuagugauauaagcauuguuuuuauugcagccauauccacuuaucc

SEQ ID NO: 121293 - RNA, 64 nt, hsa
gagaugugcgugcaaagaauaaucgcugcaguuuuguuuuuaugugugaaacguugagaacaau

SEQ ID NO: 121294 - RNA, 64 nt, hsa
gacauguuaauucaauucuagaaauccucagaaauguuuuuauauuaugcagagaugugcgugc

SEQ ID NO: 121295 - RNA, 64 nt, hsa
guggaccagucugaaugucuuuccuuuacaccuauguuuuuaaguagucaaacuucaagaaaca

SEQ ID NO: 121296 - RNA, 64 nt, hsa
uucauaaaaaacuuucaagauccaaacauuaauuuguuuuuauuuauucugagaaguugaggca

SEQ ID NO: 121297 - RNA, 64 nt, hsa
acauauggcuucuuaaaacuugggcacuuuuauuuguuuuuaucccaaauucauguuuuaaggc

SEQ ID NO: 121298 - RNA, 64 nt, hsa
uucuguuuacauauacuuuuuuuuaauagcaauguguuuuuauuaaacaugcugugugccacag

SEQ ID NO: 121299 - RNA, 64 nt, hsa
cuguauuucuugguaucauguugcuuccaaauuuuguuuuuacuguagaagacaauuaauuuau

SEQ ID NO: 121300 - RNA, 64 nt, hsa
auguguauaauuauugccucauaaacucucucuuuguuuuuaaaggaaacaucuauuaugguaa

SEQ ID NO: 121301 - RNA, 64 nt, hsa
auuuguuuacuguugugaauuuuuccuacagcacuguuuuuaaucuugauguuuuccaacuuuc

SEQ ID NO: 121302 - RNA, 64 nt, hsa
aaguagcaggguggucagggugggagacacaagauguuuuuauagucuagagccuuuaaaaaac

SEQ ID NO: 121303 - RNA, 64 nt, hsa
guauugucuuguuuuuaaaaaauacaguuccuaguguuuuuagaagucacuuaauuugucucau

SEQ ID NO: 121304 - RNA, 64 nt, hsa
aagaauuaaagcaagaaaaucugaaguauugucuuguuuuuaaaaaauacaguuccuaguguuu

SEQ ID NO: 121305 - RNA, 64 nt, hsa
acaguuauuauuauuuaaaauuacuucaacuuuguguuuuuaaauguuuugacgauuucaauac

SEQ ID NO: 121306 - RNA, 64 nt, hsa
aucacaaucauuuuauggaagaugugugauaaucuguuuuuacugguauuaauaaacacauaca

SEQ ID NO: 121307 - RNA, 64 nt, hsa
uauaccuguaucucccaacuagaaacagcuccaguguuuuuaagagaauguuucuuaaaaccaa

SEQ ID NO: 121308 - RNA, 64 nt, hsa
caguguggaguguauuggggauuuuguuauauuuuguuuuuaucuggauuguuuuuguccuagg

SEQ ID NO: 121309 - RNA, 64 nt, hsa
cucuauacacuugauaaggguaaauuuaucuuaguguuuuuaaacuugguuuugguuacuugag

SEQ ID NO: 121310 - RNA, 64 nt, hsa
uuguggcccauuuaugaaguccccaaaagaguuauguuuuuaagugccuuggcaggcucacuuc

SEQ ID NO: 121311 - RNA, 64 nt, hsa
cccuuucaagccuuauacaguaguacacuguacuuguuuuuaguaguaagaccuacuuucccac

SEQ ID NO: 121312 - RNA, 64 nt, hsa
gucaauaacacuguauuuuaauguacuugaaaaauguuuuuauuuuuguuuuauuuuugacaga

SEQ ID NO: 121313 - RNA, 64 nt, hsa
cuuguacaaacaguauuucugguguauauuuuaauguuuuuaaaaagaguaauuucauuuaaau

SEQ ID NO: 121314 - RNA, 64 nt, hsa
uuucuuuaaauuucugccugucagucuauauugcuguuuuuauuauacaucaguuucuuuguau

SEQ ID NO: 121315 - RNA, 64 nt, hsa
guuucuuuguauaacuugugaguuccauguguuuuguuuuuauuauguaaauaucauuauaaau

SEQ ID NO: 121316 - RNA, 64 nt, hsa
gacccuuauacuucaagagaacacacucagugcuuguuuuuauuuucuugacacauuuauuaac

SEQ ID NO: 121317 - RNA, 64 nt, hsa
aaaagaauugaugcuagagguaaaaaaaaauacuuguuuuuaaaaaauccuuuacgucuugugu

SEQ ID NO: 121318 - RNA, 64 nt, hsa
uucagcaucacugugucuguauuucaaguacaaauguuuuuaaaaaggauucuuuauacauaug

SEQ ID NO: 121319 - RNA, 64 nt, hsa
uuuaaaaaguccacaagaaugaucaaguaagauuuguuuuuauucuuacagacaucacccgugu

SEQ ID NO: 121320 - RNA, 64 nt, hsa
auauucucacuugaaugaagauuguuuuuuucuuuguuuuuacugguaguguucugauuuguga

SEQ ID NO: 121321 - RNA, 64 nt, hsa
caaagucuugaguucuguauauggccugguuucuuguuuuuauuaauagaugguuuauuuacua

SEQ ID NO: 121322 - RNA, 64 nt, hsa
uuuauuggaacuugauuuuccuggaugcuuucaauguuuuuaaugcuaacauagaccccaaaau

SEQ ID NO: 121323 - RNA, 64 nt, hsa
ugaggacaaaaucuuaaauaugugcuauuagcauuguuuuuagacuaguaauaugcagaaaaca

SEQ ID NO: 121324 - RNA, 64 nt, hsa
accaccuugcagacaaaaucucucucucucuuuuuguuuuuauagaaaagaagugauaguaguu

SEQ ID NO: 121325 - RNA, 64 nt, hsa
aaaagaugaugaaaaugcagaaugucuuuuuaaauguuuuuaaauauaaacaaauauucuuuac

SEQ ID NO: 121326 - RNA, 64 nt, hsa
caugaaguucuuuugagaggagaggcuauuuugauguuuuuauacaacugaagguuaacagcca

SEQ ID NO: 121327 - RNA, 64 nt, hsa
aaauuggauugacuuacuaccuaacacugagcgcuguuuuuaaaugaaaagaaugagauuuaua

SEQ ID NO: 121328 - RNA, 64 nt, hsa
aagcaaauaaaaucaaaagucauguuuaaagacguguuuuuaaaauuccacuaucccuuuucua

SEQ ID NO: 121329 - RNA, 64 nt, hsa
aucuugacuugacuuuuuuaugcaugcaaaucauuguuuuuacagaguuugugauaacucauaa

SEQ ID NO: 121330 - RNA, 64 nt, hsa
ucuuagaacuuaggugguagucaugaagagauaauguuuuuaggcaguuaaaauacuucuagaa

SEQ ID NO: 121331 - RNA, 64 nt, hsa
ugcagucuaugcacaacacuauauuuccauguaauguuuuuauuucagcccuauuuguauuauu

SEQ ID NO: 121332 - RNA, 64 nt, hsa
ugagccuuguaaugauguauauuuaaguuauuuuuguuuuuauagauuaaaguaagauuaaaau

SEQ ID NO: 121333 - RNA, 64 nt, hsa
ccauuugaauuaauaacaugaaaagaguauacuguguuuuuaaauccguguuucuuugaauuua

SEQ ID NO: 121334 - RNA, 64 nt, hsa
gauuaaccaggaaagaaagcuuuucucacugaguuguuuuuauguauugauggggacuuuucca

SEQ ID NO: 121335 - RNA, 64 nt, hsa
auacugaaacccaaugguguuuuuaaacuguuucuguuuuuauucaucuuuuguaacuaugaca

SEQ ID NO: 121336 - RNA, 64 nt, hsa
aaagagguaucaaguaaauacugaaacccaaugguguuuuuaaacuguuucuguuuuuauucau

SEQ ID NO: 121337 - RNA, 64 nt, hsa
gcuuacauguuuugaaaauccuuguacuuauuuuuguuuuuauuguugcaaaaaaauguuaaug

SEQ ID NO: 121338 - RNA, 64 nt, hsa
uacucauuuugcuuucaaucacuagagugcauuauguuuuuaaugcaaguuugucugggauguc

SEQ ID NO: 121339 - RNA, 64 nt, hsa
aaagaauggggauggggagagcuacgugguaguauguuuuuauuaggagaauaaugcaauaaaa

SEQ ID NO: 121340 - RNA, 64 nt, hsa
aagacaagucucgguguucccuuuauucuuaguuuguuuuuaaauauuaauuuuggcauucuaa

SEQ ID NO: 121341 - RNA, 64 nt, hsa
gaagugagaaguucauauuucuuuggcuuuuuuguguuuuuaaaaguuacuccuuuuagggagc

SEQ ID NO: 121342 - RNA, 64 nt, hsa
accuguguauuuuuuaaagcuacaaucuguucaauguuuuuaaaaaucuguuuauaugacauug

SEQ ID NO: 121343 - RNA, 64 nt, hsa
uaauuuuggaaacagaaggagaagcacugccauuuguuuuuauuucaacaauuggaaaaauuac

SEQ ID NO: 121344 - RNA, 64 nt, hsa
auuauuggaauucagacacuguucuuaccguguuuguuuuuaaucaaauauuaccuaaaaaugu

SEQ ID NO: 121345 - RNA, 64 nt, hsa
auaaacuuauagaaugucaaacuuugccuucaacuguuuuuauuucuagucucuuccacuuuaa

SEQ ID NO: 121346 - RNA, 64 nt, hsa
aaugguuaaauggaccacugguuucuuagagaaauguuuuuaggcuuaauucauucaauuguca

SEQ ID NO: 121347 - RNA, 64 nt, hsa
agauuuaaugauuucaaagaaaauaaugguucuuuguuuuuaauguuaaccuuuuuuaaauaca

SEQ ID NO: 121348 - RNA, 64 nt, hsa
uuuuauuccauucaauaaagaacaaaaccaauaguguuuuuauuacuuucaucugaaacauucc

SEQ ID NO: 121349 - RNA, 64 nt, hsa
gcagaaagacuuuuguuuuacugaagacaaaagauguuuuuauuuuagacccagaagagaggag

SEQ ID NO: 121350 - RNA, 64 nt, hsa
agcugguauuuaagaugcuuguaaauacuauuuauguuuuuaauuuuguaaaauaaagauuucu

SEQ ID NO: 121351 - RNA, 64 nt, hsa
ccccuuguuagauuuuuuuuaaauuuuaucuuacuguuuuuauaauuucuauugggaagaggcu

SEQ ID NO: 121352 - RNA, 64 nt, hsa
aggauucugcugguacgagaggccuuccucuuucuguuuuuaaaaaaaguuuuacugccauauu

SEQ ID NO: 121353 - RNA, 64 nt, hsa
cauuccucugguccuaaauauacaaacuuauucauguuuuuaggugaugauggucauugaaacu

SEQ ID NO: 121354 - RNA, 64 nt, hsa
uuauaauuaucucauuuguuaaggcugagaagguuguuuuuauaauagguaauuauauugaaug

SEQ ID NO: 121355 - RNA, 64 nt, hsa
ccuaugaauuuaaaaccagguuuaccauguaauuuguuuuuaaauuuauguauacuagccuggc

SEQ ID NO: 121356 - RNA, 64 nt, hsa
uauccaauauggacaaucauauuuacaaaauugauguuuuuauaaucaaauguauuuuuuuacu

SEQ ID NO: 121357 - RNA, 64 nt, hsa
uaaauguuaguuuugacuucaucuauuuuuuauuuguuuuuauuagcguagaguaggaagucuc

SEQ ID NO: 121358 - RNA, 64 nt, hsa
gacaaaguggaacaguggagcuguuuuuugcuuuuguuuuuauuuauuuuuugccacuggugau

SEQ ID NO: 121359 - RNA, 64 nt, hsa
guuuugcuguuguuuaggaguaggugguuguuguuguuuuuacuuuuuuuuuuuuuggcuuuug

SEQ ID NO: 121360 - RNA, 64 nt, hsa
ggauuuuuuauuuuauuuuuuauuuuguuaauuauguuuuuaggggaugggagguggugugugu

SEQ ID NO: 121361 - RNA, 64 nt, hsa
uuguuguugucauugcgugugugugguuuguguguguuuuuaaugagaaucuuguuuuaaaaug

SEQ ID NO: 121362 - RNA, 64 nt, hsa
auuaccuagaacccuuccugcaguauucauacaguguuuuuauuuuguuguugucauugcgugu

SEQ ID NO: 121363 - RNA, 64 nt, hsa
gauauauuaauuggaauuccuuugcauaggagaauguuuuuaugaucuguuuagugcuuauuau

SEQ ID NO: 121364 - RNA, 64 nt, hsa
gcaacuauaggugugugccacuacaccuggcuaauguuuuuaguuuuuuagagauggagucuug

SEQ ID NO: 121365 - RNA, 64 nt, hsa
cagagggucaagaagugacuuguucagaacacauuguuuuuaacagaaaaaaaaucuuuuuaua

SEQ ID NO: 121366 - RNA, 64 nt, hsa
gccucugcuucuuaagcuuuccugcugcucgcuuuguuuuuaaaaguaacuuggguugcauucu

SEQ ID NO: 121367 - RNA, 64 nt, hsa
aagggacugcagaggcgggcaagcccucucuauguguuuuuauccccaccuuccccggaaucug

SEQ ID NO: 121368 - RNA, 64 nt, hsa
auccccaccuuccccggaaucuggggagggcuuuuguuuuuacguuuucaaguucagcauugua

SEQ ID NO: 121369 - RNA, 64 nt, hsa
auaccccaagguaauaggaaaaguuugaguuaaguguuuuuaauucagucagugaauucagaau

SEQ ID NO: 121370 - RNA, 64 nt, hsa
auagauaaauucuuguaacauuaaaggauuaaaauguuuuuacauuguuuuugggugucuccuu

SEQ ID NO: 121371 - RNA, 64 nt, hsa
aguauuugugcagaaaaacaaguccuaaaguauuuguuuuuauuuguaccauccacuugugccu

SEQ ID NO: 121372 - RNA, 64 nt, hsa
guugcauuuuaaucaguaaucuaccugguggauuuguuuuuaaccaaaaagaugaauuaucaau

SEQ ID NO: 121373 - RNA, 64 nt, hsa
aguugggguuuauuguacaguuuaaaauguuagauguuuuuaauuuuuuaaauaaauggaauac

SEQ ID NO: 121374 - RNA, 64 nt, hsa
ucucuucaaugacauagaaaguucauggaacucauguuuuuaaagggcuauguaaauauaugaa

SEQ ID NO: 121375 - RNA, 64 nt, hsa
auuuagcauuuuuauuccagccuacuuggaaacauguuuuuauuugcaauauaugccugacuga

SEQ ID NO: 121376 - RNA, 64 nt, hsa
ugugagugguucagucaugagguuuuccaaaagauguuuuuagaguuguaaaaaccauauuugc

SEQ ID NO: 121377 - RNA, 64 nt, hsa
cacugcuaaaaguaggugauauaagaccauuugcuguuuuuauuaaaguauguguguguaucag

SEQ ID NO: 121378 - RNA, 64 nt, hsa
aagcucaucuagggucaccucauuuuccuaaauauguuuuuaaagcaauuauuguaguaauuuc

SEQ ID NO: 121379 - RNA, 64 nt, hsa
uucauuuuaucaaaaauuacccauaacuuucauuuguuuuuauaucgacaaugaagaugaucau

SEQ ID NO: 121380 - RNA, 64 nt, hsa
gcaauuugaaucuuaacuuuccaucagucuucaguguuuuuaaucuaaggaauaauuaucuucc

SEQ ID NO: 121381 - RNA, 64 nt, hsa
agagguuggcuguuuaugguuugcacagugacuuuguuuuuaucugugcucaggcaugauuaca

SEQ ID NO: 121382 - RNA, 64 nt, hsa
guuauuaagucaaaggaacaaugugcaauugauauguuuuuagaugagagagaaaaauuaaagc

SEQ ID NO: 121383 - RNA, 64 nt, hsa
cuuuuguuuuauaguuaugcuuuuuaaaauucauuguuuuuaaauuuagacuucuuauuuccac

SEQ ID NO: 121384 - RNA, 64 nt, hsa
ugcaguuuaucguuuuaaaaauaauccacaaagauguuuuuaucucacauacuuacaacucaac

SEQ ID NO: 121385 - RNA, 64 nt, hsa
gaugucuguacucuauaugugaugcugugcaguuuguuuuuauauggaaagaugucaacuauag

SEQ ID NO: 121386 - RNA, 64 nt, hsa
caucuauuaaguucuggauauuuacagcuucuuuuguuuuuaauugggccagaagauucugcaa

SEQ ID NO: 121387 - RNA, 64 nt, hsa
ggggauggguagagugggaauuuuuuccuaaucauguuuuuaacauuuuaaaauaaaauuuaau

SEQ ID NO: 121388 - RNA, 64 nt, hsa
uugaaauauuuccuagagaauaguaaccagguuuuguuuuuaacuuuaaaaccuaauuacuuuu

SEQ ID NO: 121389 - RNA, 64 nt, hsa
aaauguuaauagaccauauucuuugaauuaaauuuguuuuuaauuuucucuacacauuuuuuuu

SEQ ID NO: 121390 - RNA, 64 nt, hsa
guguggcuaugagaauaugauuuaugccauuuucuguuuuuaaaucuagaagaucuucuaagca

SEQ ID NO: 121391 - RNA, 64 nt, hsa
aggaaaaacugcuggugauacuuuuuuuaaguuuuguuuuuaucuugccuguuggcuucaauac

SEQ ID NO: 121392 - RNA, 64 nt, hsa
ggaaucuaacuuuuuauauugucauuauuauuguuguuuuuaaacgguucuuugucuuuucugu

SEQ ID NO: 121393 - RNA, 64 nt, hsa
guaguuuuauuuccacuaagugaaaaaagaacuguguuuuuaaacuguaggagaauuuaauaaa

SEQ ID NO: 121394 - RNA, 64 nt, hsa
aaagagaugggcauuguuuccccuauaauugugcuguuuuuauaacuuuuguaaauauuacuuu

SEQ ID NO: 121395 - RNA, 64 nt, hsa
uuauaacuuuuguaaauauuacuuuuucuggcuguguuuuuauaacuuauccauaugcaugaug

SEQ ID NO: 121396 - RNA, 64 nt, hsa
uugcucuuuuguguuguacugaacacaauauuuguguuuuuauuauuuaugccacgucaguggg

SEQ ID NO: 121397 - RNA, 64 nt, hsa
gagugagugaagaaagcuaaguugugaacaagaguguuuuuauagcauauguguugaaguaaca

SEQ ID NO: 121398 - RNA, 64 nt, hsa
agugauaaaaggacucuauucacuaaguagccuguguuuuuaaauccagggcugcaggcagcaa

SEQ ID NO: 121399 - RNA, 64 nt, hsa
uuugcauaggacaacuaaccugucuguguaacuuuguuuuuauuuuaacucuuacuagaaaauc

SEQ ID NO: 121400 - RNA, 64 nt, hsa
auuaaacuuugcagaagugauucauauucaguacuguuuuuaaucacuuuuuaaaauauaagga

SEQ ID NO: 121401 - RNA, 64 nt, hsa
guagaauaugcaucaauuucuugaaggagauucauguuuuuauaagaauuuucauguaauuauu

SEQ ID NO: 121402 - RNA, 64 nt, hsa
aaaaaaagccaugauuuauucgaugugauuggcuuguuuuuauguggcgccaagaacgaaccug

SEQ ID NO: 121403 - RNA, 64 nt, hsa
uuuuuuuuucuuuaacagauuuguauuuaagaauuguuuuuaaaaaauuuuaagauuuacacaa

SEQ ID NO: 121404 - RNA, 64 nt, hsa
uacauuuugcuuuuuaaaguugauuuuuuucuauuguuuuuagaaaaaauaaaauaacuggcaa

SEQ ID NO: 121405 - RNA, 64 nt, hsa
uguguucuuuugcgucugaugucucacuuuggcauguuuuuagacucauccaagcuguuuugug

SEQ ID NO: 121406 - RNA, 64 nt, hsa
ugagcauuuguguaaaaguauguauuugcacauguguuuuuauuucucuuggguaaguaccuag

SEQ ID NO: 121407 - RNA, 64 nt, hsa
gucuuuugugaugugucuguucgugccuuuugccuguuuuuaaguugggaugcuuauuguugac

SEQ ID NO: 121408 - RNA, 64 nt, hsa
ucagccggccuauaaaucuccuuauuuuauuucuuguuuuuauagcauaaagcuuuaguuuggc

SEQ ID NO: 121409 - RNA, 64 nt, hsa
aaaaagacaaaccagauguaauauauuuuguggauguuuuuauuucuuggauuuauaguaccuu

SEQ ID NO: 121410 - RNA, 64 nt, hsa
agaaggaacaaaggucuggaguuuacagaaugucuguuuuuaaagucacuuuaugcguuuucca

SEQ ID NO: 121411 - RNA, 64 nt, hsa
auaaaagccaaauuaauccuacaaucagguauuauguuuuuaaaccaaguugagugaauuggua

SEQ ID NO: 121412 - RNA, 64 nt, hsa
accauuaauuuuugcauugcuucaguuugccaaguguuuuuacaucaucucauuugaucucaaa

SEQ ID NO: 121413 - RNA, 64 nt, hsa
aagaaguauuuaaacuuucaauauuuuaacuuuuuguuuuuauuucuuuuagaaaaggccaaua

SEQ ID NO: 121414 - RNA, 64 nt, hsa
guuggcugugcuguauuuugauauaauuguacuguguuuuuaaauuuuguaugccaaucuuaaa

SEQ ID NO: 121415 - RNA, 64 nt, hsa
gcauauauaaguugucaaggaaacaaagcccaaauguuuuuaaaacaaguauacaguuuuuguc

SEQ ID NO: 121416 - RNA, 64 nt, hsa
uuaauucaucuguuuuaaccauuaaaaccuguuuuguuuuuagcuuuguguaagaguuguuacu

SEQ ID NO: 121417 - RNA, 64 nt, hsa
aauuuguaauuacaguuuuuguaacuugugauuauguuuuuaacuaaauuuaccaccagauaca

SEQ ID NO: 121418 - RNA, 64 nt, hsa
cauuauuuuugguguauugcuuuuucuaauugacuguuuuuaaugauuuugauacauuuuaaug

SEQ ID NO: 121419 - RNA, 64 nt, hsa
guauagccuauggcagaaaaaaugucuguaaauauguuuuuaaagguggauuuuguuuaaaaaa

SEQ ID NO: 121420 - RNA, 64 nt, hsa
ccagggccgaccagaggagccuuuuuaaaacacauguuuuuauacaaaauaagaacgaggauuu

SEQ ID NO: 121421 - RNA, 64 nt, hsa
agguauccagcccugauauuuuguguaaauaaaauguuuuuaaaaccuguuaguuaaaacacuu

SEQ ID NO: 121422 - RNA, 64 nt, hsa
aauuagaauuagucauuauucuugaugaagagucuguuuuuaaucauaaaaaucaugacaguua

SEQ ID NO: 121423 - RNA, 64 nt, hsa
ccuuaacuuacuguugcuuacaccccugaaagucuguuuuuaagcaaauggguaauaguagaaa

SEQ ID NO: 121424 - RNA, 64 nt, hsa
ugagagaaucaaaugaguuuacuuuuguuccuguuguuuuuaacuagcuuuaaguuuaaagaug

SEQ ID NO: 121425 - RNA, 64 nt, hsa
aaaagcaaccaaauuauuuuuugcugaaacuagauguuuuuacaugagaaauacuguauguguu

SEQ ID NO: 121426 - RNA, 64 nt, hsa
guuacaaaggaaguucuaaaauuaugccucccucuguuuuuauaaguugccaucgaaaagugau

SEQ ID NO: 121427 - RNA, 64 nt, hsa
uaaagcacaaaauaaccuauuguuagaaaauauguguuuuuauaaaugaauguaaaauaauuaa

SEQ ID NO: 121428 - RNA, 64 nt, hsa
aacauuuucaugaccugguuauagccuuugcugguguuuuuaaaauaccuggacucaaugacaa

SEQ ID NO: 121429 - RNA, 64 nt, hsa
caacagaugcauucauuucucuuggaauguguauuguuuuuauuuugcgaaacaaaacaaaaca

SEQ ID NO: 121430 - RNA, 64 nt, hsa
uacucugacccugaguggaaagggguuuuuguucuguuuuuauuuuaccuacauguacuauuua

SEQ ID NO: 121431 - RNA, 64 nt, hsa
uuaauuuuuaaaaaucuuuuguuuuacuuaauucuguuuuuauuauuauuauuauuuuguuuga

SEQ ID NO: 121432 - RNA, 64 nt, hsa
ucauagaaaagauuauuugcuucaucaguuaacuuguuuuuauaaaucagggcuguguucauac

SEQ ID NO: 121433 - RNA, 64 nt, hsa
cagugaauaaaccaaggugaggccuugagcucuuuguuuuuauauuaaugaggagaaaaguaug

SEQ ID NO: 121434 - RNA, 64 nt, hsa
uuggcuuaaguuuauuauagaaaaucaacacuaauguuuuuagauuuuaauuguccuauugaug

SEQ ID NO: 121435 - RNA, 64 nt, hsa
cuugcuaacuuugcuguaauuuuuuuaaacgucuuguuuuuaauauagcaaacuaucucaauac

SEQ ID NO: 121436 - RNA, 64 nt, hsa
gaaaauuguugcgauuuauuuuuucaagagaucauguuuuuaaagugucuuuugcagaguuuua

SEQ ID NO: 121437 - RNA, 64 nt, hsa
uguacugugugccgagaaggcauuucuagacccguguuuuuaaaggagggaacuuuggggauug

SEQ ID NO: 121438 - RNA, 64 nt, hsa
aagaaggcagucaguggaucuuaaaaugacaaucuguuuuuaaauuggauucuaugaaaaugca

SEQ ID NO: 121439 - RNA, 64 nt, hsa
ucaauagggucacguuaagccaugcuguaagcauuguuuuuauuuucaggcuuagccugagcac

SEQ ID NO: 121440 - RNA, 64 nt, hsa
uugggaaauaagcaccuguauuuuuuuccaaaacuguuuuuaaagcuguauacgcauacauaua

SEQ ID NO: 121441 - RNA, 64 nt, hsa
acaggugugcaccaccaugccugguucauuuuuguguuuuuaguagagaugggguuuuaccaua

SEQ ID NO: 121442 - RNA, 64 nt, hsa
uaacugcuauuuauaaaaaugccucagcagaaucuguuuuuauguugacugcuuuauguugaau

SEQ ID NO: 121443 - RNA, 64 nt, hsa
gaaacauuuuauacaaacuuuuauagacaaauuguguuuuuauacagagucaugcauauuuucu

SEQ ID NO: 121444 - RNA, 64 nt, hsa
agauaaucacuucaccaacugcagugcauuuguguguuuuuaacccucagagaacucugcauuu

SEQ ID NO: 121445 - RNA, 64 nt, hsa
caaaucggggcucuuguaucagugccagcuguaauguuuuuaaaugcaguggcugccuucuauu

SEQ ID NO: 121446 - RNA, 64 nt, hsa
auuugugaacaaauguucccuuggcuuuagcagauguuuuuaaaguuucuuuuguagaccgaac

SEQ ID NO: 121447 - RNA, 64 nt, hsa
aagacagaaacugagaauuuuuuuuguuuuguuuuguuuuuaacaacaauagcaccuugaaaau

SEQ ID NO: 121448 - RNA, 64 nt, hsa
aguuaagauggaagacuuccuucuugacaaauuguguuuuuagugaauuucuuaaaccguuuua

SEQ ID NO: 121449 - RNA, 64 nt, hsa
ccccacaaauguuaguuguguguguguguguguguguuuuuaaucacuguaaccggaugcauuu

SEQ ID NO: 121450 - RNA, 64 nt, hsa
augguucugagaaagaagcuguacguuuucuuuauguuuuuaugaccaaagcaguuucuuguca

SEQ ID NO: 121451 - RNA, 64 nt, hsa
ucuuuuuucaaucuguacauuugggcugucuguauguuuuuauagcugguuuuuaaaaagcaua

SEQ ID NO: 121452 - RNA, 64 nt, hsa
uacuggcgugagccaccaugcccagccucaaauauguuuuuaaaaaauaucauuguccuccucc

SEQ ID NO: 121453 - RNA, 64 nt, hsa
aaaguaaaaggugaugagggcaauucuguccuacuguuuuuacaggccuuuuucaaaugcagau

SEQ ID NO: 121454 - RNA, 64 nt, hsa
aagguggucucaguauugcaauaucauguaaguuuguuuuuauuugccggcugaggauucuguc

SEQ ID NO: 121455 - RNA, 64 nt, hsa
ucaugaaacugauguaaggcaauuaauuugcuucuguuuuuaggucugggagggcaaaaaagag

SEQ ID NO: 121456 - RNA, 64 nt, hsa
uccuucauccugguccuggcuuuauggaacaccauguuuuuagcauguuuuuaaauaaaaacgg

SEQ ID NO: 121457 - RNA, 64 nt, hsa
gguccuggcuuuauggaacaccauguuuuuagcauguuuuuaaauaaaaacggauaaaguguca

SEQ ID NO: 121458 - RNA, 64 nt, hsa
gauauaaccuuuaaaaauuuucucauuaagacaauguuuuuaauuuaauuugccucauuacauc

SEQ ID NO: 121459 - RNA, 64 nt, hsa
auauauauuaaccauauuuuaaaaguaccaauuuuguuuuuacagaaaagauaaaacucaaaag

SEQ ID NO: 121460 - RNA, 64 nt, hsa
agccuuacuggguugaaaaggaguagcucagaccuguuuuuauuugcucaauaacucuacucau

SEQ ID NO: 121461 - RNA, 64 nt, hsa
gcacuuaauuuuaauguaagaaaguuguucauuuuguuuuuauaaaauacaugaggacaaugcu

SEQ ID NO: 121462 - RNA, 64 nt, hsa
cgcauuuacagauuggugucaaagacauucacuauguuuuuaugguucauguuauauccucccc

SEQ ID NO: 121463 - RNA, 64 nt, hsa
gauauuuaauauuucuauauucugcuuuucuagcuguuuuuaccuaguuagcuugugacuuugc

SEQ ID NO: 121464 - RNA, 64 nt, hsa
uugacaauuccgauuugaugcugcaauuacuugcuguuuuuauugaucuuaugguuuauuucuu

SEQ ID NO: 121465 - RNA, 64 nt, hsa
aaauuggcagaggcagggugucaacuugauuagguguuuuuaugggaauguaauuugaaaucac

SEQ ID NO: 121466 - RNA, 64 nt, hsa
gaaauuugacuuaaaauucuugagcacguuaauauguuuuuaagaucugauuaucuuugagaga

SEQ ID NO: 121467 - RNA, 64 nt, hsa
uuaucaaauaguuuucucuuugugucuguguuaguguuuuuaaagcugcucauuucauuuuguc

SEQ ID NO: 121468 - RNA, 64 nt, hsa
gcguaaaacagcaucauuguacuuaagcuauggauguuuuuauuuuauauuuucuuuauuuaua

SEQ ID NO: 121469 - RNA, 64 nt, hsa
aaucuguuuggcauuaagugaauuuuaauguuuuuguuuuuauauccuuuuagcucuuaagugu

SEQ ID NO: 121470 - RNA, 64 nt, hsa
cuuuugaacugaaauucaguaaauguccaaguaauguuuuuauaauaaacuaagccauauuuag

SEQ ID NO: 121471 - RNA, 64 nt, hsa
aucaaaugauuacuaguguuaauaguagauaacuuguuuuuauuguuggugcauauuaguauaa

SEQ ID NO: 121472 - RNA, 64 nt, hsa
gaauacaauccuuugcauuguuaaggagguuuuuuguuuuuaaauggugggucaaggagcuagu

SEQ ID NO: 121473 - RNA, 64 nt, hsa
cgguaggccugagccucaacucuucagaaaauaguguuuuuaauauuccucuucagaaaauagu

SEQ ID NO: 121474 - RNA, 64 nt, hsa
aauaguguuuuuaauauuccucuucagaaaauaguguuuuuaauauuccgagcuagagcucuuc

SEQ ID NO: 121475 - RNA, 64 nt, hsa
acuaaaaaucaguuauggcacaauaaagauuuucuguuuuuaaauuguauuucaucugcuuccu

SEQ ID NO: 121476 - RNA, 64 nt, hsa
cguuuauucugaugauaaaaacaguuagccagacuguuuuuaaagcaccuggcgggaagcagaa

SEQ ID NO: 121477 - RNA, 64 nt, hsa
aaucaugcgcuguauguuuuaaucagcagaagcauguuuuuauguuuguacaaaagaagauugu

SEQ ID NO: 121478 - RNA, 64 nt, hsa
gguagauccuaaaaagcauggugagaggaucaaauguuuuuauaucaacauccuuuauuauuug

SEQ ID NO: 121479 - RNA, 64 nt, hsa
acaguggauaaaaaacaguccuucaagucuucucuguuuuuauucuucaacucucacuuucuua

SEQ ID NO: 121480 - RNA, 64 nt, hsa
uucuccucacgaauuguuuuacugcugcauuuuuuguuuuuaaaauuaaacugcaguguuuccu

SEQ ID NO: 121481 - RNA, 64 nt, hsa
cacaguggagucuuuuuauuucagaccuacagauuguuuuuauauuuguugucacagugugaca

SEQ ID NO: 121482 - RNA, 64 nt, hsa
uacauuuuccgaaacuacaguuaaagcagaagucuguuuuuaggaaaaguuucaagggagaagg

SEQ ID NO: 121483 - RNA, 64 nt, hsa
ugagcagcuuucagcacuggaggugaagagagcguguuuuuaaaauacagagacaagcacguca

SEQ ID NO: 121484 - RNA, 64 nt, hsa
uuuuaaaaauuucuaguagauuuuuggccuuuccuguuuuuaaaaaucaguuucauuuucauau

SEQ ID NO: 121485 - RNA, 64 nt, hsa
cuguuaaaguuuugauguacaucgagcugaauucuguuuuuaccaguuucaaaaccuucaagug

SEQ ID NO: 121486 - RNA, 64 nt, hsa
ccuucuuuuguagcauauaggugauguuugcucuuguuuuuauuaauuuauauguauauuuuuu

SEQ ID NO: 121487 - RNA, 64 nt, hsa
aagaacuuacugauuauuuucuucauccaacuuauguuuuuaaaugaggauuauugauaguacu

SEQ ID NO: 121488 - RNA, 64 nt, hsa
cagucuugaaauuuugccaccacagaaagaaagauguuuuuaaaagcuuggcccaaagaauagg

SEQ ID NO: 121489 - RNA, 64 nt, hsa
caaucaguguuagacaacagugaggcauaucauguguuuuuauuaaaaaugauaaagauguguu

SEQ ID NO: 121490 - RNA, 64 nt, hsa
uaucauucuuuaaaguuuacaaaaaaaaaccuuauguuuuuauguaaucagucauuacacuagg

SEQ ID NO: 121491 - RNA, 64 nt, hsa
uucugucaguacagcguauauggaaaauucaaguuguuuuuaacauauucaaguauguucagua

SEQ ID NO: 121492 - RNA, 64 nt, hsa
augauauucucuugaguauuacuucccuuugcaauguuuuuauuguuaauguagcauauauaaa

SEQ ID NO: 121493 - RNA, 64 nt, hsa
aauuuaaguguucauuuuccuaucaguugacauuuguuuuuaguuuuuguugguagaaacagua

SEQ ID NO: 121494 - RNA, 64 nt, hsa
ggugaagacaugcuacaacuacuauuuuuagcaauguuuuuaaauuugugucuauugggguggg

SEQ ID NO: 121495 - RNA, 64 nt, hsa
gaaacuuuaucaucuuucacuuuugguuuuccucuguuuuuaaacaucuuagguauaacagcac

SEQ ID NO: 121496 - RNA, 64 nt, hsa
gcuuguuauuucacugaagugccugucauuuguuuguuuuuaggguuaaauguggguaaccugu

SEQ ID NO: 121497 - RNA, 64 nt, hsa
augaaauuaaugaaagaguauauuuuaaauauauuguuuuuaacauuaaacaaauaugaaauua

SEQ ID NO: 121498 - RNA, 64 nt, hsa
cuuaguacccagaacuccuuuuagguauagcaauuguuuuuagguaaauuuauauugaguuuaa

SEQ ID NO: 121499 - RNA, 64 nt, hsa
guaggauauuuugaccugacuggaaagaugguuguguuuuuauugccagguaauaagugugauc

SEQ ID NO: 121500 - RNA, 64 nt, hsa
ccaaugcucccaagcugaauauucuugagaaauuuguuuuuauuaugccauuugacauuucaaa

SEQ ID NO: 121501 - RNA, 64 nt, hsa
uaggaaugcacauguaauccaagugaguggagaguguuuuuaauguuuuugaaugaaggaaaug

SEQ ID NO: 121502 - RNA, 64 nt, hsa
ggauccaucugagaugcaugcuaagcuauguguauguuuuuaauuuugcacugcucuuuccugg

SEQ ID NO: 121503 - RNA, 64 nt, hsa
uauacuuauuucuugagagaagauuuuaacuuauuguuuuuauuuuaugguuacauaugaugau

SEQ ID NO: 121504 - RNA, 64 nt, hsa
uucgugugcaugaguguggaugggugccuguggguguuuuuagacaccagagaaaacacagucu

SEQ ID NO: 121505 - RNA, 64 nt, hsa
cuggcauucagagaacccuugcaacucgagaagcuguuuuuauuucguuuuuguuuugauccag

SEQ ID NO: 121506 - RNA, 64 nt, hsa
uuguaguuugaaaguuguacaugauaagacauuuuguuuuuacuguauguuuuuacugaaugau

SEQ ID NO: 121507 - RNA, 64 nt, hsa
guuguacaugauaagacauuuuguuuuuacuguauguuuuuacugaaugaucuauuccccaucc

SEQ ID NO: 121508 - RNA, 64 nt, hsa
cuacaggucuuagaacuccaagauguuccauaaguguuuuuacuugugaggaaugagaagccau

SEQ ID NO: 121509 - RNA, 64 nt, hsa
uauuaguccaaaggaaaacaacagcaacaaaaucuguuuuuaaaaugucuuauaugaacauaua

SEQ ID NO: 121510 - RNA, 64 nt, hsa
uucaaaggaagcauuucuagaaaaaaggagauaauguuuuuaaauuucauuaucaaacuugggc

SEQ ID NO: 121511 - RNA, 64 nt, hsa
agaggaauggguuagcccuaauguagaaugucauuguuuuuaaaacuguuuuauaucuuaagag

SEQ ID NO: 121512 - RNA, 64 nt, hsa
auccaguaccucugcuuuucuuuugcugugcucuuguuuuuaacuuauuuuuuuuuuaacaacu

SEQ ID NO: 121513 - RNA, 64 nt, hsa
ggaaagaaaauaacuuugugaagccaguguauucuguuuuuaaaacugugccugcagugcaaua

SEQ ID NO: 121514 - RNA, 64 nt, hsa
acuaugcaaaacaucaaagugaauuuuccaugaauguuuuuaauauucucaucucaacauugug

SEQ ID NO: 121515 - RNA, 64 nt, hsa
guaacuuggccacuaauaauuaaccaucuaccucuguuuuuaauuuucuuuccaaaaggcagcu

SEQ ID NO: 121516 - RNA, 64 nt, hsa
aauguaauuagacaaaaaucauuuuuuuagaauguguuuuuauuguaaaaguaucuuuuucagc

SEQ ID NO: 121517 - RNA, 64 nt, hsa
uauuuuucuuuuggaacacuuuuuaaaauguaucuguuuuuaagguuauucuaaauuauaguag

SEQ ID NO: 121518 - RNA, 64 nt, hsa
augccuuuuaaaauacuguuuacuaugaagacaauguuuuuaauuacaaauccagaauucugua

SEQ ID NO: 121519 - RNA, 64 nt, hsa
uggaguugauuagauuacaaauaacaaucuguaguguuuuuacugccauaguuuuauaaccaaa

SEQ ID NO: 121520 - RNA, 64 nt, hsa
aaagucuuucagcugugacugcaggaagugggaguguuuuuauuguuagcuaauugcugugacu

SEQ ID NO: 121521 - RNA, 64 nt, hsa
uaaaugaaacgcugaacuaugcuaaucuggaauuuguuuuuauuugccugaaauauauuuuuuu

SEQ ID NO: 121522 - RNA, 64 nt, hsa
uaggaguugauguggugugagugauauauuucuauguuuuuaauguacagcaucuguacuuugu

SEQ ID NO: 121523 - RNA, 64 nt, hsa
uguauauauauuaaaaaaaaaacaaaguuuuguauguuuuuauuacuuuaacuauuguuauaaa

SEQ ID NO: 121524 - RNA, 64 nt, hsa
uacugcugcuggucaggacauuaaaauauugaaguguuuuuaaaaauuaaagaagaagaaaagu

SEQ ID NO: 121525 - RNA, 64 nt, hsa
gcaagacguaaagaauuuucaucccguaucacaguguuuuuauugcucgcccagacaccaugug

SEQ ID NO: 121526 - RNA, 64 nt, hsa
agaagaaaacaguacagaaggcaaaguuuacagauguuuuuaauucuaguauuuuaucuggaac

SEQ ID NO: 121527 - RNA, 64 nt, hsa
ucuuccuccccucaguggcaguuuggucuucaccuguuuuuaagcuaccuuaaacgcacuuuuc

SEQ ID NO: 121528 - RNA, 64 nt, hsa
gaaagaaaaauaauauuugauuuugaaucuuaaauguuuuuaaaaauuagacuugaaugggcac

SEQ ID NO: 121529 - RNA, 64 nt, hsa
uuuuagggaauucauccucuaagaauuauguuuuuguuuuuaaucauauguuccaaacaggcac

SEQ ID NO: 121530 - RNA, 64 nt, hsa
uagauguaaaaaaaauucaguuuaaaagaacauuuguuuuuacauuaaauguuuauuugaaauc

SEQ ID NO: 121531 - RNA, 64 nt, hsa
gggaaacuggcuggaaauaguaaucacaccucucuguuuuuaguuagagucuaaugaaacucuc

SEQ ID NO: 121532 - RNA, 64 nt, hsa
uuaggccuucagucaauuccgaagcuccuucaguuguuuuuauaaugggcguuuucacaugcac

SEQ ID NO: 121533 - RNA, 64 nt, hsa
gguugucugaacuauuuuaaauuaaggagccagauguuuuuagucaggcuauccugacaagacu

SEQ ID NO: 121534 - RNA, 64 nt, hsa
aagaacuuuccuaccuguaggcaauagauugcuauguuuuuaacaaauuguggcaaauucuaaa

SEQ ID NO: 121535 - RNA, 64 nt, hsa
cauuguugcugcacuggcaauaaguauguggcacuguuuuuauuuguuuauguuauuuaaauac

SEQ ID NO: 121536 - RNA, 64 nt, hsa
uucugaagcuuaauauuagagacccaaguaagauuguuuuuagucuugcuugaggaaugcacac

SEQ ID NO: 121537 - RNA, 64 nt, hsa
uuuauccagaaugcuucucuuuagggaacaaggauguuuuuaauggcauaacaaaggcaagacu

SEQ ID NO: 121538 - RNA, 64 nt, hsa
gguuuguuuuuucaagaaaauuuugcagaagcuauguuuuuaaaguguacauuuuauaaaguuu

SEQ ID NO: 121539 - RNA, 64 nt, hsa
cauuuccaaauuccuagaaaaguuuguuuuacuuuguuuuuauucuguuaaugcauucuuucuu

SEQ ID NO: 121540 - RNA, 64 nt, hsa
uguuuguguauugaaaacucaauauguaaucuuguguuuuuauauguauacuuguauauuccua

SEQ ID NO: 121541 - RNA, 64 nt, hsa
agcaaaauuacaccuuuaugagaaaccauaaaauuguuuuuauuuuucaggccagacauagcuu

SEQ ID NO: 121542 - RNA, 64 nt, hsa
aguguggcccgaagcuuaaaaaguuacucgguacuguuuuuaagaacacuuuuauagaguuagu

SEQ ID NO: 121543 - RNA, 64 nt, hsa
gaauucugauuccuuuuuuguugucuuuuacuuuuguuuuuaaccuggggguucggggagaggc

SEQ ID NO: 121544 - RNA, 64 nt, hsa
uucaucaauuuuuuguuuuuuacuuucuuuucuguguuuuuaaguuaauuuuuuccuugcaaug

SEQ ID NO: 121545 - RNA, 64 nt, hsa
cuuaaucccuagguuauacguaguauccuaaauguguuuuuaagauuuuuaugauuuuauuuuu

SEQ ID NO: 121546 - RNA, 64 nt, hsa
gaagaaaaaaguccaugaaaacuaaaacuuuucauguuuuuagccagugagaagauaauaaacc

SEQ ID NO: 121547 - RNA, 64 nt, hsa
guacugaauagguuuuuuuucuucuguuaguuuuuguuuuuaagugugaaugcaagugauuaau

SEQ ID NO: 121548 - RNA, 64 nt, hsa
guuuugcugaaaaugacauuaaggaaaguucugcuguuuuuagcaaaagcguccagaaaggaga

SEQ ID NO: 121549 - RNA, 64 nt, hsa
ugagcacaauuagccguaauaacauuagagaaaauguuuuuaaagaagccagcucaagcaauau

SEQ ID NO: 121550 - RNA, 64 nt, hsa
uacaacuguucuuauccacaguacaaaaaugguuuguuuuuaauauguagagcauuaugugugg

SEQ ID NO: 121551 - RNA, 64 nt, hsa
aaacagauacucuuuacaccaucaugccacgcauuguuuuuaaagcauugcguuaaaaaaaaaa

SEQ ID NO: 121552 - RNA, 64 nt, hsa
gauugagagcuaguguagaauugucuguguuuauuguuuuuaugaguaaauacaugcauuguca

SEQ ID NO: 121553 - RNA, 64 nt, hsa
uuuaagagacucuuuuaaaaaaaaaaaaaccuaauguuuuuaucuugagucaauaugauuaggu

SEQ ID NO: 121554 - RNA, 64 nt, hsa
uauuugugacaauaagauguguucaggggcucccuguuuuuaagagacucuuuuaaaaaaaaaa

SEQ ID NO: 121555 - RNA, 64 nt, hsa
aagcagaugggaacugaauuguguuuucagguuuuguuuuuaguaggugauauucauucguauc

SEQ ID NO: 121556 - RNA, 64 nt, hsa
uuggggaauuuuuuuuuaaggggaucuaaaaaaauguuuuuagaacauguaaaauguuuaaugg

SEQ ID NO: 121557 - RNA, 64 nt, hsa
uaauuaauuccaacuguacuuuuaaggcaguggcuguuuuuagacuuucuuaucacuuauaguu

SEQ ID NO: 121558 - RNA, 64 nt, hsa
gcuuuaaaaaaauacaugcaucucagcguuuuuuuguuuuuaauuguauuuaguuauggccuau

SEQ ID NO: 121559 - RNA, 64 nt, hsa
cuuuaaaauuacuuuuuuaaaauagucaaauucauguuuuuaaguaaguuggcccaugcaacau

SEQ ID NO: 121560 - RNA, 64 nt, hsa
aaaaaaaugcuuuuuaaaauuuuuacaaauacuuuguuuuuaaagugaagcuuuaaaauuacuu

SEQ ID NO: 121561 - RNA, 64 nt, hsa
cacuuuuucugaaugaucuuguuuuugguguagauguuuuuauuguguggguuaguuuaaugaa

SEQ ID NO: 121562 - RNA, 64 nt, hsa
auauuguguaauuuuaauaaauaauaacuauuguuguuuuuaugaucauuacuaccauuugugu

SEQ ID NO: 121563 - RNA, 64 nt, hsa
cagguucuaugccaucugcauugggaugucugguuguuuuuauuucugacuuuuuuaaaauucc

SEQ ID NO: 121564 - RNA, 64 nt, hsa
aaagacuucauagggucacuggaaugcuuuguguuguuuuuaaguagagguaaaauugagaugg

SEQ ID NO: 121565 - RNA, 64 nt, hsa
cugaaaguugguauuuuuuaaugcacugaauaauuguuuuuaacuggagaguuugguuaucaau

SEQ ID NO: 121566 - RNA, 64 nt, hsa
guaaguacuagggaagcuuuauaagucgugaggauguuuuuauauuuaaauguagcaaacauac

SEQ ID NO: 121567 - RNA, 64 nt, hsa
aaguuacauuuuauuuaguuagaacacuucauuuuguuuuuaguuggagaacucuauagcccuu

SEQ ID NO: 121568 - RNA, 64 nt, hsa
aguuaaagaauauuauuucuguagguuaaauuuuuguuuuuauuuuauuuuauuuuugagaggu

SEQ ID NO: 121569 - RNA, 64 nt, hsa
ugaauuucauugaacuaaauaauaaugaggauaauguuuuuaagauuuuuuuuuuuuuuuuuuu

SEQ ID NO: 121570 - RNA, 64 nt, hsa
uaguuucugcauuucaagaagacuggcagacaguuguuuuuauucuuccucaaagcauuugcaa

SEQ ID NO: 121571 - RNA, 64 nt, hsa
uccaaucaguaugggauuuauaucuauuuauacauguuuuuaaucauuuugaucaauguuuaua

SEQ ID NO: 121572 - RNA, 64 nt, hsa
caguugugugccaccacaccuggguaauuuuuuguguuuuuaguagagacuggguuucaccgug

SEQ ID NO: 121573 - RNA, 64 nt, hsa
acugggaccaguuccgggguuaagaauuaauuuuuguuuuuaauauuucacaugaaaagaauca

SEQ ID NO: 121574 - RNA, 64 nt, hsa
gguauuuguggagccuauguuuaauguugccacguguuuuuauguccuuuuuguuggacuugag

SEQ ID NO: 121575 - RNA, 64 nt, hsa
ugauagacaugucucaauuauauauguguguguauguuuuuaaagcuaaaaacauuacuuuuag

SEQ ID NO: 121576 - RNA, 64 nt, hsa
ugaaagaaaauaaaauuuaugcuauucuuugcuuuguuuuuauaaaugaauuuuucauagaauu

SEQ ID NO: 121577 - RNA, 64 nt, hsa
gugcugagauugccaaucacgguuaaacacaaaguguuuuuauagaaugaagaaacagucuuua

SEQ ID NO: 121578 - RNA, 64 nt, hsa
auaguaauucuggaaagagcaaauaaaugaagauuguuuuuauuugccugauaaaguaauugaa

SEQ ID NO: 121579 - RNA, 64 nt, hsa
gugacuacauugaaacuugaguuuguuucuuguguguuuuuauagaagugguguuuuuuuucca

SEQ ID NO: 121580 - RNA, 64 nt, hsa
uauuuucuuuuuugauaauuuauuguaccaaagcuguuuuuauagcacauagaugucuguaacc

SEQ ID NO: 121581 - RNA, 64 nt, hsa
ugcaccaaaaaucaaggacaaaaauaaguguguuuguuuuuacaggugugaaagucacagcuug

SEQ ID NO: 121582 - RNA, 64 nt, hsa
aguccuaaaagaguaacuguaauuggauguuuauuguuuuuaucuaaaguaagguguauguguu

SEQ ID NO: 121583 - RNA, 64 nt, hsa
gaagccacaugggguuucaguugcgaaacaggucuguuuuuauguucaguuuguacaauccaca

SEQ ID NO: 121584 - RNA, 64 nt, hsa
ggugguuuccugaaaaguugaauauuuaagaaauuguuuuuaacagaagcaaaauggcuuuucu

SEQ ID NO: 121585 - RNA, 64 nt, hsa
uaagaacaugcuuggacacuuagucauuguucuguguuuuuauuaaugaagaaaagggaagaca

SEQ ID NO: 121586 - RNA, 64 nt, hsa
uguuaagucuuuguucuuuuucuguguuucuguuuguuuuuagguuuguuuuguugucguuuuc

SEQ ID NO: 121587 - RNA, 64 nt, hsa
uucuggaggagaaaaaaugaguuacaaugucagguguuuuuaaaaauuccuuuuagagacaguc

SEQ ID NO: 121588 - RNA, 64 nt, hsa
uuuaugugggagaaggaaggaguaacauaaaacauguuuuuaucacucaaaguaagcaauggag

SEQ ID NO: 121589 - RNA, 64 nt, hsa
ccugaugggccaggaagggcguggacauggaggcuguuuuuacaguuuuuuuuuuguuguuguu

SEQ ID NO: 121590 - RNA, 64 nt, hsa
ggcuguuuuuacaguuuuuuuuuuguuguuguuuuguuuuuaaagaauacagaaggagccaagc

SEQ ID NO: 121591 - RNA, 64 nt, hsa; identical to SEQ ID NO: 121216

SEQ ID NO: 121592 - RNA, 64 nt, hsa; identical to SEQ ID NO: 121215

SEQ ID NO: 121593 - RNA, 64 nt, hsa
cuaacaaaauguuuccccuuguacaauuaugcuguguuuuuaaaaaacauugaccuguguguuu

SEQ ID NO: 121594 - RNA, 64 nt, hsa
auuaugcuguguuuuuaaaaaacauugaccuguguguuuuuauaaaagaaaaaguauguugugc

SEQ ID NO: 121595 - RNA, 64 nt, hsa
gugaaaacauaagccauggugaacugauaauuuuuguuuuuaaauuauuuauauuacugaauug

SEQ ID NO: 121596 - RNA, 64 nt, hsa
aaauuaaauaauagaugugaaaaugcuuugaaaauguuuuuaagugcuaugcauauuuauagag

SEQ ID NO: 121597 - RNA, 64 nt, hsa
auaaauuguuccaugcugguggaaagauagagauuguuuuuagagguugguuguuguguuuuag

SEQ ID NO: 121598 - RNA, 64 nt, hsa
acuauguauagucugagccagaucaaaguauguauguuuuuaauaugcauagaacaaaagauuu

SEQ ID NO: 121599 - RNA, 64 nt, hsa
uuauccuuccuuuaacuuaaucuuuuuauccuucuguuuuuaguucuuacagugguaaucacau

SEQ ID NO: 121600 - RNA, 57 nt, hsa
ccccuggugggcguccauagacacuauuguuuuuaaaccaggaaggcugacagauga

SEQ ID NO: 121601 - RNA, 64 nt, hsa
guguuuauucuugaugaaaagcuuuguuuguucuuguuuuuaaguuugcacucaaaucuuaaga

SEQ ID NO: 121602 - RNA, 64 nt, hsa
ucccuuuagcuguguuauuauagagcagaaauucuguuuuuaaaaauuagccuaagauauacuu

SEQ ID NO: 121603 - RNA, 64 nt, hsa
guuaacuagugucaucuauuuagagaaacauuuuuguuuuuaauugcucaaagcugucgccgcu

SEQ ID NO: 121604 - RNA, 64 nt, hsa
gaaaaacauuuggcauuccugaauaauuuccaaauguuuuuaauccaaagaaaaagguuuaaag

SEQ ID NO: 121605 - RNA, 64 nt, hsa
gccaggugcucagugacuggccaucacauuaaugaaugacgagauuggaguacacugucaccaa

SEQ ID NO: 121606 - RNA, 64 nt, hsa
acucucuccaaaaacaaaccagaaacagaaaagaaaugacgacccaagaccccccuacaagcau

SEQ ID NO: 121607 - RNA, 64 nt, hsa
aaaugauaucuaaguaguucucagcaauaauaauaaugacgauaauacuucuuuuccacaucuc

SEQ ID NO: 121608 - RNA, 64 nt, hsa
guauugcuuuuauaaauguacaaauaguuacugaaaugacgagacccuuguuugcacagcauua

SEQ ID NO: 121609 - RNA, 64 nt, hsa
aagagaaauuucccagccuauucuaaaucuuguuaaugacgaagaguccaauguaucucauuau

SEQ ID NO: 121610 - RNA, 64 nt, hsa
aacaguuuaguuucaaaccuagcucccuggguggaaugacgacuucacuauacuuagugaauau

SEQ ID NO: 121611 - RNA, 64 nt, hsa
ucacugugucccccaggcuggagugcaguggcacaaugacgacucacugcagccucaaccuccu

SEQ ID NO: 121612 - RNA, 64 nt, hsa
gagagggauaguguuaggagaaauaccuaauguaaaugacgaguuaaugggugcagccaaccaa

SEQ ID NO: 121613 - RNA, 64 nt, hsa
auuccauuuaggauguguauuuaaugcauuuaguaaugacgauaaaguguuuuuaguaugcuuu

SEQ ID NO: 121614 - RNA, 64 nt, hsa
ccuccucaggcuuaaaucucaggcuucacauugcaaugacgauugcaguuuuauuuuuggagau

SEQ ID NO: 121615 - RNA, 64 nt, hsa
aagacgugucgcacuuuucaguuguuuguauucaaaugacgauuauuuuucuacucaaugugaa

SEQ ID NO: 121616 - RNA, 64 nt, hsa
uuauaaagucacuuuuuauuuuuccucagucuucaaugacgagagcaauauuaagaagacauug

SEQ ID NO: 121617 - RNA, 64 nt, hsa
ggaaggauagcauuuggagauauaccuaauguuaaaugacgaguuacuggaugcagcacgccaa

SEQ ID NO: 121618 - RNA, 64 nt, hsa
caagcuggaggacguagaauuucacuggaucagcaaugacgagccuacacaguacuggagaacu

SEQ ID NO: 121619 - RNA, 64 nt, hsa
auguucuuguuuguaucauuagcaacaacaugcuaaugacgacaccuagcucuaagagcaauuc

SEQ ID NO: 121620 - RNA, 64 nt, hsa
acccguauuuauguuuuuaccuauugcuguaagaaaugacgauccccuucccauuaaagagagu

SEQ ID NO: 121621 - RNA, 64 nt, hsa
cacuagaguuaguuuuaaaagacaagauauuuauaaugacgacuguauagcuuuuaaguuauuu

SEQ ID NO: 121622 - RNA, 64 nt, hsa
aaagacuuuuuuuuuaaggaaaggaaaaccuuauaaugacgauucaugaguguuagcuuuuugg

SEQ ID NO: 121623 - RNA, 64 nt, hsa
agcuucuuauauagguacucuuuugucuuuacagaaugacgauacaaaugccaaugaccagaug

SEQ ID NO: 121624 - RNA, 64 nt, hsa
cuguguaagauuuuuguaaguauauuuguauuuaaaugacgaccgaucacgcguuuuucuuuuu

SEQ ID NO: 121625 - RNA, 64 nt, hsa
ucucuuuucagauccgaauucagaggccucagguaaugacgacaucauuuuaaggcauggagcu

SEQ ID NO: 121626 - RNA, 51 nt, hsa
agggcucaguggaggucugagaaugacgauacccgugacucagcccuggac

SEQ ID NO: 121627 - RNA, 64 nt, hsa
auagagaaugcccucagcucuuagcuggucuaagaaugacgaugccuucaaaaugcugcuucca

SEQ ID NO: 121628 - RNA, 64 nt, hsa
ugcgcauaauaaugacauaaucugcuuagcagaaaaugacgauuaaucuauaggaaagcucaag

SEQ ID NO: 121629 - RNA, 64 nt, hsa
ugucucucagaauuguuuucuuaccuuuuaauguaaugacgagugugcuucaguuuguuuagca

SEQ ID NO: 121630 - RNA, 64 nt, hsa
gagcucugcugccagucaaggccugcauaugcagaaugacgaugccugccuuggugcugcuucc

SEQ ID NO: 121631 - RNA, 64 nt, hsa
aacuuuaauguuuuaaaccucuuuuauaaaauucaaugacgacuacuagaauucuuuucaaaag

SEQ ID NO: 121632 - RNA, 64 nt, hsa
gaacucuggcuuuuggaagcgagaguaaaaagcuaaugacgaggaaccgaaaaaucgcgagugu

SEQ ID NO: 121633 - RNA, 64 nt, hsa
aaaaaauuacgaaagaaaagaaaucucuaugcaaaaugacgaacaugguccuguggacuccucu

SEQ ID NO: 121634 - RNA, 64 nt, hsa
uuuuaucuguagcagaaaccaagucuacuucacuaaugacgaugccgugugucucgucuccuga

SEQ ID NO: 121635 - RNA, 64 nt, hsa
cuccuggggcuuuagggggcaggaaggugggacgaaugacgaugcccauccacuaccugaagca

SEQ ID NO: 121636 - RNA, 64 nt, hsa
ggaugaacugcacauuguugaagcagaggccaugaaugacgaaggcaguccaauuaaaguaaca

SEQ ID NO: 121637 - RNA, 64 nt, hsa
cauauuguauuagcuucccagggcuuccauaacaaaugacgacaaacuugggugcuuacaacaa

SEQ ID NO: 121638 - RNA, 64 nt, hsa
ggggagggauagcauuaggagauauacuaacguaaaugacgaguuaaugggugcagcacaccaa

SEQ ID NO: 121639 - RNA, 64 nt, hsa
ugcaguuuguuugaaguuaaguggaauccuuucaaaugacgagcugcagagaacucagcaccaa

SEQ ID NO: 121640 - RNA, 64 nt, hsa
cugaacugaacugagugugucagaagugcugguuaaugacgagaagagauugccugaaaaacaa

SEQ ID NO: 121641 - RNA, 64 nt, hsa
uucugauuuuuaagguagugggcaucucucuccuaaugacgaagcugcucagcaacuccaccug

SEQ ID NO: 121642 - RNA, 64 nt, hsa
cuguguuaugugugaacaguugucuuuaugugggaaugacgacuugauugggaguagagucuca

SEQ ID NO: 121643 - RNA, 64 nt, hsa
ccucauggaguuccggcgggacgcauccauguuaaaugacgagcugucccacaucaacgcgcgg

SEQ ID NO: 121644 - RNA, 64 nt, hsa
aaacugagagggaaggugucguuuuuacacugcuaaugacgagaguggcucuuuuuagcuaggc

SEQ ID NO: 121645 - RNA, 64 nt, hsa
gcuuuaaaauauguauucaaauguuauuaaccacaaugacgaccugcuuugauuuaaccaagaa

SEQ ID NO: 121646 - RNA, 64 nt, hsa
gcacgaugauaccagaguccacgcugacauacagaaugacgaaaaggguauauauauuuucuua

SEQ ID NO: 121647 - RNA, 64 nt, hsa; identical to SEQ ID NO: 121646

SEQ ID NO: 121648 - RNA, 64 nt, hsa
gcucuugagccaaacacuguguuucguuuggcucaaugacgaauguugaagaugcuuuuauguu

SEQ ID NO: 121649 - RNA, 64 nt, hsa
augggacagggucucacucugucacccaggcuggaaugacgaagugaaguagugcaaacauagc

SEQ ID NO: 121650 - RNA, 64 nt, hsa
ucagccaaguggcgguagcacagauguggugaacaaugacgaauugaggcagggaauagaccuc

SEQ ID NO: 121651 - RNA, 64 nt, hsa
cgcugcacccugcugucccucuccaggccuuggcaaugacgaucccccaaagagcccgucugca

SEQ ID NO: 121652 - RNA, 64 nt, hsa
ccuaaugcuaucccuccccccucccccuaauguaaaugacgaguuaauggugcagcacaccaac

SEQ ID NO: 121653 - RNA, 64 nt, hsa
aaaaaggccacguaugugccuugaauguagccaaaaugacgaacaacacccagaaaucugugau

SEQ ID NO: 121654 - RNA, 64 nt, hsa
cuacacauugggauuggaauauuaauuacacuauaaugacgauaauguauucaggaaguuaaaa

SEQ ID NO: 121655 - RNA, 64 nt, hsa
ucuccaaggcaagcccagcuggugugacuuagacaaugacgaggcuucaacucacugucuuuuu

SEQ ID NO: 121656 - RNA, 64 nt, hsa
ggggccaguagacccccggagaagcaguaccgacaaugacgaagauaccagaucccuucccaac

SEQ ID NO: 121657 - RNA, 64 nt, hsa
aaguaaggaucugcaaaucuugaaucguccucaaaaugacgaagcuugaauuguccucaagaug

SEQ ID NO: 121658 - RNA, 64 nt, hsa
uucacccaggaggucacagaaugacagcaagggaaaugacgaccaagagaagaagcuuaaaguc

SEQ ID NO: 121659 - RNA, 64 nt, hsa
ucuccgggagucccucagcuucuacaucagccugaaugacgaggcugucucuuuggaugaugcc

SEQ ID NO: 121660 - RNA, 64 nt, hsa
cuucuaaaaauuauaccccaugggcuugccagguaaugacgaaaacuuaauggguguacuuuuu

SEQ ID NO: 121661 - RNA, 64 nt, hsa; identical to SEQ ID NO: 88782

SEQ ID NO: 121662 - RNA, 64 nt, hsa; identical to SEQ ID NO: 88783

SEQ ID NO: 121663 - RNA, 64 nt, hsa; identical to SEQ ID NO: 88784

SEQ ID NO: 121664 - RNA, 64 nt, hsa; identical to SEQ ID NO: 88785

SEQ ID NO: 121665 - RNA, 64 nt, hsa; identical to SEQ ID NO: 88786

SEQ ID NO: 121666 - RNA, 64 nt, hsa; identical to SEQ ID NO: 88787

SEQ ID NO: 121667 - RNA, 64 nt, hsa; identical to SEQ ID NO: 88788

SEQ ID NO: 121668 - RNA, 64 nt, hsa; identical to SEQ ID NO: 88789

SEQ ID NO: 121669 - RNA, 64 nt, hsa; identical to SEQ ID NO: 88790

SEQ ID NO: 121670 - RNA, 64 nt, hsa; identical to SEQ ID NO: 88791

SEQ ID NO: 121671 - RNA, 62 nt, hsa
caccagacuuuuucuucuaaaaucuggaugucauugacgauaauguuuauggagauaagguc

SEQ ID NO: 121672 - RNA, 64 nt, hsa
ugccagugacagacaggcucuuagcagcuuccagauugacgacaagugcugaacaguggaggaa

SEQ ID NO: 121673 - RNA, 64 nt, hsa
uggcgccgucuccaggggcugcuuccuccuggaaauugacgaggggugucuugggcagagcugg

SEQ ID NO: 121674 - RNA, 64 nt, hsa
cucuuuacuguaaugacucaaaagguauuuaagaauugacgagagcuuguguuguuuagcaucu

SEQ ID NO: 121675 - RNA, 64 nt, hsa
agucccccaauuccagagagaaacacaucacuagauugacgagggcuuuuagagacugcuccua

SEQ ID NO: 121676 - RNA, 64 nt, hsa
uacugaauucugacaaaauaaaaaaagauaccuuauugacgaaauauuuaggauaaacaaaauu

SEQ ID NO: 121677 - RNA, 64 nt, hsa
aauuaaaucuucuggagggucgcuaucacaaaacauugacgauguauguauuauaauuuuuuag

SEQ ID NO: 121678 - RNA, 64 nt, hsa
ggguugaguggaguuaugugucgcuuuuauucggauugacgaaaaucaaccauaauuuucaagg

SEQ ID NO: 121679 - RNA, 64 nt, hsa
acggaguucagugccuggguguuuggugaugguuauugacgacaauguguagcgcaugauuguu

SEQ ID NO: 121680 - RNA, 64 nt, hsa
ccaacuagacauucuacagaaagaaaaaugcauuauugacgaacuggcuacaguaccaugccuc

SEQ ID NO: 121681 - RNA, 64 nt, hsa
uuucacuaucccuucugcagcuuuccaaagcuacauugacgagacacuuacugguuuaauuugc

SEQ ID NO: 121682 - RNA, 64 nt, hsa
ugaugcucaugucugugucauggcaugagggggaauugacgagugcuugcuuagcaucagcucu

SEQ ID NO: 121683 - RNA, 64 nt, hsa
ccaaagauagcagaagaguagauaagugcucaguauugacgaccuacaucugaaaucuacaaca

SEQ ID NO: 121684 - RNA, 64 nt, hsa
ggcauugacaugugcugcuaguuuauaaacuggcauugacgaaaaucauuugaaucucuucugg

SEQ ID NO: 121685 - RNA, 64 nt, hsa
cuacuacaaugcccuccauucuucagggcugagaauugacgagaagccagcucacccaucccag

SEQ ID NO: 121686 - RNA, 64 nt, hsa
auaggucuauagcauacuaauauccaccugauuuauugacgaaguagacauuaggcaaagccaa

SEQ ID NO: 121687 - RNA, 64 nt, hsa
uguucaacuccaccagaaauuaccucgagucagcauugacgauauuggaggagcugccgugcug

SEQ ID NO: 121688 - RNA, 64 nt, hsa
acugggaaggccaaguacagucucuguggugcguauugacgaccccauggagauuuugaaaagu

SEQ ID NO: 121689 - RNA, 64 nt, hsa
ugauaauguccccaaucauaccagggagacuggcauugacgagaacucagguggaggcuugaga

SEQ ID NO: 121690 - RNA, 64 nt, hsa
ucuuuaauuuggaauucaguaauuuuucuucuuuauugacgaauuccuccccucacaaaacugu

SEQ ID NO: 121691 - RNA, 64 nt, hsa
cucagcuuaccuuuuugagaaacgauuguuagaaauugacgauguguuuguuccagugauacug

SEQ ID NO: 121692 - RNA, 64 nt, hsa
acauccuuugcagggcagccccacaacuuuaaacauugacgauuccuucucugaacacaggcag

SEQ ID NO: 121693 - RNA, 64 nt, hsa
guugaagagcuuccuggaggugcuggacgggaagauugacgaccugcaugacuuccgccgaggg

SEQ ID NO: 121694 - RNA, 64 nt, hsa
acucugcucccauccccaggauagaagcggcuacauugacgagcaugagcuggaugcccuuuug

SEQ ID NO: 121695 - RNA, 64 nt, hsa
guggauggcacaggaucaauaaugccugaggcugauugacgacaucuacauuucagugcuuuuu

SEQ ID NO: 121696 - RNA, 64 nt, hsa
uuuguuuugugaaagcuucugauuaauuuauuauauugacgauaaaacucaaaccuacccagcc

SEQ ID NO: 121697 - RNA, 64 nt, hsa
auaaguuaccaaaguugccauuuuggagauggaaauugacgaggagggaaggucuuuuauugga

SEQ ID NO: 121698 - RNA, 64 nt, hsa
cuagagacaggcaaacugcaaaccauggugagaaauugacgacuucacacuauggacagcuuuu

SEQ ID NO: 121699 - RNA, 64 nt, hsa
caggagccacauggauugauuguauccacucaccauugacgauggcauugagcguagcuagcuu

SEQ ID NO: 121700 - RNA, 64 nt, hsa
gucauucagccuguguaaccauguggaaauaaaaauugacgaccaauguauuauauggacaacu

SEQ ID NO: 121701 - RNA, 64 nt, hsa
uaggguuucuaaaauaagguuuuuuauuguaaaaauugacgauugcccugcauuucuaccaagu

SEQ ID NO: 121702 - RNA, 64 nt, hsa
ucugaucaaugacuacacccacaacaucccgcucauugacgacacggacguggacgagaacgag

SEQ ID NO: 121703 - RNA, 64 nt, hsa
cugaaaacuguugcuuuuucuuuuucccucccccauugacgacauagcggcccccgcguccggg

SEQ ID NO: 121704 - RNA, 64 nt, hsa; identical to SEQ ID NO: 88782

SEQ ID NO: 121705 - RNA, 64 nt, hsa; identical to SEQ ID NO: 88783

SEQ ID NO: 121706 - RNA, 64 nt, hsa; identical to SEQ ID NO: 88784

SEQ ID NO: 121707 - RNA, 64 nt, hsa; identical to SEQ ID NO: 88785

SEQ ID NO: 121708 - RNA, 64 nt, hsa; identical to SEQ ID NO: 88786

SEQ ID NO: 121709 - RNA, 64 nt, hsa; identical to SEQ ID NO: 88787

SEQ ID NO: 121710 - RNA, 64 nt, hsa; identical to SEQ ID NO: 88788

SEQ ID NO: 121711 - RNA, 64 nt, hsa; identical to SEQ ID NO: 88789

SEQ ID NO: 121712 - RNA, 64 nt, hsa; identical to SEQ ID NO: 88790

SEQ ID NO: 121713 - RNA, 64 nt, hsa; identical to SEQ ID NO: 88791

SEQ ID NO: 121714 - RNA, 64 nt, hsa; identical to SEQ ID NO: 83612

SEQ ID NO: 121715 - RNA, 64 nt, hsa; identical to SEQ ID NO: 83613

SEQ ID NO: 121716 - RNA, 64 nt, hsa; identical to SEQ ID NO: 83614

SEQ ID NO: 121717 - RNA, 64 nt, hsa; identical to SEQ ID NO: 83615

SEQ ID NO: 121718 - RNA, 64 nt, hsa; identical to SEQ ID NO: 83616

SEQ ID NO: 121719 - RNA, 64 nt, hsa; identical to SEQ ID NO: 83617

SEQ ID NO: 121720 - RNA, 64 nt, hsa; identical to SEQ ID NO: 83618

SEQ ID NO: 121721 - RNA, 64 nt, hsa; identical to SEQ ID NO: 83619

SEQ ID NO: 121722 - RNA, 64 nt, hsa; identical to SEQ ID NO: 83620

SEQ ID NO: 121723 - RNA, 64 nt, hsa; identical to SEQ ID NO: 83621

SEQ ID NO: 121724 - RNA, 64 nt, hsa; identical to SEQ ID NO: 83622

SEQ ID NO: 121725 - RNA, 64 nt, hsa; identical to SEQ ID NO: 83623

SEQ ID NO: 121726 - RNA, 64 nt, hsa; identical to SEQ ID NO: 83624

SEQ ID NO: 121727 - RNA, 64 nt, hsa; identical to SEQ ID NO: 83625

SEQ ID NO: 121728 - RNA, 64 nt, hsa; identical to SEQ ID NO: 83626

SEQ ID NO: 121729 - RNA, 64 nt, hsa; identical to SEQ ID NO: 83627

SEQ ID NO: 121730 - RNA, 64 nt, hsa; identical to SEQ ID NO: 83628

SEQ ID NO: 121731 - RNA, 64 nt, hsa; identical to SEQ ID NO: 83629

SEQ ID NO: 121732 - RNA, 64 nt, hsa; identical to SEQ ID NO: 83630

SEQ ID NO: 121733 - RNA, 64 nt, hsa; identical to SEQ ID NO: 83631

SEQ ID NO: 121734 - RNA, 64 nt, hsa; identical to SEQ ID NO: 83632

SEQ ID NO: 121735 - RNA, 60 nt, hsa; identical to SEQ ID NO: 83633

SEQ ID NO: 121736 - RNA, 64 nt, hsa; identical to SEQ ID NO: 83634

SEQ ID NO: 121737 - RNA, 64 nt, hsa; identical to SEQ ID NO: 83635

SEQ ID NO: 121738 - RNA, 64 nt, hsa; identical to SEQ ID NO: 83636

SEQ ID NO: 121739 - RNA, 64 nt, hsa; identical to SEQ ID NO: 83637

SEQ ID NO: 121740 - RNA, 64 nt, hsa; identical to SEQ ID NO: 83638

SEQ ID NO: 121741 - RNA, 64 nt, hsa; identical to SEQ ID NO: 83639

SEQ ID NO: 121742 - RNA, 64 nt, hsa; identical to SEQ ID NO: 83640

SEQ ID NO: 121743 - RNA, 64 nt, hsa; identical to SEQ ID NO: 83641

SEQ ID NO: 121744 - RNA, 64 nt, hsa; identical to SEQ ID NO: 83642

SEQ ID NO: 121745 - RNA, 64 nt, hsa; identical to SEQ ID NO: 83643

SEQ ID NO: 121746 - RNA, 64 nt, hsa; identical to SEQ ID NO: 83644

SEQ ID NO: 121747 - RNA, 64 nt, hsa; identical to SEQ ID NO: 83645

SEQ ID NO: 121748 - RNA, 64 nt, hsa; identical to SEQ ID NO: 83646

SEQ ID NO: 121749 - RNA, 64 nt, hsa; identical to SEQ ID NO: 83647

SEQ ID NO: 121750 - RNA, 64 nt, hsa; identical to SEQ ID NO: 83648

SEQ ID NO: 121751 - RNA, 64 nt, hsa; identical to SEQ ID NO: 83649

SEQ ID NO: 121752 - RNA, 64 nt, hsa; identical to SEQ ID NO: 83650

SEQ ID NO: 121753 - RNA, 54 nt, hsa; identical to SEQ ID NO: 83651

SEQ ID NO: 121754 - RNA, 64 nt, hsa; identical to SEQ ID NO: 83652

SEQ ID NO: 121755 - RNA, 64 nt, hsa; identical to SEQ ID NO: 83653

SEQ ID NO: 121756 - RNA, 64 nt, hsa; identical to SEQ ID NO: 83654

SEQ ID NO: 121757 - RNA, 64 nt, hsa; identical to SEQ ID NO: 83655

SEQ ID NO: 121758 - RNA, 64 nt, hsa; identical to SEQ ID NO: 83656

SEQ ID NO: 121759 - RNA, 64 nt, hsa; identical to SEQ ID NO: 83657

SEQ ID NO: 121760 - RNA, 59 nt, hsa; identical to SEQ ID NO: 83658

SEQ ID NO: 121761 - RNA, 64 nt, hsa; identical to SEQ ID NO: 83659

SEQ ID NO: 121762 - RNA, 64 nt, hsa; identical to SEQ ID NO: 83660

SEQ ID NO: 121763 - RNA, 64 nt, hsa; identical to SEQ ID NO: 83661

SEQ ID NO: 121764 - RNA, 64 nt, hsa; identical to SEQ ID NO: 83662

SEQ ID NO: 121765 - RNA, 64 nt, hsa; identical to SEQ ID NO: 83663

SEQ ID NO: 121766 - RNA, 64 nt, hsa; identical to SEQ ID NO: 83664

SEQ ID NO: 121767 - RNA, 64 nt, hsa; identical to SEQ ID NO: 83665

SEQ ID NO: 121768 - RNA, 64 nt, hsa; identical to SEQ ID NO: 83666

SEQ ID NO: 121769 - RNA, 64 nt, hsa; identical to SEQ ID NO: 83667

SEQ ID NO: 121770 - RNA, 64 nt, hsa; identical to SEQ ID NO: 83668

SEQ ID NO: 121771 - RNA, 64 nt, hsa
uuucuuuugagaguacccccaguuuauuucuacugugcuuuauugcuacuguucuuuauuguga

SEQ ID NO: 121772 - RNA, 64 nt, hsa
ccuuuuuucauuauggaaaauaauuuaaacacuagugcuuuagugugcacucuccuguaagguc

SEQ ID NO: 121773 - RNA, 64 nt, hsa
gaacacauaggaaugucuguggggugacucuacugugcuuuaucuuuuaacauuaagugccuuu

SEQ ID NO: 121774 - RNA, 64 nt, hsa
ugugagaccaaauugcugaccugggucagugcaugugcuuuaugguguggugcaucuuuggaga

SEQ ID NO: 121775 - RNA, 64 nt, hsa
auauuuggcuucaaaggaguaccuuuacuuacaugugcuuuaugguaaguacauugaauuuuac

SEQ ID NO: 121776 - RNA, 64 nt, hsa
uuguaaugcauauccaucuuggauucaauccaaggugcuuuagcuaucaguaguaccaaaggau

SEQ ID NO: 121777 - RNA, 64 nt, hsa
caccuauucaauaacugaaaaagacauuaccauagugcuuuacauuuuuaaaguaauguuacaa

SEQ ID NO: 121778 - RNA, 64 nt, hsa
uuuaggugaucaggaugccguugguggcauuuacgugcuuuauaugauuuuuaccucuguaaca

SEQ ID NO: 121779 - RNA, 64 nt, hsa
auguuuccuuuuugggugaaauggauuuaugugagugcuuuaaacaaauagcaauacuuauaga

SEQ ID NO: 121780 - RNA, 64 nt, hsa
caccuaacuguucagucauucugguuuucaagcagugcuuuaucucauguccuugaauauaguu

SEQ ID NO: 121781 - RNA, 64 nt, hsa
cuguaacccuugguugccagagauaaagugaaaagugcuuuaggugagaugacuaaauuaugcc

SEQ ID NO: 121782 - RNA, 64 nt, hsa
ggaggaagauguuuuguaaucuuuuuuuccccaugugcuuuagugggcuuugguuuucuuuuug

SEQ ID NO: 121783 - RNA, 64 nt, hsa
auucagguggauaaauagucuuacaaaagacaaugugcuuuauguuauaccuauagcuuugguc

SEQ ID NO: 121784 - RNA, 64 nt, hsa
aaaaaaagauuuguaaaaucaccggaacaauugugugcuuuauuuuauagguagugguuauuag

SEQ ID NO: 121785 - RNA, 64 nt, hsa
caugcacaggaagauauugguggccggugguuuugugcuuuaaaaaugcaauaucugaccaaga

SEQ ID NO: 121786 - RNA, 64 nt, hsa
uuaaaagggaaguuauuuauauuuuguguauaaugugcuuuauuugcaaaucacccacuccuuu

SEQ ID NO: 121787 - RNA, 64 nt, hsa
ucugauggcaguuccucaaauaacuuuaacuuuugugcuuuagggauaguuguuaaaguuacaa

SEQ ID NO: 121788 - RNA, 64 nt, hsa
uccccaacaugguuaauuccaacucucagaucuugugcuuuaguuaguacaugugacucaccag

SEQ ID NO: 121789 - RNA, 64 nt, hsa
cuuucugauauggcaguuacacuuuuucacuuaagugcuuuaguuuagacuaacuuuacaacuu

SEQ ID NO: 121790 - RNA, 64 nt, hsa
gaggacagguuucuguuaagaucaccaaguagcugugcuuuaauuagagccagacaagcuuuca

SEQ ID NO: 121791 - RNA, 63 nt, hsa
aaucacccucgcuccgucaggcgggacucgugucccagagaggaaggggcugcugaggucuga

SEQ ID NO: 121792 - RNA, 63 nt, hsa
cucccaguuuugcucugcccagcaguguuggugcccagagaugacaagggccagggagccugg

SEQ ID NO: 121793 - RNA, 63 nt, hsa
uccagacacuucacggaaggaagaucacauguccccagagaggcacccccaggcaagcucgag

SEQ ID NO: 121794 - RNA, 63 nt, hsa
gagggccucgccuggcugcagccugcgccaccgcccagagacccaagcugccuccccucuccu

SEQ ID NO: 121795 - RNA, 63 nt, hsa
ggcucuccagaaccuucuaucccacagucaggccccagagagggcaggacaagccuugucccg

SEQ ID NO: 121796 - RNA, 63 nt, hsa
aagucaccagauauuuuguucccaucaguuuagcccagagauagacaguagaaugcaaauacc

SEQ ID NO: 121797 - RNA, 63 nt, hsa
accugcagguguaagggacgauuggaguuucuucccagagagucugucccagaaggacugugg

SEQ ID NO: 121798 - RNA, 63 nt, hsa
agcccucagcagcugcagaccgccccucaccaacccagagaaccugcuuuacuuugcccaggg

SEQ ID NO: 121799 - RNA, 63 nt, hsa
aggggucagaggcccaggcccugacuucggcuucccagagaucucuccgccuuaguuaagagc

SEQ ID NO: 121800 - RNA, 63 nt, hsa
uccugucuguauuugaugcaggauuaaacacuucccagagaggauucuagucugguaaauaac

SEQ ID NO: 121801 - RNA, 63 nt, hsa
gccaguggauccccugcggucaggcugggcagccccagagagaggauguggaaagcacuuuuu

SEQ ID NO: 121802 - RNA, 63 nt, hsa
gcgugucgguguauauaggaaccauguacagagcccagagaagcccccuacauccccccggga

SEQ ID NO: 121803 - RNA, 63 nt, hsa
ugacugcagaagaccaagaaccuguuccccaagcccagagauguccaccugggcuggacugcc

SEQ ID NO: 121804 - RNA, 63 nt, hsa
guguucucaggaagacugccuccaccaccgcuacccagagaaccucugcaucuggcauuucug

SEQ ID NO: 121805 - RNA, 63 nt, hsa
gcagccagcaccaccuacacaggagucuucagacccagagaaggacggugccaagggccccag

SEQ ID NO: 121806 - RNA, 63 nt, hsa
uugguuugacacccagccucuucccuggcccuccccagagaacuuuggguaccuggugggucu

SEQ ID NO: 121807 - RNA, 63 nt, hsa
aaccugcacacuugacaaguggagaaacagaagcccagagagagcacuggguuuguucaggac

SEQ ID NO: 121808 - RNA, 63 nt, hsa
uauucggauauucuguuuacacacccaugucaucccagagaggugaucacagggcagggacac

SEQ ID NO: 121809 - RNA, 63 nt, hsa
ucccugacuccuggugcccucucccuuuguccccccagagagacauaugcccccagagagagc

SEQ ID NO: 121810 - RNA, 63 nt, hsa
cucucccuuuguccccccagagagacauaugcccccagagagagcaaaucgaagcgugggagg

SEQ ID NO: 121811 - RNA, 63 nt, hsa
augauuaggauuagugcccuuauuuaaaaaggccccagagagcuaacucacccuuccaccaua

SEQ ID NO: 121812 - RNA, 63 nt, hsa
ccccaccucucacuuugcugugagcccgggaaccccagagaccacuccuguggagagcugagg

SEQ ID NO: 121813 - RNA, 63 nt, hsa
gugagggccaggcccuucccggcugcgaggacgcccagagaccgcgggcgcugagcgcguugg

SEQ ID NO: 121814 - RNA, 63 nt, hsa
cccaauuccaucaccacugccaacaacuccucccccagagaucuggcuggagcccagaaaaag

SEQ ID NO: 121815 - RNA, 63 nt, hsa
uaagacuauguugguacuuggacuuguucgugccccagagaugggcaaagcugugcacuugca

SEQ ID NO: 121816 - RNA, 63 nt, hsa
gccaaaacugauuagcuaguggacagagauaugcccagagaugcauauguguauauuuuuaug

SEQ ID NO: 121817 - RNA, 63 nt, hsa
cucuuaucuaugaagacaucuucccagaguguccccagagacaugcaagucaugggucacacc

SEQ ID NO: 121818 - RNA, 55 nt, hsa
cuauuaucauggaaaacuaauuuuucccagagaauuuccuuucaaaccucccagu

SEQ ID NO: 121819 - RNA, 63 nt, hsa
cagcccugggaagacacauucccuucccuguuccccagagagcccaccuccgcccugggcagg

SEQ ID NO: 121820 - RNA, 63 nt, hsa
agcugccggucuuggcuuccuggucgccucugucccagagauggucccagggagccauccuag

SEQ ID NO: 121821 - RNA, 63 nt, hsa
ccaucacuauaaucaacgaacuucucuucuccacccagagauggcuuuuccaacacauuuuaa

SEQ ID NO: 121822 - RNA, 63 nt, hsa
guuggcuuucccccagccgcacgggucccaggccccagagaagaugagucuauggcaucaggu

SEQ ID NO: 121823 - RNA, 63 nt, hsa
cuggggcugguggauugggcagaauccugggcccccagagaccuuugcccacacacacuccuu

SEQ ID NO: 121824 - RNA, 63 nt, hsa
ugaccuucagcuccuaugcaggcuucucuugagcccagagacaaggcagcuuggucuagugga

SEQ ID NO: 121825 - RNA, 63 nt, hsa
ucugaaagucaggccugcugcaggacaggaucccccagagaccccauuugccucucaacacuc

SEQ ID NO: 121826 - RNA, 63 nt, hsa
guuucaggaggagggagacugcccugcuuuggucccagagaggcccucugcagauaggcgugg

SEQ ID NO: 121827 - RNA, 63 nt, hsa
gaaucagaguggggaggggacagccuggggcugcccagagacuguggguggagcugccugcug

SEQ ID NO: 121828 - RNA, 63 nt, hsa
ccucuugcucaaaaaucuguuugaucccuguuacccagagaauauauacauucuuuaucuuga

SEQ ID NO: 121829 - RNA, 63 nt, hsa
uaccuuaaacucccacugcaagcccaugaacuucccagagaguggaacggcuugcucuucuuu

SEQ ID NO: 121830 - RNA, 63 nt, hsa
gacccacugcagacacaggcucugauucucuuacccagagaugcccaugagcugacauuuuac

SEQ ID NO: 121831 - RNA, 63 nt, hsa
caucagguuaaagacuucaucuagaugaugccccccagagaugccuuuaguguaaguagcugg

SEQ ID NO: 121832 - RNA, 63 nt, hsa
aauauaauuuuauauuuacacacauacgugcuacccagagauuaauuuaguccauaugaacua

SEQ ID NO: 121833 - RNA, 63 nt, hsa
aacuacacagaggcacauccugacaggguuugccccagagaucuaaauuccagaaggagggca

SEQ ID NO: 121834 - RNA, 63 nt, hsa
uugucuuuauccacccccacuguuguggucagccccagagaauuuuaucuucuuccuuggcau

SEQ ID NO: 121835 - RNA, 63 nt, hsa
uaagacugucauguaagaggugcucuccuggcacccagagaaaaggagcauccuuaccuccaa

SEQ ID NO: 121836 - RNA, 63 nt, hsa
gccaagcugccuuaacucgccccucggggcucccccagagacugugccccgggcgggccgcgc

SEQ ID NO: 121837 - RNA, 63 nt, hsa
ucugcgaucaguuaacccauuuuaccuaggaggcccagagaugugagggcuccuuccucagga

SEQ ID NO: 121838 - RNA, 63 nt, hsa
ccccaucuauucucuguuggcuccaagagcuaccccagagaccuuaaacagaaacaguagcug

SEQ ID NO: 121839 - RNA, 63 nt, hsa
auauauguagauauauauuuuagcagugacauucccagagagccccagagcucucaagcuccu

SEQ ID NO: 121840 - RNA, 63 nt, hsa
aaccccaguccugagcuugguuucuucccagcacccagagaauccuuccucagcucucuucuu

SEQ ID NO: 121841 - RNA, 63 nt, hsa
uuaucuaaaccuuuaaaccuaucuuccaggcagcccagagaagaucuguuucccuguguccug

SEQ ID NO: 121842 - RNA, 63 nt, hsa
uuugugugcaugggucagucaccauauguuccccccagagaaugugucuauauccuccuucua

SEQ ID NO: 121843 - RNA, 63 nt, hsa
caggauagucuaagggagguguucccaucugagcccagagauaagggugucuuccuagaacau

SEQ ID NO: 121844 - RNA, 63 nt, hsa
acagcugaguuguugagucuguuuuguaaaguccccagagaaagcgcagaugcuagcacaugc

SEQ ID NO: 121845 - RNA, 63 nt, hsa
uuagaaguacguuuuugcauuauucauaugcuucccagagaagcucauuuaguuagaaaauaa

SEQ ID NO: 121846 - RNA, 63 nt, hsa
ucacagccugacauggccagguucucacacuggcccagagaaaagagccucagcaagagaguu

SEQ ID NO: 121847 - RNA, 63 nt, hsa
acuguccaagcucucagccccacagggaaccugcccagagagcuuuaccuuucccaagcaucu

SEQ ID NO: 121848 - RNA, 63 nt, hsa
agugcacaucagcacuauggggccuauguccugcccagagaccucugcuccuuccugcucaca

SEQ ID NO: 121849 - RNA, 63 nt, hsa
auaccaauauucuauuuugcagauagaauuuggcccagagagguuaacuaauauauccaugau

SEQ ID NO: 121850 - RNA, 63 nt, hsa
caaucauguuaacucuuccuuaucagccuguggcccagagacacaaugggguccuucuguagg

SEQ ID NO: 121851 - RNA, 63 nt, hsa
ucugcacaaaacuuuugggaauuccucuuugcacccagagacucagaggggaagagggugcua

SEQ ID NO: 121852 - RNA, 63 nt, hsa
gcaguaauugcauuuuaucugucucaugaugcccccagagaacuuccaacucaguaggacccc

SEQ ID NO: 121853 - RNA, 63 nt, hsa
agcuguguccauggugugucaugaaggauguaccccagagaguaacaugagccacugggcaga

SEQ ID NO: 121854 - RNA, 63 nt, hsa
cccacauuccaaaagggggccugggaugcuagccccagagaugccagcccuucaggaagcagg

SEQ ID NO: 121855 - RNA, 63 nt, hsa
gcugcacugcagcaaaaacaaaaccaccaccaccccagagaaaaccauguacuaauuggagug

SEQ ID NO: 121856 - RNA, 63 nt, hsa
gcuuaagggucccaggaguacugcagggacagccccagagaggcccaacucuggccccuuucu

SEQ ID NO: 121857 - RNA, 63 nt, hsa
gcccuagacccugccagaaaagggggcucuucccccagagaaguggcuuggagggaacuuccc

SEQ ID NO: 121858 - RNA, 63 nt, hsa
ggaggagccugcugcauucuccugcugagggaucccagagagggcaggugcccaccccacagg

SEQ ID NO: 121859 - RNA, 63 nt, hsa
ggcagagccccaggcguccccagcuguucaccucccagagaguccccagagccccaaagggcu

SEQ ID NO: 121860 - RNA, 63 nt, hsa
uuccaugaggcaggcugaaccugcagauaugcgcccagagauauggaucgcccaagaguugcg

SEQ ID NO: 121861 - RNA, 63 nt, hsa
auggaaggaagagaguagggccagugaaggcugcccagagagaaugucacagaugaggcugcc

SEQ ID NO: 121862 - RNA, 63 nt, hsa
aaaguuccugcuuuaguguuuuguucccucugccccagagagcuccccuuagugaucucaguu

SEQ ID NO: 121863 - RNA, 63 nt, hsa
gagcccagcccugggcuggggggcuccucaggacccagagaugugccuggaaccacuccugau

SEQ ID NO: 121864 - RNA, 63 nt, hsa
cccucagguuguucucugauucuuccucccaaccccagagacugcagauuugugccaugcggc

SEQ ID NO: 121865 - RNA, 63 nt, hsa
ccucuauccuaaggaagaccaagcaggccuggacccagagacgucccccaucgugggacacga

SEQ ID NO: 121866 - RNA, 63 nt, hsa
uggcaggugaugugcuggguauagcauggaccucccagagaagcucaagcuauguggcacugu

SEQ ID NO: 121867 - RNA, 63 nt, hsa
gauugugcuucucaacuccaccccauaauuucucccagagaccaucuaucaccuuuuccccaa

SEQ ID NO: 121868 - RNA, 63 nt, hsa
gcuccagcagaaaccagauuggauguuccagcucccagagaagacucuaucacagugcacaua

SEQ ID NO: 121869 - RNA, 63 nt, hsa
acuggcacacgccccacgccuuccucuauaacccccagagacaggcuggggcagcgccaaggc

SEQ ID NO: 121870 - RNA, 59 nt, hsa
cacgaccuggccuggauugacaacauccucccagagaaggaaaaaaaggagacagacaa

SEQ ID NO: 121871 - RNA, 63 nt, hsa
aaaagcaguuagcauuuccacacaaccgcuguccccagagauaacugcuguuuucauuuuaau

SEQ ID NO: 121872 - RNA, 63 nt, hsa
augcuccuugacugaaacuuuaaggggaucucucccagagacuugacauuuuagcuuuauugu

SEQ ID NO: 121873 - RNA, 63 nt, hsa
uccccgcccguuuuacaaagggggaggcuaaagcccagagacagcuugaucaaaggcacacag

SEQ ID NO: 121874 - RNA, 63 nt, hsa
agcuuucuucuuacaccuugggcuuggauauugcccagagaagaaauuuggcuuuuuuuuucu

SEQ ID NO: 121875 - RNA, 61 nt, hsa
ugcaauuugugucuuccuaaagagagcuguacccagagaguccugugcugaauguggacuc

SEQ ID NO: 121876 - RNA, 63 nt, hsa
cugagcaacaggaggacucagccugggacaggccccagagagucacacaaaggaaucuuuauu

SEQ ID NO: 121877 - RNA, 63 nt, hsa
uucugacaaaaaguccagaacccauaaacauagcccagagaagagaggcucugaaagaaagga

SEQ ID NO: 121878 - RNA, 63 nt, hsa
cuccaggcuggccuuuggccgacugucugcucacccagagaccuuggacuccggacuauccau

SEQ ID NO: 121879 - RNA, 63 nt, hsa
augcaggaguuucuccugggcagcuggucacuccccagagaagcugggccuucauggacacau

SEQ ID NO: 121880 - RNA, 63 nt, hsa
guggaccuggagaccauccccuuggaaagacaacccagagauguucagcauccuguaucuaca

SEQ ID NO: 121881 - RNA, 63 nt, hsa
cuauguuucuauaagauauggugcccuguguaucccagagaugcuagaaaacuguucuuugcu

SEQ ID NO: 121882 - RNA, 63 nt, hsa
cucagcuuugggaugugggugggaacuggagcacccagagaaaacccauacagacaguggccu

SEQ ID NO: 121883 - RNA, 63 nt, hsa
aauagcugugauggaaggacuagagcgaaagggcccagagauaucaaggaagcuuuucauucu

SEQ ID NO: 121884 - RNA, 63 nt, hsa
acaaucaacuaguauuuguugagcuccuauuugcccagagauggucauauuuaaacagaagua

SEQ ID NO: 121885 - RNA, 63 nt, hsa
ggggauuguagcagacgucugggcuuuuccccacccagagaauagcccccuucgauacacauc

SEQ ID NO: 121886 - RNA, 63 nt, hsa
ucauagagucaacuguuucaucaucauagugagcccagagagccacugcccagcagcaugcuc

SEQ ID NO: 121887 - RNA, 63 nt, hsa
acuguaaaaacagcuguagguauaauguauauucccagagaauuguauuuaacuaauuaaugu

SEQ ID NO: 121888 - RNA, 63 nt, hsa
accaccggcacuuacaaaaugugcggacugaaucccagagaacacuggcagauguauacagua

SEQ ID NO: 121889 - RNA, 63 nt, hsa
accacugaaguagaauugauuguucagcuggagcccagagaauuuaauuuaauguuuuuucuu

SEQ ID NO: 121890 - RNA, 63 nt, hsa
ucaacugauuaaagcagugaccagcaggaacugcccagagaacuggcuggccuuguuuccuga

SEQ ID NO: 121891 - RNA, 63 nt, hsa
gcucaugccuccaagucagaguuucccuggugccccagagacaggagcacaagugggaucuga

SEQ ID NO: 121892 - RNA, 63 nt, hsa
aguguuuuacacaaaugcauaucuugaacgucacccagagacuguaauuuguguaguuuuucu

SEQ ID NO: 121893 - RNA, 63 nt, hsa
ggacugguuuuccaguacaucuuuaaacaaggccccagagacucuaugucugcccguccauca

SEQ ID NO: 121894 - RNA, 63 nt, hsa
gcggccgaggccggagcaccacauccaccucgccccagagaggcucugcucccuccuauggag

SEQ ID NO: 121895 - RNA, 63 nt, hsa
gccccggggcugccguuuugcugggcagugguucccagagagucagagcuggcaccccucagu

SEQ ID NO: 121896 - RNA, 63 nt, hsa
cuguucccgcugcacggcccaccggcggccagccccagagaccagaacugauccagagcugga

SEQ ID NO: 121897 - RNA, 63 nt, hsa
ggcaggggcaggcugaggaguugcccuuugccccccagagacugacucucagagccagagaug

SEQ ID NO: 121898 - RNA, 63 nt, hsa
cucuuaaugcuguguuugagcuuucaugaguuucccagagagacauagcuggaaaauuccuau

SEQ ID NO: 121899 - RNA, 63 nt, hsa
aacccuucauaggaaauccccacccccguccaccccagagacccugcccuuccacccggaggc

SEQ ID NO: 121900 - RNA, 63 nt, hsa
gcugugucagcccagccccuucccuucuccaggcccagagaacucuuccacaaacaagaugag

SEQ ID NO: 121901 - RNA, 63 nt, hsa
gggauguaggagggggaaggaggaaacaggaagcccagagagggcaaagggccuaccucgggg

SEQ ID NO: 121902 - RNA, 63 nt, hsa
ucucugcucagaacacuaccauucaccccaucucccagagacacucucccuccuccucuuuca

SEQ ID NO: 121903 - RNA, 63 nt, hsa
gggaacagggaauagaaccuuucaaagagguugcccagagaaaagcugggccucuugcauucg

SEQ ID NO: 121904 - RNA, 63 nt, hsa
caguagccuuggggcagagggcacccgcagagucccagagaugaugugggcagugggcagaga

SEQ ID NO: 121905 - RNA, 63 nt, hsa
ccagugucugucaugccccugaguucuuuuggucccagagaggcagccugggcagucuguuua

SEQ ID NO: 121906 - RNA, 63 nt, hsa
agggcagacaaacaggugagggugaguguggcacccagagacugcucuuccugcccucacccu

SEQ ID NO: 121907 - RNA, 63 nt, hsa
ugcauggaggcccuccugugcugggggaaugagcccagagaacagcgaaguagcuugcucccu

SEQ ID NO: 121908 - RNA, 63 nt, hsa
cugagcaccugcuucaugaaggaagauagguagcccagagaagaaguuuuggacuuaacaaca

SEQ ID NO: 121909 - RNA, 63 nt, hsa
uaauuguuuuagagcguguugcuguuguaacaucccagagaagaaugaaaaggcacaugcuuu

SEQ ID NO: 121910 - RNA, 63 nt, hsa
gcccggaggggucuggaggcauaagucuagaugcccagagagcauccaggcacugaacugcuc

SEQ ID NO: 121911 - RNA, 63 nt, hsa
acagaggacaggugacaaccaccucgaagagcucccagagauuguagaaagaguccaguguaa

SEQ ID NO: 121912 - RNA, 63 nt, hsa
ggugauaacuacuuagcacugcccuggugauuacccagagauaucuaugaaaaccaguggcuu

SEQ ID NO: 121913 - RNA, 63 nt, hsa
ccacagccucauuuuacagacagcccccugaggcccagagacaugcagcucucuguccacaac

SEQ ID NO: 121914 - RNA, 63 nt, hsa
aaggugagaggaaggcaaaggccagggaggggacccagagaggccuggcacacaaggcccaag

SEQ ID NO: 121915 - RNA, 63 nt, hsa
gaacucaggaaaagcaggaacccuuuccaaaagcccagagaugcccugggcucagaucuguaa

SEQ ID NO: 121916 - RNA, 63 nt, hsa
uuuugugccaaacccauaggucugaaacugagacccagagaggcugaaugacaugcucacagu

SEQ ID NO: 121917 - RNA, 63 nt, hsa
gguucagguggggucuccagaaggcugcuugcccccagagagccaucucuuccauuuuugauu

SEQ ID NO: 121918 - RNA, 63 nt, hsa
cucccauuugcucucagugaccccagggcagagcccagagaaguguuccguacccacugcuga

SEQ ID NO: 121919 - RNA, 63 nt, hsa
caaaucuuuauuuugcagaugaggaaacagcaacccagagaggagaacuaacccacacaggau

SEQ ID NO: 121920 - RNA, 63 nt, hsa
ggauacaucugaaagcauuccuuuggcauggaccccagagauaguuuuggagccaggcauuga

SEQ ID NO: 121921 - RNA, 63 nt, hsa
caucagcagggggaaagccaagcugagaauaaacccagagacaaagaacccucggacucaggc

SEQ ID NO: 121922 - RNA, 63 nt, hsa
gggcagaaggggcggcccggacgggggagcuuucccagagacccggggauggauuggccucca

SEQ ID NO: 121923 - RNA, 63 nt, hsa
auaauggccagagauauccacagcuuggaggagcccagagaccguuugcuuuauacccacaca

SEQ ID NO: 121924 - RNA, 63 nt, hsa
ugguuaugcagaagcagagaugaggaggcuggccccagagaugaucuugcccuuccuaacuaa

SEQ ID NO: 121925 - RNA, 63 nt, hsa
caccucagcaaaugcugcaaaauccuguuuucccccagagagcuggagguuaaauacuaccag

SEQ ID NO: 121926 - RNA, 63 nt, hsa
guaaauaaugugggaaaauaguauuguuuagcucccagagaaacauuuguuccacaguuaaca

SEQ ID NO: 121927 - RNA, 63 nt, hsa
gggcucagccauucggcuuggggcaccaggcuccccagagacaaugcucaguauucauucaua

SEQ ID NO: 121928 - RNA, 63 nt, hsa
ucuuuguaauuuaugcuuucauauauccuuggucccagagauguuuagacaauuuuaggcuca

SEQ ID NO: 121929 - RNA, 63 nt, hsa
caucccuacucaucagaaagacaaauauaaaaucccagagagguggaggagcuaaaaaagcaa

SEQ ID NO: 121930 - RNA, 63 nt, hsa
caauagcaacagaaauauaaauuauauuccauucccagagagagaaugcgcuuuggauuguuu

SEQ ID NO: 121931 - RNA, 63 nt, hsa
agccuucagucccuaucagcgccuccuuuacuucccagagaacuucacagagacucuguccuu

SEQ ID NO: 121932 - RNA, 63 nt, hsa
gagcugugucccuuuacuaugcaagcacaugaccccagagacagcugguucacuggcagaucc

SEQ ID NO: 121933 - RNA, 63 nt, hsa
ugugugcaaggcaauaguuagccuugauuuuagcccagagacagauggcagagcuaucucucu

SEQ ID NO: 121934 - RNA, 63 nt, hsa
ggagauguaaugacagagaguucuggugagauacccagagagaaaaagagagagcaggguggg

SEQ ID NO: 121935 - RNA, 63 nt, hsa
cugcuccccacaccuagccuuuguucuggaaaccccagagagggcugggcuugacucaucuca

SEQ ID NO: 121936 - RNA, 63 nt, hsa
accaggcaagagucuugcuuauugggcugcauccccagagaggauaugaauuauuuuuugaaa

SEQ ID NO: 121937 - RNA, 63 nt, hsa
ggggacccaaagggucuggccucuuugggcagccccagagaugaggggucagcagaggagagc

SEQ ID NO: 121938 - RNA, 63 nt, hsa
cacuccccuugccccacacccuuuacuccccagcccagagagacgcugcuuuuaccaggaaag

SEQ ID NO: 121939 - RNA, 63 nt, hsa
ggcagcaccauuugacagguuaggaugcuggggcccagagagguuaagugucuugcccgaggu

SEQ ID NO: 121940 - RNA, 63 nt, hsa
cagaccuggcuguggagagcagcuaauguguggcccagagagccugucuguguggagcacgua

SEQ ID NO: 121941 - RNA, 63 nt, hsa
ugugcuuauuucugccauugucccucucacguucccagagaggucauucuuuuugguccaacu

SEQ ID NO: 121942 - RNA, 63 nt, hsa
cccagcgucuugacgggagcauuggccccugagcccagagaagcuggaagccugccgaaaaca

SEQ ID NO: 121943 - RNA, 63 nt, hsa
agggcccagcccugcuuccuggaguggauguggcccagagaaggaggcugggggaucaccagc

SEQ ID NO: 121944 - RNA, 63 nt, hsa
cagcucuuucugcaugugcuggucaaauccaaacccagagaacagaagcgcuuucuaagaaug

SEQ ID NO: 121945 - RNA, 63 nt, hsa
gaacaguccauauuagcuccagagagugucaaacccagagaaaugugugcaaaaaugauacuc

SEQ ID NO: 121946 - RNA, 63 nt, hsa
cuugccccuuauuucuucccugcuucccucgaacccagagauuuuugagggaugaacggguag

SEQ ID NO: 121947 - RNA, 63 nt, hsa
cccugggaacugggucuuggguagcaaagcccucccagagaaaagauugggcacaacuaaggc

SEQ ID NO: 121948 - RNA, 63 nt, hsa
ugccucuguauuuaagccaacagaguuacccaacccagagacuguuaaucauggauguuagag

SEQ ID NO: 121949 - RNA, 63 nt, hsa
uccccucucccacugagucacagguuugagauucccagagaggccaaagacagcuacaggaag

SEQ ID NO: 121950 - RNA, 63 nt, hsa
gacugcuacuuccugucucuguuuccauuaucacccagagagggacaagauaggacauggccu

SEQ ID NO: 121951 - RNA, 63 nt, hsa
cucugggcugccggugggaggggaugucgccuccccagagaugccugguccgucuugggucug

SEQ ID NO: 121952 - RNA, 63 nt, hsa
ccaauaugugccacgugccuguggcugcagacucccagagaaccagcacuggguuuacagaau

SEQ ID NO: 121953 - RNA, 63 nt, hsa
cuucaggcaccuaggggagagcgugccugacaacccagagagauucgacagucagccuugugu

SEQ ID NO: 121954 - RNA, 63 nt, hsa
ugccaagccuguggaucaggaauaucaacagcccccagagaguggugcuggcugagggucuga

SEQ ID NO: 121955 - RNA, 63 nt, hsa
gcaccucccuucccucccugaggcaggugagaacccagagagaggggccugcaggugagcagg

SEQ ID NO: 121956 - RNA, 63 nt, hsa
acaccucagggcgggugagguuccgacacugaucccagagaugccguggauacgccagggucc

SEQ ID NO: 121957 - RNA, 63 nt, hsa
auuugaguuguuuuggugccugccucugccaugcccagagaaucagggcaggcuugccaccgg

SEQ ID NO: 121958 - RNA, 63 nt, hsa
aggacuuggcugcgcguaacugccuggucagugcccagagacaagugaaggugucugcccugg

SEQ ID NO: 121959 - RNA, 63 nt, hsa
cuuuacgaguguuuuuuauuugggacccucgagcccagagauauuaauggauaucuguauuca

SEQ ID NO: 121960 - RNA, 63 nt, hsa
cagaggaagcagcccucccucgauggccucuagcccagagaagcccgcgcaucuuggacccac

SEQ ID NO: 121961 - RNA, 63 nt, hsa
agaaaaaaaaaaaaggaggggaaaugcauuuuccccagagauaaaggcugccauuuugggggu

SEQ ID NO: 121962 - RNA, 63 nt, hsa
agaguguaugauucuggaacagggugaaacucucccagagacgaagaaagaguccugggauuu

SEQ ID NO: 121963 - RNA, 63 nt, hsa
augacaugacaucacucccaauucucuccaaaccccagagaaauacugacgaaguuuucugau

SEQ ID NO: 121964 - RNA, 63 nt, hsa
uguuuugaguuuugcccuggggcuugaaugagucccagagagucguucggauggugggaggcu

SEQ ID NO: 121965 - RNA, 63 nt, hsa
guacaacaaaggugacggguguguagguacacacccagagauggagcacugcagaucagcaac

SEQ ID NO: 121966 - RNA, 63 nt, hsa
agaaauaaacauuuagaggauuuaauuagaaagcccagagaaaaagccagaaaaccaagguaa

SEQ ID NO: 121967 - RNA, 63 nt, hsa
aaaggguauuucauaguuuuuaaaccuuucauucccagagauccgaaauaucauuuguggguu

SEQ ID NO: 121968 - RNA, 63 nt, hsa
auuaaucucauuguacaagugagaaaacugagacccagagagcuuaagugacuuccucgaggu

SEQ ID NO: 121969 - RNA, 63 nt, hsa
cccuuuaacacuggugaaagcuacgguacucuccccagagauaugucuugucagccucucuag

SEQ ID NO: 121970 - RNA, 63 nt, hsa
gagccugcaauuggaaauaugagaaauucuuugcccagagagcugcccuaacagaacacuuca

SEQ ID NO: 121971 - RNA, 63 nt, hsa
aguuauuuucugaaaaauugguucuucucuuuucccagagaccuucugaucuccaaaaagagg

SEQ ID NO: 121972 - RNA, 63 nt, hsa
aaaggguucuuggaggccaggggaauacggggucccagagaaagauuuccuucucuuagaagu

SEQ ID NO: 121973 - RNA, 63 nt, hsa
auuaaaaggaagcagaagcauugaccauuuuuucccagagaagaggagaaaucuguagugagc

SEQ ID NO: 121974 - RNA, 63 nt, hsa
gggaccagaugcuucccugugcuggcuggaguccccagagauaucagccaccgagucuccugg

SEQ ID NO: 121975 - RNA, 63 nt, hsa
acuacaaugggcugaaacaguugguauagcaaccccagagaagugcuucauuuucuuuuuaua

SEQ ID NO: 121976 - RNA, 63 nt, hsa
aagaaagaauugcaguaaagucuugucuggugacccagagaucaccaugacuugaggcacaaa

SEQ ID NO: 121977 - RNA, 63 nt, hsa
ucucuucuugcugcaaaacugguuggcuugcaacccagagagagcagcuucccuuggcucugg

SEQ ID NO: 121978 - RNA, 63 nt, hsa
uccacaguaguucaggcaauuaagaauaugcaacccagagaauuucugugaaaacauuuugcu

SEQ ID NO: 121979 - RNA, 63 nt, hsa
gccaaagccgaaaauaguauaugagcauucuagcccagagacugucgcuacuaaaagaaugaa

SEQ ID NO: 121980 - RNA, 63 nt, hsa
agggaaauggguagagccuguuugucuugcuuccccagagauagaaugugaagacacgcgcua

SEQ ID NO: 121981 - RNA, 63 nt, hsa
cuuggugccccgacccccaggguucgucuaggucccagagacccucugccuggaggcgggccu

SEQ ID NO: 121982 - RNA, 63 nt, hsa
gccgccuucuuggugccaaacccccuucccccacccagagacugggcagcugugucugguucg

SEQ ID NO: 121983 - RNA, 63 nt, hsa
gaggcaagcccccuugccuuucaaacuggaaaccccagagaaaacggugcccccaccugucgc

SEQ ID NO: 121984 - RNA, 63 nt, hsa
uacacuuuacagguaccuguuaucccuacgcuucccagagagaacaaugcugugagagaguuu

SEQ ID NO: 121985 - RNA, 63 nt, hsa
gaaggagccaggacacagcucagcuugcucacgcccagagagagaaaaaguuaagcugcugac

SEQ ID NO: 121986 - RNA, 63 nt, hsa
cucuugucccugggaggccucugcuugucacuucccagagauugcagagguguguccugccua

SEQ ID NO: 121987 - RNA, 63 nt, hsa
gcccagagcacuguuggaagucugguuagaguccccagagaguuacucuaaguuaaaaugagc

SEQ ID NO: 121988 - RNA, 61 nt, hsa
gucugaaguggacugugugagccugggcauucccagagaggaagggccgcugugcacugcc

SEQ ID NO: 121989 - RNA, 63 nt, hsa
cuuuuaauccaaagaacauguauaguuuuuguacccagagacuaugauuuauauugauugcac

SEQ ID NO: 121990 - RNA, 63 nt, hsa
uccucugccgggaggguguuuucaacuccaaaccccagagagggguuguagauuggguccagc

SEQ ID NO: 121991 - RNA, 63 nt, hsa
uuuaugaugacugcuuaacuccccacugccugucccagagaggcuuuccaauguagcucagua

SEQ ID NO: 121992 - RNA, 63 nt, hsa
ucagauggaacgaaaggcgaugugcaaggccaucccagagagacggaagcaggugcgauacua

SEQ ID NO: 121993 - RNA, 63 nt, hsa
cuaugucuggucaccagcucccuccugcuggcacccagagacccggacccgcagggccugccu

SEQ ID NO: 121994 - RNA, 63 nt, hsa
ggugucacguuggggaacaaguguccuucagaacccagagaaggccgccguucuguaaauagc

SEQ ID NO: 121995 - RNA, 63 nt, hsa
aaaacgggccgguauuuacacacgcgcaaaacacccagagacggcacaaggagguugaacuca

SEQ ID NO: 121996 - RNA, 63 nt, hsa
cuucagaccagccagcaaggggccgugccagugcccagagagcaggucagacaacaggcaacc

SEQ ID NO: 121997 - RNA, 63 nt, hsa
ccaguuucuugucuuuuuuauacauuuugucaucccagagacaaucaguaugugcuuaccugu

SEQ ID NO: 121998 - RNA, 63 nt, hsa
agaauuccaauuaauuaaauaucacaauagcaucccagagagacaguaggaaauuucuccuua

SEQ ID NO: 121999 - RNA, 63 nt, hsa
uccauggaggaggugucccaagcuuugaauacccccagagaccuuuucucucccauaccauca

SEQ ID NO: 122000 - RNA, 63 nt, hsa
aacuguggccaugacugaggaaaggagcucacgcccagagacugggcugcucucccggaggcc

SEQ ID NO: 122001 - RNA, 63 nt, hsa
aauggucucugucaagcgggccgucucccuuggcccagagacggagugugggagugauuccca

SEQ ID NO: 122002 - RNA, 63 nt, hsa
aaauugauuuguuaugguuacauauuuagcgcacccagagaaaauuaauuauauuucuacaga

SEQ ID NO: 122003 - RNA, 63 nt, hsa
cucuaaccaaucaaauaguuucuuugucuugcucccagagacaccuuguaaguguccccucug

SEQ ID NO: 122004 - RNA, 63 nt, hsa
aacagggaagagacauaccccugggcuuggauucccagagaggaaaccuuggggccccagaug

SEQ ID NO: 122005 - RNA, 63 nt, hsa
augggacccacguggaguaggugacauaugcuucccagagacugguauuguggcugugccagg

SEQ ID NO: 122006 - RNA, 63 nt, hsa
ggcuccuccaggcacgucccggaccuguggggccccagagaggggacauuucccuccugggag

SEQ ID NO: 122007 - RNA, 63 nt, hsa
uacuaaaauacugauuaucuuaaucacauuuuccccagagauaaacauugagagaacgaaagc

SEQ ID NO: 122008 - RNA, 63 nt, hsa
cgagagcugucggaaccagaugcaacccggcagcccagagaacucuccugggaggcugugggu

SEQ ID NO: 122009 - RNA, 63 nt, hsa
auaaagugaaucaaauuugacauuauuuuagaucccagagaaaucaggugugauuaguucucc

SEQ ID NO: 122010 - RNA, 63 nt, hsa
uagggcauagaguugucuccuucccaacacggacccagagagcagcccuucccugcucaaagc

SEQ ID NO: 122011 - RNA, 63 nt, hsa
uacagagcagugugggcagccccaagugugguccccagagagcguuuggcuuuccugucuguc

SEQ ID NO: 122012 - RNA, 63 nt, hsa
aguguuccucgacauguuucuccagugacaccucccagagaaguuguaaguauaaaaugaaaa

SEQ ID NO: 122013 - RNA, 63 nt, hsa
ugaaauguugacuuaagugagggggaaauaaaacccagagagagagagagagcgagagagaga

SEQ ID NO: 122014 - RNA, 63 nt, hsa
agauccucaucugagagugcuuaaaaugggauccccagagaccauuaaccaauacuggaacug

SEQ ID NO: 122015 - RNA, 63 nt, hsa
cccagccugaggcuccagcugaugcccucagcucccagagagggggugccccaucuagcuggg

SEQ ID NO: 122016 - RNA, 63 nt, hsa
ccacaccacgugcccucuuggcccagccuuccucccagagaggcggccugacuuaccuggaug

SEQ ID NO: 122017 - RNA, 63 nt, hsa
uuccuuccccucuguaaauguccaugacuauugcccagagaaggcuuaccccucucuaggguu

SEQ ID NO: 122018 - RNA, 53 nt, hsa
caaguagcaaaaaaacaugaacucccagagaaggauugugggagacacuuuuu

SEQ ID NO: 122019 - RNA, 63 nt, hsa
ucacaugggacugggauaugggggcaucucuuccccagagaggcacucagugagccuccugug

SEQ ID NO: 122020 - RNA, 63 nt, hsa
guuagcguuacuucuccuguggucaguaaguugcccagagagaaggaacaaaggucuggaguu

SEQ ID NO: 122021 - RNA, 63 nt, hsa
ugacacguggacaaaugcgggcucaucagcccccccagagagggucaggccgaaccccauuuc

SEQ ID NO: 122022 - RNA, 63 nt, hsa
gaguccagcuccccccaagaugagcugcagccccccagagagagcucugcacgucaccaagua

SEQ ID NO: 122023 - RNA, 63 nt, hsa
ccccaacaaauauuaaauggcuucuucuuaaagcccagagaaagagguuuuuuaaaagacugu

SEQ ID NO: 122024 - RNA, 63 nt, hsa
ccagacuuuaggagugugagggaugcugaaucucccagagagcucacacuggccaggaaugcu

SEQ ID NO: 122025 - RNA, 63 nt, hsa
acaucuauugucauuccauugcuauuuuuuuuccccagagacuuccauaauuuaaaauaaaau

SEQ ID NO: 122026 - RNA, 63 nt, hsa
uaauuuuuuaaaaauggaagguaaacugcauagcccagagaaagauaaguaaauauuuaagaa

SEQ ID NO: 122027 - RNA, 63 nt, hsa
acguacaguuguauggauuguguacugcacaaccccagagaauaccagucacaucaaucaggg

SEQ ID NO: 122028 - RNA, 63 nt, hsa
cuuaaaugucgguccaggcccugugcaccuuaccccagagacagacucuuuuuguaagauuuu

SEQ ID NO: 122029 - RNA, 63 nt, hsa
cggggggccccagucagccucucucccagucuacccagagaagccccuuccccaugggaagac

SEQ ID NO: 122030 - RNA, 63 nt, hsa
cacgagaagugaccuucagggucaucaggcugucccagagagguccgcguucuccccaccccg

SEQ ID NO: 122031 - RNA, 63 nt, hsa
uguacauacauuguauaggccaucuguaaauaucccagagaacaaucacuauucuuaagcacu

SEQ ID NO: 122032 - RNA, 63 nt, hsa
cuugcuguuuaaaaguaaugcaauaugugaacgcccagagaacaagcacuguggaacugcuau

SEQ ID NO: 122033 - RNA, 63 nt, hsa
ggacacuuggcuuuggggggaaggaaacugaggcccagagaggggcaaccacuggccaagggu

SEQ ID NO: 122034 - RNA, 63 nt, hsa
auaacaugguacaugcuucaggacuacauaugacccagagagcaagguggcugaacuauaguc

SEQ ID NO: 122035 - RNA, 63 nt, hsa
aaaacccaagaguuuguacagacauccugucuucccagagaagguggacacucuugggcucau

SEQ ID NO: 122036 - RNA, 63 nt, hsa
gguagggagaggacaaggggucaccgagcccuucccagagagcagggagcuuauaaauggaac

SEQ ID NO: 122037 - RNA, 63 nt, hsa
ugcaaagcaguguccaggagcaggccacuacugcccagagagcagaggaggagguuguuggca

SEQ ID NO: 122038 - RNA, 63 nt, hsa
cugcucgggaaggccugagggaagcccacccgccccagagacugcccacccugggccucccgu

SEQ ID NO: 122039 - RNA, 63 nt, hsa
ccuguacaucuaauauauacugauuuguuugcccccagagaauuuuuaagguaucugccuaua

SEQ ID NO: 122040 - RNA, 63 nt, hsa
ggcucugcauagccaggaugacggcuuucaugucccagagaccuguugugcuguguauuuuga

SEQ ID NO: 122041 - RNA, 63 nt, hsa
accagucggaagggauucuggcuauugggggagcccagagacaggggaaggcagccuguccau

SEQ ID NO: 122042 - RNA, 63 nt, hsa
gggacacaagucacuucaagaagucuggugguccccagagaaacaacuauguuauccauccug

SEQ ID NO: 122043 - RNA, 63 nt, hsa
uaaagaagccucuucuauuuaaugcagacccggcccagagacugugcgugccacuaccaaagc

SEQ ID NO: 122044 - RNA, 63 nt, hsa
uaggaggauccacaggauuugagaugcuaaggccccagagaucguuugauccaacccucuuau

SEQ ID NO: 122045 - RNA, 63 nt, hsa
uucaggaaagaagugcagaauuucuuccccaagcccagagaagagcagcccugagccccugua

SEQ ID NO: 122046 - RNA, 63 nt, hsa
agggucagaacuggacagcugcagagaccugugcccagagaagggucucgacccacucaagga

SEQ ID NO: 122047 - RNA, 63 nt, hsa; identical to SEQ ID NO: 121970

SEQ ID NO: 122048 - RNA, 63 nt, hsa
gaccuucagcccucccuacagccggggguguggcccagagaagcuuccagcacagcccucuac

SEQ ID NO: 122049 - RNA, 63 nt, hsa
uaacuggacauuaguguacagcccauguccaagcccagagagaaaacaaugggaacaauuuca

SEQ ID NO: 122050 - RNA, 63 nt, hsa
ccugaggucuccuauucuacucugaaccauaaacccagagaagaauuacucauuaaccagcau

SEQ ID NO: 122051 - RNA, 63 nt, hsa
aaccugggcuaagaguuuggcauugcaggagcucccagagagacugccuucccuacacuagaa

SEQ ID NO: 122052 - RNA, 63 nt, hsa
uacuuuaaaugccugccaaggagcagccucaagcccagagaagacugaggcuacggggaacuu

SEQ ID NO: 122053 - RNA, 63 nt, hsa
cccaaugccaacccccaccccguuucccuggugcccagagaacccaccucucccccaagggcc

SEQ ID NO: 122054 - RNA, 63 nt, hsa
gaaaucucuuuguggcuuucaugggcagggaaucccagagauagcaaaugccaccugaccaga

SEQ ID NO: 122055 - RNA, 63 nt, hsa
uuaucuuccuuuugugguuuuuaauuugaagaccccagagaauuccauuacauaaugauuuug

SEQ ID NO: 122056 - RNA, 63 nt, hsa
cuaauacuuucucccuaauggaagcccugaucccccagagagcuacaggucugcucccgacgg

SEQ ID NO: 122057 - RNA, 63 nt, hsa
cccaaacuugugacugcaucccucuggagucuacccagagacagagaaugugucuuuaugugg

SEQ ID NO: 122058 - RNA, 63 nt, hsa
aggaaacagacagcggacugaggaagcgauggccccagagaaagggccccuguagccuggcuc

SEQ ID NO: 122059 - RNA, 63 nt, hsa
acaaaugaagagaaaagccaugcccaccccagccccagagaaaccaauaagaauccucuauua

SEQ ID NO: 122060 - RNA, 63 nt, hsa
uaaaggcuccuggccucucaucaggaucugccccccagagaccccccccagacacugcagggc

SEQ ID NO: 122061 - RNA, 63 nt, hsa
uugaucaccaugaaagaagaauaguuuuuuguccccagagacauucauuuaguugauauaauc

SEQ ID NO: 122062 - RNA, 63 nt, hsa
uggugugggccagaaacaagggacagugaaacacccagagacuuguaucagcaggaagccauu

SEQ ID NO: 122063 - RNA, 63 nt, hsa
acagagcacagcucaugggcaacaucacuggggcccagagagagcuguccgccagugcaucau

SEQ ID NO: 122064 - RNA, 63 nt, hsa
ucuagcaucacuccugagcugcgggagagguggcccagagaacagcagagucaguuacaccug

SEQ ID NO: 122065 - RNA, 63 nt, hsa
auguggcccaacacaauucuucuuccaacguggcccagagaagccaaaagauuggauacgcau

SEQ ID NO: 122066 - RNA, 63 nt, hsa
agguccaacccugcaaugaagcagccacuucagcccagagagauuauaagaacugauguggcc

SEQ ID NO: 122067 - RNA, 63 nt, hsa
cagcguuugccagagguggccacuucagccaagcccagagaagugugggcagaagcagugaag

SEQ ID NO: 122068 - RNA, 63 nt, hsa
auuuucugcaugggacucugaguuccuuuccuucccagagaguuuuaccguaugaagccugga

SEQ ID NO: 122069 - RNA, 63 nt, hsa
gucuuuuuugcccagaucuuuuaagacuuacaccccagagauuuaagaagaaaaccucuaaau

SEQ ID NO: 122070 - RNA, 63 nt, hsa
gcauggcuuugaccuaguaugaacuggugucugcccagagagcagcauguagcaggggggaau

SEQ ID NO: 122071 - RNA, 63 nt, hsa
uugugucugaaaccgguuuuaaaaugugacucucccagagaagaagccgcuggcuguaugaaa

SEQ ID NO: 122072 - RNA, 63 nt, hsa
cuagggcugggguucucaagccccuggcccuggcccagagauuuggauucccuuggcggccgu

SEQ ID NO: 122073 - RNA, 63 nt, hsa
auccuuggucaucauugucuccuucccaccuggcccagagaugcuuaaauccaaguuguuucu

SEQ ID NO: 122074 - RNA, 63 nt, hsa
ccucccaguuggccagaaucugaggggagagcccccagagagcccccuuccccaucagaagac

SEQ ID NO: 122075 - RNA, 63 nt, hsa
ucccuagggucucuucuugcuugacucaaucuacccagagaugccccuuagcacaccuagagg

SEQ ID NO: 122076 - RNA, 63 nt, hsa
uaaugcacuuuaaauaagguagaauggaaaaaacccagagagcaaagugcauuacuuaaagau

SEQ ID NO: 122077 - RNA, 63 nt, hsa
ggccugaugaaagcuuccugaguggugucgggucccagagagggagcccaccugcugccuggg

SEQ ID NO: 122078 - RNA, 63 nt, hsa
cugcucagccaggccucuccugggagccacucgcccagagacucagcuuggccaacuuggggg

SEQ ID NO: 122079 - RNA, 63 nt, hsa
ggcccucucugaaggaggccaccuccuaaaaggcccagagagaagagccccacucucagaggc

SEQ ID NO: 122080 - RNA, 63 nt, hsa
cagacuugggugcuuagcuucagauacucuaugcccagagauagugcacuuggcagcugucag

SEQ ID NO: 122081 - RNA, 63 nt, hsa
guaaagcuaggcagaugagcccagaagaauggucccagagaaagcagacuggcuccaauagau

SEQ ID NO: 122082 - RNA, 63 nt, hsa
gugccuacuguuccccaccucagaagcuuccugcccagagagccagcagccuugggauacuaa

SEQ ID NO: 122083 - RNA, 63 nt, hsa
uugcacugugcucucccacaaguccagcugcaacccagagauaguggaaacugaaauuaggaa

SEQ ID NO: 122084 - RNA, 63 nt, hsa
cucugaaaccaaacagcauccugccaugagcuucccagagacagaagagacuggagcaaaguc

SEQ ID NO: 122085 - RNA, 63 nt, hsa
uacugccacuaguguucaagugccucuuguuuucccagagauuuccugggucugccagaggcc

SEQ ID NO: 122086 - RNA, 63 nt, hsa
uuccccaucuguuggaccaaauaaucucaaaggcccagagaggacagugaccauccacagaca

SEQ ID NO: 122087 - RNA, 63 nt, hsa
auuccuuccaggagcaguaggugggagguuugacccagagaagccaauccuugcauuccagga

SEQ ID NO: 122088 - RNA, 63 nt, hsa
aaccaaggagcuggggcccaaggccaguccugccccagagacacuccaaguccgccaggggca

SEQ ID NO: 122089 - RNA, 63 nt, hsa
caaagagggccccagcccagccccaccacagaucccagagauaggggcccagucuccaugggg

SEQ ID NO: 122090 - RNA, 63 nt, hsa
ugcacccggggcugcaaacgucuccgugcagcccccagagagaggcccaugggcucagaccag

SEQ ID NO: 122091 - RNA, 63 nt, hsa
uuuccuaccaccuuuguggccgaccccaagcaccccagagauaugaggcacccuuugcuccac

SEQ ID NO: 122092 - RNA, 63 nt, hsa
agauuguucuccagcaccccacauucaccccugcccagagauucccccuucuccucuccccua

SEQ ID NO: 122093 - RNA, 63 nt, hsa
gucagucccucuaucccuucuccuguccaggggcccagagagaaacacaccuaccccuggccu

SEQ ID NO: 122094 - RNA, 63 nt, hsa
cgaggccgcgugcgugagaaccgcgccgguguccccagagaccaggcugugucccucuucucu

SEQ ID NO: 122095 - RNA, 63 nt, hsa
guccagccuaaucaagucaaauggagaaacaggcccagagaggaagguggcuuaccaagauca

SEQ ID NO: 122096 - RNA, 63 nt, hsa
uuaucccagucguacucuuccagguuuggaagacccagagaggccaagaucccauccuuagcc

SEQ ID NO: 122097 - RNA, 63 nt, hsa
gaccucacucuaacucaaaguaauguccagguucccagagaauaucugcugguauuuuucugu

SEQ ID NO: 122098 - RNA, 63 nt, hsa
guguuuucaucucuuggucauaauuccgagauccccagagaccacuguuucuggaguaucugu

SEQ ID NO: 122099 - RNA, 63 nt, hsa
gggacugcagagaggcuacuggaagguuaaggacccagagagaaaucgagaggugcccuacag

SEQ ID NO: 122100 - RNA, 63 nt, hsa
gagacuuucagcccuaaaucuagacucaagguucccagagaugacaaauggagaagaaaggcc

SEQ ID NO: 122101 - RNA, 63 nt, hsa
uauggauuaucuuuauaucacugucuuucuaagcccagagaugucauaagugacaagaaaagu

SEQ ID NO: 122102 - RNA, 63 nt, hsa
guccuauacucacaucagacaugugaucauagucccagagacagaguugaggucucgaagaaa

SEQ ID NO: 122103 - RNA, 63 nt, hsa
aggagggagccgggagccuggugggaagccuuccccagagagauggcuuuaggggcuuuauuu

SEQ ID NO: 122104 - RNA, 63 nt, hsa
ccauauccuuucuugaacgcacauucagcuuaccccagagagcaagugaggcaaucuggcaaa

SEQ ID NO: 122105 - RNA, 63 nt, hsa
cagcaaccugccagcuacaggagcccccugcgucccagagacucccucacccaggcaggcucc

SEQ ID NO: 122106 - RNA, 63 nt, hsa
auucuacccaaaugucaggaccaggauuuucuacccagagaccaagguguucuucccaaagac

SEQ ID NO: 122107 - RNA, 63 nt, hsa
auucuacccauaugucaggaccaggauuuucuacccagagaccaagguuaucuuccuaaagac

SEQ ID NO: 122108 - RNA, 63 nt, hsa
auucuacccauaugucaggaccgggauuuucuacccagagaccugcauguucucuccaacgac

SEQ ID NO: 122109 - RNA, 63 nt, hsa
ucuucccaucaauauccuaaaugugggggagggcccagagaauggcacccaagagccugcggg

SEQ ID NO: 122110 - RNA, 63 nt, hsa
aguccuucacacucacacuacucuguuccucuucccagagacaucgauucacuucaaagagcu

SEQ ID NO: 122111 - RNA, 63 nt, hsa
cuguggcugcggccgggagcccgccccgcuucccccagagacuguaucguggcaccguggcgc

SEQ ID NO: 122112 - RNA, 63 nt, hsa
acaccaaugcugcuauccgcaagcucaagagaucccagagauucuaaccaccaugccuacuug

SEQ ID NO: 122113 - RNA, 63 nt, hsa
aaaauaccagaaaaugagggccgcuuugagucccccagagaugucaucagagcuccucugucc

SEQ ID NO: 122114 - RNA, 63 nt, hsa
uagacuguggcccagaauagggcuggggcagcucccagagaaugaauagugcuguuuccuauu

SEQ ID NO: 122115 - RNA, 63 nt, hsa
ccugcuauccagccgcaaauccauacccccugccccagagaagccucagucccucccuccugg

SEQ ID NO: 122116 - RNA, 63 nt, hsa
cuucccaggacccugggucaccuuccugggcagcccagagagacccugccaacuuuccagacu

SEQ ID NO: 122117 - RNA, 63 nt, hsa
uccguggguuuccccuuugauucuguaaauagucccagagagaauucgugggcugagggcaau

SEQ ID NO: 122118 - RNA, 63 nt, hsa
ccaggaggcaggggaaaaaucuccuuucugcuucccagagagggucuggccuugcccaaggcc

SEQ ID NO: 122119 - RNA, 63 nt, hsa
gagguaacgaggagggcggacuccaggccccggcccagagauuuggacuuggcuggcuugcag

SEQ ID NO: 122120 - RNA, 63 nt, hsa
uauuucccauuugugccagaggaauccuggcagcccagagacuuuguagauccuuagaggucc

SEQ ID NO: 122121 - RNA, 63 nt, hsa
uagcugccggccucuggaggcuccgagccugcccccagagacgucccugccccuccaggaccu

SEQ ID NO: 122122 - RNA, 63 nt, hsa
augagauuuacuaaguugacuuaccugacggaccccagagaccuauugcauugagcagugggg

SEQ ID NO: 122123 - RNA, 63 nt, hsa
auuguuaguccgggaccuucaguacugccaagucccagagaaaacccuuuuacucuggggaga

SEQ ID NO: 122124 - RNA, 63 nt, hsa
aucuuuuccagaguaugcaacucugacguugaucccagagagcagcuucagugacaaacauau

SEQ ID NO: 122125 - RNA, 63 nt, hsa
agacccauguaaauaccagacugcagguuggaccccagagauucccaagccaaaaaccuuagc

SEQ ID NO: 122126 - RNA, 63 nt, hsa
ccuggggggaggcaggaggcacaugugaggguccccagagagaagggagugggugggcagggg

SEQ ID NO: 122127 - RNA, 63 nt, hsa
gugcuauuagugcaauaaggugaaggcugucugcccagagaaauaaguaauuuauauaagaaa

SEQ ID NO: 122128 - RNA, 63 nt, hsa
aaaucuggucuagcugggugaaacccuuauuuucccagagaugccuuaaccuuuguugguuuu

SEQ ID NO: 122129 - RNA, 63 nt, hsa
cccugcugacugcgccugucuucucccucugaccccagagaaaggggcuguggucagcuggga

SEQ ID NO: 122130 - RNA, 63 nt, hsa
gcccgggacccccgucuccaggggugccccagacccagagauuagccucccacuucggcgcag

SEQ ID NO: 122131 - RNA, 63 nt, hsa
aucuccacccaucucuacaucugggcacagcaacccagagauggccaaaagcauucaagccug

SEQ ID NO: 122132 - RNA, 63 nt, hsa
agauggccuucuuugucaucuucacucuccacccccagagaggagucagagccauaacucaau

SEQ ID NO: 122133 - RNA, 63 nt, hsa
gguuugacuuauucuucguaucauuagaagaaccccagagauagcauuccucuauuuuauuuu

SEQ ID NO: 122134 - RNA, 63 nt, hsa
aggaggaggagggagaaauggccaccacaucaccccagagaaauuucuggaaucugauugagu

SEQ ID NO: 122135 - RNA, 63 nt, hsa
ccuacucacauuuccuuggguuggagcaacagucccagagagggccacggugggagcugcgcc

SEQ ID NO: 122136 - RNA, 63 nt, hsa
cuguaauaucuuacuaaggccuuugguauacgacccagagauaacacgaugcguauuuuaguu

SEQ ID NO: 122137 - RNA, 63 nt, hsa
guaggaaggggaguaauaauguaaaacaacugacccagagaagcuaaaagccacuggcagcac

SEQ ID NO: 122138 - RNA, 63 nt, hsa
cagcuccuucucuuuucucagggacaaaugaggcccagagagaauacgaccuguguaagguca

SEQ ID NO: 122139 - RNA, 63 nt, hsa
ggugccccaaaaugcaagauuuuccacaagauucccagagacaggaaaauccucuggcuggcu

SEQ ID NO: 122140 - RNA, 63 nt, hsa
guccuugcaccugcauccguaguucccugaaaacccagagaggaaucagacuucacacugcaa

SEQ ID NO: 122141 - RNA, 63 nt, hsa
gggcagagggcagaggcuggaggcagggccuugcccagagaugccuccaccgcugccuaagug

SEQ ID NO: 122142 - RNA, 63 nt, hsa
aguuguggcucuuugucuaggacccagaucauccccagagagagcccccacaagcuccucagg

SEQ ID NO: 122143 - RNA, 63 nt, hsa
ggggcccuggcuauuugggaccuaagccuaggccccagagaucagcccgaacacccgcauccc

SEQ ID NO: 122144 - RNA, 63 nt, hsa
gacccucuuggcuuucccgugcucuuugggcuccccagagaccugacaguauuagggagugaa

SEQ ID NO: 122145 - RNA, 63 nt, hsa
aaguacugagagcccagccccagacagcugcugcccagagaagaaccagcuccacggcuccug

SEQ ID NO: 122146 - RNA, 63 nt, hsa
cucagccuggccagacacaggcccucccuguuccccagagaaaggggagcccacuguccuggg

SEQ ID NO: 122147 - RNA, 63 nt, hsa
ugcugacggccagggagaagcuccucuccccagcccagagacauacuugaagggccagagcca

SEQ ID NO: 122148 - RNA, 63 nt, hsa
ccagccuggccuguggcugcccuccaucccuuccccagagauggcuccuugggaugaagaggg

SEQ ID NO: 122149 - RNA, 63 nt, hsa
caacucccccccaacaaugccauucccacuugccccagagaagcuacucggccaaaccuagcc

SEQ ID NO: 122150 - RNA, 63 nt, hsa
gcccuucugggguccugguuccugaagagcucacccagagaggcucaaagcagccuuuugucc

SEQ ID NO: 122151 - RNA, 63 nt, hsa
cuuggaccucuuugauucugugguuuggaggcucccagagacgugccuaguccugugugccuu

SEQ ID NO: 122152 - RNA, 63 nt, hsa
cucuccacccagcccgcuccugacccuuaucuucccagagaccaggccaggaaggcccgagau

SEQ ID NO: 122153 - RNA, 63 nt, hsa
gugccagaauuaagugagucaagccaaguaaagcccagagaagauucucaucagcacuuuugu

SEQ ID NO: 122154 - RNA, 63 nt, hsa
auuuggcaguacaaaugagucugaguguaauagcccagagauuuauauauaguugaaugucua

SEQ ID NO: 122155 - RNA, 63 nt, hsa
ggaaacagacuuaucauuauugauuugagguuucccagagauauaguucacaguuaauuguug

SEQ ID NO: 122156 - RNA, 63 nt, hsa
gauaggcacacgaggaugaguggcuuuguaucgcccagagaggugcuuguccagauuucacau

SEQ ID NO: 122157 - RNA, 63 nt, hsa
aguaaaggagaaaauaaaauuguuagcauucuacccagagauaauaucaauucauauuguagu

SEQ ID NO: 122158 - RNA, 63 nt, hsa
uuuucauucuuguauuauaauuaauuuucuacccccagagauaaauguuuguuuauaucacug

SEQ ID NO: 122159 - RNA, 63 nt, hsa
accuguccugcccuucuuagcuugaagggaaaccccagagacucuucugucagggaaaacuag

SEQ ID NO: 122160 - RNA, 63 nt, hsa
aucucagcucuccuaaucccaucacuuccccagcccagagaagacauuccaacccugucugau

SEQ ID NO: 122161 - RNA, 63 nt, hsa
ugguaagaagccaaauauuuaagcucacuucuucccagagagaggaagcucugcucaggccuc

SEQ ID NO: 122162 - RNA, 63 nt, hsa
uaucucuaaggccaauaaggauaacauuaucuacccagagaguuuagaagaaaaguaggaguc

SEQ ID NO: 122163 - RNA, 63 nt, hsa
ucuucaccucccugcaaaccuaccagugaggcucccagagacgcagcugucucagugccaggg

SEQ ID NO: 122164 - RNA, 63 nt, hsa
ugauggcuuugucccaucauagggggguguccccccagagacaaagcugcagagcacauucca

SEQ ID NO: 122165 - RNA, 63 nt, hsa
cuuuuaaggacgcuuaugaucacauugcgccuacccagagaacccaggucgucuuucuauuuu

SEQ ID NO: 122166 - RNA, 63 nt, hsa
uugccuucccuuuugcccuuugggcauuccuuccccagagagggccuggaaauuauaaaucuc

SEQ ID NO: 122167 - RNA, 63 nt, hsa
uaaauaucaguucuguuuaucugaaggcuccuacccagagauucuacccagugaaacucccac

SEQ ID NO: 122168 - RNA, 63 nt, hsa
ucuccagcccugcaugccgucucaagggugggccccagagaguuuggaguguaggauucccuc

SEQ ID NO: 122169 - RNA, 63 nt, hsa
gccauccuaaggggacaugaugguucugugauucccagagagcuggcagauugugacaaucuc

SEQ ID NO: 122170 - RNA, 63 nt, hsa
uggggaccggccaggaaggaggggugacuucaucccagagagacccgaguucccccagcccuu

SEQ ID NO: 122171 - RNA, 63 nt, hsa
aggggaggagcgacaccuccaggcuuccgggagcccagagagcauguggcaggcaguggggcc

SEQ ID NO: 122172 - RNA, 63 nt, hsa
uguggcccacuugugggagucuccuguccaccucccagagacggccacccagcgggucuggcu

SEQ ID NO: 122173 - RNA, 63 nt, hsa
accgccaccugccggccucgagaggggccgaugcccagagacacagcccccacggacaaaacc

SEQ ID NO: 122174 - RNA, 63 nt, hsa
ugugagucuucucgaaggaggguugacucagaacccagagacaauacaaaaccccucacuucc

SEQ ID NO: 122175 - RNA, 63 nt, hsa
uacucaucccuuaacuucucccuuaccagugaccccagagacagagccaggacaggagugggg

SEQ ID NO: 122176 - RNA, 63 nt, hsa
aauacugccuuuggaauaugacagaaucaauagcccagagagcuuagucaaagacgauaucac

SEQ ID NO: 122177 - RNA, 63 nt, hsa
caucagcaagagagagcagcuggaacagcaggucccagagaacuacuucuaugugccagaccu

SEQ ID NO: 122178 - RNA, 63 nt, hsa
ccuggggauccagcggauggacagcuuggcucucccagagaggugaaggagcaccuggccuua

SEQ ID NO: 122179 - RNA, 63 nt, hsa
ggagcgccuggaagcagaaccaguagcuacaggcccagagauggacuggagagugaggaggag

SEQ ID NO: 122180 - RNA, 63 nt, hsa
cuaacaggaagguguccaguucaagagaacccacccagagacugggagugguggcucacgccu

SEQ ID NO: 122181 - RNA, 63 nt, hsa
gccgagccagacugugaccaggaaacagcucaucccagagaaggagaugcuuaacaaaaaaaa

SEQ ID NO: 122182 - RNA, 63 nt, hsa
uguggccguagagggaaacagccacugugacaacccagagaccuggggucagccuuaaguagg

SEQ ID NO: 122183 - RNA, 63 nt, hsa
gggcuuuaauguguaggaaaagccuucuggccacccagagagccggagcccugcuugcuguau

SEQ ID NO: 122184 - RNA, 63 nt, hsa
uauggggagguuugaugagcauuugccuuucuccccagagagcuugaccaaguuacauauucu

SEQ ID NO: 122185 - RNA, 63 nt, hsa
uccacucccuccgcugccaugaagcucauuucucccagagauuuuguggacuuggugcuaguc

SEQ ID NO: 122186 - RNA, 63 nt, hsa
cagccacaagcuugcccgcccuggcucccucugcccagagacuauggaguaaggcauucagga

SEQ ID NO: 122187 - RNA, 63 nt, hsa
cugcacagucggugccugggaggcacguagaggcccagagagucccuggggguucugcucuga

SEQ ID NO: 122188 - RNA, 63 nt, hsa
cccugcagagccaauggugcacauugguuuaagcccagagauccugcuugagcccuggacuca

SEQ ID NO: 122189 - RNA, 63 nt, hsa
gucccacucaguccauagcagagaaugaaagggcccagagaggguggugaccucugccugaag

SEQ ID NO: 122190 - RNA, 63 nt, hsa
gccacuucccucccagugccagucuccauccaccccagagaggaacaggcgggugggccaugu

SEQ ID NO: 122191 - RNA, 63 nt, hsa
gaccccagccuggggaacacgcugcccgcacugcccagagagcagugcaaacaccacaacacg

SEQ ID NO: 122192 - RNA, 63 nt, hsa
gcgagaagccaaggccagguucuggguguagggcccagagaagcagaacagcccagagcccca

SEQ ID NO: 122193 - RNA, 63 nt, hsa
ugcacugugaccucuggcuuccccagcagcuuucccagagaggcagaggggccuuccacagcc

SEQ ID NO: 122194 - RNA, 63 nt, hsa
gacuccccagcccagcaccccuuccucgugggucccagagaccucaucagccuugggauagca

SEQ ID NO: 122195 - RNA, 63 nt, hsa
ucaggacccaguccaggccuucuacgggcuaggcccagagacuuggguugcuggucccccuuc

SEQ ID NO: 122196 - RNA, 62 nt, hsa
cagcccgcuuuggucugugagcugaggcuguccccagagaggauggcagcagguauuggguc

SEQ ID NO: 122197 - RNA, 63 nt, hsa
ucacaguucacauucagcucagcagagcaagaccccagagaugcuuagagacaggacaccugg

SEQ ID NO: 122198 - RNA, 63 nt, hsa
ccccgacguagcugccccccuggggggccacagcccagagaaccagccuaggaacacucggga

SEQ ID NO: 122199 - RNA, 63 nt, hsa
ggcuccaguguggggugaggcagugagguuaggcccagagagcuggaguuggcucagaugaaa

SEQ ID NO: 122200 - RNA, 63 nt, hsa
cgagggccaggcagaauggcugcacguagguuccccagagagcaggcaggggcaucugucugu

SEQ ID NO: 122201 - RNA, 63 nt, hsa
uuaauuuauugggaaugagcugaggcggauuuccccagagaaacaaaaagguauaacuuuaac

SEQ ID NO: 122202 - RNA, 63 nt, hsa
cagaucucaugugcuacgaaggaaaccccaagacccagagaggaagggucaaccuggaggcag

SEQ ID NO: 122203 - RNA, 63 nt, hsa
acaccgcaucaguccccaucaucacuacuccuccccagagacauacagauugcccuccccggc

SEQ ID NO: 122204 - RNA, 63 nt, hsa
gggcagagggacaggucagacacccaggcccaccccagagacccuccaugaacugugcuccca

SEQ ID NO: 122205 - RNA, 62 nt, hsa
cugccuccuccccugccagcccuagcgugacuacccagagacaaaaaaaaaaaaaaaaaaaa

SEQ ID NO: 122206 - RNA, 63 nt, hsa
ccaaaugucaggguguuugcccaauaauaaagccccagagaacugggcugggcccuaugggau

SEQ ID NO: 122207 - RNA, 63 nt, hsa
aggucaucucaaggcugauacuugagcugugugcccagagaucaugcauuuagauuuauauuu

SEQ ID NO: 122208 - RNA, 63 nt, hsa
gagcccacuguaucugggcccaaggccagagggcccagagagaagccugagcaccguguuacc

SEQ ID NO: 122209 - RNA, 63 nt, hsa
cuucugaggacacaaggugggcugcccucaagccccagagagccccucauccuuccucuggga

SEQ ID NO: 122210 - RNA, 63 nt, hsa
acucgcaacaacuuaauuucuaaggguccaagucccagagaauccauagucgucaaagcuuug

SEQ ID NO: 122211 - RNA, 63 nt, hsa
ccacuuguggaaaaaaagugcuaaaguuuucuucccagagagagcauaauuccgaaacaaaac

SEQ ID NO: 122212 - RNA, 63 nt, hsa
cucugagcuggugggcaggauggcuggguggcccccagagaagcacagaccugagaugggguc

SEQ ID NO: 122213 - RNA, 63 nt, hsa
gagccaagggcacuuugcugccaccgcugcauucccagagaucaagcagcccggugccguggc

SEQ ID NO: 122214 - RNA, 63 nt, hsa
acaggaaacagcaaacaguggggugaucugcagcccagagaccuucaaaugcgaacacuauaa

SEQ ID NO: 122215 - RNA, 63 nt, hsa
uaguuggauugguacauucacugcugccagguacccagagaugucaucucucuccagguagag

SEQ ID NO: 122216 - RNA, 63 nt, hsa
gcaggggugggagagccagcucucucuacccggcccagagaccccuuccuuuccucugcagca

SEQ ID NO: 122217 - RNA, 63 nt, hsa
agucucagaugaccacggguuuaaccuucuuaucccagagacacccaauucuagagcuuuaug

SEQ ID NO: 122218 - RNA, 63 nt, hsa
cccuuugaccacaucgcucuaggauaacuggcacccagagaaaaggacuccucagaaaaaaca

SEQ ID NO: 122219 - RNA, 63 nt, hsa
ggcccgaugacuuaaagggaaaaauaauucauucccagagaugagucagaacagucuccucaa

SEQ ID NO: 122220 - RNA, 63 nt, hsa
ugugcuugggcuaugguggccauaaacccugagcccagagagcuugggucacugucaccugag

SEQ ID NO: 122221 - RNA, 63 nt, hsa
acuaagguggcuuucccacuccuggcccacagccccagagagccugucugugcauccugaacc

SEQ ID NO: 122222 - RNA, 63 nt, hsa
cggcuuccagggagaccuccccgcccagcagcccccagagacacaacaaccuaccuuccagcc

SEQ ID NO: 122223 - RNA, 63 nt, hsa
agguccauccccagcaaauguuuuggagguccccccagagagcagagugggccauggcagaag

SEQ ID NO: 122224 - RNA, 63 nt, hsa
guccuaaaaauaggggccguuuucuuacacacccccagagagaggagggacugucacacuggu

SEQ ID NO: 122225 - RNA, 50 nt, hsa
ggagaggaguuccuuacuaacccagagacuucaguguccugaaagauucc

SEQ ID NO: 122226 - RNA, 63 nt, hsa
uguguuugcuuguuugcccaccuuuggcugauacccagagaaccugggcacuugcugccugau

SEQ ID NO: 122227 - RNA, 63 nt, hsa
uuggucuggggcauuuuccucuccuuaucuugccccagagacaauucaagauuucuauauggg

SEQ ID NO: 122228 - RNA, 63 nt, hsa
cuuucuucuguccucagcuugagaucuucuuagcccagagagcaguggaguugagugaggagg

SEQ ID NO: 122229 - RNA, 63 nt, hsa
ccucacuauuggcagaaaagaccccauuuaaaacccagagaacacuggagggggaugcucuag

SEQ ID NO: 122230 - RNA, 63 nt, hsa
accagggaugguacuagggggaagugacaaggccccagagacucagagggaggaaucgaggaa

SEQ ID NO: 122231 - RNA, 63 nt, hsa
cucacucaccacuaccagccagccucagaaggccccagagagacccugcaagaccacggaggg

SEQ ID NO: 122232 - RNA, 63 nt, hsa
aggguuagggaugucuccacccugauggggugucccagagacauuuucccauggcaguccucc

SEQ ID NO: 122233 - RNA, 63 nt, hsa
ggucggggcaucuggccuggccagugcccugaucccagagagcccgaggaggugucucaggcu

SEQ ID NO: 122234 - RNA, 63 nt, hsa
ggagcagcagcaggacagacccccacgaggccccccagagaggaggaagaucccacggaggaa

SEQ ID NO: 122235 - RNA, 63 nt, hsa
cugccugagggacaacagacaucagaacaaacccccagagagaaacagucaaaaucagggccc

SEQ ID NO: 122236 - RNA, 63 nt, hsa
caagaaaaugcuucacucaacaguccucaugugcccagagauguuuauagaacuguuugaauu

SEQ ID NO: 122237 - RNA, 63 nt, hsa
cccguggccccugugccuguucggugggggugucccagagaagccuggcaccaguacccccgu

SEQ ID NO: 122238 - RNA, 63 nt, hsa
gggggcagccaagaagccggagcuggcagcauacccagagauccggggcccccccacccccaa

SEQ ID NO: 122239 - RNA, 63 nt, hsa
aaccuaccuugcuuugggagcugccugcaccaccccagagaaggccccaccuucuucaucccu

SEQ ID NO: 122240 - RNA, 63 nt, hsa
gcaucgagcuagcucccugcacggccgcacccucccagagaacuccuugaggagaacaagugc

SEQ ID NO: 122241 - RNA, 63 nt, hsa
ugggggugggggaggggagagggguaccuagaacccagagaacauuggcuuaugccagauacc

SEQ ID NO: 122242 - RNA, 63 nt, hsa
cggggaugcuugccccucuccaggacuauugagcccagagagagcuguccucucauuggguga

SEQ ID NO: 122243 - RNA, 63 nt, hsa
cccucuaggucugggcagccaugaccugcagggcccagagacacuguccuuccccucauccac

SEQ ID NO: 122244 - RNA, 63 nt, hsa
guugguuuaggcauccugugugcugacaggagacccagagagcuagggcuggagggacaggga

SEQ ID NO: 122245 - RNA, 63 nt, hsa
uccuuccugggggucuguuccuuccuaugcucacccagagaacucucugaugugccagugggc

SEQ ID NO: 122246 - RNA, 63 nt, hsa
auccaggcucguagagucacucccugcccgucucccagagaugcuucaccagcaccugccucu

SEQ ID NO: 122247 - RNA, 63 nt, hsa
cccagccccuaccuugagacccucuucucugggcccagagagaggcguccuggugaggacaag

SEQ ID NO: 122248 - RNA, 63 nt, hsa
aagaagauccuaucaugaauaaaagcuguauggcccagagaggagcucaugugucuaaaguga

SEQ ID NO: 122249 - RNA, 63 nt, hsa
agcagacuggugagcagacuggugggaucugugcccagagaugggacugggagggcccacuuc

SEQ ID NO: 122250 - RNA, 63 nt, hsa
acugaccccugccagggcacagauaggcaggaccccagagagggcaggcagccacgcccugca

SEQ ID NO: 122251 - RNA, 63 nt, hsa
gaagacccucagauguggccagagcaccggccucccagagaaagcccaggaaguccccguggu

SEQ ID NO: 122252 - RNA, 63 nt, hsa
uacugccacuucgccuuacaucccugcugacugcccagagacucagaggaaauaaaguuuaau

SEQ ID NO: 122253 - RNA, 63 nt, hsa
aagauagcaagcuaccuuccaaggccgagccagcccagagaggagcaugucuuccuuuaccuc

SEQ ID NO: 122254 - RNA, 63 nt, hsa
agucuaggagggggauaaaugggaugcccuugccccagagagaacccaguucuagguacuguc

SEQ ID NO: 122255 - RNA, 63 nt, hsa
ggucagagguggggacagagaacuccccuacagcccagagauguggcagggcucagagaagca

SEQ ID NO: 122256 - RNA, 63 nt, hsa
cgaaggggacggccggcgggggcucuccuagugcccagagacaggcccagagguuuacaaguu

SEQ ID NO: 122257 - RNA, 63 nt, hsa
ucucccuacuuuuucucacuggccucguuuugacccagagaaagccuauggaaguuaugcagu

SEQ ID NO: 122258 - RNA, 63 nt, hsa
ggggccgcuccaggccccacagagcaggagacccccagagaaagccggggcuggcaggaggcg

SEQ ID NO: 122259 - RNA, 63 nt, hsa
gccucaacugacagcugaggaaaggcaauuaggcccagagaggcagagacacucgcuuaagau

SEQ ID NO: 122260 - RNA, 63 nt, hsa
ggccacgcccagcuuccuccccccgacuccccccccagagacacggucccaccauguuaccca

SEQ ID NO: 122261 - RNA, 63 nt, hsa
uucucaguggcaaaaccuaggaaggcucauguucccagagaagggaccacaugagccuucucc

SEQ ID NO: 122262 - RNA, 63 nt, hsa
gcagagcauuuuccuuauggaagggaugagauucccagagaccugcauugcuuucuccugguu

SEQ ID NO: 122263 - RNA, 63 nt, hsa
cuucggugcuaggaaagagugaugugugagauucccagagagucgucacaccaguguuaugcc

SEQ ID NO: 122264 - RNA, 63 nt, hsa
caaaaggagaaagauaaaauacagaagacuggccccagagagaccucagaucaguauugugca

SEQ ID NO: 122265 - RNA, 63 nt, hsa
guuugguuugaauuauuaguacuauccuguagacccagagacauaguuuauauaagaauugcu

SEQ ID NO: 122266 - RNA, 63 nt, hsa
ugugcaaagcaguauguacaggcugagacacagcccagagacugaacggcaaucuuuccacac

SEQ ID NO: 122267 - RNA, 63 nt, hsa
gugugugacgaggcccccgauguucuugauuuucccagagaagcaaauaaacagcgugaacag

SEQ ID NO: 122268 - RNA, 63 nt, hsa
accucucccccaaggccacugcgcucuugggaccccagagaaaacccggagcaagcaggagug

SEQ ID NO: 122269 - RNA, 63 nt, hsa
cuggcccauguggagcuggcaugggggacacagcccagagacagagaagcuuaugaggaagug

SEQ ID NO: 122270 - RNA, 63 nt, hsa
acacaaagcucuucaggcagcugauagauuucccccagagagcuauucaaggacuuccuaagg

SEQ ID NO: 122271 - RNA, 63 nt, hsa
aacauggaagaugaaaggggaggggaugucaggcccagagaagcaaguggcuuucaacacaca

SEQ ID NO: 122272 - RNA, 63 nt, hsa
caccccauucccgcagugggagcaaacugcaugcccagagacccagcggacacacgcgguuug

SEQ ID NO: 122273 - RNA, 63 nt, hsa
cccccucccaaacugugacugguauuuauuggacccagagaaccgggccgggcacagcguggc

SEQ ID NO: 122274 - RNA, 63 nt, hsa
cuguauggacccuuccugccauuuguauuuugucccagagagaaaggcucuuuggggggcccc

SEQ ID NO: 122275 - RNA, 63 nt, hsa
ccuccucuggagccuucgccuggggagacagaacccagagagaaacaagagaguccagaaguc

SEQ ID NO: 122276 - RNA, 63 nt, hsa
ccuugaaggagccccccacauccuccccuacaucccagagaugccaccacuugugucuccaca

SEQ ID NO: 122277 - RNA, 53 nt, hsa
auggcgagagcgaccugugaggccccagagaccugacccaacacccccgacgg

SEQ ID NO: 122278 - RNA, 63 nt, hsa
agggaacagcaugcccccuccggggucaugccacccagagacugucgcugucuauggccccaa

SEQ ID NO: 122279 - RNA, 63 nt, hsa
cgucugggguccaucucccuccugagcuagaaacccagagauggaggcugucuugcuauggca

SEQ ID NO: 122280 - RNA, 63 nt, hsa
cugaguaguggggauccagagaggacccccgcccccagagacuugguuuuggcuccagccuuc

SEQ ID NO: 122281 - RNA, 63 nt, hsa
ggccaccagaaggugacacccccagaaucccuccccagagacugcaccagcgcagccagcagg

SEQ ID NO: 122282 - RNA, 63 nt, hsa
acucaagcaauagggccccgccauaggaagacccccagagagagggucagcaggggggccccg

SEQ ID NO: 122283 - RNA, 63 nt, hsa
aucagaacaacggaggauagcuuugugccuggacccagagagugugggacuccccgcuucauc

SEQ ID NO: 122284 - RNA, 63 nt, hsa
ccuuggccccaagugaacucaagauuuggcagccccagagaugccaacugcagcaugcccacc

SEQ ID NO: 122285 - RNA, 63 nt, hsa
cgguuuaaccagggcucuguaagaccacucccacccagagacuuguguggccugguguggccu

SEQ ID NO: 122286 - RNA, 63 nt, hsa
ucaucaaaccagguguccuuggcauuguguccacccagagagcucacuguuuucuuuucuuuu

SEQ ID NO: 122287 - RNA, 63 nt, hsa
uuuucccauucagcugugagugcccaacccuaucccagagaccuugaugcuuggccucccaau

SEQ ID NO: 122288 - RNA, 63 nt, hsa
uuuuccuguaaguaauuaagaagacuaaguagccccagagauaagaccuccucggaucauugu

SEQ ID NO: 122289 - RNA, 63 nt, hsa
gcccaagcaguccucacuuugcuuaacaguggccccagagagcaggaguagugaugcugguga

SEQ ID NO: 122290 - RNA, 63 nt, hsa
gggaugggaagaggcucuuugcaaacgaggguccccagagaagacuggcggggaccugauggg

SEQ ID NO: 122291 - RNA, 63 nt, hsa
gaggagguggaacugauguaggggguggcacuccccagagacugcccucacgaggggacuggg

SEQ ID NO: 122292 - RNA, 63 nt, hsa
cacugcuacccucuauuucccacucagggcugucccagagagaaggcagccgaacugaggauu

SEQ ID NO: 122293 - RNA, 63 nt, hsa
ggugagagggaugcaggcauggguuggggguggcccagagaaacuuaugacagcuguacacaa

SEQ ID NO: 122294 - RNA, 63 nt, hsa
cugccccacccacuuccuccccaccaccugugccccagagagcagggccugcccgggaaggug

SEQ ID NO: 122295 - RNA, 63 nt, hsa
agcagcacccugcagugcccaggacggccccgucccagagaacaauccagccccgaaugucag

SEQ ID NO: 122296 - RNA, 63 nt, hsa
gaacacccaggccagggacaccccuccccagcucccagagaggcccccugaggggugagcccu

SEQ ID NO: 122297 - RNA, 63 nt, hsa
cucuccccuuggugccuaacccaggacuuuguccccagagacccacugugugcccccuggagc

SEQ ID NO: 122298 - RNA, 63 nt, hsa
ggcuguuggggacuuuaccugcugggaccugcucccagagaccuuccacacugaaucucaccu

SEQ ID NO: 122299 - RNA, 63 nt, hsa
ggcggucggggacuuuaccugcugggaccugcucccagagaccuugccacacugaaucucacc

SEQ ID NO: 122300 - RNA, 63 nt, hsa
ggcuguuggggacuuuaccugcugggaccugcucccagagaccuugccacacugaaugucacc

SEQ ID NO: 122301 - RNA, 63 nt, hsa
cagggaauuaauucccccagucaaccaauggcacccagagagggcauggaggcuccacgcaac

SEQ ID NO: 122302 - RNA, 63 nt, hsa
ugggacuuccugcucaucauaguacccagugagcccagagauccuacuagacugggucagcaa

SEQ ID NO: 122303 - RNA, 63 nt, hsa
cuggacagcaggagagggugugggaugaggcuucccagagacccugggucuagaaagcggcuc

SEQ ID NO: 122304 - RNA, 63 nt, hsa
auaccacacauuucucaucucauuggcccccaccccagagaccuccaccucaacuucuggcug

SEQ ID NO: 122305 - RNA, 63 nt, hsa
aggccaucagcccaccuccaccucuggaggguccccagagacccacgcccgacgcagacccgg

SEQ ID NO: 122306 - RNA, 63 nt, hsa
agucugugaaaugaaagucccugacaugaagcucccagagauaaaacuccccaaggugccuga

SEQ ID NO: 122307 - RNA, 63 nt, hsa
ugugcaccucccggaagugcagcucccgaaagucccagagaugaaacucccuaaaaugccuga

SEQ ID NO: 122308 - RNA, 63 nt, hsa
ugugcaccucccagaagugcagcuuccaaaagucccagagaugaagcucccugagaugaaacu

SEQ ID NO: 122309 - RNA, 63 nt, hsa
agaaagagacccagaaaaaggaagagguggaaacccagagagacagagacccaaagggagaga

SEQ ID NO: 122310 - RNA, 63 nt, hsa
agcccugacacuccuuucagacccucauuccuucccagagauguugagaauguucaucucucc

SEQ ID NO: 122311 - RNA, 56 nt, hsa
aggagauugggcggauuugagccccucccagagauggcaauaaaacugacucucaa

SEQ ID NO: 122312 - RNA, 63 nt, hsa
aaaucuuuaguaggaauccuccagccauuauaucccagagagcucauuuagggcugaaacacu

SEQ ID NO: 122313 - RNA, 63 nt, hsa
uguccuaggugucugcugugaaccuccagugaccccagagacuuugcuguaauuaucugcccu

SEQ ID NO: 122314 - RNA, 63 nt, hsa
aaaccuuuagaacaucucugcuuuggagaaagacccagagaucaggcagaggugcagauucaa

SEQ ID NO: 122315 - RNA, 63 nt, hsa
guucuggggccaaggccuacccaggggccucugcccagagaacucacaacccccucucugacc

SEQ ID NO: 122316 - RNA, 63 nt, hsa
uuggcuuguaaaccuucgucucccucucuuuuacccagagacagcacauacgugugcacacgc

SEQ ID NO: 122317 - RNA, 63 nt, hsa
ucugucacuugcucuuucacucucucucucauucccagagagccacgggggagggaucacccu

SEQ ID NO: 122318 - RNA, 63 nt, hsa
agauaaggucaugggagaguggguggggacacacccagagacuggcuuugggauugggcacug

SEQ ID NO: 122319 - RNA, 63 nt, hsa
uguauucccguuuuacagauaaggaaacugaggcccagagagcugaaguacugcacccagcau

SEQ ID NO: 122320 - RNA, 63 nt, hsa
ccauucccaacuagacauuaccaaagugaccuacccagagauugcuucucauccccaguccca

SEQ ID NO: 122321 - RNA, 63 nt, hsa
caugaaugggauuagugcccuuauauaaagagacccagagagcuccaucaccccuucugccau

SEQ ID NO: 122322 - RNA, 63 nt, hsa
uucacaccuguaugauagucauggaaacugaagcccagagagguuaagaaauuugcuaggauc

SEQ ID NO: 122323 - RNA, 63 nt, hsa
gggcccugcccaacuucaggcagaacagggaggcccagagauuacagauccccuccuguaagu

SEQ ID NO: 122324 - RNA, 63 nt, hsa
uacaguuugacacugaucugguccaugaggcugcccagagaaagcacugcuucuguaugucuc

SEQ ID NO: 122325 - RNA, 63 nt, hsa
augcugcugcaacuggaagaagcuggaaccagucccagagaggcucggccuggaaacaguccc

SEQ ID NO: 122326 - RNA, 63 nt, hsa
gccugggagucgggcggccccggucaggcccugcccagagagcuccugguuccugaacugagc

SEQ ID NO: 122327 - RNA, 63 nt, hsa
uagcccccuacuguggcccccauagccccauaacccagagagggagcuggacuucagggagcc

SEQ ID NO: 122328 - RNA, 63 nt, hsa
ugcugccagcucucaacauagcaggccauaggacccagagaagaaucccagcguugcucaaag

SEQ ID NO: 122329 - RNA, 63 nt, hsa
uagaauucuuuggcgggaaggguaugauggguucccagagacaagaagcccaaccuucuggcc

SEQ ID NO: 122330 - RNA, 62 nt, hsa
augagcagguccaacucugauuauucucgaugcccagagaugcucaugcaccugugcacacu

SEQ ID NO: 122331 - RNA, 63 nt, hsa
gucuguaccucaggggaugccccgcuguggucacccagagaaucacccuuccuggucuacaga

SEQ ID NO: 122332 - RNA, 63 nt, hsa
aagaccugagugaccagucaagccucauguuaccccagagagacacauggggaguagacccug

SEQ ID NO: 122333 - RNA, 63 nt, hsa
cugcucugaaaaauggggaaaacugcuaaacaucccagagauuugcaaucuucuagcucucca

SEQ ID NO: 122334 - RNA, 63 nt, hsa
cagggcucagguggguggagcaguaaggcacuacccagagagcuugcugcugcggcccugucc

SEQ ID NO: 122335 - RNA, 63 nt, hsa
ccugggcugggcagagugacagugcuagaagaccccagagagagggcaagggcuuugggcaag

SEQ ID NO: 122336 - RNA, 63 nt, hsa
uugaaaaugcauguuccucaggccuaugcaguucccagagacucuugacaccggucucugcug

SEQ ID NO: 122337 - RNA, 63 nt, hsa
cuucaggagcucucuacccaggggcaaggagagcccagagagaagcgcccuggucucuugagc

SEQ ID NO: 122338 - RNA, 63 nt, hsa
ccugcggcaccggguucaggcagcuacuccugccccagagaugaaggggcagcuuugcaagga

SEQ ID NO: 122339 - RNA, 63 nt, hsa
caacagggcaacuggaaccccugccugaccuuacccagagaagccaugggccaccugcucugu

SEQ ID NO: 122340 - RNA, 63 nt, hsa
ugguguccugcacggaauagaaggggaaaggaccccagagaaguggcugugacccguccaagg

SEQ ID NO: 122341 - RNA, 63 nt, hsa
ccugggccucagccuccaggcacccccaggauucccagagagacgcugugauuggcaggaggc

SEQ ID NO: 122342 - RNA, 63 nt, hsa
cuuuuccacagccacucacuggggccaccaaaacccagagauggcaggugugugggacagacu

SEQ ID NO: 122343 - RNA, 63 nt, hsa
cuccagcacagcagagaccagcaggccccccaacccagagacugggucugcuggagucuccac

SEQ ID NO: 122344 - RNA, 63 nt, hsa
aaagccugcacaacccaaccucgcuuagggacccccagagaugcuggaaucgcuaggaggguu

SEQ ID NO: 122345 - RNA, 63 nt, hsa
gugggcagggcaugcgcuccccuggcugagcaccccagagauucuccugcaccuuccucaugc

SEQ ID NO: 122346 - RNA, 63 nt, hsa
agggagagaacacgcugugaaaacacagaagcucccagagaagccuucucagcuuuuaucucu

SEQ ID NO: 122347 - RNA, 63 nt, hsa
cagaaaggcuggaguuauuauucaacucaaucucccagagaacucagaggcuacaguuucuac

SEQ ID NO: 122348 - RNA, 63 nt, hsa
acuauagugagcccaugcagcaccucucacccacccagagauggagcugcucugccuuccagc

SEQ ID NO: 122349 - RNA, 63 nt, hsa
aacaaaaucugagucuccagccaggaggcuucucccagagaggacaaaaaagcccaacuugcc

SEQ ID NO: 122350 - RNA, 63 nt, hsa
ggcuccacccacuagaugccaguggcacccccucccagagaugacaaacgaaaaugucucuag

SEQ ID NO: 122351 - RNA, 63 nt, hsa
cagaagaggcucccaggcccaagcucugugugacccagagaaauaaagaugccucaguguggc

SEQ ID NO: 122352 - RNA, 63 nt, hsa
ggccagcccccaaugguccccuuacggacaggucccagagauggacagaggcacccagggccc

SEQ ID NO: 122353 - RNA, 63 nt, hsa
gacccguguccucagagcaccacacacugagcacccagagacagcgggccuggcagcgggccg

SEQ ID NO: 122354 - RNA, 63 nt, hsa
cccaggucugcugcccaggaacccuccagaccucccagagagugaauaaagugugacuugcaa

SEQ ID NO: 122355 - RNA, 63 nt, hsa
ucaccauggucuaaucccaagagggacucgucacccagagaccucaaaaggccccaggccuac

SEQ ID NO: 122356 - RNA, 63 nt, hsa
cugaggagcaggugucccugagaacccaaacuucccagagaguaugugagaaccaaccaauga

SEQ ID NO: 122357 - RNA, 54 nt, hsa
ucagccggaagagaaaaugaagaccccagagacauuuauuggggaguaggaugu

SEQ ID NO: 122358 - RNA, 63 nt, hsa
cucuauauaaguaggggcagcuuagcccugaggcccagagaccugcuguccuuuuucuccuug

SEQ ID NO: 122359 - RNA, 63 nt, hsa
cagaugcuaagcgcuucagagaggaggugucugcccagagauguggagcagaagcugggcccu

SEQ ID NO: 122360 - RNA, 63 nt, hsa; identical to SEQ ID NO: 122351

SEQ ID NO: 122361 - RNA, 63 nt, hsa
cugaagauucagacaggaaccucuuucccuguucccagagaaugcggcugagaaugagaacgc

SEQ ID NO: 122362 - RNA, 63 nt, hsa
gaaagggcucauuaagccuuuuggacacaggaccccagagaggaaaaagugacuugcccaagg

SEQ ID NO: 122363 - RNA, 63 nt, hsa
cugaggagcaggugucccugagaacccaaacuucccagagaguaucugagaaccaaccaauga

SEQ ID NO: 122364 - RNA, 63 nt, hsa
gccccugcucagucagccccacucccugggcuucccagagagugacagcugcucaggcccuaa

SEQ ID NO: 122365 - RNA, 63 nt, hsa
ccaccuaugccacagugccuaagggcuaggccacccagagacugugcccggagcuggccgugu

SEQ ID NO: 122366 - RNA, 63 nt, hsa
cuuggccugaguaaacuuggaaaggggcucccucccagagaagggacuacucucuucaccccu

SEQ ID NO: 122367 - RNA, 63 nt, hsa
gugcuaaggggauggggaagaagggacaagauucccagagaggagaggaggcuguugguagga

SEQ ID NO: 122368 - RNA, 63 nt, hsa
cacccaccuaaagacauguauaugucuugggaucccagagauuggguccuugggccuggcuuc

SEQ ID NO: 122369 - RNA, 63 nt, hsa
cugggaaaaugaacguccaggacacaccuguaucccagagagcaaagugaugaggagacugag

SEQ ID NO: 122370 - RNA, 63 nt, hsa
caccuccugcggcagaacagcacccgugacccacccagagagcaaggccaggggucuuggugc

SEQ ID NO: 122371 - RNA, 63 nt, hsa
uagguacaaugucuaucaggaaagcaaagcuuccccagagacgcucagcuuguauccauugac

SEQ ID NO: 122372 - RNA, 63 nt, hsa
uguuaucuuaugcuugagguaggcacugguuugcccagagaauuuuuauuuuucccagaccac

SEQ ID NO: 122373 - RNA, 63 nt, hsa
gaguggucgugagcuggucuuggggcacaauuacccagagauauauuuauuaacagccaaccu

SEQ ID NO: 122374 - RNA, 63 nt, hsa
ggaacugaaauccuugagaguuccggggagaaacccagagaugccugauuucauuccucgaug

SEQ ID NO: 122375 - RNA, 63 nt, hsa
cauuccacccuguuacuuauguagaaacugaggcccagagagggaagaugaccugccccaagu

SEQ ID NO: 122376 - RNA, 63 nt, hsa
cucacuugcuucuuauccuuacacucccccagccccagagaaacugccacauacaccacaaaa

SEQ ID NO: 122377 - RNA, 63 nt, hsa
uauaacccagacuaagguugaacaaccugcaugcccagagaaaacuauggcgacaaaggggaa

SEQ ID NO: 122378 - RNA, 63 nt, hsa
agaaacuuauuauuggcuucuguuucauauggacccagagagccccaccaaaccuacgucaag

SEQ ID NO: 122379 - RNA, 63 nt, hsa
cagaaacuagacauuagaauguugaggcaguuucccagagaaacaagcauauugccucaugga

SEQ ID NO: 122380 - RNA, 63 nt, hsa
accugccuccccuccauagucuuguuggagaagcccagagagaaugggacuccaacuaaggga

SEQ ID NO: 122381 - RNA, 63 nt, hsa
gauauccucuucuuaaaaaugaguaaauggaggcccagagaaauguaauuugccugagaucaa

SEQ ID NO: 122382 - RNA, 63 nt, hsa
ccccaaaauggaccuuuuuuuuuucuaaagagucccagagaauggggaauuguuccuguaaau

SEQ ID NO: 122383 - RNA, 63 nt, hsa
ccagagcauccauggccaauuucaaauugugaacccagagacacucccauccacccuucucca

SEQ ID NO: 122384 - RNA, 63 nt, hsa
agguauaccuacagcagcuacaaugauucuugucccagagagggcuaugcugcuuuuccaauu

SEQ ID NO: 122385 - RNA, 56 nt, hsa
ucagcuuucugaugaguuaaaaaggucccagagauauauagacacuggaguacugg

SEQ ID NO: 122386 - RNA, 63 nt, hsa
gaccgugaacaccugcuuccucccucgggcaggcccagagagccagagguggguaggagguua

SEQ ID NO: 122387 - RNA, 59 nt, hsa
augaucucacugagcucuaaaucugcaaucccagagaauccugacaaagcgugccaccc

SEQ ID NO: 122388 - RNA, 63 nt, hsa
aaauaucugccaucaucugccauaggaaagauacccagagacccaucauguucucuuuuuguu

SEQ ID NO: 122389 - RNA, 63 nt, hsa
auaaccuacuuacuccguaaggggaaaugaaggcccagagaagggaagggacuugaccgaggu

SEQ ID NO: 122390 - RNA, 63 nt, hsa
cugccaccugcccugcugccaggcuuacaucuucccagagaacuaugcugccacuucacaucc

SEQ ID NO: 122391 - RNA, 63 nt, hsa
ugaagccaaaaaugaagccguggccaagcgugacccagagaugggguguccuggcccuuagug

SEQ ID NO: 122392 - RNA, 63 nt, hsa
aaccaagggccuaauguuuguuacagaaaugaucccagagaccuacaagaugugggaaucagc

SEQ ID NO: 122393 - RNA, 63 nt, hsa
aucugcaugauuggcauuaguuaccacagccugcccagagagaaacuaucuucucccaacauu

SEQ ID NO: 122394 - RNA, 64 nt, hsa
gaaucacccucgcuccgucaggcgggacucgugucccagagaggaaggggcugcugaggucuga

SEQ ID NO: 122395 - RNA, 64 nt, hsa
ccucccaguuuugcucugcccagcaguguuggugcccagagaugacaagggccagggagccugg

SEQ ID NO: 122396 - RNA, 64 nt, hsa
cuccagacacuucacggaaggaagaucacauguccccagagaggcacccccaggcaagcucgag

SEQ ID NO: 122397 - RNA, 64 nt, hsa
ugagggccucgccuggcugcagccugcgccaccgcccagagacccaagcugccuccccucuccu

SEQ ID NO: 122398 - RNA, 64 nt, hsa
uggcucuccagaaccuucuaucccacagucaggccccagagagggcaggacaagccuugucccg

SEQ ID NO: 122399 - RNA, 64 nt, hsa
uaagucaccagauauuuuguucccaucaguuuagcccagagauagacaguagaaugcaaauacc

SEQ ID NO: 122400 - RNA, 64 nt, hsa
caccugcagguguaagggacgauuggaguuucuucccagagagucugucccagaaggacugugg

SEQ ID NO: 122401 - RNA, 64 nt, hsa
cagcccucagcagcugcagaccgccccucaccaacccagagaaccugcuuuacuuugcccaggg

SEQ ID NO: 122402 - RNA, 64 nt, hsa
caggggucagaggcccaggcccugacuucggcuucccagagaucucuccgccuuaguuaagagc

SEQ ID NO: 122403 - RNA, 64 nt, hsa
uuccugucuguauuugaugcaggauuaaacacuucccagagaggauucuagucugguaaauaac

SEQ ID NO: 122404 - RNA, 64 nt, hsa
ugccaguggauccccugcggucaggcugggcagccccagagagaggauguggaaagcacuuuuu

SEQ ID NO: 122405 - RNA, 64 nt, hsa
ugcgugucgguguauauaggaaccauguacagagcccagagaagcccccuacauccccccggga

SEQ ID NO: 122406 - RNA, 64 nt, hsa
uugacugcagaagaccaagaaccuguuccccaagcccagagauguccaccugggcuggacugcc

SEQ ID NO: 122407 - RNA, 64 nt, hsa
uguguucucaggaagacugccuccaccaccgcuacccagagaaccucugcaucuggcauuucug

SEQ ID NO: 122408 - RNA, 64 nt, hsa
agcagccagcaccaccuacacaggagucuucagacccagagaaggacggugccaagggccccag

SEQ ID NO: 122409 - RNA, 64 nt, hsa
uuugguuugacacccagccucuucccuggcccuccccagagaacuuuggguaccuggugggucu

SEQ ID NO: 122410 - RNA, 64 nt, hsa
caaccugcacacuugacaaguggagaaacagaagcccagagagagcacuggguuuguucaggac

SEQ ID NO: 122411 - RNA, 64 nt, hsa
cuauucggauauucuguuuacacacccaugucaucccagagaggugaucacagggcagggacac

SEQ ID NO: 122412 - RNA, 64 nt, hsa
uucccugacuccuggugcccucucccuuuguccccccagagagacauaugcccccagagagagc

SEQ ID NO: 122413 - RNA, 64 nt, hsa
ccucucccuuuguccccccagagagacauaugcccccagagagagcaaaucgaagcgugggagg

SEQ ID NO: 122414 - RNA, 64 nt, hsa
caugauuaggauuagugcccuuauuuaaaaaggccccagagagcuaacucacccuuccaccaua

SEQ ID NO: 122415 - RNA, 64 nt, hsa
cccccaccucucacuuugcugugagcccgggaaccccagagaccacuccuguggagagcugagg

SEQ ID NO: 122416 - RNA, 64 nt, hsa
agugagggccaggcccuucccggcugcgaggacgcccagagaccgcgggcgcugagcgcguugg

SEQ ID NO: 122417 - RNA, 64 nt, hsa
ucccaauuccaucaccacugccaacaacuccucccccagagaucuggcuggagcccagaaaaag

SEQ ID NO: 122418 - RNA, 64 nt, hsa
cuaagacuauguugguacuuggacuuguucgugccccagagaugggcaaagcugugcacuugca

SEQ ID NO: 122419 - RNA, 64 nt, hsa
ugccaaaacugauuagcuaguggacagagauaugcccagagaugcauauguguauauuuuuaug

SEQ ID NO: 122420 - RNA, 64 nt, hsa
gcucuuaucuaugaagacaucuucccagaguguccccagagacaugcaagucaugggucacacc

SEQ ID NO: 122421 - RNA, 55 nt, hsa; identical to SEQ ID NO: 121818

SEQ ID NO: 122422 - RNA, 64 nt, hsa
ucagcccugggaagacacauucccuucccuguuccccagagagcccaccuccgcccugggcagg

SEQ ID NO: 122423 - RNA, 64 nt, hsa
gagcugccggucuuggcuuccuggucgccucugucccagagauggucccagggagccauccuag

SEQ ID NO: 122424 - RNA, 64 nt, hsa
accaucacuauaaucaacgaacuucucuucuccacccagagauggcuuuuccaacacauuuuaa

SEQ ID NO: 122425 - RNA, 64 nt, hsa
uguuggcuuucccccagccgcacgggucccaggccccagagaagaugagucuauggcaucaggu

SEQ ID NO: 122426 - RNA, 64 nt, hsa
ccuggggcugguggauugggcagaauccugggcccccagagaccuuugcccacacacacuccuu

SEQ ID NO: 122427 - RNA, 64 nt, hsa
uugaccuucagcuccuaugcaggcuucucuugagcccagagacaaggcagcuuggucuagugga

SEQ ID NO: 122428 - RNA, 64 nt, hsa
aucugaaagucaggccugcugcaggacaggaucccccagagaccccauuugccucucaacacuc

SEQ ID NO: 122429 - RNA, 64 nt, hsa
gguuucaggaggagggagacugcccugcuuuggucccagagaggcccucugcagauaggcgugg

SEQ ID NO: 122430 - RNA, 64 nt, hsa
agaaucagaguggggaggggacagccuggggcugcccagagacuguggguggagcugccugcug

SEQ ID NO: 122431 - RNA, 64 nt, hsa
uccucuugcucaaaaaucuguuugaucccuguuacccagagaauauauacauucuuuaucuuga

SEQ ID NO: 122432 - RNA, 64 nt, hsa
auaccuuaaacucccacugcaagcccaugaacuucccagagaguggaacggcuugcucuucuuu

SEQ ID NO: 122433 - RNA, 64 nt, hsa
cgacccacugcagacacaggcucugauucucuuacccagagaugcccaugagcugacauuuuac

SEQ ID NO: 122434 - RNA, 64 nt, hsa
ccaucagguuaaagacuucaucuagaugaugccccccagagaugccuuuaguguaaguagcugg

SEQ ID NO: 122435 - RNA, 64 nt, hsa
uaauauaauuuuauauuuacacacauacgugcuacccagagauuaauuuaguccauaugaacua

SEQ ID NO: 122436 - RNA, 64 nt, hsa
uaacuacacagaggcacauccugacaggguuugccccagagaucuaaauuccagaaggagggca

SEQ ID NO: 122437 - RNA, 64 nt, hsa
uuugucuuuauccacccccacuguuguggucagccccagagaauuuuaucuucuuccuuggcau

SEQ ID NO: 122438 - RNA, 64 nt, hsa
auaagacugucauguaagaggugcucuccuggcacccagagaaaaggagcauccuuaccuccaa

SEQ ID NO: 122439 - RNA, 64 nt, hsa
agccaagcugccuuaacucgccccucggggcucccccagagacugugccccgggcgggccgcgc

SEQ ID NO: 122440 - RNA, 64 nt, hsa
uucugcgaucaguuaacccauuuuaccuaggaggcccagagaugugagggcuccuuccucagga

SEQ ID NO: 122441 - RNA, 64 nt, hsa
accccaucuauucucuguuggcuccaagagcuaccccagagaccuuaaacagaaacaguagcug

SEQ ID NO: 122442 - RNA, 64 nt, hsa
uauauauguagauauauauuuuagcagugacauucccagagagccccagagcucucaagcuccu

SEQ ID NO: 122443 - RNA, 64 nt, hsa
gaaccccaguccugagcuugguuucuucccagcacccagagaauccuuccucagcucucuucuu

SEQ ID NO: 122444 - RNA, 64 nt, hsa
guuaucuaaaccuuuaaaccuaucuuccaggcagcccagagaagaucuguuucccuguguccug

SEQ ID NO: 122445 - RNA, 64 nt, hsa
cuuugugugcaugggucagucaccauauguuccccccagagaaugugucuauauccuccuucua

SEQ ID NO: 122446 - RNA, 64 nt, hsa
ccaggauagucuaagggagguguucccaucugagcccagagauaagggugucuuccuagaacau

SEQ ID NO: 122447 - RNA, 64 nt, hsa
cacagcugaguuguugagucuguuuuguaaaguccccagagaaagcgcagaugcuagcacaugc

SEQ ID NO: 122448 - RNA, 64 nt, hsa
uuuagaaguacguuuuugcauuauucauaugcuucccagagaagcucauuuaguuagaaaauaa

SEQ ID NO: 122449 - RNA, 64 nt, hsa
gucacagccugacauggccagguucucacacuggcccagagaaaagagccucagcaagagaguu

SEQ ID NO: 122450 - RNA, 64 nt, hsa
aacuguccaagcucucagccccacagggaaccugcccagagagcuuuaccuuucccaagcaucu

SEQ ID NO: 122451 - RNA, 64 nt, hsa
aagugcacaucagcacuauggggccuauguccugcccagagaccucugcuccuuccugcucaca

SEQ ID NO: 122452 - RNA, 64 nt, hsa
gauaccaauauucuauuuugcagauagaauuuggcccagagagguuaacuaauauauccaugau

SEQ ID NO: 122453 - RNA, 64 nt, hsa
ccaaucauguuaacucuuccuuaucagccuguggcccagagacacaaugggguccuucuguagg

SEQ ID NO: 122454 - RNA, 64 nt, hsa
uucugcacaaaacuuuugggaauuccucuuugcacccagagacucagaggggaagagggugcua

SEQ ID NO: 122455 - RNA, 64 nt, hsa
ggcaguaauugcauuuuaucugucucaugaugcccccagagaacuuccaacucaguaggacccc

SEQ ID NO: 122456 - RNA, 64 nt, hsa
gagcuguguccauggugugucaugaaggauguaccccagagaguaacaugagccacugggcaga

SEQ ID NO: 122457 - RNA, 64 nt, hsa
ucccacauuccaaaagggggccugggaugcuagccccagagaugccagcccuucaggaagcagg

SEQ ID NO: 122458 - RNA, 64 nt, hsa
ugcugcacugcagcaaaaacaaaaccaccaccaccccagagaaaaccauguacuaauuggagug

SEQ ID NO: 122459 - RNA, 64 nt, hsa
ggcuuaagggucccaggaguacugcagggacagccccagagaggcccaacucuggccccuuucu

SEQ ID NO: 122460 - RNA, 64 nt, hsa
ugcccuagacccugccagaaaagggggcucuucccccagagaaguggcuuggagggaacuuccc

SEQ ID NO: 122461 - RNA, 64 nt, hsa
uggaggagccugcugcauucuccugcugagggaucccagagagggcaggugcccaccccacagg

SEQ ID NO: 122462 - RNA, 64 nt, hsa
gggcagagccccaggcguccccagcuguucaccucccagagaguccccagagccccaaagggcu

SEQ ID NO: 122463 - RNA, 64 nt, hsa
cuuccaugaggcaggcugaaccugcagauaugcgcccagagauauggaucgcccaagaguugcg

SEQ ID NO: 122464 - RNA, 64 nt, hsa
gauggaaggaagagaguagggccagugaaggcugcccagagagaaugucacagaugaggcugcc

SEQ ID NO: 122465 - RNA, 64 nt, hsa
gaaaguuccugcuuuaguguuuuguucccucugccccagagagcuccccuuagugaucucaguu

SEQ ID NO: 122466 - RNA, 64 nt, hsa
agagcccagcccugggcuggggggcuccucaggacccagagaugugccuggaaccacuccugau

SEQ ID NO: 122467 - RNA, 64 nt, hsa
ccccucagguuguucucugauucuuccucccaaccccagagacugcagauuugugccaugcggc

SEQ ID NO: 122468 - RNA, 64 nt, hsa
gccucuauccuaaggaagaccaagcaggccuggacccagagacgucccccaucgugggacacga

SEQ ID NO: 122469 - RNA, 64 nt, hsa
cuggcaggugaugugcuggguauagcauggaccucccagagaagcucaagcuauguggcacugu

SEQ ID NO: 122470 - RNA, 64 nt, hsa
cgauugugcuucucaacuccaccccauaauuucucccagagaccaucuaucaccuuuuccccaa

SEQ ID NO: 122471 - RNA, 64 nt, hsa
agcuccagcagaaaccagauuggauguuccagcucccagagaagacucuaucacagugcacaua

SEQ ID NO: 122472 - RNA, 64 nt, hsa
aacuggcacacgccccacgccuuccucuauaacccccagagacaggcuggggcagcgccaaggc

SEQ ID NO: 122473 - RNA, 59 nt, hsa; identical to SEQ ID NO: 121870

SEQ ID NO: 122474 - RNA, 64 nt, hsa
gaaaagcaguuagcauuuccacacaaccgcuguccccagagauaacugcuguuuucauuuuaau

SEQ ID NO: 122475 - RNA, 64 nt, hsa
uaugcuccuugacugaaacuuuaaggggaucucucccagagacuugacauuuuagcuuuauugu

SEQ ID NO: 122476 - RNA, 64 nt, hsa
uuccccgcccguuuuacaaagggggaggcuaaagcccagagacagcuugaucaaaggcacacag

SEQ ID NO: 122477 - RNA, 64 nt, hsa
aagcuuucuucuuacaccuugggcuuggauauugcccagagaagaaauuuggcuuuuuuuuucu

SEQ ID NO: 122478 - RNA, 61 nt, hsa; identical to SEQ ID NO: 121875

SEQ ID NO: 122479 - RNA, 64 nt, hsa
acugagcaacaggaggacucagccugggacaggccccagagagucacacaaaggaaucuuuauu

SEQ ID NO: 122480 - RNA, 64 nt, hsa
auucugacaaaaaguccagaacccauaaacauagcccagagaagagaggcucugaaagaaagga

SEQ ID NO: 122481 - RNA, 64 nt, hsa
acuccaggcuggccuuuggccgacugucugcucacccagagaccuuggacuccggacuauccau

SEQ ID NO: 122482 - RNA, 64 nt, hsa
caugcaggaguuucuccugggcagcuggucacuccccagagaagcugggccuucauggacacau

SEQ ID NO: 122483 - RNA, 64 nt, hsa
aguggaccuggagaccauccccuuggaaagacaacccagagauguucagcauccuguaucuaca

SEQ ID NO: 122484 - RNA, 64 nt, hsa
gcuauguuucuauaagauauggugcccuguguaucccagagaugcuagaaaacuguucuuugcu

SEQ ID NO: 122485 - RNA, 64 nt, hsa
gcucagcuuugggaugugggugggaacuggagcacccagagaaaacccauacagacaguggccu

SEQ ID NO: 122486 - RNA, 64 nt, hsa
gaauagcugugauggaaggacuagagcgaaagggcccagagauaucaaggaagcuuuucauucu

SEQ ID NO: 122487 - RNA, 64 nt, hsa
aacaaucaacuaguauuuguugagcuccuauuugcccagagauggucauauuuaaacagaagua

SEQ ID NO: 122488 - RNA, 64 nt, hsa
gggggauuguagcagacgucugggcuuuuccccacccagagaauagcccccuucgauacacauc

SEQ ID NO: 122489 - RNA, 64 nt, hsa
uucauagagucaacuguuucaucaucauagugagcccagagagccacugcccagcagcaugcuc

SEQ ID NO: 122490 - RNA, 64 nt, hsa
cacuguaaaaacagcuguagguauaauguauauucccagagaauuguauuuaacuaauuaaugu

SEQ ID NO: 122491 - RNA, 64 nt, hsa
uaccaccggcacuuacaaaaugugcggacugaaucccagagaacacuggcagauguauacagua

SEQ ID NO: 122492 - RNA, 64 nt, hsa
uaccacugaaguagaauugauuguucagcuggagcccagagaauuuaauuuaauguuuuuucuu

SEQ ID NO: 122493 - RNA, 64 nt, hsa
aucaacugauuaaagcagugaccagcaggaacugcccagagaacuggcuggccuuguuuccuga

SEQ ID NO: 122494 - RNA, 64 nt, hsa
ggcucaugccuccaagucagaguuucccuggugccccagagacaggagcacaagugggaucuga

SEQ ID NO: 122495 - RNA, 64 nt, hsa
aaguguuuuacacaaaugcauaucuugaacgucacccagagacuguaauuuguguaguuuuucu

SEQ ID NO: 122496 - RNA, 64 nt, hsa
aggacugguuuuccaguacaucuuuaaacaaggccccagagacucuaugucugcccguccauca

SEQ ID NO: 122497 - RNA, 64 nt, hsa
cgcggccgaggccggagcaccacauccaccucgccccagagaggcucugcucccuccuauggag

SEQ ID NO: 122498 - RNA, 64 nt, hsa
ggccccggggcugccguuuugcugggcagugguucccagagagucagagcuggcaccccucagu

SEQ ID NO: 122499 - RNA, 64 nt, hsa
gcuguucccgcugcacggcccaccggcggccagccccagagaccagaacugauccagagcugga

SEQ ID NO: 122500 - RNA, 64 nt, hsa
aggcaggggcaggcugaggaguugcccuuugccccccagagacugacucucagagccagagaug

SEQ ID NO: 122501 - RNA, 64 nt, hsa
acucuuaaugcuguguuugagcuuucaugaguuucccagagagacauagcuggaaaauuccuau

SEQ ID NO: 122502 - RNA, 64 nt, hsa
gaacccuucauaggaaauccccacccccguccaccccagagacccugcccuuccacccggaggc

SEQ ID NO: 122503 - RNA, 64 nt, hsa
ggcugugucagcccagccccuucccuucuccaggcccagagaacucuuccacaaacaagaugag

SEQ ID NO: 122504 - RNA, 64 nt, hsa
agggauguaggagggggaaggaggaaacaggaagcccagagagggcaaagggccuaccucgggg

SEQ ID NO: 122505 - RNA, 64 nt, hsa
cucucugcucagaacacuaccauucaccccaucucccagagacacucucccuccuccucuuuca

SEQ ID NO: 122506 - RNA, 64 nt, hsa
ggggaacagggaauagaaccuuucaaagagguugcccagagaaaagcugggccucuugcauucg

SEQ ID NO: 122507 - RNA, 64 nt, hsa
gcaguagccuuggggcagagggcacccgcagagucccagagaugaugugggcagugggcagaga

SEQ ID NO: 122508 - RNA, 64 nt, hsa
uccagugucugucaugccccugaguucuuuuggucccagagaggcagccugggcagucuguuua

SEQ ID NO: 122509 - RNA, 64 nt, hsa
aagggcagacaaacaggugagggugaguguggcacccagagacugcucuuccugcccucacccu

SEQ ID NO: 122510 - RNA, 64 nt, hsa
gugcauggaggcccuccugugcugggggaaugagcccagagaacagcgaaguagcuugcucccu

SEQ ID NO: 122511 - RNA, 64 nt, hsa
ccugagcaccugcuucaugaaggaagauagguagcccagagaagaaguuuuggacuuaacaaca

SEQ ID NO: 122512 - RNA, 64 nt, hsa
uuaauuguuuuagagcguguugcuguuguaacaucccagagaagaaugaaaaggcacaugcuuu

SEQ ID NO: 122513 - RNA, 64 nt, hsa
ugcccggaggggucuggaggcauaagucuagaugcccagagagcauccaggcacugaacugcuc

SEQ ID NO: 122514 - RNA, 64 nt, hsa
aacagaggacaggugacaaccaccucgaagagcucccagagauuguagaaagaguccaguguaa

SEQ ID NO: 122515 - RNA, 64 nt, hsa
gggugauaacuacuuagcacugcccuggugauuacccagagauaucuaugaaaaccaguggcuu

SEQ ID NO: 122516 - RNA, 64 nt, hsa
accacagccucauuuuacagacagcccccugaggcccagagacaugcagcucucuguccacaac

SEQ ID NO: 122517 - RNA, 64 nt, hsa
gaaggugagaggaaggcaaaggccagggaggggacccagagaggccuggcacacaaggcccaag

SEQ ID NO: 122518 - RNA, 64 nt, hsa
ggaacucaggaaaagcaggaacccuuuccaaaagcccagagaugcccugggcucagaucuguaa

SEQ ID NO: 122519 - RNA, 64 nt, hsa
cuuuugugccaaacccauaggucugaaacugagacccagagaggcugaaugacaugcucacagu

SEQ ID NO: 122520 - RNA, 64 nt, hsa
ugguucagguggggucuccagaaggcugcuugcccccagagagccaucucuuccauuuuugauu

SEQ ID NO: 122521 - RNA, 64 nt, hsa
acucccauuugcucucagugaccccagggcagagcccagagaaguguuccguacccacugcuga

SEQ ID NO: 122522 - RNA, 64 nt, hsa
ucaaaucuuuauuuugcagaugaggaaacagcaacccagagaggagaacuaacccacacaggau

SEQ ID NO: 122523 - RNA, 64 nt, hsa
aggauacaucugaaagcauuccuuuggcauggaccccagagauaguuuuggagccaggcauuga

SEQ ID NO: 122524 - RNA, 64 nt, hsa
ccaucagcagggggaaagccaagcugagaauaaacccagagacaaagaacccucggacucaggc

SEQ ID NO: 122525 - RNA, 64 nt, hsa
ugggcagaaggggcggcccggacgggggagcuuucccagagacccggggauggauuggccucca

SEQ ID NO: 122526 - RNA, 64 nt, hsa
gauaauggccagagauauccacagcuuggaggagcccagagaccguuugcuuuauacccacaca

SEQ ID NO: 122527 - RNA, 64 nt, hsa
gugguuaugcagaagcagagaugaggaggcuggccccagagaugaucuugcccuuccuaacuaa

SEQ ID NO: 122528 - RNA, 64 nt, hsa
acaccucagcaaaugcugcaaaauccuguuuucccccagagagcuggagguuaaauacuaccag

SEQ ID NO: 122529 - RNA, 64 nt, hsa
uguaaauaaugugggaaaauaguauuguuuagcucccagagaaacauuuguuccacaguuaaca

SEQ ID NO: 122530 - RNA, 64 nt, hsa
cgggcucagccauucggcuuggggcaccaggcuccccagagacaaugcucaguauucauucaua

SEQ ID NO: 122531 - RNA, 64 nt, hsa
uucuuuguaauuuaugcuuucauauauccuuggucccagagauguuuagacaauuuuaggcuca

SEQ ID NO: 122532 - RNA, 64 nt, hsa
ucaucccuacucaucagaaagacaaauauaaaaucccagagagguggaggagcuaaaaaagcaa

SEQ ID NO: 122533 - RNA, 64 nt, hsa
ucaauagcaacagaaauauaaauuauauuccauucccagagagagaaugcgcuuuggauuguuu

SEQ ID NO: 122534 - RNA, 64 nt, hsa
cagccuucagucccuaucagcgccuccuuuacuucccagagaacuucacagagacucuguccuu

SEQ ID NO: 122535 - RNA, 64 nt, hsa
ugagcugugucccuuuacuaugcaagcacaugaccccagagacagcugguucacuggcagaucc

SEQ ID NO: 122536 - RNA, 64 nt, hsa
cugugugcaaggcaauaguuagccuugauuuuagcccagagacagauggcagagcuaucucucu

SEQ ID NO: 122537 - RNA, 64 nt, hsa
aggagauguaaugacagagaguucuggugagauacccagagagaaaaagagagagcaggguggg

SEQ ID NO: 122538 - RNA, 64 nt, hsa
gcugcuccccacaccuagccuuuguucuggaaaccccagagagggcugggcuugacucaucuca

SEQ ID NO: 122539 - RNA, 64 nt, hsa
caccaggcaagagucuugcuuauugggcugcauccccagagaggauaugaauuauuuuuugaaa

SEQ ID NO: 122540 - RNA, 64 nt, hsa
gggggacccaaagggucuggccucuuugggcagccccagagaugaggggucagcagaggagagc

SEQ ID NO: 122541 - RNA, 64 nt, hsa
ccacuccccuugccccacacccuuuacuccccagcccagagagacgcugcuuuuaccaggaaag

SEQ ID NO: 122542 - RNA, 64 nt, hsa
aggcagcaccauuugacagguuaggaugcuggggcccagagagguuaagugucuugcccgaggu

SEQ ID NO: 122543 - RNA, 64 nt, hsa
gcagaccuggcuguggagagcagcuaauguguggcccagagagccugucuguguggagcacgua

SEQ ID NO: 122544 - RNA, 64 nt, hsa
uugugcuuauuucugccauugucccucucacguucccagagaggucauucuuuuugguccaacu

SEQ ID NO: 122545 - RNA, 64 nt, hsa
ccccagcgucuugacgggagcauuggccccugagcccagagaagcuggaagccugccgaaaaca

SEQ ID NO: 122546 - RNA, 64 nt, hsa
cagggcccagcccugcuuccuggaguggauguggcccagagaaggaggcugggggaucaccagc

SEQ ID NO: 122547 - RNA, 64 nt, hsa
ucagcucuuucugcaugugcuggucaaauccaaacccagagaacagaagcgcuuucuaagaaug

SEQ ID NO: 122548 - RNA, 64 nt, hsa
ggaacaguccauauuagcuccagagagugucaaacccagagaaaugugugcaaaaaugauacuc

SEQ ID NO: 122549 - RNA, 64 nt, hsa
ccuugccccuuauuucuucccugcuucccucgaacccagagauuuuugagggaugaacggguag

SEQ ID NO: 122550 - RNA, 64 nt, hsa
acccugggaacugggucuuggguagcaaagcccucccagagaaaagauugggcacaacuaaggc

SEQ ID NO: 122551 - RNA, 64 nt, hsa
uugccucuguauuuaagccaacagaguuacccaacccagagacuguuaaucauggauguuagag

SEQ ID NO: 122552 - RNA, 64 nt, hsa
auccccucucccacugagucacagguuugagauucccagagaggccaaagacagcuacaggaag

SEQ ID NO: 122553 - RNA, 64 nt, hsa
ugacugcuacuuccugucucuguuuccauuaucacccagagagggacaagauaggacauggccu

SEQ ID NO: 122554 - RNA, 64 nt, hsa
ucucugggcugccggugggaggggaugucgccuccccagagaugccugguccgucuugggucug

SEQ ID NO: 122555 - RNA, 64 nt, hsa
accaauaugugccacgugccuguggcugcagacucccagagaaccagcacuggguuuacagaau

SEQ ID NO: 122556 - RNA, 64 nt, hsa
ccuucaggcaccuaggggagagcgugccugacaacccagagagauucgacagucagccuugugu

SEQ ID NO: 122557 - RNA, 64 nt, hsa
gugccaagccuguggaucaggaauaucaacagcccccagagaguggugcuggcugagggucuga

SEQ ID NO: 122558 - RNA, 64 nt, hsa
ugcaccucccuucccucccugaggcaggugagaacccagagagaggggccugcaggugagcagg

SEQ ID NO: 122559 - RNA, 64 nt, hsa
uacaccucagggcgggugagguuccgacacugaucccagagaugccguggauacgccagggucc

SEQ ID NO: 122560 - RNA, 64 nt, hsa
uauuugaguuguuuuggugccugccucugccaugcccagagaaucagggcaggcuugccaccgg

SEQ ID NO: 122561 - RNA, 64 nt, hsa
aaggacuuggcugcgcguaacugccuggucagugcccagagacaagugaaggugucugcccugg

SEQ ID NO: 122562 - RNA, 64 nt, hsa
ucuuuacgaguguuuuuuauuugggacccucgagcccagagauauuaauggauaucuguauuca

SEQ ID NO: 122563 - RNA, 64 nt, hsa
ucagaggaagcagcccucccucgauggccucuagcccagagaagcccgcgcaucuuggacccac

SEQ ID NO: 122564 - RNA, 64 nt, hsa
aagaaaaaaaaaaaaggaggggaaaugcauuuuccccagagauaaaggcugccauuuugggggu

SEQ ID NO: 122565 - RNA, 64 nt, hsa
aagaguguaugauucuggaacagggugaaacucucccagagacgaagaaagaguccugggauuu

SEQ ID NO: 122566 - RNA, 64 nt, hsa
gaugacaugacaucacucccaauucucuccaaaccccagagaaauacugacgaaguuuucugau

SEQ ID NO: 122567 - RNA, 64 nt, hsa
cuguuuugaguuuugcccuggggcuugaaugagucccagagagucguucggauggugggaggcu

SEQ ID NO: 122568 - RNA, 64 nt, hsa
aguacaacaaaggugacggguguguagguacacacccagagauggagcacugcagaucagcaac

SEQ ID NO: 122569 - RNA, 64 nt, hsa
gagaaauaaacauuuagaggauuuaauuagaaagcccagagaaaaagccagaaaaccaagguaa

SEQ ID NO: 122570 - RNA, 64 nt, hsa
gaaaggguauuucauaguuuuuaaaccuuucauucccagagauccgaaauaucauuuguggguu

SEQ ID NO: 122571 - RNA, 64 nt, hsa
uauuaaucucauuguacaagugagaaaacugagacccagagagcuuaagugacuuccucgaggu

SEQ ID NO: 122572 - RNA, 64 nt, hsa
ccccuuuaacacuggugaaagcuacgguacucuccccagagauaugucuugucagccucucuag

SEQ ID NO: 122573 - RNA, 64 nt, hsa
agagccugcaauuggaaauaugagaaauucuuugcccagagagcugcccuaacagaacacuuca

SEQ ID NO: 122574 - RNA, 64 nt, hsa
uaguuauuuucugaaaaauugguucuucucuuuucccagagaccuucugaucuccaaaaagagg

SEQ ID NO: 122575 - RNA, 64 nt, hsa
aaaaggguucuuggaggccaggggaauacggggucccagagaaagauuuccuucucuuagaagu

SEQ ID NO: 122576 - RNA, 64 nt, hsa
uauuaaaaggaagcagaagcauugaccauuuuuucccagagaagaggagaaaucuguagugagc

SEQ ID NO: 122577 - RNA, 64 nt, hsa
ugggaccagaugcuucccugugcuggcuggaguccccagagauaucagccaccgagucuccugg

SEQ ID NO: 122578 - RNA, 64 nt, hsa
gacuacaaugggcugaaacaguugguauagcaaccccagagaagugcuucauuuucuuuuuaua

SEQ ID NO: 122579 - RNA, 64 nt, hsa
uaagaaagaauugcaguaaagucuugucuggugacccagagaucaccaugacuugaggcacaaa

SEQ ID NO: 122580 - RNA, 64 nt, hsa
uucucuucuugcugcaaaacugguuggcuugcaacccagagagagcagcuucccuuggcucugg

SEQ ID NO: 122581 - RNA, 64 nt, hsa
guccacaguaguucaggcaauuaagaauaugcaacccagagaauuucugugaaaacauuuugcu

SEQ ID NO: 122582 - RNA, 64 nt, hsa
agccaaagccgaaaauaguauaugagcauucuagcccagagacugucgcuacuaaaagaaugaa

SEQ ID NO: 122583 - RNA, 64 nt, hsa
gagggaaauggguagagccuguuugucuugcuuccccagagauagaaugugaagacacgcgcua

SEQ ID NO: 122584 - RNA, 64 nt, hsa
ucuuggugccccgacccccaggguucgucuaggucccagagacccucugccuggaggcgggccu

SEQ ID NO: 122585 - RNA, 64 nt, hsa
ggccgccuucuuggugccaaacccccuucccccacccagagacugggcagcugugucugguucg

SEQ ID NO: 122586 - RNA, 64 nt, hsa
ggaggcaagcccccuugccuuucaaacuggaaaccccagagaaaacggugcccccaccugucgc

SEQ ID NO: 122587 - RNA, 64 nt, hsa
uuacacuuuacagguaccuguuaucccuacgcuucccagagagaacaaugcugugagagaguuu

SEQ ID NO: 122588 - RNA, 64 nt, hsa
ggaaggagccaggacacagcucagcuugcucacgcccagagagagaaaaaguuaagcugcugac

SEQ ID NO: 122589 - RNA, 64 nt, hsa
gcucuugucccugggaggccucugcuugucacuucccagagauugcagagguguguccugccua

SEQ ID NO: 122590 - RNA, 64 nt, hsa
ggcccagagcacuguuggaagucugguuagaguccccagagaguuacucuaaguuaaaaugagc

SEQ ID NO: 122591 - RNA, 61 nt, hsa; identical to SEQ ID NO: 121988

SEQ ID NO: 122592 - RNA, 64 nt, hsa
gcuuuuaauccaaagaacauguauaguuuuuguacccagagacuaugauuuauauugauugcac

SEQ ID NO: 122593 - RNA, 64 nt, hsa
uuccucugccgggaggguguuuucaacuccaaaccccagagagggguuguagauuggguccagc

SEQ ID NO: 122594 - RNA, 64 nt, hsa
cuuuaugaugacugcuuaacuccccacugccugucccagagaggcuuuccaauguagcucagua

SEQ ID NO: 122595 - RNA, 64 nt, hsa
cucagauggaacgaaaggcgaugugcaaggccaucccagagagacggaagcaggugcgauacua

SEQ ID NO: 122596 - RNA, 64 nt, hsa
acuaugucuggucaccagcucccuccugcuggcacccagagacccggacccgcagggccugccu

SEQ ID NO: 122597 - RNA, 64 nt, hsa
uggugucacguuggggaacaaguguccuucagaacccagagaaggccgccguucuguaaauagc

SEQ ID NO: 122598 - RNA, 64 nt, hsa
gaaaacgggccgguauuuacacacgcgcaaaacacccagagacggcacaaggagguugaacuca

SEQ ID NO: 122599 - RNA, 64 nt, hsa
ucuucagaccagccagcaaggggccgugccagugcccagagagcaggucagacaacaggcaacc

SEQ ID NO: 122600 - RNA, 64 nt, hsa
gccaguuucuugucuuuuuuauacauuuugucaucccagagacaaucaguaugugcuuaccugu

SEQ ID NO: 122601 - RNA, 64 nt, hsa
aagaauuccaauuaauuaaauaucacaauagcaucccagagagacaguaggaaauuucuccuua

SEQ ID NO: 122602 - RNA, 64 nt, hsa
cuccauggaggaggugucccaagcuuugaauacccccagagaccuuuucucucccauaccauca

SEQ ID NO: 122603 - RNA, 64 nt, hsa
caacuguggccaugacugaggaaaggagcucacgcccagagacugggcugcucucccggaggcc

SEQ ID NO: 122604 - RNA, 64 nt, hsa
gaauggucucugucaagcgggccgucucccuuggcccagagacggagugugggagugauuccca

SEQ ID NO: 122605 - RNA, 64 nt, hsa
uaaauugauuuguuaugguuacauauuuagcgcacccagagaaaauuaauuauauuucuacaga

SEQ ID NO: 122606 - RNA, 64 nt, hsa
acucuaaccaaucaaauaguuucuuugucuugcucccagagacaccuuguaaguguccccucug

SEQ ID NO: 122607 - RNA, 64 nt, hsa
aaacagggaagagacauaccccugggcuuggauucccagagaggaaaccuuggggccccagaug

SEQ ID NO: 122608 - RNA, 64 nt, hsa
aaugggacccacguggaguaggugacauaugcuucccagagacugguauuguggcugugccagg

SEQ ID NO: 122609 - RNA, 64 nt, hsa
uggcuccuccaggcacgucccggaccuguggggccccagagaggggacauuucccuccugggag

SEQ ID NO: 122610 - RNA, 64 nt, hsa
auacuaaaauacugauuaucuuaaucacauuuuccccagagauaaacauugagagaacgaaagc

SEQ ID NO: 122611 - RNA, 64 nt, hsa
ccgagagcugucggaaccagaugcaacccggcagcccagagaacucuccugggaggcugugggu

SEQ ID NO: 122612 - RNA, 64 nt, hsa
cauaaagugaaucaaauuugacauuauuuuagaucccagagaaaucaggugugauuaguucucc

SEQ ID NO: 122613 - RNA, 64 nt, hsa
uuagggcauagaguugucuccuucccaacacggacccagagagcagcccuucccugcucaaagc

SEQ ID NO: 122614 - RNA, 64 nt, hsa
cuacagagcagugugggcagccccaagugugguccccagagagcguuuggcuuuccugucuguc

SEQ ID NO: 122615 - RNA, 64 nt, hsa
gaguguuccucgacauguuucuccagugacaccucccagagaaguuguaaguauaaaaugaaaa

SEQ ID NO: 122616 - RNA, 64 nt, hsa
uugaaauguugacuuaagugagggggaaauaaaacccagagagagagagagagcgagagagaga

SEQ ID NO: 122617 - RNA, 64 nt, hsa
aagauccucaucugagagugcuuaaaaugggauccccagagaccauuaaccaauacuggaacug

SEQ ID NO: 122618 - RNA, 64 nt, hsa
ucccagccugaggcuccagcugaugcccucagcucccagagagggggugccccaucuagcuggg

SEQ ID NO: 122619 - RNA, 64 nt, hsa
gccacaccacgugcccucuuggcccagccuuccucccagagaggcggccugacuuaccuggaug

SEQ ID NO: 122620 - RNA, 64 nt, hsa
cuuccuuccccucuguaaauguccaugacuauugcccagagaaggcuuaccccucucuaggguu

SEQ ID NO: 122621 - RNA, 53 nt, hsa; identical to SEQ ID NO: 122018

SEQ ID NO: 122622 - RNA, 64 nt, hsa
cucacaugggacugggauaugggggcaucucuuccccagagaggcacucagugagccuccugug

SEQ ID NO: 122623 - RNA, 64 nt, hsa
uguuagcguuacuucuccuguggucaguaaguugcccagagagaaggaacaaaggucuggaguu

SEQ ID NO: 122624 - RNA, 64 nt, hsa
gugacacguggacaaaugcgggcucaucagcccccccagagagggucaggccgaaccccauuuc

SEQ ID NO: 122625 - RNA, 64 nt, hsa
ugaguccagcuccccccaagaugagcugcagccccccagagagagcucugcacgucaccaagua

SEQ ID NO: 122626 - RNA, 64 nt, hsa
accccaacaaauauuaaauggcuucuucuuaaagcccagagaaagagguuuuuuaaaagacugu

SEQ ID NO: 122627 - RNA, 64 nt, hsa
gccagacuuuaggagugugagggaugcugaaucucccagagagcucacacuggccaggaaugcu

SEQ ID NO: 122628 - RNA, 64 nt, hsa
gacaucuauugucauuccauugcuauuuuuuuuccccagagacuuccauaauuuaaaauaaaau

SEQ ID NO: 122629 - RNA, 64 nt, hsa
cuaauuuuuuaaaaauggaagguaaacugcauagcccagagaaagauaaguaaauauuuaagaa

SEQ ID NO: 122630 - RNA, 64 nt, hsa
cacguacaguuguauggauuguguacugcacaaccccagagaauaccagucacaucaaucaggg

SEQ ID NO: 122631 - RNA, 64 nt, hsa
ccuuaaaugucgguccaggcccugugcaccuuaccccagagacagacucuuuuuguaagauuuu

SEQ ID NO: 122632 - RNA, 64 nt, hsa
acggggggccccagucagccucucucccagucuacccagagaagccccuuccccaugggaagac

SEQ ID NO: 122633 - RNA, 64 nt, hsa
ccacgagaagugaccuucagggucaucaggcugucccagagagguccgcguucuccccaccccg

SEQ ID NO: 122634 - RNA, 64 nt, hsa
cuguacauacauuguauaggccaucuguaaauaucccagagaacaaucacuauucuuaagcacu

SEQ ID NO: 122635 - RNA, 64 nt, hsa
ccuugcuguuuaaaaguaaugcaauaugugaacgcccagagaacaagcacuguggaacugcuau

SEQ ID NO: 122636 - RNA, 64 nt, hsa
aggacacuuggcuuuggggggaaggaaacugaggcccagagaggggcaaccacuggccaagggu

SEQ ID NO: 122637 - RNA, 64 nt, hsa
cauaacaugguacaugcuucaggacuacauaugacccagagagcaagguggcugaacuauaguc

SEQ ID NO: 122638 - RNA, 64 nt, hsa
aaaaacccaagaguuuguacagacauccugucuucccagagaagguggacacucuugggcucau

SEQ ID NO: 122639 - RNA, 64 nt, hsa
ggguagggagaggacaaggggucaccgagcccuucccagagagcagggagcuuauaaauggaac

SEQ ID NO: 122640 - RNA, 64 nt, hsa
cugcaaagcaguguccaggagcaggccacuacugcccagagagcagaggaggagguuguuggca

SEQ ID NO: 122641 - RNA, 64 nt, hsa
gcugcucgggaaggccugagggaagcccacccgccccagagacugcccacccugggccucccgu

SEQ ID NO: 122642 - RNA, 64 nt, hsa
cccuguacaucuaauauauacugauuuguuugcccccagagaauuuuuaagguaucugccuaua

SEQ ID NO: 122643 - RNA, 64 nt, hsa
gggcucugcauagccaggaugacggcuuucaugucccagagaccuguugugcuguguauuuuga

SEQ ID NO: 122644 - RNA, 64 nt, hsa
gaccagucggaagggauucuggcuauugggggagcccagagacaggggaaggcagccuguccau

SEQ ID NO: 122645 - RNA, 64 nt, hsa
ugggacacaagucacuucaagaagucuggugguccccagagaaacaacuauguuauccauccug

SEQ ID NO: 122646 - RNA, 64 nt, hsa
cuaaagaagccucuucuauuuaaugcagacccggcccagagacugugcgugccacuaccaaagc

SEQ ID NO: 122647 - RNA, 64 nt, hsa
guaggaggauccacaggauuugagaugcuaaggccccagagaucguuugauccaacccucuuau

SEQ ID NO: 122648 - RNA, 64 nt, hsa
auucaggaaagaagugcagaauuucuuccccaagcccagagaagagcagcccugagccccugua

SEQ ID NO: 122649 - RNA, 64 nt, hsa
gagggucagaacuggacagcugcagagaccugugcccagagaagggucucgacccacucaagga

SEQ ID NO: 122650 - RNA, 64 nt, hsa; identical to SEQ ID NO: 122573

SEQ ID NO: 122651 - RNA, 64 nt, hsa
ugaccuucagcccucccuacagccggggguguggcccagagaagcuuccagcacagcccucuac

SEQ ID NO: 122652 - RNA, 64 nt, hsa
uuaacuggacauuaguguacagcccauguccaagcccagagagaaaacaaugggaacaauuuca

SEQ ID NO: 122653 - RNA, 64 nt, hsa
gccugaggucuccuauucuacucugaaccauaaacccagagaagaauuacucauuaaccagcau

SEQ ID NO: 122654 - RNA, 64 nt, hsa
gaaccugggcuaagaguuuggcauugcaggagcucccagagagacugccuucccuacacuagaa

SEQ ID NO: 122655 - RNA, 64 nt, hsa
uuacuuuaaaugccugccaaggagcagccucaagcccagagaagacugaggcuacggggaacuu

SEQ ID NO: 122656 - RNA, 64 nt, hsa
ucccaaugccaacccccaccccguuucccuggugcccagagaacccaccucucccccaagggcc

SEQ ID NO: 122657 - RNA, 64 nt, hsa
agaaaucucuuuguggcuuucaugggcagggaaucccagagauagcaaaugccaccugaccaga

SEQ ID NO: 122658 - RNA, 64 nt, hsa
cuuaucuuccuuuugugguuuuuaauuugaagaccccagagaauuccauuacauaaugauuuug

SEQ ID NO: 122659 - RNA, 64 nt, hsa
gcuaauacuuucucccuaauggaagcccugaucccccagagagcuacaggucugcucccgacgg

SEQ ID NO: 122660 - RNA, 64 nt, hsa
gcccaaacuugugacugcaucccucuggagucuacccagagacagagaaugugucuuuaugugg

SEQ ID NO: 122661 - RNA, 64 nt, hsa
gaggaaacagacagcggacugaggaagcgauggccccagagaaagggccccuguagccuggcuc

SEQ ID NO: 122662 - RNA, 64 nt, hsa
cacaaaugaagagaaaagccaugcccaccccagccccagagaaaccaauaagaauccucuauua

SEQ ID NO: 122663 - RNA, 64 nt, hsa
guaaaggcuccuggccucucaucaggaucugccccccagagaccccccccagacacugcagggc

SEQ ID NO: 122664 - RNA, 64 nt, hsa
auugaucaccaugaaagaagaauaguuuuuuguccccagagacauucauuuaguugauauaauc

SEQ ID NO: 122665 - RNA, 64 nt, hsa
guggugugggccagaaacaagggacagugaaacacccagagacuuguaucagcaggaagccauu

SEQ ID NO: 122666 - RNA, 64 nt, hsa
cacagagcacagcucaugggcaacaucacuggggcccagagagagcuguccgccagugcaucau

SEQ ID NO: 122667 - RNA, 64 nt, hsa
cucuagcaucacuccugagcugcgggagagguggcccagagaacagcagagucaguuacaccug

SEQ ID NO: 122668 - RNA, 64 nt, hsa
cauguggcccaacacaauucuucuuccaacguggcccagagaagccaaaagauuggauacgcau

SEQ ID NO: 122669 - RNA, 64 nt, hsa
aagguccaacccugcaaugaagcagccacuucagcccagagagauuauaagaacugauguggcc

SEQ ID NO: 122670 - RNA, 64 nt, hsa
ccagcguuugccagagguggccacuucagccaagcccagagaagugugggcagaagcagugaag

SEQ ID NO: 122671 - RNA, 64 nt, hsa
aauuuucugcaugggacucugaguuccuuuccuucccagagaguuuuaccguaugaagccugga

SEQ ID NO: 122672 - RNA, 64 nt, hsa
agucuuuuuugcccagaucuuuuaagacuuacaccccagagauuuaagaagaaaaccucuaaau

SEQ ID NO: 122673 - RNA, 64 nt, hsa
ggcauggcuuugaccuaguaugaacuggugucugcccagagagcagcauguagcaggggggaau

SEQ ID NO: 122674 - RNA, 64 nt, hsa
uuugugucugaaaccgguuuuaaaaugugacucucccagagaagaagccgcuggcuguaugaaa

SEQ ID NO: 122675 - RNA, 64 nt, hsa
ccuagggcugggguucucaagccccuggcccuggcccagagauuuggauucccuuggcggccgu

SEQ ID NO: 122676 - RNA, 64 nt, hsa
cauccuuggucaucauugucuccuucccaccuggcccagagaugcuuaaauccaaguuguuucu

SEQ ID NO: 122677 - RNA, 64 nt, hsa
cccucccaguuggccagaaucugaggggagagcccccagagagcccccuuccccaucagaagac

SEQ ID NO: 122678 - RNA, 64 nt, hsa
uucccuagggucucuucuugcuugacucaaucuacccagagaugccccuuagcacaccuagagg

SEQ ID NO: 122679 - RNA, 64 nt, hsa
uuaaugcacuuuaaauaagguagaauggaaaaaacccagagagcaaagugcauuacuuaaagau

SEQ ID NO: 122680 - RNA, 64 nt, hsa
gggccugaugaaagcuuccugaguggugucgggucccagagagggagcccaccugcugccuggg

SEQ ID NO: 122681 - RNA, 64 nt, hsa
ccugcucagccaggccucuccugggagccacucgcccagagacucagcuuggccaacuuggggg

SEQ ID NO: 122682 - RNA, 64 nt, hsa
uggcccucucugaaggaggccaccuccuaaaaggcccagagagaagagccccacucucagaggc

SEQ ID NO: 122683 - RNA, 64 nt, hsa
ccagacuugggugcuuagcuucagauacucuaugcccagagauagugcacuuggcagcugucag

SEQ ID NO: 122684 - RNA, 64 nt, hsa
uguaaagcuaggcagaugagcccagaagaauggucccagagaaagcagacuggcuccaauagau

SEQ ID NO: 122685 - RNA, 64 nt, hsa
ugugccuacuguuccccaccucagaagcuuccugcccagagagccagcagccuugggauacuaa

SEQ ID NO: 122686 - RNA, 64 nt, hsa
cuugcacugugcucucccacaaguccagcugcaacccagagauaguggaaacugaaauuaggaa

SEQ ID NO: 122687 - RNA, 64 nt, hsa
gcucugaaaccaaacagcauccugccaugagcuucccagagacagaagagacuggagcaaaguc

SEQ ID NO: 122688 - RNA, 64 nt, hsa
uuacugccacuaguguucaagugccucuuguuuucccagagauuuccugggucugccagaggcc

SEQ ID NO: 122689 - RNA, 64 nt, hsa
uuuccccaucuguuggaccaaauaaucucaaaggcccagagaggacagugaccauccacagaca

SEQ ID NO: 122690 - RNA, 64 nt, hsa
cauuccuuccaggagcaguaggugggagguuugacccagagaagccaauccuugcauuccagga

SEQ ID NO: 122691 - RNA, 64 nt, hsa
caaccaaggagcuggggcccaaggccaguccugccccagagacacuccaaguccgccaggggca

SEQ ID NO: 122692 - RNA, 64 nt, hsa
acaaagagggccccagcccagccccaccacagaucccagagauaggggcccagucuccaugggg

SEQ ID NO: 122693 - RNA, 64 nt, hsa
uugcacccggggcugcaaacgucuccgugcagcccccagagagaggcccaugggcucagaccag

SEQ ID NO: 122694 - RNA, 64 nt, hsa
auuuccuaccaccuuuguggccgaccccaagcaccccagagauaugaggcacccuuugcuccac

SEQ ID NO: 122695 - RNA, 64 nt, hsa
gagauuguucuccagcaccccacauucaccccugcccagagauucccccuucuccucuccccua

SEQ ID NO: 122696 - RNA, 64 nt, hsa
ugucagucccucuaucccuucuccuguccaggggcccagagagaaacacaccuaccccuggccu

SEQ ID NO: 122697 - RNA, 64 nt, hsa
ccgaggccgcgugcgugagaaccgcgccgguguccccagagaccaggcugugucccucuucucu

SEQ ID NO: 122698 - RNA, 64 nt, hsa
aguccagccuaaucaagucaaauggagaaacaggcccagagaggaagguggcuuaccaagauca

SEQ ID NO: 122699 - RNA, 64 nt, hsa
uuuaucccagucguacucuuccagguuuggaagacccagagaggccaagaucccauccuuagcc

SEQ ID NO: 122700 - RNA, 64 nt, hsa
ugaccucacucuaacucaaaguaauguccagguucccagagaauaucugcugguauuuuucugu

SEQ ID NO: 122701 - RNA, 64 nt, hsa
aguguuuucaucucuuggucauaauuccgagauccccagagaccacuguuucuggaguaucugu

SEQ ID NO: 122702 - RNA, 64 nt, hsa
agggacugcagagaggcuacuggaagguuaaggacccagagagaaaucgagaggugcccuacag

SEQ ID NO: 122703 - RNA, 64 nt, hsa
agagacuuucagcccuaaaucuagacucaagguucccagagaugacaaauggagaagaaaggcc

SEQ ID NO: 122704 - RNA, 64 nt, hsa
cuauggauuaucuuuauaucacugucuuucuaagcccagagaugucauaagugacaagaaaagu

SEQ ID NO: 122705 - RNA, 64 nt, hsa
uguccuauacucacaucagacaugugaucauagucccagagacagaguugaggucucgaagaaa

SEQ ID NO: 122706 - RNA, 64 nt, hsa
aaggagggagccgggagccuggugggaagccuuccccagagagauggcuuuaggggcuuuauuu

SEQ ID NO: 122707 - RNA, 64 nt, hsa
uccauauccuuucuugaacgcacauucagcuuaccccagagagcaagugaggcaaucuggcaaa

SEQ ID NO: 122708 - RNA, 64 nt, hsa
ccagcaaccugccagcuacaggagcccccugcgucccagagacucccucacccaggcaggcucc

SEQ ID NO: 122709 - RNA, 64 nt, hsa
uauucuacccaaaugucaggaccaggauuuucuacccagagaccaagguguucuucccaaagac

SEQ ID NO: 122710 - RNA, 64 nt, hsa
uauucuacccauaugucaggaccaggauuuucuacccagagaccaagguuaucuuccuaaagac

SEQ ID NO: 122711 - RNA, 64 nt, hsa
uauucuacccauaugucaggaccgggauuuucuacccagagaccugcauguucucuccaacgac

SEQ ID NO: 122712 - RNA, 64 nt, hsa
cucuucccaucaauauccuaaaugugggggagggcccagagaauggcacccaagagccugcggg

SEQ ID NO: 122713 - RNA, 64 nt, hsa
caguccuucacacucacacuacucuguuccucuucccagagacaucgauucacuucaaagagcu

SEQ ID NO: 122714 - RNA, 64 nt, hsa
gcuguggcugcggccgggagcccgccccgcuucccccagagacuguaucguggcaccguggcgc

SEQ ID NO: 122715 - RNA, 64 nt, hsa
gacaccaaugcugcuauccgcaagcucaagagaucccagagauucuaaccaccaugccuacuug

SEQ ID NO: 122716 - RNA, 64 nt, hsa
gaaaauaccagaaaaugagggccgcuuugagucccccagagaugucaucagagcuccucugucc

SEQ ID NO: 122717 - RNA, 64 nt, hsa
cuagacuguggcccagaauagggcuggggcagcucccagagaaugaauagugcuguuuccuauu

SEQ ID NO: 122718 - RNA, 64 nt, hsa
gccugcuauccagccgcaaauccauacccccugccccagagaagccucagucccucccuccugg

SEQ ID NO: 122719 - RNA, 64 nt, hsa
gcuucccaggacccugggucaccuuccugggcagcccagagagacccugccaacuuuccagacu

SEQ ID NO: 122720 - RNA, 64 nt, hsa
uuccguggguuuccccuuugauucuguaaauagucccagagagaauucgugggcugagggcaau

SEQ ID NO: 122721 - RNA, 64 nt, hsa
cccaggaggcaggggaaaaaucuccuuucugcuucccagagagggucuggccuugcccaaggcc

SEQ ID NO: 122722 - RNA, 64 nt, hsa
ggagguaacgaggagggcggacuccaggccccggcccagagauuuggacuuggcuggcuugcag

SEQ ID NO: 122723 - RNA, 64 nt, hsa
auauuucccauuugugccagaggaauccuggcagcccagagacuuuguagauccuuagaggucc

SEQ ID NO: 122724 - RNA, 64 nt, hsa
cuagcugccggccucuggaggcuccgagccugcccccagagacgucccugccccuccaggaccu

SEQ ID NO: 122725 - RNA, 64 nt, hsa
aaugagauuuacuaaguugacuuaccugacggaccccagagaccuauugcauugagcagugggg

SEQ ID NO: 122726 - RNA, 64 nt, hsa
cauuguuaguccgggaccuucaguacugccaagucccagagaaaacccuuuuacucuggggaga

SEQ ID NO: 122727 - RNA, 64 nt, hsa
gaucuuuuccagaguaugcaacucugacguugaucccagagagcagcuucagugacaaacauau

SEQ ID NO: 122728 - RNA, 64 nt, hsa
gagacccauguaaauaccagacugcagguuggaccccagagauucccaagccaaaaaccuuagc

SEQ ID NO: 122729 - RNA, 64 nt, hsa
cccuggggggaggcaggaggcacaugugaggguccccagagagaagggagugggugggcagggg

SEQ ID NO: 122730 - RNA, 64 nt, hsa
ugugcuauuagugcaauaaggugaaggcugucugcccagagaaauaaguaauuuauauaagaaa

SEQ ID NO: 122731 - RNA, 64 nt, hsa
caaaucuggucuagcugggugaaacccuuauuuucccagagaugccuuaaccuuuguugguuuu

SEQ ID NO: 122732 - RNA, 64 nt, hsa
ccccugcugacugcgccugucuucucccucugaccccagagaaaggggcuguggucagcuggga

SEQ ID NO: 122733 - RNA, 64 nt, hsa
ugcccgggacccccgucuccaggggugccccagacccagagauuagccucccacuucggcgcag

SEQ ID NO: 122734 - RNA, 64 nt, hsa
caucuccacccaucucuacaucugggcacagcaacccagagauggccaaaagcauucaagccug

SEQ ID NO: 122735 - RNA, 64 nt, hsa
cagauggccuucuuugucaucuucacucuccacccccagagaggagucagagccauaacucaau

SEQ ID NO: 122736 - RNA, 64 nt, hsa
ugguuugacuuauucuucguaucauuagaagaaccccagagauagcauuccucuauuuuauuuu

SEQ ID NO: 122737 - RNA, 64 nt, hsa
gaggaggaggagggagaaauggccaccacaucaccccagagaaauuucuggaaucugauugagu

SEQ ID NO: 122738 - RNA, 64 nt, hsa
cccuacucacauuuccuuggguuggagcaacagucccagagagggccacggugggagcugcgcc

SEQ ID NO: 122739 - RNA, 64 nt, hsa
ucuguaauaucuuacuaaggccuuugguauacgacccagagauaacacgaugcguauuuuaguu

SEQ ID NO: 122740 - RNA, 64 nt, hsa
uguaggaaggggaguaauaauguaaaacaacugacccagagaagcuaaaagccacuggcagcac

SEQ ID NO: 122741 - RNA, 64 nt, hsa
ccagcuccuucucuuuucucagggacaaaugaggcccagagagaauacgaccuguguaagguca

SEQ ID NO: 122742 - RNA, 64 nt, hsa
aggugccccaaaaugcaagauuuuccacaagauucccagagacaggaaaauccucuggcuggcu

SEQ ID NO: 122743 - RNA, 64 nt, hsa
uguccuugcaccugcauccguaguucccugaaaacccagagaggaaucagacuucacacugcaa

SEQ ID NO: 122744 - RNA, 64 nt, hsa
ggggcagagggcagaggcuggaggcagggccuugcccagagaugccuccaccgcugccuaagug

SEQ ID NO: 122745 - RNA, 63 nt, hsa; identical to SEQ ID NO: 122142

SEQ ID NO: 122746 - RNA, 64 nt, hsa
aggggcccuggcuauuugggaccuaagccuaggccccagagaucagcccgaacacccgcauccc

SEQ ID NO: 122747 - RNA, 64 nt, hsa
agacccucuuggcuuucccgugcucuuugggcuccccagagaccugacaguauuagggagugaa

SEQ ID NO: 122748 - RNA, 64 nt, hsa
caaguacugagagcccagccccagacagcugcugcccagagaagaaccagcuccacggcuccug

SEQ ID NO: 122749 - RNA, 64 nt, hsa
ccucagccuggccagacacaggcccucccuguuccccagagaaaggggagcccacuguccuggg

SEQ ID NO: 122750 - RNA, 64 nt, hsa
gugcugacggccagggagaagcuccucuccccagcccagagacauacuugaagggccagagcca

SEQ ID NO: 122751 - RNA, 64 nt, hsa
cccagccuggccuguggcugcccuccaucccuuccccagagauggcuccuugggaugaagaggg

SEQ ID NO: 122752 - RNA, 64 nt, hsa
gcaacucccccccaacaaugccauucccacuugccccagagaagcuacucggccaaaccuagcc

SEQ ID NO: 122753 - RNA, 64 nt, hsa
ugcccuucugggguccugguuccugaagagcucacccagagaggcucaaagcagccuuuugucc

SEQ ID NO: 122754 - RNA, 64 nt, hsa
ccuuggaccucuuugauucugugguuuggaggcucccagagacgugccuaguccugugugccuu

SEQ ID NO: 122755 - RNA, 64 nt, hsa
gcucuccacccagcccgcuccugacccuuaucuucccagagaccaggccaggaaggcccgagau

SEQ ID NO: 122756 - RNA, 64 nt, hsa
agugccagaauuaagugagucaagccaaguaaagcccagagaagauucucaucagcacuuuugu

SEQ ID NO: 122757 - RNA, 64 nt, hsa
cauuuggcaguacaaaugagucugaguguaauagcccagagauuuauauauaguugaaugucua

SEQ ID NO: 122758 - RNA, 64 nt, hsa
uggaaacagacuuaucauuauugauuugagguuucccagagauauaguucacaguuaauuguug

SEQ ID NO: 122759 - RNA, 64 nt, hsa
ugauaggcacacgaggaugaguggcuuuguaucgcccagagaggugcuuguccagauuucacau

SEQ ID NO: 122760 - RNA, 64 nt, hsa
caguaaaggagaaaauaaaauuguuagcauucuacccagagauaauaucaauucauauuguagu

SEQ ID NO: 122761 - RNA, 64 nt, hsa
auuuucauucuuguauuauaauuaauuuucuacccccagagauaaauguuuguuuauaucacug

SEQ ID NO: 122762 - RNA, 64 nt, hsa
gaccuguccugcccuucuuagcuugaagggaaaccccagagacucuucugucagggaaaacuag

SEQ ID NO: 122763 - RNA, 64 nt, hsa
aaucucagcucuccuaaucccaucacuuccccagcccagagaagacauuccaacccugucugau

SEQ ID NO: 122764 - RNA, 64 nt, hsa
cugguaagaagccaaauauuuaagcucacuucuucccagagagaggaagcucugcucaggccuc

SEQ ID NO: 122765 - RNA, 64 nt, hsa
guaucucuaaggccaauaaggauaacauuaucuacccagagaguuuagaagaaaaguaggaguc

SEQ ID NO: 122766 - RNA, 64 nt, hsa
cucuucaccucccugcaaaccuaccagugaggcucccagagacgcagcugucucagugccaggg

SEQ ID NO: 122767 - RNA, 64 nt, hsa
gugauggcuuugucccaucauagggggguguccccccagagacaaagcugcagagcacauucca

SEQ ID NO: 122768 - RNA, 64 nt, hsa
gcuuuuaaggacgcuuaugaucacauugcgccuacccagagaacccaggucgucuuucuauuuu

SEQ ID NO: 122769 - RNA, 64 nt, hsa
guugccuucccuuuugcccuuugggcauuccuuccccagagagggccuggaaauuauaaaucuc

SEQ ID NO: 122770 - RNA, 64 nt, hsa
uuaaauaucaguucuguuuaucugaaggcuccuacccagagauucuacccagugaaacucccac

SEQ ID NO: 122771 - RNA, 64 nt, hsa
aucuccagcccugcaugccgucucaagggugggccccagagaguuuggaguguaggauucccuc

SEQ ID NO: 122772 - RNA, 64 nt, hsa
ugccauccuaaggggacaugaugguucugugauucccagagagcuggcagauugugacaaucuc

SEQ ID NO: 122773 - RNA, 64 nt, hsa
cuggggaccggccaggaaggaggggugacuucaucccagagagacccgaguucccccagcccuu

SEQ ID NO: 122774 - RNA, 64 nt, hsa
aaggggaggagcgacaccuccaggcuuccgggagcccagagagcauguggcaggcaguggggcc

SEQ ID NO: 122775 - RNA, 64 nt, hsa
guguggcccacuugugggagucuccuguccaccucccagagacggccacccagcgggucuggcu

SEQ ID NO: 122776 - RNA, 64 nt, hsa
caccgccaccugccggccucgagaggggccgaugcccagagacacagcccccacggacaaaacc

SEQ ID NO: 122777 - RNA, 64 nt, hsa
gugugagucuucucgaaggaggguugacucagaacccagagacaauacaaaaccccucacuucc

SEQ ID NO: 122778 - RNA, 64 nt, hsa
cuacucaucccuuaacuucucccuuaccagugaccccagagacagagccaggacaggagugggg

SEQ ID NO: 122779 - RNA, 64 nt, hsa
caauacugccuuuggaauaugacagaaucaauagcccagagagcuuagucaaagacgauaucac

SEQ ID NO: 122780 - RNA, 64 nt, hsa
ccaucagcaagagagagcagcuggaacagcaggucccagagaacuacuucuaugugccagaccu

SEQ ID NO: 122781 - RNA, 64 nt, hsa
uccuggggauccagcggauggacagcuuggcucucccagagaggugaaggagcaccuggccuua

SEQ ID NO: 122782 - RNA, 64 nt, hsa
aggagcgccuggaagcagaaccaguagcuacaggcccagagauggacuggagagugaggaggag

SEQ ID NO: 122783 - RNA, 64 nt, hsa
ccuaacaggaagguguccaguucaagagaacccacccagagacugggagugguggcucacgccu

SEQ ID NO: 122784 - RNA, 64 nt, hsa
agccgagccagacugugaccaggaaacagcucaucccagagaaggagaugcuuaacaaaaaaaa

SEQ ID NO: 122785 - RNA, 64 nt, hsa
cuguggccguagagggaaacagccacugugacaacccagagaccuggggucagccuuaaguagg

SEQ ID NO: 122786 - RNA, 64 nt, hsa
ugggcuuuaauguguaggaaaagccuucuggccacccagagagccggagcccugcuugcuguau

SEQ ID NO: 122787 - RNA, 64 nt, hsa
uuauggggagguuugaugagcauuugccuuucuccccagagagcuugaccaaguuacauauucu

SEQ ID NO: 122788 - RNA, 64 nt, hsa
cuccacucccuccgcugccaugaagcucauuucucccagagauuuuguggacuuggugcuaguc

SEQ ID NO: 122789 - RNA, 64 nt, hsa
gcagccacaagcuugcccgcccuggcucccucugcccagagacuauggaguaaggcauucagga

SEQ ID NO: 122790 - RNA, 64 nt, hsa
gcugcacagucggugccugggaggcacguagaggcccagagagucccuggggguucugcucuga

SEQ ID NO: 122791 - RNA, 64 nt, hsa
ucccugcagagccaauggugcacauugguuuaagcccagagauccugcuugagcccuggacuca

SEQ ID NO: 122792 - RNA, 64 nt, hsa
ggucccacucaguccauagcagagaaugaaagggcccagagaggguggugaccucugccugaag

SEQ ID NO: 122793 - RNA, 64 nt, hsa
ggccacuucccucccagugccagucuccauccaccccagagaggaacaggcgggugggccaugu

SEQ ID NO: 122794 - RNA, 64 nt, hsa
agaccccagccuggggaacacgcugcccgcacugcccagagagcagugcaaacaccacaacacg

SEQ ID NO: 122795 - RNA, 64 nt, hsa
agcgagaagccaaggccagguucuggguguagggcccagagaagcagaacagcccagagcccca

SEQ ID NO: 122796 - RNA, 64 nt, hsa
augcacugugaccucuggcuuccccagcagcuuucccagagaggcagaggggccuuccacagcc

SEQ ID NO: 122797 - RNA, 64 nt, hsa
ugacuccccagcccagcaccccuuccucgugggucccagagaccucaucagccuugggauagca

SEQ ID NO: 122798 - RNA, 64 nt, hsa
cucaggacccaguccaggccuucuacgggcuaggcccagagacuuggguugcuggucccccuuc

SEQ ID NO: 122799 - RNA, 62 nt, hsa; identical to SEQ ID NO: 122196

SEQ ID NO: 122800 - RNA, 64 nt, hsa
cucacaguucacauucagcucagcagagcaagaccccagagaugcuuagagacaggacaccugg

SEQ ID NO: 122801 - RNA, 64 nt, hsa
accccgacguagcugccccccuggggggccacagcccagagaaccagccuaggaacacucggga

SEQ ID NO: 122802 - RNA, 64 nt, hsa
cggcuccaguguggggugaggcagugagguuaggcccagagagcuggaguuggcucagaugaaa

SEQ ID NO: 122803 - RNA, 64 nt, hsa
ccgagggccaggcagaauggcugcacguagguuccccagagagcaggcaggggcaucugucugu

SEQ ID NO: 122804 - RNA, 64 nt, hsa
auuaauuuauugggaaugagcugaggcggauuuccccagagaaacaaaaagguauaacuuuaac

SEQ ID NO: 122805 - RNA, 64 nt, hsa
ccagaucucaugugcuacgaaggaaaccccaagacccagagaggaagggucaaccuggaggcag

SEQ ID NO: 122806 - RNA, 64 nt, hsa
cacaccgcaucaguccccaucaucacuacuccuccccagagacauacagauugcccuccccggc

SEQ ID NO: 122807 - RNA, 64 nt, hsa
ugggcagagggacaggucagacacccaggcccaccccagagacccuccaugaacugugcuccca

SEQ ID NO: 122808 - RNA, 63 nt, hsa
ucugccuccuccccugccagcccuagcgugacuacccagagacaaaaaaaaaaaaaaaaaaaa

SEQ ID NO: 122809 - RNA, 64 nt, hsa
uccaaaugucaggguguuugcccaauaauaaagccccagagaacugggcugggcccuaugggau

SEQ ID NO: 122810 - RNA, 64 nt, hsa
uaggucaucucaaggcugauacuugagcugugugcccagagaucaugcauuuagauuuauauuu

SEQ ID NO: 122811 - RNA, 64 nt, hsa
cgagcccacuguaucugggcccaaggccagagggcccagagagaagccugagcaccguguuacc

SEQ ID NO: 122812 - RNA, 64 nt, hsa
gcuucugaggacacaaggugggcugcccucaagccccagagagccccucauccuuccucuggga

SEQ ID NO: 122813 - RNA, 64 nt, hsa
uacucgcaacaacuuaauuucuaaggguccaagucccagagaauccauagucgucaaagcuuug

SEQ ID NO: 122814 - RNA, 64 nt, hsa
uccacuuguggaaaaaaagugcuaaaguuuucuucccagagagagcauaauuccgaaacaaaac

SEQ ID NO: 122815 - RNA, 64 nt, hsa
ccucugagcuggugggcaggauggcuggguggcccccagagaagcacagaccugagaugggguc

SEQ ID NO: 122816 - RNA, 64 nt, hsa
ugagccaagggcacuuugcugccaccgcugcauucccagagaucaagcagcccggugccguggc

SEQ ID NO: 122817 - RNA, 64 nt, hsa
cacaggaaacagcaaacaguggggugaucugcagcccagagaccuucaaaugcgaacacuauaa

SEQ ID NO: 122818 - RNA, 64 nt, hsa
guaguuggauugguacauucacugcugccagguacccagagaugucaucucucuccagguagag

SEQ ID NO: 122819 - RNA, 64 nt, hsa
ggcaggggugggagagccagcucucucuacccggcccagagaccccuuccuuuccucugcagca

SEQ ID NO: 122820 - RNA, 64 nt, hsa
cagucucagaugaccacggguuuaaccuucuuaucccagagacacccaauucuagagcuuuaug

SEQ ID NO: 122821 - RNA, 64 nt, hsa
ucccuuugaccacaucgcucuaggauaacuggcacccagagaaaaggacuccucagaaaaaaca

SEQ ID NO: 122822 - RNA, 64 nt, hsa
uggcccgaugacuuaaagggaaaaauaauucauucccagagaugagucagaacagucuccucaa

SEQ ID NO: 122823 - RNA, 64 nt, hsa
augugcuugggcuaugguggccauaaacccugagcccagagagcuugggucacugucaccugag

SEQ ID NO: 122824 - RNA, 64 nt, hsa
gacuaagguggcuuucccacuccuggcccacagccccagagagccugucugugcauccugaacc

SEQ ID NO: 122825 - RNA, 64 nt, hsa
ccggcuuccagggagaccuccccgcccagcagcccccagagacacaacaaccuaccuuccagcc

SEQ ID NO: 122826 - RNA, 64 nt, hsa
gagguccauccccagcaaauguuuuggagguccccccagagagcagagugggccauggcagaag

SEQ ID NO: 122827 - RNA, 64 nt, hsa
uguccuaaaaauaggggccguuuucuuacacacccccagagagaggagggacugucacacuggu

SEQ ID NO: 122828 - RNA, 50 nt, hsa; identical to SEQ ID NO: 122225

SEQ ID NO: 122829 - RNA, 64 nt, hsa
cuguguuugcuuguuugcccaccuuuggcugauacccagagaaccugggcacuugcugccugau

SEQ ID NO: 122830 - RNA, 64 nt, hsa
cuuggucuggggcauuuuccucuccuuaucuugccccagagacaauucaagauuucuauauggg

SEQ ID NO: 122831 - RNA, 64 nt, hsa
ucuuucuucuguccucagcuugagaucuucuuagcccagagagcaguggaguugagugaggagg

SEQ ID NO: 122832 - RNA, 64 nt, hsa
gccucacuauuggcagaaaagaccccauuuaaaacccagagaacacuggagggggaugcucuag

SEQ ID NO: 122833 - RNA, 64 nt, hsa
caccagggaugguacuagggggaagugacaaggccccagagacucagagggaggaaucgaggaa

SEQ ID NO: 122834 - RNA, 64 nt, hsa
ucucacucaccacuaccagccagccucagaaggccccagagagacccugcaagaccacggaggg

SEQ ID NO: 122835 - RNA, 64 nt, hsa
gaggguuagggaugucuccacccugauggggugucccagagacauuuucccauggcaguccucc

SEQ ID NO: 122836 - RNA, 64 nt, hsa
cggucggggcaucuggccuggccagugcccugaucccagagagcccgaggaggugucucaggcu

SEQ ID NO: 122837 - RNA, 64 nt, hsa
uggagcagcagcaggacagacccccacgaggccccccagagaggaggaagaucccacggaggaa

SEQ ID NO: 122838 - RNA, 64 nt, hsa
acugccugagggacaacagacaucagaacaaacccccagagagaaacagucaaaaucagggccc

SEQ ID NO: 122839 - RNA, 64 nt, hsa
ccaagaaaaugcuucacucaacaguccucaugugcccagagauguuuauagaacuguuugaauu

SEQ ID NO: 122840 - RNA, 64 nt, hsa
ccccguggccccugugccuguucggugggggugucccagagaagccuggcaccaguacccccgu

SEQ ID NO: 122841 - RNA, 64 nt, hsa
agggggcagccaagaagccggagcuggcagcauacccagagauccggggcccccccacccccaa

SEQ ID NO: 122842 - RNA, 64 nt, hsa
aaaccuaccuugcuuugggagcugccugcaccaccccagagaaggccccaccuucuucaucccu

SEQ ID NO: 122843 - RNA, 64 nt, hsa
ggcaucgagcuagcucccugcacggccgcacccucccagagaacuccuugaggagaacaagugc

SEQ ID NO: 122844 - RNA, 64 nt, hsa
gugggggugggggaggggagagggguaccuagaacccagagaacauuggcuuaugccagauacc

SEQ ID NO: 122845 - RNA, 64 nt, hsa
acggggaugcuugccccucuccaggacuauugagcccagagagagcuguccucucauuggguga

SEQ ID NO: 122846 - RNA, 64 nt, hsa
ccccucuaggucugggcagccaugaccugcagggcccagagacacuguccuuccccucauccac

SEQ ID NO: 122847 - RNA, 64 nt, hsa
cguugguuuaggcauccugugugcugacaggagacccagagagcuagggcuggagggacaggga

SEQ ID NO: 122848 - RNA, 64 nt, hsa
uuccuuccugggggucuguuccuuccuaugcucacccagagaacucucugaugugccagugggc

SEQ ID NO: 122849 - RNA, 64 nt, hsa
gauccaggcucguagagucacucccugcccgucucccagagaugcuucaccagcaccugccucu

SEQ ID NO: 122850 - RNA, 64 nt, hsa
ucccagccccuaccuugagacccucuucucugggcccagagagaggcguccuggugaggacaag

SEQ ID NO: 122851 - RNA, 64 nt, hsa
aaagaagauccuaucaugaauaaaagcuguauggcccagagaggagcucaugugucuaaaguga

SEQ ID NO: 122852 - RNA, 64 nt, hsa
gagcagacuggugagcagacuggugggaucugugcccagagaugggacugggagggcccacuuc

SEQ ID NO: 122853 - RNA, 64 nt, hsa
gacugaccccugccagggcacagauaggcaggaccccagagagggcaggcagccacgcccugca

SEQ ID NO: 122854 - RNA, 64 nt, hsa
ggaagacccucagauguggccagagcaccggccucccagagaaagcccaggaaguccccguggu

SEQ ID NO: 122855 - RNA, 64 nt, hsa
cuacugccacuucgccuuacaucccugcugacugcccagagacucagaggaaauaaaguuuaau

SEQ ID NO: 122856 - RNA, 64 nt, hsa
aaagauagcaagcuaccuuccaaggccgagccagcccagagaggagcaugucuuccuuuaccuc

SEQ ID NO: 122857 - RNA, 64 nt, hsa
cagucuaggagggggauaaaugggaugcccuugccccagagagaacccaguucuagguacuguc

SEQ ID NO: 122858 - RNA, 64 nt, hsa
aggucagagguggggacagagaacuccccuacagcccagagauguggcagggcucagagaagca

SEQ ID NO: 122859 - RNA, 64 nt, hsa
ccgaaggggacggccggcgggggcucuccuagugcccagagacaggcccagagguuuacaaguu

SEQ ID NO: 122860 - RNA, 64 nt, hsa
gucucccuacuuuuucucacuggccucguuuugacccagagaaagccuauggaaguuaugcagu

SEQ ID NO: 122861 - RNA, 64 nt, hsa
aggggccgcuccaggccccacagagcaggagacccccagagaaagccggggcuggcaggaggcg

SEQ ID NO: 122862 - RNA, 64 nt, hsa
agccucaacugacagcugaggaaaggcaauuaggcccagagaggcagagacacucgcuuaagau

SEQ ID NO: 122863 - RNA, 64 nt, hsa
aggccacgcccagcuuccuccccccgacuccccccccagagacacggucccaccauguuaccca

SEQ ID NO: 122864 - RNA, 64 nt, hsa
guucucaguggcaaaaccuaggaaggcucauguucccagagaagggaccacaugagccuucucc

SEQ ID NO: 122865 - RNA, 64 nt, hsa
ggcagagcauuuuccuuauggaagggaugagauucccagagaccugcauugcuuucuccugguu

SEQ ID NO: 122866 - RNA, 64 nt, hsa
ucuucggugcuaggaaagagugaugugugagauucccagagagucgucacaccaguguuaugcc

SEQ ID NO: 122867 - RNA, 64 nt, hsa
gcaaaaggagaaagauaaaauacagaagacuggccccagagagaccucagaucaguauugugca

SEQ ID NO: 122868 - RNA, 64 nt, hsa
aguuugguuugaauuauuaguacuauccuguagacccagagacauaguuuauauaagaauugcu

SEQ ID NO: 122869 - RNA, 64 nt, hsa
augugcaaagcaguauguacaggcugagacacagcccagagacugaacggcaaucuuuccacac

SEQ ID NO: 122870 - RNA, 64 nt, hsa
ggugugugacgaggcccccgauguucuugauuuucccagagaagcaaauaaacagcgugaacag

SEQ ID NO: 122871 - RNA, 64 nt, hsa
caccucucccccaaggccacugcgcucuugggaccccagagaaaacccggagcaagcaggagug

SEQ ID NO: 122872 - RNA, 64 nt, hsa
ccuggcccauguggagcuggcaugggggacacagcccagagacagagaagcuuaugaggaagug

SEQ ID NO: 122873 - RNA, 64 nt, hsa
cacacaaagcucuucaggcagcugauagauuucccccagagagcuauucaaggacuuccuaagg

SEQ ID NO: 122874 - RNA, 64 nt, hsa
aaacauggaagaugaaaggggaggggaugucaggcccagagaagcaaguggcuuucaacacaca

SEQ ID NO: 122875 - RNA, 64 nt, hsa
ccaccccauucccgcagugggagcaaacugcaugcccagagacccagcggacacacgcgguuug

SEQ ID NO: 122876 - RNA, 64 nt, hsa
gcccccucccaaacugugacugguauuuauuggacccagagaaccgggccgggcacagcguggc

SEQ ID NO: 122877 - RNA, 64 nt, hsa
ucuguauggacccuuccugccauuuguauuuugucccagagagaaaggcucuuuggggggcccc

SEQ ID NO: 122878 - RNA, 64 nt, hsa
gccuccucuggagccuucgccuggggagacagaacccagagagaaacaagagaguccagaaguc

SEQ ID NO: 122879 - RNA, 64 nt, hsa
accuugaaggagccccccacauccuccccuacaucccagagaugccaccacuugugucuccaca

SEQ ID NO: 122880 - RNA, 53 nt, hsa; identical to SEQ ID NO: 122277

SEQ ID NO: 122881 - RNA, 64 nt, hsa
cagggaacagcaugcccccuccggggucaugccacccagagacugucgcugucuauggccccaa

SEQ ID NO: 122882 - RNA, 64 nt, hsa
ccgucugggguccaucucccuccugagcuagaaacccagagauggaggcugucuugcuauggca

SEQ ID NO: 122883 - RNA, 64 nt, hsa
gcugaguaguggggauccagagaggacccccgcccccagagacuugguuuuggcuccagccuuc

SEQ ID NO: 122884 - RNA, 64 nt, hsa
gggccaccagaaggugacacccccagaaucccuccccagagacugcaccagcgcagccagcagg

SEQ ID NO: 122885 - RNA, 64 nt, hsa
cacucaagcaauagggccccgccauaggaagacccccagagagagggucagcaggggggccccg

SEQ ID NO: 122886 - RNA, 64 nt, hsa
gaucagaacaacggaggauagcuuugugccuggacccagagagugugggacuccccgcuucauc

SEQ ID NO: 122887 - RNA, 64 nt, hsa
gccuuggccccaagugaacucaagauuuggcagccccagagaugccaacugcagcaugcccacc

SEQ ID NO: 122888 - RNA, 64 nt, hsa
ucgguuuaaccagggcucuguaagaccacucccacccagagacuuguguggccugguguggccu

SEQ ID NO: 122889 - RNA, 64 nt, hsa
cucaucaaaccagguguccuuggcauuguguccacccagagagcucacuguuuucuuuucuuuu

SEQ ID NO: 122890 - RNA, 64 nt, hsa
cuuuucccauucagcugugagugcccaacccuaucccagagaccuugaugcuuggccucccaau

SEQ ID NO: 122891 - RNA, 64 nt, hsa
guuuuccuguaaguaauuaagaagacuaaguagccccagagauaagaccuccucggaucauugu

SEQ ID NO: 122892 - RNA, 64 nt, hsa
ugcccaagcaguccucacuuugcuuaacaguggccccagagagcaggaguagugaugcugguga

SEQ ID NO: 122893 - RNA, 64 nt, hsa
ugggaugggaagaggcucuuugcaaacgaggguccccagagaagacuggcggggaccugauggg

SEQ ID NO: 122894 - RNA, 64 nt, hsa
ggaggagguggaacugauguaggggguggcacuccccagagacugcccucacgaggggacuggg

SEQ ID NO: 122895 - RNA, 64 nt, hsa
gcacugcuacccucuauuucccacucagggcugucccagagagaaggcagccgaacugaggauu

SEQ ID NO: 122896 - RNA, 64 nt, hsa
aggugagagggaugcaggcauggguuggggguggcccagagaaacuuaugacagcuguacacaa

SEQ ID NO: 122897 - RNA, 64 nt, hsa
ucugccccacccacuuccuccccaccaccugugccccagagagcagggccugcccgggaaggug

SEQ ID NO: 122898 - RNA, 64 nt, hsa
cagcagcacccugcagugcccaggacggccccgucccagagaacaauccagccccgaaugucag

SEQ ID NO: 122899 - RNA, 64 nt, hsa
ugaacacccaggccagggacaccccuccccagcucccagagaggcccccugaggggugagcccu

SEQ ID NO: 122900 - RNA, 64 nt, hsa
ccucuccccuuggugccuaacccaggacuuuguccccagagacccacugugugcccccuggagc

SEQ ID NO: 122901 - RNA, 64 nt, hsa
cggcuguuggggacuuuaccugcugggaccugcucccagagaccuuccacacugaaucucaccu

SEQ ID NO: 122902 - RNA, 64 nt, hsa
cggcggucggggacuuuaccugcugggaccugcucccagagaccuugccacacugaaucucacc

SEQ ID NO: 122903 - RNA, 64 nt, hsa
cggcuguuggggacuuuaccugcugggaccugcucccagagaccuugccacacugaaugucacc

SEQ ID NO: 122904 - RNA, 64 nt, hsa
ccagggaauuaauucccccagucaaccaauggcacccagagagggcauggaggcuccacgcaac

SEQ ID NO: 122905 - RNA, 64 nt, hsa
cugggacuuccugcucaucauaguacccagugagcccagagauccuacuagacugggucagcaa

SEQ ID NO: 122906 - RNA, 64 nt, hsa
ccuggacagcaggagagggugugggaugaggcuucccagagacccugggucuagaaagcggcuc

SEQ ID NO: 122907 - RNA, 64 nt, hsa
gauaccacacauuucucaucucauuggcccccaccccagagaccuccaccucaacuucuggcug

SEQ ID NO: 122908 - RNA, 64 nt, hsa
caggccaucagcccaccuccaccucuggaggguccccagagacccacgcccgacgcagacccgg

SEQ ID NO: 122909 - RNA, 64 nt, hsa
aagucugugaaaugaaagucccugacaugaagcucccagagauaaaacuccccaaggugccuga

SEQ ID NO: 122910 - RNA, 64 nt, hsa
augugcaccucccggaagugcagcucccgaaagucccagagaugaaacucccuaaaaugccuga

SEQ ID NO: 122911 - RNA, 64 nt, hsa
augugcaccucccagaagugcagcuuccaaaagucccagagaugaagcucccugagaugaaacu

SEQ ID NO: 122912 - RNA, 64 nt, hsa
gagaaagagacccagaaaaaggaagagguggaaacccagagagacagagacccaaagggagaga

SEQ ID NO: 122913 - RNA, 64 nt, hsa
cagcccugacacuccuuucagacccucauuccuucccagagauguugagaauguucaucucucc

SEQ ID NO: 122914 - RNA, 56 nt, hsa; identical to SEQ ID NO: 122311

SEQ ID NO: 122915 - RNA, 64 nt, hsa
aaaaucuuuaguaggaauccuccagccauuauaucccagagagcucauuuagggcugaaacacu

SEQ ID NO: 122916 - RNA, 64 nt, hsa
uuguccuaggugucugcugugaaccuccagugaccccagagacuuugcuguaauuaucugcccu

SEQ ID NO: 122917 - RNA, 64 nt, hsa
gaaaccuuuagaacaucucugcuuuggagaaagacccagagaucaggcagaggugcagauucaa

SEQ ID NO: 122918 - RNA, 64 nt, hsa
gguucuggggccaaggccuacccaggggccucugcccagagaacucacaacccccucucugacc

SEQ ID NO: 122919 - RNA, 64 nt, hsa
auuggcuuguaaaccuucgucucccucucuuuuacccagagacagcacauacgugugcacacgc

SEQ ID NO: 122920 - RNA, 64 nt, hsa
cucugucacuugcucuuucacucucucucucauucccagagagccacgggggagggaucacccu

SEQ ID NO: 122921 - RNA, 64 nt, hsa
gagauaaggucaugggagaguggguggggacacacccagagacuggcuuugggauugggcacug

SEQ ID NO: 122922 - RNA, 64 nt, hsa
guguauucccguuuuacagauaaggaaacugaggcccagagagcugaaguacugcacccagcau

SEQ ID NO: 122923 - RNA, 64 nt, hsa
uccauucccaacuagacauuaccaaagugaccuacccagagauugcuucucauccccaguccca

SEQ ID NO: 122924 - RNA, 64 nt, hsa
ucaugaaugggauuagugcccuuauauaaagagacccagagagcuccaucaccccuucugccau

SEQ ID NO: 122925 - RNA, 64 nt, hsa
uuucacaccuguaugauagucauggaaacugaagcccagagagguuaagaaauuugcuaggauc

SEQ ID NO: 122926 - RNA, 64 nt, hsa
ugggcccugcccaacuucaggcagaacagggaggcccagagauuacagauccccuccuguaagu

SEQ ID NO: 122927 - RNA, 64 nt, hsa
guacaguuugacacugaucugguccaugaggcugcccagagaaagcacugcuucuguaugucuc

SEQ ID NO: 122928 - RNA, 64 nt, hsa
gaugcugcugcaacuggaagaagcuggaaccagucccagagaggcucggccuggaaacaguccc

SEQ ID NO: 122929 - RNA, 64 nt, hsa
ggccugggagucgggcggccccggucaggcccugcccagagagcuccugguuccugaacugagc

SEQ ID NO: 122930 - RNA, 64 nt, hsa
uuagcccccuacuguggcccccauagccccauaacccagagagggagcuggacuucagggagcc

SEQ ID NO: 122931 - RNA, 64 nt, hsa
cugcugccagcucucaacauagcaggccauaggacccagagaagaaucccagcguugcucaaag

SEQ ID NO: 122932 - RNA, 64 nt, hsa
uuagaauucuuuggcgggaaggguaugauggguucccagagacaagaagcccaaccuucuggcc

SEQ ID NO: 122933 - RNA, 62 nt, hsa; identical to SEQ ID NO: 122330

SEQ ID NO: 122934 - RNA, 64 nt, hsa
cgucuguaccucaggggaugccccgcuguggucacccagagaaucacccuuccuggucuacaga

SEQ ID NO: 122935 - RNA, 64 nt, hsa
caagaccugagugaccagucaagccucauguuaccccagagagacacauggggaguagacccug

SEQ ID NO: 122936 - RNA, 64 nt, hsa
ucugcucugaaaaauggggaaaacugcuaaacaucccagagauuugcaaucuucuagcucucca

SEQ ID NO: 122937 - RNA, 64 nt, hsa
acagggcucagguggguggagcaguaaggcacuacccagagagcuugcugcugcggcccugucc

SEQ ID NO: 122938 - RNA, 64 nt, hsa
uccugggcugggcagagugacagugcuagaagaccccagagagagggcaagggcuuugggcaag

SEQ ID NO: 122939 - RNA, 64 nt, hsa
cuugaaaaugcauguuccucaggccuaugcaguucccagagacucuugacaccggucucugcug

SEQ ID NO: 122940 - RNA, 64 nt, hsa
ccuucaggagcucucuacccaggggcaaggagagcccagagagaagcgcccuggucucuugagc

SEQ ID NO: 122941 - RNA, 64 nt, hsa
uccugcggcaccggguucaggcagcuacuccugccccagagaugaaggggcagcuuugcaagga

SEQ ID NO: 122942 - RNA, 64 nt, hsa
ccaacagggcaacuggaaccccugccugaccuuacccagagaagccaugggccaccugcucugu

SEQ ID NO: 122943 - RNA, 64 nt, hsa
gugguguccugcacggaauagaaggggaaaggaccccagagaaguggcugugacccguccaagg

SEQ ID NO: 122944 - RNA, 64 nt, hsa
cccugggccucagccuccaggcacccccaggauucccagagagacgcugugauuggcaggaggc

SEQ ID NO: 122945 - RNA, 64 nt, hsa
ccuuuuccacagccacucacuggggccaccaaaacccagagauggcaggugugugggacagacu

SEQ ID NO: 122946 - RNA, 64 nt, hsa
gcuccagcacagcagagaccagcaggccccccaacccagagacugggucugcuggagucuccac

SEQ ID NO: 122947 - RNA, 64 nt, hsa
caaagccugcacaacccaaccucgcuuagggacccccagagaugcuggaaucgcuaggaggguu

SEQ ID NO: 122948 - RNA, 64 nt, hsa
cgugggcagggcaugcgcuccccuggcugagcaccccagagauucuccugcaccuuccucaugc

SEQ ID NO: 122949 - RNA, 64 nt, hsa
gagggagagaacacgcugugaaaacacagaagcucccagagaagccuucucagcuuuuaucucu

SEQ ID NO: 122950 - RNA, 64 nt, hsa
gcagaaaggcuggaguuauuauucaacucaaucucccagagaacucagaggcuacaguuucuac

SEQ ID NO: 122951 - RNA, 64 nt, hsa
uacuauagugagcccaugcagcaccucucacccacccagagauggagcugcucugccuuccagc

SEQ ID NO: 122952 - RNA, 64 nt, hsa
aaacaaaaucugagucuccagccaggaggcuucucccagagaggacaaaaaagcccaacuugcc

SEQ ID NO: 122953 - RNA, 64 nt, hsa
gggcuccacccacuagaugccaguggcacccccucccagagaugacaaacgaaaaugucucuag

SEQ ID NO: 122954 - RNA, 64 nt, hsa
gcagaagaggcucccaggcccaagcucugugugacccagagaaauaaagaugccucaguguggc

SEQ ID NO: 122955 - RNA, 64 nt, hsa
aggccagcccccaaugguccccuuacggacaggucccagagauggacagaggcacccagggccc

SEQ ID NO: 122956 - RNA, 64 nt, hsa
ggacccguguccucagagcaccacacacugagcacccagagacagcgggccuggcagcgggccg

SEQ ID NO: 122957 - RNA, 64 nt, hsa
acccaggucugcugcccaggaacccuccagaccucccagagagugaauaaagugugacuugcaa

SEQ ID NO: 122958 - RNA, 64 nt, hsa
gucaccauggucuaaucccaagagggacucgucacccagagaccucaaaaggccccaggccuac

SEQ ID NO: 122959 - RNA, 64 nt, hsa
gcugaggagcaggugucccugagaacccaaacuucccagagaguaugugagaaccaaccaauga

SEQ ID NO: 122960 - RNA, 54 nt, hsa; identical to SEQ ID NO: 122357

SEQ ID NO: 122961 - RNA, 64 nt, hsa
gcucuauauaaguaggggcagcuuagcccugaggcccagagaccugcuguccuuuuucuccuug

SEQ ID NO: 122962 - RNA, 64 nt, hsa
ccagaugcuaagcgcuucagagaggaggugucugcccagagauguggagcagaagcugggcccu

SEQ ID NO: 122963 - RNA, 64 nt, hsa; identical to SEQ ID NO: 122954

SEQ ID NO: 122964 - RNA, 64 nt, hsa
gcugaagauucagacaggaaccucuuucccuguucccagagaaugcggcugagaaugagaacgc

SEQ ID NO: 122965 - RNA, 64 nt, hsa
agaaagggcucauuaagccuuuuggacacaggaccccagagaggaaaaagugacuugcccaagg

SEQ ID NO: 122966 - RNA, 64 nt, hsa
gcugaggagcaggugucccugagaacccaaacuucccagagaguaucugagaaccaaccaauga

SEQ ID NO: 122967 - RNA, 64 nt, hsa
ggccccugcucagucagccccacucccugggcuucccagagagugacagcugcucaggcccuaa

SEQ ID NO: 122968 - RNA, 64 nt, hsa
gccaccuaugccacagugccuaagggcuaggccacccagagacugugcccggagcuggccgugu

SEQ ID NO: 122969 - RNA, 64 nt, hsa
ccuuggccugaguaaacuuggaaaggggcucccucccagagaagggacuacucucuucaccccu

SEQ ID NO: 122970 - RNA, 64 nt, hsa
ggugcuaaggggauggggaagaagggacaagauucccagagaggagaggaggcuguugguagga

SEQ ID NO: 122971 - RNA, 64 nt, hsa
gcacccaccuaaagacauguauaugucuugggaucccagagauuggguccuugggccuggcuuc

SEQ ID NO: 122972 - RNA, 64 nt, hsa
ucugggaaaaugaacguccaggacacaccuguaucccagagagcaaagugaugaggagacugag

SEQ ID NO: 122973 - RNA, 64 nt, hsa
ucaccuccugcggcagaacagcacccgugacccacccagagagcaaggccaggggucuuggugc

SEQ ID NO: 122974 - RNA, 64 nt, hsa
cuagguacaaugucuaucaggaaagcaaagcuuccccagagacgcucagcuuguauccauugac

SEQ ID NO: 122975 - RNA, 64 nt, hsa
uuguuaucuuaugcuugagguaggcacugguuugcccagagaauuuuuauuuuucccagaccac

SEQ ID NO: 122976 - RNA, 64 nt, hsa
agaguggucgugagcuggucuuggggcacaauuacccagagauauauuuauuaacagccaaccu

SEQ ID NO: 122977 - RNA, 64 nt, hsa
gggaacugaaauccuugagaguuccggggagaaacccagagaugccugauuucauuccucgaug

SEQ ID NO: 122978 - RNA, 64 nt, hsa
acauuccacccuguuacuuauguagaaacugaggcccagagagggaagaugaccugccccaagu

SEQ ID NO: 122979 - RNA, 64 nt, hsa
ccucacuugcuucuuauccuuacacucccccagccccagagaaacugccacauacaccacaaaa

SEQ ID NO: 122980 - RNA, 64 nt, hsa
uuauaacccagacuaagguugaacaaccugcaugcccagagaaaacuauggcgacaaaggggaa

SEQ ID NO: 122981 - RNA, 64 nt, hsa
aagaaacuuauuauuggcuucuguuucauauggacccagagagccccaccaaaccuacgucaag

SEQ ID NO: 122982 - RNA, 64 nt, hsa
ccagaaacuagacauuagaauguugaggcaguuucccagagaaacaagcauauugccucaugga

SEQ ID NO: 122983 - RNA, 64 nt, hsa
aaccugccuccccuccauagucuuguuggagaagcccagagagaaugggacuccaacuaaggga

SEQ ID NO: 122984 - RNA, 64 nt, hsa
ugauauccucuucuuaaaaaugaguaaauggaggcccagagaaauguaauuugccugagaucaa

SEQ ID NO: 122985 - RNA, 64 nt, hsa
uccccaaaauggaccuuuuuuuuuucuaaagagucccagagaauggggaauuguuccuguaaau

SEQ ID NO: 122986 - RNA, 64 nt, hsa
gccagagcauccauggccaauuucaaauugugaacccagagacacucccauccacccuucucca

SEQ ID NO: 122987 - RNA, 64 nt, hsa
uagguauaccuacagcagcuacaaugauucuugucccagagagggcuaugcugcuuuuccaauu

SEQ ID NO: 122988 - RNA, 56 nt, hsa; identical to SEQ ID NO: 122385

SEQ ID NO: 122989 - RNA, 64 nt, hsa
agaccgugaacaccugcuuccucccucgggcaggcccagagagccagagguggguaggagguua

SEQ ID NO: 122990 - RNA, 59 nt, hsa; identical to SEQ ID NO: 122387

SEQ ID NO: 122991 - RNA, 64 nt, hsa
aaaauaucugccaucaucugccauaggaaagauacccagagacccaucauguucucuuuuuguu

SEQ ID NO: 122992 - RNA, 64 nt, hsa
uauaaccuacuuacuccguaaggggaaaugaaggcccagagaagggaagggacuugaccgaggu

SEQ ID NO: 122993 - RNA, 64 nt, hsa
gcugccaccugcccugcugccaggcuuacaucuucccagagaacuaugcugccacuucacaucc

SEQ ID NO: 122994 - RNA, 64 nt, hsa
cugaagccaaaaaugaagccguggccaagcgugacccagagaugggguguccuggcccuuagug

SEQ ID NO: 122995 - RNA, 64 nt, hsa
uaaccaagggccuaauguuuguuacagaaaugaucccagagaccuacaagaugugggaaucagc

SEQ ID NO: 122996 - RNA, 64 nt, hsa
caucugcaugauuggcauuaguuaccacagccugcccagagagaaacuaucuucucccaacauu

SEQ ID NO: 122997 - RNA, 64 nt, hsa
gcgacagguaacgcagugcgggguuagggauuccccgggagagaggacgaagcgaggagaguuc

SEQ ID NO: 122998 - RNA, 64 nt, hsa
cgaagacagcccgguaggcugcgucgcccgagccccgggagagaggagcgaagauccggaacuc

SEQ ID NO: 122999 - RNA, 64 nt, hsa
augcaggggauagcagugaggucagaagucuuucccgggagagagauggccuggguuaucauug

SEQ ID NO: 123000 - RNA, 64 nt, hsa
gacagccggggcugggugcugcaggggcuucagcccgggagagggggugggcguguucuuugug

SEQ ID NO: 123001 - RNA, 64 nt, hsa
ccccucacaccaccgccaggagaggccuuucccaccgggagagaaacuuccagaccagccccuc

SEQ ID NO: 123002 - RNA, 64 nt, hsa
ccccucacaccacagccaggagaggccuuucccaccgggagagaaacuuccagaccagcccucu

SEQ ID NO: 123003 - RNA, 64 nt, hsa
gcccucucacuacagccagaagaggccuuucccaccgggagaggaacuuccagaccagccccuc

SEQ ID NO: 123004 - RNA, 64 nt, hsa
acagggggccucucugccuccagccccaccuuccccgggagaagcuuuccccaauccccagguc

SEQ ID NO: 123005 - RNA, 64 nt, hsa
agaggcugcagaggcggggacacaccuguguccuccgggagaggcccccuccucuccccagacc

SEQ ID NO: 123006 - RNA, 64 nt, hsa
ggccaggagcccuggcccgcaagagggacagagcccgggagagacucgcucacucccauguugg

SEQ ID NO: 123007 - RNA, 64 nt, hsa
ccgcgcuuuccccuccucccugggauggacgcugccgggagacugccaguggagacggaaucug

SEQ ID NO: 123008 - RNA, 64 nt, hsa
ucggggagcccuacccgccaaaccugcuguuggcccgggagagccccagaggcucccggagacu

SEQ ID NO: 123009 - RNA, 64 nt, hsa
ccacccccgugcaacccaggacggcugucugaggccgggagaugccuuagacgcaggaugggcc

SEQ ID NO: 123010 - RNA, 64 nt, hsa
gaaagggaggugacuucgcccgguggcaauaguuccgggagaauuggccauugguaaaaagacu

SEQ ID NO: 123011 - RNA, 64 nt, hsa
auuuuauauguguguguggauauauauacacacacacacagaaagaugaauauauauauauaua

SEQ ID NO: 123012 - RNA, 64 nt, hsa
aaaaauaaaaaagucuuccucuggaaagagaagucacacagacaaucaugugcccuauaaaagu

SEQ ID NO: 123013 - RNA, 64 nt, hsa
aaaauaauuuugugagcccagauaucauuaggaucacacagaguuaaauauagaaaaaugaaac

SEQ ID NO: 123014 - RNA, 64 nt, hsa
uguaaauauauaucuguguauguguguauacacacacacagacacacacacacacacacgggau

SEQ ID NO: 123015 - RNA, 64 nt, hsa
agucugugugugaggcauagccccuggacacacacacacagacacacacacugccuggaugcau

SEQ ID NO: 123016 - RNA, 64 nt, hsa
gcacacacgcacaugcacagauaugccgccugggcacacagauaagcugcccaaaugcacgcac

SEQ ID NO: 123017 - RNA, 64 nt, hsa
ccggacacacacgugcacagauaugcugccuggacacacagauaaugcugccuugacacacaca

SEQ ID NO: 123018 - RNA, 64 nt, hsa
acacacacgcacgcagauaugcugccuggacacacacacagauaaugcugccucaacacucaca

SEQ ID NO: 123019 - RNA, 64 nt, hsa
auuacacgcacauagccacgcauacacacacagacacacagaugugggguacacugaacuucaa

SEQ ID NO: 123020 - RNA, 64 nt, hsa
cugcauagauuacacgcacauagccacgcauacacacacagacacacagaugugggguacacug

SEQ ID NO: 123021 - RNA, 64 nt, hsa
acaccuguaugugcacauacacacauuacacacacacacagaaugcacauuucacacacauaua

SEQ ID NO: 123022 - RNA, 64 nt, hsa
ugugauagcauacaaauucaaacauacagaaacacacacagauauggacacaguacaauucuuc

SEQ ID NO: 123023 - RNA, 64 nt, hsa
aaugcaacagaagacaaaagcacaggcaugcacacacacagaaccccaaaccacuaaaaacuac

SEQ ID NO: 123024 - RNA, 64 nt, hsa
gcagccuaggaaaccuuaaccauaucucuaacaccacacagaaagaggcuggaggagccacugg

SEQ ID NO: 123025 - RNA, 64 nt, hsa
caugcccacacagacaaaaaaacaaaacgaaauacacacagaaaaaagucuuuccaaacuguuu

SEQ ID NO: 123026 - RNA, 64 nt, hsa
uccuuuucaguauaaccuccccuaugcucaugcccacacagacaaaaaaacaaaacgaaauaca

SEQ ID NO: 123027 - RNA, 64 nt, hsa
gcagacccuucugccccaugacaggccugggugccacacagagguggccacccucccaccacag

SEQ ID NO: 123028 - RNA, 64 nt, hsa
uccacuugcacacacgcacacacucaugcucacacacacagagauauauuaaagcacaaguuuc

SEQ ID NO: 123029 - RNA, 64 nt, hsa
aaguggguccuuauguacacaccacguucacacacacacagagggaccacgugugcacgcauga

SEQ ID NO: 123030 - RNA, 64 nt, hsa
ggguggcggcguuugcugugaaccacgcucaggccacacagagacacauacuugguuucuggga

SEQ ID NO: 123031 - RNA, 64 nt, hsa
ggcauacucacacacagacacacacacacacacacacacagacucauccacacuucaaauugag

SEQ ID NO: 123032 - RNA, 64 nt, hsa
uauacacacacacucacacacacaggcauacucacacacagacacacacacacacacacacaca

SEQ ID NO: 123033 - RNA, 64 nt, hsa
ccgccacagagacacaccauuacauacacagacacacacagaaagacacacacagacacaaaau

SEQ ID NO: 123034 - RNA, 64 nt, hsa
aacacaccauuacacacacauacacagaaagacacacacagacacacaaucacacgcagccccu

SEQ ID NO: 123035 - RNA, 64 nt, hsa
ccccgccacagagacaccauuacauacacagacacacacagaaagacacagacacaaaaucaca

SEQ ID NO: 123036 - RNA, 64 nt, hsa
caccauuacauacacagacacacacagaaagacacacacagacacaaaaucacacacacacccu

SEQ ID NO: 123037 - RNA, 64 nt, hsa
ccccaccacagagacaccauuacauacacagacacacacagaaagacacacacagacacaaaau

SEQ ID NO: 123038 - RNA, 64 nt, hsa
acacaacacacacacauacacaccccugaacacacacacagacacacauacacccaugauguga

SEQ ID NO: 123039 - RNA, 64 nt, hsa
aucuggcccucuccacaugcacacccugaaaacacacacagacacacaacacacacacauacac

SEQ ID NO: 123040 - RNA, 64 nt, hsa
cacauggaugcacacacacacacgccaaugcacacacacagagauaugcacacacacggaugca

SEQ ID NO: 123041 - RNA, 64 nt, hsa
cacacacacagagauaugcacacacacggaugcacacacagauggucacacagagauacgcaaa

SEQ ID NO: 123042 - RNA, 64 nt, hsa
gauaugcacacacacggaugcacacacagauggucacacagagauacgcaaacacaccgaugca

SEQ ID NO: 123043 - RNA, 64 nt, hsa
aacacaccgaugcacacgcacauagagauaugcacacacagaugcacacacagauauacacaug

SEQ ID NO: 123044 - RNA, 64 nt, hsa
cacacgcacauagagauaugcacacacagaugcacacacagauauacacauggaugcacgcaca

SEQ ID NO: 123045 - RNA, 64 nt, hsa
gaugcacagagauaugcacacaccgaugugcgcacacacagauaugcacacacauggaugagca

SEQ ID NO: 123046 - RNA, 64 nt, hsa
cacacacaccaaugcgcacacacaccgauguacacacacagaugcacacacagaugcacacaca

SEQ ID NO: 123047 - RNA, 64 nt, hsa
ugcgcacacacaccgauguacacacacagaugcacacacagaugcacacacaccgaugcugacu

SEQ ID NO: 123048 - RNA, 64 nt, hsa
auacacacucgcaacaugucuacacacguccacacacacagacacacagauaccccaaauccuc

SEQ ID NO: 123049 - RNA, 64 nt, hsa
ucgcaacaugucuacacacguccacacacacagacacacagauaccccaaauccucucagaacu

SEQ ID NO: 123050 - RNA, 64 nt, hsa
agcaggucgggagaguagaguacauaaucagugccacacagaggcagggcgugucugagagacu

SEQ ID NO: 123051 - RNA, 64 nt, hsa
guuucuuuucuguggggcccagacuucuguaaagcacacagauguggguaagaugaaaaacugu

SEQ ID NO: 123052 - RNA, 64 nt, hsa
gcagggaggggacuggggaagugcgcacacagcccacacagacaacacgcacccacacagacac

SEQ ID NO: 123053 - RNA, 64 nt, hsa
agugcgcacacagcccacacagacaacacgcacccacacagacacagagggaagggguugggau

SEQ ID NO: 123054 - RNA, 64 nt, hsa
guccuuccugccugagcccugcacugucccagaccacacagaagucuggucaccucugggcgcc

SEQ ID NO: 123055 - RNA, 64 nt, hsa
ccgcacuccccacuggcagccgcuggugucucuucacacagaggcacaaccuggacccaggcag

SEQ ID NO: 123056 - RNA, 64 nt, hsa
cagaagaggaaaaaaaagcaacaaaaaaagaaaacacacagaagagauuuaaaaaaaaaaaagg

SEQ ID NO: 123057 - RNA, 64 nt, hsa
ggagcagggcuuaggggcuagcagcccacggggccacacagagaaacaaccacgcagacaguca

SEQ ID NO: 123058 - RNA, 64 nt, hsa
cggcgauggcaucacacagacggugaugaugucacacacagacacagugacaacacacaccaug

SEQ ID NO: 123059 - RNA, 64 nt, hsa
acauauuaaugucacacagacgcggcgauggcaucacacagacggugaugaugucacacacaga

SEQ ID NO: 123060 - RNA, 64 nt, hsa
ucacgggccaugucgacgucacacauauuaaugucacacagacgcggcgauggcaucacacaga

SEQ ID NO: 123061 - RNA, 64 nt, hsa
uauagcgauggcgucgugcagaugcagcacgucgcacacagacauggggaacuuggcaugacgu

SEQ ID NO: 123062 - RNA, 64 nt, hsa
gacaggaguauuuuuuuuuuuuuacagcuuuacacacacagaugugggcuuugauuuccaagua

SEQ ID NO: 123063 - RNA, 64 nt, hsa
caaaggacauuaugugugcauguguguauaagugcacacagaaauauauauacauauguagacu

SEQ ID NO: 123064 - RNA, 64 nt, hsa
uauuguguacaccaugcccauguauauacaaguacacacagauguacacacagauguacacaug

SEQ ID NO: 123065 - RNA, 64 nt, hsa
caugcccauguauauacaaguacacacagauguacacacagauguacacaugcuccagccccag

SEQ ID NO: 123066 - RNA, 64 nt, hsa
acccaccacacacacacacacacacacacacacacacacagacacacagacacauacgcacaca

SEQ ID NO: 123067 - RNA, 64 nt, hsa
cacacacacacacacacacacacacacacacagacacacagacacauacgcacacacgugcaca

SEQ ID NO: 123068 - RNA, 64 nt, hsa
cugcucgcacagauuacuucagggcuggaaaagucacacagacacacaaaaugucacaauccug

SEQ ID NO: 123069 - RNA, 64 nt, hsa
agcccugcagccaaacagagccuucacaaccagccacacagagccugccucagcugcucgcaca

SEQ ID NO: 123070 - RNA, 64 nt, hsa
cagacacacaaacacacacacacagacacacacacacacagacacaccaaguaccaguauaagc

SEQ ID NO: 123071 - RNA, 64 nt, hsa
cucugcauuuacacaccagacacacaaacacacacacacagacacacacacacacagacacacc

SEQ ID NO: 123072 - RNA, 64 nt, hsa
cacagacacacacacacacacacacacacacacacacacagagagauaaggaacaaaaguguuu

SEQ ID NO: 123073 - RNA, 64 nt, hsa
cacagagacccuugaguacacauacacacacacacacacagacacacacacacacacacacaca

SEQ ID NO: 123074 - RNA, 64 nt, hsa
ggagaagcacuguugaaauuuauacacacacacacacacagagacccuugaguacacauacaca

SEQ ID NO: 123075 - RNA, 64 nt, hsa
gcggucacgcccucagccccuccgggcacacgugccgccugaccgggcgacccuuuucaguucg

SEQ ID NO: 123076 - RNA, 64 nt, hsa
gcuggucucgaacuccugaccucaggugauccacccgccugagccucccaaagugcugggauua

SEQ ID NO: 123077 - RNA, 64 nt, hsa
cggaguucuuuaucuucagugagaaugugccugcccgccugagagccagcuuccgcguuggagg

SEQ ID NO: 123078 - RNA, 64 nt, hsa
auaacugaaaauaggcauauagauauauuccaagccgccugacgaucuaauuguaaaaaguaaa

SEQ ID NO: 123079 - RNA, 64 nt, hsa
cacccugcugcugcuccucccucugacccagacuccgccugaggccagccugcgggaagcugac

SEQ ID NO: 123080 - RNA, 64 nt, hsa
gguccuacacauuccagacauuuuccuuuuugagccgccugaaaguacagcuggagcccuuccc

SEQ ID NO: 123081 - RNA, 64 nt, hsa
agcagaaacccccaggaggagagagaugcugcucccgccugauuggggccucacccagaaggaa

SEQ ID NO: 123082 - RNA, 64 nt, hsa
ccgagagccuggcaggugaaacucugcaggccuuccgccugauuauuauuuauucacuccuuuc

SEQ ID NO: 123083 - RNA, 64 nt, hsa
gacccagacccacuuccuccagagaggccucucuccgccugagcuauuucccuugcuagugugc

SEQ ID NO: 123084 - RNA, 64 nt, hsa
uccagaaccucagccccgauuccagcacccaccaccgccugacccuguguaaccugcugucccg

SEQ ID NO: 123085 - RNA, 64 nt, hsa
caggccucucucaccucuccuacucacuuaaagcccgccugacagaaaccacggccacauuugg

SEQ ID NO: 123086 - RNA, 64 nt, hsa
ggccaucugugcuccaugcccgcccauccccuugccgccugacugggucggauggccccagugg

SEQ ID NO: 123087 - RNA, 64 nt, hsa
uuuuauggugcuguuaacaugggagucacacaagccgccugacuuuuucucauugccauuagua

SEQ ID NO: 123088 - RNA, 64 nt, hsa
accccaacucgccaaagaaaagauucaccauugcccgccugaagaagcccucaggggaaggaac

SEQ ID NO: 123089 - RNA, 64 nt, hsa
gacccagaaacucagaguugauggugagaggaggccgccugagucaggacaccuggcuucuuga

SEQ ID NO: 123090 - RNA, 64 nt, hsa
accucucccuuuggggauuuaaugucuggugcugccgccugaguuucaagaauuaaagcugcaa

SEQ ID NO: 123091 - RNA, 64 nt, hsa
ugggauuggacaguaguggugcaucugguccuugccgccugagagccccaggagacaucggcua

SEQ ID NO: 123092 - RNA, 64 nt, hsa
uguaaucuggucugagcugggccugugggaggggccgccugaggccugugcgcuguuguccucg

SEQ ID NO: 123093 - RNA, 64 nt, hsa
augacuuagaugggcagaaucaacaaagaugaaaccgccugaggacacauuuaacaaguaacau

SEQ ID NO: 123094 - RNA, 64 nt, hsa
uauuuuaccaguuuccagaauuuccaguacaggaccgccugaagagagagccauuguucaauuc

SEQ ID NO: 123095 - RNA, 64 nt, hsa
cugaagugcauccaaaggugcucagagagccggcccgccugaaucauucucgauuuaacucgag

SEQ ID NO: 123096 - RNA, 64 nt, hsa
ccuacugacaaguaaauuuauacaggacugaaaaccgccugaaaccugcugcaacuauuguuau

SEQ ID NO: 123097 - RNA, 64 nt, hsa
gggccccagcuggcccguucuacucaccuaagugccgccugacccuuguacacuaggagcuggc

SEQ ID NO: 123098 - RNA, 64 nt, hsa
cucaccccaagccccagcccgcgaggccuccccuccgccugauuucgaucgcccgcgguccccc

SEQ ID NO: 123099 - RNA, 64 nt, hsa
gcacuggcccccucuccccagccucagcugcuguccgccugaucugucuugggcuguaggcuag

SEQ ID NO: 123100 - RNA, 64 nt, hsa
cugugccgcugagccgcgcuguccaggugugcggccgccugagcccgagccaggagcacuagag

SEQ ID NO: 123101 - RNA, 64 nt, hsa
ggcuggggccugggucagagcggugcugcccgugccgccugaagagcugcagccagaacaggug

SEQ ID NO: 123102 - RNA, 64 nt, hsa
ggcacaaggccuggcuggcugcgagcucaggaggccgccugaggacugcacaccgggcccacac

SEQ ID NO: 123103 - RNA, 64 nt, hsa
cagcucuggcugguucugcccuuaccccuccugcccgccugagaacugcacacccugcccgcug

SEQ ID NO: 123104 - RNA, 64 nt, hsa
cuuuccgcguacagaagugcuugcccggggagucccgccugaccugccuucauguggacccuua

SEQ ID NO: 123105 - RNA, 64 nt, hsa
uuauuugacucuguggcucuaagacugccuugaaccgccugaggccuaugcaucugaacaagug

SEQ ID NO: 123106 - RNA, 64 nt, hsa
ccagcgugacggagcccacacugccaccuuguggccgccugagacccucgcgccccccgcgccc

SEQ ID NO: 123107 - RNA, 64 nt, hsa
ggggcaccggggacucgcgggcuucugcugggucccgccugaggugauaucgucacuguuuagg

SEQ ID NO: 123108 - RNA, 64 nt, hsa
ggacaggcccagcgcggccagcgucccaggguacccgccugagcuccugcugcggaggagcugc

SEQ ID NO: 123109 - RNA, 64 nt, hsa
agaauauuuuugaaagcuacgcagacaagaacagccgccugacgaaauggaaacacacacagac

SEQ ID NO: 123110 - RNA, 64 nt, hsa
uucuuuguuuaugcacuuuuuccuuacugugcauccgccugaaaguguuuugcccuauauaccu

SEQ ID NO: 123111 - RNA, 64 nt, hsa
ccggcucuccucuccccuguccugcacccaucccccgccugaagccaccggcuccaauugccag

SEQ ID NO: 123112 - RNA, 64 nt, hsa
ugcauccuugaaauccugggcucaggugauccucccgccugagccuccugaguaucugggacua

SEQ ID NO: 123113 - RNA, 64 nt, hsa
cccgcgguacuggcgccaucagggccucccuugcccgccugagagcagcagcagucucugucau

SEQ ID NO: 123114 - RNA, 64 nt, hsa
gcuggccccggccggucacauugacugauggccaccgccugacgaaucgagugccugugugucu

SEQ ID NO: 123115 - RNA, 64 nt, hsa
gcugaaugcccccugcuuacuuggugagggugccccgccugagucagugcucucagcuggcagu

SEQ ID NO: 123116 - RNA, 64 nt, hsa
gcuacuuguguggcauaagcuagaggagccggugccgccugaaugccgagcuaacuguugccac

SEQ ID NO: 123117 - RNA, 64 nt, hsa
ucuccacugcaacagucugucuuucugccuacauccgccugagaccaaggagggucuuugguac

SEQ ID NO: 123118 - RNA, 64 nt, hsa
aggagaaugcugugcuguggaugacugcagcuggccgccugaggggacaccagacucagcucuu

SEQ ID NO: 123119 - RNA, 64 nt, hsa
uucccacacauguggaagccacguugccucucgaccgccugaggcccuuaaguacaucgcuuuc

SEQ ID NO: 123120 - RNA, 64 nt, hsa
caucugucucugcaaugcaaagugaagaguccacccgccugagugggaugacuucagcuagagu

SEQ ID NO: 123121 - RNA, 64 nt, hsa
ucaugccccuaagaaaagugaauuuccuuuaacaccgccugaaacaugcacacugcaaauauca

SEQ ID NO: 123122 - RNA, 64 nt, hsa
aacgggacugcugggagaggagggguaggaaggcccgccugagcgcgacggggcuuccgggaag

SEQ ID NO: 123123 - RNA, 64 nt, hsa
ucuuugaugagaaccgcacaggggaccucaucucccgccugaccucggacaccaccauggucag

SEQ ID NO: 123124 - RNA, 64 nt, hsa
gcagcccuggcccccaucagcccugcuagacgcaccgccugaaggcacagcuaaccacuucgca

SEQ ID NO: 123125 - RNA, 54 nt, hsa
gggccgaggccgaggccugagcggccgccugaccgucgaccuuggggcucucca

SEQ ID NO: 123126 - RNA, 64 nt, hsa
ccacaccaccauuguggccacccgucacuaucgcccgccugaggugauccuuggugagugacug

SEQ ID NO: 123127 - RNA, 64 nt, hsa
ugucccuguggccccauccaaccacuguacacacccgccugacaccgugggucauuacaaaaaa

SEQ ID NO: 123128 - RNA, 64 nt, hsa
aaaccagcucugucccugugcaggcuccaggcucccgccugacaaacaggcagggagccacagu

SEQ ID NO: 123129 - RNA, 64 nt, hsa
acuccagccccuugguccuguggauggcuggaucccgccugaaacggaccugcagagcagcagc

SEQ ID NO: 123130 - RNA, 64 nt, hsa
guuagaaauguacauucucaggcuccacagcaggccgccugaaucaaauccugggaggugggga

SEQ ID NO: 123131 - RNA, 64 nt, hsa
uaccccgaaaccggccccgacgccccgcagaggcccgccugaagccagcccggcgcccuagcag

SEQ ID NO: 123132 - RNA, 64 nt, hsa
cuccaccgccucucugcucugacccuucucaggcccgccugaugugcuggaccaucccccugcu

SEQ ID NO: 123133 - RNA, 64 nt, hsa
caucgguaaauaaaaguuuuugauccuguugaacccgccugagacggugcugugcaggggaaag

SEQ ID NO: 123134 - RNA, 64 nt, hsa
accccagggucaagggugaaggaaagcaagcucaccgccugaacacggagauugucuuucugcc

SEQ ID NO: 123135 - RNA, 64 nt, hsa
ccaucuuauuucuuuuggggauuauacaccucagccgccugagaugggggucagcucuuuauau

SEQ ID NO: 123136 - RNA, 54 nt, hsa
aagucccggacgaugaaugaggagccgccugagccuuccuggagccaggaccug

SEQ ID NO: 123137 - RNA, 64 nt, hsa
ggccuccgaugccuggccugccagacacugcgccccgccugaccugggggagccgaccaauuag

SEQ ID NO: 123138 - RNA, 64 nt, hsa
ucgagcuucaggacagagcagccaaugaaaacggccgccugaacccacagcaauaagaaugaau

SEQ ID NO: 123139 - RNA, 64 nt, hsa
gaagguucuugucacugugauuggaugcuggaugccgccugauagacaugcuggccuggcugag

SEQ ID NO: 123140 - RNA, 64 nt, hsa
gcccggcuaaaaagcgcggccugcgccgccgccgccgccugauuucgcucgggcuucgggugac

SEQ ID NO: 123141 - RNA, 64 nt, hsa
gcuuuguucuuucauuuccuccagcacuuucuuuccgccugaguccagcccaaggccuuuuauu

SEQ ID NO: 123142 - RNA, 64 nt, hsa
agccccccuugccugcccgcugcccccgccuccuccgccugaaugacccgacuggaauccacuc

SEQ ID NO: 123143 - RNA, 64 nt, hsa
cgccuccuggguucaagugauucucauggcucagccgccugaguagcugggauuacagguguga

SEQ ID NO: 123144 - RNA, 64 nt, hsa
aauuaccuuccuuuuuggcuggaagacuuagaagccgccugaucauacuuucucauuuuacaga

SEQ ID NO: 123145 - RNA, 64 nt, hsa
ucgcuguuucggggacucggggcggccaguaccaccgccugaggcggggcucagcagcguugca

SEQ ID NO: 123146 - RNA, 64 nt, hsa
ucuaugaggacauggguggugggcaaagugacagccgccugagccccucugccugguccccuuu

SEQ ID NO: 123147 - RNA, 53 nt, hsa
ccuaccggcuggugcaguagcuaccgccugacaggugagacggccgagggaca

SEQ ID NO: 123148 - RNA, 64 nt, hsa
caggccugggggcagcccuuccccugccuaguccccgccugagugccagccccccaccccgccu

SEQ ID NO: 123149 - RNA, 64 nt, hsa
ccuugaaaugucacgggcuucuacggacaggagcccgccugagcgcaaagcuuucugggaguug

SEQ ID NO: 123150 - RNA, 64 nt, hsa
aguggacgaacccccuccccccgggcucuugucaccgccugagaccucgcgagacuuucggucc

SEQ ID NO: 123151 - RNA, 64 nt, hsa
acugagcagaagcccccacagcuggccagcagccccgccugacauggaacagaacggagccauc

SEQ ID NO: 123152 - RNA, 64 nt, hsa
ccuccugaccuucgccgcccugcccuccgccgcuccgccugagcuccccgguuugcagaaugga

SEQ ID NO: 123153 - RNA, 64 nt, hsa
uuagaaauaccaugcacuuggggguaccaauuaaccgccugaaaauuagcauauugauaguucu

SEQ ID NO: 123154 - RNA, 64 nt, hsa
cugaauagcucuucauagcugacccuucuugugaccgccugacugcuggcuacuauccaugcac

SEQ ID NO: 123155 - RNA, 64 nt, hsa
ccucucgccagccacuccugcagugugcguccggccgccugagcagguguggugccgucccgcc

SEQ ID NO: 123156 - RNA, 64 nt, hsa
uucucaguuugugaaacgcuaacugcacacgaagccgccugacggcacccagcgcuguggcugu

SEQ ID NO: 123157 - RNA, 64 nt, hsa
caggcaaggggauggagagggcuugccuucccucccgccugaccuuccucagucauuucugcaa

SEQ ID NO: 123158 - RNA, 64 nt, hsa
cugcccuccccuguggaaaggucuauaugacgggccgccugaggccccagaacucgucugugaa

SEQ ID NO: 123159 - RNA, 64 nt, hsa
cagcuccggcagccacagaaggcugcagcccagcccgccugagacacgacgccugccccagggg

SEQ ID NO: 123160 - RNA, 64 nt, hsa
cccgaagccaccauccccacccugucuuccacagccgccugaaagccacaaugagaaugaugca

SEQ ID NO: 123161 - RNA, 64 nt, hsa
ugcgaggagugguguccugacggacucagcacucccgccugauguauuggaucauaggagagca

SEQ ID NO: 123162 - RNA, 62 nt, hsa
gucucacauuuuuacuugguguaauuaauaaacgaagauaaaucauaguguauguguauuau

SEQ ID NO: 123163 - RNA, 62 nt, hsa
auuuugcaugguuuuaaaauuaaaaauaauuccgaagauacaccagcucacaaaugaaaacg

SEQ ID NO: 123164 - RNA, 62 nt, hsa
uauauuuugaauuauuuauuuuacaaaaugggcgaagauauugucuuuaggauaaggcagag

SEQ ID NO: 123165 - RNA, 62 nt, hsa
uaugacuaaauagucugugcagguucauagaccgaagauacuacacacuuuaaaccaauuaa

SEQ ID NO: 123166 - RNA, 62 nt, hsa
gaggagucaaugucauucuaccccucgcuaaacgaagauauuaacaucuauugcuuuuuccc

SEQ ID NO: 123167 - RNA, 62 nt, hsa
gggacucuguguauuauucagguuuauuggcacgaagauacuuguuuuaaguuccuugagaa

SEQ ID NO: 123168 - RNA, 62 nt, hsa
ccagaguuguucucguccaagguagaaagguacgaagauacaauacuguuauucauuuaucc

SEQ ID NO: 123169 - RNA, 62 nt, hsa
agacgaaggcagucgagguguggaggugaucacgaagauacauguguuugacuguuuaauuu

SEQ ID NO: 123170 - RNA, 62 nt, hsa
ucaauacaauuuacugacaugacaaccuagaacgaagauagcuauguggcaucacgguggaa

SEQ ID NO: 123171 - RNA, 62 nt, hsa
gcuuuggcccaaugccuauaaaaugcccauuucgaagauauacaaaaacauacuucaaaaau

SEQ ID NO: 123172 - RNA, 62 nt, hsa
ugcaccuccuucgcugucaagugggucccccacgaagauacugcacggagagcagugccaag

SEQ ID NO: 123173 - RNA, 62 nt, hsa
uacauguuugggauuuuuauuuuuuacguguccgaagauaagcuccaggucuuaucguaucc

SEQ ID NO: 123174 - RNA, 62 nt, hsa
gggcuggccacggccaggugugggagggacuucgaagauaagagugagcggcugccuccggg

SEQ ID NO: 123175 - RNA, 62 nt, hsa
ccaugagccauuucacagaaaaaccaucccaccgaagauauugucuaucaccccaggggcca

SEQ ID NO: 123176 - RNA, 62 nt, hsa
auaaaauuauggauccagauuguucugagagacgaagauacuugcugcugauagaggugaaa

SEQ ID NO: 123177 - RNA, 62 nt, hsa
ucucugucagagaagccacugcaagaugcugccgaagauaacccucucuuuccugccucauu

SEQ ID NO: 123178 - RNA, 62 nt, hsa
aacuuucuguccacuauaggagagaauucagccgaagauaugagaguaaugagagacauuuu

SEQ ID NO: 123179 - RNA, 62 nt, hsa
cauugauaagaguccuauaaauaagauaaauacgaagauaaagcuuuauucuuuaguguuaa

SEQ ID NO: 123180 - RNA, 62 nt, hsa
aguaguaucaaaugaaagugaugauacuguaacgaagauaaauuggcuaaucaguauacaag

SEQ ID NO: 123181 - RNA, 62 nt, hsa
gcugcugugccugauguccggacagcccugcucgaagauauagaaagagugaccugcacaaa

SEQ ID NO: 123182 - RNA, 62 nt, hsa
ccacacuuggcuugagcacucaacccagaaggcgaagauagcuuuugguuguaggcggcuuc

SEQ ID NO: 123183 - RNA, 62 nt, hsa
aaggggccccccugggauggggagaagggcuucgaagauaaacugagcuccauuccccuggc

SEQ ID NO: 123184 - RNA, 62 nt, hsa
aaucuguugcugacuagcauuagacuguuacacgaagauaaacugaauaagcauuuagcuuu

SEQ ID NO: 123185 - RNA, 62 nt, hsa
guagacccccggagaagcaguaccgacaaugacgaagauaccagaucccuucccaaccccuu

SEQ ID NO: 123186 - RNA, 62 nt, hsa
ugggaccuuugggaagugauuaagucaagucacgaagauagagcuuugcgaaugggaucagg

SEQ ID NO: 123187 - RNA, 62 nt, hsa
aaucaguagcaagugcuggaaaaggcacaugccgaagauacucaagagcucccaagauuugc

SEQ ID NO: 123188 - RNA, 62 nt, hsa
uauacaugugccuuaccaggugaguggucuuucgaagauaaaaaacucuagucccuuuaaac

SEQ ID NO: 123189 - RNA, 62 nt, hsa
uacugguaugugaugccaacuuuuauuucuuucgaagauaauugccuucuuugccuagccaa

SEQ ID NO: 123190 - RNA, 62 nt, hsa
ccaccaaagccagguuuccugguaaggucacucgaagauaagggauggggaugggggcugac

SEQ ID NO: 123191 - RNA, 64 nt, hsa
agucuggcuaucugagauacagcugugagagccggauccggaguuaccugagggaggugagccu

SEQ ID NO: 123192 - RNA, 64 nt, hsa
augugaaacagucauccuucugcauaaauugaaggauccggauuccuuaaugauggacugaaug

SEQ ID NO: 123193 - RNA, 64 nt, hsa
cugcgucgcccgagccccgggagagaggagcgaagauccggaacucgccaacucaccccgggca

SEQ ID NO: 123194 - RNA, 64 nt, hsa
gggccgccugucccggcguccgcgaaacgcuacggauccggacgggcgccgucgcucggguggc

SEQ ID NO: 123195 - RNA, 64 nt, hsa
gaguguggcugcaagagaaaaggggcuggaggaagauccggagggcagggguguucccucugcu

SEQ ID NO: 123196 - RNA, 64 nt, hsa
cgguguaagaucuucucaucagcccucaauuugugauccggaauuuuaugagaaggauuagaaa

SEQ ID NO: 123197 - RNA, 64 nt, hsa
cuucggaaauccugcaaauagaaagauaauucuagauccggaauaccuguaucugguggaaacc

SEQ ID NO: 123198 - RNA, 64 nt, hsa
acgaugacaguguuccccgauaccaugcuguaaggauccggaaagaagagcgagagaucaaaga

SEQ ID NO: 123199 - RNA, 64 nt, hsa
gguggggugggugggugcuggcgguggggaccaagauccggaaagaugaauaaagacaaacaug

SEQ ID NO: 123200 - RNA, 64 nt, hsa
uccgccuggggcagaaagccacaaacuccauccagauccggaacgucagccagcucccagccac

SEQ ID NO: 123201 - RNA, 64 nt, hsa
ggacgaccucguaucccgcguccccgccgcgcuggauccggacugaguggccgggccugcggac

SEQ ID NO: 123202 - RNA, 64 nt, hsa
uguuuuuuaagauugagaauacauaccugacaacgauccggaaacugcuccucaccacucccgu

SEQ ID NO: 123203 - RNA, 64 nt, hsa
uuccccccaucccucugagggccggcggaugcuggauccggagccccagguuccgccccagagc

SEQ ID NO: 123204 - RNA, 64 nt, hsa
agaagucuguccgucuaugaacaugcgggggaaggauccggaaccaggacccagaagcaccucc

SEQ ID NO: 123205 - RNA, 64 nt, hsa
agagggagccaggcagcuguguacagugagaagggauccggaugggggagcucuguacagaggg

SEQ ID NO: 123206 - RNA, 64 nt, hsa
ggguggaagcagcggugccgcggagggccagccagauccggacccuucccuuaggguccagucu

SEQ ID NO: 123207 - RNA, 64 nt, hsa
aacuaaauagcauguauugugucuuuugcaugaugauccggauuuaauuugauaucacagucua

SEQ ID NO: 123208 - RNA, 64 nt, hsa
acuuugccaaccugcccagcugcugccgcuggaggauccggaaagaguuuccgaagagugaagg

SEQ ID NO: 123209 - RNA, 64 nt, hsa
gaaucucgucauaagugaucucaggcucucacaggauccggagggaaauguguuagagggucug

SEQ ID NO: 123210 - RNA, 64 nt, hsa
ucaguccccuccccaaccucagugacugacagaggauccggaucucagagccugagaccagguu

SEQ ID NO: 123211 - RNA, 64 nt, hsa
cacccgcgggggcucccccugcacauuugcacacgauccggagagccgaaggccgcgugcuucc

SEQ ID NO: 123212 - RNA, 64 nt, hsa
uuuagcggccugccaccacagcacgcggccuccugauccggaagcacgcagcauguucccugcu

SEQ ID NO: 123213 - RNA, 64 nt, hsa
auuacuuucuuuucuggagugccaugcuggcgaggauccggaugcggcagcacccucuuucggg

SEQ ID NO: 123214 - RNA, 64 nt, hsa
gaagaauuguaaagaccuguacauagcacaacaugauccggauaauauauauacuguucaugua

SEQ ID NO: 123215 - RNA, 64 nt, hsa
uguucaacucuuaugcuacauuaaaaccacacuggauccggauacguaugguggcucacgccug

SEQ ID NO: 123216 - RNA, 64 nt, hsa
ggacccugguggggguggcuccuucucacugcuggauccggacuuuuuaaauaaaaacaaguaa

SEQ ID NO: 123217 - RNA, 64 nt, hsa
cagccugaaacagacccagacacagccugaaacagauccggacagacagacagaaacagccuga

SEQ ID NO: 123218 - RNA, 64 nt, hsa
gggagggacgggagcugguugggguggcuuagcagauccggacagggcccucugucccuguguc

SEQ ID NO: 123219 - RNA, 64 nt, hsa
gagucuacaccuauauuugcaaguauguggacuggauccggaugaucaugaggaacaacugacc

SEQ ID NO: 123220 - RNA, 64 nt, hsa
uccugccccagagaugaaggggcagcuuugcaaggauccggagccagcucccaggggcccagag

SEQ ID NO: 123221 - RNA, 63 nt, hsa
gccagaaguccagcugcugacagcccuggaugugauccggagucccuucccaccaggggcuga

SEQ ID NO: 123222 - RNA, 63 nt, hsa; identical to SEQ ID NO: 123221

SEQ ID NO: 123223 - RNA, 64 nt, hsa
agcauagccauacaccucagccugugaaaugaacgauccggacccucaccaacuuuccccaccu

SEQ ID NO: 123224 - RNA, 64 nt, hsa
gaaaugacaccgcacgccagcgccccgcggccgcgauccggaccccaagcccacggcucccucg

SEQ ID NO: 123225 - RNA, 64 nt, hsa
ccgacccgcgggcgaggccggguaccugggcugggauccggagcaagcgggcgagggcagcgcc

SEQ ID NO: 123226 - RNA, 64 nt, hsa
ucgacagggacaucuuaggcucugucagugagcagauccggaagaacuuugcucggacacacug

SEQ ID NO: 123227 - RNA, 64 nt, hsa
cggaaggagggagcucugaugagcacgguuugucacacgauaaagggauuuuuuuuuucagggc

SEQ ID NO: 123228 - RNA, 64 nt, hsa
caccaaauuguuauuugcacuaacaaagcucaaaacacgauaaguuuacuccuccaucucagua

SEQ ID NO: 123229 - RNA, 64 nt, hsa
ccaguauggugagugccaagacagagagcuaugaacacgauaucuaucugggaacacugagaag

SEQ ID NO: 123230 - RNA, 64 nt, hsa
agguccguuuccuuacacauuuuauccccucagaacacgauaaaccauggccaauucaguuuca

SEQ ID NO: 123231 - RNA, 64 nt, hsa
auuacaggcgugagccaccgcgcccggcggcgaaacacgauauuguacuaacaucuuaauuuug

SEQ ID NO: 123232 - RNA, 64 nt, hsa
ugcauucauacaaagugagaguaggaagacucaaacacgauauuacccaaguuccugagacuag

SEQ ID NO: 123233 - RNA, 64 nt, hsa
uuguuuuuuguuuaagucgagauauaaaaacugaacacgauaacacuuacucuuaaaucaagca

SEQ ID NO: 123234 - RNA, 64 nt, hsa
cuacuuuuuaguaaaauauuuuuggauagcguugacacgauagaucuuauuccauacuucuuua

SEQ ID NO: 123235 - RNA, 64 nt, hsa
cccgagcuaaucauggaaugucuguucccagcaaacacgauaaagaaagauugugcacuuuaac

SEQ ID NO: 123236 - RNA, 64 nt, hsa
agcccuguaagccagcuuucuucuauauuuauaaacacgauaaaugcaugagaagaucuguuau

SEQ ID NO: 123237 - RNA, 64 nt, hsa
ugggaggacgcagcccacugcccagaaacaagaaacacgauaccauucuggccuuccccacccc

SEQ ID NO: 123238 - RNA, 64 nt, hsa
ugcaggaagcucagggggcaguagcacacuuugcacacgauaaagcaaagacgauggauugaca

SEQ ID NO: 123239 - RNA, 64 nt, hsa
aaauaauuuuuacuuauauuuuucagaggauuugacacgauaagccucaucugauggaagagag

SEQ ID NO: 123240 - RNA, 64 nt, hsa
gcauuuuauuaaaagaauaauuauaauuaaaaaaacacgauacagaucagugcauauaguauau

SEQ ID NO: 123241 - RNA, 64 nt, hsa
uggaaaauuuauaagaaaguaauccaaauaagaaacacgauaguugaaaauaauuuuuauagua

SEQ ID NO: 123242 - RNA, 64 nt, hsa
ugauaauaugaucguauucuauaaauacauauacacacgauacuccuuuccagaaguuccuggg

SEQ ID NO: 123243 - RNA, 64 nt, hsa
cgucaaaguugugcccaacacuguggaucagcaaacacgauagaggagaccagucaguacuucu

SEQ ID NO: 123244 - RNA, 64 nt, hsa
gauccuuuauuggugguagagcaaaaaaacccaaacacgauaaaccuuucaaaagacuuucuaa

SEQ ID NO: 123245 - RNA, 64 nt, hsa
aaagagagagagagagaauuccgaauuggggaacacacgauaccuguuuuucuuuuccguugcu

SEQ ID NO: 123246 - RNA, 64 nt, hsa
acuugggcuauuauucaaggaccauugcuauagaacacgauaggauuuacacaagaaguaacuc

SEQ ID NO: 123247 - RNA, 64 nt, hsa
caggcgugcacacgcagcgcacaugcauugagacacacgauaccucguuccaccuuggcgucac

SEQ ID NO: 123248 - RNA, 64 nt, hsa
ucuuuuuccuuccccuggacuguccucugacccuuuggcucauccuagauugcaguguguccug

SEQ ID NO: 123249 - RNA, 64 nt, hsa
caugcagauggagaagugguguuggcagcaagcuuuggcucauguggauuugguuuaaguggug

SEQ ID NO: 123250 - RNA, 64 nt, hsa
ucugucacccaggcuagagugcgguggugugaucuuggcucacugcaaccucccccuccugggu

SEQ ID NO: 123251 - RNA, 64 nt, hsa
ucuguugcucaggcuggagugcaguggugcaaucuuggcucacugcaaccuacaccucccgggu

SEQ ID NO: 123252 - RNA, 64 nt, hsa
ucugucacccaggcuggaaugcaguggugugaucuuggcucacugcaaccuccacuucccgggu

SEQ ID NO: 123253 - RNA, 64 nt, hsa
ugagacuggguaauugauaaagaaaaagguuuguuuggcucacaauuuugcuggcuagaagguu

SEQ ID NO: 123254 - RNA, 64 nt, hsa
gccaucguccaggcuggagugcgcuggcuugaucuuggcucacugcagccucaauguccccagg

SEQ ID NO: 123255 - RNA, 64 nt, hsa
cuuguugccagggcuggagugcaauggcgugaucuuggcucacugcaaccuccgccucccgggu

SEQ ID NO: 123256 - RNA, 64 nt, hsa
gugguggaggcaaagggcagaauuucugaccccuuuggcucagcugcccuuccccacaaauaaa

SEQ ID NO: 123257 - RNA, 64 nt, hsa
ucugccacccaggcuggaguacaguggcaugaucuuggcucacugcaacgucugccuccugggu

SEQ ID NO: 123258 - RNA, 64 nt, hsa
ucuguugcccaggcuggagugcaguggugccaucuuggcucacuccaagcucccccucccgugu

SEQ ID NO: 123259 - RNA, 64 nt, hsa
aaaaaaaucuuuuuauaaaaugaacuuuuaacacuuggcucaaaccucuaggucauacugccaa

SEQ ID NO: 123260 - RNA, 64 nt, hsa
gcaggggaaacugcuguggauuugagaggcaaaguuggcucagcugugugcccaguuccuccug

SEQ ID NO: 123261 - RNA, 64 nt, hsa
uuuguguuuuuauuggagguggggugucacuauguuggcucagcugauuucaaauuccugaccu

SEQ ID NO: 123262 - RNA, 64 nt, hsa
cucugucaccaggcuggagugcaguggugcgaucuuggcucauggcaaccucugccucccaggu

SEQ ID NO: 123263 - RNA, 64 nt, hsa
uccacugaccuacugaauaucuagcauccuuagauuggcucaacuguuacuuuccuaaggaguc

SEQ ID NO: 123264 - RNA, 64 nt, hsa
cuguauguaagugaaaagcaucaccaucuacccauuggcucaagcagaaaucuggaagucaucu

SEQ ID NO: 123265 - RNA, 64 nt, hsa
ucucucgcccaggcuggagugcaacgguacgaucuuggcucagugcaaccuccgccuccugggu

SEQ ID NO: 123266 - RNA, 64 nt, hsa
ucugucucccaggcuggagugcaauggugcaaucuuggcucacuauagccuugaccucucaggc

SEQ ID NO: 123267 - RNA, 64 nt, hsa
ucugucgcccaggcuggagugcaguggugugaucuuggcucacugcaaccuccgccucuugggu

SEQ ID NO: 123268 - RNA, 64 nt, hsa
gaagagguacaggcgguguccgccucguuucugguuggcucagcggguuucuagggcugugacg

SEQ ID NO: 123269 - RNA, 64 nt, hsa
uuuccugcagggaggggugccaugagucuugcuuuuggcucauacaggagagagggaaggcugc

SEQ ID NO: 123270 - RNA, 64 nt, hsa
ccuuuuuggcucuggcuuuuaaacauuguccugguuggcucauuuaauuuuuuuuuuuuuuuuu

SEQ ID NO: 123271 - RNA, 64 nt, hsa
ggagugcaguggugugaucuuggcucacuugaucuuggcucacuguaaccuccaccucccaggc

SEQ ID NO: 123272 - RNA, 64 nt, hsa
ucugucacccaggcuggagugcaguggugugaucuuggcucacuugaucuuggcucacuguaac

SEQ ID NO: 123273 - RNA, 64 nt, hsa
gcccucccagguaccuagcagaggcugucaguccuuggcucaccuggaacagggcuggggcugg

SEQ ID NO: 123274 - RNA, 64 nt, hsa
ucagcuggguguacugagccuguucaccuggucuuuggcucacucuguguugaaacccagaacc

SEQ ID NO: 123275 - RNA, 64 nt, hsa
aaacugcauggccuuggagagagacucugggcucuuggcucagauguguucaucaaauacuccu

SEQ ID NO: 123276 - RNA, 64 nt, hsa
gcucagcaaguggagguuucaauguauuuuucaguuggcucaucagccagcauuggugaauauu

SEQ ID NO: 123277 - RNA, 64 nt, hsa
uuguugcccaggcugggagggcaauggcaccgucuuggcucacugcaaccuccgccucccgggu

SEQ ID NO: 123278 - RNA, 64 nt, hsa
uaccaucaaaucucugucucugcuugguuaaaaauuggcucacuauugcuuuguaguaaccccu

SEQ ID NO: 123279 - RNA, 64 nt, hsa
uaaucagcuauaugaagaaucucagcuggguguuuuggcucaggccuguaaucccagcacuuug

SEQ ID NO: 123280 - RNA, 64 nt, hsa
ucugucacccaggcuggagugcaguggugcaaucuuggcucacugcaacuugggccucccaggu

SEQ ID NO: 123281 - RNA, 64 nt, hsa
uugaaaaauccguauccucugcuucuggugaacauuggcucagggguuagcaucuuagcaguau

SEQ ID NO: 123282 - RNA, 64 nt, hsa
gccagagcgacuuugaucaccaucaccaacaacauuggcucaauagcaagaaugugugcccuua

SEQ ID NO: 123283 - RNA, 64 nt, hsa
cuuguugcccaggcuggagugcaacggcaugauuuuggcucacugcagccucugccucccaggc

SEQ ID NO: 123284 - RNA, 64 nt, hsa
ucuguugcccaggcuggagugcaguggcgugaucuuggcucacuacaaccuccaccuuccaggc

SEQ ID NO: 123285 - RNA, 64 nt, hsa
auuaaucuuagucugaaaucaaaauauagauuaauuggcucagcuuuaauaccuuucuaggagg

SEQ ID NO: 123286 - RNA, 64 nt, hsa
ucagucacuggaugcacaaaaucacuguguaacauuggcucacuuggugagcauaggguugacu

SEQ ID NO: 123287 - RNA, 64 nt, hsa
cuugccugcuggugacaagcagagcgccugugauuuggcucaagacuccuauaugaugcaggug

SEQ ID NO: 123288 - RNA, 64 nt, hsa
acuuaagccugauuuuccugaugcuuauuguaacuuggcucauugccugcagguaaagaauaac

SEQ ID NO: 123289 - RNA, 64 nt, hsa
ccuguugugcaggcuggagugcaguggcacagucuuggcucacugcaaccuccaccuccugggu

SEQ ID NO: 123290 - RNA, 64 nt, hsa
ccuguugugcaggcuguagugcaguggcacgaucuuggcucacugcaaccuccaccucccgggu

SEQ ID NO: 123291 - RNA, 64 nt, hsa
cucuguugccaggcuggagugcaguggcgcaaucuuggcucacugcaaccuccgccucccaggu

SEQ ID NO: 123292 - RNA, 64 nt, hsa
uagcccugguuagcugacagucagcuguggggaacacagcuacaacccuacccuggcagggacc

SEQ ID NO: 123293 - RNA, 64 nt, hsa
ccccuacccaacccugcccugccccaccccaccucacagcuacucaguggggcuggcaucaagg

SEQ ID NO: 123294 - RNA, 64 nt, hsa
aaguaauuugccuaaggucacagcuaauaaguggcacagcuaauauucccaguaaagauaccau

SEQ ID NO: 123295 - RNA, 64 nt, hsa
acaggccagauaagugaaguaauuugccuaaggucacagcuaauaaguggcacagcuaauauuc

SEQ ID NO: 123296 - RNA, 64 nt, hsa
gggucacggcccacagcuagguggggucacggcccacagcuagguggggacugucugcuggcuc

SEQ ID NO: 123297 - RNA, 64 nt, hsa
cucauuuucaucagcacagcauggggucacggcccacagcuagguggggucacggcccacagcu

SEQ ID NO: 123298 - RNA, 64 nt, hsa
ugugucagggccauucaaauuguugguguugcaucacagcuaccuuaacuguuuuuaacaugga

SEQ ID NO: 123299 - RNA, 64 nt, hsa
cccccuucaccccccccacccccgccuugccacacacagcuaauauucuaaugguaaauuucuc

SEQ ID NO: 123300 - RNA, 64 nt, hsa
ggcccagagagguuaagugucuugcccgaggucacacagcuaucugcaugucccacaacucccc

SEQ ID NO: 123301 - RNA, 64 nt, hsa
aaauacaaaaguuaaccaagccuaugcuuguagucacagcuacucgggaggccgaggugggagg

SEQ ID NO: 123302 - RNA, 64 nt, hsa
ugcaacgggguggcauucacuuagggucugacuucacagcuaugacaaaaccgaaaaagcaaaa

SEQ ID NO: 123303 - RNA, 64 nt, hsa
cucaguuccacagaaugucaggaccaaauaacuucacagcuacucugcaaagggcaaauuauaa

SEQ ID NO: 123304 - RNA, 64 nt, hsa
uauguugagggaacucugccaccugcgugcaacccacagcuaaaguaaauucaaugacacuacu

SEQ ID NO: 123305 - RNA, 64 nt, hsa
guuucccuacaagagggaaagaaggcaaaaacggcacagcuaucuccaaacacaucugaguuca

SEQ ID NO: 123306 - RNA, 64 nt, hsa
uaggcaggacaugcugaagccaaagccaauaacacacagcuaacacacagcucccauaaccgcu

SEQ ID NO: 123307 - RNA, 64 nt, hsa
ugaaggcaaugccauccucaaacacugcaggcaucacagcuaacaauugugaagucgucuuaac

SEQ ID NO: 123308 - RNA, 64 nt, hsa
cucaucuuagugccugagaguauuuaggcagauugaaaaggacaccuuuuaacucaccucucaa

SEQ ID NO: 123309 - RNA, 64 nt, hsa
gauacaugguugugaccugaggauuuaagggauggaaaaggaagacuagaggcuugcauaauaa

SEQ ID NO: 123310 - RNA, 64 nt, hsa
agcagagagaacccagguuagaaggaugggaagagaaaaggagcaguuuuauugcuuauagaaa

SEQ ID NO: 123311 - RNA, 64 nt, hsa
ugcacugaaacauguggucuggucugacuugagagaaaaggaauguugcacaaggguugugaau

SEQ ID NO: 123312 - RNA, 64 nt, hsa
ggaaauagauguguguuuaauggaauugaagucugaaaaggaaguaguuauuuuagcagaaaau

SEQ ID NO: 123313 - RNA, 64 nt, hsa
aauugaauuauuuuucuccaaauugagacucucagaaaaggaagauugaauuagcguguuuuuu

SEQ ID NO: 123314 - RNA, 64 nt, hsa
ugagaacucuuguuucuuggggaaggagaggagggaaaaggaccagggucaagggggaccagag

SEQ ID NO: 123315 - RNA, 64 nt, hsa
acugacugauuaauuauuccugauaacaucucaagaaaaggagaaggaaaguguuucuggagaa

SEQ ID NO: 123316 - RNA, 64 nt, hsa
aaaagaaagaucagauuguuacugugucuguguagaaaaggaagacauaagaaacuccauuuug

SEQ ID NO: 123317 - RNA, 64 nt, hsa
gacaucccuccguggugugugucuuggugcauuggaaaaggagucaggagccacugugagguga

SEQ ID NO: 123318 - RNA, 64 nt, hsa
aaacaauggugauuuuauuuauuuuuacucucuggaaaaggagauaauacaauuccagaaagug

SEQ ID NO: 123319 - RNA, 64 nt, hsa
gcccuugcauggaaaacuguuuauuuuuuucagugaaaaggaauucugcuuucguguuuuuggg

SEQ ID NO: 123320 - RNA, 64 nt, hsa
aucuuaucacacugauguguucaacuguuuaugggaaaaggaaacuaggaugguuuuauuugug

SEQ ID NO: 123321 - RNA, 64 nt, hsa
uucuacaacgcuagaacuguugaacuucuugggagaaaaggagaaucuuuguuuuguugugcug

SEQ ID NO: 123322 - RNA, 64 nt, hsa
ccagcgcagagcagagugcugaguaaagaugucagaaaaggaaagcaauggucugguacaaguc

SEQ ID NO: 123323 - RNA, 64 nt, hsa
ggcuauuacauaagaaacaauggacccaagagaagaaaaggaagaaagaaagguuuuuugguuu

SEQ ID NO: 123324 - RNA, 64 nt, hsa
acaauuuuaggcucaaaaauuaaagcuaacacaggaaaaggaacuguacuggcuauuacauaag

SEQ ID NO: 123325 - RNA, 64 nt, hsa
aauuccauuacuccauuuacaggagcguuccuaggaaaaggaauuuuaggaggagaauuuguga

SEQ ID NO: 123326 - RNA, 64 nt, hsa
aggcuuaaucuucagcuucuaugcaccaagcguggaaaaggagaaaguccugcagaaucaaucc

SEQ ID NO: 123327 - RNA, 64 nt, hsa
gccagagaaaaaucacagcuuccuugucggaggggaaaaggacaggugaucuggggaaaacgca

SEQ ID NO: 123328 - RNA, 64 nt, hsa
uuauuuucuucagccugugcaaaacaaagcaauggaaaaggaaacuaaaaaauauacauacuag

SEQ ID NO: 123329 - RNA, 64 nt, hsa
guuuccugcugacuacaacccucuccuguuuacugaaaaggagucaggaaaacuacagguguug

SEQ ID NO: 123330 - RNA, 64 nt, hsa
caaucaccccugccuuuuguucaacucuauaaaggaaaaggaauguagcucaacuugugauaaa

SEQ ID NO: 123331 - RNA, 64 nt, hsa
cauuuuaucgagagaaccuucugcuucugaggaagaaaaggaguuaggagaaagaagagcagcu

SEQ ID NO: 123332 - RNA, 64 nt, hsa
acagguuugaggggcuggggagugggaggggggagaaaaggaauguauuuaaacaauuuccgau

SEQ ID NO: 123333 - RNA, 64 nt, hsa
ugacaagaaauuuaaagaaucaaaacgaugguuugaaaaggaaaccuaugauacaugcaggaga

SEQ ID NO: 123334 - RNA, 64 nt, hsa
caauccugcugcuggguauauacccgaaagaaaggaaaaggaagccaguauauugaagagguau

SEQ ID NO: 123335 - RNA, 64 nt, hsa
aaaugagauucugucauuugcaauaauauagauggaaaaggaggcccuuaugugaagugaaaua

SEQ ID NO: 123336 - RNA, 64 nt, hsa
uuuagucuccuuuuucaacaaaggaguguguucagaaaaggagagagaggcugagaucauucag

SEQ ID NO: 123337 - RNA, 64 nt, hsa
gggagccuguccguucagagccucuggcugcauagaaaaggauucuggugcuuccccuguuugc

SEQ ID NO: 123338 - RNA, 64 nt, hsa
gaagugugacggagcaggcgggcugaggagaguggaaaaggaagcgacccagaaauggcaggga

SEQ ID NO: 123339 - RNA, 64 nt, hsa
ugaaaaaaaaaaaugcuuuuaaaaaagauaaaaugaaaaggagagcucucuuuuucucucucuu

SEQ ID NO: 123340 - RNA, 64 nt, hsa
gaugaggggacauuuucuggauucugggaggcaagaaaaggacaaauaucuuuuuuggaacuaa

SEQ ID NO: 123341 - RNA, 64 nt, hsa
ggaguccucuagcaggccuaagacaugugaggaggaaaaggaaaaaaagcaaaaagcaagggag

SEQ ID NO: 123342 - RNA, 61 nt, hsa
gagaacagguccugaugugaacaaccuaugggaaaaggaaaggucgagagaaucuugucca

SEQ ID NO: 123343 - RNA, 64 nt, hsa
cucuaagucaagugcaaggacuuaacuugcguuugaaaaggaauuagagggucagaaacaccca

SEQ ID NO: 123344 - RNA, 64 nt, hsa
ccugaggaaucaaggggccauuaccaaggggcaggaaaaggauauguaagagguggccuucaug

SEQ ID NO: 123345 - RNA, 64 nt, hsa
aucuccaguauuuccuuuggauacucaggaaugggaaaaggacagcacaggaugcccuccaagg

SEQ ID NO: 123346 - RNA, 64 nt, hsa
uauuuuggcuuacucuuuggaugagaccagacaagaaaaggauuaaacggguggcuccuuuaau

SEQ ID NO: 123347 - RNA, 64 nt, hsa
accuuagacaaaaaaagcagaacccacuggaguagaaaaggaagcauguagcauauacucagua

SEQ ID NO: 123348 - RNA, 64 nt, hsa
ucauuucuucuucucacgucugugacaaaugguugaaaaggagucaacauggccccaacuauag

SEQ ID NO: 123349 - RNA, 64 nt, hsa
uagggaacuccagacugacacagcaguuguuuuugaaaaggaaauaaacuuugaugaauuagau

SEQ ID NO: 123350 - RNA, 64 nt, hsa
aaaacucuggagugagaggaugccagaggaucaagaaaaggaucacaguuucuugaagaagcuu

SEQ ID NO: 123351 - RNA, 64 nt, hsa
ugugagagaaaaaccaaucaauguuuacaaaauggaaaaggacacagcauguccuuugaacucc

SEQ ID NO: 123352 - RNA, 64 nt, hsa
caacgacagccccaaucuucccgucuuuaugagagaaaaggaaaaaggaaucaaagguggaaga

SEQ ID NO: 123353 - RNA, 64 nt, hsa
gaguguggaagggggucuaggagagggagagcuggaaaaggagcugauggggucuuauccuggc

SEQ ID NO: 123354 - RNA, 64 nt, hsa
caaggcggcagagcugugcgcccacccagcuauugaaaaggacuuucugugggcacacacucug

SEQ ID NO: 123355 - RNA, 64 nt, hsa
uuuuucccauaagacaaugacauacgcuuuuaaugaaaaggaaucacguuagaggaaaaauauu

SEQ ID NO: 123356 - RNA, 64 nt, hsa
aaggaacuugucucuucaucuaauaugauagcgggaaaaggagaggaaacuacugccuuuagaa

SEQ ID NO: 123357 - RNA, 64 nt, hsa
cuucugugcguugggucaguuucuguuacguaacgaaaaggauaaacaucucccacgggagagg

SEQ ID NO: 123358 - RNA, 64 nt, hsa
uuuuuaagugcuguauuaauaauacuuucugaaagaaaaggacacuuaccccaaaacuucaauc

SEQ ID NO: 123359 - RNA, 64 nt, hsa
auaauuaaaaacccaaagaaccagcucauguuuggaaaaggaaucuuccacugaaacauuugga

SEQ ID NO: 123360 - RNA, 64 nt, hsa
augcuuuuccucaggaaauucggcaagacuuggagaaaaggaaagcuccaucaaagaggacccc

SEQ ID NO: 123361 - RNA, 64 nt, hsa
gauuauuaugagugggggacuggugacuuuauaugaaaaggaaggaagagugaccuaagcuagc

SEQ ID NO: 123362 - RNA, 64 nt, hsa
cauaacugugcuugucucagucaaacuuaauugggaaaaggaggaguaagagcaggcccuuucu

SEQ ID NO: 123363 - RNA, 64 nt, hsa
acuccaucucaaaaaaaaaaaaaaaaguaagaaagaaaaggacucccuuagaaugggaaagaaa

SEQ ID NO: 123364 - RNA, 64 nt, hsa
ccauuuguaccuaagagaaaaauaggcucaguuagaaaaggacucccuggccaggcgcagugac

SEQ ID NO: 123365 - RNA, 64 nt, hsa
uggacuuuagacaaaagcaagaggaucagaugaagaaaaggagagguagauacagucaguguca

SEQ ID NO: 123366 - RNA, 64 nt, hsa
gaaaagaacauaagaacucaaggagaacauaagagaaaaggaaaccuguuacagaaaagacaag

SEQ ID NO: 123367 - RNA, 64 nt, hsa
caauauggauuuagaaaaaggaacaccugaugaagaaaaggagagguagauacagucaguguca

SEQ ID NO: 123368 - RNA, 64 nt, hsa
aacaaagucaacugaaucuuuuauucauagaaaugaaaaggaaaauaaaaacuguggcugacca

SEQ ID NO: 123369 - RNA, 64 nt, hsa
gaaaaauacuguuucuucuauccaacucucuuaugaaaaggaacucuguauuuucuauuagcca

SEQ ID NO: 123370 - RNA, 61 nt, hsa
cugaagacuuauggcagugaacacaucugauuucccacagcacaacagcccugcauggguu

SEQ ID NO: 123371 - RNA, 61 nt, hsa
accuuguaaaacugcugggagaaaagcaugauucccacaaggacuaaguaucagugauuug

SEQ ID NO: 123372 - RNA, 61 nt, hsa
gcgggaccuacaaguccuuccucuuggcgcauucccacacuccagucuggauccaggucug

SEQ ID NO: 123373 - RNA, 61 nt, hsa
gccaggagcgcccugacaucccaaaaccaucuucccacauguggguuguuggaaucccacc

SEQ ID NO: 123374 - RNA, 61 nt, hsa
caugacuaguauuucuaauuagccuaauaaauucccacacuuucugaagugaacacuaaug

SEQ ID NO: 123375 - RNA, 61 nt, hsa
agauuaaaguaggcuggguuucauuuccaucuucccacacaucucauugaauuugaugguu

SEQ ID NO: 123376 - RNA, 61 nt, hsa
ggagucacacuaauacuaucaacuaucagucuucccacagcuucaaucacugucauuauuc

SEQ ID NO: 123377 - RNA, 61 nt, hsa
ucaaaauaaauuaucacuucgaaaacuugcuuucccacacuaagguaaguucagacuagau

SEQ ID NO: 123378 - RNA, 61 nt, hsa
gguaucaaugcuguagauggauggaagaggcuucccacaggaaggugccaccagucaguug

SEQ ID NO: 123379 - RNA, 61 nt, hsa
uuuacucuucuagaguacuguuaaugccccuuucccacagucuuuuauauaauuaaauaua

SEQ ID NO: 123380 - RNA, 61 nt, hsa
uuagccuugcacuccagggcccuaccugcauuucccacaugacuuucuggaagccucccaa

SEQ ID NO: 123381 - RNA, 61 nt, hsa
gguaggcuucaaagagccuauauuccucuuuuucccacaccgaucaagucaacucaguacu

SEQ ID NO: 123382 - RNA, 61 nt, hsa
uuucucugcauuuaaaaaaaucccccagcacuucccacagugccuauugauacuuggggag

SEQ ID NO: 123383 - RNA, 61 nt, hsa
guugcuguacaaaagcaaugguugaugauacuucccacaccacaaaugggacacauggucu

SEQ ID NO: 123384 - RNA, 61 nt, hsa
ccugggacuuugcagucaaaugaagcugagcuucccacaucccguucuucgguuugccaug

SEQ ID NO: 123385 - RNA, 61 nt, hsa
aaaaccauccuuccuuuccuuucgcccuuguuucccacauucccuucguccugcccaaggg

SEQ ID NO: 123386 - RNA, 61 nt, hsa
ucucaaccccagcagucuggcuuguuucucauucccacaauuuccuggguuccaccaagca

SEQ ID NO: 123387 - RNA, 61 nt, hsa
agguaccaggauggcaggacccgcacgccucuucccacaccugucagcuucggaagcaucu

SEQ ID NO: 123388 - RNA, 61 nt, hsa
cuguaugggagaaaaagaguaagaggaaauauucccacagccaugaagggugaaagggcac

SEQ ID NO: 123389 - RNA, 61 nt, hsa
cugcucugggugguaagggaagcccucccgguucccacaggcuaugaugcugcauggcaga

SEQ ID NO: 123390 - RNA, 61 nt, hsa
gccccuggcuuccucuuccauguucugcccuuucccacaccuuuguuccucaauagcuggg

SEQ ID NO: 123391 - RNA, 61 nt, hsa
gccccuggcuuccucuuccauguucugcccuuucccacauguuggaggcuuuuccaacguc

SEQ ID NO: 123392 - RNA, 61 nt, hsa
uugucauuugagaaaggaugcaggaggacaauucccacagauaaucugaggaaugcagaaa

SEQ ID NO: 123393 - RNA, 61 nt, hsa
uuggggugaaggagacauuucuguccuuggcuucccacagccccaacgcagucuguguaug

SEQ ID NO: 123394 - RNA, 64 nt, hsa; identical to SEQ ID NO: 86383

SEQ ID NO: 123395 - RNA, 64 nt, hsa; identical to SEQ ID NO: 86384

SEQ ID NO: 123396 - RNA, 64 nt, hsa; identical to SEQ ID NO: 86385

SEQ ID NO: 123397 - RNA, 64 nt, hsa; identical to SEQ ID NO: 86386

SEQ ID NO: 123398 - RNA, 64 nt, hsa; identical to SEQ ID NO: 86387

SEQ ID NO: 123399 - RNA, 64 nt, hsa; identical to SEQ ID NO: 86388

SEQ ID NO: 123400 - RNA, 64 nt, hsa; identical to SEQ ID NO: 86389

SEQ ID NO: 123401 - RNA, 64 nt, hsa; identical to SEQ ID NO: 86390

SEQ ID NO: 123402 - RNA, 64 nt, hsa; identical to SEQ ID NO: 86391

SEQ ID NO: 123403 - RNA, 64 nt, hsa; identical to SEQ ID NO: 86392

SEQ ID NO: 123404 - RNA, 64 nt, hsa; identical to SEQ ID NO: 86393

SEQ ID NO: 123405 - RNA, 64 nt, hsa; identical to SEQ ID NO: 86394

SEQ ID NO: 123406 - RNA, 61 nt, hsa; identical to SEQ ID NO: 86395

SEQ ID NO: 123407 - RNA, 64 nt, hsa; identical to SEQ ID NO: 86396

SEQ ID NO: 123408 - RNA, 64 nt, hsa; identical to SEQ ID NO: 86397

SEQ ID NO: 123409 - RNA, 64 nt, hsa; identical to SEQ ID NO: 86398

SEQ ID NO: 123410 - RNA, 64 nt, hsa; identical to SEQ ID NO: 86399

SEQ ID NO: 123411 - RNA, 64 nt, hsa; identical to SEQ ID NO: 86400

SEQ ID NO: 123412 - RNA, 64 nt, hsa; identical to SEQ ID NO: 86401

SEQ ID NO: 123413 - RNA, 64 nt, hsa; identical to SEQ ID NO: 86402

SEQ ID NO: 123414 - RNA, 64 nt, hsa; identical to SEQ ID NO: 86403

SEQ ID NO: 123415 - RNA, 64 nt, hsa; identical to SEQ ID NO: 86404

SEQ ID NO: 123416 - RNA, 64 nt, hsa; identical to SEQ ID NO: 86405

SEQ ID NO: 123417 - RNA, 64 nt, hsa; identical to SEQ ID NO: 86406

SEQ ID NO: 123418 - RNA, 64 nt, hsa; identical to SEQ ID NO: 86407

SEQ ID NO: 123419 - RNA, 64 nt, hsa; identical to SEQ ID NO: 86408

SEQ ID NO: 123420 - RNA, 64 nt, hsa; identical to SEQ ID NO: 86409

SEQ ID NO: 123421 - RNA, 64 nt, hsa; identical to SEQ ID NO: 86410

SEQ ID NO: 123422 - RNA, 64 nt, hsa; identical to SEQ ID NO: 86411

SEQ ID NO: 123423 - RNA, 64 nt, hsa; identical to SEQ ID NO: 86412

SEQ ID NO: 123424 - RNA, 64 nt, hsa; identical to SEQ ID NO: 86413

SEQ ID NO: 123425 - RNA, 64 nt, hsa; identical to SEQ ID NO: 86414

SEQ ID NO: 123426 - RNA, 64 nt, hsa; identical to SEQ ID NO: 86415

SEQ ID NO: 123427 - RNA, 64 nt, hsa; identical to SEQ ID NO: 86416

SEQ ID NO: 123428 - RNA, 64 nt, hsa; identical to SEQ ID NO: 86417

SEQ ID NO: 123429 - RNA, 64 nt, hsa; identical to SEQ ID NO: 86418

SEQ ID NO: 123430 - RNA, 64 nt, hsa; identical to SEQ ID NO: 86419

SEQ ID NO: 123431 - RNA, 64 nt, hsa; identical to SEQ ID NO: 86420

SEQ ID NO: 123432 - RNA, 64 nt, hsa; identical to SEQ ID NO: 86421

SEQ ID NO: 123433 - RNA, 64 nt, hsa; identical to SEQ ID NO: 86422

SEQ ID NO: 123434 - RNA, 64 nt, hsa; identical to SEQ ID NO: 86423

SEQ ID NO: 123435 - RNA, 64 nt, hsa; identical to SEQ ID NO: 86424

SEQ ID NO: 123436 - RNA, 64 nt, hsa; identical to SEQ ID NO: 86425

SEQ ID NO: 123437 - RNA, 64 nt, hsa; identical to SEQ ID NO: 86426

SEQ ID NO: 123438 - RNA, 64 nt, hsa; identical to SEQ ID NO: 86427

SEQ ID NO: 123439 - RNA, 64 nt, hsa; identical to SEQ ID NO: 86428

SEQ ID NO: 123440 - RNA, 64 nt, hsa; identical to SEQ ID NO: 86429

SEQ ID NO: 123441 - RNA, 64 nt, hsa; identical to SEQ ID NO: 86430

SEQ ID NO: 123442 - RNA, 64 nt, hsa; identical to SEQ ID NO: 86431

SEQ ID NO: 123443 - RNA, 64 nt, hsa; identical to SEQ ID NO: 86432

SEQ ID NO: 123444 - RNA, 64 nt, hsa; identical to SEQ ID NO: 86433

SEQ ID NO: 123445 - RNA, 64 nt, hsa; identical to SEQ ID NO: 86434

SEQ ID NO: 123446 - RNA, 64 nt, hsa; identical to SEQ ID NO: 86435

SEQ ID NO: 123447 - RNA, 64 nt, hsa; identical to SEQ ID NO: 86436

SEQ ID NO: 123448 - RNA, 64 nt, hsa; identical to SEQ ID NO: 86437

SEQ ID NO: 123449 - RNA, 64 nt, hsa; identical to SEQ ID NO: 86438

SEQ ID NO: 123450 - RNA, 64 nt, hsa; identical to SEQ ID NO: 86439

SEQ ID NO: 123451 - RNA, 64 nt, hsa; identical to SEQ ID NO: 86440

SEQ ID NO: 123452 - RNA, 64 nt, hsa; identical to SEQ ID NO: 86441

SEQ ID NO: 123453 - RNA, 64 nt, hsa; identical to SEQ ID NO: 86442

SEQ ID NO: 123454 - RNA, 64 nt, hsa; identical to SEQ ID NO: 86443

SEQ ID NO: 123455 - RNA, 64 nt, hsa; identical to SEQ ID NO: 86444

SEQ ID NO: 123456 - RNA, 64 nt, hsa; identical to SEQ ID NO: 86445

SEQ ID NO: 123457 - RNA, 60 nt, hsa; identical to SEQ ID NO: 86446

SEQ ID NO: 123458 - RNA, 64 nt, hsa; identical to SEQ ID NO: 86447

SEQ ID NO: 123459 - RNA, 64 nt, hsa; identical to SEQ ID NO: 86448

SEQ ID NO: 123460 - RNA, 64 nt, hsa; identical to SEQ ID NO: 86449

SEQ ID NO: 123461 - RNA, 64 nt, hsa; identical to SEQ ID NO: 86450

SEQ ID NO: 123462 - RNA, 64 nt, hsa; identical to SEQ ID NO: 86451

SEQ ID NO: 123463 - RNA, 64 nt, hsa; identical to SEQ ID NO: 86452

SEQ ID NO: 123464 - RNA, 64 nt, hsa; identical to SEQ ID NO: 86453

SEQ ID NO: 123465 - RNA, 64 nt, hsa; identical to SEQ ID NO: 86454

SEQ ID NO: 123466 - RNA, 64 nt, hsa; identical to SEQ ID NO: 86455

SEQ ID NO: 123467 - RNA, 64 nt, hsa; identical to SEQ ID NO: 86456

SEQ ID NO: 123468 - RNA, 64 nt, hsa; identical to SEQ ID NO: 86457

SEQ ID NO: 123469 - RNA, 64 nt, hsa; identical to SEQ ID NO: 86458

SEQ ID NO: 123470 - RNA, 64 nt, hsa; identical to SEQ ID NO: 86459

SEQ ID NO: 123471 - RNA, 64 nt, hsa; identical to SEQ ID NO: 86460

SEQ ID NO: 123472 - RNA, 64 nt, hsa; identical to SEQ ID NO: 86461

SEQ ID NO: 123473 - RNA, 55 nt, hsa; identical to SEQ ID NO: 86462

SEQ ID NO: 123474 - RNA, 64 nt, hsa; identical to SEQ ID NO: 86463

SEQ ID NO: 123475 - RNA, 64 nt, hsa; identical to SEQ ID NO: 86464

SEQ ID NO: 123476 - RNA, 64 nt, hsa; identical to SEQ ID NO: 86465

SEQ ID NO: 123477 - RNA, 64 nt, hsa; identical to SEQ ID NO: 86466

SEQ ID NO: 123478 - RNA, 64 nt, hsa; identical to SEQ ID NO: 86467

SEQ ID NO: 123479 - RNA, 64 nt, hsa; identical to SEQ ID NO: 86468

SEQ ID NO: 123480 - RNA, 64 nt, hsa; identical to SEQ ID NO: 86469

SEQ ID NO: 123481 - RNA, 64 nt, hsa; identical to SEQ ID NO: 86470

SEQ ID NO: 123482 - RNA, 64 nt, hsa; identical to SEQ ID NO: 86471

SEQ ID NO: 123483 - RNA, 64 nt, hsa; identical to SEQ ID NO: 86472

SEQ ID NO: 123484 - RNA, 64 nt, hsa; identical to SEQ ID NO: 86473

SEQ ID NO: 123485 - RNA, 64 nt, hsa; identical to SEQ ID NO: 86474

SEQ ID NO: 123486 - RNA, 64 nt, hsa; identical to SEQ ID NO: 86475

SEQ ID NO: 123487 - RNA, 64 nt, hsa; identical to SEQ ID NO: 86476

SEQ ID NO: 123488 - RNA, 64 nt, hsa; identical to SEQ ID NO: 86477

SEQ ID NO: 123489 - RNA, 64 nt, hsa; identical to SEQ ID NO: 86478

SEQ ID NO: 123490 - RNA, 64 nt, hsa; identical to SEQ ID NO: 86479

SEQ ID NO: 123491 - RNA, 64 nt, hsa; identical to SEQ ID NO: 86480

SEQ ID NO: 123492 - RNA, 64 nt, hsa; identical to SEQ ID NO: 86481

SEQ ID NO: 123493 - RNA, 64 nt, hsa; identical to SEQ ID NO: 86482

SEQ ID NO: 123494 - RNA, 64 nt, hsa; identical to SEQ ID NO: 86483

SEQ ID NO: 123495 - RNA, 64 nt, hsa; identical to SEQ ID NO: 86484

SEQ ID NO: 123496 - RNA, 64 nt, hsa; identical to SEQ ID NO: 86485

SEQ ID NO: 123497 - RNA, 64 nt, hsa; identical to SEQ ID NO: 86486

SEQ ID NO: 123498 - RNA, 64 nt, hsa; identical to SEQ ID NO: 86487

SEQ ID NO: 123499 - RNA, 64 nt, hsa; identical to SEQ ID NO: 86488

SEQ ID NO: 123500 - RNA, 64 nt, hsa; identical to SEQ ID NO: 86489

SEQ ID NO: 123501 - RNA, 64 nt, hsa; identical to SEQ ID NO: 86490

SEQ ID NO: 123502 - RNA, 64 nt, hsa; identical to SEQ ID NO: 86491

SEQ ID NO: 123503 - RNA, 64 nt, hsa; identical to SEQ ID NO: 86492

SEQ ID NO: 123504 - RNA, 64 nt, hsa; identical to SEQ ID NO: 86493

SEQ ID NO: 123505 - RNA, 51 nt, hsa; identical to SEQ ID NO: 86494

SEQ ID NO: 123506 - RNA, 64 nt, hsa; identical to SEQ ID NO: 86495

SEQ ID NO: 123507 - RNA, 64 nt, hsa; identical to SEQ ID NO: 86496

SEQ ID NO: 123508 - RNA, 64 nt, hsa; identical to SEQ ID NO: 86497

SEQ ID NO: 123509 - RNA, 64 nt, hsa; identical to SEQ ID NO: 86498

SEQ ID NO: 123510 - RNA, 64 nt, hsa; identical to SEQ ID NO: 86499

SEQ ID NO: 123511 - RNA, 64 nt, hsa; identical to SEQ ID NO: 86500

SEQ ID NO: 123512 - RNA, 64 nt, hsa; identical to SEQ ID NO: 86501

SEQ ID NO: 123513 - RNA, 64 nt, hsa; identical to SEQ ID NO: 86502

SEQ ID NO: 123514 - RNA, 64 nt, hsa; identical to SEQ ID NO: 86503

SEQ ID NO: 123515 - RNA, 64 nt, hsa; identical to SEQ ID NO: 86504

SEQ ID NO: 123516 - RNA, 64 nt, hsa; identical to SEQ ID NO: 86505

SEQ ID NO: 123517 - RNA, 64 nt, hsa; identical to SEQ ID NO: 86506

SEQ ID NO: 123518 - RNA, 64 nt, hsa; identical to SEQ ID NO: 86507

SEQ ID NO: 123519 - RNA, 64 nt, hsa; identical to SEQ ID NO: 86508

SEQ ID NO: 123520 - RNA, 64 nt, hsa; identical to SEQ ID NO: 86509

SEQ ID NO: 123521 - RNA, 64 nt, hsa; identical to SEQ ID NO: 86510

SEQ ID NO: 123522 - RNA, 64 nt, hsa; identical to SEQ ID NO: 86511

SEQ ID NO: 123523 - RNA, 64 nt, hsa; identical to SEQ ID NO: 86512

SEQ ID NO: 123524 - RNA, 64 nt, hsa; identical to SEQ ID NO: 86513

SEQ ID NO: 123525 - RNA, 64 nt, hsa; identical to SEQ ID NO: 86514

SEQ ID NO: 123526 - RNA, 64 nt, hsa; identical to SEQ ID NO: 86515

SEQ ID NO: 123527 - RNA, 64 nt, hsa; identical to SEQ ID NO: 86516

SEQ ID NO: 123528 - RNA, 64 nt, hsa; identical to SEQ ID NO: 86517

SEQ ID NO: 123529 - RNA, 64 nt, hsa; identical to SEQ ID NO: 86518

SEQ ID NO: 123530 - RNA, 64 nt, hsa; identical to SEQ ID NO: 86519

SEQ ID NO: 123531 - RNA, 64 nt, hsa; identical to SEQ ID NO: 86520

SEQ ID NO: 123532 - RNA, 64 nt, hsa; identical to SEQ ID NO: 86521

SEQ ID NO: 123533 - RNA, 64 nt, hsa; identical to SEQ ID NO: 86522

SEQ ID NO: 123534 - RNA, 64 nt, hsa; identical to SEQ ID NO: 86523

SEQ ID NO: 123535 - RNA, 64 nt, hsa; identical to SEQ ID NO: 86524

SEQ ID NO: 123536 - RNA, 64 nt, hsa; identical to SEQ ID NO: 86525

SEQ ID NO: 123537 - RNA, 64 nt, hsa
uugcccaauuaauacuagggugcaguguauccuggagagguagggugugugggggaggaauccc

SEQ ID NO: 123538 - RNA, 64 nt, hsa
uccggucccaaggacaaggcucuuccagugcuaggagagguaugagcagccucucaccugugag

SEQ ID NO: 123539 - RNA, 64 nt, hsa
cagccuuccuaguugguuuuucuaggccuggugugagagguagggaagucugcacauaacuaau

SEQ ID NO: 123540 - RNA, 64 nt, hsa
gaugugccaggugccugcguugugccaguugcuggagagguagugugagcagagcagcugaaau

SEQ ID NO: 123541 - RNA, 64 nt, hsa
ggggagagguagagaugagacaagagguagaggggagagguagagguagccacgagcugauaau

SEQ ID NO: 123542 - RNA, 64 nt, hsa
ugcugcaaaaugacccagaggcaggggucagggggagagguagagaugagacaagagguagagg

SEQ ID NO: 123543 - RNA, 64 nt, hsa
gguggagauacccuuuuugaaagguggccuuggugagagguauggagccaagucuucuagguug

SEQ ID NO: 123544 - RNA, 64 nt, hsa
guaaaagggaagaaugucugauacugaucuauuagagagguacuuuagaggcuucuugauuggc

SEQ ID NO: 123545 - RNA, 64 nt, hsa
gccagucuguuuucuuccauguuuaauuagaagugagagguagaaguacuucaaauucaacagg

SEQ ID NO: 123546 - RNA, 64 nt, hsa
cagauguucacuuuugcaauuuguggaggguggagagagguagacuuuuguuguguguuuuaua

SEQ ID NO: 123547 - RNA, 64 nt, hsa
uuagacaaaagcaagaggaucagaugaagaaaaggagagguagauacagucagugucacuucag

SEQ ID NO: 123548 - RNA, 64 nt, hsa
ggauuuagaaaaaggaacaccugaugaagaaaaggagagguagauacagucagugucacuucag

SEQ ID NO: 123549 - RNA, 64 nt, hsa
cccauggagagggaauguguggcucuggcugcccagggcccaacucgguucacacggaucgugc

SEQ ID NO: 123550 - RNA, 64 nt, hsa
guuuuuuaauccaguggcaaggugcucccacuccagggcccagcacaucuccuggauuccuuag

SEQ ID NO: 123551 - RNA, 64 nt, hsa
guuccaucuccgagaguggugugcagggcaggccagggcccaugcuggcugcagucucuguggc

SEQ ID NO: 123552 - RNA, 64 nt, hsa
ggagcaguuacaucgggucuggugcuccagaccuagggcccagcacuuucaucagauccugccu

SEQ ID NO: 123553 - RNA, 64 nt, hsa
cucccaggugccagguggucuuccagccucuccaagggcccaccccccugccucuuccucccac

SEQ ID NO: 123554 - RNA, 64 nt, hsa
ggaggaauagcugugauggaaggacuagagcgaaagggcccagagauaucaaggaagcuuuuca

SEQ ID NO: 123555 - RNA, 64 nt, hsa
agcaagggcauugccuccucucucugcucacuucagggcccagugcacucacuucacagugaca

SEQ ID NO: 123556 - RNA, 64 nt, hsa
uccccuacaauccuugggcagagcauguggucugagggcccacagugaaagaacagcaguggug

SEQ ID NO: 123557 - RNA, 64 nt, hsa
ggagagggggugaugaccccuccccaagccccucagggcccagaccuuccugcucuccagcagg

SEQ ID NO: 123558 - RNA, 64 nt, hsa
ggcagggucaggcugggguaagccgggguuccacagggcccagcccuggcaggggucuggcccc

SEQ ID NO: 123559 - RNA, 64 nt, hsa
cacuaaagguauuaauaaguccaguggaccacagagggcccaaucccucuuggccgcuaaggcu

SEQ ID NO: 123560 - RNA, 64 nt, hsa
cacacaaagccuuaugagaguauuccuucccucuagggcccaaagaggcugcuaaccagcagga

SEQ ID NO: 123561 - RNA, 64 nt, hsa
ucaaaaacccugggguccugggccagagacaggcagggcccaguccaggggccccaggccuccc

SEQ ID NO: 123562 - RNA, 64 nt, hsa
caccaggugaggugagcgugugugcucucagggaagggcccaggaucccaugccugggaggagc

SEQ ID NO: 123563 - RNA, 64 nt, hsa
ggaggcggcgguggcacugaagagauagcuuucaagggcccaacacuuugcacuucggcuggcu

SEQ ID NO: 123564 - RNA, 64 nt, hsa
agaaaaccagccacuucuuuucauaagcacugacagggcccagcccacagccacaggugcgauc

SEQ ID NO: 123565 - RNA, 64 nt, hsa
gagugaaaggaccuuugggggugggugggagcaaagggcccaccugcugguuggugaaagcagu

SEQ ID NO: 123566 - RNA, 64 nt, hsa
gagggucuccuaccuggaagucccccugagcuccagggcccagcccuaccugccagugcuggug

SEQ ID NO: 123567 - RNA, 64 nt, hsa
aaauauuucauguccuauuuuaauagaaaaccucagggcccaaguaacagugauagaaguuaga

SEQ ID NO: 123568 - RNA, 64 nt, hsa
agaaaacagucuuccauagauuuuuaaggaagaaagggcccaagccaggagaucgcuugguuuu

SEQ ID NO: 123569 - RNA, 64 nt, hsa
accuuucugcuaggauuggcuucccgcagagggcagggcccauccuaagcagcuuccaaguccc

SEQ ID NO: 123570 - RNA, 64 nt, hsa
ggcgggcuggcuugacucaggcccugugagauagagggcccagcccagccccacccacagaucc

SEQ ID NO: 123571 - RNA, 64 nt, hsa
gaugggcuugagggggcucagagcauaaggcuucagggcccaaguugggagaagugaccaaagu

SEQ ID NO: 123572 - RNA, 64 nt, hsa
aagcugcccuuuggguaggugcugggcuccugggagggcccagaugauggggugaggcaugucu

SEQ ID NO: 123573 - RNA, 64 nt, hsa
gaauaaacuguuuucuccaccaggcuuugacaaaagggcccacaggaaucuuaccaaugccaac

SEQ ID NO: 123574 - RNA, 64 nt, hsa
uaaagaaagauugugcacuuuaaccucucucaucagggcccaagggcuggcugggauuuuuuuu

SEQ ID NO: 123575 - RNA, 64 nt, hsa
ggcuccucccuuggcuuucccuuggcccacuuccagggcccaggugcugcaacuaaaugugaaa

SEQ ID NO: 123576 - RNA, 64 nt, hsa
aagggcugggucugccucagaaggcaccagcaccagggcccagguauuaaggcugagagugaag

SEQ ID NO: 123577 - RNA, 64 nt, hsa
ccggcgcuuugauugccugaguuucugacacuucagggcccagagguccugcgaggggcagaac

SEQ ID NO: 123578 - RNA, 64 nt, hsa
cagaacuggacccccaugccagugcugcugcaggagggcccauauacuagggucugcugagcug

SEQ ID NO: 123579 - RNA, 64 nt, hsa
gacuauuugcugugggcucuccuccagccugcccagggcccacccagaugccucugggguuacc

SEQ ID NO: 123580 - RNA, 64 nt, hsa
gacugugcacauuucacuaggguccaaauacagaagggcccagggcccaggggcuugcagcuuc

SEQ ID NO: 123581 - RNA, 64 nt, hsa
cacauuucacuaggguccaaauacagaagggcccagggcccaggggcuugcagcuucgugaggg

SEQ ID NO: 123582 - RNA, 64 nt, hsa
cugugcugcauacccaccgcccagcuucucccugagggcccaccagccugugcuguacaccccg

SEQ ID NO: 123583 - RNA, 64 nt, hsa
cugugcugcauacccaccgcccagcuucucccugagggcccaccagccugugcugcauacccac

SEQ ID NO: 123584 - RNA, 64 nt, hsa
gucuuggggccgaacagccccugcccugccucugagggcccaccagccugugcugcauacccac

SEQ ID NO: 123585 - RNA, 64 nt, hsa
ccacaugcucugagaagaggagcccucaucuugaagggcccaggagggucuauggggagaggaa

SEQ ID NO: 123586 - RNA, 64 nt, hsa
ccucuggggcucuaggguugcuggagccugagucagggcccagaggcugaguuuucucuuugug

SEQ ID NO: 123587 - RNA, 64 nt, hsa
aggcacggagggaaggucagaggagaaggcaggcagggcccagugagaggggagcaugccuucc

SEQ ID NO: 123588 - RNA, 64 nt, hsa
cuuggucacagggcgguucugggcacuugaacucagggcccaagcagaagcacaggcccagucc

SEQ ID NO: 123589 - RNA, 64 nt, hsa
uuguaggaaggucuggccuggggucgggugaaggagggcccaggucaguucuggggucccagug

SEQ ID NO: 123590 - RNA, 64 nt, hsa
ggcacgggggcaugggcagagagggccacggggcagggcccacugagggaacaucaguggcccu

SEQ ID NO: 123591 - RNA, 64 nt, hsa
ugagauccauccacgauccagcuccgguggagaaagggcccaugucaagccuuguucugcaccc

SEQ ID NO: 123592 - RNA, 64 nt, hsa
ugccuccugacagcuuccaaagagcugacuguggagggcccacaguguaucccaccccugcccg

SEQ ID NO: 123593 - RNA, 64 nt, hsa
aaagguggugggggguggauggcggcugugacucagggcccagggaucacaugggggucacugc

SEQ ID NO: 123594 - RNA, 64 nt, hsa
gcggcuuucugggucucagcccucucugcgguugagggcccagaggacagagagauggacaugc

SEQ ID NO: 123595 - RNA, 64 nt, hsa
gucuccaccccccuccccccgccccgcacuccuaagggcccaucugcccagccucugaguuuuc

SEQ ID NO: 123596 - RNA, 64 nt, hsa
ugcugagaagccaccgggaaagcagccagcacaaagggcccaggaagccagcccccgagagcug

SEQ ID NO: 123597 - RNA, 64 nt, hsa
ggaccggugcuggggccucuccuugcugugugugagggcccagguggaaggcgcggaccugaca

SEQ ID NO: 123598 - RNA, 64 nt, hsa
agaaccccagcccuguccagguggcuccgcgcccagggcccaggcuuagcagugcucccugccc

SEQ ID NO: 123599 - RNA, 64 nt, hsa
ucggcucccuguggcuugugcccaugcaccugccagggcccagcaggccaacccaucaucuaga

SEQ ID NO: 123600 - RNA, 64 nt, hsa
gcuuugcggcggugugagcuggcggucaggagugagggcccagccuucccggcaccucccagcc

SEQ ID NO: 123601 - RNA, 64 nt, hsa
agaaaaaacccauccuaaaggcugggcccaugcaagggcccaccugaauaaacagaaugagcug

SEQ ID NO: 123602 - RNA, 64 nt, hsa; identical to SEQ ID NO: 74086

SEQ ID NO: 123603 - RNA, 64 nt, hsa; identical to SEQ ID NO: 74087

SEQ ID NO: 123604 - RNA, 64 nt, hsa; identical to SEQ ID NO: 74088

SEQ ID NO: 123605 - RNA, 64 nt, hsa; identical to SEQ ID NO: 74089

SEQ ID NO: 123606 - RNA, 64 nt, hsa; identical to SEQ ID NO: 74090

SEQ ID NO: 123607 - RNA, 64 nt, hsa; identical to SEQ ID NO: 74091

SEQ ID NO: 123608 - RNA, 64 nt, hsa; identical to SEQ ID NO: 74092

SEQ ID NO: 123609 - RNA, 64 nt, hsa; identical to SEQ ID NO: 74093

SEQ ID NO: 123610 - RNA, 64 nt, hsa; identical to SEQ ID NO: 74094

SEQ ID NO: 123611 - RNA, 64 nt, hsa; identical to SEQ ID NO: 74095

SEQ ID NO: 123612 - RNA, 64 nt, hsa; identical to SEQ ID NO: 74096

SEQ ID NO: 123613 - RNA, 64 nt, hsa; identical to SEQ ID NO: 74097

SEQ ID NO: 123614 - RNA, 64 nt, hsa; identical to SEQ ID NO: 74098

SEQ ID NO: 123615 - RNA, 64 nt, hsa; identical to SEQ ID NO: 74099

SEQ ID NO: 123616 - RNA, 64 nt, hsa; identical to SEQ ID NO: 74100

SEQ ID NO: 123617 - RNA, 64 nt, hsa; identical to SEQ ID NO: 74101

SEQ ID NO: 123618 - RNA, 64 nt, hsa; identical to SEQ ID NO: 74102

SEQ ID NO: 123619 - RNA, 64 nt, hsa; identical to SEQ ID NO: 74103

SEQ ID NO: 123620 - RNA, 64 nt, hsa; identical to SEQ ID NO: 123549

SEQ ID NO: 123621 - RNA, 64 nt, hsa; identical to SEQ ID NO: 123550

SEQ ID NO: 123622 - RNA, 64 nt, hsa; identical to SEQ ID NO: 123551

SEQ ID NO: 123623 - RNA, 64 nt, hsa; identical to SEQ ID NO: 123552

SEQ ID NO: 123624 - RNA, 64 nt, hsa; identical to SEQ ID NO: 123553

SEQ ID NO: 123625 - RNA, 64 nt, hsa; identical to SEQ ID NO: 123554

SEQ ID NO: 123626 - RNA, 64 nt, hsa; identical to SEQ ID NO: 123555

SEQ ID NO: 123627 - RNA, 64 nt, hsa; identical to SEQ ID NO: 123556

SEQ ID NO: 123628 - RNA, 64 nt, hsa; identical to SEQ ID NO: 123557

SEQ ID NO: 123629 - RNA, 64 nt, hsa; identical to SEQ ID NO: 123558

SEQ ID NO: 123630 - RNA, 64 nt, hsa; identical to SEQ ID NO: 123559

SEQ ID NO: 123631 - RNA, 64 nt, hsa; identical to SEQ ID NO: 123560

SEQ ID NO: 123632 - RNA, 64 nt, hsa; identical to SEQ ID NO: 123561

SEQ ID NO: 123633 - RNA, 64 nt, hsa; identical to SEQ ID NO: 123562

SEQ ID NO: 123634 - RNA, 64 nt, hsa; identical to SEQ ID NO: 123563

SEQ ID NO: 123635 - RNA, 64 nt, hsa; identical to SEQ ID NO: 123564

SEQ ID NO: 123636 - RNA, 64 nt, hsa; identical to SEQ ID NO: 123565

SEQ ID NO: 123637 - RNA, 64 nt, hsa; identical to SEQ ID NO: 123566

SEQ ID NO: 123638 - RNA, 64 nt, hsa; identical to SEQ ID NO: 123567

SEQ ID NO: 123639 - RNA, 64 nt, hsa; identical to SEQ ID NO: 123568

SEQ ID NO: 123640 - RNA, 64 nt, hsa; identical to SEQ ID NO: 123569

SEQ ID NO: 123641 - RNA, 64 nt, hsa; identical to SEQ ID NO: 123570

SEQ ID NO: 123642 - RNA, 64 nt, hsa; identical to SEQ ID NO: 123571

SEQ ID NO: 123643 - RNA, 64 nt, hsa; identical to SEQ ID NO: 123572

SEQ ID NO: 123644 - RNA, 64 nt, hsa; identical to SEQ ID NO: 123573

SEQ ID NO: 123645 - RNA, 64 nt, hsa; identical to SEQ ID NO: 123574

SEQ ID NO: 123646 - RNA, 64 nt, hsa; identical to SEQ ID NO: 123575

SEQ ID NO: 123647 - RNA, 64 nt, hsa; identical to SEQ ID NO: 123576

SEQ ID NO: 123648 - RNA, 64 nt, hsa; identical to SEQ ID NO: 123577

SEQ ID NO: 123649 - RNA, 64 nt, hsa; identical to SEQ ID NO: 123578

SEQ ID NO: 123650 - RNA, 64 nt, hsa; identical to SEQ ID NO: 123579

SEQ ID NO: 123651 - RNA, 64 nt, hsa; identical to SEQ ID NO: 123580

SEQ ID NO: 123652 - RNA, 64 nt, hsa; identical to SEQ ID NO: 123581

SEQ ID NO: 123653 - RNA, 64 nt, hsa; identical to SEQ ID NO: 123582

SEQ ID NO: 123654 - RNA, 64 nt, hsa; identical to SEQ ID NO: 123583

SEQ ID NO: 123655 - RNA, 64 nt, hsa; identical to SEQ ID NO: 123584

SEQ ID NO: 123656 - RNA, 64 nt, hsa; identical to SEQ ID NO: 123585

SEQ ID NO: 123657 - RNA, 64 nt, hsa; identical to SEQ ID NO: 123586

SEQ ID NO: 123658 - RNA, 64 nt, hsa; identical to SEQ ID NO: 123587

SEQ ID NO: 123659 - RNA, 64 nt, hsa; identical to SEQ ID NO: 123588

SEQ ID NO: 123660 - RNA, 64 nt, hsa; identical to SEQ ID NO: 123589

SEQ ID NO: 123661 - RNA, 64 nt, hsa; identical to SEQ ID NO: 123590

SEQ ID NO: 123662 - RNA, 64 nt, hsa; identical to SEQ ID NO: 123591

SEQ ID NO: 123663 - RNA, 64 nt, hsa; identical to SEQ ID NO: 123592

SEQ ID NO: 123664 - RNA, 64 nt, hsa; identical to SEQ ID NO: 123593

SEQ ID NO: 123665 - RNA, 64 nt, hsa; identical to SEQ ID NO: 123594

SEQ ID NO: 123666 - RNA, 64 nt, hsa; identical to SEQ ID NO: 123595

SEQ ID NO: 123667 - RNA, 64 nt, hsa; identical to SEQ ID NO: 123596

SEQ ID NO: 123668 - RNA, 64 nt, hsa; identical to SEQ ID NO: 123597

SEQ ID NO: 123669 - RNA, 64 nt, hsa; identical to SEQ ID NO: 123598

SEQ ID NO: 123670 - RNA, 64 nt, hsa; identical to SEQ ID NO: 123599

SEQ ID NO: 123671 - RNA, 64 nt, hsa; identical to SEQ ID NO: 123600

SEQ ID NO: 123672 - RNA, 64 nt, hsa; identical to SEQ ID NO: 123601

SEQ ID NO: 123673 - RNA, 64 nt, hsa; identical to SEQ ID NO: 74086

SEQ ID NO: 123674 - RNA, 64 nt, hsa; identical to SEQ ID NO: 74087

SEQ ID NO: 123675 - RNA, 64 nt, hsa; identical to SEQ ID NO: 74088

SEQ ID NO: 123676 - RNA, 64 nt, hsa; identical to SEQ ID NO: 74089

SEQ ID NO: 123677 - RNA, 64 nt, hsa; identical to SEQ ID NO: 74090

SEQ ID NO: 123678 - RNA, 64 nt, hsa; identical to SEQ ID NO: 74091

SEQ ID NO: 123679 - RNA, 64 nt, hsa; identical to SEQ ID NO: 74092

SEQ ID NO: 123680 - RNA, 64 nt, hsa; identical to SEQ ID NO: 74093

SEQ ID NO: 123681 - RNA, 64 nt, hsa; identical to SEQ ID NO: 74094

SEQ ID NO: 123682 - RNA, 64 nt, hsa; identical to SEQ ID NO: 74095

SEQ ID NO: 123683 - RNA, 64 nt, hsa; identical to SEQ ID NO: 74096

SEQ ID NO: 123684 - RNA, 64 nt, hsa; identical to SEQ ID NO: 74097

SEQ ID NO: 123685 - RNA, 64 nt, hsa; identical to SEQ ID NO: 74098

SEQ ID NO: 123686 - RNA, 64 nt, hsa; identical to SEQ ID NO: 74099

SEQ ID NO: 123687 - RNA, 64 nt, hsa; identical to SEQ ID NO: 74100

SEQ ID NO: 123688 - RNA, 64 nt, hsa; identical to SEQ ID NO: 74101

SEQ ID NO: 123689 - RNA, 64 nt, hsa; identical to SEQ ID NO: 74102

SEQ ID NO: 123690 - RNA, 64 nt, hsa; identical to SEQ ID NO: 74103

SEQ ID NO: 123691 - RNA, 64 nt, hsa; identical to SEQ ID NO: 96836

SEQ ID NO: 123692 - RNA, 64 nt, hsa; identical to SEQ ID NO: 96837

SEQ ID NO: 123693 - RNA, 64 nt, hsa; identical to SEQ ID NO: 96838

SEQ ID NO: 123694 - RNA, 64 nt, hsa; identical to SEQ ID NO: 96839

SEQ ID NO: 123695 - RNA, 64 nt, hsa; identical to SEQ ID NO: 96840

SEQ ID NO: 123696 - RNA, 64 nt, hsa; identical to SEQ ID NO: 96841

SEQ ID NO: 123697 - RNA, 64 nt, hsa; identical to SEQ ID NO: 96842

SEQ ID NO: 123698 - RNA, 64 nt, hsa; identical to SEQ ID NO: 96843

SEQ ID NO: 123699 - RNA, 64 nt, hsa; identical to SEQ ID NO: 96844

SEQ ID NO: 123700 - RNA, 64 nt, hsa; identical to SEQ ID NO: 96845

SEQ ID NO: 123701 - RNA, 64 nt, hsa; identical to SEQ ID NO: 96846

SEQ ID NO: 123702 - RNA, 64 nt, hsa; identical to SEQ ID NO: 96847

SEQ ID NO: 123703 - RNA, 64 nt, hsa; identical to SEQ ID NO: 96848

SEQ ID NO: 123704 - RNA, 64 nt, hsa; identical to SEQ ID NO: 96849

SEQ ID NO: 123705 - RNA, 64 nt, hsa; identical to SEQ ID NO: 96850

SEQ ID NO: 123706 - RNA, 64 nt, hsa; identical to SEQ ID NO: 96851

SEQ ID NO: 123707 - RNA, 64 nt, hsa; identical to SEQ ID NO: 96852

SEQ ID NO: 123708 - RNA, 64 nt, hsa; identical to SEQ ID NO: 96853

SEQ ID NO: 123709 - RNA, 64 nt, hsa; identical to SEQ ID NO: 96854

SEQ ID NO: 123710 - RNA, 64 nt, hsa; identical to SEQ ID NO: 96855

SEQ ID NO: 123711 - RNA, 64 nt, hsa; identical to SEQ ID NO: 96856

SEQ ID NO: 123712 - RNA, 64 nt, hsa; identical to SEQ ID NO: 96857

SEQ ID NO: 123713 - RNA, 64 nt, hsa; identical to SEQ ID NO: 96858

SEQ ID NO: 123714 - RNA, 64 nt, hsa; identical to SEQ ID NO: 96859

SEQ ID NO: 123715 - RNA, 64 nt, hsa; identical to SEQ ID NO: 96860

SEQ ID NO: 123716 - RNA, 64 nt, hsa; identical to SEQ ID NO: 96861

SEQ ID NO: 123717 - RNA, 64 nt, hsa; identical to SEQ ID NO: 96862

SEQ ID NO: 123718 - RNA, 64 nt, hsa; identical to SEQ ID NO: 96863

SEQ ID NO: 123719 - RNA, 64 nt, hsa; identical to SEQ ID NO: 96864

SEQ ID NO: 123720 - RNA, 64 nt, hsa; identical to SEQ ID NO: 96865

SEQ ID NO: 123721 - RNA, 64 nt, hsa; identical to SEQ ID NO: 96866

SEQ ID NO: 123722 - RNA, 64 nt, hsa; identical to SEQ ID NO: 96867

SEQ ID NO: 123723 - RNA, 64 nt, hsa; identical to SEQ ID NO: 96868

SEQ ID NO: 123724 - RNA, 64 nt, hsa; identical to SEQ ID NO: 96869

SEQ ID NO: 123725 - RNA, 64 nt, hsa; identical to SEQ ID NO: 96870

SEQ ID NO: 123726 - RNA, 64 nt, hsa; identical to SEQ ID NO: 96871

SEQ ID NO: 123727 - RNA, 64 nt, hsa; identical to SEQ ID NO: 96872

SEQ ID NO: 123728 - RNA, 64 nt, hsa; identical to SEQ ID NO: 96873

SEQ ID NO: 123729 - RNA, 64 nt, hsa; identical to SEQ ID NO: 96874

SEQ ID NO: 123730 - RNA, 64 nt, hsa; identical to SEQ ID NO: 96875

SEQ ID NO: 123731 - RNA, 64 nt, hsa
ugaccgaaacuugauauuuuuuucuuucaugaguguccggcaucugcuggucuucauugugaaa

SEQ ID NO: 123732 - RNA, 64 nt, hsa
gcuuuuguggaaauugucagccucuacgggcagaguccggcauccccuccccagacugccugcu

SEQ ID NO: 123733 - RNA, 64 nt, hsa
caugacucugccuaaccaugggcucagggccagguccucacagcagucacaggcccaggaaggc

SEQ ID NO: 123734 - RNA, 64 nt, hsa
uggacuugaagguuugaugccaaagcagacauuuuccucacacccaccugcugcuguaugaaua

SEQ ID NO: 123735 - RNA, 64 nt, hsa
gcgcguggggccacugccguggcggcggcugcccuccucacacucggcuccgcgccgccuccgg

SEQ ID NO: 123736 - RNA, 64 nt, hsa
ggauugcugaggaaugcagggacgccuguuucuguccucacaccacagaaagaaaccugaggga

SEQ ID NO: 123737 - RNA, 64 nt, hsa
acauagaccuccccaaaaguuaacuggcucuccuuccucacacaguucaucauaacccaacccc

SEQ ID NO: 123738 - RNA, 64 nt, hsa
cugaauaccuguuuccauagugcccacaggguauuccucacauuuucuccauagaagaugcuuu

SEQ ID NO: 123739 - RNA, 64 nt, hsa
caaaugagaagaauguggcaaugccuuuaaucaguccucacaccuuucuacacauaagauaauu

SEQ ID NO: 123740 - RNA, 64 nt, hsa
caaauguaaaaaacguggcaaugccuuuaacugguccucacaccuugcuacauauaagacaguu

SEQ ID NO: 123741 - RNA, 64 nt, hsa
acuguggcugcaggugggacuuuguuguuuggauuccucacagccuuggcuccugagaaaggug

SEQ ID NO: 123742 - RNA, 64 nt, hsa
guuccccucacagucaaugcagugguauagcauauccucacauuucuagugcccuugagacugu

SEQ ID NO: 123743 - RNA, 64 nt, hsa
uagggaugcucaaaucuauauagauauaaaauuauccucacaguaacauagaaucucuuggugc

SEQ ID NO: 123744 - RNA, 64 nt, hsa
uucagcccccugcagcuaagaauuguauugacuguccucacagcggcuuuucauagcuuucagc

SEQ ID NO: 123745 - RNA, 64 nt, hsa
gaggagggaaggauggcuaagcugggaccggcaguccucacagggugccugugagaaaggacau

SEQ ID NO: 123746 - RNA, 64 nt, hsa
uucucuugaguacccuuggcuuccagccaugcuguccucacauacgguaaagccaaagagcugu

SEQ ID NO: 123747 - RNA, 64 nt, hsa
ugcugucuugacaucucuugccuuguccuccgguauguucuaaagcugugucugagaucuggau

SEQ ID NO: 123748 - RNA, 64 nt, hsa
acugguguuaaauguugucuacagugcaaaauccauguucuaacauauguaauaauugccagga

SEQ ID NO: 123749 - RNA, 64 nt, hsa
gcccagcuaguaaucccuuuuagugggaaaggauauguucuaggagaaacaagcaauuuaccuu

SEQ ID NO: 123750 - RNA, 64 nt, hsa
cuggucuccccugcuguuaguaacagucaccaaaauguucuaagcaacuacuuuccuagaguau

SEQ ID NO: 123751 - RNA, 64 nt, hsa
ugcuagugauuucauuaccaaguuacuugaaaaaauguucuauaugcauuuaauucugaaauca

SEQ ID NO: 123752 - RNA, 64 nt, hsa
ccacaaaauguugcaagucaugauggauggaaauauguucuaacagcaucugccucuauucaau

SEQ ID NO: 123753 - RNA, 64 nt, hsa
auugcagaaguaagacaaacauguauauuuuuaaauguucuaacauaagaccuguucucucuag

SEQ ID NO: 123754 - RNA, 64 nt, hsa
uucccugcgaagacuugagauuuagugucugugaauguucuaguuccuagguccagcaagucac

SEQ ID NO: 123755 - RNA, 64 nt, hsa
uuggucuuuuuuauuuuagguuguuuuauguugaauguucuauaucuuauuaguuaauuuguau

SEQ ID NO: 123756 - RNA, 64 nt, hsa
uucucagcuauucugagcuuauuuauuuauuuguauguucuaauggcuaaacauuuacauuaaa

SEQ ID NO: 123757 - RNA, 64 nt, hsa
gauauauguauaugcuaaaauauaacuugcaaagauguucuaaauacacaugcuauaaguucgc

SEQ ID NO: 123758 - RNA, 64 nt, hsa
aguagcaauacugcaccuggugaucacaaagauaauguucuacuucugauagaaauaauuucuc

SEQ ID NO: 123759 - RNA, 64 nt, hsa
gaaaugcuucagggauuccauaaacauuuaaacaauguucuaagguacauauacuuagaacauu

SEQ ID NO: 123760 - RNA, 64 nt, hsa
acagagaggaggaaaaaagaugaggauugcauacauguucuaaacccuuugucagauugcaguu

SEQ ID NO: 123761 - RNA, 64 nt, hsa
acaagagucauuuuuagaggauuuuaacagguucauguucuaugauguaaaaucaagacacaca

SEQ ID NO: 123762 - RNA, 64 nt, hsa
gaaaaugauaacucaucuuuucugauaauugccuauguucuagguaacaggaaaacaggcauua

SEQ ID NO: 123763 - RNA, 64 nt, hsa
uuauuugaauugagcaccucaagcaugcuuagcaauguucuaaucacuauggacagauguaaaa

SEQ ID NO: 123764 - RNA, 64 nt, hsa
gaguugguagauugcuguugaucuuuuaucaauaauguucuauagaaaagaaaaaaaaaauaua

SEQ ID NO: 123765 - RNA, 64 nt, hsa
auggagguucuaaggccuaggauucuaaaaugugauguucuaaggcucugagagucuagauucu

SEQ ID NO: 123766 - RNA, 64 nt, hsa
uuauaguucuaggcacuguaguucuaagacucaaauguucuaaguuucuaagauucuaaagguc

SEQ ID NO: 123767 - RNA, 64 nt, hsa
uugauucaaccuuaaaaauaaggucaucaguauuauguucuaaauaaacuuauggccauacaug

SEQ ID NO: 123768 - RNA, 64 nt, hsa
ggcuaccagaagccgagauagaagcauggaacauauguucuaguaagaagugucuggguuguuu

SEQ ID NO: 123769 - RNA, 64 nt, hsa
auguuuucuuucguaauuuuauguguauuguaaaauguucuaccguacuuuaguaguuugaagu

SEQ ID NO: 123770 - RNA, 64 nt, hsa
caaugagauauacuaaacaaugagauucuauagaauguucuagaaugugcacaagcggguuucu

SEQ ID NO: 123771 - RNA, 64 nt, hsa
acaguagugauuaauagugucaugguagcuaaaggagaaaaaggggguuucguuuacacgcugu

SEQ ID NO: 123772 - RNA, 64 nt, hsa
ggggguuuuguuuacaaacuucuuuuuguauugagagaaaaauagccaaagcaucuuugacaga

SEQ ID NO: 123773 - RNA, 64 nt, hsa
auucccuuuuaacuuaaaaaaauuguaaaugugggagaaaaaacccugcaggauggaaacaauu

SEQ ID NO: 123774 - RNA, 64 nt, hsa
aguauaccuaugugugcagcaguaaaaaauuagugagaaaaagcaacuuuuugucacucuuagg

SEQ ID NO: 123775 - RNA, 64 nt, hsa
auaccaaauacaagauuuuaaaagcaaccauggggagaaaaagaucagugaaagcaagacaguc

SEQ ID NO: 123776 - RNA, 64 nt, hsa
cagcaacaauguacccaaaagaggguagaauucugagaaaaacuauuagcuuagaauuugcaac

SEQ ID NO: 123777 - RNA, 64 nt, hsa
caaaccaugccuuuuuuuuaaggagcaaaaaucugagaaaaaaagugagagaccucugccuaca

SEQ ID NO: 123778 - RNA, 64 nt, hsa
uucaagguggcagcuguuagggcugaaucuucuggagaaaaaggugccaucucaggagaauagc

SEQ ID NO: 123779 - RNA, 64 nt, hsa
gcuggggccccuauaacaaaagacagauugacaagagaaaaacaaacauaaauuuauuagcggg

SEQ ID NO: 123780 - RNA, 64 nt, hsa
uacgcgacaguuauuuuuacaguaagguauuuucgagaaaaaugcauuacguguuuuggaaaau

SEQ ID NO: 123781 - RNA, 64 nt, hsa
cagaagcugcaaaagggaucuucgaaacugggcagagaaaaaauaaaguggaauauuaaguaaa

SEQ ID NO: 123782 - RNA, 64 nt, hsa
uaugaauuugucacauguaucacccccaaaaaaagagaaaaagaaaaauagaagacauauaaau

SEQ ID NO: 123783 - RNA, 64 nt, hsa
acauuaugggauugcaaccagcaaaacauaaacugagaaaaaguucuauagggcaaaucaccug

SEQ ID NO: 123784 - RNA, 64 nt, hsa
caugugaugaagacaaauauguauaccuggcauagagaaaaauauauaccugguacauuggaga

SEQ ID NO: 123785 - RNA, 64 nt, hsa
cuggcauagagaaaaauauauaccugguacauuggagaaaaauaauuacacuuucaaagagaau

SEQ ID NO: 123786 - RNA, 64 nt, hsa
ggcaguguaacaaccuauagugccauugauccaugagaaaaagauuuucugguacuacuccaaa

SEQ ID NO: 123787 - RNA, 64 nt, hsa
acuuuuaauuuuuauuuuggcaaaacugucaaaugagaaaaaugauuuuaaaaacuuuuuuuuc

SEQ ID NO: 123788 - RNA, 64 nt, hsa
ucuguuucgaauauagccacagaaauaaaggauggagaaaaaucugggacagguaauuuugcaa

SEQ ID NO: 123789 - RNA, 64 nt, hsa
ucuguuucgaacauagccacagaaauaaaggauggagaaaaaucugggacagguaauuuugcaa

SEQ ID NO: 123790 - RNA, 64 nt, hsa
ucuguuuugaguauagccagagaaaacaaggauggagaaaaaucuaggacagguaauuuugaaa

SEQ ID NO: 123791 - RNA, 64 nt, hsa
agugaugagaaggauucuuuuucgaauauaaccagagaaaaaaaggauggagaaauaucuagga

SEQ ID NO: 123792 - RNA, 64 nt, hsa
ucuguuuuggguauagccagagaaaacaaggauggagaaaaaucuaggacagguaauuuugaaa

SEQ ID NO: 123793 - RNA, 64 nt, hsa
uccaguuccguucugagagaaaaagagagagagagagaaaaagaccaugcugcauacauucugu

SEQ ID NO: 123794 - RNA, 64 nt, hsa
agcaaacauguugcuguuuccaguuccguucugagagaaaaagagagagagagagaaaaagacc

SEQ ID NO: 123795 - RNA, 64 nt, hsa
aaggcaaagcuuuuguggagucaggggggagacugagaaaaaaugaauuaacccuguguuguca

SEQ ID NO: 123796 - RNA, 64 nt, hsa
cuaggcacuuuuguccagagccugcugucccauggagaaaaaguuuuaagcacugaaaaaauuu

SEQ ID NO: 123797 - RNA, 64 nt, hsa
aguacuugccacaaaaucaauaaaagauguuuuugagaaaaaaaggaagaaaccaacucauuca

SEQ ID NO: 123798 - RNA, 64 nt, hsa
augcagagauuaagagcauauagaccaccuaguggagaaaaauggaguaaaggagauaaguaag

SEQ ID NO: 123799 - RNA, 64 nt, hsa
aaagagacugguagcucaucauccuaccauaaaagagaaaaaaauucggaaagugaucagagca

SEQ ID NO: 123800 - RNA, 64 nt, hsa
gauugaugacaagcaaguuacucaggaaucaaaagagaaaaaaguuucugaaaacaaugaaacc

SEQ ID NO: 123801 - RNA, 64 nt, hsa
aaguuccguuauauacuguggccugaaauaauuugagaaaaaagguuacuuuguuauucagcuu

SEQ ID NO: 123802 - RNA, 64 nt, hsa
ggucaguuugauuggauacuuaaguuuuagaaaugagaaaaauacagaguuuuagaaaugagau

SEQ ID NO: 123803 - RNA, 64 nt, hsa
gagcaagaaaagagaaaauauuaaaacgaggagagagaaaaauaauauuaacacaaaaaaaugc

SEQ ID NO: 123804 - RNA, 64 nt, hsa
augagcaaacaaaaaaaucgaaagacaaacgggagagaaaaagaggaagggaacuuauuucuua

SEQ ID NO: 123805 - RNA, 64 nt, hsa
uguuauguuuuuggcaugaacaaaagaaacaagagagaaaaaaaucaaaauaauuaaaauaaau

SEQ ID NO: 123806 - RNA, 64 nt, hsa
gcucuuugaauguaugucaaacucaguuacuccagagaaaaaacugccuuucccuucaaagugc

SEQ ID NO: 123807 - RNA, 64 nt, hsa
agaagcacuccucgguacucccauaauccucucggagaaaaaaaucacaaggcaacugugaguc

SEQ ID NO: 123808 - RNA, 64 nt, hsa
gugcacuguauauagaagucuaaaacacaccuaagagaaaaagaucgaauuuuucagaugauuc

SEQ ID NO: 123809 - RNA, 51 nt, hsa
auaacauccauaguguuuagagagaaaaaaauaaaccaauaaccuaccuac

SEQ ID NO: 123810 - RNA, 64 nt, hsa
cuacuucuaggauugcaaaggagucuuccaacuagagaaaaauuguccacugacauuugggauu

SEQ ID NO: 123811 - RNA, 64 nt, hsa
gucaucauuguagaaaagcaagaaaaugcagauagagaaaaagaagaaaauaaaacuggaguau

SEQ ID NO: 123812 - RNA, 64 nt, hsa
agaaaaaguuuucuaaccccugcucuagguuacggagaaaaaaaaaauggaauaauguucucug

SEQ ID NO: 123813 - RNA, 64 nt, hsa
agcacuagagagggagggggaagagcagaaguuagagaaaaaaagccaccggaggaaaggaaaa

SEQ ID NO: 123814 - RNA, 64 nt, hsa
uuccuuccuccaaagaauuaauaggcaacagugggagaaaaaaaaggcauaauggcaaauccuu

SEQ ID NO: 123815 - RNA, 64 nt, hsa
ucaauccuaacuagaaauacuaaaaauggcuuuugagaaaaauacuuccucugcuuguauuuug

SEQ ID NO: 123816 - RNA, 64 nt, hsa
ucacuguuaaagccauugacuccuuuaguacacugagaaaaaucuuauaguaaaacuagccuuu

SEQ ID NO: 123817 - RNA, 64 nt, hsa
caacaugacaagcugugaguuuguguguuuguaagagaaaaauguguggguacuugcuaauaaa

SEQ ID NO: 123818 - RNA, 64 nt, hsa
ucaguuaagaaaucuacuuuaacaaaacaaaaaggagaaaaaguaauaaugugauggcaaucuu

SEQ ID NO: 123819 - RNA, 64 nt, hsa
uuuuucucucacuauaguauaagaaucuauuuuggagaaaaaaagaaaauaugagggucucgaa

SEQ ID NO: 123820 - RNA, 64 nt, hsa
aacaaaagcaaaaaaaaaaagcaaaaaaagaaaagagaaaaaaagaaaaaaugcaaauggaaua

SEQ ID NO: 123821 - RNA, 64 nt, hsa
gcaaagcucacugaacauaaguuaauucauacuggagaaaaacccuacaaauguaaagaaugug

SEQ ID NO: 123822 - RNA, 64 nt, hsa
ucaacucuuauuacacauaagauaauucacaguggagaaaaacccuacaaaugugaagaaugug

SEQ ID NO: 123823 - RNA, 64 nt, hsa
guuuuccuuauugcacaggaaagcauuuauacuugagaaaaauuguauaaagaauggaaaaguc

SEQ ID NO: 123824 - RNA, 64 nt, hsa
guaucauagaucuuauuguacacauuuuguaccagagaaaaacccugaagcaguuguucaaacu

SEQ ID NO: 123825 - RNA, 64 nt, hsa
ucaaacuuuguucaauaccaggaaauuuauauuggagaaaaacccuaugaguguaaugaauuug

SEQ ID NO: 123826 - RNA, 64 nt, hsa
ucacgcuugauuguagguaagauaauuuauauuggagaaaaauccuccaaguaugaagaaugug

SEQ ID NO: 123827 - RNA, 64 nt, hsa
ucacaccuuauugcacaggaaagcauuuauacuugagaaaaauuguauaaagaauauggaaaag

SEQ ID NO: 123828 - RNA, 64 nt, hsa
ucaaacuuuguucgacaucagggaauuuguauuggagaaaaacccugcaaauguaauaaauaug

SEQ ID NO: 123829 - RNA, 64 nt, hsa
acauguucagacuaacauucuuuugcaguauagugagaaaaaaacauuuuaaaauuaauuauca

SEQ ID NO: 123830 - RNA, 64 nt, hsa
auuugggcuuauuuagaaaaaaggguaagcuagagagaaaaagaaagaacuguccgucccccuu

SEQ ID NO: 123831 - RNA, 52 nt, hsa
ugugguucuccuccaguugauagagaaaaacaacccagcgaaggcgccuucu

SEQ ID NO: 123832 - RNA, 64 nt, hsa
cuuucucccagcuuugccgccugugcugccauuagagaaaaaaagaagcauaaucgugggcauc

SEQ ID NO: 123833 - RNA, 64 nt, hsa
caaauuauugcuucaaccaucagucauaacucuagagaaaaacuucaucuucaucucggaauuc

SEQ ID NO: 123834 - RNA, 64 nt, hsa
gcagcuuaaugugauauaugacuaucuugaacaagagaaaaaacuaggagauguuucuccugaa

SEQ ID NO: 123835 - RNA, 64 nt, hsa
guaaaagaugaaguuuuauacacacagcaaaaaggagaaaaaauucuaguauauuuuaagagau

SEQ ID NO: 123836 - RNA, 64 nt, hsa
guucauaaggaggugagaaguaauuuuuuuaaaggagaaaaauuuuuuggcuuuagauuuaaag

SEQ ID NO: 123837 - RNA, 64 nt, hsa
cuguugaauguuucuaaaaaugccuuuuuaaggagagaaaaaaaaaucaaagggcagucucaau

SEQ ID NO: 123838 - RNA, 64 nt, hsa
ucuugccuuauccaggaauaauugccccuuugcagagaaaaaaaaaaacuuaaaaaaagcacau

SEQ ID NO: 123839 - RNA, 64 nt, hsa
ugcuagcuaggcaguaauaaacucuguuacagaagagaaaaagggccgggcacaguggcuuauu

SEQ ID NO: 123840 - RNA, 64 nt, hsa
uuccagaaguuaaucauuugaauucugaacacuggagaaaaaccgaaaaauggacggggcauga

SEQ ID NO: 123841 - RNA, 64 nt, hsa
aagauugcuauauuuuggguuauuuucuugacaggagaaaaagaucuaaagaucuuuuauuuuc

SEQ ID NO: 123842 - RNA, 64 nt, hsa
aaauugaaaucagaagaacaaaaaagaagagcaagagaaaaagcaaauuugguaaguugugugu

SEQ ID NO: 123843 - RNA, 64 nt, hsa
uucacuugaugaaaacuccuccaaaagguccuucgagaaaaaauuuauuuacagcucuuaaugc

SEQ ID NO: 123844 - RNA, 64 nt, hsa
caaaagaaaaugcacucuaacuuaugugaacugagagaaaaaaaucagguuuuaaacaggaaaa

SEQ ID NO: 123845 - RNA, 64 nt, hsa
aauaaaacuguucucagacauuaagcuaaacuaagagaaaaauaacuuuguugccaaaagguug

SEQ ID NO: 123846 - RNA, 64 nt, hsa
aaaauaauugagaaaaauaaauaacaagauaauugagaaaaaaauaaaauaaauucccaauucc

SEQ ID NO: 123847 - RNA, 64 nt, hsa
gccaaacuugagccaaucugagagcaaaauaauugagaaaaauaaauaacaagauaauugagaa

SEQ ID NO: 123848 - RNA, 64 nt, hsa
uuuuccuucugaagucugagcccauuucuggggggagaaaaaaaaagcaaaucagaaaacccac

SEQ ID NO: 123849 - RNA, 64 nt, hsa
gcccaguaaaauuucaggauuaacuaaagaagaggagaaaaagaagaaaagauucuucuuaaaa

SEQ ID NO: 123850 - RNA, 64 nt, hsa
aucuauucuacaugaggaggcugagaaaggggaagagaaaaacaaaccaaauggaugauguuag

SEQ ID NO: 123851 - RNA, 64 nt, hsa
aggaaacacgaaagaaaagucaggaagguagagagagaaaaagggagggaaggagaaagaaugg

SEQ ID NO: 123852 - RNA, 64 nt, hsa
aaacaaguccccaagaaaaaauucacucuauguagagaaaaaauauuuucucucauguuaguac

SEQ ID NO: 123853 - RNA, 64 nt, hsa
uggucagucacaaauucuuuuuuagccuucccuggagaaaaacaaguccccaagaaaaaauuca

SEQ ID NO: 123854 - RNA, 64 nt, hsa
agauuacccaaaaacugucuuuaaaagagagagagagaaaaaaaaaauaguauuugcauaaccc

SEQ ID NO: 123855 - RNA, 64 nt, hsa
caguuuauuuuuaaagauagauccuuuuauaggugagaaaaaaacaaucuggaagaaaaaaacc

SEQ ID NO: 123856 - RNA, 64 nt, hsa
uugaaaagauuaggaaucuacgcauacacugagagagaaaaaagugagaggaagacuauaaaaa

SEQ ID NO: 123857 - RNA, 64 nt, hsa
cauauccagguuagcugguaagaggauuuuuuuggagaaaaaaaugauauuuagaaaguuaauu

SEQ ID NO: 123858 - RNA, 64 nt, hsa
aggaagaaaauguagauuagaaaauaagacuucugagaaaaaguucaaggaauaaagauuguuu

SEQ ID NO: 123859 - RNA, 64 nt, hsa
gugaucacuaaaaugaggccaagguuuaggaggugagaaaaaguaucccuuuuacggauucagu

SEQ ID NO: 123860 - RNA, 64 nt, hsa
uuaucucaaaaaaaaaaaaaaaaagagagagagagagaaaaagaaaugcuguguuuaaucuucu

SEQ ID NO: 123861 - RNA, 64 nt, hsa
aaagggaaccugcaauaaucuugaaaaagaaaaagagaaaaauuuuaaaauccugcuauaggag

SEQ ID NO: 123862 - RNA, 64 nt, hsa
agaaaaagagaaaaauuuuaaaauccugcuauaggagaaaaaaagagaaaaaaauaaaaaucaa

SEQ ID NO: 123863 - RNA, 64 nt, hsa
aaaaauuuuaaaauccugcuauaggagaaaaaaagagaaaaaaauaaaaaucaaaaaaaaaaaa

SEQ ID NO: 123864 - RNA, 64 nt, hsa
ucugcacucugcugcuuugaaaucugguugaaaugagaaaaagcauuuucuguuuucccaccag

SEQ ID NO: 123865 - RNA, 64 nt, hsa
aaguguggucuuuuucuuuccuccuaauguugaagagaaaaaaaaaaaaaaaaguuugcccaga

SEQ ID NO: 123866 - RNA, 64 nt, hsa
ccauguuuagggaugugccucaguugggagcaaggagaaaaaugggaagaaccaguuuuaucca

SEQ ID NO: 123867 - RNA, 64 nt, hsa
aaauaaaauccauucucacggcaggcaaaucagugagaaaaauguaaagaucuggaggauuuac

SEQ ID NO: 123868 - RNA, 64 nt, hsa
gagccgacggaggaggaggagccuuccaaacagagagaaaaaaaugaggccgaaaauuuagagg

SEQ ID NO: 123869 - RNA, 64 nt, hsa
acgcuacacuguccuggcagaaaacaaaagugacgagaaaaaaaguaggucccacugcgucugu

SEQ ID NO: 123870 - RNA, 64 nt, hsa
aaguaauauggcccacacuuuauucaccacccuggagaaaaaaaaacccaggaauauguggaaa

SEQ ID NO: 123871 - RNA, 64 nt, hsa
acaaugcaauacuuacauuuuaauacucuuguaggagaaaaagcaacuguauaaaugaauguag

SEQ ID NO: 123872 - RNA, 64 nt, hsa
aacuuucaggauguauuuuaaaugagcugcaagagagaaaaaucugacaggagaugggauuuua

SEQ ID NO: 123873 - RNA, 64 nt, hsa
ucagcaguuugugccuccuacacagucaaagaaagagaaaaaagauaaaguagaaaaagaaaaa

SEQ ID NO: 123874 - RNA, 64 nt, hsa
uuccuacucuaauucaacuaaaguuauaaauaaagagaaaaacucauucagaaaucauggauuu

SEQ ID NO: 123875 - RNA, 64 nt, hsa
ugugcuuaccacacugccacauuuuaaugagucagagaaaaauuaauuuuucuucaauacaaua

SEQ ID NO: 123876 - RNA, 64 nt, hsa
agguuugaacagugggagauaccagaggugggaggagaaaaaguuauuuauuaccguucccuuc

SEQ ID NO: 123877 - RNA, 64 nt, hsa
agcacugauaaacagaauacuuuuaaaacaccuugagaaaaaaagauaauacauacacaugaac

SEQ ID NO: 123878 - RNA, 64 nt, hsa
aguaagaauaaaaacuaccaaagugauauacagagagaaaaaaagacuuagagaagaggaagag

SEQ ID NO: 123879 - RNA, 64 nt, hsa
ugcaaagaagcaauaaaauaugacuuauaaccaggagaaaaaucaguagaaacccagaaaagac

SEQ ID NO: 123880 - RNA, 64 nt, hsa
ccaaaauagcugcccuuaaagaguuguuagcagagagaaaaauaacagugaaugugcuccuggu

SEQ ID NO: 123881 - RNA, 64 nt, hsa
caaaccaaagaaacaaugaucuacucaaacauuggagaaaaaaacugccagaggaggaguugcc

SEQ ID NO: 123882 - RNA, 64 nt, hsa
uaugagaauaucaguugguauaaagagagagaaagagaaaaacauuucagcccuuagaugaggu

SEQ ID NO: 123883 - RNA, 64 nt, hsa
uuacuuucaaugugaggaaugaaugauaaauuaagagaaaaaaauaucaggaaggucaauauau

SEQ ID NO: 123884 - RNA, 64 nt, hsa
gcaucuuuuuaaaacaaggaaaagggaaaaaaaggagaaaaaacgaugcaucaagcuuguuugu

SEQ ID NO: 123885 - RNA, 64 nt, hsa
aauagagauugauaagauuuagcaacugguguuggagaaaaaaagaaaagcaaaugaguguuuu

SEQ ID NO: 123886 - RNA, 64 nt, hsa
cccacaaggggagaaaaaguaggggaagcggauggagaaaaacccaaagccacuaguauuagaa

SEQ ID NO: 123887 - RNA, 64 nt, hsa
uauuuaaacaucaucucacccacccccacaaggggagaaaaaguaggggaagcggauggagaaa

SEQ ID NO: 123888 - RNA, 64 nt, hsa
ucuguaguuuagaguguaagaaguaauggguacagagaaaaaaaauuuaagaccaauauuuuaa

SEQ ID NO: 123889 - RNA, 64 nt, hsa
gaguuaauugcaaugugauaguggguagaaaggagagaaaaacccacugaaggguucaaauaca

SEQ ID NO: 123890 - RNA, 64 nt, hsa
caacagcaaacuucagccguuucacuuuuuguuggagaaaaauaguagauuuuaauuugacuca

SEQ ID NO: 123891 - RNA, 64 nt, hsa
aucagauuguuuucacaguuaugauucccagugggagaaaaaugccucaauauauuuguaaccu

SEQ ID NO: 123892 - RNA, 64 nt, hsa
uguacaggagaaaaaggguuguuugacaaccuuugagaaaaagaaacaaaaggaaguaguuaaa

SEQ ID NO: 123893 - RNA, 64 nt, hsa
aaaacacauuuguauguuaaguccuauuguacaggagaaaaaggguuguuugacaaccuuugag

SEQ ID NO: 123894 - RNA, 64 nt, hsa
cgugagccagucauccauacacuaaggccuaguugagaaaaaccuuugauucaggauggcuggg

SEQ ID NO: 123895 - RNA, 64 nt, hsa
ggggcaaggcagaggacagguuuucucagguuaagagaaaaacgaaauuuuaaaaacuuuaaaa

SEQ ID NO: 123896 - RNA, 64 nt, hsa
cguagaaaaccauaacaucggccaucuuggaaaagagaaaaacaauggaguuacuuauuuaaaa

SEQ ID NO: 123897 - RNA, 64 nt, hsa
uucaacugugaauguagaagugggggggaggggggagaaaaagaaaacucuggcguuagaggau

SEQ ID NO: 123898 - RNA, 64 nt, hsa
gucugccccagaaacucucacacuuccagacccugagaaaaaagccacccugaauuuacccggc

SEQ ID NO: 123899 - RNA, 64 nt, hsa
guuguuguuguuuuuuuuuaagaaucuucugauagagaaaaagacugcuuugucacucaaacau

SEQ ID NO: 123900 - RNA, 64 nt, hsa
ccuuuuugucucaaucuuccaauacagguauauugagaaaaaaagcagucuaauaaaauccuag

SEQ ID NO: 123901 - RNA, 64 nt, hsa
gacuuggaaaguuggagaagaggcauuccuacuggagaaaaaugucaguguuuuccuauaagcu

SEQ ID NO: 123902 - RNA, 64 nt, hsa
ucgcaccuucaaaugcauggaaggacucacacuggagaaaaacccuaugaauguaagcaguaug

SEQ ID NO: 123903 - RNA, 64 nt, hsa
gauguaugagaauuacaagucacauuaguaagaagagaaaaauuuuggucauguuuaugauuug

SEQ ID NO: 123904 - RNA, 64 nt, hsa
ugagggcaacaggagauguggggacguguuaggagagaaaaaaaaaaaaacaaaaauauauaug

SEQ ID NO: 123905 - RNA, 64 nt, hsa
ucaaccaacacaagaucaaaaaggaaaaggacgagagaaaaauuauuuuuaagauaauuaaaca

SEQ ID NO: 123906 - RNA, 64 nt, hsa
ucaaaccuuacuaaacauaagauaacucauacuggagaaaaaucuuacaaaugugaagaaugug

SEQ ID NO: 123907 - RNA, 64 nt, hsa
auacaccuuauugcacagaaaaucauuuauauuugagaaaaauuguagaaauauagacugugaa

SEQ ID NO: 123908 - RNA, 64 nt, hsa
aaugggagcuucuaaugaggacaaacaaaaaauagagaaaaauuaauaaagucaaaauguuuau

SEQ ID NO: 123909 - RNA, 64 nt, hsa
aaaacauuaaugauacaugaaucuuggccacaaugagaaaaauaaaaaugaaaaaagagcaggc

SEQ ID NO: 123910 - RNA, 64 nt, hsa
uuaaacuuuguucaacaucagggaauucagauuggagaaaaacccugcaaauguaauaaauuug

SEQ ID NO: 123911 - RNA, 64 nt, hsa
cucacaccuuauugccaggaaagcauuuauacuugagaaaaauuguaccaauauaaagacugug

SEQ ID NO: 123912 - RNA, 64 nt, hsa
aguuauauggauagauuacaauauauaauauugagagaaaaaauuaaaaugcacaaaggaacac

SEQ ID NO: 123913 - RNA, 64 nt, hsa
ugaauggcuuauuuaauaaauggaagguucauaggagaaaaauuuuagcuuucuacuuuauauc

SEQ ID NO: 123914 - RNA, 64 nt, hsa
aguauguuuuucuguguguauguuuagagcaacagagaaaaaaagaugugggagaggacauaua

SEQ ID NO: 123915 - RNA, 64 nt, hsa
ucagagcuuucuauccaucugagagccaacacaggagaaaaaccauaggaaagugacauguagg

SEQ ID NO: 123916 - RNA, 64 nt, hsa
acagcagcaagacacgcacagucaaccauuuuccgagaaaaaaagaaaauuccccacuuggaaa

SEQ ID NO: 123917 - RNA, 64 nt, hsa
cugagggccacugcagaugacucuccuuugaaaugagaaaaagaaaagaaagcaagaacagaaa

SEQ ID NO: 123918 - RNA, 64 nt, hsa
cugucacaaacuuaagaggaaauaaggaaaaggagagaaaaaagaaauugguuaugaauaaaag

SEQ ID NO: 123919 - RNA, 64 nt, hsa
auguuucccuguauuugauaaaacacauaauuuugagaaaaauaaaguuuuaaauguaucuaug

SEQ ID NO: 123920 - RNA, 64 nt, hsa
agcggauaguguuuauggagaauggguuccuguggagaaaaauggugaagaaaacaaagaugau

SEQ ID NO: 123921 - RNA, 64 nt, hsa
ccccgguaacuggaggaaugggagccguuuugaugagaaaaaugggcuggagagaaggagaagg

SEQ ID NO: 123922 - RNA, 64 nt, hsa
augucugaagauguuaagauccccugauuacuuugagaaaaacaacuaaaacaagaaccguguu

SEQ ID NO: 123923 - RNA, 64 nt, hsa
cuuuuugcuucucuuuuagaaauacuuguggggagagaaaaaaggaugguuugggcauauuggu

SEQ ID NO: 123924 - RNA, 64 nt, hsa
aauuaugcuagagcaauuagacacccauggcgaggagaaaaaagaaccucuacuuaaaccucac

SEQ ID NO: 123925 - RNA, 64 nt, hsa
acauaaaacuagauaacuuugaaaaaagccacaggagaaaaaucuucaggaucuugggcuaggu

SEQ ID NO: 123926 - RNA, 64 nt, hsa
gcuaucuauaaaaaagagaaaaaagaaaaaaaaugagaaaaaaguaagaaaaaaaaaaauccug

SEQ ID NO: 123927 - RNA, 64 nt, hsa
uaugagaaaaaauauacuugcuaucuauaaaaaagagaaaaaagaaaaaaaaugagaaaaaagu

SEQ ID NO: 123928 - RNA, 64 nt, hsa
ggaaagaaguuauagaaucuucauagaguucuaugagaaaaaauauacuugcuaucuauaaaaa

SEQ ID NO: 123929 - RNA, 64 nt, hsa
uugaggacagugacugccauuuguauauaaaaaggagaaaaaugguaaguacauaauugugaau

SEQ ID NO: 123930 - RNA, 64 nt, hsa
ucuuuucaucucagucauaacccaaaagcuacgggagaaaaagcagaaguguaaucucuguauc

SEQ ID NO: 123931 - RNA, 64 nt, hsa
ugaacaacacuaacaugagaacacaagaacuuaagagaaaaagaaaccuacucaagaaaagaca

SEQ ID NO: 123932 - RNA, 64 nt, hsa
acccuccgagaaagaagaacguaagcacaggaaagagaaaaagaaaucuguugaagaaaggaca

SEQ ID NO: 123933 - RNA, 64 nt, hsa
uauauauaaaaaauaaaaagcuauuucuaguuuauuucacuauaaaguuuugcuuuauuaaaaa

SEQ ID NO: 123934 - RNA, 64 nt, hsa
aucacaguguauuaguauuuguuacauuuuuguauuucacuaucuuuauacuauauaauauggu

SEQ ID NO: 123935 - RNA, 64 nt, hsa
uuagagcaacauugucuuauuaaagcauaguuuauuucacuagaaaaaauuuaauaucaaggac

SEQ ID NO: 123936 - RNA, 64 nt, hsa
agaggccauauauauugccuccuuauccuugagauuucacuaccuuuauguuaaaaguugugua

SEQ ID NO: 123937 - RNA, 64 nt, hsa
gaccaguaggaaccaggcugggucaggcucuuaauuucacuauggugggggacaaaaugaacac

SEQ ID NO: 123938 - RNA, 57 nt, hsa
gaaaaaguucgaagaaaugaaaccauuuuucacuagcgacagccacuuuuuacucuc

SEQ ID NO: 123939 - RNA, 64 nt, hsa
gggguaugcaguuuacccaaguccaaauaaagcauuucacuagguuacacguuauguauaugug

SEQ ID NO: 123940 - RNA, 64 nt, hsa
guuaaggucugagugcaugugugcauuaaaaacauuucacuaccuauucucucauggacuucuc

SEQ ID NO: 123941 - RNA, 64 nt, hsa
ucucaagcuccuauuacuauuugugguuguauuauuucacuaaucauuaguuaagacugugcua

SEQ ID NO: 123942 - RNA, 64 nt, hsa
aaaaaguguaacacuaaggugaacuugcuucccuuuucacuaauuuugcuaaacuuuguaaugc

SEQ ID NO: 123943 - RNA, 64 nt, hsa
cuuuugauauuauacugaugaauauuuguagguguuucacuauaaggaacagcuaaggaauaau

SEQ ID NO: 123944 - RNA, 64 nt, hsa
cacaaauaaagugagaguaauguaauggagcucuuuucacuaggguauaaguagcugccaauuu

SEQ ID NO: 123945 - RNA, 64 nt, hsa
uaugagauggcugaaaaaauaccacaucgucuguuuucacuaggugaugccaaaauauuuugcu

SEQ ID NO: 123946 - RNA, 64 nt, hsa
ggcuaauuuuuuguauuuuuaguagagacggggguuucacuauguuggcuaggcuggucuugaa

SEQ ID NO: 123947 - RNA, 64 nt, hsa
acaaauacacacccccacaaaacuaaaaucaaaguuucacuacauaacacugggccuuacugca

SEQ ID NO: 123948 - RNA, 64 nt, hsa
ggaagaaaugcuagccuggaagcucggcauuugguuucacuaagggccaugugguucccugcag

SEQ ID NO: 123949 - RNA, 64 nt, hsa
acaugauauuugacuuuucauaaguaguggaagguuucacuaaguaaaacucucaguuucuugg

SEQ ID NO: 123950 - RNA, 64 nt, hsa
aaaugguauuugacuuuucauaaguaguggaagguuucacuaaguaaagaucugaguuucuugg

SEQ ID NO: 123951 - RNA, 64 nt, hsa
uuaguauuaggucgguacuaagaaauaagcauguuuucacuaauuuaaguacuugagacucuug

SEQ ID NO: 123952 - RNA, 64 nt, hsa
ucucauuauugagauucauccauauuguugaauguuucacuaguuaauguuuauuguucaauau

SEQ ID NO: 123953 - RNA, 64 nt, hsa
cuacaauuuuuucaggauuauuaaaaucuucuucuuucacuaucguagcuuaaacucuguuugg

SEQ ID NO: 123954 - RNA, 64 nt, hsa
gaaagagcaaggcuguuuuugaaaaucauuacacuuucacuagaagcccaaaccucagcauucu

SEQ ID NO: 123955 - RNA, 64 nt, hsa
uuaugacauuagcuuuaaagguguaaaaaagauguuucacuaauguaacggugaaagagaaucc

SEQ ID NO: 123956 - RNA, 64 nt, hsa
cgugauauagugagaaagauucuaccaaccacuguuucacuacuuuuuaguuaaaauuggguau

SEQ ID NO: 123957 - RNA, 64 nt, hsa
cucuccuccccgcugccccuaacugcagcucagcuuucacuauagcagugcuucccaaacgggu

SEQ ID NO: 123958 - RNA, 64 nt, hsa
acuuggguguuugauuugaagaguuacgcauuuauuucacuauuuauugggaaaaaaaugcauu

SEQ ID NO: 123959 - RNA, 64 nt, hsa; identical to SEQ ID NO: 85524

SEQ ID NO: 123960 - RNA, 64 nt, hsa; identical to SEQ ID NO: 85525

SEQ ID NO: 123961 - RNA, 64 nt, hsa; identical to SEQ ID NO: 85526

SEQ ID NO: 123962 - RNA, 64 nt, hsa; identical to SEQ ID NO: 85527

SEQ ID NO: 123963 - RNA, 64 nt, hsa; identical to SEQ ID NO: 85528

SEQ ID NO: 123964 - RNA, 64 nt, hsa; identical to SEQ ID NO: 85529

SEQ ID NO: 123965 - RNA, 64 nt, hsa; identical to SEQ ID NO: 85530

SEQ ID NO: 123966 - RNA, 64 nt, hsa; identical to SEQ ID NO: 85531

SEQ ID NO: 123967 - RNA, 64 nt, hsa; identical to SEQ ID NO: 85532

SEQ ID NO: 123968 - RNA, 64 nt, hsa; identical to SEQ ID NO: 85533

SEQ ID NO: 123969 - RNA, 64 nt, hsa; identical to SEQ ID NO: 85534

SEQ ID NO: 123970 - RNA, 64 nt, hsa; identical to SEQ ID NO: 85535

SEQ ID NO: 123971 - RNA, 55 nt, hsa; identical to SEQ ID NO: 85536

SEQ ID NO: 123972 - RNA, 64 nt, hsa; identical to SEQ ID NO: 85537

SEQ ID NO: 123973 - RNA, 64 nt, hsa; identical to SEQ ID NO: 85538

SEQ ID NO: 123974 - RNA, 64 nt, hsa; identical to SEQ ID NO: 85539

SEQ ID NO: 123975 - RNA, 64 nt, hsa; identical to SEQ ID NO: 85540

SEQ ID NO: 123976 - RNA, 64 nt, hsa; identical to SEQ ID NO: 85541

SEQ ID NO: 123977 - RNA, 64 nt, hsa; identical to SEQ ID NO: 85542

SEQ ID NO: 123978 - RNA, 64 nt, hsa; identical to SEQ ID NO: 85543

SEQ ID NO: 123979 - RNA, 64 nt, hsa; identical to SEQ ID NO: 85544

SEQ ID NO: 123980 - RNA, 64 nt, hsa; identical to SEQ ID NO: 85545

SEQ ID NO: 123981 - RNA, 64 nt, hsa; identical to SEQ ID NO: 85546

SEQ ID NO: 123982 - RNA, 64 nt, hsa; identical to SEQ ID NO: 85547

SEQ ID NO: 123983 - RNA, 64 nt, hsa; identical to SEQ ID NO: 85548

SEQ ID NO: 123984 - RNA, 64 nt, hsa; identical to SEQ ID NO: 85549

SEQ ID NO: 123985 - RNA, 64 nt, hsa; identical to SEQ ID NO: 85550

SEQ ID NO: 123986 - RNA, 64 nt, hsa; identical to SEQ ID NO: 85551

SEQ ID NO: 123987 - RNA, 64 nt, hsa; identical to SEQ ID NO: 85552

SEQ ID NO: 123988 - RNA, 64 nt, hsa; identical to SEQ ID NO: 85553

SEQ ID NO: 123989 - RNA, 64 nt, hsa; identical to SEQ ID NO: 85554

SEQ ID NO: 123990 - RNA, 64 nt, hsa; identical to SEQ ID NO: 85555

SEQ ID NO: 123991 - RNA, 64 nt, hsa; identical to SEQ ID NO: 85556

SEQ ID NO: 123992 - RNA, 64 nt, hsa; identical to SEQ ID NO: 85557

SEQ ID NO: 123993 - RNA, 64 nt, hsa; identical to SEQ ID NO: 85558

SEQ ID NO: 123994 - RNA, 64 nt, hsa; identical to SEQ ID NO: 85559

SEQ ID NO: 123995 - RNA, 64 nt, hsa; identical to SEQ ID NO: 85560

SEQ ID NO: 123996 - RNA, 64 nt, hsa; identical to SEQ ID NO: 85561

SEQ ID NO: 123997 - RNA, 64 nt, hsa; identical to SEQ ID NO: 85562

SEQ ID NO: 123998 - RNA, 64 nt, hsa; identical to SEQ ID NO: 85563

SEQ ID NO: 123999 - RNA, 62 nt, hsa; identical to SEQ ID NO: 85564

SEQ ID NO: 124000 - RNA, 57 nt, hsa; identical to SEQ ID NO: 85565

SEQ ID NO: 124001 - RNA, 64 nt, hsa; identical to SEQ ID NO: 85566

SEQ ID NO: 124002 - RNA, 64 nt, hsa; identical to SEQ ID NO: 85567

SEQ ID NO: 124003 - RNA, 64 nt, hsa; identical to SEQ ID NO: 85568

SEQ ID NO: 124004 - RNA, 64 nt, hsa; identical to SEQ ID NO: 85569

SEQ ID NO: 124005 - RNA, 64 nt, hsa; identical to SEQ ID NO: 85570

SEQ ID NO: 124006 - RNA, 64 nt, hsa; identical to SEQ ID NO: 85571

SEQ ID NO: 124007 - RNA, 64 nt, hsa
acaggagauuuuauuauaucuggagacccugagagacccugagaccuggggcacccuggcuggc

SEQ ID NO: 124008 - RNA, 64 nt, hsa
uguggccugaacaggagauuuuauuauaucuggagacccugagagacccugagaccuggggcac

SEQ ID NO: 124009 - RNA, 64 nt, hsa
ccugacucucggggggagaaggggcucccaacaugacccugaguccccuggauuuugcauucac

SEQ ID NO: 124010 - RNA, 64 nt, hsa
uccgagccugguagggaagggacccgcguggcgcgacccugaccgaucccaccucaacagcucc

SEQ ID NO: 124011 - RNA, 64 nt, hsa
aggaucuccagaaagccgccuguccuuccagcaugacccugagaccucuguguugguccugcgc

SEQ ID NO: 124012 - RNA, 64 nt, hsa
auucucuggcaacacccuugucuccagcucagcagacccugaaggacacuuugagacaccaauc

SEQ ID NO: 124013 - RNA, 64 nt, hsa
gggacugcugguuucucgcagccauugccugccugacccugaaccagcaccuucuuuuccgagu

SEQ ID NO: 124014 - RNA, 64 nt, hsa
ucaguaccgucugaagcuccuggaggaggacgaugacccugaugacucggaggugauuugcagc

SEQ ID NO: 124015 - RNA, 64 nt, hsa
agaccuugccuccccuccucuccugcccagcucugacccugaugcuuaauaaacgcagcgacgu

SEQ ID NO: 124016 - RNA, 64 nt, hsa
acgaacuggauccaaaaaaccauucaggccaagugacccugacaugugacaucuaccucccgac

SEQ ID NO: 124017 - RNA, 64 nt, hsa
cuuccuccuaaacugucagccccuuucaggcuuucuucccuauccacccucagcuuuaugggau

SEQ ID NO: 124018 - RNA, 64 nt, hsa
agagcauccugaucaauugcaaguacuuccacuucuucccuaaaugcgcuuuguguguuuucca

SEQ ID NO: 124019 - RNA, 64 nt, hsa
aaagccaguagcacauacgcagggcauugcagggcuucccuauugaugguucaagugcuuuucu

SEQ ID NO: 124020 - RNA, 64 nt, hsa
agauaagcuucauguacauuugucaccucucuuucuucccuauccugcccugcugucccaaucc

SEQ ID NO: 124021 - RNA, 64 nt, hsa
auccugagaaaacaucuggacuuaagaguuucugcuucccuacaaagaucuuuaaaguuauuuu

SEQ ID NO: 124022 - RNA, 64 nt, hsa
uaacugguaaauuucuacuuuaggugggcauuuucuucccuagaauaugcccuuuauuaugcua

SEQ ID NO: 124023 - RNA, 64 nt, hsa
auucuuugcuccaaugucaccuccucugagaggccuucccuaaccacccaaucauucuaaagca

SEQ ID NO: 124024 - RNA, 64 nt, hsa
gcuaggauuacaagugugagccacuaugccuggccuucccuaucuucuaccugaaccuucuucc

SEQ ID NO: 124025 - RNA, 64 nt, hsa
acagagugauacgcuguuuaaaaaggaaaaaauccuucccuagagcuaguauccuaaagcugca

SEQ ID NO: 124026 - RNA, 64 nt, hsa
ccugguucacuccuggcaguuucuucucaagcuccuucccuaggagcaugguggcacgugccug

SEQ ID NO: 124027 - RNA, 64 nt, hsa
uuauacuuuucucaguucuacuuaugacaccucacuucccuagagaaggccugccuccccauag

SEQ ID NO: 124028 - RNA, 64 nt, hsa
cucccaacccuguggugcuaggaccacuccccgccuucccuacggccuccucgcccugcacauu

SEQ ID NO: 124029 - RNA, 64 nt, hsa
uuuauaaugaaagaaaaaggcauuggagacugaaggcagaaaugguugugacagugcuguuugg

SEQ ID NO: 124030 - RNA, 64 nt, hsa
agaauguagaucaauaaguacuuuuuagugauguggcagaaaucccuguugauucuaaguuuua

SEQ ID NO: 124031 - RNA, 64 nt, hsa
gcuauuacugaauuauagaaacugguuuauuucuggcagaaagcugcagugccaccugaguucc

SEQ ID NO: 124032 - RNA, 64 nt, hsa
cccauucacuucucuagaaagcugccaagacagaggcagaaagaaauggaugauaguucuguca

SEQ ID NO: 124033 - RNA, 64 nt, hsa
uacugacaaaauacauggaagugaguuauaaugaggcagaaacaaaauccucgguaacauugau

SEQ ID NO: 124034 - RNA, 64 nt, hsa
auaccaucuggcggcugcacauuguaacaguaaaggcagaaagcuguagugauaaccucucucc

SEQ ID NO: 124035 - RNA, 64 nt, hsa
cuuagcagaugggaggaacugcugagagaagaugggcagaaagcuggagccccuggaguuggcu

SEQ ID NO: 124036 - RNA, 64 nt, hsa
uguuugugacugauuacuggcugugucuugggugggcagaaacucgaacuugcuauguaauuug

SEQ ID NO: 124037 - RNA, 64 nt, hsa
aggaugaaagacaaagaaggaaaagaguaucaaaggcagaaaggagaucauuuaguugggucug

SEQ ID NO: 124038 - RNA, 64 nt, hsa
aaagacagggaauagugggaucaaagcuaggaaaggcagaaacacaaccacucaccaguccuag

SEQ ID NO: 124039 - RNA, 64 nt, hsa
gaauguuugagguccagccuugguguagagaagcggcagaaacagaaaucccaaaaggugucau

SEQ ID NO: 124040 - RNA, 64 nt, hsa
aucauacucuugugagguuggauuuaaccacagaggcagaaaguuggucuacuuugcucguucc

SEQ ID NO: 124041 - RNA, 64 nt, hsa
ugcuggugaggccucaggacacuuacacaaucauggcagaaaaaggagaagcaggcaccuuuuu

SEQ ID NO: 124042 - RNA, 64 nt, hsa
uuuccuauuacugaggaaaaccuccauacacugaggcagaaacuugugucaguuggaggaaaau

SEQ ID NO: 124043 - RNA, 64 nt, hsa
cagccccgaggcugagaccagacaaagcccgggaggcagaaagaugcuccaagaaccaacacua

SEQ ID NO: 124044 - RNA, 64 nt, hsa
augacccaaucugccuuugaaucuggaggaaauaggcagaaacaaaaugacuguagaacuuauu

SEQ ID NO: 124045 - RNA, 64 nt, hsa
cccucccugucccuucgaguccaggacaacaacgggcagaaaucgagagugugcucuccccggc

SEQ ID NO: 124046 - RNA, 64 nt, hsa
aguugggagcuauccuuguuuaugccucacuauuggcagaaaagaccccauuuaaaacccagag

SEQ ID NO: 124047 - RNA, 64 nt, hsa
agagucucagggaaagagaaccacaauagaaaaaggcagaaaaggccgggcgcgguggcucaug

SEQ ID NO: 124048 - RNA, 64 nt, hsa
acaugccugugaucccagcuacucaggaagcugaggcagaaagaucccuugacccugagaggua

SEQ ID NO: 124049 - RNA, 64 nt, hsa
aguuugggguucugggucgguuccagcggcuuuaggcagaaagugcucgcucucacccagcaca

SEQ ID NO: 124050 - RNA, 64 nt, hsa
agguccuaucaaaggaggcugccggaacucaagaggcagaaaaagaccaguuaggcggugcaga

SEQ ID NO: 124051 - RNA, 64 nt, hsa
gcuggacucagcaggaacaccaaaucccggaccaggcagaaaccacccaagacugaggggcucg

SEQ ID NO: 124052 - RNA, 64 nt, hsa
agauuguuugaaaaaaaaaaaaggggagcagggaggcagaaaguccuggaaaaguaaauuguuu

SEQ ID NO: 124053 - RNA, 64 nt, hsa
cauuucacuaagcuccuccuuuacuuucucucuccucuuugaugucaaacgccuugaaaacaag

SEQ ID NO: 124054 - RNA, 64 nt, hsa
uucuccuuuaaauucuuuccuaccuugguccugccucuuugaguauauuaguagguuuuuuuua

SEQ ID NO: 124055 - RNA, 64 nt, hsa
acugggccuggaagaccaucccagccucugaguucucuuugaguaugagugauuacuuggauuu

SEQ ID NO: 124056 - RNA, 64 nt, hsa
gcugggucuggaagacuguuguggccucucaguucucuuugagucugacugacuguggccaguc

SEQ ID NO: 124057 - RNA, 64 nt, hsa
uuuuuuuguuauuauuuucuuagccagaacaucucucuuugaacucacacugauacacaccugc

SEQ ID NO: 124058 - RNA, 64 nt, hsa
ccuuucugcuuucuggagggcaccaggggccuuucucuuugauaaauuuuuuuugucuguugac

SEQ ID NO: 124059 - RNA, 64 nt, hsa
aguccugccuuuccuagcaugcacacaacauccucucuuugaguuuggguucuccccagccccu

SEQ ID NO: 124060 - RNA, 64 nt, hsa
gagaaccuuuuccacacaccuccuccuuccuguucucuuugaaccauucaucaccucugccuuc

SEQ ID NO: 124061 - RNA, 64 nt, hsa
aggcacuauuccuggugcaguauuucagggauuucucuuugagggguucuuuucugguagcuca

SEQ ID NO: 124062 - RNA, 64 nt, hsa
acauuguguaauauuuguaugagaaugacucaagcucuuugagaacauuccaaacuaguaacau

SEQ ID NO: 124063 - RNA, 64 nt, hsa
gaucugaacacaguuuagugcuuuacaugcugugcucuuugaagagauuucaacaagaauauug

SEQ ID NO: 124064 - RNA, 64 nt, hsa
ccaggagguuggugacugaaacauucacacagggcucuuugauggacccacgaacgcucuuagc

SEQ ID NO: 124065 - RNA, 64 nt, hsa
cagcccaaaaccagucauguucuuccaaaagcuucucuuugauagaauuuugaggccaugccac

SEQ ID NO: 124066 - RNA, 64 nt, hsa
cugauuuuauccuggagaauacagugcaauauuucucuuugauuauuuauuccucuugauugug

SEQ ID NO: 124067 - RNA, 64 nt, hsa
ggcucccaauagggagggggcugcccucuacagucucuuugacuguaagacagggcucuguauc

SEQ ID NO: 124068 - RNA, 64 nt, hsa
agggaagaauguuagguucaugguaacuaguaugcucuuugagauuuuuacaguguugaaacuu

SEQ ID NO: 124069 - RNA, 64 nt, hsa
uguguaagcuuucuccaugucagaagcaagccugcucuuugauaaaucugucuuccugaaaauc

SEQ ID NO: 124070 - RNA, 64 nt, hsa
agucucgacuuuuccuuuuuugaguccuguguggcucuuugaaucagcgugaaacugaggcucc

SEQ ID NO: 124071 - RNA, 64 nt, hsa
ggaacgcauccggcuccaagcacacugugcccugcucuuugagguuggagauuuacaguaugcc

SEQ ID NO: 124072 - RNA, 64 nt, hsa
uuuuuuauagguggagcaauacaauuugaauagucucuuugagaaguaugugcccuaucucaug

SEQ ID NO: 124073 - RNA, 64 nt, hsa
uaagaaaaaaacuggcuucauuucugugaaauugcucuuugaaaauuucuuuuuacacguguaa

SEQ ID NO: 124074 - RNA, 64 nt, hsa
aaguaguagcaagacaugcuuaguguguauuucucucuuugagacacuguaauuucuaccagaa

SEQ ID NO: 124075 - RNA, 64 nt, hsa
acucaguucugcauauacagugcaucagucuguucucuuugaccacaauuggaauacauuucaa

SEQ ID NO: 124076 - RNA, 64 nt, hsa
gauauuugguuggaaacuccguuccuacaaaacccucuuugaugcggcggagacgauggucagc

SEQ ID NO: 124077 - RNA, 64 nt, hsa
cugaucgccaaagcacgucaaaauucuccgcuaucucuuugacaacaccuggcuggacgcccug

SEQ ID NO: 124078 - RNA, 64 nt, hsa
gaacaguuucaguauugagauggcucaggagaggcucuuugauuuuuaaaguuuuggggugggg

SEQ ID NO: 124079 - RNA, 64 nt, hsa
cucugucucgcuugcucgcucucgcuguuucucucucuuugaggcauuuguuuggaaaaaaucg

SEQ ID NO: 124080 - RNA, 64 nt, hsa
uaccacacucaugggucacuggggcugcgcagggcucuuugagguggguggcuucuuuuggaaa

SEQ ID NO: 124081 - RNA, 64 nt, hsa
uguguccgucaucccagcccccgguuggagccugcucuuugaacuccgcugccuuccuuagcag

SEQ ID NO: 124082 - RNA, 64 nt, hsa
cagauaauuuuuaaguuuccuagugauucucaaucucuuugaauuuuacuuacauuuacacaca

SEQ ID NO: 124083 - RNA, 64 nt, hsa
cagauaauguauaaguuucccagugauucucaaccucuuugaauuuuacuuauaauuacauaca

SEQ ID NO: 124084 - RNA, 64 nt, hsa
cucuguagccaggcuggagugcaguggcauaaucucagcucacugcaaccucugcuucccgggu

SEQ ID NO: 124085 - RNA, 64 nt, hsa
cuugucgcccaggcuggaguguaguggcgcagucucagcucacugcaaccuccaccucccgggu

SEQ ID NO: 124086 - RNA, 64 nt, hsa
gauuugccuuuuguuguuuucucucuuuggugauucagcucagcucaugggccucaucccuucu

SEQ ID NO: 124087 - RNA, 64 nt, hsa
gccuuuuguuguuuucucucuuuggugauucagcucagcucaugggccucaucccuucucuccc

SEQ ID NO: 124088 - RNA, 64 nt, hsa
auucuuacuaugguuagaaagugaauuagaaauuucagcucaguuucuauuuuacuauucaagu

SEQ ID NO: 124089 - RNA, 64 nt, hsa
uaguaugaaagcuggaacauggccuuguucaaccucagcucagaauauguguacagcaaguuuu

SEQ ID NO: 124090 - RNA, 64 nt, hsa
ucuguugcccgggcuggaguacaauggcaugaucucagcucacugcaaccuccaccuccugggu

SEQ ID NO: 124091 - RNA, 64 nt, hsa
caccacagccagccaguaugaccuaucuuaaucaucagcucaacuguaauuuaaauuuggcugu

SEQ ID NO: 124092 - RNA, 64 nt, hsa
cgucagggcccagggugcugugaccgaugagaccucagcucagcccucaggugcaguggcccua

SEQ ID NO: 124093 - RNA, 64 nt, hsa
ccacagugcuggcugggccccaaugcaccgucccucagcucaggagggaugggccugaccugac

SEQ ID NO: 124094 - RNA, 64 nt, hsa
ucugucgcccuggcuggagugcaauggugugaucucagcucacugcacccuccgccucucgggu

SEQ ID NO: 124095 - RNA, 64 nt, hsa
uuagucacccagacuagaggucaguggcaggaucucagcucacugcaaccucugccuccugggc

SEQ ID NO: 124096 - RNA, 64 nt, hsa
gagcuccugccgcagggggcccugcacacugaugucagcucaccagucucuucccugacagggc

SEQ ID NO: 124097 - RNA, 64 nt, hsa
ccugagccuggggcgucucggagcuggauccccgucagcucauccaggcuggacaaaccaguuc

SEQ ID NO: 124098 - RNA, 64 nt, hsa
ucugucacacaggcuggaaugcagugaugccaucucagcucacugcaaccuccaccuccugggu

SEQ ID NO: 124099 - RNA, 64 nt, hsa
ucuguugcccaggcuggaguacaguggcgcgaucucagcucacugcaagcuccgccucccaagu

SEQ ID NO: 124100 - RNA, 64 nt, hsa
aaauuauguucagugauaacuuaguuaucagaaaucagcucaguggucuuccccgccaugauuc

SEQ ID NO: 124101 - RNA, 64 nt, hsa
ucauggauuauuaauggauuuaagagggcaucaaucagcucaacucaagauuucauaaucauuu

SEQ ID NO: 124102 - RNA, 64 nt, hsa
agcacaaccauucugaaguuacuggagcaugggcucagcucauccucccucuggccccuucucc

SEQ ID NO: 124103 - RNA, 64 nt, hsa
aacgagucuggccuggugccggcccaguguuuccucagcucauccgcccucuguugcucccuag

SEQ ID NO: 124104 - RNA, 64 nt, hsa
aguguccgccgccgccucuccagcucacccucacucagcucacuuucugacgugucccagccug

SEQ ID NO: 124105 - RNA, 64 nt, hsa
ucuuugacuucauuuccugaagggucaccaagggucagcucagggcuaggaaaaaccauuucca

SEQ ID NO: 124106 - RNA, 64 nt, hsa
ucugucacccagguuggagugcaguggcgugaucucagcucacugcaaccuccaccucgcaggu

SEQ ID NO: 124107 - RNA, 64 nt, hsa
cucuguugccaggcuggagugcaguggcgcgaucucagcucacuacaaccuccgccucccaugu

SEQ ID NO: 124108 - RNA, 64 nt, hsa
ucugucuccuaagcuggagugcaguggcaucaucucagcucacugcaaccucugccucccaggu

SEQ ID NO: 124109 - RNA, 64 nt, hsa
acuccaggcgguccccacccacagaagcagaccuucagcucaggccccggcauugccaucagca

SEQ ID NO: 124110 - RNA, 64 nt, hsa
gaccccaccccacccacagagcacgagggccccgucagcucagucugugucagccccgauggcc

SEQ ID NO: 124111 - RNA, 64 nt, hsa
agagcucgugggauuccugcugcuccagguguccucagcucaccugucccagacugaggacagg

SEQ ID NO: 124112 - RNA, 64 nt, hsa
uccccgaguuggacaaggaggcuguuucugcacaucagcucauuucccgcaccccauuucuugc

SEQ ID NO: 124113 - RNA, 64 nt, hsa
ucugucgcccaggcuggagugcaguggugcgaucucagcucacugcaagcuccgccuccucccg

SEQ ID NO: 124114 - RNA, 64 nt, hsa
cuuguuguccagucuggagugcaauggcacaaucucagcucacagcaaccucugccuccugggu

SEQ ID NO: 124115 - RNA, 64 nt, hsa
uuuauuuggcuuucugugaacugaggucuuaauaucagcucauuuuaaaagucuuugcaguggu

SEQ ID NO: 124116 - RNA, 64 nt, hsa
ucugucaucuaggcuggagugcaguggugugaucucagcucacugcagccucugucucccgggc

SEQ ID NO: 124117 - RNA, 64 nt, hsa
ucuguuacccaggcuggagugcaguggugcgaucucagcucacugcaaccucugccuccugguu

SEQ ID NO: 124118 - RNA, 64 nt, hsa
aguccuggggguaaggggaugacaugcccaggugucagcucaaaggaucucugcaucaucuuga

SEQ ID NO: 124119 - RNA, 64 nt, hsa
ccaucaagcauuccaguagcccccacagaggcccucagcucaguuuuuggcucuguuauggagc

SEQ ID NO: 124120 - RNA, 64 nt, hsa
gaagucgcccgggcugcaguucaguggugcaaucucagcucacugcaagcucugccucccaggu

SEQ ID NO: 124121 - RNA, 64 nt, hsa
ccagcauuuggaagaccaagacaggcagaucgcuucagcucaggaguucgagaucauucuggcc

SEQ ID NO: 124122 - RNA, 64 nt, hsa
ugcucucccuuguggacccugguaaagaaaagccucagcucauagugaacacagcagaccuaga

SEQ ID NO: 124123 - RNA, 64 nt, hsa
uucacacuaaacauaugaaugcagcacugcugccucagcucagcuucgugccuggguuccccac

SEQ ID NO: 124124 - RNA, 64 nt, hsa
aucuuuuuuuuuccuucucuacuuauuuaaauugccacuggaauaaaugugccuuuugaagcaa

SEQ ID NO: 124125 - RNA, 64 nt, hsa
gggaaaaaguucacugcuacaaagggaucccaacccacuggaggcuuugaaguagggagguugg

SEQ ID NO: 124126 - RNA, 64 nt, hsa
ccuggccuugagccgugaccuccaggaagggaccccacuggaauuuuauuucucucaggugcgu

SEQ ID NO: 124127 - RNA, 64 nt, hsa
gagcguguacuaccccaggacgcaugcagggcccccacuggagcguguacuaccccaggacgca

SEQ ID NO: 124128 - RNA, 64 nt, hsa
cuuagaacagaccucucugugcaauaacuuguggccacuggaaaucccugggccggcauuugua

SEQ ID NO: 124129 - RNA, 64 nt, hsa
aucucuaacaccacacagaaagaggcuggaggagccacuggacaaagcuucugucucugugugu

SEQ ID NO: 124130 - RNA, 64 nt, hsa
agguuggaguuccagggcugggcccugguggaguccacuggaagucccauuauggauguugaaa

SEQ ID NO: 124131 - RNA, 64 nt, hsa
cugugcaauaaugucuguguuucucucccaccugccacuggaacuggagaaugcacuuuauucu

SEQ ID NO: 124132 - RNA, 64 nt, hsa
gaagccugguggcaauaaggaucuucccacuuugccacuggaugacuuuggaugggucacuugu

SEQ ID NO: 124133 - RNA, 64 nt, hsa
cuugccgacaagggcaacucacgggugcaugaaaccacuggaacauggccgucgcugugggggu

SEQ ID NO: 124134 - RNA, 64 nt, hsa
ggcucccuuacuugugaguaagggaucaugcucaccacuggagaagcuuacaccgggacuuuuu

SEQ ID NO: 124135 - RNA, 64 nt, hsa
ucuaauucuucuuuaaucuaaaguagauagcuucccacuggaaaguaaacaaaaccaucccucc

SEQ ID NO: 124136 - RNA, 64 nt, hsa
ggaggccaggaaagggggagcggggcgcccagggccacuggaacagccccacuggagucaaggc

SEQ ID NO: 124137 - RNA, 64 nt, hsa
ggggagcggggcgcccagggccacuggaacagccccacuggagucaaggcuccgagggaggaga

SEQ ID NO: 124138 - RNA, 64 nt, hsa
uacuugaauacucucacaaguagggagcucacucccacuggaacagcccauuuuaucuuugaau

SEQ ID NO: 124139 - RNA, 64 nt, hsa
uuuuccagauucuuccacuggcuccacauccaccccacuggaucuucagaaggcuagagggcga

SEQ ID NO: 124140 - RNA, 64 nt, hsa
ccccaucacuggaucccagauccccucacuccacccacuggauuccugcauugguuuuugguuu

SEQ ID NO: 124141 - RNA, 64 nt, hsa
ucagcugcuggauucuggaugucaacaaaccucaccacuggauccugacaaccacaaugccugg

SEQ ID NO: 124142 - RNA, 64 nt, hsa
gcccccuacuggauccuggaccucuacgucuuaaccacuggaucccacacaaaucagugaaugg

SEQ ID NO: 124143 - RNA, 64 nt, hsa
ccguccccccaaucccucaccccccacaccucagccacuggagacugaugauccaaccacagga

SEQ ID NO: 124144 - RNA, 64 nt, hsa
ccucccugccacccccccugccugagcccaggacccacuggagccagccccacccuaggcagga

SEQ ID NO: 124145 - RNA, 61 nt, hsa
ugcugcggguccacuucugagugacugaccuccacuggaggagacccauugcugggaggag

SEQ ID NO: 124146 - RNA, 64 nt, hsa
guccuugacuugaugaauuuggucugccucugagccacuggaggaagcuguuuugagccagggu

SEQ ID NO: 124147 - RNA, 64 nt, hsa
cagauacucgccaaggcagagcgcaaagugcuagccacuggaaaugcaugacuucccuccaccc

SEQ ID NO: 124148 - RNA, 64 nt, hsa
ggaagaagaagaagaacuucuagguccuaaacuagaagaggaagaagaagaggaaguaguugaa

SEQ ID NO: 124149 - RNA, 64 nt, hsa
agaacuucuagguccuaaacuagaagaggaagaagaagaggaaguaguugaaaaugaugaggag

SEQ ID NO: 124150 - RNA, 64 nt, hsa
agaauuccaguuguuaggaagagaugaggaguuggaagaggagggauuagaaacaggaggaggc

SEQ ID NO: 124151 - RNA, 64 nt, hsa
guuuccaugguaacacaucccuaauuuuaccagggaagaggagaguacucacuuuaccaucuuu

SEQ ID NO: 124152 - RNA, 64 nt, hsa
ugacagagggacguucuaggagcaauuggggcaagaagaggacagugauauuuuaaaacaaagu

SEQ ID NO: 124153 - RNA, 64 nt, hsa
caaguauaccccaccagggccugagugacuagaggaagaggacgaggccuuguuggcacuagau

SEQ ID NO: 124154 - RNA, 64 nt, hsa
uugacaagcuaugguaggauuaggaaaguuugcugaagaggaucuuugacgccacagugggacu

SEQ ID NO: 124155 - RNA, 64 nt, hsa
uacauccuaacauaugcauuuggucaagguugcagaagaggacugaagauugacugccaagcua

SEQ ID NO: 124156 - RNA, 64 nt, hsa
gagccuggaagaggaggaggaugagcaggaggaggaagaggaggaggaggaggaggaggaggaa

SEQ ID NO: 124157 - RNA, 64 nt, hsa
gcccccaggcagucagcagccccugcagagccuggaagaggaggaggaugagcaggaggaggaa

SEQ ID NO: 124158 - RNA, 64 nt, hsa
acugaccuucugcugggaaagcagcccugaggaggaagaggaggcgagggaaucagaaauugag

SEQ ID NO: 124159 - RNA, 64 nt, hsa
acagacaagauggaagaaggaccuugcagaggacgaagaggaggaggaugaggaggacacagaa

SEQ ID NO: 124160 - RNA, 64 nt, hsa
gaguagugaaaugaugcggaaagacagcuaucaggaagaggaaauacagaagccugaauaaucu

SEQ ID NO: 124161 - RNA, 64 nt, hsa
ucuaucacauauuuaagcaaacaucacauuuggagaagaggaaaucauaaaaucauccuagaag

SEQ ID NO: 124162 - RNA, 64 nt, hsa
agcauuucacuggcagccuccacuagaauuuggugaagaggaggaggaggagauugaugacaag

SEQ ID NO: 124163 - RNA, 64 nt, hsa
aaaagauaauauucuaaaaacugagaaauccagugaagaggaccuuucagguaaacaugauaca

SEQ ID NO: 124164 - RNA, 64 nt, hsa
aacaagagucaaugguacuuguccuagcguuuuggaagaggaaaacaggaacccaccaaaccaa

SEQ ID NO: 124165 - RNA, 64 nt, hsa
cuguguaugucaacagaagggauaccgucuccuugaagaggaaacucugucacuccucaugccu

SEQ ID NO: 124166 - RNA, 64 nt, hsa
agaccauuagggaaaagaaauuccugcacaaugggaagaggagaaugguguggauaugguucug

SEQ ID NO: 124167 - RNA, 64 nt, hsa
cagaagaaaaguugauuacugccuguacucuacagaagaggaccucaaggaucaauaauccaac

SEQ ID NO: 124168 - RNA, 64 nt, hsa
guuuuauaggaauuugcuuccuaagucuacuuuugaagaggaaaacaggaacguaccauauauu

SEQ ID NO: 124169 - RNA, 64 nt, hsa
aauuagaggugauuuucagauuucuuguucuauggaagaggaagcugagcucagggagauauga

SEQ ID NO: 124170 - RNA, 64 nt, hsa
ccccaggcacugcacagcaccuuggcugaugcuggaagaggagggcagucagugucacuucugg

SEQ ID NO: 124171 - RNA, 64 nt, hsa
uggaaaugcauccaucaaagagagccacccagaggaagaggauugauguccuugcaaaugcauu

SEQ ID NO: 124172 - RNA, 64 nt, hsa
gagcuacucaugacugaagggaaacugcagcugggaagaggagccuguuuuugugagagacuuu

SEQ ID NO: 124173 - RNA, 64 nt, hsa
ucucuuuucaacuuauuuaaaugacagcaccugagaagaggaaccguuuuacacuggauguuuc

SEQ ID NO: 124174 - RNA, 64 nt, hsa
gcccccuccuucccucucuucugccugauagagggaagaggaagaggaggacgaacagagaucc

SEQ ID NO: 124175 - RNA, 64 nt, hsa
uccuucccucucuucugccugauagagggaagaggaagaggaggacgaacagagauccugaaau

SEQ ID NO: 124176 - RNA, 64 nt, hsa
aaaguacagauugucucaguuauacaaguggcaagaagaggacaguggaccagcuccugggacc

SEQ ID NO: 124177 - RNA, 64 nt, hsa
cauaugugucccuccuaaagcugcaugcucaguugaagaggacgagaggacgaccuucucugau

SEQ ID NO: 124178 - RNA, 62 nt, hsa
gggauaguuuuaaaguguagcaucuccaggaagaagaggaaaaggagggaaccccggauugg

SEQ ID NO: 124179 - RNA, 64 nt, hsa
gacagauggugagguaaagucaaaggcauggguagaagaggaccaggggggcaagagcaacaac

SEQ ID NO: 124180 - RNA, 64 nt, hsa
ggcugcacacgaugacucauuggaugggacagaagaagaggaugaggaugagauggaagaggag

SEQ ID NO: 124181 - RNA, 64 nt, hsa
ggaugggacagaagaagaggaugaggaugagauggaagaggaggaggaggaggagcuggaggag

SEQ ID NO: 124182 - RNA, 64 nt, hsa
uaguuggugaacagagagaaccaggaggguaacagaagaggagggaccuacugaacccagaguc

SEQ ID NO: 124183 - RNA, 64 nt, hsa
accaauaacaacagccacccugcccagucuggaagaagaggaggaagacucuggagccaaggca

SEQ ID NO: 124184 - RNA, 64 nt, hsa
cagcagaagagccauucaucucauaaacaaaaaggaagaggaaagaaugaggaaggacccugug

SEQ ID NO: 124185 - RNA, 64 nt, hsa
cugaaacugugagcuggaguuggggagaggucuggaagaggaccaucugggauuucuacagccu

SEQ ID NO: 124186 - RNA, 64 nt, hsa
ucuaaaugcugguaaauauuuacauucagccagggaagaggaggccagaggucgggccagcugc

SEQ ID NO: 124187 - RNA, 64 nt, hsa
aaccuguggggaaggagguuuucucccugcccgggaagaggacagauaacugauuuccguucuu

SEQ ID NO: 124188 - RNA, 60 nt, hsa
ucugcgacucaguugauugagcugcucucugaagaggaagaggagaaagccagagaguca

SEQ ID NO: 124189 - RNA, 64 nt, hsa
ugcgacucaguugauugagcugcucucugaagaggaagaggagaaagccagagagucacucuua

SEQ ID NO: 124190 - RNA, 64 nt, hsa
uuuuguuuauuuuuuugauaaugacuggacaucagaagaggaaaaaaacucaaaacaaaagcga

SEQ ID NO: 124191 - RNA, 64 nt, hsa
gaaagccccacaaacuaaaacagccuuuccuagggaagaggaaggggaggugggcuggaucugu

SEQ ID NO: 124192 - RNA, 64 nt, hsa
uucaaagcugccugucccuaccccauggugcuaggaagaggagugggguggugucagacccugg

SEQ ID NO: 124193 - RNA, 64 nt, hsa
uugcuuuuuguuuauuuaaugcuguggcaugggugaagaggaggggaagaggccuguuuggccu

SEQ ID NO: 124194 - RNA, 64 nt, hsa
ugaaaucuccuguaaacuuuacuugacuacuuaugaagaggaccucugacuugcuugagaguuc

SEQ ID NO: 124195 - RNA, 64 nt, hsa
gaccaaacuaaaggagaucauuguagaccaucaagaagaggaagauaugagaaaguaagucucu

SEQ ID NO: 124196 - RNA, 64 nt, hsa
cagccaguaaaaaacacuuccaaaaagauacacagaagaggaacuaaaugacugcgaagcugga

SEQ ID NO: 124197 - RNA, 64 nt, hsa
aaaccuuccuaggacaaaaaggagacuggggagggaagaggauuacuuuaaagcaccugaaacg

SEQ ID NO: 124198 - RNA, 64 nt, hsa
uugcugaaagcuuugguuuugcugaugaaaucaggaagaggacaaguggccuggccagcccaca

SEQ ID NO: 124199 - RNA, 64 nt, hsa
aagagcuacaagauggcugcucugaggccuuugagaagaggacaucacagaaaggagaaucucc

SEQ ID NO: 124200 - RNA, 64 nt, hsa
acgaggaccaucgggggcagagucguuggagacugaagaggaagaggaggaggagaaggggagu

SEQ ID NO: 124201 - RNA, 64 nt, hsa
accaucgggggcagagucguuggagacugaagaggaagaggaggaggagaaggggagugagcgg

SEQ ID NO: 124202 - RNA, 64 nt, hsa
uagguggaauaaugacucgagcaggaaagcaguagaagaggauuccuucaccacaguuucaccu

SEQ ID NO: 124203 - RNA, 64 nt, hsa
uuccugggguauauuaauuuaguuauauuuagcagaagaggaauauaaccaaaugugacuaaaa

SEQ ID NO: 124204 - RNA, 64 nt, hsa
cgugaagaggaagcggaagagccggugggggccugaagaggauaagguagagcucccaccugcu

SEQ ID NO: 124205 - RNA, 64 nt, hsa
cugcccccgggaagccagccuccgcagccaccgugaagaggaagcggaagagccggugggggcc

SEQ ID NO: 124206 - RNA, 64 nt, hsa
gccuggccccuugcugacucaggcugcacuguuugaagaggagcagagaggcuggcacuagggg

SEQ ID NO: 124207 - RNA, 64 nt, hsa
gagccagcucccaggggcccagagccccccacuugaagaggagcuugagcuucccucugccugc

SEQ ID NO: 124208 - RNA, 64 nt, hsa
gugaagucgucagccuaaaauuuguuucucucuugaagaggauucuuugaaaagguccugcaga

SEQ ID NO: 124209 - RNA, 64 nt, hsa
ggccuauuaaaaaaaaaaguuguuuucugaacuagaagaggaaaaaaauggcaauuuuugagug

SEQ ID NO: 124210 - RNA, 64 nt, hsa
guaggugaaaaggcagaacacuccgcgcuucuuagaagaggagugagaggaaggcggggggcgc

SEQ ID NO: 124211 - RNA, 64 nt, hsa
ggacuucuucaaaauuuaaaaacuugugauuuaagaagaggaaaagauaagcuacagauugaga

SEQ ID NO: 124212 - RNA, 64 nt, hsa
aaaaugggcaaaagacaugaauagauguuucacugaagaggaucuauagauggcaaguaagcau

SEQ ID NO: 124213 - RNA, 64 nt, hsa
ucuuggaaccaccagucuaguccguccuggcacagaagaggagucaaguaauggaggucccagc

SEQ ID NO: 124214 - RNA, 64 nt, hsa
ucccaugagacugcccugcccagguauccugggggaagaggagaugugaucaggccccaccccu

SEQ ID NO: 124215 - RNA, 64 nt, hsa
cuaaaugccaugacagguguccuuccaagagacagaagaggagacacagacacagagcaggagg

SEQ ID NO: 124216 - RNA, 64 nt, hsa
caaugggcccaauccagugucccuaugagagacggaagaggagacacagacacaaagcaggagg

SEQ ID NO: 124217 - RNA, 64 nt, hsa
aacaucugugcacaccauccauuccgcucgcugagcgauggaaaagcuugccuggaagacuaug

SEQ ID NO: 124218 - RNA, 64 nt, hsa
uauugugcagcuguugguuuucauguagugcccugcgauggaaauuagauauauuucauguauu

SEQ ID NO: 124219 - RNA, 64 nt, hsa; identical to SEQ ID NO: 107849

SEQ ID NO: 124220 - RNA, 64 nt, hsa; identical to SEQ ID NO: 107850

SEQ ID NO: 124221 - RNA, 64 nt, hsa; identical to SEQ ID NO: 107851

SEQ ID NO: 124222 - RNA, 64 nt, hsa; identical to SEQ ID NO: 107852

SEQ ID NO: 124223 - RNA, 64 nt, hsa; identical to SEQ ID NO: 107853

SEQ ID NO: 124224 - RNA, 64 nt, hsa; identical to SEQ ID NO: 107854

SEQ ID NO: 124225 - RNA, 64 nt, hsa; identical to SEQ ID NO: 107855

SEQ ID NO: 124226 - RNA, 64 nt, hsa; identical to SEQ ID NO: 107856

SEQ ID NO: 124227 - RNA, 64 nt, hsa; identical to SEQ ID NO: 107857

SEQ ID NO: 124228 - RNA, 64 nt, hsa; identical to SEQ ID NO: 107858

SEQ ID NO: 124229 - RNA, 64 nt, hsa; identical to SEQ ID NO: 107859

SEQ ID NO: 124230 - RNA, 64 nt, hsa; identical to SEQ ID NO: 107860

SEQ ID NO: 124231 - RNA, 64 nt, hsa; identical to SEQ ID NO: 107861

SEQ ID NO: 124232 - RNA, 64 nt, hsa; identical to SEQ ID NO: 107862

SEQ ID NO: 124233 - RNA, 64 nt, hsa; identical to SEQ ID NO: 107863

SEQ ID NO: 124234 - RNA, 63 nt, hsa; identical to SEQ ID NO: 107864

SEQ ID NO: 124235 - RNA, 64 nt, hsa; identical to SEQ ID NO: 107865

SEQ ID NO: 124236 - RNA, 64 nt, hsa; identical to SEQ ID NO: 107866

SEQ ID NO: 124237 - RNA, 64 nt, hsa; identical to SEQ ID NO: 107867

SEQ ID NO: 124238 - RNA, 64 nt, hsa; identical to SEQ ID NO: 107868

SEQ ID NO: 124239 - RNA, 64 nt, hsa; identical to SEQ ID NO: 107869

SEQ ID NO: 124240 - RNA, 64 nt, hsa; identical to SEQ ID NO: 107870

SEQ ID NO: 124241 - RNA, 64 nt, hsa; identical to SEQ ID NO: 107871

SEQ ID NO: 124242 - RNA, 64 nt, hsa; identical to SEQ ID NO: 107872

SEQ ID NO: 124243 - RNA, 64 nt, hsa; identical to SEQ ID NO: 107873

SEQ ID NO: 124244 - RNA, 64 nt, hsa; identical to SEQ ID NO: 107874

SEQ ID NO: 124245 - RNA, 64 nt, hsa; identical to SEQ ID NO: 107875

SEQ ID NO: 124246 - RNA, 64 nt, hsa; identical to SEQ ID NO: 107876

SEQ ID NO: 124247 - RNA, 64 nt, hsa; identical to SEQ ID NO: 107877

SEQ ID NO: 124248 - RNA, 64 nt, hsa; identical to SEQ ID NO: 107878

SEQ ID NO: 124249 - RNA, 64 nt, hsa; identical to SEQ ID NO: 107879

SEQ ID NO: 124250 - RNA, 64 nt, hsa; identical to SEQ ID NO: 107880

SEQ ID NO: 124251 - RNA, 64 nt, hsa; identical to SEQ ID NO: 107881

SEQ ID NO: 124252 - RNA, 64 nt, hsa; identical to SEQ ID NO: 107882

SEQ ID NO: 124253 - RNA, 64 nt, hsa; identical to SEQ ID NO: 107883

SEQ ID NO: 124254 - RNA, 64 nt, hsa; identical to SEQ ID NO: 107884

SEQ ID NO: 124255 - RNA, 64 nt, hsa; identical to SEQ ID NO: 107885

SEQ ID NO: 124256 - RNA, 64 nt, hsa; identical to SEQ ID NO: 107886

SEQ ID NO: 124257 - RNA, 64 nt, hsa; identical to SEQ ID NO: 107887

SEQ ID NO: 124258 - RNA, 64 nt, hsa; identical to SEQ ID NO: 107888

SEQ ID NO: 124259 - RNA, 64 nt, hsa; identical to SEQ ID NO: 107889

SEQ ID NO: 124260 - RNA, 64 nt, hsa; identical to SEQ ID NO: 107890

SEQ ID NO: 124261 - RNA, 64 nt, hsa; identical to SEQ ID NO: 107891

SEQ ID NO: 124262 - RNA, 64 nt, hsa; identical to SEQ ID NO: 107892

SEQ ID NO: 124263 - RNA, 64 nt, hsa; identical to SEQ ID NO: 107893

SEQ ID NO: 124264 - RNA, 64 nt, hsa; identical to SEQ ID NO: 107894

SEQ ID NO: 124265 - RNA, 64 nt, hsa; identical to SEQ ID NO: 107895

SEQ ID NO: 124266 - RNA, 64 nt, hsa; identical to SEQ ID NO: 107896

SEQ ID NO: 124267 - RNA, 64 nt, hsa; identical to SEQ ID NO: 107897

SEQ ID NO: 124268 - RNA, 64 nt, hsa; identical to SEQ ID NO: 107898

SEQ ID NO: 124269 - RNA, 64 nt, hsa; identical to SEQ ID NO: 107899

SEQ ID NO: 124270 - RNA, 64 nt, hsa; identical to SEQ ID NO: 107900

SEQ ID NO: 124271 - RNA, 64 nt, hsa; identical to SEQ ID NO: 107901

SEQ ID NO: 124272 - RNA, 64 nt, hsa; identical to SEQ ID NO: 107902

SEQ ID NO: 124273 - RNA, 64 nt, hsa; identical to SEQ ID NO: 107903

SEQ ID NO: 124274 - RNA, 64 nt, hsa; identical to SEQ ID NO: 107904

SEQ ID NO: 124275 - RNA, 64 nt, hsa; identical to SEQ ID NO: 107905

SEQ ID NO: 124276 - RNA, 64 nt, hsa; identical to SEQ ID NO: 107906

SEQ ID NO: 124277 - RNA, 64 nt, hsa; identical to SEQ ID NO: 107907

SEQ ID NO: 124278 - RNA, 64 nt, hsa; identical to SEQ ID NO: 107908

SEQ ID NO: 124279 - RNA, 64 nt, hsa; identical to SEQ ID NO: 107909

SEQ ID NO: 124280 - RNA, 64 nt, hsa; identical to SEQ ID NO: 107910

SEQ ID NO: 124281 - RNA, 64 nt, hsa; identical to SEQ ID NO: 107911

SEQ ID NO: 124282 - RNA, 64 nt, hsa; identical to SEQ ID NO: 107912

SEQ ID NO: 124283 - RNA, 64 nt, hsa; identical to SEQ ID NO: 107913

SEQ ID NO: 124284 - RNA, 64 nt, hsa; identical to SEQ ID NO: 107914

SEQ ID NO: 124285 - RNA, 64 nt, hsa; identical to SEQ ID NO: 107915

SEQ ID NO: 124286 - RNA, 64 nt, hsa; identical to SEQ ID NO: 107916

SEQ ID NO: 124287 - RNA, 64 nt, hsa; identical to SEQ ID NO: 107917

SEQ ID NO: 124288 - RNA, 64 nt, hsa; identical to SEQ ID NO: 107918

SEQ ID NO: 124289 - RNA, 64 nt, hsa; identical to SEQ ID NO: 107919

SEQ ID NO: 124290 - RNA, 64 nt, hsa; identical to SEQ ID NO: 107920

SEQ ID NO: 124291 - RNA, 64 nt, hsa; identical to SEQ ID NO: 107921

SEQ ID NO: 124292 - RNA, 64 nt, hsa; identical to SEQ ID NO: 107922

SEQ ID NO: 124293 - RNA, 64 nt, hsa; identical to SEQ ID NO: 107923

SEQ ID NO: 124294 - RNA, 64 nt, hsa; identical to SEQ ID NO: 107924

SEQ ID NO: 124295 - RNA, 64 nt, hsa; identical to SEQ ID NO: 107925

SEQ ID NO: 124296 - RNA, 64 nt, hsa; identical to SEQ ID NO: 107926

SEQ ID NO: 124297 - RNA, 64 nt, hsa; identical to SEQ ID NO: 107927

SEQ ID NO: 124298 - RNA, 64 nt, hsa; identical to SEQ ID NO: 107928

SEQ ID NO: 124299 - RNA, 64 nt, hsa; identical to SEQ ID NO: 107929

SEQ ID NO: 124300 - RNA, 64 nt, hsa; identical to SEQ ID NO: 107930

SEQ ID NO: 124301 - RNA, 64 nt, hsa; identical to SEQ ID NO: 107931

SEQ ID NO: 124302 - RNA, 64 nt, hsa; identical to SEQ ID NO: 107932

SEQ ID NO: 124303 - RNA, 64 nt, hsa; identical to SEQ ID NO: 107933

SEQ ID NO: 124304 - RNA, 64 nt, hsa; identical to SEQ ID NO: 83366

SEQ ID NO: 124305 - RNA, 64 nt, hsa; identical to SEQ ID NO: 83367

SEQ ID NO: 124306 - RNA, 64 nt, hsa; identical to SEQ ID NO: 83368

SEQ ID NO: 124307 - RNA, 64 nt, hsa; identical to SEQ ID NO: 83369

SEQ ID NO: 124308 - RNA, 64 nt, hsa; identical to SEQ ID NO: 83370

SEQ ID NO: 124309 - RNA, 64 nt, hsa; identical to SEQ ID NO: 83371

SEQ ID NO: 124310 - RNA, 64 nt, hsa; identical to SEQ ID NO: 83372

SEQ ID NO: 124311 - RNA, 64 nt, hsa; identical to SEQ ID NO: 83373

SEQ ID NO: 124312 - RNA, 64 nt, hsa
ugugauuuguauaaugaaaugcauuucauuuggaagaauucaaugaaccauuuuuccaagugac

SEQ ID NO: 124313 - RNA, 64 nt, hsa
ucaacaaaaaaguuuggauguagaagcagcuguaagaauucaacuguuuauuauaacaagauac

SEQ ID NO: 124314 - RNA, 64 nt, hsa
cuuauuugguuccuaacacaaacugggaagagauagaauucaucuauacuuucuuuuuucuugg

SEQ ID NO: 124315 - RNA, 64 nt, hsa
aacacagcuuaaaaauaaaauaacugaaagaaauagaauucagcaaauaguuauuuuuugcacu

SEQ ID NO: 124316 - RNA, 64 nt, hsa
cuuuaccucauucucaaaccuugauaaacauaagagaauucauaccggagagaaacuguacaaa

SEQ ID NO: 124317 - RNA, 64 nt, hsa
aacuuacauugagaagauaugaaagaugaauauaagaauucauccuagauauaaaaccauagaa

SEQ ID NO: 124318 - RNA, 64 nt, hsa
cucuccagggaguagauguaaaguacuuguacauagaauucagaacugaagauauuuauuaaaa

SEQ ID NO: 124319 - RNA, 64 nt, hsa
cauccuccuuuuguucugcauugacucauuuaccagaauucauuggaagaaaucaccaaagauu

SEQ ID NO: 124320 - RNA, 64 nt, hsa
gguaugugauggguuguagaagcguguguuugagagaauucagagacauuugaaggcugcugug

SEQ ID NO: 124321 - RNA, 64 nt, hsa
gugcaugcaacacacuuaggggaggaguggccccagaauucagcacgcacacaacacacaaggg

SEQ ID NO: 124322 - RNA, 64 nt, hsa
guucgaucuucuggguuuaguuuugucuuuaaaaagaauucaaaaaaagacugacaaugacagu

SEQ ID NO: 124323 - RNA, 64 nt, hsa
uaaaaucaagaaaauuuaaaaagacaaaaaaaaaagaauucauugauaauucuaacucagacuu

SEQ ID NO: 124324 - RNA, 64 nt, hsa
cuuucuacuaaugcucagcccuucucguuguaagagaauucacaccggagaacaacuuuuuaaa

SEQ ID NO: 124325 - RNA, 64 nt, hsa
gaugaggacaaaucucagacuuugcucagagcucagaauucaguggggaccagagagccugcaa

SEQ ID NO: 124326 - RNA, 64 nt, hsa
uuuauuugcuguuuagguuugugacugaauugugagaauucaguugugauuuuuaacauguguc

SEQ ID NO: 124327 - RNA, 64 nt, hsa
uuuuauuugauauuucaucuauguuugaaaugugagaauucagauguaauuuuuuaccuugauu

SEQ ID NO: 124328 - RNA, 64 nt, hsa
gaugacaaugauaaguaugacaugagcuucaaccagaauucagccucugguaaacaugaacacu

SEQ ID NO: 124329 - RNA, 64 nt, hsa
cuucagauugaauucacaucuuauucagcaucaaagaauucacacaggagagaaagcacaugaa

SEQ ID NO: 124330 - RNA, 64 nt, hsa
gcuauuaguauuuucauaccuuagucacauuuggagaauucacaugggaauaaaauuccauugc

SEQ ID NO: 124331 - RNA, 64 nt, hsa
uuguguccaaaaugcaaccuucagaguguaucaaagaauucagacaggcuucuguuuucagagu

SEQ ID NO: 124332 - RNA, 64 nt, hsa
acagucccagaaguaaacccucacugugaaucagagaauucacauaggaaagaaaccagaugaa

SEQ ID NO: 124333 - RNA, 64 nt, hsa; identical to SEQ ID NO: 124324

SEQ ID NO: 124334 - RNA, 64 nt, hsa; identical to SEQ ID NO: 124325

SEQ ID NO: 124335 - RNA, 64 nt, hsa
agcuugugaguagagcaaacaaacguuuuuccaaagaauucacagugcuccuuugcaauuuaua

SEQ ID NO: 124336 - RNA, 64 nt, hsa
gaaacuauuggaugaaaugaggaaaaacaggaaaagaauucacuuuuuaaaugaagaaauuagu

SEQ ID NO: 124337 - RNA, 64 nt, hsa
auuuugauauuuuggauacauuaacucacuuaggagaauucagaaaagaaugggugauuaaagu

SEQ ID NO: 124338 - RNA, 64 nt, hsa
agcaucuucucacuaauguuuuucacuauaacagagaauucauuucaauuugaguugguucucu

SEQ ID NO: 124339 - RNA, 64 nt, hsa
aaagauacccucucauggaauaaacaccuugcuuagaauucauauaacaaagaaguaaccuuau

SEQ ID NO: 124340 - RNA, 64 nt, hsa
cucguuuggcacgcauguuagauggcagagaccaagaauucaagaugguugguggccagauuuu

SEQ ID NO: 124341 - RNA, 64 nt, hsa
ggcaguccugcacuccuucuggaggcucuaggggagaauucauuucuggccuuuucauuuuuag

SEQ ID NO: 124342 - RNA, 64 nt, hsa
acaggauccagguuuuuauagcuugauauaaaacagaauucaaaaguggcuguggagugauuua

SEQ ID NO: 124343 - RNA, 64 nt, hsa
gaauugguuguuaauuucuguuacuggcuuugcuagaauucauaugugcauaaauaacacuaau

SEQ ID NO: 124344 - RNA, 64 nt, hsa
uuccuucgugaacaaaaauaaaauaggcacauuuagaauucagagccaauaugugcuugcuuau

SEQ ID NO: 124345 - RNA, 64 nt, hsa
caaugagcgccugauaaccaggguugguuccuggagaauucacucauugauucauuuguucaca

SEQ ID NO: 124346 - RNA, 64 nt, hsa
gccaagaauuuuuagaauuuuugagaauuuuuuaagaauucauugguuauaagcaacaguugcc

SEQ ID NO: 124347 - RNA, 64 nt, hsa
uucagaacagcgauugaccaguaacugugagaucagaauucacccaaaggaagacauuuucauc

SEQ ID NO: 124348 - RNA, 64 nt, hsa
gaagcauguguaaaauuauacuuucaguaauuggagaauucagagauugcauuucuagcagaga

SEQ ID NO: 124349 - RNA, 64 nt, hsa
cuaguaagcgaugcugcaacuuguuaucuuaacaagaauucaagucguuuuaauuaaaucccac

SEQ ID NO: 124350 - RNA, 64 nt, hsa
uagauaauaauuucuaugggaccaaagacuagacagaauucaguaagucacaugaaguaauggu

SEQ ID NO: 124351 - RNA, 64 nt, hsa
aagugaaaacacugggcucccuguuaaacgaugaagaauucaagacagugacagcauuacguca

SEQ ID NO: 124352 - RNA, 64 nt, hsa
ccggccugggacucagcauuucugauaugccuuaagaauucauucuguuuuguacaauuauuuu

SEQ ID NO: 124353 - RNA, 64 nt, hsa
guguggcagaaguuuauuuauuuuuauccaguauagaauucaauuauaugauuauaucacaauu

SEQ ID NO: 124354 - RNA, 64 nt, hsa
uaaauuuuaucaauauggugcugguucaaaccagagaauucaugcugcagggaaacucaaucaa

SEQ ID NO: 124355 - RNA, 64 nt, hsa
uuucagucacagaucacgccuuaaaagacauaggagaauucauacuggagagaaaccuuacaag

SEQ ID NO: 124356 - RNA, 64 nt, hsa
cuucagucaagcuucauccuaugcaaaacauaggagaauucaugcaggagagaaaugucacaag

SEQ ID NO: 124357 - RNA, 64 nt, hsa
cuuuagaugucgcuccacacuugauacacaucagagaauucacacuggugaaaggccuuaugag

SEQ ID NO: 124358 - RNA, 64 nt, hsa
cuuuagauacaacuccagccucauuaaacaucggagaauucacacuggagagagaccuuaucag

SEQ ID NO: 124359 - RNA, 64 nt, hsa
uucucuuucucaaggauguuccuugcugagaaaaagaauucagugauauuucucccauuugcuu

SEQ ID NO: 124360 - RNA, 64 nt, hsa
auuugcucuuuccucaugccuaaguaugcaugaaagaauucacacuggggagaaauacuaugaa

SEQ ID NO: 124361 - RNA, 64 nt, hsa
cuucaacuguuccucacaccuuacuacucauaaaagaauucauacuggaggaaaagcccuacaa

SEQ ID NO: 124362 - RNA, 64 nt, hsa
cuucaaccgguccucaaaccuuguggaacauaagagaauucauacuggagagaaacccuacaaa

SEQ ID NO: 124363 - RNA, 64 nt, hsa
aauccuuuauugauuguucaacucuuaacaccagagaauucacacuggugagaaacccuuugaa

SEQ ID NO: 124364 - RNA, 64 nt, hsa
gccuuugcuuguuuccuaccuuaauagaaaucagagaauucacacuagugagaaaccguaucag

SEQ ID NO: 124365 - RNA, 64 nt, hsa
uuuuaauaauuauccaacucuuacucaacaucaaagaauucauaccagugugaaacccuaugaa

SEQ ID NO: 124366 - RNA, 64 nt, hsa
cuucauuuguuuuuuugauuuuaauagacaucagagaauucacaaaggagagaaacccuaucag

SEQ ID NO: 124367 - RNA, 61 nt, hsa
caagcauaaugcacaucuaaugagacaucagagaauucacaguggggagaaacccuaugaa

SEQ ID NO: 124368 - RNA, 64 nt, hsa
uuuugggagugauucacaccuggcacaccauacuagaauucacacuggagagaaaccuuacaag

SEQ ID NO: 124369 - RNA, 64 nt, hsa
guugucagucacaaaucacagcuugaaagacaggagaauucauacuggagaaaaaacauacaaa

SEQ ID NO: 124370 - RNA, 64 nt, hsa
uuuugaauauaauucauaccuggcaaaacauauuagaauucaaacuggagagaaaccuuacaaa

SEQ ID NO: 124371 - RNA, 64 nt, hsa
uuuuaaucaaaaaacaacccuugcacgucaucauagaauucauacugcagagaaacuuuacaaa

SEQ ID NO: 124372 - RNA, 64 nt, hsa
uuucgggaaugauucacacguggcaccccauacuagaauucacacuggagagaaaccuuacaag

SEQ ID NO: 124373 - RNA, 64 nt, hsa
uuuucauucacaaauccagcuucaaauacauaggagaauucacacuggagaaaagccauagaaa

SEQ ID NO: 124374 - RNA, 64 nt, hsa
uuuugcauauaaugcauaucuggcaaaacauacuagaauucacacuggagagaaacucauuaua

SEQ ID NO: 124375 - RNA, 64 nt, hsa
gccaucauuucauucgugggccugcugcucucuaagaauucaguagcauuuuaauaguuucuaa

SEQ ID NO: 124376 - RNA, 64 nt, hsa
ugcccauuucacacaacuguggauaaauuuuggaagaauucaugaugcuaguucuuacgcuuga

SEQ ID NO: 124377 - RNA, 64 nt, hsa
aggcuccccagggccccgcuucuccguacaccccagcuccuaggucucagagaacucccccacc

SEQ ID NO: 124378 - RNA, 64 nt, hsa
gggccuggcucucccugggaggcuggggccccuaagcuccuagguuuuccuuccaagcacccag

SEQ ID NO: 124379 - RNA, 64 nt, hsa
agucuaggggguuccauucuggccaugcgagcccagcuccuaccaacgucgguaacuugagcag

SEQ ID NO: 124380 - RNA, 64 nt, hsa
gagcgugaccccuccugcugggaccuguguuguaagcuccuauuugcuuaucuuguuuauuuca

SEQ ID NO: 124381 - RNA, 64 nt, hsa
cacaugcaugcacacaaacguguacacaagugugagcuccuacacgcauacacacacacacgug

SEQ ID NO: 124382 - RNA, 64 nt, hsa
cacacaugcauguacagguaagcacacauguacaagcuccuacaggcuugcucucacacacgug

SEQ ID NO: 124383 - RNA, 64 nt, hsa
gccucaccuuucaccccccaccccccacagcgucagcuccuaccucugaccccagcuucucucu

SEQ ID NO: 124384 - RNA, 64 nt, hsa
ccuugccucaccuuuaaccccccaccugagccccagcuccuaccucugaccccaacuucucuuu

SEQ ID NO: 124385 - RNA, 64 nt, hsa
ucaggcagcugagggcugagaaugaggcaguuggaaucuagacacuaugcuggguucccugagu

SEQ ID NO: 124386 - RNA, 64 nt, hsa
guuguucacaaaaggccacauuccaaguauuuguaaucuagaaaguguuauguaagugauguua

SEQ ID NO: 124387 - RNA, 64 nt, hsa
uuauucuguauuuggccuuauucgggcauuaggaaaucuagagaucuaaaggguugaaugacaa

SEQ ID NO: 124388 - RNA, 64 nt, hsa
aaacauuuuauaugcuccuuuggauaugcaauuuaaucuagauuaucuauuuuucucccaugau

SEQ ID NO: 124389 - RNA, 64 nt, hsa
gugacgagugaaacugucuccaaaaaaaaaaaaaaaucuagaauucuuggaaguacauuauauu

SEQ ID NO: 124390 - RNA, 64 nt, hsa
ucuguaacaaaaguacuuucucuuuacucuauuaaaucuagaauuagccgggcauggucgcuca

SEQ ID NO: 124391 - RNA, 64 nt, hsa
uguuuguuuugauuugcucuguuuuauucagucaaaucuagaguuugaauccucugcuaaagaa

SEQ ID NO: 124392 - RNA, 64 nt, hsa
aaaaaaacuggcaaagugaaaagauacagucaaaaaucuagaauuucuuuaauuuugcuucucu

SEQ ID NO: 124393 - RNA, 64 nt, hsa
uuucauuucaacugauaauaguaaagcuauuucaguuuaguaaaaauuuucuuuuuuccacaag

SEQ ID NO: 124394 - RNA, 64 nt, hsa
auaaauuacagaauuuauuacuacucauuucaguguuuaguacagaaauugccuuaaaaauugc

SEQ ID NO: 124395 - RNA, 64 nt, hsa
cuuuuuaaugauguaagaaaauugucaggagaauggcucuuauuuauguguguuuuaacuuaug

SEQ ID NO: 124396 - RNA, 54 nt, hsa
uuucuaaaccuucugaguaaauuuggcucuuagaauuaaguuaauuucuucucu

SEQ ID NO: 124397 - RNA, 64 nt, hsa
augaacuaggaacgcauuuacuaugagaaaauauggcucuuaagcaguguaagagugaaaauau

SEQ ID NO: 124398 - RNA, 64 nt, hsa
cacuaucucagaaauaccuuaauucucuaagacuggcucuuagaccucucccaucaugccuuga

SEQ ID NO: 124399 - RNA, 64 nt, hsa
ccugugaucuggaaaucuaccaccaaucccgaucggcucuuauuagcuccccgcuccacaagac

SEQ ID NO: 124400 - RNA, 64 nt, hsa
ccugugcuuuggaaauccaccaccaaucccgaucggcucuuauuagcuccccgcuccacaagac

SEQ ID NO: 124401 - RNA, 64 nt, hsa
acggggaucuggaaauccacgaccaaucccgaucggcucuuauuagcuccccgcuccacaagac

SEQ ID NO: 124402 - RNA, 64 nt, hsa
caugagcgucugcaaaacacuugccugaauacauaucacguauuuuagacucgaagccucaaag

SEQ ID NO: 124403 - RNA, 64 nt, hsa
cacaacuuaauuugaaccacaaguauccagcuuaaucacguaucuuacucacgauaccacuggu

SEQ ID NO: 124404 - RNA, 64 nt, hsa
aacucuugaaaucuccauuuucaaucccuucgaaaucacguaugguuuccacaaagccgagucg

SEQ ID NO: 124405 - RNA, 64 nt, hsa
acacuggguuaauucuguuugccccuggaacacaaucacguaaguuuccuucuagacuggcauc

SEQ ID NO: 124406 - RNA, 64 nt, hsa
aaagaaaaaaaaaauuccuaaaacuguggaauggaucacguagacauguaacccagcagcaguu

SEQ ID NO: 124407 - RNA, 64 nt, hsa
aaaagggaacugaacauuccagagcguguagugaaucacguaaagcuagaaaugauccccagcu

SEQ ID NO: 124408 - RNA, 64 nt, hsa
uuguuccagaguguggaaguauaaagacaugggcaucacguaaauugguuuuguuugcuauucu

SEQ ID NO: 124409 - RNA, 64 nt, hsa
ucacauauugacauugagcucaguggccuguuucaucacguaugugcugcuaccuguacagcag

SEQ ID NO: 124410 - RNA, 64 nt, hsa
cuaggaguagaucuuauuccagaucauauacaagaucacguagucuagcuaguucacauucaag

SEQ ID NO: 124411 - RNA, 64 nt, hsa
uugauuguacuauauugcaggauauggagauuucaucacguacuacaauacaguguauuuuguu

SEQ ID NO: 124412 - RNA, 64 nt, hsa
ggcacuucgggcaauaacucuguggcacgugggcaucacguaagcagcacacuaggaggcccag

SEQ ID NO: 124413 - RNA, 64 nt, hsa
cgaccagccucugccuuaaaggaaaucuuuauuaaucacguaugguucacagauaauucuuuuu

SEQ ID NO: 124414 - RNA, 64 nt, hsa
uuauugauauucuaagaaauaucugugaaauaucaucacguauguuauacaaccuucauuuaaa

SEQ ID NO: 124415 - RNA, 64 nt, hsa
agaucagaccuguguauuuagaucagaccuguguaucacguaagugugugagugcagugcagau

SEQ ID NO: 124416 - RNA, 64 nt, hsa
ugaaauaaauacugcaccaaaaaugugaaaaagaaucacguaguaaauguauacuuaguguuuu

SEQ ID NO: 124417 - RNA, 64 nt, hsa
cacaguauggugaugaugacuuuuaagcauuuacaucacguacucauaaccuauuaugaaaaua

SEQ ID NO: 124418 - RNA, 64 nt, hsa
cagugggauggccucauccacaggugcguugggcaucacguaggugcggagcucaauuugccca

SEQ ID NO: 124419 - RNA, 64 nt, hsa
aaccagaaaacauucaaaagaacuucaacaaaucaucacguaacaggaucuucagaaaaacuac

SEQ ID NO: 124420 - RNA, 64 nt, hsa
uuuucacuauaccucuaaaaccaauuguaccgacaucacguagacaaaaacuccagauaaaucc

SEQ ID NO: 124421 - RNA, 64 nt, hsa
guuuuuagugaaauauuauuucacaaagaacuauaucacguaccuuuccucugacuguuuccug

SEQ ID NO: 124422 - RNA, 64 nt, hsa
cguguucacuuggcucccauagcccucuugauggaucacguaaaacugaaaggcagcggggagc

SEQ ID NO: 124423 - RNA, 64 nt, hsa
cagugcauuuucauguuuugaaucugauuaguggaucacguagcuacuuucccugucgcgucca

SEQ ID NO: 124424 - RNA, 64 nt, hsa
gccacaccccuuaugugaacuagugccuuuggguaucacguaaaauuuuuuccaaaggguuacu

SEQ ID NO: 124425 - RNA, 64 nt, hsa
ugggauauuaaggcccuggugucuuacagaaaccaucacguaugucgcagcagcauuucacccc

SEQ ID NO: 124426 - RNA, 64 nt, hsa
guuugauugaggagcugcacugaucacccaaugcaucacguaccccacugggccagcccugcag

SEQ ID NO: 124427 - RNA, 64 nt, hsa
ccgcauggagcccccgugauuaguagcccguaugaucacguagacccacccaacacacuccugc

SEQ ID NO: 124428 - RNA, 64 nt, hsa
cugccccuucugggugacacagccgguaaacggaaucacguaugguucuuucugugggucugug

SEQ ID NO: 124429 - RNA, 64 nt, hsa
acaacagccaucuuagguccccgaggugcccagcaucacguaaaacaucgauaugcuaagaaga

SEQ ID NO: 124430 - RNA, 64 nt, hsa
ccucagcacagacucuuucagauggaggugccauaucacguacaccauaugcaaguuucccgcc

SEQ ID NO: 124431 - RNA, 64 nt, hsa
aaucugugcuucuaacugagaugagaguguauuaaucacguaucgcagggcuccagcuguuuua

SEQ ID NO: 124432 - RNA, 64 nt, hsa
acuuccucagauugugcacuguuuguuuaaaauaaucacguauuuuagucugaugcuguuguau

SEQ ID NO: 124433 - RNA, 64 nt, hsa
caaaugucuauaauuuugaaacaagugauucguuaucacguaaguucaucuuauaaaguauaug

SEQ ID NO: 124434 - RNA, 64 nt, hsa
ccuaugaaccuagaacuugaagugacuccuacuuaucacguaaauuuuuaugucugauaucaaa

SEQ ID NO: 124435 - RNA, 64 nt, hsa
gagccgggauuguccaauuacuaaaauguaaauaaucacguauuguggggaggggaguuccaag

SEQ ID NO: 124436 - RNA, 64 nt, hsa; identical to SEQ ID NO: 121771

SEQ ID NO: 124437 - RNA, 64 nt, hsa; identical to SEQ ID NO: 121772

SEQ ID NO: 124438 - RNA, 64 nt, hsa; identical to SEQ ID NO: 121773

SEQ ID NO: 124439 - RNA, 64 nt, hsa; identical to SEQ ID NO: 121774

SEQ ID NO: 124440 - RNA, 64 nt, hsa; identical to SEQ ID NO: 121775

SEQ ID NO: 124441 - RNA, 64 nt, hsa; identical to SEQ ID NO: 121776

SEQ ID NO: 124442 - RNA, 64 nt, hsa; identical to SEQ ID NO: 121777

SEQ ID NO: 124443 - RNA, 64 nt, hsa; identical to SEQ ID NO: 121778

SEQ ID NO: 124444 - RNA, 64 nt, hsa; identical to SEQ ID NO: 121779

SEQ ID NO: 124445 - RNA, 64 nt, hsa; identical to SEQ ID NO: 121780

SEQ ID NO: 124446 - RNA, 64 nt, hsa; identical to SEQ ID NO: 121781

SEQ ID NO: 124447 - RNA, 64 nt, hsa; identical to SEQ ID NO: 121782

SEQ ID NO: 124448 - RNA, 64 nt, hsa; identical to SEQ ID NO: 121783

SEQ ID NO: 124449 - RNA, 64 nt, hsa; identical to SEQ ID NO: 121784

SEQ ID NO: 124450 - RNA, 64 nt, hsa; identical to SEQ ID NO: 121785

SEQ ID NO: 124451 - RNA, 64 nt, hsa; identical to SEQ ID NO: 121786

SEQ ID NO: 124452 - RNA, 64 nt, hsa; identical to SEQ ID NO: 121787

SEQ ID NO: 124453 - RNA, 64 nt, hsa; identical to SEQ ID NO: 121788

SEQ ID NO: 124454 - RNA, 64 nt, hsa; identical to SEQ ID NO: 121789

SEQ ID NO: 124455 - RNA, 64 nt, hsa; identical to SEQ ID NO: 121790

SEQ ID NO: 124456 - RNA, 64 nt, hsa
auggacuguaucuuaugcaucucuguauuucugcgccuagcacggugccuagcacacaguaggc

SEQ ID NO: 124457 - RNA, 64 nt, hsa
uuaugcaucucuguauuucugcgccuagcacggugccuagcacacaguaggcgcucaauaaaug

SEQ ID NO: 124458 - RNA, 62 nt, hsa
guuuuuuuaaaaauaucuuuuucuccucucagcucauacauaacacaaggcagaaaucugga

SEQ ID NO: 124459 - RNA, 62 nt, hsa
aauuuucauuuuaaagcacaccugagaugauucucauacaaccgaaauuuuagauccauagc

SEQ ID NO: 124460 - RNA, 62 nt, hsa
gcagggaggggugccaugagucuugcuuuuggcucauacaggagagagggaaggcugccagg

SEQ ID NO: 124461 - RNA, 62 nt, hsa
cacacccccacaccccuuugccgguuccucgacucauacaucccucgugcuuucccaucucc

SEQ ID NO: 124462 - RNA, 62 nt, hsa
cuugaagaguagaaacaauuguauuuugaagucucauacaagcugucugauagagaacuuuc

SEQ ID NO: 124463 - RNA, 62 nt, hsa
aauacugugguugccucuaugugcuguuuuuccucauacaaguaaacacagaaagucaaauu

SEQ ID NO: 124464 - RNA, 62 nt, hsa
acuuugucuucuuucucccuuucccuccuucccucauacauugcuuucucucccucuccugc

SEQ ID NO: 124465 - RNA, 62 nt, hsa
ggaaaacacuaagugaaacuguuuacaauaaccucauacaaccuucugucccaucuccuggu

SEQ ID NO: 124466 - RNA, 64 nt, hsa
ccuuuggggaaaagggugggggucagccuccccaaaaucacauggauuccccaaguggaaacua

SEQ ID NO: 124467 - RNA, 64 nt, hsa
ugaugaauauauagguuagggaucuuuugguuuuaaaucacagaaaaccuaauucaaacuggcu

SEQ ID NO: 124468 - RNA, 64 nt, hsa
uaguugcuuuauaugcuuuaccuucuaggucuuaaaaucacacauuggaaaaugacaauaucaa

SEQ ID NO: 124469 - RNA, 64 nt, hsa
ugauaugguuacuucuauguugaaauaaaauuuaaaaucacaugcaaaaaaaaaaucagcaaaa

SEQ ID NO: 124470 - RNA, 64 nt, hsa
aaacaguuacaagccuccaaauucaaauaaaauuaaaucacaguucagaugaaacugaauauca

SEQ ID NO: 124471 - RNA, 64 nt, hsa
caaaacauggaaaauaaguuuagugcacauagcuaaaucacaaaacauccaauuucucuguuuc

SEQ ID NO: 124472 - RNA, 64 nt, hsa
guauaaucagcacuuugccaugcucagaaaauucaaaucacauggaacuuuagagguagauuua

SEQ ID NO: 124473 - RNA, 64 nt, hsa
agauaggagugaauacaccuaccuggugccuugaaaaucacaucaaguaguuaauuaucuaccc

SEQ ID NO: 124474 - RNA, 64 nt, hsa
cugaguaggcuuguauugguacccuaggacauaaaaaucacauauaucauguuucaguaaaugc

SEQ ID NO: 124475 - RNA, 64 nt, hsa
gcugugccuagaacaaagaaucaggcuggcaaagaaaucacaggucuuuccucaaacuuuaaau

SEQ ID NO: 124476 - RNA, 64 nt, hsa
aucugaagcucacaaagaugaagugacuuccucaaaaucacaugguucaggacagaaacaagau

SEQ ID NO: 124477 - RNA, 64 nt, hsa
ccagggccuuaauuuuucccuuuucaaccugaacaaaucacauucuguccagauuccucuugua

SEQ ID NO: 124478 - RNA, 64 nt, hsa
cauacacagacacacacagaaagacacagacacaaaaucacacacacacccuccccgccacaga

SEQ ID NO: 124479 - RNA, 64 nt, hsa
cacagacacacacagaaagacacacacagacacaaaaucacacacacacccuccccgccacaga

SEQ ID NO: 124480 - RNA, 64 nt, hsa
ugaguaacugaagccuaggccccguccccaccucaaaucacacacacccccuccccaccacaga

SEQ ID NO: 124481 - RNA, 64 nt, hsa
ucccaggagcugcccagaguugcugggagcugaaaaaucacauccuggccuggcacaucagaaa

SEQ ID NO: 124482 - RNA, 64 nt, hsa
ccacaauauaaaacuguacuucacugucaggaagaaaucacagaaucauaugauucugcuuuua

SEQ ID NO: 124483 - RNA, 64 nt, hsa
uacaggggcuggugaccucuuuuugcuaauaggaaaaucacauuacuacaaaauggggagaaaa

SEQ ID NO: 124484 - RNA, 64 nt, hsa
uguuauuguguguuaaguuuuucaucugugcaucaaaucacaaaaagaauaaauagagcuuuuu

SEQ ID NO: 124485 - RNA, 64 nt, hsa
ccccuuuuagagcauccggaagugauaacacgcaaaaucacaaaguagcauaaaucaguaaauu

SEQ ID NO: 124486 - RNA, 64 nt, hsa
ccugaaacuauggucuacauuaauauggauuuuuaaaucacaugucauuacuuuugcaacacca

SEQ ID NO: 124487 - RNA, 64 nt, hsa
acacuccaaccacauuccaagcugagauaaaaucaaaucacaaauguuuaaccacuuugcugcu

SEQ ID NO: 124488 - RNA, 64 nt, hsa
cacaaaguaguccauuccugaucucacuuaaaauaaaucacaaguaaauuugaauuuucgguuu

SEQ ID NO: 124489 - RNA, 64 nt, hsa
uaguuccuuaagaauaaucuaguuauauuuuuugaaaucacauauaauuagacuuuauaauaua

SEQ ID NO: 124490 - RNA, 64 nt, hsa
cacuaauacuguggugagugauuuuacucaaaggaaaucacacuauuaagcagcuugguuuuga

SEQ ID NO: 124491 - RNA, 64 nt, hsa
acauauaaacaauuauuuaucacuuuuaugacccaaaucacaauaaaauugucauuuaggauaa

SEQ ID NO: 124492 - RNA, 64 nt, hsa
uuguagaggcagaggcaaaguuaucaucauacaaaaaucacaaacaaaaaggagaucuguauuc

SEQ ID NO: 124493 - RNA, 64 nt, hsa
uuauggggauuucuaugaguauuguguugaaucuaaaucacauucgguuauauaaucauugagc

SEQ ID NO: 124494 - RNA, 64 nt, hsa
caaaugugaagacugugacaaaguugucagucacaaaucacagcuugaaagacaggagaauuca

SEQ ID NO: 124495 - RNA, 64 nt, hsa
aguaucuuaaguuuaacugggcacuucccucuggaaaucacaguguugugcaccaggaacacaa

SEQ ID NO: 124496 - RNA, 64 nt, hsa
uauaucauuuucaucccaaguagugauaucugugaaaucacagguuugaugugugcuaauuaug

SEQ ID NO: 124497 - RNA, 64 nt, hsa
uucucuuuaaaucagauuuguaauggcucccaaauuccaucacaucacauuuaaauugcagaca

SEQ ID NO: 124498 - RNA, 64 nt, hsa
ugauuacccagagauaucuaugaaaaccaguggcuuccaucaaaccuuugccaacucagguuca

SEQ ID NO: 124499 - RNA, 64 nt, hsa
ugggucauugaucccuggcucagaggauagcgguuuccaucauaaaccaagaugaugaguucag

SEQ ID NO: 124500 - RNA, 64 nt, hsa
cuuccuccuguucccugggucagaggauagcgguuuccaucauaaaccaagaugaugaguucag

SEQ ID NO: 124501 - RNA, 64 nt, hsa
uuccaucagcccugaaggacagcagaggaguauuuuccaucauuucaaaccacaaacaaaauua

SEQ ID NO: 124502 - RNA, 64 nt, hsa
ggucacaacacaacuguguccugagcacacaagauuccaucagcccugaaggacagcagaggag

SEQ ID NO: 124503 - RNA, 64 nt, hsa
ccacagaaugucugaauucuugcauucuuuacccuuccaucacuauauugauucuuuuuuuaaa

SEQ ID NO: 124504 - RNA, 64 nt, hsa
cuggcauugcgggaggugcucugcugcacagcuguuccaucaggcccuauuggccucuguuaga

SEQ ID NO: 124505 - RNA, 64 nt, hsa
agagcuuaauuaaguuuuagaaauauguaauaccuuccaucauuccaucauccuuaaauucugu

SEQ ID NO: 124506 - RNA, 64 nt, hsa
auuaaguuuuagaaauauguaauaccuuccaucauuccaucauccuuaaauucuguuaccaaau

SEQ ID NO: 124507 - RNA, 64 nt, hsa
uuuugaagaauauuuaagaaaagcacuuuuguuauuccaucaauaaaugcucuauuuuacucuu

SEQ ID NO: 124508 - RNA, 64 nt, hsa
uuugaaauacuaaaagcaaaucuacagauccuuuuuccaucauuuuacagugaccuuuucuuca

SEQ ID NO: 124509 - RNA, 64 nt, hsa
gagaugguaaguuaacugauaaaaccugucagcauuccaucauuuuccccuuuugacguaucag

SEQ ID NO: 124510 - RNA, 64 nt, hsa
ucauccugugcagaggaugagaggaagguguuaguuccaucagccccauaaaauuaugaaccuu

SEQ ID NO: 124511 - RNA, 64 nt, hsa
ccaugguaaccagccacaguacauauguaauucuuuccaucaccccaaccucuccuuucugugc

SEQ ID NO: 124512 - RNA, 64 nt, hsa
aaaguugaaaagccaaaggucaaacaggcuguaauuccaucaucaucguuguuauuaaagaauc

SEQ ID NO: 124513 - RNA, 64 nt, hsa
cgucauguacuguguauucuuaugaaugguuucuuuccaucagcauaaugauuugagauuuguc

SEQ ID NO: 124514 - RNA, 64 nt, hsa
auguaaccaacacuccagucaagcuucagaauauuuccaucaccccagaagguucucuuguaua

SEQ ID NO: 124515 - RNA, 64 nt, hsa
gcagcugcaaaaugguuuaaugcccccuacauauuuccaucaccuugaacaauagcuuuagcuu

SEQ ID NO: 124516 - RNA, 64 nt, hsa
cuccgagcucagacagaggaagcccugcagaaaguuccaucaggcuguuuccuaaaggaugugu

SEQ ID NO: 124517 - RNA, 64 nt, hsa
aaaaauauuuacuaguugaaguuauuaucaguuuuuaauuuaguucuuaaacucauuucacuuc

SEQ ID NO: 124518 - RNA, 64 nt, hsa
ccaaguuuuaggaacauguuaggauauaggagacuuaauuuauaauaaugagagcauuuuuuua

SEQ ID NO: 124519 - RNA, 63 nt, hsa
guauagaugcuauuguuauuaauaaaguuaccaauuaauuuaaaggcuuugcuggauucuuuu

SEQ ID NO: 124520 - RNA, 64 nt, hsa
cucaugguguuccccucuuaaaggagaggagcuuuuaauuuacacuuaccaccucauuugcuuu

SEQ ID NO: 124521 - RNA, 64 nt, hsa
auugucacugacauuuaaugguacuguauauuacuuaauuuauugaagauuauuauuuaugucu

SEQ ID NO: 124522 - RNA, 64 nt, hsa
augauauguuuucucagauuuucuguuguacaguuuaauuuagcaguccauaucacauugcaaa

SEQ ID NO: 124523 - RNA, 64 nt, hsa
gaucauauuuauuuauuuauaugaaccaugucuauuaauuuaauuauuuaauaauauuuauauu

SEQ ID NO: 124524 - RNA, 64 nt, hsa
ggguugguucuuuggguucuguuuguuuauuuguuuaauuuaaugauuuguaaagugauguucc

SEQ ID NO: 124525 - RNA, 64 nt, hsa
guacaguauauauauguauauauauuuuaauuuuuuaauuuaagcaaagacuaaaaucaaccau

SEQ ID NO: 124526 - RNA, 64 nt, hsa
uuuggcauaccagugaaugaugaagaacaugagauuaauuuaauuuaucuucgguaacuugaca

SEQ ID NO: 124527 - RNA, 64 nt, hsa
cauaccagugaaugaugaagaacaugagauuaauuuaauuuaucuucgguaacuugacauucug

SEQ ID NO: 124528 - RNA, 64 nt, hsa
aacaguagcacuuugaaaacuuuuuaggccagcuuuaauuuaauggcccuacugauauucacau

SEQ ID NO: 124529 - RNA, 64 nt, hsa
accauuucuguuagaacgaugucaauucaugcuuuuaauuuagcaucaauagaaaauugcugua

SEQ ID NO: 124530 - RNA, 64 nt, hsa
agaagcaaagcaggccaauagaaaugcaauauuuuuaauuuauucuacugaaaugguuuaaaau

SEQ ID NO: 124531 - RNA, 64 nt, hsa
aaagaaaaaaugguaguaauugagcagaaaaaaauuaauuuauauauguauugauuggcaacca

SEQ ID NO: 124532 - RNA, 64 nt, hsa
cauucuuagaguagagcagaguuuuuaguuaguauuaauuuauuuuccuccauucauguacuuu

SEQ ID NO: 124533 - RNA, 64 nt, hsa
auguaaccaaaucuagauaauuucaaaguugucauuaauuuaguaagccuaauauaaacaaaua

SEQ ID NO: 124534 - RNA, 64 nt, hsa
uagauauuuucacaaugucaguauuucaguguaguuaauuuaucuaaauuaaagccuuuaguau

SEQ ID NO: 124535 - RNA, 64 nt, hsa
gcuguguuuaauuugacuucucugccuuugacauuuaauuuagugaucuuagcauagcuuauua

SEQ ID NO: 124536 - RNA, 64 nt, hsa
ucuauaucaauguguccuuaguuuucuuagccuguuaauuuaaaaauccagacuugggggucau

SEQ ID NO: 124537 - RNA, 64 nt, hsa
uaacuucaugcagaauuucacagacaucuaugcauuaauuuaaauucuuggugcaaaugugugc

SEQ ID NO: 124538 - RNA, 64 nt, hsa
aggcuauauauuguagcuuaauuuuuauuugcaauuaauuuauuuaaacuaaguaaauacuuuu

SEQ ID NO: 124539 - RNA, 64 nt, hsa
acuguagcaaaguuuuauaugugguagcauaccuuuaauuuauccuauuacaaaacuguucuga

SEQ ID NO: 124540 - RNA, 64 nt, hsa
auauguagcuuucuauauauguaguagguuggcuuuaauuuaauauacuugauucagaaacaaa

SEQ ID NO: 124541 - RNA, 64 nt, hsa
ucaaugugguggagaaagggaagggguuggcuuuuuaauuuauuuuucuucaucuuuuauaaca

SEQ ID NO: 124542 - RNA, 64 nt, hsa
uauaagaauaaauuuggacccgguuucugauuauuuaauuuaaaagaucacuuacaggaucaug

SEQ ID NO: 124543 - RNA, 64 nt, hsa
ugacuguuguaauggaguaaagaagagggccagcuuaauuuaaaaauaaagugaguuuaccaaa

SEQ ID NO: 124544 - RNA, 64 nt, hsa
uauauugcuguaaacuuaauugauaaagcucuguuuaauuuagaguuuugaagaaauagucucc

SEQ ID NO: 124545 - RNA, 64 nt, hsa
guagaauauugcaaauuaaccacacaaaaaauguuuaauuuaugcaacaagcauguuugugcaa

SEQ ID NO: 124546 - RNA, 64 nt, hsa
ugguaaggacucugguaccagggaagagggagaauuaauuuauugugcaaaugcugguauuucu

SEQ ID NO: 124547 - RNA, 64 nt, hsa
gggagaagauugaugcaauaggacaauuuccaauuuaauuuagauccucuaaucuuucuacaug

SEQ ID NO: 124548 - RNA, 64 nt, hsa
uaguuuuuaauuauuauuaauauaaaggaucaaauuaauuuaaauaugauucugaagucuacag

SEQ ID NO: 124549 - RNA, 64 nt, hsa
auuggucuggugagauguuucauauuugugacaguuaauuuaaaaauuaugaguuaaugcugcc

SEQ ID NO: 124550 - RNA, 64 nt, hsa
uaggguuuuauuaucccagggacuaccucggcuuuuaauuuaaaaaaaaaaaagaaguggguaa

SEQ ID NO: 124551 - RNA, 64 nt, hsa
ggaaggaaaggucuuugugggauaauccauauguuuaauuuauucaacuucaucaaucacuuua

SEQ ID NO: 124552 - RNA, 64 nt, hsa
uuccuucuuagccauggagagcauuugugauuaauuaauuuauauaugaaauaaugguuuccau

SEQ ID NO: 124553 - RNA, 64 nt, hsa
ugcaucgagaaccugaauaaaucaugccacuauauuaauuuauauuacauguuucauauuuaaa

SEQ ID NO: 124554 - RNA, 64 nt, hsa
auuagauuauugcagaacaacccucuguaaauuauuaauuuaucucucuagcaacuuaauuuug

SEQ ID NO: 124555 - RNA, 64 nt, hsa
uauuaauagaugguuuauuuacuaugguaauguauuaauuuauuuuugguguuguucgauuguc

SEQ ID NO: 124556 - RNA, 64 nt, hsa
acaggucaaaauaaaaguugaacuugaguuacauuuaauuuaaauauaaaugcauuuugagaaa

SEQ ID NO: 124557 - RNA, 64 nt, hsa
uguauaauuauaugaaugugauguuuauugcuuauuaauuuauaauucagucauucucuauaua

SEQ ID NO: 124558 - RNA, 64 nt, hsa
uccagaacuaaacaagucccuaaguuuccuuauuuuaauuuacugugacuagauuugaagcaaa

SEQ ID NO: 124559 - RNA, 64 nt, hsa
cauauaauaaauagaaauuuuguuaacauggaauuuaauuuaugugaaagaguucuggauucaa

SEQ ID NO: 124560 - RNA, 64 nt, hsa
uauauggaagauaauuuuauguguuauaguaggauuaauuuauuuaguugugcagucaguguca

SEQ ID NO: 124561 - RNA, 64 nt, hsa
uguauuggaaauaucuaguuuuuuaaauuuuuaauuaauuuauuuauaauuuacuguguguucc

SEQ ID NO: 124562 - RNA, 64 nt, hsa
uuaaaauacucacauauuuuuacuuaaauuuucuuuaauuuacuuauauguuauuauaauuuug

SEQ ID NO: 124563 - RNA, 64 nt, hsa
cauuuuacuuauggcuuuucuaauuuuuaauuaauuaauuuauuuuuuugagacagagucuugu

SEQ ID NO: 124564 - RNA, 64 nt, hsa
agaaaaaucaaauaccuuagagauuaugaagucauuaauuuauacugaaauuggauugacuuac

SEQ ID NO: 124565 - RNA, 64 nt, hsa
uaauuauuuaaaacucuagaaagaugaacaaagguuaauuuaaacuuaccuaagaagaugagaa

SEQ ID NO: 124566 - RNA, 64 nt, hsa
ucuucucagagagccuaaauucuaauacauuuuauuaauuuauacuaaucuucauauuuacugu

SEQ ID NO: 124567 - RNA, 64 nt, hsa
caugccuccuagaaacuacacuauggguaauuaauuaauuuauuucauagaggccacccagaug

SEQ ID NO: 124568 - RNA, 64 nt, hsa
gcugaagucugccaaggguacauuauggccauuuuuaauuuacagcuaaaauauuuuuuaaaau

SEQ ID NO: 124569 - RNA, 64 nt, hsa
ccaucaguuucugaguaacaaagagcaccaaguuuuaauuuaaauaggagauuuaacacuaggg

SEQ ID NO: 124570 - RNA, 64 nt, hsa
uuuauguauguguauguacguaaauacauacauauuaauuuacauuagagugaaaaauaaaugg

SEQ ID NO: 124571 - RNA, 64 nt, hsa
uguucaacacagugaagauuaucugcuuuuuaaauuaauuuauuuacgauaucuagagcugugu

SEQ ID NO: 124572 - RNA, 64 nt, hsa
uauucagcuacuauacagaaaaaggaugaacaaauuaauuuauuucuaauugagccaguuagac

SEQ ID NO: 124573 - RNA, 64 nt, hsa
ucuuuugaaaauauauauucacaauuuuaauauuuuaauuuauuuuuuacuauuuaacccugua

SEQ ID NO: 124574 - RNA, 64 nt, hsa
ucaggacucugagucugaucaugaauuuuauguuuuaauuuauguuuuuuuuuugucuucugga

SEQ ID NO: 124575 - RNA, 64 nt, hsa
gaauaacugaacaaauauauuagucuagggccacuuaauuuagaggaagaaaaaaaaucaaccc

SEQ ID NO: 124576 - RNA, 64 nt, hsa
gauaguauuacauuugaaauuguuauaaggguuauuaauuuaauaaaauucaucaucagguuuc

SEQ ID NO: 124577 - RNA, 64 nt, hsa
gacaaaauuaaaagaaggaaugauaagaauaaauuuaauuuaccaaauauuguuaauuaaaauu

SEQ ID NO: 124578 - RNA, 64 nt, hsa
ggauauuaaauaagucccaggcagauuuacauauuuaauuuaaaacauuggcuuuauuucauuu

SEQ ID NO: 124579 - RNA, 64 nt, hsa
uaaaaauaaaauccuuccuucccauguuacuaaauuaauuuauguuuuugagagguugagucuc

SEQ ID NO: 124580 - RNA, 64 nt, hsa
uugggauuauacuuccuuucuguaccaauuucuuuuaauuuaaagaacuauaagucaguuauau

SEQ ID NO: 124581 - RNA, 64 nt, hsa
ugagcaugucccuaagauaaaccagaauuggcaguuaauuuaggcgucuagaaaaucucaguuc

SEQ ID NO: 124582 - RNA, 64 nt, hsa
uucuagcaaaggaaggguagaaaggaauugaaaauuaauuuacacuaguugcuacuugggaaua

SEQ ID NO: 124583 - RNA, 64 nt, hsa
uuuauggcauuugagauugaaacuaagaaauguuuuaauuuauuaccuuuacaacauuuauuua

SEQ ID NO: 124584 - RNA, 64 nt, hsa
uauuuacauuacauacauacauuuacaacauuuauuaauuuauauuaaaauagcaugaauaagc

SEQ ID NO: 124585 - RNA, 64 nt, hsa
uuuaaauuuguuaggucugaagaaucuaaaacuguuaauuuaacccuuaacuugugccuagaaa

SEQ ID NO: 124586 - RNA, 64 nt, hsa
uagaaaauagaaaugccaguaaacaacauaauguuuaauuuacaacuuacauuagggguuuggg

SEQ ID NO: 124587 - RNA, 64 nt, hsa
acaggaacaggcaugaagauauugccauacaauuuuaauuuauacaaguauuggccccucaagu

SEQ ID NO: 124588 - RNA, 64 nt, hsa
gaaauucugcugguuaacuuuaucucucucucucuuaauuuagacuuucaaccuaugaaaaugu

SEQ ID NO: 124589 - RNA, 64 nt, hsa
ugucuuuaaugucuucagacaaaaaagccuuacauuaauuuaauguuugcacucugaggugcaa

SEQ ID NO: 124590 - RNA, 64 nt, hsa
ccuuugucuugugcaaacauguagaauaugcucuuuaauuuaguaaaauauuuuuuuaaaaggu

SEQ ID NO: 124591 - RNA, 64 nt, hsa
aauuaauaauuacauaccuuuauagauuuugaaauuaauuuaaauauuaguauuugguacauga

SEQ ID NO: 124592 - RNA, 64 nt, hsa
guguuuggauuguauauauggugcuaaaaauaaauuaauuuacuuuauaaaccuuaucuguaca

SEQ ID NO: 124593 - RNA, 64 nt, hsa
uuucuaaacgcuuacaacuuaucugccacucauauuaauuuacuugaauuugucauaaagcuaa

SEQ ID NO: 124594 - RNA, 64 nt, hsa
aacuuuuguagauaauuuuuguuaauuuguuuuguuaauuuauguuuuuccuaauuuuaagcau

SEQ ID NO: 124595 - RNA, 64 nt, hsa
gaaauggcuuuaaauuaauacucuuauuuuuuauuuaauuuaauuacauaaauuaaaccuuacc

SEQ ID NO: 124596 - RNA, 64 nt, hsa
cacaaauuauguuauugaaaagcauuauuaauguuuaauuuauuuaaaauuuuggaauuugcca

SEQ ID NO: 124597 - RNA, 64 nt, hsa
cacuagguuuuuuucuaauaauguuaaaggcuauuuaauuuauuuaaucaacuuuaagcauuac

SEQ ID NO: 124598 - RNA, 64 nt, hsa
aucauccuauccaccaaaaucuuauuccuuaguauuaauuuaucucauugggaagaaauuugua

SEQ ID NO: 124599 - RNA, 64 nt, hsa
aagucuuugugcauuuuagcaggacuuaauuuucuuaauuuauucuuuccuuucaauuauagug

SEQ ID NO: 124600 - RNA, 64 nt, hsa
aagaggccuuguuuauauauggguagcuucacauuuaauuuauaaaguuaacaaucuggaaacu

SEQ ID NO: 124601 - RNA, 64 nt, hsa
uuuuggcugucauuucaaaaguggaauaaauuuauuaauuuaguaguacuaaaugguauccuua

SEQ ID NO: 124602 - RNA, 64 nt, hsa
caucauggcucuuggcaguuuaaauuuaguaauuuuaauuuagugaacagaauugagaagaacg

SEQ ID NO: 124603 - RNA, 64 nt, hsa
aaguaugagcguuaggacacuauuuuaauuauuuuuaauuuauuaauauuuaaauaugugaagc

SEQ ID NO: 124604 - RNA, 64 nt, hsa
uuaauuuauuaauauuuaaauaugugaagcugaguuaauuuauguaagucauauuuauauuuuu

SEQ ID NO: 124605 - RNA, 64 nt, hsa
ccuugggacuccacaacaacaacaacaacaaaauuuaauuuaauuuaaaaauagccccagucgu

SEQ ID NO: 124606 - RNA, 64 nt, hsa
ggacuccacaacaacaacaacaacaaaauuuaauuuaauuuaaaaauagccccagucgucauca

SEQ ID NO: 124607 - RNA, 64 nt, hsa
ugcaccauguucuggcacuguauuuugaaugacauuaauuuauuaaauaaauuguauauauuca

SEQ ID NO: 124608 - RNA, 64 nt, hsa
aagauuuagaguggguuaaccaggucauuacaucuuaauuuaauaacaagcauuacuguagagu

SEQ ID NO: 124609 - RNA, 64 nt, hsa
aacugcaugccugccccuuauuugagcugccuuuuuaauuuauugcauauccuuuuuauuaucu

SEQ ID NO: 124610 - RNA, 64 nt, hsa
cacagaaaaguuggaaauaaccaaaacugaagucuuaauuuaccuucaguuuaaucuguggauu

SEQ ID NO: 124611 - RNA, 64 nt, hsa
cuccccuggacuagaaauccaguauaguuugccauuaauuuauugaaucugguuuuggacaaug

SEQ ID NO: 124612 - RNA, 64 nt, hsa
aggcaguucuucuuagguuccgucucacggcguuuuaauuuauuuucacugucacacgcauaga

SEQ ID NO: 124613 - RNA, 64 nt, hsa
auuuugagauuuuauuuagaaaugaauugucuaauuaauuuauguagaguccuuuuuuccaaag

SEQ ID NO: 124614 - RNA, 64 nt, hsa
auagcgagcucaaagcaauuaagugggaacauuuuuaauuuaaaaaaaauuuccaaauauuugu

SEQ ID NO: 124615 - RNA, 58 nt, hsa
cuagagcuguagccacguaguuuucuacuuaauuuaaagaaaagaauuccuuaccuau

SEQ ID NO: 124616 - RNA, 64 nt, hsa
gucuaugaauuucuucuuaauuuaacaaauuugguuaauuuauaaaaucacagauugguaaaug

SEQ ID NO: 124617 - RNA, 64 nt, hsa
uaacaggaaaaaaauggugucuaugaauuucuucuuaauuuaacaaauuugguuaauuuauaaa

SEQ ID NO: 124618 - RNA, 64 nt, hsa
ugcuuguaaaauuaaaccaucaucuagaauagaguuaauuuauuauaaucaagcuacaaauagg

SEQ ID NO: 124619 - RNA, 64 nt, hsa
aucuauacuguuuuggcaaguuugcauuuuaguauuaauuuauaauuagggauuguucaaacuu

SEQ ID NO: 124620 - RNA, 64 nt, hsa
aaacuaguuacauuauaaacgguuucaaacauguuuaauuuacauuagguuuuuauguaagagu

SEQ ID NO: 124621 - RNA, 64 nt, hsa
gcguuuuccuaauuuuaguacuuaauuucucuuuuuaauuuaagugaucuuucuaauucgaaag

SEQ ID NO: 124622 - RNA, 64 nt, hsa
cagacacuguguaacaacaccugggucaacucuuuuaauuuauauacaaagcaaagaacaacau

SEQ ID NO: 124623 - RNA, 64 nt, hsa
cuuugguuguuuuccuguaauauaaaagaaaaaguuaauuuaucaauugauugaauacaguuuu

SEQ ID NO: 124624 - RNA, 64 nt, hsa
cggacaccaccauaaaaauggaaucaaaagaaaguuaauuuaugaaauuaagaggucagcagaa

SEQ ID NO: 124625 - RNA, 64 nt, hsa
uugggaaagucuuuuuaauagaacaagaacgaucuuaauuuaagaauauuauccugguuuaaca

SEQ ID NO: 124626 - RNA, 64 nt, hsa
aauaaguauauuuagaacuuguuaaaaauacauuuuaauuuaugauauacauauuauuuuaauu

SEQ ID NO: 124627 - RNA, 64 nt, hsa
agucuauaacaugaaaugauuauuaaauuguuuauuaauuuagagcuauaagaggaacuuauuu

SEQ ID NO: 124628 - RNA, 64 nt, hsa
cauauuuauuacuauaauuugcuaugacuucagguuaauuuauuuguguuugcauaguuugagc

SEQ ID NO: 124629 - RNA, 64 nt, hsa
cuaaauauuuuaacaaguuuguuauauauuuuauuuaauuuaaaagaaaucucuuaccaaccua

SEQ ID NO: 124630 - RNA, 64 nt, hsa
uuugaagucugccguauuuuuacaaguguguuuauuaauuuauuuuccaauaggauuuaaauag

SEQ ID NO: 124631 - RNA, 64 nt, hsa
gaccauuauucacagguggacaaauguuguccuguuaauuuauaggcguuuuuuggggaugugg

SEQ ID NO: 124632 - RNA, 64 nt, hsa
auugcuaagagggcccaaagaauuggaauccuccuuaauuuaauugcuuugaagcauagcuaca

SEQ ID NO: 124633 - RNA, 64 nt, hsa
ccuaguaccuuuggcugcuaaggcagcagcauguuuaauuuauaacaacacaaaccucugagag

SEQ ID NO: 124634 - RNA, 64 nt, hsa
uucaggugugcuugguuuauuauauuuagucaaguuaauuuagucgaaugugguaacauuuuuc

SEQ ID NO: 124635 - RNA, 64 nt, hsa
aacagcauugauagguuaaagaagcuugguauuuuuaauuuacuucaaugauuagcucaguugc

SEQ ID NO: 124636 - RNA, 64 nt, hsa
uguauauuguagauuuuuuucauucauguguuauuuaauuuacacugaucucugcuauuuuaac

SEQ ID NO: 124637 - RNA, 64 nt, hsa
auuuuugugagugaccaccuuugcaauauguuuguuaauuuacuucauguuggguucuuucuga

SEQ ID NO: 124638 - RNA, 64 nt, hsa
cugccauuuuuuccuacuauaauaaugcugaaucuuaauuuagaggguacaaggguaugguaau

SEQ ID NO: 124639 - RNA, 64 nt, hsa
acauaguaaucuuuagcuuuuuauacaaauauauuuaauuuaggaguauaugugugucuauaca

SEQ ID NO: 124640 - RNA, 64 nt, hsa
aacugcauuuuaagucagacaguaaauguuuuuuuuaauuuacagcaaaugaagcaguuuuauu

SEQ ID NO: 124641 - RNA, 64 nt, hsa
uuuaaaaaauaaaaaccacuacuguuacauuuuauuaauuuaaaaagcuagaaaauucauguag

SEQ ID NO: 124642 - RNA, 64 nt, hsa
uauuacucccaauugaauuaucuaccucauuuuguuaauuuaauuuaucaaagguaacauuguu

SEQ ID NO: 124643 - RNA, 64 nt, hsa
cucccaauugaauuaucuaccucauuuuguuaauuuaauuuaucaaagguaacauuguuuucuc

SEQ ID NO: 124644 - RNA, 64 nt, hsa
auuucaaaugaagauuccugccuuaaaauauuuuuuaauuuaauggucaguauauuuuguaaaa

SEQ ID NO: 124645 - RNA, 64 nt, hsa
aauuuaauggucaguauauuuuguaaaaaucauguuaauuuauuucauaguugacauuaauauc

SEQ ID NO: 124646 - RNA, 64 nt, hsa
agauuauuguaaaaugagagcgagcaaauaaaacuuaauuuaaucuuugcagauacauacuuau

SEQ ID NO: 124647 - RNA, 64 nt, hsa
gaaugacuuuuuccuuuuaaauuuaguucuaucauuaauuuaucauuaaauuuaguucuaucau

SEQ ID NO: 124648 - RNA, 64 nt, hsa
caaaacaaaaugaacacuugaccaaaaaaccacauuaauuuaaauggagccuuucauuauuuuc

SEQ ID NO: 124649 - RNA, 64 nt, hsa
caguuucuagacaauauccuaauuguuggaaggguuaauuuauuccugaauuaguaccaggcag

SEQ ID NO: 124650 - RNA, 64 nt, hsa
cuugcuauuuauuuuuuuucaauuguugguggcauuaauuuaauaauucuuguuuuucaccuuc

SEQ ID NO: 124651 - RNA, 64 nt, hsa
uguuguuauuguuauuguuguuguuguuguuuuuuuaauuuaggugaagacauauuaaauauga

SEQ ID NO: 124652 - RNA, 64 nt, hsa
ugcaaugaauaauuuuccugcuucacuguuauuuuuaauuuaaccuggcaaauuaagugagacu

SEQ ID NO: 124653 - RNA, 64 nt, hsa
guuaugaaaaagugucauugugacaucacagguauuaauuuacaaauuagaguauuugaaauag

SEQ ID NO: 124654 - RNA, 64 nt, hsa
gaagaugcagaugauaaaacuaauuuugaacuuuuuaauuuauauaaauuauuuuauaucacuu

SEQ ID NO: 124655 - RNA, 64 nt, hsa
ggauuagaauuuugaauuaauagcucuccuacuauuaauuuacaugugcuuuuuguguggcgcu

SEQ ID NO: 124656 - RNA, 64 nt, hsa
ucuucccaggaauaguacuuaauagauuuuaauguuaauuuauauucauuguagaauugaauuu

SEQ ID NO: 124657 - RNA, 64 nt, hsa
gcacaucagcugugaugacauuuugaggguaguuuuaauuuagcucgguucucuuguuggugcc

SEQ ID NO: 124658 - RNA, 64 nt, hsa
aaccuuuaaaaauuuucucauuaagacaauguuuuuaauuuaauuugccucauuacaucuaaua

SEQ ID NO: 124659 - RNA, 64 nt, hsa
aauuuuuuauauuuccuuacaauuuugguggccauuaauuuaacuuuaggcuuuugggcauaug

SEQ ID NO: 124660 - RNA, 64 nt, hsa
gcagggcagacauacauaugauagcuugugcugauuaauuuaaccccauuuguaaacagaugaa

SEQ ID NO: 124661 - RNA, 64 nt, hsa
uuuugcaaauuuuuaucauacuaaaguuguucuuuuaauuuagcauaucuaaaauaggauuuag

SEQ ID NO: 124662 - RNA, 64 nt, hsa
ugaagcauagcaaaucuacuuuaaacuggauggguuaauuuauauaaacauuuucauuuuaagu

SEQ ID NO: 124663 - RNA, 64 nt, hsa
aaaaaucucagguaagaaggcaaggaaggcucuguuaauuuauagcuguuuagaggggaaagca

SEQ ID NO: 124664 - RNA, 64 nt, hsa
aaugauaauaaaaaugguuuucucaaaacugguguuaauuuaaguuaccugggauguuucuuug

SEQ ID NO: 124665 - RNA, 64 nt, hsa
uagcacucuagcuugcauggguguugcauugacuuuaauuuauugaaaaauacaaauuuuugua

SEQ ID NO: 124666 - RNA, 64 nt, hsa
uguagcauauaggugauguuugcucuuguuuuuauuaauuuauauguauauuuuuuuaauuuaa

SEQ ID NO: 124667 - RNA, 64 nt, hsa
gcucuuguuuuuauuaauuuauauguauauuuuuuuaauuuaacaugaacacccuuagaaaaug

SEQ ID NO: 124668 - RNA, 64 nt, hsa
guguuauuccaggauauuuuacuuaaucuaaaaguuaauuuauguugcucauauauuacucaag

SEQ ID NO: 124669 - RNA, 64 nt, hsa
gccauguaaguauuguauaaaaagauucacauuguuaauuuagccauuuugaaauucagaugag

SEQ ID NO: 124670 - RNA, 64 nt, hsa
ccguguagguuguauacuuacauuuuuucuuuccuuaauuuauacaugauccuuuuuccuuaau

SEQ ID NO: 124671 - RNA, 64 nt, hsa
uuucuuuccuuaauuuauacaugauccuuuuuccuuaauuuauacaugauccaggcacauuuga

SEQ ID NO: 124672 - RNA, 64 nt, hsa
gccauucacuuaaauaauucaugaagggaaugguuuaauuuaaaggaagaccuaauaggaagaa

SEQ ID NO: 124673 - RNA, 64 nt, hsa
uuuaaaaauuaauaacuuuuaguaauuacuuuuauuaauuuaaaauagaacgcuugagaggcac

SEQ ID NO: 124674 - RNA, 64 nt, hsa
auagguuuuuuaaaauuaauauuaauaacuuuuauuaauuuaaaauagaaugcuuaaaauaaaa

SEQ ID NO: 124675 - RNA, 64 nt, hsa
aaguagguuaaauuaaaaucuaauuuaaauuagguuaauuuauauuacauuguagaucauucuu

SEQ ID NO: 124676 - RNA, 64 nt, hsa
ugauaggacagugacaaaauucguaagugaauacuuaauuuaaaaguguuaacauuaaugcuca

SEQ ID NO: 124677 - RNA, 64 nt, hsa
gcaguuacuuuguaucuaauugauacauuuuauguuaauuuaccaccauacauuuuauuaauca

SEQ ID NO: 124678 - RNA, 64 nt, hsa
gcgcuaugaacugaaaaauauguuuucuuacuguuuaauuuauuuuuauuguuugaacaggaag

SEQ ID NO: 124679 - RNA, 64 nt, hsa
augcuguaaugaauauucuugugcauauuucacauuaauuuaugggauuacaucugcaggauaa

SEQ ID NO: 124680 - RNA, 64 nt, hsa
augugacuggagcauggaagugaaugcuacuuucuuaauuuaaucugcccuguccuaccugcuc

SEQ ID NO: 124681 - RNA, 64 nt, hsa
uuuuuuuuuuuuugcacuguaacuauaauaccucuuaauuuaccuuuuuaaaagcuguggguca

SEQ ID NO: 124682 - RNA, 64 nt, hsa
ugccguaauuuugauacaucugugauuuaggucauuaauuuagauaaacuagcucauuauuucc

SEQ ID NO: 124683 - RNA, 64 nt, hsa
guuaacaguugaguguucagcuccugacuuaccuuuaauuuagaggcaauauuauuacuguuua

SEQ ID NO: 124684 - RNA, 64 nt, hsa
auauguauauuuuauugauuucaguuugcaauuuuuaauuuauguucuuaugaugguuuaaacc

SEQ ID NO: 124685 - RNA, 64 nt, hsa
agauaacgugacuucaugagggagaaugucacuauuaauuuaucauaccauuuccaaaaagggc

SEQ ID NO: 124686 - RNA, 64 nt, hsa
agcuuuagaguaaggaugagaaacuugaguguuuuuaauuuaaagauaaaagccuguguuuuac

SEQ ID NO: 124687 - RNA, 64 nt, hsa
aaacuaucaacuguaaagcuccuuuucuuccacuuuaauuuaaaaguucaugucauuuaaaaac

SEQ ID NO: 124688 - RNA, 64 nt, hsa
uugccaccauuggccauacuguguguuuguuuguuuaauuuacuuucacaauaaacuucugugu

SEQ ID NO: 124689 - RNA, 64 nt, hsa
aaauugaaguucaaucuuaaguuuuuugcugucuuuaauuuacuagaauugccuaauuuuuagu

SEQ ID NO: 124690 - RNA, 64 nt, hsa
acuuuuaauuuacacuuaguaaauuaaaaguuguuuaauuuacuuggcauuuuaggacauguac

SEQ ID NO: 124691 - RNA, 64 nt, hsa
aauuuuuuuaauucauguuuuucauuugauacuuuuaauuuacacuuaguaaauuaaaaguugu

SEQ ID NO: 124692 - RNA, 64 nt, hsa
ggggaaggcgauguggugaccccacccccacccguuaauuuaaagcuguuucuaaacaguugag

SEQ ID NO: 124693 - RNA, 64 nt, hsa
cuauucuuugaccaaacuguggguauuguuaauauuaauuuauauuugucucauuuuguaugua

SEQ ID NO: 124694 - RNA, 64 nt, hsa
accagcagcauuguacagcaagggguaaauaagcuuaauuuauuaauuuaccaggcuuaauuaa

SEQ ID NO: 124695 - RNA, 64 nt, hsa
cauuguacagcaagggguaaauaagcuuaauuuauuaauuuaccaggcuuaauuaagaucccau

SEQ ID NO: 124696 - RNA, 64 nt, hsa
uuuucacaucauguaaugugaggccuuguacuuguuaauuuauaucucagaucauauuugaugg

SEQ ID NO: 124697 - RNA, 64 nt, hsa
ugcuggcucagcauccucaggaccaaguuguugcuuaauuuauuguuuuuuaauaacuaaucca

SEQ ID NO: 124698 - RNA, 64 nt, hsa
uugccacgugugcugugacuucucugugggugauuuaauuuauuuggauccaccucugagugag

SEQ ID NO: 124699 - RNA, 64 nt, hsa
cuuuagaacuauuaauagcaaccugcauuuuuuuuuaauuuauacuucagaauccuuuaagaac

SEQ ID NO: 124700 - RNA, 64 nt, hsa
acugcuguguugagcuuuucuuuccugggguauauuaauuuaguuauauuuagcagaagaggaa

SEQ ID NO: 124701 - RNA, 64 nt, hsa
auuguaacuuugcagcuuuuuuauuuagguagcuuuaauuuauuuaugaaaguuaauccauuuc

SEQ ID NO: 124702 - RNA, 64 nt, hsa
ugaaaugcuaugauucacauguaacauuuaaacauuaauuuaaaaagggaaccuuggagaauuc

SEQ ID NO: 124703 - RNA, 64 nt, hsa
cuuuuguucacuaguuccuuuuuucucuacauuuuuaauuuauuaaacuugcugugaaaacacu

SEQ ID NO: 124704 - RNA, 64 nt, hsa
auaaaaggaaaaaaaacuuagccuagaauuagaauuaauuuaauugaauucaucuaaagauguc

SEQ ID NO: 124705 - RNA, 64 nt, hsa
ugcagccugggaucucccuacuccauuuuuuccuuuaauuuaaguggccacauguauaugucuu

SEQ ID NO: 124706 - RNA, 64 nt, hsa
uggagaggauuuucuugguuacuuguauucacgguuaauuuacaacccaaacagcaaaacacag

SEQ ID NO: 124707 - RNA, 64 nt, hsa
gaauuucuccuuuuaguguuuauauacgugcagauuaauuuauauauauauauauacacacaca

SEQ ID NO: 124708 - RNA, 64 nt, hsa
auagaauaucauaugcacugggaguuaaauauauuuaauuuaaugaucauuauauauguggggg

SEQ ID NO: 124709 - RNA, 64 nt, hsa
cgauguauuuuuguacacuugaaauagaguacucuuaauuuacugggcaaaugugcuuggaauu

SEQ ID NO: 124710 - RNA, 64 nt, hsa
agaaaacuaccuggugaugcaaucuuuuuuuuuuuuaauuuaauuuaauuuuaaaauaaaugcu

SEQ ID NO: 124711 - RNA, 64 nt, hsa
acuaccuggugaugcaaucuuuuuuuuuuuuaauuuaauuuaauuuuaaaauaaaugcugcauu

SEQ ID NO: 124712 - RNA, 64 nt, hsa
cagccaaccugugcaaccugcuggagcuuuauuuuuaauuuaauuuauauagaguaccuauuau

SEQ ID NO: 124713 - RNA, 64 nt, hsa
aaccugugcaaccugcuggagcuuuauuuuuaauuuaauuuauauagaguaccuauuauuauau

SEQ ID NO: 124714 - RNA, 64 nt, hsa
auuuucuuaauuaugguaccucugucuauaggacuuaauuuagcaguccauuuuugaguaaaac

SEQ ID NO: 124715 - RNA, 64 nt, hsa
auguuauccacuacagguuuuaugagacuuccuauuaauuuauuaaauuuauuaaauguuggcu

SEQ ID NO: 124716 - RNA, 64 nt, hsa
augaagauguuuucauuaauagucugguuuaguauuaauuuaaccuugaaauaagaaauugguc

SEQ ID NO: 124717 - RNA, 64 nt, hsa
ccuucaucuuuaaccugguggauggagccaguuauuaauuuauaauaauacaugucugaaauuu

SEQ ID NO: 124718 - RNA, 64 nt, hsa
uaccaauuaauauuuuugaaagagcucuuuuagguuaauuuaaguacagcaauuucucauguaa

SEQ ID NO: 124719 - RNA, 64 nt, hsa
aacgguuuaaacaggaaggauugugcagcaggcuuuaauuuaauguagauucauacugcucugu

SEQ ID NO: 124720 - RNA, 64 nt, hsa
guugucguuuuagggcuuaaggguuaauucacccagaguauauuaauauaauaaaaagaucacu

SEQ ID NO: 124721 - RNA, 64 nt, hsa
gagagaaauaacuuuaaaguuuauuagacaaaacagaguauagaugccaagaugucuguaaaau

SEQ ID NO: 124722 - RNA, 64 nt, hsa
cggggugaauauuuuauacuguaagugagcaaucagaguauaauguuuauggugacaaaauuaa

SEQ ID NO: 124723 - RNA, 64 nt, hsa
gcgguuucccaagccuuuguccaucucagcccccagaguauaucugugcuuggggaaucucaca

SEQ ID NO: 124724 - RNA, 64 nt, hsa
ggaaucaaugggucccauggaguaaauuaguuccagaguauauucaugcccccgagaggaaauu

SEQ ID NO: 124725 - RNA, 64 nt, hsa
aggcggccaaggcucuguuccaggaaauucuugaagaguauaaugaaagcaacaccaaaaugaa

SEQ ID NO: 124726 - RNA, 64 nt, hsa
uguggauguacuguuuguauauauuguauauauuaaaacagagauaugugcaugaaaucaagaa

SEQ ID NO: 124727 - RNA, 64 nt, hsa
cuaauacugcuuaagaaaauuaaguuacuuuugcaaaacagauaaucauaagaugaaucaguau

SEQ ID NO: 124728 - RNA, 64 nt, hsa
ccaagagucuugcuaccaggagggcaagaagaccaaaacagacagacaaguccagcagaagcag

SEQ ID NO: 124729 - RNA, 64 nt, hsa
auuguaguaaaaaagucuucuuuacuaucuuaauaaaacagauauugugagauucacauacaaa

SEQ ID NO: 124730 - RNA, 64 nt, hsa
acuggugccuaccauacacggaaagcaaaacagaaaaacagaagacaaaaaauagagaucagca

SEQ ID NO: 124731 - RNA, 64 nt, hsa
gugccuguacuggugccuaccauacacggaaagcaaaacagaaaaacagaagacaaaaaauaga

SEQ ID NO: 124732 - RNA, 64 nt, hsa
guauaaaauaaaauacauuuauaaaauaaaaaggaaaacagacuuaaauuuucuccuauguuaa

SEQ ID NO: 124733 - RNA, 64 nt, hsa
uuuauaaugaaaauaaacauguauaaaauuuaaaaaaacagacucccauuucuuaaaaacggau

SEQ ID NO: 124734 - RNA, 64 nt, hsa
ggugaggugcuguguuucuuauuucauacgagauaaaacagagagaaguucucucuucuccagc

SEQ ID NO: 124735 - RNA, 64 nt, hsa
cuggaacuuuugacuuuggguccccaaacagccaaaaacagauacagaaaucuuugguugugug

SEQ ID NO: 124736 - RNA, 64 nt, hsa
acucagcuaaauauuugcauuuaggaauacuccuaaaacagauauugccaacuagauacacugc

SEQ ID NO: 124737 - RNA, 64 nt, hsa
auaaggaguauauuuucaagccaagaaccaguagaaaacagaaauaauggugcucccaaauauu

SEQ ID NO: 124738 - RNA, 64 nt, hsa
agucacuauuuauuauugcuuaugugcccuguucaaaacagaggcacuuaauuugaucuuuuau

SEQ ID NO: 124739 - RNA, 64 nt, hsa
aagaaaaaaggccuugaauugacaaauuaacagaaaaacagaacaaguuuauucuaucauuugg

SEQ ID NO: 124740 - RNA, 64 nt, hsa
auuucccacaaaguccauuuugccuuuguugccuaaaacagacaaaauagacuuagauuuauua

SEQ ID NO: 124741 - RNA, 64 nt, hsa
agugaaucaacuuccacuuaguuguaccgagcauaaaacagaacuugggcuuccuggcagugag

SEQ ID NO: 124742 - RNA, 64 nt, hsa
gagaaacaggaaacaaagaaugccgaaaagaaugaaaacagagaaaaaauguaugugcuugaaa

SEQ ID NO: 124743 - RNA, 64 nt, hsa
ugaaaaaugcuaaucucuuugacuuagucagaaaaaaacagaggauaauuaagauacuagucau

SEQ ID NO: 124744 - RNA, 64 nt, hsa
aacagcuucucaguuaagugaaaauaaaccaguuaaaacagaaccuuuaagagcaaccauggca

SEQ ID NO: 124745 - RNA, 64 nt, hsa
ggccaaauggaaagaacacauaauaaacaagaaaaaaacagaggugaagaaaaauccaagucug

SEQ ID NO: 124746 - RNA, 64 nt, hsa
gcggacuaugcagagugcuugugaggguuucacuaaaacagaggcaaaacuguccauugaauuc

SEQ ID NO: 124747 - RNA, 64 nt, hsa
agagacacaguccugcagccucauauggcucaauaaaacagaaaggggcaaguauagaagauua

SEQ ID NO: 124748 - RNA, 64 nt, hsa
cagaaaaauauauauuuuaaguuuaaaaaacagaaaaacagacaaaacaauccccaucagguag

SEQ ID NO: 124749 - RNA, 64 nt, hsa
aacauauacagaaaaauauauauuuuaaguuuaaaaaacagaaaaacagacaaaacaaucccca

SEQ ID NO: 124750 - RNA, 64 nt, hsa
caaaaaaaaaaaaaaaaaaaagaaaaaaaaagaaaaaacagaaauauauccagcuaacaagauc

SEQ ID NO: 124751 - RNA, 64 nt, hsa
aauguuuauuuaaaaaaaaaaaagaugacaaagaaaaacagagagagagaauauuggagauguc

SEQ ID NO: 124752 - RNA, 60 nt, hsa
auuuauuauaucguacauaaguuaguaugaaaaacagacuaucaccuuuauugagaaaca

SEQ ID NO: 124753 - RNA, 64 nt, hsa
uacauuccuuggauaucugacaacguguuucugaaaaacagauuuucauaaguaauaauaaaaa

SEQ ID NO: 124754 - RNA, 64 nt, hsa
cgacuuuuuaguuuggguccuacuguuguuauuaaaaacagaacaaaaacaaaacacacacaca

SEQ ID NO: 124755 - RNA, 64 nt, hsa
aaaacagaacaaaaacaaaacacacacacacacaaaaacagaaacaaaaaaaaccagcauuaaa

SEQ ID NO: 124756 - RNA, 64 nt, hsa
uaaaguauuacugauaaaaaauuaucuaaggaaaaaaacagaaaauuauuugguguggccaucu

SEQ ID NO: 124757 - RNA, 64 nt, hsa
uuuuaaaaagugucuguaaaucuucaguguuaaaaaaacagaugcccauuuguuggcuguuuuu

SEQ ID NO: 124758 - RNA, 64 nt, hsa
auugggagcuaggucagcugccagaugaguugcaaaaacagaaaaaaaccuacccauugaauaa

SEQ ID NO: 124759 - RNA, 64 nt, hsa
uuaauuguauuuuaaauugaagccuuacauuuuuaaaacagauuuuguauuuuucuuguggagg

SEQ ID NO: 124760 - RNA, 64 nt, hsa
cucuuucuucagaauuaaaacuaaaaucuuaaauaaaacagaaaacuugauggugacacuuggg

SEQ ID NO: 124761 - RNA, 64 nt, hsa
acguuugugcaguauugaaaagacaggagaaaagaaaacagaaaccugguuauaaccugacgcu

SEQ ID NO: 124762 - RNA, 64 nt, hsa
ucuguugcaacuaugaaugaaaacaaaacaccacaaaacagacuucacuaacacagaaaaacag

SEQ ID NO: 124763 - RNA, 64 nt, hsa
caaaacaccacaaaacagacuucacuaacacagaaaaacagaaacugagugugagaguugugaa

SEQ ID NO: 124764 - RNA, 64 nt, hsa
aaaaacguuucuuucuuauuuuuuuucuuuuccuaaaacagacuugaaaguauuauacagggau

SEQ ID NO: 124765 - RNA, 64 nt, hsa
uugacuacuuuguucuuugguuaagauccaaaagaaaacagaaaacaauuccacgaggccaauc

SEQ ID NO: 124766 - RNA, 64 nt, hsa
gugagcuuugaaguagguggcuugagcuagagauaaaacagaaucuucuggguaguccccuguu

SEQ ID NO: 124767 - RNA, 64 nt, hsa
ggcagacaauaguauagaagucuggaaaaaaacaaaaacagaauuugagaaccuuggaccacuc

SEQ ID NO: 124768 - RNA, 64 nt, hsa
aaauauauaugaucauugaaauacuuuuuaacaaaaaacagauucuauauuauuauauauauau

SEQ ID NO: 124769 - RNA, 64 nt, hsa
aggaagcuccagauccaguaucuuguuuggccucaaaacagaagcagcuucuuuugucucccag

SEQ ID NO: 124770 - RNA, 64 nt, hsa
agcauccaggcugaccucaaggaagcauagccacaaaacagaauagcaccugucuguacauauu

SEQ ID NO: 124771 - RNA, 64 nt, hsa
uuagccauaguucugaaugcacuucaauuaagccaaaacagacagcuagugaucuuuuuauaug

SEQ ID NO: 124772 - RNA, 64 nt, hsa
uuucacccuacuucaaguacacuuccacaccaggaaaacagacccaaauuccauaaacagaacu

SEQ ID NO: 124773 - RNA, 64 nt, hsa
acuuauccagggccauagaaguaugaaucuaauuaaaacagaaaugggaauuauugcacagaaa

SEQ ID NO: 124774 - RNA, 64 nt, hsa
acaaugaauggaaucuacugacacagcuaauuggaaaacagaugucuucuucuguccuauugau

SEQ ID NO: 124775 - RNA, 64 nt, hsa
ggugagguugucccugcaguacuccuugucacagaaaacagaaaaacaguuguuccuguugugu

SEQ ID NO: 124776 - RNA, 64 nt, hsa
auuuucuaaauaaaaauauugaaugcuuucuaacaaaacagaauauuucaaagaaauuagcaag

SEQ ID NO: 124777 - RNA, 64 nt, hsa
cagccugcauuaauuugcuuuucuuuuaauuaauaaaacagacacagaguuaagauaguuuauc

SEQ ID NO: 124778 - RNA, 64 nt, hsa
cacuuacagaagaguauccuaaugaaaacacuuuaaaacagauugggaaaacugagcauguguc

SEQ ID NO: 124779 - RNA, 64 nt, hsa
aaaaugguuccugauuuauuuucagccaguaaucaaaacagacugggaaugaauaaagcacuua

SEQ ID NO: 124780 - RNA, 64 nt, hsa
cuaccuggagcaaaacagaugugcagaucuaacuaaaacagagcuauagugaaacaaaaugaga

SEQ ID NO: 124781 - RNA, 64 nt, hsa
agaaacugaacuggcaaaauuaacuaccuggagcaaaacagaugugcagaucuaacuaaaacag

SEQ ID NO: 124782 - RNA, 64 nt, hsa
uuguuaccauccuuuaaucauaacuaaaacauugaaaacagaacaaaugagaaaagaaaaaaaa

SEQ ID NO: 124783 - RNA, 64 nt, hsa
cccauuuguuucaaagaggucugcauguugggcgaaaacagaacaacuguguuuccuuuuacuu

SEQ ID NO: 124784 - RNA, 64 nt, hsa
accaaaaacuagacaaauaaagacaaacuaaaacaaaacagaacaaaagcaaaggaaaaugcuu

SEQ ID NO: 124785 - RNA, 64 nt, hsa
uuccgucugauagauggaaggguaacauugccuuaaaacagaaauaugcaggcguuggcuauuu

SEQ ID NO: 124786 - RNA, 64 nt, hsa
cccaaaugccuacuggauccuacagccauacaggaaaacagacggacacagcccuuuccuuaaa

SEQ ID NO: 124787 - RNA, 64 nt, hsa
gcaguauacugcuaucgagacauguuuguucggaaaaacagaaagauccauaaagaugcagagu

SEQ ID NO: 124788 - RNA, 64 nt, hsa
aauucaccuuaccaauauuaaucccagcguguguaaaacagaacaguaacucuaugugacccca

SEQ ID NO: 124789 - RNA, 64 nt, hsa
cucuuucugaaaucuaagcuuuguauuuaauuaaaaaacagaauucaacaucuauugauaaaac

SEQ ID NO: 124790 - RNA, 64 nt, hsa
gagguuuacgagauuuggcugccuuaagaauacaaaaacagaaaugcagaauuucuggggcugc

SEQ ID NO: 124791 - RNA, 64 nt, hsa
cuguaacucacccccaccaccauacacacacacaaaaacagaaacaaaaucaaaacagagaaag

SEQ ID NO: 124792 - RNA, 64 nt, hsa
caccauacacacacacaaaaacagaaacaaaaucaaaacagagaaagcagaaaaucuaccaaga

SEQ ID NO: 124793 - RNA, 64 nt, hsa
aaugagaugggaugaaauccuaugacaguaagcaaaaacagaaccaugaaaaaugauuggacau

SEQ ID NO: 124794 - RNA, 64 nt, hsa
gauccuuguucuuugacaauuugugaugucugaaaaaacagaacccgaaaagcuauggugauau

SEQ ID NO: 124795 - RNA, 64 nt, hsa
caucaaaauauacuuuuggaaguagaugacuuugaaaacagaaaugguacugauggccucucau

SEQ ID NO: 124796 - RNA, 64 nt, hsa
cuucauuacucaucacauccccgaugcuaaauuaaaaacagaaaacaaagaaaagcuuguauau

SEQ ID NO: 124797 - RNA, 64 nt, hsa
acuugguuaaguuuccacccccuccaauuugugaaaaacagagcagugaccuagcuguugcauc

SEQ ID NO: 124798 - RNA, 64 nt, hsa
uuuaguauuuaauggucuuuggagaaaaaauaauaaaacagaguguuauauauauauuuuuugg

SEQ ID NO: 124799 - RNA, 64 nt, hsa
ggaagucagcucuuucacuuuuuacaaguuggcaaaaacagacuuccggggaauuucgauguuu

SEQ ID NO: 124800 - RNA, 64 nt, hsa
ugaugucuguaauaaaagugggaaggugggucuuaaaacagaccaaaccccgccccgcccccaa

SEQ ID NO: 124801 - RNA, 64 nt, hsa
aaaagaggcagggguugcaauccuagucucugauaaaacagaauuuaaaccaacaaagaucaaa

SEQ ID NO: 124802 - RNA, 64 nt, hsa
ggcuacauaaccaaaauagcaugguacugguaccaaaacagagauauagaucaauagaacagaa

SEQ ID NO: 124803 - RNA, 64 nt, hsa
uacauugauaggauacauacugaaaucagcaaacaaaacagauguauagauuagaguguggaga

SEQ ID NO: 124804 - RNA, 64 nt, hsa
caaacaaaacagauguauagauuagaguguggagaaaacagaggaaaacuugcaguuacgaaga

SEQ ID NO: 124805 - RNA, 64 nt, hsa
acaaacuacccauccaugagcugccaggcagucaaaaacagaagcuuccccgacuugugagucc

SEQ ID NO: 124806 - RNA, 64 nt, hsa
cccucccuuccuggagggauggccagggaaggagaaaacagagaacugacaccuuugaaaccac

SEQ ID NO: 124807 - RNA, 64 nt, hsa
ucuguuuuucuuuuugauuuuuguuuuuuaaaccaaaacagacaauagcuuauuuucuuuccgc

SEQ ID NO: 124808 - RNA, 64 nt, hsa
cccuacccccaccccucuagagacccuccagcuaaaaacagagccugaguucagggacccaagu

SEQ ID NO: 124809 - RNA, 64 nt, hsa
acauggcaggccuggaauccugcagcccuccccaaaaacagauugacccaggaaugaaucugcu

SEQ ID NO: 124810 - RNA, 64 nt, hsa
aaacuugaacauucuacuuuuguugauacagaaaaaaacagaugaugccuuuuaugagcacaaa

SEQ ID NO: 124811 - RNA, 64 nt, hsa
aaguuuuuaaaggugauucugugcaguaagguauaaaacagauauauaauaaauagccuagcuu

SEQ ID NO: 124812 - RNA, 64 nt, hsa
uuguauguuuggauuuucaauaucgacuuugcuuaaaacagagcccaccugcauaguaacugug

SEQ ID NO: 124813 - RNA, 64 nt, hsa
uagcauccuacuucugcugggcugcaucauuauauaaugccacaggcaucuagucaagguaaag

SEQ ID NO: 124814 - RNA, 64 nt, hsa
uuaauaguuguuuuugucccuuucuuggaaauguuaaugccaaaguugccugaacauugggcgg

SEQ ID NO: 124815 - RNA, 64 nt, hsa
aagugaaaaauguggguagcuuauacuuucaaacuaaugccagugacuagagagagguuucauu

SEQ ID NO: 124816 - RNA, 64 nt, hsa
aaauacaggguauguucuaaucuauauuaagcaauaaugccagugcauaaucauuccauuuguu

SEQ ID NO: 124817 - RNA, 64 nt, hsa
uuuaaugccaagauugacagguuggccguuugcuuaaugccagaaguugggggaaaguuacgcu

SEQ ID NO: 124818 - RNA, 64 nt, hsa
gaaaaauggccauguugucuuuuuuuuuuuuuuuuaaugccaagauugacagguuggccguuug

SEQ ID NO: 124819 - RNA, 64 nt, hsa
aaacauuuuaaauuuccuagaaaugucuucaggguaaugccaauuuaagaucucucuuaacuug

SEQ ID NO: 124820 - RNA, 64 nt, hsa
ugagacugacaaaaaccuuaauguaauuuacuuauaaugccagaaggaaaacacuauuuucaua

SEQ ID NO: 124821 - RNA, 64 nt, hsa
cuaugcuuggagagagcccugaauccuuuaacuuuaaugccaucuuaggccuggaaguuagagu

SEQ ID NO: 124822 - RNA, 64 nt, hsa
aaugcuagugacugcacaauauugugacuguacuuaaugccacugaacuguacacuuuaaaaug

SEQ ID NO: 124823 - RNA, 64 nt, hsa
guaguccuuuccuguagauauuuuuaaugccauuuaaugccauugucaccuuggauuuaugagu

SEQ ID NO: 124824 - RNA, 64 nt, hsa
guauuucgugguaguccuuuccuguagauauuuuuaaugccauuuaaugccauugucaccuugg

SEQ ID NO: 124825 - RNA, 64 nt, hsa
aagcaaugggccuuguaccaaaggaccucauggcuaaugccacuugcuucaggagugccucacg

SEQ ID NO: 124826 - RNA, 64 nt, hsa
guuauugaggugaucaagaucuguuccacagggcuaaugccaccaucuccccucaaaauuuugu

SEQ ID NO: 124827 - RNA, 64 nt, hsa
uauuagauaccuuggguugaauacacuuuuaacagcccuagaucgauagcccuagcccuagaua

SEQ ID NO: 124828 - RNA, 64 nt, hsa
auacacuuuuaacagcccuagaucgauagcccuagcccuagauagauagcccuagcccuagaua

SEQ ID NO: 124829 - RNA, 64 nt, hsa
gaucgauagcccuagcccuagauagauagcccuagcccuagauagauagcuauuagguuggugc

SEQ ID NO: 124830 - RNA, 59 nt, hsa; identical to SEQ ID NO: 76155

SEQ ID NO: 124831 - RNA, 64 nt, hsa; identical to SEQ ID NO: 76156

SEQ ID NO: 124832 - RNA, 64 nt, hsa; identical to SEQ ID NO: 76157

SEQ ID NO: 124833 - RNA, 64 nt, hsa; identical to SEQ ID NO: 76158

SEQ ID NO: 124834 - RNA, 64 nt, hsa; identical to SEQ ID NO: 76159

SEQ ID NO: 124835 - RNA, 64 nt, hsa; identical to SEQ ID NO: 76160

SEQ ID NO: 124836 - RNA, 64 nt, hsa; identical to SEQ ID NO: 76161

SEQ ID NO: 124837 - RNA, 64 nt, hsa; identical to SEQ ID NO: 76162

SEQ ID NO: 124838 - RNA, 64 nt, hsa; identical to SEQ ID NO: 76163

SEQ ID NO: 124839 - RNA, 64 nt, hsa; identical to SEQ ID NO: 76164

SEQ ID NO: 124840 - RNA, 64 nt, hsa; identical to SEQ ID NO: 76165

SEQ ID NO: 124841 - RNA, 64 nt, hsa; identical to SEQ ID NO: 76166

SEQ ID NO: 124842 - RNA, 64 nt, hsa; identical to SEQ ID NO: 76167

SEQ ID NO: 124843 - RNA, 64 nt, hsa; identical to SEQ ID NO: 76168

SEQ ID NO: 124844 - RNA, 64 nt, hsa; identical to SEQ ID NO: 76169

SEQ ID NO: 124845 - RNA, 58 nt, hsa; identical to SEQ ID NO: 76170

SEQ ID NO: 124846 - RNA, 64 nt, hsa; identical to SEQ ID NO: 76171

SEQ ID NO: 124847 - RNA, 64 nt, hsa; identical to SEQ ID NO: 76172

SEQ ID NO: 124848 - RNA, 64 nt, hsa; identical to SEQ ID NO: 76173

SEQ ID NO: 124849 - RNA, 64 nt, hsa; identical to SEQ ID NO: 76174

SEQ ID NO: 124850 - RNA, 64 nt, hsa; identical to SEQ ID NO: 76175

SEQ ID NO: 124851 - RNA, 52 nt, hsa; identical to SEQ ID NO: 76176

SEQ ID NO: 124852 - RNA, 64 nt, hsa; identical to SEQ ID NO: 76177

SEQ ID NO: 124853 - RNA, 64 nt, hsa; identical to SEQ ID NO: 76178

SEQ ID NO: 124854 - RNA, 64 nt, hsa; identical to SEQ ID NO: 76179

SEQ ID NO: 124855 - RNA, 64 nt, hsa; identical to SEQ ID NO: 76180

SEQ ID NO: 124856 - RNA, 64 nt, hsa; identical to SEQ ID NO: 76181

SEQ ID NO: 124857 - RNA, 64 nt, hsa; identical to SEQ ID NO: 76182

SEQ ID NO: 124858 - RNA, 64 nt, hsa; identical to SEQ ID NO: 76183

SEQ ID NO: 124859 - RNA, 64 nt, hsa; identical to SEQ ID NO: 76184

SEQ ID NO: 124860 - RNA, 64 nt, hsa; identical to SEQ ID NO: 76185

SEQ ID NO: 124861 - RNA, 64 nt, hsa; identical to SEQ ID NO: 76186

SEQ ID NO: 124862 - RNA, 64 nt, hsa; identical to SEQ ID NO: 76187

SEQ ID NO: 124863 - RNA, 64 nt, hsa; identical to SEQ ID NO: 76188

SEQ ID NO: 124864 - RNA, 64 nt, hsa; identical to SEQ ID NO: 76189

SEQ ID NO: 124865 - RNA, 64 nt, hsa; identical to SEQ ID NO: 76190

SEQ ID NO: 124866 - RNA, 64 nt, hsa; identical to SEQ ID NO: 76191

SEQ ID NO: 124867 - RNA, 64 nt, hsa; identical to SEQ ID NO: 76192

SEQ ID NO: 124868 - RNA, 64 nt, hsa; identical to SEQ ID NO: 76193

SEQ ID NO: 124869 - RNA, 64 nt, hsa; identical to SEQ ID NO: 76194

SEQ ID NO: 124870 - RNA, 64 nt, hsa; identical to SEQ ID NO: 76195

SEQ ID NO: 124871 - RNA, 64 nt, hsa; identical to SEQ ID NO: 76196

SEQ ID NO: 124872 - RNA, 64 nt, hsa; identical to SEQ ID NO: 76197

SEQ ID NO: 124873 - RNA, 64 nt, hsa; identical to SEQ ID NO: 76198

SEQ ID NO: 124874 - RNA, 64 nt, hsa; identical to SEQ ID NO: 76199

SEQ ID NO: 124875 - RNA, 64 nt, hsa; identical to SEQ ID NO: 76200

SEQ ID NO: 124876 - RNA, 64 nt, hsa; identical to SEQ ID NO: 76201

SEQ ID NO: 124877 - RNA, 64 nt, hsa; identical to SEQ ID NO: 76202

SEQ ID NO: 124878 - RNA, 64 nt, hsa; identical to SEQ ID NO: 76203

SEQ ID NO: 124879 - RNA, 64 nt, hsa; identical to SEQ ID NO: 76204

SEQ ID NO: 124880 - RNA, 64 nt, hsa; identical to SEQ ID NO: 76205

SEQ ID NO: 124881 - RNA, 64 nt, hsa; identical to SEQ ID NO: 76206

SEQ ID NO: 124882 - RNA, 64 nt, hsa; identical to SEQ ID NO: 76207

SEQ ID NO: 124883 - RNA, 64 nt, hsa; identical to SEQ ID NO: 76208

SEQ ID NO: 124884 - RNA, 64 nt, hsa; identical to SEQ ID NO: 76209

SEQ ID NO: 124885 - RNA, 64 nt, hsa; identical to SEQ ID NO: 76210

SEQ ID NO: 124886 - RNA, 64 nt, hsa; identical to SEQ ID NO: 76211

SEQ ID NO: 124887 - RNA, 64 nt, hsa; identical to SEQ ID NO: 76212

SEQ ID NO: 124888 - RNA, 64 nt, hsa; identical to SEQ ID NO: 76213

SEQ ID NO: 124889 - RNA, 64 nt, hsa; identical to SEQ ID NO: 76214

SEQ ID NO: 124890 - RNA, 64 nt, hsa; identical to SEQ ID NO: 76215

SEQ ID NO: 124891 - RNA, 64 nt, hsa; identical to SEQ ID NO: 76216

SEQ ID NO: 124892 - RNA, 64 nt, hsa; identical to SEQ ID NO: 76217

SEQ ID NO: 124893 - RNA, 64 nt, hsa; identical to SEQ ID NO: 76218

SEQ ID NO: 124894 - RNA, 64 nt, hsa; identical to SEQ ID NO: 76219

SEQ ID NO: 124895 - RNA, 64 nt, hsa; identical to SEQ ID NO: 55961

SEQ ID NO: 124896 - RNA, 64 nt, hsa; identical to SEQ ID NO: 55962

SEQ ID NO: 124897 - RNA, 64 nt, hsa; identical to SEQ ID NO: 55963

SEQ ID NO: 124898 - RNA, 64 nt, hsa; identical to SEQ ID NO: 55964

SEQ ID NO: 124899 - RNA, 64 nt, hsa; identical to SEQ ID NO: 55965

SEQ ID NO: 124900 - RNA, 64 nt, hsa; identical to SEQ ID NO: 55966

SEQ ID NO: 124901 - RNA, 64 nt, hsa; identical to SEQ ID NO: 55967

SEQ ID NO: 124902 - RNA, 64 nt, hsa; identical to SEQ ID NO: 55968

SEQ ID NO: 124903 - RNA, 64 nt, hsa; identical to SEQ ID NO: 55969

SEQ ID NO: 124904 - RNA, 64 nt, hsa; identical to SEQ ID NO: 55970

SEQ ID NO: 124905 - RNA, 64 nt, hsa; identical to SEQ ID NO: 93643

SEQ ID NO: 124906 - RNA, 64 nt, hsa; identical to SEQ ID NO: 93644

SEQ ID NO: 124907 - RNA, 64 nt, hsa; identical to SEQ ID NO: 93645

SEQ ID NO: 124908 - RNA, 64 nt, hsa; identical to SEQ ID NO: 93646

SEQ ID NO: 124909 - RNA, 64 nt, hsa; identical to SEQ ID NO: 93647

SEQ ID NO: 124910 - RNA, 64 nt, hsa; identical to SEQ ID NO: 93648

SEQ ID NO: 124911 - RNA, 64 nt, hsa; identical to SEQ ID NO: 93649

SEQ ID NO: 124912 - RNA, 64 nt, hsa; identical to SEQ ID NO: 93650

SEQ ID NO: 124913 - RNA, 64 nt, hsa; identical to SEQ ID NO: 93651

SEQ ID NO: 124914 - RNA, 64 nt, hsa; identical to SEQ ID NO: 93652

SEQ ID NO: 124915 - RNA, 64 nt, hsa; identical to SEQ ID NO: 93653

SEQ ID NO: 124916 - RNA, 64 nt, hsa; identical to SEQ ID NO: 93654

SEQ ID NO: 124917 - RNA, 64 nt, hsa; identical to SEQ ID NO: 93655

SEQ ID NO: 124918 - RNA, 64 nt, hsa; identical to SEQ ID NO: 93656

SEQ ID NO: 124919 - RNA, 64 nt, hsa; identical to SEQ ID NO: 93657

SEQ ID NO: 124920 - RNA, 64 nt, hsa; identical to SEQ ID NO: 93658

SEQ ID NO: 124921 - RNA, 64 nt, hsa; identical to SEQ ID NO: 93659

SEQ ID NO: 124922 - RNA, 64 nt, hsa; identical to SEQ ID NO: 93660

SEQ ID NO: 124923 - RNA, 64 nt, hsa; identical to SEQ ID NO: 93661

SEQ ID NO: 124924 - RNA, 64 nt, hsa; identical to SEQ ID NO: 93662

SEQ ID NO: 124925 - RNA, 64 nt, hsa; identical to SEQ ID NO: 93663

SEQ ID NO: 124926 - RNA, 64 nt, hsa; identical to SEQ ID NO: 93664

SEQ ID NO: 124927 - RNA, 64 nt, hsa
cuuucuucaggaauaacugauauaucuuuauuacaaacugaaagagagaagauuaucaaacaaa

SEQ ID NO: 124928 - RNA, 64 nt, hsa
agaaaacaagcaguuucagauuuacgaacauugaaaacugaacuggcacagaaaaaaaaaauaa

SEQ ID NO: 124929 - RNA, 64 nt, hsa
aucucaugcaaugcacacuuucuucugaauuagcaaacugaauaaacuacagaaauuuuuuaga

SEQ ID NO: 124930 - RNA, 64 nt, hsa
aagggguuuguaguuguaagagauuuaauauucaaaacugaaauauucugcauuucuuagaaau

SEQ ID NO: 124931 - RNA, 64 nt, hsa
auuuuacaauugugaaaaccucauggauuugggcaaacugaauguauauaggcuuuugacaaaa

SEQ ID NO: 124932 - RNA, 64 nt, hsa
aaaggcaaacauaggucugggcauuaaauuauacaaacugaaaauguguuacaagaaaaauaug

SEQ ID NO: 124933 - RNA, 64 nt, hsa
uguuuaaaaauuugcaagcaucaagugucaaucaaaacugaagaugaaacacuaaugaauguug

SEQ ID NO: 124934 - RNA, 64 nt, hsa
cacuauguaaauggcucacaagucaauugcaaacaaacugaauguacaaaucuuagugcuggug

SEQ ID NO: 124935 - RNA, 64 nt, hsa
uaaaaugagacuuuuuauauguuaauguauaauaaaacugaaacaagauuauuuuccauuugaa

SEQ ID NO: 124936 - RNA, 64 nt, hsa
uauguuacauauguuuauauucacaaauauuuuuaaacugaaauaucugaacauaauauaauuu

SEQ ID NO: 124937 - RNA, 64 nt, hsa
agaucuucucuggucagacuuggaagaauuuccaaaacugaaguuagccccaagacuucccuag

SEQ ID NO: 124938 - RNA, 64 nt, hsa
uuuugguugauuuuuuugccuucccuucaauuuuaaacugaagcauuuuaauauggguagaaac

SEQ ID NO: 124939 - RNA, 64 nt, hsa
cguuuucacaaaacuauuugaguagaauaaauggaaacugaauuccauuugugcccguuaaacc

SEQ ID NO: 124940 - RNA, 64 nt, hsa
gagaagaaauugagggcaaaguaauaugucuccaaaacugaacugauugcuuguugagauuacc

SEQ ID NO: 124941 - RNA, 64 nt, hsa
auuuaaagucagauuuauagacucgaggagacagaaacugaaucccacaccuggugcaauuaga

SEQ ID NO: 124942 - RNA, 64 nt, hsa
auauuauuuuauaaaauguuuucuguauggcaauaaacugaaaacauggaucaacccuucuuuu

SEQ ID NO: 124943 - RNA, 64 nt, hsa
uaugauuaagcuuaaacccuguuagcaaaacugaaaacugaaauguucucaauaucaacauauu

SEQ ID NO: 124944 - RNA, 64 nt, hsa
caauuguuaugauuaagcuuaaacccuguuagcaaaacugaaaacugaaauguucucaauauca

SEQ ID NO: 124945 - RNA, 64 nt, hsa
gagaucugccucuguauagauguugucaguuaggaaacugaagccauaggucaggcagacauca

SEQ ID NO: 124946 - RNA, 64 nt, hsa
cauauccacaauuccaaaaucuccaaaccucugaaaacugaaauauuuuucauaaauuaggcgu

SEQ ID NO: 124947 - RNA, 64 nt, hsa
uuuaagcaaacuacuacagccaacucaaaagcuaaaacugaacaaauuugauguuaugcaaaca

SEQ ID NO: 124948 - RNA, 64 nt, hsa
caacgaauaguaaauaaugaacucgugcaagacaaaacugaaacccucuuuccaggaccucagu

SEQ ID NO: 124949 - RNA, 64 nt, hsa
uaagaugaucccaauaaaagaaaaauugcucaggaaacugaaccuuuuucugaaccaagcacug

SEQ ID NO: 124950 - RNA, 64 nt, hsa
aaugcugacaguuggagccaaugccucauaguguaaacugaaagaaaaauaguugcuuuuuaaa

SEQ ID NO: 124951 - RNA, 64 nt, hsa
agggauggggcaggggacuguuaggaugcauuauaaacugaaaagccuuuuuaaaauuuuaugu

SEQ ID NO: 124952 - RNA, 64 nt, hsa
ggucauaccagaaaucaucaauugagguacggagaaacugaacugagaagguaagaaaagcaau

SEQ ID NO: 124953 - RNA, 64 nt, hsa
aaaaaauagcaucuaguccaacuccuugauuguaaaacugaaaaacuaagguuauuugaauguu

SEQ ID NO: 124954 - RNA, 64 nt, hsa
agcaacaaacauuuccuaaaugggaugcaaaaagaaacugaaugauguugaauuuuaguuuuuc

SEQ ID NO: 124955 - RNA, 64 nt, hsa
agcuuacuuugcagagcuucccaaagugaaagggaaacugaacuucacaauuuugcaccuggcu

SEQ ID NO: 124956 - RNA, 64 nt, hsa
auguugcaaaagcuuacauuuuuccuuaaaaggaaaacugaaacccaguccuucaagcaucagc

SEQ ID NO: 124957 - RNA, 64 nt, hsa
uuuaaaaugccugaggaaauacauuuuucuuaauaaacugaagagucucaguauggcuauuaaa

SEQ ID NO: 124958 - RNA, 64 nt, hsa
aaugaugugccagcuaaaauugugugccauuuaaaaacugaaaauauuuuaaaauuauuugucu

SEQ ID NO: 124959 - RNA, 64 nt, hsa
gaucucaccugucgcguagcucuaauauucacauaaacugaaauaaagaaguggaaugaggagc

SEQ ID NO: 124960 - RNA, 64 nt, hsa
uaacuaaaggguaguuguuuuacaaugaagacuaaaacugaacaagauguugcaugcucuugag

SEQ ID NO: 124961 - RNA, 64 nt, hsa
uguuuugguauauuguacacaaaccuacaaaaauaaacugaacuugcaauauuuuugcaaaaaa

SEQ ID NO: 124962 - RNA, 64 nt, hsa
gcagaugaaugacuccaggaagaagguuaucaugaaacugaacucaccauuucuauuaauuucu

SEQ ID NO: 124963 - RNA, 64 nt, hsa
gaaaaaagggcaccuuugucacuugaaaggaaugaaacugaaugcaaaauaagcuaauuccaua

SEQ ID NO: 124964 - RNA, 64 nt, hsa
guaucuccccucccuucaggaauaacuuauuggaaaacugaaaagaaucacugaauggaauguu

SEQ ID NO: 124965 - RNA, 64 nt, hsa
gagaacuugagaaaauuacuucauaaacauauggaaacugaaaauggacucucuuugugacaaa

SEQ ID NO: 124966 - RNA, 64 nt, hsa
auuuccuaguggaguuuuauaaauuaaaaggucaaaacugaagcuuuuuauuuaggcuuuucca

SEQ ID NO: 124967 - RNA, 64 nt, hsa
ccaaucuaaaauggcagagaagaugaaauuugauaaacugaauuuuuuuuaaaaauccauuuac

SEQ ID NO: 124968 - RNA, 63 nt, hsa
cagacaccaauacugaaugaauacuuaaccguaaaacugaaagaggauucuaguucuucauaa

SEQ ID NO: 124969 - RNA, 64 nt, hsa
aggaguaaaauaaggaaggaacguucaucacuuuaaacugaaccuggcaaguuaauuuccucag

SEQ ID NO: 124970 - RNA, 64 nt, hsa
ugauuguaaguugcugauggacagugaucauuagaaacugaauuuuguauaauacuaguuuuau

SEQ ID NO: 124971 - RNA, 64 nt, hsa
guuguggcuccuguugaauaagaugauccauuaaaaacugaacaagguugaggagaaauagugc

SEQ ID NO: 124972 - RNA, 64 nt, hsa
augaaugugaagcaaacaaaaaaaauuuguauguaaacugaaaauaagaaaauacauuagcaag

SEQ ID NO: 124973 - RNA, 64 nt, hsa
aggcccauuauuuuuauuaaaacugaaaaaauuuaaacugaauuuuuugaccuuggaaaauauu

SEQ ID NO: 124974 - RNA, 64 nt, hsa
acaggauuugcuucuaggcccauuauuuuuauuaaaacugaaaaaauuuaaacugaauuuuuug

SEQ ID NO: 124975 - RNA, 64 nt, hsa
auuuguugaacuggaaauguuuuacaugauucuuaaacugaaacuugguguaaaaauagaauug

SEQ ID NO: 124976 - RNA, 64 nt, hsa
uuuauuaauuguacucaacccucgcagaacaguaaaacugaagauuauuguuucugaauguuuu

SEQ ID NO: 124977 - RNA, 64 nt, hsa
gguuaauaccaaguauucauuucaugauguaaagaaacugaacagugaaguggcuugauugcuu

SEQ ID NO: 124978 - RNA, 64 nt, hsa; identical to SEQ ID NO: 124977

SEQ ID NO: 124979 - RNA, 64 nt, hsa
ucacauaauuacacacgugaaauaauuaaagcuuaaacugaauuuguauuucauuuuauuguca

SEQ ID NO: 124980 - RNA, 64 nt, hsa
cuucaggauugucugguuaaauaguaugggaaaaaaacugaagaguuucacauaauuacacacg

SEQ ID NO: 124981 - RNA, 64 nt, hsa
aucuguguugcagggaaacuaaacagagguuuccaaacugaaggcaaccuaauuguaaaugccu

SEQ ID NO: 124982 - RNA, 64 nt, hsa
uuuuaaggccauuuuauauuaagccagugcuggaaaacugaauuuuuuuuauuauguauaauaa

SEQ ID NO: 124983 - RNA, 64 nt, hsa
ggcaaaaugcuacaguucauaucuuccuuuaaccaaacugaaguacauaaagaccauguacaug

SEQ ID NO: 124984 - RNA, 64 nt, hsa
caugugugaaaaguuugaugcauuuugagauggaaaacugaaauuuggaaaaagaaauacuuua

SEQ ID NO: 124985 - RNA, 64 nt, hsa
aacguuugaaaggagucuuacaccuguaucaugaaaacugaauccuuuugaaauaccacuauau

SEQ ID NO: 124986 - RNA, 64 nt, hsa
ggcauauuucaggcuuuaaauuauucuacuuuccaaacugaauucuccugcagugccaaguauc

SEQ ID NO: 124987 - RNA, 64 nt, hsa
gcaaagguggcaaugcuuaaacuaaauaaugaauaaacugaauauuuuggaaacugcuaaauuc

SEQ ID NO: 124988 - RNA, 64 nt, hsa
auguaugcuuuuuaccuagcugguagcauaaauaaaacugaaucucaacauacaaaguugaauu

SEQ ID NO: 124989 - RNA, 64 nt, hsa
agaaacugaauuuugcaaagggccaaauuuccccaaacugaacgggcucaggaaauguuccuuu

SEQ ID NO: 124990 - RNA, 64 nt, hsa
caggaaacuugcaucaguuggauauccuuuugagaaacugaauuuugcaaagggccaaauuucc

SEQ ID NO: 124991 - RNA, 64 nt, hsa
cugcggucauauuguagagagaugcucaguguuaaaacugaaacacacaaacacacacacacac

SEQ ID NO: 124992 - RNA, 64 nt, hsa
ccucauacacauuuaggaaaugguuaagaaguguaaacugaacccuuauccuugucuucaaucu

SEQ ID NO: 124993 - RNA, 64 nt, hsa
ccuccuauguuguugaaggagggacuagggggagaaacugaaagcugauuaauuacaggagguu

SEQ ID NO: 124994 - RNA, 64 nt, hsa
gcacuccugguuacagauacuggggcagcaaauaaaacugaaucuuguuuucagaccuuauacu

SEQ ID NO: 124995 - RNA, 64 nt, hsa
ucaagauggugaugguagagaagcugcccggaauaaacugaauuucauauguucuaaaaugacu

SEQ ID NO: 124996 - RNA, 64 nt, hsa
uuucaaacuaaauuguauuuucagagcuauccugaaacugaacagcugaaacuuuaaaaaauaa

SEQ ID NO: 124997 - RNA, 64 nt, hsa
acuacuggaaacugaaugcauuuagcauauuuugaaacugaagucauucauuagguaacaagga

SEQ ID NO: 124998 - RNA, 64 nt, hsa
gucuuagcauacagugugugcccagaacuacuggaaacugaaugcauuuagcauauuuugaaac

SEQ ID NO: 124999 - RNA, 64 nt, hsa
uauuacuuuguaauuuaaaaaacugaaaaaaaaaaaacugaagaacuuuggggggaauuuugua

SEQ ID NO: 125000 - RNA, 64 nt, hsa
aagagcaaagcuuuuuauuacuuuguaauuuaaaaaacugaaaaaaaaaaaacugaagaacuuu

SEQ ID NO: 125001 - RNA, 64 nt, hsa
uuggauuuacacuugaggguaaauuaaaucugguaaacugaauuuccuaguuaaauaaaauuag

SEQ ID NO: 125002 - RNA, 64 nt, hsa
aaaagcgugcaauaugcuuuaaagcuaucaacaaaaacugaauauuauaagcaagcaauaucau

SEQ ID NO: 125003 - RNA, 64 nt, hsa
uccaguguccaaaauauauaaguaaauagcuguagagucacauauaugaagugaauagcauaug

SEQ ID NO: 125004 - RNA, 64 nt, hsa
uuuucaacaguagaugaaggaaaugauacugaaugagucacaguguucccuggcaaguaagcug

SEQ ID NO: 125005 - RNA, 64 nt, hsa
guagagaguagagucacacuuuuuuugaugaaaugagucacagagaaguuacaugacaaagaua

SEQ ID NO: 125006 - RNA, 64 nt, hsa
cucacaaaucuuguauuaaaguagguagagaguagagucacacuuuuuuugaugaaaugaguca

SEQ ID NO: 125007 - RNA, 64 nt, hsa
agacuuaauagauuaacugucgcaaauuugaucagagucacagaguagaauuugaucagaauca

SEQ ID NO: 125008 - RNA, 64 nt, hsa
cuacaggaaguacccugggggcucagcugagagagagucacagaaaggccagagggucucagga

SEQ ID NO: 125009 - RNA, 64 nt, hsa
cccgccugguuccagccccauccccucucccacugagucacagguuugagauucccagagaggc

SEQ ID NO: 125010 - RNA, 64 nt, hsa
auugcuagacgucucacucaaagacauuuguugggagucacauuugcaucauagacgagacagu

SEQ ID NO: 125011 - RNA, 64 nt, hsa
aaaugacccaagagaacuuucuuauuuugcuacugagucacacaagggaaguggaaggaagaac

SEQ ID NO: 125012 - RNA, 64 nt, hsa
uuaaaguauuagaaaagguuuuagcugaaaugaggagucacaauuaaggauggaggugauauuu

SEQ ID NO: 125013 - RNA, 64 nt, hsa
cuaauauguaaaagucugcaugacucuuaacaaugagucacauccauugauuuuacagggauuu

SEQ ID NO: 125014 - RNA, 64 nt, hsa
guucccaaguaggcauucuaggcucuauuuaacugagucacacugcauaggaauuuagaaccua

SEQ ID NO: 125015 - RNA, 64 nt, hsa
gcugcuguggauaucuccaugaaguuuucccacugagucacaucagaaaugcccuacaucuuau

SEQ ID NO: 125016 - RNA, 64 nt, hsa
ggccuggguucuagaucucugggaaccagugccugagucacagcugucagugcagccauuugcc

SEQ ID NO: 125017 - RNA, 64 nt, hsa
ggccuggguucuagaccucugggaaccagcaccugagucacagcugucuaggccucggugcugg

SEQ ID NO: 125018 - RNA, 64 nt, hsa
acuaaauugcuuauguuuauucccugucagcggaguggagaaugucauucaucaauaaaccaaa

SEQ ID NO: 125019 - RNA, 64 nt, hsa
uuuuuaaagaucuggcaacuuuucaggauuauuuguggagaacucuaagguuaagaucaggaaa

SEQ ID NO: 125020 - RNA, 64 nt, hsa
auuauugcggaccgugguacccaguuuuaggaauguggagaaaggaauucuguugauuccguug

SEQ ID NO: 125021 - RNA, 64 nt, hsa
acacuacagguagguuggucuuugaaguccacuaguggagaaugucaagacaagauacuuauua

SEQ ID NO: 125022 - RNA, 64 nt, hsa
aagaaaauucauacuggggagaaaccccacaaauguggagaaugcggaaaagccuuuaacuggu

SEQ ID NO: 125023 - RNA, 64 nt, hsa
uccucaacucuuauuacacauaagauaauucacaguggagaaaaacccuacaaaugugaagaau

SEQ ID NO: 125024 - RNA, 64 nt, hsa
ggaauucaaucugucaaauuuguuuuauucucaaguggagaacuucucccacauaauauauaua

SEQ ID NO: 125025 - RNA, 64 nt, hsa
uggaggacaacuuaucuucacuaagcugaaucagguggagaaaguaaucuccuugcaaucaugu

SEQ ID NO: 125026 - RNA, 64 nt, hsa
cacuuagcagcaacugaagacaauuaucaaccacguggagaaaaucaaaccgagcagggcugug

SEQ ID NO: 125027 - RNA, 64 nt, hsa
uguggagucucccucugauugguuuuggggaaauguggagaagagugcccugcuuugcaaacau

SEQ ID NO: 125028 - RNA, 64 nt, hsa
cacaucacuuucucuucuugcguguggggcagguguggagaagggcuuuaaggaggccaauuug

SEQ ID NO: 125029 - RNA, 64 nt, hsa
ccuuuuaagccaugggugggucuaacuggcuuuuguggagaaauuagcacaccccaacuuuaau

SEQ ID NO: 125030 - RNA, 64 nt, hsa
ugguaucaggaaggcauuuucaaucauucaaaauguggagaauuuaauggcuaaaucuuuaaaa

SEQ ID NO: 125031 - RNA, 64 nt, hsa
gagggccguaccccacccucagcaccccuuccauguggagaaaggagugaaaccuuuagggcag

SEQ ID NO: 125032 - RNA, 64 nt, hsa
ugguggcacugagcccccccaacacugugcccugguggagaaagcacugaccugucaugccccc

SEQ ID NO: 125033 - RNA, 64 nt, hsa
cuagcauuaggcagauaggccacaggaagaagguguggagaacccaccugaaccagauugagac

SEQ ID NO: 125034 - RNA, 64 nt, hsa
gccuuggauuccagaauguuucaugguaagcacuguggagaaccuacaugucagguucuggagu

SEQ ID NO: 125035 - RNA, 64 nt, hsa
guuuucuuuuuuuagggagaagggcuuuucuuuaguggagaaauggaacucgccccccuacccc

SEQ ID NO: 125036 - RNA, 64 nt, hsa
gagcaagccuuccuccauggcccaucacucggcuguggagaacaaagaccaaugugaagacacu

SEQ ID NO: 125037 - RNA, 64 nt, hsa
aucaaaauuccuguguugugugccaagguauaaaguggagaaguuagaugagugcaaggagcuc

SEQ ID NO: 125038 - RNA, 64 nt, hsa
gagcagcagccaacacguuuagcagacacugcgcguggagaagggcuuaucugcaguacacucu

SEQ ID NO: 125039 - RNA, 64 nt, hsa
ugccuccuggaguagguccacgugaaaacaaugaguggagaagucgucacgggucuuucauccc

SEQ ID NO: 125040 - RNA, 64 nt, hsa
gagcgcuucggugaaaguaaagacaguagucauuguggagaaacaucuagccagauuggagaua

SEQ ID NO: 125041 - RNA, 64 nt, hsa
gagagcagggguacuuccgccuugccguuagcuuguggagaacgugcuucuuauuccuggcagg

SEQ ID NO: 125042 - RNA, 64 nt, hsa
gggacgaagccuuagagggugacauagcuagaaaguggagaagcucacuguucacugugcaaag

SEQ ID NO: 125043 - RNA, 64 nt, hsa
uuacagagaggaaucucccagucacggaccaaauacuugcaaguuagaggcuggcaggggggau

SEQ ID NO: 125044 - RNA, 64 nt, hsa
ugaagaaacagagccucagagagauuaguaccucacuugcaaaguuaggaaauggggagcuagg

SEQ ID NO: 125045 - RNA, 64 nt, hsa
aaagcaagaaggccaugaccaucccugccucgaaacuugcaagucacuugucugaguuaguuuc

SEQ ID NO: 125046 - RNA, 64 nt, hsa
ugcuugaugacuucuuuugcucucaaaguuccauacuugcaaaauugguuuuucaagacugaaa

SEQ ID NO: 125047 - RNA, 64 nt, hsa
aggccagcccgugcagaccacccccgacgcguccacuugcaacacccgccucacugugccaaca

SEQ ID NO: 125048 - RNA, 64 nt, hsa
uguccgugagagacacgggcuccccucgagggagacuugcaaaugcuccauaaacagccacagu

SEQ ID NO: 125049 - RNA, 64 nt, hsa
cccccuucuaccaggcugcaaauguggcucuagcacuugcaaauuguuuuuucuuccgaauagu

SEQ ID NO: 125050 - RNA, 64 nt, hsa
gugccccagaguugcuguggacagaccuguaaggacuugcaaaacaaaagaaagugagggguuu

SEQ ID NO: 125051 - RNA, 64 nt, hsa
aauuuaagauuacuaccaguaaccaacuuaaagcaaacuauaggggucccuaauuuuggauuuu

SEQ ID NO: 125052 - RNA, 64 nt, hsa
aucuguagcuggauuuaccacaagugacaucuagaaacuauaguucacaggacagagcagagcc

SEQ ID NO: 125053 - RNA, 64 nt, hsa
ugauggauccuuuagaauugccuaccuaaaagguaaacuauacuauccuuauaaauacugauca

SEQ ID NO: 125054 - RNA, 64 nt, hsa
ugaauguauuuggaauacuuacauauuauaaaauaaacuauaccucuucaagagguauccuguu

SEQ ID NO: 125055 - RNA, 64 nt, hsa
agacuuagccuaguaauuuuauagugagaguuucaaacuauauaucagugucuauagcaucaaa

SEQ ID NO: 125056 - RNA, 64 nt, hsa
cuuucagaacuuauagucuaugccaauuuugaaaaaacuauaagcacaaggaauuaaauacuau

SEQ ID NO: 125057 - RNA, 64 nt, hsa
aauauaugaaauuacuauacauugaaaugccugcaaacuauaugcaaaaaugaguaugaggaaa

SEQ ID NO: 125058 - RNA, 64 nt, hsa
gucaagaggccagagaaaaugcacaaacuguaggaaacuauaggaaagcauuuacuaugagguu

SEQ ID NO: 125059 - RNA, 64 nt, hsa
ccuaaaauugaaaaaaacaucuagccauauccauaaacuauaucaucaccaagagauguuuauu

SEQ ID NO: 125060 - RNA, 64 nt, hsa
aaaguaaaacuuuugguucagaagcuugacucauaaacuauacuauauauucccaaaaauguca

SEQ ID NO: 125061 - RNA, 64 nt, hsa
aacagucaaguguacuucacacuacuagauguuaaaacuauaugauuauuggcauauacugacu

SEQ ID NO: 125062 - RNA, 64 nt, hsa
cuauaccaaacauuauauuaaaaacacaaaauaaaaacuauaaaaauguacuuuaggacauuaa

SEQ ID NO: 125063 - RNA, 64 nt, hsa
cagcuuuuguuagaaucuugcauguugauuacuaaaacuauacuuuguuucccauuuauuuauu

SEQ ID NO: 125064 - RNA, 64 nt, hsa
ugacacuggaauauguuuaguagauuagggggaaaaacuauaaagguuuauacaauuguuugua

SEQ ID NO: 125065 - RNA, 64 nt, hsa
gauuuuugugaugaagagcuuccauuacuucugaaaacuauauuuaucugagugaguccaaggu

SEQ ID NO: 125066 - RNA, 64 nt, hsa
gaacaaagcuggaggcaucgcauuacccaacuucaaacuauacuacagggcuacaguaaccaaa

SEQ ID NO: 125067 - RNA, 64 nt, hsa
ucaagauggauuaaagacuuaaauguaaaaccccaaacuauaaaaacucuggaagauaaccuag

SEQ ID NO: 125068 - RNA, 64 nt, hsa
ucuucauuaggaauuuaucagaaaguauacagagaaacuauaagcaauuaugugggaaaucauu

SEQ ID NO: 125069 - RNA, 64 nt, hsa
caccuagaugucaacuccacaagaugaaucuuauaaacuauauuuuaugaauauaggaaaaucu

SEQ ID NO: 125070 - RNA, 64 nt, hsa
guauuacccugauacuagacuagacaucacaagaaaacuauaagccaauauuccuuauuaauac

SEQ ID NO: 125071 - RNA, 64 nt, hsa
auaaagaaaagagguuuauacugcaaaagaagugaaacuauauguauucacaguugauacauag

SEQ ID NO: 125072 - RNA, 64 nt, hsa
gacuccacgucugugucacugaggugaccugcgugucacugagguggccaccaugcuggccugc

SEQ ID NO: 125073 - RNA, 64 nt, hsa
auuucacugcugcugucugugacuccacgucugugucacugaggugaccugcgugucacugagg

SEQ ID NO: 125074 - RNA, 64 nt, hsa
gcuuuaguaguuuguuugguccccucuaguaugugucacugagaaauuuuuuaaagacauggua

SEQ ID NO: 125075 - RNA, 64 nt, hsa
augcaaagcaggugaaaccuuaggagaugauccagucacugacuugauugagggauaaguguga

SEQ ID NO: 125076 - RNA, 64 nt, hsa
ggcuggguggcucuggggccaaccgaccacaggugucacugaucacaggugucaccguaguggc

SEQ ID NO: 125077 - RNA, 64 nt, hsa
ucccuucaggcuucugacacacuaguggccucgagucacugauaguggugccuccuccuuaccu

SEQ ID NO: 125078 - RNA, 64 nt, hsa
ucccuagggcucccaacugaccucaggccucugagucacugaaugucaccaggagagguggggg

SEQ ID NO: 125079 - RNA, 64 nt, hsa
ccucccucagcacuuccccaucacaacaaccuaugucacugacucagaugcagggucugcucac

SEQ ID NO: 125080 - RNA, 64 nt, hsa
auguuuaaguggucaagcaaggcucuaggagguagucacugagcuggaccuuaaacacaucugc

SEQ ID NO: 125081 - RNA, 64 nt, hsa
guaacuggguuguuuaauguuuuaauugauaauugucacugaucguauuucuacuuguuaaaua

SEQ ID NO: 125082 - RNA, 64 nt, hsa
guuguauucaguaaaaaagaauaguaaauauaaggucacugagauucuaaguaagauaguaaau

SEQ ID NO: 125083 - RNA, 64 nt, hsa
ucacugagauucuaaguaagauaguaaaucuaaggucacugagccaaauccuuuucaauaggca

SEQ ID NO: 125084 - RNA, 64 nt, hsa
ggcggagguuacauauggaugaaaaugaaucuuagucacugaauauucauauacauuuccccca

SEQ ID NO: 125085 - RNA, 64 nt, hsa
ggcagagcagcugagggaggggcgcuggccacaugucacugauggucagauuccaaaguccuuu

SEQ ID NO: 125086 - RNA, 64 nt, hsa
acguaaaguuaaccuuccaauugucugagcugucgucacugacuucaugacagucuggcccucc

SEQ ID NO: 125087 - RNA, 64 nt, hsa
agugcuuucccagccaaaugucugugcucucugugucacugagggccacagguuccucuaacau

SEQ ID NO: 125088 - RNA, 64 nt, hsa
gcuggccaguguuuggaggggaggaugagugccugucacugaggccucacuaugguuggcgucu

SEQ ID NO: 125089 - RNA, 64 nt, hsa
gggucuucuguccagcucccuugccccaugugcugucacugacucuccuugggacucgccugcc

SEQ ID NO: 125090 - RNA, 64 nt, hsa
gacugucacugcucuccccuggcuacugggaggagucacugagagcuucguuaccccugcugcc

SEQ ID NO: 125091 - RNA, 64 nt, hsa
uuguuuaaauauaaacagaaguguaccuuuuauaauaaaaaaaagaaguugaguaaaaaaaaaa

SEQ ID NO: 125092 - RNA, 64 nt, hsa
uaaauaguugaugcaauuuuuaacguuaauugauauaaaaaaaaaaacaacaaaauuaggcuug

SEQ ID NO: 125093 - RNA, 64 nt, hsa
ugugagaucagcugaaccacuuaugauaauaauaauaaaaaagacugcuuugcccucacgucag

SEQ ID NO: 125094 - RNA, 64 nt, hsa
aauaucuugauggacucuuuuauaaaauuauuuuauaaaaaacaauguuacacuaaaaucagcc

SEQ ID NO: 125095 - RNA, 64 nt, hsa
ucaaaacuaguguauucacuuacccuaguucauuauaaaaaauaucuaggcauuguggauauaa

SEQ ID NO: 125096 - RNA, 64 nt, hsa
gcuaaaacauaaucacaaagcuuuaucguguuguauaaaaaaauuaacaauauaauggcaauag

SEQ ID NO: 125097 - RNA, 64 nt, hsa
ucuacaucacuggcugcucuucaucaaaccuacuauaaaaaacauucaaguucaacuguuucuu

SEQ ID NO: 125098 - RNA, 64 nt, hsa
cuggacaacauagugagaccuugucuccacaaaaauaaaaaagaaacuauccaggagugguggu

SEQ ID NO: 125099 - RNA, 64 nt, hsa
ugcagaaggauguucuucugggauuugcagguacauaaaaaauguauggcaucuuuuccuugca

SEQ ID NO: 125100 - RNA, 64 nt, hsa
aguuauggaucuucaaugccucugagucauuguuauaaaaaaucaguuaucacuauaccaugcu

SEQ ID NO: 125101 - RNA, 64 nt, hsa
cucaacagggaugcaaauugguucuucaguaaggauaaaaaaaaaucacaagcaguuguuugug

SEQ ID NO: 125102 - RNA, 64 nt, hsa
ccuucuccuuggauuguuuuggaaguuauucuucauaaaaaauguuaacgugggcugggcaugg

SEQ ID NO: 125103 - RNA, 64 nt, hsa
uuugaauguauauuucuauuuaugauaccaauuuauaaaaaauaauuacacagaaaaaauggaa

SEQ ID NO: 125104 - RNA, 64 nt, hsa
uuacuuguucuugauaagugaaaacugcagggaaauaaaaaauacauaucaaaacauggacaug

SEQ ID NO: 125105 - RNA, 64 nt, hsa
aauggaauaauuauuaaugaaagauuuuugaaauauaaaaaauaaauuaggcccaauccaagaa

SEQ ID NO: 125106 - RNA, 64 nt, hsa
caauauaaccagcaauuuagguggcaucuauaaaauaaaaaauuucuacuguggacauccccuu

SEQ ID NO: 125107 - RNA, 64 nt, hsa
guuaugaaauaaaaaaaagauggguuuuguaaaaauaaaaaaaaaauauuuuuagcagaacagg

SEQ ID NO: 125108 - RNA, 64 nt, hsa
gaaguacagacguacuuuaaauuuuuguuaugaaauaaaaaaaagauggguuuuguaaaaauaa

SEQ ID NO: 125109 - RNA, 64 nt, hsa
uuguguucacagucuaauuuccaaaagaccaucaauaaaaaagagagcauguuuaaauugaaau

SEQ ID NO: 125110 - RNA, 64 nt, hsa
auaaaucugaaaaauccauaaugaaauaggaguuauaaaaaauuuauagugauauuaaucuuuc

SEQ ID NO: 125111 - RNA, 64 nt, hsa
aaaaaagcuggugggugaaagaaaucauguuaugauaaaaaauuuuguaauuuucuugaugacu

SEQ ID NO: 125112 - RNA, 64 nt, hsa
aaaugagaacauguugguauuuaucuauuguaagauaaaaaagcuggugggugaaagaaaucau

SEQ ID NO: 125113 - RNA, 64 nt, hsa
cuaauggcuguggcauuguugaugcucacauaugauaaaaaaguguccuauaauucuauugaaa

SEQ ID NO: 125114 - RNA, 64 nt, hsa
guguauggauauguguaaauguuaugacuccuugauaaaaaauuuauuauguccauuauucaag

SEQ ID NO: 125115 - RNA, 64 nt, hsa
uuaucacacaaagagaccaauaaaaauaaaaaaaauaaaaaaaaaaaaagacgaacuauuggag

SEQ ID NO: 125116 - RNA, 64 nt, hsa
uguaggucauuaucacacaaagagaccaauaaaaauaaaaaaaauaaaaaaaaaaaaagacgaa

SEQ ID NO: 125117 - RNA, 64 nt, hsa
gacuacauuuugugaggaucaaugaagacuaaauauaaaaaacauuuucuugaauggcaugcua

SEQ ID NO: 125118 - RNA, 64 nt, hsa
ucaacugugucugauguuucuucucauguaagaaauaaaaaauaaaaauaaaauaaaauauauu

SEQ ID NO: 125119 - RNA, 64 nt, hsa
auaaaauauauugguauguaacuacaggaaaaaaauaaaaaauauauaguggacaguaaccuuu

SEQ ID NO: 125120 - RNA, 64 nt, hsa
ugguaaugaaaauggaaugcagcuacugcagcuaauaaaaaauuuuagauagcaauuguuacaa

SEQ ID NO: 125121 - RNA, 64 nt, hsa
uuuccucccuuucucauguuuuuauaaauagguaauaaaaaauguuuugccugccaauugaaug

SEQ ID NO: 125122 - RNA, 64 nt, hsa
accacccaccuuaacucuuucuugucaggaguauauaaaaaagaaagaaaacaaaacucgcccu

SEQ ID NO: 125123 - RNA, 64 nt, hsa
gcaaagucuucuuugaauaucagggacugagucaauaaaaaaaauaguagaaagguggcuuuua

SEQ ID NO: 125124 - RNA, 64 nt, hsa
ggacaacagagcaagacucugucucaaaaaaaaaauaaaaaauaaaaaauaaaaaauaaaagaa

SEQ ID NO: 125125 - RNA, 64 nt, hsa
agagcaagacucugucucaaaaaaaaaauaaaaaauaaaaaauaaaaaauaaaagaaacauaag

SEQ ID NO: 125126 - RNA, 64 nt, hsa
gacucugucucaaaaaaaaaauaaaaaauaaaaaauaaaaaauaaaagaaacauaagauaagua

SEQ ID NO: 125127 - RNA, 64 nt, hsa
ugagcaacauggcaaaacccugugucuacaaaaaauaaaaaauuagcugggcaugacggccaga

SEQ ID NO: 125128 - RNA, 64 nt, hsa
uugauuaauuaacugggccuuuauacuuaacuaaauaaaaaacuaagcagauaugaguuaaauu

SEQ ID NO: 125129 - RNA, 64 nt, hsa
guugccauuguggaagaaauuauuugguacauuaauaaaaaaaguugguaaaacaugguuuuau

SEQ ID NO: 125130 - RNA, 64 nt, hsa
ggaacaccaaacaggaaagaacuaugucugaaauauaaaaaauaaaaauaaaaaaacaacuaug

SEQ ID NO: 125131 - RNA, 64 nt, hsa
ggaaagaacuaugucugaaauauaaaaaauaaaaauaaaaaaacaacuaugaauaugcacaagg

SEQ ID NO: 125132 - RNA, 64 nt, hsa
aaauucauuuucuaacaccauguguuagaaaauuauaaaaaauaaaauaauuuuagaaaguuuu

SEQ ID NO: 125133 - RNA, 64 nt, hsa
ugagugucuauguuaacuucccucuaucccgcuuauaaaaaaauucuccaacaaaaauacuugu

SEQ ID NO: 125134 - RNA, 64 nt, hsa
cuucacuuugggccaaacauuugaaaaacuuuuuauaaaaaauuguuugauauuucuuaauguc

SEQ ID NO: 125135 - RNA, 64 nt, hsa
aaauaauaauaauaauaauaaaguaaaaauaaaaauaaaaaaguaaucagaagcuaaaguaaag

SEQ ID NO: 125136 - RNA, 64 nt, hsa
gcuaacauggugaaaccccaucucuacuaaaaauauaaaaaauuagccaggugugguggcacgc

SEQ ID NO: 125137 - RNA, 64 nt, hsa
uuuaaaugccuggaacugacuucuugauaaaaauauaaaaaauaauuuccauguaaguuaccag

SEQ ID NO: 125138 - RNA, 64 nt, hsa
uacuggaccauaaaguuaauuauagcuuugaaagauaaaaaaaaaaaaaacaaaaaaaaacuca

SEQ ID NO: 125139 - RNA, 64 nt, hsa
ucuuuuuaaaaaguuauauuuucuaaagaaaaaaauaaaaaaaguuguauuuucuaauuuuuau

SEQ ID NO: 125140 - RNA, 64 nt, hsa
acguugugcacauguacccuagaacuuaaaguauauaaaaaaaagaaaccuugcacugauuuug

SEQ ID NO: 125141 - RNA, 64 nt, hsa
guggcgaaacuccaucucuacaaaaaaugcaaaaauaaaaaauauaguacucaaguauucuuga

SEQ ID NO: 125142 - RNA, 64 nt, hsa
acuagaauuuguaaugcaaauggagcucagucuaauaaaaaagagguuuugguauuaaaaguuc

SEQ ID NO: 125143 - RNA, 64 nt, hsa
gccaaacauguuggcaucaauuuuauacagggauauaaaaaaguauauguggauaaauuuuuug

SEQ ID NO: 125144 - RNA, 64 nt, hsa
auauguggauaaauuuuuuguaaucuuuagggauauaaaaaaguguauguggauaaauuuuuug

SEQ ID NO: 125145 - RNA, 64 nt, hsa
auaaaauugaaaucugcauucaugccaauucagcauaaaaaagaauaggcuacaguucucucac

SEQ ID NO: 125146 - RNA, 64 nt, hsa
gauguuuugaaagugagcauucauuuaaggauaaauaaaaaauaaaguaguaauaaagaauaaa

SEQ ID NO: 125147 - RNA, 64 nt, hsa
aucauuccaaauaagaguuuaauuuuuauuaauuauaaaaaacucuguauuaguuuccuagaug

SEQ ID NO: 125148 - RNA, 64 nt, hsa
auuuuuaaaaacuuuuuuuuggaccuaaauaauaauaaaaaaaaaagcccuuuaaacuuuguaa

SEQ ID NO: 125149 - RNA, 64 nt, hsa
uauaaauuaauguaauacugugugaauucagacuauaaaaaacaucauucagaaaacuuuauaa

SEQ ID NO: 125150 - RNA, 64 nt, hsa
uuuucuaaacacuuuacuagaagaacauuucaguauaaaaaaccuaauuuauuuuuacagaaaa

SEQ ID NO: 125151 - RNA, 64 nt, hsa
uuauucucuucagcuuuaacuauacuugagugcaauaaaaaacuuaauaaaauuuuaugccugu

SEQ ID NO: 125152 - RNA, 64 nt, hsa
cauauuccggggaucaucacaucaguccaaggauauaaaaaaauggaagauuaaaaacucaaau

SEQ ID NO: 125153 - RNA, 64 nt, hsa
uuauacuuuguacuuuugcccaaacguguaaauaauaaaaaaguuuuggcuuuuuucuuuagaa

SEQ ID NO: 125154 - RNA, 64 nt, hsa
uuuuccguuccuuuuauuuaagucuuuuuauuuaauaaaaaaguuagcuauuucacuuaacgcc

SEQ ID NO: 125155 - RNA, 64 nt, hsa
uucgugucauugugauauuugacaacucuaaaaaauaaaaaaaaaaaacuuagagcacaauaau

SEQ ID NO: 125156 - RNA, 64 nt, hsa
auuugaugagcaaaaucuacuucuaguguuaggaauaaaaaaaaaagaccaguaacuuuguuuu

SEQ ID NO: 125157 - RNA, 64 nt, hsa
aaagaaaacaccgacagcuguaaaauguucuaagauaaaaaaacucgagcuacaaagaaagaau

SEQ ID NO: 125158 - RNA, 64 nt, hsa
aaauguaaugugauuuguacuaggcgucaugagcauaaaaaauaauacauaguuucuguuaagg

SEQ ID NO: 125159 - RNA, 64 nt, hsa
augcuaguuuauuuuuuuagcagugaaaaugaauauaaaaaaggugacauaggucaaguuuucc

SEQ ID NO: 125160 - RNA, 64 nt, hsa
auuauugcuuuaauuagagcagcacauugcuaaaauaaaaaauacaccuuaauuuuuaagaaau

SEQ ID NO: 125161 - RNA, 64 nt, hsa
uuaauucuuaaauauugaggccccauugugaguaauaaaaaauacgacauaaguagaagacuaa

SEQ ID NO: 125162 - RNA, 64 nt, hsa
auucagaaaaccacuuaagcaagacccuucugaaauaaaaaauguugcuuuuuaaauaguuugu

SEQ ID NO: 125163 - RNA, 64 nt, hsa
aagcaacuucccuggggaagccaaacacauauucauaaaaaaaaucaaguagcugaugugcagu

SEQ ID NO: 125164 - RNA, 64 nt, hsa
aggaaaaaaauagcaauauuugaguuauguaaggauaaaaaauccacugacuuguauuuuugca

SEQ ID NO: 125165 - RNA, 64 nt, hsa
uuuagaucccauaauaaaaaugaauguuuuucuuauaaaaaauuauacaaaugcugaagugaga

SEQ ID NO: 125166 - RNA, 64 nt, hsa
auguguauuuagaauauuuguauaacuguguaaaauaaaaaaggaauuauguggucagugcauu

SEQ ID NO: 125167 - RNA, 64 nt, hsa
uacaaaccugugggccuguugcaauacuuuaaaaauaaaaaauuuuauuccauuugcuuguuuu

SEQ ID NO: 125168 - RNA, 64 nt, hsa
cccuauauaaaaaucauuggcacaguuacacuuaauaaaaaaaauuaaacagaagagcacccug

SEQ ID NO: 125169 - RNA, 64 nt, hsa
uuuguuacguaaaguuaaaaugauuuuugucugaauaaaaaaaaagcauugcaaaugcuuuaga

SEQ ID NO: 125170 - RNA, 64 nt, hsa
ccuuggaauugucucuaaaugcaucaagcauacaauaaaaaaaacugaaauuaacauccagugg

SEQ ID NO: 125171 - RNA, 64 nt, hsa
guuagauggaaaaugcuauuggcagggaauaauaauaaaaaaaaaagaaaaucauucuguuucc

SEQ ID NO: 125172 - RNA, 64 nt, hsa
ugggguuccuuuacuauugggugaaucauuagguauaaaaaauaaucaucaaccaggcaaauua

SEQ ID NO: 125173 - RNA, 64 nt, hsa
uauucagagcauuuuuaccucucucuuaaauguuauaaaaaacaauuguauuuuuaagaauguu

SEQ ID NO: 125174 - RNA, 64 nt, hsa
acaucaaguucauuugcagaaacaaauaacugaaauaaaaaacauguuaauccuuguaucauac

SEQ ID NO: 125175 - RNA, 64 nt, hsa
agucuaucuuuguauaucuuugaacuuuucaagaauaaaaaagcuuaaaaaguauacauggccu

SEQ ID NO: 125176 - RNA, 64 nt, hsa
uguauguuauaccuauuuuacuacaauaaaaaguauaaaaaagagaagauauuuaggugacuua

SEQ ID NO: 125177 - RNA, 64 nt, hsa
acuaggggcaaauggguuuuucuaaauaaaugacauaaaaaagaacugguugucuuucuuuaaa

SEQ ID NO: 125178 - RNA, 64 nt, hsa
caugaccuugauuguuaaauguaguuauauuugaauaaaaaaugaaucauuuccaaaauucuuu

SEQ ID NO: 125179 - RNA, 64 nt, hsa
auuucaaagcucuuuuccuaacugguuaaguaaaauaaaaaauugagcuuucuagaauauuugc

SEQ ID NO: 125180 - RNA, 64 nt, hsa
aaaagagagaguaacuacagaagaacuuuaaaaaauaaaaaauaagcuuaccuuggauucuugg

SEQ ID NO: 125181 - RNA, 64 nt, hsa
guaggagugaagacaggaucccgugcuuaaaaaaauaaaaaauaaaaaaauaaaaaaaaaauaa

SEQ ID NO: 125182 - RNA, 64 nt, hsa
ugaagacaggaucccgugcuuaaaaaaauaaaaaauaaaaaaauaaaaaaaaaauaagacuuua

SEQ ID NO: 125183 - RNA, 64 nt, hsa
ggaucccgugcuuaaaaaaauaaaaaauaaaaaaauaaaaaaaaaauaagacuuuaacugcagu

SEQ ID NO: 125184 - RNA, 64 nt, hsa
aaaaccccauuuuccuaaagaacaaaguaguaaaauaaaaaaaaauuuaaaaaauuaaaaaaua

SEQ ID NO: 125185 - RNA, 64 nt, hsa
uaguaaaauaaaaaaaaauuuaaaaaauuaaaaaauaaaaaaaagaggucacuaaaagaccaag

SEQ ID NO: 125186 - RNA, 64 nt, hsa
ucuugcacuugacugaguugggacaaggcuucacauaaaaaauuauuucuucacuuuuaacaca

SEQ ID NO: 125187 - RNA, 64 nt, hsa
caaaugacuacuuugaaauaguugaaguaccagcauaaaaaaaugaaauguguauugauuucua

SEQ ID NO: 125188 - RNA, 64 nt, hsa
uuccaaacucauauuacaaaaacaaaauaaaauaauaaaaaaagaaagcaugauauuuacuguu

SEQ ID NO: 125189 - RNA, 64 nt, hsa
uuccagugucuauaaaagaaacacuuugaagucuauaaaaaauaaaauaauuauaaauaucauu

SEQ ID NO: 125190 - RNA, 58 nt, hsa
agaugaaugccagacugugaaggaaaauauaaaaaaaaagucgacugcuaugcucaaa

SEQ ID NO: 125191 - RNA, 64 nt, hsa
aagaaaaucuuauauaguacauuuuacaaaaauuauaaaaaaugaauuaguacuggcgaggacu

SEQ ID NO: 125192 - RNA, 64 nt, hsa
uguguuuuuuucuggaacuacuucaagugagaaaauaaaaaaaaauggugacaaagcuguacag

SEQ ID NO: 125193 - RNA, 64 nt, hsa
aaaggaaauaaaaaugcaugauuaaaaacuaagaauaaaaaaccuauuuuuauguuuccuaaag

SEQ ID NO: 125194 - RNA, 64 nt, hsa
uucuaccauuacugaacauuaggacaaacacaaaauaaaaaacaaaacacagacaacggugcug

SEQ ID NO: 125195 - RNA, 64 nt, hsa
cugaccauuucuuguucuguuuccaaugaaaucaauaaaaaaaaagaaguacuuuaaauggggu

SEQ ID NO: 125196 - RNA, 64 nt, hsa
uauuccaaagagacacacuaauaaauacuucauuauaaaaaauaaaaaagaaucuuuguagaga

SEQ ID NO: 125197 - RNA, 64 nt, hsa
aagagacacacuaauaaauacuucauuauaaaaaauaaaaaagaaucuuuguagagauuuugau

SEQ ID NO: 125198 - RNA, 64 nt, hsa
cggccuacaagaacaaaacuccaucucaaaauaaauaaaaaaauaaauaaaaauaaaaauagac

SEQ ID NO: 125199 - RNA, 64 nt, hsa
aauucauuuauuuuaaauaaaugaauaaaauaaaauaaaaaagaauauucagucguuggcacau

SEQ ID NO: 125200 - RNA, 64 nt, hsa
uagugauaauuccugauuccaagaaugccaucugauaaaaaagaauagaaauggaaagugggac

SEQ ID NO: 125201 - RNA, 64 nt, hsa
gguuccuguaaaauuucaaauugaugugguauuaauaaaaaaaaaaaaaacacaaacaaugacu

SEQ ID NO: 125202 - RNA, 64 nt, hsa
guaaccuuauauuuaaaagaugauuuugcaaaaaauaaaaaauaaaaaauaugccuucuggagu

SEQ ID NO: 125203 - RNA, 64 nt, hsa
uauauuuaaaagaugauuuugcaaaaaauaaaaaauaaaaaauaugccuucuggagugaugucu

SEQ ID NO: 125204 - RNA, 64 nt, hsa
aacaugagucacagcuuuuguucugugguaaccuauaaaaaaaguuugucuuugagauucaaug

SEQ ID NO: 125205 - RNA, 64 nt, hsa
ucuuaacuugaccugggauaacuacuuuaaagaaauaaaaaauuccagucaauuauuccucaac

SEQ ID NO: 125206 - RNA, 64 nt, hsa
cuuauugugaaaguugugcuguuuucuaaguaaaauaaaaaauaaaaaauuagcaauuuaugau

SEQ ID NO: 125207 - RNA, 64 nt, hsa
ugaaaguugugcuguuuucuaaguaaaauaaaaaauaaaaaauuagcaauuuaugauagccagu

SEQ ID NO: 125208 - RNA, 64 nt, hsa
cugucaugcucaugcaugaauagaauuuagucaaauaaaaaauuuuggucauuugguacugacu

SEQ ID NO: 125209 - RNA, 64 nt, hsa
auggaugaaaguauucaucacaauauuauuuauaauaaaaaauugcaaauguuauaaaugaaca

SEQ ID NO: 125210 - RNA, 64 nt, hsa
acuagccugggcaacauggcaagacccugucccuauaaaaaauacaaaaauuagccaggcaugg

SEQ ID NO: 125211 - RNA, 64 nt, hsa
aaaauaauauaaaagugauuuauaugaaguuaaaauaaaaaaucaguaugauggaauaaacuug

SEQ ID NO: 125212 - RNA, 64 nt, hsa
acacacgaugaaauaucucugcugaagacaguggauaaaaaacaguccuucaagucuucucugu

SEQ ID NO: 125213 - RNA, 64 nt, hsa
auggaugauuuuauguuauguggauuucauuucaauaaaaaaaaacucuuaucaaaaaacccau

SEQ ID NO: 125214 - RNA, 64 nt, hsa
aauacauaaaaauacauaaaaucugaugaugaauauaaaaaaguaaccaaccucauuggaacaa

SEQ ID NO: 125215 - RNA, 64 nt, hsa
gacuuuaaagaauugugaucaggucacauuguuaauaaaaaaaaaaaacgggcuagucccuaug

SEQ ID NO: 125216 - RNA, 64 nt, hsa
gaaaacauacuuauuuuaaaaaagaaaaaaaaggauaaaaaaacccaaacugaaauucuauaua

SEQ ID NO: 125217 - RNA, 64 nt, hsa
uuagaccucaucucuacaaaaauaaaaaauaaaaauaaaaaaaacuuagcuaggcauguugcca

SEQ ID NO: 125218 - RNA, 64 nt, hsa
ccuggaaacauaguuagaccucaucucuacaaaaauaaaaaauaaaaauaaaaaaaacuuagcu

SEQ ID NO: 125219 - RNA, 64 nt, hsa
acuauuauuaucuuuguaauaaauuaaccuagcaauaaaaaauauucuguuucuuucguuagau

SEQ ID NO: 125220 - RNA, 64 nt, hsa
gucuaguuucgguaacuguuccagacaucaagcaauaaaaaaaugaauaccacaaaagauguuu

SEQ ID NO: 125221 - RNA, 64 nt, hsa
aauucuaagcagaaaaagaaaaaaaacacaaaaaauaaaaaaccccuacaaaaaaacuuuaaaa

SEQ ID NO: 125222 - RNA, 64 nt, hsa
guugaaggggggguugacuuucgcaauguauaggauaaaaaaucugauauaucaaaccauuugu

SEQ ID NO: 125223 - RNA, 64 nt, hsa
uuauucacacuuucaaacuguguauuuucuuacaauaaaaaaugaugaaaaaaaaaaaggcuuu

SEQ ID NO: 125224 - RNA, 64 nt, hsa
uuuauuuuauuuuuuugguauuuauucaucaggaauaaaaaaaacaaaguuuuauuaaagauug

SEQ ID NO: 125225 - RNA, 64 nt, hsa
cagugaacuuaaagcaaagaccucuuaguaaaaaauaaaaaaaaauaaaaaauaaaaauaaaaa

SEQ ID NO: 125226 - RNA, 64 nt, hsa
aaagcaaagaccucuuaguaaaaaauaaaaaaaaauaaaaaauaaaaauaaaaaaaguuaaauu

SEQ ID NO: 125227 - RNA, 64 nt, hsa
cuuaguaaaaaauaaaaaaaaauaaaaaauaaaaauaaaaaaaguuaaauuuauuuauagaaau

SEQ ID NO: 125228 - RNA, 64 nt, hsa
agaaacuaugggaaaaaaaauugcaaaaucuaaaauaaaaaaugcaaaaucuaaaauaaaaaau

SEQ ID NO: 125229 - RNA, 64 nt, hsa
ugcaaaaucuaaaauaaaaaaugcaaaaucuaaaauaaaaaauggaaaggaaacuuugaaccuu

SEQ ID NO: 125230 - RNA, 64 nt, hsa
uuccggagucuuugaagcugaaaauauaaaacaaauaaaaaauaaaaaaauaaaaacccacaaa

SEQ ID NO: 125231 - RNA, 64 nt, hsa
gucuuugaagcugaaaauauaaaacaaauaaaaaauaaaaaaauaaaaacccacaaaaauguug

SEQ ID NO: 125232 - RNA, 64 nt, hsa
uucaagugaauuuauuuguguguucuuuacuuauauaaaaaaagauaacuuuaaggaugugcaa

SEQ ID NO: 125233 - RNA, 64 nt, hsa
uguaaaugaagaucaguauuucugccuagaucugauaaaaaaauuuucuugucuuaguuauaaa

SEQ ID NO: 125234 - RNA, 64 nt, hsa
uucuuagccauucuuugcagcagaagauuucuugauaaaaaaggauuaccuuuccuuguaaaga

SEQ ID NO: 125235 - RNA, 64 nt, hsa
augugagguuccaaaauauguaaaaaugauaauaauaaaaaaagauuaacaucccuugucaucu

SEQ ID NO: 125236 - RNA, 64 nt, hsa
agagagagccagaccuugucucaaaaaauaaaaaauaaaaaaauaaaaacaaaauaaggaaucc

SEQ ID NO: 125237 - RNA, 64 nt, hsa
cugagagagagagagccagaccuugucucaaaaaauaaaaaauaaaaaaauaaaaacaaaauaa

SEQ ID NO: 125238 - RNA, 64 nt, hsa
uaaguuuuguaagagcuuuaaaauauuuucacagauaaaaaauugcaaacaaguacucugguua

SEQ ID NO: 125239 - RNA, 64 nt, hsa
uguugagauuuacguggaacccuaaagcaguaaaauaaaaaaccugguugcagcacauucacac

SEQ ID NO: 125240 - RNA, 64 nt, hsa
caaaggaucuuuuguccauuccauuaauaacugaauaaaaaauaaauaaaauggauagaaaaaa

SEQ ID NO: 125241 - RNA, 64 nt, hsa
uauuugggauccucuuuucuauguauguauauauauaaaaaacuaugaaucacucacacucacu

SEQ ID NO: 125242 - RNA, 64 nt, hsa
accagccugggcaacauggcgaaacuccauuucuauaaaaaauacaaaaaaaaaaaaaucuagc

SEQ ID NO: 125243 - RNA, 64 nt, hsa
gcauucugugauccccugguuacugaguuaaaaaauaaaaaaguacgaguuagacauaugaaau

SEQ ID NO: 125244 - RNA, 64 nt, hsa
cacauuuuaguuuucugaugccacauagucuugcauaaaaaaggguucuugccuuaaaagugaa

SEQ ID NO: 125245 - RNA, 64 nt, hsa
gaacacauaaguaaguugcuuuggugccaagaaaauaaaaaagcuauuaucaggucuccuaacu

SEQ ID NO: 125246 - RNA, 64 nt, hsa
aaggagcauuuguuuugauuuuacucuuuuugguauaaaaaauuuugcuagcuuaguaaaacga

SEQ ID NO: 125247 - RNA, 64 nt, hsa
ggaagaaguaaggaaaaggagagagcuagucuagauaaaaaaagagauaaagacuacagaagga

SEQ ID NO: 125248 - RNA, 64 nt, hsa
aaugaugaaaagaguaguucaagaaguucuggagauaaaaaaaauacgagugauagaaguagca

SEQ ID NO: 125249 - RNA, 64 nt, hsa
ggugcgggaagaagcagaagcaaaaaaaauaaaaauaaaaaaauaaauaaaaauaaaaaaaaua

SEQ ID NO: 125250 - RNA, 64 nt, hsa
agcaaaaaaaauaaaaauaaaaaaauaaauaaaaauaaaaaaaauaaaaaaggaaaaaaaaaaa

SEQ ID NO: 125251 - RNA, 64 nt, hsa
aauaaaaauaaaaaaauaaauaaaaauaaaaaaaauaaaaaaggaaaaaaaaaaaagaagaaac

SEQ ID NO: 125252 - RNA, 64 nt, hsa
aucacuguucuuuuuuuauuuuauugucauuucaauaaaaaauauuugaaagagaaugacucug

SEQ ID NO: 125253 - RNA, 64 nt, hsa
aaaauacugauaaauucggaucaaauuugggggaauaaaaaauauuagagcaaaggaguuugcu

SEQ ID NO: 125254 - RNA, 64 nt, hsa
gugagagacccuguaucugaaaguaauaauaaaaauaaaaaauauaaaugaggucucguugaug

SEQ ID NO: 125255 - RNA, 64 nt, hsa
uggccaacauggugaaaccccgucucuacuaaagauaaaaaaauuagcugaguguguugguggg

SEQ ID NO: 125256 - RNA, 64 nt, hsa
caacaaagcaagacucugucucaaaaaaauaaaaauaaaaaaaaaaucuuaguuccauggaauu

SEQ ID NO: 125257 - RNA, 64 nt, hsa
uuaagugacaucuauuguuuaucagcuuuuaaggauaaaaaagguauuuuaaaaguuggauauu

SEQ ID NO: 125258 - RNA, 64 nt, hsa
aaggagcucuuacgaaaaacccagguuagaccgcauaaaaaauaaagugaacagugagguggua

SEQ ID NO: 125259 - RNA, 64 nt, hsa
uuauaguugguuauguaguaaacacugucauuuuauaaaaaaugagaauuauuuuggaucuuag

SEQ ID NO: 125260 - RNA, 64 nt, hsa
aaaaaggaaauuggaugggauacuguggcaaaucauaaaaaaccagauaauugaacuuugaagu

SEQ ID NO: 125261 - RNA, 64 nt, hsa
ugaaguuuugguaaaaauucuuuuuucuuuuuuaauaaaaaauuagguuauuacuuuuuuuaua

SEQ ID NO: 125262 - RNA, 64 nt, hsa
aaauaaaaucuauucuguguuuauguagggugguauaaaaaagaggucuucauuuagacaugug

SEQ ID NO: 125263 - RNA, 64 nt, hsa
cuuugguugucccuauuaacaaaaaaguauuuuaauaaaaaauugaaaugagugagucauauuu

SEQ ID NO: 125264 - RNA, 64 nt, hsa
uucauccuuacaauccugucccaugguauuuaacauaaaaaaaaauaaaacuguuaacagauuc

SEQ ID NO: 125265 - RNA, 64 nt, hsa
acagugugugcacuucaggcaauuuuuggaaaauauaaaaaauuccaaauucugccuuucagca

SEQ ID NO: 125266 - RNA, 64 nt, hsa
cuacuuuaugguauaccagugaaagaacuguaguauaaaaaagagguauuaauguuuuaugaaa

SEQ ID NO: 125267 - RNA, 64 nt, hsa
uagacagucaggguguauuauuucaagagcuucaauaaaaaaaguguuugcagguauuugucau

SEQ ID NO: 125268 - RNA, 64 nt, hsa
gggaccacaggcugcaccauaagacccacucacaauaaaaaaauaaaaggccgagccgggcaug

SEQ ID NO: 125269 - RNA, 64 nt, hsa
aaggccgagccgggcaugguugcucacucccguaauaaaaaaauaaaagaacaggcugagccgg

SEQ ID NO: 125270 - RNA, 64 nt, hsa
aaggcuacagcaacuaaaacagcaugguacugguauaaaaaaagacacauagaucaauggaaua

SEQ ID NO: 125271 - RNA, 64 nt, hsa
uugguacauauacaccauggaauacuaugcagccauaaaaaagaacaagacuguguccuuuaca

SEQ ID NO: 125272 - RNA, 64 nt, hsa
uaggcaacauaguaagaccucaucucuacuaaaaauaaaaaaaaacagccagguguguuagucc

SEQ ID NO: 125273 - RNA, 64 nt, hsa
aaucaaguugcugcagccuaugcacuggcccagaauaaaaaacguggugauucugcuaaagcuu

SEQ ID NO: 125274 - RNA, 64 nt, hsa
ccuggcaacagagugagacuccaucucaaaaaaaauaaaaaaaaagaaaaagaaauaaacucua

SEQ ID NO: 125275 - RNA, 64 nt, hsa
aaagcauuugguuguuuccaguaccuuucucuucauaaaaaaaucauacagcagaaaaaccuua

SEQ ID NO: 125276 - RNA, 64 nt, hsa
gacagaaugagacucugugucaaaaaaauaaaaaauaaaaaaucuaagggcucaggaaccaguu

SEQ ID NO: 125277 - RNA, 64 nt, hsa
ccugggugacagaaugagacucugugucaaaaaaauaaaaaauaaaaaaucuaagggcucagga

SEQ ID NO: 125278 - RNA, 64 nt, hsa
uguugguauguagccuggauaaaugcucuuaauuauaaaaaauucugucgaggaguguuccaua

SEQ ID NO: 125279 - RNA, 64 nt, hsa
uaaaacuuuuuguuauggaagaauucaaauauaaauaaaaaauugugaguaauaaaaugaacuc

SEQ ID NO: 125280 - RNA, 63 nt, hsa
uccccucaaaaaaauaaaaauaaaaaaaauaaaaauaaaaaaacauuuuuuucaagcagggag

SEQ ID NO: 125281 - RNA, 64 nt, hsa
aaauaaacugugcaauccccucaaaaaaauaaaaauaaaaaaaauaaaaauaaaaaaacauuuu

SEQ ID NO: 125282 - RNA, 64 nt, hsa
agacucugucucaauaaauaaauaauuaauuaaaauaaaaaacagcuuaaagagaaaaauggcc

SEQ ID NO: 125283 - RNA, 64 nt, hsa
uggccaacauggcgaaaccccgucucuacuaaacauaaaaaaauuagucagguguggcggugcg

SEQ ID NO: 125284 - RNA, 64 nt, hsa
ucguauuauucacuuguaaaaaugauuguaacagauaaaaaauguaucugcagcaacucugcag

SEQ ID NO: 125285 - RNA, 64 nt, hsa
uacaugauuuucaaguuguaaugcagauggacagauaaaaaagauuuuacguuugucuuuuggc

SEQ ID NO: 125286 - RNA, 64 nt, hsa
uuucuacuccaggacugguuuuguuuuuauauauauaaaaaaaaaaagugaaaacaccaaugug

SEQ ID NO: 125287 - RNA, 64 nt, hsa
cacuguuuuguuagcgagcaccuuuugaccaguaauaaaaaaccuuggcuuuggaguuuuccac

SEQ ID NO: 125288 - RNA, 64 nt, hsa
caauagaucgcccuuaaagacccauuguaaggucauaaaaaaccucggccaccugcacaaagau

SEQ ID NO: 125289 - RNA, 64 nt, hsa
gcaacaagaaaccuuaaggugucuuaccgacgaaauaaaaaacauaaaugauuguucuccaagg

SEQ ID NO: 125290 - RNA, 64 nt, hsa
auaaggagaaaagagaaugggagagugagagaaaauaaaaaaggcaaaagggagagagagggga

SEQ ID NO: 125291 - RNA, 64 nt, hsa
uagagagaucugcccuguguuauccaguuaugagauaaaaaaugaauauaagagugcuugucau

SEQ ID NO: 125292 - RNA, 64 nt, hsa
aagcuggaaaauuacuuaaaacaggaaagugucaauaaaaaaacuugagcaacaccaacauauu

SEQ ID NO: 125293 - RNA, 64 nt, hsa
agcugcugaauuugugccccuggauuggaagcaaauaaaaaaaaaaaacaacacauaaacuaaa

SEQ ID NO: 125294 - RNA, 64 nt, hsa
gccacagagcaagacuccgucucaaaacauaaaaauaaaaaaaauacaaauagcugacccgggu

SEQ ID NO: 125295 - RNA, 64 nt, hsa
cgaccugggcagcauagcgagaccccaucucuauauaaaaaaaaagauguuaaaacagugaaau

SEQ ID NO: 125296 - RNA, 64 nt, hsa
ggucauuuaaagucaauauuuauuuauguauguaauaaaaaaaguuggauuuuuguguaugucu

SEQ ID NO: 125297 - RNA, 64 nt, hsa
guguuauuggaagaaaaaugcuauuaaugggcuaauaaaaaacauguguuucucuuauggauuu

SEQ ID NO: 125298 - RNA, 64 nt, hsa
ugcaguuuaugauauuguuuuucuaaaaacaaaugcuguuuauacauaugagauagcuauuuug

SEQ ID NO: 125299 - RNA, 64 nt, hsa
auuaacuacuccucguaaguguugcauuuacauggcuguuuagaaaacugcugcccaaauuuau

SEQ ID NO: 125300 - RNA, 64 nt, hsa
ugcuuucugaaacugagguauaacaccagagcuugcuguuuaaaggauuauaugauguacauca

SEQ ID NO: 125301 - RNA, 64 nt, hsa
ucaugucacuauauauaagaauauuguaugucaugcuguuuaugugugacuaccggguuuuuaa

SEQ ID NO: 125302 - RNA, 64 nt, hsa
cugaaugugacuggcgugcugagaauguguuuacgcuguuuaaugucugccaggugaggguuac

SEQ ID NO: 125303 - RNA, 64 nt, hsa
aucccggccaggugggcggggacuaacaaagacagcuguuuagggucuucuccccucacccaug

SEQ ID NO: 125304 - RNA, 64 nt, hsa
cccuuuggucaaucauaacaugcuguuuaaagcagcuguuuacaggauguguagugguaugccc

SEQ ID NO: 125305 - RNA, 64 nt, hsa
ucuuaagggaccacccuuuggucaaucauaacaugcuguuuaaagcagcuguuuacaggaugug

SEQ ID NO: 125306 - RNA, 64 nt, hsa
agaauugaacuguuguacuuccaaagagaauugggcuguuuauaaugauuuuaauagagaaaga

SEQ ID NO: 125307 - RNA, 64 nt, hsa
guguuuauucuucauaaggacuuuguuuuagaaagcuguuuauagcuuuggaccuuuuuagugu

SEQ ID NO: 125308 - RNA, 64 nt, hsa
caaugaaaaguagauauagauauugugaaaauaggcuguuuaacaaacagauuggaauaaagcc

SEQ ID NO: 125309 - RNA, 64 nt, hsa
uuuaaagaucugaagugugaguagaauguauucagcuguuuaacauguaguuuagauauucaaa

SEQ ID NO: 125310 - RNA, 64 nt, hsa
uauuccacuaacugaaauauggcaacuuagaggcgcuguuuauuuacuguauacgucgaccuau

SEQ ID NO: 125311 - RNA, 64 nt, hsa
gucauaaucauauuguguauaacuuggaaauggugcuguuuaaaaaaauuguguauuuauacag

SEQ ID NO: 125312 - RNA, 64 nt, hsa
agagaagguccucugguuagucucucaaauugaggcuguuuagggaaauccuuauucaguuggu

SEQ ID NO: 125313 - RNA, 64 nt, hsa
acaggugguaugggagagcaaaaggcaagcuaaugcuguuuaccguguuuuggucaaacguaac

SEQ ID NO: 125314 - RNA, 64 nt, hsa
aauacaauuucagaaaagguucugauacucuuguuuuugauaaagcauuuuuucaacuaaccau

SEQ ID NO: 125315 - RNA, 64 nt, hsa
gacaucacugaaaugaacuucaguaagcuuucaauuuugauacacaguucauuauucauaacuu

SEQ ID NO: 125316 - RNA, 64 nt, hsa
aaucguuggugccaucagugauuuacaaacaauauuuugauauugcagaugacuugcuuacugu

SEQ ID NO: 125317 - RNA, 64 nt, hsa
ugugaaaaagccuaagaaaaaggaaauuggacaguuuugauacaaacuuuguuugcuaaugcac

SEQ ID NO: 125318 - RNA, 64 nt, hsa
acauuagaagaaaacauauauuuuauuuucauacuuuugauaugauuguaacauauuucuugag

SEQ ID NO: 125319 - RNA, 64 nt, hsa
uuauagaagcuacuuuuaaaucagaauauuuaauuuuugauauucauauaauuaauagaaguug

SEQ ID NO: 125320 - RNA, 64 nt, hsa
ucucaaaaauuuaguuaccaaaguagaaaagguauuuugauacuagauauuaaaaacuacauau

SEQ ID NO: 125321 - RNA, 64 nt, hsa
ugagauaaaaguguuuuaaaauucuguuuauaguuuuugauaugcauauauaauuauguguaua

SEQ ID NO: 125322 - RNA, 64 nt, hsa
agauuuaacaaucuuauaaucuauugaaugccauuuuugauaaagcacuggaggucuuauugcc

SEQ ID NO: 125323 - RNA, 64 nt, hsa
caaaacuaccuaggcuuuacucuugagugucuccuuuugauagggauuguuucuggaccaguuu

SEQ ID NO: 125324 - RNA, 64 nt, hsa
auauuauuaauauuuuaaaaagaguuaaguuguauuuugauaauucacaaacuaucaugcaaau

SEQ ID NO: 125325 - RNA, 64 nt, hsa
aaauaaugcaaacuuuuaaaauaagcaucuagguuuuugauaauucugucuacuuacaacaaac

SEQ ID NO: 125326 - RNA, 64 nt, hsa
acccugcaaauggcuauugaguuggaaguauuguuuuugauauguaagagauauucagaaugcu

SEQ ID NO: 125327 - RNA, 64 nt, hsa
acugauauauucccaguauuuucauaaugccauguuuugauaaaguacugaaucaccacuuuau

SEQ ID NO: 125328 - RNA, 64 nt, hsa
acauacaguaaaaaaguagaaauuuaugaaauacuuuugauaaaaaguuuauuuugugcuuacc

SEQ ID NO: 125329 - RNA, 64 nt, hsa
uacuuuccacaguuaaauuuacauuaauggcaauuuuugauaguuuuauggcuuuuuacuguua

SEQ ID NO: 125330 - RNA, 64 nt, hsa
agaucucauaacuuuauacagcauguuguaagcauuuugauaacuaaaauccuguucuagugaa

SEQ ID NO: 125331 - RNA, 64 nt, hsa
cugaaucaagauucauguuuuuuauuuuuauuuuuuuugauacagagucucacucugucacuca

SEQ ID NO: 125332 - RNA, 64 nt, hsa
cccacaguagguauugaaacugguaaaaucaguuuuuugauaguguguguauauaagaaaaaau

SEQ ID NO: 125333 - RNA, 64 nt, hsa
cuuugguuggaacgcauuggcuuuuuuuuucuuguuuugauagaaauggaauuaagcaaaagua

SEQ ID NO: 125334 - RNA, 64 nt, hsa
gucauuuguuucaaugugacugaaacaaaauguuuuuugauaggaaggaaacuggaauucuuug

SEQ ID NO: 125335 - RNA, 64 nt, hsa
aggaaacuucugauguuuauuaaaaaaacuggccuuuugauagagguaacuuaauuugggaauu

SEQ ID NO: 125336 - RNA, 64 nt, hsa
ucaguucuaccaaauaggaugucauguuugacauuuuugauagugacuuuggggucuucuucac

SEQ ID NO: 125337 - RNA, 64 nt, hsa
ugcaggguuuuaaacuuuauaauuacuuuaauauuuuugauaacuagaaaucuaguauugccau

SEQ ID NO: 125338 - RNA, 64 nt, hsa
uuuucucagugaccucuggaauaaaagaacugacuuuugauaguuuuaaaauuaaucuuugcau

SEQ ID NO: 125339 - RNA, 64 nt, hsa
aggacuagcuuaccugauuuuaaugaaaaucacauuuugauacaaacaccagauuugaaaguuc

SEQ ID NO: 125340 - RNA, 64 nt, hsa
gaggucuuguugagaaggcaaaauuuucuaaauauuuugauaucaauuuggguaaagaaaggaa

SEQ ID NO: 125341 - RNA, 64 nt, hsa
gcuuaugcuaguucaguauuuggucuaggcuucauuuugauaugacugaauugcaaucuauauu

SEQ ID NO: 125342 - RNA, 64 nt, hsa
ucuguuuuuuuuuaauuuguuguuguuguuacuguuuugauaccucggaaacaccuccguugac

SEQ ID NO: 125343 - RNA, 64 nt, hsa
uguauuugcaccaucauuuacuuuucuggcuuacuuuugauagaaaucuagguugguucaaacc

SEQ ID NO: 125344 - RNA, 64 nt, hsa
uagaauuaaauuuaaauuuauccuccaacuaaauuuuugauagaauuaaauuuaaauuuguccu

SEQ ID NO: 125345 - RNA, 64 nt, hsa
guuggaguguuugcacaauuuaaauuugauaaauuuuugauagaauuaaauuuaaauuuauccu

SEQ ID NO: 125346 - RNA, 64 nt, hsa
ccaguccagcagaauuacauuuugaugaccuccauuuugauacuuguagaccagaucuaauccg

SEQ ID NO: 125347 - RNA, 64 nt, hsa
aguagguacguuuauuuuuacuuuuuuauuauaauuuugauauuaaaaagaacagagauggggu

SEQ ID NO: 125348 - RNA, 64 nt, hsa
ggcauuuugaaaacuuuuagaaaaaaguaguacuuuuugauacuuuaguauuuauggaaacuag

SEQ ID NO: 125349 - RNA, 64 nt, hsa
uguuugcuugagaaaagcaaaaaugcuaacaagguuuugauagauuggcccaaaauucuaacuu

SEQ ID NO: 125350 - RNA, 64 nt, hsa
ucagauuuuaguuuuuaaaauacugauacauccauuuugauauaccauguauucacacuuuaaa

SEQ ID NO: 125351 - RNA, 64 nt, hsa
uauuacuuuauguacaacugaaguuuuguuuuaguuuugauaauaaauucuuuggaacuuuaau

SEQ ID NO: 125352 - RNA, 64 nt, hsa
aaaggcauccauuuucuaggcuuaaaagauauauuuuugauauauuuaauuauauucucuacac

SEQ ID NO: 125353 - RNA, 64 nt, hsa
auccugaagaaauaagccucaguuuuccaucuguuuuugauaagaauaagaaagggagugagug

SEQ ID NO: 125354 - RNA, 64 nt, hsa
aagcgguaauggaggaagacuagugcuuugugcauuuugauauauuugaguucauuuuuuccac

SEQ ID NO: 125355 - RNA, 64 nt, hsa
cagucuauaacuaucaacguagugcaacaggguguuuugauaccuuuguuuucaccucuugaca

SEQ ID NO: 125356 - RNA, 64 nt, hsa
aacauuuccaguuggucauucuaagcauuuacccuuuugauacucuagcuagucagguacucca

SEQ ID NO: 125357 - RNA, 64 nt, hsa
caauguaaaugaaauaaauauauucaaauuggcuuuuugauaugcaucaaguggcauuuuguuc

SEQ ID NO: 125358 - RNA, 64 nt, hsa
agugugugguagaaacaaacuccauuacucugauuuuugauacaguuuucagaaaaagaaauga

SEQ ID NO: 125359 - RNA, 64 nt, hsa
ugcaaaccuacuaacaaauuauacuguugcacaauuuugauaaaaauuuagaacagcauugucc

SEQ ID NO: 125360 - RNA, 64 nt, hsa
aaaggaaguuuuaaaggccguuggcugugcuguauuuugauauaauuguacuguguuuuuaaau

SEQ ID NO: 125361 - RNA, 64 nt, hsa
uucuuucaaccuauacaaccuaacuuauggacuguuuugauagaugauaauuuuuuuuuuuuag

SEQ ID NO: 125362 - RNA, 64 nt, hsa
gcagaagaaaugaagaaagugaugaugauuuagauuuugauauugauuuagaagacacaggagg

SEQ ID NO: 125363 - RNA, 64 nt, hsa
acauugccucaaaaauugguccucgguaagugccuuuugauaaaugaucucaaauaaaugacuc

SEQ ID NO: 125364 - RNA, 64 nt, hsa
uuuuuuuauccgaucaaccugugcacuuuugauauuuugauauuauauuugcuuccuuaauucc

SEQ ID NO: 125365 - RNA, 64 nt, hsa
acauguucuuuuuuuauccgaucaaccugugcacuuuugauauuuugauauuauauuugcuucc

SEQ ID NO: 125366 - RNA, 64 nt, hsa
cuacuuuagagccucuuuuucucccaacucauauuuuugauaggaaaaacagaaaacccaucca

SEQ ID NO: 125367 - RNA, 64 nt, hsa
cguaacacagaacgagguuaucuaggguuguagcuuuugauacaacuccccgaucuagauuuau

SEQ ID NO: 125368 - RNA, 64 nt, hsa
acacaguaucauugcaaaugcaguuuacagggauuuuugauauacuggcuugggaccuauaaga

SEQ ID NO: 125369 - RNA, 64 nt, hsa
uaaauaacuacauaauagccugagaauaaugggauuuugauagugccauuuauuguuaaagauu

SEQ ID NO: 125370 - RNA, 64 nt, hsa
agcaaguuuuuaaaucauuugugugcucuggcucuuuugauagaagaaagcaacacaaaagcuc

SEQ ID NO: 125371 - RNA, 64 nt, hsa
acaaccuuuccaauaaucccuuaaucagaucacauuuugauaaacccugggaacaucuggcugc

SEQ ID NO: 125372 - RNA, 64 nt, hsa
uugcuggguuaccaaauaugcaaaauuuuaaggcuuuugauacuucguuaugaguguauuuuug

SEQ ID NO: 125373 - RNA, 64 nt, hsa
ucauccuacuauguugaaagaaccaauguuaauauuuugauaaauaucauuuguccuuuuacuu

SEQ ID NO: 125374 - RNA, 64 nt, hsa
gggcaaaugaauuagccaacuguuaacuggaagcuuuugauaauuuuuuuuuuuagaacaauuu

SEQ ID NO: 125375 - RNA, 64 nt, hsa
ccuuugcugaguuauacauuccuuuaucaaucucuuuugauacaacauuuaaaacaaguagcuu

SEQ ID NO: 125376 - RNA, 64 nt, hsa
ccucucccaucauuuugauaaagaacuacaucauuuuugauagaauuggugaauguuccuaaac

SEQ ID NO: 125377 - RNA, 64 nt, hsa
aucaagaacccuaugaagaauuccucucccaucauuuugauaaagaacuacaucauuuuugaua

SEQ ID NO: 125378 - RNA, 64 nt, hsa
uuuuuuccaaguagcagacgucauguugcaugguuuuugauauuuauauguaaguuuuucaaau

SEQ ID NO: 125379 - RNA, 64 nt, hsa
gauuaauuuuaugaaauaaauucugagcugcugcuuuugauauagucagacuuaagacugaacc

SEQ ID NO: 125380 - RNA, 64 nt, hsa
uuuuugucacuuccccaucagaaaagcauauucuuuuugauagagggucaguguuauaaauaau

SEQ ID NO: 125381 - RNA, 64 nt, hsa
cuuccuucaacuaaucuugucucauucacucaccuuuugauaucgaaggcagaaauugcguuua

SEQ ID NO: 125382 - RNA, 64 nt, hsa
aggaaaaacuuaugcgguagccugcauuagggcuuuuugauacuugcagauugggggaaaacaa

SEQ ID NO: 125383 - RNA, 64 nt, hsa
aaaauuggcgacuugaaauuaaaucaugccaagguuuugauacacuugucuuaagauauuaaug

SEQ ID NO: 125384 - RNA, 64 nt, hsa
auauuuaaguagccuguggcuauuuuuauacugauuuugauaucauguucuuuucauagucgua

SEQ ID NO: 125385 - RNA, 64 nt, hsa
uguauauuccaguuaccuagauauucccuugagauuuugauacaauuugagggaggcagaaguc

SEQ ID NO: 125386 - RNA, 64 nt, hsa
ucuuccugccgccucccccacuccaaguguuuauuuuugauaccaaacaugaauuuucaguucc

SEQ ID NO: 125387 - RNA, 64 nt, hsa
uacuccaggucucccugucucucccccgcugccauuuugauaguauaaucuauuuuuaaauggg

SEQ ID NO: 125388 - RNA, 64 nt, hsa
agcgaaacuccgucucaaaaaaaaaaaaaaaaaaucaacucauaacuuagaaaccgauguuauu

SEQ ID NO: 125389 - RNA, 64 nt, hsa
ugggccugccuggccuaaacccaguaguuaaaaaucaacucauugccuguaaucccagcacuuu

SEQ ID NO: 125390 - RNA, 64 nt, hsa
gguaguuugauagggauagcauugaacuauuugcucaacucaacauuuuaggaauuuauuucug

SEQ ID NO: 125391 - RNA, 64 nt, hsa
gguuuccuaaccuccucuuguaguaauucucaacucaacucaaagucccaagaauuuggaaugg

SEQ ID NO: 125392 - RNA, 64 nt, hsa
auccugguuuccuaaccuccucuuguaguaauucucaacucaacucaaagucccaagaauuugg

SEQ ID NO: 125393 - RNA, 64 nt, hsa
auacaaccccaaaucuacuacuuuaaauguaacaucaacucaguuguaugaaucuggaguguaa

SEQ ID NO: 125394 - RNA, 64 nt, hsa
ggacaacaguggcaaagcugaaauuuuuauacauucaacucaugauucacauguggcaucaguc

SEQ ID NO: 125395 - RNA, 64 nt, hsa
gcaaugcaucccaaugguuguggggauugugggcucaacucaagagaaguuuaggagggggagc

SEQ ID NO: 125396 - RNA, 64 nt, hsa
cacccuccacccacuaccuccuccaacaaaggagucaacucaguugaaaaaacugguccuuugg

SEQ ID NO: 125397 - RNA, 64 nt, hsa
agagcugcaccucuccuccuagcauuaguuuagaucaacucaaggaguauuuauuaauggcugc

SEQ ID NO: 125398 - RNA, 64 nt, hsa
uaaaagaacaguaaacauugguaagaaugagcuuucaacucauaggcuuauuuccaauuuaauu

SEQ ID NO: 125399 - RNA, 64 nt, hsa
uuuuaggcauauguuuuaaacauagaaaguuucuucaacucaaaagaguuccuucaaaugauga

SEQ ID NO: 125400 - RNA, 64 nt, hsa
gcaaggccagccuuucuggcagaaggagcuguccucaacucagggccgcugugagcaaagcuga

SEQ ID NO: 125401 - RNA, 64 nt, hsa
agaaggggacaggcaguccgcggucucuggacaaucaacucaagguacgcccacugcaaggccu

SEQ ID NO: 125402 - RNA, 64 nt, hsa
ggccccucguuuuaucauucccaguccauugucaucacgucagagaaaaaucuucaggggugcu

SEQ ID NO: 125403 - RNA, 64 nt, hsa
auuuuaaugaguuauaaaauuauucugcaucucaucacgucacaguauuucuguacuauuuauu

SEQ ID NO: 125404 - RNA, 64 nt, hsa
cuucaagcugauccaguaggugcagcugccgcagccgggggaggccugcccgggaaggcugcug

SEQ ID NO: 125405 - RNA, 64 nt, hsa
ggccuuccugaacugggaagucccuggcuggcccccgggggagaggggcaaaugccuccgggac

SEQ ID NO: 125406 - RNA, 64 nt, hsa
ucauuggccugcccuucaacaauggccucaugggccgggggaacaucccuacccuuggcagugu

SEQ ID NO: 125407 - RNA, 64 nt, hsa
uaucuuuauacuauauaauaugguaacuuggguaccgggggaacuuuaaaauuucaucucaaaa

SEQ ID NO: 125408 - RNA, 64 nt, hsa
gcagagaaacagauguugcagacuuccacggcacccgggggagugguggguguggacacauugg

SEQ ID NO: 125409 - RNA, 57 nt, hsa
ccaugugggugaaaggauagacacagaccgggggacucgggcacugcuccuggcucu

SEQ ID NO: 125410 - RNA, 64 nt, hsa
caggagugagcgagggcagcggaaaggaguucuuccgggggacacgaauugccuggcugaguag

SEQ ID NO: 125411 - RNA, 64 nt, hsa
cugcagaugccacaccugcuccuucuugcuuuccccgggggaggaaggggguuguggucgggga

SEQ ID NO: 125412 - RNA, 64 nt, hsa
ugaggcuggcucacccugaagaggugggauaggaccgggggaccccagagggaggccuaggagg

SEQ ID NO: 125413 - RNA, 64 nt, hsa
cacaagcaagagagaauuuaacacuguuucaaacccgggggaguuggcuguguuaaagaaagac

SEQ ID NO: 125414 - RNA, 64 nt, hsa
uggcagggcaggggguggugggccagacugguccccgggggacuucuucacaggggcugcuggc

SEQ ID NO: 125415 - RNA, 64 nt, hsa
cccagcauggcuggagugggaagaggcuugggccccgggggaaugguuagggggacugaacccc

SEQ ID NO: 125416 - RNA, 64 nt, hsa
guuuggucuugucagaccuguagccuggaccucgccgggggaccagggagugcacgucuguaga

SEQ ID NO: 125417 - RNA, 63 nt, hsa
ucucggccauguccggcugacacgggcgccuucccgggggagugggaggagagggaggggagg

SEQ ID NO: 125418 - RNA, 64 nt, hsa
cagaggcuggggguagccauugugcagucauggcccgggggaaacuugccaaccuucgugucag

SEQ ID NO: 125419 - RNA, 64 nt, hsa
aguuucugccauagccccaugcccagccugugcgccgggggaccuggggacucgggugcuggga

SEQ ID NO: 125420 - RNA, 64 nt, hsa
ccuguccuccaggcuguaggggaggagagccuggccgggggagacagacuggacauuucccugu

SEQ ID NO: 125421 - RNA, 64 nt, hsa
cgcggcgcgguaggcgagcgccgaggcccagcggccgggggaggacgaccucguaucccgcguc

SEQ ID NO: 125422 - RNA, 53 nt, hsa
ggacccgagagccgcucugagcaccgggggaugugacugccucagcggcagag

SEQ ID NO: 125423 - RNA, 64 nt, hsa
guuugcccaguccuggguuguuuccaggagaaagccgggggaggggcccucaggccauucccca

SEQ ID NO: 125424 - RNA, 64 nt, hsa
aagcucagcuccgugugacccacauggccccaggccgggggacaccagaggcuccuccaugggc

SEQ ID NO: 125425 - RNA, 64 nt, hsa
ucugaauuuaacaaaugcuuagucucagcagccuccgggggaaaaaagcuuagccuagcaguca

SEQ ID NO: 125426 - RNA, 64 nt, hsa
ccgccacguugcagaaagagccagccaaggagacccgggggaggaaccgcaguguccccuguca

SEQ ID NO: 125427 - RNA, 64 nt, hsa
caaauccuaggcccugcauuccugucauccucauccgggggaaacaccaucaucccaguagcug

SEQ ID NO: 125428 - RNA, 64 nt, hsa
cgcagcgggagcgcacaggugccccgcggcccagccgggggauaacgcagggcggucuucugcu

SEQ ID NO: 125429 - RNA, 64 nt, hsa
gaggugguccccaugucccuggcacacuagcauuccgggggaugaggaauccccagcccuugag

SEQ ID NO: 125430 - RNA, 56 nt, hsa
caacaggcccacuccucugauuaccuccgggggauggacggcaaacagguaaggag

SEQ ID NO: 125431 - RNA, 64 nt, hsa
acuggggaggcugaggcaggagaaucacuugaacccgggggacagagguuguagugagccaaga

SEQ ID NO: 125432 - RNA, 60 nt, hsa
uggcggucaaguccagcugaagccggggggccgggggaggggcgcgggagggggcggggc

SEQ ID NO: 125433 - RNA, 64 nt, hsa
caggaaugagucaaucagccuuuaggucuuuaguccgggggacuuggggcugagagaguauaaa

SEQ ID NO: 125434 - RNA, 64 nt, hsa
ccugaaaggcugcuccuggccagaggacucugucccgggggaccguguccucccccauguccug

SEQ ID NO: 125435 - RNA, 64 nt, hsa
gccaaagggcuccuguccacccugacaccacaggccgggggagaguagggacucuaccccccuc

SEQ ID NO: 125436 - RNA, 64 nt, hsa
ccccacagugagcaugccgggccccuccauccacccgggggagcccagugaagccucugaggga

SEQ ID NO: 125437 - RNA, 60 nt, hsa
aggguugguuucaggccugagauccgcuggccgggggagguggguguggguggaagggcu

SEQ ID NO: 125438 - RNA, 64 nt, hsa
auguggacucuggaagagccaggggcccagaaugccgggggaggcuucugaguggcacucaugg

SEQ ID NO: 125439 - RNA, 64 nt, hsa
cugagacuaagacguggacaggggccgcgcagauccgggggaggcucccaaauuggaaccaggc

SEQ ID NO: 125440 - RNA, 64 nt, hsa
acacauggagucuuagcaaaugcacuaauguauuccgggggacugucaccuggcaccacugggg

SEQ ID NO: 125441 - RNA, 64 nt, hsa
ugacauagacccugcccuuccucuuugaauucuuccgggggaaggggugacugaacugggaguc

SEQ ID NO: 125442 - RNA, 64 nt, hsa
acuggugccuugcuuagagccagaagggaugaagccgggggaucuauggaacagaggaggagcg

SEQ ID NO: 125443 - RNA, 64 nt, hsa
gaacaugaccuucuggcugcuggugcgggacacuccgggggagaauguggaacccagccacacu

SEQ ID NO: 125444 - RNA, 64 nt, hsa
aucgcugccccccaaccucguagcaacagcaauaccgggggacccugcggccaggccuggugcc

SEQ ID NO: 125445 - RNA, 64 nt, hsa
cccugagaggcgcccgcggucugcggccaguggcccgggggaaagcuggggcugggaagcccgg

SEQ ID NO: 125446 - RNA, 64 nt, hsa
cuuccuuggcauuuggcaucacugccuucuguucccgggggagcauggaucuuuuguccucacu

SEQ ID NO: 125447 - RNA, 64 nt, hsa
aauggcugaguggaucaaaccucagccgcagccuccgggggacaggcccagggcgggaaaugga

SEQ ID NO: 125448 - RNA, 64 nt, hsa
ggccucacugcaggcaggagccccgccccuccugccgggggaggcccagggaccggagcauuuc

SEQ ID NO: 125449 - RNA, 64 nt, hsa
caguuuggaucuauugggggaguguggccacagaccgggggaugauugaauuguucagaaccug

SEQ ID NO: 125450 - RNA, 64 nt, hsa
gcccgcgugcuggagaauugacugaagcacagcaccgggggagagggacacuccuccucggaag

SEQ ID NO: 125451 - RNA, 64 nt, hsa
ccuaccagcuccuccagcccugccgggcacaugcccgggggacgccugcccugcccagguggcc

SEQ ID NO: 125452 - RNA, 64 nt, hsa
ucuccuaccuuuccucagguaugauguucuguccccgggggagaugcaacggcucuccuuugcc

SEQ ID NO: 125453 - RNA, 64 nt, hsa
cucugagggcccagcccuccccggggcgcucugcccgggggacuccggacacugacagccgcgu

SEQ ID NO: 125454 - RNA, 64 nt, hsa
uucaugcgcugcgaguggcggggcugcccagaggccgggggagcagacagggccggugcucccu

SEQ ID NO: 125455 - RNA, 64 nt, hsa
ugagugccauacucccaacagcuccagguacccaccgggggaugugccugcucaggaaaccucu

SEQ ID NO: 125456 - RNA, 64 nt, hsa
gcccguggggugagcagcuggcuuggccggaaacccgggggaggcccagccacggcacauccug

SEQ ID NO: 125457 - RNA, 64 nt, hsa
uugaacauucaucuguacugaaguguuacuugaaccgggggaaucucggaccugggggagccgg

SEQ ID NO: 125458 - RNA, 64 nt, hsa
uuaaagaaaaaugaaaaagguuaguguuugggggccgggggaggacugaccgcuucauaagcca

SEQ ID NO: 125459 - RNA, 64 nt, hsa
acaccaccccuugccaaagucaucugccugcuccccgggggagaggaccgccggccucagcuac

SEQ ID NO: 125460 - RNA, 64 nt, hsa
ggcagcguggccacaaggggcggcacuccucaggccgggggagccacugccccguccaaggccg

SEQ ID NO: 125461 - RNA, 59 nt, hsa
gcauggugcacgucuacugaaaugggggcccgggggacuuuuuuaaaaaaccagaucgg

SEQ ID NO: 125462 - RNA, 64 nt, hsa
gccauuuggguaagccgguggcuggucucgucugccgggggaaggguggggaggugcaauggga

SEQ ID NO: 125463 - RNA, 64 nt, hsa
gaugcggguggcccaaggaccacgaucaagggguccgggggaccgaggucccagaucagugagg

SEQ ID NO: 125464 - RNA, 64 nt, hsa
gggggagcuggauccagagcuggaggggguggguccgggggagggaguggcucggaaggggccc

SEQ ID NO: 125465 - RNA, 64 nt, hsa
gaggcccggaccaguugggaggagugagcaggccccgggggagggggaugagcgcaguuugcuc

SEQ ID NO: 125466 - RNA, 64 nt, hsa
aaggagcaacucuguccccugagcguugggggucccgggggagagguggacagacaccucccuc

SEQ ID NO: 125467 - RNA, 64 nt, hsa
ugaccucacagcucugcagaggauggagcuugcuccgggggaccgggacugucuguucucaggg

SEQ ID NO: 125468 - RNA, 64 nt, hsa
ugagcugcccuccgcucccuccgggguggcgcgcccgggggaggggggaguugggggcuggaua

SEQ ID NO: 125469 - RNA, 64 nt, hsa
gcaacaucuccccuucguuuuugagggggucaugccgggggagccaccagccccucacuggguu

SEQ ID NO: 125470 - RNA, 64 nt, hsa
gcuagcuccaccugccuuggccaccagggcagccccgggggauccgggcugcugggcagcaggu

SEQ ID NO: 125471 - RNA, 64 nt, hsa
ugugccagcccccuccagucugccacugccgugcccgggggacauccugcgcccaggcuggagg

SEQ ID NO: 125472 - RNA, 64 nt, hsa
guacggccuugucuucaggucucgaggccugacuccgggggacagguggcagcaggucggccgc

SEQ ID NO: 125473 - RNA, 64 nt, hsa
aaaaaacaauaaaggacuguccccucaaaaccagccgggggacuguuaaauuggcucagggcua

SEQ ID NO: 125474 - RNA, 64 nt, hsa
caucggcgugagcccgcuccccucuccccgcgggccgggggacgccccccagacucacacgggg

SEQ ID NO: 125475 - RNA, 55 nt, hsa
uggccugugcugaaagcuagguccuccgggggaggaggguguagcuggcauguca

SEQ ID NO: 125476 - RNA, 64 nt, hsa
ggaacaugugccucccguuccagcaucuggcugcccgggggaggaaggacacccggggcgggcg

SEQ ID NO: 125477 - RNA, 64 nt, hsa
ucuucccauuuccuggcacacucugccccucuguccgggggacacgcgcauguguuugccaggg

SEQ ID NO: 125478 - RNA, 64 nt, hsa
gcuggcacagcaguucugagcccuggacucugccccgggggauguggccggcacugggcagccc

SEQ ID NO: 125479 - RNA, 64 nt, hsa
ccucugugugguccaagggcaagaguggcuggagccgggggacugugcuggucugagccccacg

SEQ ID NO: 125480 - RNA, 64 nt, hsa
ccugcuuuugacccaaagguccugacgguugcguccgggggaggggaaggaagggccgcugucg

SEQ ID NO: 125481 - RNA, 64 nt, hsa
acugcgcucaggaucccgccccggagcccccagcccgggggagagggggagggaguugggagaa

SEQ ID NO: 125482 - RNA, 64 nt, hsa
cauucgggugagcguccuggccugggcccuaugcccgggggaagggugaaauugggguucaggc

SEQ ID NO: 125483 - RNA, 64 nt, hsa
cagaggccugucucccccuucccuccccaccggcccgggggagaccucuucacacccaaagaug

SEQ ID NO: 125484 - RNA, 64 nt, hsa
agcggcggauccugguggccaccaaucuguuuggccgggggauggacaucgagcgagucaacau

SEQ ID NO: 125485 - RNA, 64 nt, hsa
gaaggaagcagaaguucaaggugaucgugccagcccgggggaaaaggcugaguccaccgcugug

SEQ ID NO: 125486 - RNA, 64 nt, hsa
cuccgcccgcagacucuggcuccuccgacuacacccgggggaaccuaguccgccuggggcuggc

SEQ ID NO: 125487 - RNA, 64 nt, hsa
ccccuucccccgugugaacacgagugacagggcuccgggggaagucucagagaagccauagccc

SEQ ID NO: 125488 - RNA, 64 nt, hsa
uucugcagucugcgccuuuccacgcccuccagccccgggggagauaaggucaugggagaguggg

SEQ ID NO: 125489 - RNA, 64 nt, hsa
gguccauauuaaagaagcaagggucuucccauacccgggggaccccugacaaaccuaccaggcc

SEQ ID NO: 125490 - RNA, 64 nt, hsa
caggagccaagcccaccccuucuuuguguagggaccgggggaccauggccuguuccgggacacu

SEQ ID NO: 125491 - RNA, 64 nt, hsa
ggcugacggccgacccugggaggaggugacaucgccgggggagguugugggcaacgguggagga

SEQ ID NO: 125492 - RNA, 64 nt, hsa
augcaccuucugaggcaccuccagcugcccccggccgggggaugcgaggcucggagcacccuug

SEQ ID NO: 125493 - RNA, 64 nt, hsa
ccacggcccuuuggggaccugcacacccaccucuccgggggacuugacaaggggcccugaggcc

SEQ ID NO: 125494 - RNA, 64 nt, hsa
aaccggcuggaccacgucucccuggccccagugaccgggggaagcugagccccucccuccugug

SEQ ID NO: 125495 - RNA, 64 nt, hsa
ccgacggcccggaaguuccgcguguccgggggcaccgggggauuggccggggcgcggcgugcaa

SEQ ID NO: 125496 - RNA, 64 nt, hsa
caccaaugggccugcccccaccccaggaguuuggccgggggaacccauucaugcuguuccucug

SEQ ID NO: 125497 - RNA, 64 nt, hsa
uccauaauauaucuaauuacaggagaauuuacaacaucucaaguacguaaauuaaguugucauu

SEQ ID NO: 125498 - RNA, 64 nt, hsa
auagcauggcccuuaugucuugaguugagguuaucaucucaaugaggcuuaagcuccuagagua

SEQ ID NO: 125499 - RNA, 64 nt, hsa
acugcacuccacccugggcaacagagcaagaccccaucucaaaaauaaauaaauauauauaaaa

SEQ ID NO: 125500 - RNA, 64 nt, hsa
ugguaacuuggguaccgggggaacuuuaaaauuucaucucaaaaauaauuuuuaaaaagccuga

SEQ ID NO: 125501 - RNA, 64 nt, hsa
guuugagaccagccugggcaacauagugagaucccaucucaaaaaacauuauuuuuaaaauuag

SEQ ID NO: 125502 - RNA, 64 nt, hsa
auugcacuccagccugggcgacagagcaagacgccaucucaaaaacaaaaaaacaaaauucaug

SEQ ID NO: 125503 - RNA, 64 nt, hsa
cauccuucagugauaucaccacuugcucagucaccaucucaaccuuaugucaccucagcccuca

SEQ ID NO: 125504 - RNA, 64 nt, hsa
agucaccaucucaaccuuaugucaccucagcccucaucucaaugcccaaaccccuuacacacac

SEQ ID NO: 125505 - RNA, 64 nt, hsa
cggauauagucauucuagggguuucagucuuuuccaucucaaggcauuguguguuuuguuccgg

SEQ ID NO: 125506 - RNA, 64 nt, hsa
guuugagaccagccucaucaacacagugaaacuccaucucaauuuaaaaagaaaaaaagugguu

SEQ ID NO: 125507 - RNA, 64 nt, hsa
caaugugcuguaaaguguuuuauuguaaauugcucaucucaauaaaauuuacuucagguuugug

SEQ ID NO: 125508 - RNA, 64 nt, hsa
agggugucuaggaauacagaagcuccuugacuuacaucucaauaaacccaucguaaguccaaaa

SEQ ID NO: 125509 - RNA, 64 nt, hsa
agccccgucuggugccaguguggaagcugccucccaucucaacucccugagagccacaggugcc

SEQ ID NO: 125510 - RNA, 64 nt, hsa
acugcacuccaggcugggugacagagcgagacuccaucucaaaaaaaaaaaaaagaaaaaaaaa

SEQ ID NO: 125511 - RNA, 64 nt, hsa
agagcaugccgcugcacuccagccugggagacugcaucucaaaaaagaaaaauaaacgaaguaa

SEQ ID NO: 125512 - RNA, 64 nt, hsa
cugcucuccagccugcaugacgggagugagacaccaucucaaaaaauacauauaauaauauaaa

SEQ ID NO: 125513 - RNA, 64 nt, hsa
agccaucucaagcaaguuucgacguuugacuagccaucucaagcaaguuuaaucaaugaucauc

SEQ ID NO: 125514 - RNA, 64 nt, hsa
cuacuuuuucuuugauuuucgacguuugacuagccaucucaagcaaguuucgacguuugacuag

SEQ ID NO: 125515 - RNA, 64 nt, hsa
cacugcacuccagccuggcgacagagagagacuccaucucaaaacaaaacaaaaaaaauuagcc

SEQ ID NO: 125516 - RNA, 64 nt, hsa
augcauaaaauuaaauauuuuuguuucaaagaaacaucucaauacacuuagggguguauuguuu

SEQ ID NO: 125517 - RNA, 64 nt, hsa
acugcacuccagccugggugacagagccagacuccaucucaaagaaaaaaaaaaaauauuaaga

SEQ ID NO: 125518 - RNA, 64 nt, hsa
acugcacuccagcccaggugacagugugagacuccaucucaaaaaaaaaaauaagaggccgggu

SEQ ID NO: 125519 - RNA, 64 nt, hsa
gucuguggcacauucuuaaauauuuccaucagcccaucucaacaauauauguccuauaaaugga

SEQ ID NO: 125520 - RNA, 64 nt, hsa
ggcuugcagucucccagauguugcaucccugaaacaucucaacaaccugaaugucccaacccag

SEQ ID NO: 125521 - RNA, 64 nt, hsa; identical to SEQ ID NO: 91204

SEQ ID NO: 125522 - RNA, 64 nt, hsa; identical to SEQ ID NO: 91205

SEQ ID NO: 125523 - RNA, 64 nt, hsa; identical to SEQ ID NO: 91206

SEQ ID NO: 125524 - RNA, 64 nt, hsa; identical to SEQ ID NO: 91207

SEQ ID NO: 125525 - RNA, 64 nt, hsa; identical to SEQ ID NO: 91208

SEQ ID NO: 125526 - RNA, 64 nt, hsa; identical to SEQ ID NO: 91209

SEQ ID NO: 125527 - RNA, 64 nt, hsa; identical to SEQ ID NO: 91210

SEQ ID NO: 125528 - RNA, 64 nt, hsa; identical to SEQ ID NO: 91211

SEQ ID NO: 125529 - RNA, 64 nt, hsa; identical to SEQ ID NO: 91212

SEQ ID NO: 125530 - RNA, 64 nt, hsa; identical to SEQ ID NO: 91213

SEQ ID NO: 125531 - RNA, 64 nt, hsa; identical to SEQ ID NO: 91214

SEQ ID NO: 125532 - RNA, 64 nt, hsa; identical to SEQ ID NO: 91215

SEQ ID NO: 125533 - RNA, 64 nt, hsa
gccggaggggacguggccaagggugagguggccaaaaccagaaccagcagucuccugccuuguu

SEQ ID NO: 125534 - RNA, 64 nt, hsa
gcagccaccuccucugagaucccucaccuucuccaaaccagauccaaucaaaccucagcccgag

SEQ ID NO: 125535 - RNA, 64 nt, hsa
ugggauuacaggugugagccaccgcaccuggccuaaaccagauuucuuuagggcacaauuuuuu

SEQ ID NO: 125536 - RNA, 64 nt, hsa
ucaggucaauguucaaugaacauuccuaucuucuaaaccagauuucucuuuuuuuuuccugaga

SEQ ID NO: 125537 - RNA, 64 nt, hsa
uuacagaauaacauguuuuaagauaauuaaguuuaaaccagagaauuugauuguuacucauuuu

SEQ ID NO: 125538 - RNA, 64 nt, hsa
aaaaacauauuacuuugaauucaaauugucaugaaaaccagaacaguguuuguccauguugcau

SEQ ID NO: 125539 - RNA, 64 nt, hsa
guuuguuaaaaaaacaaacacauguuuugaagagaaaccagaucugaacauguauuuguugagu

SEQ ID NO: 125540 - RNA, 64 nt, hsa
gcuggucccuggagaacugcgaacgagcugcagaaaaccagauuuuaaaauguagaagucguug

SEQ ID NO: 125541 - RNA, 64 nt, hsa
ugugccaagccauguuagagauacagugggagcaaaaccagauguguuuucugcccucugacuc

SEQ ID NO: 125542 - RNA, 64 nt, hsa
ugaagaauuugucuugagaaauuacagaggauuuaaaccagaauguuaggaauaguuauucuag

SEQ ID NO: 125543 - RNA, 64 nt, hsa
acuccuuguaaaauguauuuguccuucucaaagcaaaccagaggcccuccacugucacccuaaa

SEQ ID NO: 125544 - RNA, 64 nt, hsa
aaugguugcugaacccaaaacauguuuaggaggaaaaccagaagaacagagcaguggcacugga

SEQ ID NO: 125545 - RNA, 64 nt, hsa
aagagaagacauuugccuuuuguuaaaagaugguaaaccagaucugucuccaagaccuuggccu

SEQ ID NO: 125546 - RNA, 64 nt, hsa
gagaaguuugaagcacaacucccuuaaggucuccaaaccagacggugacgccugcgggaccauc

SEQ ID NO: 125547 - RNA, 64 nt, hsa
uaaagaaaaaagaaaaaaaaggaagacuaaacagaaaccagaacugaaacauucaccugguagc

SEQ ID NO: 125548 - RNA, 64 nt, hsa
ugucuuuuuuaauuagaagacaggaagaaaacaaaaaccagacugugucccacaaucagaaacc

SEQ ID NO: 125549 - RNA, 64 nt, hsa
cuuaucauuaguagauuuuauaagccacagagacaaaccagaaacggaauaauguuacuuugga

SEQ ID NO: 125550 - RNA, 64 nt, hsa
ugcgcacacauacuagguugaaagagaguugaggaaaccagaaggccaaguggaucugcuggca

SEQ ID NO: 125551 - RNA, 64 nt, hsa
gggauuacaggccugagcaacugugccuggcccaaaaccagaccguuaacacauuaaagagucu

SEQ ID NO: 125552 - RNA, 64 nt, hsa
uuuuuucauucuuccaucccuaggaaaguacuuaaaaccagacuuuuaaauuuuuauuuauuua

SEQ ID NO: 125553 - RNA, 64 nt, hsa
gaagggaacauuuucccucauccucugaaaguggaaaccagacugagaugguaaguuaacugau

SEQ ID NO: 125554 - RNA, 64 nt, hsa
aacacaaaagggcaucaccaucccacgaugucugaaaccagagcaggaaaaagaaggcacacuu

SEQ ID NO: 125555 - RNA, 64 nt, hsa
ugguguuuaacuaaugcugcuggcggacauccuaaaaccagaugcauccucagaggacgagucu

SEQ ID NO: 125556 - RNA, 64 nt, hsa
cuguaucuucagccagcaaacgaaaccauaucgcaaaccagagcugcuggaaaccagcacacgc

SEQ ID NO: 125557 - RNA, 64 nt, hsa
agaugaaagccacagaagauaaauacaggggucaaaaccagacuaacaguuuuagaaagugaaa

SEQ ID NO: 125558 - RNA, 64 nt, hsa
uuuuuuacauuuuaaauugucuuuauuguguauaaaaccagauuagacuauauucuucaucuga

SEQ ID NO: 125559 - RNA, 64 nt, hsa
gcagaccccugcuccgaggacucuuaguuuuucaaaaccagaaucugggacuuaccaggguuag

SEQ ID NO: 125560 - RNA, 64 nt, hsa
acucccaaagcgcaugauugcugggaaacaguagaaaccagacuugccuugaaaguguuuaagu

SEQ ID NO: 125561 - RNA, 64 nt, hsa
acugaaggcaaaucuccuuuguccauuuaccuggaaaccagaaugauuuugacauacaggagag

SEQ ID NO: 125562 - RNA, 64 nt, hsa
uugcauuucuuuauuucugucucauaauugucaaaaaccagaauuaggucaaguucauaguuuc

SEQ ID NO: 125563 - RNA, 64 nt, hsa
uuuuauacuguccaaaaugaagcauccccgugacaaaccagagugggcagaagcaucgagagcg

SEQ ID NO: 125564 - RNA, 64 nt, hsa
agccccucuucugcuguccuugaggacagacaccaaaccagagguggaggaagaacgguaggaa

SEQ ID NO: 125565 - RNA, 64 nt, hsa
aaaaacuguacacuguugucaccuugaccauuaaaaaccagaaugaggacaauggaguuuugua

SEQ ID NO: 125566 - RNA, 64 nt, hsa
gggcucuuggauggaacccuuucccguauuaaacaaaccagagacagaaucagugcugacucag

SEQ ID NO: 125567 - RNA, 64 nt, hsa
guaccuggaugauucccaccaaggaggaauggccaaaccagaugggugagaacaagcccaaugu

SEQ ID NO: 125568 - RNA, 64 nt, hsa
aaccuaagaaauggcuguaaacugagauuacaaaaaaccagaggccuuuugggagccacaggcu

SEQ ID NO: 125569 - RNA, 64 nt, hsa
uuguuuuguuuuuuuuuuuuaaugggggacaaaagagagggaaagaccccuauaaaucuauaua

SEQ ID NO: 125570 - RNA, 64 nt, hsa
gaacugguuugugggacaggggcagcuugcucaggagagggaauaacgcaggucccuuuucuug

SEQ ID NO: 125571 - RNA, 64 nt, hsa
ucuggacggcaggcucacugccaggccagccuccgagagggagagagagagagagaggacagcu

SEQ ID NO: 125572 - RNA, 64 nt, hsa
ggagguugaagccaaguggggugcugggaggagggagagggaggucacuggaaaggggagagcc

SEQ ID NO: 125573 - RNA, 64 nt, hsa
ggauucugaggguggggagggagagagagggagggagagggagugaagagccugcccuccuaua

SEQ ID NO: 125574 - RNA, 64 nt, hsa
gacugcuguuggauucugaggguggggagggagagagagggagggagagggagugaagagccug

SEQ ID NO: 125575 - RNA, 64 nt, hsa
uugauaucagaaugaacugucaagggaggugcuggagagggauuaaccugugcugccugggacc

SEQ ID NO: 125576 - RNA, 64 nt, hsa
ccacuccugggccugccccagcuccuugcccagggagagggaaagaguuaacggugugggccac

SEQ ID NO: 125577 - RNA, 64 nt, hsa
gugaucgccuggcccagcaggagcugcuucagccgagagggacuauuacccaagagagguaucc

SEQ ID NO: 125578 - RNA, 64 nt, hsa
ucgagaugagacgccaugcagaucccggcugcgagagagggagacacccggaggagcagguggg

SEQ ID NO: 125579 - RNA, 64 nt, hsa
agagggacagguucugucaggggugacaccaggagagagggacagguucuguugggggugacac

SEQ ID NO: 125580 - RNA, 64 nt, hsa
acagggacagguucugucgggggugacaccaggagagagggacagguucugucaggggugacac

SEQ ID NO: 125581 - RNA, 64 nt, hsa
acagggacagguucuaucaugggugacaccaggagagagggacagguucuguugggggugacaa

SEQ ID NO: 125582 - RNA, 64 nt, hsa
gugaauaacaaacugcacaaccugcaaaccaggagagagggacagguucugucaggggugacac

SEQ ID NO: 125583 - RNA, 64 nt, hsa
cuguggugggucacaguguggcuauguuaucuaugagagggagaaugagaaagagagggacaga

SEQ ID NO: 125584 - RNA, 64 nt, hsa
uggcuauguuaucuaugagagggagaaugagaaagagagggacagagagauaaaagaaauuggg

SEQ ID NO: 125585 - RNA, 64 nt, hsa
ccacucacccaggagcuggcugggccaggaccgggagagggagcacugcugcccuccuggcccu

SEQ ID NO: 125586 - RNA, 64 nt, hsa
ccauccccucaugggugcugccauccuuccuggagagagggaggugaaagcuggugugagccca

SEQ ID NO: 125587 - RNA, 64 nt, hsa
ccgagauagauagccaugucugccuugggcacgggagagggaaguggcagcaugcaugcuguuu

SEQ ID NO: 125588 - RNA, 64 nt, hsa
aggcuaugucacccuaacuauccuggaauguguugagagggauucugaaugaucaauauagcuu

SEQ ID NO: 125589 - RNA, 64 nt, hsa
ggagcgcuggauucguggcacagucugaggcccugagagggaaauccaugcuuuuaagaacuaa

SEQ ID NO: 125590 - RNA, 64 nt, hsa
gcugccagaccccaggccuggcugcugcuguguggagagggaggcggcccgcagcagaacagcc

SEQ ID NO: 125591 - RNA, 64 nt, hsa
aggaacuuugccugucccacgagggaguaugggagagagggacugccacacagaagcugaagac

SEQ ID NO: 125592 - RNA, 64 nt, hsa
gcuacuguuggccugggagcugagagaaggcacugagagggacaguaggcggaggaccagguga

SEQ ID NO: 125593 - RNA, 64 nt, hsa
ugggaccugcuaaguguggaauuaccugauaagggagagggaaauacaaggagggccucuggug

SEQ ID NO: 125594 - RNA, 64 nt, hsa
uuauacaaaugggggcggcuggaaagaggagaaggagagggaguacaaagacagggaauagugg

SEQ ID NO: 125595 - RNA, 64 nt, hsa
guucagagucacuuuuguucccuucuccauucuggagagggacuuccccuacauagagcccuga

SEQ ID NO: 125596 - RNA, 64 nt, hsa
gggugggaccagaaauucuugagcaaauuuucaggagagggagaagggccuucucagaagcuug

SEQ ID NO: 125597 - RNA, 64 nt, hsa
guauauuuaauguugauuguugaauuuuaguuacgagagggaagaacaauuuuacuucuguccu

SEQ ID NO: 125598 - RNA, 64 nt, hsa
cugccuauaagaggaaauaagagagaaaguggaggagagggacaaaaggaguaauuauuuggua

SEQ ID NO: 125599 - RNA, 64 nt, hsa
aagcauuaaaaugcaugguguugagaagaaucaggagagggauacaagagaggagauggggucc

SEQ ID NO: 125600 - RNA, 64 nt, hsa
cccccucacugaagcuggguagccuauugggguugagagggaaaaugugaaaucucagaauuua

SEQ ID NO: 125601 - RNA, 64 nt, hsa
uuuguuguuuuacucuaaagcugggaaaggaaaugagagggaaaagaccccggagagggaagaa

SEQ ID NO: 125602 - RNA, 64 nt, hsa
agcugggaaaggaaaugagagggaaaagaccccggagagggaagaaaaucucaguauuuugaaa

SEQ ID NO: 125603 - RNA, 64 nt, hsa
cccacaauucuggccauacuuaagcaaugggagggagagggaggaggggaagaucugggcaauu

SEQ ID NO: 125604 - RNA, 64 nt, hsa
auauaggaauaaugccuaggggaaagggagaagugagagggacaauuggguucauuuaugcccu

SEQ ID NO: 125605 - RNA, 64 nt, hsa
ugagaaugggcuuccuuuuugguucaguauuagugagagggagagggagauggaugguggggua

SEQ ID NO: 125606 - RNA, 64 nt, hsa
ugggcuuccuuuuugguucaguauuagugagagggagagggagauggauggugggguagguuuu

SEQ ID NO: 125607 - RNA, 64 nt, hsa
uucucucccccguccccguggacguaagcgcucugagagggaacgggggggguguccaggcgcg

SEQ ID NO: 125608 - RNA, 64 nt, hsa
ugcggacucugcagcuccgcggccccggcgcagggagagggagggcacgggcgcgggccgggcc

SEQ ID NO: 125609 - RNA, 64 nt, hsa
cagagagggagagaggcagagagacagagagggagagagggacagagagagauagagcaggagg

SEQ ID NO: 125610 - RNA, 64 nt, hsa
gagagaggcagagagggagagaggcagagagacagagagggagagagggacagagagagauaga

SEQ ID NO: 125611 - RNA, 64 nt, hsa
cagagaaggagagaggcagagagggagagaggcagagagggagagaggcagagagacagagagg

SEQ ID NO: 125612 - RNA, 64 nt, hsa
gaaggaaagagacaggcagagaaggagagaggcagagagggagagaggcagagagggagagagg

SEQ ID NO: 125613 - RNA, 64 nt, hsa
cagagggagagagagacagaggggaagagaggcagagagggaaagaggcagagaaggaaagaga

SEQ ID NO: 125614 - RNA, 64 nt, hsa
gaggaggcagagagggagagaaacagaggagacagagagggagagagagacagagggagagaga

SEQ ID NO: 125615 - RNA, 64 nt, hsa
agagagauaugaggagagagagacagaggaggcagagagggagagaaacagaggagacagagag

SEQ ID NO: 125616 - RNA, 64 nt, hsa
gacaauuucaucaucccacuguacuuuuuuuuuugagagggaguuucacucuuguugcccaggc

SEQ ID NO: 125617 - RNA, 64 nt, hsa
agggauggcuguccacaggauccuccagccccgugagagggacugucccuugaguuucucaacu

SEQ ID NO: 125618 - RNA, 64 nt, hsa
cucucagagucaagggugacuuggggacuugguggagagggacuacguggaagaccuggggcca

SEQ ID NO: 125619 - RNA, 64 nt, hsa
gggaggagaagugacuggaaaagaacuggugugggagagggauaccucucagagucaaggguga

SEQ ID NO: 125620 - RNA, 64 nt, hsa
aggggaaggaagagagagggagcaggcggagcgagagagggagaaacaggcgcggggucucagg

SEQ ID NO: 125621 - RNA, 64 nt, hsa
ucagaggagggaggaggaauaaggggaaggaagagagagggagcaggcggagcgagagagggag

SEQ ID NO: 125622 - RNA, 64 nt, hsa
uggcgacuguccccauccgccuggcugagcaggagagagggagcuggcggugcccagcgcaagg

SEQ ID NO: 125623 - RNA, 64 nt, hsa
guuuacagugcacggaguguggaagggggucuaggagagggagagcuggaaaaggagcugaugg

SEQ ID NO: 125624 - RNA, 64 nt, hsa
aauauuagggacuggggaggggaccaccagaggggagagggaagcugcuuacuuuggggguaga

SEQ ID NO: 125625 - RNA, 64 nt, hsa
cggcuucaugugauaugacaguggaugcuaaggugagagggaugcaggcauggguugggggugg

SEQ ID NO: 125626 - RNA, 64 nt, hsa
gccuggccuggcuucacacacauagccgacucaggagagggaugcccaugggggaacaugugac

SEQ ID NO: 125627 - RNA, 64 nt, hsa
auuaagcacaaggucacauucucugugaucacaugagagggaaggugaugacuuaaauggcagg

SEQ ID NO: 125628 - RNA, 64 nt, hsa
ugccagggagcagccacacgucugucuguguuuagagagggaagaggguucuccagguucacca

SEQ ID NO: 125629 - RNA, 64 nt, hsa
guaguccgcgccaggaagagagcaacgaggaaaggagagggacucuggcgucccggcaggcgag

SEQ ID NO: 125630 - RNA, 64 nt, hsa
ccgcggccccagccuugaccuguuugacuugagcgagagggaggaagggcgcgcgggccgcggg

SEQ ID NO: 125631 - RNA, 64 nt, hsa
accugccauggagggugcccagcagacguggugugagagggacagcucacgaggcuuggaccug

SEQ ID NO: 125632 - RNA, 64 nt, hsa
cuuggaccugguggagggugcccggcagacgugugagagggacgguucacaaggcuuggaccug

SEQ ID NO: 125633 - RNA, 64 nt, hsa
accugccguggagggugcccagcagacgugguaugagagggauggcucacgaggcuuggaccug

SEQ ID NO: 125634 - RNA, 64 nt, hsa
ggaccugguggagggugcccagcagacguggugugagagggacggcucacagggcuuggaccug

SEQ ID NO: 125635 - RNA, 64 nt, hsa
accugccguggagggugcccggcagacguggcgugagagggacggcucacgaggcuuggaccug

SEQ ID NO: 125636 - RNA, 64 nt, hsa
cagccccauugacacaaacccucaaagcagacgugagagggacgguucacaaagcucggaccug

SEQ ID NO: 125637 - RNA, 64 nt, hsa
ccggggcaggcuuagggcacaguuaggggccaaggagagggaaggccagggccccuguucuagg

SEQ ID NO: 125638 - RNA, 64 nt, hsa
uaagaucacgccauugcacuccagccugggcaacgagagggaaacucuguuucaaaaaaaaaaa

SEQ ID NO: 125639 - RNA, 64 nt, hsa
ucucuucuucuccuuccucuacauuuuaaagggggagagggaaaaguaaccgggagacaaauug

SEQ ID NO: 125640 - RNA, 64 nt, hsa
ccccgagagccaggggaaggaguggcucugggcagagagggacacauagcacugggguggcagg

SEQ ID NO: 125641 - RNA, 64 nt, hsa
gggaagggagcauugcagccuaagaagaaggccagagagggaaaaggcaggugcuuuuggcaga

SEQ ID NO: 125642 - RNA, 64 nt, hsa
uccacccuguuacuuauguagaaacugaggcccagagagggaagaugaccugccccaaguggug

SEQ ID NO: 125643 - RNA, 64 nt, hsa
caguuugcaguucacugcaaaucuuuuacauuaaggcaaagauugaaaacaugcuuaaccacua

SEQ ID NO: 125644 - RNA, 64 nt, hsa
auugugugucaccccuguuuauucuugaacagagggcaaagagggcacugggcacuucucacaa

SEQ ID NO: 125645 - RNA, 64 nt, hsa
uagguggauccagggaaaagcaguggggacggaaggcaaagagaccacucaacccccaccugga

SEQ ID NO: 125646 - RNA, 64 nt, hsa
aggcaaagagaccacucaacccccaccuggaaggggcaaagaaaagccagaguuccauguuugu

SEQ ID NO: 125647 - RNA, 64 nt, hsa
uagagacucguguccugagugggucugagaauuuggcaaagacuuacugguugguguucuugau

SEQ ID NO: 125648 - RNA, 64 nt, hsa
guaaccucaugguugugcucaggcugacagggagggcaaagagugaaaaggaagcaucucuuuc

SEQ ID NO: 125649 - RNA, 64 nt, hsa
uucuauuuuccucuuugaacacucaagauugcauggcaaagacccagucaaaaugauuuacccc

SEQ ID NO: 125650 - RNA, 64 nt, hsa
cauauacuguuuaccuuuuuccauggagucuccuggcaaagaauaaaauauauuuauuuuaaag

SEQ ID NO: 125651 - RNA, 64 nt, hsa
uucaauucugaaaaaaagcauacaucaugauuauggcaaagaggagagaaagaaauuuauuuua

SEQ ID NO: 125652 - RNA, 64 nt, hsa
cuauguggucauucucuacaacauauguuagcacggcaaagaaccuucaaauugaagacugaga

SEQ ID NO: 125653 - RNA, 64 nt, hsa
ucuuuuucuccuuuauaugacuuucucugaguugggcaaagaagaagcugacacaccguauguu

SEQ ID NO: 125654 - RNA, 64 nt, hsa
uuauguauuaugucugcuuaaaucauuuaaaaacggcaaagaauuauauagacuaugagguacc

SEQ ID NO: 125655 - RNA, 64 nt, hsa
agcaaagagaagagcauuggggcuggaguguuccggcaaagacagagccagcagcugcgcuggg

SEQ ID NO: 125656 - RNA, 64 nt, hsa
agcccggggguugggagggacagggauaaauaaaggcaaagacugaagacaaacaugggaggag

SEQ ID NO: 125657 - RNA, 64 nt, hsa
agaucauaaggcaaugcaugaaccacagaagcugcaugguuaaaauagcggccugugcccagua

SEQ ID NO: 125658 - RNA, 64 nt, hsa
cgauuuuucugucauuaguucuagauauguacuucaugguuaaauucuaaaucugaaaaugcua

SEQ ID NO: 125659 - RNA, 64 nt, hsa
aaagucaaaagggaaaagguagcugaugagguuacaugguuacauguucuacaucaugcauagu

SEQ ID NO: 125660 - RNA, 64 nt, hsa
auucacugggggauauuuuuguugcuuuuacuuucaugguuagagcuacaaagaacagugauuu

SEQ ID NO: 125661 - RNA, 64 nt, hsa
ucccagcuccauccccuaguugcagacucaucaccaugguuaccauagugacugcuucauugcc

SEQ ID NO: 125662 - RNA, 64 nt, hsa
aucaccaugguuaccauagugacugcuucauugccaugguuacauacuaauugcugcagcucug

SEQ ID NO: 125663 - RNA, 64 nt, hsa
gcaucuauaauaaacuauaaaaaaugggaguacccaugguuaggauauagcuaugccuuuaugg

SEQ ID NO: 125664 - RNA, 64 nt, hsa
gaauauaugauccauaaaaauuuaaagugagaggcaugguuagugugugauacaauaaaaagua

SEQ ID NO: 125665 - RNA, 64 nt, hsa
aaugaaaaguauuugccaaacugaauaaaacugucaugguuaccuugaaaggacaaugguuauu

SEQ ID NO: 125666 - RNA, 64 nt, hsa
gcagggucaaagcacaauacugggcaauucagagcaugguuagaagaggaaaggggagucucaa

SEQ ID NO: 125667 - RNA, 64 nt, hsa
uguuuuugcaacuagguauuucuaacgccagcacacuauuuacaagauggacuuaccuggcaga

SEQ ID NO: 125668 - RNA, 64 nt, hsa
guuucuaaaaacacacacaaagcacauugggccaacuauuuaguaagcccggauagacuuauug

SEQ ID NO: 125669 - RNA, 64 nt, hsa
uuuauuuuugaagaagaauagccuuuuucucugcacuauuuagauccgaaugaaccuuaugaug

SEQ ID NO: 125670 - RNA, 64 nt, hsa
uuaggcgggaacugcaaacagacucuuuucugagacuauuuauccaauccacuggucugugagu

SEQ ID NO: 125671 - RNA, 64 nt, hsa
aauguaggauagaggguacaguggcacuguauauacuauuuauagucucagcuacuagggaggc

SEQ ID NO: 125672 - RNA, 64 nt, hsa
uaauugucugugacuauuuucuauaauaauuaguacuauuuaauggugagcuuuuaaaaaugua

SEQ ID NO: 125673 - RNA, 64 nt, hsa
gaaacaaaugugaaagcagucaaauuaaguagauacuauuuagaaauguaaaauacucuccaga

SEQ ID NO: 125674 - RNA, 64 nt, hsa
cagaugggacuaaguguuuaugggacaauuauguacuauuuaacuuaaauauauuuuguuuaau

SEQ ID NO: 125675 - RNA, 64 nt, hsa
auaauacaaauuuaaaaaccaauacaguauaacaacuauuuacauagugcuuacauuguauuag

SEQ ID NO: 125676 - RNA, 64 nt, hsa
guauucagagauuguaaaugaaaaaaauauagaaacuauuuaguuuugguagauuuuuuuucug

SEQ ID NO: 125677 - RNA, 64 nt, hsa
cauguuguguuuuguaaaucaacugaauugagguacuauuuacuuagauuuauugcacccuuuu

SEQ ID NO: 125678 - RNA, 64 nt, hsa
uuaaagcucacauuuuauaguaucacugcuacaaacuauuuaaugaaauguggcaucgggugaa

SEQ ID NO: 125679 - RNA, 64 nt, hsa
gcacagauauucucaaacuuucucagcucaugacacuauuuagugccucaguacuuuuuucaca

SEQ ID NO: 125680 - RNA, 64 nt, hsa
uguacguuuguauauauuuucccuuuuuuguaugacuauuuauuuagaaaauuucuaggugaaa

SEQ ID NO: 125681 - RNA, 64 nt, hsa
aagugcuaacaucagaaucaaacuuaaagcuuccacuauuuaugucuuugagaaguauguagua

SEQ ID NO: 125682 - RNA, 64 nt, hsa
ugaauaagguaagaaaacuauuuugaauaaauaaacuauuuauuuaaaaugucuuuguauuuuu

SEQ ID NO: 125683 - RNA, 64 nt, hsa
uuccuauuacuaguguuugcagaauagguguaggacuauuuaaguuuagaccuugguuugguag

SEQ ID NO: 125684 - RNA, 64 nt, hsa
cacauauuuauuaagagaaaaaaaguaauuuaugacuauuuaaaauaaaauuuaaaaguagagu

SEQ ID NO: 125685 - RNA, 64 nt, hsa
ugaacuaaaccuuccacuucaggguuuggaugaaacuauuuaaaggacaaauagaauauauaac

SEQ ID NO: 125686 - RNA, 64 nt, hsa
aauauauaacacuuggaaaauuucaauuuuuuuaacuauuuaaaguuaugaaaaaauagacguc

SEQ ID NO: 125687 - RNA, 64 nt, hsa
agaucagcuauugguagcuuuuugauuuccccaaacuauuuaauuucuuagcagaaacauuagu

SEQ ID NO: 125688 - RNA, 64 nt, hsa
aguucuuauuuuguuuuuguuguaauguuugaauacuauuuaauauccgguuuuaauauugcug

SEQ ID NO: 125689 - RNA, 64 nt, hsa
uuucccugcaguuuugccaauagagugauuuuagacuauuuacaucguggguuacaaccaaugg

SEQ ID NO: 125690 - RNA, 64 nt, hsa
aaccacauaaccaagcauugugaacugcuauccaacuauuuagugguagaacuaggauuugaac

SEQ ID NO: 125691 - RNA, 64 nt, hsa
cguaacucaacauggcaugccuuucucuccguaaacuauuuagugagauuuuuagggacuauuu

SEQ ID NO: 125692 - RNA, 64 nt, hsa
gcauuaaaucccuugccaguuaccauuaacuguaacuauuuagcuuuuguuuagggaucuuucu

SEQ ID NO: 125693 - RNA, 64 nt, hsa
augaguuucucagaaacauguuuuuaacaauuguacuauuuagucauuguccauuuacuauaau

SEQ ID NO: 125694 - RNA, 64 nt, hsa
cuguaaaauacuuaagacgguuucugauuuuuccacuauuuaaauaaugcugugaugaauaucu

SEQ ID NO: 125695 - RNA, 64 nt, hsa
aaaacccaacaagaacacuucgcguugcguuuagacuauuuauuaccgggaucacaggccuggc

SEQ ID NO: 125696 - RNA, 64 nt, hsa
uagcuucuuguaguuuuaacuuauugcuauguuaacuauuuauucuccucguugcccuguaagg

SEQ ID NO: 125697 - RNA, 64 nt, hsa
ggauuuacauuaacugcuggaaucacauuuugcuacuauuuaagaaugcaucauagauuuaaug

SEQ ID NO: 125698 - RNA, 64 nt, hsa
uuuguugaaguauuuaagauuuauugaaaaggcuacuauuuauaacuuccaaccagaacuuugc

SEQ ID NO: 125699 - RNA, 64 nt, hsa
uaagaugucuaaaauagggaccuagaagcuuaacacuauuuaaguaaauacaguagaagcucac

SEQ ID NO: 125700 - RNA, 64 nt, hsa
guguuaggauugcuacugaugcugucauguggaaacuauuuaaaggcacuauuauaaauuuauc

SEQ ID NO: 125701 - RNA, 64 nt, hsa; identical to SEQ ID NO: 24611

SEQ ID NO: 125702 - RNA, 64 nt, hsa; identical to SEQ ID NO: 24612

SEQ ID NO: 125703 - RNA, 64 nt, hsa; identical to SEQ ID NO: 24613

SEQ ID NO: 125704 - RNA, 64 nt, hsa; identical to SEQ ID NO: 24614

SEQ ID NO: 125705 - RNA, 64 nt, hsa; identical to SEQ ID NO: 24615

SEQ ID NO: 125706 - RNA, 64 nt, hsa; identical to SEQ ID NO: 24616

SEQ ID NO: 125707 - RNA, 64 nt, hsa; identical to SEQ ID NO: 24617

SEQ ID NO: 125708 - RNA, 64 nt, hsa; identical to SEQ ID NO: 24618

SEQ ID NO: 125709 - RNA, 64 nt, hsa; identical to SEQ ID NO: 24619

SEQ ID NO: 125710 - RNA, 64 nt, hsa; identical to SEQ ID NO: 24620

SEQ ID NO: 125711 - RNA, 64 nt, hsa; identical to SEQ ID NO: 24621

SEQ ID NO: 125712 - RNA, 64 nt, hsa; identical to SEQ ID NO: 24622

SEQ ID NO: 125713 - RNA, 64 nt, hsa; identical to SEQ ID NO: 24623

SEQ ID NO: 125714 - RNA, 64 nt, hsa; identical to SEQ ID NO: 24624

SEQ ID NO: 125715 - RNA, 64 nt, hsa; identical to SEQ ID NO: 24625

SEQ ID NO: 125716 - RNA, 64 nt, hsa; identical to SEQ ID NO: 24626

SEQ ID NO: 125717 - RNA, 64 nt, hsa; identical to SEQ ID NO: 24627

SEQ ID NO: 125718 - RNA, 64 nt, hsa; identical to SEQ ID NO: 24628

SEQ ID NO: 125719 - RNA, 64 nt, hsa; identical to SEQ ID NO: 24629

SEQ ID NO: 125720 - RNA, 64 nt, hsa; identical to SEQ ID NO: 24630

SEQ ID NO: 125721 - RNA, 64 nt, hsa; identical to SEQ ID NO: 24631

SEQ ID NO: 125722 - RNA, 64 nt, hsa; identical to SEQ ID NO: 24632

SEQ ID NO: 125723 - RNA, 64 nt, hsa; identical to SEQ ID NO: 24633

SEQ ID NO: 125724 - RNA, 64 nt, hsa; identical to SEQ ID NO: 24634

SEQ ID NO: 125725 - RNA, 64 nt, hsa; identical to SEQ ID NO: 24635

SEQ ID NO: 125726 - RNA, 64 nt, hsa; identical to SEQ ID NO: 24636

SEQ ID NO: 125727 - RNA, 64 nt, hsa; identical to SEQ ID NO: 24637

SEQ ID NO: 125728 - RNA, 64 nt, hsa; identical to SEQ ID NO: 24638

SEQ ID NO: 125729 - RNA, 64 nt, hsa; identical to SEQ ID NO: 24639

SEQ ID NO: 125730 - RNA, 64 nt, hsa; identical to SEQ ID NO: 24640

SEQ ID NO: 125731 - RNA, 64 nt, hsa; identical to SEQ ID NO: 24641

SEQ ID NO: 125732 - RNA, 64 nt, hsa; identical to SEQ ID NO: 24642

SEQ ID NO: 125733 - RNA, 64 nt, hsa; identical to SEQ ID NO: 24643

SEQ ID NO: 125734 - RNA, 64 nt, hsa; identical to SEQ ID NO: 24644

SEQ ID NO: 125735 - RNA, 63 nt, hsa; identical to SEQ ID NO: 24645

SEQ ID NO: 125736 - RNA, 64 nt, hsa; identical to SEQ ID NO: 24646

SEQ ID NO: 125737 - RNA, 64 nt, hsa; identical to SEQ ID NO: 24647

SEQ ID NO: 125738 - RNA, 64 nt, hsa; identical to SEQ ID NO: 24648

SEQ ID NO: 125739 - RNA, 64 nt, hsa; identical to SEQ ID NO: 24649

SEQ ID NO: 125740 - RNA, 64 nt, hsa; identical to SEQ ID NO: 24650

SEQ ID NO: 125741 - RNA, 64 nt, hsa; identical to SEQ ID NO: 24651

SEQ ID NO: 125742 - RNA, 64 nt, hsa; identical to SEQ ID NO: 24652

SEQ ID NO: 125743 - RNA, 64 nt, hsa; identical to SEQ ID NO: 24653

SEQ ID NO: 125744 - RNA, 64 nt, hsa; identical to SEQ ID NO: 24654

SEQ ID NO: 125745 - RNA, 64 nt, hsa; identical to SEQ ID NO: 24655

SEQ ID NO: 125746 - RNA, 64 nt, hsa; identical to SEQ ID NO: 24656

SEQ ID NO: 125747 - RNA, 64 nt, hsa; identical to SEQ ID NO: 24657

SEQ ID NO: 125748 - RNA, 64 nt, hsa; identical to SEQ ID NO: 24658

SEQ ID NO: 125749 - RNA, 64 nt, hsa; identical to SEQ ID NO: 24659

SEQ ID NO: 125750 - RNA, 64 nt, hsa; identical to SEQ ID NO: 24660

SEQ ID NO: 125751 - RNA, 64 nt, hsa; identical to SEQ ID NO: 24661

SEQ ID NO: 125752 - RNA, 64 nt, hsa; identical to SEQ ID NO: 24662

SEQ ID NO: 125753 - RNA, 64 nt, hsa; identical to SEQ ID NO: 24663

SEQ ID NO: 125754 - RNA, 64 nt, hsa; identical to SEQ ID NO: 24664

SEQ ID NO: 125755 - RNA, 64 nt, hsa; identical to SEQ ID NO: 24665

SEQ ID NO: 125756 - RNA, 64 nt, hsa; identical to SEQ ID NO: 24666

SEQ ID NO: 125757 - RNA, 64 nt, hsa; identical to SEQ ID NO: 24667

SEQ ID NO: 125758 - RNA, 64 nt, hsa; identical to SEQ ID NO: 24668

SEQ ID NO: 125759 - RNA, 64 nt, hsa
auugucaaagaguagccgauuuuagaguucuuuuggaucauaaacuggaaauacugauggaagc

SEQ ID NO: 125760 - RNA, 64 nt, hsa
uauuuucuguguaagcuuuuaaaauuauuuuuggggaucauagcuuguuuuauuuugugcuaua

SEQ ID NO: 125761 - RNA, 64 nt, hsa
gaggauauaaacugcaucauuagugaaauuauugguuguguaauccuuugugaaauauaauucu

SEQ ID NO: 125762 - RNA, 64 nt, hsa
cauguaauucagugggguuagguacauucacaauguuguguaaugaucaccgcugucuacuugu

SEQ ID NO: 125763 - RNA, 64 nt, hsa
cuauagccaauguauuugaaugcuugcacugcugguuguguaucaucaauaugaacuuuuuauc

SEQ ID NO: 125764 - RNA, 64 nt, hsa
ccauuauuuccugcucuaauguauagugggagugguuguguaaugaaaggaccaccaaaauaau

SEQ ID NO: 125765 - RNA, 64 nt, hsa
uuuguuuguuugggaaaaggagacuuggggaagaguuguguauguggguguuucucccccuagu

SEQ ID NO: 125766 - RNA, 64 nt, hsa
uguauguggguguuucucccccuaguuaauuccuguuguguaaggguaggcuuuguugaaaaag

SEQ ID NO: 125767 - RNA, 64 nt, hsa
cugaacuugauuccagcccccuuuucccuuugguguuguguaugucucuucauuuccucucaaa

SEQ ID NO: 125768 - RNA, 64 nt, hsa
uguuuucuuccucccccccccccccgcaccauugguuguguaucacuuucacuuuacacuugca

SEQ ID NO: 125769 - RNA, 64 nt, hsa
gcuucccuguauuaccuccccuacucccuuauguguuguguauuccacuuaggaagaaaugccc

SEQ ID NO: 125770 - RNA, 64 nt, hsa
gucucucuugagcuacaguagaggggaagggauuguuguguagucaagucaccaugcugaaugu

SEQ ID NO: 125771 - RNA, 64 nt, hsa
gcauuucaaguacauguguguguguuuuauucagguuguguaaugcucccguagaauuauagaa

SEQ ID NO: 125772 - RNA, 64 nt, hsa
aaacugauggauuucauuauagaauuaucugugaguuguguagacacagucuuaauguuucugg

SEQ ID NO: 125773 - RNA, 50 nt, hsa
auaaagaagaaaaacuguagguuguguagcuggagaagugacagucaggg

SEQ ID NO: 125774 - RNA, 64 nt, hsa
cccacagcaguggagauuuguauucuuauuuacaguuguguacuauaaaguguguguuacauag

SEQ ID NO: 125775 - RNA, 64 nt, hsa
auuauucuugaaacuagguaaaacucacugaauuguuguguaauagccuuuuuauuauugccug

SEQ ID NO: 125776 - RNA, 64 nt, hsa
guuaacuuaauaucccuccaggaaugguuccuacguuguguauuacuugguuucuuuuacuuac

SEQ ID NO: 125777 - RNA, 64 nt, hsa
cuuaaauuccagcucccuuuuacuggagucugugguuguguacagguaugggccaaguguaaaa

SEQ ID NO: 125778 - RNA, 64 nt, hsa
guguugugagucaguggaacacugaaauacagcgguuguguaauuuaagaguggcaacaguuuc

SEQ ID NO: 125779 - RNA, 64 nt, hsa
ucaucauaaacuuuuuaaaggaaaauaagcaaacuaaaaagaacauugguuuagauaaauacuu

SEQ ID NO: 125780 - RNA, 64 nt, hsa
augaggguuuacauuuguuuuguuuuguaaccguuaaaaagaaguuguuuccagcuaauuauug

SEQ ID NO: 125781 - RNA, 64 nt, hsa
uuuucaugguauuuucuuccauaauaucucauuuuaaaaagaaguucuuuaugaacuuaguguc

SEQ ID NO: 125782 - RNA, 64 nt, hsa
uagguauauuuccaacuuuauauaucacaguauuuaaaaagacauguuugcauugagaaauuaa

SEQ ID NO: 125783 - RNA, 64 nt, hsa
uaaggguuaauucacccagaguauauuaauauaauaaaaagaucacuaaauguuuugucacuuu

SEQ ID NO: 125784 - RNA, 64 nt, hsa
ccuucuauauauuguaacuuaaagaaaauacuuauaaaaagacuucauuuuuagugauugacaa

SEQ ID NO: 125785 - RNA, 64 nt, hsa
ggaauacuaaggacaauuauuuuuauagacaaaguaaaaagacagauauuuaagaggcauaacc

SEQ ID NO: 125786 - RNA, 64 nt, hsa
ccagagagugauuucauuuacacucauaguaguauaaaaagagauacauuucccucuuaggccc

SEQ ID NO: 125787 - RNA, 64 nt, hsa
uuagaaacucuucuaauaaaugaaguaaaaaaauuaaaaagaauacaaauauuccagccccaaa

SEQ ID NO: 125788 - RNA, 64 nt, hsa
gacagggucccaugagagcaguucuguggagauauaaaaagaauggaagaaggaaugccuuaua

SEQ ID NO: 125789 - RNA, 64 nt, hsa
agucucccaccuaaauaucaagauggcuauaugcuaaaaagagaaaauauggucaagucuaaaa

SEQ ID NO: 125790 - RNA, 64 nt, hsa
uguuuuuuaaaggaggcuuuuugcccaucaagaauaaaaagaaauaaaaccaaaggguuaccgg

SEQ ID NO: 125791 - RNA, 64 nt, hsa
cuaacaacuuguggcuuuaacugacaggagcaauuaaaaagagcaagaggguucugcauuggca

SEQ ID NO: 125792 - RNA, 64 nt, hsa
cucacaaauaggaaauaaaacuaaaacguggauuuaaaaagaacugcacgggcuuuaggguaaa

SEQ ID NO: 125793 - RNA, 64 nt, hsa
ugauucuauaagauuauuuauauauguaaguguuuaaaaagauuauuuuccagaaaguuugugc

SEQ ID NO: 125794 - RNA, 64 nt, hsa
uaauaauucuccuauauuugaggggggcaugggauaaaaagauuuaauaauaccuggauagaga

SEQ ID NO: 125795 - RNA, 64 nt, hsa
cauaacagacuuugacucuaugaccuaugaagaauaaaaagauaaucugaagguguuugaguca

SEQ ID NO: 125796 - RNA, 64 nt, hsa
auuuugugacaugcauacagauagcauguguuauuaaaaagaguugccuauugaaaugaucaug

SEQ ID NO: 125797 - RNA, 64 nt, hsa
uggagaaauuaagcuuauagacagcauguguuauuaaaaagaguuaccuauugaaaugauagug

SEQ ID NO: 125798 - RNA, 64 nt, hsa
ccuucaaaaauauuuauauugucacucauuuacguaaaaagauauuucuaauuuacuguugccc

SEQ ID NO: 125799 - RNA, 64 nt, hsa
ugucauucuuacaaaacauuuuuuuguucucuuguaaaaagaguaguuauuaguucugcuuuag

SEQ ID NO: 125800 - RNA, 64 nt, hsa
cuuugaguuauaacuaguauuauucauguuuucauaaaaagaaguuagugacccagagcuauaa

SEQ ID NO: 125801 - RNA, 64 nt, hsa
ggacaguagccacuuacaaacaaaucaacauuuuuaaaaagaaaauguaaagguguguuuuggg

SEQ ID NO: 125802 - RNA, 64 nt, hsa
ggaaacauaagaggaggccaaaaguuaaacguucuaaaaagaggcgaaaggaagcaagcaguuc

SEQ ID NO: 125803 - RNA, 64 nt, hsa
auaaaaaacgcagaaaagaaaaaaagguuaagcauaaaaagaaagggaaaaagcagaaacacug

SEQ ID NO: 125804 - RNA, 64 nt, hsa
uggucuguccacgcaauggaacauuauuagacucuaaaaagaaaugaaguacucacacaugcca

SEQ ID NO: 125805 - RNA, 64 nt, hsa
agauuccaguuuacaaucacuaggauggcuacaauaaaaagauggacaagaacgagugucggug

SEQ ID NO: 125806 - RNA, 64 nt, hsa
guggugucucuaugcccuuugaaagcaguuuuuauaaaaagaaagcccgggucugcagagaaug

SEQ ID NO: 125807 - RNA, 64 nt, hsa
uugaagcuguuauaagaauuaggauuccagauuguaaaaagauccccaaaugauucuggacacu

SEQ ID NO: 125808 - RNA, 64 nt, hsa
gagauucugugauuuauuugcccuguuuauggauuaaaaagaaaauucuaauauaaagcauuuc

SEQ ID NO: 125809 - RNA, 64 nt, hsa
uauuucaggaggagaaugaguauguuaaugaagauaaaaagaagugacaucucuuguacacuga

SEQ ID NO: 125810 - RNA, 64 nt, hsa
uaucauauuuaucacaugaccacuuuugauuccuuaaaaagacauuacaggcuuaaauuccauu

SEQ ID NO: 125811 - RNA, 64 nt, hsa
gaauauacacaacucagagaugcaauggauaauauaaaaagaguaccugagauguauuuuuuua

SEQ ID NO: 125812 - RNA, 64 nt, hsa
uuucuaacacagacuuucuucacugucuuucauuuaaaaagaaauuaaugcucuuaagauauau

SEQ ID NO: 125813 - RNA, 64 nt, hsa
gaugguuagauacacagcauguugauuuggucacuaaaaagaagaaaaggacuaacaagcuuca

SEQ ID NO: 125814 - RNA, 64 nt, hsa
uuuuaaauaaaaauaaagaaaagauuucccacaauaaaaagauuuuuacuggaaaaaaaucacu

SEQ ID NO: 125815 - RNA, 64 nt, hsa
uguacccuggaacuuaauaaaaguuggaaauuuuuaaaaagaaugaauaagaccugguauuuga

SEQ ID NO: 125816 - RNA, 64 nt, hsa
uauuuugggaaauuaguguauuuuauaaaaauuuuaaaaagaaaaaagacuacuacagguuaag

SEQ ID NO: 125817 - RNA, 64 nt, hsa
aaaagucuugcaaugacaagagguuucauggucuuaaaaagauacuuuaugugguugaagauga

SEQ ID NO: 125818 - RNA, 64 nt, hsa
uagagaacgcuuucagggaaaaauacuuuaauaguaaaaagauucucugcgagcaacagugccc

SEQ ID NO: 125819 - RNA, 64 nt, hsa
ucccccacggggugcaccgaacuuggguuugcgcuaaaaagaacucaaaaggagaacugugcuc

SEQ ID NO: 125820 - RNA, 64 nt, hsa
aacagagguauuaaaggcuagccuaacuguugucuaaaaagauuguacaguauuuaagggauuu

SEQ ID NO: 125821 - RNA, 64 nt, hsa
ccuuuuagcuuuucaucuccaguggcauuaaacauaaaaagacccuggcauuuuuucacauacu

SEQ ID NO: 125822 - RNA, 64 nt, hsa
uuucacuagcagggaaguuuccuugagccuaaaauaaaaagaaaaaauuaaaaagaaucaguuu

SEQ ID NO: 125823 - RNA, 64 nt, hsa
aaguuuccuugagccuaaaauaaaaagaaaaaauuaaaaagaaucaguuuuuuuaauuaaaaaa

SEQ ID NO: 125824 - RNA, 64 nt, hsa
uuccaguucgaucuucuggguuuaguuuugucuuuaaaaagaauucaaaaaaagacugacaaug

SEQ ID NO: 125825 - RNA, 64 nt, hsa
aaacacaaauacauuuuuuaaaaucaagaaaauuuaaaaagacaaaaaaaaaagaauucauuga

SEQ ID NO: 125826 - RNA, 64 nt, hsa
caguauuuugagguuuuauuguuuuuuuaauaacuaaaaagaaaaaaggaacaguguaaauuug

SEQ ID NO: 125827 - RNA, 64 nt, hsa
acaaugaauugauguuuaguuugcuuuagucauuuaaaaagauauuguaccaggaugugcuauu

SEQ ID NO: 125828 - RNA, 64 nt, hsa
acacauuucacuuuucuguaaauauacauaaacuuaaaaagaaaaccucauggagucaucuugc

SEQ ID NO: 125829 - RNA, 64 nt, hsa
uacagaaaacccagcuagacuauuggguaugaacuaaaaagagacugugccauggugagaaaaa

SEQ ID NO: 125830 - RNA, 64 nt, hsa
cccuuguacauauaucuuuagagagaagauauuuuaaaaagaaauaccuuuuuaaaaauuauuu

SEQ ID NO: 125831 - RNA, 64 nt, hsa
caacaucuaggaaagugagcucuuaaagacagacuaaaaagaguaauaaaucaauacaacaaca

SEQ ID NO: 125832 - RNA, 64 nt, hsa
uuuuuugguuuuugaguuguucuugucauagacauaaaaagacaauucauuuucuuguuuuauu

SEQ ID NO: 125833 - RNA, 64 nt, hsa
aaguugagauucggcaguugcccaauuccuuuaauaaaaagaaacuaaauaauuugggccccaa

SEQ ID NO: 125834 - RNA, 64 nt, hsa
uggacagaagcaccuggagaguuggagagcuuuuuaaaaagacaucucucagcacuucccucuc

SEQ ID NO: 125835 - RNA, 64 nt, hsa
gcauuucuacacuuuguuucuugguccuuggcaauaaaaagaaugaucucccugagccuuugac

SEQ ID NO: 125836 - RNA, 64 nt, hsa
uaaaaucuccucuauauagaaacaagaauuuuguuaaaaagagaauuugaaucccuuccuauac

SEQ ID NO: 125837 - RNA, 64 nt, hsa
uuaaaaguaguaagccacauuacauuuaucuuuguaaaaagauuuaugguaacugguuucuuac

SEQ ID NO: 125838 - RNA, 64 nt, hsa
ucagauguuaaaauaaaugguuuggugcuuuuuauaaaaagauaaucucagugcuuuccuccuu

SEQ ID NO: 125839 - RNA, 64 nt, hsa
aguaaugaauccaacugcuuaaaguugguauuaauaaaaagacaaccacauaguucguuuaccu

SEQ ID NO: 125840 - RNA, 64 nt, hsa
augaagcaaugugauuauaugaagagacacaaauuaaaaagacaaauuaaaccugaaauuauau

SEQ ID NO: 125841 - RNA, 64 nt, hsa
ccacguagguacuacugaauccaacugccaacaauaaaaagacuuuuauuuaguagaggcuacc

SEQ ID NO: 125842 - RNA, 64 nt, hsa
aacaauuuaugaauugaauuaucuugguugaaaauaaaaagaucacuuucucaguuuucauaag

SEQ ID NO: 125843 - RNA, 64 nt, hsa
uugcccagaaagaagaugggggaggaggcaguaauaaaaagauugaaguauuuugcuggaauaa

SEQ ID NO: 125844 - RNA, 64 nt, hsa
aauaaacuucagcugaagauuuuauauaggacuuuaaaaagaagagaagagaaagaagaaacaa

SEQ ID NO: 125845 - RNA, 64 nt, hsa
aaugguugcaaaaaaaaaaaaaagucagugcuucuaaaaagaauuuaagauaaugguuuuuaaa

SEQ ID NO: 125846 - RNA, 64 nt, hsa
cauuuuucacagauccaccugucucuugaaaauauaaaaagacaaaacagguuugccuuggcau

SEQ ID NO: 125847 - RNA, 64 nt, hsa
acaguuuauuagaaauagcauuuccucauaagcauaaaaagaaaaucuuuguugccaacugaag

SEQ ID NO: 125848 - RNA, 64 nt, hsa
uacaacuugcuuuuagcaugauuauuuuccuaaauaaaaagacaaagaauuuacuuacuuuaug

SEQ ID NO: 125849 - RNA, 64 nt, hsa
gaaggaaauagccgcucugauagguagaugugaguaaaaagaacaggaaaaaauugcuucuuuu

SEQ ID NO: 125850 - RNA, 64 nt, hsa
aggcaaguuucccuaaguuugaguugauaguuauuaaaaagaaaacaaaacaaaaaaaaaaggc

SEQ ID NO: 125851 - RNA, 64 nt, hsa
ugaaacuggguauauuuaugauuucuuucagcguuaaaaagaaacauaguguugcccuuuuucu

SEQ ID NO: 125852 - RNA, 64 nt, hsa
ucucaaaugauauacauuuaaagggcagauuuuuuaaaaagauacuacuauaauaaacauuucc

SEQ ID NO: 125853 - RNA, 64 nt, hsa
gaaaagcuuuaguuuaaaauaaggagauccagaauaaaaagaagagacugaucucuucaauuau

SEQ ID NO: 125854 - RNA, 64 nt, hsa
augugccuguaaaccaaggaguuuuccccguuuguaaaaagacauuguagauaauugaauguuu

SEQ ID NO: 125855 - RNA, 64 nt, hsa
aacauaacuuucuaggagcuauaaaucaaaguuuuaaaaagauguuuggauauauuugaguauu

SEQ ID NO: 125856 - RNA, 64 nt, hsa
cuugaaagcuucaccuggccuacaacuuuuauuuuaaaaagaugaucaagaaaacuucaucuuc

SEQ ID NO: 125857 - RNA, 64 nt, hsa
caagaaagauaaaccccugucucaaggaacauuuuaaaaagaacgucuguccccugugaugcug

SEQ ID NO: 125858 - RNA, 64 nt, hsa
uuugaaacaaaagaaaauaaugcauuguguuuuuuaaaaagaguaucuuauacauguauccuaa

SEQ ID NO: 125859 - RNA, 64 nt, hsa
uguuuuuuaaaaagaguaucuuauacauguauccuaaaaagagaagcucaugugcaauuggugc

SEQ ID NO: 125860 - RNA, 64 nt, hsa
caaacugaauuuuugaaagacuauugcagguguuuaaaaagaaagaaaaguuguuuuaucuaau

SEQ ID NO: 125861 - RNA, 64 nt, hsa
aacacuaaaacuaugaaacaauuacuuuuuauauuaaaaagaccauggauuuaacuuaugaaaa

SEQ ID NO: 125862 - RNA, 64 nt, hsa
augaagacaauuucuguaaugguuuuaagagauuuaaaaagaaauucacugguucuuuacaaaa

SEQ ID NO: 125863 - RNA, 64 nt, hsa
aaaaauaccguuaauucaaauugacagagauugauaaaaagaaacugauuuaccuaaguuuacu

SEQ ID NO: 125864 - RNA, 64 nt, hsa
uggucacucuccccaaaauauuauauuuuuucuauaaaaagaaaaaaauggaaaaaaauuacaa

SEQ ID NO: 125865 - RNA, 64 nt, hsa
uucgaaaacauaaagaaaagaugagcaaagaugguaaaaagaagaaaaagaagucaaagacaaa

SEQ ID NO: 125866 - RNA, 64 nt, hsa
auauuuuuaggaccaaucucauuuuuaauaagguuaaaaagaaaaaaaaagucuagcgaaaaaa

SEQ ID NO: 125867 - RNA, 64 nt, hsa
acaagaguauuugguagggaaagcagguuuaaaauaaaaagacaacccacccccugcccuuuug

SEQ ID NO: 125868 - RNA, 64 nt, hsa
cuaaggcaaauugaaaauuagaaugguugugguuuaaaaagacauuaagugaauucuagguagc

SEQ ID NO: 125869 - RNA, 64 nt, hsa
gaaaagugacacuucaaaagugugcuuacauuuuuaaaaagacaaauaaaaacaguguuuuaua

SEQ ID NO: 125870 - RNA, 64 nt, hsa
guaaagcuuuucuuuuuuaauuuccaggaaaaaauaaaaagaguaugagucuucuguaauucau

SEQ ID NO: 125871 - RNA, 64 nt, hsa
aagccaaauuuccaguuuaaguaauugccuacaauaaaaagaaauuuugccugccauuuucaga

SEQ ID NO: 125872 - RNA, 64 nt, hsa
uagcucuuuccuucaaauucaacuagagccuuuuuaaaaagacauuugccugcuagucagauac

SEQ ID NO: 125873 - RNA, 64 nt, hsa
uugaguccacguuugguagcaucaguuguugaguuaaaaagaaaauuauugcauuugaucugga

SEQ ID NO: 125874 - RNA, 64 nt, hsa
auucacauuugccaccauaauguucuuuuuuauguaaaaagaagaacuuggagacauuaacaug

SEQ ID NO: 125875 - RNA, 64 nt, hsa
gagaugugacugucuacaguucuauuuguauauauaaaaagaagacugaaagucuuuugacaug

SEQ ID NO: 125876 - RNA, 64 nt, hsa
auguuuugucuauucuuuugcuguuugugccucauaaaaagagaaugaggucuucugcuagagc

SEQ ID NO: 125877 - RNA, 64 nt, hsa
cuauguagaaugacuauucuaaauauuaauguauuaaaaagaaaauacaacaaaauguauauuu

SEQ ID NO: 125878 - RNA, 64 nt, hsa
aaaaacuggugaaaaagaaauauaaaaaggacccuaaaaagaauucugcaaaauaagagaagaa

SEQ ID NO: 125879 - RNA, 64 nt, hsa
uguagagaucuuauuacaaagugauuuucuacauuaaaaagagacugaaauaaauuguauaguu

SEQ ID NO: 125880 - RNA, 64 nt, hsa
cucaguauuccacaggcacaccuuaauuucauuguaaaaagauauauauauuuugucuauuuuu

SEQ ID NO: 125881 - RNA, 64 nt, hsa
cuaauaaaucaaguguuccaaauacaauuugcauuaaaaagauuggcauuauuuuccucaucag

SEQ ID NO: 125882 - RNA, 64 nt, hsa
accacaugaacacugucaucuuuucucaugaaaguaaaaagaaccaagaacauuuuucacucug

SEQ ID NO: 125883 - RNA, 64 nt, hsa
acaugugccagcugaauuuaaaauauaauacuuuuaaaaagaaaauuauuacauccuuuacauu

SEQ ID NO: 125884 - RNA, 64 nt, hsa
uaaaaaugagcucacucagaauuucuauucuuucuaaaaagagauuuauuuuuaaaucaauggg

SEQ ID NO: 125885 - RNA, 64 nt, hsa
aguuccuaagaagcuucuaauaaauuauacaaauuaaaaagauucuuuuucugauuaaaacccu

SEQ ID NO: 125886 - RNA, 64 nt, hsa
augccuaguuuuuaguaaucuguacauuuuguuguaaaaagaaaaaccacucccaguccccagc

SEQ ID NO: 125887 - RNA, 64 nt, hsa
uuuuccuuaaauuaucucagcuuuuaacuucauuuaaaaagacuuuugucuaagaagaauauua

SEQ ID NO: 125888 - RNA, 64 nt, hsa
gaguagagaagagaccuucaggugcuuuuguggcuaaaaagauuacagcgucaucugguugaac

SEQ ID NO: 125889 - RNA, 64 nt, hsa
aauaauaaaaacaaauuuuuuuaagcacuggggauaaaaagacaucauggaaguauaacuuauu

SEQ ID NO: 125890 - RNA, 64 nt, hsa
auaccugggccucugauggggaauucuggucuucuaaaaagauguuagaaauuccugguggcac

SEQ ID NO: 125891 - RNA, 64 nt, hsa
aaaagauaggacucuaaaccuagucaucuuggaauaaaaagaagagcugguuuguuuuagagca

SEQ ID NO: 125892 - RNA, 64 nt, hsa
uuuguggugguuguauguguccuuacauagaccuuaaaaagagcucacccuuccaggccaaugc

SEQ ID NO: 125893 - RNA, 64 nt, hsa
guuugccuuuugugugugugugucccuuauuugauaaaaagauguuuugaguuguuuuuuuuuu

SEQ ID NO: 125894 - RNA, 64 nt, hsa
auauauauuuuugugaauuauacuuuguuguuuuuaaaaagaaaaucaguugauuaaguuaaua

SEQ ID NO: 125895 - RNA, 64 nt, hsa
aaugagcaucucaaauguuuucugcagaaaaaaauaaaaagauucuaauaaaauguauucucuu

SEQ ID NO: 125896 - RNA, 64 nt, hsa
cauccuucaauuucuguauaaaagcagaucuuuuuaaaaagauacuucuguaacuuaagaaacc

SEQ ID NO: 125897 - RNA, 64 nt, hsa
guauauuauuguuuacaauaaauauacauugcauuaaaaagaaaguggcccuguggauuuauuc

SEQ ID NO: 125898 - RNA, 64 nt, hsa
uguuugcccagccacugugauggauauugaauaauaaaaagaugacuaggacggggcccugacc

SEQ ID NO: 125899 - RNA, 64 nt, hsa
caugggguuucuuuuggaaagaguuucauugcuuuaaaaagaagcucagaaagucuuuauaacc

SEQ ID NO: 125900 - RNA, 64 nt, hsa
agcauaaaguaauuacucaaaccauaauguaaaguaaaaagauaaccauacuauacauagaaag

SEQ ID NO: 125901 - RNA, 64 nt, hsa
aagccaaucaucucagccaugauuaucucagaaauaaaaagagaugcagcagcucaggacugag

SEQ ID NO: 125902 - RNA, 64 nt, hsa
auaucaugggauuuaaauuuaucauaaccauguguaaaaagaaauuaauguaugaugacaucuc

SEQ ID NO: 125903 - RNA, 64 nt, hsa
caugggauuuggcuugugagucuguaacaguucuuaaaaagaauaucugagaaacuacucuguu

SEQ ID NO: 125904 - RNA, 64 nt, hsa
uguagaagaauggacuaucuguccaaacuaagaauaaaaagaaugacacuuguauuuuguaugu

SEQ ID NO: 125905 - RNA, 64 nt, hsa
uuuacaacaacagggacagggcaaaagaggggaguaaaaagaaauagccaaaaaguacaauugu

SEQ ID NO: 125906 - RNA, 64 nt, hsa
uuuacucuaccaauguuaugucgaaacugcauuguaaaaagagaagaaaguggcagguuuucca

SEQ ID NO: 125907 - RNA, 64 nt, hsa
uuuacuugaaguuuuacugcucuuugccaugugguaaaaagaggcugagacauauuuaagaauu

SEQ ID NO: 125908 - RNA, 64 nt, hsa
cuagaguaucuagaagggugaaaacaaaaaaaaauaaaaagaaacacagacgcccaggugucag

SEQ ID NO: 125909 - RNA, 64 nt, hsa
auaugguaguacccacccgguauuccuaaaauccuaaaaagauacaccuugcaguagcagaggc

SEQ ID NO: 125910 - RNA, 64 nt, hsa
aaaauugcaauuuguuuaauucagaauguguauuuaaaaagaaaaggaauuuaacaauuugcau

SEQ ID NO: 125911 - RNA, 64 nt, hsa
acacacgugcacacacacacacauuuaaaugauauaaaaagaagagguugaaagauuauuaaau

SEQ ID NO: 125912 - RNA, 64 nt, hsa
ugggugcauuugguggcuuaaaagcaaagcuuccuaaaaagauuuuucuuggcagcuccagguc

SEQ ID NO: 125913 - RNA, 64 nt, hsa
aauauguucccgcuauguggauaacucuucuuuuuaaaaagaaaauagagaauagcaaaucuuc

SEQ ID NO: 125914 - RNA, 64 nt, hsa
auugggcccuuagaaugugaaaaaaaaaaguaauuaaaaagacacuuuuaccgaacucgggauu

SEQ ID NO: 125915 - RNA, 64 nt, hsa
gaagaaggacugaagaaaauccuucagcaauccuuaaaaagaccaugcauucagaucugaagua

SEQ ID NO: 125916 - RNA, 64 nt, hsa
uuguuauucaguuacuaaauuugaggugaauaauuaaaaagaaaaggacauuaggagagugaaa

SEQ ID NO: 125917 - RNA, 64 nt, hsa
cauccugcuuucuauuuuacauugaguaaaguuuuaaaaagacaacagucaaguugauuuugau

SEQ ID NO: 125918 - RNA, 64 nt, hsa
uguauggauauaauauaaaaugaauucauauaauuaaaaagaauuugguuaauaagaauuugga

SEQ ID NO: 125919 - RNA, 64 nt, hsa; identical to SEQ ID NO: 125910

SEQ ID NO: 125920 - RNA, 64 nt, hsa
acacacacgugcacacacacacauuuaaaggauauaaaaagaagagguugaaagauuauuaaau

SEQ ID NO: 125921 - RNA, 64 nt, hsa
cucacauugcagaacaauuccgaaaauggcaaacuacuacuacuacuguucaguuuuuuaaaag

SEQ ID NO: 125922 - RNA, 64 nt, hsa
acauugcagaacaauuccgaaaauggcaaacuacuacuacuacuguucaguuuuuuaaaaguuu

SEQ ID NO: 125923 - RNA, 64 nt, hsa
aaaucuguaucaguggacuuuuaaaacuugguacuacuacuaaaucuacuauaucaugaauauu

SEQ ID NO: 125924 - RNA, 64 nt, hsa
guuaaaucuguaucaguggacuuuuaaaacuugguacuacuacuaaaucuacuauaucaugaau

SEQ ID NO: 125925 - RNA, 64 nt, hsa
uauggcaagauguuacagcauuuauaguuaauacuacuacuaauauguaaaccaaaaguuaaau

SEQ ID NO: 125926 - RNA, 64 nt, hsa
gguuauggcaagauguuacagcauuuauaguuaauacuacuacuaauauguaaaccaaaaguua

SEQ ID NO: 125927 - RNA, 64 nt, hsa
guauuuucuacucugacuacuuuccuguuguuacuacuacuaugcuaaauacuaugcauacauu

SEQ ID NO: 125928 - RNA, 64 nt, hsa
guaguauuuucuacucugacuacuuuccuguuguuacuacuacuaugcuaaauacuaugcauac

SEQ ID NO: 125929 - RNA, 64 nt, hsa
ucacagugacugaguacgguggugguaguggugguacuacuacuacugguauuuagucagcagg

SEQ ID NO: 125930 - RNA, 64 nt, hsa
cagugacugaguacgguggugguaguggugguacuacuacuacugguauuuagucagcagggau

SEQ ID NO: 125931 - RNA, 64 nt, hsa
cuuaacuguuauauuaugauugugacauagauuauacuacuacuaauuuuuggauguuucaaaa

SEQ ID NO: 125932 - RNA, 64 nt, hsa
aacuguuauauuaugauugugacauagauuauacuacuacuaauuuuuggauguuucaaaaggu

SEQ ID NO: 125933 - RNA, 64 nt, hsa
aaggaaaaacacaagcaaaaaaaaaaaaaagcaucuaucucaucuaucucaauccuaauuucuc

SEQ ID NO: 125934 - RNA, 64 nt, hsa
cacaagcaaaaaaaaaaaaaagcaucuaucucaucuaucucaauccuaauuucuccucccuucc

SEQ ID NO: 125935 - RNA, 64 nt, hsa
agcaaguauggaaaaaagaugaucuagaagucaacuaucucaaccuccauuguuacccacuagg

SEQ ID NO: 125936 - RNA, 64 nt, hsa
auaaauaaucaagcuuaggacuaaaugaaagauacuaucucauguaugcuuuaaauagagaauu

SEQ ID NO: 125937 - RNA, 64 nt, hsa
cucgcucuguugcccagcccagaguacaguggcacuaucucagcucacugcaaucuccgccucc

SEQ ID NO: 125938 - RNA, 64 nt, hsa
ugcaaucuccgccucccugguucaagugauucuccuaucucagccucccaaguagcugggacua

SEQ ID NO: 125939 - RNA, 64 nt, hsa
acauagauuuauguaaugcuuuauguuuaaaaacauuccccaauuaucuuauuuaauuuuugca

SEQ ID NO: 125940 - RNA, 64 nt, hsa
guggaggaagauccaaacagaaaagugcaaaguuauuccccaucuuccaaggguugaauucugg

SEQ ID NO: 125941 - RNA, 64 nt, hsa
uuuuuuguggggcacaguacuggauuugacagugauuccccacguguguucaucugcacccacc

SEQ ID NO: 125942 - RNA, 64 nt, hsa
agaucugugaauaugaaauacaugugcauauuucauuccccaggcagacauuuuuuagaaauca

SEQ ID NO: 125943 - RNA, 64 nt, hsa
cccagcucugaaagggcacgaguucucucagcccauuccccaccuccccuuccauaccccuucc

SEQ ID NO: 125944 - RNA, 64 nt, hsa
agggagaggagggcccuguccggcauguguggguauuccccagaagcauuugccuccugcugag

SEQ ID NO: 125945 - RNA, 64 nt, hsa
cuggccacaggugcacccuucccacacccuuuacauuccccagagccaagggaguuuaaguuug

SEQ ID NO: 125946 - RNA, 64 nt, hsa
ccucauggacugaggccagagcccccuguggcccauuccccauucauuuuucccuucuuagguu

SEQ ID NO: 125947 - RNA, 64 nt, hsa
gauuuuuuaauauuagauaaaacgaguaaacgaaauuccccagaaauuaguaguaagugggguc

SEQ ID NO: 125948 - RNA, 64 nt, hsa
ggcagaaauuugugacugagaugugacauuugggauuccccaucacuugucaugcccucagcac

SEQ ID NO: 125949 - RNA, 64 nt, hsa
cauaauccccaagcccagcccgggccugucugggauuccccacuugugccugggguccucuggg

SEQ ID NO: 125950 - RNA, 64 nt, hsa
caagagcuucucugggauuuucuugugauaucugauuccccagugaggccugggacguuuuuaa

SEQ ID NO: 125951 - RNA, 64 nt, hsa
uucugaaagcuucuuccagucccugaucuggcucauuccccaccuucaacucccaccuuacaug

SEQ ID NO: 125952 - RNA, 64 nt, hsa
gagucccaguuacaucaaacagugacuuccaguuauuccccaguaagucugagugguuccuuca

SEQ ID NO: 125953 - RNA, 64 nt, hsa
ucucuuuucaucuuugaugucaguuccaauuauuuggcaucaaaaaccuucaugguagguagag

SEQ ID NO: 125954 - RNA, 64 nt, hsa
cuuuuauacuaggcuucuuaguuuuaaaaggaaguggcaucauuguuucaguucuaguuuguau

SEQ ID NO: 125955 - RNA, 64 nt, hsa
acgccucccugcugccucccccagaugcaugugguggcaucaccauuccccaaauugaauauca

SEQ ID NO: 125956 - RNA, 64 nt, hsa
acaggccgggacaggccucacccaaggccaaggcuggcaucagccaaucauucagagcugaggc

SEQ ID NO: 125957 - RNA, 64 nt, hsa
aagauucuccaaaaaguccagaagccuugacagcuggcaucaaucagcccaagacccccagggg

SEQ ID NO: 125958 - RNA, 64 nt, hsa
ugugaagacucuggccauggugacuggccauguguggcaucaucugggcuaauggccaccgggc

SEQ ID NO: 125959 - RNA, 64 nt, hsa
gagauuggaaugggcagcucaucucugucccacuuggcaucagcuggcgucaugcaaagucaug

SEQ ID NO: 125960 - RNA, 64 nt, hsa
gcaucuuguuuauaccuuugccuuggaaguugcauggcaucaccuccaccauacuccaucaguu

SEQ ID NO: 125961 - RNA, 64 nt, hsa
acauauuccauauugauuuugacgcucuguauauuggcaucagguggcagcugaauaucuuuug

SEQ ID NO: 125962 - RNA, 64 nt, hsa
cuccucugccugagugugucuuuguaaugucagcuggcaucauacaaagagcaggagaagcaaa

SEQ ID NO: 125963 - RNA, 64 nt, hsa
cacucaccugcacaagaaucccugcaucagguucuccuuugaggguacccacccaggacagucc

SEQ ID NO: 125964 - RNA, 64 nt, hsa
gagcuuccaggccugcucuaagaugccuugcuuguccuuugacccaucagcauggagcucagug

SEQ ID NO: 125965 - RNA, 64 nt, hsa
agcugauguggcccaaguccaucucuuggucuucuccuuugaagcacagccuauuucugagcca

SEQ ID NO: 125966 - RNA, 64 nt, hsa
gaaugccaccugccacaguugauggugaggaagcuccuuugacguggugcaauuuugaugagau

SEQ ID NO: 125967 - RNA, 64 nt, hsa
aacauuauaaaacauuaaauucaauacauacugcuccuuugaaauuuggguaaaaaauuguaca

SEQ ID NO: 125968 - RNA, 64 nt, hsa
acugguuucuuuaucccuaacaugaauucauuucuccuuugaagucauuuauuauuuuauaaau

SEQ ID NO: 125969 - RNA, 64 nt, hsa
uuuuaugguguguuccuaacauaaaauaaucgucuccuuugacauuuccuucuuugucuuagcu

SEQ ID NO: 125970 - RNA, 64 nt, hsa
auuauaaaaccauguugauucccuucugguacaauccuuugaguuauaguuugcuuugcuuuuu

SEQ ID NO: 125971 - RNA, 64 nt, hsa
uaguacauauacacagacauccauaugcagcguuuccuuugaaggugaccaguuguuuguagcu

SEQ ID NO: 125972 - RNA, 64 nt, hsa
uuuuacucgccaccuuccgguggagcugccucguuccuuugaacuaugcccucacccuucugcc

SEQ ID NO: 125973 - RNA, 64 nt, hsa
guucugucuggcugugugaguggcgucucucccuuccuuugagggaagcucagcuuucuuacgc

SEQ ID NO: 125974 - RNA, 64 nt, hsa
uuucugugcugcuguaauuguugguuugccugucuccuuugagcugugggcauugccgggguag

SEQ ID NO: 125975 - RNA, 64 nt, hsa
gcuuuauacugcauacaaauuuacucaugagccuuccuuugaggaaggauguggaucuccaaau

SEQ ID NO: 125976 - RNA, 64 nt, hsa
cucaaaggggguuuaaaaaaaaaaaaccagcccauccuuugaggcugauuuuucuuuuuuuuaa

SEQ ID NO: 125977 - RNA, 64 nt, hsa
auguuagagaccaaacuuagugauuagagguugguccuuugaccuucuucucuuaauugcuuuu

SEQ ID NO: 125978 - RNA, 64 nt, hsa
agaaaacaucucaucacaauuggagaccucuacuuccuuugagcuuuccuacucaaugguagga

SEQ ID NO: 125979 - RNA, 64 nt, hsa
gaacccaguggguuggagccucccacuuugucccuccuuugaaguggaugggaacucaaggugc

SEQ ID NO: 125980 - RNA, 64 nt, hsa
ucaaagucucacauggaaaagugaguucugccuuuccuuugaucgagggucaaaauacaaagac

SEQ ID NO: 125981 - RNA, 64 nt, hsa
uucuuaaaaagucaauuauaauuuguaacucacauccuuugagcuaaacuaaauuaaaauuaca

SEQ ID NO: 125982 - RNA, 64 nt, hsa
gauuacaauuuaauacauuguaaaaaguauuaaauccuuugaaacaucuuuuguugcuuauuua

SEQ ID NO: 125983 - RNA, 64 nt, hsa
uguugaucagagagcguguccguugugaucccaguccuuugaaacugugaagccucgccccgcg

SEQ ID NO: 125984 - RNA, 64 nt, hsa
aaaaaaagauucaauguucauuguuauuuguugcuccuuugaagguaaugggucuuuuuucuuu

SEQ ID NO: 125985 - RNA, 64 nt, hsa
uggacaccuggugcugcuaauuguguucaugguuuccuuugauuggcuauugaacccuucuggg

SEQ ID NO: 125986 - RNA, 64 nt, hsa
acaacuuggccauuauuuuacaaugauguauccuuccuuugacaauuagacacacagguaccag

SEQ ID NO: 125987 - RNA, 64 nt, hsa
cugguuaacuuuuauuucuuuugaugaaaauuuuuccuuugauaguacuuguauuauugugcca

SEQ ID NO: 125988 - RNA, 64 nt, hsa
aguccauagaggucccuggcuaccaaacacauucuccuuugaauuguuaaaauucagaacauuc

SEQ ID NO: 125989 - RNA, 64 nt, hsa
uugguggaaaugauaaacguuuuaaguguuaacauccuuugaaugcguuggauuucagagaaua

SEQ ID NO: 125990 - RNA, 64 nt, hsa
aaagagaauuuauuuucaaguugugaguaaauccuccuuugaaauucaccugauuauuagauaa

SEQ ID NO: 125991 - RNA, 64 nt, hsa
uccaccaggccuucucuccagcuggacacaaaccuccuuugaagggaaauaauugccguuaggc

SEQ ID NO: 125992 - RNA, 64 nt, hsa
cagggcucaagaagucugcugggaguccccugaguccuuugacuuaguacugacuugcacugag

SEQ ID NO: 125993 - RNA, 64 nt, hsa
aaaucuggcaggauuuuaaaacucaaucagucuuuccuuugagcuagugacuugaaaagaaaga

SEQ ID NO: 125994 - RNA, 64 nt, hsa
gaauucaccacucugguuacccaacuacagaaccuccuuugaucaggccaguagguugugaugc

SEQ ID NO: 125995 - RNA, 64 nt, hsa
uccuaugauugugguuucucagcuucuuuaccucuccuuugaguuagguccaccucaguuuucu

SEQ ID NO: 125996 - RNA, 64 nt, hsa
aaggcccccccaaaaauacaguauguagcugaauuccuuugaaagaucaugauaaacucagaag

SEQ ID NO: 125997 - RNA, 64 nt, hsa
ucaaaaacugcacggacauacaaaaucaaucuuuuccuuugaucuuguggcuaaaccagcauuu

SEQ ID NO: 125998 - RNA, 64 nt, hsa
cccgggccaaauucaggggucuagugcccugcauuccuuugaggcaaaaaauaaaugggcuaug

SEQ ID NO: 125999 - RNA, 64 nt, hsa
aauaaaaguaugaguuccauaccuucuaauuuuaggcugucagaaauuccuuuauucuuuggga

SEQ ID NO: 126000 - RNA, 64 nt, hsa
aguaaccccagauagaguugacguuucagcuuugggcugucaaaaggguaugucauggaccaaa

SEQ ID NO: 126001 - RNA, 64 nt, hsa
cuuuugggagacuggaaaagggaaggugacugaaggcugucaggauucuucaaggagaaugaau

SEQ ID NO: 126002 - RNA, 64 nt, hsa
caaucaaggccacugcuacaucucccagacucugggcugucagcccaugugcaccugcccccca

SEQ ID NO: 126003 - RNA, 64 nt, hsa
ugguuguaaagugaaguaagauuggaggguggauggcugucagagcucuugcagauacuguguu

SEQ ID NO: 126004 - RNA, 64 nt, hsa
cggcacgggggcagcgugcagcccugcccugucaggcugucagacaagccccggggggcagcag

SEQ ID NO: 126005 - RNA, 64 nt, hsa
uccugcgcuacuacagcaagaaccgcccaaccgaggcugucaggugcuacgagcugcuggcccu

SEQ ID NO: 126006 - RNA, 64 nt, hsa
ugugcauagaggcgcuggagcggcacgucauccaggcugucaacaccagccccgagcggggagg

SEQ ID NO: 126007 - RNA, 64 nt, hsa
aaacauagcaaauugugcugcacaugaggaaauaggcugucacuaucacauuguccugaaaaca

SEQ ID NO: 126008 - RNA, 64 nt, hsa
cuucagcgucuuuuccuagagcuggucaccacuaggcugucacuauaaauuccuugaauauaag

SEQ ID NO: 126009 - RNA, 64 nt, hsa
ugaucacaucagagaggucugcguggcaguuuggggcugucacgugaccagugacccacacucu

SEQ ID NO: 126010 - RNA, 64 nt, hsa
uccagcguggccuuugauccagacuuagggacgaggcugucacuggugggcacccucuguuccu

SEQ ID NO: 126011 - RNA, 64 nt, hsa
ucauacccaccucugggacucugcguggcuguuuggcugucacuuguagcaauaacgacauuag

SEQ ID NO: 126012 - RNA, 64 nt, hsa
ccuuaagaagguucagagaccagccuucuccagaggcugucacugcaggagccgugggccuggg

SEQ ID NO: 126013 - RNA, 64 nt, hsa
uucaacaguaauguuugagaauuacuggguuaaauugugggaaaggguccagauuuuaaaggug

SEQ ID NO: 126014 - RNA, 64 nt, hsa
cacagugacugucagcagauuccuuuacuuuuguuugugggagguaggaauuguuuuaaugcau

SEQ ID NO: 126015 - RNA, 64 nt, hsa
aggaaaggagacaaguccaaagcucguuuguggauugugggacugagcgaaggaguacaaauau

SEQ ID NO: 126016 - RNA, 64 nt, hsa
uagggagccaggccgaaggggccucacugaccaauugugggacaauuugaacaucaggaugaau

SEQ ID NO: 126017 - RNA, 64 nt, hsa
gaaauagcuuauuguuuaguaaaauggcccuugguugugggaagaaagagaauuauuuuuaacu

SEQ ID NO: 126018 - RNA, 64 nt, hsa
uaauauguauguugucauuguuucaugcuauacuuugugggauaaaacuugggaaugagugugg

SEQ ID NO: 126019 - RNA, 64 nt, hsa
uugaagcagcacaucuccacugucccuggcaggauugugggaggcuucacaaccccugcuuucc

SEQ ID NO: 126020 - RNA, 64 nt, hsa
ccucuucugagacuguuguuuuuuuagagcuugauugugggagaaaagcuugugugaaauuccc

SEQ ID NO: 126021 - RNA, 64 nt, hsa
aucccacuggcugcaggccuccugcugcuccuguuugugggacuguucaucuccuaugugaugc

SEQ ID NO: 126022 - RNA, 64 nt, hsa
ugauauuugugaaggccuuuaggauauuuuuuucuugugggaaaacuuguugguuauugcuuaa

SEQ ID NO: 126023 - RNA, 64 nt, hsa
caacagucucccccuuuccccuucccccggauuguugugggagcuacccuccacucuaaagaga

SEQ ID NO: 126024 - RNA, 64 nt, hsa
guagagaaugcuggagggaaggggcugucucuguuugugggagagagacauauggcuugagaag

SEQ ID NO: 126025 - RNA, 64 nt, hsa
gagaaagucauuacuuacuacugcacuccugcuuuugugggaaaaauuuucuucuuccccagaa

SEQ ID NO: 126026 - RNA, 64 nt, hsa
gcagcaggaaacggguaggugagguguugggcaguugugggaacuucugagaguauuacagagu

SEQ ID NO: 126027 - RNA, 64 nt, hsa
uagaaaggugguucugaaauggcaccugguacucuugugggaccuggggaauauaaggaacucu

SEQ ID NO: 126028 - RNA, 64 nt, hsa
cggccccucauuggccaagggcacuguggauguuuugugggaggcagcauggcaccguggaaag

SEQ ID NO: 126029 - RNA, 64 nt, hsa
ugcacagaggagaggcgcccuaagaauguaagcauugugggaaagcauucauaucugccaagau

SEQ ID NO: 126030 - RNA, 64 nt, hsa
cucauacgagagagaauccguaugaauguaaggauugugggaaagcauucagcuugcuuaauug

SEQ ID NO: 126031 - RNA, 61 nt, hsa
auacuggagagaaaccuuaggagugcagucauugugggaaagcuuucauccagaggucucc

SEQ ID NO: 126032 - RNA, 64 nt, hsa
cauauccuggagaaaagcccuacgaaugcauugauugugggaaagccuucaaugaucgcucaac

SEQ ID NO: 126033 - RNA, 64 nt, hsa
gggaugggaacccaaggcuguccacaucuggcuuuugugggacucagaaagggaagcagaacug

SEQ ID NO: 126034 - RNA, 64 nt, hsa
cacaaguccuccucagggagccccaagggggauuuugugggaccgcugcccacagauccaggug

SEQ ID NO: 126035 - RNA, 64 nt, hsa
uaaauuugucaaaacuaggugagaaaauagagcauugugggaaaaacugaguccaacuagauua

SEQ ID NO: 126036 - RNA, 64 nt, hsa
gacuucuaguccaaauauaagaaacugucauguuuugugggaaaauaauuuuauaauccauuua

SEQ ID NO: 126037 - RNA, 64 nt, hsa
acucgaauccacccaggaacucccuggcaguggauugugggaggcucuugcuuacacuaaucag

SEQ ID NO: 126038 - RNA, 64 nt, hsa
ugguaugugaaauauuguacauagaccugaugaguugugggaccagaugucaucucuggucaga

SEQ ID NO: 126039 - RNA, 64 nt, hsa
cagugucuuggugcaccaagaugccuucuaaaggcugacauaccuuggacccuaauggggcaga

SEQ ID NO: 126040 - RNA, 64 nt, hsa
cuuccuccuugagggaauagaaauggaccuuucucugacauaguucuuggcaugggagccagcc

SEQ ID NO: 126041 - RNA, 64 nt, hsa
aaagucuugcaaaauggggcaguggacugacaggcugacauagaaaauaaacuuugcccaauca

SEQ ID NO: 126042 - RNA, 64 nt, hsa
acaacucucuugaugaccauucugucuggaucuacugacauaagauggccuguagcaaugaggc

SEQ ID NO: 126043 - RNA, 64 nt, hsa
aaaaucaaccaacacaagaucaaaaaggaaaaggacgagagaaaaauuauuuuuaagauaauua

SEQ ID NO: 126044 - RNA, 64 nt, hsa
ccccacccugaccgugcugaacagacccccccacacgagagaaaauaaaggagcaauaaaguca

SEQ ID NO: 126045 - RNA, 64 nt, hsa; identical to SEQ ID NO: 61424

SEQ ID NO: 126046 - RNA, 64 nt, hsa; identical to SEQ ID NO: 61425

SEQ ID NO: 126047 - RNA, 64 nt, hsa; identical to SEQ ID NO: 61426

SEQ ID NO: 126048 - RNA, 64 nt, hsa; identical to SEQ ID NO: 61427

SEQ ID NO: 126049 - RNA, 64 nt, hsa; identical to SEQ ID NO: 61428

SEQ ID NO: 126050 - RNA, 64 nt, hsa; identical to SEQ ID NO: 61429

SEQ ID NO: 126051 - RNA, 64 nt, hsa; identical to SEQ ID NO: 61430

SEQ ID NO: 126052 - RNA, 64 nt, hsa; identical to SEQ ID NO: 61431

SEQ ID NO: 126053 - RNA, 64 nt, hsa; identical to SEQ ID NO: 61432

SEQ ID NO: 126054 - RNA, 64 nt, hsa; identical to SEQ ID NO: 61433

SEQ ID NO: 126055 - RNA, 64 nt, hsa
uugcucaauacagcaaauuagcuccuaaccuaacaaaguuuaaguuuacuuggauugauaauua

SEQ ID NO: 126056 - RNA, 64 nt, hsa
cuuucugucacuuuuuuccuccuuacauuaaagaaaaguuuaauuacaguuaaaaauguauaau

SEQ ID NO: 126057 - RNA, 64 nt, hsa
ucaaacuuggauguaucaagguaaaauuauugucaaaguuuaaauaccuauauauucucugaau

SEQ ID NO: 126058 - RNA, 64 nt, hsa
uuagguuuuugaccuuuucuuccuuuguuuuuuaaaaguuuaugacaguuggcuccccccccac

SEQ ID NO: 126059 - RNA, 64 nt, hsa
aauguagccugccuuacauauaagcuaauguagaaaaguuuagacuuauaaaaaggcagauagu

SEQ ID NO: 126060 - RNA, 64 nt, hsa
aaaucacaaauaaaacagugaaguuuuaaugaauaaaguuuaaucaauuaguaauggcggaaac

SEQ ID NO: 126061 - RNA, 64 nt, hsa
gcaaccuuucugaauauucuguggugccaaguagaaaguuuaacugaaauuaauaagccaaugg

SEQ ID NO: 126062 - RNA, 64 nt, hsa
aaauauaguaaaagucauauuuaaacuuuauccuaaaguuuaaaucuaacagaacaacugaaau

SEQ ID NO: 126063 - RNA, 64 nt, hsa
gacuucuuuuaacuuggauuccuuuguauauaguaaaguuuaguauauauauauuuuuuucuuu

SEQ ID NO: 126064 - RNA, 64 nt, hsa
uuuguaucuaaucucugauuauuaaaauguuuauaaaguuuauuuuuaccaaagagaugcaauu

SEQ ID NO: 126065 - RNA, 64 nt, hsa
uucaguauaaaacuuuaguauaauuguaguuugcaaaguuuauuucaguucacauguaagguau

SEQ ID NO: 126066 - RNA, 64 nt, hsa
aaauacagcuuuugaucuguaaugcuuuuauacaaaaguuuauuuuaauaauaaaauguuuguu

SEQ ID NO: 126067 - RNA, 64 nt, hsa
aaaaccugugcuugaucugacauuuguauacauaaaaguuuacaugaauuuuacaacaaacuag

SEQ ID NO: 126068 - RNA, 64 nt, hsa
acaugauauaaauuuuuguuuuuugcacaaaccaaaaguuuaauguuaauucuuuuuacaaaac

SEQ ID NO: 126069 - RNA, 64 nt, hsa
aaggacuacuuaaacauuugucauauuaagaaaaaaaguuuaucuagcacuugugacauaccaa

SEQ ID NO: 126070 - RNA, 64 nt, hsa
aggagggacccagagccgaguuucggaguuugguaaaguuuacaggguagcuucugaaauuaac

SEQ ID NO: 126071 - RNA, 64 nt, hsa
uaauacaaaacaaacuugauuaaaacuggugcuuaaaguuuauuacccacaacuccacagucuc

SEQ ID NO: 126072 - RNA, 64 nt, hsa
cacugcuugauauuauaaauuuaaaacacaagugaaaguuuagccaugguuuugugcggcauca

SEQ ID NO: 126073 - RNA, 64 nt, hsa
ccaugguuuugugcggcaucauaguuaugucaauaaaguuuauuuaggucauagaauauccuaa

SEQ ID NO: 126074 - RNA, 64 nt, hsa
uuagaaaguaaguuuaaagacuuuaaggacauucaaaguuuaaaauaguguucaaauugcaaaa

SEQ ID NO: 126075 - RNA, 64 nt, hsa
accacucaaaauuaacuuguuuucuucauccaaaaaaguuuauuucuuccacguacuuaaauuu

SEQ ID NO: 126076 - RNA, 64 nt, hsa
cuguuaggccauucucuaaauucuaguuuagccaaaaguuuaugugugguuuggggcuucauuu

SEQ ID NO: 126077 - RNA, 64 nt, hsa
uuugcucuguguucucccgguaacugucagacaaaaaguuuauuggcucugaggaacugagaaa

SEQ ID NO: 126078 - RNA, 64 nt, hsa
ggauuuaacuugauauagcucucaggaucuaaauaaaguuuaaauuaucauuaagacacugcua

SEQ ID NO: 126079 - RNA, 64 nt, hsa
uauuuaaauaggaaaucagacaaacaauauucagaaaguuuaagcauauaaacuuuuuauuuuu

SEQ ID NO: 126080 - RNA, 64 nt, hsa
gauuuuauuacaaaauaaaacauuuuuuaauguuaaaguuuauauauuccaugcuuguuuucuc

SEQ ID NO: 126081 - RNA, 64 nt, hsa
guuuaaagagggggaagaguugguuugcaaaggaaaaguuuaaauagcuuaauaucaauagaau

SEQ ID NO: 126082 - RNA, 64 nt, hsa
gggucgucaaacgcuaaaucuaaguaacgaauugaaaguuuaaagagggggaagaguugguuug

SEQ ID NO: 126083 - RNA, 64 nt, hsa
gucaguguugucuuaauauccuugauaaugcuguaaaguuuauuuuuacaaauauuucuguuua

SEQ ID NO: 126084 - RNA, 64 nt, hsa
uauguagaauauauuuccuuauucagaauuucuaaaaguuuaaguucuaugagggcuaauaucu

SEQ ID NO: 126085 - RNA, 64 nt, hsa
auauguuacauacuaacauauauauacacaacagaaaguuuauuggauuuaguacugauauuua

SEQ ID NO: 126086 - RNA, 64 nt, hsa
auuuuuuuuaaauuuguuggcucuuaagaugaauaaaguuuauaggugcaucugccuccucuuc

SEQ ID NO: 126087 - RNA, 64 nt, hsa
gcugauuuaacuuguauuuugucacuuuuuuauaaaaguuuauuguuugauguuuuuaaagguu

SEQ ID NO: 126088 - RNA, 64 nt, hsa
gugaagcauuauggucuaaugauucaaauguuuuaaaguuuaaugccuagcagagaacugccuu

SEQ ID NO: 126089 - RNA, 64 nt, hsa
aggccagauacccugaagcauaaaguuuacgucaaaaguuuacauggagaaggcgguuccguuc

SEQ ID NO: 126090 - RNA, 64 nt, hsa
cucggagcagaagaggccagauacccugaagcauaaaguuuacgucaaaaguuuacauggagaa

SEQ ID NO: 126091 - RNA, 64 nt, hsa
caaugugaagaauuuguuuaaaaacauccuguagaaaguuuauaagaaaaccaguauuugaaca

SEQ ID NO: 126092 - RNA, 64 nt, hsa
uuuggaccacuauuuuacuggccuuugaaagaacaaaguuuacuucaacuaaaauguuucuucc

SEQ ID NO: 126093 - RNA, 64 nt, hsa
cuguacagcacuaguuacauuaugacaggaaguaaaaguuuacauggugaaauaauacugggga

SEQ ID NO: 126094 - RNA, 64 nt, hsa
auuuuccaaaaucacaaaaagcaauguguacaacaaaguuuacaucauuguuucaccaaaaaaa

SEQ ID NO: 126095 - RNA, 64 nt, hsa
ggaacccagaaaaggugauguuaugacuucuugaaaaguuuaacaauuuggcaauaaaauauua

SEQ ID NO: 126096 - RNA, 64 nt, hsa
aaauuuauuauaggaaaauaaaucaaacccaaagaaaguuuauucaaugcuaauuugaaagaaa

SEQ ID NO: 126097 - RNA, 64 nt, hsa
auagaaccacaaacacagaucacaggggccuuacaaaguuuaugucugaacaaauaagucaauu

SEQ ID NO: 126098 - RNA, 64 nt, hsa
gaauaacaaucuccauuuuuuucuuuacuaucuaaaaguuuaucgguaucuugauguauauaua

SEQ ID NO: 126099 - RNA, 64 nt, hsa
aaacauauagaaaagagcaagaaugcacauguauaaaguuuacauaaagaaguuuuuuuaaguu

SEQ ID NO: 126100 - RNA, 64 nt, hsa
aaucuaaauaacauagcuaggacacuuguuagggaaaguuuauuuaguauccaaagacuguuua

SEQ ID NO: 126101 - RNA, 64 nt, hsa
aauguuaugaucacuuucacccaugauauaaaguaaaguuuauuuuccucugccauccuugcua

SEQ ID NO: 126102 - RNA, 64 nt, hsa
cuuauauaaaaauuuuuaucaacacuaaacuuuuaaaguuuacaaguuuuuuuuuucuuuuuua

SEQ ID NO: 126103 - RNA, 64 nt, hsa
auuuauuuuguuccugaaaugggauuuagugcaaaaaguuuacaacuacagucuuuaacacauu

SEQ ID NO: 126104 - RNA, 64 nt, hsa
uagccacugagccuuuuauuauuugucuauuuguaaaguuuauuugucuuaacucauuuaauaa

SEQ ID NO: 126105 - RNA, 64 nt, hsa
gauuucaccagauacacaauccucaggcugacauaaaguuuacgaggacugcuacuauaacuga

SEQ ID NO: 126106 - RNA, 64 nt, hsa
augcuuuuaggacagaauggagacuuauacacccaaaguuuaucuguguuuguuuguaaguauu

SEQ ID NO: 126107 - RNA, 64 nt, hsa
uuagcagucuuauauguacuagaaaagauuuuuuaaaguuuauuuaaagcuguguagaugaagg

SEQ ID NO: 126108 - RNA, 64 nt, hsa
gagaccagcugugauguuuaaagacauaaaggauaaaguuuacuuuuaaaggguuucuaaacau

SEQ ID NO: 126109 - RNA, 64 nt, hsa
gauacaauuaaauuuuguucagaaaguuuguuuuaaaguuuauuuuaagcacuaucguaccaaa

SEQ ID NO: 126110 - RNA, 64 nt, hsa
auugaaaagaaaaagaagagccuuaacauauauaaaaguuuaaagaagaguaacacuugaaaag

SEQ ID NO: 126111 - RNA, 64 nt, hsa
aggcuaauacaggaaacaagagguaccaaaaaagaaaguuuauuuuuuaaaauucuaaguagag

SEQ ID NO: 126112 - RNA, 64 nt, hsa
ccaucucaaaauaaaauaaaauaaaacuuagagcaaaguuuaaaacugaguauucauauuaagu

SEQ ID NO: 126113 - RNA, 64 nt, hsa
aacaaccguuuuuauuaacugcaucucauuagggaaaguuuauaugucuuguuauuuuuuauua

SEQ ID NO: 126114 - RNA, 64 nt, hsa
gaacaucuuucgcguauucacgguuuguaguugaaaaguuuacuguaaaaaaaucaaaaacaaa

SEQ ID NO: 126115 - RNA, 64 nt, hsa
auuaaaauuguccuucaguuuugaggccauguguaaaguuuaaccauauuguaaaauaucuauu

SEQ ID NO: 126116 - RNA, 64 nt, hsa
ccaguuuaaagcaauaacuuucauaguuucuuucaaaguuuaauacauccaauaugucaaguua

SEQ ID NO: 126117 - RNA, 64 nt, hsa
ccaauaugucaaguuaaaccauucugggauuugcaaaguuuaauacauccaauaugucaaguua

SEQ ID NO: 126118 - RNA, 64 nt, hsa; identical to SEQ ID NO: 126117

SEQ ID NO: 126119 - RNA, 64 nt, hsa
cuuuacagauuuauggaaauuaaauuuauggggaaaaguuuauuuuuaauauuacuuauagcug

SEQ ID NO: 126120 - RNA, 64 nt, hsa
acuuacaaugugaaguaacuuaugaauaaaaggaaaaguuuaucccauauucaaauaauuccua

SEQ ID NO: 126121 - RNA, 64 nt, hsa
ugugggaaaauaauuuuauaauccauuuaaagugaaaguuuaucacacaaauaguacacuuauu

SEQ ID NO: 126122 - RNA, 64 nt, hsa
ucuuuguacucugucucuguagucucuccauucuaaaguuuaauuuggaaaggucuguccugaa

SEQ ID NO: 126123 - RNA, 64 nt, hsa
cuggaauguuucaaugagcaaaauaaauuagacaaaaguuuacuuucuuuuuuuccaaaauaca

SEQ ID NO: 126124 - RNA, 64 nt, hsa
ugagcuagccaaaugugggcauacuauuacagggaaaguuuaaaggucugauaacuugaaauag

SEQ ID NO: 126125 - RNA, 64 nt, hsa
uauuuauuuuuguaagccuaaaagugauucuuugaaaguuuaaagaaacuugaccaaaagacag

SEQ ID NO: 126126 - RNA, 64 nt, hsa
auuagcaaugguuuuuacuaaugcuaaaacuuuuaaaguuuauuuuuuaauaaauuguugagua

SEQ ID NO: 126127 - RNA, 64 nt, hsa
auaugauauucuuauuagaaaacagaaguagcuaaaaguuuauuauuuuaauccuauuuaaaug

SEQ ID NO: 126128 - RNA, 64 nt, hsa
gcaagcacuucucauugcuaaaaauaaauaaaccaaaguuuaaccgaaucaguuagggaaagug

SEQ ID NO: 126129 - RNA, 64 nt, hsa
gacauagcaguaacacuguuuuuuaacaacaacaaaaguuuagguucuaauuuauguaaauacc

SEQ ID NO: 126130 - RNA, 64 nt, hsa
cugauuuuguguaauuuaacaauagauaugaaauaaaguuuaaauuacaggcucugaguaaucu

SEQ ID NO: 126131 - RNA, 64 nt, hsa
cauccugcuuccuucauuggggaaguuuuaaaaaaaaguuuagauguugccuuuacaguugccu

SEQ ID NO: 126132 - RNA, 64 nt, hsa
uuaugaacugcaucaagacuucaauccugauuagugucuccagucaagcucuggguacugaauu

SEQ ID NO: 126133 - RNA, 64 nt, hsa
gauaguuuguccuguguccuuagugaugugugugugucuccaugcacaugcacgccgggauucc

SEQ ID NO: 126134 - RNA, 64 nt, hsa
cacucuuguuaccaaaucuaucucccuagugcagugucuccaggccugaguuucuucuggaaca

SEQ ID NO: 126135 - RNA, 64 nt, hsa
gcuugacccaggaaauagauggugccccccaaauugucuccacaugaagauguacugaugacgc

SEQ ID NO: 126136 - RNA, 64 nt, hsa
cucaucccacuuccuuuccuacuguccuggaaccugucuccauugugugauccagcccugguuc

SEQ ID NO: 126137 - RNA, 64 nt, hsa
agccacucggggcaggccagcaauaaaaacugucugucuccaucgucucauccuccuuucaguu

SEQ ID NO: 126138 - RNA, 64 nt, hsa
cagguggugagcugguggcucucuggugagcuagugucuccacagccugucuccaaggccuccc

SEQ ID NO: 126139 - RNA, 64 nt, hsa
gguggcucucuggugagcuagugucuccacagccugucuccaaggccuccccuauguacauuuc

SEQ ID NO: 126140 - RNA, 64 nt, hsa
uaucuacuugggcacucucuuccaagaaagaccuugucuccauuuucauuagacaaugcuucuu

SEQ ID NO: 126141 - RNA, 64 nt, hsa
gaaacagagugaccagcucauugggagacaucccugucuccagagguauguuugaaagcuucuc

SEQ ID NO: 126142 - RNA, 64 nt, hsa
ggcuucccaaaccuuguuuugcaacaucccaaauugucuccaguugaaggaaggccuuuaucag

SEQ ID NO: 126143 - RNA, 64 nt, hsa
cugggugagcuugaaguccucugggacagagaccugucuccacgccuccgggagcugugucccu

SEQ ID NO: 126144 - RNA, 64 nt, hsa
agaccuuggggaggaagcugagcaucccccgggaugucuccaguccugacacagucccucagag

SEQ ID NO: 126145 - RNA, 64 nt, hsa
cagcguccaacucaguagcuccaguguaugaaaaugucuccagggcuaaaggcuggagaucuca

SEQ ID NO: 126146 - RNA, 64 nt, hsa
acucccauugccaugggguccuucaccaugguacugucuccacagcccucaguccccaccccag

SEQ ID NO: 126147 - RNA, 64 nt, hsa
cucuguggauaccauuucauuuccauucuuguguugucuccaaggcccuuuuggagauauacuu

SEQ ID NO: 126148 - RNA, 64 nt, hsa
uucacaccuuucuccaaggaucgaaccaaagaugugucuccaguauugugucugugccccugug

SEQ ID NO: 126149 - RNA, 64 nt, hsa
acugcacuccagcuuagguggcaaagugagacccugucuccaaaaaaagaaaauagagcuuuau

SEQ ID NO: 126150 - RNA, 64 nt, hsa
ccugcaucccagcucuggggugugcagagguuugugucuccagggaacccacggcuggagagaa

SEQ ID NO: 126151 - RNA, 64 nt, hsa
cuuggcuuagccacgcugaugaguaagugagggaugucuccaucuugagaucaccaggcaagag

SEQ ID NO: 126152 - RNA, 64 nt, hsa
gacuucagaggcccugccaagucuagcauguuccugucuccaacaccgccuccugcacaugcag

SEQ ID NO: 126153 - RNA, 64 nt, hsa
ccccccccccgccacauuagcugcgccccugaagugucuccagcagaagagauggaugaaugga

SEQ ID NO: 126154 - RNA, 64 nt, hsa
aggagaaaaaaauccaauuuugucaguauuuucuuagucugaaaaaaacagcaguaguaaucug

SEQ ID NO: 126155 - RNA, 64 nt, hsa
uaacaguuuagaaggcuugauagaaagagugcauuagucugaagaguauacauuggauaggaaa

SEQ ID NO: 126156 - RNA, 64 nt, hsa
ucagggaccacaaagaauuuucagugggaaugucuagucugaggggucugagguuguuuuuacu

SEQ ID NO: 126157 - RNA, 64 nt, hsa
guguguacuguauuauuuucagaaaaaaauauaauagucugaguccaaguuaucuugauuuaaa

SEQ ID NO: 126158 - RNA, 64 nt, hsa
caacauaaaucacuuuuuaaauuccaggaacggguagucugacacggugauuauccuuuugagg

SEQ ID NO: 126159 - RNA, 64 nt, hsa
cuauucaaaucaacugccugaaugacauuucuaguagucugauguauuuuucugaggaauaguu

SEQ ID NO: 126160 - RNA, 64 nt, hsa; identical to SEQ ID NO: 68831

SEQ ID NO: 126161 - RNA, 64 nt, hsa; identical to SEQ ID NO: 68832

SEQ ID NO: 126162 - RNA, 64 nt, hsa; identical to SEQ ID NO: 68833

SEQ ID NO: 126163 - RNA, 64 nt, hsa; identical to SEQ ID NO: 68834

SEQ ID NO: 126164 - RNA, 64 nt, hsa; identical to SEQ ID NO: 68835

SEQ ID NO: 126165 - RNA, 64 nt, hsa; identical to SEQ ID NO: 68836

SEQ ID NO: 126166 - RNA, 64 nt, hsa; identical to SEQ ID NO: 68837

SEQ ID NO: 126167 - RNA, 64 nt, hsa; identical to SEQ ID NO: 68838

SEQ ID NO: 126168 - RNA, 64 nt, hsa; identical to SEQ ID NO: 68839

SEQ ID NO: 126169 - RNA, 64 nt, hsa; identical to SEQ ID NO: 68840

SEQ ID NO: 126170 - RNA, 64 nt, hsa; identical to SEQ ID NO: 68841

SEQ ID NO: 126171 - RNA, 64 nt, hsa; identical to SEQ ID NO: 68842

SEQ ID NO: 126172 - RNA, 64 nt, hsa; identical to SEQ ID NO: 68843

SEQ ID NO: 126173 - RNA, 64 nt, hsa; identical to SEQ ID NO: 68844

SEQ ID NO: 126174 - RNA, 64 nt, hsa; identical to SEQ ID NO: 68845

SEQ ID NO: 126175 - RNA, 64 nt, hsa; identical to SEQ ID NO: 68846

SEQ ID NO: 126176 - RNA, 64 nt, hsa; identical to SEQ ID NO: 68847

SEQ ID NO: 126177 - RNA, 64 nt, hsa; identical to SEQ ID NO: 68848

SEQ ID NO: 126178 - RNA, 64 nt, hsa; identical to SEQ ID NO: 68849

SEQ ID NO: 126179 - RNA, 64 nt, hsa; identical to SEQ ID NO: 68850

SEQ ID NO: 126180 - RNA, 64 nt, hsa; identical to SEQ ID NO: 68851

SEQ ID NO: 126181 - RNA, 64 nt, hsa; identical to SEQ ID NO: 68852

SEQ ID NO: 126182 - RNA, 64 nt, hsa; identical to SEQ ID NO: 68853

SEQ ID NO: 126183 - RNA, 64 nt, hsa; identical to SEQ ID NO: 68854

SEQ ID NO: 126184 - RNA, 64 nt, hsa; identical to SEQ ID NO: 68855

SEQ ID NO: 126185 - RNA, 64 nt, hsa; identical to SEQ ID NO: 68856

SEQ ID NO: 126186 - RNA, 64 nt, hsa; identical to SEQ ID NO: 68857

SEQ ID NO: 126187 - RNA, 64 nt, hsa; identical to SEQ ID NO: 68858

SEQ ID NO: 126188 - RNA, 64 nt, hsa; identical to SEQ ID NO: 68859

SEQ ID NO: 126189 - RNA, 64 nt, hsa; identical to SEQ ID NO: 68860

SEQ ID NO: 126190 - RNA, 64 nt, hsa; identical to SEQ ID NO: 68861

SEQ ID NO: 126191 - RNA, 64 nt, hsa; identical to SEQ ID NO: 68862

SEQ ID NO: 126192 - RNA, 64 nt, hsa; identical to SEQ ID NO: 68863

SEQ ID NO: 126193 - RNA, 64 nt, hsa; identical to SEQ ID NO: 68864

SEQ ID NO: 126194 - RNA, 64 nt, hsa; identical to SEQ ID NO: 68865

SEQ ID NO: 126195 - RNA, 64 nt, hsa; identical to SEQ ID NO: 68866

SEQ ID NO: 126196 - RNA, 64 nt, hsa; identical to SEQ ID NO: 68867

SEQ ID NO: 126197 - RNA, 64 nt, hsa; identical to SEQ ID NO: 68868

SEQ ID NO: 126198 - RNA, 64 nt, hsa; identical to SEQ ID NO: 68869

SEQ ID NO: 126199 - RNA, 64 nt, hsa; identical to SEQ ID NO: 68870

SEQ ID NO: 126200 - RNA, 64 nt, hsa; identical to SEQ ID NO: 68871

SEQ ID NO: 126201 - RNA, 64 nt, hsa; identical to SEQ ID NO: 68872

SEQ ID NO: 126202 - RNA, 64 nt, hsa; identical to SEQ ID NO: 68873

SEQ ID NO: 126203 - RNA, 64 nt, hsa; identical to SEQ ID NO: 68874

SEQ ID NO: 126204 - RNA, 64 nt, hsa; identical to SEQ ID NO: 68875

SEQ ID NO: 126205 - RNA, 64 nt, hsa; identical to SEQ ID NO: 68876

SEQ ID NO: 126206 - RNA, 64 nt, hsa; identical to SEQ ID NO: 68877

SEQ ID NO: 126207 - RNA, 64 nt, hsa; identical to SEQ ID NO: 68877

SEQ ID NO: 126208 - RNA, 64 nt, hsa; identical to SEQ ID NO: 68879

SEQ ID NO: 126209 - RNA, 64 nt, hsa; identical to SEQ ID NO: 68880

SEQ ID NO: 126210 - RNA, 64 nt, hsa; identical to SEQ ID NO: 68881

SEQ ID NO: 126211 - RNA, 64 nt, hsa; identical to SEQ ID NO: 68882

SEQ ID NO: 126212 - RNA, 64 nt, hsa; identical to SEQ ID NO: 68883

SEQ ID NO: 126213 - RNA, 64 nt, hsa; identical to SEQ ID NO: 68884

SEQ ID NO: 126214 - RNA, 64 nt, hsa; identical to SEQ ID NO: 68885

SEQ ID NO: 126215 - RNA, 64 nt, hsa; identical to SEQ ID NO: 68886

SEQ ID NO: 126216 - RNA, 64 nt, hsa; identical to SEQ ID NO: 68887

SEQ ID NO: 126217 - RNA, 64 nt, hsa; identical to SEQ ID NO: 68888

SEQ ID NO: 126218 - RNA, 64 nt, hsa; identical to SEQ ID NO: 68889

SEQ ID NO: 126219 - RNA, 64 nt, hsa; identical to SEQ ID NO: 68890

SEQ ID NO: 126220 - RNA, 64 nt, hsa; identical to SEQ ID NO: 68891

SEQ ID NO: 126221 - RNA, 64 nt, hsa; identical to SEQ ID NO: 68892

SEQ ID NO: 126222 - RNA, 64 nt, hsa; identical to SEQ ID NO: 68893

SEQ ID NO: 126223 - RNA, 64 nt, hsa; identical to SEQ ID NO: 68894

SEQ ID NO: 126224 - RNA, 64 nt, hsa; identical to SEQ ID NO: 68895

SEQ ID NO: 126225 - RNA, 64 nt, hsa; identical to SEQ ID NO: 68896

SEQ ID NO: 126226 - RNA, 64 nt, hsa; identical to SEQ ID NO: 68897

SEQ ID NO: 126227 - RNA, 64 nt, hsa; identical to SEQ ID NO: 68898

SEQ ID NO: 126228 - RNA, 64 nt, hsa; identical to SEQ ID NO: 68899

SEQ ID NO: 126229 - RNA, 64 nt, hsa; identical to SEQ ID NO: 68900

SEQ ID NO: 126230 - RNA, 64 nt, hsa; identical to SEQ ID NO: 68901

SEQ ID NO: 126231 - RNA, 64 nt, hsa; identical to SEQ ID NO: 68902

SEQ ID NO: 126232 - RNA, 64 nt, hsa; identical to SEQ ID NO: 68903

SEQ ID NO: 126233 - RNA, 64 nt, hsa; identical to SEQ ID NO: 68904

SEQ ID NO: 126234 - RNA, 64 nt, hsa; identical to SEQ ID NO: 68905

SEQ ID NO: 126235 - RNA, 64 nt, hsa; identical to SEQ ID NO: 68906

SEQ ID NO: 126236 - RNA, 64 nt, hsa; identical to SEQ ID NO: 68907

SEQ ID NO: 126237 - RNA, 64 nt, hsa; identical to SEQ ID NO: 68908

SEQ ID NO: 126238 - RNA, 64 nt, hsa; identical to SEQ ID NO: 68909

SEQ ID NO: 126239 - RNA, 64 nt, hsa; identical to SEQ ID NO: 68910

SEQ ID NO: 126240 - RNA, 64 nt, hsa; identical to SEQ ID NO: 68911

SEQ ID NO: 126241 - RNA, 64 nt, hsa; identical to SEQ ID NO: 68912

SEQ ID NO: 126242 - RNA, 64 nt, hsa; identical to SEQ ID NO: 68913

SEQ ID NO: 126243 - RNA, 64 nt, hsa; identical to SEQ ID NO: 68914

SEQ ID NO: 126244 - RNA, 64 nt, hsa; identical to SEQ ID NO: 68915

SEQ ID NO: 126245 - RNA, 64 nt, hsa; identical to SEQ ID NO: 68916

SEQ ID NO: 126246 - RNA, 64 nt, hsa; identical to SEQ ID NO: 68917

SEQ ID NO: 126247 - RNA, 64 nt, hsa; identical to SEQ ID NO: 68918

SEQ ID NO: 126248 - RNA, 64 nt, hsa; identical to SEQ ID NO: 68919

SEQ ID NO: 126249 - RNA, 64 nt, hsa; identical to SEQ ID NO: 68920

SEQ ID NO: 126250 - RNA, 64 nt, hsa; identical to SEQ ID NO: 68921

SEQ ID NO: 126251 - RNA, 64 nt, hsa; identical to SEQ ID NO: 68922

SEQ ID NO: 126252 - RNA, 64 nt, hsa; identical to SEQ ID NO: 68923

SEQ ID NO: 126253 - RNA, 64 nt, hsa; identical to SEQ ID NO: 68924

SEQ ID NO: 126254 - RNA, 64 nt, hsa; identical to SEQ ID NO: 68925

SEQ ID NO: 126255 - RNA, 64 nt, hsa; identical to SEQ ID NO: 68926

SEQ ID NO: 126256 - RNA, 64 nt, hsa; identical to SEQ ID NO: 68927

SEQ ID NO: 126257 - RNA, 64 nt, hsa; identical to SEQ ID NO: 68928

SEQ ID NO: 126258 - RNA, 64 nt, hsa; identical to SEQ ID NO: 68929

SEQ ID NO: 126259 - RNA, 64 nt, hsa; identical to SEQ ID NO: 68930

SEQ ID NO: 126260 - RNA, 64 nt, hsa; identical to SEQ ID NO: 68931

SEQ ID NO: 126261 - RNA, 64 nt, hsa; identical to SEQ ID NO: 68932

SEQ ID NO: 126262 - RNA, 64 nt, hsa; identical to SEQ ID NO: 68933

SEQ ID NO: 126263 - RNA, 64 nt, hsa; identical to SEQ ID NO: 68934

SEQ ID NO: 126264 - RNA, 64 nt, hsa; identical to SEQ ID NO: 68935

SEQ ID NO: 126265 - RNA, 64 nt, hsa
aacuaaccuugagaccugaggguuuccacagugggaaccccaauagggcuagggcucucaggua

SEQ ID NO: 126266 - RNA, 64 nt, hsa
gugcuucaguguuaagaguggggcaaugaagagugaaccccaaugaagagugaucccaacuuug

SEQ ID NO: 126267 - RNA, 64 nt, hsa
uaacaccucccaagaaagauaggggaagaagccagaaccccaccuggccugcccacaggacaag

SEQ ID NO: 126268 - RNA, 64 nt, hsa
uccgcugcagcuggccacacugagggcccucugggaaccccaccccacuggagccgcuccggca

SEQ ID NO: 126269 - RNA, 64 nt, hsa
aggugaaggggcccgggaacaccugcucucaccugaaccccaggugaaggggcccggaacaccu

SEQ ID NO: 126270 - RNA, 64 nt, hsa
aggugaaggggcccgggaacaccugcucucaccugaaccccaggugaaggggcccagaacaccu

SEQ ID NO: 126271 - RNA, 64 nt, hsa
ccguccugccgugacacccuucauccuacccuuggaaccccaaggccaaguugguucaaacugu

SEQ ID NO: 126272 - RNA, 64 nt, hsa
gagugaucugaauuaucuggcacccuccugaauggaaccccagaguaccuccuguguggaaggg

SEQ ID NO: 126273 - RNA, 64 nt, hsa
ggcccacauuggaagagcagcaccuccucagccugaaccccagggcuguaacugccaggcucuc

SEQ ID NO: 126274 - RNA, 64 nt, hsa
cugguggggauaggccagccgcgcaucagacugugaaccccacgaaggagcccauuguggccua

SEQ ID NO: 126275 - RNA, 64 nt, hsa
cuuacagcgaagacuugaguuccuccaagucccagaaccccaagaaugggcaagaaggaucagg

SEQ ID NO: 126276 - RNA, 64 nt, hsa
uggcaaccuggagaauccacauaccuuguguauugaaccccaggaaaaggaagaggucgaacca

SEQ ID NO: 126277 - RNA, 64 nt, hsa
uggagggauguuccccugagccaggcugagacuagaaccccaucuucccugagccaggcugaga

SEQ ID NO: 126278 - RNA, 64 nt, hsa
agaaccccaucuucccugagccaggcugagacuagaaccccaucuuccccaccacgccaccccu

SEQ ID NO: 126279 - RNA, 64 nt, hsa
gcguggggagccaugcucaccguggcaaacacaggaaccccaugacucgccccucaccuggcgu

SEQ ID NO: 126280 - RNA, 64 nt, hsa
gaagggagagaaccuggaagccgugguaugugaggaaccccaaggugagaacuuuguacucacu

SEQ ID NO: 126281 - RNA, 64 nt, hsa
acuucuuccagacaccagaagaaauggccuucaauuauuugaaaagagacacagagacaccucu

SEQ ID NO: 126282 - RNA, 64 nt, hsa
gaacaguucaaaugggaaaguguucuaaaacauauuauuugagauuugucauauucaucuuugg

SEQ ID NO: 126283 - RNA, 64 nt, hsa
guuuuuaggauuugggaaaauaaacuguaaauguuuauuugauagguaaauauaguuuuauugu

SEQ ID NO: 126284 - RNA, 64 nt, hsa
cagguaaacauuuuucauuuggcaaauggcauaauuauuugaaagugacaggaaucuccucaga

SEQ ID NO: 126285 - RNA, 64 nt, hsa
cccugguucuguucugccuccaacauguauaauuuuauuugaaauacauaaucuuuucacuaug

SEQ ID NO: 126286 - RNA, 64 nt, hsa
gaggacuguguagacuuuaugucaguuuuugucauuauuugaaaaucuauucugacaacuuuuu

SEQ ID NO: 126287 - RNA, 64 nt, hsa
gaacaagaaaugcaucugucuuagaaacuggagauuauuugauguuagguaaaacauguaauug

SEQ ID NO: 126288 - RNA, 64 nt, hsa
uuugaaucuaguuuucagugaucagaagcagcaguuauuugaguguaugaauggaaugaugauc

SEQ ID NO: 126289 - RNA, 64 nt, hsa
uaaugaaaaucuaaugauguaauaggcauuuucuuuauuugaaccuaccucuuuuauuuucuga

SEQ ID NO: 126290 - RNA, 64 nt, hsa
guauauuacuguuaaauuaccaacacaaggcaauuuauuugaaagauuccguuuauccugccau

SEQ ID NO: 126291 - RNA, 64 nt, hsa
ggauuuuaaaacugaauuuuaucugcuauaccaguuauuugagaaaguaugauuuuaauguaaa

SEQ ID NO: 126292 - RNA, 64 nt, hsa
gaaagugauauuaagaaugcuuucccaaauuccauuauuugacauugagucugacaacuguuag

SEQ ID NO: 126293 - RNA, 64 nt, hsa
guauuacauaaccuggaagacugagaaggguauauuauuugaaggaucuuuuuauuuccccgag

SEQ ID NO: 126294 - RNA, 64 nt, hsa
gugauuacaggcaccagugcagugaugauuguacuuauuugacacauacuccccgucguccugg

SEQ ID NO: 126295 - RNA, 64 nt, hsa
uugagauggaguuuugcucuuaaugauauuauuauuauuugagacagaguuuugcucuuauugc

SEQ ID NO: 126296 - RNA, 64 nt, hsa
aacaaaggcaguggagcauacaauacaauucuauuuauuugagguuaauugaaguuaauaauuu

SEQ ID NO: 126297 - RNA, 64 nt, hsa
auaugucaggaaauaaggucacuuuaugucaaaauuauuugaguacuaugggaccuggcgcagu

SEQ ID NO: 126298 - RNA, 64 nt, hsa
acaacaacaacaacaacaacaacaaaccacaaaauuauuugaguacugugaaggauuauuuguc

SEQ ID NO: 126299 - RNA, 64 nt, hsa
agccuuccccuucagugaagaaaacauuuauuuuuuauuugauuccuaggauuuaguaaacucu

SEQ ID NO: 126300 - RNA, 64 nt, hsa
aaguuauuuuuacagggacuuuauuuuuugaucuuuauuugagauuguuuucauaucuaucuaa

SEQ ID NO: 126301 - RNA, 64 nt, hsa
uacucaaaccuguggcaaauucauccuagcaacguuauuugacgaggggcaugaacauuuauag

SEQ ID NO: 126302 - RNA, 64 nt, hsa
cacugaaaaaauuugauuaauguauuuaaauguauuauuugaagcaucauucacuuguugauuu

SEQ ID NO: 126303 - RNA, 64 nt, hsa
uaguaaaauuaauagccauaaaguccuagacuucuuauuugaaguuaaaauuucuuauuugaaa

SEQ ID NO: 126304 - RNA, 64 nt, hsa
aaguccuagacuucuuauuugaaguuaaaauuucuuauuugaaaaguugaaauuuaugagcuuu

SEQ ID NO: 126305 - RNA, 64 nt, hsa
uugggaggggaguuuaauuacucagauuggccuguuauuugauuuccuccuuugggaaaagaau

SEQ ID NO: 126306 - RNA, 64 nt, hsa
gucaaugacauuuggauguuuucuucaaagaauuuuauuugacccagauuucuuauaaaguuau

SEQ ID NO: 126307 - RNA, 64 nt, hsa
uacuauuaaaacagaauaccauagaguaauugcauuauuugaaaauucucucauuuuacaaugc

SEQ ID NO: 126308 - RNA, 64 nt, hsa
uagugucuauuugcauauaacccugaaaacauuauuauuugaaaacuuuucuauaucucaaauu

SEQ ID NO: 126309 - RNA, 64 nt, hsa
cuucagccaaacacaauaugggcucaagucacuuuuauuugaaaugucauuuggugccaguauu

SEQ ID NO: 126310 - RNA, 64 nt, hsa
caguauuuuuuaacugcauaauagccuaacaugauuauuugaacuuauuuacacauaguuugaa

SEQ ID NO: 126311 - RNA, 64 nt, hsa
aguaagugcaacaugaaaaaaaucuaugaaaagauuauuugaccuaauuauucacugauaguac

SEQ ID NO: 126312 - RNA, 64 nt, hsa
agguauuucuuuccauuguaaauuaaaagucauuuuauuugacagacuuuacugguucaucgaa

SEQ ID NO: 126313 - RNA, 64 nt, hsa
gagcacaugaguuaagauugugacugaucaugauuuauuugaagauggagcacugcugauuuau

SEQ ID NO: 126314 - RNA, 64 nt, hsa
gacuuuacccaauucaguugucagacauaaugauuuauuugaaggcuuguuuuauuugaagaaa

SEQ ID NO: 126315 - RNA, 64 nt, hsa
uugucagacauaaugauuuauuugaaggcuuguuuuauuugaagaaaagcauauugccaaaaau

SEQ ID NO: 126316 - RNA, 64 nt, hsa
uuuacuuuauugcccuaacaauuuuuuauuaaauuuauuugaaaaugcaucacaugaugaaaaa

SEQ ID NO: 126317 - RNA, 64 nt, hsa
uguaugguaggggcuuaaaagaaacuauaaaguuuuauuugaaugaacacuaugcacugcugua

SEQ ID NO: 126318 - RNA, 64 nt, hsa
cccuuuuuuuuugguuuuaaaucacuguacaguguuauuugauauuuuaauuuauuuuuugauu

SEQ ID NO: 126319 - RNA, 64 nt, hsa
ggcuuguuuuuaaagcuuuauuuauuaaaccauauuauuugauuacuguguuagaauuucauaa

SEQ ID NO: 126320 - RNA, 64 nt, hsa
uuaugcaggaugaucacaauuuaguggagaguauuuauuugagccuaaauuguagguagcccuu

SEQ ID NO: 126321 - RNA, 64 nt, hsa
agcaggggaaccuuaguuaauaauaaaauacuacuuauuugaguuacugauacagauucauuua

SEQ ID NO: 126322 - RNA, 64 nt, hsa
uauuuugauaaaaauuaacuaguaauacuuguauuuauuugaaacacugggcuguuugcacagc

SEQ ID NO: 126323 - RNA, 64 nt, hsa
uuuuuuuuaaacugggcaucugguuucuaaaaauuuauuugaaacaaucuagaauuuucuuggu

SEQ ID NO: 126324 - RNA, 64 nt, hsa
uuuaagaacuuuaagacgauuaauuguaaauaauuuauuugauuggugcaguucuaaucccuaa

SEQ ID NO: 126325 - RNA, 64 nt, hsa
gcaaccacgaauuucacccuggagauauuuuuucuuauuugaguccaccaaaggauaaugccaa

SEQ ID NO: 126326 - RNA, 64 nt, hsa
gaauauuaaaauuaucauuaauaauauaaaacacuuauuugagauuaaauuaaauuuuucauga

SEQ ID NO: 126327 - RNA, 64 nt, hsa
uauuuaugcuggugaaacguauaaucacauccaauuauuugaacacaugcaaaauaauuuuuua

SEQ ID NO: 126328 - RNA, 64 nt, hsa
uaaauugucaaaauuuccagauuacugguaaaaauuauuugaaaacaaacuuauggguaauaaa

SEQ ID NO: 126329 - RNA, 64 nt, hsa
uaauuuuuugcuuuauuuucaucugccaguggacuuauuugaaauuuucacuuuagucaaauua

SEQ ID NO: 126330 - RNA, 64 nt, hsa
cauuaauaugcuuauaacacuagugccaguuauuuuauuugauaaugcuuaugguauuuguaua

SEQ ID NO: 126331 - RNA, 64 nt, hsa
ugccuuugggaucgacuggguuuuaauggccuaguuauuugaggauuuugcuguguuguuuucc

SEQ ID NO: 126332 - RNA, 64 nt, hsa
aaauugccauaaauuuggugccacuuucuuuuauuuauuugacugaguuaauauuauuguauua

SEQ ID NO: 126333 - RNA, 64 nt, hsa
gggaaauuaaucaggcuauacauaaguauuguauuuauuugaauaaaaauaaaaagagcaaccc

SEQ ID NO: 126334 - RNA, 64 nt, hsa
guuuccuugauaaaacaaauguaaaugaggaauuuuauuugaauuggaauauuguuuuucuaga

SEQ ID NO: 126335 - RNA, 64 nt, hsa
ucaguaaauccaguccaaauucucaucacauguauuauuugauacuaaauuuucaauuauuacu

SEQ ID NO: 126336 - RNA, 64 nt, hsa
aacauuuguucaaaaacuaaccaagguaaaauauuuauuugaaagcccaacuuugauguuaaau

SEQ ID NO: 126337 - RNA, 64 nt, hsa
uguuacuuaaaaaacuacauggcuuuccuugaauuuauuugacgguauuauguaauagacuuga

SEQ ID NO: 126338 - RNA, 64 nt, hsa
uuuuuuuuuguuuucuaaaagcuacauaaaggccuuauuugacauuuucacugauaacugaucg

SEQ ID NO: 126339 - RNA, 64 nt, hsa
uuugcuacgaugaaggugacauuucucuggucauuuauuugagaguucgaagucaaagucgagg

SEQ ID NO: 126340 - RNA, 64 nt, hsa
cuuucucuauaaaaauaacacauuauuuuauccguuauuugaaauuuuacauuucugguuacca

SEQ ID NO: 126341 - RNA, 64 nt, hsa
aaguaggaaggaauacagcuagcaagaaagcaauuuauuugaaacuucuaauggauuuuugagu

SEQ ID NO: 126342 - RNA, 64 nt, hsa
aaacugucuuuaucuuugauuauucuuuuaauuuuuauuugagcuguuucaauagcauaaugaa

SEQ ID NO: 126343 - RNA, 64 nt, hsa
aguaggucacuccccaaccccugaagaaaguggcuuauuugagguuguuggugcuguugguauu

SEQ ID NO: 126344 - RNA, 64 nt, hsa
uauaauaggaaaaaaaaauaugcauuugcuuaguuuauuugaauaaaagcucuaaaccuagguu

SEQ ID NO: 126345 - RNA, 64 nt, hsa
ugaaguaaaucacuugacaacuuuuaagggcauguuauuugaagugcucagcaguugaaagcaa

SEQ ID NO: 126346 - RNA, 64 nt, hsa
cuuagauuuaagaaaaagagaaaaucagauguauuuauuugacuucauuccguauuugaaagca

SEQ ID NO: 126347 - RNA, 64 nt, hsa
aauccccuuuuuaaaaaguuguuguuguuguuguuuauuugauuuugaguuaggagggauaaua

SEQ ID NO: 126348 - RNA, 64 nt, hsa
uuuguucaucuugaagaauguauaguggcuuagguuauuugagguuuucguuuugaauauauau

SEQ ID NO: 126349 - RNA, 64 nt, hsa
ucaugacugucauucuauuaugaagaaaacaguuuuauuugagugcuuuaauauaaugcaacau

SEQ ID NO: 126350 - RNA, 64 nt, hsa
gaaaaaaaucugaacugagaaaggagcucugaauuuauuugacagucuaacuuuugaauuacau

SEQ ID NO: 126351 - RNA, 64 nt, hsa
guauuuucuuccuuacgucaauacuuuuccugcauuauuugaaauugugggcuggggagaaaca

SEQ ID NO: 126352 - RNA, 64 nt, hsa
auauauauauauaaaccaaaaguaguuggaaagauuauuugaaaugacuaauuugugcuaucuu

SEQ ID NO: 126353 - RNA, 64 nt, hsa
ggauguauaauuuugggcgaaguuaaauuacaauuuauuugagguuauuccuaaaccuauuuau

SEQ ID NO: 126354 - RNA, 64 nt, hsa
agucaccuugaauuauuuucugagucaccuugaguuauuugaucucucagccugcuuucucauc

SEQ ID NO: 126355 - RNA, 64 nt, hsa
gcucuacuuuuauuuuuuauguugcuuaacuguuuuauuugaaggaaaccugugugauuuaaaa

SEQ ID NO: 126356 - RNA, 64 nt, hsa
uguuuaauggggcugauguguaaagcuguucaaguuauuugauguuuacaccucagggaaaguc

SEQ ID NO: 126357 - RNA, 64 nt, hsa
ucaguauuuccaaguaccauuuuuauauaguagcuuauuugaccauaagucacacaucaaaaaa

SEQ ID NO: 126358 - RNA, 64 nt, hsa
uuuuuucauucauauuuuuguuguuuccaggaauuuauuugauauuaaugggcguaaaacagca

SEQ ID NO: 126359 - RNA, 64 nt, hsa
guacaaguaucauacacguacuuuugagcuacuauuauuugaaaaaaaucugccaaauagcauc

SEQ ID NO: 126360 - RNA, 64 nt, hsa
ggagauacacuacccaguauuguuugauacauuuuuauuugauaaacauucagugcaggaaacu

SEQ ID NO: 126361 - RNA, 64 nt, hsa
uucuguucucucuuccccaaauaauauuaaaguauuauuugaacuuuuuaagaugaggcaguuc

SEQ ID NO: 126362 - RNA, 64 nt, hsa
ucagucaacaaguauuuuaacucucaguccaacauuauuugaauugagcaccucaagcaugcuu

SEQ ID NO: 126363 - RNA, 64 nt, hsa
uuuuuuuguuaaucauagcaggauaugacaacucuuauuugaauugauuuuuucaucuaaugua

SEQ ID NO: 126364 - RNA, 64 nt, hsa
uguuccugaaaagauccuauuaaaagacaguaguuuauuugaacugguuauggaaggugacuuu

SEQ ID NO: 126365 - RNA, 64 nt, hsa
uucaauuagcuuaaauaaguugcuuuguuauauuuuauuugaauugaacuacgcuaggccuaaa

SEQ ID NO: 126366 - RNA, 64 nt, hsa
uaaggcagauuuauuuuuaugauuuguuuaggaauuauuugauuuuauaaugguaauuuucaug

SEQ ID NO: 126367 - RNA, 64 nt, hsa
gaugacacguuucuuaaguaggaguuugagugaauuauuugauauauuacuuuguuaauaauag

SEQ ID NO: 126368 - RNA, 64 nt, hsa
uugguaaugaaguuaaauuaaauuucuuauugaauuauuugaauucaaugaaugcacugcagag

SEQ ID NO: 126369 - RNA, 64 nt, hsa
ucaaaauguacuauguguuaaguaauauuggcuauuauuugacuuguugcugguuuggaguuua

SEQ ID NO: 126370 - RNA, 64 nt, hsa
uuggcuauuauuugacuuguugcugguuuggaguuuauuugaguauugcugaucuuuucuaaag

SEQ ID NO: 126371 - RNA, 64 nt, hsa
uuagggacagaugaguuuuccagauagugucagcuuauuugaagauuaauuuucuuuguuaacu

SEQ ID NO: 126372 - RNA, 64 nt, hsa
cucuaccuauugcacuguugugacucguuggccauuauuugauuuuuguacgaaaaaaagcuuu

SEQ ID NO: 126373 - RNA, 64 nt, hsa
caacagccggauuaguuacaguucagcguuugccuuauuugaauaugguuugaacaguucgcug

SEQ ID NO: 126374 - RNA, 64 nt, hsa
ggguucuuugagaauaaaagagaaaagaccuacuuuauuugacagcaaaacuguucuaauuguu

SEQ ID NO: 126375 - RNA, 64 nt, hsa
ucagaaccuguuagauuaaagcugcacccugugauuauuugaaaagaauuagcuugagaguaau

SEQ ID NO: 126376 - RNA, 64 nt, hsa
uaaaaguaucuggucauuucaguuugguuuguaauuauuugaugcaauuuuaucauaagaguaa

SEQ ID NO: 126377 - RNA, 64 nt, hsa
guuuguauacauguuaagagaaugcuuugaaagcuuauuugauagauaauguuuagagcauuuc

SEQ ID NO: 126378 - RNA, 64 nt, hsa
aaguaugugucucuaaaggaagaaauacauauuuuuauuugacuauguuuggaguuuaauuaau

SEQ ID NO: 126379 - RNA, 64 nt, hsa
ugauacauuuuuguggugcaaguaauuaauguuauuauuugauuguuauaccauaugugcccau

SEQ ID NO: 126380 - RNA, 64 nt, hsa
guacauaagugucuguggcuuaaauaauauguuguuauuugauacauuuuuguggugcaaguaa

SEQ ID NO: 126381 - RNA, 64 nt, hsa
agauaauaaaccagucucuuggagggcacaacccuuauuugacaaaacuuggauguuggcuuga

SEQ ID NO: 126382 - RNA, 64 nt, hsa
ugaaauugcaaaaguacuuuuagggagcaggaguuuauuugacaucuaguuaucugucugucug

SEQ ID NO: 126383 - RNA, 64 nt, hsa
uggcuuaacucaagaacaguuucuucuggauuccuuauuugauuuauuuaaccuaauuauauuc

SEQ ID NO: 126384 - RNA, 64 nt, hsa
acauuuucaagggauaaggccuucuguacuuugcuuauuugaagaaucagugguaggagcagug

SEQ ID NO: 126385 - RNA, 64 nt, hsa
agggaaguccaguaaagaaaccuauuuuccgaauuuauuugaucaugaacuccuuuuuuuuuca

SEQ ID NO: 126386 - RNA, 64 nt, hsa
cccaucuucuuucauuaaccccuccuaaggcauguuauuugaaagcaauugagacgcaaccgaa

SEQ ID NO: 126387 - RNA, 64 nt, hsa
aaaagcaccucuuuuggcucaauguuuuccaaacuuauuugaccccaaaaccuuuuucauauac

SEQ ID NO: 126388 - RNA, 64 nt, hsa
uaugugcucuuccugcuucacuugcacuaauuaauuauuugaacaacuuagagcuucuucccug

SEQ ID NO: 126389 - RNA, 64 nt, hsa
aauuuugugaaacuuaaucaucuuuuaaaauguauuauuugaagaguauuuuauuucuguauug

SEQ ID NO: 126390 - RNA, 64 nt, hsa
auaacauuuuaaaauucuaaguguauaguuucauuuauuugaagugauuucaaauauuucaaau

SEQ ID NO: 126391 - RNA, 64 nt, hsa
aaacacauacuuuuuuggauauaaaugaccauauuuauuugacugcuaguuuuuuuguuuuuuu

SEQ ID NO: 126392 - RNA, 64 nt, hsa
agaaauauagcuuauuuuaaacuuuugacgguuuuuauuugaaagagauugcauuuaugcauau

SEQ ID NO: 126393 - RNA, 62 nt, hsa
uggaggcggaucaucuaauucucuguggaaugaauacacacauauauauuacaagggauaau

SEQ ID NO: 126394 - RNA, 62 nt, hsa
cucugucuucagcacccucauaagucgucacuaauacacaguuuuguacauguaacauuaaa

SEQ ID NO: 126395 - RNA, 62 nt, hsa
guguaugaauaaauauuaccugucuaccucaaaauacacauacugcugaagcauucuguaca

SEQ ID NO: 126396 - RNA, 62 nt, hsa
gacuuugcaauggugcuaagcugauagauuuaaauacacagacgggcgaguggcgcccgugu

SEQ ID NO: 126397 - RNA, 62 nt, hsa
gguugguaagagugacuaaccagccuaacuuuaauacacauguauaaagauguucacagaga

SEQ ID NO: 126398 - RNA, 62 nt, hsa
uauauuuuucuuuuaauuuccagugacuuuagaauacacacaguuuuuccgacuuuucaaaa

SEQ ID NO: 126399 - RNA, 62 nt, hsa
ccauugcuuaaaauauaacauguuuuggauccaauacacacauuguuacaacuaacacaaau

SEQ ID NO: 126400 - RNA, 62 nt, hsa
cccacagucuuuuauauaauuaaauauaugucaauacacauuagaaucagauuugaaaaagu

SEQ ID NO: 126401 - RNA, 62 nt, hsa
uacauauuuucaggaucguucaucuagugagcaauacacauauuauaggccaauauuuuuuu

SEQ ID NO: 126402 - RNA, 62 nt, hsa
uaauguaaaugggggcuucaauauauauauauaauacacacacacacacacaugcacacaua

SEQ ID NO: 126403 - RNA, 62 nt, hsa
ugauuaaguaaaaaaaaucccuauucuuggaaaauacacaauaaaguauuuugagguaaagg

SEQ ID NO: 126404 - RNA, 62 nt, hsa
uacacaugccuccaugcauauaugugugugauaauacacaugcauuuaugugcgugugugua

SEQ ID NO: 126405 - RNA, 62 nt, hsa
aaaaaauuuauauauacauuguguguguguguaauacacacacacaacccccuauaccugga

SEQ ID NO: 126406 - RNA, 62 nt, hsa
agagcgagcaagagagggagagaggaggaaaaaauacacauaauacaaacauacaugcaugc

SEQ ID NO: 126407 - RNA, 62 nt, hsa
caugaagauaacuuuuuuuaaaaaaaagcagaaauacacaaugaucucccuuguaagcuccu

SEQ ID NO: 126408 - RNA, 62 nt, hsa
ggagacuuauaagaaggaguacauuugaguugaauacacaaaucuuuacuucucuaccaauu

SEQ ID NO: 126409 - RNA, 62 nt, hsa
cgcaccugccucacauuuucuuucucacuguaaauacacauucuuauucuugaaccuucuga

SEQ ID NO: 126410 - RNA, 62 nt, hsa
agaaacaagagccccuaagucccagccucugcaauacacaguuaccagaugggaaugcagca

SEQ ID NO: 126411 - RNA, 62 nt, hsa
uuuuaaggaaauacacagugaaguuuuuaggaaauacacacuaaguauuuagggauaaagua

SEQ ID NO: 126412 - RNA, 62 nt, hsa
auguaagagaauaaaugccauuguuuuaaggaaauacacagugaaguuuuuaggaaauacac

SEQ ID NO: 126413 - RNA, 62 nt, hsa
cccucuaaauuaguucccuagcuuucucaaugaauacacacauauuuuuacauagcuaugau

SEQ ID NO: 126414 - RNA, 62 nt, hsa
ucuuuauugcugguuuuucauuuacacugauaaauacacagaucuuauaaagucuuuaacau

SEQ ID NO: 126415 - RNA, 62 nt, hsa
uuuugaccaguguuuuacaacauguacauaagaauacacauaauucaacuagagauuugaag

SEQ ID NO: 126416 - RNA, 62 nt, hsa
gaguauuuggagcaagaagcugcaaugcgccaaauacacaauaggccuuuucuuuaucauuc

SEQ ID NO: 126417 - RNA, 62 nt, hsa
cuguuuagagagauagaaguuaugacauauguaauacacaucuguguacacagaaaccggca

SEQ ID NO: 126418 - RNA, 62 nt, hsa
aaagccaccaauucuagaucuugauuugaauuaauacacacaauaucugagacacuuacacu

SEQ ID NO: 126419 - RNA, 62 nt, hsa
ugccagauaucccauacagaauuagcagagaaaauacacacaggcuucuauucaaauuuucu

SEQ ID NO: 126420 - RNA, 62 nt, hsa
agacuuuaaaauguaagcauuguaauucugaaaauacacauuuuaagaagaaacuauuuugc

SEQ ID NO: 126421 - RNA, 62 nt, hsa
uuuuuuguuguuguuagugagucucccuucaaaauacacaguagguaguguaaauacugcuu

SEQ ID NO: 126422 - RNA, 62 nt, hsa
ucaugguauuacugaagguguguauacucccuaauacacauuuaugaaaaucuacuuguuua

SEQ ID NO: 126423 - RNA, 64 nt, hsa
gguccuuaugccagcaagauuuaaccaacuguaaagauaguagucuuugcauacauuuaaguaa

SEQ ID NO: 126424 - RNA, 64 nt, hsa
gcuaauguagaaaaguuuagacuuauaaaaaggcagauaguauauauauauuuauauacaugua

SEQ ID NO: 126425 - RNA, 64 nt, hsa
uuugccaauauaguaaugcuuuuaguagaguacuagauaguaucaguuuuggauucuuauuguu

SEQ ID NO: 126426 - RNA, 64 nt, hsa
caagacuucauaaugauuuuaugucuugcuuuaaagauaguaccugcagaauaguuuuugaaua

SEQ ID NO: 126427 - RNA, 64 nt, hsa
ccuuuaagguaauuuuuaaaaaaaaucugaguagagauaguacuaauauuggcaagaagguccc

SEQ ID NO: 126428 - RNA, 64 nt, hsa
gcugccacagcuccugccaucacauuuacauuuaagauaguagagaggaaguggagggaaguug

SEQ ID NO: 126429 - RNA, 64 nt, hsa
cuauuuuucuuuuuugagauaguacuuuuuaaagagauaguacuuuuuugauauaguacuuuau

SEQ ID NO: 126430 - RNA, 64 nt, hsa
uuuuuugauucuuauuuucuauuuuucuuuuuugagauaguacuuuuuaaagagauaguacuuu

SEQ ID NO: 126431 - RNA, 64 nt, hsa
ccagucuacuucuuuaaaaaccauuuaaacugcuagauaguauuagaauaguccaauagaaaau

SEQ ID NO: 126432 - RNA, 64 nt, hsa
gcauaacuguauuuuauguguuuauucuuuauauagauaguauuuuauauuuuauucucacccg

SEQ ID NO: 126433 - RNA, 64 nt, hsa
cucguguaauuuacuuuaagauuaucugccugcucuucuucaaagcugaccuugcuuuagaaau

SEQ ID NO: 126434 - RNA, 64 nt, hsa
aauacauuggacauugguuuccaaaucucccuuucuucuucaguuccuuccuuguucaauauau

SEQ ID NO: 126435 - RNA, 64 nt, hsa
cccuuuggcucaccuuguaucagcaaacaaaguacuucuucagggaaaccugaaauuucuaaug

SEQ ID NO: 126436 - RNA, 64 nt, hsa
ucauguuugacauuuuugauagugacuuuggggucuucuucacugaaagcaccuuagaacugua

SEQ ID NO: 126437 - RNA, 64 nt, hsa
cucugcucacauuguuggccucuggauucuggcccuucuucauuggcuguugcuuuggacugga

SEQ ID NO: 126438 - RNA, 64 nt, hsa
gcccuuucacucccaggccaagcccuggagcaaucuucuucaggcagcugucuccaccuccagg

SEQ ID NO: 126439 - RNA, 64 nt, hsa
gugcaaaauacucuauggaaaucauaauugucaucuucuucaugguguuagggauauauuguca

SEQ ID NO: 126440 - RNA, 64 nt, hsa
gaccuaaggcucaguguggucaacagaaagcugccuucuucacuugaggcuaagucuucauaua

SEQ ID NO: 126441 - RNA, 64 nt, hsa
acaccacacacagucaugauuuuguuaaaguagccuucuucagaugcuuuucuaagggcuaguu

SEQ ID NO: 126442 - RNA, 64 nt, hsa
ggaauauuggcuugauuuaucuagaaaguuuuuccuucuucaauuuuacuauauucauucuaca

SEQ ID NO: 126443 - RNA, 64 nt, hsa
ugggaaaagaauuccuaaugugcuacuagaauuccuucuucaguuuuaacgaguaauuggauaa

SEQ ID NO: 126444 - RNA, 64 nt, hsa
gaggcucaggacgcgcccucugaaucgaguguuucuucuucacaagucaccaagagaggacaug

SEQ ID NO: 126445 - RNA, 64 nt, hsa
gaccuuuaguaaauggggaaauuaacaggacuuucuucuucaucuucaaacucuucagaagcag

SEQ ID NO: 126446 - RNA, 64 nt, hsa
aaaguuuuuuuaccuucucuucuaagagaauauucuucuucacuucuuccuuguaauuauacuu

SEQ ID NO: 126447 - RNA, 64 nt, hsa
cagcccucuucagcccuccccaguccuccccagccuucuucagccuucuucagcucagcccucu

SEQ ID NO: 126448 - RNA, 64 nt, hsa
cagcccuccccaguccuccccagccuucuucagccuucuucagcucagcccucuucuauuucuu

SEQ ID NO: 126449 - RNA, 64 nt, hsa
acuuuuucauauuuuaguguaguuagaagaauuccuucuucaaacauuaaagauccacaaagca

SEQ ID NO: 126450 - RNA, 64 nt, hsa
uuucuagccaacuaacucacagaaaaacuguuuacuucuucacuuucgaaguauuuggcuuuug

SEQ ID NO: 126451 - RNA, 64 nt, hsa
cuuucucugagccagcggaugcacaguccguggccuucuucaggcuuauugaugaugcuuuuug

SEQ ID NO: 126452 - RNA, 64 nt, hsa
cacaaucgugaccccgcgaccucuccaucuucagcuucuucaucuucaccagaggaaucacucu

SEQ ID NO: 126453 - RNA, 64 nt, hsa
uuauaguuacuccugguuaugcagcuucucuugucuucuucauauauaugauaucauuuauuuu

SEQ ID NO: 126454 - RNA, 64 nt, hsa
cuuacuggugugggcaggcacuaguggacgucagcuucuucauuuuaauucuccuuuuaaugua

SEQ ID NO: 126455 - RNA, 64 nt, hsa
aagccuccgguuuccacuacuguguagacuccugcuucuucaagcaccugcagauucugauuuu

SEQ ID NO: 126456 - RNA, 64 nt, hsa
aacacccccaccccaacacccccaagacagcagucuucuucacccgcugcagccguuccguccc

SEQ ID NO: 126457 - RNA, 64 nt, hsa
ugcaaccuccaccuccuggguucaagcaauucuccuucuucagccucccgaguagcugggauua

SEQ ID NO: 126458 - RNA, 64 nt, hsa
ugcaaccuccaccucccggguucaagcaauucuccuucuucagccucccgaguagcugagauua

SEQ ID NO: 126459 - RNA, 64 nt, hsa
auuuuugauaacuguguacuucuggugacuguacaguuugaaauacuauuuuuuaucaaguuuu

SEQ ID NO: 126460 - RNA, 64 nt, hsa
gcuuucugauuuuugguaguccauugaagaagggaguuugaaaguuguuguauacuguuaacga

SEQ ID NO: 126461 - RNA, 64 nt, hsa
auggguuaccuuaaaaaguugauuuccuugaagcaguuugaaaauuugaauugagucuuaacuu

SEQ ID NO: 126462 - RNA, 64 nt, hsa
ggcaggcaguaucgauuuuaugaagagaaagugaaguuugaaaacuuuucaaacuuuucuaguu

SEQ ID NO: 126463 - RNA, 64 nt, hsa
guacauuuguauaccuguaauguaaauguggagaaguuugaaucaacauaaacacguuuuuugg

SEQ ID NO: 126464 - RNA, 64 nt, hsa
aguaaaaaacaaacaaaaacaaaaaaaccugagaaguuugaauuguaguuaaaugaccccaaac

SEQ ID NO: 126465 - RNA, 64 nt, hsa
cacuuugccuuagauaacugugugugugugugccaguuugaacucugacaccacauuuuccuuc

SEQ ID NO: 126466 - RNA, 60 nt, hsa
aggagaagcgugcugaauaggauucuucucaguuugaaagacaaugaaaaaugguuuugu

SEQ ID NO: 126467 - RNA, 64 nt, hsa
ucugcuaguucaaaaugugaauuaggaccuggucaguuugaaauauaccaaauucuaugcccuu

SEQ ID NO: 126468 - RNA, 64 nt, hsa
agcuuuauacagaggaggggcacacuugucugugaguuugaagcccugaguuccaguccugugg

SEQ ID NO: 126469 - RNA, 64 nt, hsa
ucggauucucacuaacuuuuguuacuauucuaaaaguuugaauuugcugggguguuuauucuga

SEQ ID NO: 126470 - RNA, 64 nt, hsa
ggaggccgaggcagguggaucacuugaggccaggaguuugaaaccagccuggccaacaugguga

SEQ ID NO: 126471 - RNA, 64 nt, hsa
ccacuguguauagaaguagauuaagagccauauaaguuugaaggaaacaguuaauaccauuuuu

SEQ ID NO: 126472 - RNA, 64 nt, hsa
cauuuuuuaaggaaacaauauaaccacaaagcacaguuugaacaaaaucuccucuuuuagcuga

SEQ ID NO: 126473 - RNA, 64 nt, hsa
acugaagauauuggcacaaauguuuuauacaaagaguuugaacaaaaaaucccuguaagaccag

SEQ ID NO: 126474 - RNA, 64 nt, hsa
cuugagaccacuuuaguguacuuacauuuagaugaguuugaaaucucaauggugucuaauuauu

SEQ ID NO: 126475 - RNA, 64 nt, hsa
gaaguucuaguguuuucaauuuuaaacauauccaaguuugaauuccuaaaauuauggaaacaga

SEQ ID NO: 126476 - RNA, 64 nt, hsa
auguuucacacaaacaaggccugucagcuaaagaaguuugaacauuuggguuacuauuucuugu

SEQ ID NO: 126477 - RNA, 64 nt, hsa
uugccucuuccaggcauacugcauucuguggaucaguuugaacagcuucuccaccuuauuugga

SEQ ID NO: 126478 - RNA, 64 nt, hsa
aguuuagggcauguuuucuguuuuaaagaccagaaguuugaaggcacccaaauccuugucgcca

SEQ ID NO: 126479 - RNA, 64 nt, hsa
gaagaguuguguauaguuaguuguuaucucuacaaguuugaaaguuuucccaucaaacauuauc

SEQ ID NO: 126480 - RNA, 64 nt, hsa
ggguccuaguaagugccacuuccacuaagaauacaguuugaauguauaaucaguaguguuuaca

SEQ ID NO: 126481 - RNA, 64 nt, hsa
acauacacuuuuugaguaggcaauauguucacauaguuugaaauuaaagguacaaaauggcgua

SEQ ID NO: 126482 - RNA, 64 nt, hsa
aucaauacaacaacauuaaaagccagacuagcggaguuugaaucuuggcccugcuguuaguaac

SEQ ID NO: 126483 - RNA, 64 nt, hsa
uccucaucuuuccaaguuguucuuugaauugaggaguuugaaggcauaaacaguuacuugggga

SEQ ID NO: 126484 - RNA, 64 nt, hsa
cuaacacauuuucuaagucgccagugcugcuuacaguuugaauacaugaaaauccuguuucuga

SEQ ID NO: 126485 - RNA, 64 nt, hsa
aaaaaaaaggaaaaaaagaaaaaaggaaaaaaacaguuugaacacaaaggcucuauggaagaaa

SEQ ID NO: 126486 - RNA, 64 nt, hsa
ggcccuuaacccagccuuuuccaguguguaacccaguuugaaaucuuaaaaaaagaaaaaauga

SEQ ID NO: 126487 - RNA, 64 nt, hsa
acauucugguguaguuuaaaaugccuuugggggcaguuugaagcaguucuucaugccacuuagu

SEQ ID NO: 126488 - RNA, 64 nt, hsa
ugggggcaguuugaagcaguucuucaugccacuuaguuugaaaauaaaauucuagauaugcaaa

SEQ ID NO: 126489 - RNA, 64 nt, hsa
uagagaauuuauuucauauaaaauaauaauauaaaguuugaacugauuagaauguuccuuaaau

SEQ ID NO: 126490 - RNA, 64 nt, hsa
uuuuuggucaacuggcuagacuaaacaaaguauaaguuugaaaugaaauggucuagagggaaau

SEQ ID NO: 126491 - RNA, 64 nt, hsa
uuucaaauaagcauaauuugcucaauuaaguaugaguuugaauuuaguuugaaaucuggaauug

SEQ ID NO: 126492 - RNA, 64 nt, hsa
cauaauuugcucaauuaaguaugaguuugaauuuaguuugaaaucuggaauuggccagacugug

SEQ ID NO: 126493 - RNA, 64 nt, hsa
acugaauguaauacuugaguagauuuuuuuuucuaguuugaaauuuagucugucuuuuugaccu

SEQ ID NO: 126494 - RNA, 64 nt, hsa
uguuuuaugacaugguauacuacuauauuuacucaguuugaaacuauucauuucuacacacuau

SEQ ID NO: 126495 - RNA, 64 nt, hsa
cuuuuguuuggcugcuguaauuuuuaaguauuugaguuugaacagauuagcucuggggggaggg

SEQ ID NO: 126496 - RNA, 64 nt, hsa
acaggggugggaauaaaauggauuuaggacacccaguuugaauugcaguuuuuuuuuuucugac

SEQ ID NO: 126497 - RNA, 64 nt, hsa
guugauuuccuaaguguggcugaugguagccucuaguuugaagugagggaagaaugaguaguca

SEQ ID NO: 126498 - RNA, 64 nt, hsa
uguuuacauuuuauaacuuccuguccuucaaaagaguuugaaaugucauuuugggaaaagagag

SEQ ID NO: 126499 - RNA, 64 nt, hsa
guuuauggaaaguaucuuuaauaaagcuggauacaguuugaaagaaaaaaaaaaguguggcaau

SEQ ID NO: 126500 - RNA, 64 nt, hsa
agcggcugauuuuugguaguccauugaagaagagaguuugaaaguuguauacuguuaaugacug

SEQ ID NO: 126501 - RNA, 64 nt, hsa
gcauuuuuuauaacuguacuucuggugacuguacaguuugaaauauucuuuaucaaguuuuaua

SEQ ID NO: 126502 - RNA, 56 nt, hsa
uaacuguguacuucuggugacuguacaguuugaaauacuauuuuuuaaucaaguuu

SEQ ID NO: 126503 - RNA, 64 nt, hsa; identical to SEQ ID NO: 126460

SEQ ID NO: 126504 - RNA, 64 nt, hsa
cacauuuuccacuuuguuuuccccaaaacauaucaguuugaauacuugaaucaugcaggccaau

SEQ ID NO: 126505 - RNA, 64 nt, hsa
uuucauguuguaaaacuaaagaauuucgcucugcaguuugaaaaacuguggccacagcugugac

SEQ ID NO: 126506 - RNA, 64 nt, hsa
gaguauaaauucacuugucaccucagugcuuuacaguuugaaguggucacuuaccugaugguuc

SEQ ID NO: 126507 - RNA, 64 nt, hsa
uaugaggaggaucagccacacaauccagugcuucaguuugaaaauguaaaauucuaacccuaaa

SEQ ID NO: 126508 - RNA, 64 nt, hsa
ugggagugggagcaaaauugugaucuuuccuaggaguuugaaugccccauauuuguguccucgc

SEQ ID NO: 126509 - RNA, 64 nt, hsa
ggggcugcgagguaguagacaggaugcccaguuaaguuugaauuucagauagaaaauaauuuua

SEQ ID NO: 126510 - RNA, 64 nt, hsa
cagagcgggcuucuucauggcugcguuguugcugaguuugaacugcuccucccuggccugcgug

SEQ ID NO: 126511 - RNA, 64 nt, hsa
gugccuuucuguuuaccagcuacuucaaucccaaaguuugaaucugcagauaccuuacucccag

SEQ ID NO: 126512 - RNA, 64 nt, hsa
uuuaccuauaaaguucagaugagaauacguguccaguuugaauuuucuuaucacuguguacaca

SEQ ID NO: 126513 - RNA, 64 nt, hsa
gcacaauacaaauguucuuuacuucuggggaaacaguuugaaaauguugagacagcacagcagc

SEQ ID NO: 126514 - RNA, 64 nt, hsa
uguguugagaaaauuaaaaauucauuguuccagcaguuugaaaauaaauuguugucgaugauag

SEQ ID NO: 126515 - RNA, 64 nt, hsa
ucagcuuuuuaagcuuccccaugugauugaggacaguuugaaguuaguguuucagccauagcuc

SEQ ID NO: 126516 - RNA, 64 nt, hsa
agcuggcugaagauuauacuuucaauucagagcgaguuugaagaugacacuuugaggcaucgug

SEQ ID NO: 126517 - RNA, 64 nt, hsa
ucagauuucagccccauccccaaugaagagcuugaguuugaagauuauacuuuuuuugagacag

SEQ ID NO: 126518 - RNA, 64 nt, hsa; identical to SEQ ID NO: 74296

SEQ ID NO: 126519 - RNA, 64 nt, hsa; identical to SEQ ID NO: 74297

SEQ ID NO: 126520 - RNA, 64 nt, hsa; identical to SEQ ID NO: 74298

SEQ ID NO: 126521 - RNA, 64 nt, hsa; identical to SEQ ID NO: 74299

SEQ ID NO: 126522 - RNA, 64 nt, hsa; identical to SEQ ID NO: 74300

SEQ ID NO: 126523 - RNA, 64 nt, hsa; identical to SEQ ID NO: 74301

SEQ ID NO: 126524 - RNA, 64 nt, hsa; identical to SEQ ID NO: 74302

SEQ ID NO: 126525 - RNA, 64 nt, hsa; identical to SEQ ID NO: 74303

SEQ ID NO: 126526 - RNA, 64 nt, hsa; identical to SEQ ID NO: 74304

SEQ ID NO: 126527 - RNA, 64 nt, hsa; identical to SEQ ID NO: 74305

SEQ ID NO: 126528 - RNA, 64 nt, hsa; identical to SEQ ID NO: 74306

SEQ ID NO: 126529 - RNA, 64 nt, hsa; identical to SEQ ID NO: 74307

SEQ ID NO: 126530 - RNA, 64 nt, hsa; identical to SEQ ID NO: 74308

SEQ ID NO: 126531 - RNA, 64 nt, hsa; identical to SEQ ID NO: 74309

SEQ ID NO: 126532 - RNA, 64 nt, hsa; identical to SEQ ID NO: 74310

SEQ ID NO: 126533 - RNA, 64 nt, hsa; identical to SEQ ID NO: 74311

SEQ ID NO: 126534 - RNA, 64 nt, hsa; identical to SEQ ID NO: 74312

SEQ ID NO: 126535 - RNA, 64 nt, hsa; identical to SEQ ID NO: 74313

SEQ ID NO: 126536 - RNA, 64 nt, hsa; identical to SEQ ID NO: 81134

SEQ ID NO: 126537 - RNA, 64 nt, hsa; identical to SEQ ID NO: 81135

SEQ ID NO: 126538 - RNA, 64 nt, hsa; identical to SEQ ID NO: 81136

SEQ ID NO: 126539 - RNA, 64 nt, hsa; identical to SEQ ID NO: 81137

SEQ ID NO: 126540 - RNA, 64 nt, hsa; identical to SEQ ID NO: 81138

SEQ ID NO: 126541 - RNA, 64 nt, hsa; identical to SEQ ID NO: 81139

SEQ ID NO: 126542 - RNA, 64 nt, hsa; identical to SEQ ID NO: 81140

SEQ ID NO: 126543 - RNA, 64 nt, hsa; identical to SEQ ID NO: 81141

SEQ ID NO: 126544 - RNA, 64 nt, hsa; identical to SEQ ID NO: 81142

SEQ ID NO: 126545 - RNA, 64 nt, hsa; identical to SEQ ID NO: 81143

SEQ ID NO: 126546 - RNA, 64 nt, hsa; identical to SEQ ID NO: 81144

SEQ ID NO: 126547 - RNA, 64 nt, hsa; identical to SEQ ID NO: 81145

SEQ ID NO: 126548 - RNA, 64 nt, hsa; identical to SEQ ID NO: 81146

SEQ ID NO: 126549 - RNA, 64 nt, hsa; identical to SEQ ID NO: 81147

SEQ ID NO: 126550 - RNA, 64 nt, hsa; identical to SEQ ID NO: 81148

SEQ ID NO: 126551 - RNA, 64 nt, hsa; identical to SEQ ID NO: 81149

SEQ ID NO: 126552 - RNA, 64 nt, hsa; identical to SEQ ID NO: 81150

SEQ ID NO: 126553 - RNA, 64 nt, hsa; identical to SEQ ID NO: 81151

SEQ ID NO: 126554 - RNA, 64 nt, hsa; identical to SEQ ID NO: 81152

SEQ ID NO: 126555 - RNA, 64 nt, hsa; identical to SEQ ID NO: 81153

SEQ ID NO: 126556 - RNA, 64 nt, hsa; identical to SEQ ID NO: 81154

SEQ ID NO: 126557 - RNA, 64 nt, hsa; identical to SEQ ID NO: 81155

SEQ ID NO: 126558 - RNA, 64 nt, hsa; identical to SEQ ID NO: 81156

SEQ ID NO: 126559 - RNA, 64 nt, hsa; identical to SEQ ID NO: 81157

SEQ ID NO: 126560 - RNA, 64 nt, hsa; identical to SEQ ID NO: 81158

SEQ ID NO: 126561 - RNA, 64 nt, hsa; identical to SEQ ID NO: 81159

SEQ ID NO: 126562 - RNA, 64 nt, hsa; identical to SEQ ID NO: 81160

SEQ ID NO: 126563 - RNA, 64 nt, hsa; identical to SEQ ID NO: 81161

SEQ ID NO: 126564 - RNA, 64 nt, hsa; identical to SEQ ID NO: 81162

SEQ ID NO: 126565 - RNA, 64 nt, hsa; identical to SEQ ID NO: 81163

SEQ ID NO: 126566 - RNA, 64 nt, hsa; identical to SEQ ID NO: 81164

SEQ ID NO: 126567 - RNA, 64 nt, hsa; identical to SEQ ID NO: 81165

SEQ ID NO: 126568 - RNA, 64 nt, hsa; identical to SEQ ID NO: 81166

SEQ ID NO: 126569 - RNA, 64 nt, hsa; identical to SEQ ID NO: 81167

SEQ ID NO: 126570 - RNA, 64 nt, hsa; identical to SEQ ID NO: 81168

SEQ ID NO: 126571 - RNA, 64 nt, hsa; identical to SEQ ID NO: 81169

SEQ ID NO: 126572 - RNA, 64 nt, hsa; identical to SEQ ID NO: 81170

SEQ ID NO: 126573 - RNA, 64 nt, hsa; identical to SEQ ID NO: 81171

SEQ ID NO: 126574 - RNA, 64 nt, hsa; identical to SEQ ID NO: 81172

SEQ ID NO: 126575 - RNA, 64 nt, hsa; identical to SEQ ID NO: 81173

SEQ ID NO: 126576 - RNA, 64 nt, hsa
ggggguucccgaggcccagggccaaggcacucccaccgccuaccuuagcacagggucucugcag

SEQ ID NO: 126577 - RNA, 63 nt, hsa
ccucgucauuccuggugugagccuggucggcucaccgccuaucaucugcauuugccuuacuca

SEQ ID NO: 126578 - RNA, 64 nt, hsa
cuuagucauguugcuacuaaaaguagggcauaugaccgccuaagaaacagaacuucgagaaguc

SEQ ID NO: 126579 - RNA, 64 nt, hsa
cacccccugcccacaaaaaauugcuccuaacuccaccgccuaucccaaaccuacaagaacuaau

SEQ ID NO: 126580 - RNA, 64 nt, hsa
uccacccugcccacaaaacauugcucuuaacuucaccgccuaacccaaaaccuauaagaacuaa

SEQ ID NO: 126581 - RNA, 64 nt, hsa
aucgaagaaguacaacccacauagcccucuggagaccgccuagaucagagacucagcaaaaaca

SEQ ID NO: 126582 - RNA, 64 nt, hsa
cccgcccgccccacuaucuuuaaggagaccagagaccgccuacuggagagaaaggaggaaaaaa

SEQ ID NO: 126583 - RNA, 64 nt, hsa
ucucuuugacccccagggacccuugccccaggacaccgccuaccccguacagaccccuucacuc

SEQ ID NO: 126584 - RNA, 64 nt, hsa
gcagucuccaucugcggcccugucccauggcuuaaccgccuauugguaucuguguauauuuacg

SEQ ID NO: 126585 - RNA, 64 nt, hsa
uugagaauuguuaaauguucagcaggagaacgccaccgccuagugugaaugcuaggucagaagc

SEQ ID NO: 126586 - RNA, 64 nt, hsa
cugucuucuggacaggcucugcuucuccaaggaaaccgccuaguuuacuguuuugaaaucaaug

SEQ ID NO: 126587 - RNA, 64 nt, hsa
uauuugguguuuaagauagcaccauuguuuaaauaccgccuauguacucccaaaugaauaaaac

SEQ ID NO: 126588 - RNA, 64 nt, hsa
aggcuggucucgaacuccugaccucaggugauccaccgccuaggccucccaaaaccauuagggc

SEQ ID NO: 126589 - RNA, 64 nt, hsa
cauuacauuuuuaggagaaaguaaguugcuuugcaccgccuacuuaauucuuuuccauauauug

SEQ ID NO: 126590 - RNA, 64 nt, hsa
cugggccgcuguguagccaggacaugcccaugccaccgccuauugaacaguucauaggaguggc

SEQ ID NO: 126591 - RNA, 64 nt, hsa
acucugaguggggcuaaauaaguuauuuucucugaccgccuacuggaaauauuuuuaaguggaa

SEQ ID NO: 126592 - RNA, 64 nt, hsa
acggcagcagggcagaggagacuauggggagcccaccgccuacacaguaggggcaguagccccc

SEQ ID NO: 126593 - RNA, 64 nt, hsa
agaguauacuuuuucuuuccagaaauaauuucauaccgccuaugaaauaucagauaaauuaccu

SEQ ID NO: 126594 - RNA, 64 nt, hsa
ugcacuuccccaagucggcacugaguggcccagcaccgccuagcccugccaccccacugcccuc

SEQ ID NO: 126595 - RNA, 64 nt, hsa
uguuaauaaagccguaggcccuugucuaagugcaaccgccuagacuuucuuucagauacauguc

SEQ ID NO: 126596 - RNA, 64 nt, hsa
uguucacuggcgcugggacagucagggugaccccaccgccuaccucucuacaucuaaagagccc

SEQ ID NO: 126597 - RNA, 64 nt, hsa
gcacgccccccagaacgcagucuccacugagggcaccgccuauugguguccugugggagggcga

SEQ ID NO: 126598 - RNA, 64 nt, hsa
guccauacccgaggguggauauucaaccagccccaccgccuacccgacucgguuucuggauauc

SEQ ID NO: 126599 - RNA, 64 nt, hsa
cugggaaagaacgucauaaaauacgaaaaauguguuagaacacuuuauuuucccagccgcuuuc

SEQ ID NO: 126600 - RNA, 64 nt, hsa
aaguguguuaaagcuuucaguuauucuaguuucauuagaacacgugaaaaaauuaaaaacucaa

SEQ ID NO: 126601 - RNA, 64 nt, hsa
cugcucugggcucucucagaaacuucaggagauguuagaacaagucuuuccaguuagagaagag

SEQ ID NO: 126602 - RNA, 64 nt, hsa
aauacaucaagccagcuucauucacucacuuuacuuagaacagagauauaagggccugggaugc

SEQ ID NO: 126603 - RNA, 64 nt, hsa
agccucuccccaacccugccgcauugucuaauuuuuagaacacuaggcuucuucuuucauguag

SEQ ID NO: 126604 - RNA, 64 nt, hsa
guuuuuggguuccuggaacagcgcucaccuuuguuuagaacacugguuuaaagggauaaucauc

SEQ ID NO: 126605 - RNA, 64 nt, hsa
guauguugguuacccuccuagcuuuccauuugguuuagaacauaaagcaaauagacacagucau

SEQ ID NO: 126606 - RNA, 64 nt, hsa
aaguuuuguuuuuguuuuuuuccaacuguguucauuagaacagcguguucuaaguauuugaaac

SEQ ID NO: 126607 - RNA, 64 nt, hsa
ggagucacaguugacaaaaagcucuuacacuacauuagaacacugcauuagagcccauuucaau

SEQ ID NO: 126608 - RNA, 64 nt, hsa
guaccaauccuaggaacuguauacuaguuccuacuuagaacaaaaguaucaaguuugcacacaa

SEQ ID NO: 126609 - RNA, 64 nt, hsa
cuaaguacuuuacuuguauuaucccauuuaauacuuagaacaaccccgugagauaaguaguuau

SEQ ID NO: 126610 - RNA, 64 nt, hsa
cuucuuuccagcacauuuuuuuuaaaaacucagguuagaacaaaaaugucauaaagggcacuaa

SEQ ID NO: 126611 - RNA, 64 nt, hsa
guauuugaaauaggauauuuagcauuucuguaguuuagaacagauguuacagugugugguuuug

SEQ ID NO: 126612 - RNA, 64 nt, hsa
auguuuuccuaaaugucccugauauucuacuuauuuagaacaucuuuucauuuuuuccauuauu

SEQ ID NO: 126613 - RNA, 64 nt, hsa
uaggacuuuaacacuuuaucuauggcuacuguuauuagaacaauguaaauguauuugcugaaag

SEQ ID NO: 126614 - RNA, 64 nt, hsa
uuacuaugcauuaagaccucugauucaaaacuuauuagaacaguagcuucugcuggaauuugca

SEQ ID NO: 126615 - RNA, 64 nt, hsa
uaaaguacuuauucauauaccuuguaacuaaaaauuagaacagcucccuagaauugugaacuuu

SEQ ID NO: 126616 - RNA, 64 nt, hsa
uguucuaugaggaauuuaguaccucuucacugugaaauucgaaauaaugauuuuuauaaaagca

SEQ ID NO: 126617 - RNA, 64 nt, hsa
ccuaaggacaggggauaucaagaugccagcacaaaaauucgagaaaucuuccaccaugcgggaa

SEQ ID NO: 126618 - RNA, 64 nt, hsa
uucuucagagcuuucuggcucucuuucccccacaaaauucgacauauuuaaaaaucuccgugug

SEQ ID NO: 126619 - RNA, 64 nt, hsa
gcccauuuuuguggcugggcuggggggaggaggcaaauucgauuugaacauauacuuguaauuc

SEQ ID NO: 126620 - RNA, 64 nt, hsa
cuuaaagauaaucacugugagcaacuuagaguaaaaauucgaaaacugaaaaauaaggcuagug

SEQ ID NO: 126621 - RNA, 64 nt, hsa
cauuuacaauuguguuuuagaucuacagaguuagaaauucgaaaacuauuccaggacuaauucu

SEQ ID NO: 126622 - RNA, 64 nt, hsa
ugucuuacaagcacuuugucuugucucugcaagaaaauucgauuccagucauuucccauaaaau

SEQ ID NO: 126623 - RNA, 64 nt, hsa
cuaacaauuauguauauucaaacuugauuauuuuaaauucgaucuucagcuguacuguaaauag

SEQ ID NO: 126624 - RNA, 64 nt, hsa
auuuaaacaaaaagauacuaaauauacagaaguuaaauucgaacuagccacagaaucauuuguu

SEQ ID NO: 126625 - RNA, 64 nt, hsa
aaauaagauuaauggaagacuuuaagguauuuuaaaauucgaaggguauccaagguucuguauu

SEQ ID NO: 126626 - RNA, 64 nt, hsa
cauaucuucauuaagaguuuuuggaaaacucaucaaauucgaugaauacauuuucuucauaacc

SEQ ID NO: 126627 - RNA, 64 nt, hsa
agaccuacuugguggcauuaaacuguuugaaugcaaauucgauuucagauugaacuuguuaagg

SEQ ID NO: 126628 - RNA, 64 nt, hsa
agaaauaucugaaccuucuuucuguucaguccuaaaauucgaaauaaagugagacuaugguuca

SEQ ID NO: 126629 - RNA, 64 nt, hsa
uucugagggcaucuugguccaggaaaugugcacaaaauucgaccugauuuacaguuucaaaaac

SEQ ID NO: 126630 - RNA, 64 nt, hsa
auccaggcgugggcccgugucugucccugguuguaaauucgagggucugcauaucugauguuca

SEQ ID NO: 126631 - RNA, 64 nt, hsa
gaaaaaaaugaaacuucaaaauugaugaaaaacuaaauucgaggaauuaaaaucgaacaaaaca

SEQ ID NO: 126632 - RNA, 64 nt, hsa
uuaaaacugacagaggacauuuagauacauaauaaaauucgagcuacauaaguauauggaaaau

SEQ ID NO: 126633 - RNA, 64 nt, hsa
ucaagugaaguuauaauuuacacugaggguuucaaaauucgacuagaaguggagauauauuauu

SEQ ID NO: 126634 - RNA, 64 nt, hsa
guuuugcugccuccuaccuuucuaagcgucaugcaaauucgagaauggagaaggacgcugccgg

SEQ ID NO: 126635 - RNA, 64 nt, hsa
aauccuuguucauugaagcauuugugucgguuaaaaauucgaaggcuuaugggucuccagaaac

SEQ ID NO: 126636 - RNA, 64 nt, hsa
uguauuccuuguuucuguauagauguaagcacauaaauucgauggaauagaauuacguuaacaa

SEQ ID NO: 126637 - RNA, 64 nt, hsa
ucugggcgcugggaagucguccaagaugauuaaaaaauucgacaagaaggacgaggagucuggu

SEQ ID NO: 126638 - RNA, 64 nt, hsa
gauuucuuauuauuauauguuagccugcaugguuaaauucgacaacuuguaacucuaugaacuu

SEQ ID NO: 126639 - RNA, 64 nt, hsa
cacuuugauauuaaaauuuugcuuauguuuugcuaaauucgaauaauguuugaagauuuuuagg

SEQ ID NO: 126640 - RNA, 64 nt, hsa
ggcugaaagggagcaacuuuuccuccaauccuggaaauucgacacaauuagauuugaacugcug

SEQ ID NO: 126641 - RNA, 64 nt, hsa
ugccugggaaccccaggaauugacccugaguuuuaaauucgaaaauaaaguggggcugggacac

SEQ ID NO: 126642 - RNA, 64 nt, hsa
accugaguacuagucuucuuacauuuacaaguagaaauucgauuaauggcuucuucccuuguaa

SEQ ID NO: 126643 - RNA, 64 nt, hsa
gguguugaugaugccuucuauacauuaguucgagaaauucgaaaacauaaagaaaagaugagca

SEQ ID NO: 126644 - RNA, 64 nt, hsa
acuuuucuuaaugggucucagcaauuuugccaauaaauucgacucuaaugggggaagcagggug

SEQ ID NO: 126645 - RNA, 64 nt, hsa
cuaggaaauuugggaacaugauuguauuguauuaaaauucgaagugauuauuaucagcuuaauu

SEQ ID NO: 126646 - RNA, 64 nt, hsa
uaauaagaucucaguugcacgugcaaacaaauccaaauucgaacauucuuaggagguuuuuguu

SEQ ID NO: 126647 - RNA, 64 nt, hsa
guaagcaaaacuuuccucccagauaauugcuuccaaauucgaagaguuagucaccaagagagcc

SEQ ID NO: 126648 - RNA, 64 nt, hsa
ggaaagugaaggcagagugagcaggcaaaguagaaaauucgaaaagguccucaacgaguuugua

SEQ ID NO: 126649 - RNA, 64 nt, hsa
uggcacaucaagaguuaacucugccuucugggccaaauucgaaauaaccaguccauuuuuccuu

SEQ ID NO: 126650 - RNA, 64 nt, hsa
aauuugcccagguaggcgugagaguguggguuuuaaauucgaagcucaggccauaguuucagag

SEQ ID NO: 126651 - RNA, 64 nt, hsa
ggccugggccggccugaccuaagccugguaguuaaaauucgaccccugaccuagcaacugaugu

SEQ ID NO: 126652 - RNA, 64 nt, hsa
cagucaccagugcgauucuggauaaagccacugaaaauucgaaccaggaaauggaaccccacca

SEQ ID NO: 126653 - RNA, 64 nt, hsa
uaccuacguuccuguguuuacauacacaaguagcaaauucgaguaugcauaguguagauggaca

SEQ ID NO: 126654 - RNA, 64 nt, hsa
ggauccaagcagggggaugaaaaacucagcagagaaauucgagaccauuuugcaagacugugcc

SEQ ID NO: 126655 - RNA, 64 nt, hsa
uccugcgcuucgaauccuuguuugaacuuuuuaaaaauucgaaaacuuuggggaacgaaugcaa

SEQ ID NO: 126656 - RNA, 64 nt, hsa
uuauuuggcucauuucagaaaauugugaaaguucaaauucgagaagauuuaacucaaguggaac

SEQ ID NO: 126657 - RNA, 64 nt, hsa
cuccccuccugcuaaagaaccaguuaccccaggaaaauucgacuccuguuuuucuuuaauuaac

SEQ ID NO: 126658 - RNA, 64 nt, hsa
caaggugcaaggcaggcagaucauuugaggucagaaauucgagaccagcguggucaacauggug

SEQ ID NO: 126659 - RNA, 64 nt, hsa
uuuguacuccaaguugucaaagcaucaacaaugaaaauucgauuaggaaacuuuauuuaaaauu

SEQ ID NO: 126660 - RNA, 64 nt, hsa
uuagaaaguaacuuaauuuuaauaccacuacuaaaaauucgaaaauuucuucuuuaaucacauu

SEQ ID NO: 126661 - RNA, 64 nt, hsa
uuuacuucuuaccauuuuuuaaaaguaugcagcuaaauucgaagcuuuuggucuauauuguuaa

SEQ ID NO: 126662 - RNA, 64 nt, hsa
aaaaauuuugcuguuuuguaaaacagauugagaaaaauucgaucuuauuuagugaucuguugca

SEQ ID NO: 126663 - RNA, 64 nt, hsa
uccuaaccuugcugcuuucacagggugggaaacgaaauucgagggaaauuccccggaaauauga

SEQ ID NO: 126664 - RNA, 64 nt, hsa; identical to SEQ ID NO: 45862

SEQ ID NO: 126665 - RNA, 64 nt, hsa; identical to SEQ ID NO: 45863

SEQ ID NO: 126666 - RNA, 64 nt, hsa; identical to SEQ ID NO: 45864

SEQ ID NO: 126667 - RNA, 64 nt, hsa; identical to SEQ ID NO: 45865

SEQ ID NO: 126668 - RNA, 64 nt, hsa; identical to SEQ ID NO: 45866

SEQ ID NO: 126669 - RNA, 64 nt, hsa; identical to SEQ ID NO: 45867

SEQ ID NO: 126670 - RNA, 64 nt, hsa; identical to SEQ ID NO: 45868

SEQ ID NO: 126671 - RNA, 64 nt, hsa; identical to SEQ ID NO: 45869

SEQ ID NO: 126672 - RNA, 64 nt, hsa; identical to SEQ ID NO: 45870

SEQ ID NO: 126673 - RNA, 64 nt, hsa; identical to SEQ ID NO: 45871

SEQ ID NO: 126674 - RNA, 64 nt, hsa; identical to SEQ ID NO: 45872

SEQ ID NO: 126675 - RNA, 64 nt, hsa; identical to SEQ ID NO: 45873

SEQ ID NO: 126676 - RNA, 64 nt, hsa; identical to SEQ ID NO: 45874

SEQ ID NO: 126677 - RNA, 64 nt, hsa; identical to SEQ ID NO: 45875

SEQ ID NO: 126678 - RNA, 64 nt, hsa
uccuucaggaggaucuuagccaagaauauuugcaaugacacaugaauuuaauuuuauaaauaua

SEQ ID NO: 126679 - RNA, 64 nt, hsa
aacguuuaauaguccgggucuacagggaagaacaaugacacagcuugagcguuacuuccuccuu

SEQ ID NO: 126680 - RNA, 64 nt, hsa
aaucugaauuuuaaaacaugcuguuuaugacacaaugacacauuuguugcaccaauuaaguguu

SEQ ID NO: 126681 - RNA, 64 nt, hsa
guuuauuaaaucugaauuuuaaaacaugcuguuuaugacacaaugacacauuuguugcaccaau

SEQ ID NO: 126682 - RNA, 64 nt, hsa
uaguagccugcuacuccauaguauggcucaauagaugacacaucauuuugacauuaucaauagg

SEQ ID NO: 126683 - RNA, 64 nt, hsa
cuagucucuauauaugugguuaguagucauggaaaugacacauaaaguacgccagaaguuugau

SEQ ID NO: 126684 - RNA, 64 nt, hsa
uuccucgcugcuuaugcccacaggguuuuucuguaugacacaccucagaggagccugugcuuaa

SEQ ID NO: 126685 - RNA, 64 nt, hsa
ggcaggggaaagaaacgcguuaaagggccaugacaugacacaguucccuggccggguuuggacu

SEQ ID NO: 126686 - RNA, 64 nt, hsa
uacaugacacaugucaagaccaaaauaacugugaaugacacaccuugcuguaaaugaacugugc

SEQ ID NO: 126687 - RNA, 64 nt, hsa
acaaccuaguaauaauguggauaaauguaucuacaugacacaugucaagaccaaaauaacugug

SEQ ID NO: 126688 - RNA, 64 nt, hsa
agcagagaugacucagcacugucccuuagcagggaugacacagcaaggaugacucagcacugcc

SEQ ID NO: 126689 - RNA, 64 nt, hsa
ugcagagaugacucagcacugucccuuagcagggaugacacagcaaggaugacucagcacugcc

SEQ ID NO: 126690 - RNA, 64 nt, hsa
agcagggaugacucagcacugucccuuagcagugaugacacagcaaggaugacucagcacugcc

SEQ ID NO: 126691 - RNA, 64 nt, hsa
agcagggaugacucagcagugucccuuagcagcgaugacacagcaaggaugacucagcacugcc

SEQ ID NO: 126692 - RNA, 64 nt, hsa
caguuccuuugaucucgcuguaagauuugucaaggcugacuacucacuucuccuuuaaauucuu

SEQ ID NO: 126693 - RNA, 64 nt, hsa
ucaggaaguucacuguuagaaauaggcuuuguuagcugacuagggucagggaaacuuuucucuu

SEQ ID NO: 126694 - RNA, 64 nt, hsa
uuaugagaaagaggcaugaccugacugcacuguugcugacuacuacucugccaaucggcuaccc

SEQ ID NO: 126695 - RNA, 64 nt, hsa
gcacuacccaugaggaauucguggaauggcuacugcugacuaacaugaugcacauaaccaaaug

SEQ ID NO: 126696 - RNA, 64 nt, hsa
uauguauuuaguguuuuguauaauaccaagaaccgcugacuaaauuuacucaaauuagggcauu

SEQ ID NO: 126697 - RNA, 64 nt, hsa
uauuuucaugcuuuucaaacaacaugaauagucagcugacuaaagacuguguguguugugguaa

SEQ ID NO: 126698 - RNA, 64 nt, hsa
gagccagcacccucagaugauuucccuccaaacugcugacuaggucauccucugucugguagag

SEQ ID NO: 126699 - RNA, 64 nt, hsa
ugggagagccugggcaggaucccaucagaaaggugcugacuaaacugguugcccggacacucaa

SEQ ID NO: 126700 - RNA, 64 nt, hsa
acuuggccuuguggaugggccccuuacaguauuugcugacuagucucauuuuuaggugauaaau

SEQ ID NO: 126701 - RNA, 64 nt, hsa
uaccuuucacagcuuuuaucaggccaaguuaaaggcugacuacauuuuuucaucaugaggaaag

SEQ ID NO: 126702 - RNA, 64 nt, hsa
auauaaauauauuuuuuucuuagacuaaauaugagcugacuaucucuuuugauguguguacaua

SEQ ID NO: 126703 - RNA, 64 nt, hsa
cucccaauagggauaaauuuagggugacuguguggcugacuauucugcuuccucaggcaacacu

SEQ ID NO: 126704 - RNA, 64 nt, hsa
ugucuacagagaaccuggaguuccugaaccugaugcugacuagugaggaaagauuuuuguuguu

SEQ ID NO: 126705 - RNA, 64 nt, hsa
ucucauggguggcacucagucucucuucucuccagcugacuaaacuuuuuuucuguaccaguua

SEQ ID NO: 126706 - RNA, 64 nt, hsa
uuuuccccugaauuacccaucaaauugaucugcagcugacuaaaggccacagcugagccuggaa

SEQ ID NO: 126707 - RNA, 64 nt, hsa
caucaucaauaaaacaguuggcaugcaucccacugcugacuauaaugccucuccuuaaaugcuu

SEQ ID NO: 126708 - RNA, 64 nt, hsa
ugcuacaaaacuugaauauaacacauuuuggaaggcugacuaaccucgauucuguguugugaug

SEQ ID NO: 126709 - RNA, 64 nt, hsa
uuaacuguguuaaaguacuugaaauguauugacugcugacuauauuuuaaaaacaaaaugaaau

SEQ ID NO: 126710 - RNA, 64 nt, hsa
aauaguucaguauaaauugucguuuuuuucuugugcugacuaacuauaagcaugaucuuguuaa

SEQ ID NO: 126711 - RNA, 64 nt, hsa
guaugaugucuuucaaacuuagacauauuugagagcugacuacaaacauuaaaucgcacuuuua

SEQ ID NO: 126712 - RNA, 64 nt, hsa
ugaucuguuuuaaaguuggggggugggaaauuuagcugacuagggacaaacauguaaaccuauu

SEQ ID NO: 126713 - RNA, 56 nt, hsa
cgcuguccacggaccugugagcugcugcugacuagggcugcaugggagagccaggg

SEQ ID NO: 126714 - RNA, 64 nt, hsa
ccugcguaugcacaugcucagaauugucuacuaggcugacuauguaucaccucuucagcuugga

SEQ ID NO: 126715 - RNA, 64 nt, hsa
aaguucccuaugaaaaauguguuccauugccauagcugacuacaaauuaaaguugaggagguuu

SEQ ID NO: 126716 - RNA, 64 nt, hsa
cacugccaggacccaccacuggaagcaggauggagcugacuacggaacugcacacucagugggc

SEQ ID NO: 126717 - RNA, 64 nt, hsa
auuuaaucaugugaaacuuuuccuagaugcaaaugcugacuaauaaagacaaagccacccugaa

SEQ ID NO: 126718 - RNA, 64 nt, hsa
gcuaccugauggaauuccugcacuuaaaguucuggcugacuaaacaagauauaucauuuucuuu

SEQ ID NO: 126719 - RNA, 64 nt, hsa
gauuuuaaugaaacauggauaguuguggccaccugcugacuauuugugguuuaaaauaaaaggu

SEQ ID NO: 126720 - RNA, 64 nt, hsa
ggucuuacaucugugugguauaguagaaaggccagcugacuagaucucuggauucuaauuuugg

SEQ ID NO: 126721 - RNA, 64 nt, hsa
aaaagacaagagaauuugguuauaaaagaaaugggcugacuaggcaugauuuuuuuggucuuaa

SEQ ID NO: 126722 - RNA, 64 nt, hsa
agggguucuuagucucagcacuaugacauuuugggcugacuacuuauuuguuaggcgggagcuc

SEQ ID NO: 126723 - RNA, 64 nt, hsa
cuccacgcccugcccccugcauccccuagagacagcugacuagcagcugcccagcugucaaggu

SEQ ID NO: 126724 - RNA, 64 nt, hsa
aaagaaccguuaagugaacuauuauaauauuuuugcugacuacccaguugaagaaaaguuuguu

SEQ ID NO: 126725 - RNA, 64 nt, hsa
gcagacauuuccaaguuuguugaaauaauacgaagcugacuagcuuacgugaaugauguugccc

SEQ ID NO: 126726 - RNA, 64 nt, hsa
aauucucuguuaucuuuacgagguaaaacugcaagcugacuagcauguucugugaaucugccau

SEQ ID NO: 126727 - RNA, 64 nt, hsa
aagauuccagaugagcuguucaugugggccccuugcugacuauauuccagccacuucaggguug

SEQ ID NO: 126728 - RNA, 64 nt, hsa
caucugugaauggaacugaagugaacgugaauaugcugacuauauccuggaagcauuuuuauac

SEQ ID NO: 126729 - RNA, 64 nt, hsa
ggccacucaacagagaggaccaacauccaguccugcugacuauuugacccccacaacaaugggu

SEQ ID NO: 126730 - RNA, 64 nt, hsa
gggacugagagacaggacuagcuggauuuccuaggcugacuaagaaucccuaagccuagcuggg

SEQ ID NO: 126731 - RNA, 64 nt, hsa
ucccacccaugagggcugcaggcacuacaaaagagcugacuacugagaauucuggaaaacaagg

SEQ ID NO: 126732 - RNA, 64 nt, hsa
ucacagauguguuaauuuuugaagcaaugugggugcugacuacuaguaguaucaaaaauauguu

SEQ ID NO: 126733 - RNA, 64 nt, hsa
cugccauguguuuuuuauuuuguuuuuuagcagugcugacuaagccgaaguuuuguaagguaca

SEQ ID NO: 126734 - RNA, 64 nt, hsa
gagucuauacaaaggcuugcuaaguguguuuccugcugacuacaacccucuccuguuuacugaa

SEQ ID NO: 126735 - RNA, 64 nt, hsa
uugucagaaucuuccuuuggacaaaacaucacuagcugacuauaaaaacaaaagugucaucauu

SEQ ID NO: 126736 - RNA, 64 nt, hsa
agugggaucaaugccggcggccucugugaugguugcugacuaauccgggauuucaugagucaga

SEQ ID NO: 126737 - RNA, 64 nt, hsa
gcaacgugacucuguuuuuuguguguguuuccaugcugacuaguccccuacuguuaauaucacu

SEQ ID NO: 126738 - RNA, 64 nt, hsa
agauggcuacagaccagagauuccacgcucucaggcugacuagaguccgcaucucaucuccaaa

SEQ ID NO: 126739 - RNA, 64 nt, hsa
auucauggaccacuguuucuugcuuguaccucuggcugacuaaauuuggggacagauucagucu

SEQ ID NO: 126740 - RNA, 64 nt, hsa
gacaugguucccuacuagggauuauacaguauuugcugacuacuuccuaagagccaaaaauaaa

SEQ ID NO: 126741 - RNA, 64 nt, hsa
aggaaggccaagccauuacgggagcacagcaugugcugacuacuguacuuccagaccccugccc

SEQ ID NO: 126742 - RNA, 64 nt, hsa
ucaagugcuuaaaauuaauguaauuaaaagcuuagcugacuacagaauaggugaggguuucuua

SEQ ID NO: 126743 - RNA, 64 nt, hsa
uuguaugucugugugccccuccugccccgaaagugcugacuauggggaaaucuuuuagcugcug

SEQ ID NO: 126744 - RNA, 64 nt, hsa
ggugcuggaccaccuggucggggaggagaccauggcugacuaccugcuguacacccucaacaaa

SEQ ID NO: 126745 - RNA, 64 nt, hsa
uacaaauugcaguggcuaggaccuccagcagaaugcugacuauaaguagugauaguggguauuc

SEQ ID NO: 126746 - RNA, 58 nt, hsa
gaccugaguuugugcuguaagacaaaaugcugacuacuguagaaaaaaaggucaugau

SEQ ID NO: 126747 - RNA, 64 nt, hsa
ccugccaggcacaggcagggcaggaccagcccacgcugacuacagggccgccggcaauaaaagc

SEQ ID NO: 126748 - RNA, 64 nt, hsa
ugauggggcugcccucaguccucuagaucaagaugcugacuauuagggggcagugauugccauc

SEQ ID NO: 126749 - RNA, 64 nt, hsa
ucugauccaagcauauuugcuuggggaacuaagugcugacuaguuuguuuucuaugucaagggg

SEQ ID NO: 126750 - RNA, 64 nt, hsa
cuugagcucacuacucaauugugcagcuuaauaugcugacuagggacauuccccuauggauuau

SEQ ID NO: 126751 - RNA, 64 nt, hsa
gggacauauaaacauuaagucuguaguagcagcagcugacuaacgagggagauagggagauucu

SEQ ID NO: 126752 - RNA, 64 nt, hsa
uuauuuaauauuuucuaaucugaacccauauacagcugacuaauucauucuuagaaauguguua

SEQ ID NO: 126753 - RNA, 64 nt, hsa
ugaucauuggcauccugggcguuucuugcccucugcugacuacugauuggauuuuaccuauggc

SEQ ID NO: 126754 - RNA, 64 nt, hsa
caaacagaaagcaccgucgagaaauggcuccagcgcugacuagcggccaccucauuuccccccu

SEQ ID NO: 126755 - RNA, 64 nt, hsa
agguaggggacuaguggaucuuaucauaguuuuggcugacuaugcagggcuuaaaaggccagcg

SEQ ID NO: 126756 - RNA, 64 nt, hsa
cuuuaacuguuagucuuaaauaguugggacaucagcugacuaauagaccucagccucaaaaggc

SEQ ID NO: 126757 - RNA, 64 nt, hsa
ugcuaaaucgauaggagucaguuuugucuuaaaugcugacuacagccacugacaugguuggcug

SEQ ID NO: 126758 - RNA, 64 nt, hsa
ucggauuaacuggaaaauauaucugaauucaacugcugacuauaaaugguauucuaauaaaauu

SEQ ID NO: 126759 - RNA, 64 nt, hsa
cuggcucaggagcucauagauggaggaggugugggcugacuaccucccagaagccccucaugcc

SEQ ID NO: 126760 - RNA, 63 nt, hsa
gguguucuaaaugucuuaagaaccuaauuaaauagcugacuacauuuugugucucuuuuuuua

SEQ ID NO: 126761 - RNA, 64 nt, hsa
guacucagaggguuaacagacaagcacaaggcaugcugacuacauugguguauccagauugcuu

SEQ ID NO: 126762 - RNA, 64 nt, hsa
agcccagcugggauugguguagggagggccgaacgcugacuaguguggccucacugccccaggc

SEQ ID NO: 126763 - RNA, 64 nt, hsa
acgcucuugcuuccuaaugcucuauacaaagagggcugacuauauuucuugaagugguguaaaa

SEQ ID NO: 126764 - RNA, 64 nt, hsa
gaguuuauccuuuccguaaucucuuuuuaacccugcugacuauuacagggcuuguuuaaucaca

SEQ ID NO: 126765 - RNA, 64 nt, hsa
ggccauuuggccggcucugguggccacugagcuggcugacuaagccccgucugaccccagccca

SEQ ID NO: 126766 - RNA, 64 nt, hsa
cuuuaauauaauauuauacugcuauauuuaaaaagcugacuacuugauauaauuacuuaaugug

SEQ ID NO: 126767 - RNA, 64 nt, hsa
acacaguagauuuuugacaaacaguggcugcucugcugacuaucuuuuaggaauucaggaagca

SEQ ID NO: 126768 - RNA, 64 nt, hsa
cuggcccagucccagguuggagucccucugcauagcugacuacucaugcauugcucaaagcugg

SEQ ID NO: 126769 - RNA, 64 nt, hsa
gauggggguggcaagggggagacgggugggggucgcugacuauagacuguagcugggaggaggg

SEQ ID NO: 126770 - RNA, 64 nt, hsa
cuugagccacauguauuucuguauuuaaagaauugcugacuaacuuucagguaaccagacccau

SEQ ID NO: 126771 - RNA, 64 nt, hsa
ugggcgaagcuaacaucggugccuccccgaccuugcugacuaggcacaugggacgcaaaggagg

SEQ ID NO: 126772 - RNA, 64 nt, hsa
auaggucccuggcauccugguucauaucuguguugcugacuacagugucugugauguccgcaug

SEQ ID NO: 126773 - RNA, 64 nt, hsa
accaggagucacugagccaaugacuuuaccagcugcugacuaaucuucaucaccacuguagauu

SEQ ID NO: 126774 - RNA, 64 nt, hsa
gcaccccacccccaccaaccaggggagccacuaagcugacuaacaacuguccccucacccacca

SEQ ID NO: 126775 - RNA, 64 nt, hsa
ccccacucuugcccaugggugacucuuacccacagcugacuagggccagcgcaaauacuggaac

SEQ ID NO: 126776 - RNA, 64 nt, hsa
auugauggaaguguaggguuuaugaauuauugcagcugacuaccauaccucacacagcguuggu

SEQ ID NO: 126777 - RNA, 64 nt, hsa
acugcaggcccacaguuguagaccauucuucugugcugacuauuaggacacauggagugggauu

SEQ ID NO: 126778 - RNA, 64 nt, hsa
cuacaggcaguggaccuuggcccggcagcaccacgcugacuauagcaaccagcuggacccggcc

SEQ ID NO: 126779 - RNA, 64 nt, hsa
agcugggacaaacugcguuuggagcugugguuaagcugacuaaggaggcgguggcucuuucuua

SEQ ID NO: 126780 - RNA, 64 nt, hsa
guuaugaugacucuugauaacuuguuaaucuguugcugacuagcauuagacuguuacacgaaga

SEQ ID NO: 126781 - RNA, 64 nt, hsa
cucauuuuucagucuuacagaagauugugugaaggcugacuauacauaaagugacuggaauuuu

SEQ ID NO: 126782 - RNA, 64 nt, hsa
aguguuucauuuugaacacauuuuggauuauuaagcugacuaagcaaugaucuaauacacauuu

SEQ ID NO: 126783 - RNA, 64 nt, hsa
cagcuuccuggacaagaucgacgugaucaagcaggcugacuaugugccgagcgaucaggugugc

SEQ ID NO: 126784 - RNA, 64 nt, hsa
aggaaggagagccugcugcauggggugggguagggcugacuagaagggccaguccugccuggcc

SEQ ID NO: 126785 - RNA, 64 nt, hsa
ucccaugggaguggcuuuccauuuugggcagaaugcugacuaguagacuaacauaaaagauaua

SEQ ID NO: 126786 - RNA, 64 nt, hsa
caccgcguuucauucuauuggucaauuccauguggcugacuaggucaauuuuuuuucugaacaa

SEQ ID NO: 126787 - RNA, 64 nt, hsa
uucaaacuaccugguuaaccaaaauacaaaagcagcugacuaugugugauuucauaauagcaca

SEQ ID NO: 126788 - RNA, 64 nt, hsa
ucaauggugcuacuauauaugaucaagauaacaugcugacuaguaaccaugaagauucagaugu

SEQ ID NO: 126789 - RNA, 64 nt, hsa
auagcacuuuaccuuuugguuggcuagauaaguggcugacuaccuguuuuucucacuguggugu

SEQ ID NO: 126790 - RNA, 64 nt, hsa
ugccauuuucuucccagaaauauguaauccccuggcugacuaggacuguuaaacauagugugga

SEQ ID NO: 126791 - RNA, 64 nt, hsa
gagcuagaaggaaaagcuuuuaagucucauguuugcugacuauaaaaauaaaucauaguaauaa

SEQ ID NO: 126792 - RNA, 64 nt, hsa
ccacugaggagcagguaaaugggagagguuuccagcugacuagaacccucuuuucuacucgucc

SEQ ID NO: 126793 - RNA, 64 nt, hsa
ccuguuuugaaugccaaacccaccauucacuggugcugacuacauagaaugggguugagagaag

SEQ ID NO: 126794 - RNA, 64 nt, hsa
ccgagagccacacagauuugacuuucucuagagagcugacuaaugaugaacggaagcaaauaca

SEQ ID NO: 126795 - RNA, 56 nt, hsa
cuaaggccgauggucagugagaggaagcugacuagccccuggauucuucuccagac

SEQ ID NO: 126796 - RNA, 64 nt, hsa
ggagcuagaaggaaaagcaugaagucucauguuugcugacuauaaaaauaaaucauaguaauaa

SEQ ID NO: 126797 - RNA, 64 nt, hsa
ccugugggcaucagacucagcgugggcugagugcugaguguaacuuacacuccuaaaucaagcu

SEQ ID NO: 126798 - RNA, 64 nt, hsa
cacucccgccaucugcugcaggcaggaaggcaugugaguguacguuuucuuccaggagacauca

SEQ ID NO: 126799 - RNA, 64 nt, hsa
aacaauuuagaauggauauuuugacgaaucggcaugaguguaacagugauaaccugaucuguuu

SEQ ID NO: 126800 - RNA, 64 nt, hsa
uuuaaagugccacauuuggcaguacaaaugagucugaguguaauagcccagagauuuauauaua

SEQ ID NO: 126801 - RNA, 64 nt, hsa
uacaugaaaaaucuuacacuggagagaaacccuaugaguguaagcaaugugggaaagccuuugu

SEQ ID NO: 126802 - RNA, 64 nt, hsa
aucaugaaaggacucacacuggagagaaccccuaugaguguaagcaauuugggaaagccuucag

SEQ ID NO: 126803 - RNA, 64 nt, hsa
aucaugaaaggacucacaugggagagaaacccuaugaguguaugccaagugggaaagccuucau

SEQ ID NO: 126804 - RNA, 64 nt, hsa
aucaugaaaggacucacacuggagagaaacccuaugaguguaagcaaugugggaaagccuucag

SEQ ID NO: 126805 - RNA, 64 nt, hsa
aaggcaugguaggacucacuggagagaaacccuaugaguguaaggaaugugggaaagccuucag

SEQ ID NO: 126806 - RNA, 64 nt, hsa
accaugaaaggacucacacuggagagaaacccuaugaguguaagcaaugugggaaagccuucag

SEQ ID NO: 126807 - RNA, 64 nt, hsa
uccaugguagaacucacacuggagagaaacccuaugaguguaaggaaugugggaaagccuucag

SEQ ID NO: 126808 - RNA, 64 nt, hsa
uaccugaaaaaucuuacacuggagagaaacccuaugaguguaagcaaugugggaaagccuuuau

SEQ ID NO: 126809 - RNA, 64 nt, hsa
aacaugaaaggacucacacuggagagaaacccuaugaguguaagcaauguggaaaaaccuucag

SEQ ID NO: 126810 - RNA, 64 nt, hsa
cagggagaacuuacaggauguuagagacaaaacaagcagacaccugaaacaaucaacgcccaau

SEQ ID NO: 126811 - RNA, 64 nt, hsa
uucacucauagaaacauuauuaauugguaggguaagcagacacucugaaacaaugagaaaaaua

SEQ ID NO: 126812 - RNA, 64 nt, hsa
ucugcuucugagcaaauggcucaaguucuaccagagcagacagucacccuacuuuucagcagca

SEQ ID NO: 126813 - RNA, 64 nt, hsa
uugauggaucacguaaaacugaaaggcagcggggagcagacaaagaugaggucuacacuguccu

SEQ ID NO: 126814 - RNA, 64 nt, hsa
ggcagggagcccuucuccccacagagcuuucaggagcagacaguggccuccccuuccccucccu

SEQ ID NO: 126815 - RNA, 64 nt, hsa
aagguggcaggagaggcuuuggggaggaucagccagcagacaugagcacugcuggcccgugugg

SEQ ID NO: 126816 - RNA, 64 nt, hsa
gccuccgcaggaacccccaaagugcagauuccggagcagacacauccgggcggagagacucagc

SEQ ID NO: 126817 - RNA, 64 nt, hsa
auuccggagcagacacauccgggcggagagacucagcagacaagugcugcaguugcacgguggg

SEQ ID NO: 126818 - RNA, 64 nt, hsa
guucuagcagacacugacugcgcaccugcucuguagcagacacggaagaguccaagggagcagc

SEQ ID NO: 126819 - RNA, 64 nt, hsa
ccaggcauccuggguuucaccagugacgcguucuagcagacacugacugcgcaccugcucugua

SEQ ID NO: 126820 - RNA, 64 nt, hsa
gcgagggccgggagacagauacuuggcugugaugagcagacauccucuguccccguggaggggu

SEQ ID NO: 126821 - RNA, 64 nt, hsa
acaccaaagaugaggguagcgagcaacuggcuugagcagacagaacggggaagacuccacucug

SEQ ID NO: 126822 - RNA, 64 nt, hsa
cgccaggucccagggaagucuugcacagacucuuagcagacaagcagggaaaagagaggguccu

SEQ ID NO: 126823 - RNA, 64 nt, hsa
uguccagcauaaggagccccagaguucuuucaccagcagacagauucuccauguguuuucccac

SEQ ID NO: 126824 - RNA, 64 nt, hsa
cagcaccguucugugcacaaaacccagaccuguuagcagacaggccccgugaggcaaugggagc

SEQ ID NO: 126825 - RNA, 64 nt, hsa
gccucccaaaugagccaugagaugauacauccaaagcagacagcuccacccuggccgaguccaa

SEQ ID NO: 126826 - RNA, 64 nt, hsa
gccccgucucaccuucuuuaccucaggagccaggagcagacagcaauacuucguccacaccugg

SEQ ID NO: 126827 - RNA, 64 nt, hsa
ccuggcugacccugagcucucgcaguuggagggaagcagacagacuugacuuuuugcaaguccg

SEQ ID NO: 126828 - RNA, 64 nt, hsa
aaccuccccuuacccugaaccgugugacucugcaagcagacaccucgaggcagguguucuaggc

SEQ ID NO: 126829 - RNA, 64 nt, hsa
agaagccgaaauuccuagaaaucagguuucuacugcuaggcaauugaaguauaaacuauuuuau

SEQ ID NO: 126830 - RNA, 64 nt, hsa
augucagcaauaugaaggauguuauggaaggcgugcuaggcauucaauuccugcagaaaccgga

SEQ ID NO: 126831 - RNA, 64 nt, hsa
gcuuuaaauuacuuuuuggauuguagccaguucagcuaggcaaaagccauacuuuucacaauua

SEQ ID NO: 126832 - RNA, 64 nt, hsa
caugggccaggccaggcacuguuuuguggcccaugcuaggcaguggcugcuccaugagcccuuu

SEQ ID NO: 126833 - RNA, 64 nt, hsa; identical to SEQ ID NO: 85128

SEQ ID NO: 126834 - RNA, 64 nt, hsa; identical to SEQ ID NO: 85129

SEQ ID NO: 126835 - RNA, 64 nt, hsa; identical to SEQ ID NO: 85130

SEQ ID NO: 126836 - RNA, 58 nt, hsa; identical to SEQ ID NO: 85131

SEQ ID NO: 126837 - RNA, 64 nt, hsa; identical to SEQ ID NO: 85132

SEQ ID NO: 126838 - RNA, 64 nt, hsa; identical to SEQ ID NO: 85133

SEQ ID NO: 126839 - RNA, 64 nt, hsa; identical to SEQ ID NO: 85134

SEQ ID NO: 126840 - RNA, 64 nt, hsa; identical to SEQ ID NO: 85135

SEQ ID NO: 126841 - RNA, 64 nt, hsa; identical to SEQ ID NO: 85136

SEQ ID NO: 126842 - RNA, 64 nt, hsa; identical to SEQ ID NO: 85137

SEQ ID NO: 126843 - RNA, 64 nt, hsa; identical to SEQ ID NO: 85138

SEQ ID NO: 126844 - RNA, 64 nt, hsa; identical to SEQ ID NO: 85139

SEQ ID NO: 126845 - RNA, 64 nt, hsa; identical to SEQ ID NO: 85140

SEQ ID NO: 126846 - RNA, 64 nt, hsa; identical to SEQ ID NO: 85141

SEQ ID NO: 126847 - RNA, 64 nt, hsa; identical to SEQ ID NO: 85142

SEQ ID NO: 126848 - RNA, 64 nt, hsa; identical to SEQ ID NO: 85141

SEQ ID NO: 126849 - RNA, 64 nt, hsa; identical to SEQ ID NO: 85144

SEQ ID NO: 126850 - RNA, 64 nt, hsa; identical to SEQ ID NO: 85145

SEQ ID NO: 126851 - RNA, 64 nt, hsa; identical to SEQ ID NO: 85146

SEQ ID NO: 126852 - RNA, 64 nt, hsa; identical to SEQ ID NO: 85147

SEQ ID NO: 126853 - RNA, 64 nt, hsa; identical to SEQ ID NO: 85148

SEQ ID NO: 126854 - RNA, 64 nt, hsa; identical to SEQ ID NO: 85149

SEQ ID NO: 126855 - RNA, 64 nt, hsa; identical to SEQ ID NO: 85150

SEQ ID NO: 126856 - RNA, 64 nt, hsa; identical to SEQ ID NO: 85151

SEQ ID NO: 126857 - RNA, 64 nt, hsa; identical to SEQ ID NO: 85152

SEQ ID NO: 126858 - RNA, 64 nt, hsa; identical to SEQ ID NO: 85153

SEQ ID NO: 126859 - RNA, 64 nt, hsa; identical to SEQ ID NO: 85154

SEQ ID NO: 126860 - RNA, 64 nt, hsa; identical to SEQ ID NO: 85155

SEQ ID NO: 126861 - RNA, 53 nt, hsa
gcagucugcccaaaauuuaaggggacaaguagcuccccccacgacaugucucc

SEQ ID NO: 126862 - RNA, 64 nt, hsa
aucucccaggauuccuguugcuuuacccacaacagacaaguaauugucuaaguguuuuucuucg

SEQ ID NO: 126863 - RNA, 64 nt, hsa
aggcucagaccccucccugcccuucagagcucaagacaaguaauacacccaggucuugacugca

SEQ ID NO: 126864 - RNA, 64 nt, hsa
agaaauaacccagaugcccaugagcaagagaguggacaaguaaacuggaauauucacauaauag

SEQ ID NO: 126865 - RNA, 64 nt, hsa
gaaagugucugggcuucuucugggguuccacccugacaaguagggucacagaggcuggugcaca

SEQ ID NO: 126866 - RNA, 64 nt, hsa
cauuaccacauguagccuuggagacccaggcaaggacaaguacacguguacucacagagggaga

SEQ ID NO: 126867 - RNA, 64 nt, hsa
ccuugaaggucuggcaaucccuguucuuucauuugacaaguacuuacugaguacucacuauaua

SEQ ID NO: 126868 - RNA, 64 nt, hsa
cugguuuucguucaagauauucuugguaguaacugacaaguauguugcacauguauugggggag

SEQ ID NO: 126869 - RNA, 64 nt, hsa
cugccgaugcccuguccacugccuacacaugacagacaaguaacccccucaugggggaugggga

SEQ ID NO: 126870 - RNA, 64 nt, hsa
cauuuuaucuucauuaucccugugaaguaggugggacaaguauaaggggaagaggggugcugaa

SEQ ID NO: 126871 - RNA, 64 nt, hsa
cugugagucaaagaaaagguccuuuucagggagugacaaguaguaauuaggcugaguugggugg

SEQ ID NO: 126872 - RNA, 64 nt, hsa
ccauccaccagucuauuuauuaacuuagcaagaggacaaguaaagggcccucuuggcuugauuu

SEQ ID NO: 126873 - RNA, 64 nt, hsa
acauuauacaaaaguuuauaauuugccacaucuggacaaguaacuuucuucuuuuguucauagg

SEQ ID NO: 126874 - RNA, 64 nt, hsa
cuuccagcuuuuacgagugagccaaaaacagaaggacaaguacaacugugcuggccugcuguac

SEQ ID NO: 126875 - RNA, 64 nt, hsa
ucauuuacucacauugagcuaacuuuaaauuacugacaaguagaaucaaaggugcagcugacug

SEQ ID NO: 126876 - RNA, 64 nt, hsa
uggcauaugccacauaaaaaaugaaccugauauagacaaguacuaccuuuucaaauucugaaag

SEQ ID NO: 126877 - RNA, 64 nt, hsa
aaaggcccuccuuugagcuacaaacaucugguaagacaaguacauccacucaugaaugcagaca

SEQ ID NO: 126878 - RNA, 53 nt, hsa
auuccacucaacagauguagugugacaaguauaauaugugcaauaaucauugu

SEQ ID NO: 126879 - RNA, 64 nt, hsa
uggcacaggcauuaucucugcaauuuuagaaaaugacaaguagagaauacuacauugagaaacu

SEQ ID NO: 126880 - RNA, 64 nt, hsa
acaaaguuucagaguauauuguugaagagacagagacaaguaauuucaguguaaagugugugau

SEQ ID NO: 126881 - RNA, 64 nt, hsa
cuggaaauuaaaccaauuuccugcauuaagcugagacaaguauauauacagcccuauacaguuu

SEQ ID NO: 126882 - RNA, 64 nt, hsa
auccucauggcaagguuaauauguugguguucuugacaaguaccaggcuuucucagccacaacc

SEQ ID NO: 126883 - RNA, 64 nt, hsa
ccuauauuuucgccauuuuacaauggagaguugugacaaguacagguuaucaaguuugcacuua

SEQ ID NO: 126884 - RNA, 64 nt, hsa
ggcggguaaauuaggaaucugcacuauuuuggaggacaaguagcacaaacuguauaacgguuua

SEQ ID NO: 126885 - RNA, 64 nt, hsa
aacaaagaucuguucugcuguaagaguuaaaauggacaaguauugauaucaaugcaguaugaac

SEQ ID NO: 126886 - RNA, 64 nt, hsa
cugccgaacucaaugcagugagaagagggacagggacaaguaguccuugaaacugagccccauu

SEQ ID NO: 126887 - RNA, 64 nt, hsa
ccguucuaaaaguuuauuuacaauaucaaaaucugacaaguaaaucagcauuguuguuugguuc

SEQ ID NO: 126888 - RNA, 64 nt, hsa
aagauuuuuguucaauacauuuuagauuaggauugacaaguaaagauacugcuauggaaugaua

SEQ ID NO: 126889 - RNA, 64 nt, hsa
gauaguugacugaguuucuuuagggcauugaauagacaaguaaagcuaaugaauuuaaaagccu

SEQ ID NO: 126890 - RNA, 64 nt, hsa
gacauugaaggcuuauuuuccccaauggcuuuuugacaaguauaaagcuauuauuacauuguau

SEQ ID NO: 126891 - RNA, 64 nt, hsa
uucucugaagacaaccaagagaaaauugcaaaaagacaaguaugacuuuuauaugaaccccuuc

SEQ ID NO: 126892 - RNA, 64 nt, hsa
cuguaccagugcucuaaauaacaaaagcuagggugacaaguacauguuccuuuuggaaagaagc

SEQ ID NO: 126893 - RNA, 64 nt, hsa
uuaaaaccuucauaucuagguauccauugugacagacaaguaaaauugcaggugauuugauaau

SEQ ID NO: 126894 - RNA, 64 nt, hsa
aauaauauaagucuuagagaucauuuuauaucaugacaaguagagcuaccucauucuuuuuaau

SEQ ID NO: 126895 - RNA, 64 nt, hsa
aaugugguuauugaaaaccuaauagcugccucaugacaaguacauguuauuuaaggaggaaaaa

SEQ ID NO: 126896 - RNA, 64 nt, hsa
uaguuuucaagccuuuuuuuucugcuaacauucagacaaguaacaggcaacaaagauuuaagaa

SEQ ID NO: 126897 - RNA, 64 nt, hsa
uguuaauauauucggcccauauuuuguguguuuggacaaguacaucucccuuuugccuaaugaa

SEQ ID NO: 126898 - RNA, 64 nt, hsa
agagagaaaaaaauaaaccaauaaccuaccuacugacaaguaaauuuauacaggacugaaaacc

SEQ ID NO: 126899 - RNA, 64 nt, hsa
ucuacuuuuucuagcuacaauaucuucauacaaugacaaguaugaugauuugcuaucaaaauaa

SEQ ID NO: 126900 - RNA, 64 nt, hsa
agagcauagauucuauaaauucuuacuugucuaagacaaguaaaucuguguuaaacaaguagua

SEQ ID NO: 126901 - RNA, 64 nt, hsa
gagaauggcaugguaggcuacuuuucagggccuugacaaguacaucacccagugguauccuaca

SEQ ID NO: 126902 - RNA, 64 nt, hsa
gggccacugccaucccuuccugugugcucuuuuugacaaguaaaucacuccaguuagcugaugu

SEQ ID NO: 126903 - RNA, 64 nt, hsa
gugauggacuucacaacaacuagccaggaagggugacaaguaccuucugccuccuccauucuuc

SEQ ID NO: 126904 - RNA, 64 nt, hsa
cuccgagccucuguuucuccaaguguaagaugaggacaaguauaaaaccuccuuuauggguuug

SEQ ID NO: 126905 - RNA, 64 nt, hsa
ucaggccauguauuaacagaugccagugcgcucugacaaguauuccaaaguguucuguagcuag

SEQ ID NO: 126906 - RNA, 64 nt, hsa
cugugucccagauugugacccuagacuuucaauugacaaguaaaaaauugacuuuacuagacau

SEQ ID NO: 126907 - RNA, 64 nt, hsa
ucugcagcagaugcuuuugguccagguacugagggacaaguagaaagauuugaaacaguuggca

SEQ ID NO: 126908 - RNA, 64 nt, hsa
uuuguaacagugugaucuuuacugaugcacucaugacaaguacccaauguauuuuagcuauuuu

SEQ ID NO: 126909 - RNA, 64 nt, hsa
ccccacccccacuuacuauaguucugugauccuggacaaguaacugaaucucuccgugccacag

SEQ ID NO: 126910 - RNA, 64 nt, hsa
gaaccacugauuuuaauuugccuaauuaucuuaugacaaguaucaaauuaagaugacacuuaaa

SEQ ID NO: 126911 - RNA, 64 nt, hsa
ggaaggcaaaaagaucuuaagauucaagagagaggacaaguaguuauggcuaaggacaugaaau

SEQ ID NO: 126912 - RNA, 64 nt, hsa
uaugccuaaauaacaguauucuuaaaaucugacagacaaguaacaugucaauuacuugauauuc

SEQ ID NO: 126913 - RNA, 64 nt, hsa
guguuuaaauuaaaauagaaaaauaagggcucaugacaaguacauuauuugauucuacuuagga

SEQ ID NO: 126914 - RNA, 64 nt, hsa
auuuauacagaaaguggcuauugacuuucuauuugacaaguaguuauaauuggcaagcaguuug

SEQ ID NO: 126915 - RNA, 64 nt, hsa
aacucauugucuguuuggaagaccagaaugugaagacaaguaguagaagaaaaugaaugcugcu

SEQ ID NO: 126916 - RNA, 64 nt, hsa
guuggguuccaaauuugcauuuuauuuggaaacagacaaguagaagaugcuacagaaaaguauu

SEQ ID NO: 126917 - RNA, 64 nt, hsa
agaaaaccacugcaacagacucauugaagaaaaugacaaguaucaaagacauuuaggcaacuua

SEQ ID NO: 126918 - RNA, 64 nt, hsa
ucauagccuguggucuccacauaaacagcaacaagacaaguaauaguccuuuuuuuguuuguuu

SEQ ID NO: 126919 - RNA, 64 nt, hsa
aggagagagucuaagauaaaagcuuaggcugauagacaaguaguuaagagcuaagagcaguacu

SEQ ID NO: 126920 - RNA, 64 nt, hsa
guuauucaaaauuauacaguuuucaaaaaaucaagacaaguaggcccaauacaaacuacugaau

SEQ ID NO: 126921 - RNA, 64 nt, hsa
ugccaguugcugguuguacacucgaacgaagacugacaaguauccucaucaugaugugacucac

SEQ ID NO: 126922 - RNA, 64 nt, hsa
uguagaguuucuaugugccuacauacauuucugugacaaguauuugucguaaauuaauuuuaau

SEQ ID NO: 126923 - RNA, 64 nt, hsa
uucguaacagaagggaggggaaagcgcagcuacugacaaguagaacacugcuacuuuuuuuaag

SEQ ID NO: 126924 - RNA, 64 nt, hsa
uguguguauuuuuuuaaaugaaaacucaaaauaagacaaguaauuuguugauaaauauuuuuaa

SEQ ID NO: 126925 - RNA, 64 nt, hsa
aaaccaaaacggaagaggagaaacucaauacaaagacaaguacaacuccauuagaaaaauucag

SEQ ID NO: 126926 - RNA, 64 nt, hsa
acaagaccacaugguauaacaauacuagacuauagacaaguaaaaauuuauaaauauuaagaau

SEQ ID NO: 126927 - RNA, 64 nt, hsa
uaccguuuugucuauaagauacacaaguauaaaugacaaguacaaauaacaaugaauguuuaau

SEQ ID NO: 126928 - RNA, 64 nt, hsa
uccuucugugacuuaacuuuguaaaggggauauggacaaguaaguaacacgcaucgcugucccg

SEQ ID NO: 126929 - RNA, 64 nt, hsa
cauaaauaguuaucauuuuaauugcaauaacacagacaaguaguuaaugaugauaacaauggug

SEQ ID NO: 126930 - RNA, 64 nt, hsa
aauucugugguugguguuccucuguagauuucaagacaaguagugaugucauuuucucccugag

SEQ ID NO: 126931 - RNA, 64 nt, hsa
ucauggaaaggugccaaacuguuuugaauggaaggacaaguaagagugaggccacaguucccac

SEQ ID NO: 126932 - RNA, 64 nt, hsa
uuuugcaaacccaacuaagccaggaccccaaugcgacaaguaguucaugaguauuccuagcaaa

SEQ ID NO: 126933 - RNA, 64 nt, hsa
aagucauaucugucuuugcacaaauguaccaaucgacaaguauauuuuauauauuccauaaaaa

SEQ ID NO: 126934 - RNA, 64 nt, hsa
aaaacaccagaaguuugguuaacuugggcaauaugacaaguauuacuuuuugggcaaaacuacu

SEQ ID NO: 126935 - RNA, 64 nt, hsa
uuucacuucaaggcucaaugcuauucuaacuaaugacaaguauuuucuacuaaaccagaaauug

SEQ ID NO: 126936 - RNA, 64 nt, hsa
uaauguuucaugauuucuaccuccaaagugugaagacaaguaaaacaauguuucuaaauugucu

SEQ ID NO: 126937 - RNA, 64 nt, hsa
aggguugaugcuuacugaccuggugauguuagaagacaaguaguuuauggauuuaaacauuaga

SEQ ID NO: 126938 - RNA, 64 nt, hsa
augcugccaggggcagugaaguguuuaggugaaggacaaguagguaagaggacgccuucaggca

SEQ ID NO: 126939 - RNA, 64 nt, hsa
gcgccuuugucugucuaucuggugacaagagagagacaaguaaaugggggccguugggacggcg

SEQ ID NO: 126940 - RNA, 55 nt, hsa
acaaaccuuaccucagcugaaaauggacaaguauuuucaaugacugaaauauagc

SEQ ID NO: 126941 - RNA, 64 nt, hsa
gcugggacugccuggagauuugucaggagcugcagacaaguaccuuggagcauucuguuauuuu

SEQ ID NO: 126942 - RNA, 64 nt, hsa
cuucagagacagggacucuuuuuggaucucuauugacaaguaauaaaagucuggcccucauaac

SEQ ID NO: 126943 - RNA, 64 nt, hsa
ugccuggucuaguagcggaucucacucagccgcagacaaguaaucacuaacccguuuuauucua

SEQ ID NO: 126944 - RNA, 64 nt, hsa
ugccuguuagacaugacugaugacauaucugaaagacaaguauguugagaguugcugguguaaa

SEQ ID NO: 126945 - RNA, 64 nt, hsa
auaacucaaucaaaauuuuuaucuuuaaaucugagacaaguauuauauuuaaaacuagaucuau

SEQ ID NO: 126946 - RNA, 64 nt, hsa
uauaagagaacuuucggagccugccuccuucagugacaaguagggcacaaaauucuagaagcag

SEQ ID NO: 126947 - RNA, 64 nt, hsa
agaaucuguggcugggagaaaauuucaucaaauagacaaguaaaaggcucaucaguuuuagcau

SEQ ID NO: 126948 - RNA, 64 nt, hsa
agcacauucacugacaugauauuauuugcagauugacaaguaggaaguggggaauuuuauuaag

SEQ ID NO: 126949 - RNA, 64 nt, hsa
aaauguacgauagguagaauugugguucccuaaagacaaguacauaaaggugacccugaugaaa

SEQ ID NO: 126950 - RNA, 64 nt, hsa
uggguccuagaccaggacuuccugugugacccuggacaaguacuaccuuccugggccucagcuu

SEQ ID NO: 126951 - RNA, 64 nt, hsa
aaaacaauguugggcacaaagaaaauuuagaucugacaaguauaauuuucuaaagacauuauuu

SEQ ID NO: 126952 - RNA, 64 nt, hsa
acacuugucagccucagagcauuuaaggaaacuagacaaguaaaauuauccucuuuguaauuua

SEQ ID NO: 126953 - RNA, 64 nt, hsa
uaguugaaacaguaggauagauauuugucaucuugacaaguagcccuuugcaauuuauacuuga

SEQ ID NO: 126954 - RNA, 64 nt, hsa
auucuuuagaauucuauaauucauagcaauuuuugacaaguaagauugcaaaauagaaauaucu

SEQ ID NO: 126955 - RNA, 64 nt, hsa
ucaacagaaugguuuaaguaguaccaggaaguaggacaaguaauuucaaaaauauaaagguguu

SEQ ID NO: 126956 - RNA, 64 nt, hsa
gaggaaaugacugugccuggaacaggaugaaauagacaaguagagauuuaauuagcaaaaauuu

SEQ ID NO: 126957 - RNA, 64 nt, hsa
ccgcuuugugagaugaauacuuccugagaaacuugacaaguaucucuccauuuuaccauuauga

SEQ ID NO: 126958 - RNA, 64 nt, hsa
cuaaucugcaacagccuucugauggccaugaaaggacaaguauggagaugaaagcuaucacacu

SEQ ID NO: 126959 - RNA, 64 nt, hsa
gacuuggccccagacgcauagacugagguauaaagacaaguaugaauauuacucucaaaaucuu

SEQ ID NO: 126960 - RNA, 64 nt, hsa
cuucagaaacaaaucucagaagacaagcugaccugacaaguacuaugugugugcaugucuguau

SEQ ID NO: 126961 - RNA, 64 nt, hsa
gccuuguaaacagcucacugucuaauacucgaaggacaaguaacaauuuauauuggaugagagu

SEQ ID NO: 126962 - RNA, 64 nt, hsa
aaagucauaguuuuuuucuuuuuuaauugaaagggacaaguaucaucuaaauauuaugccuuga

SEQ ID NO: 126963 - RNA, 64 nt, hsa
ugugucugugauggugagaauucccaagggcucugacaaguagauucuucgacugaggaaucua

SEQ ID NO: 126964 - RNA, 64 nt, hsa
cugagguggugauuuggccaguguuuuaacuugugacaaguacucaggugugaggacaagaaug

SEQ ID NO: 126965 - RNA, 64 nt, hsa
uccugaccacgauagaacugcuccugugguuugggacaaguaauaaaacaacugcuugaguuuu

SEQ ID NO: 126966 - RNA, 64 nt, hsa
gaggcccuucuaccaggguccggugggcgacccugacaaguaccgccugucucaggaugaccgc

SEQ ID NO: 126967 - RNA, 64 nt, hsa
agauaaugucuauauauuggccaaacuggugcaugacaaguacuguauuuuuuuauaccuaaau

SEQ ID NO: 126968 - RNA, 64 nt, hsa
gauucacugcuuucucugucuagaacagacgggugacaaguaugggcaggaggcauggggcagg

SEQ ID NO: 126969 - RNA, 64 nt, hsa
gccccgacacaggcagccuggagaagcugggcaggacaaguaggacaucccuggagccuccaga

SEQ ID NO: 126970 - RNA, 64 nt, hsa
cuuaguccuggguuuuugaaaaagugcuaaaacggacaaguagaauaaauguugcuguggaaug

SEQ ID NO: 126971 - RNA, 64 nt, hsa
aggaaggaggcuggaauaaauaaaaauaaaaauagacaaguaagacagcauaaauaauacauuu

SEQ ID NO: 126972 - RNA, 64 nt, hsa
cuggagccaagaagaguaacaagccaaaugaacagacaaguaaaagacaugacagcgauacuuu

SEQ ID NO: 126973 - RNA, 64 nt, hsa
aauuggaaggcaaauuuuuguccaaaaaccuacagacaaguacuuugagagaauuuccaauaua

SEQ ID NO: 126974 - RNA, 64 nt, hsa
ugaugacugaacuucagggugaacuugguuuuuggacaaguacaaacaauuucaacugauauuc

SEQ ID NO: 126975 - RNA, 64 nt, hsa
uaaaugcgguagauucaaacaaagaugcucuguagacaaguagaauuaaaccugcgaauccgug

SEQ ID NO: 126976 - RNA, 64 nt, hsa
cauguagccacaucucuccacuucuugccuuuuggacaaguagacaugauuucuagaccuagag

SEQ ID NO: 126977 - RNA, 64 nt, hsa
guauuuugaugccaaggagcgggcagcagccaaagacaaguaucagcuagguaccugcuucccu

SEQ ID NO: 126978 - RNA, 64 nt, hsa
gauccgugcccuugcuucugacuuucgccucugggacaaguaagucaaugugggcaguucaguc

SEQ ID NO: 126979 - RNA, 64 nt, hsa
uggcaauaggugugaacagggaacucagaauacagacaaguagaaagauucucgcuuaaaaaaa

SEQ ID NO: 126980 - RNA, 64 nt, hsa
uguaauuauacugaaggaguacaccugugagagagacaaguaccugauuuggaagccccaacau

SEQ ID NO: 126981 - RNA, 64 nt, hsa
caggaaugggagugagaacauucacuuuuugaaggacaaguauaugugggucuaugaugauguu

SEQ ID NO: 126982 - RNA, 64 nt, hsa
ucaucacuuccuuugugcgcuuccugccuuaagugacaaguagcaacauggcuuggguccccug

SEQ ID NO: 126983 - RNA, 64 nt, hsa
gaguucuauaauauaagcugccauauauuuuguagacaaguauggcuccuccauaucucccucu

SEQ ID NO: 126984 - RNA, 64 nt, hsa
auuugcucaccauuugauauauaaugaauuauaggacaaguauaagcugaucugcuauagcugu

SEQ ID NO: 126985 - RNA, 64 nt, hsa
uuauguggguggcuucuaguuugcaacuucaagggacaaguauuaauaguucaguguauggcgu

SEQ ID NO: 126986 - RNA, 64 nt, hsa
cuaucuccuaacuuuggaccuauuaucagaaggugacaaguacuggcucuuuauucauuaagcu

SEQ ID NO: 126987 - RNA, 64 nt, hsa
auguugcuuuaucaguauaugcuuagcuguaagugacaaguauuuuuucugaacagaaguuuac

SEQ ID NO: 126988 - RNA, 60 nt, hsa
agagagaccuaaaaaccugaagaggaaggggacaaguagccaccugaguuccugagguga

SEQ ID NO: 126989 - RNA, 64 nt, hsa
acucagagagcccagggcaacugccaagcagggggacaaguauucuggcggggggugggggaga

SEQ ID NO: 126990 - RNA, 64 nt, hsa
auuuuggggcagcuuuccgguuauauaacacauugacaaguauauguauuaagaguccuugcau

SEQ ID NO: 126991 - RNA, 64 nt, hsa
uucccaagucuguccucucaauuucaccugcauugacaaguauuaauugaaccccaacuguaua

SEQ ID NO: 126992 - RNA, 64 nt, hsa
agccacuggguggaggggcagggaggcaaaaugagacaaguagccuugguuagucuuagaguug

SEQ ID NO: 126993 - RNA, 64 nt, hsa
aggggcaguuuuguuugccugaauaaacguaaaggacaaguaaacaauuugaugauaagcuaca

SEQ ID NO: 126994 - RNA, 64 nt, hsa
aaugauguuggugcugcuuccuucuaagagcucagacaaguaaaguaugaaacauucuuauuuc

SEQ ID NO: 126995 - RNA, 64 nt, hsa
aauaaucuauggguuagaaaagcaucccugaauaaucaaaaauuggcaguauuggcauuguucu

SEQ ID NO: 126996 - RNA, 64 nt, hsa
cuggauagauaaucugguaauaaaugauagguaaaucaaaaauuacuuuuauuuaggaguuuga

SEQ ID NO: 126997 - RNA, 64 nt, hsa
aaucugaagauuaaccauuuuuuugucuuagaauaucaaaaagaaaaagaaaaagguguucuag

SEQ ID NO: 126998 - RNA, 64 nt, hsa
gguaauuaauccauuccuggcauaaaaagucuuuaucaaaaaaaauuguagaugcuugcuuuuu

SEQ ID NO: 126999 - RNA, 64 nt, hsa
aaaauggugggauuuuuuuuuaucaugauuaaauaucaaaaaauugcccuaugaaaacuuuaaa

SEQ ID NO: 127000 - RNA, 64 nt, hsa
gaaaaacaccuaaaauuugaaaaaugauuguaggaucaaaaaaggcagaugaaauuacuuaaua

SEQ ID NO: 127001 - RNA, 64 nt, hsa
uuuucaucuuugaugucaguuccaauuauuuggcaucaaaaaccuucaugguagguagaguuuu

SEQ ID NO: 127002 - RNA, 64 nt, hsa
uaaggcauacagccuucagaagccaacauuuuuaaucaaaaacuuauaaaacaugaugaucauu

SEQ ID NO: 127003 - RNA, 64 nt, hsa
guuauuugccauguaaaugaaaacgucuuuauuuaucaaaaaaacacagaggcuauuuuuauau

SEQ ID NO: 127004 - RNA, 64 nt, hsa
uuaacaagaaaugcacuacuguuguguauaguagaucaaaaauuauuuauuacuaagaggaugu

SEQ ID NO: 127005 - RNA, 64 nt, hsa
uuugauaguuuuauggcuuuuuacuguuagacuaaucaaaaauaacuuuaaaaggaacaaagaa

SEQ ID NO: 127006 - RNA, 64 nt, hsa
agcacuaugcuugggggccauuuuaaacagugaaaucaaaaaaagaacagaaaugcaaaaacca

SEQ ID NO: 127007 - RNA, 64 nt, hsa
uuagaauauugaaaagccaucaaaaaguugugauaucaaaaauguaugagucucuuaauauacu

SEQ ID NO: 127008 - RNA, 64 nt, hsa
caccaggaacccaaauuuagaauauugaaaagccaucaaaaaguugugauaucaaaaauguaug

SEQ ID NO: 127009 - RNA, 64 nt, hsa
uccacacacaacucugagaauacccacugccagcaucaaaaagcaaagauacuaauuuuuuaag

SEQ ID NO: 127010 - RNA, 62 nt, hsa
acaaagaaugugaaguauaauaucuacccaucaucaaaaaucacaucagauaaguaaccuau

SEQ ID NO: 127011 - RNA, 64 nt, hsa
uucuaaguaagaacacugagauauugggacacacaucaaaaaccuggagugcucaauuggaagu

SEQ ID NO: 127012 - RNA, 64 nt, hsa
acauauggaaauauaggcuauguaauguaaauacaucaaaaauggguaauuuucuuugacucug

SEQ ID NO: 127013 - RNA, 64 nt, hsa
gacuuacccuuucauguacuuccaaagaaagguaaucaaaaagaaucuucuuaagugauauaau

SEQ ID NO: 127014 - RNA, 64 nt, hsa
uuuauauguuauagauuaaaauauguugcaaaauaucaaaaauuuguguuauuucagcaguaag

SEQ ID NO: 127015 - RNA, 64 nt, hsa
auuggcauuccaaaauucagcuaaaggaaaaaugaucaaaaacaaaguaaggugcacaguuagc

SEQ ID NO: 127016 - RNA, 64 nt, hsa
uuacaaaacagaaaaauaaaugauuuaaaaucaaaucaaaaagaaaaaacuaaacauuuaaaca

SEQ ID NO: 127017 - RNA, 64 nt, hsa
cagccuuuggaggaauagagauggucaauuaacaaucaaaaagaggagauuaaccucuuguuuu

SEQ ID NO: 127018 - RNA, 64 nt, hsa
ccuuacaugagaagaugagcaagaugaacuugcaaucaaaaacuuaaauauauauaaauaaagg

SEQ ID NO: 127019 - RNA, 64 nt, hsa
cccacuuaacacuuugauuagcaugaacuugccaaucaaaaaaugacaaucaauuugagaaaau

SEQ ID NO: 127020 - RNA, 64 nt, hsa
uggacaacauagugagauccuaucucuauaaaaaaucaaaaauuagccaggcaugguggugcau

SEQ ID NO: 127021 - RNA, 64 nt, hsa
aguuucuguaaauuauuuagcagccuuaaaguuuaucaaaaaauuguccagauuccacgugcag

SEQ ID NO: 127022 - RNA, 64 nt, hsa
uuuagauuuuauuuuuuaaucuaauuuuuuucuaaucaaaaagaaaauugagcuuaaggcaaaa

SEQ ID NO: 127023 - RNA, 64 nt, hsa
uauagcacacugcuuucuccacagagaugcugauaucaaaaacuugaagauacagugaaguucu

SEQ ID NO: 127024 - RNA, 64 nt, hsa
aggauauucauuauuuucaaauggcuuuuggacuaucaaaaacaguaaggcuuuuguucagaaa

SEQ ID NO: 127025 - RNA, 64 nt, hsa
uugcgcuuaauccaauauuuugccuuuuuucuauaucaaaaaaccuuuacaguuagcagggaug

SEQ ID NO: 127026 - RNA, 64 nt, hsa
uuucucuuguaccauagaaaaauguauaaaaauuaucaaaaagcuaaugugcagggauauugcc

SEQ ID NO: 127027 - RNA, 64 nt, hsa
gggugggcugucaagacgugucauguacauuuguaucaaaaauaaagaagugaccaugagcugu

SEQ ID NO: 127028 - RNA, 64 nt, hsa
ccuccccacucucgccccuucucuaugaacuuaaaucaaaaaccacuucccuccaucuccuccu

SEQ ID NO: 127029 - RNA, 64 nt, hsa
caauaaaauacuggcaaaccgaauccagcagcacaucaaaaagcuuauccaccaugaucaagug

SEQ ID NO: 127030 - RNA, 64 nt, hsa
gaacucaaacaaauuuacaggaacaaacaaccccaucaaaaagucggcaaaggacaugaacaga

SEQ ID NO: 127031 - RNA, 64 nt, hsa
auuugaauuuguuacacuaagcauguauuuuauaaucaaaaauaauuaagauuuaaaacaaugu

SEQ ID NO: 127032 - RNA, 64 nt, hsa
auauggaguauguaaguuggcaauaacaguauacaucaaaaaauuuacaaacacugcaagacaa

SEQ ID NO: 127033 - RNA, 64 nt, hsa
auuuaaaaaaacaaaaaacaaaaaaaaucaaaaaaucaaaaaaauaauaaacuucauuuuaacc

SEQ ID NO: 127034 - RNA, 64 nt, hsa
acaguuuuauuuaaaaaaacaaaaaacaaaaaaaaucaaaaaaucaaaaaaauaauaaacuuca

SEQ ID NO: 127035 - RNA, 64 nt, hsa
guauuuacaggagaaagaggugauuauggagggaaucaaaaauacugcuuucaguuaguagcua

SEQ ID NO: 127036 - RNA, 64 nt, hsa
uaagugcgcauaucuuuucuguauacagcuuaaaaucaaaaauguauguuaagagaauuuuuuc

SEQ ID NO: 127037 - RNA, 64 nt, hsa
aguaauaguauugacuguuuaaaaaauugagcucaucaaaaauauugucaucaaauacaggugg

SEQ ID NO: 127038 - RNA, 64 nt, hsa
auggauuuuaauaagcuccaguauuauucaaaugaucaaaaauauaguuauaauuuuuugaauu

SEQ ID NO: 127039 - RNA, 64 nt, hsa
guugcugucauuacauaucuauuaaaugucaucaaauauguaguagacaaugcuguaauuaggu

SEQ ID NO: 127040 - RNA, 64 nt, hsa
cauauugauagcaucuaauucuuuugacaaucuuaauauguagguucauuuaaauuuuaagaca

SEQ ID NO: 127041 - RNA, 64 nt, hsa
cuuacagauaacuaaggcaaaaagcuaaauaaacaauauguaaccucuaacauuugguaaaagg

SEQ ID NO: 127042 - RNA, 64 nt, hsa
cauuacagaaaaaguuugauaauuccugcuuuauaauauguaaggcauugucccauuuugcaua

SEQ ID NO: 127043 - RNA, 64 nt, hsa
ggcauuauugaguaaugaauuuuaaguauagcaaaauauguauaguguuuauacaugaugcuga

SEQ ID NO: 127044 - RNA, 64 nt, hsa
uuuuuuaauugcagacaguaaugcaugucacacuaauauguaguggccuuuucaaggccuaguc

SEQ ID NO: 127045 - RNA, 64 nt, hsa
aauuuggggggauuauuuauucagcaugaaaccuaauauguauauguuugaaauacuucauaau

SEQ ID NO: 127046 - RNA, 64 nt, hsa
agauaagcucaguaauauguuaccaugggauaaaaauauguaucccugccuaagaauaacuugu

SEQ ID NO: 127047 - RNA, 64 nt, hsa
aauguguuucuuauuaauauguaaauucacaguaaauauguaaagcuaaauacuuuccucucca

SEQ ID NO: 127048 - RNA, 64 nt, hsa
uguggcagggcaagguuuaaauguguuucuuauuaauauguaaauucacaguaaauauguaaag

SEQ ID NO: 127049 - RNA, 64 nt, hsa
uguaaugcauauuuuuaaagacaauuuggaucuaaauauguauuucauaauucucccauaauaa

SEQ ID NO: 127050 - RNA, 64 nt, hsa
auauauagccugauaaacaacuucuauuaaaucaaauauguaccacaguguaugugucuuuugc

SEQ ID NO: 127051 - RNA, 64 nt, hsa
augccugccucguagugaaguuguagcucuccguaauauguauauuuuacucaguuuucaacau

SEQ ID NO: 127052 - RNA, 64 nt, hsa
ggauucagaggguuccuugaaaguuuuauguauaaauauguaaaauaaaaauuaaaacuuuguu

SEQ ID NO: 127053 - RNA, 64 nt, hsa
cacauuuaauauuuuucuuauaucuacauuucugaauauguaaagcaaguuauugaaauaggac

SEQ ID NO: 127054 - RNA, 64 nt, hsa
gaauuaccuauuaaaaagaaaucugauauauaaaaauauguacuauuuuaaggaaaaauuucca

SEQ ID NO: 127055 - RNA, 64 nt, hsa
guaaaauuuuuuauaaacuaaaguuguaccuuuuaauauguaguaaacucucauuuauuugggg

SEQ ID NO: 127056 - RNA, 64 nt, hsa
gcauacuagcaagacagcucuucuugaaaaaaaaaauauguauacacaaauauauacguauauc

SEQ ID NO: 127057 - RNA, 64 nt, hsa
ugaaggaccuuauuuggcauauaaaauuuuauaaaauauguauuuaaagcuuuuucuuauuuuu

SEQ ID NO: 127058 - RNA, 55 nt, hsa
accauggauacccuuacugagcagaaauauguaaccuuagacucagccaguuucc

SEQ ID NO: 127059 - RNA, 64 nt, hsa
cuauuucucuauggucuacagcaugccaguaaauaauauguaggaccaauaauaaauuaucaau

SEQ ID NO: 127060 - RNA, 64 nt, hsa
acugcuuugcuucuuuuuauugacaugauagauaaauauguaucuacacagaguaauaauaaua

SEQ ID NO: 127061 - RNA, 64 nt, hsa
ccacauucccaugaauaucaagaauaguugucagaauauguauguaccugagcauauguacaca

SEQ ID NO: 127062 - RNA, 64 nt, hsa
uggguucaaauucucuauguacagaugauguaaaaauauguauaugucuagauaaaaggagaga

SEQ ID NO: 127063 - RNA, 64 nt, hsa
uuuucuauuaagauauauuugucauuuucucuugaauauguauuaaaauaucccaagcaaucca

SEQ ID NO: 127064 - RNA, 64 nt, hsa
caacuuauaauuacaaugcacaauuuauaauuacaauauguauuuaugucuuuugcuauggagc

SEQ ID NO: 127065 - RNA, 64 nt, hsa
uuguaagucuuuucaccauucaugaauaauaauaaauauguacugcuggcauguaaugcuuagu

SEQ ID NO: 127066 - RNA, 64 nt, hsa
uguaacaugugauacauacaaaagaauauaguuuaauauguauugaaauaaaacacaauaaaau

SEQ ID NO: 127067 - RNA, 64 nt, hsa
uauguaacugccauaaguauagcuuuuagaauguaauauguaaacugugauuugguccucugga

SEQ ID NO: 127068 - RNA, 64 nt, hsa
cagaaaucaggagauuuuuauccuauccauaaguaauauguaacugccauaaguauagcuuuua

SEQ ID NO: 127069 - RNA, 64 nt, hsa
gaaaagaaaagauuuaguaauuucuuaccaugcuaauauguaaaguucaugccauccaggcauu

SEQ ID NO: 127070 - RNA, 64 nt, hsa
ccaggcauuuaagagcgauccucaucccuucagcaauauguauuugaguucacacuauuucugu

SEQ ID NO: 127071 - RNA, 64 nt, hsa
auaauuguaaagauagaaauuauauugauaaguaaauauguaaaauuguaaauauguaaaaaaa

SEQ ID NO: 127072 - RNA, 64 nt, hsa
aaauuauauugauaaguaaauauguaaaauuguaaauauguaaaaaaaagaauggugucugcug

SEQ ID NO: 127073 - RNA, 64 nt, hsa
cuaccaauacuaucugcuacugaauaacucucuaaauauguagaccucacuaauaacuaaccuu

SEQ ID NO: 127074 - RNA, 64 nt, hsa
auuagaggcuaauaaaggcagaauguuuauugugaauauguaauauuuguuggcugggccacgu

SEQ ID NO: 127075 - RNA, 64 nt, hsa
ucaugugccgugccuuaucugaguuuucgguauaaauauguagauaauggauuuuuuuuuuuua

SEQ ID NO: 127076 - RNA, 64 nt, hsa
auaguaguuuuaaguaugucuaauuuaaacguauaauauguacaucacugagacaaucauguac

SEQ ID NO: 127077 - RNA, 64 nt, hsa
uaugcagagaaauuaagaauuuacaucuuuuacaaauauguauaucucugaaauaaugaaauau

SEQ ID NO: 127078 - RNA, 64 nt, hsa
aauggauucucauauuaacacagguauuugacauaauauguauuaaguuauacuaauguuucaa

SEQ ID NO: 127079 - RNA, 64 nt, hsa
auggaguugcuucuguugaauuagcucugccaccaauauguaucuucauacacguuuggaaaug

SEQ ID NO: 127080 - RNA, 64 nt, hsa
acaccauauaagucaaauauguauuuaacaaagcaauauguauucauucacuuucaagauuugu

SEQ ID NO: 127081 - RNA, 64 nt, hsa
uauauauauauuuauauaaacaccauauaagucaaauauguauuuaacaaagcaauauguauuc

SEQ ID NO: 127082 - RNA, 64 nt, hsa
ugugagccaguuauuaaaagcagucauuauuuaaaauauguaaacuuacaguuaaaaacaaagg

SEQ ID NO: 127083 - RNA, 64 nt, hsa
ugucagaaauuuguagaaaaugacuucuuguuugaauauguaaaagcuuucaagaaaaauuaaa

SEQ ID NO: 127084 - RNA, 64 nt, hsa
agacuccaucucaaaaacugaaaauaaaaauaaaaauauguauucuccuaacugaaauauuuac

SEQ ID NO: 127085 - RNA, 64 nt, hsa
cuaaaacaagagcuauccucauuccaaauuuuaaaauauguacucuggccgguugcaguggcuc

SEQ ID NO: 127086 - RNA, 64 nt, hsa
acagaaaauucaauccuuuauuuuuuucucuguaaauauguacagugcacgggcuaugagauag

SEQ ID NO: 127087 - RNA, 64 nt, hsa
uuguuucuguugucuuuuaaaaugucaaauauauaauauguaauuuuuuuaaaaaccaccagau

SEQ ID NO: 127088 - RNA, 64 nt, hsa
guggaauagugaauacuuacuauaauuugacuugaauauguagcucauccuuuacaccaacucc

SEQ ID NO: 127089 - RNA, 64 nt, hsa
uuaaaugagaaguacuugguuuuuuuuuuucuuaaauauguauaugacauuuaaauguaacuua

SEQ ID NO: 127090 - RNA, 64 nt, hsa
aaauacuuuaauuguuaaaagucagaagagacagaauauguaggaaauguuuuuuguuuauuau

SEQ ID NO: 127091 - RNA, 64 nt, hsa
aacagggcuucaguauauucacaucuaauagguuaauauguacauuuggaugaugauuuuucuu

SEQ ID NO: 127092 - RNA, 64 nt, hsa
acaccuuaagggucuaacuuguaaugaagacagaaauauguaugaggaugaucacugaaauauu

SEQ ID NO: 127093 - RNA, 64 nt, hsa
auauccguguaauggaagauuaugcaggcauuaaaauauguacacaaaaaguuugguaaaggaa

SEQ ID NO: 127094 - RNA, 64 nt, hsa
cuaggaacugagaacuguauuggaauagguucaaaauauguaagaaaugcuaaugugggagaua

SEQ ID NO: 127095 - RNA, 64 nt, hsa
gaucaaacauuuuaauaugugcauguuauauauaaauauguaaauucugugauacucuaugauc

SEQ ID NO: 127096 - RNA, 64 nt, hsa
uccuuuauauuguguuagaggcugaggauauagaaauauguaacucagagucccauuccacaag

SEQ ID NO: 127097 - RNA, 64 nt, hsa
gaaggcacaacaccauauggaaaagcaagacagaaauauguacagggcagagaggcugcacugu

SEQ ID NO: 127098 - RNA, 64 nt, hsa
augacaggcacauguaagaaaccaaaauuugcuaaauauguacaugagucuucaucacagcauc

SEQ ID NO: 127099 - RNA, 64 nt, hsa
uucauuucuuuuucuguaaaugcaggaugaaaacaauauguaucuccuaggauggcugugagga

SEQ ID NO: 127100 - RNA, 64 nt, hsa
uuuuccuguggaaaccugucauagaauuuugugcaauauguaugugucuaugaagcugucuugu

SEQ ID NO: 127101 - RNA, 64 nt, hsa
uguuaacgagacugauauucaacaggcuucuaagaauauguaucuucauaaacugaucacuauc

SEQ ID NO: 127102 - RNA, 64 nt, hsa
uauguguggucuucccauuaaaugugaacauuuuaauauguaugcauucaccuugccucuugca

SEQ ID NO: 127103 - RNA, 64 nt, hsa
auaccuuguaaacuuguauuguggauguguaaauaauauguacuuuggguuuuuaacaccgcau

SEQ ID NO: 127104 - RNA, 64 nt, hsa
ugcuuacaauagaugucucacacagaacaauacaaauauguaaaaaaucuuucaccacauauuc

SEQ ID NO: 127105 - RNA, 64 nt, hsa
ugguaguauaagucaccuaaaaaagacuucuagaaauauguacuuuaauuauuuguuuuucucc

SEQ ID NO: 127106 - RNA, 64 nt, hsa
agauaaacuauuaaaacuuuaaaaaauacucaaaaauauguaaguuuuuugguugaaccuuuag

SEQ ID NO: 127107 - RNA, 64 nt, hsa
aaaauacugcacuuuaaguuucucaagacucugaaauauguaaaauucaauauuuuuauauucc

SEQ ID NO: 127108 - RNA, 64 nt, hsa
aauaaguaucuguguguuuguguauugaaaacucaauauguaaucuuguguuuuuauauguaua

SEQ ID NO: 127109 - RNA, 64 nt, hsa
cuggccaacauggugaaaccccaucacuacuaaaaauauguaaauuagucgggcguggugucac

SEQ ID NO: 127110 - RNA, 64 nt, hsa
cagcaaucgaaagucaguguguucuuguaaaaugaauauguauguaggguuuuaacccuuccau

SEQ ID NO: 127111 - RNA, 64 nt, hsa
uucuagaagaaauguuuguaaaaggggcagguguaauauguaaggaacaugcacuuuauugguu

SEQ ID NO: 127112 - RNA, 64 nt, hsa
guucuuauccacaguacaaaaaugguuuguuuuuaauauguagagcauuauguguggacuacug

SEQ ID NO: 127113 - RNA, 64 nt, hsa
auuaguuugucucaauaaacaaaauguagagaaaaauauguagcuaugacuuuguuacaacugu

SEQ ID NO: 127114 - RNA, 64 nt, hsa
uauauguauacauucuguacaguaguuccaucaaaauauguaauaauucacaccaauuuuauua

SEQ ID NO: 127115 - RNA, 64 nt, hsa
uuguuuuacuaaagagaaaaaugugaguggaaaaaauauguaugugguauauacucaaauguau

SEQ ID NO: 127116 - RNA, 64 nt, hsa
uauauuuuauauauauauauauauauauauauauaauauguauauauauauauauugacuuguu

SEQ ID NO: 127117 - RNA, 64 nt, hsa
ugguuguuuucguuguuguuaacaaaggaaugagaauauguaauacuuaaauaaacaugaccac

SEQ ID NO: 127118 - RNA, 64 nt, hsa
ucuuuguuaguugcaagauggauuucauaugcagaauauguaaaugaagaggacucauaaguaa

SEQ ID NO: 127119 - RNA, 64 nt, hsa
aaacaugcuaauuagaaaaaguccugcuuuaaguaauauguagccacauuugaauccucuacca

SEQ ID NO: 127120 - RNA, 64 nt, hsa
caucaacuaaaguuguacuuuaaaaauuuacuacaauauguacauuucuaagucaaacacuugu

SEQ ID NO: 127121 - RNA, 64 nt, hsa
uauuucagaaguuuaaauauuaagcaugacagaaaauauguauuaacacuacucaaagcaaaag

SEQ ID NO: 127122 - RNA, 64 nt, hsa
cgacacagugagacucugucucaaaaaaacaaaacaaacaaacaaaaauacaaaaaauuagccg

SEQ ID NO: 127123 - RNA, 64 nt, hsa
acagugagacucugucucaaaaaaacaaaacaaacaaacaaaaauacaaaaaauuagccgggcg

SEQ ID NO: 127124 - RNA, 64 nt, hsa
cuccggccuaggcaacgagagcaaaacuccaauacaaacaaacaaacaaacaccugugcuaggu

SEQ ID NO: 127125 - RNA, 64 nt, hsa
ggccuaggcaacgagagcaaaacuccaauacaaacaaacaaacaaacaccugugcuaggucagu

SEQ ID NO: 127126 - RNA, 64 nt, hsa
uaggcaacgagagcaaaacuccaauacaaacaaacaaacaaacaccugugcuaggucagucugg

SEQ ID NO: 127127 - RNA, 64 nt, hsa
auuucuucaucugcuggggggaaaaaguaaauuacaaacaaacaaacaaagcagaacuaaaaua

SEQ ID NO: 127128 - RNA, 64 nt, hsa
cuucaucugcuggggggaaaaaguaaauuacaaacaaacaaacaaagcagaacuaaaauauugg

SEQ ID NO: 127129 - RNA, 64 nt, hsa
aucugcuggggggaaaaaguaaauuacaaacaaacaaacaaagcagaacuaaaauauugggacc

SEQ ID NO: 127130 - RNA, 64 nt, hsa
ucuguaaaagguaaaaaugaaaaacaaaaacaagcaaacaaacaaaaaacaauggaaaagauga

SEQ ID NO: 127131 - RNA, 64 nt, hsa
uaaaagguaaaaaugaaaaacaaaaacaagcaaacaaacaaaaaacaauggaaaagaugaagcu

SEQ ID NO: 127132 - RNA, 64 nt, hsa
auguguguuaauuuggcuguaauggcauuuaaagcaaacaaacaaacaaaaaaagcugugaaaa

SEQ ID NO: 127133 - RNA, 64 nt, hsa
guguuaauuuggcuguaauggcauuuaaagcaaacaaacaaacaaaaaaagcugugaaaauggc

SEQ ID NO: 127134 - RNA, 64 nt, hsa
uaauuuggcuguaauggcauuuaaagcaaacaaacaaacaaaaaaagcugugaaaauggccuug

SEQ ID NO: 127135 - RNA, 64 nt, hsa
cagagcaaacccuguuuccaaacaaacaaacaaacaaacaaauacacagacagaaguaguuaaa

SEQ ID NO: 127136 - RNA, 64 nt, hsa
gcgacagagcaaacccuguuuccaaacaaacaaacaaacaaacaaauacacagacagaaguagu

SEQ ID NO: 127137 - RNA, 64 nt, hsa
cugggcgacagagcaaacccuguuuccaaacaaacaaacaaacaaacaaauacacagacagaag

SEQ ID NO: 127138 - RNA, 64 nt, hsa
cagccugggcgacagagcaaacccuguuuccaaacaaacaaacaaacaaacaaauacacagaca

SEQ ID NO: 127139 - RNA, 64 nt, hsa
acuccagccugggcgacagagcaaacccuguuuccaaacaaacaaacaaacaaacaaauacaca

SEQ ID NO: 127140 - RNA, 64 nt, hsa
gcaacagaacaagaacccaucucaaacaaacaaacaaacaaaaaaaaaaaacucuugucuccuu

SEQ ID NO: 127141 - RNA, 64 nt, hsa
cugggcaacagaacaagaacccaucucaaacaaacaaacaaacaaaaaaaaaaaacucuugucu

SEQ ID NO: 127142 - RNA, 64 nt, hsa
caaccugggcaacagaacaagaacccaucucaaacaaacaaacaaacaaaaaaaaaaaacucuu

SEQ ID NO: 127143 - RNA, 64 nt, hsa
acuccaaccugggcaacagaacaagaacccaucucaaacaaacaaacaaacaaaaaaaaaaaac

SEQ ID NO: 127144 - RNA, 64 nt, hsa
ugugacugcuugcugacuuuaucauaauuuucuucaaacaaaaaaauguauagaaaaaucaugu

SEQ ID NO: 127145 - RNA, 64 nt, hsa
ccuauaaucuauagacaugugauagcaaaagaaacaaacaaaagccaggaaaacacucauuuuc

SEQ ID NO: 127146 - RNA, 64 nt, hsa
acuuagugaaauaaaauaagaggaaagccaaaaacaaacaaacaaaaagcauauggggagcugg

SEQ ID NO: 127147 - RNA, 64 nt, hsa
agugaaauaaaauaagaggaaagccaaaaacaaacaaacaaaaagcauauggggagcugguauu

SEQ ID NO: 127148 - RNA, 64 nt, hsa
ugauuaaugcaaggggaaauuuuuauacugaaaacaaacaaacaaacuagcagcuacuaaaaua

SEQ ID NO: 127149 - RNA, 64 nt, hsa
uaaugcaaggggaaauuuuuauacugaaaacaaacaaacaaacuagcagcuacuaaaauagaga

SEQ ID NO: 127150 - RNA, 64 nt, hsa
ggcaaacugagguagcgacacaaaguuaaacaaacaaacaaaaaacacaaaacauaauaaaaca

SEQ ID NO: 127151 - RNA, 64 nt, hsa
ugggggcaaacugagguagcgacacaaaguuaaacaaacaaacaaaaaacacaaaacauaauaa

SEQ ID NO: 127152 - RNA, 64 nt, hsa
cgcuuucagaauaguuuugcaaauuguacacaaacaaacaaaaagguggaagcuuuuuaauaaa

SEQ ID NO: 127153 - RNA, 64 nt, hsa
auuccgcuuucagaauaguuuugcaaauuguacacaaacaaacaaaaagguggaagcuuuuuaa

SEQ ID NO: 127154 - RNA, 64 nt, hsa
uuuuuucuagucccaugugauuuaaacaaacaaacaaacaaacagaaguaacgaagcuaagaau

SEQ ID NO: 127155 - RNA, 64 nt, hsa
ggauuuuuuucuagucccaugugauuuaaacaaacaaacaaacaaacagaaguaacgaagcuaa

SEQ ID NO: 127156 - RNA, 64 nt, hsa
uguaggauuuuuuucuagucccaugugauuuaaacaaacaaacaaacaaacagaaguaacgaag

SEQ ID NO: 127157 - RNA, 64 nt, hsa
cuagcccccuugaucccuaaagaaaacaaacaaacaaacaaaaacuguugcuauuuccuaaccu

SEQ ID NO: 127158 - RNA, 64 nt, hsa
ccuccuagcccccuugaucccuaaagaaaacaaacaaacaaacaaaaacuguugcuauuuccua

SEQ ID NO: 127159 - RNA, 64 nt, hsa
uaacccuccuagcccccuugaucccuaaagaaaacaaacaaacaaacaaaaacuguugcuauuu

SEQ ID NO: 127160 - RNA, 64 nt, hsa
ucuucuauaaaccaggcuguuaauacaaugaugacaaacaaaacuggcaagaucacuaaaaaau

SEQ ID NO: 127161 - RNA, 64 nt, hsa
ccaaccccguuuuuaagcaauggaacucuuucuucaaacaaaagcuuaugcagaacaucucugu

SEQ ID NO: 127162 - RNA, 64 nt, hsa
cagccugggcgacagagcgagacuucgucucaaacaaacaaaaaaauuagccgggcaugguggc

SEQ ID NO: 127163 - RNA, 64 nt, hsa
acuccagccugggcgacagagcgagacuucgucucaaacaaacaaaaaaauuagccgggcaugg

SEQ ID NO: 127164 - RNA, 64 nt, hsa
agcuagcaaaugaguuuuagcggggacaaaaaaucaaacaaaaaagugaaugcuuagaaccuuc

SEQ ID NO: 127165 - RNA, 64 nt, hsa
cagcgcugucucgugaauggacaguagccacuuacaaacaaaucaacauuuuuaaaaagaaaau

SEQ ID NO: 127166 - RNA, 64 nt, hsa
gcuuuuuguucuguuggugugauucaaagcaaaacaaacaaacaaaaacaaauuuuaagaacac

SEQ ID NO: 127167 - RNA, 64 nt, hsa
uuuguucuguuggugugauucaaagcaaaacaaacaaacaaaaacaaauuuuaagaacacaaca

SEQ ID NO: 127168 - RNA, 64 nt, hsa
uucuuugacaaaaauguguacuguguaagccuugcaaacaaaaaacaacaaaaaagaagcagca

SEQ ID NO: 127169 - RNA, 64 nt, hsa
ugaagucucuuuaugguuagagaagaccaaaaaacaaacaaacaaacuuagaaacauaaaagga

SEQ ID NO: 127170 - RNA, 64 nt, hsa
gucucuuuaugguuagagaagaccaaaaaacaaacaaacaaacuuagaaacauaaaaggaaaug

SEQ ID NO: 127171 - RNA, 64 nt, hsa
agaaagggaaaaagcagaaacacugcagaagacacaaacaaacaaagaagagaaggauucuuau

SEQ ID NO: 127172 - RNA, 64 nt, hsa
agggaaaaagcagaaacacugcagaagacacaaacaaacaaagaagagaaggauucuuauaccg

SEQ ID NO: 127173 - RNA, 64 nt, hsa
ucugaaccagcuaucccucuggaaugcagcugaccaaacaaauucccacuaauguaacugguag

SEQ ID NO: 127174 - RNA, 64 nt, hsa
acuuccaguauaguggggacaaucaguuaauaagcaaacaaacacauuucuauuuauaaauggu

SEQ ID NO: 127175 - RNA, 64 nt, hsa
ccgcagggccagccuuguuucucuaacaaacaaacaaacaaacagccuuguuucucuagucaca

SEQ ID NO: 127176 - RNA, 64 nt, hsa
ggggccgcagggccagccuuguuucucuaacaaacaaacaaacaaacagccuuguuucucuagu

SEQ ID NO: 127177 - RNA, 64 nt, hsa
gggcggggccgcagggccagccuuguuucucuaacaaacaaacaaacaaacagccuuguuucuc

SEQ ID NO: 127178 - RNA, 64 nt, hsa
aucagaccaucugagcccacuacuaucaaacaaacaaacaaaaacuguuaauauauuagccaua

SEQ ID NO: 127179 - RNA, 64 nt, hsa
ccaaaucagaccaucugagcccacuacuaucaaacaaacaaacaaaaacuguuaauauauuagc

SEQ ID NO: 127180 - RNA, 64 nt, hsa
uaccccaaaucagaccaucugagcccacuacuaucaaacaaacaaacaaaaacuguuaauauau

SEQ ID NO: 127181 - RNA, 64 nt, hsa
cuaucccuguaagcuaaacaaacaaacaaacaaacaaacaaacaguucuauauauaauaguuuc

SEQ ID NO: 127182 - RNA, 64 nt, hsa
ccaccuaucccuguaagcuaaacaaacaaacaaacaaacaaacaaacaguucuauauauaauag

SEQ ID NO: 127183 - RNA, 64 nt, hsa
aaugccaccuaucccuguaagcuaaacaaacaaacaaacaaacaaacaaacaguucuauauaua

SEQ ID NO: 127184 - RNA, 64 nt, hsa
uuauaaugccaccuaucccuguaagcuaaacaaacaaacaaacaaacaaacaaacaguucuaua

SEQ ID NO: 127185 - RNA, 64 nt, hsa
uuucuuauaaugccaccuaucccuguaagcuaaacaaacaaacaaacaaacaaacaaacaguuc

SEQ ID NO: 127186 - RNA, 64 nt, hsa
uuaugaacaaaacaaaacaacaacaaaaaacaaacaaacaaaaaagcuauggcacuagaauuua

SEQ ID NO: 127187 - RNA, 64 nt, hsa
uuucuuaugaacaaaacaaaacaacaacaaaaaacaaacaaacaaaaaagcuauggcacuagaa

SEQ ID NO: 127188 - RNA, 64 nt, hsa
guaaucugaaguaugguauuacaaaacaaacaaacaaacaaaaaacccauguguuaaaauacuc

SEQ ID NO: 127189 - RNA, 64 nt, hsa
uauuguaaucugaaguaugguauuacaaaacaaacaaacaaacaaaaaacccauguguuaaaau

SEQ ID NO: 127190 - RNA, 64 nt, hsa
uggguauuguaaucugaaguaugguauuacaaaacaaacaaacaaacaaaaaacccauguguua

SEQ ID NO: 127191 - RNA, 64 nt, hsa
ggucgcggcagcagugauggauuuauaguuccuccaaacaaagaugggaccccucccgagggaa

SEQ ID NO: 127192 - RNA, 64 nt, hsa
aguaacaaugcugcaucuagauuggagugcugcacaaacaaacauaagagcaaagcaaaacugu

SEQ ID NO: 127193 - RNA, 64 nt, hsa
acuaucacuuuauaagaaucauuuucuaguaaugcaaacaaauuauuuuuuacaaaaaaacaaa

SEQ ID NO: 127194 - RNA, 64 nt, hsa
cugggugacagagucagacuccgucccaaaaaaacaaacaaacaaaacaaaacaaaaaaaaaca

SEQ ID NO: 127195 - RNA, 64 nt, hsa
gugacagagucagacuccgucccaaaaaaacaaacaaacaaaacaaaacaaaaaaaaacagaag

SEQ ID NO: 127196 - RNA, 64 nt, hsa
cacuccuacccccuuccucaacccccaaacaaaacaaacaaacuucccuggcuucgcaccugcc

SEQ ID NO: 127197 - RNA, 64 nt, hsa
uuucaaccccacuccuacccccuuccucaacccccaaacaaaacaaacaaacuucccuggcuuc

SEQ ID NO: 127198 - RNA, 64 nt, hsa
auucaguuuuuguaguaaaggcgucacaugcaaacaaacaaaaugaaugaaacagucaaauggu

SEQ ID NO: 127199 - RNA, 64 nt, hsa
aacuauucaguuuuuguaguaaaggcgucacaugcaaacaaacaaaaugaaugaaacagucaaa

SEQ ID NO: 127200 - RNA, 64 nt, hsa
aaaucaaaauacauuaggguuuacuugguuguggcaaacaaacaaaaaaugcuuucaguguuga

SEQ ID NO: 127201 - RNA, 64 nt, hsa
caaaauacauuaggguuuacuugguuguggcaaacaaacaaaaaaugcuuucaguguugaaaua

SEQ ID NO: 127202 - RNA, 64 nt, hsa
acuccagccugggugacagagcgagacuccgucucaaacaaacaaacaaaaaacuguuuucauu

SEQ ID NO: 127203 - RNA, 64 nt, hsa
cagccugggugacagagcgagacuccgucucaaacaaacaaacaaaaaacuguuuucauuugcu

SEQ ID NO: 127204 - RNA, 64 nt, hsa
cugggugacagagcgagacuccgucucaaacaaacaaacaaaaaacuguuuucauuugcucucu

SEQ ID NO: 127205 - RNA, 64 nt, hsa
gauaauaaacaucauuuuaaaagaucaaaacaaacaaacaaaaaaaacaaggguggguggggag

SEQ ID NO: 127206 - RNA, 64 nt, hsa
uccugauaauaaacaucauuuuaaaagaucaaaacaaacaaacaaaaaaaacaagggugggugg

SEQ ID NO: 127207 - RNA, 64 nt, hsa
gagaccgaacccccucaccugaaucccccucuaucaaacaaacaaaaaagcagcaguaaagagc

SEQ ID NO: 127208 - RNA, 64 nt, hsa
ccgaacccccucaccugaaucccccucuaucaaacaaacaaaaaagcagcaguaaagagcuaga

SEQ ID NO: 127209 - RNA, 64 nt, hsa
uuuauuguauguaaggaaaaauuuuaccugaaaacaaacaaacaaacccuaaaacucagcacca

SEQ ID NO: 127210 - RNA, 64 nt, hsa
uuguauguaaggaaaaauuuuaccugaaaacaaacaaacaaacccuaaaacucagcaccacuac

SEQ ID NO: 127211 - RNA, 64 nt, hsa
cacuccagccuggcaacagagcuagaauccgucucaaacaaacaaacaaaaaaucccacagcua

SEQ ID NO: 127212 - RNA, 64 nt, hsa
ccagccuggcaacagagcuagaauccgucucaaacaaacaaacaaaaaaucccacagcuauugg

SEQ ID NO: 127213 - RNA, 64 nt, hsa
ccuggcaacagagcuagaauccgucucaaacaaacaaacaaaaaaucccacagcuauuggauca

SEQ ID NO: 127214 - RNA, 64 nt, hsa
ugggugacagacucugucuccaaaacaaaacaaacaaacaaaaagauuuuauuaaagauauuuu

SEQ ID NO: 127215 - RNA, 64 nt, hsa
aaccugggugacagacucugucuccaaaacaaaacaaacaaacaaaaagauuuuauuaaagaua

SEQ ID NO: 127216 - RNA, 64 nt, hsa
gucuuguuugauaaugugggcauccacaaacaaacaaacaaauaacagaaacaaaaucuguaaa

SEQ ID NO: 127217 - RNA, 64 nt, hsa
auuggucuuguuugauaaugugggcauccacaaacaaacaaacaaauaacagaaacaaaaucug

SEQ ID NO: 127218 - RNA, 64 nt, hsa
cauaauuggucuuguuugauaaugugggcauccacaaacaaacaaacaaauaacagaaacaaaa

SEQ ID NO: 127219 - RNA, 64 nt, hsa
acuaagaagccuuaauacucuguaaacaaacaaacaaacaaaaaacaaccuuagcauuaagaaa

SEQ ID NO: 127220 - RNA, 64 nt, hsa
cuuuacuaagaagccuuaauacucuguaaacaaacaaacaaacaaaaaacaaccuuagcauuaa

SEQ ID NO: 127221 - RNA, 64 nt, hsa
caagcuuuacuaagaagccuuaauacucuguaaacaaacaaacaaacaaaaaacaaccuuagca

SEQ ID NO: 127222 - RNA, 64 nt, hsa
auucaaauggaaggaaccaccugaauuauaucugcaaacaaaauggaaauaguuguugaauagu

SEQ ID NO: 127223 - RNA, 64 nt, hsa
uggaaauguacauauccaauaugaaauacuaaaacaaacaaacaaacaaaaaaccagaaugcau

SEQ ID NO: 127224 - RNA, 64 nt, hsa
aauguacauauccaauaugaaauacuaaaacaaacaaacaaacaaaaaaccagaaugcauugua

SEQ ID NO: 127225 - RNA, 64 nt, hsa
uacauauccaauaugaaauacuaaaacaaacaaacaaacaaaaaaccagaaugcauuguauagg

SEQ ID NO: 127226 - RNA, 64 nt, hsa
gaaagacugcaguugugcuaaaaacaaaacaaaacaaacaaacaaacaaaaaaguaaaaaaaga

SEQ ID NO: 127227 - RNA, 64 nt, hsa
gacugcaguugugcuaaaaacaaaacaaaacaaacaaacaaacaaaaaaguaaaaaaagauuac

SEQ ID NO: 127228 - RNA, 64 nt, hsa
gcaguugugcuaaaaacaaaacaaaacaaacaaacaaacaaaaaaguaaaaaaagauuacuuuc

SEQ ID NO: 127229 - RNA, 64 nt, hsa
uguaugacacccagcuuuaaaacaaacaaacaaacaaacaaaaaaagggugggggagggaggga

SEQ ID NO: 127230 - RNA, 64 nt, hsa
gaaauguaugacacccagcuuuaaaacaaacaaacaaacaaacaaaaaaagggugggggaggga

SEQ ID NO: 127231 - RNA, 64 nt, hsa
cucugaaauguaugacacccagcuuuaaaacaaacaaacaaacaaacaaaaaaaggguggggga

SEQ ID NO: 127232 - RNA, 64 nt, hsa
ugcucucugaaauguaugacacccagcuuuaaaacaaacaaacaaacaaacaaaaaaagggugg

SEQ ID NO: 127233 - RNA, 64 nt, hsa
acgugaccauuugauucucaaacaaaaguuguuccaaacaaaaugaugaacuuugauuugaaca

SEQ ID NO: 127234 - RNA, 64 nt, hsa
auuuguuuugucauuuacgugaccauuugauucucaaacaaaaguuguuccaaacaaaaugaug

SEQ ID NO: 127235 - RNA, 64 nt, hsa
uggcgaaauccccgucuuuacaaaaacaaacaaacaaacaaaaaagauauugcaguuguguugu

SEQ ID NO: 127236 - RNA, 64 nt, hsa
aacguggcgaaauccccgucuuuacaaaaacaaacaaacaaacaaaaaagauauugcaguugug

SEQ ID NO: 127237 - RNA, 64 nt, hsa
gggcaacguggcgaaauccccgucuuuacaaaaacaaacaaacaaacaaaaaagauauugcagu

SEQ ID NO: 127238 - RNA, 64 nt, hsa
uugaaagaacaaaacaaaacaaaacaaacacaaacaaacaaaaaaccuucaacugccuuaugcc

SEQ ID NO: 127239 - RNA, 64 nt, hsa
cugauugaaagaacaaaacaaaacaaaacaaacacaaacaaacaaaaaaccuucaacugccuua

SEQ ID NO: 127240 - RNA, 64 nt, hsa
uguauuuucucuggcuuuaaaauuuuaaaacaaacaaacaaaaaagccauagagagcagaacuu

SEQ ID NO: 127241 - RNA, 64 nt, hsa
uguguguauuuucucuggcuuuaaaauuuuaaaacaaacaaacaaaaaagccauagagagcaga

SEQ ID NO: 127242 - RNA, 64 nt, hsa
cacuuacaucucucuaugcuguucuacaagcaaacaaacaaaaauaggaguauaggaacugcug

SEQ ID NO: 127243 - RNA, 64 nt, hsa
cuagcacuuacaucucucuaugcuguucuacaagcaaacaaacaaaaauaggaguauaggaacu

SEQ ID NO: 127244 - RNA, 64 nt, hsa
accagccugggugacagagugaaacucguaucuccaaacaaacaaacaaaaaguccuuaaacau

SEQ ID NO: 127245 - RNA, 64 nt, hsa
gccugggugacagagugaaacucguaucuccaaacaaacaaacaaaaaguccuuaaacauaugu

SEQ ID NO: 127246 - RNA, 64 nt, hsa
gggugacagagugaaacucguaucuccaaacaaacaaacaaaaaguccuuaaacauaugugaac

SEQ ID NO: 127247 - RNA, 64 nt, hsa
gggggacccuccccagcccauuccugcugucaaacaaacaaaaccuugcaaagcgcuggguucu

SEQ ID NO: 127248 - RNA, 64 nt, hsa
uugcgggggacccuccccagcccauuccugcugucaaacaaacaaaaccuugcaaagcgcuggg

SEQ ID NO: 127249 - RNA, 64 nt, hsa
uguuaagacuaaaauuuugccuauaccuuuaagacaaacaaacaaacacacacacaaacaagcu

SEQ ID NO: 127250 - RNA, 64 nt, hsa
aagacuaaaauuuugccuauaccuuuaagacaaacaaacaaacacacacacaaacaagcucuaa

SEQ ID NO: 127251 - RNA, 64 nt, hsa
uagcuucuugucuuaggccugaaccaaaaaacaacaaacaaacaaaaaacaagaaugaaaaaca

SEQ ID NO: 127252 - RNA, 64 nt, hsa
uucuugucuuaggccugaaccaaaaaacaacaaacaaacaaaaaacaagaaugaaaaacagaaa

SEQ ID NO: 127253 - RNA, 64 nt, hsa
acuucaggucuuaagugcaaaucaaagcaaaaaacaaacaaaacuuacauggaaaaacuguaag

SEQ ID NO: 127254 - RNA, 64 nt, hsa
ggucucagaccuacaaagaguuaaaacaaacagacaaacaaaaaaaaacacuacuauuuuaaau

SEQ ID NO: 127255 - RNA, 64 nt, hsa
auggaagcuggagugugacuggaaaaauacucagcaaacaaaguuaccaauuccauacagagau

SEQ ID NO: 127256 - RNA, 64 nt, hsa
gggcugaaaacagcagcauuuucaguaauuccuacaaacaaaaaucuuugugucuggacaccug

SEQ ID NO: 127257 - RNA, 64 nt, hsa
cgacggagcgagacucugucucaaaacaaacaaacaaacaaaagacccaaucugagucuuaucg

SEQ ID NO: 127258 - RNA, 64 nt, hsa
ugggcgacggagcgagacucugucucaaaacaaacaaacaaacaaaagacccaaucugagucuu

SEQ ID NO: 127259 - RNA, 64 nt, hsa
agccugggcgacggagcgagacucugucucaaaacaaacaaacaaacaaaagacccaaucugag

SEQ ID NO: 127260 - RNA, 64 nt, hsa
aacauaaaauauaaacaaucaaaauccaaacaaacaaacaaacacucacugcaucgggacuuuu

SEQ ID NO: 127261 - RNA, 64 nt, hsa
acaaaacauaaaauauaaacaaucaaaauccaaacaaacaaacaaacacucacugcaucgggac

SEQ ID NO: 127262 - RNA, 64 nt, hsa
caaaacaaaacauaaaauauaaacaaucaaaauccaaacaaacaaacaaacacucacugcaucg

SEQ ID NO: 127263 - RNA, 64 nt, hsa
cccuuuggcuucugauuuuucucuuuuuuaaaaacaaacaaacaaacuguugcagauuaugagu

SEQ ID NO: 127264 - RNA, 64 nt, hsa
uuggcuucugauuuuucucuuuuuuaaaaacaaacaaacaaacuguugcagauuaugagugaac

SEQ ID NO: 127265 - RNA, 64 nt, hsa
gugcuuguggucugugcuugcucagaaaaacaaacaaacaaacaguuuuuccaauuauaaauaa

SEQ ID NO: 127266 - RNA, 64 nt, hsa
ugacgugcuuguggucugugcuugcucagaaaaacaaacaaacaaacaguuuuuccaauuauaa

SEQ ID NO: 127267 - RNA, 64 nt, hsa
acagagagagacuccaucucaaaacaaaaacaaacaaacaaacagaaagcaccgucgagaaaug

SEQ ID NO: 127268 - RNA, 64 nt, hsa
ggcgacagagagagacuccaucucaaaacaaaaacaaacaaacaaacagaaagcaccgucgaga

SEQ ID NO: 127269 - RNA, 64 nt, hsa
uaauuuuuaaaacuugcacaaaucaaaacaaacacaaacaaaauuguauuuuauccuguuggug

SEQ ID NO: 127270 - RNA, 64 nt, hsa
agguguuucacuugcugagauuuccuguacauugcaaacaaauacagaaugcaaacccucaaag

SEQ ID NO: 127271 - RNA, 64 nt, hsa
gcaauuuuaaaacagacuccuuuaaaaaaacaaacaaacaaaaaaaacauagacuucuuuauau

SEQ ID NO: 127272 - RNA, 64 nt, hsa
auaggcaauuuuaaaacagacuccuuuaaaaaaacaaacaaacaaaaaaaacauagacuucuuu

SEQ ID NO: 127273 - RNA, 64 nt, hsa
gacucugucucaaaaaaaaaaaaacaaaaacaaacaaacaaaaaaaacaccucaccaugagugc

SEQ ID NO: 127274 - RNA, 64 nt, hsa
guaagacucugucucaaaaaaaaaaaaacaaaaacaaacaaacaaaaaaaacaccucaccauga

SEQ ID NO: 127275 - RNA, 64 nt, hsa
acuuccuugaaaauuuuauuaaaaaacaaacaaacaaacaaaaagccuguccacccuugagaau

SEQ ID NO: 127276 - RNA, 64 nt, hsa
aaucacuuccuugaaaauuuuauuaaaaaacaaacaaacaaacaaaaagccuguccacccuuga

SEQ ID NO: 127277 - RNA, 64 nt, hsa
aagaaaucacuuccuugaaaauuuuauuaaaaaacaaacaaacaaacaaaaagccuguccaccc

SEQ ID NO: 127278 - RNA, 64 nt, hsa
acaacuaauguuaauaagaucucaguugcacgugcaaacaaauccaaauucgaacauucuuagg

SEQ ID NO: 127279 - RNA, 64 nt, hsa
uugugcugggacugcuauacuugacauuauacugcaaacaaaacuuaaagagauaagcauuaaa

SEQ ID NO: 127280 - RNA, 64 nt, hsa
acauucccuagauucaaaggcaaaacagaagaaacaaacaaacaaacaaaaaaagcuugcaaaa

SEQ ID NO: 127281 - RNA, 64 nt, hsa
ucccuagauucaaaggcaaaacagaagaaacaaacaaacaaacaaaaaaagcuugcaaaauauu

SEQ ID NO: 127282 - RNA, 64 nt, hsa
uagauucaaaggcaaaacagaagaaacaaacaaacaaacaaaaaaagcuugcaaaauauuuuau

SEQ ID NO: 127283 - RNA, 64 nt, hsa
guguucuuuugccuucaaucuguugucuucaaaacaaacaaacaaaaaaagcuucuugcgccuu

SEQ ID NO: 127284 - RNA, 64 nt, hsa
ucuuuugccuucaaucuguugucuucaaaacaaacaaacaaaaaaagcuucuugcgccuuuccc

SEQ ID NO: 127285 - RNA, 64 nt, hsa
aaaaaaaaaaaaaaaaaaaaauccuaaaaacaaacaaacaaaaaaaacaauucuucauucagaa

SEQ ID NO: 127286 - RNA, 64 nt, hsa
aaaaaaaaaaaaaaaaaaaaaaaaauccuaaaaacaaacaaacaaaaaaaacaauucuucauuc

SEQ ID NO: 127287 - RNA, 64 nt, hsa
caggauaauuuuuaaaccaaucaaaugaaaaaaacaaacaaacaaaaaaggaaaugucauguga

SEQ ID NO: 127288 - RNA, 64 nt, hsa
auaauuuuuaaaccaaucaaaugaaaaaaacaaacaaacaaaaaaggaaaugucaugugagguu

SEQ ID NO: 127289 - RNA, 64 nt, hsa
augacagagugagacccuguuucuaaaaacaaaacaaacaaacaaacaaacaacguaucuuacu

SEQ ID NO: 127290 - RNA, 64 nt, hsa
cagagugagacccuguuucuaaaaacaaaacaaacaaacaaacaaacaacguaucuuacugacu

SEQ ID NO: 127291 - RNA, 64 nt, hsa
gugagacccuguuucuaaaaacaaaacaaacaaacaaacaaacaacguaucuuacugacuaaac

SEQ ID NO: 127292 - RNA, 64 nt, hsa
acuccuccuaccccccaagguaagaaacaaaaaacaaacaaacaaacaaaaauagaagacaaaa

SEQ ID NO: 127293 - RNA, 64 nt, hsa
cuccuaccccccaagguaagaaacaaaaaacaaacaaacaaacaaaaauagaagacaaaagaaa

SEQ ID NO: 127294 - RNA, 64 nt, hsa
uaccccccaagguaagaaacaaaaaacaaacaaacaaacaaaaauagaagacaaaagaaagaca

SEQ ID NO: 127295 - RNA, 64 nt, hsa
gugacagagcaagaccccaucucaaaaaaaaaaacaaacaaacaaaaaaaaaaccauauauaua

SEQ ID NO: 127296 - RNA, 64 nt, hsa
cagagcaagaccccaucucaaaaaaaaaaacaaacaaacaaaaaaaaaaccauauauauacaua

SEQ ID NO: 127297 - RNA, 64 nt, hsa
uauauaucuauauaaauuaaaacaaagaaacaaacaaacaaaaaacaagacaaacaacuacaaa

SEQ ID NO: 127298 - RNA, 64 nt, hsa
aauauauauaucuauauaaauuaaaacaaagaaacaaacaaacaaaaaacaagacaaacaacua

SEQ ID NO: 127299 - RNA, 64 nt, hsa
gcacuccggccugggcaacagaggaagacugccucaaacaaacaaaaaacaacaaaccaaacca

SEQ ID NO: 127300 - RNA, 64 nt, hsa
uccggccugggcaacagaggaagacugccucaaacaaacaaaaaacaacaaaccaaaccaaacc

SEQ ID NO: 127301 - RNA, 64 nt, hsa
gucauuuuguuuuaugacagacacacguaucuaacaaacaaacaaacagugaccuucuccaugg

SEQ ID NO: 127302 - RNA, 64 nt, hsa
uuuuguuuuaugacagacacacguaucuaacaaacaaacaaacagugaccuucuccauggguca

SEQ ID NO: 127303 - RNA, 64 nt, hsa
uaagguuuucuggcuuauugaggaaauuuccuaacaaacaaacaaacaaacaaacagaagagaa

SEQ ID NO: 127304 - RNA, 64 nt, hsa
guuuucuggcuuauugaggaaauuuccuaacaaacaaacaaacaaacaaacagaagagaagauc

SEQ ID NO: 127305 - RNA, 64 nt, hsa
ucuggcuuauugaggaaauuuccuaacaaacaaacaaacaaacaaacagaagagaagaucauua

SEQ ID NO: 127306 - RNA, 64 nt, hsa
gcuuauugaggaaauuuccuaacaaacaaacaaacaaacaaacagaagagaagaucauuaacca

SEQ ID NO: 127307 - RNA, 64 nt, hsa
ugggcgacagaucaagacucugucacacacaaaacaaacaaacaaauuuucccguuucucucug

SEQ ID NO: 127308 - RNA, 64 nt, hsa
cgacagaucaagacucugucacacacaaaacaaacaaacaaauuuucccguuucucucuguccc

SEQ ID NO: 127309 - RNA, 64 nt, hsa
gcaccacggcaagaaaaccaaaaaccaaaacaaacaaacaaaaaaaacccaacaacaacccaga

SEQ ID NO: 127310 - RNA, 64 nt, hsa
uuuugcaccacggcaagaaaaccaaaaaccaaaacaaacaaacaaaaaaaacccaacaacaacc

SEQ ID NO: 127311 - RNA, 64 nt, hsa
guguguauuugauggcucuaagggcuauaaauuacaaacaaaacacaucccagacauuaggagu

SEQ ID NO: 127312 - RNA, 64 nt, hsa
augggguguaccuguuuaucuguuaacuauuauccaaacaaauuaaauacugugguugccucua

SEQ ID NO: 127313 - RNA, 64 nt, hsa
uaugggguguaccuguuuaucuguaacuguuauccaaacaaauuaaauacuguggaugccuuua

SEQ ID NO: 127314 - RNA, 64 nt, hsa
guguguauuugauggcuccaagggcuauaaauuacaaacaaaacacaucccagacauuaggagu

SEQ ID NO: 127315 - RNA, 64 nt, hsa
ucuuucuuuuuccuuuuuuuuuaaaaaaacaaaacaaacaaaacaccuugaaucaaguuuguuu

SEQ ID NO: 127316 - RNA, 64 nt, hsa
uaugcaaaaaggaaaacacacacaaccaauaacucaaacaaaaaagggacauuuaugugcaguu

SEQ ID NO: 127317 - RNA, 64 nt, hsa
caauuuaagacuaagacuuugaagguaaaacaaacaaacaaacaucagucuuagucucuugcua

SEQ ID NO: 127318 - RNA, 64 nt, hsa
uugucaauuuaagacuaagacuuugaagguaaaacaaacaaacaaacaucagucuuagucucuu

SEQ ID NO: 127319 - RNA, 64 nt, hsa
gaaagagacuuugccucacuuuuacauucacaaacaaacaaaggaggggggagcagguuuuaug

SEQ ID NO: 127320 - RNA, 64 nt, hsa
cacggaaagagacuuugccucacuuuuacauucacaaacaaacaaaggaggggggagcagguuu

SEQ ID NO: 127321 - RNA, 64 nt, hsa
aggauggaggaagaucuacgaagcaaauggaaaacaaacaaaaaaagaggcagggguugcaauc

SEQ ID NO: 127322 - RNA, 64 nt, hsa
acaaagggcuaauauccagaaucuacaaugaacucaaacaaauuuacaggaacaaacaacccca

SEQ ID NO: 127323 - RNA, 64 nt, hsa
aguuccaaaauuuaaucacuaauuaaaaaucuaucaaacaaaacucuggaccagacagauuuau

SEQ ID NO: 127324 - RNA, 64 nt, hsa
ugacaaagaucuaauccagaaucuauaaagaacucaaacaaaucaacaaugagaaaaacaaccc

SEQ ID NO: 127325 - RNA, 64 nt, hsa
ccugggcaacagagggagcccccgucucaacaaacaaacaaaaagagccagugggggagggagg

SEQ ID NO: 127326 - RNA, 64 nt, hsa
ccagccugggcaacagagggagcccccgucucaacaaacaaacaaaaagagccagugggggagg

SEQ ID NO: 127327 - RNA, 64 nt, hsa
gaaagccuggcgauaccccaucucuauuuagaaacaaacaaacaaacaaauaaaaaaccuggca

SEQ ID NO: 127328 - RNA, 63 nt, hsa
gccuggcgauaccccaucucuauuuagaaacaaacaaacaaacaaauaaaaaaccuggcaccu

SEQ ID NO: 127329 - RNA, 64 nt, hsa
ccugagugacagagcgagacccugucucaaaaaacaaacaaacaaacaaacaaaaacagaacau

SEQ ID NO: 127330 - RNA, 64 nt, hsa
agugacagagcgagacccugucucaaaaaacaaacaaacaaacaaacaaaaacagaacauucug

SEQ ID NO: 127331 - RNA, 64 nt, hsa
acagagcgagacccugucucaaaaaacaaacaaacaaacaaacaaaaacagaacauucugggca

SEQ ID NO: 127332 - RNA, 64 nt, hsa
agcgagacccugucucaaaaaacaaacaaacaaacaaacaaaaacagaacauucugggcacggu

SEQ ID NO: 127333 - RNA, 64 nt, hsa
caguguguuugacaagacagcuugauauuucuaucaaacaaaugacuuucauauugcaacaauc

SEQ ID NO: 127334 - RNA, 64 nt, hsa
uaaauacuauguguucuggugugucuuaaaauuccaaacaaaaugaucccugcauuuccugaag

SEQ ID NO: 127335 - RNA, 64 nt, hsa
gcuucaauuagaauuauuuuucucaaaaaacaaacaaacaaaaaacacaaaaaaaaccacucuu

SEQ ID NO: 127336 - RNA, 64 nt, hsa
ugaggcuucaauuagaauuauuuuucucaaaaaacaaacaaacaaaaaacacaaaaaaaaccac

SEQ ID NO: 127337 - RNA, 64 nt, hsa
aagaagacauugcuggaguugacuuucuucuguccaaacaaacaaacaaaaacuaaacacacac

SEQ ID NO: 127338 - RNA, 64 nt, hsa
agacauugcuggaguugacuuucuucuguccaaacaaacaaacaaaaacuaaacacacacacaa

SEQ ID NO: 127339 - RNA, 64 nt, hsa
auugcuggaguugacuuucuucuguccaaacaaacaaacaaaaacuaaacacacacacaaaccc

SEQ ID NO: 127340 - RNA, 64 nt, hsa
agccuggugacagaacgagacucugucuuaaaaacaaacaaacaaaaaaaaaaucuguuagaua

SEQ ID NO: 127341 - RNA, 64 nt, hsa
uggugacagaacgagacucugucuuaaaaacaaacaaacaaaaaaaaaaucuguuagauaagcu

SEQ ID NO: 127342 - RNA, 64 nt, hsa
ccagacuccgucucuaaacaaacaaacaaacaaacaaacaaauaaagaaagaacauuggacaug

SEQ ID NO: 127343 - RNA, 64 nt, hsa
agagccagacuccgucucuaaacaaacaaacaaacaaacaaacaaauaaagaaagaacauugga

SEQ ID NO: 127344 - RNA, 64 nt, hsa
caacagagccagacuccgucucuaaacaaacaaacaaacaaacaaacaaauaaagaaagaacau

SEQ ID NO: 127345 - RNA, 64 nt, hsa
ugggcaacagagccagacuccgucucuaaacaaacaaacaaacaaacaaacaaauaaagaaaga

SEQ ID NO: 127346 - RNA, 64 nt, hsa
agccugggcaacagagccagacuccgucucuaaacaaacaaacaaacaaacaaacaaauaaaga

SEQ ID NO: 127347 - RNA, 64 nt, hsa
aggaggcaauaaucuuuuaacaguguuuugcaaacaaacaaaaagagaaaaaucccagccaggg

SEQ ID NO: 127348 - RNA, 64 nt, hsa
auauaggaggcaauaaucuuuuaacaguguuuugcaaacaaacaaaaagagaaaaaucccagcc

SEQ ID NO: 127349 - RNA, 64 nt, hsa
cucuauagcaagaugaagaggaaaaacaaacaaacaaacaaaaaaaaacacaaaaaaagaaaga

SEQ ID NO: 127350 - RNA, 64 nt, hsa
ggaacucuauagcaagaugaagaggaaaaacaaacaaacaaacaaaaaaaaacacaaaaaaaga

SEQ ID NO: 127351 - RNA, 64 nt, hsa
uagaggaacucuauagcaagaugaagaggaaaaacaaacaaacaaacaaaaaaaaacacaaaaa

SEQ ID NO: 127352 - RNA, 64 nt, hsa
uguugauaaugggcuuuguuagcacuuuuuaaaacaaacaaacaaacaaaacaaaaaagcaaac

SEQ ID NO: 127353 - RNA, 64 nt, hsa
gauaaugggcuuuguuagcacuuuuuaaaacaaacaaacaaacaaaacaaaaaagcaaaccaca

SEQ ID NO: 127354 - RNA, 64 nt, hsa
augggcuuuguuagcacuuuuuaaaacaaacaaacaaacaaaacaaaaaagcaaaccacauuug

SEQ ID NO: 127355 - RNA, 64 nt, hsa
auuccaucugaaaaacaaaaacaaaaacagaaaacaaacaaacaaaaaacaaaaaauccccaca

SEQ ID NO: 127356 - RNA, 64 nt, hsa
caucugaaaaacaaaaacaaaaacagaaaacaaacaaacaaaaaacaaaaaauccccacaacuu

SEQ ID NO: 127357 - RNA, 64 nt, hsa
aaaaaacucagccaacagguaguauugguaaaaacaaacaaacaaaaauccuuugcccucagaa

SEQ ID NO: 127358 - RNA, 64 nt, hsa
aacucagccaacagguaguauugguaaaaacaaacaaacaaaaauccuuugcccucagaagugc

SEQ ID NO: 127359 - RNA, 64 nt, hsa
uugguggauuagacagguuaaauauauaaacaaacaaacaaaaauugcucaaaaaagaggagaa

SEQ ID NO: 127360 - RNA, 64 nt, hsa
cuucuugguggauuagacagguuaaauauauaaacaaacaaacaaaaauugcucaaaaaagagg

SEQ ID NO: 127361 - RNA, 64 nt, hsa
ccaucucaaaacaaaacaaaacaaaacaaacaaacaaacaaaacuugcaucuaaccaaaaaguc

SEQ ID NO: 127362 - RNA, 64 nt, hsa
aacuccaucucaaaacaaaacaaaacaaaacaaacaaacaaacaaaacuugcaucuaaccaaaa

SEQ ID NO: 127363 - RNA, 64 nt, hsa
acgaaacuccaucucaaaacaaaacaaaacaaaacaaacaaacaaacaaaacuugcaucuaacc

SEQ ID NO: 127364 - RNA, 64 nt, hsa
aaacaaaauuaacugcuuaaauguuuugucggggcaaacaaaauuaugugaauuguguuguuuu

SEQ ID NO: 127365 - RNA, 64 nt, hsa
gaaaauguaaaagaccacaauuguucuucaaaaacaaacaaaacaaaacaaaacaaaauuaacu

SEQ ID NO: 127366 - RNA, 64 nt, hsa
cacccaaaaguucaaauuugucagugacauuuaccaaacaaacaggcagaguucacuauucuau

SEQ ID NO: 127367 - RNA, 64 nt, hsa
uauugucggcaggcggugagggguagaaaaaaaacaaacaaacaaacagaaaaaaaaaccaaaa

SEQ ID NO: 127368 - RNA, 64 nt, hsa
gucggcaggcggugagggguagaaaaaaaacaaacaaacaaacagaaaaaaaaaccaaaaaaaa

SEQ ID NO: 127369 - RNA, 64 nt, hsa
uuguaaaaaauaaaaauguauauagcugugagcucaaacaaaaacugcagacaaacaaaaaaga

SEQ ID NO: 127370 - RNA, 64 nt, hsa
guauauagcugugagcucaaacaaaaacugcagacaaacaaaaaagagaaaagcuuuuauuugu

SEQ ID NO: 127371 - RNA, 64 nt, hsa
gaaauuuugccuuuccacgcuucccucaguucaccaaaguuaccaaaauguaaaauaaaauaag

SEQ ID NO: 127372 - RNA, 64 nt, hsa
ugguuaucaccuucaauaguuucaauaugucccccaaaguuauguguuugaaacuugcaauagu

SEQ ID NO: 127373 - RNA, 64 nt, hsa
cuguauuguaauaaguauacucuguuauagucaacaaaguuaaauccaaauucaaaauuaucca

SEQ ID NO: 127374 - RNA, 64 nt, hsa
uguuauaaugugguguaucacauggauuauaaagcaaaguuauggucgauuucuauucuugaaa

SEQ ID NO: 127375 - RNA, 64 nt, hsa
uggcauuguacucaauggauuugaugcuguuugacaaaguuacugauucacugcauggcuccca

SEQ ID NO: 127376 - RNA, 64 nt, hsa
auuugcacuggaguucuaugcucucgcaccuuuccaaaguuaacagauuuugggguuguguugu

SEQ ID NO: 127377 - RNA, 64 nt, hsa
uuuccugggucuaaaauaaucgcuaguguuaugucaaaguuaagcccgcacgccaggcccaguu

SEQ ID NO: 127378 - RNA, 64 nt, hsa
agccaagaccuuaauuccaggaaagcacagaggacaaaguuaauucaaaaagaggcgcuagauc

SEQ ID NO: 127379 - RNA, 64 nt, hsa
aaacaggaccaaugagaggccacauccagcuacgcaaaguuacuggacaugcggucugcagugc

SEQ ID NO: 127380 - RNA, 64 nt, hsa
uuuccccucaccucuggaauuaaagaaggaacuccaaaguuacugaaaucucagggcaugaaca

SEQ ID NO: 127381 - RNA, 64 nt, hsa
cacaaucaacagugguuuuauuuuuuccucuacucaaaguuaaaacugaccaaaguuacuggcu

SEQ ID NO: 127382 - RNA, 64 nt, hsa
uuuauuuuuuccucuacucaaaguuaaaacugaccaaaguuacuggcuuuuuacuuugcuagaa

SEQ ID NO: 127383 - RNA, 64 nt, hsa
agggacacucugcuaguuuugaauaaguaaccaucaaaguuacuaaaacauggccaggcgcagu

SEQ ID NO: 127384 - RNA, 64 nt, hsa
acagagcgagaaccugucucaaaaaaaacaaaaacaaaguuacuaaaaugucaccuucacagaa

SEQ ID NO: 127385 - RNA, 64 nt, hsa
uguucauuaaaugcagucaugugacaacuguguucaaaguuagaaauaguggucggggaggcuu

SEQ ID NO: 127386 - RNA, 64 nt, hsa
ccuagagcaauuuagagcuaaaaccaguaauaagcaaaguuauugguuauaagcaagguauaag

SEQ ID NO: 127387 - RNA, 64 nt, hsa
uuauugguuauaagcaagguauaagcaguuaaagcaaaguuauuaauuauuaauauaugagaau

SEQ ID NO: 127388 - RNA, 64 nt, hsa
gguuuuguggcauaugaauagcuguuuaacaaaucaaaguuagcuuuuugcuucucagcuuuuu

SEQ ID NO: 127389 - RNA, 64 nt, hsa
uguaguguauuuaugugauaugugucaaguuacucaaaguuauugcuguuggaacugaacaaua

SEQ ID NO: 127390 - RNA, 64 nt, hsa
uuuacacaacccggauauguuguauauuuugacccaaaguuacagguagguuuaagagaauuuu

SEQ ID NO: 127391 - RNA, 64 nt, hsa
uugacaaaggaggaggaaacgauuacucuguaaacaaaguuauccuuacuugggagauugccac

SEQ ID NO: 127392 - RNA, 64 nt, hsa
uuguagccuugcugcuugcuuuucuucuggguggcaaaguuacuacuggaaaaacacuauaagu

SEQ ID NO: 127393 - RNA, 64 nt, hsa
ccuggccaacuuaaagauuuuucuggagguucagcaaaguuauguuaaauuaggggccuuuggu

SEQ ID NO: 127394 - RNA, 64 nt, hsa
ggcucuuuuuuuccuuccagaagaguugcaucaacaaaguuaauuguauuuauguauguaaaua

SEQ ID NO: 127395 - RNA, 64 nt, hsa
aaguacuacauuuucuuuuguucuugauaguagccaaaguuaaauguaucacauugaagaaggc

SEQ ID NO: 127396 - RNA, 64 nt, hsa
ugacagccuuucuauauuaaaggcucaggaugucacggagaaucuaucuaaucccacuguauua

SEQ ID NO: 127397 - RNA, 64 nt, hsa
ucugcacccagggggcggcucugcaggauugcuuacggagaacucugugucuggcaccucucuc

SEQ ID NO: 127398 - RNA, 64 nt, hsa
cugaguucgggaguucaagaccagccugaccaacacggagaaaccccgucucuacuaaaaauac

SEQ ID NO: 127399 - RNA, 64 nt, hsa
cuugcaacuucuuucuguugagagaaccucagguacggagaagaauagagguccucaugggucc

SEQ ID NO: 127400 - RNA, 64 nt, hsa
caaguuuacaucaagauaaacccugagaagaacuacggagaaaucaaauaaaauccugucauau

SEQ ID NO: 127401 - RNA, 64 nt, hsa
aaaucccauauguugggcaacaguucaaauaagcacggagaaguguugcccaaacuugguucuc

SEQ ID NO: 127402 - RNA, 64 nt, hsa
caaaagauggaauuugcccuuccuagaaaauaugacggagaaaagucugacucagagaaagugg

SEQ ID NO: 127403 - RNA, 64 nt, hsa
ugaaaaaaauuauuccuaaacucucuaaguguggacggagaaugagcaagccccagaaguauuu

SEQ ID NO: 127404 - RNA, 64 nt, hsa
cagaaggagagauugauccaugucuguuuguaggacggagaaaccgcuuggguaacuuguucaa

SEQ ID NO: 127405 - RNA, 64 nt, hsa
aaugaccugguaucuugccagagggcuuucuuaaacggagaauaagucaguauucuuaugccau

SEQ ID NO: 127406 - RNA, 64 nt, hsa
ccuugccgccugcugaaacauggugugcaggucaacggagaauacuagcugcuccuuuuucacc

SEQ ID NO: 127407 - RNA, 64 nt, hsa
uuagaauuuccagucuaaauggcacaggguaguuacggagaaaaggggauggagaaggagaaac

SEQ ID NO: 127408 - RNA, 64 nt, hsa
uugcuaggucauaccagaaaucaucaauugagguacggagaaacugaacugagaagguaagaaa

SEQ ID NO: 127409 - RNA, 64 nt, hsa
guggauuggagaaauuggggggaaauagaagaguacggagaaaggaagagauugaaaauguuac

SEQ ID NO: 127410 - RNA, 64 nt, hsa
uacagaaaaaguuuucuaaccccugcucuagguuacggagaaaaaaaaaauggaauaauguucu

SEQ ID NO: 127411 - RNA, 64 nt, hsa
cagggcagcaguacccccguuuggcacuugaggcacggagaagggaagggaaguccgcccagcc

SEQ ID NO: 127412 - RNA, 64 nt, hsa
aggagaacaaccaaagcagcuuacagacgccugaacggagaaugaaguguuucaaguaagcgag

SEQ ID NO: 127413 - RNA, 64 nt, hsa
gccuacguucucuuuaaaagcuguuguacguacuacggagaaacucaucauuuuuauacaggac

SEQ ID NO: 127414 - RNA, 64 nt, hsa
aaagggggggcuauggaagagcgguagggaguccacggagaagaugcagugaaugcuugcaugc

SEQ ID NO: 127415 - RNA, 64 nt, hsa
cuucggagaagugaaauauaacauuacucaguggacggagaaaucuguuuuguuacagagacau

SEQ ID NO: 127416 - RNA, 64 nt, hsa
ccagauccacaguugccaaacguugcaggaccgcacggagaagaugaaggagaucguagggugg

SEQ ID NO: 127417 - RNA, 64 nt, hsa
cugagguugggaguucgagaccagccugaccaacacggagaaacccuaucucuacuaaaaauac

SEQ ID NO: 127418 - RNA, 64 nt, hsa
ccaaguccaaauccugaaggagacgcgggagcccacggagaacgcuccaggagggccuguccau

SEQ ID NO: 127419 - RNA, 62 nt, hsa
ugucuuuguucuuggagagguggagugacuguucacggagaaugcacggcauggggaugaac

SEQ ID NO: 127420 - RNA, 64 nt, hsa
guccacucuucugcaguauccucccuggcagaacacggagaaucaggauuucuuaaauacucaa

SEQ ID NO: 127421 - RNA, 64 nt, hsa
uucugggaguucucuggcuucacgaagcauguuuacggagaaaacuacaaccuaucaguaccca

SEQ ID NO: 127422 - RNA, 51 nt, hsa
cggcccuugagaguaggugacacggagaagccagagccugagcgugagugc

SEQ ID NO: 127423 - RNA, 64 nt, hsa
acccacugcacuggccuugcucucccgcacgaggacggagaacacaaacuccgcaucugugggu

SEQ ID NO: 127424 - RNA, 64 nt, hsa
uggauaugaagaacuauugacuucuugggaaaaaacggagaaauauuaauuggaaaguugauuu

SEQ ID NO: 127425 - RNA, 64 nt, hsa
guggggagggcugccucagcagguuucucagaccacggagaagugacuuuugggcccggggcca

SEQ ID NO: 127426 - RNA, 64 nt, hsa
auaagcuauagacccgaggaaacucagagucggaacggagaaagguggacuggaaggggcccgu

SEQ ID NO: 127427 - RNA, 64 nt, hsa
guggcuggaguauuaggggccuggggauuggagaacggagaagaaguuguagcagagggaaaug

SEQ ID NO: 127428 - RNA, 60 nt, hsa
cuuguuguaauuucaacuaaaggcugaggcacggagaagaaaaggaaucagcaacugccc

SEQ ID NO: 127429 - RNA, 64 nt, hsa
gacaacagucaagcuguggaugaaaugaccaggaacggagaaugaaguauguaaaucccagcuu

SEQ ID NO: 127430 - RNA, 64 nt, hsa
cacucuuuauuuguuugggggcuggaggggggagacggagaaacagugaaaaguucggacucuc

SEQ ID NO: 127431 - RNA, 64 nt, hsa
uccucuuccuuaauucuaguuaaaacauucacuuacggagaauguaagguuaccuuugauguau

SEQ ID NO: 127432 - RNA, 64 nt, hsa
ccgcagaacuggcugcugcgugugaacugaacagacggagaagaugugcuagggagaaucugcc

SEQ ID NO: 127433 - RNA, 64 nt, hsa
agauuuuaagaucaaucccuuuuugaaacaacucacggagaaaaccagaacauaaauggccucc

SEQ ID NO: 127434 - RNA, 64 nt, hsa
acaaccugugaugugggcagagaugaggccaagaacggagaagggaggagcaugaagaguugua

SEQ ID NO: 127435 - RNA, 64 nt, hsa
aggagagugcauggugcagagggggcuggggcgcacggagaagcaggucccuauauugaccaag

SEQ ID NO: 127436 - RNA, 64 nt, hsa
ucccggaccccagugcuggggugggggaagggggacggagaaugacucaggcagggccccaggg

SEQ ID NO: 127437 - RNA, 64 nt, hsa
gucugguccugcuucuggcuacagccacccuggaacggagaaggcagcugacggggauugccuu

SEQ ID NO: 127438 - RNA, 64 nt, hsa
uuuccuucccauggcugcaucuuaagauggaugcacggagaaaccgucugccuggcucccuguc

SEQ ID NO: 127439 - RNA, 64 nt, hsa
gccacugggagugaggaagccagacuccagagacacggagaagaucaaacuggagcugcguuca

SEQ ID NO: 127440 - RNA, 64 nt, hsa
uuccaugggcagauuucccuuccugaaggccaaaacggagaacugcucucuuuaauuauuucaa

SEQ ID NO: 127441 - RNA, 64 nt, hsa
uagcagucucucuggauggcggagagugaaggagacggagaaacgcgccccaucccuuccgccg

SEQ ID NO: 127442 - RNA, 64 nt, hsa
uagauauuuggacaucaaauuuggacaccaggucacggagaaacacaaacaccacccaggaaca

SEQ ID NO: 127443 - RNA, 64 nt, hsa
gcaguaaugagggcaccgcgcagcucaguuagagacggagaaagggaagaggcugggauggucu

SEQ ID NO: 127444 - RNA, 64 nt, hsa
ggggagaggagcaggugggacccucaagaaaaugacggagaacaucccagacagaugggacuca

SEQ ID NO: 127445 - RNA, 64 nt, hsa
guaccugcacaaggccgucuucaggggccugcucacggagaaggcggcgcccgucaugaacguc

SEQ ID NO: 127446 - RNA, 64 nt, hsa
gaagaauuguauuucaagauucaaacaauaaccagcaauuaaacuuuuuucuacaauguauuug

SEQ ID NO: 127447 - RNA, 64 nt, hsa
uuuaaguacuaaacugcagccuuuucugucgccagcaauuaaagaccaccaaucuuguuugucc

SEQ ID NO: 127448 - RNA, 64 nt, hsa
uaaaaauuauugggaaagauuuaaagugcaggcugcaauuaaaacauggagaaaaguagaaaua

SEQ ID NO: 127449 - RNA, 64 nt, hsa
auuuacugucuggcuuugcccuuaaaauaggguugcaauuaaaaugugauuggcuuagguaauc

SEQ ID NO: 127450 - RNA, 64 nt, hsa
gaaaucaucuaaagaguuaaaauuucagugaucugcaauuaauuacauuguggaagauuauuuu

SEQ ID NO: 127451 - RNA, 64 nt, hsa
uauauuugcagacuauacauguuggauuaaaugggcaauuaaguuuuauaggaauuugcuuccu

SEQ ID NO: 127452 - RNA, 64 nt, hsa
uguugacuaaagaaucugguaguugcuuaauugggcaauuaaacaauuuauggcucuauuuugu

SEQ ID NO: 127453 - RNA, 64 nt, hsa
cuuauauauacaauuccacacuggaagacacucagcaauuaaugaaguuaauuacugggccaac

SEQ ID NO: 127454 - RNA, 64 nt, hsa
caagaugugggaaucagcauaacagggcaaugcagcaauuaaccccacaucguuuucuguaguu

SEQ ID NO: 127455 - RNA, 64 nt, hsa
uauaucagaugacacugguggcucuaaggauauugcaauuaagcagcuaccuguagccagguau

SEQ ID NO: 127456 - RNA, 61 nt, hsa
uuuguacauuauauaguauuuugaagauauggaaccuuaugaaaaaaaaauagcaaauuag

SEQ ID NO: 127457 - RNA, 59 nt, hsa
uucauauccugucugacuagcaaaacgcagaaccuuaagauuguccacauccuucaugc

SEQ ID NO: 127458 - RNA, 64 nt, hsa
augugaugccuugcuuuucauaaaauagguauaauugggucauacacuugacgagagggugacu

SEQ ID NO: 127459 - RNA, 64 nt, hsa
aguuaucucuguaauguucugucccaguaugucuuugggucaccaguuaccuucuuaaaauaug

SEQ ID NO: 127460 - RNA, 64 nt, hsa
guacaaccauaugagccuuguaaggccaguucaguugggucaugccacuguuugagucucauag

SEQ ID NO: 127461 - RNA, 64 nt, hsa
gauucugugguuugguggguccccuagggccauguugggucaaguuagauggucccccauggca

SEQ ID NO: 127462 - RNA, 64 nt, hsa
uagugaugguggaucuagagacauucacuugaagagcaaggauuggggugggguggguugguga

SEQ ID NO: 127463 - RNA, 64 nt, hsa
uaaauccggcauugauguuuccaccauguggaaaagcaaggauuucccuggccccgcccugcac

SEQ ID NO: 127464 - RNA, 64 nt, hsa
ugugugaacaaaugugacuccauauuuauuacacagcaaggacugcuguguguggguguguucc

SEQ ID NO: 127465 - RNA, 64 nt, hsa
cugccuaggaggcuguaugccagagcucaucucuagcaaggaauuuaucuucaggugaagaaga

SEQ ID NO: 127466 - RNA, 64 nt, hsa
gaagagccaucuuggcaggguuauuuuauaucugagcaaggaguuuaaaugagacuaguuuaga

SEQ ID NO: 127467 - RNA, 64 nt, hsa
caaggugcuggacuguuacugacuuggaucccaaagcaaggagaucauuuggagcucuuggguc

SEQ ID NO: 127468 - RNA, 64 nt, hsa
gauauuuucacaccuuaccucauuuaauacaacaagcaaggagguagacaauauugucuaccuu

SEQ ID NO: 127469 - RNA, 64 nt, hsa
gccucaacggaauuuacaguucagaguccaaaauagcaaggaaguggugggaagaaggugagag

SEQ ID NO: 127470 - RNA, 64 nt, hsa
ccaggcaagcugugaucugaaaggagcaaggaacagcaaggaauuauuuuccagaaugacaccc

SEQ ID NO: 127471 - RNA, 64 nt, hsa
aggggucugaccaggcaagcugugaucugaaaggagcaaggaacagcaaggaauuauuuuccag

SEQ ID NO: 127472 - RNA, 64 nt, hsa
gaagcaaggaugagcagcaugaagaugucagaucagcaaggagaaacuucaacucaaucccagg

SEQ ID NO: 127473 - RNA, 64 nt, hsa
uaccucaguauuucagggcagcaaguguuugugaagcaaggaugagcagcaugaagaugucaga

SEQ ID NO: 127474 - RNA, 64 nt, hsa
cauagaucacguuacaagcacuuggcucagguccagcaaggacagaugaacaaauuccugaguc

SEQ ID NO: 127475 - RNA, 64 nt, hsa
aauuugcugccccccaccaguggcuucuagggaaagcaaggaccucacaugccaggugcccuag

SEQ ID NO: 127476 - RNA, 64 nt, hsa
augacucagcacugucccuuagcagggaugacacagcaaggaugacucagcacugccccucagc

SEQ ID NO: 127477 - RNA, 64 nt, hsa
augacacagcaaggaugacucagcacugccccucagcaaggaugacucagcacugccgcucaac

SEQ ID NO: 127478 - RNA, 64 nt, hsa; identical to SEQ ID NO: 127476

SEQ ID NO: 127479 - RNA, 64 nt, hsa; identical to SEQ ID NO: 127477

SEQ ID NO: 127480 - RNA, 64 nt, hsa
augacucagcacugucccuuagcagugaugacacagcaaggaugacucagcacugccccucagc

SEQ ID NO: 127481 - RNA, 64 nt, hsa; identical to SEQ ID NO: 127477

SEQ ID NO: 127482 - RNA, 64 nt, hsa
augacucagcagugucccuuagcagcgaugacacagcaaggaugacucagcacugccccucacc

SEQ ID NO: 127483 - RNA, 64 nt, hsa
augacucagcagggaugacucagcaccgccccucagcaaggaugacucagcagggaugauucag

SEQ ID NO: 127484 - RNA, 64 nt, hsa
gaugcugggccgggcagacauuuaugcucugagcagcaaggaccauugggauggaggugggcac

SEQ ID NO: 127485 - RNA, 64 nt, hsa
ccuggcacuuggcagguacuccuggauguugaugagcaaggaagagcaacggcccugucagcug

SEQ ID NO: 127486 - RNA, 64 nt, hsa
ggcucucucugccuagucuacaguacugacagaaagcaaggacaugcggccugcauggugggag

SEQ ID NO: 127487 - RNA, 64 nt, hsa
uucacauaggcucucaggugccagucuuccagaaagcaaggacugcccuucauucagccuugcu

SEQ ID NO: 127488 - RNA, 64 nt, hsa
augugaaggggagccagggaacguuucugaacuaagcaaggacaaauucagagacccugagcuu

SEQ ID NO: 127489 - RNA, 64 nt, hsa
guuuggaggaggcaagacuggaggugggaaaauuagcaaggaggucugugaaauaauccaggag

SEQ ID NO: 127490 - RNA, 64 nt, hsa
uaagcuggagccacaaugcaugaggcacacacacagcaaggaugacgcuguaaacauagcccac

SEQ ID NO: 127491 - RNA, 64 nt, hsa
gacaugggggaugcgcucgggauuggugugaagaagcaaggacuguuagaggcaggcuuuauag

SEQ ID NO: 127492 - RNA, 64 nt, hsa
gaauacauagccaccauugguaguacaccccaaaagcaaggauggcaugaugcuggugacucaa

SEQ ID NO: 127493 - RNA, 64 nt, hsa
uuaaaagauuguguggucaaauauucaauuuaagagcaaggaaauucuuauaaauauaacaaua

SEQ ID NO: 127494 - RNA, 64 nt, hsa
ucauauuaaaaacaaaaagugguccacuugaagcagcaaggacaaagggcaguuuagggagagg

SEQ ID NO: 127495 - RNA, 64 nt, hsa
uguaggcaggcuguaccugcaaauaggcauucugagcaaggauccuaaauuucccuuuggcuca

SEQ ID NO: 127496 - RNA, 64 nt, hsa
auugcuggaaacucagcugugcuccagacuagagccuccuuaccuaugcuauggauuuuuaauu

SEQ ID NO: 127497 - RNA, 64 nt, hsa
gcuagcaggcauucuuauaaaagaaacuuucgagccuccuuauauugcuggaaacucagcugug

SEQ ID NO: 127498 - RNA, 64 nt, hsa
gcugaggcugagcuucugauucaccaccccagggccuccuuauaguucucugcacacaauaggu

SEQ ID NO: 127499 - RNA, 64 nt, hsa
uuguguuuugugaccucagcagggugggggucuuccuccuuacucuaagcuaaaucuaggugag

SEQ ID NO: 127500 - RNA, 64 nt, hsa
gcuagauaugucuggcugaagauuugaugugguuccuccuuaagcuaugcguccuguuaauaau

SEQ ID NO: 127501 - RNA, 64 nt, hsa
ugguguucagcugugcugaugccugccauuggguccuccuuaggcucuguaagucgugacagcc

SEQ ID NO: 127502 - RNA, 64 nt, hsa
ccagacuguuucagcccagcccaucucagccaacccuccuuagacugagcugucagagcaagca

SEQ ID NO: 127503 - RNA, 64 nt, hsa
uugcucugugcgccuuuuauuuguccuuaaacuaccuccuuagagcucugaaggggucuccuag

SEQ ID NO: 127504 - RNA, 64 nt, hsa
cguuucaggacauggggcauagaaacugaggaguagcugagaggaagaugaagagaagcugaga

SEQ ID NO: 127505 - RNA, 64 nt, hsa
aaacugaggaguagcugagaggaagaugaagagaagcugagaagaagcugaggauccucacagg

SEQ ID NO: 127506 - RNA, 64 nt, hsa
gaacucuggauuuuuagagcuuuagaaauuuguaagcugagagaacaauguuucacuuaauagg

SEQ ID NO: 127507 - RNA, 64 nt, hsa
cuaaccaauaguuuauuuguuucauaaaucuaaaagcugagaaguccaagaugguggggcugcc

SEQ ID NO: 127508 - RNA, 64 nt, hsa
uugagaagagacacaggucucccgucccugcaccagcugagagagacuugccgcaaagcacaag

SEQ ID NO: 127509 - RNA, 64 nt, hsa
gugaggauuuucacuucuuuucucuagacuuggaagcugagauucagagaggaagcaucccuug

SEQ ID NO: 127510 - RNA, 64 nt, hsa
gguggugugcaccuauagucccagcuacucaggaagcugagacaagaggaucaauugagcccag

SEQ ID NO: 127511 - RNA, 64 nt, hsa
aaucgcuugaaccugggagguggagguugcagugagcugagaucgugcuauugcacuccagccu

SEQ ID NO: 127512 - RNA, 64 nt, hsa
gggagugagacaucuucuugcugcuggauuuccaagcugagaggacgugaaccugggaccacca

SEQ ID NO: 127513 - RNA, 64 nt, hsa
gagaaaugauguuauaaaaaacucauaaggcaagagcugagaaggaagcgcugaucuucuauuu

SEQ ID NO: 127514 - RNA, 64 nt, hsa
ccuuuugcuuuucagugucuucucagaaacaaccagcugagaagguaauuaaagucucauuuau

SEQ ID NO: 127515 - RNA, 64 nt, hsa; identical to SEQ ID NO: 127514

SEQ ID NO: 127516 - RNA, 64 nt, hsa
aauacacuuugaaacuauuuuucuguauuccaagagcugagaucuuagauuuuauguaguauua

SEQ ID NO: 127517 - RNA, 64 nt, hsa
guaucucuucuuucccuuuccugucucaggaaucagcugagaauucauucgauugucaugccuc

SEQ ID NO: 127518 - RNA, 64 nt, hsa
ccaccagucagggacagcagccucccugucacucagcugagaaggccagcccucccuggcugug

SEQ ID NO: 127519 - RNA, 64 nt, hsa
caccugucccucuccuauguggcagcuggggagcagcugagauguggacuuguaugcugcccac

SEQ ID NO: 127520 - RNA, 64 nt, hsa
gcccucggagccaaugaacagcuccuccucuuggagcugagaugagccccacguggagcucggg

SEQ ID NO: 127521 - RNA, 64 nt, hsa
gcucaagugauccuccugacucagccucuugaauagcugagaccacaggcuugugucaccaugc

SEQ ID NO: 127522 - RNA, 64 nt, hsa
aaucgcuugaacccaggaggcagagguugcagugagcugagaucgugccacugcacucuagccg

SEQ ID NO: 127523 - RNA, 64 nt, hsa
aauugcuuuaaccuuggaggcggagguugcauugagcugagaucaugcuagugcgcuccagccu

SEQ ID NO: 127524 - RNA, 64 nt, hsa
aaucacuugaacccaggaggcagagguuggagugagcugagaucgcgccaccgcacuccagccu

SEQ ID NO: 127525 - RNA, 64 nt, hsa
aaucgcuugagccagggagguggagguugcagugagcugagaucacaucauugcacuccagccu

SEQ ID NO: 127526 - RNA, 64 nt, hsa
uagggcacuugcuuccuucuuagcuaaaagcaccagcugagauuuuucagguaauuuuguuguu

SEQ ID NO: 127527 - RNA, 64 nt, hsa
aaaaccacauuuuucuacauacagcuggggagguagcugagaacuuggcacugcgcacacauac

SEQ ID NO: 127528 - RNA, 64 nt, hsa
ccagaacuuccuguucugugggucuggggucaccagcugagaugucaccugcuuuauuucuggc

SEQ ID NO: 127529 - RNA, 64 nt, hsa
aacagcacucgcugcaggguauuuuuagagucauagcugagagcuuguuagcuaagacccauug

SEQ ID NO: 127530 - RNA, 64 nt, hsa
ggcuccaggaagggcucuggcucagguugcagacagcugagaaaagauggcccugucagccacc

SEQ ID NO: 127531 - RNA, 64 nt, hsa
acuucagucaauagccauaucagggguacauucuagcugagaagcaaugggucacucauuaaug

SEQ ID NO: 127532 - RNA, 64 nt, hsa
ugacaagaacaaagccacugacugagauggagugagcugagacagauaagagaauaccuugguc

SEQ ID NO: 127533 - RNA, 64 nt, hsa
agaagaggcaaagcuacagguuuacuugggagccagcugagaagagagcagacucacaggugcu

SEQ ID NO: 127534 - RNA, 64 nt, hsa
agagaacgcagagcucccagccugcuguggaggcagcugagaagugguggccucaggacugaga

SEQ ID NO: 127535 - RNA, 64 nt, hsa
gaucacuugggcccaggaggucaagccugcagcgagcugagaucacaccacugcacuccagccu

SEQ ID NO: 127536 - RNA, 64 nt, hsa
aaucgcuugaaccggggagguggagguugcagugagcugagaucacgccauuguacuccagccu

SEQ ID NO: 127537 - RNA, 64 nt, hsa
cuuuuggcuugcagacugccuucuaucccagaacagcugagaaaucuaugaagcugagauucug

SEQ ID NO: 127538 - RNA, 64 nt, hsa
gccuucuaucccagaacagcugagaaaucuaugaagcugagauucugaaggacccagcuuaggu

SEQ ID NO: 127539 - RNA, 64 nt, hsa
ucuauccucauaccaccacugcugcuucccacccagcugagaaugcccccuccucccugacucc

SEQ ID NO: 127540 - RNA, 64 nt, hsa
uuaucuucugaaggguuuuaaagaauggccaauuagcugagaagaauuaucuaaucaauuagug

SEQ ID NO: 127541 - RNA, 64 nt, hsa
cugaagauaaaggaagaaccaaaagccaaguuaaagcugagagcacaagugcugcauggaaagg

SEQ ID NO: 127542 - RNA, 64 nt, hsa
accuaaccugcaucccauuuccagccucuuuucaagcugagaaaaaaaaaaaaaaacacguuug

SEQ ID NO: 127543 - RNA, 64 nt, hsa
aguuaaaaaaaaggggggagggaaugggagagaaagcugagauuucaguuuccuacugcaguuu

SEQ ID NO: 127544 - RNA, 64 nt, hsa
cuuuggcccagagguggguuaaacuguaagggacagcugagauugagugucaguauugcuaagc

SEQ ID NO: 127545 - RNA, 64 nt, hsa
agagugaaaacacaugcuacaaugaggcagcaucagcugagagcaggaagagcgaucuacuuua

SEQ ID NO: 127546 - RNA, 64 nt, hsa
uauuuccaagauuuuccaagaugaagccagugcuagcugagaagcagcaaugaacagaaagcug

SEQ ID NO: 127547 - RNA, 64 nt, hsa
cuucaagcaauccuccugugucagccaccagaguagcugagacuacagggguaugccaccaugc

SEQ ID NO: 127548 - RNA, 64 nt, hsa
gcucaagugauccucccaccucagccuccugaguagcugagaccacaggcgugugccaccacgc

SEQ ID NO: 127549 - RNA, 64 nt, hsa
uccagguagcucuccugaaccuccuccuuccccaagcugagaagcugagagcuggaggacaaua

SEQ ID NO: 127550 - RNA, 64 nt, hsa
gcucuccugaaccuccuccuuccccaagcugagaagcugagagcuggaggacaauauccaggga

SEQ ID NO: 127551 - RNA, 64 nt, hsa
uaaacaucacagcagauaaugaagcugauuuuuuagcugagauagaagcuuuggagaaaaugaa

SEQ ID NO: 127552 - RNA, 64 nt, hsa
aaucgcuugaacccgggaggcagagguugcagugagcugagaucaugccacugcacuccggccu

SEQ ID NO: 127553 - RNA, 64 nt, hsa
cuuuuuuguauacucauggggcugauugcaccauagcugagaacguggaaugcagaaugagccc

SEQ ID NO: 127554 - RNA, 64 nt, hsa
aaggguuugcccaguuugcagaugagaaacccaaagcugagagagguguggggaaccgcccaag

SEQ ID NO: 127555 - RNA, 64 nt, hsa
gcauaaagguauugagagggaacaaaaaacauaaagcugagaaucuugagagagcucaucuacc

SEQ ID NO: 127556 - RNA, 64 nt, hsa
aauaacuuaaacccgggaggcggagguuacagugagcugagaucgugccacugcacuccagccu

SEQ ID NO: 127557 - RNA, 66 nt, hsa
aaauccacauaaaagugcucuccugccugggcagcaacaaccaagaacaaagccccgggacuguuu

SEQ ID NO: 127558 - RNA, 66 nt, hsa
cagcucuuuaaauagcugcccaucuccugugauugcacaaccaagcacuuugacauuugcaccuua

SEQ ID NO: 127559 - RNA, 66 nt, hsa
ggcuccugucccugcugcuccucuaggccucacucaacaaccaagcgccuggaggacgggacagau

SEQ ID NO: 127560 - RNA, 66 nt, hsa
guuguguaauacuaaaaucacgagaacaccuaaacaacaaccaaaaaucuauugugguaugcacuu

SEQ ID NO: 127561 - RNA, 66 nt, hsa
ugcccacuagacaucagaagcacucccccaguugugacaaccaaaaauaucuccagaccuuggcaa

SEQ ID NO: 127562 - RNA, 66 nt, hsa
aguugccaaaaagagcuuauagccggaagcccugggacaaccaacagcagacaguggccaaaauuu

SEQ ID NO: 127563 - RNA, 66 nt, hsa
aauuuaaaguuaguaucuacagauggaauuguaucuacaaccaaaugccucuuaucccugaauuca

SEQ ID NO: 127564 - RNA, 66 nt, hsa
ugcccucccagacgcugacugggaaacacaagaaguacaaccaacaggaaccagcgccaagggcag

SEQ ID NO: 127565 - RNA, 66 nt, hsa
cccccucggugaaugauggcugcuucuaaaacaaauacaaccaaaacucagcagugugaucuauag

SEQ ID NO: 127566 - RNA, 66 nt, hsa
uccauaguucccuccacgaaagcauucagaaacccuacaaccaaaaguccauccacagcuucauga

SEQ ID NO: 127567 - RNA, 66 nt, hsa
gcuaauugugccaggggcuguuauauacauauauacacaaccaaggugugaucugaauuuaaucca

SEQ ID NO: 127568 - RNA, 66 nt, hsa
gucaauugcuaauacccaguuacuuaugauuuaaaaacaaccaacagaaaacaucccacugacugu

SEQ ID NO: 127569 - RNA, 66 nt, hsa
ggccuuugcucacggguggcccugcccaccccuggcacaaccaaaaucccacugaugcccaucaug

SEQ ID NO: 127570 - RNA, 66 nt, hsa
agcagggcaaguucugaaccaggagaggcagccuagacaaccaaguggcagcaggugggggcauuc

SEQ ID NO: 127571 - RNA, 66 nt, hsa
gcaugacagcgauacaguacuuaagugucuguguagacaaccaaagaauaaaugauucaugguuuu

SEQ ID NO: 127572 - RNA, 66 nt, hsa
uuagguuuugugauagaaugggauuugaugaaaaagacaaccaaaggaaaauggggaggcuuggga

SEQ ID NO: 127573 - RNA, 66 nt, hsa
cagcauuagucacuuugaaauguaacgaaugguacuacaaccaauuccaaguuuuaauuuuuaaca

SEQ ID NO: 127574 - RNA, 66 nt, hsa
gauauuuagcagcaacccuggcccacucuaguuaugacaaccaaaaaugucucuauacauugccag

SEQ ID NO: 127575 - RNA, 66 nt, hsa
agcuuggccagcuuugugaaccuuugacaucugaaaacaaccaaggauccaucugggcuucucuuc

SEQ ID NO: 127576 - RNA, 66 nt, hsa
ggagggggcaaaugagccuuaagaaaugguuuuuaaacaaccaaacaaaaagcaggaaaaacaaau

SEQ ID NO: 127577 - RNA, 66 nt, hsa
gccucgggagugggaauugcugguacaaagaccaaaacaaccaaaugccaccgcugcccugugggu

SEQ ID NO: 127578 - RNA, 66 nt, hsa
guagauuuuauucaucacaggacagaauaaucaaggacaaccaaaauccuuuuguuaguuucagua

SEQ ID NO: 127579 - RNA, 66 nt, hsa
uaugaguucagaucuaucuuauuggucuuuaauauuacaaccaauccuuaacuuuccacuauaaag

SEQ ID NO: 127580 - RNA, 66 nt, hsa
accugcauugcucucccucgugcuccccaaaucaccacaaccaaccaauaccgcgauccaugaggg

SEQ ID NO: 127581 - RNA, 66 nt, hsa
guguucagccugaccccgccucaccaauacacggacacaaccaaaucauaacauauagcagaccaa

SEQ ID NO: 127582 - RNA, 66 nt, hsa
aaggaccacauugcuuacuugaaacagacaaugaaaacaaccaaagugauauauaaaauaguugau

SEQ ID NO: 127583 - RNA, 66 nt, hsa
cuuuucacagcaagaacaguccauguuguauauaauacaaccaacauuauagaacuuuuaggguug

SEQ ID NO: 127584 - RNA, 66 nt, hsa
ucuuucuucugcuuucuucaccauaauaaacuuuggacaaccaagcaagcucuaaccgcaaugcca

SEQ ID NO: 127585 - RNA, 66 nt, hsa
gccaaaaugauguacaguuaaaaagagugcguggaaacaaccaaacaauauaaccuaaaacuaaca

SEQ ID NO: 127586 - RNA, 66 nt, hsa
gcuagggugagaugucagaaagcgcuuguauuuuaaacaaccaaaaagaauuguaaggguggcuug

SEQ ID NO: 127587 - RNA, 66 nt, hsa
uucuuuuuguuauuuuuauuguuuguacuaauguugacaaccaaaauuugcaaaaaaauuaaaguu

SEQ ID NO: 127588 - RNA, 66 nt, hsa
gcauuuuacuuuugcauccaguuuuuauaguuuuccacaaccaagccacccuucacagauaaaaua

SEQ ID NO: 127589 - RNA, 66 nt, hsa
gggagauacaauucaaguugagauuuguggggggacacaaccaaaccauaucagcauccuuucaag

SEQ ID NO: 127590 - RNA, 66 nt, hsa
ugaguaggcugacccugagaagggacaauuaaagagacaaccaagggaacacauugagacuacaaa

SEQ ID NO: 127591 - RNA, 66 nt, hsa
ugagaagaauuaagaaaacucuucaaugaaguguuaacaaccaaacccuacagacgguaucagaaa

SEQ ID NO: 127592 - RNA, 66 nt, hsa
aagaaugauaccauuuuuaaaggcuucauuccuacaacaaccaaggcccucgguuauugguuugug

SEQ ID NO: 127593 - RNA, 66 nt, hsa
gaagaagauccagaaguugaauuuuuaaagucacuaacaaccaaacaaaaacagaaacuucucagg

SEQ ID NO: 127594 - RNA, 66 nt, hsa
aggguuggugguggcagugcagcaggggagggacaaacaaccaagcuaugggugacagaggcucuc

SEQ ID NO: 127595 - RNA, 66 nt, hsa
uagugauagagugcagugauguuugccauuugcuggacaaccaacacccggguugcuccuuugauu

SEQ ID NO: 127596 - RNA, 66 nt, hsa
uggaguuccuuuucuuucuguuguuguuucccagcuacaaccaacuaaagacacaaauggcguucu

SEQ ID NO: 127597 - RNA, 66 nt, hsa
ucagagguuagugaaauucacaucaaagucaaacccacaaccaagucguccacaaauacuucacug

SEQ ID NO: 127598 - RNA, 66 nt, hsa
agcuggucaagacggucacgggagcucuaggugggcacaaccaaccccucuccugggaggccccug

SEQ ID NO: 127599 - RNA, 66 nt, hsa
gagaguuuuagccgucuuguguuucuuguuuacuucacaaccaaauuuguccccucuucucucugu

SEQ ID NO: 127600 - RNA, 66 nt, hsa
gggcaggugucacaaagaagagggcccuaagggcucacaaccaaagugauccgccaagcagggcag

SEQ ID NO: 127601 - RNA, 66 nt, hsa
aauucauuuuucugauuugauaacuacccaaaccaaacaaccaauacauacaugggaagagaggcc

SEQ ID NO: 127602 - RNA, 66 nt, hsa
ucugcugucgcuaccacugugcacaucugaaaacucacaaccaagaaaauccauucuauuuucuua

SEQ ID NO: 127603 - RNA, 66 nt, hsa
aagaguuaucggcccauagcuaauaaguagugacagacaaccaagcuucaauauuuuucuaaagaa

SEQ ID NO: 127604 - RNA, 66 nt, hsa
accugaaugaaagaagcaaaugacuauucucugaagacaaccaagagaaaauugcaaaaagacaag

SEQ ID NO: 127605 - RNA, 66 nt, hsa
gaccucugguuuaagauacugcuuuaacuacuguugacaaccaaguagagugacuuaagcugaaca

SEQ ID NO: 127606 - RNA, 66 nt, hsa
gucucccuguuuuuuauuuuuauuccuuucuacacuacaaccaaauugcuccaaaagacuuacuga

SEQ ID NO: 127607 - RNA, 66 nt, hsa
gauaagagcacuggguuugagauucccuccauuaaaacaaccaagacaaagaaaggaggggaaaaa

SEQ ID NO: 127608 - RNA, 55 nt, hsa
augagcaguuugccaacugagaaggacaaccaaagugagcuggaucuuugaagca

SEQ ID NO: 127609 - RNA, 66 nt, hsa
aaaaucuaauauuuuaucuuucuuuuuuuaugaccaacaaccaaauaaagcccaucaucaaucauc

SEQ ID NO: 127610 - RNA, 66 nt, hsa
agcaugugcucugcgcucccugcaagcugagcagauacaaccaaugcaucacuguauacucuugcu

SEQ ID NO: 127611 - RNA, 52 nt, hsa
uacaggaaacugaaagcugaagacaaccaagaggcuuaugagaucuaaugug

SEQ ID NO: 127612 - RNA, 66 nt, hsa
cgaacucaaggcuuaauuaacggggcacuaaacaaaacaaccaauaaagucaccagcaguauuacu

SEQ ID NO: 127613 - RNA, 66 nt, hsa
ugcauagcuuugcacuucaaaaaagcuuaauuaaguacaaccaaccaccuuuccagccauagagau

SEQ ID NO: 127614 - RNA, 66 nt, hsa
guguuuccuuaauuuauuuuguuaacaccccuaauuacaaccaaagugaugauguggagucuucug

SEQ ID NO: 127615 - RNA, 66 nt, hsa
caacagaagaggcugcugggccucuugucuucacaaacaaccaagagaucauccucuuggagagaa

SEQ ID NO: 127616 - RNA, 66 nt, hsa
acaaaaaaaccucuaugcaaucugaguagagcagccacaaccaaaaaauucuacaacacacacugu

SEQ ID NO: 127617 - RNA, 66 nt, hsa
uauucucauugcuguauuauauuggaaaaguuuuaaacaaccaagcuaaagcuaugugaaaguuga

SEQ ID NO: 127618 - RNA, 66 nt, hsa
gagauuacaggcaugaaccacugugcccagccgaaaacaaccaagaauuuuuuaacaauaaaauga

SEQ ID NO: 127619 - RNA, 66 nt, hsa
aaaguauuuaaauguuugccaaaaacaacagccaaaacaaccaaacuauuuucuaaauaaaccuuu

SEQ ID NO: 127620 - RNA, 66 nt, hsa
ugcauuuccugcuaauuuauuuugaguuuuaagaaaacaaccaaaacaauuccaaugaaaauuuua

SEQ ID NO: 127621 - RNA, 66 nt, hsa
cauagucaugugcgaggucaaaacugagucaccaccacaaccaaguuccagcuggcaagaagagga

SEQ ID NO: 127622 - RNA, 66 nt, hsa
aaaguuuuccuuuguaaucacucccauuuuuacuuaacaaccaacuuguuguggcucuuauuucug

SEQ ID NO: 127623 - RNA, 66 nt, hsa
uauauauauauauaaauuaaaaaggaaagaaaacuaacaaccaaccaaccaaccaaccaaccacaa

SEQ ID NO: 127624 - RNA, 66 nt, hsa
cuacaauuacuuugaacauuaauguugaaaaagaaaacaaccaaagaaaauugguacuuacccuuc

SEQ ID NO: 127625 - RNA, 66 nt, hsa
uuaccuugcaucucacagguagacaguauauaacuaacaaccaaagacuacauauugucacugaca

SEQ ID NO: 127626 - RNA, 59 nt, hsa
aucacaauaaacaggauugaacuuuguaaacaaccaaagucaggggccuucagaacugc

SEQ ID NO: 127627 - RNA, 66 nt, hsa
uaaguuucagaauguucccuucuuguagagagauggacaaccaaagucagugggacaaacuccagc

SEQ ID NO: 127628 - RNA, 66 nt, hsa
ucucauuugacccuuauagguagaaauaaugaauuaacaaccaauaaaauuaaucauuuggcauua

SEQ ID NO: 127629 - RNA, 66 nt, hsa
cucuuuugucuacaaaaugcuucuaguccaggaggcacaaccaagaacugggauuaaugaagcauu

SEQ ID NO: 127630 - RNA, 66 nt, hsa
uguaaauuauauggcuuaucacuucuuagacaaauaacaaccaauagagaucauuguuaagaauac

SEQ ID NO: 127631 - RNA, 66 nt, hsa
auauuuuaguuaagaaaauuguuuaaauauagcaauacaaccaauaauuuguuuuauguuucacug

SEQ ID NO: 127632 - RNA, 66 nt, hsa
cugacccugcaggaagcaaagaggugagcuuaaagaacaaccaaacucugccaggggucccagaaa

SEQ ID NO: 127633 - RNA, 66 nt, hsa
ugcugcuuuuacuuugaugugaucucauugauguacacaaccaaguuccaauaaagugcuagaaug

SEQ ID NO: 127634 - RNA, 66 nt, hsa
cuuuggaguuauucaguuaaugacccuuuaauucucacaaccaaccagucauguugcuugaagcca

SEQ ID NO: 127635 - RNA, 66 nt, hsa
uuuagauuaacaguuuuguacuuuacauuuuuuuauacaaccaaccaguuucuuuucuagccaauc

SEQ ID NO: 127636 - RNA, 66 nt, hsa
gaggucccuggaaaaaaauauauaauuuucucacaaacaaccaauacauaaccuauggcaguuggu

SEQ ID NO: 127637 - RNA, 66 nt, hsa
aggaaguuaaagguugucuuuggucauuauguccugacaaccaacacccagcaggccacugaaauu

SEQ ID NO: 127638 - RNA, 66 nt, hsa
caaguccugugaggcaaaaaaacaaaacaaaacaaaacaaccaaacaaauacaaucuaacuuuuac

SEQ ID NO: 127639 - RNA, 66 nt, hsa
ggggggaaaaacccaacuuggugaacucccagcuaaacaaccaagacuucacugaagauuuauucc

SEQ ID NO: 127640 - RNA, 66 nt, hsa
aggauacagagugaugggugcauccugaccaaugcgacaaccaacacgugcucucacaaaccccug

SEQ ID NO: 127641 - RNA, 66 nt, hsa
ucuauaaucacaugcaaauacacagaauggauuguuacaaccaaaaugcaggcucuauuguuuuca

SEQ ID NO: 127642 - RNA, 66 nt, hsa
ucacugccauuuuuacacacuugacuuuuuaaaaauacaaccaaccaaccaccacaacuucuuaua

SEQ ID NO: 127643 - RNA, 66 nt, hsa
uuagaaaauauggguccauuccuuucuagaaaggggacaaccaagugucucaguuugccuugcggg

SEQ ID NO: 127644 - RNA, 66 nt, hsa
guuaccugggaugaagaauaaagagagcaaacuaccacaaccaaugguugagccccugucaagugc

SEQ ID NO: 127645 - RNA, 66 nt, hsa
acagucucacaaguaaacaccagcagcucauagauuacaaccaagaaagugacuguaucagaugau

SEQ ID NO: 127646 - RNA, 66 nt, hsa
cuaucuuagaaggugcuuuuagaaagaaccaggagaacaaccaaagcagcuuacagacgccugaac

SEQ ID NO: 127647 - RNA, 66 nt, hsa
aaagucugagcucuguugcagauaaccagagacccaacaaccaaaggcaaagcguaagccuugauu

SEQ ID NO: 127648 - RNA, 66 nt, hsa
uggugcacccgaacauuaggagaaaaugaaaaauauacaaccaaccguucgugagucaucaaaaag

SEQ ID NO: 127649 - RNA, 66 nt, hsa
guggagugaacaaagagcaugaaaauguugaagaccacaaccaaaauuuacucaaaucaaaguuaa

SEQ ID NO: 127650 - RNA, 66 nt, hsa
uuuuuauuaaucucuguauccuuagauaguccuccaacaaccaaagguugggacucugucuuacau

SEQ ID NO: 127651 - RNA, 66 nt, hsa
auauaugccugacugaauuaagcuugcuuguuuuaaacaaccaaaucauuggaacagaaaaggauu

SEQ ID NO: 127652 - RNA, 66 nt, hsa
cuaauaaaaagacaagcggugggacagagggaaccuacaaccaaaaacugccuagaucuuugcagu

SEQ ID NO: 127653 - RNA, 66 nt, hsa
accuucauucuucuaauacagcaaaauaaaaauuuaacaaccaaggaauaguauuuaagaaaaugu

SEQ ID NO: 127654 - RNA, 66 nt, hsa
uguguucauaucauuuucuuggggauuauuuguaggacaaccaaccuggaguuuugccucucuaga

SEQ ID NO: 127655 - RNA, 66 nt, hsa
cuccugauucuuaacauugucuuuaaugaccacaagacaaccaacagcuggccacguacuuaaaau

SEQ ID NO: 127656 - RNA, 66 nt, hsa
ugauuauagaaccacuauuacgugaaaaggcuugaaacaaccaacauauacaaauaaaacccugcc

SEQ ID NO: 127657 - RNA, 66 nt, hsa
auugaaauagacugaaauuaucuuggcaaaaguuagacaaccaaagacgacuuuaguggacugguu

SEQ ID NO: 127658 - RNA, 66 nt, hsa
uuccagucagauaauggcauuguacagacaugggaaacaaccaauuuuuuuguuuuucaguuguug

SEQ ID NO: 127659 - RNA, 66 nt, hsa
ggguggggcaaaauuagcaaaaaacaaaaaccaaugacaaccaaacugaaaccgaaacgaaaaauc

SEQ ID NO: 127660 - RNA, 66 nt, hsa
ucugguggauauuuuaacuugcuauucacaaucaggacaaccaaagucaaggacccagaugaacca

SEQ ID NO: 127661 - RNA, 66 nt, hsa
uuccucugaaugaaauuaucacagguugucucaagcacaaccaacugaaugucucuuaacuguggg

SEQ ID NO: 127662 - RNA, 66 nt, hsa
ccccauuuuuaaccucagccuucccuacugucaccaacaaccaagcuaaauaaagucaacagccug

SEQ ID NO: 127663 - RNA, 66 nt, hsa
ucuuuuuuauaauucuuuguacuaacucagcauguaacaaccaauuuacauggaaauaaaucgaaa

SEQ ID NO: 127664 - RNA, 66 nt, hsa
ugagaaucagacugacaguuuacagacgcugcugucacaaccaagaauguuaugugcaaguuuauc

SEQ ID NO: 127665 - RNA, 66 nt, hsa
acuguuuggagucuuuuaugaagucagucaacauuuacaaccaaagggcggggggggggguggggg

SEQ ID NO: 127666 - RNA, 66 nt, hsa
cagcggguagggcacagggaagagggagggugucucacaaccaaccaguucagaaugauacggaac

SEQ ID NO: 127667 - RNA, 54 nt, hsa
caccacaucgacuacuauaaaaagacaaccaacggccgacugccugugaagugg

SEQ ID NO: 127668 - RNA, 66 nt, hsa
auucacugaauaauuauaggcuuuuccucacauuagacaaccaacauaaucuucuuaaaggucuaa

SEQ ID NO: 127669 - RNA, 66 nt, hsa
uguuuaaaggauucaguuucuuugcugacguacuuuacaaccaaauaaaaucuugucgguggcugu

SEQ ID NO: 127670 - RNA, 66 nt, hsa
uagacgugaacucagaacugucggaggaaagacaacacaaccaacgcgaaaccaauuccucauccu

SEQ ID NO: 127671 - RNA, 66 nt, hsa
auguguguauauguacagugaaaauguugucucuuuacaaccaauugauaaccaaucacauaguuu

SEQ ID NO: 127672 - RNA, 66 nt, hsa
ucugacacauuugaguguccaaaauagccaauuaacacaaccaaauacaacugggccaauauaaac

SEQ ID NO: 127673 - RNA, 66 nt, hsa
gugacgggaaauacacagcauagcuuugaaauaaugacaaccaaggacaugaccauuagaacagca

SEQ ID NO: 127674 - RNA, 66 nt, hsa
auugggaauuuucuuaggguuauuacacuuaaagcaacaaccaacuaguaacagcuccaggaaagg

SEQ ID NO: 127675 - RNA, 66 nt, hsa
cgagaccucggcgagacuguaacuagugauguuuguacaaccaaagacucuauuuugugguuuaag

SEQ ID NO: 127676 - RNA, 66 nt, hsa
guguuauuuuugcuugaaacaacgcacacauuuucaacaaccaaaaaaugacaauuucuaguuuag

SEQ ID NO: 127677 - RNA, 66 nt, hsa
cagaugccgcaacuccacacaguguguaaaauauauacaaccaaaaaucagcuuuugcaggucuuu

SEQ ID NO: 127678 - RNA, 66 nt, hsa
uccaagaugguagaacuagguuaggaaaaauuccacacaaccaaacagucugccuuaaaagugacc

SEQ ID NO: 127679 - RNA, 66 nt, hsa
aauuuagauagauaagggcuacagcauacuaaaucgacaaccaaauuugucaugugacuaaaccgu

SEQ ID NO: 127680 - RNA, 66 nt, hsa
uaugcuagucaaccugauucacuaacacacagaugaacaaccaaaauauaccuaaaagguauaguc

SEQ ID NO: 127681 - RNA, 66 nt, hsa
ggggccucuccguauuugugcauugggcuccgugccacaaccaagcuucauuagucuuaaauuuca

SEQ ID NO: 127682 - RNA, 66 nt, hsa
auaaucuauuuugguauuguuacgaacauggauaugacaaccaaacuggaaaucagaacacuaggg

SEQ ID NO: 127683 - RNA, 66 nt, hsa
uauacauaaaugcccagcacaauucauuguuaaaaaacaaccaaaccucacacuacuguauuucau

SEQ ID NO: 127684 - RNA, 66 nt, hsa
gcccugggccagggugauuggacugagaauuuggccacaaccaaauugaugcuggcuggaaccaga

SEQ ID NO: 127685 - RNA, 66 nt, hsa
acuacuccuguaauuccuaccucccugcaaccaacuacaaccaagcucucugcaucuacucccaag

SEQ ID NO: 127686 - RNA, 66 nt, hsa
uaaaagaagcugaaaacuuaaugcaggaagaacaugacaaccaagcaaaugugaggagucugguga

SEQ ID NO: 127687 - RNA, 66 nt, hsa
caaccucagaaaguaacuaucuugaagguuugaaaaacaaccaaagaaagggagugaggacuaugg

SEQ ID NO: 127688 - RNA, 66 nt, hsa
guccucagaaauucucggcacacccuagaguauuguacaaccaacacccccacauaacuuuguccc

SEQ ID NO: 127689 - RNA, 66 nt, hsa
cauggccgaacucuugauagugacaaaucaguaaauacaaccaagaaaaagaaaaugaggggucag

SEQ ID NO: 127690 - RNA, 66 nt, hsa
gaugaguuuucaaugaguagucauaguugaaauuuuacaaccaaagcucccauuugauuguaaucu

SEQ ID NO: 127691 - RNA, 66 nt, hsa
uucagcaggguauuuaagugcuagggcuggucacacacaaccaacugaaaaagacuagagggauua

SEQ ID NO: 127692 - RNA, 66 nt, hsa
aaguuauugcuacugcugugaggccauagguacuagacaaccaauacaugcaggguuggguuuucu

SEQ ID NO: 127693 - RNA, 66 nt, hsa
uaacaauuaggcagacucuuuaugcuugcaaaaacuacaaccaauggaaugugauguucaugggua

SEQ ID NO: 127694 - RNA, 66 nt, hsa
uccuugcuuuucucuacuuccaaaucacaauuucuuacaaccaagcuuugugcucccgaguaagca

SEQ ID NO: 127695 - RNA, 66 nt, hsa
uuucaaagauaaauuggaauugcuguuggugaaauaacaaccaaaauacugaaucugauguacaua

SEQ ID NO: 127696 - RNA, 66 nt, hsa
ggaaucaagaggacaaucuagcucuccauacuuugaacaaccaaaugugcauugaauacucugaaa

SEQ ID NO: 127697 - RNA, 66 nt, hsa
uuguggagaagcuuuuuggaucagcauuuuguaaaaacaaccaaaaucaggaagguaaauugguug

SEQ ID NO: 127698 - RNA, 66 nt, hsa
caauacaaaguguuaauaugugucaucaguauaauaacaaccaacaaaaugccacuuucagaaaac

SEQ ID NO: 127699 - RNA, 66 nt, hsa
cauggguaccacaggaaccugggggccugugaaacuacaaccaaaaggcacacaaaaccguuucca

SEQ ID NO: 127700 - RNA, 66 nt, hsa
gagggagagaacugagcaucuccagcauucucagccacaaccaaaaaaaaauaaaaagggcagccc

SEQ ID NO: 127701 - RNA, 66 nt, hsa
auauuuacccacaaacaccuguauaugcgugcauauacaaccaaguggguagaccuagguguucuc

SEQ ID NO: 127702 - RNA, 66 nt, hsa
cuuccccaagcccccacagcuacuccaacccaaacaacaaccaagccaguuuaaugguaggaauuu

SEQ ID NO: 127703 - RNA, 66 nt, hsa
accuguuuggggcagcagggagcaaaaucuccuuuaacaaccaagcaguuccucauucacaucaac

SEQ ID NO: 127704 - RNA, 66 nt, hsa
ucuuaaaaguccuucauacaccuucuggguagggaaacaaccaacuaauugacuaacaccaccaac

SEQ ID NO: 127705 - RNA, 66 nt, hsa
cucuaaggguaaaucagggauagggccaaggagaaaacaaccaagaacucuuuccuguaauaagca

SEQ ID NO: 127706 - RNA, 66 nt, hsa
gcuaaagaaaaggaauaagcccugcccaguauguagacaaccaauucaaaugauugugcuaacuua

SEQ ID NO: 127707 - RNA, 66 nt, hsa
ccuaaaccauugguaauuuccacugucuuuucauuuacaaccaagcaacaccaguuaacauaguag

SEQ ID NO: 127708 - RNA, 66 nt, hsa
cacaccuuuaugacacacauuucuuauccccauuuuacaaccaaggcaucuaaagcaacaagaaau

SEQ ID NO: 127709 - RNA, 66 nt, hsa
ccugugaagaauucccuugcguauucucucucuaaaacaaccaaaaaaaaauggagaggcuuuuua

SEQ ID NO: 127710 - RNA, 66 nt, hsa
cagaucagcuggguccagaguuuaaugggcaacuggacaaccaaguuaaccccaauugaaagcacc

SEQ ID NO: 127711 - RNA, 66 nt, hsa
uacccaguagaugccacuagcccuccucucccagugacaaccaaaagucuucagacauugucaaac

SEQ ID NO: 127712 - RNA, 66 nt, hsa
uuuauuuccuucucuguuuuugggaaaugagaggcuacaaccaagacagcugaaggagaaugaaac

SEQ ID NO: 127713 - RNA, 66 nt, hsa
acuuuccuaagaaaccgcugauaaccaggacaaaacacaaccaaggguacacgcaggcaugcacgg

SEQ ID NO: 127714 - RNA, 66 nt, hsa
uccauugagugguuccauuuugccuguguggggcugacaaccaagccucgggggaaaugguaagug

SEQ ID NO: 127715 - RNA, 66 nt, hsa
augaaagaagcaggcaaagggaaggagccccugagaacaaccaaucuccgcucucuccuguccauu

SEQ ID NO: 127716 - RNA, 66 nt, hsa
ggggagugaacagugccuauuguugaaaaguuaaaaacaaccaagugccaagauguugaguggguu

SEQ ID NO: 127717 - RNA, 66 nt, hsa
gcaggacagaaauuguguuguuuuguucuuugaaauacaaccaaauucucuuaaaaugauugguag

SEQ ID NO: 127718 - RNA, 66 nt, hsa
agagggguucuugggagaagaggcauagguccagcaacaaccaacaaagcagaaggagggcucacc

SEQ ID NO: 127719 - RNA, 66 nt, hsa
ggcucuguguuuaagaaaaggaggacugaaggacaaacaaccaagaguggcccaguccccaccccc

SEQ ID NO: 127720 - RNA, 66 nt, hsa
cuuucuuagguaauucacugcagguuaagaauccacacaaccaaguucaugggaauuuuguguaaa

SEQ ID NO: 127721 - RNA, 66 nt, hsa
uuuuggagauuuuccuucagcuacaaauguuccaguacaaccaauauuacuccugaggggcaaaga

SEQ ID NO: 127722 - RNA, 66 nt, hsa
aaaauucuaccauuuuaaauucauguuucaacuccuacaaccaaaugagaaaaaucagggaugagc

SEQ ID NO: 127723 - RNA, 66 nt, hsa
agcuauguguuguuuuguucgaaagauggcaaguguacaaccaaaccaauccacuugcuuacagaa

SEQ ID NO: 127724 - RNA, 66 nt, hsa
guuuugguuguaauauucaguucacucacccaauguacaaccaaugaaauaaaagaagcauuuaaa

SEQ ID NO: 127725 - RNA, 66 nt, hsa
aacuguuucuauaaggaaauaauacuuuuuuaaacaacaaccaaaaaaugccuugcugauucacua

SEQ ID NO: 127726 - RNA, 66 nt, hsa
auaucaugugcuguaaaauaagaacuagcugaagagacaaccaaagaagcauuaaggcagguugau

SEQ ID NO: 127727 - RNA, 66 nt, hsa
uauacugggccagguccugguagaaccuuucaacaaacaaccaaacaaaaagaaaacacaaagaaa

SEQ ID NO: 127728 - RNA, 66 nt, hsa
uccccugaaggcuucuuguuagaaaauaguacaguuacaaccaauaggaacaacaaaaagaaaaag

SEQ ID NO: 127729 - RNA, 66 nt, hsa
uuguguaaacagcagcagucacguuccucggccgccacaaccaacaccaaagcaggaaaaccauuu

SEQ ID NO: 127730 - RNA, 66 nt, hsa
cucuuacuuuuuucuuaguaacugaucauuuccuagacaaccaagauucucaauaagucccagucu

SEQ ID NO: 127731 - RNA, 66 nt, hsa
caaauccaaaguucuuucaaaaaaaaaaacugaaacacaaccaaaaaagcaagagcgagagagagu

SEQ ID NO: 127732 - RNA, 66 nt, hsa
uuguggguuuuuuuuuuuaaaaaaagaaaaugaaaaacaaccaagcgcauccaaucucaaggaauc

SEQ ID NO: 127733 - RNA, 66 nt, hsa
caauagagugauuuuagacuauuuacaucguggguuacaaccaaugguaagucaugaauuuagcgu

SEQ ID NO: 127734 - RNA, 66 nt, hsa
ccauuucuaccacuagacccuuggaccaccauuggaacaaccaagcagaauguacuugauauuauu

SEQ ID NO: 127735 - RNA, 55 nt, hsa
gcagggcaaagcacaacuagagcucacaaccaaaacugcacuucagccucugcug

SEQ ID NO: 127736 - RNA, 66 nt, hsa
cugugaaaauaucuugaaauuguacaccaaaaccuuacaaccaacuuauuugaacauuuauuacac

SEQ ID NO: 127737 - RNA, 66 nt, hsa
acucacuauuuucaugaacaguuacccucuguccccacaaccaaagacaacucauggccuccuuug

SEQ ID NO: 127738 - RNA, 66 nt, hsa
aucuagugaagaggucgccauaaaauauuagagucaacaaccaaaauuauuaagcucugugcgagg

SEQ ID NO: 127739 - RNA, 66 nt, hsa
uacugaacccuuuaucaacuauguuuuuucagucugacaaccaaggcggcuacuaagugacuaagg

SEQ ID NO: 127740 - RNA, 66 nt, hsa
cccacacugaaaccaaaacauaaaaaccaaacccagacaaccaaaacauauucaaagcagcagcca

SEQ ID NO: 127741 - RNA, 66 nt, hsa
gagaggcuggggcagggccuuaugucuucuccuaguacaaccaaacagguaccuccuuuuuuuucu

SEQ ID NO: 127742 - RNA, 66 nt, hsa
gaaagaaguccuuucucuuuauugaguucgaggacuacaaccaauuuacacugccaucugaugccg

SEQ ID NO: 127743 - RNA, 66 nt, hsa
uguuagcaggugggaggaggccacagaacaauaaaaacaaccaaauaagaugccgagucucuggug

SEQ ID NO: 127744 - RNA, 66 nt, hsa
gucucguaagguuccacugagacgagaugucugagaacaaccaaagaaggccugcucuuugcugcu

SEQ ID NO: 127745 - RNA, 66 nt, hsa
gcauucuguaauauucuagggucacuccccuuagauacaaccaauguggcuauuuguuuuagaggc

SEQ ID NO: 127746 - RNA, 66 nt, hsa
uggagcugggggcucucagugguuaaacaaugcccaacaaccaaccagcuggcccuuggucuccuc

SEQ ID NO: 127747 - RNA, 66 nt, hsa
guccaaaugugaucaacuguucagggucucucucuuacaaccaagaacauuaucuuaguggaagau

SEQ ID NO: 127748 - RNA, 66 nt, hsa
cacagaaugucuacaagaauuauagcuuuaaaaaauacaaccaauuuuuauauuucaaaaauauuu

SEQ ID NO: 127749 - RNA, 66 nt, hsa
agguuugaguagaggcuuagagacaguugggugagaacaaccaaaaucuuaucauggucucaguca

SEQ ID NO: 127750 - RNA, 66 nt, hsa
guuguucuagcagugaagagauaaagaaaaaaaaguacaaccaaaugccagucaggcacagcagaa

SEQ ID NO: 127751 - RNA, 66 nt, hsa
gagaacuuucagacagguuuuacgaauauuuuuuacacaaccaaguuauggaguggcugccagcaa

SEQ ID NO: 127752 - RNA, 66 nt, hsa
uuuuuuuuuugcuuguuuuuaaagccaaaacaaaaaacaaccaagcacucuuccauauauaaaucu

SEQ ID NO: 127753 - RNA, 66 nt, hsa
cagagccuuucugaagagaauuauaucaaacuaauuacaaccaagaaauaauaguaugaagcggau

SEQ ID NO: 127754 - RNA, 66 nt, hsa
aauggacauauuucuuaugcaaaaaggaaaacacacacaaccaauaacucaaacaaaaaagggaca

SEQ ID NO: 127755 - RNA, 66 nt, hsa
aaauauauaccuauuuuaucuaguuaccuuucauuaacaaccaauuuuaaccgugugucaagauuu

SEQ ID NO: 127756 - RNA, 66 nt, hsa
cuguaugguagauucuugaccuuaaauuuaacaacaacaaccaaaaucagauuuuuuuugugaguc

SEQ ID NO: 127757 - RNA, 66 nt, hsa
ucugcagaugcuaguguuuuuuuggauacaauuuugacaaccaaguuaguaaacaaaauaucuuaa

SEQ ID NO: 127758 - RNA, 66 nt, hsa
gguauuucuagaagcagaaauagacugggaagaugcacaaccaagggguuacaggcaucgcccaug

SEQ ID NO: 127759 - RNA, 66 nt, hsa
aggaagucuguaccaaaucuguaggggguuuuucccacaaccaagcaauagacaccagcugggugu

SEQ ID NO: 127760 - RNA, 66 nt, hsa
aucuuaauucuuaauuuaaaaacauguuuacaaguuacaaccaacuucuaugaaaaguugaaaaga

SEQ ID NO: 127761 - RNA, 66 nt, hsa
caaggugacuggggacuuggaaccccuaggaccugaacaaccaagacuuuaaauaaauuuuaaaau

SEQ ID NO: 127762 - RNA, 66 nt, hsa
cagagcaggagugacaagggaggaaagaccaaaaaaacaaccaaccaaaaaaaaaaaaaaaaagga

SEQ ID NO: 127763 - RNA, 66 nt, hsa
ccuaagggcuucucucucaggaccucuaauuugaccacaaccaaccugggcuucagccacaucagu

SEQ ID NO: 127764 - RNA, 66 nt, hsa
cccucuucucccuagcuuagcauaaugucuggggaaacaaccaaaaucgcaauuuuaacaauaugc

SEQ ID NO: 127765 - RNA, 66 nt, hsa
ucacucgaaauaauuuuuuuuuucaaaagcaccuuaacaaccaauugcgaugcuguccuguuccuu

SEQ ID NO: 127766 - RNA, 66 nt, hsa
gaugaucaauggacuuuaaugaaaaaaaaaauaaaaacaaccaaaaaaauugaaggaauaucacca

SEQ ID NO: 127767 - RNA, 66 nt, hsa
cagccaaacugggaaccuaggugucugggucuugugacaaccaaagcacuuugacacuacccccug

SEQ ID NO: 127768 - RNA, 66 nt, hsa
ggaauucucuuuaaagaaaccaccaccaacaacaaaacaaccaaaaaccauguuuuaugucaaagc

SEQ ID NO: 127769 - RNA, 66 nt, hsa
ugaaggucuucccaacccuauugcuucuaaguuguaacaaccaaccauugagugguacuuauaucu

SEQ ID NO: 127770 - RNA, 66 nt, hsa
cacauuaccauucauaguaagaauucugguguuuacacaaccaaauuugaugcgaucugcucagua

SEQ ID NO: 127771 - RNA, 66 nt, hsa
ucaguaccuggcguugguacacaggcaaggauuggcacaaccaaaauuggccuuuuucucccucuu

SEQ ID NO: 127772 - RNA, 66 nt, hsa
auucauuuuuccuuaaccaguugugcaaggacagcaacaaccaaucuaaugaugagaauguacuua

SEQ ID NO: 127773 - RNA, 66 nt, hsa
gcugggauuacaggcgugagccacuggcccggcggcacaaccaaaucuuauuaaacucacccuagg

SEQ ID NO: 127774 - RNA, 66 nt, hsa
uugcucaaaggcuggugacuugugggccauucaucuacaaccaaguccugauggagcaagaggccc

SEQ ID NO: 127775 - RNA, 66 nt, hsa
aguagaauuuucucacugcguugggcauugguggggacaaccaaaacaggucugcagagcaaaggc

SEQ ID NO: 127776 - RNA, 66 nt, hsa
uaagcacuggccagucuguugugggcauuguuuucuacaaccaaauucuggguuuuuuucuucuuu

SEQ ID NO: 127777 - RNA, 66 nt, hsa
acauucggauggauuuggaaguuggaauuccucuuaacaaccaagggguuuauuuucaaagcaaua

SEQ ID NO: 127778 - RNA, 56 nt, hsa
aagggaaaccacagcuuuaaacgaagacaaccaaaagaaugcaaacuggauuuauc

SEQ ID NO: 127779 - RNA, 66 nt, hsa
guuuuguucaguaauuauaggucaaaucuaauuacaacaaccaagauggauugccaaacucuucug

SEQ ID NO: 127780 - RNA, 66 nt, hsa
guccuucccugggaaucaccacucgguccaaccuagacaaccaagaccgcuauaccuaaagaccuc

SEQ ID NO: 127781 - RNA, 66 nt, hsa
cauaggcauugauaaagccaggaaggaaauaaagucacaaccaaauaguauacacugucucuacug

SEQ ID NO: 127782 - RNA, 66 nt, hsa
ucaccagaugccaguugcacccucccccaaguugagacaaccaaaaaugucuccagauauugccag

SEQ ID NO: 127783 - RNA, 66 nt, hsa
cauggagaaugcaccauacucaugcaugcaaauuagacaaccaaguaugaaucuauuugugggugu

SEQ ID NO: 127784 - RNA, 66 nt, hsa
gcauuuugccccucaccccaauguuccacaccaucgacaaccaaggggugagguggggacaggccu

SEQ ID NO: 127785 - RNA, 66 nt, hsa
aaucaaauuacaagcuauuuaaguuuauauuccaucacaaccaagucagacuuguauuauaaguca

SEQ ID NO: 127786 - RNA, 66 nt, hsa
guuggugucacaguucaggcgcuccuugaauuaccaacaaccaaggcaucucagcuuucuguggcu

SEQ ID NO: 127787 - RNA, 66 nt, hsa
agcuucagagcugcuuucccagaaauucacgcuuaaacaaccaaccgguaaccaccacuuccccac

SEQ ID NO: 127788 - RNA, 64 nt, hsa; identical to SEQ ID NO: 120595

SEQ ID NO: 127789 - RNA, 64 nt, hsa; identical to SEQ ID NO: 120596

SEQ ID NO: 127790 - RNA, 64 nt, hsa; identical to SEQ ID NO: 120626

SEQ ID NO: 127791 - RNA, 64 nt, hsa; identical to SEQ ID NO: 120627

SEQ ID NO: 127792 - RNA, 64 nt, hsa; identical to SEQ ID NO: 120650

SEQ ID NO: 127793 - RNA, 64 nt, hsa; identical to SEQ ID NO: 120651

SEQ ID NO: 127794 - RNA, 64 nt, hsa; identical to SEQ ID NO: 120660

SEQ ID NO: 127795 - RNA, 64 nt, hsa; identical to SEQ ID NO: 120661

SEQ ID NO: 127796 - RNA, 64 nt, hsa; identical to SEQ ID NO: 120680

SEQ ID NO: 127797 - RNA, 64 nt, hsa; identical to SEQ ID NO: 120681

SEQ ID NO: 127798 - RNA, 64 nt, hsa; identical to SEQ ID NO: 120750

SEQ ID NO: 127799 - RNA, 64 nt, hsa; identical to SEQ ID NO: 120751

SEQ ID NO: 127800 - RNA, 64 nt, hsa; identical to SEQ ID NO: 120802

SEQ ID NO: 127801 - RNA, 64 nt, hsa; identical to SEQ ID NO: 120803

SEQ ID NO: 127802 - RNA, 64 nt, hsa
cuaaaauacaccuggaucugucuagucaaucaacauagcagagacagucuuaaaccuaccauug

SEQ ID NO: 127803 - RNA, 64 nt, hsa
aucccuucggagccaacaagaccgccccagggcuauagcagaaagaacuuuaaagcucaggagg

SEQ ID NO: 127804 - RNA, 64 nt, hsa
ucuggggccuggacacacugaggacaaugcggcuauagcagauggccauggcagucaguggcag

SEQ ID NO: 127805 - RNA, 64 nt, hsa
agccgggcccuuuccauaggaacugcccuuggagauagcagaguguggcugccccuccuugcuc

SEQ ID NO: 127806 - RNA, 64 nt, hsa
caucauuuagaaaugguuugccuuaauggagacaauagcagauccuguaguauuuccaguagac

SEQ ID NO: 127807 - RNA, 64 nt, hsa
cucuauuaguucuauaggagugaucucaagugagauagcagagcaagaugccaaaagaccauaa

SEQ ID NO: 127808 - RNA, 64 nt, hsa
augccucuguaauugggguugacacaugaacagaauagcagacacaaugcauaugaaaguuaca

SEQ ID NO: 127809 - RNA, 64 nt, hsa
aaggggaucagaaguaggaaggaaaaaauaagagauagcagaggaaaaagaaaaacauuuccuc

SEQ ID NO: 127810 - RNA, 64 nt, hsa
ucauagcugaaaauaaugauacugucaauuugagauagcagaaguuucacacaucaaaguaaaa

SEQ ID NO: 127811 - RNA, 64 nt, hsa
auauuaugaauuauuuucagaaauggaucuuugaauagcagaucaggauuuaaauaauaaaauu

SEQ ID NO: 127812 - RNA, 64 nt, hsa
ucgaaauuacuaaucaguuggggaaaaaaauacuauagcagacagcacuaaugucaucaacaaa

SEQ ID NO: 127813 - RNA, 64 nt, hsa
ucugggcaaaggagugcuaugcggaauucucugcauagcagaaaagcucccaccauuuucuuuu

SEQ ID NO: 127814 - RNA, 64 nt, hsa
aacuuggcccuuuccugauggaaauauuuccuccauagcagaaguuguguucugacaagacuga

SEQ ID NO: 127815 - RNA, 64 nt, hsa
uucucacguucuagugauuuggggcaugggcuuaauagcagauguacaguguauuccugcauua

SEQ ID NO: 127816 - RNA, 64 nt, hsa
ggagacaacggcagagggagugagcaggggagaaauagcagaggggcuuggagggucacauagg

SEQ ID NO: 127817 - RNA, 64 nt, hsa
ccagccagacuggguuaagggagcugcucaagcaauagcagagguuucacccggcaggaugaca

SEQ ID NO: 127818 - RNA, 64 nt, hsa
gacgcugcaggaacaagugggcuuggggaauugaauagcagagagcaaaccaaucagucccuca

SEQ ID NO: 127819 - RNA, 64 nt, hsa
gaaauuauuucaucagguggaaagucugggucuaauagcagacugcacaugagcagagugacau

SEQ ID NO: 127820 - RNA, 64 nt, hsa
uaauaaaacaacaacaaaaacagcaguuugugauauagcagagguuuaaauguacccuccccuu

SEQ ID NO: 127821 - RNA, 64 nt, hsa
uccucugggaauguuacauuguuugucugucuucauagcagauuuuaauuuugaauaaauaaau

SEQ ID NO: 127822 - RNA, 64 nt, hsa
auacgucccuguaacccaaucucucgguugauugauagcagaacagcucuuguuggucugagaa

SEQ ID NO: 127823 - RNA, 64 nt, hsa
uaugcagcauuuaccagaaaagaguauuccugggauagcagaaugcauaacacugaguguuaau

SEQ ID NO: 127824 - RNA, 64 nt, hsa
uuuguuuucuagggacacaaccaaaucauaacauauagcagaccaaucuauuuuugugugcugu

SEQ ID NO: 127825 - RNA, 64 nt, hsa
caguucuuauuguauggcauaggacuggcauuauauagcagaaaucaacuacuguacaauuucu

SEQ ID NO: 127826 - RNA, 64 nt, hsa
aacaauuuauuuucacaauucauauuuauuauagauagcagaaguaauccauuuuaauauggcc

SEQ ID NO: 127827 - RNA, 64 nt, hsa
agggaauggcuccuuauaccaaagaugcuggcacauagcagaacccagugcacguccuccccuu

SEQ ID NO: 127828 - RNA, 64 nt, hsa
gugauauucucuuugaauaaaccuauaauagaaaauagcagacaacauaaacaucuuuguaaau

SEQ ID NO: 127829 - RNA, 64 nt, hsa
accugaauuggaaaggaugugauuaauauaaauaauagcagauauaaauugugguuauguuacc

SEQ ID NO: 127830 - RNA, 64 nt, hsa
uaguauucccugugccccuggaugcacuuucauuauagcagagaguuuuuguugguucuuagac

SEQ ID NO: 127831 - RNA, 64 nt, hsa
cuuagaaaagcuaagagaagauaaggucugaauaauagcagaaaaaccaacaucuacaaaacau

SEQ ID NO: 127832 - RNA, 64 nt, hsa
ugggugaugucuuuccuuauguugcuuuuucaacauagcagaauuaauguagggagcuaaaucc

SEQ ID NO: 127833 - RNA, 64 nt, hsa
aaaucucaaauaggcuauuaaaaaagucuacaacauagcagaucuguuuugugguuuggaauau

SEQ ID NO: 127834 - RNA, 64 nt, hsa
aggauguggaguagagggaagggaaggauuggugauagcagagcuccaggccucccuuccaguc

SEQ ID NO: 127835 - RNA, 64 nt, hsa
uucauccucugagugugaccaggcauccuccacaauagcagacaguguuuucugggauaaguaa

SEQ ID NO: 127836 - RNA, 64 nt, hsa
ggauuuugaauaugccaaacacauuaaaggaaaaauagcagagauguucaccuuuuccuugcug

SEQ ID NO: 127837 - RNA, 64 nt, hsa
uccugaacagaugcuucuggucuguuuuccuggaauagcagacauccuuuugaacacuaaugau

SEQ ID NO: 127838 - RNA, 64 nt, hsa
uaaagaagaacucuggaguggucuaagacugauaauagcagaagaauaucaagaacacagaaac

SEQ ID NO: 127839 - RNA, 64 nt, hsa
aaggagacuggcugaagcugaaugaggaggcccuauagcagaagucugauucuaagagcaguag

SEQ ID NO: 127840 - RNA, 64 nt, hsa
cccuagcaagaagucugcucuguaucaccuuuauauagcagacaugucacccugcuucuacaca

SEQ ID NO: 127841 - RNA, 64 nt, hsa
uucccugugccacuuugacucagaggcugggagcauagcagaggggccaggcccaggcagagcu

SEQ ID NO: 127842 - RNA, 64 nt, hsa
ugaggucauccuugaaaaguggcagaaaaagaaaauagcagagauggguccagugcaguggcuu

SEQ ID NO: 127843 - RNA, 64 nt, hsa
gcuggcuucuuuuuccaugcguuaacuuuucccaauagcagaggaggcaaauaugagcauacaa

SEQ ID NO: 127844 - RNA, 64 nt, hsa
augaaguuuccccacaugugaagacagguacaaaauagcagagccaagcagacagugggucuau

SEQ ID NO: 127845 - RNA, 64 nt, hsa
gagagcaaaaccacauguucugucuugaggagccauagcagaaagagcaaauuagucauuauuu

SEQ ID NO: 127846 - RNA, 64 nt, hsa
uaaauauauacauacauaugagaaaaugauguuuauagcagagcuucacuagacaugguaugua

SEQ ID NO: 127847 - RNA, 64 nt, hsa
uuuggccauguccaguuuauacaguuuacaaaauauagcagaugcaagauuaugggggaaaucc

SEQ ID NO: 127848 - RNA, 64 nt, hsa
ccauaugguucuaggucccucuuacgucaucugcauagcagacuauaccucuucuguccgcuga

SEQ ID NO: 127849 - RNA, 64 nt, hsa
aagcgacaccagcaagccugugagcauuguguauauagcagacauggagguccugcagcaggag

SEQ ID NO: 127850 - RNA, 64 nt, hsa
uccuccacagguguugccuuuuuauaaagaccugauagcagaauaaauugguguuucccuguug

SEQ ID NO: 127851 - RNA, 64 nt, hsa
gcucuaagaagcagacaaccggacaugcgcauucauagcagaaggaaaccaucaagaaguggaa

SEQ ID NO: 127852 - RNA, 64 nt, hsa
uauucaagccacuagaauuaucaaauaugacgcuauagcagaguaaauacucugaauaagagac

SEQ ID NO: 127853 - RNA, 64 nt, hsa
aaacuuauuucuaaaauuaaaagaaaaaaaaacuauagcagagaggcuaaaaucuauuuaucga

SEQ ID NO: 127854 - RNA, 64 nt, hsa
gaaagaagguugcuguggugaggaacgagacuccauagcagagguaugccaucauggaaggggu

SEQ ID NO: 127855 - RNA, 64 nt, hsa
gcuggucaauacaaaaacuuguacacaaauauuuauagcagaauuauucauaauggccaaaagc

SEQ ID NO: 127856 - RNA, 64 nt, hsa
caaggggaauauauucaggucuagucuucuuauaauagcagaggucuugguaaaauaacuacca

SEQ ID NO: 127857 - RNA, 64 nt, hsa
agaucuuagggaugauuaaaggcagcauuugaugauagcagacauuguuacaaggacaugguga

SEQ ID NO: 127858 - RNA, 64 nt, hsa
gugaccaaugcguuggagaacgagggagggcuucauagcagaagacauuggaguuggaagguug

SEQ ID NO: 127859 - RNA, 64 nt, hsa
uucaauucaguuaagacuucugugauagauguuuauagcagagaagaaaugucucaucaauaga

SEQ ID NO: 127860 - RNA, 64 nt, hsa
ggaugcaagugauucuaaguuuguggauuuguggauagcagagggaucgggaccucuuggagga

SEQ ID NO: 127861 - RNA, 64 nt, hsa
ccuuagaacuuaucuguuaugcuccugauagccaauagcagauagaagcuugcaaucaagaggg

SEQ ID NO: 127862 - RNA, 64 nt, hsa
ggcgccugucgggcccgcacucaggagcacagccauagcagacggggggcugcgggcggggcga

SEQ ID NO: 127863 - RNA, 64 nt, hsa
gcucccgcauaccaggauaacccccgcaaaccacauagcagacccccgccauccucgcagagug

SEQ ID NO: 127864 - RNA, 64 nt, hsa
gaaaguaaugcccagucuuccugaauccuccuuaauagcagaaccuuggugauuuuguuggcuc

SEQ ID NO: 127865 - RNA, 64 nt, hsa
uuugcccuguuuucaacauuggaguaggcacugcauagcagauaccauugaauugcuguaaaaa

SEQ ID NO: 127866 - RNA, 64 nt, hsa
uucuuuucuguaaguuuaaguuuuccaucugaccauagcagaaaaaccuagacccaccuaguga

SEQ ID NO: 127867 - RNA, 64 nt, hsa
uuuauggucgauauacaauugauuuuuuaaaauaauagcagauuucuugcuucauaugacaaag

SEQ ID NO: 127868 - RNA, 64 nt, hsa
ugauugggacaguugccaggaggauaccaacuugauagcagaggggguuuuaugcaaacgcacu

SEQ ID NO: 127869 - RNA, 64 nt, hsa
cuccauugaacacauuuuucaacuuaaggucugcauagcagacuuuuaauaaccuugggauuua

SEQ ID NO: 127870 - RNA, 64 nt, hsa
ugaacaaaauguauuuagaaauauauuuaguuuuauagcagaagcagcucaauuguuugguugg

SEQ ID NO: 127871 - RNA, 64 nt, hsa
agcuaaaaacccugauaugguaauauuauggugcauagcagaggucucggaaaaaaaauauuuc

SEQ ID NO: 127872 - RNA, 64 nt, hsa
aaaaaaauuguauuaugugauccuaaggacaggaauagcagaccagccaacgggauggccuugg

SEQ ID NO: 127873 - RNA, 64 nt, hsa
ucuguuguucuguggucacagugaccuuagcuacauagcagacuuucccaaauguauugauuac

SEQ ID NO: 127874 - RNA, 64 nt, hsa
cagugcuggggacaaguuucuguugaaacuuuagauagcagaauuauuugcaauuuguagcaua

SEQ ID NO: 127875 - RNA, 64 nt, hsa
ggaguccuugaagcagagggcacuggaagacaauauagcagauuaaaauagcacagcucaugug

SEQ ID NO: 127876 - RNA, 64 nt, hsa
uguauagcuuucuaauauauauaauauuaugguaauagcagaaguuuuguuaucuuaauagcgg

SEQ ID NO: 127877 - RNA, 64 nt, hsa
ugccccacacuucucuuucucuuguaacugcacaauagcagaaaauuggcaagauguauuuuua

SEQ ID NO: 127878 - RNA, 64 nt, hsa
ucaaggggcuguuuccaggucucccggugucuaaauagcagagcuggaaugggaacugagaacc

SEQ ID NO: 127879 - RNA, 52 nt, hsa
aaaaggaggaaaaacaguaauaauagcagaaauuuugaagccagaaggacaa

SEQ ID NO: 127880 - RNA, 64 nt, hsa
ucaaagcugagucaguggcucuugcgaaugccccauagcagaagucccgggaagguaaaugcca

SEQ ID NO: 127881 - RNA, 64 nt, hsa
ccuugaguaaaugagcugaaguguaaagcaaagaauagcagaagcagcuugguaggauggaagg

SEQ ID NO: 127882 - RNA, 64 nt, hsa
gcuuggagaggagaucaugaucuuuauacugugaauagcagaaugucacagaugaagaauauua

SEQ ID NO: 127883 - RNA, 64 nt, hsa
ccaacgaacccucugcccuuggcucagaaugguuauagcagaaauacaaaaaaaaaaaaaaagu

SEQ ID NO: 127884 - RNA, 64 nt, hsa
auauuaaacauucuugcugcugcgcugcaaaaccauagcagauuugaggcacuguugaggacug

SEQ ID NO: 127885 - RNA, 64 nt, hsa
ccuaacagaccaucacagauuggaaacuugguagauagcagagcaugguauuagugaaaaaggu

SEQ ID NO: 127886 - RNA, 64 nt, hsa
cuggauggcuauucagauaacauggcaaaaaaugauagcagaagaucauuaaaaacuuaaaaua

SEQ ID NO: 127887 - RNA, 64 nt, hsa
uauaauuauauccuaucaaagaaaucgauacguaauagcagauuguuuuauauucauuccauuu

SEQ ID NO: 127888 - RNA, 64 nt, hsa
caguaaauauaugacugcaccagaaauaugugaaauagcagacauucugcuuacucaugucucc

SEQ ID NO: 127889 - RNA, 64 nt, hsa
cgugggcacccacggacguggcuuggugcugaggauagcagagcccccagccaucacugcuggc

SEQ ID NO: 127890 - RNA, 64 nt, hsa
auacucuaccaugaaggaugcgguaauggcaggaauagcagaauaauuggugcuuguaaacauu

SEQ ID NO: 127891 - RNA, 64 nt, hsa
ugaggaaccguaacucuuuggaacaaaccaaaauauagcagauguaauuguacaguuccugauu

SEQ ID NO: 127892 - RNA, 64 nt, hsa
aauguaaagaguauugaaggaacaacaaauaacaauagcagaaauaacagugugacauaaagug

SEQ ID NO: 127893 - RNA, 64 nt, hsa
gaggauauaagagcacuaaugcccucuuauuuucauagcagagacuugauacugucucaacuuu

SEQ ID NO: 127894 - RNA, 64 nt, hsa
uguuguuuucuuguaacaugauauggaauaaaguauagcagaaucuccguacauguucuaggua

SEQ ID NO: 127895 - RNA, 64 nt, hsa
gcagaggcauggaggagggaggcgugggaugggaauagcagaaaccaaccaugucuucagugau

SEQ ID NO: 127896 - RNA, 64 nt, hsa
uugcccucucccaucuggacuuagaugggagggcauagcagaucuugaagggauauacuuuccu

SEQ ID NO: 127897 - RNA, 64 nt, hsa
aagcugcagccggugcuugcacaccgccuugcacauagcagaggcuccgggcucacuccuuccu

SEQ ID NO: 127898 - RNA, 64 nt, hsa
gagccgcagccggugcuugcacaccgccuugcacauagcagaggcuccgggcugacuccuuccu

SEQ ID NO: 127899 - RNA, 64 nt, hsa
gauauaccauguauucacacuuuaaaaaauacacauagcagaguaucggaaaguauguaccaaa

SEQ ID NO: 127900 - RNA, 64 nt, hsa
ucuguguucuuuuuuugccgcagccaauaagauaauagcagaauuagccaauccuaaaaccuuc

SEQ ID NO: 127901 - RNA, 64 nt, hsa
agaacgaaguuuaaaauugugacucugauucauuauagcagaacuuuaaauuucccagcuuuuu

SEQ ID NO: 127902 - RNA, 64 nt, hsa
agguuaauguaacccaacaagagcacauuuuaucauagcagagacaucuguaugcauuccuguc

SEQ ID NO: 127903 - RNA, 64 nt, hsa
cgggacuuucacugugauuuccaccagagaaauuauagcagaguggcugagcaugugcucugag

SEQ ID NO: 127904 - RNA, 64 nt, hsa
cuuaaaucgugggaauuuuaauguuuguuccaaaauagcagaaauuguaaaaauuaugaauuau

SEQ ID NO: 127905 - RNA, 64 nt, hsa
caaaaugggagaaaacgccaguguguuuaaauugauagcagauaucacgacagauuuaaccucu

SEQ ID NO: 127906 - RNA, 64 nt, hsa
ugauacaauuucuugcugucaccaauuuuuuauaauagcagaguggccuguucuaagaaggcca

SEQ ID NO: 127907 - RNA, 64 nt, hsa
ccaagaaagaagacuaguaaauugucugccuccuauagcagaaaggugaauguacaaacuguug

SEQ ID NO: 127908 - RNA, 64 nt, hsa
uuuggaaucauuaaacuuggccuucucaaacucaauagcagaucucugagauucuccuuuuauu

SEQ ID NO: 127909 - RNA, 64 nt, hsa
ucacagcuuuguguuuauucucuuugcucauggaauagcagaacaagauaaacauggguuaaga

SEQ ID NO: 127910 - RNA, 64 nt, hsa
uuucauguuuaagaaaugagaaauugugccaaagauagcagaagaguagauaagugcucaguau

SEQ ID NO: 127911 - RNA, 64 nt, hsa; identical to SEQ ID NO: 127826

SEQ ID NO: 127912 - RNA, 64 nt, hsa
ucccaaagguguugauuuacaaagaggccagcuaauagcagaaaucaugacccugaaagagaga

SEQ ID NO: 127913 - RNA, 64 nt, hsa
cucaucauuuguggcagucccuuauaauuggugcauagcagaugguuuccacauuuagauccug

SEQ ID NO: 127914 - RNA, 64 nt, hsa
ucugugccuuggucucuccuuccucuuggcugagauagcagaggggcuccccgggucucucacu

SEQ ID NO: 127915 - RNA, 64 nt, hsa
acguggguucccugcggcuccuuagucaccucugauagcagauugagggaggaaaacagguaag

SEQ ID NO: 127916 - RNA, 64 nt, hsa
cucaauuuauuuucacaauucauauuuauuauagauagcagaaguaauccauuuuaauauggcc

SEQ ID NO: 127917 - RNA, 64 nt, hsa
ggaagcccuggagacccucgcccaacuccaccagauagcagagggguaagagaggaugugcaag

SEQ ID NO: 127918 - RNA, 64 nt, hsa
gcuauuuuauuaaauuuuucacuuagucugagaaauagcagauagucucauauuuaggaaaacu

SEQ ID NO: 127919 - RNA, 64 nt, hsa
aaacaguggggaacuacugcuggaaaaagcccuaauagcagaaauaaacauugaguuguacgag

SEQ ID NO: 127920 - RNA, 64 nt, hsa
aauguauaaaguaacaauucagauucacuugggaauagcagaauuuuuuuauacaggguuaaua

SEQ ID NO: 127921 - RNA, 64 nt, hsa
uguaauacuugaaauuuauuuuuuuauuauuuugauagcagaugugcuauuuauuuauuuaaua

SEQ ID NO: 127922 - RNA, 64 nt, hsa
uauuauggagaugaacaugaugauguaacuuguaauagcagaauaguuaaugaaugaaacuagu

SEQ ID NO: 127923 - RNA, 64 nt, hsa
uuuacacauauccuggagucuaccuaugucacugauagcagauauuuuucuucaacauauauua

SEQ ID NO: 127924 - RNA, 64 nt, hsa
gaaguuaccacaggggucagguuacuuucuucaaauagcagauuucaguacuuuauccucauug

SEQ ID NO: 127925 - RNA, 64 nt, hsa
gauccaccaugcccgggcugaaauauuucucguaauagcagaauauuucauggccgaacucuug

SEQ ID NO: 127926 - RNA, 64 nt, hsa
agaaaaaagguuccgcuuggagcagaggggcugaauagcagaagguugcaccucccccaaccuu

SEQ ID NO: 127927 - RNA, 64 nt, hsa
cccaaacaggauuauaaagucaagugaggaauaaauagcagaaaaauaccuuaaaggaacaaaa

SEQ ID NO: 127928 - RNA, 64 nt, hsa
ggagccccucuuggacugccuggguuaaaucugcauagcagaagugguugaugaguucaucuga

SEQ ID NO: 127929 - RNA, 64 nt, hsa
ggaaucaacaucuuccgaguccuucuugggggaaauagcagagccccacuuaacuccauaaacu

SEQ ID NO: 127930 - RNA, 64 nt, hsa
guggaucagugcuauuguguguucucaguuuaagauagcagaucaucucagcaguaagcacacc

SEQ ID NO: 127931 - RNA, 64 nt, hsa
ggaggggggcaccccccccauggaugcccuucagauagcagaggacacccuccaaacacugguu

SEQ ID NO: 127932 - RNA, 64 nt, hsa
gaauguccguccucuguugauugauuggagaggaauagcagaacauuucuccugccccucguug

SEQ ID NO: 127933 - RNA, 64 nt, hsa
auccauuccuugaggacagaccuuaguugaaaugauagcagaaugugcuucucucuggcagcug

SEQ ID NO: 127934 - RNA, 64 nt, hsa
gcuaguggcuucaaaauagagaaucccacuuucuauagcagauuguguaacaauuuuaaugcua

SEQ ID NO: 127935 - RNA, 64 nt, hsa
auuuuguugcuuucuuaccuacuauuggcccuaaauagcagaaagaagagaagugaccgagaga

SEQ ID NO: 127936 - RNA, 64 nt, hsa
uguuguuccuucauuuuuuucuuuuuaauaagacauagcagaauuccuuagguaugggauuuau

SEQ ID NO: 127937 - RNA, 64 nt, hsa
aguuuuuaaaaauugcgcuacuugccugggaaacauagcagaccucguuucuacuaaaaauuuu

SEQ ID NO: 127938 - RNA, 64 nt, hsa
uuuacaaaggugaugggggauauuuuguuaggugauagcagaagcuuuucauuuuuaaacauag

SEQ ID NO: 127939 - RNA, 64 nt, hsa
uaagccagaaaauagaaaugauuauuucugauuaauagcagaaacuuuuucaaucucaaauaua

SEQ ID NO: 127940 - RNA, 64 nt, hsa
cuggaaguacccauugaaacaugcguauuuguguauagcagaacucugaaauaauauucugaca

SEQ ID NO: 127941 - RNA, 64 nt, hsa
gaaaguaccaucauaauuaaccuaaauuuuuguuauagcagaguuucuuguuuaaaaaaaaaua

SEQ ID NO: 127942 - RNA, 64 nt, hsa
uaguauauaaaagcugugcccuagcguaaacaguauagcagaaacuuacugugcuggacucuuu

SEQ ID NO: 127943 - RNA, 64 nt, hsa
gagccugcugccugcugaggggacacuuggggaaauagcagacucagaauggacacucuacaac

SEQ ID NO: 127944 - RNA, 64 nt, hsa
auugcaggagccauaugacaagccuuugugcucuauagcagacacuaaagacuggguuacauau

SEQ ID NO: 127945 - RNA, 64 nt, hsa
cucuccuucugugaguauaacuccugcaguuccuauagcagauaagauauaagaaagugccucc

SEQ ID NO: 127946 - RNA, 64 nt, hsa
acugcaggaguuugccaacgccauucuucagcagauagcagaccauugucccgacauccuagag

SEQ ID NO: 127947 - RNA, 64 nt, hsa
cugagacaugaugggaaucucauucccaccucucauagcagagccaaaccuuuaguguuggugg

SEQ ID NO: 127948 - RNA, 64 nt, hsa
aaaccaaaaacaacagugacaauagagucucaggauagcagagucugaaaauaccuuggucucc

SEQ ID NO: 127949 - RNA, 64 nt, hsa
uuuguguuugaaagugaaaccaacauccagaucuauagcagaguccuuauucuucucauaaauc

SEQ ID NO: 127950 - RNA, 64 nt, hsa
aaucucugaaauuuccuuaaauuauauacuuaacauagcagagaaacuggauuguuuuuguaua

SEQ ID NO: 127951 - RNA, 64 nt, hsa
uuccccaucuuuuagagcuguuaauagaaauuauauagcagauucuuuguugggaagacugaaa

SEQ ID NO: 127952 - RNA, 64 nt, hsa
gcgaaggugacugauucgcccucugcaacuacaaauagcagagugagccaggcggugccaaagc

SEQ ID NO: 127953 - RNA, 64 nt, hsa
cagauacuacaaauaauuuucuuaaaagucuaagauagcagaaaauacaguaaaaacacaggag

SEQ ID NO: 127954 - RNA, 64 nt, hsa
auagacuuaggcauuaacauguuuguggaagaauauagcagacguauauuguaucauuugagug

SEQ ID NO: 127955 - RNA, 64 nt, hsa
uguucagguuauucuuagagacuacacauuuggaauagcagagcaaaauauggauaaugaaagu

SEQ ID NO: 127956 - RNA, 64 nt, hsa
uacagaccaaagcaacaaauauuuauugccauguauagcagaaaaugaaacaugcaacaaaagc

SEQ ID NO: 127957 - RNA, 64 nt, hsa
uccauggggccagguuuccuggccacuuuuguugauagcagauggaucaauauuaguaacccca

SEQ ID NO: 127958 - RNA, 64 nt, hsa
aucccagcggaacaaguggcaacagcaggaguuaauagcagaguugaggcggcgccaggccaag

SEQ ID NO: 127959 - RNA, 64 nt, hsa
gauguuuacagugaauaauuuuaaaaccacaaacauagcagaaauguacuuuauuauuaaauuu

SEQ ID NO: 127960 - RNA, 64 nt, hsa
aguuuuguuuugccuuuaacaagaaguaaaauauauagcagaaugagagccaaggacuagaaaa

SEQ ID NO: 127961 - RNA, 64 nt, hsa
cauugccuuucugcaucaauguguuuguuaccaaauagcagaaauuucgcuuagaaggggaaaa

SEQ ID NO: 127962 - RNA, 64 nt, hsa
cauuuuauuaaacacagggaaagcauuuaggagaauagcagagagccaaaucugaccuaaaagu

SEQ ID NO: 127963 - RNA, 64 nt, hsa
uggagaugcuuuuuacuuucaaccauaagcgguaauagcagaggaaagggugaagggagucugg

SEQ ID NO: 127964 - RNA, 64 nt, hsa
caggacaauuuauuguaccauucuuucauauaccauagcagauuauccauuucaauuuuuuuuu

SEQ ID NO: 127965 - RNA, 64 nt, hsa
gauugcuugagccauguuguuugaauugcugccaauagcagaccauaucccuaucauguuguug

SEQ ID NO: 127966 - RNA, 64 nt, hsa
uagauucucucuggaaacugacuuugucaaauaaauagcagauuguagugucugguuugguuug

SEQ ID NO: 127967 - RNA, 64 nt, hsa
gagaggucaagggucucuaguucaauggccagucauagcagaagggaggccaagcaccagucca

SEQ ID NO: 127968 - RNA, 64 nt, hsa
ggcaggucugggccaggcucacagggacuccggcauagcagacccugccccagcaggcccccuu

SEQ ID NO: 127969 - RNA, 64 nt, hsa
uuugcuucucaguuuacauuucugauacaugcagauagcagaugucuuuaaaugaaauacaugu

SEQ ID NO: 127970 - RNA, 64 nt, hsa
aaaaacaugggacuguaugucauuacuaugacugauagcagaauaauaaugcaucuuacuucua

SEQ ID NO: 127971 - RNA, 64 nt, hsa
gcugaagugaggacugcagcugcuuucuugaacaauagcagaguugagugguugcaacacacac

SEQ ID NO: 127972 - RNA, 64 nt, hsa
ugcugggcucuggaccaugagcugaguaggaaggauagcagaggccaacccugaccuuccugga

SEQ ID NO: 127973 - RNA, 64 nt, hsa
gucaucagcugugauauguuugugcacauuacguauagcagaggauguaagcaauauuauuguu

SEQ ID NO: 127974 - RNA, 64 nt, hsa
uuuuggaagacuuacgaugcauguauacaaacgaauagcagauaaugaugacuaguucacacau

SEQ ID NO: 127975 - RNA, 64 nt, hsa
gcuguaacacaguaaauauguacuuguagccuggauagcagacuguguucaacuuuuuaaaaag

SEQ ID NO: 127976 - RNA, 64 nt, hsa
uuguauaguauauguuuugccauauuuaauauuaauagcagaggaagacuccuuuuuucaucac

SEQ ID NO: 127977 - RNA, 64 nt, hsa
uggcccagggaccccucacggggccaggggaggcauagcagaaagacuggccccuuccuagggu

SEQ ID NO: 127978 - RNA, 64 nt, hsa
guauuaggccacacaguggaaccccauuuauaucauagcagaagaaauaggauuaucaauguga

SEQ ID NO: 127979 - RNA, 64 nt, hsa
aaaagaugggcucuuucugguuaguuguuacaugauagcagagauauuuuuacuuagauuacuu

SEQ ID NO: 127980 - RNA, 64 nt, hsa
uugcaguguuuacaacauagccaguguuuacagcauagcagaugcugcugcugauuaagagaau

SEQ ID NO: 127981 - RNA, 64 nt, hsa
cuaaaauacaauuuugagguuuuccaauaauaccauagcagaaauguccaagggguugggggaa

SEQ ID NO: 127982 - RNA, 64 nt, hsa
auuaguauuuauaacuuuuuaaagggcucuuuguauagcagaggaucucauuugacuuuguuuu

SEQ ID NO: 127983 - RNA, 64 nt, hsa
gaggauuuugauccaagcuggucccacucaguccauagcagagaaugaaagggcccagagaggg

SEQ ID NO: 127984 - RNA, 64 nt, hsa
ggcauaaccuuuaacuauuuucaagccuuacacaauagcagagaauauaaacugaaaaaaucca

SEQ ID NO: 127985 - RNA, 64 nt, hsa
aaauaguuacugugcccacggagccuacccgauuauagcagagguaaguuaggaacgaacaugu

SEQ ID NO: 127986 - RNA, 64 nt, hsa
auugaccagaaaaauugaaaguguucugaggcacauagcagaggagcugcagauuuccugcuug

SEQ ID NO: 127987 - RNA, 64 nt, hsa
gacucgaaguuaguaaauccuuaaaggcuuuuuaauagcagacuuccaaaagauugcauuuagg

SEQ ID NO: 127988 - RNA, 64 nt, hsa
ccacaaagcuuuacaucuucauuuugacuguuccauagcagaauaaagcacuugaaaggaaaca

SEQ ID NO: 127989 - RNA, 64 nt, hsa
ggcacaagguccuagagacauuagguccacaugaauagcagaacugacuuugaaggaaggaagc

SEQ ID NO: 127990 - RNA, 64 nt, hsa
ccucuccucuggccugugggguuauaagugauggauagcagaaagggagaacugacuccugucc

SEQ ID NO: 127991 - RNA, 64 nt, hsa
acaguuuucugucacuggugggcacuggacaggcauagcagacucucuuguggccacacuaggu

SEQ ID NO: 127992 - RNA, 64 nt, hsa
gaacagaauugauacuggcuggcuggacagacugauagcagaaaaaguacagguguguauuucu

SEQ ID NO: 127993 - RNA, 64 nt, hsa
uauccuggaacuguuauucuauuuaaucuucauuauagcagaaaugugccaccauggcuuugac

SEQ ID NO: 127994 - RNA, 64 nt, hsa
agaaauuaagccauuuacauguuuguguuuuucuauagcagagcauuauauuuugcauuauaug

SEQ ID NO: 127995 - RNA, 64 nt, hsa
cuuucuugccucgguucucauuacacuuucacccauagcagaaaacacuuugugcggcugccga

SEQ ID NO: 127996 - RNA, 64 nt, hsa
aacacaaaaguuuauugcuguuugcuaaagcaaaauagcagaaaauuuuguauaugcaaaacug

SEQ ID NO: 127997 - RNA, 64 nt, hsa
uuggaaggcauuaugugauuuacaauaugagaauauagcagaaaaaccagaugaggcuguggcu

SEQ ID NO: 127998 - RNA, 64 nt, hsa
ucuccugcugagaugggggaaauccggcugcggcauagcagaugcucguucuugccuccuucag

SEQ ID NO: 127999 - RNA, 64 nt, hsa
uuguuucccugcuagccucagccuccauugugguauagcagaacuucacccacuuguaagccag

SEQ ID NO: 128000 - RNA, 64 nt, hsa
guguauacacacggugcaccaaucuacaguauauauagcagagaaucagaggcuaaaaauauua

SEQ ID NO: 128001 - RNA, 64 nt, hsa
gcagaagaggaauauaaccaaaugugacuaaaauauagcagaaauucagguuguuuguaaaaau

SEQ ID NO: 128002 - RNA, 64 nt, hsa
gaucuuucuuugggcaagguuaagccuuuacugcauagcagaccacacagaagggugugggcca

SEQ ID NO: 128003 - RNA, 64 nt, hsa
gccgaguagaguaauauauacccagaguaugucuauagcagaggggguuaugggggcgggaggg

SEQ ID NO: 128004 - RNA, 64 nt, hsa
gaauggggggcgggccagggugggaagagaagaaauagcagagccuauuuuggugagguuuuuu

SEQ ID NO: 128005 - RNA, 64 nt, hsa
agcgaguccuugagcuccacaacaucuaccagauauagcagacaagcacccauggaggcagguu

SEQ ID NO: 128006 - RNA, 64 nt, hsa
uguuuaugaggaugauugcugguuucccuuacacauagcagagcucacucaguucucacaguag

SEQ ID NO: 128007 - RNA, 64 nt, hsa
ggagggaaagagaguaacuaauaggggaugaaauauagcagaagcuagaagaaagcggugaggu

SEQ ID NO: 128008 - RNA, 64 nt, hsa
auauuaaacauucuugcugcugcgcugcaaagccauagcagauuugaggcgcuguugaggacug

SEQ ID NO: 128009 - RNA, 64 nt, hsa
uacaagguuuuauuccuauuuaauguuauugacuauagcagauuuuggaaaucaguguuuucca

SEQ ID NO: 128010 - RNA, 64 nt, hsa
gaccauuuacggggagaaacuugauucugggaagauagcagaguacaaaccagcugccucacuu

SEQ ID NO: 128011 - RNA, 64 nt, hsa
auguugucaggucguucuuaucuagagaagagcuauagcagaucucggacaaacucagaauaua

SEQ ID NO: 128012 - RNA, 64 nt, hsa
uauauacgugugguucauccaucaucugcugcacauagcagacuagaauucugggaacccugug

SEQ ID NO: 128013 - RNA, 64 nt, hsa
uuccugaauguuucagagaaacaggaaucagaaaauagcagauaucauguaggaaagagaggau

SEQ ID NO: 128014 - RNA, 64 nt, hsa
cuugggcucaggccugagguuuugcaucuguucaauagcagaggagagagggguguacugucug

SEQ ID NO: 128015 - RNA, 64 nt, hsa
ugcccuuuuccuugacuauuacacugccuggaggauagcagagaagccugucuguacuucauuc

SEQ ID NO: 128016 - RNA, 64 nt, hsa
ccucuucaugguaaugcuguuuuaccaagacuuuauagcagauggacccagaaagaauuuucug

SEQ ID NO: 128017 - RNA, 64 nt, hsa
uuuaugcugcuccugauauaacacuuuccagccuauagcagaagcacauuuucagacugcaaua

SEQ ID NO: 128018 - RNA, 64 nt, hsa
augucauagaaacuguaugaacaaccagauuuacauagcagagaaaucauacauugaaugcuua

SEQ ID NO: 128019 - RNA, 64 nt, hsa
auaguuuuacuuauuuuguuuacucuaaaaaucuauagcagaguuucucuauuuuauauuucau

SEQ ID NO: 128020 - RNA, 64 nt, hsa
gaaguauuguucauauuugucaccucuuggaaugauagcagauccuguaaguugauguauuaau

SEQ ID NO: 128021 - RNA, 64 nt, hsa
ucacuccccauguucuaguauuauuuuguaacaaauagcagacaucugaucauuuuauccauaa

SEQ ID NO: 128022 - RNA, 64 nt, hsa
auccugaaaaaugagucuccauugcuuuuauaaaauagcagaauuagcuuugcuucaaaagaaa

SEQ ID NO: 128023 - RNA, 64 nt, hsa
uguguggcuuuuguuuuagaauuuuguucaaauuauagcagaauuuaggcaaaaauaaaacaga

SEQ ID NO: 128024 - RNA, 64 nt, hsa
aucccuguuauuuugugaauugggacaagauaacauagcagaggaauuaauaauuuuuuugaaa

SEQ ID NO: 128025 - RNA, 64 nt, hsa
ccgguguuugcugguuucagggaaggaguuugauauagcagauuaaccacccuccuuguagcua

SEQ ID NO: 128026 - RNA, 64 nt, hsa
cguuucuacccaaaguuguguguggaaggaguguauagcagagaggaaaucccuuucaacagag

SEQ ID NO: 128027 - RNA, 64 nt, hsa
ucuuucuggacagccaugacuguagcaaggcuugauagcagagguuuggugguucagaguuaua

SEQ ID NO: 128028 - RNA, 64 nt, hsa
gccaaacaguaaccuccaggagaaaacaagaugaauagcagaggccaauucaauagaaucaguu

SEQ ID NO: 128029 - RNA, 64 nt, hsa
aagcccuucccauaaaacacaacugcugaagaaaauagcagacguuuccccucucucuaacucu

SEQ ID NO: 128030 - RNA, 64 nt, hsa
ugucagucuccugucuccuuuugcucugucugugcgcugguaaaguccagguccucauccgucc

SEQ ID NO: 128031 - RNA, 64 nt, hsa
ggcccgugccuuagacuucucccgacccccagagcgcugguacacaggucuaggcaccacacag

SEQ ID NO: 128032 - RNA, 64 nt, hsa
agaaaaguagguccagccuuaagcagcacagaugcgcugguagaugcauagucaggaacuuuuu

SEQ ID NO: 128033 - RNA, 64 nt, hsa
cagcucuuuuuucuagaauccucauuacagcuaacgcugguaauaaagguaggaaaacaauaga

SEQ ID NO: 128034 - RNA, 64 nt, hsa
agaaggauucuuuuuucaauguacuguauugggacgcugguaacuguuaacccaguguucagca

SEQ ID NO: 128035 - RNA, 64 nt, hsa
uaacuuaauaagccuauuccaucacaaucaugaucgcugguaaaguagcucaguggugugggga

SEQ ID NO: 128036 - RNA, 64 nt, hsa
aaaaucaguuacucuaauuccaggugaagcaagccgcugguagcaucacccuuaugagaaguga

SEQ ID NO: 128037 - RNA, 64 nt, hsa
guccuggccuuccucaugaucugugagaacaugacgcugguagaggccauccagacggugcagg

SEQ ID NO: 128038 - RNA, 64 nt, hsa
auacuaugaagccucugauacuuaaacagcauggcgcugguacguaaauagaccaaugcaguua

SEQ ID NO: 128039 - RNA, 64 nt, hsa
gugaaguucauuuaaaaaaauaacuacaguauagcgcugguacaguacacuaaaagacuuugau

SEQ ID NO: 128040 - RNA, 64 nt, hsa
gggcucugcacuugaaggcaggacccucagaccucgcugguaaaggucaaauggggucaucugc

SEQ ID NO: 128041 - RNA, 64 nt, hsa
cacgcaacguacugggcaaaugacaauccucagccgcugguauuuucuaaggggucucuucacu

SEQ ID NO: 128042 - RNA, 64 nt, hsa
cuggcugagugcguuuuguccuucacguaaccuucgcugguaaaaauaagcccaugugaugucc

SEQ ID NO: 128043 - RNA, 64 nt, hsa
cgcuuuuaccugagacaggcccugagccugaggccgcugguagacuuuuguuaaaagagagaga

SEQ ID NO: 128044 - RNA, 64 nt, hsa
ccaggccugguggacacaggaagccuacccaacacgcugguauuuggccaacacugaggaugug

SEQ ID NO: 128045 - RNA, 64 nt, hsa
ggggugguggcaccagagcucuugucuauucagacgcugguaugggggcucggaccccucacug

SEQ ID NO: 128046 - RNA, 64 nt, hsa
cccaggaggacugccccgugcagacuggaggggacgcugguagagauggaggaggaggcaauug

SEQ ID NO: 128047 - RNA, 64 nt, hsa
cuggagcccuccccaggaugugagccaguccccucgcugguacggaaugccgcugggugcccgg

SEQ ID NO: 128048 - RNA, 64 nt, hsa
gacacuucaagguucacuguagcugagccauggccgcugguaacagacaucaggguuccagacu

SEQ ID NO: 128049 - RNA, 64 nt, hsa
ucucccucuuuccugcagggugauucuggggguccgcugguauguggagaccaccuccgaggcc

SEQ ID NO: 128050 - RNA, 64 nt, hsa
ggugugaaugaacuucccuccuaguugcugauggcgcugguaccugcuggcccauggcccgggu

SEQ ID NO: 128051 - RNA, 64 nt, hsa
caugugagccgcacaggucacacuagagaagcugcgcugguaucuuuccuggucgugugcugag

SEQ ID NO: 128052 - RNA, 64 nt, hsa
ucuggacccugggacugucuuggcaucuuaacugcaguuucaaugaggcagagggcaaagagag

SEQ ID NO: 128053 - RNA, 64 nt, hsa
agugcuucucuuuggcuuuuucuugguuacacugcaguuucaggauugggugagacagagacaa

SEQ ID NO: 128054 - RNA, 64 nt, hsa
gacauucuuuuuuuuauaagucuauuuuucuacucaguuucagaacacuaaucugauuuucacu

SEQ ID NO: 128055 - RNA, 64 nt, hsa
cugucaggaugcuuaagcucuuuucagacaucugcaguuucaucccuaccuuguucacauacca

SEQ ID NO: 128056 - RNA, 64 nt, hsa
aguugauuuuuguaugcagaguaagcugggggcccaguuucaaucuucugcauauggcuagcca

SEQ ID NO: 128057 - RNA, 64 nt, hsa
acuguugcucauuuuguaaguauauguguuauagcaguuucauucaagaaaaguuuaaaauuaa

SEQ ID NO: 128058 - RNA, 64 nt, hsa
agauggucauauuuaaacagaaguauacguuuuucaguuucaacaugaauuuuuuuauuucugu

SEQ ID NO: 128059 - RNA, 64 nt, hsa
auuuggguuuuguucuuguauugcuuucuuucaacaguuucaaaauaaaauaucauauaaauau

SEQ ID NO: 128060 - RNA, 64 nt, hsa
guccuggcuuuguggcaaccccagggaggugcagcaguuucacuccuuccuccacuguguccag

SEQ ID NO: 128061 - RNA, 64 nt, hsa
gacaccaucaaaauuuaagaccaugaugaaauuucaguuucauucaaauguuaccuaaaauuua

SEQ ID NO: 128062 - RNA, 64 nt, hsa
auucauuuuacuuuuucauuuuggggugaagauucaguuucagucuuuugaauauagguuucca

SEQ ID NO: 128063 - RNA, 64 nt, hsa
ccaccacuuccuaaaucuuaagaacuuuaauugacaguuucaauugaaggugcuguuuguagac

SEQ ID NO: 128064 - RNA, 64 nt, hsa
gcgcugugcuuuguauaaguggucuuucuaugggcaguuucaccuuccaugaaggcuuauaacu

SEQ ID NO: 128065 - RNA, 64 nt, hsa
cauaagaauuacuugguggccucaugagggauggcaguuucacuuugcaucagcuuucccccau

SEQ ID NO: 128066 - RNA, 64 nt, hsa
uuuuuuuugcaugaagaaaaaugucuaucauuuacaguuucaauagcacauaauuuauuuucua

SEQ ID NO: 128067 - RNA, 64 nt, hsa
gaaacauucagaucccucuuccuuuacucaaauacaguuucaaaaggaagacucaugagaaauu

SEQ ID NO: 128068 - RNA, 64 nt, hsa
ucaaaagaauuguuggagcuuuuuauuaaagcuacaguuucaguucugcuuuuggggaauugug

SEQ ID NO: 128069 - RNA, 64 nt, hsa
augagaaucuaaugcuugaugaccugagguguaacaguuucauccugaaaccacccuucacccu

SEQ ID NO: 128070 - RNA, 64 nt, hsa
uaguagauuuuuggccuuuccuguuuuuaaaaaucaguuucauuuucauauuucauagaucagc

SEQ ID NO: 128071 - RNA, 64 nt, hsa
uuuugauguacaucgagcugaauucuguuuuuaccaguuucaaaaccuucaagugauaugugga

SEQ ID NO: 128072 - RNA, 64 nt, hsa
uguccucuacauuggaaagcuaauccuaccuugucaguuucaaccaacugaguuuuuucuuuaa

SEQ ID NO: 128073 - RNA, 64 nt, hsa
agguuccaaacuaauauggcauauaucaacucuacaguuucaaauaaaugacuuuuuaauugua

SEQ ID NO: 128074 - RNA, 64 nt, hsa
gguacgcagacaaacacaugaacaucgacuuugacaguuucaucugcugcuucguuaggcugga

SEQ ID NO: 128075 - RNA, 64 nt, hsa
cucauccaaagccaugcaggaucacucaggauuucaguuucacccucuauuuccaaagccauuu

SEQ ID NO: 128076 - RNA, 64 nt, hsa
aguacaguguuuucaaucuaaaaagaaguauuggcaguuucacuugcaaaauuacacagcuggu

SEQ ID NO: 128077 - RNA, 64 nt, hsa
auauuuugaaacugucugcuuuuugcuauuucugcaguuucaaguuaguuagaagcauguuguc

SEQ ID NO: 128078 - RNA, 64 nt, hsa
agccuagaucuuguuaacccaucaggugcagugucaguuucaaaucaaauuaucuaagaaaaca

SEQ ID NO: 128079 - RNA, 64 nt, hsa; identical to SEQ ID NO: 128063

SEQ ID NO: 128080 - RNA, 64 nt, hsa
cauuuuauuuuguuuucauuuuggggugaagauucaguuucagucuuuuggauauagguuucca

SEQ ID NO: 128081 - RNA, 64 nt, hsa
ccauacuucgccaagguuguagcaugggcaguuucaguuucagccuaagagacuggugacaucc

SEQ ID NO: 128082 - RNA, 64 nt, hsa
gugucuccauacuucgccaagguuguagcaugggcaguuucaguuucagccuaagagacuggug

SEQ ID NO: 128083 - RNA, 64 nt, hsa
caguuccagcuuccuaaaauagacaguggguaucgggcagcagucacuggggcucaagggcagu

SEQ ID NO: 128084 - RNA, 64 nt, hsa
uaguuguuuacauuucuugaaaaaauaggaacucgggcagcagaaucagauuggcagaaucuuu

SEQ ID NO: 128085 - RNA, 64 nt, hsa
auucagcaccagugaaaggcuuugagaaggacgugggcagcaaaacgacacugcgcaucaccua

SEQ ID NO: 128086 - RNA, 64 nt, hsa
cagacccagagaaggacggugccaagggccccaggggcagcaaggccuugguggagcagccaga

SEQ ID NO: 128087 - RNA, 64 nt, hsa
cccagcaggcccagcaugcagguggugggacacugggcagcaaggcugcugccggaaucacuuc

SEQ ID NO: 128088 - RNA, 64 nt, hsa
ugucuguguuguuagaacucagaggaagaggcaggggcagcagccgacagggggcagcaugacc

SEQ ID NO: 128089 - RNA, 64 nt, hsa
cucagaggaagaggcaggggcagcagccgacagggggcagcaugacccaagcaaggggccugag

SEQ ID NO: 128090 - RNA, 64 nt, hsa
uacgggguucuuggagagucggccagacggcggggggcagcaggaacuuugccucauaccccac

SEQ ID NO: 128091 - RNA, 64 nt, hsa
ugacuccauauggaggccucacacccagaggguagggcagcagaucuucuuuauaacuauuuau

SEQ ID NO: 128092 - RNA, 64 nt, hsa
agcacagggagaauguugacuuagaagcaauagggggcagcaggccaccaagagcacaacccca

SEQ ID NO: 128093 - RNA, 64 nt, hsa
gggaauguggcacugucuauccauccgguggacugggcagcauuccuccccagggcucuucccu

SEQ ID NO: 128094 - RNA, 64 nt, hsa
ugugcucuuucaggugggaguuuuggggccuccagggcagcaggcaccaccuccauaucccggc

SEQ ID NO: 128095 - RNA, 64 nt, hsa
cuuugcagggcccaguugauggccuuguuagcaugggcagcaugcagccacuucacccuggggg

SEQ ID NO: 128096 - RNA, 64 nt, hsa
ggcgacucccauacccugaagccuggggcaugcugggcagcaccggugcccaaaucuggcuggu

SEQ ID NO: 128097 - RNA, 64 nt, hsa
ggugaaggcaaguucaagcaccacuugagacugggggcagcauggaguagggcagggcuacggg

SEQ ID NO: 128098 - RNA, 64 nt, hsa
uaaccuaacgaaauuuccaugaagaaccaagucagggcagcaucuccuuagucccagcucaggc

SEQ ID NO: 128099 - RNA, 64 nt, hsa
cuucuacugaaggacaguccgcugucuccagugggggcagcagcugucccccagccucgaugga

SEQ ID NO: 128100 - RNA, 64 nt, hsa
ccacugucuugcaguggacggagagccuuggcgagggcagcaggguagagaggacaaagaaugu

SEQ ID NO: 128101 - RNA, 64 nt, hsa
acagagaucacacacaccaaaccagacagaggcagggcagcauggagacagguagacagaccuc

SEQ ID NO: 128102 - RNA, 64 nt, hsa
aaguugaagucgacugccaaagaggcccagcagagggcagcacccccaucauuuuuuugaauuu

SEQ ID NO: 128103 - RNA, 64 nt, hsa
gaccugucuuugggaaacauuaaaggauguuugagggcagcaggaaaauaauacaaaacuuaag

SEQ ID NO: 128104 - RNA, 64 nt, hsa
gcgcuggggagagggaugaaggcucggcggcccagggcagcacccaaggucugggcaaacucag

SEQ ID NO: 128105 - RNA, 64 nt, hsa
cugagccgauggggccccccaggcccaggcgaaagggcagcagcauguggcccauggcaccacc

SEQ ID NO: 128106 - RNA, 64 nt, hsa
uaguguccaagcaucuuagcuguucaagaggagagggcagcauaacuuccugaccaccgguguc

SEQ ID NO: 128107 - RNA, 64 nt, hsa
uuccaaggguuugccuugugucucagcucauucugggcagcacguuugucuucugucccuagag

SEQ ID NO: 128108 - RNA, 64 nt, hsa
caacauagcuuccccacccaggcacccccucccggggcagcaggcgugggagucagggcugcau

SEQ ID NO: 128109 - RNA, 64 nt, hsa
gagagcagccuggcccucaccagugcgcaagcuggggcagcaaggcugacaguugcugcaugcc

SEQ ID NO: 128110 - RNA, 64 nt, hsa
aaggcugccuucauggccaucuagccccaguucagggcagcauccauagcccacaagccagcgu

SEQ ID NO: 128111 - RNA, 64 nt, hsa
accaguaucaggauuucuguucugagagcagcgugggcagcaaggcagggcagcccagaggugg

SEQ ID NO: 128112 - RNA, 64 nt, hsa
uucucaaaguccagaaaauuagggucccagaagggggcagcagcaggcugggaguuaggaggga

SEQ ID NO: 128113 - RNA, 64 nt, hsa
ugcaugagaaaucuaucuuacugugguucuccaugggcagcaggaccauuuuucagaaucaaga

SEQ ID NO: 128114 - RNA, 64 nt, hsa
ccuggaugaaccaucuacgggcauagaccccacagggcagcagcaaauguggugagcaucauua

SEQ ID NO: 128115 - RNA, 64 nt, hsa
ugguucuauguagcauuucuccuuauaucaccaugggcagcaucagugauuacaagguaagaaa

SEQ ID NO: 128116 - RNA, 64 nt, hsa
cuggccggggguuggggagccacacagggugaacgggcagcagccggcuccaugccccacugcc

SEQ ID NO: 128117 - RNA, 64 nt, hsa
uggcaucagcccuggggccuccuggguggcaggggggcagcagcucuccuccccacucacaggc

SEQ ID NO: 128118 - RNA, 64 nt, hsa
acacgugggaacuaaagagaaaaaugaccagccugggcagcauagcaagacccugucucuaaaa

SEQ ID NO: 128119 - RNA, 64 nt, hsa
ucuuacuuucagaauuuccacggggggacuaggagggcagcauugcuggggagaggggcuccug

SEQ ID NO: 128120 - RNA, 64 nt, hsa
uagacacuggcauuaucccuuuaggaagaggggggggcagcaagagagccuauuugggacagca

SEQ ID NO: 128121 - RNA, 64 nt, hsa
ugcuugccuauaccuggcaccucauuaagaugcugggcagcaguauaacaggaggaagagaucc

SEQ ID NO: 128122 - RNA, 64 nt, hsa; identical to SEQ ID NO: 72441

SEQ ID NO: 128123 - RNA, 64 nt, hsa; identical to SEQ ID NO: 72442

SEQ ID NO: 128124 - RNA, 64 nt, hsa; identical to SEQ ID NO: 72443

SEQ ID NO: 128125 - RNA, 64 nt, hsa; identical to SEQ ID NO: 72444

SEQ ID NO: 128126 - RNA, 64 nt, hsa; identical to SEQ ID NO: 72445

SEQ ID NO: 128127 - RNA, 64 nt, hsa; identical to SEQ ID NO: 72446

SEQ ID NO: 128128 - RNA, 64 nt, hsa; identical to SEQ ID NO: 72447

SEQ ID NO: 128129 - RNA, 64 nt, hsa; identical to SEQ ID NO: 72448

SEQ ID NO: 128130 - RNA, 64 nt, hsa; identical to SEQ ID NO: 72449

SEQ ID NO: 128131 - RNA, 64 nt, hsa; identical to SEQ ID NO: 72450

SEQ ID NO: 128132 - RNA, 64 nt, hsa; identical to SEQ ID NO: 72451

SEQ ID NO: 128133 - RNA, 64 nt, hsa; identical to SEQ ID NO: 72452

SEQ ID NO: 128134 - RNA, 64 nt, hsa; identical to SEQ ID NO: 72453

SEQ ID NO: 128135 - RNA, 64 nt, hsa; identical to SEQ ID NO: 72454

SEQ ID NO: 128136 - RNA, 64 nt, hsa; identical to SEQ ID NO: 72455

SEQ ID NO: 128137 - RNA, 64 nt, hsa; identical to SEQ ID NO: 72456

SEQ ID NO: 128138 - RNA, 64 nt, hsa; identical to SEQ ID NO: 72457

SEQ ID NO: 128139 - RNA, 64 nt, hsa; identical to SEQ ID NO: 72458

SEQ ID NO: 128140 - RNA, 64 nt, hsa; identical to SEQ ID NO: 72459

SEQ ID NO: 128141 - RNA, 64 nt, hsa; identical to SEQ ID NO: 72460

SEQ ID NO: 128142 - RNA, 64 nt, hsa; identical to SEQ ID NO: 72461

SEQ ID NO: 128143 - RNA, 64 nt, hsa; identical to SEQ ID NO: 72462

SEQ ID NO: 128144 - RNA, 64 nt, hsa; identical to SEQ ID NO: 72463

SEQ ID NO: 128145 - RNA, 64 nt, hsa; identical to SEQ ID NO: 72464

SEQ ID NO: 128146 - RNA, 64 nt, hsa; identical to SEQ ID NO: 72465

SEQ ID NO: 128147 - RNA, 64 nt, hsa; identical to SEQ ID NO: 72466

SEQ ID NO: 128148 - RNA, 64 nt, hsa; identical to SEQ ID NO: 72467

SEQ ID NO: 128149 - RNA, 64 nt, hsa; identical to SEQ ID NO: 72468

SEQ ID NO: 128150 - RNA, 64 nt, hsa; identical to SEQ ID NO: 72469

SEQ ID NO: 128151 - RNA, 64 nt, hsa; identical to SEQ ID NO: 72470

SEQ ID NO: 128152 - RNA, 64 nt, hsa; identical to SEQ ID NO: 72471

SEQ ID NO: 128153 - RNA, 64 nt, hsa; identical to SEQ ID NO: 72472

SEQ ID NO: 128154 - RNA, 64 nt, hsa; identical to SEQ ID NO: 72473

SEQ ID NO: 128155 - RNA, 64 nt, hsa; identical to SEQ ID NO: 72474

SEQ ID NO: 128156 - RNA, 64 nt, hsa; identical to SEQ ID NO: 72475

SEQ ID NO: 128157 - RNA, 64 nt, hsa; identical to SEQ ID NO: 72476

SEQ ID NO: 128158 - RNA, 64 nt, hsa; identical to SEQ ID NO: 72477

SEQ ID NO: 128159 - RNA, 64 nt, hsa; identical to SEQ ID NO: 72478

SEQ ID NO: 128160 - RNA, 64 nt, hsa; identical to SEQ ID NO: 72479

SEQ ID NO: 128161 - RNA, 64 nt, hsa; identical to SEQ ID NO: 72480

SEQ ID NO: 128162 - RNA, 64 nt, hsa; identical to SEQ ID NO: 72481

SEQ ID NO: 128163 - RNA, 64 nt, hsa; identical to SEQ ID NO: 72482

SEQ ID NO: 128164 - RNA, 64 nt, hsa; identical to SEQ ID NO: 72483

SEQ ID NO: 128165 - RNA, 64 nt, hsa; identical to SEQ ID NO: 72484

SEQ ID NO: 128166 - RNA, 64 nt, hsa; identical to SEQ ID NO: 72485

SEQ ID NO: 128167 - RNA, 64 nt, hsa; identical to SEQ ID NO: 72486

SEQ ID NO: 128168 - RNA, 64 nt, hsa; identical to SEQ ID NO: 72487

SEQ ID NO: 128169 - RNA, 64 nt, hsa; identical to SEQ ID NO: 72488

SEQ ID NO: 128170 - RNA, 64 nt, hsa; identical to SEQ ID NO: 72489

SEQ ID NO: 128171 - RNA, 64 nt, hsa; identical to SEQ ID NO: 72490

SEQ ID NO: 128172 - RNA, 64 nt, hsa; identical to SEQ ID NO: 72491

SEQ ID NO: 128173 - RNA, 64 nt, hsa; identical to SEQ ID NO: 72492

SEQ ID NO: 128174 - RNA, 64 nt, hsa; identical to SEQ ID NO: 72493

SEQ ID NO: 128175 - RNA, 64 nt, hsa
cagaaaggaaaaaaaggaagagagaggaagggagaagggagaggaaugaauugaggaagugaaa

SEQ ID NO: 128176 - RNA, 64 nt, hsa
ggaaaagcagaaaggaaaaaaaggaagagagaggaagggagaagggagaggaaugaauugagga

SEQ ID NO: 128177 - RNA, 64 nt, hsa
aacaaaagggagagccccacaaaacuuuggggacaagggagagagagacucaucugacacuucu

SEQ ID NO: 128178 - RNA, 64 nt, hsa
aggggcaacacaguuccauucuagagggaaacaaaagggagagccccacaaaacuuuggggaca

SEQ ID NO: 128179 - RNA, 64 nt, hsa
aaaaggcccggcccaggaccacugugagcuggaaaagggagaaaggcagugggaaaagagguga

SEQ ID NO: 128180 - RNA, 64 nt, hsa
accccauucccucuuuaucuaucaacucuaggacaagggagaacaaaagcaagccagaagcaga

SEQ ID NO: 128181 - RNA, 64 nt, hsa
accaauaaaaaaaugacuccuaguuguguuuggaaagggagagaagagaugucugaggaagguc

SEQ ID NO: 128182 - RNA, 64 nt, hsa
uggccaccacgcagccuuggcuccuacagcccaaaagggagaauggagggaggcuccaggcuuu

SEQ ID NO: 128183 - RNA, 64 nt, hsa
auaaugaucuuggaauauuugcugugaagggagaaagggagagaaaacucuucugaggaucauu

SEQ ID NO: 128184 - RNA, 64 nt, hsa
guacugaaauaaugaucuuggaauauuugcugugaagggagaaagggagagaaaacucuucuga

SEQ ID NO: 128185 - RNA, 64 nt, hsa
cugaagauuaaugcagagaaagagcaaagcccaaaagggagaaaaaaaaaacaaaaaaacaaaa

SEQ ID NO: 128186 - RNA, 64 nt, hsa
acgcucuggguccuguuauuugcuagggaggguaaagggagacuauuucaaagcuacuguuccu

SEQ ID NO: 128187 - RNA, 64 nt, hsa
gcaaccgccaaauuguuucagagcagaaaagaaaaagggagaaaaccucuuagcaaagcccugu

SEQ ID NO: 128188 - RNA, 64 nt, hsa
ggcugguggcugggacccuccaggggugagaaggaagggagaagguggcauaacuuuuuggaac

SEQ ID NO: 128189 - RNA, 64 nt, hsa
aaggucugugugguugucuucacgggcaaucaggaagggagagagcuggggaccauauucugca

SEQ ID NO: 128190 - RNA, 64 nt, hsa
cugcaaugcagccaaauccgaggaagagaaacugaagggagaaguagauggcaaugguuaugau

SEQ ID NO: 128191 - RNA, 64 nt, hsa
ucuuuuaucauugcaggccaguggacagagggagaagggagaacaggggucgccaacacuugug

SEQ ID NO: 128192 - RNA, 64 nt, hsa
gguaugggaccugcuaaguguggaauuaccugauaagggagagggaaauacaaggagggccucu

SEQ ID NO: 128193 - RNA, 64 nt, hsa
uucaagcacuugauuaacacaacacugcaaacagaagggagaaagugucagugacacaguuucc

SEQ ID NO: 128194 - RNA, 64 nt, hsa
guggacucuuuaaaaucugguauccuauccacccaagggagacacuaacagauaggccaaagua

SEQ ID NO: 128195 - RNA, 64 nt, hsa
ccauuugauaagagaaaugcauuugauugugaagaagggagaguuaaauucuccauuauguucg

SEQ ID NO: 128196 - RNA, 64 nt, hsa
uuuuuccuuugaugggcuuaaaagaaauuauccaaagggagaaagagcaguaugccacuucuua

SEQ ID NO: 128197 - RNA, 64 nt, hsa
aaguguccucagccgacacucacgagggcagugcaagggagaaccugccagcccagccccacca

SEQ ID NO: 128198 - RNA, 64 nt, hsa
ugaaagcgugguucuguaagaaaucagagggagaaagggagagaagggggagggagacaaccca

SEQ ID NO: 128199 - RNA, 64 nt, hsa
ggaagaagaagucuaaaagaaaacaucauuugcaaagggagagaggggcaagcaugauauguug

SEQ ID NO: 128200 - RNA, 64 nt, hsa
aguucugaucuuugggcauggccaggggaagcagaagggagacucuaggaguugaaauggguca

SEQ ID NO: 128201 - RNA, 64 nt, hsa
gaccauuguaccuggcacaagggcuguucaugaaaagggagacuuacugggaggugcaagacag

SEQ ID NO: 128202 - RNA, 64 nt, hsa
gcagguucaaguuccacuucuugguggggaugagaagggagagagagcuagagggacaaagaga

SEQ ID NO: 128203 - RNA, 64 nt, hsa
gagaccuucagaaacuaaggaggaguuuuauauuaagggagacauuuuagucaguaagacgaua

SEQ ID NO: 128204 - RNA, 64 nt, hsa
ccucucucuaacucuggguaucccacagaugcaaaagggagaauaaaccugaauauuauuacca

SEQ ID NO: 128205 - RNA, 64 nt, hsa
aggcuggggcuggggguggcugggaggggaagggaagggagaggcaagcuggcugugaacuguc

SEQ ID NO: 128206 - RNA, 64 nt, hsa
gugaaguggguggagcaucagcguuugcucaguuaagggagagguagagaggggcccgugaagu

SEQ ID NO: 128207 - RNA, 64 nt, hsa
gugagcagauggcuaaguucucuccuccccagaauggauuaacagcugcguggaaaguggggga

SEQ ID NO: 128208 - RNA, 64 nt, hsa
augaugcuuugugugauacauuaaguucuuauuuuggauuaaaagaaguuuuccauuugauacc

SEQ ID NO: 128209 - RNA, 64 nt, hsa
ugacuaauggugucacugcuggcaauggugauaauggauuaauuccucaaaggaagagcagaac

SEQ ID NO: 128210 - RNA, 64 nt, hsa
ugacuaauggugccacugcuggcaauggugaugauggauuaauuccuccaaggaagagcagaac

SEQ ID NO: 128211 - RNA, 64 nt, hsa
aucagcugccucucgaauggaagaacagugguaauggauuaacauccuauuuuguuguacuaaa

SEQ ID NO: 128212 - RNA, 64 nt, hsa
guuuguugucuuauuugugguggcacucguuuaauggauuaacugagguugcucaauguucagu

SEQ ID NO: 128213 - RNA, 64 nt, hsa
uuacuuccugccucagucugcuuucucuacugucuggauuaauuaggcagccugcuauaaaguu

SEQ ID NO: 128214 - RNA, 64 nt, hsa
guuuuugguuucuuauucaaagaugauaauuuaguggauuaaccaguccagacgcacugaucuu

SEQ ID NO: 128215 - RNA, 64 nt, hsa
auguucguugcagcacugcccaucagugacagacuggauuaaaaaaaugugguacauacacacc

SEQ ID NO: 128216 - RNA, 64 nt, hsa
cuuccuuaugccauauacaaaaauuaacucaagauggauuaaagacuuaauguaaaacccaaaa

SEQ ID NO: 128217 - RNA, 64 nt, hsa
uauguauuaugcuuuguauccgaaagggucuaaguggauuaauauuaaaacuauguauauuaau

SEQ ID NO: 128218 - RNA, 64 nt, hsa
uuaaauguuauuuuugccuuucaauguaaucaauuggauuaacaaugcugcaauauaauuuagc

SEQ ID NO: 128219 - RNA, 64 nt, hsa
cuuuaaaaacucuaaaucuuuauucaugugucacuggauuaauuuaucugauaaugugucucac

SEQ ID NO: 128220 - RNA, 64 nt, hsa
aaacuuuuuaaauuuaaauugguuuacaugaaaguggauuaaaaggccuuucaaaagaaugggu

SEQ ID NO: 128221 - RNA, 64 nt, hsa
ccaaucugacaauaauguguucaucaggugccuauggauuaaaucacauacuggcauauuuaag

SEQ ID NO: 128222 - RNA, 64 nt, hsa
agagugcaauauauaauaaucauuuuuaaaguauuggauuaaaucugauagguuuuccagaaau

SEQ ID NO: 128223 - RNA, 64 nt, hsa
agauugcaauauauaauaaucauuuuuaaaguauuggauuaaaucugauagguuuuccagaaau

SEQ ID NO: 128224 - RNA, 64 nt, hsa
ccaaucugacaauaauguguucaucaggugccuguggauuaaaucacauacuggcauauuuaag

SEQ ID NO: 128225 - RNA, 64 nt, hsa
ucugaaacaugugcuguguccacucaggguuaaauggauuaaggguggugcaagaugugcuuug

SEQ ID NO: 128226 - RNA, 64 nt, hsa
gucauuguuuccauuuuuuuuuuaauucuucccuuggauuaauauuuucuacugaaaagaaaug

SEQ ID NO: 128227 - RNA, 64 nt, hsa
uagacauaucugaagagauggauuaagaaugcuuuggauuaaggauuguggagcacauuucaau

SEQ ID NO: 128228 - RNA, 64 nt, hsa
uucaugugucuuucuguagacauaucugaagagauggauuaagaaugcuuuggauuaaggauug

SEQ ID NO: 128229 - RNA, 64 nt, hsa
ggugauugggccaugaggucugugcccuccugaauggauuaauccauucauggauuaauggauu

SEQ ID NO: 128230 - RNA, 64 nt, hsa
ggucugugcccuccugaauggauuaauccauucauggauuaauggauuauuaugagugggggac

SEQ ID NO: 128231 - RNA, 64 nt, hsa
uagucaaagacauuuuauccacauuucuaauaguggacuugauuaaguagauaagaucagcauc

SEQ ID NO: 128232 - RNA, 64 nt, hsa
uuauuuuguaaucuuguuuaacuuguugcuacugggacuugauuuacuguggcacuaguuaagu

SEQ ID NO: 128233 - RNA, 64 nt, hsa
cuuauagcaugauuugaugccugauaaucacagaggacuugaucuauuucucagguuauaaauu

SEQ ID NO: 128234 - RNA, 64 nt, hsa
ggggaaccuggccagccagcuuccugcuaugcugggacuugauuuccuucuugcucuguugguc

SEQ ID NO: 128235 - RNA, 64 nt, hsa
caaaugguuaacgcaggcagaacuccuuauugugggacuugaaggaaucauuuucucaucauua

SEQ ID NO: 128236 - RNA, 64 nt, hsa
auguuuuuaacccugagaucaaguuuaguaggcaggacuugaucucaaguggucacaaaguuuu

SEQ ID NO: 128237 - RNA, 53 nt, hsa
cgaccaaaggcaaucacuagaccggacuugaggcacgcggugcacccccagac

SEQ ID NO: 128238 - RNA, 64 nt, hsa
cugccguucauguugcuuucuccuuuguccucuuggacuugagggcauugugaaaagcuuugcu

SEQ ID NO: 128239 - RNA, 64 nt, hsa
gaaagcagcacaugcguuucuguggcagcuguggggacuugacagcaaugcucaucucucaugc

SEQ ID NO: 128240 - RNA, 64 nt, hsa
gacguagcuuccuccgaguggaacugcagccuggggacuugauuaggugcuaugcaucaguagc

SEQ ID NO: 128241 - RNA, 64 nt, hsa
ccaagugggcaagaaccccaacuuguuucucaggggacuugauuguucucuuagcugguggaau

SEQ ID NO: 128242 - RNA, 64 nt, hsa
uaauguugccacguguuuuuauguccuuuuuguuggacuugaguacucagcccaguuguucuca

SEQ ID NO: 128243 - RNA, 64 nt, hsa
cugggaguacaggcgucugccaccaugccuaauuuuuuucuauuuuuaggagagaccgguuuuc

SEQ ID NO: 128244 - RNA, 64 nt, hsa
gugcuuggugcaugauaguaggccuucaauaaauuuuuucuaaaugaaugaaaucuuucuggac

SEQ ID NO: 128245 - RNA, 64 nt, hsa
aaaagucccauucgguucuacauuauuaacuuuuuuuuucuauauccugaugaccaguaaauua

SEQ ID NO: 128246 - RNA, 64 nt, hsa
guuuuuuuuucuuuacauaaauauugauauauucuuuuucuacucaaagugccaaaggcuacag

SEQ ID NO: 128247 - RNA, 64 nt, hsa
ucguagauuaauugauuugcuaucuuuuaguuuuuuuuucuaugcauguagauguauuaaauau

SEQ ID NO: 128248 - RNA, 64 nt, hsa
uaagccauucccauauucaacauuuuguguacuguuuuucuaauuacauauauuacaaugaaca

SEQ ID NO: 128249 - RNA, 64 nt, hsa
gaugaaacauuaauuagggaucuugcugcuuuucuuuuucuacacgaaguuuucauuaaagcca

SEQ ID NO: 128250 - RNA, 64 nt, hsa
agaaaggcacauguuuaagaggaauaccuaaagguuuuucuaaauuccaacauuuaaaaggcaa

SEQ ID NO: 128251 - RNA, 64 nt, hsa
uauauaaauaugucagauguacauagagaucuauuuuuucuaaaacauuccccuccccacuccu

SEQ ID NO: 128252 - RNA, 63 nt, hsa
gaggcagagaccuccaauaaagugccuucugggcuuuuucuaaccuuugucuuagcuaccugu

SEQ ID NO: 128253 - RNA, 64 nt, hsa
uucgacucuucugugcgcuacugcugcgcacugcuuuuucuacaggcauuacaucaacuccuaa

SEQ ID NO: 128254 - RNA, 64 nt, hsa
uguaucagcaaguuaaaugguuccauuucugugauuuuucuauuauuugaggggaguuggcaga

SEQ ID NO: 128255 - RNA, 64 nt, hsa
uuguaguuuaagugcaaagaaacaguagugguuuuuuuucuauuguuuuguagucuuccugucc

SEQ ID NO: 128256 - RNA, 64 nt, hsa
augugcaauacuguauuuaguguuucuauuucaauuuuucuaggauguuaauuuauaugaaaau

SEQ ID NO: 128257 - RNA, 64 nt, hsa
agcuucuaaaaggccuuuuuguuauacagugcuuuuuuucuaguuuuauggacuugguuacugu

SEQ ID NO: 128258 - RNA, 64 nt, hsa
cacuuaaugagacauucuuuuuuuuauaagucuauuuuucuacucaguuucagaacacuaaucu

SEQ ID NO: 128259 - RNA, 64 nt, hsa
uaaaaugaggggaaauggauuuauaaacuuguuuuuuuucuaggugacccuguuuaauaggcuu

SEQ ID NO: 128260 - RNA, 64 nt, hsa
uuauuuuucacugccagcuucaaggaaagaaaauuuuuucuacaauuugcaugagggauuuuuu

SEQ ID NO: 128261 - RNA, 64 nt, hsa
acccauuauuccucuguaccugaauucagguugguuuuucuauuuggaaaagacuuuauaaaug

SEQ ID NO: 128262 - RNA, 64 nt, hsa
aauucauuguucuacaaguaaauaaauauuuugauuuuucuauuuccuccuaaagaaaguacac

SEQ ID NO: 128263 - RNA, 64 nt, hsa
uuaacuuaaggagacggguaaaggaucuuaaauuuuuuucuaauagaaagaugugcuacacugu

SEQ ID NO: 128264 - RNA, 64 nt, hsa
acagugcaaaaguucuuuaaaaugcauaugucuuuuuuucuaauuccguuuuguuuuaaagcac

SEQ ID NO: 128265 - RNA, 64 nt, hsa
cauuaaacaauuguuguguucuuuuuaccuuuuauuuuucuauuaccuugcuaccaaacaguuu

SEQ ID NO: 128266 - RNA, 64 nt, hsa
uguagaucagucuucaugugaccugcaguauuuuuuuuucuaauguauuugucagaaaucuguu

SEQ ID NO: 128267 - RNA, 64 nt, hsa
uuuaaaaaaacugaauuuuuauacauggcauacauuuuucuaguuccuucugcuugcuuuauua

SEQ ID NO: 128268 - RNA, 64 nt, hsa
guauuucaacagugugacuaauguuugaaauuauuuuuucuaagaguuuuucuauaaccuucca

SEQ ID NO: 128269 - RNA, 64 nt, hsa
ugugacuaauguuugaaauuauuuuuucuaagaguuuuucuauaaccuuccaaaagucgugaug

SEQ ID NO: 128270 - RNA, 64 nt, hsa
aucucuuaacuguagauuuuauuggccuguuuuuuuuuucuaaauaauucuuuaaaacuugacu

SEQ ID NO: 128271 - RNA, 64 nt, hsa
acaaaggcaauaaaaauaaauuugacuuuagcuuuuuuucuauacuuuccucuuuuuguaauuc

SEQ ID NO: 128272 - RNA, 64 nt, hsa
ugaucucacuguuauuauuaacauuuauuuauuauuuuucuaaaugugaaagcaauacauaauu

SEQ ID NO: 128273 - RNA, 64 nt, hsa
gcguuaacauuuucauauuuuuuucuuucagucauuuuucuauuugugguauauguauauaugu

SEQ ID NO: 128274 - RNA, 64 nt, hsa
ugaauguaguuauaaugcuuuugaaaaauuuuccuuuuucuauauccccuuaguccagccucuc

SEQ ID NO: 128275 - RNA, 64 nt, hsa
gggggaccacuggaucauuccagauuucuugugauuuuucuauuguguaauucuuggugggcuc

SEQ ID NO: 128276 - RNA, 64 nt, hsa
uuguuaucacauacagcaaauuccuuuuuuuuucuuuuucuaugagcacacucugcugcuucua

SEQ ID NO: 128277 - RNA, 64 nt, hsa
acaucaaauauuagccauuucccauuuuauuuuauuuuucuauguagguucauguuccauguuc

SEQ ID NO: 128278 - RNA, 64 nt, hsa
uuuaaauaaagcacuuucugucaaauaauggacuuuuuucuaaacagaaauuauuuucuauuaa

SEQ ID NO: 128279 - RNA, 64 nt, hsa
uauuuuuguacagauucugcaguuuaugauauuguuuuucuaaaaacaaaugcuguuuauacau

SEQ ID NO: 128280 - RNA, 64 nt, hsa
aaaagcuguaaauugcaugugcauauuugucuauuuuuucuauaaguuuuauugcaagagguaa

SEQ ID NO: 128281 - RNA, 64 nt, hsa
uucccuugcaaauuauuuuuaaaauucuaucuuguuuuucuauguauuucuuucugacuagacu

SEQ ID NO: 128282 - RNA, 64 nt, hsa
ugcaggaaaaacaaucuguuauuccagucuuaaauuuuucuaaaagaagacaauauuuuagaac

SEQ ID NO: 128283 - RNA, 64 nt, hsa
ggcagacacuuuauugcacaugaaauuuguaauuuuuuucuauuuaaguacacauuuggaaauu

SEQ ID NO: 128284 - RNA, 64 nt, hsa
agaaaauuuuccaaaaauguuaguuuacuaguaauuuuucuaagucuacuuauuaaauaacuua

SEQ ID NO: 128285 - RNA, 64 nt, hsa
cuaaaaauuaguauugaguuuaauggugaacacauuuuucuauuuucucuugaaucugcuucua

SEQ ID NO: 128286 - RNA, 64 nt, hsa
gaugaaaugaaaagagguucaauuaaaaccuacuuuuuucuagugcuaaagaaaagauuuaagc

SEQ ID NO: 128287 - RNA, 64 nt, hsa
aggugugaagagcagggcucagcagcaagucacauuuuucuacuauuugaccaaaaggaaaaga

SEQ ID NO: 128288 - RNA, 64 nt, hsa
caaacucaaauuccuguuuccaacuucaaauaguuuuuucuauaaacacaaaaucaguguuuau

SEQ ID NO: 128289 - RNA, 64 nt, hsa
ucauauguauuugaguggaggauuuuuuuucucauuuuucuaguguuaaauuuuaaccagcauu

SEQ ID NO: 128290 - RNA, 64 nt, hsa
ugucgaauguauguuuauacaucaguggaacccauuuuucuagccuagcaagucccaaacacau

SEQ ID NO: 128291 - RNA, 64 nt, hsa
gggccugucccucaaugccaguuuaggauuucuuuuuuucuauaccuugaaaugauuauaaaau

SEQ ID NO: 128292 - RNA, 64 nt, hsa
ucccaaacacuggcaacaaccacuuccucaacaauuuuucuauuugcuucagccuacucagauu

SEQ ID NO: 128293 - RNA, 64 nt, hsa
ucuauuugcuucagccuacucagauuuuuucagguuuuucuagcuccuccauaaccucacuccc

SEQ ID NO: 128294 - RNA, 64 nt, hsa
gagggagagaagguggaaaugguuuuuuuuuuuuuuuuucuauuuucuuucuuuuuuuuuuuuu

SEQ ID NO: 128295 - RNA, 64 nt, hsa
cuuuuuuuuuuuuuuuuuuuuuggucaacagccguuuuucuaguuccaaguuuuaaauacaugg

SEQ ID NO: 128296 - RNA, 64 nt, hsa
agagcuaaaauguuuauugcuguuuugucuuucuuuuuucuaaaaaaagaaaaaaaagaaaaaa

SEQ ID NO: 128297 - RNA, 64 nt, hsa
aagaacaaagaaacaugacugucucaaagaguaauuuuucuagauuagaccagucagguuuuug

SEQ ID NO: 128298 - RNA, 64 nt, hsa
gugcacagaauauuagucucuucuacauguuuuauuuuucuauuuauaauucccuuuuuuguug

SEQ ID NO: 128299 - RNA, 64 nt, hsa
uuuuguuguuauauuuuauacacagaauagaucuuuuuucuaacacauauuugaacugaauaac

SEQ ID NO: 128300 - RNA, 64 nt, hsa
agguagcuuuuuaauguuuacagaaauuuuaauuuuuuucuauuuugaaauuugaggcuuguuu

SEQ ID NO: 128301 - RNA, 64 nt, hsa
uuuaaauuucaaggaaauaugaaggcacuuccuuuuuuucuaagaaggaaguugcuagaugauu

SEQ ID NO: 128302 - RNA, 64 nt, hsa
cuaauaaguagugacagacaaccaagcuucaauauuuuucuaaagaaauuacaggugggauaug

SEQ ID NO: 128303 - RNA, 64 nt, hsa
cauuauugugaagugauguucagauuucuaguuuuuuuucuaguuuuuaauuuuaacaucagaa

SEQ ID NO: 128304 - RNA, 64 nt, hsa
agaccaaguagauaauggaaccaaaguuguuacuuuuuucuaguaguuauuuuuccuuuuucuu

SEQ ID NO: 128305 - RNA, 64 nt, hsa
uucgaagcuuaauuuauauucuuucuuuguaccuuuuuucuaaaauuaccaaagauauuacaca

SEQ ID NO: 128306 - RNA, 64 nt, hsa
ugccaucaagaaccccauuugggaguauuuuugauuuuucuacuuuuuguugaaaaaaggaauu

SEQ ID NO: 128307 - RNA, 64 nt, hsa
agugugaugcuauacuauuggaaaaauagcagcuuuuuucuauuuuauaaguuguaugcauaaa

SEQ ID NO: 128308 - RNA, 64 nt, hsa
uuucauuuuaagcaucaucuugaauuucuaaacuuuuuucuaugucuugguguuaaaagauuuc

SEQ ID NO: 128309 - RNA, 64 nt, hsa
aaaccucaaaucauaaagacauuuaaaagaauuguuuuucuaacuggaggggcucuagugcuaa

SEQ ID NO: 128310 - RNA, 64 nt, hsa
ugcguacuacauuuccugccuuuuucuuucaguguuuuucuaagacuaaauaaauagcaaacuu

SEQ ID NO: 128311 - RNA, 64 nt, hsa
agcuguaagcaagucacuuaaucuuucuaccucuuuuuucuaucugccaaauugagauaaugau

SEQ ID NO: 128312 - RNA, 64 nt, hsa
uccuuaaauauauauagauauguauauauacauguuuuucuauuaaaaauagacaguaaaauac

SEQ ID NO: 128313 - RNA, 64 nt, hsa
uagaccuggaaacauaaauuuaaauccuuagacauuuuucuagaaaaaaaugcaaaguuuauaa

SEQ ID NO: 128314 - RNA, 64 nt, hsa
uugcuuaggugauccacugccaugugauccauaauuuuucuacauaaaaaaucaaaguuaaaag

SEQ ID NO: 128315 - RNA, 64 nt, hsa
uuuguauaaaacaauagaacagaaauuugggacauuuuucuaggaaauaaaauuccucggugua

SEQ ID NO: 128316 - RNA, 64 nt, hsa
uguguguguguauaccugggggugggcagugcucuuuuucuaaaacuaauauggcuuauauauc

SEQ ID NO: 128317 - RNA, 64 nt, hsa
auuuaucuuugcuugcacaucugcucuguuuugguuuuucuacaggaaaugaaaaucaacuugu

SEQ ID NO: 128318 - RNA, 64 nt, hsa
cccgccccacaacaucuauaaggggcaaaaagucuuuuucuaauaaguauucuucuaugguagu

SEQ ID NO: 128319 - RNA, 64 nt, hsa
uuugaauuuuuuuucaguauauauauguuucuuguuuuucuauuuuucuacuucauacuguuaa

SEQ ID NO: 128320 - RNA, 64 nt, hsa
uuuuuucaguauauauauguuucuuguuuuucuauuuuucuacuucauacuguuaaugucaaau

SEQ ID NO: 128321 - RNA, 64 nt, hsa
cacuuuucaguuguuuguauucaaaugacgauuauuuuucuacucaaugugaauaucccuggcc

SEQ ID NO: 128322 - RNA, 64 nt, hsa
ggcagcugggcugagucugcccugagggggcgccuuuuucuaauuugaacagaggcacccuaug

SEQ ID NO: 128323 - RNA, 64 nt, hsa
ucuuaugaagcagauauaaauccaguaagcuauuuuuuucuaccuaugggcaaguucauaaguc

SEQ ID NO: 128324 - RNA, 64 nt, hsa
cuacuuggugcugaugaauuuaugccuagcuuuuuuuuucuagguggugauuuuucaauuucuu

SEQ ID NO: 128325 - RNA, 64 nt, hsa
acuuuaucauuuucaagauguccucuaggaauuuuuuuucuaguaauuuugcaaucuaccuaau

SEQ ID NO: 128326 - RNA, 64 nt, hsa
agaauuucaagcucuggguaauaacugcugauauuuuuucuaauuucaaauuuaccucuuuugg

SEQ ID NO: 128327 - RNA, 64 nt, hsa
cugcccucacauuuuguuugaaauuucagaacuguuuuucuauguaaauauugaaaacuuauga

SEQ ID NO: 128328 - RNA, 64 nt, hsa
auggaagcuaaaauugacauauuuuuauguaaaguuuuucuauucuuugauuuuuaauaaacuu

SEQ ID NO: 128329 - RNA, 64 nt, hsa
aaauaagagcaguauccuuagcucuagccaagcauuuuucuaauuccugccuuuggucacaaag

SEQ ID NO: 128330 - RNA, 64 nt, hsa
aagacuuauaaaggauuucaucagaaguuuucauuuuuucuaaauccuccccuacaaaauuuuc

SEQ ID NO: 128331 - RNA, 64 nt, hsa
aaugaguaguaacccaauuuagcuuuacaaagauuuuuucuauuacuuuuuuuuuuuauugugg

SEQ ID NO: 128332 - RNA, 64 nt, hsa
uucccuuaggcauuuuauaaaaauuuaaaaauuauuuuucuauuuuguuuaaaagacaaugcau

SEQ ID NO: 128333 - RNA, 64 nt, hsa
acacuguuaaaauuuuggcauauuuccugcugauuuuuucuacugcugauuuuugcacagguga

SEQ ID NO: 128334 - RNA, 64 nt, hsa
caaaaacaaaagauauaaaaauggaucauaaacauuuuucuaaauccugaaaaaugcauagaca

SEQ ID NO: 128335 - RNA, 64 nt, hsa
gagcuuacauugaaaacagauauuacagcuuauuuuuuucuacauaauugugaccaauacauuu

SEQ ID NO: 128336 - RNA, 64 nt, hsa
ucugauguaccaauuuagaucuauuucuuuauacuuuuucuaaucaauugcuuaauaguacuuu

SEQ ID NO: 128337 - RNA, 64 nt, hsa
ccuuugucauagcaguugaaugugcauugacauauuuuucuaugauuuuuuaaaauuacaauag

SEQ ID NO: 128338 - RNA, 64 nt, hsa
gagucucuccuuguuuggaacaaaucgcuucgccuuuuucuacuugccugcugaagcuuuggag

SEQ ID NO: 128339 - RNA, 64 nt, hsa
uacguuuuuuuguaacgugagacugcagaguuuguuuuucuauaugugaaggauuacaacacaa

SEQ ID NO: 128340 - RNA, 64 nt, hsa
ucaagaauuuaaaggauuucauggaagaaccaaguuuuucuaugauauuaaaaaauguacagug

SEQ ID NO: 128341 - RNA, 64 nt, hsa
acguuugcugcgauaaaucuuuuggauuuuuguguuuuucuaaugagaauacuguuuuucauua

SEQ ID NO: 128342 - RNA, 64 nt, hsa
cgacgucacuacagcuucuuuuuuuuuuuuuuuuuuuuucuauuuuugccagacucuugauacu

SEQ ID NO: 128343 - RNA, 64 nt, hsa
uacuucugguagaugucuuaugagauuguucugcuuuuucuaaguuacuuagauguuggauaug

SEQ ID NO: 128344 - RNA, 64 nt, hsa
uuacacuauucauaacucuuaaaauuauucucuuuuuuucuaagagucccucccuuccaaaagu

SEQ ID NO: 128345 - RNA, 64 nt, hsa
uuuauccucuucaccaccacuacccacuccauuuuuuuucuauuuuuaagauuagaggaaaaug

SEQ ID NO: 128346 - RNA, 64 nt, hsa
guaaaccuuuacacuaaggucuccauauacuauuuuuuucuacugaaaacaauuuagaaagaag

SEQ ID NO: 128347 - RNA, 64 nt, hsa
auuuuaauuacuugugauuuagauguauccauccuuuuucuauuaagaauacaaaugcugggcu

SEQ ID NO: 128348 - RNA, 64 nt, hsa
uaaaguuuugcuuuuaaaacguggacauaacucauuuuucuaguuuuugacaauuguguguuuu

SEQ ID NO: 128349 - RNA, 64 nt, hsa
ccuugguggaugggauggcuguaucuagacaaaauuuuucuaaaacuccaucaaggcucuuauu

SEQ ID NO: 128350 - RNA, 64 nt, hsa
cagagcucagccuucucacucuaaaagaaagauauuuuucuauuuauuuucuacaucuggccag

SEQ ID NO: 128351 - RNA, 64 nt, hsa
gguuuccuuuguaugcuucagccuuccuaguugguuuuucuaggccuggugugagagguaggga

SEQ ID NO: 128352 - RNA, 64 nt, hsa
cucuuuugggaccuccuuugucaguaccccuucuuuuuucuaagcagcuaauaagagguugggu

SEQ ID NO: 128353 - RNA, 64 nt, hsa
gcuauacuuucagacuucacaauuuuaagccacuuuuuucuauuaacaguugaaugaaccagug

SEQ ID NO: 128354 - RNA, 64 nt, hsa
auacuuagagguaagucauuuauuauuuuuuuccuuuuucuaaucuuuuccuuaaaauuaauag

SEQ ID NO: 128355 - RNA, 64 nt, hsa
cuuguauaacagaaauaccuucuauacaaaccuuuuuuucuacuuuuagauagaaaugucuacu

SEQ ID NO: 128356 - RNA, 64 nt, hsa
gaagaaaaauuccugugauaguucaguucuuuaguuuuucuauuugaaaaaaaaaaaucauuua

SEQ ID NO: 128357 - RNA, 64 nt, hsa
uaauuuucacaaaugucauguuugccaauaugaauuuuucuagucaacauauuauuguaauuua

SEQ ID NO: 128358 - RNA, 64 nt, hsa
auuuaguagaggcuaccuuucccaccagugacucuuuuucuacaacugccuugucaguuuggua

SEQ ID NO: 128359 - RNA, 64 nt, hsa
uuuggaacgugacacaauguuaggcauaccuccuuuuuucuaauacauggaauacauuuuguug

SEQ ID NO: 128360 - RNA, 64 nt, hsa
auauacuuaaaauauucccauuuguaucuauuuuuuuuucuacuguuuuuuauuuggacacuua

SEQ ID NO: 128361 - RNA, 64 nt, hsa
acugggaauuuuguuuucaccuuauacugaguccuuuuucuaauguaaaaauauuucuuccaag

SEQ ID NO: 128362 - RNA, 64 nt, hsa
uuguguucuauuuccacucgucuggccugccucauuuuucuaggcccuuuuguaagcuguaauu

SEQ ID NO: 128363 - RNA, 64 nt, hsa
ccucaauuuccaccucccaagggaaguuuauguauuuuucuaggcccuuuucuaugucuuuaca

SEQ ID NO: 128364 - RNA, 64 nt, hsa
aauuucaguagccucaguuauucaaccuaggagauuuuucuaccucuuuacuacccugcugaag

SEQ ID NO: 128365 - RNA, 64 nt, hsa
cccauuucaauauugcacuuauuaauggucuuuauuuuucuagcauagauaacaauugauucuu

SEQ ID NO: 128366 - RNA, 64 nt, hsa
acauaagcuagaucacuacaaggagcuguuaucuuuuuucuaaucaaguguuuaaaacacugau

SEQ ID NO: 128367 - RNA, 64 nt, hsa
aguacuugaagucaguuuuagaugcuuuauuuuauuuuucuagucaaaaacguguuucccccag

SEQ ID NO: 128368 - RNA, 64 nt, hsa
cuuuuaauuauucuagaauuuuaacugcaucucauuuuucuagcauggugagaacuaauaugua

SEQ ID NO: 128369 - RNA, 64 nt, hsa
uuggcucuucucagcuuuuuuuguacauauuuuuuuuuucuaaagagaagaaaaaguuaucaca

SEQ ID NO: 128370 - RNA, 64 nt, hsa
uuuuuuuucuuaucuaccuguuauauugugcuaauuuuucuauguaugugaugugaaaugaaga

SEQ ID NO: 128371 - RNA, 64 nt, hsa
agcauauccguucaaaaauuuuuccacuaugucuuuuuucuaguggcuacuguuuuaguuuucu

SEQ ID NO: 128372 - RNA, 64 nt, hsa
gaggucauaucuguuuuucuuuaucauucauuucuuuuucuaaaaguuguuacugauaugcuuu

SEQ ID NO: 128373 - RNA, 64 nt, hsa
ccuggaaacacuaccauuauuuuugguguauugcuuuuucuaauugacuguuuuuaaugauuuu

SEQ ID NO: 128374 - RNA, 64 nt, hsa
caaccagacaggaguuaacuuguauuagaauuguuuuuucuaaaguuauguuaccugagaaauu

SEQ ID NO: 128375 - RNA, 64 nt, hsa
aacaggauaagguuacacuuguauuagaauuguuuuuuucuaaaguuauguuaccugaaaaauc

SEQ ID NO: 128376 - RNA, 64 nt, hsa
uugggauaaacuccaauguuuaauacauugauuuuuuuucuaaagaaauggguuuuaaacuuug

SEQ ID NO: 128377 - RNA, 64 nt, hsa
uuauguaguguaugcguagccucuaucucguauuuuuuucuauuucuccuccccacaccaucaa

SEQ ID NO: 128378 - RNA, 64 nt, hsa
ugcaaacuuuagacauugugauucacugaaaucauuuuucuacugucaaauauguaccuuuucu

SEQ ID NO: 128379 - RNA, 64 nt, hsa
gcuuuuuuccagcccaggugugguuuuguuuguuuuuuucuauguuuguggguuuuuuuucauc

SEQ ID NO: 128380 - RNA, 64 nt, hsa
cuagaaugaaggccugcuagcacuagcguggacauuuuucuagcauucacccuugggcugcaga

SEQ ID NO: 128381 - RNA, 64 nt, hsa
cuaaagacuacuuugaguaggcaacauaacuaaauuuuucuaguuucuuaugauacagguucau

SEQ ID NO: 128382 - RNA, 64 nt, hsa
uuuacuaaggauuagauuauuuaaugaaugucuuuuuuucuauauauugaauuagauguuaucc

SEQ ID NO: 128383 - RNA, 64 nt, hsa
ucuguaaccaaaggaacuuaauuuuagagccaaauuuuucuaucuuguuggauuuuuuacagug

SEQ ID NO: 128384 - RNA, 64 nt, hsa
ucacuggauuucuuuagacauugaagcaaacauuuuuuucuaagaauugcuucucagaugauga

SEQ ID NO: 128385 - RNA, 64 nt, hsa
uuggugucucaguggcuucuugcuuauuccaugcuuuuucuaucccauccucucucugugcccu

SEQ ID NO: 128386 - RNA, 64 nt, hsa
auuuaggaaauggaagcuuuuaauuuuaauuucuuuuuucuaagacagagucucacucugucgc

SEQ ID NO: 128387 - RNA, 64 nt, hsa
gccaacuacagauggcauaugccuuaaagaugcauuuuucuauguauuuaauauuuuguguaca

SEQ ID NO: 128388 - RNA, 64 nt, hsa
ggauauauugguacaacaugacuuaaaacuuuuuuuuuucuauuaaaacuuaaaggggaacaaa

SEQ ID NO: 128389 - RNA, 64 nt, hsa
gcuaauaugcacaguaaauccaugucuuuguuuguuuuucuauuaaaaagcaaucaagaaagau

SEQ ID NO: 128390 - RNA, 64 nt, hsa
gcuugcuauauaagauucaaaagagcuuuuuaaauuuuucuaauaauaucuuacauuuguacag

SEQ ID NO: 128391 - RNA, 64 nt, hsa
uugccagacuuucuccaaaugaaaccugaaucaauuuuucuaaaucuagguuucauagaguccu

SEQ ID NO: 128392 - RNA, 64 nt, hsa
auuguuguauuuucaugacugaccuuaacuguacuuuuucuagcaagagaugcuuuauucugca

SEQ ID NO: 128393 - RNA, 64 nt, hsa
uaauuuacuuguacaauucauuguuacuguucuguuuuucuauuaaucuuuugucaacuuccug

SEQ ID NO: 128394 - RNA, 64 nt, hsa
agcauuuucuuagaccucuucagcugauuguuuauuuuucuaugaauuccuacacaugguuauu

SEQ ID NO: 128395 - RNA, 64 nt, hsa
uuaacuagguugcuacuuuauuugccuaaauacuuuuuucuauuuuguuagauuuugccuuucu

SEQ ID NO: 128396 - RNA, 64 nt, hsa
accagcaauuucuuuuuccuuguggucugauuccuuuuucuaauccaugaaggccaucuuguag

SEQ ID NO: 128397 - RNA, 64 nt, hsa
aaacaaaauacccuuuuucuuuuaguaugguuuauuuuucuagguuuucugucccucccucagu

SEQ ID NO: 128398 - RNA, 64 nt, hsa
uaacugucuuuucucaguuuccauuucauuuuuuuuuuucuaguuuuggugacuuagugauuuu

SEQ ID NO: 128399 - RNA, 64 nt, hsa
gggucuuaaaagguucuggaaagcaguaaguucauuuuucuaaaaacuauaacauucuguugga

SEQ ID NO: 128400 - RNA, 64 nt, hsa
aguacuuacguguuuaucuaacaguucacuuccauuuuucuagucuggauuuuuugaguauuua

SEQ ID NO: 128401 - RNA, 64 nt, hsa
aaaacuggggauuucucaaugugacuaacucuaauuuuucuaauuauaacugccuuuaauuaac

SEQ ID NO: 128402 - RNA, 64 nt, hsa
uaaaagaguuuuauuauaaaccguguguuuuugguuuuucuaaguauauagaaagcuuguauaa

SEQ ID NO: 128403 - RNA, 64 nt, hsa
uagcaccuggaugaacauuaggagugcuuagucuuuuuucuacuugcuuuuccaaacacucaca

SEQ ID NO: 128404 - RNA, 64 nt, hsa
cuccacuugccucuuauugucuuauuuuuauauauuuuucuaaauauauguauauauacaguac

SEQ ID NO: 128405 - RNA, 64 nt, hsa
uauauauauacacacacauauauaaaaaguauaauuuuucuauuuuuguuuuugguuuuaauuu

SEQ ID NO: 128406 - RNA, 64 nt, hsa
uuugaaaacugaauguaauacuugaguagauuuuuuuuucuaguuugaaauuuagucugucuuu

SEQ ID NO: 128407 - RNA, 64 nt, hsa
cauucucauuuagagaaaccuauuuucuuuuuucuuuuucuauuuuaguguuucauuuaugugc

SEQ ID NO: 128408 - RNA, 64 nt, hsa
uuuucuuucacccaagaaugugcuuuccuggaaauuuuucuagauagaauauuauguaauuugu

SEQ ID NO: 128409 - RNA, 64 nt, hsa
auucauuugaguuaacagugguguuagugauagauuuuucuauucuuuucccuugacguuuacu

SEQ ID NO: 128410 - RNA, 64 nt, hsa
cugcaggaccugggagcauccuaaagugucaacguuuuucuaugacuuuuagguaggaugagag

SEQ ID NO: 128411 - RNA, 64 nt, hsa
guacuacauguaaacugauuuuuuguucugauuuuuuuucuaauauuuuuaggaaaauauuaag

SEQ ID NO: 128412 - RNA, 64 nt, hsa
uggaaguagaucugaauaggcuaccggagccuuguuuuucuaaaggggggcgcugucuagcacu

SEQ ID NO: 128413 - RNA, 64 nt, hsa
ucaccuguguaaguugguauuugggcacuuuauauuuuucuaaaaacguguuuuggauccugua

SEQ ID NO: 128414 - RNA, 64 nt, hsa
aagcuaaugguaauuagaaucauuugaauuuauuuuuuucuaauaugugaaacacagauuucaa

SEQ ID NO: 128415 - RNA, 64 nt, hsa
aauccauagcagcaccguucauucuaugagucuauuuuucuaaugaugcaguaauuaaauugca

SEQ ID NO: 128416 - RNA, 64 nt, hsa
gacuauuuucaaaaucauuuucaucaagacaccuuuuuucuaaaauaggcauugcauacacaua

SEQ ID NO: 128417 - RNA, 64 nt, hsa
aaauguguaaagaacaaucaauauacuuuauuuuuuuuucuauuuuauaaaauaaauauauaug

SEQ ID NO: 128418 - RNA, 64 nt, hsa
cauuuuaaguguguggcuuauaaauauuuugguauuuuucuauacuacguaaauucugaguuua

SEQ ID NO: 128419 - RNA, 64 nt, hsa
cuggaagcccugcgguagcuagcacugaagacuauuuuucuauugguauaacccgcccaccuga

SEQ ID NO: 128420 - RNA, 64 nt, hsa
accucauagcaguaaaugacuugcuguuguuuaauuuuucuaaggcaucuuaauagacuucugu

SEQ ID NO: 128421 - RNA, 64 nt, hsa
caagaacacuggcuuaauucaagucaguugauuuuuuuucuauuaaaacuguuguuaaaauauu

SEQ ID NO: 128422 - RNA, 64 nt, hsa
gacaccuaucuauuaaaccauucugcaaauacgguuuuucuaccugauugcauauagcauaugu

SEQ ID NO: 128423 - RNA, 64 nt, hsa
aucuguuuuuacaucauaaugcaagaauuggaaauuuuucuaugguagccuaguuauuugagcc

SEQ ID NO: 128424 - RNA, 64 nt, hsa
uuaaaggcaggucugaauaagaccuagcuuuguuuuuuucuaauggaaugaaccauuuuccucu

SEQ ID NO: 128425 - RNA, 64 nt, hsa
cuaauuauugcuuccuuucuuauuacuuuccuaauuuuucuauauuuuaaaaacuacaguuucc

SEQ ID NO: 128426 - RNA, 64 nt, hsa
uaaauagaaucuaauaaaccaauguagcauuauuuuuuucuaaaugaagccccaaaaaagaaaa

SEQ ID NO: 128427 - RNA, 64 nt, hsa
uaauauuuuauuuuucuuuuuaugccacuuuggauuuuucuacaaaggcagugguguccaaaau

SEQ ID NO: 128428 - RNA, 64 nt, hsa
aaaaucucugcccuaaauuuuacuaauaaauccauuuuucuagugauacacaaauuguuuaagg

SEQ ID NO: 128429 - RNA, 64 nt, hsa
cugaagcuuuacaggacauacucccacucccauuuuuuucuaagccuacagcaucuugauucau

SEQ ID NO: 128430 - RNA, 64 nt, hsa
ggacgagagcacgccugggagcgaaagcuggccuuuuuucuacgaaugcacuacauuaaagaug

SEQ ID NO: 128431 - RNA, 64 nt, hsa
uuaaauuuauaguugugaacauugcuuguguguguuuuucuaaguagauucacaagauaauuaa

SEQ ID NO: 128432 - RNA, 64 nt, hsa
gaaggggagaaguagaaccacaguguuuuauuuauuuuucuaaaacucuuacuaaauccagauu

SEQ ID NO: 128433 - RNA, 64 nt, hsa
caacacaacuggaguuuccauuuaucauaauuaguuuuucuaaauagacccuuaugggaguuug

SEQ ID NO: 128434 - RNA, 64 nt, hsa
gcaaaacaaaaacaauucaggaacaacggcuaauuuuuucuaaaguuaaauuuagugcacucug

SEQ ID NO: 128435 - RNA, 64 nt, hsa
aaagaacaaaauaaaauaauaauuuauaggacaguuuuucuacugccauucaauuugaugugag

SEQ ID NO: 128436 - RNA, 64 nt, hsa
cgaucuaaaaacuuaauuuuauaaaauugacuuauuuuucuagacuaaaauuguauaugcuuuu

SEQ ID NO: 128437 - RNA, 64 nt, hsa
ugcugauuguugccaucacguuccuacaaaauuguuuuucuaugggauguucuggcagcugugu

SEQ ID NO: 128438 - RNA, 64 nt, hsa
gaaauguuaaauacaauuucugaaaguuauguuuuuuuucuaucaucugguauaccauugcuuu

SEQ ID NO: 128439 - RNA, 64 nt, hsa
uuuugaccucccauuuuuacuauuugccaauaccuuuuucuaggaaugugcuuuuuuuuguaca

SEQ ID NO: 128440 - RNA, 64 nt, hsa
cucuguuaacauuuugauguuguguuuuugcuuauuuuucuaugcauaguuaugcauuuauauu

SEQ ID NO: 128441 - RNA, 64 nt, hsa
uugugucuuaggccaauuucugggccuucuggguuuuuucuacacugucaauaauuaucgcuuu

SEQ ID NO: 128442 - RNA, 64 nt, hsa
cgggaugccaagguaaguggagguauacuucgaauuuuucuagaagguaaagccuaguuugcug

SEQ ID NO: 128443 - RNA, 64 nt, hsa
uuuuuuaauauaugucaaguuugaauuggaauaauuuuucuaugauuagguacaauuuaucaaa

SEQ ID NO: 128444 - RNA, 64 nt, hsa
acacagauccuaaguagaaccagguaauugucucuuuuucuaauaaggaauuuggguaauuuuu

SEQ ID NO: 128445 - RNA, 64 nt, hsa
uacacagauccaaaauagaaucagauuaucucuuuuuuucuaaaggagagaaagacuuagaaca

SEQ ID NO: 128446 - RNA, 64 nt, hsa
guggcugaggucucuugaaauugcuaaagggaaauuuuucuaugguaaugcucuuacggauaua

SEQ ID NO: 128447 - RNA, 64 nt, hsa
uaaaaaucaaaauucuuuuaaauaucaacuuaauuuuuucuaaguaagauacaaaaaauuuuca

SEQ ID NO: 128448 - RNA, 64 nt, hsa
uuuuaagcauguagccaguaauaauuugaaguuuuuuuucuaugcaagcuuaccuuguuggcau

SEQ ID NO: 128449 - RNA, 64 nt, hsa
auuaaaauuguaucagaggguuuucucuaaucauuuuuucuauuuuuuuuuuuguacuucuaga

SEQ ID NO: 128450 - RNA, 64 nt, hsa
aaaugaaauuuggcuaauaggagcaauucagcuauuuuucuauacaguaauuggugugugguau

SEQ ID NO: 128451 - RNA, 64 nt, hsa
aguuuuuuucaucacuaugauuuuauaaaacaauuuuuucuaugaaccuuuacuuacuugacug

SEQ ID NO: 128452 - RNA, 64 nt, hsa
guugaaggcuacuuuucuguucuuuuuuuuuuuuuuuuucuauccuguacauuuaguugaacug

SEQ ID NO: 128453 - RNA, 64 nt, hsa
caaaucuguaaguuauuuuugaauuuucugaacuuuuuucuaagagauuacauaggagacuaaa

SEQ ID NO: 128454 - RNA, 64 nt, hsa
auuuacaggucucuauuuauguauuuauuauuuauuuuucuacuuucccacuuuucuaaaaggu

SEQ ID NO: 128455 - RNA, 64 nt, hsa
cagaccagccccagcgaggacuuguugguugugguuuuucuaucagggaagucaauggcuggcc

SEQ ID NO: 128456 - RNA, 64 nt, hsa
agaacuaggggaaaggaguuugaaugugucuauuuuuuucuagugaauguauuuuaaccacagu

SEQ ID NO: 128457 - RNA, 64 nt, hsa
ggaaauguaauaauggacauuagggagcccugccuuuuucuacugguucccccaauguuugaaa

SEQ ID NO: 128458 - RNA, 64 nt, hsa
ugccugauucuuuaauauugccuaaaucggaaccuuuuucuauguugcacacaugguuuucaga

SEQ ID NO: 128459 - RNA, 64 nt, hsa
uguuucauuugacggucucuuuuugaucaaccaauuuuucuaaaaguucagucgaaagcuuuua

SEQ ID NO: 128460 - RNA, 64 nt, hsa
aaaaguuucagcuccgugugugagaugugcagguuuuuucuaggggguagggggagacuaaaau

SEQ ID NO: 128461 - RNA, 64 nt, hsa
cguuugccuuggcuugguuucauacacugauuuauuuuucuaugccaggcaguagagucucucu

SEQ ID NO: 128462 - RNA, 64 nt, hsa
cacaaaaaguugugucauaacuuacccagauauguuuuucuaucauuugaaaccuuuuuagcua

SEQ ID NO: 128463 - RNA, 64 nt, hsa
aaagacuguuauaaugguguauauguugggguuuuuuuucuaagcuucuuugucuuaaauuuua

SEQ ID NO: 128464 - RNA, 64 nt, hsa
aguuuuggcaugaauauacuaaagcuuuuuuuuuuuuuucuagcauguguuuucuccucuuugg

SEQ ID NO: 128465 - RNA, 64 nt, hsa
ggcugcuuuuuguuuuucauuuucuuucagaagauuuuucuaacuuagggucugucuugcaugu

SEQ ID NO: 128466 - RNA, 64 nt, hsa
uuuuaagggcuuuaugugaacuaugauauuguaauuuuucuaagcauauucaaaagggugacaa

SEQ ID NO: 128467 - RNA, 64 nt, hsa
uuuaaaguuucuugcauuuauuauucucaaaaguuuuuucuaaguuaaacagucaguaugcaau

SEQ ID NO: 128468 - RNA, 64 nt, hsa
uuuuuuucuauggguguuaucaccuagcugaauguuuuucuaaaggaguuuauguuccauuaaa

SEQ ID NO: 128469 - RNA, 64 nt, hsa
ccaaauuaaaaaagauaaacacaagauugguguuuuuuucuauggguguuaucaccuagcugaa

SEQ ID NO: 128470 - RNA, 64 nt, hsa
cucaaugagcauguuuagacuuuaacauaagcuauuuuucuaacuacaaagguuuaaaugaaca

SEQ ID NO: 128471 - RNA, 64 nt, hsa
aaaaaacugacuguauaaacacuuaucacugaccuuuuucuauguguaguuuugccuuuuaucu

SEQ ID NO: 128472 - RNA, 64 nt, hsa
uugacagguuaucuggaacaaaggagcuucuuuuuuuuucuagguuuugcaggcaugaaauagu

SEQ ID NO: 128473 - RNA, 64 nt, hsa
aggaauuacugcuuagaacagcugcuuggguguauuuuucuacacaggucuguacuucugccac

SEQ ID NO: 128474 - RNA, 64 nt, hsa
ccaaaucuuucauacagauacagguaaagaaauauuuuucuagguugucggagcugcguaccuc

SEQ ID NO: 128475 - RNA, 64 nt, hsa
uuuguauuuuuuuucuuuugaaaggguuuguuaauuuuucuaauuuuaccaaaguuugcagccu

SEQ ID NO: 128476 - RNA, 64 nt, hsa
guauuagggaagaaugagacaauuuuguguaggcuuuuucuaaaguccaguacuuuguccagau

SEQ ID NO: 128477 - RNA, 64 nt, hsa
uugauuuccccugaccucuaauggcuggauccuauuuuucuacaaccuuucagugacaucguuc

SEQ ID NO: 128478 - RNA, 64 nt, hsa
auuucucgcaucccuucucgugagcgcuuagaccuuuuucuauuuuagucggauuuuguuuugg

SEQ ID NO: 128479 - RNA, 64 nt, hsa
agggagaacagaaaugcaaaaauacagaugucuauuuuucuaaacugggggguggaggggugcc

SEQ ID NO: 128480 - RNA, 64 nt, hsa
gagucuauuuuuguacaaaagagaagcaaaaucuuuuuucuaaaccugugccucccucuccucg

SEQ ID NO: 128481 - RNA, 64 nt, hsa
uuuaggcaauuaucucucuuccagggaguaccuuuuuuucuaguugagaauuaauaauggucca

SEQ ID NO: 128482 - RNA, 64 nt, hsa
uaaaauuuaaauagcuaccauuggcaaucugcuuuuuuucuaaaaucugauuugcagccaggaa

SEQ ID NO: 128483 - RNA, 64 nt, hsa
agaacuuuguaccuuuccccugauuuuuaaacccuuuuucuaaacagacugacuuucuuacaaa

SEQ ID NO: 128484 - RNA, 64 nt, hsa
gcuucagggcugcguggaaagaguuuuuacucucuuuuucuagccuguauaccaggcuuuuccc

SEQ ID NO: 128485 - RNA, 64 nt, hsa
aagaaguggccugcagaaguuuaauaauuugacuuuuuucuaauauuuuaguuugaaagaaaau

SEQ ID NO: 128486 - RNA, 64 nt, hsa
ucugcagguuugugaaauaggaugaaacucaaucuuuuucuauuguggguuugcauuugaaaag

SEQ ID NO: 128487 - RNA, 64 nt, hsa
uuaugccuauuuuaacauuaacuucuaaagaaguuuuuucuaagaaaauguuucaaggcaauau

SEQ ID NO: 128488 - RNA, 64 nt, hsa
gaagauucuugucacagaaucagcaauaccauaguuuuucuacaugugcucagcugggggugug

SEQ ID NO: 128489 - RNA, 64 nt, hsa
uuuuuuuuuuuuaaguuucauucuuccuagaauauuuuucuaacaauuuuuauuucagcuuuaa

SEQ ID NO: 128490 - RNA, 64 nt, hsa
gcccuguuuccagagcaaaguaacagagaccagguuuuucuagagagcuaagugggauguguag

SEQ ID NO: 128491 - RNA, 64 nt, hsa
ggcgucagccaccgcgcccggcccugugccuugcuuuuucuacucacuaagauauaaaacagcu

SEQ ID NO: 128492 - RNA, 64 nt, hsa
guuuacauugagcacuagaacauguuuggccuuuuuuuucuacguuaugcaaaaugcccaggga

SEQ ID NO: 128493 - RNA, 64 nt, hsa
uuuuuugucuuacaauucagggaauauauuuauauuuuucuaugaaaaguuaugaaugugacua

SEQ ID NO: 128494 - RNA, 64 nt, hsa
gcuccuuuaacaucugcuaauuaagugcaauaaauuuuucuagaaaauggcaaagaugacuucc

SEQ ID NO: 128495 - RNA, 64 nt, hsa
gguguuggggaugccagaacaccacuugguuuuauuuuucuaagugcaugugaugugauagagu

SEQ ID NO: 128496 - RNA, 64 nt, hsa
uuaauauagugaguucuuucaggagcuuucucuguuuuucuauugauaccucuauauauuuuua

SEQ ID NO: 128497 - RNA, 64 nt, hsa
gguauuucauguuacuccuaagcuugaaagcucuuuuuucuauauacagaauucauagaauuuu

SEQ ID NO: 128498 - RNA, 64 nt, hsa
auggaaaugagagcccggcgcauggauuuuaauguuuuucuaacaacuguggagauuugaggga

SEQ ID NO: 128499 - RNA, 64 nt, hsa
uuuuauuggauuuuuguauuuuaaauuucaaauauuuuucuacaucaaaccuagcaaaaaugga

SEQ ID NO: 128500 - RNA, 64 nt, hsa
ccccuugaggucaguaauaaauacaaaaaaaucauuuuucuagagcagagucuuaaaaucaggu

SEQ ID NO: 128501 - RNA, 64 nt, hsa
acagcuuaaaaucaaaaauguauguuaagagaauuuuuucuauuacuuauggaucaugcuuuaa

SEQ ID NO: 128502 - RNA, 64 nt, hsa
gugaggauacuuucaguaccacuccuaccauucauuuuucuaaauuccuuaguacauauacuug

SEQ ID NO: 128503 - RNA, 64 nt, hsa
ccucauugccugccuuccauucauauuacacuuauuuuucuauuuuuuguauuaccuuuuuaaa

SEQ ID NO: 128504 - RNA, 64 nt, hsa
aauccuaauugcaguuuagugaaauuacuagauuuuuuucuaaucuucaguauguagugagcau

SEQ ID NO: 128505 - RNA, 64 nt, hsa
uaaagaacagaguggaguggauauauucacuuuuuuuuucuaaaacauacaaagugauaaaaua

SEQ ID NO: 128506 - RNA, 64 nt, hsa
aguagaaagugcgaagagcugaguuccccaccuuuuuuucuauugaugcuucuuuuuuaacaaa

SEQ ID NO: 128507 - RNA, 64 nt, hsa
aaaugccagcugcagauaacucaaagccaucccuuuuuucuaaagggcacauugagaaugucac

SEQ ID NO: 128508 - RNA, 64 nt, hsa; identical to SEQ ID NO: 102117

SEQ ID NO: 128509 - RNA, 64 nt, hsa; identical to SEQ ID NO: 102118

SEQ ID NO: 128510 - RNA, 64 nt, hsa; identical to SEQ ID NO: 102119

SEQ ID NO: 128511 - RNA, 64 nt, hsa; identical to SEQ ID NO: 102120

SEQ ID NO: 128512 - RNA, 64 nt, hsa; identical to SEQ ID NO: 102121

SEQ ID NO: 128513 - RNA, 64 nt, hsa; identical to SEQ ID NO: 102122

SEQ ID NO: 128514 - RNA, 64 nt, hsa; identical to SEQ ID NO: 102123

SEQ ID NO: 128515 - RNA, 64 nt, hsa; identical to SEQ ID NO: 102124

SEQ ID NO: 128516 - RNA, 64 nt, hsa; identical to SEQ ID NO: 102125

SEQ ID NO: 128517 - RNA, 64 nt, hsa; identical to SEQ ID NO: 102126

SEQ ID NO: 128518 - RNA, 64 nt, hsa; identical to SEQ ID NO: 102127

SEQ ID NO: 128519 - RNA, 64 nt, hsa; identical to SEQ ID NO: 102128

SEQ ID NO: 128520 - RNA, 64 nt, hsa; identical to SEQ ID NO: 102129

SEQ ID NO: 128521 - RNA, 64 nt, hsa; identical to SEQ ID NO: 102130

SEQ ID NO: 128522 - RNA, 64 nt, hsa; identical to SEQ ID NO: 102131

SEQ ID NO: 128523 - RNA, 64 nt, hsa; identical to SEQ ID NO: 102132

SEQ ID NO: 128524 - RNA, 64 nt, hsa; identical to SEQ ID NO: 102133

SEQ ID NO: 128525 - RNA, 64 nt, hsa; identical to SEQ ID NO: 102134

SEQ ID NO: 128526 - RNA, 64 nt, hsa; identical to SEQ ID NO: 102135

SEQ ID NO: 128527 - RNA, 64 nt, hsa; identical to SEQ ID NO: 102136

SEQ ID NO: 128528 - RNA, 64 nt, hsa; identical to SEQ ID NO: 102137

SEQ ID NO: 128529 - RNA, 64 nt, hsa; identical to SEQ ID NO: 102138

SEQ ID NO: 128530 - RNA, 64 nt, hsa; identical to SEQ ID NO: 102139

SEQ ID NO: 128531 - RNA, 64 nt, hsa; identical to SEQ ID NO: 102140

SEQ ID NO: 128532 - RNA, 64 nt, hsa; identical to SEQ ID NO: 102141

SEQ ID NO: 128533 - RNA, 64 nt, hsa; identical to SEQ ID NO: 102142

SEQ ID NO: 128534 - RNA, 64 nt, hsa; identical to SEQ ID NO: 102143

SEQ ID NO: 128535 - RNA, 64 nt, hsa; identical to SEQ ID NO: 102144

SEQ ID NO: 128536 - RNA, 64 nt, hsa; identical to SEQ ID NO: 102145

SEQ ID NO: 128537 - RNA, 64 nt, hsa; identical to SEQ ID NO: 102146

SEQ ID NO: 128538 - RNA, 64 nt, hsa; identical to SEQ ID NO: 102147

SEQ ID NO: 128539 - RNA, 64 nt, hsa; identical to SEQ ID NO: 102148

SEQ ID NO: 128540 - RNA, 64 nt, hsa; identical to SEQ ID NO: 102149

SEQ ID NO: 128541 - RNA, 64 nt, hsa; identical to SEQ ID NO: 102150

SEQ ID NO: 128542 - RNA, 64 nt, hsa; identical to SEQ ID NO: 102151

SEQ ID NO: 128543 - RNA, 64 nt, hsa; identical to SEQ ID NO: 102152

SEQ ID NO: 128544 - RNA, 64 nt, hsa; identical to SEQ ID NO: 102153

SEQ ID NO: 128545 - RNA, 64 nt, hsa; identical to SEQ ID NO: 102154

SEQ ID NO: 128546 - RNA, 64 nt, hsa; identical to SEQ ID NO: 102155

SEQ ID NO: 128547 - RNA, 64 nt, hsa; identical to SEQ ID NO: 102156

SEQ ID NO: 128548 - RNA, 64 nt, hsa; identical to SEQ ID NO: 102157

SEQ ID NO: 128549 - RNA, 64 nt, hsa; identical to SEQ ID NO: 102158

SEQ ID NO: 128550 - RNA, 64 nt, hsa; identical to SEQ ID NO: 102159

SEQ ID NO: 128551 - RNA, 64 nt, hsa; identical to SEQ ID NO: 102160

SEQ ID NO: 128552 - RNA, 64 nt, hsa; identical to SEQ ID NO: 102161

SEQ ID NO: 128553 - RNA, 64 nt, hsa; identical to SEQ ID NO: 102162

SEQ ID NO: 128554 - RNA, 64 nt, hsa; identical to SEQ ID NO: 102163

SEQ ID NO: 128555 - RNA, 64 nt, hsa; identical to SEQ ID NO: 102164

SEQ ID NO: 128556 - RNA, 64 nt, hsa; identical to SEQ ID NO: 102165

SEQ ID NO: 128557 - RNA, 64 nt, hsa; identical to SEQ ID NO: 102166

SEQ ID NO: 128558 - RNA, 64 nt, hsa; identical to SEQ ID NO: 102167

SEQ ID NO: 128559 - RNA, 64 nt, hsa; identical to SEQ ID NO: 102168

SEQ ID NO: 128560 - RNA, 64 nt, hsa; identical to SEQ ID NO: 102169

SEQ ID NO: 128561 - RNA, 64 nt, hsa; identical to SEQ ID NO: 102170

SEQ ID NO: 128562 - RNA, 64 nt, hsa; identical to SEQ ID NO: 102171

SEQ ID NO: 128563 - RNA, 64 nt, hsa; identical to SEQ ID NO: 102172

SEQ ID NO: 128564 - RNA, 64 nt, hsa; identical to SEQ ID NO: 102173

SEQ ID NO: 128565 - RNA, 64 nt, hsa; identical to SEQ ID NO: 102174

SEQ ID NO: 128566 - RNA, 64 nt, hsa; identical to SEQ ID NO: 102175

SEQ ID NO: 128567 - RNA, 64 nt, hsa; identical to SEQ ID NO: 102176

SEQ ID NO: 128568 - RNA, 64 nt, hsa; identical to SEQ ID NO: 102177

SEQ ID NO: 128569 - RNA, 64 nt, hsa; identical to SEQ ID NO: 102178

SEQ ID NO: 128570 - RNA, 64 nt, hsa; identical to SEQ ID NO: 102179

SEQ ID NO: 128571 - RNA, 64 nt, hsa; identical to SEQ ID NO: 102180

SEQ ID NO: 128572 - RNA, 64 nt, hsa; identical to SEQ ID NO: 102181

SEQ ID NO: 128573 - RNA, 64 nt, hsa; identical to SEQ ID NO: 102182

SEQ ID NO: 128574 - RNA, 64 nt, hsa; identical to SEQ ID NO: 102183

SEQ ID NO: 128575 - RNA, 64 nt, hsa; identical to SEQ ID NO: 102184

SEQ ID NO: 128576 - RNA, 64 nt, hsa; identical to SEQ ID NO: 102185

SEQ ID NO: 128577 - RNA, 64 nt, hsa; identical to SEQ ID NO: 102186

SEQ ID NO: 128578 - RNA, 64 nt, hsa; identical to SEQ ID NO: 102187

SEQ ID NO: 128579 - RNA, 64 nt, hsa; identical to SEQ ID NO: 102188

SEQ ID NO: 128580 - RNA, 64 nt, hsa; identical to SEQ ID NO: 102189

SEQ ID NO: 128581 - RNA, 64 nt, hsa; identical to SEQ ID NO: 102190

SEQ ID NO: 128582 - RNA, 64 nt, hsa; identical to SEQ ID NO: 102191

SEQ ID NO: 128583 - RNA, 64 nt, hsa; identical to SEQ ID NO: 102192

SEQ ID NO: 128584 - RNA, 64 nt, hsa; identical to SEQ ID NO: 102193

SEQ ID NO: 128585 - RNA, 64 nt, hsa; identical to SEQ ID NO: 102194

SEQ ID NO: 128586 - RNA, 64 nt, hsa; identical to SEQ ID NO: 102195

SEQ ID NO: 128587 - RNA, 64 nt, hsa; identical to SEQ ID NO: 102196

SEQ ID NO: 128588 - RNA, 64 nt, hsa; identical to SEQ ID NO: 102197

SEQ ID NO: 128589 - RNA, 64 nt, hsa; identical to SEQ ID NO: 102198

SEQ ID NO: 128590 - RNA, 64 nt, hsa; identical to SEQ ID NO: 102199

SEQ ID NO: 128591 - RNA, 64 nt, hsa; identical to SEQ ID NO: 102200

SEQ ID NO: 128592 - RNA, 64 nt, hsa; identical to SEQ ID NO: 102201

SEQ ID NO: 128593 - RNA, 64 nt, hsa; identical to SEQ ID NO: 102202

SEQ ID NO: 128594 - RNA, 64 nt, hsa; identical to SEQ ID NO: 102203

SEQ ID NO: 128595 - RNA, 64 nt, hsa; identical to SEQ ID NO: 102204

SEQ ID NO: 128596 - RNA, 64 nt, hsa; identical to SEQ ID NO: 102205

SEQ ID NO: 128597 - RNA, 64 nt, hsa; identical to SEQ ID NO: 102206

SEQ ID NO: 128598 - RNA, 64 nt, hsa; identical to SEQ ID NO: 102207

SEQ ID NO: 128599 - RNA, 64 nt, hsa; identical to SEQ ID NO: 102208

SEQ ID NO: 128600 - RNA, 64 nt, hsa; identical to SEQ ID NO: 102209

SEQ ID NO: 128601 - RNA, 64 nt, hsa
caacaauguucucuaguuucaagcuccagcuucucagaaagaauuaaagaacuugcuguucaaa

SEQ ID NO: 128602 - RNA, 64 nt, hsa
gacauugugaccaugacccagccacagucaauaccagaaagaugauucagagucugaaguggug

SEQ ID NO: 128603 - RNA, 64 nt, hsa
uuggaaaaaacugcaaaucagaaagaaugauuugcagaaagaaagaaaaacuaugguguaauuu

SEQ ID NO: 128604 - RNA, 64 nt, hsa
acuaauauggcucuguuuggaaaaaacugcaaaucagaaagaaugauuugcagaaagaaagaaa

SEQ ID NO: 128605 - RNA, 64 nt, hsa
auaaagaugacuuucaaggaacauauaauguagucagaaagaugagaggauuaguuauacaauu

SEQ ID NO: 128606 - RNA, 64 nt, hsa
ugguauuuugaucaguuuuauuuaaaugugugaucagaaagaauggcguacaaaucuuauuauu

SEQ ID NO: 128607 - RNA, 64 nt, hsa
ucauuuuguuucaacgguccaaacgcccaaccuucagaaagaggaagucagauagaaauagucc

SEQ ID NO: 128608 - RNA, 64 nt, hsa
agguguauuucuugguacccccaagauaucaggccagaaagagaugagucaguugcugugcucu

SEQ ID NO: 128609 - RNA, 64 nt, hsa
ucucggggguggucacaaccccacaucccacagccagaaagaacaauggucaucugagaauacu

SEQ ID NO: 128610 - RNA, 64 nt, hsa
aaaaaaaaauuuuauaaucucaaaugcuaguaagcagaaagaugcucuccgagguccaacuaua

SEQ ID NO: 128611 - RNA, 64 nt, hsa
cugaaccugcaguccacccucccuggaaccacaccagaaagagaccuggguugucguuuucuug

SEQ ID NO: 128612 - RNA, 64 nt, hsa
ucucucucuggucacugcccuuaccugacccucacagaaagagagcucugagcaggugaggggg

SEQ ID NO: 128613 - RNA, 64 nt, hsa
aaaugagggaacagguggugucuaucuuguauaucagaaagauuaucuagggucuauccuagug

SEQ ID NO: 128614 - RNA, 64 nt, hsa
uaaauacaguuccagauggguuauugcagauuaacagaaagacacucaacuggacucauguccc

SEQ ID NO: 128615 - RNA, 64 nt, hsa
aacuaagguaacuucucagaaagauaucaaaucucagaaagaaugucaaaucagaugaaguuau

SEQ ID NO: 128616 - RNA, 64 nt, hsa
acucacuguggaaauaaaaacuaagguaacuucucagaaagauaucaaaucucagaaagaaugu

SEQ ID NO: 128617 - RNA, 64 nt, hsa
guuguucacuuccagaaagagaaagacgacguaucagaaagagguuaugugauucuaccaaaug

SEQ ID NO: 128618 - RNA, 64 nt, hsa
gcagcuugaaaaauuaaaggagguuguucacuuccagaaagagaaagacgacguaucagaaaga

SEQ ID NO: 128619 - RNA, 64 nt, hsa
ggauucaucagcuagaacagcaaguugaaaaacucagaaagaagcucaagaccgcacagcagcg

SEQ ID NO: 128620 - RNA, 64 nt, hsa
agcuggagugaggaguagaggucuccggcuauuccagaaagaaaagugagccacaugcaggcug

SEQ ID NO: 128621 - RNA, 64 nt, hsa
ugcugccaagccacuugccaaagaagaggaaccacagaaagagagacaucaugaccaggagaaa

SEQ ID NO: 128622 - RNA, 64 nt, hsa
ugugaaaggucauaauagcuuucccaucaugaaucagaaagauguggacagcuugauguuuuag

SEQ ID NO: 128623 - RNA, 64 nt, hsa
ugaaaacuagagccuuuaaaugauuucaauuccacagaaagaaagugagcuugaacauaggaug

SEQ ID NO: 128624 - RNA, 64 nt, hsa
cacagagacacaccauuacauacacagacacacacagaaagacacacacagacacaaaaucaca

SEQ ID NO: 128625 - RNA, 64 nt, hsa
cggccacagaaacacaccauuacacacacauacacagaaagacacacacagacacacaaucaca

SEQ ID NO: 128626 - RNA, 64 nt, hsa
gccacagagacaccauuacauacacagacacacacagaaagacacagacacaaaaucacacaca

SEQ ID NO: 128627 - RNA, 64 nt, hsa
accacagagacaccauuacauacacagacacacacagaaagacacacacagacacaaaaucaca

SEQ ID NO: 128628 - RNA, 64 nt, hsa
ccguggauccugguccuaggcuggacacaggauucagaaagacaccaggcugcacagaaagagc

SEQ ID NO: 128629 - RNA, 64 nt, hsa
cuggacacaggauucagaaagacaccaggcugcacagaaagagccagauggaccugagugucgg

SEQ ID NO: 128630 - RNA, 64 nt, hsa
agaaugucaaggaagacuuuugguagagaaggagcagaaagauguguuuuugggaagaagaaga

SEQ ID NO: 128631 - RNA, 64 nt, hsa
uguugcuuucuuaccuacuauuggcccuaaauagcagaaagaagagaagugaccgagagaaccu

SEQ ID NO: 128632 - RNA, 64 nt, hsa
auaauugacucuaaggcuuuuauuaagaaaacagcagaaagauuaaaucuugaauuaagucugg

SEQ ID NO: 128633 - RNA, 64 nt, hsa
cauauuaaauacaugccuucuauauggaacauggcagaaagacugaaaaauaacaguaauuaau

SEQ ID NO: 128634 - RNA, 64 nt, hsa
ugggggggagguggggguagggggcacagaacaccagaaagaguguugguguguagguagauuc

SEQ ID NO: 128635 - RNA, 64 nt, hsa
auugcccggugcucugcagggcuggaauuucaaacagaaagagggaauaagauccugugauuuu

SEQ ID NO: 128636 - RNA, 64 nt, hsa
gaugguacaguaaaccaaaacccaacaauguggccagaaagaaagagcaauaauaauuaauuca

SEQ ID NO: 128637 - RNA, 64 nt, hsa
cacuggaaacauuuaaaugaucaggagggaguaacagaaagagcaaggcuguuuuugaaaauca

SEQ ID NO: 128638 - RNA, 64 nt, hsa
aaugugugguuaguguuuuuuuauuccccuaagacagaaagaacaaaaaauguuuuaaauuucu

SEQ ID NO: 128639 - RNA, 64 nt, hsa
augacauacacugaauugaaaaucuauuuuauuacagaaagaucaguuucuaacaaaugaaaau

SEQ ID NO: 128640 - RNA, 64 nt, hsa
ggagaagggggucaaagcaaggaucuuucacccacagaaagagagcacugaccccgauggcgau

SEQ ID NO: 128641 - RNA, 64 nt, hsa
auucaguugguaagcuuccaggaaaaaggacaggcagaaagaguuugagaccugaauagcuccc

SEQ ID NO: 128642 - RNA, 64 nt, hsa
aaagaaucauuagaaauuaugaguggaaauucuccagaaagauaguauuauagagucuuuugaa

SEQ ID NO: 128643 - RNA, 64 nt, hsa
acuaaaacaguauguucugguuuuggcccucuugcagaaagaagcauuagaaaaauuacuuuaa

SEQ ID NO: 128644 - RNA, 64 nt, hsa
aaaaauugaggaucucuguuuuuccuggggcaaacagaaagaaaucugcaugaguugcuuuugu

SEQ ID NO: 128645 - RNA, 64 nt, hsa
agaaagccagaggacuagagccaaaaacuuguuucagaaagauaggagauagcucuguagaaac

SEQ ID NO: 128646 - RNA, 64 nt, hsa
agaaagccagaggacuagauccaaagacuuguuucagaaagaugagagagaacucuguggauac

SEQ ID NO: 128647 - RNA, 64 nt, hsa
agaaagccagaggacuagaggccaagacuuguuucagaaagauggaagagaguucuuuggaaac

SEQ ID NO: 128648 - RNA, 64 nt, hsa
caugcagggaagggucugccccugcccuggcacacacaggcacccauucccucccccugcugac

SEQ ID NO: 128649 - RNA, 64 nt, hsa
gcuaagagucccucccugccacgcccuggcaggacacaggcacuuuuccaaugggcaagcccag

SEQ ID NO: 128650 - RNA, 64 nt, hsa
uauuaucaaguaguaguauuuuaugacuagagaucacaggcacaaguugaaacaaacuaacaug

SEQ ID NO: 128651 - RNA, 64 nt, hsa
guuucaucaccaacauaaggaaugaaguuggaaccacaggcagaucugaaaaagaaccaaauag

SEQ ID NO: 128652 - RNA, 64 nt, hsa
gcaaacagaaccacagggcccaggaggcauuccacacaggcacugccccaggacaacacaacaa

SEQ ID NO: 128653 - RNA, 64 nt, hsa
ucacuccuccucaagcucacaccaauugguuuggcacaggcacagagcuggucccuaguuaagu

SEQ ID NO: 128654 - RNA, 64 nt, hsa
guuauauugccuaggcuggaaugcagugguuauucacaggcaugauuauaacacacuacucucu

SEQ ID NO: 128655 - RNA, 64 nt, hsa
caggccuauuaaaucacaaucuuuggugacgggucacaggcauugguaguuuugaagcucucca

SEQ ID NO: 128656 - RNA, 64 nt, hsa
cgcacaugcacacauacacaugcaugcacacauacacaggcauacaugcaugcacacacacaug

SEQ ID NO: 128657 - RNA, 64 nt, hsa
cacacacacaugcacacauacacgugcacacauacacaggcacacaugcaugcacacauacaca

SEQ ID NO: 128658 - RNA, 64 nt, hsa
cauacacaugcacacacacaugcacacauauaugcacaggcacacacauguacgcacacacaca

SEQ ID NO: 128659 - RNA, 64 nt, hsa
uauauugagauucuuuguggcuauuggugugucucacaggcaaaauuugauuuggcuaaaauag

SEQ ID NO: 128660 - RNA, 64 nt, hsa
ccuuugccugaagcuguuuugggaagggucuccacacaggcacugaucucccaagcuuuuguca

SEQ ID NO: 128661 - RNA, 64 nt, hsa
gcuccucauugcucccaucugccucugcugcacacacaggcaccagcagggaugccacaggagu

SEQ ID NO: 128662 - RNA, 64 nt, hsa
agcccugccugugaagcucuuguuucugacauuucacaggcagagaggugccaucaguucgccu

SEQ ID NO: 128663 - RNA, 64 nt, hsa
ugagcccaccccaaguaugccugccaccuacgcccacaggcagggcacacugggcagccagccu

SEQ ID NO: 128664 - RNA, 64 nt, hsa
gcgaaccaccuccggguuuccaucaugucaaggucacaggcauccaugugugcaaaccaucugc

SEQ ID NO: 128665 - RNA, 64 nt, hsa
ggacucaguggcucacauuuccugccagcuacaccacaggcagaugggagucgggguggcacaa

SEQ ID NO: 128666 - RNA, 64 nt, hsa
ccggccccgagauccucugcuguaacugcagggucacaggcaucccgggagaaugggccuccac

SEQ ID NO: 128667 - RNA, 64 nt, hsa
gagccacuguaccuggcgaaaaacaguuuguuaacacaggcagccaacaucacucaggauaagc

SEQ ID NO: 128668 - RNA, 64 nt, hsa
ggcuccagaggucuguacaucacauacauaugcacacaggcacacauggcaaaacucggaagug

SEQ ID NO: 128669 - RNA, 64 nt, hsa
cguccucaguaaaagcagccaccccuucaagagucacaggcauccauccagucguaucuuucag

SEQ ID NO: 128670 - RNA, 64 nt, hsa
gccgccaugaaaagacugcucuugagccccaaggcacaggcacgugcucugggaaauagacagg

SEQ ID NO: 128671 - RNA, 64 nt, hsa
cugcuuggggcucccaggcugggugugccuuagccacaggcagggcugucaauaacccccuucc

SEQ ID NO: 128672 - RNA, 64 nt, hsa
ugggauaagcacucccagccccguuuaucagaaacacaggcaaggaaauuggaacugccaccca

SEQ ID NO: 128673 - RNA, 64 nt, hsa
cccagagcggcccccuugguacccgcagugaugacacaggcacuggcccccggagggagcgacc

SEQ ID NO: 128674 - RNA, 64 nt, hsa
gcccccggagggagcgacccagccggcggcugaccacaggcaccccggccucuccgagacggcc

SEQ ID NO: 128675 - RNA, 64 nt, hsa
agguuucauuuaaaagugcugggagcaggugagccacaggcaacucuucucucggaaccugcac

SEQ ID NO: 128676 - RNA, 64 nt, hsa
uucuguagucaagcaccugaacaggcccugagcucacaggcagccaauguaaagagggaaacac

SEQ ID NO: 128677 - RNA, 64 nt, hsa
gaugauguauuaaauaccaagauaaagaaaaaugcaccuaaaaucuaauuagaauucucugggu

SEQ ID NO: 128678 - RNA, 64 nt, hsa
ucauuuuaagugauagauaguggagaaaauuuaucaccuaaaauauacccaucaguauaaggca

SEQ ID NO: 128679 - RNA, 64 nt, hsa
cauuguacacagguguacaccaugcaugcaccaacaccuaaaacucaaaacuaaauggcuauuu

SEQ ID NO: 128680 - RNA, 64 nt, hsa
guuucuugggcaagucaaauucuggaaucacauccaccuaaauuaaaaugacuagcucguauuu

SEQ ID NO: 128681 - RNA, 64 nt, hsa
uuugaugaggauauuuagcuaucaaucuaauagucaccuaaaauaucuuuuuuguuggaaaaaa

SEQ ID NO: 128682 - RNA, 64 nt, hsa
gcauuguuccucaaacuuggcuacguauuggaaucaccuaaaaaguuaaaacaaaacauggaug

SEQ ID NO: 128683 - RNA, 64 nt, hsa
auuacaggcaugagccaccacgcuuggcuaagaacaccuaaauuuuuauguuucuuggcucaaa

SEQ ID NO: 128684 - RNA, 64 nt, hsa
aucaaaucuauucagguuucuucacuguugagaacaccuaaauguuuuuauuuuugagaagugg

SEQ ID NO: 128685 - RNA, 64 nt, hsa
augcuggaucccaugggaucgaugucugaggucccaccuaaagucccuaaccgggaggcaucgc

SEQ ID NO: 128686 - RNA, 64 nt, hsa
uacugagugccaguuguaaauguuuuucaaccagcaccuaaaaagacucuuuucaaaaaaucac

SEQ ID NO: 128687 - RNA, 64 nt, hsa
ucagaagcaauuuacuaauuuauucuucgacuacauacugcagcagaaccagcaauacacuuga

SEQ ID NO: 128688 - RNA, 64 nt, hsa
ggauucaaaguugucucugaaacuccucuuugucauacugcacauauaaaacgucuuuuguuuc

SEQ ID NO: 128689 - RNA, 64 nt, hsa
gauccuaugucauaauuuuuugagaaaauguuugauacugcaagaucauuguuuaguggucugu

SEQ ID NO: 128690 - RNA, 64 nt, hsa
aaaagaacuuuaugauuacgguccucuuucucacauacugcaaacuuaaaagauacauacacca

SEQ ID NO: 128691 - RNA, 64 nt, hsa
cguauucucaugaucccagauaaguguguguuuuauacugcaacaauaugcagcaaugguaagc

SEQ ID NO: 128692 - RNA, 64 nt, hsa
cacacacauauauauauauauauauaguacucuaauacugcaagaagguuuuuuaaacuuccca

SEQ ID NO: 128693 - RNA, 64 nt, hsa
uguauauuuuaagaauucuuuauacaauuuuaauauacugcaauacugcaguuuuugacaauuu

SEQ ID NO: 128694 - RNA, 64 nt, hsa
uuaagaauucuuuauacaauuuuaauauacugcaauacugcaguuuuugacaauuuggauucca

SEQ ID NO: 128695 - RNA, 64 nt, hsa
cagcugcuuugaaggcugaagauuguuuuguaugauacugcacagcaucaggcauuuuaaagca

SEQ ID NO: 128696 - RNA, 64 nt, hsa
auacuuuauggugguucuucuccuccgaaauaauauacugcagaaaucccagacagagcuccuu

SEQ ID NO: 128697 - RNA, 64 nt, hsa
caacagucacaccuugcaagucaucauagucuucauacugcagagaaaucuuacaaaugugaag

SEQ ID NO: 128698 - RNA, 64 nt, hsa
caaaaaacaacccuugcacgucaucauagaauucauacugcagagaaacuuuacaaauaggaag

SEQ ID NO: 128699 - RNA, 64 nt, hsa
ucugaaauugaguuuauucaaaguguaaaagcacauacugcauuuucugcugaaagaucauuau

SEQ ID NO: 128700 - RNA, 64 nt, hsa
aaaguguaaugaguacuguggaaaccaaauuugaauacugcaaauuuguaggaguuacuagguu

SEQ ID NO: 128701 - RNA, 64 nt, hsa; identical to SEQ ID NO: 45668

SEQ ID NO: 128702 - RNA, 64 nt, hsa; identical to SEQ ID NO: 45669

SEQ ID NO: 128703 - RNA, 64 nt, hsa; identical to SEQ ID NO: 45670

SEQ ID NO: 128704 - RNA, 64 nt, hsa; identical to SEQ ID NO: 45671

SEQ ID NO: 128705 - RNA, 64 nt, hsa; identical to SEQ ID NO: 45672

SEQ ID NO: 128706 - RNA, 64 nt, hsa; identical to SEQ ID NO: 45673

SEQ ID NO: 128707 - RNA, 64 nt, hsa; identical to SEQ ID NO: 45674

SEQ ID NO: 128708 - RNA, 64 nt, hsa; identical to SEQ ID NO: 45675

SEQ ID NO: 128709 - RNA, 64 nt, hsa; identical to SEQ ID NO: 45676

SEQ ID NO: 128710 - RNA, 64 nt, hsa; identical to SEQ ID NO: 45677

SEQ ID NO: 128711 - RNA, 64 nt, hsa; identical to SEQ ID NO: 45678

SEQ ID NO: 128712 - RNA, 64 nt, hsa; identical to SEQ ID NO: 45679

SEQ ID NO: 128713 - RNA, 64 nt, hsa; identical to SEQ ID NO: 45680

SEQ ID NO: 128714 - RNA, 64 nt, hsa; identical to SEQ ID NO: 45681

SEQ ID NO: 128715 - RNA, 64 nt, hsa; identical to SEQ ID NO: 45682

SEQ ID NO: 128716 - RNA, 64 nt, hsa; identical to SEQ ID NO: 45683

SEQ ID NO: 128717 - RNA, 64 nt, hsa; identical to SEQ ID NO: 45684

SEQ ID NO: 128718 - RNA, 64 nt, hsa; identical to SEQ ID NO: 45685

SEQ ID NO: 128719 - RNA, 64 nt, hsa; identical to SEQ ID NO: 45686

SEQ ID NO: 128720 - RNA, 64 nt, hsa; identical to SEQ ID NO: 45687

SEQ ID NO: 128721 - RNA, 64 nt, hsa; identical to SEQ ID NO: 45688

SEQ ID NO: 128722 - RNA, 64 nt, hsa; identical to SEQ ID NO: 45689

SEQ ID NO: 128723 - RNA, 64 nt, hsa; identical to SEQ ID NO: 45690

SEQ ID NO: 128724 - RNA, 64 nt, hsa; identical to SEQ ID NO: 45691

SEQ ID NO: 128725 - RNA, 64 nt, hsa; identical to SEQ ID NO: 45692

SEQ ID NO: 128726 - RNA, 64 nt, hsa; identical to SEQ ID NO: 45693

SEQ ID NO: 128727 - RNA, 64 nt, hsa; identical to SEQ ID NO: 45694

SEQ ID NO: 128728 - RNA, 64 nt, hsa; identical to SEQ ID NO: 45695

SEQ ID NO: 128729 - RNA, 64 nt, hsa; identical to SEQ ID NO: 45696

SEQ ID NO: 128730 - RNA, 64 nt, hsa; identical to SEQ ID NO: 45697

SEQ ID NO: 128731 - RNA, 64 nt, hsa; identical to SEQ ID NO: 45698

SEQ ID NO: 128732 - RNA, 64 nt, hsa; identical to SEQ ID NO: 45699

SEQ ID NO: 128733 - RNA, 64 nt, hsa; identical to SEQ ID NO: 45700

SEQ ID NO: 128734 - RNA, 64 nt, hsa; identical to SEQ ID NO: 45701

SEQ ID NO: 128735 - RNA, 64 nt, hsa; identical to SEQ ID NO: 45702

SEQ ID NO: 128736 - RNA, 64 nt, hsa; identical to SEQ ID NO: 45702

SEQ ID NO: 128737 - RNA, 64 nt, hsa; identical to SEQ ID NO: 45704

SEQ ID NO: 128738 - RNA, 64 nt, hsa; identical to SEQ ID NO: 45705

SEQ ID NO: 128739 - RNA, 64 nt, hsa; identical to SEQ ID NO: 45706

SEQ ID NO: 128740 - RNA, 64 nt, hsa; identical to SEQ ID NO: 45707

SEQ ID NO: 128741 - RNA, 64 nt, hsa; identical to SEQ ID NO: 45708

SEQ ID NO: 128742 - RNA, 64 nt, hsa; identical to SEQ ID NO: 45709

SEQ ID NO: 128743 - RNA, 64 nt, hsa; identical to SEQ ID NO: 45710

SEQ ID NO: 128744 - RNA, 64 nt, hsa; identical to SEQ ID NO: 45711

SEQ ID NO: 128745 - RNA, 64 nt, hsa; identical to SEQ ID NO: 45712

SEQ ID NO: 128746 - RNA, 64 nt, hsa; identical to SEQ ID NO: 45713

SEQ ID NO: 128747 - RNA, 64 nt, hsa; identical to SEQ ID NO: 45714

SEQ ID NO: 128748 - RNA, 64 nt, hsa; identical to SEQ ID NO: 45715

SEQ ID NO: 128749 - RNA, 64 nt, hsa; identical to SEQ ID NO: 45716

SEQ ID NO: 128750 - RNA, 64 nt, hsa; identical to SEQ ID NO: 45717

SEQ ID NO: 128751 - RNA, 64 nt, hsa
ccauucagagguguggcuuuuuccacgucuuuuucuccugcaaugaacugcucccacguccugc

SEQ ID NO: 128752 - RNA, 64 nt, hsa
guggguggguggguuugauugagaacacuuugggcuccugcagugauggugggaaagaaaaauu

SEQ ID NO: 128753 - RNA, 64 nt, hsa
ccggcugcagaggccagaggcccccagcccagggcuccugcacuuacuugcuuauuugacaacg

SEQ ID NO: 128754 - RNA, 64 nt, hsa
ggacuguagggagggcggcaggggccuggagauccuccugcagaccacgcccguccugccugug

SEQ ID NO: 128755 - RNA, 64 nt, hsa
aucacaggaagacuuuguaaggacaguuuaaguucuccugcaagguuuaauuuguuaucaugua

SEQ ID NO: 128756 - RNA, 64 nt, hsa
aaccaacagucugucaguguacagcagcaguacucuccugcacagucucaagcaaccauauauu

SEQ ID NO: 128757 - RNA, 64 nt, hsa
gagggagcuguauuccuuuauacaaaucugauggcuccugcagcacuuuuuccuucugaaaaua

SEQ ID NO: 128758 - RNA, 64 nt, hsa
ugaaaaaagcaagauugaaauuugaacuaugagucuccugcauggcaacaaaaugugugucacc

SEQ ID NO: 128759 - RNA, 64 nt, hsa
uguccucuguccgucuguccugcgccugcgccuccuccugcaugucggggccccugcguguguu

SEQ ID NO: 128760 - RNA, 64 nt, hsa
cgggcggggcgagggcggcggggccugggucccccuccugcacgcggacuccgggguucggauc

SEQ ID NO: 128761 - RNA, 64 nt, hsa
ggccaggaccgagcucuuccugcuguuugccggccuccugcagagguaccgccugcugcccccg

SEQ ID NO: 128762 - RNA, 64 nt, hsa
agcgugcgagcccugcaccccccagguccugggacuccugcagaccccacuccauucccgcucc

SEQ ID NO: 128763 - RNA, 64 nt, hsa
aaaaauucgcugggaggccaauaggcugaaauggcuccugcacuuuggguuccuaagucagcaa

SEQ ID NO: 128764 - RNA, 64 nt, hsa
caguauaacugauaugauaugaagggggacuuaucuccugcagagauuggagaagguagaggag

SEQ ID NO: 128765 - RNA, 64 nt, hsa
gggaucccagcaucucagaguccagucaaguucccuccugcagccugaccccaggcagcucgag

SEQ ID NO: 128766 - RNA, 64 nt, hsa
cacagcuuccugagucaccccucuguccagccagcuccugcacaaauggaacuccccagggccu

SEQ ID NO: 128767 - RNA, 64 nt, hsa
cccucccgucugugagcucccugcccagcaccaccuccugcacugcacuucugccguccacauc

SEQ ID NO: 128768 - RNA, 64 nt, hsa
uacagaacuccacauauacaacuuccgucauuaccuccugcagucugacaagcucaucacugaa

SEQ ID NO: 128769 - RNA, 64 nt, hsa
gaaucaaacucaaccaggaggcaugauuccuucucuccugcaauugcacaaaaacaaguggugg

SEQ ID NO: 128770 - RNA, 64 nt, hsa
ucucacacaugaucuucagagugcuggaaacacacuccugcagaagcuguaggacucuugaauu

SEQ ID NO: 128771 - RNA, 64 nt, hsa
ccagccgggcucucuaguggugauccggcucauucuccugcaaguuggaagcacaauuuucccc

SEQ ID NO: 128772 - RNA, 64 nt, hsa
ugggcaaggcgguggguggugggcaaggugggaccuccugcagccuggaaagaggagggaggcc

SEQ ID NO: 128773 - RNA, 64 nt, hsa
acauauguacauguacccaccacaaacgugcaagcuccugcacacaugcaugcacacaaacgug

SEQ ID NO: 128774 - RNA, 64 nt, hsa
acacgcacacguacauucacuacaaacgugcagccuccugcacacgugcacauucauguguaca

SEQ ID NO: 128775 - RNA, 64 nt, hsa
augcacauguacgcaccacaaacacaugcgcaggcuccugcaggcgugaauacacacaugcaca

SEQ ID NO: 128776 - RNA, 64 nt, hsa
uucuccucuccccuccuucccccaccacaggucucuccugcauaggcagccacuguccguucuu

SEQ ID NO: 128777 - RNA, 64 nt, hsa
ugccaaccacggagaugugccaagcaucucaucucuccugcacacuuuagucagaaggacuucu

SEQ ID NO: 128778 - RNA, 64 nt, hsa
gcugcccacguguggccuccgcuggcucugccugcuccugcaacagugcggucccugcccggag

SEQ ID NO: 128779 - RNA, 64 nt, hsa
cacacaugcugucacgcauacacacacgcacauacuccugcacauguucccaugcaugugugug

SEQ ID NO: 128780 - RNA, 64 nt, hsa
uuguuccucaauagcugggggcugggacugaggccuccugcagguaccugccccccuucacaca

SEQ ID NO: 128781 - RNA, 64 nt, hsa
acaguccccugggugucagaaggugggcuagggccuccugcaggguugugggguggaacagggu

SEQ ID NO: 128782 - RNA, 64 nt, hsa
cagcugggaucugccugaggacagagaacauggucuccugcagggcccugccucccaagccccg

SEQ ID NO: 128783 - RNA, 64 nt, hsa
cuccguccacacuggccggcacccccugcugggucuccugcauuccacggagccccugcugcca

SEQ ID NO: 128784 - RNA, 64 nt, hsa
guacuccaggcuugcuucggagucauagucaucccuccugcacugcuccuuuccaaacacugua

SEQ ID NO: 128785 - RNA, 64 nt, hsa
caaaccuaccaucuguucaacuuccaccuaccaccuccugcaccccuuugaucggggacuuacu

SEQ ID NO: 128786 - RNA, 64 nt, hsa
acacagggacuaggacaucgaccacccucugccccuccugcagucagaacccgaguagugcaag

SEQ ID NO: 128787 - RNA, 64 nt, hsa
cucuugccuugggacacucuugaggcuggcagcccuccugcaaugaguugcucucaguuccuuc

SEQ ID NO: 128788 - RNA, 64 nt, hsa
aacagguaacugacuguucccaccugcuccuuuucuccugcagcauggagcaaucagucaugug

SEQ ID NO: 128789 - RNA, 64 nt, hsa
guucaugucccugcggcuggccucucgccagccacuccugcagugugcguccggccgccugagc

SEQ ID NO: 128790 - RNA, 64 nt, hsa
ccagcaggcccagggaucccugaccugcaccagguggcaccaaggguccugaguccuggagaug

SEQ ID NO: 128791 - RNA, 64 nt, hsa
gcaggguccuccauggguuuccaacccccaucacuggcaccaggaucucccacaggcacuggug

SEQ ID NO: 128792 - RNA, 64 nt, hsa
ccuaggucagggguccuggaauaccccguagcucuggcaccaccacacuggccucugauggcaa

SEQ ID NO: 128793 - RNA, 64 nt, hsa
gagcugcugggccaggucugcggcagugcugggguggcaccaggugggcagugguagguggggu

SEQ ID NO: 128794 - RNA, 64 nt, hsa
agaaguaaaacuuggccuccuccagccccucucauggcaccaauggaaguguccuccuguucuc

SEQ ID NO: 128795 - RNA, 64 nt, hsa
cgcgguaagaggagggggagccaggcucaaguauuggcaccaaguuaggucucagaggaaagaa

SEQ ID NO: 128796 - RNA, 64 nt, hsa
ggacaagcaggacugagggaacugcuggcucgccuggcaccaccacacggccacagccagccau

SEQ ID NO: 128797 - RNA, 64 nt, hsa
acacggccacagccagccaucugcucugccaggguggcaccagcucagcuggcgcauguccugu

SEQ ID NO: 128798 - RNA, 64 nt, hsa
caugcugcugccccuggucccagguggggugagcuggcaccagcuccuguggaauguuugguug

SEQ ID NO: 128799 - RNA, 64 nt, hsa
uuuuauacugauauuaguuuggaugugccacuuuuggcaccaaacguguaugucauuuuuauuu

SEQ ID NO: 128800 - RNA, 64 nt, hsa
ccacaggcucugaccagcagccuaugaggggguuuggcaccaagcucuguccaaucagguaggc

SEQ ID NO: 128801 - RNA, 64 nt, hsa
ccgucguauacccuggaugaacgaauuaauuaccuggcaccaccucgucugggcucccugcgcc

SEQ ID NO: 128802 - RNA, 64 nt, hsa
gacguccagaagaagucccuuggcccugcuaggguggcaccagacuucucuggucccacaggac

SEQ ID NO: 128803 - RNA, 64 nt, hsa
cacugccucaugcugacagagcagcaugcucucuuggcaccagccugcaccucagccaguaggg

SEQ ID NO: 128804 - RNA, 64 nt, hsa
acggggaguagcuuuguggaaacugauuugauggacacugcaccagcuuccuucagguucuaga

SEQ ID NO: 128805 - RNA, 64 nt, hsa
ccuuggugacagcagcgcagugccaaugcugaucacacugcaugggagauuuuguuaacgucug

SEQ ID NO: 128806 - RNA, 64 nt, hsa
uggggacauuuauguaaauacgucucuaauugccacacugcagcugaacaguguguaguauuuu

SEQ ID NO: 128807 - RNA, 64 nt, hsa
cugccggguagacucuccacucccccugccgcccacacugcagcagccacauccauacacacac

SEQ ID NO: 128808 - RNA, 64 nt, hsa
augaaguuaucuuuuuuguuuaaaaaaaaaaaaaacacugcauuaaaaaaguaucuguugcauu

SEQ ID NO: 128809 - RNA, 64 nt, hsa
uuuauuggaaacuuuaacugcaguguuaauauauacacugcaaaagaccaaggaugcaguugaa

SEQ ID NO: 128810 - RNA, 64 nt, hsa
ucuguaaaagugcaggaacaguuauucuaugagaacacugcaucugcauucauagccacgaguu

SEQ ID NO: 128811 - RNA, 64 nt, hsa
acucuaccaaucacgggcauuuuaucuucucugaacacugcaguuuguuagacuagagcugagg

SEQ ID NO: 128812 - RNA, 64 nt, hsa
guuuucuuacccacauuccccaaucaauacacacacacugcagaacccagaacagaaggccaca

SEQ ID NO: 128813 - RNA, 64 nt, hsa
agagcccugggccaaggaacacccccuaguccugacacugcagccucaagcagguacgcuguac

SEQ ID NO: 128814 - RNA, 64 nt, hsa
gauccccuaguuggcaagacuauuuuaacuugauacacugcagauucagaugugcugaaagcuc

SEQ ID NO: 128815 - RNA, 64 nt, hsa
cuuuggugcaggucuugggagcgugaucuagauuacacugcaccauucccaaguuaauccccug

SEQ ID NO: 128816 - RNA, 64 nt, hsa
aaugauaugagaaaaauuuuguuaggccacaaaaacacugcacugugaacauuuuagaaaaggu

SEQ ID NO: 128817 - RNA, 64 nt, hsa
acaggacuacacacuuguauauacauucuugagaacacugcaaugugaaaaucacguuugcuau

SEQ ID NO: 128818 - RNA, 64 nt, hsa
guucugauuugcucucagcugcagagacacagagacacugcagaugucacacgcuuucaucuuc

SEQ ID NO: 128819 - RNA, 64 nt, hsa
gcaaaaugccugcuuggaggucugcaauuuuggaacacugcaguauggaacuuuggcauuggag

SEQ ID NO: 128820 - RNA, 64 nt, hsa
ggagagcccugauuggacaaucacaucacagaucacacugcaguuuccauguuagcacugugga

SEQ ID NO: 128821 - RNA, 64 nt, hsa
guccgaguugccucccacuggaggucaggagucuacacugcagccucgggcacuguggggagug

SEQ ID NO: 128822 - RNA, 64 nt, hsa
aacaaauauuaaagcaaggaaaaguguaacugaaacacugcacuuuacuguuuuauacuuuugu

SEQ ID NO: 128823 - RNA, 64 nt, hsa
uggagucaguggauacaaguagugcagaagguucacacugcaaauaguguucucaucucaaagc

SEQ ID NO: 128824 - RNA, 64 nt, hsa
uguugcaguucugcccgaagacaugaaaggaugcacacugcaaagaaacaguaugaauguaaaa

SEQ ID NO: 128825 - RNA, 64 nt, hsa
uaccacuguacugcucaaaaacaugagaggaaucacacugcacagaaacacuaugaauguaaac

SEQ ID NO: 128826 - RNA, 64 nt, hsa
uagugcuuaaaauuaaguuuuaaaaugaaaucagacacugcagguuuguauauaaaaugaaaag

SEQ ID NO: 128827 - RNA, 64 nt, hsa
ugugacuggaaaaggugacaaguuggugacuuugacacugcagguauuccauuuucaugguuua

SEQ ID NO: 128828 - RNA, 63 nt, hsa
auauauaaaaaauaaaaagcuauuucuaguuuauuucacuauaaaguuuugcuuuauuaaaaa

SEQ ID NO: 128829 - RNA, 63 nt, hsa
ucacaguguauuaguauuuguuacauuuuuguauuucacuaucuuuauacuauauaauauggu

SEQ ID NO: 128830 - RNA, 63 nt, hsa
uagagcaacauugucuuauuaaagcauaguuuauuucacuagaaaaaauuuaauaucaaggac

SEQ ID NO: 128831 - RNA, 63 nt, hsa
gaggccauauauauugccuccuuauccuugagauuucacuaccuuuauguuaaaaguugugua

SEQ ID NO: 128832 - RNA, 63 nt, hsa
accaguaggaaccaggcugggucaggcucuuaauuucacuauggugggggacaaaaugaacac

SEQ ID NO: 128833 - RNA, 57 nt, hsa; identical to SEQ ID NO: 123938

SEQ ID NO: 128834 - RNA, 63 nt, hsa
ggguaugcaguuuacccaaguccaaauaaagcauuucacuagguuacacguuauguauaugug

SEQ ID NO: 128835 - RNA, 63 nt, hsa
uuaaggucugagugcaugugugcauuaaaaacauuucacuaccuauucucucauggacuucuc

SEQ ID NO: 128836 - RNA, 63 nt, hsa
cucaagcuccuauuacuauuugugguuguauuauuucacuaaucauuaguuaagacugugcua

SEQ ID NO: 128837 - RNA, 63 nt, hsa
aaaaguguaacacuaaggugaacuugcuucccuuuucacuaauuuugcuaaacuuuguaaugc

SEQ ID NO: 128838 - RNA, 63 nt, hsa
uuuugauauuauacugaugaauauuuguagguguuucacuauaaggaacagcuaaggaauaau

SEQ ID NO: 128839 - RNA, 63 nt, hsa
acaaauaaagugagaguaauguaauggagcucuuuucacuaggguauaaguagcugccaauuu

SEQ ID NO: 128840 - RNA, 63 nt, hsa
augagauggcugaaaaaauaccacaucgucuguuuucacuaggugaugccaaaauauuuugcu

SEQ ID NO: 128841 - RNA, 63 nt, hsa
gcuaauuuuuuguauuuuuaguagagacggggguuucacuauguuggcuaggcuggucuugaa

SEQ ID NO: 128842 - RNA, 63 nt, hsa
caaauacacacccccacaaaacuaaaaucaaaguuucacuacauaacacugggccuuacugca

SEQ ID NO: 128843 - RNA, 63 nt, hsa
gaagaaaugcuagccuggaagcucggcauuugguuucacuaagggccaugugguucccugcag

SEQ ID NO: 128844 - RNA, 63 nt, hsa
caugauauuugacuuuucauaaguaguggaagguuucacuaaguaaaacucucaguuucuugg

SEQ ID NO: 128845 - RNA, 63 nt, hsa
aaugguauuugacuuuucauaaguaguggaagguuucacuaaguaaagaucugaguuucuugg

SEQ ID NO: 128846 - RNA, 63 nt, hsa
uaguauuaggucgguacuaagaaauaagcauguuuucacuaauuuaaguacuugagacucuug

SEQ ID NO: 128847 - RNA, 63 nt, hsa
cucauuauugagauucauccauauuguugaauguuucacuaguuaauguuuauuguucaauau

SEQ ID NO: 128848 - RNA, 63 nt, hsa
uacaauuuuuucaggauuauuaaaaucuucuucuuucacuaucguagcuuaaacucuguuugg

SEQ ID NO: 128849 - RNA, 63 nt, hsa
aaagagcaaggcuguuuuugaaaaucauuacacuuucacuagaagcccaaaccucagcauucu

SEQ ID NO: 128850 - RNA, 63 nt, hsa
uaugacauuagcuuuaaagguguaaaaaagauguuucacuaauguaacggugaaagagaaucc

SEQ ID NO: 128851 - RNA, 63 nt, hsa
gugauauagugagaaagauucuaccaaccacuguuucacuacuuuuuaguuaaaauuggguau

SEQ ID NO: 128852 - RNA, 63 nt, hsa
ucuccuccccgcugccccuaacugcagcucagcuuucacuauagcagugcuucccaaacgggu

SEQ ID NO: 128853 - RNA, 63 nt, hsa
cuuggguguuugauuugaagaguuacgcauuuauuucacuauuuauugggaaaaaaaugcauu

SEQ ID NO: 128854 - RNA, 64 nt, hsa
uggacacauugguucggcaaucugauucuccugaauuucccagccaggcucuuguggggaggcc

SEQ ID NO: 128855 - RNA, 64 nt, hsa
ugaccauggaaggaaauaaggaaauucaacccaaauuucccaagacggcugaaagacagguuuu

SEQ ID NO: 128856 - RNA, 64 nt, hsa
aauagaacaaaauacaggacaucaaauauuagccauuucccauuuuauuuuauuuuucuaugua

SEQ ID NO: 128857 - RNA, 64 nt, hsa
ccucuaucuuaucacuuagcuaaagacagccuaaauuucccaauuuucuguccaaaauauuugu

SEQ ID NO: 128858 - RNA, 64 nt, hsa
cagaagacuuaagucuuccuuuauacucagugaaauuucccagaauguaauacugucacuguuc

SEQ ID NO: 128859 - RNA, 64 nt, hsa
ccuuuuaaauugcccacccuuuaauuuugaagcaauuucccaaguguguguuuguuuuauauuu

SEQ ID NO: 128860 - RNA, 64 nt, hsa
guaguucauguuugagaauuuuuuuauugcuuucauuucccaguuaaaugauauuuaacaccug

SEQ ID NO: 128861 - RNA, 64 nt, hsa
auccugauuugguuucucccuguuguaauuugagauuucccaaauuaagucuuauaaugauuag

SEQ ID NO: 128862 - RNA, 64 nt, hsa
aaguuggguaacaaaaauggcaaaagaaaugcagauuucccaguuaucuugcucugaagacauu

SEQ ID NO: 128863 - RNA, 64 nt, hsa
uuacucacauuguccuacuccagccccuucaauuauuucccaucuccacaaauagucgggggaa

SEQ ID NO: 128864 - RNA, 64 nt, hsa
ggagcucuucuagcuaaaugaccauccaguagagauuucccacauucccaugaauaucaagaau

SEQ ID NO: 128865 - RNA, 64 nt, hsa
auaggaagugugugggcugccuuccugggcaaguauuucccagugggaaguuggagggggcuuu

SEQ ID NO: 128866 - RNA, 64 nt, hsa
caggagaggagaggggcugugccccaggcuccccauuucccagcuccucacagaggccugguuu

SEQ ID NO: 128867 - RNA, 64 nt, hsa
auugugacucugauucauuauagcagaacuuuaaauuucccagcuuuuugaagauuuaagcuac

SEQ ID NO: 128868 - RNA, 64 nt, hsa
agacuuaauuugucaugacugaacgaauuuguuuauuucccauuagguuuaguggagcuacaca

SEQ ID NO: 128869 - RNA, 64 nt, hsa
gccuuuugcuaaaguuuugcacuuuuuuuuuuucauuucccauuuuuaaguaguuacuaaguua

SEQ ID NO: 128870 - RNA, 64 nt, hsa
uauaaaaaggcucacugacaagagacagcuguuaauuucccacagcaaucauugcagacuaacu

SEQ ID NO: 128871 - RNA, 64 nt, hsa
uaaccuauuucaagucugaguuuugaaaauuuacauuucccaaguauugcauuauugagguauu

SEQ ID NO: 128872 - RNA, 64 nt, hsa
uuuucucuguuucacugugugaaaaaaagaagauauuucccauaaaugggaaguuugcccauug

SEQ ID NO: 128873 - RNA, 64 nt, hsa
uagcccuuaacaaaucuucagcuugucucucaguauuucccaaucaugaaaaucccuugcuaug

SEQ ID NO: 128874 - RNA, 64 nt, hsa
ccauaaaugcuuucugaggauccgguacaaaaugauuucccaaaguucugaagugccuugagaa

SEQ ID NO: 128875 - RNA, 64 nt, hsa
acagaccacugacaaauacacagauagacaaggaauuucccaugguaaaaagggauaucaguaa

SEQ ID NO: 128876 - RNA, 64 nt, hsa
guuaauucacuauuaaaaacagcaaggcccugcuauuucccaagaauaaagaaauuuaaaauuc

SEQ ID NO: 128877 - RNA, 64 nt, hsa
cugcaugaauuguuuauuugcagugaugcuucauauuucccagcacuguucaugguaucuuauu

SEQ ID NO: 128878 - RNA, 64 nt, hsa
gcuucauauuucccagcacuguucaugguaucuuauuucccagguccuucauuguagccauggg

SEQ ID NO: 128879 - RNA, 64 nt, hsa
cauguccggcuuguguugugacauuuaacacaagauuucccaaagaagaaaggccuuauauaug

SEQ ID NO: 128880 - RNA, 64 nt, hsa
cucugaugugacucauguauccaaacauccauggauuucccauaaauuugagguaugugggaag

SEQ ID NO: 128881 - RNA, 64 nt, hsa
uacagagcauugcuuugucaacucagcugggaacauuucccagugcaacucacauuuuucacug

SEQ ID NO: 128882 - RNA, 64 nt, hsa
ucuauaaaaucugguacacuaugacgagggucagauuucccauucagacgccccucucccaugc

SEQ ID NO: 128883 - RNA, 64 nt, hsa
aucugagacgcaggaggcaucugcuggagcagcaauuucccaauuuauugaaagugaucgcuuu

SEQ ID NO: 128884 - RNA, 64 nt, hsa
cacggccacagagaggcaggacggcagagccaugauuucccaccgagcgauuacgagaaccucu

SEQ ID NO: 128885 - RNA, 64 nt, hsa
auguaucuccaguagcaauguugccauauuauuuauuucccaaacuuaguggacaauggaguca

SEQ ID NO: 128886 - RNA, 64 nt, hsa
uuuuucaugucuucagagucacagacuugaguucauuucccagcucugccacucaugauuauau

SEQ ID NO: 128887 - RNA, 64 nt, hsa
uuccaggcucagcagggagcugcuggagguaguagagccugaagucuugcaggacucacuggau

SEQ ID NO: 128888 - RNA, 64 nt, hsa
uuccaggcucagcagggagcugcuggcugagaaagagccugaagucuugcaggacucacuggau

SEQ ID NO: 128889 - RNA, 54 nt, hsa
agcagggagcugcuggaugagaaagagccugaagucuugcaggacucacuggau

SEQ ID NO: 128890 - RNA, 64 nt, hsa
gggacacuaaugaagauacgguugcuucaccuuggagccugaacaugacauuucuaaguggggu

SEQ ID NO: 128891 - RNA, 64 nt, hsa
ugucagagaucugggaggucuccacugaggaugugagccugauuauccuauaggcagacguggg

SEQ ID NO: 128892 - RNA, 64 nt, hsa
aaguguguugggaauugcaugccaucuccacccugagccugaccuuucugagugacaugggugu

SEQ ID NO: 128893 - RNA, 64 nt, hsa
cggcugugggggaggucccugccaguguuuagaagagccugacuguguucagugccuuggagca

SEQ ID NO: 128894 - RNA, 64 nt, hsa
cucuaagggcauuugaaagacugccagguagugcgagccugagauggucuggaggauucucucu

SEQ ID NO: 128895 - RNA, 64 nt, hsa
cauugcaccuggccaagaagagacaucuugacuugagccugaagacuauguacagagacugacc

SEQ ID NO: 128896 - RNA, 64 nt, hsa
gaaauuuccagaugucucaugcugcauagggcaggagccugaaaagcuaauuugagaagauaau

SEQ ID NO: 128897 - RNA, 64 nt, hsa
gauuccuagucagagauugggagaaauacaagaugagccugaaucaucucauguaccugacagu

SEQ ID NO: 128898 - RNA, 64 nt, hsa
ggugccucuggaugcccgggauggcaaugagguggagccugaugaugaccacuucuccauugug

SEQ ID NO: 128899 - RNA, 64 nt, hsa
ccuuucacgucagcuaccuggauauugaggagcugagccugaguggacucugccagugccuggu

SEQ ID NO: 128900 - RNA, 64 nt, hsa
cagcagcauuucaccccugaagucucuaaacucugagccugaaaagauuuguauuuaauacaca

SEQ ID NO: 128901 - RNA, 64 nt, hsa
gaaagagcuggauuggcuggggauaugguauaacgagccugagccuucuguacgugucugacac

SEQ ID NO: 128902 - RNA, 64 nt, hsa
cugccucaccuaccccagggaacuuccaaggaaggagccugagccacuggggacuaagugggca

SEQ ID NO: 128903 - RNA, 64 nt, hsa
cggugggagaggcccgggucagagcccugggggugagccugaaggccacagagaaagaaccuug

SEQ ID NO: 128904 - RNA, 64 nt, hsa
ugccucccugucuccaaagaucucccacaguguggagccugaacaagaagaggcuggggagggu

SEQ ID NO: 128905 - RNA, 64 nt, hsa
uccuggaggaccuggagagcugggagaccaugaugagccugacuccccaugccccaccuuugcu

SEQ ID NO: 128906 - RNA, 64 nt, hsa
gcucucucucccaccuccuccccagaugggaggagagccugaggcccaagcaggacccgggggu

SEQ ID NO: 128907 - RNA, 64 nt, hsa
caagcugcugaaguggccucuccauauuccagcugagccugaaucugacucuugaggguugggg

SEQ ID NO: 128908 - RNA, 64 nt, hsa
accugagccucagauuccaauagcucacucccuagagccugacgccggggccccugaccccuga

SEQ ID NO: 128909 - RNA, 64 nt, hsa
cccugagccucagauuccaauaccucacuccccagagccugaugccggggccccugaccccuga

SEQ ID NO: 128910 - RNA, 64 nt, hsa
cugucuugcucucucugccuucccugugucuuucuucucuuaccagagcaucuguuugcagagg

SEQ ID NO: 128911 - RNA, 64 nt, hsa
uggacucugaagucucuauuuuccaaguuguccuuucucuuaaaauacccuuuacugauuuaau

SEQ ID NO: 128912 - RNA, 64 nt, hsa
cauucgugugcuuccauggacaaaccugauuuuuuucucuuaguucuaaagaaucuuggguuau

SEQ ID NO: 128913 - RNA, 64 nt, hsa
agaguuuaguuuucaguugcugaaguagcucauuuucucuuacuaauguuugguuccucaggga

SEQ ID NO: 128914 - RNA, 64 nt, hsa
acacaguggcuacaauauucacaaaauucuuauguucucuuaugaaaaauauacacuuuucauu

SEQ ID NO: 128915 - RNA, 64 nt, hsa
auugugagcuuugguucuuugaacaggugaucuauucucuuacauuuugugcuuuuuaucuugg

SEQ ID NO: 128916 - RNA, 64 nt, hsa
gugaaaagaucaagaaacgugugaaaacucccuauucucuuaagcgguggcgccccuccaccug

SEQ ID NO: 128917 - RNA, 64 nt, hsa
gcacauacugaaugcugaaguauacauaugcuauuucucuuaaaccucagagcaaccauaugag

SEQ ID NO: 128918 - RNA, 64 nt, hsa
cuuauugauuggagagggacugacaugcuccucauucucuuaacuuugccaaacccauucuugu

SEQ ID NO: 128919 - RNA, 64 nt, hsa
acagucuacauagggaaggacucuuuccuuagccuucucuuauugauuggagagggacugacau

SEQ ID NO: 128920 - RNA, 64 nt, hsa
ccgcgcugcgccaccugcacucaccccccucacauucucuuaagcacccgguggcccuccgagg

SEQ ID NO: 128921 - RNA, 64 nt, hsa
ggauuacaggcgugagccaccgcgcccggccugauucucuuaaaauugaagaggugcugccaag

SEQ ID NO: 128922 - RNA, 64 nt, hsa
augcgcuccuggcuuuuaaaccuguuccugacuguucucuuacugccgaaacccuugacuguua

SEQ ID NO: 128923 - RNA, 64 nt, hsa
cuacuggggaaacuuccuauaccggagcuccaguuucucuuaagcugcccaauuucacagagua

SEQ ID NO: 128924 - RNA, 64 nt, hsa
cagcucugcuccguaugccaagaggagacuuuaauucucuuacugcuucuuuucacuucagagc

SEQ ID NO: 128925 - RNA, 64 nt, hsa
aauuuaggaccaauaccuccuccagaucagauucuucucuuaauuucauagauuguguuuuuuu

SEQ ID NO: 128926 - RNA, 64 nt, hsa
uccuguuucucuuaaaauaaaauccauuuccuauuucucuuaaaauaaaauccauuauucuuaa

SEQ ID NO: 128927 - RNA, 64 nt, hsa
caaaaugugauuaugcuuaacagcuguuuccuguuucucuuaaaauaaaauccauuuccuauuu

SEQ ID NO: 128928 - RNA, 64 nt, hsa
cacaaacuggguggcuuuaaacaacagaaauuuauucucuuaacaguuccagagacuaaauguc

SEQ ID NO: 128929 - RNA, 64 nt, hsa
auauagaauauugaaauuggaagaacauuuuauuuucucuuauuucuguugugauuuuuaaaaa

SEQ ID NO: 128930 - RNA, 64 nt, hsa
aaaaaauaguaaaguaggcagagcuagguuuauuuucucuuaaacaauuuuuaaaauucagaau

SEQ ID NO: 128931 - RNA, 64 nt, hsa
cuagucauggaaguaacuuuuauuuuaauugacauucucuuauuaaaugcccuauccaucauua

SEQ ID NO: 128932 - RNA, 64 nt, hsa
uuuuaagagaauuuuuuaaaaauacauuuuaugguucucuuaaggaauuaauauucacuucuga

SEQ ID NO: 128933 - RNA, 64 nt, hsa
gggguuagggagaaaucugucuccauauugcugguucucuuaccaaaaugcuuuuauaaagaaa

SEQ ID NO: 128934 - RNA, 64 nt, hsa
caauacaguauucacucuagaaacaauuaucuuuuucucuuaaugauuuugugugcaucuuuaa

SEQ ID NO: 128935 - RNA, 64 nt, hsa
uuuuuagacguuuuuuuccuccaaggugguuuucuucucuuaaauaacucgaucuguacccagc

SEQ ID NO: 128936 - RNA, 64 nt, hsa
aaaauugcacuucucuuaaaacuguaacuggccuuucucuuaccuugccuuaggcguucuaauc

SEQ ID NO: 128937 - RNA, 64 nt, hsa
ggggguacccccagcagccucucgaaaauugcacuucucuuaaaacuguaacuggccuuucucu

SEQ ID NO: 128938 - RNA, 64 nt, hsa
gagagagaggucauauguccaauaguugccuuucuucucuuaggcagcucugcacuucauguuc

SEQ ID NO: 128939 - RNA, 64 nt, hsa
auccuaccaaauauuuauccuucucuguccucuauucucuuacucuccucucucccuuuuuccu

SEQ ID NO: 128940 - RNA, 64 nt, hsa
uuuaaaaggcccuugacauuuugcguuuuaauauuucucuuaacccuauucucagggaagaugg

SEQ ID NO: 128941 - RNA, 64 nt, hsa
guccuuuuuuuuuguuuuuuuuuuuuuuaauuauuucucuuagcagaucagcaaucccucuagg

SEQ ID NO: 128942 - RNA, 64 nt, hsa
ugccugauuuaagugucugagaaacaaaucuuuguucucuuaggcugcaauggaacaacuuuac

SEQ ID NO: 128943 - RNA, 64 nt, hsa
cccuaagacagaaagaacaaaaaauguuuuaaauuucucuuauauaggaaauaauaggaacguc

SEQ ID NO: 128944 - RNA, 64 nt, hsa
cuuagguuuaagcuguauaugaaauauuuaugcgacucucaaacuuuaaaggaguugcuccuuu

SEQ ID NO: 128945 - RNA, 64 nt, hsa
acagcaacauugaaaugcuaaaaaguuuuuaaacacucucaauuucuaauucaccaugucacag

SEQ ID NO: 128946 - RNA, 64 nt, hsa
acucugcccucuuagcaucuuauucuacaugacaacucucaagguacucacagaucuguuuaac

SEQ ID NO: 128947 - RNA, 64 nt, hsa
uucagauaagcaguuuaaacuucauuuagcuuggacucucaagagaacugaaacauaaucaaug

SEQ ID NO: 128948 - RNA, 64 nt, hsa
caggcacagggacugaaccccaggccuccugggacuggagcagcagugaggcaaaacccgaccu

SEQ ID NO: 128949 - RNA, 64 nt, hsa
gaccuccguugaacauucuguauggaaaagagcccuggagcaucagguuccccagauaggcccc

SEQ ID NO: 128950 - RNA, 64 nt, hsa
agaaauuugagaggaaaaguggaagaaguguuuucuggagcagaagauuccacuucuuuggucc

SEQ ID NO: 128951 - RNA, 64 nt, hsa
uuuauugguacaacuguagggaagaaucuacaaccuggagcauuucagguuugcucuuuaaaua

SEQ ID NO: 128952 - RNA, 64 nt, hsa
uccgguacagcccgggcuccgcgugccccgcccgcuggagcaccugccaccgaggcgcgcgugg

SEQ ID NO: 128953 - RNA, 64 nt, hsa
cagggcuuuguggcguggguguuuuccagucugccuggagcagcgagaagcagcugugcagacu

SEQ ID NO: 128954 - RNA, 64 nt, hsa
ugcaggccacguacccaugacguaaacggcggcacuggagcaagcuggggcgggggguggguaa

SEQ ID NO: 128955 - RNA, 64 nt, hsa
guuaggugggcaugaaauuuguuucccccagucccuggagcaaaccuuacaauuugccuuuaga

SEQ ID NO: 128956 - RNA, 64 nt, hsa
uuugcaguuggaugaauagagaagggaaaaguugcuggagcacggagugaagaugggaggagcu

SEQ ID NO: 128957 - RNA, 64 nt, hsa
aggcccacugcugcuccugggugagaagggagcucuggagcaggaccagcugggggccggcacu

SEQ ID NO: 128958 - RNA, 64 nt, hsa
ucugggauggggaauuuguccuuacagucccacucuggagcacugucugaagaugaggaaucau

SEQ ID NO: 128959 - RNA, 64 nt, hsa
uuuacagccccaugcuacaggccaucaagaugaccuggagcagagagcaugggccuuggguaaa

SEQ ID NO: 128960 - RNA, 64 nt, hsa
cagcccuggagcaggcaggccgagggcugcggcacuggagcaggcugacuuacaugcuccacau

SEQ ID NO: 128961 - RNA, 64 nt, hsa
cagggagucugcaggagcgcagacaggcacagcccuggagcaggcaggccgagggcugcggcac

SEQ ID NO: 128962 - RNA, 64 nt, hsa
auaauuuaguuugcuguauuaacugcuccugggccuggagcaguauucccaccuuaagauuccc

SEQ ID NO: 128963 - RNA, 64 nt, hsa
aggaaagucaccugcaagagaucccggcacugaucuggagcagcugacagggugggucucccuu

SEQ ID NO: 128964 - RNA, 64 nt, hsa
cuggggagcaggcagccagcaucugggccuuggccuggagcacaaagacccuggcuuucauuuu

SEQ ID NO: 128965 - RNA, 64 nt, hsa
uggucuaaguccaguccaguccuaucugggcuuccuggagcagaagcagcaacuuguccuagca

SEQ ID NO: 128966 - RNA, 64 nt, hsa
gccuagaacccagucuaaugagaacuccagaaagcuggagcagcccaccuagagcuggccgcgg

SEQ ID NO: 128967 - RNA, 64 nt, hsa
ccucuaugacgacaucgagugcuuccuuauggagcuggagcagcccgccuagaacccagucuaa

SEQ ID NO: 128968 - RNA, 64 nt, hsa
ggucccauggcugaagcuggagcagcggauugcucuggagcagccaaggccgccagcgugugga

SEQ ID NO: 128969 - RNA, 64 nt, hsa
cugcuccuuuacccucuuggucccauggcugaagcuggagcagcggauugcucuggagcagcca

SEQ ID NO: 128970 - RNA, 64 nt, hsa
guuccgcacuguucuugcaguguuucaucaacuccuggagcauuggaauggaaggggcuuggga

SEQ ID NO: 128971 - RNA, 64 nt, hsa
cccagcuggaggccagacuccucucuugugcuagcuggagcagcuccuuccccuuugcugauaa

SEQ ID NO: 128972 - RNA, 64 nt, hsa
ugggcaaggcucuccguggaguggacucgagucccuggagcaggcaguguggaggcagccaucc

SEQ ID NO: 128973 - RNA, 64 nt, hsa
gagcuggagccaugaggaggggcugggacuggagcuggagcaggcacuugcagccgggaaagcc

SEQ ID NO: 128974 - RNA, 64 nt, hsa
auuagugcuccugccuaaaugucuggcugaguugcuggagcaaagggggauucagugcauccag

SEQ ID NO: 128975 - RNA, 64 nt, hsa
auaccccaggaccccuuccccagcagcagagacccuggagcacaggagaguagggaggaggggu

SEQ ID NO: 128976 - RNA, 64 nt, hsa
acaggcaauaauauauuggccccauuagcccuuccuggagcagucauaaugaauuacagucaug

SEQ ID NO: 128977 - RNA, 64 nt, hsa
cuaggaagaagccugugucuuuuuucagaaaucccuggagcaacuuaaaugucuuuagaaauga

SEQ ID NO: 128978 - RNA, 64 nt, hsa
uugcagagcugggcugggcacagcccugugacgucuggagcauuggcugcauucucuuugagua

SEQ ID NO: 128979 - RNA, 64 nt, hsa
ugucccugagcagaguuacaugcuccaagacucccuggagcacgugcagcuguuugaccugaug

SEQ ID NO: 128980 - RNA, 64 nt, hsa
ucgccuggcgguggcuccaggguucucugguucucuggagcagaguucucugaauaccccaucc

SEQ ID NO: 128981 - RNA, 64 nt, hsa
uguuuauagcuuugucaaguaaauuuggacgcagcuggagcacaggcccuguuuguuugcacau

SEQ ID NO: 128982 - RNA, 64 nt, hsa
caggaagagguugcuggagcaagaggagaggaugcuggagcaagaggagaggcugcuggagcuu

SEQ ID NO: 128983 - RNA, 64 nt, hsa
uugagucgccugaaccaagagcaggaagagguugcuggagcaagaggagaggaugcuggagcaa

SEQ ID NO: 128984 - RNA, 64 nt, hsa
agacgagagguuguuggagcaagaggagagguugcuggagcaagaggagagguugcuggagcug

SEQ ID NO: 128985 - RNA, 64 nt, hsa
agaggagagguugcuggagcaagaggagagguugcuggagcaagaggagaggcuacuggagcug

SEQ ID NO: 128986 - RNA, 64 nt, hsa
agaggagaaguugcuggagcaagaggagagguugcuggagcaagaggagagguugcuggagcaa

SEQ ID NO: 128987 - RNA, 64 nt, hsa
guugcucagguuguuggagcaagaggagaaguugcuggagcaagaggagagguugcuggagcaa

SEQ ID NO: 128988 - RNA, 64 nt, hsa
acccuagaagaaugauuggacagaugugagccaucuggagcagaggggcacuaacccaggcuga

SEQ ID NO: 128989 - RNA, 64 nt, hsa
cuuccaggacuuuuuugcgcaccccuggguggaccuggagcacaugcccaguggggagagucug

SEQ ID NO: 128990 - RNA, 64 nt, hsa
gagugggugcgguguagaggaugcucuuggccggcuggagcaagaccuggcucccaccagaggg

SEQ ID NO: 128991 - RNA, 64 nt, hsa
cccuaggcuguuccgcguggguuaccuuaucacccuggagcacuugguauuccagaccccugac

SEQ ID NO: 128992 - RNA, 64 nt, hsa
ggcauagggggcaagcucuuggggcaucaggacccuggagcaccagguccuuccuggaauauua

SEQ ID NO: 128993 - RNA, 64 nt, hsa
gagcaccagguccuuccuggaauauuagauccaccuggagcaccgggucucucuaagucucacc

SEQ ID NO: 128994 - RNA, 64 nt, hsa
ccgucucugucacggucucucuuccucacagaagcuggagcaagaacggcagaacguggaaggg

SEQ ID NO: 128995 - RNA, 56 nt, hsa
ucacucagaaagccucuuagucauuccuggagcacacagggccuuugcguggagcc

SEQ ID NO: 128996 - RNA, 58 nt, hsa
uaccaauuccaauuucaaaaugucucaauggugcuauaauaaauaaacuucaacacuc

SEQ ID NO: 128997 - RNA, 58 nt, hsa
uuugggaaggcuuuaaagacgcauguuauggugcuaauguacuuucacuuuuaaacuc

SEQ ID NO: 128998 - RNA, 58 nt, hsa
aaggaaaaaaaguagaagccugacuacuuggugcuaacuacuaaagauuuuggcagaa

SEQ ID NO: 128999 - RNA, 58 nt, hsa
ucacauaccccucuccauguaugagaucuggugcuagcaaucagauucaacccgaagg

SEQ ID NO: 129000 - RNA, 58 nt, hsa
ccccgcugcccccuccacaguuccugaauggugcuaaggaucugcagcaguuggcaac

SEQ ID NO: 129001 - RNA, 58 nt, hsa
ugcagcggaccacuugcccaguuugcuguggugcuagccuuccccaucauccaccggg

SEQ ID NO: 129002 - RNA, 58 nt, hsa
aauaaggugcuucugcuucuucuagagauggugcuaaagaaaggacuagcauaugaga

SEQ ID NO: 129003 - RNA, 58 nt, hsa
ggggcuggugggcaugcuguccacuguguggugcuaggacugccaaugccaggcccaa

SEQ ID NO: 129004 - RNA, 58 nt, hsa
aauaauaggcuugaaaauugauauccuguggugcuaaaguacaguagaaagagaggag

SEQ ID NO: 129005 - RNA, 58 nt, hsa
uaauagcauugggauauagucacuguaauggugcuauuaacaaacagucaacaccauu

SEQ ID NO: 129006 - RNA, 58 nt, hsa
auuuauuguuuggccagcuaugccaauguggugcuauuguuucuuuaagaaaguacuu

SEQ ID NO: 129007 - RNA, 58 nt, hsa
guauguaaaacucuguuuuuuaguauaauggugcuauuuuguaguuuguuauaugaaa

SEQ ID NO: 129008 - RNA, 58 nt, hsa
gaggccgggugugaccucaucuuucucauggugcuauccuggugcuauuggggugggg

SEQ ID NO: 129009 - RNA, 58 nt, hsa
ugaccucaucuuucucauggugcuauccuggugcuauugggguggggagcucccuccc

SEQ ID NO: 129010 - RNA, 64 nt, hsa
ggagaggcccaucacuggugugguggggugggcucucccuuaggcuugggcaaggcagccaccu

SEQ ID NO: 129011 - RNA, 64 nt, hsa
uuaggcuugggcaaggcagccaccugcccuugcucucccuuaguguucccuggccucccugcca

SEQ ID NO: 129012 - RNA, 63 nt, hsa
cauacaaugccugaucaugcugcuccugucacccuccacgauuccacagaccaggacauucca

SEQ ID NO: 129013 - RNA, 54 nt, hsa
guggucaaagcguuccauaguucccuccacgaaagcauucagaaacccuacaac

SEQ ID NO: 129014 - RNA, 63 nt, hsa
uucagugcuucuugguucccaggaugccacuuccuccacgaauagcuaccuguugaagugaua

SEQ ID NO: 129015 - RNA, 63 nt, hsa
agggccgcuggcuuccgaacagacgugguugcucuccacgaggcgcauggggagcccgcgggc

SEQ ID NO: 129016 - RNA, 63 nt, hsa
uuggguuccuaauuccugguguuuaauaauucucuccacgaucauguuuuucugauuuuuuuu

SEQ ID NO: 129017 - RNA, 63 nt, hsa
uagcccucagcuucccacggaaucagauggauccuccacgauuacgugaauaaaaugauggaa

SEQ ID NO: 129018 - RNA, 63 nt, hsa
guacaguauacucaaggucuugcauaacccacacuccacgaaaaccgcaucguaaacagagag

SEQ ID NO: 129019 - RNA, 63 nt, hsa
aucucguggccuucccccucagacuacccaugucuccacgaaggcguccuggagucacucccc

SEQ ID NO: 129020 - RNA, 63 nt, hsa
aggacaaguuacaccuccacucagcacucuggacuccacgaugccuuugagucuguuuuccca

SEQ ID NO: 129021 - RNA, 63 nt, hsa
cuaugcaacugaaaaacugaggaugauuguuagcuccacgagugcaaacugcagucaccaagu

SEQ ID NO: 129022 - RNA, 56 nt, hsa
gcagcauggacaccaacuaaugcugacuccacgauccugccacccuguagcgccag

SEQ ID NO: 129023 - RNA, 63 nt, hsa
cugagauuguggcucccccucuggaggagguggcuccacgaugccuugauuuucacucaucau

SEQ ID NO: 129024 - RNA, 63 nt, hsa
cccagaguggccucagcugcacgacuccagaggcuccacgacugagcucugaggccagugccu

SEQ ID NO: 129025 - RNA, 63 nt, hsa
acaggcaucccuggguggccuuuccugcugacacuccacgagcugacccagcagaauucucug

SEQ ID NO: 129026 - RNA, 63 nt, hsa
auuagaguguuauugguagugucuagccuuuuccuccacgacauuccuugacuuaauccauuu

SEQ ID NO: 129027 - RNA, 63 nt, hsa
auggaugcuuguuucaaaggguuuccucucccucuccacgaaggcaguaccagccaguacucc

SEQ ID NO: 129028 - RNA, 63 nt, hsa
ccaaucuccuuccaccucccucccucccgccagcuccacgauuuuucgguguuucucuguaca

SEQ ID NO: 129029 - RNA, 63 nt, hsa
cccaucugucucacccucuccuguuguauccagcuccacgacaaacuucugccuuccccaaca

SEQ ID NO: 129030 - RNA, 63 nt, hsa
uguccucucuuccuacauuugucccugagaguacuccacgauuacuagguucuugauucccuu

SEQ ID NO: 129031 - RNA, 63 nt, hsa
accacaacauaauaguugaaagaucaagauuggcuccacgaaagugauacggagguuaggaug

SEQ ID NO: 129032 - RNA, 63 nt, hsa
cccugcucgcaugccgccccgcccuccccccaccuccacgacuauuuauugagcgccuguugu

SEQ ID NO: 129033 - RNA, 63 nt, hsa
uuugcagggauagcugggaguauggccacccugcuccacgaugcgguaaugaauccagcagaa

SEQ ID NO: 129034 - RNA, 62 nt, hsa
augccccggggaccuugugauccagcucacagcuccacgaagacucaaaaggaaaagccauu

SEQ ID NO: 129035 - RNA, 63 nt, hsa
gagagcguuucugucuuuugggagaguacuuuucuccacgagcccucuggccacugugggagg

SEQ ID NO: 129036 - RNA, 63 nt, hsa
ccugcagaacacagaaugaaacaugcugguagacuccacgagggcagggccucuccugucgcc

SEQ ID NO: 129037 - RNA, 63 nt, hsa
uucuagucauguguuuuuuaggacgauuucugucuccacgaugguggaaacaguggggaacua

SEQ ID NO: 129038 - RNA, 63 nt, hsa
cugaccucaccaagucaaguggaccacucuccacuccacgaggaugugaaacgguucuuuaaa

SEQ ID NO: 129039 - RNA, 63 nt, hsa
cuggcugcucaggagaggcgacacauuucaaaucuccacgagauauucuccacacagaaaauc

SEQ ID NO: 129040 - RNA, 63 nt, hsa
guuugcgggggaagccacacaucgcacguuuuacuccacgacgcacggggcucugcugucggg

SEQ ID NO: 129041 - RNA, 58 nt, hsa
gaauuaucccgaaaaguuaacaugucaccuccacgaggccauccucugugaccgaagg

SEQ ID NO: 129042 - RNA, 63 nt, hsa
gguccccagacccccugagcccucccagggacccuccacgaccagcucugggggaggcacagg

SEQ ID NO: 129043 - RNA, 63 nt, hsa
cuuuagguccuucugguuuggaggaaguggagccuccacgaacucucucuuacuccgaccauu

SEQ ID NO: 129044 - RNA, 63 nt, hsa
guaccuagaauagucucacugucccccguuugccuccacgagccugcuguuuccaggaaauua

SEQ ID NO: 129045 - RNA, 63 nt, hsa
gguccaccuucccaagccuccagagaguucucccuccacgauugugaaaacaaaugaaaacaa

SEQ ID NO: 129046 - RNA, 63 nt, hsa
agcacugcgcauggcuguucugcugcaacugugcuccacgaaacagaagaaaagguaaggugu

SEQ ID NO: 129047 - RNA, 63 nt, hsa
uucagaauccggagcaguaaguggagaagagcucuccacgagugcucagucuuagaacuauua

SEQ ID NO: 129048 - RNA, 63 nt, hsa
cauugcccuuggcuuuuucugguaugugcugugcuccacgaccaagccgagaaaggaccuagg

SEQ ID NO: 129049 - RNA, 63 nt, hsa
ggguuuaauuuuaaagacuuucugguuacacuacuccacgaacuccuccaaagauccguuauu

SEQ ID NO: 129050 - RNA, 63 nt, hsa
uuguuauaagauauugauuucauuuagauuucccuccacgaggucagcaaacuaucauguucu

SEQ ID NO: 129051 - RNA, 63 nt, hsa
cacguggacgugggcaccucaguagcggagcaucuccacgaaacggggcaccacaggaucccu

SEQ ID NO: 129052 - RNA, 63 nt, hsa
uaacucacucuagugggaccuugacuggagaaacuccacgaucuuccugaagaagagaaaugg

SEQ ID NO: 129053 - RNA, 63 nt, hsa
uaaucucccacaaggcaucuguugcuuuggguccuccacgacucuuaggcccgccucaacaac

SEQ ID NO: 129054 - RNA, 63 nt, hsa
auaaagacgggaguccugcaauuguacugcggacuccacgaguucuuuucuggugggaggacu

SEQ ID NO: 129055 - RNA, 63 nt, hsa
ggcuguguccuccccuagggaugagggucgggccuccacgaugcccugggcugugugcucuua

SEQ ID NO: 129056 - RNA, 63 nt, hsa
ccaggucccugggaaugagcugccuaccugcugcuccacgaggaagcucaggccugcacaggc

SEQ ID NO: 129057 - RNA, 63 nt, hsa
uucacgcacauauccguggccaccugagaccugcuccacgacccuuccaggcagagccgagag

SEQ ID NO: 129058 - RNA, 63 nt, hsa
cugccuccagcuuuccugguuagcgcaacgcggcuccacgaccacacgcacuucaggguggaa

SEQ ID NO: 129059 - RNA, 63 nt, hsa
aaacuccggagggucggacgggaccugggcucucuccacgauucuggcuguuugcccaggaac

SEQ ID NO: 129060 - RNA, 63 nt, hsa
cuguuuuaccauccugggagcaaggcccugcagcuccacgagaccuuuaccccgggaagaagc

SEQ ID NO: 129061 - RNA, 63 nt, hsa
gggcagccucugggcccugaaccccugcuggggcuccacgacccugagagaaggggugagaag

SEQ ID NO: 129062 - RNA, 63 nt, hsa
ucacgcugguguuugaggcauuuccacugugaucuccacgaggggauguuuuccgggacacau

SEQ ID NO: 129063 - RNA, 63 nt, hsa
gagaaucuguccagaaguugcauaggggauggccuccacgauaaggacaugcaacacguguuu

SEQ ID NO: 129064 - RNA, 63 nt, hsa
ccacccgugggccaggggcggccggacccgucccuccacgaccccgccaccccuccuaggccu

SEQ ID NO: 129065 - RNA, 63 nt, hsa
aagcugaugggcuuccucuggcccucccuuuuccuccacgaggauuaaaggauacaagcugac

SEQ ID NO: 129066 - RNA, 63 nt, hsa
ccccacagagcauccuccucucaucugugacaacuccacgagcccuuaauuucuuaguccuca

SEQ ID NO: 129067 - RNA, 63 nt, hsa
uaucccguguacagagagauccagagcccuacacuccacgaccugggggcucacagcacagaa

SEQ ID NO: 129068 - RNA, 63 nt, hsa
caccagaacuuccacagacgcccccacuagcuacuccacgaagcccccgagccucgccagacc

SEQ ID NO: 129069 - RNA, 63 nt, hsa
gccacgugggcccccagccucccccucggccgccuccacgacccggaguaggggggcucggga

SEQ ID NO: 129070 - RNA, 63 nt, hsa
acccauccccgagguccccagcgaggacacacacuccacgagagcagccccuccacucugccc

SEQ ID NO: 129071 - RNA, 63 nt, hsa
acacacccccccacaaggaacccucaggccacccuccacgaggugugacuaacuaugcaauaa

SEQ ID NO: 129072 - RNA, 63 nt, hsa
guaggguguguauauauaaaagguuguguacaacuccacgaggugaaaaauauucaguaacuu

SEQ ID NO: 129073 - RNA, 63 nt, hsa
agccuuguaaauaaccacaagguccacucccugcuccacgaagccuuaagccauaggcccagg

SEQ ID NO: 129074 - RNA, 63 nt, hsa
gcuaaagacugcauuauuuuacuacuguaauuucuccacgacauagcauuauguacauagaug

SEQ ID NO: 129075 - RNA, 63 nt, hsa
cuaaguguguaggagccagugagcgaaucaagacuccacgaccugccagcuguuuccaggauc

SEQ ID NO: 129076 - RNA, 63 nt, hsa
gcccaucccgauggaagccgccuccuccgccuccuccacgagagaaggacagucguggcagcc

SEQ ID NO: 129077 - RNA, 63 nt, hsa
gagaccagccuggccaacauggugaaaccccgucuccacgaaaaagauaaaaauaagcugggc

SEQ ID NO: 129078 - RNA, 63 nt, hsa
cagggauugccgaguccacguaacugaccuguacuccacgaggcccugugggaacgguccagg

SEQ ID NO: 129079 - RNA, 63 nt, hsa
ccuguuuuugugaccaaagaggaagccauuagucuccacgaguucccgguggaacagaugaca

SEQ ID NO: 129080 - RNA, 63 nt, hsa
gagaggaugccagggacaccaggccucuggccucuccacgagucacugcucuccccauuggca

SEQ ID NO: 129081 - RNA, 63 nt, hsa
gcgaggccacucgacucccggggccggggccgacuccacgaacaccagcccaaacugaagugc

SEQ ID NO: 129082 - RNA, 64 nt, hsa
gucugggcauuaaauuauacaaacugaaaauguguuacaagaaaaauaugagaguuuuaacuag

SEQ ID NO: 129083 - RNA, 64 nt, hsa
acaaauuuuuaaaauugaaauuaggaauuugaauuuacaagaaugccuuggauauuucuguguu

SEQ ID NO: 129084 - RNA, 64 nt, hsa
aacaguccacuucagggcagacggcaauaaucucuuacaagaaugaagccauauucaaccccag

SEQ ID NO: 129085 - RNA, 64 nt, hsa
gcaaaugaauagauguagagaauaacaauauuacuuacaagaugaaaugauuagauuagaagug

SEQ ID NO: 129086 - RNA, 64 nt, hsa
uagagacaugcuuguguuuuggaauuucacacccuuacaagaauaccacauuuugaaacccaga

SEQ ID NO: 129087 - RNA, 64 nt, hsa
guccaucuuuucaaagauacaacaaaagcagaaguuacaagaauauugcggagagguuggaaag

SEQ ID NO: 129088 - RNA, 64 nt, hsa
uugguuaagacugcugaggccaagugcuauuuuguuacaagaaaggaagaacuuggcuauuuuc

SEQ ID NO: 129089 - RNA, 64 nt, hsa
gaaucaaguaugaaaaucugcacaaaugcaauguuuacaagaacugguugauucugggaggcau

SEQ ID NO: 129090 - RNA, 64 nt, hsa
gccaaguacuaaagcaccuugcagagcgugucuauuacaagaugucauuuccaccagcaguucc

SEQ ID NO: 129091 - RNA, 64 nt, hsa
ugggucgaguggggccuuggagaacuuuucugucuuacaagaggauuguaaaaugcacccauca

SEQ ID NO: 129092 - RNA, 64 nt, hsa
ugggacaugccugucuuccuaauaccauuuggagcuggacaacauuugacaccaaccaaucaua

SEQ ID NO: 129093 - RNA, 64 nt, hsa
ggagcuggacaacauuugacaccaaccaaucauacuggacaaggcccuuagaggacuugaaaua

SEQ ID NO: 129094 - RNA, 64 nt, hsa
ggaacuuaaaaccuugaaggucugucauaggacucuggacaaucucacaccuuagcuauuccca

SEQ ID NO: 129095 - RNA, 64 nt, hsa
cugaaaggaagguuucuauucguugguuguggaccuggacaaaguccaagucuguggaacuuaa

SEQ ID NO: 129096 - RNA, 64 nt, hsa
cgccucugcccgggagaaagcccaggccagccugcuggacaagcagagaccaugagaaggagag

SEQ ID NO: 129097 - RNA, 64 nt, hsa
gaggcugugaaugcugagaccagaguuuaucaugcuggacaagccuggaaggaggcaauaagug

SEQ ID NO: 129098 - RNA, 64 nt, hsa
gaggauugcuugaguccaggaauuugagaccagccuggacaacacagugagaccucaucucuau

SEQ ID NO: 129099 - RNA, 64 nt, hsa
gagagcaucauggggcagacagaugguggauggucuggacaagaagcgaguaagccacugcggu

SEQ ID NO: 129100 - RNA, 64 nt, hsa
cggcugccauuggagccaauguguggcucagugccuggacaaaugaugccauggcagacaguag

SEQ ID NO: 129101 - RNA, 64 nt, hsa
uaacacuaucauggacuacaccaggguccugguccuggacaaaggaguaguagcugaauuugau

SEQ ID NO: 129102 - RNA, 64 nt, hsa
ggaggccgaggcagguggauugcuugagcucagccuggacaacauggcaaaaccccaucuauua

SEQ ID NO: 129103 - RNA, 64 nt, hsa
gaagauugcuugagcucaggaguuugaaaccagccuggacaacauauagcaagacucugccucu

SEQ ID NO: 129104 - RNA, 64 nt, hsa
cuguuugucuacccagaggaaggaggcacugcugaauggcuauggccuggcuaagaaggugauu

SEQ ID NO: 129105 - RNA, 64 nt, hsa
ggccagccagccuguacucugggcaagagcccaaaauggcuaggaauguuugacucccuuaauc

SEQ ID NO: 129106 - RNA, 64 nt, hsa
ucagaugaaaauaaaauaaacgaaacauuuagacaauggcuauauuaaucugggaaggcaacac

SEQ ID NO: 129107 - RNA, 64 nt, hsa
acgaauauaagcuuaaaauaagugaaucuaauaaaauggcuauuccucuuuuuacuuggaaaua

SEQ ID NO: 129108 - RNA, 64 nt, hsa
uaaaauuuuugcucaaaaccagaaaaagaauuguaauggcuacaguuucaguuacuuccauuuu

SEQ ID NO: 129109 - RNA, 64 nt, hsa
uuuauuaccagcugacacugcugaggagaaacccaauggcuaccuagacuauagggauaguugu

SEQ ID NO: 129110 - RNA, 64 nt, hsa
cuuuacccaaaaacuaaaucucuaauauggcaaaaauggcuagacacccauuuucacauuccca

SEQ ID NO: 129111 - RNA, 64 nt, hsa
gaggcccugucuguaccuaacgcccuauuuuugcaauggcuauauggcaagaaagcugguaaac

SEQ ID NO: 129112 - RNA, 64 nt, hsa
acuucgcuuaaauaguccaaguauauucucugagaggaaguacugaaagaugaauugacauaca

SEQ ID NO: 129113 - RNA, 64 nt, hsa
aaaccagccaacugcuuuuugugcggucuccuauaggaaguaucgcaauuguuuuguuuucauu

SEQ ID NO: 129114 - RNA, 64 nt, hsa
aauaaaaaauaaauaauggaacacagcaaguccuaggaaguagguuaaaacuaauucuuuaaaa

SEQ ID NO: 129115 - RNA, 64 nt, hsa
ucucacugagacagcaacauuuaaaccaaaccagaggaaguauuuguggaacucacugccucag

SEQ ID NO: 129116 - RNA, 64 nt, hsa
uaaacagaagcagaggcuaauucagugucacaugaggaaguagcugucagaugucacauaauua

SEQ ID NO: 129117 - RNA, 64 nt, hsa
ccauacucagacgugugaccuccauacugggcuaaggaaguaucagcacuagaaauugggcagu

SEQ ID NO: 129118 - RNA, 64 nt, hsa
uucuuuuguauccuggcaaauacuccugcaggccaggaaguauaauagcaaaaaguugaacaaa

SEQ ID NO: 129119 - RNA, 64 nt, hsa
aauugacaggacaauaaauacuucaaauacuuuuaggaaguaaaugaguaggaguuuaggaggg

SEQ ID NO: 129120 - RNA, 64 nt, hsa
uaggcagaagagauccaucaacagauugcaagcaaggaaguauguucacuuuaaaguuugagaa

SEQ ID NO: 129121 - RNA, 64 nt, hsa
ugauaaaguggcuguuaaaaagggaguugauuugaggaaguauuacuuagcauucaugcauauu

SEQ ID NO: 129122 - RNA, 64 nt, hsa
ucaaagcaaggaaacuauguaacauguaggaaguaggaaguaaauuauagugauguaaucuuga

SEQ ID NO: 129123 - RNA, 64 nt, hsa
aaggaagucaaagcaaggaaacuauguaacauguaggaaguaggaaguaaauuauagugaugua

SEQ ID NO: 129124 - RNA, 64 nt, hsa
uuuggcuaucuuaagccauuguaugggggggauuaggaaguaggagggauuguccuacaacagg

SEQ ID NO: 129125 - RNA, 64 nt, hsa
cauuagauuugaaagaguaauaguuuauaaaauaaggaaguaacaugugaggcucuccccuccu

SEQ ID NO: 129126 - RNA, 64 nt, hsa
ccccauuagucaguguuacagcuguguuggggauaggaaguauaucuggcagauugauauuuau

SEQ ID NO: 129127 - RNA, 64 nt, hsa
aaauacgcuuucugccaccuacacauuucuauuuaggaaguaaaauuugcuucauggucaugac

SEQ ID NO: 129128 - RNA, 64 nt, hsa
auaugcagguucguuuucauucuagggcagugccaggaaguauauugauagcuuuguagguaca

SEQ ID NO: 129129 - RNA, 64 nt, hsa
augccugugguacuugauggccuguuggucaaauaggaaguacaagugugugauguuagaaccu

SEQ ID NO: 129130 - RNA, 64 nt, hsa
agauuuaauguuacagcaucuacucuuuggcacuuuuucacauaagccagccuuagagacuaga

SEQ ID NO: 129131 - RNA, 64 nt, hsa
guguauguguaaugauuuguguccauuucaaguguuuucacaccagucacacauuauagaaauu

SEQ ID NO: 129132 - RNA, 64 nt, hsa
cagaacuauauuauaccaaguacuuuauuuaucguuuucacaaaacuauuugaguagaauaaau

SEQ ID NO: 129133 - RNA, 64 nt, hsa
uaaaggaugaaauugcaccuauuuuacacuuauauuuucacaguuaauugaacauauuuuuaaa

SEQ ID NO: 129134 - RNA, 64 nt, hsa
uaauccuauuuucauaauuuuuccuuuugccaguuuuucacauuaucuuugauaugugagcaac

SEQ ID NO: 129135 - RNA, 64 nt, hsa
cuuaaucuauuuucagucuucuggcacguaauuuuuuucacaguuauuauucuucuauuaacaa

SEQ ID NO: 129136 - RNA, 64 nt, hsa
ccugaaauacucacauucccacauacauucacuauuuucacacacacacacacacacacacaca

SEQ ID NO: 129137 - RNA, 64 nt, hsa
gccuuauuuucaaaaaugugaaauauaaggcacguuuucacacaaaauuucaaaacaaaaacaa

SEQ ID NO: 129138 - RNA, 64 nt, hsa
guagauaugaacuuacauuucugugcaaguuguuuuuucacaaaauaucuuccuaagaggcagc

SEQ ID NO: 129139 - RNA, 64 nt, hsa
gauugacuuaucaaaagaagaucugauuaagggcuuuucacaaugguaagugugcccuuucauu

SEQ ID NO: 129140 - RNA, 64 nt, hsa
ugcuuuucuuuuuucuuucuguaucuaugccuuuuuuucacaguaguccuuggcucugcacgga

SEQ ID NO: 129141 - RNA, 64 nt, hsa
gacuaaauauauuuaaaaggccacauuuauauuuuuuucacaagaaccacauaauaaauuccac

SEQ ID NO: 129142 - RNA, 64 nt, hsa
aaucaagaaaguuagucauguuuuauguaccauguuuucacacgugucucuucucuucgacuuc

SEQ ID NO: 129143 - RNA, 64 nt, hsa
aacuuuucaaauugguuacauuaauuuuaguuuauuuucacaaguaaaaauggcuuuuuauuua

SEQ ID NO: 129144 - RNA, 64 nt, hsa
cugauuaacuugucagugucuguauuuucugauuuuuucacauacgcucauuuuauguaauauu

SEQ ID NO: 129145 - RNA, 64 nt, hsa
auacuaugauuaaaaaagcuuuauaucuugggauuuuucacaacugauaaugugcaaagauaua

SEQ ID NO: 129146 - RNA, 64 nt, hsa
gcagcugcaacucuauagacuuuugacaaauucuuuuucacacugauguagauaacagcuuaac

SEQ ID NO: 129147 - RNA, 64 nt, hsa
uuuccagggcucaaaaaguuuccuuuuauucauauuuucacaugacguaaaauuuuaugugcuu

SEQ ID NO: 129148 - RNA, 64 nt, hsa
uuaaccacccccuucuuuuuuguuguuguggguuuuuucacauaaacacauacauugccaauuu

SEQ ID NO: 129149 - RNA, 64 nt, hsa
ccuguuggaaucaugaugauaaucauagcagcacuuuucacagcaucagcagucaucucacuag

SEQ ID NO: 129150 - RNA, 64 nt, hsa
ccaguggcauuaaacauaaaaagacccuggcauuuuuucacauacuugaaucccuaaaugcacc

SEQ ID NO: 129151 - RNA, 64 nt, hsa
acacccaccagauuguacauacuguguuuggcuguuuucacauauguuggauguaguguucuuu

SEQ ID NO: 129152 - RNA, 64 nt, hsa
cuccugggggagcuuaaaacgggggaaacacugguuuucacagaugcuccacauggcugucuuu

SEQ ID NO: 129153 - RNA, 64 nt, hsa
ucucauagaugcauugaguagugccuuuuuagcuuuuucacauuacuuugucaccauauccuuu

SEQ ID NO: 129154 - RNA, 64 nt, hsa
uuucaaacucauacuuuauuuucauuugaaauguuuuucacaccuuuugcauuacauaauaauu

SEQ ID NO: 129155 - RNA, 64 nt, hsa
aaucucuaauauggcaaaaauggcuagacacccauuuucacauucccaucugucaccaauuggu

SEQ ID NO: 129156 - RNA, 64 nt, hsa
aaagucugugugaugaacuuucucuucauacuuuuuuucacaguuggcuggaugaaauuuucua

SEQ ID NO: 129157 - RNA, 64 nt, hsa
uaauauucacugaucugcaguuuaugagaacacauuuucacaguuauguuucuucauaggaaaa

SEQ ID NO: 129158 - RNA, 64 nt, hsa
agaccauagacaugauauagacuaacuuccccauuuuucacaagaggaaaccauccuuaugacu

SEQ ID NO: 129159 - RNA, 64 nt, hsa
agcccccagggaucaugugaaagugagaaagcccuuuucacacuguggagcggugcagaugugg

SEQ ID NO: 129160 - RNA, 64 nt, hsa
gaacaaugauacacagcugcaccggggggucaccuuuucacaaauguagaccuccaugaacuca

SEQ ID NO: 129161 - RNA, 64 nt, hsa
uuguuaacuaaauuuuuuucuuaaaauaaagacuuuuucacaaugacuggcacagauuacucag

SEQ ID NO: 129162 - RNA, 64 nt, hsa
aguuuuguuaggaacauuugaguuacuucaaucauuuucacaggcagccaacaagcaauuaaga

SEQ ID NO: 129163 - RNA, 64 nt, hsa
gccauuucgcuguguugucuaaauaaugaggguuuuuucacaccauuucucaaaaggagauucg

SEQ ID NO: 129164 - RNA, 64 nt, hsa
gcacaaaaacaagugguggugaaacauuguucuguuuucacaagagaugagggagcaggcuuuc

SEQ ID NO: 129165 - RNA, 64 nt, hsa
auuuuuggggauuugucgacucauuuugucugaauuuucacaacugguauuaugucacuagcua

SEQ ID NO: 129166 - RNA, 64 nt, hsa
aacuagcaaaaaucugcauaaugcaacaacacaguuuucacacuucaaauuuuacaugaggggu

SEQ ID NO: 129167 - RNA, 64 nt, hsa
aagaacuuuccaggaaggcuaaagggaaaccgaauuuucacagccaugauucuuuugcccacac

SEQ ID NO: 129168 - RNA, 64 nt, hsa
gggcaacccuggugaccagcaccaucucuccuccuuuucacaguucucuccuucuuccccccgc

SEQ ID NO: 129169 - RNA, 64 nt, hsa
ucaucuucaagguuaaaccucuuggcaguuacccuuuucacaaagugcacagugggaaucgaga

SEQ ID NO: 129170 - RNA, 64 nt, hsa
aaugagaccuuaauaacaaauaggcguaaaaaaauuuucacauugaaaugauagaaacauuuga

SEQ ID NO: 129171 - RNA, 64 nt, hsa
ugguauuauuuuauauacuuuuccagcuugauaauuuucacaauagaaagagaccaaauauuuu

SEQ ID NO: 129172 - RNA, 64 nt, hsa
gauuuuuuauuuaaaaauuugagauuuuuaaaauuuuucacagcacaggucuucucauuuucuu

SEQ ID NO: 129173 - RNA, 64 nt, hsa
gaccauuguauuuuccacuagcagugaaaaugauuuuucacaacuaacuuguaaauauauuuua

SEQ ID NO: 129174 - RNA, 64 nt, hsa
gauucucuugauuccuggcaccaaaaucagauuguuuucacaguuaugauucccagugggagaa

SEQ ID NO: 129175 - RNA, 64 nt, hsa
gauacacacuguaacuacaagaaauuauaaauguuuuucacaucaggcuguucuuuuuuuuuuu

SEQ ID NO: 129176 - RNA, 64 nt, hsa
aaaaaaaaaaaaaauuauucuguaccaucacaacuuuucacaacgauggcaagccuuaugucuu

SEQ ID NO: 129177 - RNA, 64 nt, hsa
aaaaauaguagacaacugcuuaaugguugggguuuuuucacaauuuucaacauuagugauuuuu

SEQ ID NO: 129178 - RNA, 64 nt, hsa
cugcguuugauauucaaacaucauaugccggaaauuuucacaguuuuuagugaacuuaaggaau

SEQ ID NO: 129179 - RNA, 64 nt, hsa
gucggucggucuccccccuccccgcccccuucucuuuucacauacagucacauugagguuugga

SEQ ID NO: 129180 - RNA, 64 nt, hsa
cucuuccuggcauguaagugcccacuuccucauguuuucacacgauggagaccaacaaauaggu

SEQ ID NO: 129181 - RNA, 64 nt, hsa
aaaaauuuucauuuauuuaauggaaacuugcccauuuucacaugucugcuuauuuauuuuauau

SEQ ID NO: 129182 - RNA, 64 nt, hsa
guuucuauauuauuuagaauauuuguuguugcaauuuucacauaagaaaauuuaacaguugugu

SEQ ID NO: 129183 - RNA, 64 nt, hsa
uugcacugaaaucuaaagauguuuuaaaaaacacuuuucacaaaaauaguccuuugucauuaca

SEQ ID NO: 129184 - RNA, 64 nt, hsa
cuuggggacuuccuucgucagcacuggcuuucuguuuucacaagacagacgucugucccgcugc

SEQ ID NO: 129185 - RNA, 64 nt, hsa
uggagagaugagaagcaauuccaccaaacucauguuuucacaggaggguucaguguggagagca

SEQ ID NO: 129186 - RNA, 64 nt, hsa
caagcuccucaaacaggguucaguccacguuguguuuucacaccuuucuccaaggaucgaacca

SEQ ID NO: 129187 - RNA, 64 nt, hsa
aaauguacauacuauguucaugauagugugauuuuuuucacauuuaagcaggaaugcaauauaa

SEQ ID NO: 129188 - RNA, 64 nt, hsa
uaugguauuguauuguaaaccauuaaugaaaacuuuuucacaguugagugaaauuaaaaucacu

SEQ ID NO: 129189 - RNA, 64 nt, hsa
ggaccaaguuuuaugacccagaggcuuaaugauguuuggauauauuucaaaucggcgugcuuac

SEQ ID NO: 129190 - RNA, 64 nt, hsa
guugcuaaacagcucaguaacacacuugaaugaauuuggauaccagauuguccucauuacaguu

SEQ ID NO: 129191 - RNA, 64 nt, hsa
uuuuuaguaucagcagcauuuggcaaguuuauuuuuuggauauaaacugugguucaucuguuca

SEQ ID NO: 129192 - RNA, 64 nt, hsa
aaaacuuaaugcuaagaaacauuuuauaugcuccuuuggauaugcaauuuaaucuagauuaucu

SEQ ID NO: 129193 - RNA, 64 nt, hsa
uacugacucaauaccuuuaggauuuguaucagaguuuggauacuaguguuagugguggugucac

SEQ ID NO: 129194 - RNA, 64 nt, hsa
cuguauuucacucagccuuaaauguuauaauauuuuuggauaacgguuauuaauucuuugagac

SEQ ID NO: 129195 - RNA, 64 nt, hsa
uacauuauaaaagcagaacauacauguaccaguuuuuggauacuaaaugacagccuuguuucuc

SEQ ID NO: 129196 - RNA, 64 nt, hsa
aaucugcugugccccuaaaauagcauuuagaaguuuuggauaugaaaaacagaagagagaaaaa

SEQ ID NO: 129197 - RNA, 64 nt, hsa
ccagucuguaaaauaaccaaccacuuacuuagcguuuggauagacuccaugccuucucucuccc

SEQ ID NO: 129198 - RNA, 64 nt, hsa
gacugcccauguuucugaggcuucagagucgaaguuuggauacauuucaagugcauuucaagcc

SEQ ID NO: 129199 - RNA, 64 nt, hsa
agcagauguuuaaauagauuauuuuauagcuuauuuuggauauuuuuucuuuuaauaaacuaau

SEQ ID NO: 129200 - RNA, 64 nt, hsa
ugaugucauuuuucccccugcuucagguuaauuuuuuggauauuucagaaacccauagcaauuc

SEQ ID NO: 129201 - RNA, 64 nt, hsa
ugagcuuuuacuuaaaauuuagauagaacuuuuuuuuggauacagcacaaacuccaguugacag

SEQ ID NO: 129202 - RNA, 64 nt, hsa
uuuaagaagccaugguacuuuuuucuugaguuacuuuggauauguuuuuucaaugccaucugaa

SEQ ID NO: 129203 - RNA, 64 nt, hsa
uggcaaccucuguauuuggguuacagucaaccuauuuggauacuuggcaaaagauucuugcugu

SEQ ID NO: 129204 - RNA, 64 nt, hsa
auuuuauaugccuuuugagcuguguaacuuaauauuuggauacuugacaauuuguuuuauuaug

SEQ ID NO: 129205 - RNA, 64 nt, hsa
uaucugauaguguucuaaaauuugguuacuuggguuuggauacccuuagugggaugauguaaau

SEQ ID NO: 129206 - RNA, 64 nt, hsa
cuuucaguauuauguauuuguaaaaaccauuguuuuuggauauaaagcuaauaagcacuuuaaa

SEQ ID NO: 129207 - RNA, 64 nt, hsa
auuuuucuuuccuuuuccacuucuuucuaacagauuuggauauuuuuaauuuccaggcauagca

SEQ ID NO: 129208 - RNA, 64 nt, hsa
gcaauuuggggaauaucaaacuuagcauuauacauuuggauauucuaguuguauuguaaauuuu

SEQ ID NO: 129209 - RNA, 64 nt, hsa
ucauaugcuuuuccugcauacauuauuuugaucauuuggauaacaucaaugaacacuggcuuuu

SEQ ID NO: 129210 - RNA, 64 nt, hsa
ucucuuaagaaacccugagauuaaaaaaagacuauuuggauaacuuauaggaaagccuagaacc

SEQ ID NO: 129211 - RNA, 64 nt, hsa
uauuguguguucugugaaugcuagcucucuugaauuuggauauugguuauuuuuuauagagugu

SEQ ID NO: 129212 - RNA, 64 nt, hsa
uuuaccuaccaccuucccacuuggcuagcuguccuuuggauaugugcuguuaacuggggaaggc

SEQ ID NO: 129213 - RNA, 64 nt, hsa
auugaugcuaaauauaucuuacauuugaauuccuuuuggauaaaguuauuucuugaugugacag

SEQ ID NO: 129214 - RNA, 64 nt, hsa
ucaucccuucugagugaaauuugcucauaaagcauuuggauacuaagccauuauuugccauuuu

SEQ ID NO: 129215 - RNA, 64 nt, hsa
aaguucauuucaucuugagaucauggugaaauauuuuggauauauaaauuccuuaagcuauugu

SEQ ID NO: 129216 - RNA, 64 nt, hsa
ucuuguuucuagccaagggagagccagcgcagguuuuggauacuagagaaagucauuugcuugu

SEQ ID NO: 129217 - RNA, 64 nt, hsa
gcagccauacuuaccuuugagguuuuauuuaaaguuuggauaccacuagcuauauuuugcuuuu

SEQ ID NO: 129218 - RNA, 64 nt, hsa
agaagugaauuguggacguaaaaugguugugcuauuuggauaauggcacuaggcagcauuugua

SEQ ID NO: 129219 - RNA, 64 nt, hsa
uaaccauuucuuuuauguacauuugaaaaugcccuuuggauacuuggaacugcuaaauuauuuu

SEQ ID NO: 129220 - RNA, 64 nt, hsa
agugaggugaacgacuucagauuucauuauuggauuuggauauuugagguaaaauuucauuuug

SEQ ID NO: 129221 - RNA, 64 nt, hsa
uauagaccaauucucugaucucgaguuguuuuuguuuggauacagcccuuuuuuuuuucuuuuu

SEQ ID NO: 129222 - RNA, 64 nt, hsa
aucagaaauccccuugggggagcaggaugagaccuuuggauagaacagaagcugagcaagagaa

SEQ ID NO: 129223 - RNA, 64 nt, hsa
gauagaacagaagcugagcaagagaacauguugguuuggauaaccgguugcacuauaucuguga

SEQ ID NO: 129224 - RNA, 64 nt, hsa
uugacuggcucccucaguccuauucuguagccuuuuuggauaaaauuggguuuuaacauaccuc

SEQ ID NO: 129225 - RNA, 64 nt, hsa
uagcacuugaaaacaugacaagggcccguaguuguuuggauaagagaacuccagcauagagccu

SEQ ID NO: 129226 - RNA, 64 nt, hsa
ucuguuaaauuaagcauuaucuucuaagaccuuuuuuggauagucaaauauaagagauaaauag

SEQ ID NO: 129227 - RNA, 64 nt, hsa
uaagagauaaauaguuuaauuuuuucagaccuuuuuuggauaguccaauauuagagauaaauag

SEQ ID NO: 129228 - RNA, 64 nt, hsa
ugcauauugucagagcagcaugagaaauaugauauuuggauagggauuucagcaacuaaacauu

SEQ ID NO: 129229 - RNA, 64 nt, hsa
ugcaaacuuguguuaauucuguuuaauauacaaauuuggauagcuuaauuauaaacauauuuuu

SEQ ID NO: 129230 - RNA, 64 nt, hsa; identical to SEQ ID NO: 129130

SEQ ID NO: 129231 - RNA, 64 nt, hsa; identical to SEQ ID NO: 129131

SEQ ID NO: 129232 - RNA, 64 nt, hsa; identical to SEQ ID NO: 129132

SEQ ID NO: 129233 - RNA, 64 nt, hsa; identical to SEQ ID NO: 129133

SEQ ID NO: 129234 - RNA, 64 nt, hsa; identical to SEQ ID NO: 129134

SEQ ID NO: 129235 - RNA, 64 nt, hsa; identical to SEQ ID NO: 129135

SEQ ID NO: 129236 - RNA, 64 nt, hsa; identical to SEQ ID NO: 129136

SEQ ID NO: 129237 - RNA, 64 nt, hsa; identical to SEQ ID NO: 129137

SEQ ID NO: 129238 - RNA, 64 nt, hsa; identical to SEQ ID NO: 129138

SEQ ID NO: 129239 - RNA, 64 nt, hsa; identical to SEQ ID NO: 129139

SEQ ID NO: 129240 - RNA, 64 nt, hsa; identical to SEQ ID NO: 129140

SEQ ID NO: 129241 - RNA, 64 nt, hsa; identical to SEQ ID NO: 129141

SEQ ID NO: 129242 - RNA, 64 nt, hsa; identical to SEQ ID NO: 129142

SEQ ID NO: 129243 - RNA, 64 nt, hsa; identical to SEQ ID NO: 129143

SEQ ID NO: 129244 - RNA, 64 nt, hsa; identical to SEQ ID NO: 129144

SEQ ID NO: 129245 - RNA, 64 nt, hsa; identical to SEQ ID NO: 129145

SEQ ID NO: 129246 - RNA, 64 nt, hsa; identical to SEQ ID NO: 129146

SEQ ID NO: 129247 - RNA, 64 nt, hsa; identical to SEQ ID NO: 129147

SEQ ID NO: 129248 - RNA, 64 nt, hsa; identical to SEQ ID NO: 129148

SEQ ID NO: 129249 - RNA, 64 nt, hsa; identical to SEQ ID NO: 129149

SEQ ID NO: 129250 - RNA, 64 nt, hsa; identical to SEQ ID NO: 129150

SEQ ID NO: 129251 - RNA, 64 nt, hsa; identical to SEQ ID NO: 129151

SEQ ID NO: 129252 - RNA, 64 nt, hsa; identical to SEQ ID NO: 129152

SEQ ID NO: 129253 - RNA, 64 nt, hsa; identical to SEQ ID NO: 129153

SEQ ID NO: 129254 - RNA, 64 nt, hsa; identical to SEQ ID NO: 129154

SEQ ID NO: 129255 - RNA, 64 nt, hsa; identical to SEQ ID NO: 129155

SEQ ID NO: 129256 - RNA, 64 nt, hsa; identical to SEQ ID NO: 129156

SEQ ID NO: 129257 - RNA, 64 nt, hsa; identical to SEQ ID NO: 129157

SEQ ID NO: 129258 - RNA, 64 nt, hsa; identical to SEQ ID NO: 129158

SEQ ID NO: 129259 - RNA, 64 nt, hsa; identical to SEQ ID NO: 129159

SEQ ID NO: 129260 - RNA, 64 nt, hsa; identical to SEQ ID NO: 129160

SEQ ID NO: 129261 - RNA, 64 nt, hsa; identical to SEQ ID NO: 129161

SEQ ID NO: 129262 - RNA, 64 nt, hsa; identical to SEQ ID NO: 129162

SEQ ID NO: 129263 - RNA, 64 nt, hsa; identical to SEQ ID NO: 129163

SEQ ID NO: 129264 - RNA, 64 nt, hsa; identical to SEQ ID NO: 129164

SEQ ID NO: 129265 - RNA, 64 nt, hsa; identical to SEQ ID NO: 129165

SEQ ID NO: 129266 - RNA, 64 nt, hsa; identical to SEQ ID NO: 129166

SEQ ID NO: 129267 - RNA, 64 nt, hsa; identical to SEQ ID NO: 129167

SEQ ID NO: 129268 - RNA, 64 nt, hsa; identical to SEQ ID NO: 129168

SEQ ID NO: 129269 - RNA, 64 nt, hsa; identical to SEQ ID NO: 129169

SEQ ID NO: 129270 - RNA, 64 nt, hsa; identical to SEQ ID NO: 129170

SEQ ID NO: 129271 - RNA, 64 nt, hsa; identical to SEQ ID NO: 129171

SEQ ID NO: 129272 - RNA, 64 nt, hsa; identical to SEQ ID NO: 129172

SEQ ID NO: 129273 - RNA, 64 nt, hsa; identical to SEQ ID NO: 129173

SEQ ID NO: 129274 - RNA, 64 nt, hsa; identical to SEQ ID NO: 129174

SEQ ID NO: 129275 - RNA, 64 nt, hsa; identical to SEQ ID NO: 129175

SEQ ID NO: 129276 - RNA, 64 nt, hsa; identical to SEQ ID NO: 129176

SEQ ID NO: 129277 - RNA, 64 nt, hsa; identical to SEQ ID NO: 129177

SEQ ID NO: 129278 - RNA, 64 nt, hsa; identical to SEQ ID NO: 129178

SEQ ID NO: 129279 - RNA, 64 nt, hsa; identical to SEQ ID NO: 129179

SEQ ID NO: 129280 - RNA, 64 nt, hsa; identical to SEQ ID NO: 129180

SEQ ID NO: 129281 - RNA, 64 nt, hsa; identical to SEQ ID NO: 129181

SEQ ID NO: 129282 - RNA, 64 nt, hsa; identical to SEQ ID NO: 129182

SEQ ID NO: 129283 - RNA, 64 nt, hsa; identical to SEQ ID NO: 129183

SEQ ID NO: 129284 - RNA, 64 nt, hsa; identical to SEQ ID NO: 129184

SEQ ID NO: 129285 - RNA, 64 nt, hsa; identical to SEQ ID NO: 129185

SEQ ID NO: 129286 - RNA, 64 nt, hsa; identical to SEQ ID NO: 129186

SEQ ID NO: 129287 - RNA, 64 nt, hsa; identical to SEQ ID NO: 129187

SEQ ID NO: 129288 - RNA, 64 nt, hsa; identical to SEQ ID NO: 129188

SEQ ID NO: 129289 - RNA, 64 nt, hsa; identical to SEQ ID NO: 129189

SEQ ID NO: 129290 - RNA, 64 nt, hsa; identical to SEQ ID NO: 129190

SEQ ID NO: 129291 - RNA, 64 nt, hsa; identical to SEQ ID NO: 129191

SEQ ID NO: 129292 - RNA, 64 nt, hsa; identical to SEQ ID NO: 129192

SEQ ID NO: 129293 - RNA, 64 nt, hsa; identical to SEQ ID NO: 129193

SEQ ID NO: 129294 - RNA, 64 nt, hsa; identical to SEQ ID NO: 129194

SEQ ID NO: 129295 - RNA, 64 nt, hsa; identical to SEQ ID NO: 129195

SEQ ID NO: 129296 - RNA, 64 nt, hsa; identical to SEQ ID NO: 129196

SEQ ID NO: 129297 - RNA, 64 nt, hsa; identical to SEQ ID NO: 129197

SEQ ID NO: 129298 - RNA, 64 nt, hsa; identical to SEQ ID NO: 129198

SEQ ID NO: 129299 - RNA, 64 nt, hsa; identical to SEQ ID NO: 129199

SEQ ID NO: 129300 - RNA, 64 nt, hsa; identical to SEQ ID NO: 129200

SEQ ID NO: 129301 - RNA, 64 nt, hsa; identical to SEQ ID NO: 129201

SEQ ID NO: 129302 - RNA, 64 nt, hsa; identical to SEQ ID NO: 129202

SEQ ID NO: 129303 - RNA, 64 nt, hsa; identical to SEQ ID NO: 129203

SEQ ID NO: 129304 - RNA, 64 nt, hsa; identical to SEQ ID NO: 129204

SEQ ID NO: 129305 - RNA, 64 nt, hsa; identical to SEQ ID NO: 129205

SEQ ID NO: 129306 - RNA, 64 nt, hsa; identical to SEQ ID NO: 129206

SEQ ID NO: 129307 - RNA, 64 nt, hsa; identical to SEQ ID NO: 129207

SEQ ID NO: 129308 - RNA, 64 nt, hsa; identical to SEQ ID NO: 129208

SEQ ID NO: 129309 - RNA, 64 nt, hsa; identical to SEQ ID NO: 129209

SEQ ID NO: 129310 - RNA, 64 nt, hsa; identical to SEQ ID NO: 129210

SEQ ID NO: 129311 - RNA, 64 nt, hsa; identical to SEQ ID NO: 129211

SEQ ID NO: 129312 - RNA, 64 nt, hsa; identical to SEQ ID NO: 129212

SEQ ID NO: 129313 - RNA, 64 nt, hsa; identical to SEQ ID NO: 129213

SEQ ID NO: 129314 - RNA, 64 nt, hsa; identical to SEQ ID NO: 129214

SEQ ID NO: 129315 - RNA, 64 nt, hsa; identical to SEQ ID NO: 129215

SEQ ID NO: 129316 - RNA, 64 nt, hsa; identical to SEQ ID NO: 129216

SEQ ID NO: 129317 - RNA, 64 nt, hsa; identical to SEQ ID NO: 129217

SEQ ID NO: 129318 - RNA, 64 nt, hsa; identical to SEQ ID NO: 129218

SEQ ID NO: 129319 - RNA, 64 nt, hsa; identical to SEQ ID NO: 129219

SEQ ID NO: 129320 - RNA, 64 nt, hsa; identical to SEQ ID NO: 129220

SEQ ID NO: 129321 - RNA, 64 nt, hsa; identical to SEQ ID NO: 129221

SEQ ID NO: 129322 - RNA, 64 nt, hsa; identical to SEQ ID NO: 129222

SEQ ID NO: 129323 - RNA, 64 nt, hsa; identical to SEQ ID NO: 129223

SEQ ID NO: 129324 - RNA, 64 nt, hsa; identical to SEQ ID NO: 129224

SEQ ID NO: 129325 - RNA, 64 nt, hsa; identical to SEQ ID NO: 129225

SEQ ID NO: 129326 - RNA, 64 nt, hsa; identical to SEQ ID NO: 129226

SEQ ID NO: 129327 - RNA, 64 nt, hsa; identical to SEQ ID NO: 129227

SEQ ID NO: 129328 - RNA, 64 nt, hsa; identical to SEQ ID NO: 129228

SEQ ID NO: 129329 - RNA, 64 nt, hsa; identical to SEQ ID NO: 129229

SEQ ID NO: 129330 - RNA, 64 nt, hsa
ugcugccuaccucacagagguaucaugaagauagcauuuagaaagggcuuuguugugguggggu

SEQ ID NO: 129331 - RNA, 64 nt, hsa
ucuuaagagcaucuuccaagacuccagcagugagcauuuagagaguguguugucuuccagaguc

SEQ ID NO: 129332 - RNA, 64 nt, hsa
uaauuaauuuggagcacaaaauucaaagcauggacauuuagaagaaagauguuuggcguagcag

SEQ ID NO: 129333 - RNA, 64 nt, hsa
aaagcauaaagcucaaaugaaauguaugcauucacauuuagaaaagugaauugaaguuucaagu

SEQ ID NO: 129334 - RNA, 64 nt, hsa
auuccuucucccuaucugcuuauaucgcauugcucauuuagaguuugcaggaggcuccauacua

SEQ ID NO: 129335 - RNA, 64 nt, hsa
auuaauugauuuccuacuauauucccagcagacacauuuagaaacuaagcuauguuaaccucag

SEQ ID NO: 129336 - RNA, 64 nt, hsa
cauaaccaguuccaucauccugguggaacuugaacauuuagaguuuaucuagagagcuugguua

SEQ ID NO: 129337 - RNA, 64 nt, hsa
cuacaacaaaaaaagaguugagugaaucuguuuacauuuagaauaauguuuuuuucuucaagag

SEQ ID NO: 129338 - RNA, 64 nt, hsa
ugcccuguugagagaaauuagggggaaaugauuacauuuagaagcugcuagaguuauccagugu

SEQ ID NO: 129339 - RNA, 64 nt, hsa
uaugguccuuagaaaagacuuugcuuuuauaaagcauuuagaaaaaaugcauacuuuuaaaaca

SEQ ID NO: 129340 - RNA, 64 nt, hsa
acugauuaugcuuuugaaauuuucucuuguaaaacauuuagaaaacaaaaacaaaaaaaaugug

SEQ ID NO: 129341 - RNA, 64 nt, hsa
ggcauggauugaagaagauugucuacucaaauggcauuuagacauuagaaugucugggaaaaua

SEQ ID NO: 129342 - RNA, 64 nt, hsa
aaagaaaggaacuucuuuuugccuucuaauugaucauuuagacuauucuggcuaagucugccca

SEQ ID NO: 129343 - RNA, 64 nt, hsa
uuaccggcuaauucaagcgaggaaaaauguaagucauuuagaccaaagccaagcaguuucuuug

SEQ ID NO: 129344 - RNA, 64 nt, hsa
uuguagaauaaauuaaaaggauaaucuaaaucaccauuuagauuaagcuugacuugcaaacuag

SEQ ID NO: 129345 - RNA, 64 nt, hsa
uauuauuuuaccaauuuuuuuuuaguauuaaguccauuuagaacuaaccauauuauuuauggaa

SEQ ID NO: 129346 - RNA, 64 nt, hsa
acauucugugguuucucauuauacuuacuuccugcauuuagagggaguuuauuuaaaagaaaua

SEQ ID NO: 129347 - RNA, 64 nt, hsa
caguauggaguucagauuacaguguuuuccauuacauuuagauucauagaaucugaauggcuga

SEQ ID NO: 129348 - RNA, 64 nt, hsa
uacauggaguauggaggaaauuuucugaaaaauacauuuagauuaguuuaguuugaaggagagg

SEQ ID NO: 129349 - RNA, 64 nt, hsa
agaaaaagaaccgcuuguaugauuuucaaaagaacauuuagaauucuauagagucaaaacuaua

SEQ ID NO: 129350 - RNA, 64 nt, hsa
uugugcaguaugaaaucguauuguaauuuucuugcauuuagaugucaaccucagaaacaggaac

SEQ ID NO: 129351 - RNA, 64 nt, hsa
acuaaaugaguuuucagcuuuauaaauuguuaaacauuuagacaaacauauauguauguaugaa

SEQ ID NO: 129352 - RNA, 64 nt, hsa
acagugcagauaagaguugaauauugauaucauacauuuagacugcuguucugauugcauuuau

SEQ ID NO: 129353 - RNA, 64 nt, hsa
ugcuguucugauugcauuuaucuuuuuccuacaucauuuagaauuuuauuucccugauucaguu

SEQ ID NO: 129354 - RNA, 64 nt, hsa
uuagcaauagggaugguaggauucaaaugugugucauuuagaaguggaagcuauuagcaccaau

SEQ ID NO: 129355 - RNA, 64 nt, hsa
cuuaguuuaaaaaaaaaaucaagucuaaacauugcauuuagaaagcuuuuguucuuggauaaaa

SEQ ID NO: 129356 - RNA, 64 nt, hsa
uugcugcccgcuuaggggcuuagaaggagaagccagugagcaggcucacacuaaguuguaaaca

SEQ ID NO: 129357 - RNA, 64 nt, hsa
ggaggaucacuugagcacaggaguuugaggcugcagugagcagccugggcaagagagugagacu

SEQ ID NO: 129358 - RNA, 64 nt, hsa
agaaaggugcaagaaagugagcagucugccugugagugagcacagaugccggggugugugugug

SEQ ID NO: 129359 - RNA, 64 nt, hsa
uguggccgaggugauggcaagaaaggugcaagaaagugagcagucugccugugagugagcacag

SEQ ID NO: 129360 - RNA, 64 nt, hsa
cccacccugggagacagaccccaccuccuuggguagugagcagugagcagaaagcugugaacag

SEQ ID NO: 129361 - RNA, 64 nt, hsa
ugggagacagaccccaccuccuuggguagugagcagugagcagaaagcugugaacaggcugggc

SEQ ID NO: 129362 - RNA, 64 nt, hsa
ccuucuuuuugaaaccucccaauggcauuucagaagugagcaguggaauuuuccugccauccua

SEQ ID NO: 129363 - RNA, 64 nt, hsa
gcuccauaaaauaggguaauaaaggucaaacaucagugagcaagcuguguacacuggaaaacac

SEQ ID NO: 129364 - RNA, 64 nt, hsa
ugcuauuuaaaggaaucacaaaugaucauacuuaagugagcaaaaaugacaaguuuuacuagcu

SEQ ID NO: 129365 - RNA, 64 nt, hsa
acaccauggauuauauucuuuuuuucccuucaguagugagcaguuuguauguacagagaaaaug

SEQ ID NO: 129366 - RNA, 64 nt, hsa
cccuacauuacacaguucagccuuuaucaagcuuagugagcagugagcacugaaacauuauuuu

SEQ ID NO: 129367 - RNA, 64 nt, hsa
uuacacaguucagccuuuaucaagcuuagugagcagugagcacugaaacauuauuuuuuaaugu

SEQ ID NO: 129368 - RNA, 64 nt, hsa
ucccaggcaugcagcugccuggggcccaaguugcagugagcaggguggggucugggagggggug

SEQ ID NO: 129369 - RNA, 64 nt, hsa
aaaggggagccagaaaugggcaguucucccagggagugagcagcuacuguaacuuuuuuaaauu

SEQ ID NO: 129370 - RNA, 64 nt, hsa
gaugucaggacuaaaaaaaggcaucacagugagcagugagcacagagggaguuucgaguauaag

SEQ ID NO: 129371 - RNA, 64 nt, hsa
auggauggaugucaggacuaaaaaaaggcaucacagugagcagugagcacagagggaguuucga

SEQ ID NO: 129372 - RNA, 64 nt, hsa
aaacugacaaagucuaaaugagcacauguaucccagugagcaguaaaucaauggaacaucccaa

SEQ ID NO: 129373 - RNA, 55 nt, hsa
auagcugggugucaggcugaggguuagugagcagguuacacuuaaaaguacuuca

SEQ ID NO: 129374 - RNA, 64 nt, hsa
acagcuucuagugauuucuggggccccaccguaaagugagcaugcuuucugaacucgcuucucu

SEQ ID NO: 129375 - RNA, 64 nt, hsa
ucacuccccuccuuucccaacacuucagacugcaagugagcaaaccugccccaucccgugcaaa

SEQ ID NO: 129376 - RNA, 64 nt, hsa
ucugaguuggaaguugagcuccaccuccuuuccaagugagcacucaguguugaaucacaguuac

SEQ ID NO: 129377 - RNA, 64 nt, hsa
ucauuaggauacaagacagcccagugucaucaacagugagcaaaucuggcaugguguuugucuc

SEQ ID NO: 129378 - RNA, 64 nt, hsa
gggaaggggcucacaugggcccaggcugagugugagugagcaugucaaguugucugacacugug

SEQ ID NO: 129379 - RNA, 64 nt, hsa
gaagaagcucagaggguggggagaagcaugaagcagugagcagagcacugggugagagggagaa

SEQ ID NO: 129380 - RNA, 63 nt, hsa
caagaauauaacugauugaugaaagggcauauuuaggucaauauaaaauaauagcaaguauuu

SEQ ID NO: 129381 - RNA, 63 nt, hsa
aacacaccccaaggaagcaauauuuaauaaaacuaggucaaaaacaaaacaaaacagugacac

SEQ ID NO: 129382 - RNA, 64 nt, hsa; identical to SEQ ID NO: 53437

SEQ ID NO: 129383 - RNA, 64 nt, hsa; identical to SEQ ID NO: 53438

SEQ ID NO: 129384 - RNA, 64 nt, hsa; identical to SEQ ID NO: 53439

SEQ ID NO: 129385 - RNA, 64 nt, hsa; identical to SEQ ID NO: 53440

SEQ ID NO: 129386 - RNA, 64 nt, hsa; identical to SEQ ID NO: 53441

SEQ ID NO: 129387 - RNA, 64 nt, hsa; identical to SEQ ID NO: 53442

SEQ ID NO: 129388 - RNA, 64 nt, hsa; identical to SEQ ID NO: 53443

SEQ ID NO: 129389 - RNA, 64 nt, hsa; identical to SEQ ID NO: 53444

SEQ ID NO: 129390 - RNA, 64 nt, hsa; identical to SEQ ID NO: 53445

SEQ ID NO: 129391 - RNA, 64 nt, hsa; identical to SEQ ID NO: 53446

SEQ ID NO: 129392 - RNA, 64 nt, hsa; identical to SEQ ID NO: 53447

SEQ ID NO: 129393 - RNA, 64 nt, hsa; identical to SEQ ID NO: 53448

SEQ ID NO: 129394 - RNA, 64 nt, hsa; identical to SEQ ID NO: 53449

SEQ ID NO: 129395 - RNA, 64 nt, hsa; identical to SEQ ID NO: 53450

SEQ ID NO: 129396 - RNA, 64 nt, hsa; identical to SEQ ID NO: 53451

SEQ ID NO: 129397 - RNA, 64 nt, hsa; identical to SEQ ID NO: 53452

SEQ ID NO: 129398 - RNA, 64 nt, hsa; identical to SEQ ID NO: 53453

SEQ ID NO: 129399 - RNA, 64 nt, hsa; identical to SEQ ID NO: 53454

SEQ ID NO: 129400 - RNA, 64 nt, hsa
agcagcugcuucaucaaucccaugacacaugccuuguuagcaugcccaucaaauaaucagauca

SEQ ID NO: 129401 - RNA, 64 nt, hsa
agacucaaaauagagaggagacuuuaaacuuacauguuagcauaaaacagacuucucucucauu

SEQ ID NO: 129402 - RNA, 64 nt, hsa
uuucuuucgucuuguauuccuugccacuuuauuuuguuagcaacuucuagauguuuaucuucau

SEQ ID NO: 129403 - RNA, 64 nt, hsa
guuuccauggcucacccuuggcauccauccucgguguuagcagcagcguucccugccuccugca

SEQ ID NO: 129404 - RNA, 64 nt, hsa
uuuuauuuuuguuuuauuaauuuggggaaagggguguuagcauuagugccaugauaucuacugg

SEQ ID NO: 129405 - RNA, 64 nt, hsa
cuuucuaaauaccagcagaagaggcucccgccucuguuagcaugaucaguacuauugugacauu

SEQ ID NO: 129406 - RNA, 64 nt, hsa
uuuccagugaacacagaugcagaaauccuuaaaauguuagcaaaucaggaaugcaagccuuguu

SEQ ID NO: 129407 - RNA, 64 nt, hsa
gugaaaguuuuuggcaaaacuacaaauaggauuauguuagcauuuacacugaggagaaaauugu

SEQ ID NO: 129408 - RNA, 64 nt, hsa
cagacgcuucuuuccugauuaucuuauuucauuguguuagcaaaauaugaccucccuaaaacac

SEQ ID NO: 129409 - RNA, 64 nt, hsa
gucucuguccccaaaauagcugcccuuaaagaguuguuagcagagagaaaaauaacagugaaug

SEQ ID NO: 129410 - RNA, 64 nt, hsa
ccucuagcauuccaaaagguuuuugcuuugaaaguguuagcagaagcauguugaugugaauuau

SEQ ID NO: 129411 - RNA, 64 nt, hsa
uguugaugugaauuaugauuucuucaugugcuacuguuagcacacugaguuuuuauaguugcac

SEQ ID NO: 129412 - RNA, 64 nt, hsa
auaaaagauccuuucuuauaguaagacuugugcuuguuagcagguuuuucuguuaguuuuuccc

SEQ ID NO: 129413 - RNA, 64 nt, hsa
gaugacggggccuccuucuucaaacaggaauuucuguuagcaauauguuagcaagagagggcac

SEQ ID NO: 129414 - RNA, 64 nt, hsa
cuccuucuucaaacaggaauuucuguuagcaauauguuagcaagagagggcacucccaggcccc

SEQ ID NO: 129415 - RNA, 64 nt, hsa
aaugcaucauuccuuuguuguugauaaugggcuuuguuagcacuuuuuaaaacaaacaaacaaa

SEQ ID NO: 129416 - RNA, 64 nt, hsa
cauuacaccaaguccauuuagagauaaugggcuuuguuagcacuuucaaaaaaaaaaaaagcaa

SEQ ID NO: 129417 - RNA, 64 nt, hsa
uucaggcacuuuagaaauauccuuuuagaagcagcgagugcaugggcuaauuaucaucaaucuu

SEQ ID NO: 129418 - RNA, 64 nt, hsa
uacccuucgcuugaggcagaugcagcccuucccccgagugcauggcuuggagagcagaaugugg

SEQ ID NO: 129419 - RNA, 64 nt, hsa
uuccaugccacuaugagucaacucaggaaaacugcgagugcauuugaggcuuagggguagucau

SEQ ID NO: 129420 - RNA, 64 nt, hsa
ccccccgagucucucccugaaggggagcaccgggcgagugcaugugcuacugcugcuacaggcc

SEQ ID NO: 129421 - RNA, 64 nt, hsa
gguuccccauauuauuacaguuccacaucaaggccgagugcaccgcccaccacugccacggccu

SEQ ID NO: 129422 - RNA, 64 nt, hsa
aagucagauaguaaggaugugguaccaauccucccgagugcaaugcuaaacacuuccagguggg

SEQ ID NO: 129423 - RNA, 64 nt, hsa
gcaacugaaaaacugaggaugauuguuagcuccacgagugcaaacugcagucaccaaguaaaac

SEQ ID NO: 129424 - RNA, 64 nt, hsa
gcuggcacagaaggcauuguucccuacccucuggcgagugcaugcagcagagaguuagacagca

SEQ ID NO: 129425 - RNA, 64 nt, hsa
ucucaucaacgggaaaguacuuccucugagagugcgagugcaccaugcucacuguugcugcgug

SEQ ID NO: 129426 - RNA, 64 nt, hsa
ccccuugaccugagacugcggugagucuguaacucgagugcauugagacuuccagaucauuacu

SEQ ID NO: 129427 - RNA, 64 nt, hsa
ugagccccccgaccggcuuagcugugaugggagucgagugcauuugcuuuauaagugaggguag

SEQ ID NO: 129428 - RNA, 64 nt, hsa
cccucucccuuguggacaggcagggagaugcaugcgagugcaugcagcaggggauggggccgug

SEQ ID NO: 129429 - RNA, 64 nt, hsa
gcccccucggggacgcccccaccagcucaaauuccgagugcagaaaagaaaccggaccccccag

SEQ ID NO: 129430 - RNA, 64 nt, hsa
accgcgaacagccucugucugggugggacccccgcgagugcauccagcagcaguagcagggccg

SEQ ID NO: 129431 - RNA, 64 nt, hsa
cucaguuguaacuuggggaaguuaacgauccgcccgagugcagaggaaaaccagaaacgccuug

SEQ ID NO: 129432 - RNA, 64 nt, hsa
cugguaaggagugacaaggaagcucacagcugggcgagugcauuuugaauaguuuuuuguaagu

SEQ ID NO: 129433 - RNA, 64 nt, hsa
cgaucccuccuggcagcuggaacccuggcugugccgagugcaccuagagggcacgcagcgugag

SEQ ID NO: 129434 - RNA, 64 nt, hsa
aaaaaaacccuugauuauacucuguuggacaaaccgagugcaaugaaugaugcuuuucugaaaa

SEQ ID NO: 129435 - RNA, 64 nt, hsa
ggcaaagcggaaugcggcggccaaaaugcugcuucgagugcacacggugccucuggaugcccgg

SEQ ID NO: 129436 - RNA, 64 nt, hsa
gucaugugugccggaggccuucccacuccuacugcgagugcacagacagcacccuccucuccgu

SEQ ID NO: 129437 - RNA, 64 nt, hsa
ucagggaccaggggccuccugcuuuucagaggcccgagugcauuuaucccaaaacgaggcaucu

SEQ ID NO: 129438 - RNA, 64 nt, hsa
cugcaucauccacccacagagaaaugccucugugcgagugcaccgacagaaaacugucagcucu

SEQ ID NO: 129439 - RNA, 64 nt, hsa
accugcauccugcugcacccccacccacgacacucgagugcaagaucgccucacuccuaacccu

SEQ ID NO: 129440 - RNA, 64 nt, hsa
uuuccauuauugcauuacauguuguggaaucucucgagugcaaagacugucuaguuauuuauca

SEQ ID NO: 129441 - RNA, 64 nt, hsa
gugccaccgccagcaagcccagaggcacacaguccgagugcacccgcuuagccuuuacauuccu

SEQ ID NO: 129442 - RNA, 64 nt, hsa
uaugaaaaauucaaggcaguaugcacagaauggacgagugcagcccagcccucaugcccaggau

SEQ ID NO: 129443 - RNA, 64 nt, hsa
ugacucucuaugcaacaccccauccuugccgcaccgagugcacuuuaggggccccuacggccgg

SEQ ID NO: 129444 - RNA, 64 nt, hsa
agcccccugccccaucuucuggcacaggccaucccgagugcaugucccuguugcccacugcacu

SEQ ID NO: 129445 - RNA, 64 nt, hsa
cacaggagggccagcgcuguggaccuuacaacgccgagugcacugcauuccugugcccuagaug

SEQ ID NO: 129446 - RNA, 64 nt, hsa
ugaugguggagcuaagguccaggccucucccucccgagugcauuuuuggggagauaguaaaugu

SEQ ID NO: 129447 - RNA, 64 nt, hsa
cccagagauccggggcccccccacccccaaaucacgagugcagcuggagcuugcucccccuugu

SEQ ID NO: 129448 - RNA, 64 nt, hsa
gccagaaaccccaaagucugggagcugcaccuuccgagugcaggccaugugagcccugccucuu

SEQ ID NO: 129449 - RNA, 64 nt, hsa
uggagauggagucucgcucuguugcccaggcuggcgagugcaauggcgcgaucuuggcucacug

SEQ ID NO: 129450 - RNA, 64 nt, hsa
acacuguggaaaauaccuuugcagacguggcacccgagugcacacaccgaccgccacaugugcu

SEQ ID NO: 129451 - RNA, 64 nt, hsa
auguggaaaacccuucaguuuccuuacaggcuuucgagugcacaugagaaugcacacuggagag

SEQ ID NO: 129452 - RNA, 64 nt, hsa
gucuccuuuucgauaugccaaaccaauuuugggucgagugcauuuaacgagaacaaaacaaaag

SEQ ID NO: 129453 - RNA, 64 nt, hsa
gguaaggcaaaaauuguuuaucaaaaauauguuccgagugcaaugcccacugaaagacaaacuu

SEQ ID NO: 129454 - RNA, 64 nt, hsa
uccagugccaugaucccaccugcgaccucuagugcgagugcagagaaggugggaccagggccag

SEQ ID NO: 129455 - RNA, 64 nt, hsa
uccuaugccuuugacaaagauugcaguggccccucgagugcagaggucaucccagguguugcug

SEQ ID NO: 129456 - RNA, 64 nt, hsa
agcuggucauuucgccugggacucggcaccuuuccgagugcagcuggagggaucugagcgcagg

SEQ ID NO: 129457 - RNA, 64 nt, hsa
aucgccaccaguaucaauugugugagcuugggugcgagugcacgcgugcgugaguacggagagu

SEQ ID NO: 129458 - RNA, 64 nt, hsa
auccuccgaaucuggagauguuguagagcuggaacgagugcagaguaggaacgcuuugaugcgc

SEQ ID NO: 129459 - RNA, 64 nt, hsa
uacauggcauaauugaaauacuguuauuuguaaagaguucuauacugccuaccuuagcuaacca

SEQ ID NO: 129460 - RNA, 64 nt, hsa
cuuauuuuagcaaauauuauauuucaugacaauggaguucuagaaagcagcaucuguuuuuugu

SEQ ID NO: 129461 - RNA, 64 nt, hsa
uacuugaauguauacuguagauuuuuaacaaagcgaguucuauauuuauuauguuuaguguggu

SEQ ID NO: 129462 - RNA, 64 nt, hsa
ugaaggaaaaugauacgcaacauaauuaaauuuugaguucuacauaaguaauucaagaaaacaa

SEQ ID NO: 129463 - RNA, 64 nt, hsa
uaacugugaaguuuacauuguaaauaguauuugagaguucuaaauuuugucuuuaacucauaaa

SEQ ID NO: 129464 - RNA, 64 nt, hsa
ggcaacagagcaagacuccaucucaaaaaaaaaagaguucuagcccaggagcgguggcucacac

SEQ ID NO: 129465 - RNA, 64 nt, hsa
aagaaaaucaaaacgcauucuucauucucuauaagaguucuaggcggggcgugguggcucacac

SEQ ID NO: 129466 - RNA, 64 nt, hsa
gacugcuuucaaucucgguuuacguuuagaaauugaguucuacugaguagggcuuccuuaaguu

SEQ ID NO: 129467 - RNA, 64 nt, hsa
cccgaggccagugguugcucggggccuuccgugugaguucuaguguucacuugaugccggggaa

SEQ ID NO: 129468 - RNA, 64 nt, hsa
agaccauccaagccagaaauuauuuaauaaaucagaguucuagcaauagaguccucucccaagu

SEQ ID NO: 129469 - RNA, 64 nt, hsa
gguccaagcagacaggauuccgucaguugugauagaguucuagauuggcaaugcaguuacauug

SEQ ID NO: 129470 - RNA, 64 nt, hsa
ccauuuauauccuauguauaaauuaaaugagguggcuucagaaauggcagaauaaaucuaaagu

SEQ ID NO: 129471 - RNA, 64 nt, hsa
ccuuuaacccuuacauuuauaugauucugggguugcuucagaaguguuauuucaugaaucauuc

SEQ ID NO: 129472 - RNA, 64 nt, hsa
auaauguaaagcuggugaaguuuggccaguuugggcuucagaagucuaagucuagugaagguac

SEQ ID NO: 129473 - RNA, 64 nt, hsa
guauuuuaacuccuaauuuacccuucaggucucagcuucagaacauucacuuauaaagaaaccc

SEQ ID NO: 129474 - RNA, 64 nt, hsa
uugaguucuguaagucuucguguucugacuuacugcuucagagggauuggccuguccccuuucc

SEQ ID NO: 129475 - RNA, 64 nt, hsa
uccagcagccuggcugacccacuauuucuccucugcuucagaggaaacccaggaaaugcccuua

SEQ ID NO: 129476 - RNA, 64 nt, hsa
uggcuuggggaggagucccucuagguagaacacagcuucagaaacuagcuuuaagaaauaauuc

SEQ ID NO: 129477 - RNA, 64 nt, hsa
ugcuuauuagaggacaagaucaggacugcuuucagcuucagaacacuuuugguucagaacagcg

SEQ ID NO: 129478 - RNA, 64 nt, hsa
uuuugaguuccuacaucauuuguccacaaagauggcuucagagagguggucacaugcuuugcuc

SEQ ID NO: 129479 - RNA, 64 nt, hsa
gcucccucuggccagugccagcugugcucagcuggcuucagaaacugcucccugagggggagcg

SEQ ID NO: 129480 - RNA, 64 nt, hsa; identical to SEQ ID NO: 45744

SEQ ID NO: 129481 - RNA, 64 nt, hsa; identical to SEQ ID NO: 45745

SEQ ID NO: 129482 - RNA, 64 nt, hsa; identical to SEQ ID NO: 45746

SEQ ID NO: 129483 - RNA, 64 nt, hsa; identical to SEQ ID NO: 45747

SEQ ID NO: 129484 - RNA, 64 nt, hsa; identical to SEQ ID NO: 45748

SEQ ID NO: 129485 - RNA, 64 nt, hsa; identical to SEQ ID NO: 45749

SEQ ID NO: 129486 - RNA, 64 nt, hsa; identical to SEQ ID NO: 45750

SEQ ID NO: 129487 - RNA, 64 nt, hsa; identical to SEQ ID NO: 45751

SEQ ID NO: 129488 - RNA, 64 nt, hsa; identical to SEQ ID NO: 45752

SEQ ID NO: 129489 - RNA, 64 nt, hsa; identical to SEQ ID NO: 45753

SEQ ID NO: 129490 - RNA, 64 nt, hsa; identical to SEQ ID NO: 45754

SEQ ID NO: 129491 - RNA, 64 nt, hsa; identical to SEQ ID NO: 45755

SEQ ID NO: 129492 - RNA, 64 nt, hsa; identical to SEQ ID NO: 45756

SEQ ID NO: 129493 - RNA, 64 nt, hsa; identical to SEQ ID NO: 45757

SEQ ID NO: 129494 - RNA, 64 nt, hsa; identical to SEQ ID NO: 45758

SEQ ID NO: 129495 - RNA, 64 nt, hsa; identical to SEQ ID NO: 45759

SEQ ID NO: 129496 - RNA, 64 nt, hsa; identical to SEQ ID NO: 45760

SEQ ID NO: 129497 - RNA, 64 nt, hsa; identical to SEQ ID NO: 45761

SEQ ID NO: 129498 - RNA, 64 nt, hsa; identical to SEQ ID NO: 45762

SEQ ID NO: 129499 - RNA, 64 nt, hsa; identical to SEQ ID NO: 45763

SEQ ID NO: 129500 - RNA, 64 nt, hsa; identical to SEQ ID NO: 45764

SEQ ID NO: 129501 - RNA, 64 nt, hsa; identical to SEQ ID NO: 45765

SEQ ID NO: 129502 - RNA, 64 nt, hsa; identical to SEQ ID NO: 45766

SEQ ID NO: 129503 - RNA, 64 nt, hsa; identical to SEQ ID NO: 45767

SEQ ID NO: 129504 - RNA, 64 nt, hsa; identical to SEQ ID NO: 45768

SEQ ID NO: 129505 - RNA, 64 nt, hsa; identical to SEQ ID NO: 45769

SEQ ID NO: 129506 - RNA, 64 nt, hsa; identical to SEQ ID NO: 45770

SEQ ID NO: 129507 - RNA, 64 nt, hsa; identical to SEQ ID NO: 45771

SEQ ID NO: 129508 - RNA, 64 nt, hsa; identical to SEQ ID NO: 45772

SEQ ID NO: 129509 - RNA, 64 nt, hsa; identical to SEQ ID NO: 45773

SEQ ID NO: 129510 - RNA, 64 nt, hsa; identical to SEQ ID NO: 45774

SEQ ID NO: 129511 - RNA, 64 nt, hsa; identical to SEQ ID NO: 45775

SEQ ID NO: 129512 - RNA, 64 nt, hsa; identical to SEQ ID NO: 45776

SEQ ID NO: 129513 - RNA, 64 nt, hsa; identical to SEQ ID NO: 45777

SEQ ID NO: 129514 - RNA, 64 nt, hsa; identical to SEQ ID NO: 45778

SEQ ID NO: 129515 - RNA, 64 nt, hsa; identical to SEQ ID NO: 45779

SEQ ID NO: 129516 - RNA, 64 nt, hsa
caggauggagaagggcaacuugcuuauuaagaucacccagcaaguuaggagugaucagaaccag

SEQ ID NO: 129517 - RNA, 64 nt, hsa
ccauguguacuucugaaaauauuuuaaccagcccacccagcagucaguacacaugccugggcca

SEQ ID NO: 129518 - RNA, 64 nt, hsa
augcuguagaauuuuugucuuaaaaagaccacauacccagcacccaugaaauaaaagauucauc

SEQ ID NO: 129519 - RNA, 64 nt, hsa
acaagauguuuuuauagucuagagccuuuaaaaaacccagcagaauguaauucaguauuuguuu

SEQ ID NO: 129520 - RNA, 64 nt, hsa
cuguuggguuuuccuaugauuuugauguguccugacccagcauauggaugcccuccccuuggag

SEQ ID NO: 129521 - RNA, 64 nt, hsa
aggcccagagaggggcaaccacuggccaagggucacccagcaaguuuuggcuaagagccuggcc

SEQ ID NO: 129522 - RNA, 64 nt, hsa
gacauggaacuuucaaugcuaaaacugggacaguacccagcaaguggggaugguugguccccua

SEQ ID NO: 129523 - RNA, 64 nt, hsa
agccccccuaccuuaggccacccuccucaugcccacccagcaaggggcagaggccacaggccug

SEQ ID NO: 129524 - RNA, 64 nt, hsa
uaccuagggcggcucaacuccucccacagcaccaacccagcauggucccacugaaguccuacua

SEQ ID NO: 129525 - RNA, 64 nt, hsa
aacagucucucccauucucuaguacugcuccccuacccagcagucacuuccaguucauucagcu

SEQ ID NO: 129526 - RNA, 59 nt, hsa
cagccauaguugagcccugauugccacagacccagcacccagcaaaucccucucuaccu

SEQ ID NO: 129527 - RNA, 64 nt, hsa
gccauaguugagcccugauugccacagacccagcacccagcaaaucccucucuaccucccaagg

SEQ ID NO: 129528 - RNA, 64 nt, hsa
ucuucuugcccuaugcagugcaagcucacuucucacccagcaagguugacucaucugccuccau

SEQ ID NO: 129529 - RNA, 64 nt, hsa
gagcagaaacuuguauucucaggauucaggaucuacccagcaccaaagauguauuuucaggaga

SEQ ID NO: 129530 - RNA, 64 nt, hsa
ggccaagaaaguucuaguagugcugcaaacacuaacccagcaguugccccacccuguguaguug

SEQ ID NO: 129531 - RNA, 64 nt, hsa
ggaccaaguccaaggccaggucucagucggugucacccagcaagcaggcagcgccccggcccgc

SEQ ID NO: 129532 - RNA, 64 nt, hsa
gcuguucugaaugcucuaagugcuugcacaccucacccagcaaaacaaaagcuguguggcuccc

SEQ ID NO: 129533 - RNA, 53 nt, hsa
agacauccaucaccuacugagcgacccagcagccaccuccuuccugaacacau

SEQ ID NO: 129534 - RNA, 64 nt, hsa
gagggucgucuggccugcuugcugggucuuuguaacccagcacuuccucuugcccuccuggcuu

SEQ ID NO: 129535 - RNA, 64 nt, hsa
gcaccgcguuuccauagcagcauguccuacggaaacccagcacguguguagagccucgaucguc

SEQ ID NO: 129536 - RNA, 64 nt, hsa
ugaccuccgaaggcccaaauucaugaagcagcaaacccagcagaucuccaccccccugccucag

SEQ ID NO: 129537 - RNA, 64 nt, hsa
acuuucgcagccaucuucccgcucagccccagacacccagcaaucaagccagaugaguaccaca

SEQ ID NO: 129538 - RNA, 64 nt, hsa
gcacugaggugccgugugacgguggccuuggaggacccagcacugacccauagagggcuccucu

SEQ ID NO: 129539 - RNA, 64 nt, hsa
gaggaucuucauguaccugcucuucuguuugcacacccagcauagccuccuugcaggcagaagg

SEQ ID NO: 129540 - RNA, 64 nt, hsa
ugaggguugcaauggggaaaugacuuauaaagucacccagcaggucaacaaugggcccacgacc

SEQ ID NO: 129541 - RNA, 64 nt, hsa
ggagaaugagaacuggaagccacugcuaccgucuacccagcaccaguagugccgaugugccaca

SEQ ID NO: 129542 - RNA, 64 nt, hsa
caugcgguagccuccgcagaggcugggggccuccacccagcagcagaccaaccaggaagcagcu

SEQ ID NO: 129543 - RNA, 64 nt, hsa
ccagcucuggguccucauguaugggcucccaaggacccagcagccuggauccuuccagagcauc

SEQ ID NO: 129544 - RNA, 64 nt, hsa
agcuuccagcuaggccagaagggcaugcucuggaacccagcaggaucacagcugccugugcacg

SEQ ID NO: 129545 - RNA, 64 nt, hsa
ugggggccgugauccugauggucacauugcuuuaacccagcagggcuucggccaggggcuuucc

SEQ ID NO: 129546 - RNA, 64 nt, hsa
gugccagaccuggacuaaacugcaccaaggaaacacccagcagggucuccugugagccggggac

SEQ ID NO: 129547 - RNA, 64 nt, hsa
ucagacuugaaagacugcaauagaaaacucccaaacccagcacuccagacucgagggaagccag

SEQ ID NO: 129548 - RNA, 64 nt, hsa
ugcugaauuuuuccuugaggcuguuuggugugugacccagcaagggcccugugugggacagcag

SEQ ID NO: 129549 - RNA, 64 nt, hsa
cggucacucuccgcugaggacccagggcgucagcacccagcacugccacauguccaccaaggaa

SEQ ID NO: 129550 - RNA, 64 nt, hsa
ucaacagccccaugacuucagcuccaccuggggcacccagcaccccaccacagggcuagaggcc

SEQ ID NO: 129551 - RNA, 64 nt, hsa
caaacugggauggcccaggucccccagcaaggguacccagcaaggguagcuccggggcuuccug

SEQ ID NO: 129552 - RNA, 64 nt, hsa
caguaucaggccugccagacggcacccacccagcacccagcaacuccaacuaacaagaaacuca

SEQ ID NO: 129553 - RNA, 64 nt, hsa
gcuccgucaguaucaggccugccagacggcacccacccagcacccagcaacuccaacuaacaag

SEQ ID NO: 129554 - RNA, 64 nt, hsa
uggcagcagccucaccgaagagaggaaccaccacacccagcagcuccugacagacccccacccc

SEQ ID NO: 129555 - RNA, 64 nt, hsa
ccagauuuacuuuuggggccuguucuaagugcaaacccagcaaguuucacuuguccuguccauu

SEQ ID NO: 129556 - RNA, 64 nt, hsa
gcaaaaaaaaaaaaucucaggccauguugggguaacccagcaagggccagugaugauuuccccc

SEQ ID NO: 129557 - RNA, 64 nt, hsa
uuggauguccaaauuugaacuccuuccuaaagaaacccagcagccaccuugaaaaaggccauug

SEQ ID NO: 129558 - RNA, 64 nt, hsa; identical to SEQ ID NO: 97314

SEQ ID NO: 129559 - RNA, 64 nt, hsa; identical to SEQ ID NO: 97315

SEQ ID NO: 129560 - RNA, 64 nt, hsa; identical to SEQ ID NO: 97316

SEQ ID NO: 129561 - RNA, 64 nt, hsa; identical to SEQ ID NO: 97317

SEQ ID NO: 129562 - RNA, 64 nt, hsa; identical to SEQ ID NO: 97318

SEQ ID NO: 129563 - RNA, 64 nt, hsa; identical to SEQ ID NO: 97319

SEQ ID NO: 129564 - RNA, 64 nt, hsa; identical to SEQ ID NO: 97320

SEQ ID NO: 129565 - RNA, 64 nt, hsa; identical to SEQ ID NO: 97321

SEQ ID NO: 129566 - RNA, 64 nt, hsa; identical to SEQ ID NO: 97322

SEQ ID NO: 129567 - RNA, 64 nt, hsa; identical to SEQ ID NO: 97323

SEQ ID NO: 129568 - RNA, 64 nt, hsa; identical to SEQ ID NO: 97324

SEQ ID NO: 129569 - RNA, 64 nt, hsa; identical to SEQ ID NO: 97325

SEQ ID NO: 129570 - RNA, 64 nt, hsa; identical to SEQ ID NO: 97326

SEQ ID NO: 129571 - RNA, 64 nt, hsa; identical to SEQ ID NO: 97327

SEQ ID NO: 129572 - RNA, 64 nt, hsa; identical to SEQ ID NO: 97328

SEQ ID NO: 129573 - RNA, 64 nt, hsa; identical to SEQ ID NO: 97329

SEQ ID NO: 129574 - RNA, 64 nt, hsa; identical to SEQ ID NO: 97330

SEQ ID NO: 129575 - RNA, 64 nt, hsa; identical to SEQ ID NO: 97331

SEQ ID NO: 129576 - RNA, 61 nt, hsa
aacagaggaggccagugaggcagagacagagcucucccacucucagacccucuuuugucuu

SEQ ID NO: 129577 - RNA, 61 nt, hsa
cacucucagacccucuuuugucuucauuuuccucucccacuuagcacaugugugcuugagg

SEQ ID NO: 129578 - RNA, 61 nt, hsa
aaauauauuuauuuuuuuaccauaccaacuucucucccaucucuagguggcucaguccaug

SEQ ID NO: 129579 - RNA, 61 nt, hsa
aggccccagagcgagcuuccccuccucccugcucucccaggccccugccacagccucuuuc

SEQ ID NO: 129580 - RNA, 61 nt, hsa
acagcccuccucucccaagaaauccaggcuccucucccaagaaauccaggugcuuuccaga

SEQ ID NO: 129581 - RNA, 61 nt, hsa
agaagaacugauuggggcuuccacagcccuccucucccaagaaauccaggcuccucuccca

SEQ ID NO: 129582 - RNA, 61 nt, hsa
auaaaacgguagaauaugaaaagcucaggaucucucccaaggcuaccuacugcaggagggc

SEQ ID NO: 129583 - RNA, 61 nt, hsa
gcuuuguuuccuguucaccagcaaaaaaugucucucccauuuuucugaaaguggcugaugu

SEQ ID NO: 129584 - RNA, 61 nt, hsa
cuucuuccuccagcagcgggaacugccacugcucucccaggcccuguucuggaggcuaacc

SEQ ID NO: 129585 - RNA, 61 nt, hsa
cacugaaaacaaagccaagccucugcccugccucucccagcucccacaaggguuccaggaa

SEQ ID NO: 129586 - RNA, 61 nt, hsa
gcccacgugagcaccugucucccacucaaaccucucccaucucccaacaacugcacuuuag

SEQ ID NO: 129587 - RNA, 61 nt, hsa
auccuugccacugucuugcuuuuauuuuuuacucucccacugagcaagcgucugugguccu

SEQ ID NO: 129588 - RNA, 61 nt, hsa
agcugccaguguugcuuuucuguugguagagcucucccauuuggugacauggaaaauaccu

SEQ ID NO: 129589 - RNA, 61 nt, hsa
uacuaaauccaguagaugggcuguguagcaacucucccagggaacacacuaggguacuuag

SEQ ID NO: 129590 - RNA, 61 nt, hsa
cugggcguguaguguaacuggaaucuuuugccucucccagccaccuccucccagcccccca

SEQ ID NO: 129591 - RNA, 61 nt, hsa
uguuuuuuugggugguggcuggaaacagccccucucccacguggcagaggcucagccuggc

SEQ ID NO: 129592 - RNA, 61 nt, hsa
gugagacaguccacccagagcucucccaagucucucccaaauaccuuagaguagggacacu

SEQ ID NO: 129593 - RNA, 61 nt, hsa
auuugaacagggugagacaguccacccagagcucucccaagucucucccaaauaccuuaga

SEQ ID NO: 129594 - RNA, 61 nt, hsa
ugcauuuucuaagugggacauucaaaaaacucucucccaggaccucggaugaccauacuca

SEQ ID NO: 129595 - RNA, 61 nt, hsa
uuuuuuuuuuaaguuucacucacauagccaacucucccaaagggcacaccccuggggcuga

SEQ ID NO: 129596 - RNA, 61 nt, hsa
cuucuuguggcacaggaaagcugcccucucccucucccaccacacuccugacuaauggccu

SEQ ID NO: 129597 - RNA, 61 nt, hsa
aggucagcacugggggaaacuugcugguggucucucccacaaccuugcccagaguccuuuc

SEQ ID NO: 129598 - RNA, 61 nt, hsa
gggugaccuuucuggucuuugcacuuccauccucucccacuuccaucuggcaucccacgcg

SEQ ID NO: 129599 - RNA, 61 nt, hsa
acaauugucacaugaccgguacuggaagaaacucucccauccaacaucacccaguggaugg

SEQ ID NO: 129600 - RNA, 61 nt, hsa
uuaauuguuaugaaaauggaucuuuucuugacucucccacaugcucuguuaugggagagaa

SEQ ID NO: 129601 - RNA, 61 nt, hsa
cucgccucucccgccucgauccugcaccuuccucucccaggucgcugcugcagccaaccca

SEQ ID NO: 129602 - RNA, 61 nt, hsa
agccccacacuggggugccgccugcccgucucucucccauggagccccagcccccuuuggg

SEQ ID NO: 129603 - RNA, 61 nt, hsa
cuugcuggggacggggggccccagucagccucucucccagucuacccagagaagccccuuc

SEQ ID NO: 129604 - RNA, 61 nt, hsa
ccugggcaggcugcagccucaugccaugucucucucccacuaccugaugggcacauggaca

SEQ ID NO: 129605 - RNA, 61 nt, hsa
guccucucagcccugccugcccuggccugggcucucccagccucccagcccucugcccccu

SEQ ID NO: 129606 - RNA, 61 nt, hsa
ucgugggaaacagcaaaacacuaagccugaccucucccaaauugggaagaccagaggagaa

SEQ ID NO: 129607 - RNA, 61 nt, hsa
uccugcaucuuuccuuaagggaagccccauccucucccaggaccaggaguuuaugaccagg

SEQ ID NO: 129608 - RNA, 61 nt, hsa
gguccagucaucccagugggcuucucuuugucucucccagauuagaccuuugggugagauu

SEQ ID NO: 129609 - RNA, 61 nt, hsa
gcuccuuuuccccuucccucccaccagauugcucucccaccuuucauuucuuccuccaggc

SEQ ID NO: 129610 - RNA, 61 nt, hsa
gggcuccaaauuccucuugugaucuccucaccucucccacuccauugauaccaacucuuuc

SEQ ID NO: 129611 - RNA, 61 nt, hsa
ucauuuuuuuggucacccuuuaaguguccuucucucccaggaugagugaggagcugugcug

SEQ ID NO: 129612 - RNA, 61 nt, hsa
ccugucccaucugcagccacacuacucgcuccucucccaacaacucccuucguggggacaa

SEQ ID NO: 129613 - RNA, 61 nt, hsa
ggggcagcuuucuuuggggcuucagugagaacucucccaguugcccuuggugggguuucca

SEQ ID NO: 129614 - RNA, 61 nt, hsa
uuggcaggacggcuacgagcagcuuaggcagcucucccagcacgccaugaagggggucauc

SEQ ID NO: 129615 - RNA, 61 nt, hsa
uguuuguggucuguguugacagccacccacccucucccaccucaugcuccugcaccugcac

SEQ ID NO: 129616 - RNA, 61 nt, hsa
cccccaccaccaccgacucucccaacccagacucucccacuccagaauguagaagccuguc

SEQ ID NO: 129617 - RNA, 61 nt, hsa
uuagauaaagaugagcccccaccaccaccgacucucccaacccagacucucccacuccaga

SEQ ID NO: 129618 - RNA, 61 nt, hsa
aaagguggggagaagggauccuaaucccuuccucucccauucacccuguguaacaggaccc

SEQ ID NO: 129619 - RNA, 61 nt, hsa
uggcaggaucggcuuccucaggggcacagaccucucccacccacaagaacuccucccaccc

SEQ ID NO: 129620 - RNA, 61 nt, hsa
gcuucaucacauugggagguucagagcauuacucucccacugugccugccauccaggcagc

SEQ ID NO: 129621 - RNA, 61 nt, hsa
cggcccauagacaaguggcgcugggguuucccucucccagaaccgcugccaccaccgccac

SEQ ID NO: 129622 - RNA, 61 nt, hsa
caucugucccugaccucuaaccuuucucugccucucccacacucucccagagcucacugau

SEQ ID NO: 129623 - RNA, 61 nt, hsa
ugaccucuaaccuuucucugccucucccacacucucccagagcucacugauuagacagcac

SEQ ID NO: 129624 - RNA, 61 nt, hsa
gugguuggaggucuguggagucaaggucccccucucccaggcaggcucucugagggcauuc

SEQ ID NO: 129625 - RNA, 61 nt, hsa
cuccacaucuucugccccaguguguccccaccucucccagccuguauacccagauuacuuu

SEQ ID NO: 129626 - RNA, 61 nt, hsa
aucacuucccucacugcccuacccaggcuuucucucccacuucccugacucugggaauaac

SEQ ID NO: 129627 - RNA, 61 nt, hsa
auccuggggauccagcggauggacagcuuggcucucccagagaggugaaggagcaccuggc

SEQ ID NO: 129628 - RNA, 61 nt, hsa
ccuguuuuccuuccucugcuaucucucacaccucucccagacuaugucaucuuguucuccu

SEQ ID NO: 129629 - RNA, 61 nt, hsa
ugcucuaguguucugucucccagucaccucgcucucccagcaccagugcccuucuccugcu

SEQ ID NO: 129630 - RNA, 61 nt, hsa
gcuuugacucaugccuuacuccauggccacccucucccaaagagggggcucgcuuccccca

SEQ ID NO: 129631 - RNA, 61 nt, hsa
uucccugcuuggaagcguggggucucccuggcucucccaggauaccaugcuguccucuuag

SEQ ID NO: 129632 - RNA, 61 nt, hsa
acagcugcagggggaccccagugccaacuuccucucccacuagggcccugccuucagcugg

SEQ ID NO: 129633 - RNA, 61 nt, hsa
cauaucagcuuucacacuuuccccaugcacucucucccacccccuuccagggccucugcuc

SEQ ID NO: 129634 - RNA, 61 nt, hsa
cuugaagacucccugaucccagaccugucgucucucccacccccuccccaaagccacugga

SEQ ID NO: 129635 - RNA, 61 nt, hsa
ggcuuggcuuuacuuugagcccccaaccccccucucccagcccugguaggguuccccaacc

SEQ ID NO: 129636 - RNA, 61 nt, hsa
gccaccacucccuuagucuuucccaggcuuacucucccaauaaaugugcuagagcucugcc

SEQ ID NO: 129637 - RNA, 61 nt, hsa
aacuagaacacccaacaccaaacuguacagacucucccaccccaaccuccccagacucugc

SEQ ID NO: 129638 - RNA, 61 nt, hsa
ugggaccugcaucugaugcuggggccagggacucucccacgcacgagcuagugaguggcac

SEQ ID NO: 129639 - RNA, 61 nt, hsa
aaauuuaagagggugggacaguccccugcuccucucccagagggcacugcuuggaaauugu

SEQ ID NO: 129640 - RNA, 61 nt, hsa
ugggacaucuucagcccuuuuauuaccacuccucucccauuuguggcaguuugcguuuacu

SEQ ID NO: 129641 - RNA, 61 nt, hsa
aaccuuccccacacucagcuccaaacgccuccucucccaggucaucugccugcccacacgc

SEQ ID NO: 129642 - RNA, 61 nt, hsa
uccagccugggugacagaguuagauuccacccucucccaccccggcaaaaaaaaaaaaaaa

SEQ ID NO: 129643 - RNA, 61 nt, hsa
uuguccaggggagccuggcggcgcaucccuccucucccaccuccuggcacuuccagcuggg

SEQ ID NO: 129644 - RNA, 61 nt, hsa
uccccaggccuugccugaggggucaggcugccucucccaacacacacucagauagcacaaa

SEQ ID NO: 129645 - RNA, 61 nt, hsa
uccuugcccuagcacacugggacuggccccacucucccagcuggacuccugcaugcuccuc

SEQ ID NO: 129646 - RNA, 64 nt, hsa; identical to SEQ ID NO: 117329

SEQ ID NO: 129647 - RNA, 64 nt, hsa; identical to SEQ ID NO: 117330

SEQ ID NO: 129648 - RNA, 64 nt, hsa; identical to SEQ ID NO: 117331

SEQ ID NO: 129649 - RNA, 64 nt, hsa; identical to SEQ ID NO: 117332

SEQ ID NO: 129650 - RNA, 64 nt, hsa; identical to SEQ ID NO: 117333

SEQ ID NO: 129651 - RNA, 64 nt, hsa; identical to SEQ ID NO: 117334

SEQ ID NO: 129652 - RNA, 64 nt, hsa; identical to SEQ ID NO: 117335

SEQ ID NO: 129653 - RNA, 64 nt, hsa; identical to SEQ ID NO: 117336

SEQ ID NO: 129654 - RNA, 64 nt, hsa; identical to SEQ ID NO: 117337

SEQ ID NO: 129655 - RNA, 64 nt, hsa; identical to SEQ ID NO: 117338

SEQ ID NO: 129656 - RNA, 64 nt, hsa; identical to SEQ ID NO: 117339

SEQ ID NO: 129657 - RNA, 64 nt, hsa; identical to SEQ ID NO: 117340

SEQ ID NO: 129658 - RNA, 64 nt, hsa; identical to SEQ ID NO: 117341

SEQ ID NO: 129659 - RNA, 64 nt, hsa; identical to SEQ ID NO: 117342

SEQ ID NO: 129660 - RNA, 64 nt, hsa; identical to SEQ ID NO: 117343

SEQ ID NO: 129661 - RNA, 64 nt, hsa; identical to SEQ ID NO: 117344

SEQ ID NO: 129662 - RNA, 64 nt, hsa; identical to SEQ ID NO: 117345

SEQ ID NO: 129663 - RNA, 64 nt, hsa; identical to SEQ ID NO: 117346

SEQ ID NO: 129664 - RNA, 64 nt, hsa; identical to SEQ ID NO: 117347

SEQ ID NO: 129665 - RNA, 64 nt, hsa; identical to SEQ ID NO: 117348

SEQ ID NO: 129666 - RNA, 64 nt, hsa; identical to SEQ ID NO: 117349

SEQ ID NO: 129667 - RNA, 64 nt, hsa; identical to SEQ ID NO: 117350

SEQ ID NO: 129668 - RNA, 64 nt, hsa; identical to SEQ ID NO: 117351

SEQ ID NO: 129669 - RNA, 64 nt, hsa; identical to SEQ ID NO: 117352

SEQ ID NO: 129670 - RNA, 64 nt, hsa; identical to SEQ ID NO: 117353

SEQ ID NO: 129671 - RNA, 64 nt, hsa; identical to SEQ ID NO: 117354

SEQ ID NO: 129672 - RNA, 64 nt, hsa; identical to SEQ ID NO: 117355

SEQ ID NO: 129673 - RNA, 64 nt, hsa; identical to SEQ ID NO: 117356

SEQ ID NO: 129674 - RNA, 64 nt, hsa; identical to SEQ ID NO: 117357

SEQ ID NO: 129675 - RNA, 64 nt, hsa; identical to SEQ ID NO: 117358

SEQ ID NO: 129676 - RNA, 64 nt, hsa; identical to SEQ ID NO: 117359

SEQ ID NO: 129677 - RNA, 64 nt, hsa; identical to SEQ ID NO: 117360

SEQ ID NO: 129678 - RNA, 64 nt, hsa; identical to SEQ ID NO: 117361

SEQ ID NO: 129679 - RNA, 64 nt, hsa; identical to SEQ ID NO: 117362

SEQ ID NO: 129680 - RNA, 62 nt, hsa
auccaugauucugcuuugguccaauugcuuccucucugcagaggaacaacccuaaaaccaga

SEQ ID NO: 129681 - RNA, 62 nt, hsa
ggagaagguugcuucauuggcccugggacuucucucugcaggaggagagaacgcugccucuc

SEQ ID NO: 129682 - RNA, 62 nt, hsa
uuucauccuucaguuguauuuagcuuugaguuucucugcaucuguccaccccauguguauau

SEQ ID NO: 129683 - RNA, 62 nt, hsa
ccagggcgugcuccaggcaccucuuccugaagucucugcauuuggagauucguggagaaccu

SEQ ID NO: 129684 - RNA, 62 nt, hsa
augcuauagauugacacccuccugccuguuuuucucugcaucccaaccuggccaaggccccu

SEQ ID NO: 129685 - RNA, 62 nt, hsa
cuugacuguggcauugcacucugcacuguuucucucugcagaccuaggggaaaacugcaggu

SEQ ID NO: 129686 - RNA, 62 nt, hsa
gggaccuuugauugucuuuccagagaugcugcucucugcagggcaccaccuucaaggcacag

SEQ ID NO: 129687 - RNA, 62 nt, hsa
uagcaaaucuuacagaagguccugugugacccucucugcaucuguccccaggaccuaugcuc

SEQ ID NO: 129688 - RNA, 62 nt, hsa
uuuguggaaccauuguuuguuaauguugggauucucugcacuuuugaaugugaaagcuuaua

SEQ ID NO: 129689 - RNA, 62 nt, hsa
uucuaauagguauuuagaagcacuugaaauaaucucugcauguguuacaauucaguuauuuc

SEQ ID NO: 129690 - RNA, 62 nt, hsa
cccagggguccugaggguuucagcaccaggguucucugcagccacacaaucagcccggcucg

SEQ ID NO: 129691 - RNA, 62 nt, hsa
cucacaacccgagauagguacuguuaccauccucucugcagacgaggaaaccgaggaccagg

SEQ ID NO: 129692 - RNA, 62 nt, hsa
uuaauuucuucccccaaagccggauucuuaauucucugcaacacuuugaggacauuuaugau

SEQ ID NO: 129693 - RNA, 62 nt, hsa
ccauccagcgagagaguuucaaaagcaaaacaucucugcaguuuuucccaaguacccugaga

SEQ ID NO: 129694 - RNA, 51 nt, hsa; identical to SEQ ID NO: 83452

SEQ ID NO: 129695 - RNA, 62 nt, hsa
aacaaacuccuaguccuuuagaaauaacagauucucugcacaaaaccacccauucauucauu

SEQ ID NO: 129696 - RNA, 62 nt, hsa
cuuccuccugcgccugguugauucagcccaccucucugcaucccgcuucccgcgucucuucu

SEQ ID NO: 129697 - RNA, 62 nt, hsa
ccaccucucugcaucccgcuucccgcgucucuucucugcacuccugccgaccuucccaccug

SEQ ID NO: 129698 - RNA, 62 nt, hsa
gagaggaggccgcacucucccugucucucccgucucugcacccagcuccucucugcaugcug

SEQ ID NO: 129699 - RNA, 62 nt, hsa
ucccugucucucccgucucugcacccagcuccucucugcaugcugagggcuaaauugggauc

SEQ ID NO: 129700 - RNA, 62 nt, hsa
ugagggguuuuuuuaaccucagagcuagcugcucucugcagccuccuccacuggcuucucug

SEQ ID NO: 129701 - RNA, 62 nt, hsa
aagagucaccccagcugcugggcuccucugccucucugcagcagaauguccguccucuguug

SEQ ID NO: 129702 - RNA, 62 nt, hsa
auuuuucucuuaaaaaagaagacuuguguaagucucugcaucaacgccaauaaacauguugc

SEQ ID NO: 129703 - RNA, 62 nt, hsa
gauagcaaaauauacuguguauucagagggccucucugcagcugcuagcucagacaccaaag

SEQ ID NO: 129704 - RNA, 62 nt, hsa
agaagagcagaggucuucucugcaccaaccacucucugcagauggcuggagaaagggugugc

SEQ ID NO: 129705 - RNA, 62 nt, hsa
ccuugucaaggugggcagaagagcagaggucuucucugcaccaaccacucucugcagauggc

SEQ ID NO: 129706 - RNA, 62 nt, hsa
gcugcacugcaaagggaguaacggacucugcuucucugcagugcaaaggguguaagggacuc

SEQ ID NO: 129707 - RNA, 62 nt, hsa
gaggcaguuccuaccuugggaauggaagauuuucucugcaguuugcugaggcccaggagggg

SEQ ID NO: 129708 - RNA, 62 nt, hsa
gucuuuucuuggcguuccugccaggcucucccucucugcaccugucucauagccucgaauau

SEQ ID NO: 129709 - RNA, 62 nt, hsa
cucauucauauuccugccuuucuuccaucagcucucugcaaagaugauuuugcuuuucccua

SEQ ID NO: 129710 - RNA, 62 nt, hsa
gcccaccccaagcuccgacauugagguuuucaucucugcagggagagguuccaauguccacc

SEQ ID NO: 129711 - RNA, 62 nt, hsa
cuccagcccaaaaccgugaggaaggugauauaucucugcauuuucccuuguuguugcuugaa

SEQ ID NO: 129712 - RNA, 62 nt, hsa
gcaacuuccuaagcugccccugccccagcuccucucugcaacccagcccucuccugagcucu

SEQ ID NO: 129713 - RNA, 62 nt, hsa
ucccaccgcggccccugccuggccaccuggccucucugcaccagggugacaagggguccucg

SEQ ID NO: 129714 - RNA, 62 nt, hsa
cccuagccgccaccccacguuucuguaccgggucucugcaguguuaaacggacguguaaaua

SEQ ID NO: 129715 - RNA, 62 nt, hsa
gucccagccugggacaggcccccuuuccccucucucugcaggccaggagggccuccuuccug

SEQ ID NO: 129716 - RNA, 62 nt, hsa
ggucucccccucuucucugcccuccacccccgucucugcacugagauacauaagaaacaagg

SEQ ID NO: 129717 - RNA, 62 nt, hsa
gaccaugggaccaccaagcucuaggucauccaucucugcauccaaauaguagggaaacgugg

SEQ ID NO: 129718 - RNA, 62 nt, hsa
uggcuuuugcugcucuguucucccucuacauuucucugcagaacucgcguuagaaacacaga

SEQ ID NO: 129719 - RNA, 62 nt, hsa
ugcacuugcugucugcggagccagugugccauucucugcacaugggcagccagccugagcug

SEQ ID NO: 129720 - RNA, 62 nt, hsa
caaguccacaccuggccuuggcugcugcccgcucucugcagcguggauuuccuuugcccauu

SEQ ID NO: 129721 - RNA, 62 nt, hsa
caugcugcucaaaucuucacagaguggaucuuucucugcaguacuguauccacacgagccaa

SEQ ID NO: 129722 - RNA, 62 nt, hsa
guuuggagauuacagguccuaucaugccucauucucugcauucacugaccaugcugcucaaa

SEQ ID NO: 129723 - RNA, 62 nt, hsa
ccugagcgccgccucugugcccaggucccauuucucugcagcacuggccccuuggugcacac

SEQ ID NO: 129724 - RNA, 62 nt, hsa
ggugggagggccucccuggcuugggagaccgcucucugcaagggagggggagagaagcagag

SEQ ID NO: 129725 - RNA, 62 nt, hsa
ccucagucuccagccugggcugccgagggcuaucucugcagaaugaguugugaucauuguca

SEQ ID NO: 129726 - RNA, 62 nt, hsa
gucugcauggguagcaggcugcaggaguggggucucugcacagccugggauggggcuugggg

SEQ ID NO: 129727 - RNA, 62 nt, hsa
cuuuucccuuauggcucugaggccaucggcugucucugcauuucauuggcuguggaggagag

SEQ ID NO: 129728 - RNA, 62 nt, hsa
uuuacacuacuuuuucuuccccuuccucuugcucucugcacaccccauucuuaaacuccucc

SEQ ID NO: 129729 - RNA, 62 nt, hsa
uauuagggugcuguuuguuauugagagcccaaucucugcaugaauaacagaaagguggacau

SEQ ID NO: 129730 - RNA, 64 nt, hsa
ccuggcucccucugggucauauggugcagacugugaccagcaccaggcaggcaguccugucugc

SEQ ID NO: 129731 - RNA, 64 nt, hsa
acccugcuugaagcgcagaaggcacagccuuacugaccagcacgcccacugacuggcaucugcc

SEQ ID NO: 129732 - RNA, 64 nt, hsa
acugcuccacuccacacucacaccucuauucacagaccagcaucuccucuccuuaucaggaaca

SEQ ID NO: 129733 - RNA, 64 nt, hsa
auuguuuuuguaacuugcauuuuacaagaguucugaccagcaccagauaagcuucagugcucuc

SEQ ID NO: 129734 - RNA, 64 nt, hsa
auuccccacucucacuaacauugcuuccuuuuuugaccagcaggaaacagcaggucuggccaga

SEQ ID NO: 129735 - RNA, 64 nt, hsa
aagagucuggccucccuccagcccugggcagacugaccagcaagguggaccuuuacauucaagc

SEQ ID NO: 129736 - RNA, 64 nt, hsa
ggauggaggggugguccugacucaacauguuacugaccagcaacuugucuuuuucuggacugaa

SEQ ID NO: 129737 - RNA, 64 nt, hsa
gccugggaauguauuauucugcagcaugaccugugaccagcacugucucaguuucacuuucaca

SEQ ID NO: 129738 - RNA, 64 nt, hsa
guuuaauguugcuucacuuaucccacccuacagagaccagcaagguucugccaggccucgagca

SEQ ID NO: 129739 - RNA, 64 nt, hsa
auuuacuguugcuucauuuaucccauccuucagagaccagcaagguucugccaggccccaagca

SEQ ID NO: 129740 - RNA, 64 nt, hsa
gaccagagccuugcaacucaaaguguggucuguggaccagcagcggcagugacaccugggagcu

SEQ ID NO: 129741 - RNA, 64 nt, hsa
cugcagggcaagaacauucauguaggagcccgaggaccagcaggcugggaauggggagcaaguc

SEQ ID NO: 129742 - RNA, 64 nt, hsa
gugugugugugagagagagagagagagagagagagaccagcaucuucaagagaaguauucugcu

SEQ ID NO: 129743 - RNA, 64 nt, hsa
ccgccugcccuccugcccacccucccacccacccgaccagcagagcuuuuuaauacaagaaaac

SEQ ID NO: 129744 - RNA, 64 nt, hsa
uccaccccuuccagaccaagcucaacgccuccaagaccagcaggccaaggccaagcccugcccc

SEQ ID NO: 129745 - RNA, 64 nt, hsa
cugagccucgggacucaguggacaccaaagucaagaccagcacccaccacgggcccugccagcc

SEQ ID NO: 129746 - RNA, 64 nt, hsa
uuuucuaccuaaggaccagaauuuuuuaucuagagaccagcauguucuccccaaagaccaagau

SEQ ID NO: 129747 - RNA, 64 nt, hsa
uuuucuaccuaaggaccagaauuuuuugucuagagaccagcauguucuccccaaagaccagaau

SEQ ID NO: 129748 - RNA, 64 nt, hsa
uuuucuaccuaaagaccaggacuuuuuaucuagagaccagcauguucuccccaaagacuggaau

SEQ ID NO: 129749 - RNA, 64 nt, hsa
uucauuggguuuuauaguggcuuucugauuuuugguaguccauugaagaagggaguuugaaagu

SEQ ID NO: 129750 - RNA, 64 nt, hsa
cccaggaaggccgggguggaucccucuuuguguuguaguccaugcuauuaaaaguguggcccac

SEQ ID NO: 129751 - RNA, 64 nt, hsa
cauaucagcugaagucugccuguggauucuccuuguaguccagaucuacuaucugcaacucuuu

SEQ ID NO: 129752 - RNA, 64 nt, hsa
acgccacgcgcaucucuuguucuguguucaaucaguaguccaggggagaagcuucugcuacuuc

SEQ ID NO: 129753 - RNA, 64 nt, hsa
ucuuuuugaaauuuuaucaguaauccagaauuuaguaguccaugccuucucacucagcauuuag

SEQ ID NO: 129754 - RNA, 64 nt, hsa
uauuucguuagauugacacuuccacacacucccuguaguccagguagggcccagaaauaggaaa

SEQ ID NO: 129755 - RNA, 64 nt, hsa
ugggaccaaugaaagcauggcugagaaauagcagguaguccaggauagucuaagggagguguuc

SEQ ID NO: 129756 - RNA, 64 nt, hsa
ggaaaugccugaccucucagucuggcucugcuguguaguccauagcccagccagaugagcuugc

SEQ ID NO: 129757 - RNA, 64 nt, hsa
ucauauuuggaacuuuguaauagcgggaguagcaguaguccaaaccuaguauagggaaaggaua

SEQ ID NO: 129758 - RNA, 64 nt, hsa
ugacucagccccuuguguuuacagacaaggacauguaguccaagguugcauggugaguucacag

SEQ ID NO: 129759 - RNA, 64 nt, hsa
gaugcuccaucugcuucucccccuuucucuugcuguaguccaaugugcuaugagcaucagcuua

SEQ ID NO: 129760 - RNA, 64 nt, hsa
cucauuauagucuaaaagcaaaauaaauucugaaguaguccaauaacagaacuguaugaccccu

SEQ ID NO: 129761 - RNA, 64 nt, hsa
aggaaaugauaaggaagaccaggaggagcucuucguaguccagaaagguagaagugggaguugu

SEQ ID NO: 129762 - RNA, 64 nt, hsa
gcgagccaaccccaccucuaugcccugagcccugguaguccagagaccccaacucugcccuggc

SEQ ID NO: 129763 - RNA, 64 nt, hsa
cuuaaagaagaaaaacauguauaaaauaguuuuaguaguccaaaaugucaacuaucuguagcug

SEQ ID NO: 129764 - RNA, 64 nt, hsa
accacaauaucauuuauaauugaugucaauauuaguaguccacuuuaugcuuaaaauaaaauca

SEQ ID NO: 129765 - RNA, 64 nt, hsa
uuucucaaugcuucuaauauuuaacaaucuccauguaguccaaauuugucauuaaaaaaaaauc

SEQ ID NO: 129766 - RNA, 64 nt, hsa
guaacaugaaaaugauuauucugcauuuuauucaguaguccaaauuaaagaaaauguuuuucuc

SEQ ID NO: 129767 - RNA, 64 nt, hsa
agaggcuucccuaguuuacaagucagagucacuuguaguccauuuaaaugcccucauccguauu

SEQ ID NO: 129768 - RNA, 64 nt, hsa
gagacagucuaguuuaaaaggcuuagguccuuuuguaguccauaagcauggugauuugguuuca

SEQ ID NO: 129769 - RNA, 64 nt, hsa
uucacgcccacccacccccuggcccugccagcugguaguccaucagcacaaugaaggagacuug

SEQ ID NO: 129770 - RNA, 64 nt, hsa
gaugcuauggcaagaaucuuuuuguguuuggaguguaguccauuugcaauagaaauaaaaaaau

SEQ ID NO: 129771 - RNA, 64 nt, hsa
ugaaugcuaaggcugaaaucccaaccugagauuuguaguccaggauuacaaccagaaggaaagu

SEQ ID NO: 129772 - RNA, 64 nt, hsa
cauugcccuuugggggugcccugggaucccugggguaguccagcucuucuucauuucccagcgu

SEQ ID NO: 129773 - RNA, 64 nt, hsa
auagaucucaaauagagaccuguugguugcuaggguaguccagacaccccuuagaugucuucau

SEQ ID NO: 129774 - RNA, 64 nt, hsa
uucauguaugaccuacuuguaauuaacuugaguuguaguccacagccucaggacaaaugucguu

SEQ ID NO: 129775 - RNA, 64 nt, hsa
cagcuuuccauguaacuguaugcauaaagccaauguaguccaguuucuaagaucauguuccaag

SEQ ID NO: 129776 - RNA, 64 nt, hsa
augucuguagucccagcuacuugggcacacgccuguaguccaggccacucgagcacacaccugu

SEQ ID NO: 129777 - RNA, 64 nt, hsa
aaacuuagccggguaugguggugcaugugugccuguaguccaagcuacuugaaggcugagacag

SEQ ID NO: 129778 - RNA, 64 nt, hsa
ucugauaaauccugugaagcgucugauaaauccuguaguccaagcucaggcauaauucagcaua

SEQ ID NO: 129779 - RNA, 64 nt, hsa
uaauuuuaaaaauagauaccuguuugacuuugagguaguccagaccuuuucuuuuuuuuuuuuu

SEQ ID NO: 129780 - RNA, 64 nt, hsa
ucaacuguacuuggagaaaucguguuuuaaagcaguaguccacaaaguauucugcucaugugcc

SEQ ID NO: 129781 - RNA, 64 nt, hsa
aggcuuuucuuccccugaccaaaacuccuucccuguaguccagcugagggacacacaucccugg

SEQ ID NO: 129782 - RNA, 64 nt, hsa
gacgcuagauuuuuuuuucuaagggugaauacuaguaguccaggcuugauuuggagggugaaug

SEQ ID NO: 129783 - RNA, 64 nt, hsa
guucugggaaaauaccacauucuuuuugacugcuguaguccauaugugaauacuaaauguuaaa

SEQ ID NO: 129784 - RNA, 64 nt, hsa
aauuauauuuuuucagaaaacagugaugaauucuguaguccagugcuugccaaugcaaauugcc

SEQ ID NO: 129785 - RNA, 64 nt, hsa
aggauuucugggaccccgcaguugggaggaggaaguaguccagccuuccagguggcgugagagg

SEQ ID NO: 129786 - RNA, 64 nt, hsa
aauaucaacucauuuuagcaucaacuuuaaaauuguaguccaaagugugauuuaaauguuaucu

SEQ ID NO: 129787 - RNA, 64 nt, hsa
ccaaagaucgaggaaaucuaccaagacuaguaggguaguccagaagaagcuguuucagggccug

SEQ ID NO: 129788 - RNA, 64 nt, hsa
uuguaaccugugugaagcagcagccagccuuaaaguaguccauucuugcuaaugguuagaacag

SEQ ID NO: 129789 - RNA, 64 nt, hsa
ucagaaucauguuaacuauuggguugugacugaaguaguccaggguuugccuugaaaccauuac

SEQ ID NO: 129790 - RNA, 64 nt, hsa
cacagaaaacagccaagcugggauuugaacccauguaguccaacuccaaggccucugccccuaa

SEQ ID NO: 129791 - RNA, 64 nt, hsa
ccggaagguguaaaaccccaggcuuccucuucuuguaguccaucucccagacuugugacuaugg

SEQ ID NO: 129792 - RNA, 64 nt, hsa
ccaaaugaccuugacuuuucugccuugugaauucguaguccaaucagcugaaauuaaaucacuu

SEQ ID NO: 129793 - RNA, 64 nt, hsa
acauaugugaacauuccagccuucagcauaagugguaguccaaauuuucuuuaagcagcugcuc

SEQ ID NO: 129794 - RNA, 64 nt, hsa
cuucugaugugggggaggcuggagcuccaugcacguaguccagaugccugggaaggaacaucuc

SEQ ID NO: 129795 - RNA, 64 nt, hsa
uuccccaucugaggcagguuucuaggaggugucuguaguccauguggcaccuuugugagaauua

SEQ ID NO: 129796 - RNA, 64 nt, hsa
gggggcuggagggauccaagagcuuggggauucaguaguccagaucucuggagcugaaggggcc

SEQ ID NO: 129797 - RNA, 64 nt, hsa
ccaaagccuguuagccaccauccaugcuaccuagguaguccauaggaaccacccccaugaccac

SEQ ID NO: 129798 - RNA, 64 nt, hsa
accaguugaggaggaauugaacucaggacucagaguaguccagguguucuccuccuauucaguu

SEQ ID NO: 129799 - RNA, 64 nt, hsa
uuucucugccucugccacaagguuucagaguaguguaguccaaguagaggguggggcacccuuu

SEQ ID NO: 129800 - RNA, 64 nt, hsa
agaacacggggagguuuguuugugugaaaggaaaguaguccaggcugucccugaaacugagucu

SEQ ID NO: 129801 - RNA, 64 nt, hsa
cucccaagacugagguuguucgguuuuaauuccuguaguccaaucacacaauuucuuauggaaa

SEQ ID NO: 129802 - RNA, 64 nt, hsa
uaguaaaaaugauaccaguauaaaaaugguacuuguaguccaugagcuugaacccaaugacuga

SEQ ID NO: 129803 - RNA, 64 nt, hsa
uuuccaucuuguuuguuuuccuaccuuaugcugaguaguccagagaguuaaaaaaauucucugc

SEQ ID NO: 129804 - RNA, 64 nt, hsa
acauugagguaacauccuuuucucugacagucaaguaguccaucagaaauuggcagucacuucc

SEQ ID NO: 129805 - RNA, 64 nt, hsa
gagguggcucugauuuccuggcagcugaacucggguaguccaguggccuagcugguaccacauc

SEQ ID NO: 129806 - RNA, 64 nt, hsa
cuugugagaucucuccucagcuggaaugaggaauguaguccaucuaaacugcuugcuaggcuca

SEQ ID NO: 129807 - RNA, 64 nt, hsa
aggcuucuacugaaaguccugaaaagaccuugcaguaguccaagcuacaccaaacauuaacaca

SEQ ID NO: 129808 - RNA, 64 nt, hsa
ugaauuuaagagauugguauuaguuuucauagcuguaguccauucuaauaauuucugaucuucu

SEQ ID NO: 129809 - RNA, 64 nt, hsa
uuccacucuuuaaaguucugcaguucaccaacugguaguccauuaaauucuccugucuagaaug

SEQ ID NO: 129810 - RNA, 64 nt, hsa
cagguaaguaaagagaaacaauuuuugucacaaaguaguccauuccugaucucacuuaaaauaa

SEQ ID NO: 129811 - RNA, 64 nt, hsa
uugggcucucaccacuucaguuuauaccuugccuguaguccagucucuccagcaucaauuccau

SEQ ID NO: 129812 - RNA, 64 nt, hsa
gacgguguccucgcagugucgccgccaccccagcguaguccaagucagacuauuucacaaaguc

SEQ ID NO: 129813 - RNA, 64 nt, hsa
cacucugcugccauucacagccuaauuuucuggaguaguccaaacaauguuuggaaaaacaugg

SEQ ID NO: 129814 - RNA, 64 nt, hsa
ggacuucauuggguuuuauagcggcugauuuuugguaguccauugaagaagagaguuugaaagu

SEQ ID NO: 129815 - RNA, 64 nt, hsa
aacuuuccaguuuacugaacuccagaccaugcauguaguccacuccagaaaucaugcucgcuuc

SEQ ID NO: 129816 - RNA, 64 nt, hsa
aaaaauguguggcuuugggucugcauuaaacgcuguaguccauguucaugccaaaaauggcugg

SEQ ID NO: 129817 - RNA, 64 nt, hsa
uucauuggguuuuacaguggcuuucugauuuuugguaguccauugaagaagggaguuugaaagu

SEQ ID NO: 129818 - RNA, 64 nt, hsa
ggcccagaaaacugaacgauuauuuuguuccuccguaguccaaagggcagaguugcggaaggcc

SEQ ID NO: 129819 - RNA, 64 nt, hsa
gccgucccaaggagugcccagcacuacucagcauguaguccaggaccugcggcaucagcauccc

SEQ ID NO: 129820 - RNA, 64 nt, hsa
ccccucauugguguccuuuuaaaaaauauuuacuguaguccaauaagauagcagcuguacaaaa

SEQ ID NO: 129821 - RNA, 64 nt, hsa
cucagauaagcuuuuuucauaauucaggaauaaaguaguccauagaaauguuucuguuucauau

SEQ ID NO: 129822 - RNA, 64 nt, hsa
gaugaaauggggcaccccuggccaucacucauguguaguccagguuugagaggaacuggaaggg

SEQ ID NO: 129823 - RNA, 64 nt, hsa
aguaggacagugaaaaauguuuccuugcaaacuuguaguccaguaucaguuacuuccuauuuuu

SEQ ID NO: 129824 - RNA, 64 nt, hsa
uacaaaaauuagcugggcaugguggcacccgccuguaguccagcuacuugaggcugagauggga

SEQ ID NO: 129825 - RNA, 64 nt, hsa
ccuggacuuaaaagauuuuuuaaaaccuccauaaguaguccaggggcgguggcucacgccugua

SEQ ID NO: 129826 - RNA, 64 nt, hsa
cagccuuuacguucaucaccugcuagaaccucucguaguccaucaccauuucuuggcauuggaa

SEQ ID NO: 129827 - RNA, 64 nt, hsa
gcuugguacuucccagggcuaccggcaguccucuguaguccagagaggugagauuagaucuucu

SEQ ID NO: 129828 - RNA, 64 nt, hsa
aagcauuguuugacagguagaaacucauguaucuguaguccaugaguuauauccuggcucagug

SEQ ID NO: 129829 - RNA, 64 nt, hsa
uacuguuuuaacaucauuguugaaaccagacccuguaguccaguggugcugcccuguugugcaa

SEQ ID NO: 129830 - RNA, 64 nt, hsa
uugaggcagagucuucuuugugccugaguggccuguaguccaucuccagcauguaacuggccuu

SEQ ID NO: 129831 - RNA, 64 nt, hsa
uucaacaguaucaugcuaauauuccauuugaucgguaguccaaguucuuuggccagauagugca

SEQ ID NO: 129832 - RNA, 64 nt, hsa
cuauuuuaguugguuuguaucuugccuaaggugcguaguccaacucuugguauuacccuccuaa

SEQ ID NO: 129833 - RNA, 64 nt, hsa
guuuuauaccauuaaaagagugugacaauguauuguaguccaucaucacucaaaccugaaacuu

SEQ ID NO: 129834 - RNA, 64 nt, hsa
uacaaaaguuagccagguacaguaguacacaccuguaguccaagcuacuugggaggcugaagug

SEQ ID NO: 129835 - RNA, 64 nt, hsa
gccugggacucccaccuuccuaucaauucucaugguaguccaaacugcagacucucaaacuugc

SEQ ID NO: 129836 - RNA, 64 nt, hsa
guuggccaggcuggucuugaacucuugaccucauguaguccacccgccucugccucccaaagug

SEQ ID NO: 129837 - RNA, 64 nt, hsa
aaaggagaggagcuggggccuuggggacccccagguaguccaugcggcccauuccuccccuucc

SEQ ID NO: 129838 - RNA, 64 nt, hsa
gccacauuuaaauuguuuuacuggcaguucuauaguaguccagacuuuagaaaccaaacacaac

SEQ ID NO: 129839 - RNA, 64 nt, hsa
ugccacucuuuaccuagucccugcuguguagggcguaguccagguuagcuagguagaguuagug

SEQ ID NO: 129840 - RNA, 64 nt, hsa
uagcuuucacuacacuacaggauaugaucuccauguaguccauauaaaccugcagagugauuuu

SEQ ID NO: 129841 - RNA, 64 nt, hsa
gugcuccuggaaacuuagcuuuugaugucuccaaguaguccaccuucauuuaacucuuugaaac

SEQ ID NO: 129842 - RNA, 64 nt, hsa
cauuguccaccaccccagccuagagccuagaacuguaguccagcugaggaaggaggcagagcug

SEQ ID NO: 129843 - RNA, 64 nt, hsa
agcagccacaggcccagggagcuguagcaagaggguaguccaaaggcagaugccagacaagaca

SEQ ID NO: 129844 - RNA, 64 nt, hsa
ucagaaauaaagcuguaucugccauuuuaagccuguaguccauuauuacuugggucuuuacuuc

SEQ ID NO: 129845 - RNA, 64 nt, hsa
gcuggggggcuucaacuauaguugcccugugacuguaguccaccccugccugccuuguuugauu

SEQ ID NO: 129846 - RNA, 64 nt, hsa
ucagaaauaaaacuguaucugacauuuuaagccuguaguccauuauuacuugggucuuuacuuc

SEQ ID NO: 129847 - RNA, 64 nt, hsa
gccugugggccaaaucuagcucacuaucuguuuuuguaaauaaaauuuuauaauaguacacagc

SEQ ID NO: 129848 - RNA, 64 nt, hsa
aaaucuuuccaaauguucugguaucuuugaaaaauguaaauaguuuauuuauagagaacccuac

SEQ ID NO: 129849 - RNA, 64 nt, hsa
gguuaugcacaggugggagucuuuuguauauaguuguaaauauugucuugguuauguaaaaaug

SEQ ID NO: 129850 - RNA, 64 nt, hsa
gguacuugugcauuuaaaaaccaacacaaaaagauguaaauacuuaacacucaaauauuaacau

SEQ ID NO: 129851 - RNA, 64 nt, hsa
guuuuugaaauguaaauguauucauguguguucuuguaaauacgugucgcucagauguccuuug

SEQ ID NO: 129852 - RNA, 64 nt, hsa
uuugcugcaagcaguuuauauaaagauacauauguguaaauauauguacaaaaauuacugaaag

SEQ ID NO: 129853 - RNA, 64 nt, hsa
auuuauguucacacaggaauuugguuuacugcuuuguaaauaaaaggaaaaacuccggguauau

SEQ ID NO: 129854 - RNA, 64 nt, hsa
gggggcuuuuuuagguuuuggggcauuuguuuuuuguaaauaagaugauuaugcuuuguggcua

SEQ ID NO: 129855 - RNA, 64 nt, hsa
aguuauaugauauucuuuaaacaaauaugaaaaauguaaauacucaugaaugaaaauacaucuu

SEQ ID NO: 129856 - RNA, 64 nt, hsa
ugaccauuuuaguuuuaauuccaugucagauaaguguaaauagaagaguuuaaaagcaugaaac

SEQ ID NO: 129857 - RNA, 64 nt, hsa
agcuuuauuguaaauacuauggaaggggcuuuguuguaaauacuauguaauauauauaaaauau

SEQ ID NO: 129858 - RNA, 64 nt, hsa
agaagccucuuggugauuuuggaaggagcuuuauuguaaauacuauggaaggggcuuuguugua

SEQ ID NO: 129859 - RNA, 64 nt, hsa
uuuuacugaugauguagauacuuuuguaaauaaauguaaauauguacacaagugacuagguggu

SEQ ID NO: 129860 - RNA, 64 nt, hsa
aguaaauuguuuuuacugaugauguagauacuuuuguaaauaaauguaaauauguacacaagug

SEQ ID NO: 129861 - RNA, 64 nt, hsa
uagauuaagcuuuucauuuuaauauauaauuuaauguaaauaaaacaucacuaucaauuuuaag

SEQ ID NO: 129862 - RNA, 64 nt, hsa
uuagaaaagacaauuuuuuuucaaaugugcaauuuguaaauauugcuaaaagcauguauaguua

SEQ ID NO: 129863 - RNA, 64 nt, hsa
cuguaauaaucuuucuuugggcacaaagaaguacuguaaauaaaugcuuguaaauauuuccucc

SEQ ID NO: 129864 - RNA, 64 nt, hsa
cuuugggcacaaagaaguacuguaaauaaaugcuuguaaauauuuccuccaucaccauugaacu

SEQ ID NO: 129865 - RNA, 64 nt, hsa
aaaauauuaaauaagcucaaauauauauauuugguguaaauaaagaguccaugguaaaugguuu

SEQ ID NO: 129866 - RNA, 64 nt, hsa
uuauguccugucuguguaaagauucaucuuuuauuguaaauauuuagacuuuaccacagaaaua

SEQ ID NO: 129867 - RNA, 56 nt, hsa
acuucugcauggaacucugagcaagauguaaauaaaauuaaaagguggauggcaag

SEQ ID NO: 129868 - RNA, 64 nt, hsa
uguauaugagcuucaaauaagcaccuuuuuauuauguaaauaaauaaaaguuaucuguaucccc

SEQ ID NO: 129869 - RNA, 64 nt, hsa
uugucccaucauggcccaccugguuuccugauguuguaaauaacaucaaugcaucugcuguggg

SEQ ID NO: 129870 - RNA, 64 nt, hsa
cucuuuaauucccaccuaagccucuggguaauauuguaaauauuguuuuaaaaugcaucagccu

SEQ ID NO: 129871 - RNA, 64 nt, hsa
uaauuuucaguaauuguuuugcacuuucaaagauuguaaauaguucauucaaucaaugguaugg

SEQ ID NO: 129872 - RNA, 64 nt, hsa
uuaauguguaggaauuguauguauguauaucuucuguaaauaacaucuaguaucuucacuaaau

SEQ ID NO: 129873 - RNA, 64 nt, hsa
augaccaauguagccauugcuuuaaaauguaccguguaaauauaaacacauccuaucagaucgc

SEQ ID NO: 129874 - RNA, 64 nt, hsa
guuaagggcacaaagacagccauggggacauuuauguaaauacgucucuaauugccacacugca

SEQ ID NO: 129875 - RNA, 64 nt, hsa
acaagcucaucgauuuucuuuaguagauuaccgguguaaauacccagugugcuuaugagucagu

SEQ ID NO: 129876 - RNA, 64 nt, hsa
uuuuacauuuagaguauuuacacuaugauaaaguuguaaauaauuuucuaagacaguuuuuaua

SEQ ID NO: 129877 - RNA, 64 nt, hsa
uauauuauuccaaaguuauuucauaccauuauuauguaaauaugaagaguuuuuuucuguuuau

SEQ ID NO: 129878 - RNA, 64 nt, hsa
gaauuuuguaaaaagaaauugugaaaaaugagcuuguaaauacuccauuauuuuauuuuauagu

SEQ ID NO: 129879 - RNA, 64 nt, hsa
cugucuuaccaaacagugggagggaauuccuagcuguaaauauaaauuuugucccuuccauuuc

SEQ ID NO: 129880 - RNA, 64 nt, hsa
cuaaccuuaaaggcucaauaacaaauacaacaaauguaaauauguuuacauuuuaagacauaug

SEQ ID NO: 129881 - RNA, 64 nt, hsa
ugaguggcacuucuuuugucuuaggaauacauguuguaaauauauaucuguguauguguguaua

SEQ ID NO: 129882 - RNA, 64 nt, hsa
gagaauucagauauacuuuaucuuuuuaaaaaaguguaaauaaaaucaaagaauguaaagucua

SEQ ID NO: 129883 - RNA, 64 nt, hsa
caauaggguaaguaaauauagccaccuguuaacauguaaauaagcauaauuuguuccaaagaug

SEQ ID NO: 129884 - RNA, 64 nt, hsa
guaaaauacugauuuucauucuuucaagcuuauuuguaaauaccuauuugaaugcuguguauuu

SEQ ID NO: 129885 - RNA, 64 nt, hsa
uguucaaaauccaacaaguaaugugaauuuuagauguaaauaucugccacuugauuuuuuuucc

SEQ ID NO: 129886 - RNA, 64 nt, hsa
cuggggcuucggcuucuuuuuuucuuuguuuucuuguaaauacagaauuauuagcuuaaaacug

SEQ ID NO: 129887 - RNA, 64 nt, hsa
agaauuauuagcuuaaaacuguacuguugaauucuguaaauaguuauaucucgguuggagcggg

SEQ ID NO: 129888 - RNA, 64 nt, hsa
aaacagcuaaguaccuagaagagcucccugcaaguguaaauauuaaggaugaccugugcaaaau

SEQ ID NO: 129889 - RNA, 64 nt, hsa
ugugguagcuaaaggcacggaauuuagacggccuuguaaauagggcaugaggaacucaucugug

SEQ ID NO: 129890 - RNA, 64 nt, hsa
auaaucuguuuauuaauaagccaugauauguguauguaaauauucuuacaguacuuguuuuuag

SEQ ID NO: 129891 - RNA, 64 nt, hsa
ugcaauaccauauggaaaucuuuuaauaaauauauguaaauaaaauaaaaaauauuugucucca

SEQ ID NO: 129892 - RNA, 64 nt, hsa
uucaaaagaacuauuuaaaacucuugaaaacucauguaaauaaaaaucauagggugaaaauugu

SEQ ID NO: 129893 - RNA, 64 nt, hsa
aaaagguggaggcauuguaaaaaggaaauagugauguaaauaaacauguucucuuucaaguaug

SEQ ID NO: 129894 - RNA, 64 nt, hsa
aggguggacacacauauguguauuuacagugcaguguaaauaguucuguaguagagguuaacuc

SEQ ID NO: 129895 - RNA, 64 nt, hsa
uuauuuuggagacggcuaaugguaggaauguuaauguaaauaguggugguaauguaaaaucauu

SEQ ID NO: 129896 - RNA, 64 nt, hsa
ugaucaagcauuuuuauaagauauuugcaauuuuuguaaauauuuuuggccugcaacugggaag

SEQ ID NO: 129897 - RNA, 64 nt, hsa
aauuagaacaaugcacaucugucuuccaagauuuuguaaauauuuuugauuuuuuucauuaaau

SEQ ID NO: 129898 - RNA, 64 nt, hsa
uuuagacccagaagagaggaguuugcucugaauuuguaaauaagucuuccccauuccucauacu

SEQ ID NO: 129899 - RNA, 64 nt, hsa
augucaaguauuauaagcugguauuuaagaugcuuguaaauacuauuuauguuuuuaauuuugu

SEQ ID NO: 129900 - RNA, 64 nt, hsa
ggaagaaaauuuccuccacauucauguacaaugauguaaauauuucaauaacuuagaaugcuuc

SEQ ID NO: 129901 - RNA, 64 nt, hsa
uauaucagugcuccaguauauaaccucaaacaaauguaaauagaacgaauuauuuucuuguuuu

SEQ ID NO: 129902 - RNA, 64 nt, hsa
aacuguguacaaaaggauugcuuguaaauaugcauguaaauaguucuguuaauaacccacuguu

SEQ ID NO: 129903 - RNA, 64 nt, hsa
cagcuaacuaaaaacuguguacaaaaggauugcuuguaaauaugcauguaaauaguucuguuaa

SEQ ID NO: 129904 - RNA, 64 nt, hsa
gccacugcacccacccaagacaagugauuuucauuguaaauauuugacuuuagugaaagcgucc

SEQ ID NO: 129905 - RNA, 64 nt, hsa
gggguguuuauucuuccaacacauuucacuuuucuguaaauauacauaaacuuaaaaagaaaac

SEQ ID NO: 129906 - RNA, 64 nt, hsa
gcucuuguuuucauuuuuguuguacguguagaucuguaaauaaaauugcaguauuuaaagcuua

SEQ ID NO: 129907 - RNA, 64 nt, hsa
aaaaaaaacaaaaaaaagcuuuuaugauggauuuuguaaauagauuuguuacagggugaccugu

SEQ ID NO: 129908 - RNA, 64 nt, hsa
ugaaauuugcuuuuuauccaaauauuuuguaucuuguaaauauggcuaauuauaggaaugccua

SEQ ID NO: 129909 - RNA, 64 nt, hsa
gguuacuuggguuuggauacccuuagugggaugauguaaauagaggcuagcuaccuaggcuugu

SEQ ID NO: 129910 - RNA, 64 nt, hsa
ugugacauguuuauauucacccauguacauuuucuguaaauaccaaacgcuacugauucccaug

SEQ ID NO: 129911 - RNA, 64 nt, hsa
aaauacuguuaguuuuaauacaagagaaugcauuuguaaauaugguauagaguuuauuaauaua

SEQ ID NO: 129912 - RNA, 64 nt, hsa
aaaccauauugugacaagagaugagccucuguacuguaaauaagaaaugaaguagagaaauguu

SEQ ID NO: 129913 - RNA, 64 nt, hsa
uggacuucugucauaauucuugcugagucaagaguguaaauaaaagaaauggcaggacucauau

SEQ ID NO: 129914 - RNA, 64 nt, hsa
ggauuuuuuuaccagcuuuguuuacagacccaaauguaaauauuaaaaauaaauauuugcaauu

SEQ ID NO: 129915 - RNA, 64 nt, hsa
auauaauuuaucugcuauuuuuaauuacuuaccuuguaaauaacuuuaauaauauucaaaaguu

SEQ ID NO: 129916 - RNA, 64 nt, hsa
guuugcuagaaauauaacuuuuaauacaguagccuguaaauaaaacacucuuccauaugauauu

SEQ ID NO: 129917 - RNA, 64 nt, hsa
uauucaccuaaaguagaaauaaucuguuacuuauuguaaauacugcccuagugucuccauggac

SEQ ID NO: 129918 - RNA, 64 nt, hsa
aucggaacugcucaggauugauacauuucaagucuguaaauacggacaccaacgccauuuaccc

SEQ ID NO: 129919 - RNA, 64 nt, hsa
uuggguuuuguuuuaaguuuuacuaauuucuauauguaaauaaaagauauaaugauugugcaaa

SEQ ID NO: 129920 - RNA, 64 nt, hsa
aguguccuucagaacccagagaaggccgccguucuguaaauagcgacgucgguguugcugccca

SEQ ID NO: 129921 - RNA, 64 nt, hsa
gggggcgcaaacccuuuuccucccagccuauuuuuguaaauaaaauguuuaaacuugaaauaca

SEQ ID NO: 129922 - RNA, 64 nt, hsa
cuugcaccauuguaauaaaagcuguuagaauauuuguaaauaucuuucugcuguaguguggugg

SEQ ID NO: 129923 - RNA, 64 nt, hsa
aggauuauuuauugcuaacguaaauagauagcauuguaaauaaucaucacaaugaucaaaucac

SEQ ID NO: 129924 - RNA, 64 nt, hsa
ucuuaaugggagagcuauaaauggcagagcuauguguaaauauuuuaagagcaugcagccaucu

SEQ ID NO: 129925 - RNA, 64 nt, hsa
gcuuccauagccaugagaacaucuuaaaacuauguguaaauauauuaaggaaaguauagcuuug

SEQ ID NO: 129926 - RNA, 64 nt, hsa
ccuuguuuauauaucacugagguauacuaugccauguaaauagacuauuuuuuauaaucuuuac

SEQ ID NO: 129927 - RNA, 64 nt, hsa
ucugacuaugaaaaaugucucuuucaguuuguucuguaaauauuuagaaaagugacagcuguca

SEQ ID NO: 129928 - RNA, 64 nt, hsa
cagcugucaaccucagaguaacuauuucuaaaaauguaaauauguauuaauccuuguaucuuuu

SEQ ID NO: 129929 - RNA, 64 nt, hsa
uuuaaaaaauuuuaagauuuacacaauguuucucuguaaauauugccauuaaauguaaauaacu

SEQ ID NO: 129930 - RNA, 64 nt, hsa
uacacaauguuucucuguaaauauugccauuaaauguaaauaacuuuaauaaaacguuuauagc

SEQ ID NO: 129931 - RNA, 64 nt, hsa
guugaaauucaauaccaaauacaguaaaaacaaauguaaauaaaagaaaacacaucaucaauaa

SEQ ID NO: 129932 - RNA, 64 nt, hsa
uuuaaauggcuugauguagcagucauagcaaguuuguaaauagcaucuauguuacacucuccua

SEQ ID NO: 129933 - RNA, 64 nt, hsa
auccacgagugcuguugcacuaccaucuauuuguuguaaauaaaaguguuguuuucaaagccau

SEQ ID NO: 129934 - RNA, 64 nt, hsa
uagaauugggaaauuuuagugagaaaaaaugcacuguaaauaugcuuuaguuuuaauucaguug

SEQ ID NO: 129935 - RNA, 64 nt, hsa
uucucacuagaauugguauggaaaagcaaaauacuguaaauaaacuuuuuuucuaacaauuugc

SEQ ID NO: 129936 - RNA, 64 nt, hsa
gagagcugggaauauggcauuuggacacuucauuuguaaauaguguacauuuuaaacauuggcu

SEQ ID NO: 129937 - RNA, 64 nt, hsa
aagcuuguguacuugaccguuuuuauauuacuuuuguaaauauucuuguccacauucuacuuca

SEQ ID NO: 129938 - RNA, 64 nt, hsa
guauaccaccuguacauacauuguauaggccaucuguaaauaucccagagaacaaucacuauuc

SEQ ID NO: 129939 - RNA, 64 nt, hsa
gcguucuacuuccagaagauggucacuuuaaccuuguaaauauuuaucuaaaaugauauuuaca

SEQ ID NO: 129940 - RNA, 64 nt, hsa
guaauauauuauuauuugauuguauauguacaacuguaaauacauuuguaccucucuuguauuc

SEQ ID NO: 129941 - RNA, 64 nt, hsa
ucaugcuauucagcauugaugcuauauuguauuauguaaauaauaaaagccauguacagaggga

SEQ ID NO: 129942 - RNA, 64 nt, hsa
uauaguuaguguugugguaaugccuguuuucaucuguaaauaguuaaguauguacacgaggcac

SEQ ID NO: 129943 - RNA, 64 nt, hsa
cuuuuagcauuuugcuaagacuugaaacaaaaaauguaaauacaaaagaaaucaaguuuuguuu

SEQ ID NO: 129944 - RNA, 64 nt, hsa
uuugauguaacaaaaugcuauuaaucuaaauauuuguaaauaaaguaccuguaucuagauuaaa

SEQ ID NO: 129945 - RNA, 64 nt, hsa
aggccuccaucucacuguaaauaagucucuguucuguaaauagauguacagaagccauguuauu

SEQ ID NO: 129946 - RNA, 64 nt, hsa
cugucccucaccaacaccaaggccuccaucucacuguaaauaagucucuguucuguaaauagau

SEQ ID NO: 129947 - RNA, 64 nt, hsa
aacucuauucuugugagcauuauuaaaucuuguuuguaaauauauugucuuucucuuaauauuu

SEQ ID NO: 129948 - RNA, 64 nt, hsa
augaauaggcgguacugaguugugcagagugggauguaaauaucgccuuccucucccuauaucc

SEQ ID NO: 129949 - RNA, 64 nt, hsa
auacucuguacgguucuguaaaccgaaaaacuuuuguaaauauauaaauauacauagacauaaa

SEQ ID NO: 129950 - RNA, 64 nt, hsa
aaaaagcaacaaguuugcacagcuagaguguuuuuguaaauaaauguauuuguauaacacaguc

SEQ ID NO: 129951 - RNA, 64 nt, hsa
aagggcagcccugccugcccuccccaucccccgcuguaaauauacacuauuuuugauagcacac

SEQ ID NO: 129952 - RNA, 64 nt, hsa
uuccugugccuaacagcauaauugccuuuuccuauguaaauauuaugaugguggaucaagacau

SEQ ID NO: 129953 - RNA, 64 nt, hsa
auuuuugggagaucugauuuucuuauccaaguuuuguaaauaguuguuauuucuauauuuggau

SEQ ID NO: 129954 - RNA, 64 nt, hsa
uuauuuaauuauuuuaaaacguacacacuuuucuuguaaauaugucacaucugaguucaaaaaa

SEQ ID NO: 129955 - RNA, 64 nt, hsa
uguaccaguuucaugaaguaugucuuuggguuuuuguaaauaauuuuaacucaaauaaaauugc

SEQ ID NO: 129956 - RNA, 64 nt, hsa
uuuaaaguaaccuuuuuuccauuguaaauauuucuguaaauacuaccaauuggaaauuagaaca

SEQ ID NO: 129957 - RNA, 64 nt, hsa
uuaacuaaaaguuuuaaaguaaccuuuuuuccauuguaaauauuucuguaaauacuaccaauug

SEQ ID NO: 129958 - RNA, 64 nt, hsa
guacaaguguaaauauaugugcccauaaaaucauuguaaauauuauuuagucaucacaaauaaa

SEQ ID NO: 129959 - RNA, 64 nt, hsa
gacuuuccuuuucaaaaauacuuuaauguacaaguguaaauauaugugcccauaaaaucauugu

SEQ ID NO: 129960 - RNA, 64 nt, hsa
aagauuguucacaacaucucauguaguuuaaauuuguaaauacugcuucuguuuuguuucuccu

SEQ ID NO: 129961 - RNA, 64 nt, hsa
augauucuaggcuguuaaauagauuucucaauaauguaaauaacuaaauuguucucugcauaua

SEQ ID NO: 129962 - RNA, 64 nt, hsa
ucugcaaaacuguauagcuuugacaauuccauauuguaaauacuguguaaaucuuguugaaaua

SEQ ID NO: 129963 - RNA, 64 nt, hsa
uaaaucaugcuguuucugaaacagcuuccuaguuuguaaauagacuuacuugguauauuuuuau

SEQ ID NO: 129964 - RNA, 64 nt, hsa
cauagaaaauuggguguguauacuuguauaacuuuguaaauaaguuuuuuuucuggguucauau

SEQ ID NO: 129965 - RNA, 64 nt, hsa
gaggaguugauaugcaacugcaguucauccgcacuguaaauacauguauuuaaaaaaacaaucc

SEQ ID NO: 129966 - RNA, 64 nt, hsa
auuaucauaaaaauuuaccagucugaauagaucuuguaaauauuugugaauagaaugaauaccu

SEQ ID NO: 129967 - RNA, 64 nt, hsa
auucuaugcaguggaugaauguucuuuaaauuuguguaaauacuucugcaaagguacugaugcu

SEQ ID NO: 129968 - RNA, 64 nt, hsa
ugcaugcuguaguucuagcuuuucugcuauaauauguaaauaugacuguagccuuuuaagcuuc

SEQ ID NO: 129969 - RNA, 64 nt, hsa
ugauuuacaguauuguuauuuuugucuaaaguucuguaaauacaugcuuuaauguuaucuuuga

SEQ ID NO: 129970 - RNA, 64 nt, hsa
aauacaugcuuuaauguuaucuuugagaaaucuauguaaauaauauagucuacaacauagagac

SEQ ID NO: 129971 - RNA, 64 nt, hsa
uccuaccccuuccuguccugccuccucaucaguguguaaauaauuugcacugaaacguggauac

SEQ ID NO: 129972 - RNA, 64 nt, hsa
ugaaacguggauacagagccacgaguuuggauguuguaaauaaaacuauuuauugugcuggguc

SEQ ID NO: 129973 - RNA, 64 nt, hsa
agaaugguucucuuugacccacucuggucuauuguguaaauauuuauuuagacuauuuuaauaa

SEQ ID NO: 129974 - RNA, 64 nt, hsa
uuaggguauaggcaucuagagaugcacuguccacuguaaauacuauaaugagagccacaucugu

SEQ ID NO: 129975 - RNA, 64 nt, hsa
acuuguuucuacaauucaguauuugauguggucguguaaauauguacaauauuguaaauacaua

SEQ ID NO: 129976 - RNA, 64 nt, hsa
guauuugauguggucguguaaauauguacaauauuguaaauacauaaaaaauauacaaauuuuu

SEQ ID NO: 129977 - RNA, 64 nt, hsa
auacauauuuuacguuugaacaaggagauuuaauuguaaauaugaaagccaaaguauuccugaa

SEQ ID NO: 129978 - RNA, 64 nt, hsa
aagaauuaagauuuuucuuuguuccauuguacaguguaaauaacuaaguuguuaacugucaagu

SEQ ID NO: 129979 - RNA, 64 nt, hsa
agaguggugcuagccaggaagaagccaguaaacauguaaauauagugcaacccagucgggcuuu

SEQ ID NO: 129980 - RNA, 64 nt, hsa
guauaaaauagaguauuuucauguguuagauguguguaaauaugcuaucuucuuuaagaaauua

SEQ ID NO: 129981 - RNA, 64 nt, hsa
ugagaaccuggguguauuaacuuuguguauauaguguaaauauccccacuguacuguuagaggc

SEQ ID NO: 129982 - RNA, 64 nt, hsa
aucuauguacauauauugucuguccauauguauuuguaaauagguuguauauaaugucagguuu

SEQ ID NO: 129983 - RNA, 64 nt, hsa
uuucucuuuauguaguuugacuaugccuuaccuuuguaaauauuuuugcuuguguugucgcaaa

SEQ ID NO: 129984 - RNA, 64 nt, hsa
uuggaaaaaaaaaucugauacuccauuugauuauuguaaauauuugaucuugaaucacuugaca

SEQ ID NO: 129985 - RNA, 64 nt, hsa
aaacuuuaauuuauugacauuguacauagcucuguguaaauagaauugcaacugucagguuuug

SEQ ID NO: 129986 - RNA, 64 nt, hsa
agacaaaguauuuauguaauuauuugauaacucuuguaaauagguggaauaugaaugcuuggaa

SEQ ID NO: 129987 - RNA, 64 nt, hsa
acugguugggugucuuuaauugugaacacauauuuguaaauagugccuuuauuaauuguucuug

SEQ ID NO: 129988 - RNA, 64 nt, hsa
uggaauuaguagacaaggauauuaaaagagcuauuguaaauauaaaguagaggaaaacauaaga

SEQ ID NO: 129989 - RNA, 64 nt, hsa
uauaugaguugccuauauuugcuauucaaaauuuuguaaauaugcaaaucagcuuuauagguuu

SEQ ID NO: 129990 - RNA, 64 nt, hsa
aguuuuguuuguuagaaaaguugcucuuaaaagauguaaauagaugacaaacgauguaaauaau

SEQ ID NO: 129991 - RNA, 64 nt, hsa
uugcucuuaaaagauguaaauagaugacaaacgauguaaauaauuuuguaagaggcuucaaaau

SEQ ID NO: 129992 - RNA, 64 nt, hsa
auuuuuaccucaauuguugauaucaaucaucaauuguaaauaaauaauugccaaggcaaauaaa

SEQ ID NO: 129993 - RNA, 64 nt, hsa
cuauuuaaaggcuucuaagaagcguauaccuaacuguaaauaaauguauguauagcauauguac

SEQ ID NO: 129994 - RNA, 64 nt, hsa
cugaaaugaaauguuuuuagauuacuuuuucaacuguaaauaauguacauuuaaugucacaaga

SEQ ID NO: 129995 - RNA, 64 nt, hsa
uaauuuuacauuguauuagauuuucugauucuuuuguaaauacagaacuuaaauagaaggcaac

SEQ ID NO: 129996 - RNA, 64 nt, hsa
gguuucuacuuuauggaauuauauggucaauauuuguaaauauucuaugaguuuugggugggua

SEQ ID NO: 129997 - RNA, 64 nt, hsa
cagaucaaauuaauacaaucagaagguuucgaaauguaaauauuccuuauuuaagacauguuua

SEQ ID NO: 129998 - RNA, 64 nt, hsa
guuaauuuguucuuaccaaaaaauaaaauuacuuuguaaauagcaguucacauuuuuccacagu

SEQ ID NO: 129999 - RNA, 64 nt, hsa
uggacacuuguaagucaaucaguguuaaaguauuuguaaauagaagcaagcuauuauuaacaac

SEQ ID NO: 130000 - RNA, 64 nt, hsa
agcuguauguuaagagagacucuuacuaacauguuguaaauauuacaauucaugaaauguuauu

SEQ ID NO: 130001 - RNA, 64 nt, hsa
aaagaugucuuucugguuuuaacgcaugcaggcauguaaauauuugucuggagucacaguauua

SEQ ID NO: 130002 - RNA, 64 nt, hsa
cuguaaagcuuauuacuaauuuuuguauuauuuuuguaaauagccaauagaaaaguuugcuuga

SEQ ID NO: 130003 - RNA, 64 nt, hsa
uaucguagcuuaaacucuguuugguuuugucaucuguaaauacuuaccuacauacacugcaugu

SEQ ID NO: 130004 - RNA, 64 nt, hsa
uugggauauuuuaaaaaugcuacugagauucugcuguaaauaugacuagagaauauauuggguu

SEQ ID NO: 130005 - RNA, 64 nt, hsa
agaaaugcugugauucuguuuuaaguccauaccuuguaaauaagugccuuacgugaguguguca

SEQ ID NO: 130006 - RNA, 64 nt, hsa
ugaagauuuccuuuuuccuugccuauuuuuucauuguaaauauuuauauacuacugaccaagau

SEQ ID NO: 130007 - RNA, 64 nt, hsa
cccaaauaccgcgaaugcaucagcuaaagcagcguguaaauaggagugacgagaaaguuaaugg

SEQ ID NO: 130008 - RNA, 64 nt, hsa
gcuuaauggaauuauaauucucaggauaguauuuuguaaauaaagaugauuuaaauaugaaucu

SEQ ID NO: 130009 - RNA, 64 nt, hsa
uucaauuauguuaugacaaaugugcucucuuucuuguaaauagacaugaguggcccaaagcaac

SEQ ID NO: 130010 - RNA, 64 nt, hsa
aguucuucaguuauauuuacauguguuguaaauauguaaauauacuuuuagcuuaggaagucuu

SEQ ID NO: 130011 - RNA, 64 nt, hsa
uuugaaguaguucuucaguuauauuuacauguguuguaaauauguaaauauacuuuuagcuuag

SEQ ID NO: 130012 - RNA, 64 nt, hsa
ucuauccuagaaagauuuuaaugugagcuuaagauguaaauaaauaauuuugcaaacaugccuu

SEQ ID NO: 130013 - RNA, 64 nt, hsa
uuuguauuuauguguauauaaaauguacaaugaauguaaauaugacuuucuggaaaguuuagac

SEQ ID NO: 130014 - RNA, 64 nt, hsa
ucaugaugcugacuggcguuagcugauuaacccauguaaauaggcacuuaaauagaagcaggaa

SEQ ID NO: 130015 - RNA, 64 nt, hsa
ucaucuuuguugagagucuucgugacuguaagauuguaaauacagauuauuuauuaacucuguu

SEQ ID NO: 130016 - RNA, 64 nt, hsa
uuucuccuaagucaugcagguaaugacaauauacuguaaauaccacaugugaguuuaccugaau

SEQ ID NO: 130017 - RNA, 64 nt, hsa
ugaauagauaccuuguaaacuuguauuguggauguguaaauaauauguacuuuggguuuuuaac

SEQ ID NO: 130018 - RNA, 64 nt, hsa
uucauauucuuuauuuauaaaggaucaaugcugcuguaaauacagguauuuuuaauuuuaaaau

SEQ ID NO: 130019 - RNA, 64 nt, hsa
agcuuucuaauggugucuucagaaauuuauaaaauguaaauacugauuugacuggucuuuaaga

SEQ ID NO: 130020 - RNA, 64 nt, hsa
uaggucucuaaacacagacuuuuuaaauugcaacuguaaauaugaaauggucaucacaucugac

SEQ ID NO: 130021 - RNA, 64 nt, hsa
guaauuuguaaccauuuucuauuugugcaaacucuguaaauauguguuuaaacaaauguaauau

SEQ ID NO: 130022 - RNA, 64 nt, hsa
gugaagggacucauuuuucuuugcuuucagcccauguaaauaaauaauacaguauuaacauuuu

SEQ ID NO: 130023 - RNA, 64 nt, hsa
agcucuuuaagugauccucguucugguggcuuuguguaaauauguuugcccuaguugaauuaag

SEQ ID NO: 130024 - RNA, 64 nt, hsa
cguuucuuaaguauugcgcagauuuguucaacuuuguaaauauggacaucacuuuuuuuuucuu

SEQ ID NO: 130025 - RNA, 64 nt, hsa
cguauaauagggauugugaccugauauuuggagauguaaauauugcucagcauauuaaucccga

SEQ ID NO: 130026 - RNA, 64 nt, hsa
auuuuucccccagugaaugauuuagaauuuuuuauguaaauauacagaauguuuuuucuuacuu

SEQ ID NO: 130027 - RNA, 64 nt, hsa
aguuccuguccaauuuguguaauuuguuuaaaauuguaaauaaauuaaacuuuucugguuucug

SEQ ID NO: 130028 - RNA, 64 nt, hsa
aagaaaggaaagaucucuaaauucaaagcuagauuguaaauaggcauucaagaaguauugucuu

SEQ ID NO: 130029 - RNA, 64 nt, hsa
uuccuggaaaugaugacuuuauugcuuagaaaguuguaaauaauuaaaagcuucccaagaguua

SEQ ID NO: 130030 - RNA, 64 nt, hsa
caugaaaauuauaugaaauuuaaguuuuggugucuguaaauaaaguuuuguuggcuucagccac

SEQ ID NO: 130031 - RNA, 64 nt, hsa
gcccauggaccaaauccuaucugcugcuuguuuuuguaaauagaguuuuaucaaaccacagcca

SEQ ID NO: 130032 - RNA, 64 nt, hsa
uagaucacuuauaccuaucacaauguaaauacuauguaaauaguuguuauacuguauuuuucaa

SEQ ID NO: 130033 - RNA, 64 nt, hsa
uaaauuaucuuuagaucacuuauaccuaucacaauguaaauacuauguaaauaguuguuauacu

SEQ ID NO: 130034 - RNA, 64 nt, hsa
acuuggaggaaucacagucauauagcauguauucuguaaauauuaucuguaauuguuauuauug

SEQ ID NO: 130035 - RNA, 64 nt, hsa
agcccgucuccucuucccuucccuggcccccggguguaaauagauuguuauaauuuuuuucuua

SEQ ID NO: 130036 - RNA, 64 nt, hsa
accuccuccagacccccuccccuccugugucccuuguaaauagaaccagcccagcccgucuccu

SEQ ID NO: 130037 - RNA, 64 nt, hsa
agaaucucgcaguguuucugugaauagauuuuuuuguaaauaugaccuuuaagauauuguauua

SEQ ID NO: 130038 - RNA, 64 nt, hsa
ugccacuuuucuaaacugcaucuggauugaaagguguaaauaucaauaacagugcuacuuaguu

SEQ ID NO: 130039 - RNA, 64 nt, hsa
cugugacugcuuugcugaccauuuuggaugucauuguaaauaaagguuucuauuuaaaauugga

SEQ ID NO: 130040 - RNA, 64 nt, hsa
uuucagcuuaaaguuauguuauuauauguggaaguguaaauauagauuugguguuuugcaaucu

SEQ ID NO: 130041 - RNA, 64 nt, hsa
aaaguauauaaugcuugcaccucagguaaaaaucuguaaauaucuaaguuguaaaccugcuugu

SEQ ID NO: 130042 - RNA, 64 nt, hsa
uuucauguaaauuuugcacaguuacuuguucauauguaaauauuuuacuuucagaaaugaaguu

SEQ ID NO: 130043 - RNA, 64 nt, hsa
guaugaaauugucuauugauaguacuuuuaugacuguaaauacucuggcuuucuccgugugaau

SEQ ID NO: 130044 - RNA, 64 nt, hsa
uguguuuguuuuuacaggugugaaagucacagcuuguaaauaaguguuguauguauuaaaccuu

SEQ ID NO: 130045 - RNA, 64 nt, hsa
aauuugcagccguuuuacaaauaucuguggaacauguaaauacugucaaauggaaaauaaaaua

SEQ ID NO: 130046 - RNA, 64 nt, hsa
auuguaauaauuguggaaauguuuugucuuuaaguguaaauauuuuaaaauuugacauacccua

SEQ ID NO: 130047 - RNA, 64 nt, hsa
acgucaaauaggagaggaagauaagauaaauauuuguaaauaaaaccuaaaguuuaaauguuuu

SEQ ID NO: 130048 - RNA, 64 nt, hsa
aaucucuuugguuccuguauauuccauguauaaguguaaauauaaucagacagguuuaaaaguu

SEQ ID NO: 130049 - RNA, 64 nt, hsa
acaugaagauguuaaaaucgguuuuuaaaggugauguaaauagugauuuccuuaaugaaaaaua

SEQ ID NO: 130050 - RNA, 64 nt, hsa
aaacccuaaaugguuauuuuuccucagaaugauuuguaaauagcuacuggaaauauuauacagu

SEQ ID NO: 130051 - RNA, 64 nt, hsa
cuaaagcaaaauuuagaagaaagaacuacacauauguaaauaccauauuuuugauaaaaaugug

SEQ ID NO: 130052 - RNA, 64 nt, hsa
cacauauguaaauaccauauuuuugauaaaaauguguaaauagauuuaucaaugaugaguggac

SEQ ID NO: 130053 - RNA, 64 nt, hsa
uggacuugcauccauuuuguauuuuuguaauauuuguaaauaugaacuuuuuaaauugcugcaa

SEQ ID NO: 130054 - RNA, 64 nt, hsa
gggcagccccagucaccacgagcuguuucauuuguguaaauacgaugcugaauuuuaugaggcu

SEQ ID NO: 130055 - RNA, 64 nt, hsa
ccacuguaauuuucaagccuauuuuauuuguaccuguaaauacuguacagcuaauauauauaua

SEQ ID NO: 130056 - RNA, 64 nt, hsa
uauauacaaaucuucauuuucauacauaguacaauguaaauauauaacuuuguuaacacuuuug

SEQ ID NO: 130057 - RNA, 64 nt, hsa
caguucagaaauaccacaauuaauauuuucaauguguaaauaucuuuucauaauuuuuccuacg

SEQ ID NO: 130058 - RNA, 64 nt, hsa
auacaauuccaaugaguauucugauuaucagauuuguaaauaacuauguaaauagaaacagaua

SEQ ID NO: 130059 - RNA, 64 nt, hsa
ugaguauucugauuaucagauuuguaaauaacuauguaaauagaaacagauaccagaauaaauc

SEQ ID NO: 130060 - RNA, 64 nt, hsa
uagugagucucccuucaaaauacgcaguagguaguguaaauacugcuuguuugugucucucugc

SEQ ID NO: 130061 - RNA, 64 nt, hsa
ucugaagaagaaaaagaaauuuuauguauguauguguaaauauguguauauauuucuaucucuu

SEQ ID NO: 130062 - RNA, 64 nt, hsa
uuuuaacaacaacaaaaguuuagguucuaauuuauguaaauaccuaguauguguauuuuugacu

SEQ ID NO: 130063 - RNA, 56 nt, hsa
uucgagaaauuaaaucuuaaaaucuguguaaauagaaaacuugaaccauuaguaau

SEQ ID NO: 130064 - RNA, 64 nt, hsa
aaccauugcauucuuguacacugauuugaaaugcuguaaauaugucccaauuuguauugauucu

SEQ ID NO: 130065 - RNA, 64 nt, hsa
ucccaauuuguauugauucucuuuaaauauaaaauguaaauaaaauauuccaauaaaaguuugu

SEQ ID NO: 130066 - RNA, 64 nt, hsa
acaccuaagagucucuauuucacaauuauauuuuuguaaauaguauaugcauuuuuaauacauu

SEQ ID NO: 130067 - RNA, 64 nt, hsa
aucauagccuaugaugauaaacacugccuauauauguaaauagcuuuucaucaauucuuaaauu

SEQ ID NO: 130068 - RNA, 64 nt, hsa
gaauggugguuucagagaucucucuucccaaauguguaaauauucuauaccagauaaguuuaaa

SEQ ID NO: 130069 - RNA, 64 nt, hsa
uuuuuuauucugucggguuacugaccucacuuuauguaaauacuucgcaugacaaauucaguaa

SEQ ID NO: 130070 - RNA, 64 nt, hsa
aaagcacuacuuuguaaagaugacuacccaagauuguaaauacaaaauuuaaaaagguacuuaa

SEQ ID NO: 130071 - RNA, 64 nt, hsa
uauugcaauaaaugucaaaugaaacaagcucuuguguaaauagacuucugugccuaauagugac

SEQ ID NO: 130072 - RNA, 64 nt, hsa
uugucaguguguugaauugcaaaccgaguacugcuguaaauacuauguuuacuucaugcugaau

SEQ ID NO: 130073 - RNA, 64 nt, hsa
ugacuggcauguguucaugcuauucagaaucacuuguaaauagucugcuuuuaaaggagggcau

SEQ ID NO: 130074 - RNA, 64 nt, hsa; identical to SEQ ID NO: 130058

SEQ ID NO: 130075 - RNA, 64 nt, hsa; identical to SEQ ID NO: 130059

SEQ ID NO: 130076 - RNA, 64 nt, hsa
uagugagucucccuucaaaauacacaguagguaguguaaauacugcuuguuugugucucucugc

SEQ ID NO: 130077 - RNA, 64 nt, hsa
cgaggucaagagaucgagaccauccuggccaacaugaugaaaccccguuucuacuaaaaauaca

SEQ ID NO: 130078 - RNA, 64 nt, hsa
aggcccaacauuaaacacaaagcuguugaaauauugaugaaaauguaagaauuuuugugaccac

SEQ ID NO: 130079 - RNA, 64 nt, hsa
agaaaugucagacacucuuuggauuugauucagaugaugaaagugccugaugaaaacgguucag

SEQ ID NO: 130080 - RNA, 64 nt, hsa
acucuuuggauuugauucagaugaugaaagugccugaugaaaacgguucagaaagaucugucaa

SEQ ID NO: 130081 - RNA, 64 nt, hsa
aaaauuugagacuauuuaaacuuauaaaucauauugaugaaaagauuuaagcacaaacuuuagg

SEQ ID NO: 130082 - RNA, 64 nt, hsa
aaguuuagaagcugagacacaaaggguugggagcugaugaaacucacaaaugaugguaggaaga

SEQ ID NO: 130083 - RNA, 64 nt, hsa
uuaaaguagguagagaguagagucacacuuuuuuugaugaaaugagucacagagaaguuacaug

SEQ ID NO: 130084 - RNA, 64 nt, hsa
aggaacuaugcuggaaacugauaguucacuauucugaugaaaaggcugguuuuguuguuguugu

SEQ ID NO: 130085 - RNA, 64 nt, hsa
uguaauuucguugcuauaguaguuugcuaaaagaugaugaaaaugcagaaugucuuuuuaaaug

SEQ ID NO: 130086 - RNA, 64 nt, hsa
cucugaaggcaaauauaagcugggaaaaaaguuuugaugaaauucuugaaguucauggugauca

SEQ ID NO: 130087 - RNA, 64 nt, hsa
caguugaaaauggauuuuuaaauuauacuguagcugaugaaacuccugauuuuguaguuaauuu

SEQ ID NO: 130088 - RNA, 64 nt, hsa
gaauauugugagguguuuauaaaauuauaaaauuugaugaaauucuuacaauuauuaauuauuu

SEQ ID NO: 130089 - RNA, 64 nt, hsa
auaacucuuuaaaaagcccucuuaaugaugcucuugaugaaagaaaaagacagaaggaaggaag

SEQ ID NO: 130090 - RNA, 64 nt, hsa
uuuuaaaaauugagugaggguuauuauuuguauuugaugaaagaaaauccaaauaaagcccacc

SEQ ID NO: 130091 - RNA, 64 nt, hsa
aauaaaggacguucaugagaaaucgacuaccagcugaugaaauaccugcaaagugcucuaaaaa

SEQ ID NO: 130092 - RNA, 64 nt, hsa
ugugaauacuucucucagugugagagguuagccgugaugaaagcagcguuacuucugaccgugc

SEQ ID NO: 130093 - RNA, 64 nt, hsa
uuucaguggcgauauauccccuuugaccuucucuugaugaaauuuacaugguuuccuuugagac

SEQ ID NO: 130094 - RNA, 64 nt, hsa
gagaaaguauuugaagaaacuguugcacaacauaugaugaaauuuugauuucucugaaucucag

SEQ ID NO: 130095 - RNA, 64 nt, hsa
ccaacacuuaaucauggcagccaggaugggugaaugaugaaagcucuucugcaugagccgguuu

SEQ ID NO: 130096 - RNA, 64 nt, hsa
ucuuacacauaauuuaaauguuaucauacuuuuuugaugaaaacauaaugccuuaguaaaauag

SEQ ID NO: 130097 - RNA, 64 nt, hsa
ugucuaauauuuaaacauguacuggcacaauuugugaugaaaauauuagcacauuugcaauaau

SEQ ID NO: 130098 - RNA, 64 nt, hsa
aauguaguugucacacuaaaauuuaauuggauauugaugaaaucauuggccuggcaaaauaaaa

SEQ ID NO: 130099 - RNA, 64 nt, hsa
uuccaaaguguaaguuugugaauagauuuuagcaugaugaaacugucauaauggugaauguuca

SEQ ID NO: 130100 - RNA, 64 nt, hsa
ggagcuggugugacuguuaccagacagaggcaacugaugaaaaagcccugugaaagauaggaug

SEQ ID NO: 130101 - RNA, 64 nt, hsa
cauauggaugauaaagcuguaaauaaaauucuuuugaugaaacucuccgguuacgagacaaaga

SEQ ID NO: 130102 - RNA, 64 nt, hsa
agauucaacucuaaguugcaagcgaagucaaaacugaugaaaauuuauuuagaaaaaucuaaaa

SEQ ID NO: 130103 - RNA, 64 nt, hsa
gagauaaagcuuacuugacuuucaaauggagagaugaugaaaacccacucauucacucuuucag

SEQ ID NO: 130104 - RNA, 64 nt, hsa
aaucuaaaaucaaccaggcuacuuaagucugcucugaugaaacccaauaaucucucaauaccuu

SEQ ID NO: 130105 - RNA, 64 nt, hsa
auucuaagaucaaccagguuacuuaaguccgcucugaugaaacccagucucucaauaccuuccu

SEQ ID NO: 130106 - RNA, 64 nt, hsa
uguaaucauguuauuuuauucauuguuaaugcuuugaugaaaaggcuuuauaugcaguagaucu

SEQ ID NO: 130107 - RNA, 64 nt, hsa
aaaaugugccuguuuaaagcacucaguagagggcugaugaaacuaauuuuuuuuccuuuaagac

SEQ ID NO: 130108 - RNA, 64 nt, hsa
guuaccgaggcugugccuagagaguggagauuuuugaugaaaggugugcucgcucucugcguuc

SEQ ID NO: 130109 - RNA, 64 nt, hsa
caucccacucagccccucccuaccccucaagauuugaugaaaauuccaaccaugaggaugggug

SEQ ID NO: 130110 - RNA, 64 nt, hsa
caucaaagagcaauaccuguuguuuagcaaagagugaugaaaaauugaucuuguuuugaaauug

SEQ ID NO: 130111 - RNA, 64 nt, hsa
cucgcagguuacuaggcaucaagauuuauaucuuugaugaaacgaaacaaauguaauaugcauc

SEQ ID NO: 130112 - RNA, 64 nt, hsa
uacagagcugaaggacggggggcgguaggggucuugaugaaaccucuugaacgaagcacaguuu

SEQ ID NO: 130113 - RNA, 64 nt, hsa
gacggguggcugacaucuguaaagaauccuccugugaugaaacugaggaaucggguggccgggc

SEQ ID NO: 130114 - RNA, 64 nt, hsa
cucagcuucagguucuucaccucuaagauggggaugaugaaaacaguaccugucaugcagaauu

SEQ ID NO: 130115 - RNA, 64 nt, hsa
cuuuuauuuuauuagucaccggggaacuuuucagugaugaaaauacacaggguaauaaaccuuc

SEQ ID NO: 130116 - RNA, 64 nt, hsa
cagcuuaugagggcaaugggggcaccuaaacucuugaugaaagaacuuuaaaaagaaauguaaa

SEQ ID NO: 130117 - RNA, 64 nt, hsa
uguaucuuugaccuccauuuuacuuuuaaucaucugaugaaauuuuguuuuagguaauuuccuu

SEQ ID NO: 130118 - RNA, 64 nt, hsa
uggcacauguauauuacuaaaguagauaauuccaaugagaaauacuaccagauuauuguuauaa

SEQ ID NO: 130119 - RNA, 64 nt, hsa
uagaagcaguguaguucuaccucucauuuuacagaugagaaaaccgaagcccagaaaaacucuc

SEQ ID NO: 130120 - RNA, 64 nt, hsa
cuggaugugcuuugaucguuaaugagguggucacaugagaaaugauaccuguuacuacuguauu

SEQ ID NO: 130121 - RNA, 64 nt, hsa
auaucuuuuacuacuugaacauuuaaauuucuaaaugagaaagguauauauauuacuguaacug

SEQ ID NO: 130122 - RNA, 64 nt, hsa
gguaaguggccuggugaguggagguagaaaaaugaugagaaaugaacugagagcauuaagcaga

SEQ ID NO: 130123 - RNA, 64 nt, hsa
cuauuuagggacaaagaagguauaaaguccagagaugagaaaacugggucagcccucagaaacu

SEQ ID NO: 130124 - RNA, 64 nt, hsa
cccaaauguuguggaaaacuggaauauuaagaaaaugagaaauuauauuuauuagaauaaaaug

SEQ ID NO: 130125 - RNA, 64 nt, hsa
aguuugucacuugagcuuauguacagaaugcuauaugagaaacacuuuuagaauggauuuauuu

SEQ ID NO: 130126 - RNA, 64 nt, hsa
augauguuauuauauaugcuuaugaaacagauuuaugagaaaaguuuuuuuuaaauaaauuauu

SEQ ID NO: 130127 - RNA, 64 nt, hsa
uguuauauuuguuuuccuguauuuagguggagaaaugagaaaaagcuuuaguuccaauugacag

SEQ ID NO: 130128 - RNA, 64 nt, hsa
gaggcaguguaacaaccuauagugccauugauccaugagaaaaagauuuucugguacuacucca

SEQ ID NO: 130129 - RNA, 64 nt, hsa
uaacuuuuaauuuuuauuuuggcaaaacugucaaaugagaaaaaugauuuuaaaaacuuuuuuu

SEQ ID NO: 130130 - RNA, 64 nt, hsa
aaaguuuauuuuuaccaaagagaugcaauucauuaugagaaaguauugcauaauaaauuuuguu

SEQ ID NO: 130131 - RNA, 64 nt, hsa
uuggggccagaccuuugccugauuccugauucccaugagaaaucagaacugcuuucugcagcaa

SEQ ID NO: 130132 - RNA, 64 nt, hsa
auaaaaccuaccucaggguugcuucaaggauuaaaugagaaaauaugucaacaauaaagaccug

SEQ ID NO: 130133 - RNA, 64 nt, hsa
ucucagaaacaaccagccuugaaggcuacaacugaugagaaagauucuguuucgaacauagcca

SEQ ID NO: 130134 - RNA, 64 nt, hsa
ucugagaaaccaccaggcuugaaggcuacaagugaugagaaagauucuguuuugaauauagcca

SEQ ID NO: 130135 - RNA, 64 nt, hsa
aauguccuauuucugauuauuaagacuaguauaaaugagaaaauccaagcuauuaaguaccauu

SEQ ID NO: 130136 - RNA, 64 nt, hsa
ccucagagaaauuugauagacucaaacagauaguaugagaaauaucuuugaaagaaauauggag

SEQ ID NO: 130137 - RNA, 64 nt, hsa
uuugaaauugcauuacaguucauaaaaauugaaaaugagaaauuaaaccugcaagugaaacauu

SEQ ID NO: 130138 - RNA, 64 nt, hsa
ccucaguaaaaauagugaagacaugcaucauggaaugagaaaaugagaaaggaaugaguugucu

SEQ ID NO: 130139 - RNA, 64 nt, hsa
aaaauagugaagacaugcaucauggaaugagaaaaugagaaaggaaugaguugucuaacaucac

SEQ ID NO: 130140 - RNA, 64 nt, hsa
ucaaauccuaaucaggaaaaagacucaucuaguaaugagaaacaaacuauuagucugccaguuu

SEQ ID NO: 130141 - RNA, 64 nt, hsa
gauuaauagcagcagcauguucaguuucgcuuauaugagaaacauguuuaggcaacuagucaga

SEQ ID NO: 130142 - RNA, 64 nt, hsa
ucucuuacaagaaugaagccauauucaaccccagaugagaaaacccaacagauccaucccuuga

SEQ ID NO: 130143 - RNA, 64 nt, hsa
cuucauaauaaauagcaaaauaauugaagcuuccaugagaaagaaaacacuauuuugauaaauu

SEQ ID NO: 130144 - RNA, 64 nt, hsa
aauaauuuccuucuuuaaagcaaguauauauaguaugagaaacuuggaggcauuucauacacac

SEQ ID NO: 130145 - RNA, 64 nt, hsa
gaauuuaggcaauguuucucauuuggaaaaugaaaugagaaauaauuuccuucuuuaaagcaag

SEQ ID NO: 130146 - RNA, 64 nt, hsa
gcaugcacacacacaaaaaauaccuaaauuuuggaugagaaaaugauaaaauaugcuaaguucu

SEQ ID NO: 130147 - RNA, 64 nt, hsa
cuggugggaugguaauggggauuagagaacugacaugagaaaagaggagcuguuuugguauuaa

SEQ ID NO: 130148 - RNA, 64 nt, hsa
gccuucaauccuggccaaguuggaguagacugguaugagaaaacuaugauuaguucacauuuac

SEQ ID NO: 130149 - RNA, 64 nt, hsa
auacuuguacuucuaauaacauuuuucaugaaucaugagaaaauuuccacagauacuucccuua

SEQ ID NO: 130150 - RNA, 64 nt, hsa
ggcccuugauucuggcaaggcaaauaaagccagaaugagaaauuaccaucuucuacuagagaaa

SEQ ID NO: 130151 - RNA, 64 nt, hsa
acaacuacauguauguguggcauuuuuguuagagaugagaaaaggauugagaaggauaaacugg

SEQ ID NO: 130152 - RNA, 64 nt, hsa
ugucgcuguuuaaguagaacaaugccaacgauguaugagaaacagggaauaaaucaggauuugu

SEQ ID NO: 130153 - RNA, 64 nt, hsa
acaccuugaucuuggacuuccagccuccaaaacuaugagaaauaaauuucuauuguuuaaguca

SEQ ID NO: 130154 - RNA, 64 nt, hsa
ucuuuuuuauuugggauaauuuaaaaaaugauggaugagaaaagaaagauugguccggguuaau

SEQ ID NO: 130155 - RNA, 64 nt, hsa
agcaaguagcuuacaaggggacaauucuggacuaaugagaaagaccugaagugaaggcuagaga

SEQ ID NO: 130156 - RNA, 64 nt, hsa
gagauggugagcacaagguaagucauaaagaauaaugagaaaauaaaucuaugcuggugcagcu

SEQ ID NO: 130157 - RNA, 64 nt, hsa
auuaucaguuaggcaauguuuuuaaaacuuaguaaugagaaacugugaaaagagccaaguguua

SEQ ID NO: 130158 - RNA, 64 nt, hsa
aagaauuaguccaaauggaaccccuugaaggauaaugagaaaccacaaggccugccucugacug

SEQ ID NO: 130159 - RNA, 64 nt, hsa
uggauugagagagacacuacaugacuccaaguauaugagaaaaggacagagcucuaauugauaa

SEQ ID NO: 130160 - RNA, 64 nt, hsa
gguuaccaagauuaaaaagugagauaaauggucaaugagaaagaauggaagaugguaaacaauc

SEQ ID NO: 130161 - RNA, 64 nt, hsa
ggcuuaucagaacuccuuucuaaggagcacuagaaugagaaaucauguuguucgaucguuucac

SEQ ID NO: 130162 - RNA, 64 nt, hsa
agccaacuuaaaccugugcuuucauguuuaagaaaugagaaauugugccaaagauagcagaaga

SEQ ID NO: 130163 - RNA, 64 nt, hsa
ggguauucaauaauugggugcccuaaauuucuggaugagaaaauuuucaauucuggccaugaga

SEQ ID NO: 130164 - RNA, 64 nt, hsa
aaauuucuggaugagaaaauuuucaauucuggccaugagaaagaaaaaaaaauaaacagccuuc

SEQ ID NO: 130165 - RNA, 64 nt, hsa
uauuuuacugccuuuccuuuuaauuuuuguuugaaugagaaaaguuuaauacaacaggugucca

SEQ ID NO: 130166 - RNA, 64 nt, hsa
gaauacuccauccccuucccucccagugaauggaaugagaaaagccuucuuccuuugcuucagg

SEQ ID NO: 130167 - RNA, 64 nt, hsa
aaaagcacuucuuacauggcggcagcaagagaaaaugagaaagaagcaaaaguggaaaccccua

SEQ ID NO: 130168 - RNA, 64 nt, hsa
ucaugcaguugcuuagaauaaucauuacuguuauaugagaaacauuuuaguaauuuaauaaaag

SEQ ID NO: 130169 - RNA, 64 nt, hsa
ugauaguacauauugcuuuguuuaugucuuugagaugagaaaggcuuaaaacuugagaauauau

SEQ ID NO: 130170 - RNA, 64 nt, hsa
ucacugguugggguccauuuuguauauaacuuuuaugagaaaaaaaugguaauuauuucacgca

SEQ ID NO: 130171 - RNA, 64 nt, hsa
ugacaacaguuacauaauucacucugaguguuuuaugagaaagccuucuuuugggggucaacag

SEQ ID NO: 130172 - RNA, 64 nt, hsa
cauguuucacaaggucuuuaaagugacuaauggcaugagaaauacaaaaauacucagauaaggu

SEQ ID NO: 130173 - RNA, 64 nt, hsa
aaugauguuuuguauauuuuaauagacugauaggaugagaaagauuuauauuauuagauuucag

SEQ ID NO: 130174 - RNA, 64 nt, hsa
uaauuugaaaaauauugucauaucuggcccuuugaugagaaaaggaaauuacaauaauaaaguu

SEQ ID NO: 130175 - RNA, 64 nt, hsa
aggccuucuaaaaagcagguuaaaaugcucuaaaaugagaaagccugugguuucacuuauuuau

SEQ ID NO: 130176 - RNA, 64 nt, hsa
gcuuuguaaaaugaagaguagaauuccaagaaaaaugagaaauaauuuuguaaaacuuaacaaa

SEQ ID NO: 130177 - RNA, 64 nt, hsa
aaacuucccugugauucccccgaauacccccaaaaugagaaacaaaauuuuuuuucuuacucca

SEQ ID NO: 130178 - RNA, 64 nt, hsa
caguaccagcaagucaugagauuuuuuaguaaagaugagaaagaugguugaagaaaauuagugc

SEQ ID NO: 130179 - RNA, 64 nt, hsa
uuuuaauaaugcacuauuacccagggcagauauuaugagaaacuguuucuucucuaaggguuua

SEQ ID NO: 130180 - RNA, 64 nt, hsa
uuaucccacuuaugagauugggaaaaagaucaauaugagaaauaccauacagauaccuuaaaug

SEQ ID NO: 130181 - RNA, 64 nt, hsa
uuauuuaaauauuauguuugugaacuaucuaagcaugagaaaauacaaagcuuucuuuguaucu

SEQ ID NO: 130182 - RNA, 64 nt, hsa
auugucaugccagauugucagaaguuccagacagaugagaaagcaaaaaguacuuuguaaagug

SEQ ID NO: 130183 - RNA, 64 nt, hsa
ugauaaaaaauacagacuuaaugagcaacucaagaugagaaaacugcucuuuuuccaaaaauua

SEQ ID NO: 130184 - RNA, 64 nt, hsa
agcuguacuugccccccuccccaaaaaaccauggaugagaaagaaaggagucaggggccugaua

SEQ ID NO: 130185 - RNA, 64 nt, hsa
uuucaguaacccagcugcaauaccugucuguaauaugagaaaaaaaaaaugaaucuauuuaauc

SEQ ID NO: 130186 - RNA, 64 nt, hsa
cuagcuuacaagggcuagaucuaagauuauucccaugagaaauguugaauuuaugaagaauaga

SEQ ID NO: 130187 - RNA, 64 nt, hsa
ugaguuacucugcuacucuuaggcugcauaguuuaugagaaaaugaacacaugcauuuauggau

SEQ ID NO: 130188 - RNA, 64 nt, hsa
ugaucucuuucaccuuuauuucaucuucauaagaaugagaaaggcucaaaaggaagcacuuuua

SEQ ID NO: 130189 - RNA, 64 nt, hsa
agccccgguaacuggaggaaugggagccguuuugaugagaaaaaugggcuggagagaaggagaa

SEQ ID NO: 130190 - RNA, 64 nt, hsa
auaaaauuggcaaccagccacuauuuuguugacuaugagaaaguuaaaaguuuauguuaauuuu

SEQ ID NO: 130191 - RNA, 64 nt, hsa
uuuaauuucaaauagaauauggacuuaaauguuaaugagaaaauggcuuuaaucaauucuagca

SEQ ID NO: 130192 - RNA, 64 nt, hsa
cuauuggaagauaaacuugucaaacuugucaagaaugagaaaagccaaauuagaaaauccuaug

SEQ ID NO: 130193 - RNA, 64 nt, hsa
caacuccauuuguugagggucuuuguguucuucaaugagaaaucaaauuugagacguugaaauu

SEQ ID NO: 130194 - RNA, 64 nt, hsa
aucugccuguuauaaagaugaacaaaaaaacuuaaugagaaagaucacagauacguaauaauuu

SEQ ID NO: 130195 - RNA, 64 nt, hsa
uugcuaucuauaaaaaagagaaaaaagaaaaaaaaugagaaaaaaguaagaaaaaaaaaaaucc

SEQ ID NO: 130196 - RNA, 64 nt, hsa
auggaaagaaguuauagaaucuucauagaguucuaugagaaaaaauauacuugcuaucuauaaa

SEQ ID NO: 130197 - RNA, 63 nt, hsa
uacuggccaaguucaagugaguaagccgcgucccccaacuacagcuggagacggggccagcuc

SEQ ID NO: 130198 - RNA, 63 nt, hsa
cgugcugacggcaaggggcaauggagugaguuucccaacuaagaaaccacuauuauauauuuu

SEQ ID NO: 130199 - RNA, 63 nt, hsa
accagcacagaacugaggaacaucugcaggaggcccaacuagugaaaggcuuugccuccgggg

SEQ ID NO: 130200 - RNA, 63 nt, hsa
uguggcagcccauggguaugacauaggccaaggcccaacuaacagucaagaaacagcuccucg

SEQ ID NO: 130201 - RNA, 63 nt, hsa
aucuuuuuaaucauaaucaacaucaguuuuugacccaacuaaccuugacuguauucaaacuua

SEQ ID NO: 130202 - RNA, 63 nt, hsa
uacuuauuguuuuuagaauuacuuuuacauuuucccaacuagauggccuagaguccaacauua

SEQ ID NO: 130203 - RNA, 63 nt, hsa
aauuagcugggcaugguggccugugccuauagucccaacuacuuagaggaggaucgcuugauc

SEQ ID NO: 130204 - RNA, 63 nt, hsa
gcauuuaaaaggaauaaccuccuucucccuuuccccaacuacaaaaauguuuggcaacuuugu

SEQ ID NO: 130205 - RNA, 63 nt, hsa
aauuagcuggacaugguggcaaucagcucuagucccaacuacuuggaggcugaagcaggaaga

SEQ ID NO: 130206 - RNA, 63 nt, hsa
gggaaguuuauaauagccuaacacuaccccacccccaacuaggaggaaccucuguuuucaaga

SEQ ID NO: 130207 - RNA, 63 nt, hsa
cucucaaaaauaaucuuaaauacugcaaauagucccaacuaagauucagucaguauguuuguu

SEQ ID NO: 130208 - RNA, 63 nt, hsa
ccuagaguggcaaauggaacuucucugaucucccccaacuagacuggagcccccgaaggaugg

SEQ ID NO: 130209 - RNA, 63 nt, hsa
auuuagcugggcaugguggcaugugccuguaaucccaacuacuagggacagugaggcagaagg

SEQ ID NO: 130210 - RNA, 63 nt, hsa
cuccagggcucaaggauccuccugccucagucucccaacuaagugggacuacaggcacgugcc

SEQ ID NO: 130211 - RNA, 63 nt, hsa
aaagaaaagacgaauauuuaaggugacagauaucccaacuacgcugauuugaucuuuacaaau

SEQ ID NO: 130212 - RNA, 63 nt, hsa
gauuacaggcgugagccaccgugccuggccacgcccaacuaauuuuuguauuuuuaguagaga

SEQ ID NO: 130213 - RNA, 63 nt, hsa
gauuucuaaaauauucuaugugugauuucuguucccaacuagguucuaagugccaucaaagca

SEQ ID NO: 130214 - RNA, 63 nt, hsa
auuuaaccccuugguacugaaaaugagaaaauccccaacuaugcaugccaagggguuaaugaa

SEQ ID NO: 130215 - RNA, 63 nt, hsa
cauuucauuuaagauaaggcucauauaguauuacccaacuaguugguaaugugauuauguggu

SEQ ID NO: 130216 - RNA, 55 nt, hsa
uuacaggaagugaagaaugagauggcccaacuaaaccaauuuggaaucauuaacu

SEQ ID NO: 130217 - RNA, 63 nt, hsa
uuuuuaaaaaggaucacgucuaaugcccauuuucccaacuauucuuuccaaaguaagauauaa

SEQ ID NO: 130218 - RNA, 63 nt, hsa
aauuagcugggcaugguggcauauaccuguaaccccaacuacuuggguggcugaggcaggaga

SEQ ID NO: 130219 - RNA, 63 nt, hsa
cugaguagcuggauuacaggcaugugccacccacccaacuaauuuuuguguuuuuaauaaaga

SEQ ID NO: 130220 - RNA, 63 nt, hsa
guuuagaaagaggaacaccagauugaccacauucccaacuagaaaaaucuucuugcgucaauc

SEQ ID NO: 130221 - RNA, 63 nt, hsa
aauuagccaagugugguggcauaugccuguaaucccaacuacucagaaggccgaggcaggaga

SEQ ID NO: 130222 - RNA, 63 nt, hsa
agcuuuggaagcugucaaucccggagcaacuuucccaacuacccaaccccaccauggccagga

SEQ ID NO: 130223 - RNA, 63 nt, hsa
gacacaggagcuccuccaggagcaggcugggaucccaacuaucgcuuguugccucuuuuucaa

SEQ ID NO: 130224 - RNA, 63 nt, hsa
aauuagccaggugugguggcgggcgccuguaaucccaacuacucaggaggcugaggcuagaga

SEQ ID NO: 130225 - RNA, 63 nt, hsa
cacccacaccuaagucacagaauuucuaaguuccccaacuacucucacacccuuuuaaagaua

SEQ ID NO: 130226 - RNA, 63 nt, hsa
ccccugcacacucccacccaggacagcccccagcccaacuaggaaagggccaugggcagaggg

SEQ ID NO: 130227 - RNA, 63 nt, hsa
agagcaugguccuucagaaaaggcaauaaacggcccaacuagugcuucuggcgaugacauuuc

SEQ ID NO: 130228 - RNA, 63 nt, hsa
gggcagcagcgcccccacggggcucgcugggcgcccaacuacgacccgcucugcucacucugc

SEQ ID NO: 130229 - RNA, 63 nt, hsa
gguccaggaccagaccucucuacaaaaaauugccccaacuacaguuugcaaccccaaaccaca

SEQ ID NO: 130230 - RNA, 63 nt, hsa
uggugggcccagguccuuguaucaugccacggucccaacuacaggguccuagcugggggccug

SEQ ID NO: 130231 - RNA, 63 nt, hsa
uucauuucagggcauagucaaaggcaucauccucccaacuacccacuugauuauguauuucag

SEQ ID NO: 130232 - RNA, 63 nt, hsa
aaccaccuuuccagccauagagauuuuaauuagcccaacuagaagccuagugugugugcuuuc

SEQ ID NO: 130233 - RNA, 63 nt, hsa
cugcaguucuacaggcuacaccgggaagaaaggcccaacuaccgucucgagugccugcagugg

SEQ ID NO: 130234 - RNA, 63 nt, hsa
ugaguauauauuuuaucucuuauaccuguaucucccaacuagaaacagcuccaguguuuuuaa

SEQ ID NO: 130235 - RNA, 63 nt, hsa
agugaugcccuucaccccagggaggugucuguucccaacuaguuuauguggcacugagacauc

SEQ ID NO: 130236 - RNA, 63 nt, hsa
aggguaucgcauacucaaaugguagacaaugaccccaacuaaaucuuccugauguuacacugc

SEQ ID NO: 130237 - RNA, 63 nt, hsa
cagccaaauagcuuauaaggcuuauggcaaugucccaacuauugcaaucauaaaacccuaguu

SEQ ID NO: 130238 - RNA, 63 nt, hsa
gugauuaauuauugaaagugggguguugaagaccccaacuacuauuguagaguggucuauuuc

SEQ ID NO: 130239 - RNA, 63 nt, hsa
guuaggaagugauaaaacaucucucuucuccuucccaacuacugcaugaagaaauucuacuuc

SEQ ID NO: 130240 - RNA, 63 nt, hsa
uaacauuccuucaaccacuugaagauccaaauucccaacuaguauucucuucuccacacuuaa

SEQ ID NO: 130241 - RNA, 63 nt, hsa
ugcgccucuggacgugcuagccauuuccagugucccaacuacugucaucgugagguuuucauc

SEQ ID NO: 130242 - RNA, 63 nt, hsa
aauuagcugggcgugguggcgcaugccuguagucccaacuacuagggaggcugaggcaggaga

SEQ ID NO: 130243 - RNA, 63 nt, hsa
auccagugaccucucucucugggacuugguuuccccaacuaaaauuugaaguaguugaauggg

SEQ ID NO: 130244 - RNA, 63 nt, hsa
uuuuuccuuuuagccaucuuuuguucuuguaaucccaacuagauaggcuuuaugcucacauca

SEQ ID NO: 130245 - RNA, 63 nt, hsa
aaguaacuaagacuacaggcaugcaccaccauacccaacuaauuuuauuuuuuauuuuuugca

SEQ ID NO: 130246 - RNA, 63 nt, hsa
aauagccaggggcuacaggcauauaccaccaugcccaacuaauuuuuuaauuuuuuguagaga

SEQ ID NO: 130247 - RNA, 63 nt, hsa
aucacguugacauuagaccaaauacuuuugauucccaacuacucguuuguucuuuuucuccuu

SEQ ID NO: 130248 - RNA, 63 nt, hsa
gcauuuaguugaaugaagucuucuuggauuucacccaacuaaaaggauuuuuaaaaauaaaua

SEQ ID NO: 130249 - RNA, 63 nt, hsa
aauaagccaggugugguggugcaugacuguaaucccaacuacucagcaggagaagcacuugaa

SEQ ID NO: 130250 - RNA, 63 nt, hsa
uuuuuuuuuugagacggagucccacucuugucgcccaacuagaguguaguggcacaaucucgg

SEQ ID NO: 130251 - RNA, 63 nt, hsa
ccuuaacugucccaucugugcagaguccauugccccaacuagacugugagcuccuccucugag

SEQ ID NO: 130252 - RNA, 63 nt, hsa
ugccugguacuggugggggaaauaguccguauccccaacuauuaaggauuugucccaggccaa

SEQ ID NO: 130253 - RNA, 63 nt, hsa
ggguuuuguucccccuccaucucgauucucguacccaacuaaaaaaaaaaaaauaaagaaaaa

SEQ ID NO: 130254 - RNA, 63 nt, hsa
cccaccaugaagagaaagcaaacaaacagaaaccccaacuaggucacaccauuuuucuucuug

SEQ ID NO: 130255 - RNA, 63 nt, hsa
cuccucuucuugaaggccaaccuggagcaguuccccaacuacaccccgccuccccucaucugc

SEQ ID NO: 130256 - RNA, 63 nt, hsa
augauaucaaaagaauaaucaauuuaguuaccucccaacuaaaaaguaaaaaugaaaaagacg

SEQ ID NO: 130257 - RNA, 63 nt, hsa
cagaaaacucaguuucuuuauuccuucuuuucucccaacuacuguuacugguuauagaggucu

SEQ ID NO: 130258 - RNA, 63 nt, hsa
gaugugaaaaaggacuauggccacauucaaucgcccaacuacccagacgauuaccggcccagc

SEQ ID NO: 130259 - RNA, 63 nt, hsa
gagaagaaaacaucuauucucuccaaaaaugcacccaacuagcucuauguuuacaaauggaca

SEQ ID NO: 130260 - RNA, 63 nt, hsa
auuaaaguuuguguguuguguccauuuugcaaacccaacuaagccaggaccccaaugcgacaa

SEQ ID NO: 130261 - RNA, 63 nt, hsa
cacacacgcccacaugacaaucaucugaaaguccccaacuauacacauucuguucaaccaacu

SEQ ID NO: 130262 - RNA, 63 nt, hsa
uuugcauuaaauuacagaaauuuaauucagaaccccaacuacuguguuaugcaaaagcaagcu

SEQ ID NO: 130263 - RNA, 63 nt, hsa
gucucugaagacaaauaauuaaaccuuuuuuuucccaacuaaagaauggauuuaauuaaacua

SEQ ID NO: 130264 - RNA, 63 nt, hsa
gccaggauugauggcagcugagggaaauucuugcccaacuaaacccagaacucaaacuuaaca

SEQ ID NO: 130265 - RNA, 63 nt, hsa
cagucacugugcuauccuuguggagucuuguggcccaacuaccagagaacgcugucccccgac

SEQ ID NO: 130266 - RNA, 63 nt, hsa
gugacugauucccagccuguggcagggcguggucccaacuacucagccuagcacaggcuggca

SEQ ID NO: 130267 - RNA, 63 nt, hsa
agaggagaaaauuaauaaaucuuaaacuuggugcccaacuauuguaagaaauauuuaauuaca

SEQ ID NO: 130268 - RNA, 63 nt, hsa
ccgacuucuccuaugugucacuuauuccaagaacccaacuaugcccuuagguagaaagauuug

SEQ ID NO: 130269 - RNA, 63 nt, hsa
aauuagccaggcgugacggugcgugccuguagucccaacuacucggaaggcugaggcaggaga

SEQ ID NO: 130270 - RNA, 63 nt, hsa
guagauauguuugaauauagaaacuuuuuuuaccccaacuacugaauccaggaguaccaaaua

SEQ ID NO: 130271 - RNA, 63 nt, hsa
ggauuacagcgugaucuaccacaccuggccaaucccaacuacucuggaagcugaagcagcaag

SEQ ID NO: 130272 - RNA, 63 nt, hsa
cuuucugaucaaggccuuauuggaaagcagucccccaacuacccccagcugugcuuaugguac

SEQ ID NO: 130273 - RNA, 63 nt, hsa
acugacccugccuugggccuugcugcugcugcacccaacuacugagcugagaccacugaguac

SEQ ID NO: 130274 - RNA, 63 nt, hsa
aaguagcugggauuacaggcacccaccaccaugcccaacuaauuuuuguauuuuuauagagau

SEQ ID NO: 130275 - RNA, 63 nt, hsa
aggccagccccaucuugguccugucacccuggccccaacuauuaaagugccauuuccugucug

SEQ ID NO: 130276 - RNA, 63 nt, hsa
acacuuaggacuagaagauuagaaacuaccaaucccaacuacguaauaggaaaauguaggauc

SEQ ID NO: 130277 - RNA, 63 nt, hsa
accugcauuucccacaugacuuucuggaagccucccaacuauucuugcuuuucccagacagcu

SEQ ID NO: 130278 - RNA, 63 nt, hsa
cuggaaaucccugcccuguucagccccacagcucccaacuauuugguuccugcuccauggucg

SEQ ID NO: 130279 - RNA, 63 nt, hsa
cucagcugccuccccagcucuaucccaaccucucccaacuauaaaacuaggugcugcagcccc

SEQ ID NO: 130280 - RNA, 63 nt, hsa
aaaaagcuauuuucauugguacauuuaaagucccccaacuauggggagguaccaauucuggac

SEQ ID NO: 130281 - RNA, 63 nt, hsa
ccucauccggggcuuuggauagagugagaauuccccaacuaaauuggacuucucugcuuuauc

SEQ ID NO: 130282 - RNA, 62 nt, hsa
acccagcaauugaggugugauggcggccccaccccaacuaccaccucuuuucaggcacagac

SEQ ID NO: 130283 - RNA, 63 nt, hsa
uguucuugcgcuuugugcacuuggaggggaaaacccaacuacauaugcacuuucuugguugug

SEQ ID NO: 130284 - RNA, 63 nt, hsa
ucagauauacaugucuagauguuacagcaaagccccaacuaaucuuuagaagcauauuggaac

SEQ ID NO: 130285 - RNA, 63 nt, hsa
auagcuuacauuuccucuuuuugccuuuaucuccccaacuaaaauacaauggggaagaagucu

SEQ ID NO: 130286 - RNA, 63 nt, hsa
accuccuccaccugcuucaaccugcucaagcugcccaacuacagcaagaagagcguccuccgc

SEQ ID NO: 130287 - RNA, 63 nt, hsa
gccucucaccucugugccucugucuccuuguugcccaacuacuaucucagagauauugugagg

SEQ ID NO: 130288 - RNA, 63 nt, hsa
aaaugcagagaugaggcuaaggcaagaauaugccccaacuaaagcauagauuccccaaaguga

SEQ ID NO: 130289 - RNA, 63 nt, hsa
caccauacuuucuuguacauuugugucucccuucccaacuagacuguaagugccuugcgguca

SEQ ID NO: 130290 - RNA, 63 nt, hsa
gcuagaaacucucaguccaaaccuugcuccuuccccaacuaggggaccgauuuggacuugucu

SEQ ID NO: 130291 - RNA, 63 nt, hsa
acuuccaaaggucaauaugucguccuuuggcaucccaacuaacaauaaagaauaggcuauaag

SEQ ID NO: 130292 - RNA, 63 nt, hsa
acuucuaaaggucaauauaucauccuuuggcaucccaacuaacaauaaagaguaggcuauaag

SEQ ID NO: 130293 - RNA, 63 nt, hsa
cuauggggcccagggggaaaggccaaacagaaacccaacuacccccuaaugaagggccuggag

SEQ ID NO: 130294 - RNA, 63 nt, hsa
aauuauccuggcggaguuaugcacgcuuguagucccaacuaccugggaggcugaggcgggaga

SEQ ID NO: 130295 - RNA, 63 nt, hsa
aguaaacacaauugaagccucucugaaguuaaacccaacuauguuuauuaaaaugugugaaac

SEQ ID NO: 130296 - RNA, 63 nt, hsa
auugccgaguucuuauuuucaccuuuucauaaucccaacuacaauaacaagaauuuuauugac

SEQ ID NO: 130297 - RNA, 63 nt, hsa
uguaguuuccgcuuugcuugcuuguuuaacaaacccaacuaaagugcuugaggcuaccucuac

SEQ ID NO: 130298 - RNA, 63 nt, hsa
ggaaccauuccuuuauguugccccuuacugaugcccaacuaauguguuucugguuacuaacag

SEQ ID NO: 130299 - RNA, 63 nt, hsa
aacauaaccaaaaauuaaauugaaacaaaaugucccaacuaagaaaauauauagagcauuuua

SEQ ID NO: 130300 - RNA, 63 nt, hsa
guuaaguagcagagccagaauggacuucagaaucccaacuacaauacaaauguuuauuuaaau

SEQ ID NO: 130301 - RNA, 63 nt, hsa
aaaauuuaccuccuuugcaggccauaggacuagcccaacuaugagaaauagcuguucugugaa

SEQ ID NO: 130302 - RNA, 63 nt, hsa
aaaagccaggcauugguggugugugccuauagucccaacuacuagggaggcugaggugggagg

SEQ ID NO: 130303 - RNA, 63 nt, hsa
cuaauuugcuuuggugggguccuuaaaacauuucccaacuaaagaauagaauuguaaaggaaa

SEQ ID NO: 130304 - RNA, 63 nt, hsa
aaccucuauccuggaaccuguccucccuuucuccccaacuaugcaucuguugucugcuccucu

SEQ ID NO: 130305 - RNA, 63 nt, hsa
uccuggguucaagugauucuucugccucagccucccaacuagcugggacuacagguacaccac

SEQ ID NO: 130306 - RNA, 63 nt, hsa
uauuuaguguguucagugaugauaucacugguucccaacuagaugcuuguuggccacgggaag

SEQ ID NO: 130307 - RNA, 63 nt, hsa
ugggaauuguguggguauuaauguuuccauguucccaacuauguugagaaguggaaaaaaacc

SEQ ID NO: 130308 - RNA, 63 nt, hsa
agagauggcaaacacaguggcaagacaacauuacccaacuauagaagagaggcuaacuagcaa

SEQ ID NO: 130309 - RNA, 63 nt, hsa
caagugucucuugacuggcucaagaauuagggccccaacuacacacccccaagccacagggaa

SEQ ID NO: 130310 - RNA, 63 nt, hsa
cgcuggcuccuucuagacauuucuugccacuuccccaacuagaccacuccuagugauuacuga

SEQ ID NO: 130311 - RNA, 63 nt, hsa
uucugugauaaaaugaauucaccacucugguuacccaacuacagaaccuccuuugaucaggcc

SEQ ID NO: 130312 - RNA, 63 nt, hsa
uuauugcuuuaaacaaguuugugcuuaaucugucccaacuaaaauggagcuuauaaacuuacu

SEQ ID NO: 130313 - RNA, 63 nt, hsa
aauuagccaggcaugguggcaaacgccuguaaucccaacuacuugggaggcugaggcaggaga

SEQ ID NO: 130314 - RNA, 63 nt, hsa
acuuucccagcccuuugguuuguggguaucugccccaacuacuguugggaucagccuccuguc

SEQ ID NO: 130315 - RNA, 63 nt, hsa
cuauuggagacaauccuuugaucauaaauucuccccaacuauaaaucauuuuaugucuuuauc

SEQ ID NO: 130316 - RNA, 63 nt, hsa
gucuuuugcccaccccccuggcauucagcuggacccaacuaggccaucaugaguggcuucucc

SEQ ID NO: 130317 - RNA, 63 nt, hsa
aaguagcugggacuacaggcacacgccaccacacccaacuaauuuuuguauuuuuaguagaga

SEQ ID NO: 130318 - RNA, 63 nt, hsa
ugugacaaaugguugaaaaggagucaacauggccccaacuauagugccggaaccuuuucauca

SEQ ID NO: 130319 - RNA, 63 nt, hsa
aauuagccagaugugguggugcacaccuguagucccaacuauucggcaggcugaggcaguaga

SEQ ID NO: 130320 - RNA, 63 nt, hsa
gacuccgucacaacaacaacaacaaaaagcuuccccaacuaaagccuagaagagcuucugagg

SEQ ID NO: 130321 - RNA, 63 nt, hsa
cagccaagaaacucacccaaagccuguagccuccccaacuacuccagacuguccugcucaccc

SEQ ID NO: 130322 - RNA, 63 nt, hsa
uggaggaaaaaugacuaaggacugagcccccuacccaacuacccccaccccaaucccaccuuc

SEQ ID NO: 130323 - RNA, 63 nt, hsa
uuggcaggacauggaauuuggccucaugacaggcccaacuagggauaggaaggaaaaugaaga

SEQ ID NO: 130324 - RNA, 63 nt, hsa
caggcccuggcucuguaaccauuaaccucuucccccaacuaacaccaaugaaaacaccauucc

SEQ ID NO: 130325 - RNA, 63 nt, hsa
ggguguggcuuuuuuucucuccuuuuuaccaaccccaacuaaacugggaguaagacuuaguca

SEQ ID NO: 130326 - RNA, 63 nt, hsa
aaaucuugcagagguagcuccgaaaccaucuggcccaacuagccucaacugacagcugaggaa

SEQ ID NO: 130327 - RNA, 63 nt, hsa
aaguagccgggcgugguggugggcgccuguagucccaacuacucaggaggcugaggcaggaga

SEQ ID NO: 130328 - RNA, 63 nt, hsa
cacauccaccuccauccccaacccauccucauccccaacuacagccccaaacccagccccaga

SEQ ID NO: 130329 - RNA, 63 nt, hsa
ucuuaaaggaagcaggggcuggaugccuuucaucccaacuauucucugugguaucaaaaagaa

SEQ ID NO: 130330 - RNA, 63 nt, hsa
gagcagccagcccucugccccugcccagggcuccccaacuauaggccugggacccccgcccag

SEQ ID NO: 130331 - RNA, 63 nt, hsa
uaguagcuggcauuacaggcacaugccaccacgcccaacuaauuuuuauauuuuuaguagaga

SEQ ID NO: 130332 - RNA, 63 nt, hsa
ccuuuccccucuucccugucuuccccaccuucccccaacuacccgggccugacccggccccua

SEQ ID NO: 130333 - RNA, 63 nt, hsa
cagugccacccacuccuugggccccuaggaugacccaacuacccccauaacuuucugcuuccc

SEQ ID NO: 130334 - RNA, 63 nt, hsa
guuauggucaaucccaaaagucaccacuccauucccaacuagacauuaccaaagugaccuacc

SEQ ID NO: 130335 - RNA, 63 nt, hsa
gaguagcugggauuacaggcaugcgccaccacgcccaacuaauuuuguauuuuuaguagagac

SEQ ID NO: 130336 - RNA, 63 nt, hsa
ccugagucaggcgugguggugcgugcaucuagucccaacuauuugggaggcugaggcaggagg

SEQ ID NO: 130337 - RNA, 63 nt, hsa
ugaucaccaccaacaucauaggucuauaaaucacccaacuaagaucagggguguuucauggga

SEQ ID NO: 130338 - RNA, 63 nt, hsa
auauccucucuugccagcuuuuucccgugcucccccaacuauguaucagauaagauucuuuga

SEQ ID NO: 130339 - RNA, 63 nt, hsa
aauggaacccuugauuuccuaccucaguguacacccaacuauugguuguaucaguuuguguau

SEQ ID NO: 130340 - RNA, 59 nt, hsa
ucacagagccaagugacugaacacgcauucccaacuauauaucuacagaugcauuccau

SEQ ID NO: 130341 - RNA, 63 nt, hsa
caguagcugggaccacaggugcccgccaccacacccaacuaauuuuuguauuuuuaguagaga

SEQ ID NO: 130342 - RNA, 63 nt, hsa
caaucuggaacaaugucccuccucuuagaaugucccaacuaaagaccaguuaaaauauuaggg

SEQ ID NO: 130343 - RNA, 63 nt, hsa
acaucacauuuuggugucucucaggcuuucccccccaacuaugguuucuuugcuuuuuguuuu

SEQ ID NO: 130344 - RNA, 63 nt, hsa
gucugccaagaucuuucuuuugaauguuuugaacccaacuacuugucauagauguuugacugu

SEQ ID NO: 130345 - RNA, 63 nt, hsa
agcccaggguucccauuuggcuucuggcaguggcccaacuagccaagucugguguucccucau

SEQ ID NO: 130346 - RNA, 63 nt, hsa
cuggagggaugccacaccccucacagggcagcccccaacuacaucuucccugcuuacucucug

SEQ ID NO: 130347 - RNA, 63 nt, hsa
uugccagauuguggucuauguuugaucuguguccccaacuagacagggaguucucugaggaca

SEQ ID NO: 130348 - RNA, 63 nt, hsa
uagaugucagucucguuaccagcagccuuuugacccaacuacggcgcucuauauuuuaguaga

SEQ ID NO: 130349 - RNA, 63 nt, hsa
auucacaaaacuucuugcuucaaaugaaaaaaucccaacuauugagcauguuuaaaucuuugc

SEQ ID NO: 130350 - RNA, 63 nt, hsa
uagaugucaaucucguuaccagcagccuuuugacccaacuacagcgcucuauauuuuaguaga

SEQ ID NO: 130351 - RNA, 63 nt, hsa
uaggugucacucuuguuaccagcagacuuuugacccaacuacagugcucugucuuuuaguaga

SEQ ID NO: 130352 - RNA, 63 nt, hsa
cugucucuuccugcuuuagacagccauuaagaucccaacuaauuuuaccgaaccuaaaaccca

SEQ ID NO: 130353 - RNA, 63 nt, hsa
cugugugguaacagaaagcuucuuaccaauuuccccaacuauguugcacaucagccucauuuu

SEQ ID NO: 130354 - RNA, 64 nt, hsa; identical to SEQ ID NO: 76226

SEQ ID NO: 130355 - RNA, 64 nt, hsa; identical to SEQ ID NO: 76227

SEQ ID NO: 130356 - RNA, 64 nt, hsa; identical to SEQ ID NO: 76228

SEQ ID NO: 130357 - RNA, 64 nt, hsa; identical to SEQ ID NO: 76229

SEQ ID NO: 130358 - RNA, 64 nt, hsa; identical to SEQ ID NO: 76230

SEQ ID NO: 130359 - RNA, 64 nt, hsa; identical to SEQ ID NO: 76231

SEQ ID NO: 130360 - RNA, 64 nt, hsa; identical to SEQ ID NO: 76232

SEQ ID NO: 130361 - RNA, 64 nt, hsa; identical to SEQ ID NO: 76233

SEQ ID NO: 130362 - RNA, 64 nt, hsa; identical to SEQ ID NO: 76234

SEQ ID NO: 130363 - RNA, 64 nt, hsa; identical to SEQ ID NO: 76235

SEQ ID NO: 130364 - RNA, 64 nt, hsa; identical to SEQ ID NO: 76236

SEQ ID NO: 130365 - RNA, 64 nt, hsa; identical to SEQ ID NO: 76237

SEQ ID NO: 130366 - RNA, 64 nt, hsa; identical to SEQ ID NO: 76238

SEQ ID NO: 130367 - RNA, 64 nt, hsa; identical to SEQ ID NO: 76239

SEQ ID NO: 130368 - RNA, 64 nt, hsa; identical to SEQ ID NO: 76240

SEQ ID NO: 130369 - RNA, 64 nt, hsa; identical to SEQ ID NO: 76241

SEQ ID NO: 130370 - RNA, 64 nt, hsa; identical to SEQ ID NO: 76242

SEQ ID NO: 130371 - RNA, 64 nt, hsa; identical to SEQ ID NO: 76243

SEQ ID NO: 130372 - RNA, 64 nt, hsa
gcugaguuccuuuauguuucguuuauucacuaaaguagcugacacaaaacacaccaaaaccuag

SEQ ID NO: 130373 - RNA, 64 nt, hsa
ugcuuuuuuugaaagcugauucucaugaauucaaguagcugaguuccuuuauguuucguuuauu

SEQ ID NO: 130374 - RNA, 64 nt, hsa
ggcuucaagcaauccuccugugucagccaccagaguagcugagacuacagggguaugccaccau

SEQ ID NO: 130375 - RNA, 64 nt, hsa
gggcucaagugauccucccaccucagccuccugaguagcugagaccacaggcgugugccaccac

SEQ ID NO: 130376 - RNA, 64 nt, hsa
ccaggaccucggaugaccauacucagacgugugaccuccauacugggcuaaggaaguaucagca

SEQ ID NO: 130377 - RNA, 64 nt, hsa
gugccgaggacaugcaugacacuuccaaagacucccuccauagcgacacccuuucuguuuggac

SEQ ID NO: 130378 - RNA, 64 nt, hsa
aacugguugcugucagguuuaucucauccuaacaccuccauaauauuuucugcuaaaggaguga

SEQ ID NO: 130379 - RNA, 64 nt, hsa
uugcccacccugaagguggauaagccaaccaugcccuccauagagguccccuauccuuaaauaa

SEQ ID NO: 130380 - RNA, 64 nt, hsa
cugcagacauucucaaagccucuuauuuuucuagcgaacguauuucuccagacccagaggcccu

SEQ ID NO: 130381 - RNA, 64 nt, hsa
uuuuaaaucucugcaacuccaaaguagacuccuucgaacguauuuaauuuggccuuuucagcuu

SEQ ID NO: 130382 - RNA, 64 nt, hsa
cagaggccccaucagcacagagggccucguuccacgaacguagaguuugacugccuaagggaca

SEQ ID NO: 130383 - RNA, 64 nt, hsa
auucagaacaaaauaaguagacaaaauaacaaaagacaggaaaauaagucucuuuguauccuua

SEQ ID NO: 130384 - RNA, 64 nt, hsa
uuaguugagcuauuuauguauaaguaaaugagaugacaggaagcuguaacugagcacaaaguac

SEQ ID NO: 130385 - RNA, 64 nt, hsa
aggugguggucauguuucccuucuaguuuuggcugacaggaagcucaguucaguaccauaacua

SEQ ID NO: 130386 - RNA, 64 nt, hsa
aguuuggaccuugccuccuuuaggggaaagguaggacaggaaugucccugccugguacuggugg

SEQ ID NO: 130387 - RNA, 64 nt, hsa
guccaaaaagcacccacagagaggcaaugggugagacaggaauccccucacagugggcgacaga

SEQ ID NO: 130388 - RNA, 64 nt, hsa
aguaaguacagcauaguaguuucccgauugugcugacaggaagugcucuguggcuaaaacaagu

SEQ ID NO: 130389 - RNA, 64 nt, hsa
auggggggauuucugguuaugucaaggcucuggagacaggaagggccuuuggccgccuugggua

SEQ ID NO: 130390 - RNA, 64 nt, hsa
ggcaggaagcggccuccaagacccuucgccuugggacaggaaugggcaccugcuucugagucca

SEQ ID NO: 130391 - RNA, 64 nt, hsa
uucuuaauaucacuuuggucuccauuuuucccaggacaggaaauaugucccccccuaacuuucu

SEQ ID NO: 130392 - RNA, 64 nt, hsa
ggcugacugggaacaccccauaacuacagagucugacaggaagacuggagacuguccacuucua

SEQ ID NO: 130393 - RNA, 64 nt, hsa
guggacccccuuagaguugugagcccuuaaaagggacaggaauugcucacucggggagcucggc

SEQ ID NO: 130394 - RNA, 64 nt, hsa
ccuccaaucucuguagccccagaagugaacgccagacaggaacacgcauguguguauauaugug

SEQ ID NO: 130395 - RNA, 64 nt, hsa
acaggaacugcauaaagguucuugaauucugcaggacaggaaauaacuguauuaccugcuuugc

SEQ ID NO: 130396 - RNA, 64 nt, hsa
gaguagcggagucacugaccucuuuaaaucauaggacaggaacugcauaaagguucuugaauuc

SEQ ID NO: 130397 - RNA, 62 nt, hsa
aggcaucuuucugaauuucauucucuugaaggugcugccaccccuuggcacuguggaacugc

SEQ ID NO: 130398 - RNA, 62 nt, hsa
acuuccugccccaacugcaggaaugcugacaaugcugccaugcccaccaucggguguaggug

SEQ ID NO: 130399 - RNA, 62 nt, hsa
guuucuguugcugccaaaguaauguggcucucugcugccacccugugcugcugaggugcgua

SEQ ID NO: 130400 - RNA, 62 nt, hsa
auggggcugccgggcuggccgccaguuucuguugcugccaaaguaauguggcucucugcugc

SEQ ID NO: 130401 - RNA, 62 nt, hsa
ucccagcggggcucccugagcucucaaggagaugcugccaucacugggaggcucagaggacc

SEQ ID NO: 130402 - RNA, 62 nt, hsa
uuuaaugagcgugggccuggaccuuccccagaugcugccaggcagccccuccccaagccuca

SEQ ID NO: 130403 - RNA, 62 nt, hsa
ugccugcugcucccuuuuucugucucuguccaugcugccauguuucucugcugccaaauugg

SEQ ID NO: 130404 - RNA, 62 nt, hsa
uuucugucucuguccaugcugccauguuucucugcugccaaauugggccccuuggccccuuc

SEQ ID NO: 130405 - RNA, 62 nt, hsa
ggaccccagggacuugccuuccccacccacucugcugccagcaggcccagggaucccugacc

SEQ ID NO: 130406 - RNA, 62 nt, hsa
ccacaguucugggagccuucaacccuggcucaugcugccauagucuccacggugcccuucac

SEQ ID NO: 130407 - RNA, 62 nt, hsa
cuguggcauguuugaccuguggcaggacucgcugcugccaggugagucaccgccuguccugc

SEQ ID NO: 130408 - RNA, 62 nt, hsa
gccaucucugucucccugggugccagcagcccugcugccaugugcacugggguggcacugga

SEQ ID NO: 130409 - RNA, 62 nt, hsa
ccugugggcagccgcgccagcugccgggacacugcugccagaccugcccccaggguaagucu

SEQ ID NO: 130410 - RNA, 62 nt, hsa
ggcaggccagggcugcgcaucaguggacacauugcugccaggaagagcugcgacggugaggc

SEQ ID NO: 130411 - RNA, 62 nt, hsa
cucccaaguuccagagccucuccgggccucagugcugccaucuguacaaugguggagugagu

SEQ ID NO: 130412 - RNA, 62 nt, hsa
gggccgggaguacaagcugcccauggacgaccugcugccacuucucaucuacguggugucgc

SEQ ID NO: 130413 - RNA, 62 nt, hsa
cacagaccuaauauauguccggacagcuuggaugcugccacguaaggucacugcuguggcga

SEQ ID NO: 130414 - RNA, 62 nt, hsa
agaccuggagggcagccacacagcuggacggaugcugccacaucugggcauacagugucugg

SEQ ID NO: 130415 - RNA, 62 nt, hsa
caugacuugggggugcuacuagaagccaggaaugcugccaaacauucuaccaugcacagcac

SEQ ID NO: 130416 - RNA, 62 nt, hsa
gaaaaugaacuuuuguuucuaaaguuggaccuugcugccaugacuguuuaguuuacagaaac

SEQ ID NO: 130417 - RNA, 62 nt, hsa
gaauacuuuuacuacucagaaaugaauuuaugugcugccauuugcuauaaaguugaacuuug

SEQ ID NO: 130418 - RNA, 62 nt, hsa
cagaaaaccuaccaaacaaaaacaucagaagcugcugccauaaugacuauuuucuacuguag

SEQ ID NO: 130419 - RNA, 62 nt, hsa
uggcucugauuugaaaucgggagaaacagagcugcugccaaugggaucuuuuagguaacucc

SEQ ID NO: 130420 - RNA, 62 nt, hsa
agcuuccgugugucugugcagugcccaugagcugcugccaaugggaucuuucagguaccccc

SEQ ID NO: 130421 - RNA, 62 nt, hsa
gaucgcccugcuggcugccggcaccgcccuccugcugccagagacgaggcaggcacagcugc

SEQ ID NO: 130422 - RNA, 62 nt, hsa
ggaguaucgaacccucugccuagggccggaguugcugccaguacccgcucccucugcucauc

SEQ ID NO: 130423 - RNA, 62 nt, hsa
ccguaccgccaacucgggucacaccugaacgcugcugccagccgaugccccagcccugcacg

SEQ ID NO: 130424 - RNA, 62 nt, hsa
cgccacaccuacuggggcaucuggcuggugccugcugccauggccagcccccacucucaccc

SEQ ID NO: 130425 - RNA, 62 nt, hsa
ucccuucuuuaccuucauuucauccuguuggcugcugccaccaaaucugucuagaauccugc

SEQ ID NO: 130426 - RNA, 62 nt, hsa
aauaaauauuuguuugggugguuugugagccuugcugccaaguccugccuuugggucgacau

SEQ ID NO: 130427 - RNA, 62 nt, hsa
uugugcugccauuugauuuuucuaaccuugaaugcugccaguguggaguggguaauccaggc

SEQ ID NO: 130428 - RNA, 62 nt, hsa
auuccagaagaagagaagcugcugaccaauugugcugccauuugauuuuucuaaccuugaau

SEQ ID NO: 130429 - RNA, 62 nt, hsa
gccauccucccacuugcagugcaggaucccacugcugccaaagagaugggacaaggaaccuc

SEQ ID NO: 130430 - RNA, 62 nt, hsa
cagaccuggacuccaaggccggccugcgcacuugcugccaccagaaacuggaggacaugauc

SEQ ID NO: 130431 - RNA, 62 nt, hsa
cagagaaaggggcuguggugcuuguugguugaugcugccauguaagcuggacuccugggacu

SEQ ID NO: 130432 - RNA, 62 nt, hsa
caacagcgcucaugucucuuggcccagucaggugcugccagguuuagauaggaaaguacaug

SEQ ID NO: 130433 - RNA, 62 nt, hsa
augccugaccuuugagaugcucaguucucuggugcugccaaaagaugcuuccaugguccgug

SEQ ID NO: 130434 - RNA, 62 nt, hsa
gucaacccacgcagaagaaacagaagaacucaugcugccagauagauagaaaaagaagcaug

SEQ ID NO: 130435 - RNA, 62 nt, hsa
uucaaagucuacuagcucgcauuaguuucuguugcugccaacagaucugaacuaaugcuaac

SEQ ID NO: 130436 - RNA, 62 nt, hsa
gcucuucacuaugacaguaaaggcucucugccugcugccaaggccugugacuuucuaaccug

SEQ ID NO: 130437 - RNA, 62 nt, hsa
aacuccccguuccugcguaguccgcuuucucuugcugccacauucuaaaggcuugauauuuu

SEQ ID NO: 130438 - RNA, 62 nt, hsa
aagcuggcgugugccagggcucgagucccacgugcugccaacucaaacauagccuccuuccc

SEQ ID NO: 130439 - RNA, 62 nt, hsa
cggcuccccuaaagguagaagauacucgagcaugcugccaggggagcuggauggugaaacac

SEQ ID NO: 130440 - RNA, 62 nt, hsa
gugccuguuaugaaugaaaaauccauccacucugcugccauucacagccuaauuuucuggag

SEQ ID NO: 130441 - RNA, 62 nt, hsa
ccuuuucagcugcacuauuuaauuaugguaccugcugccacucaucacagagcccuucuugg

SEQ ID NO: 130442 - RNA, 62 nt, hsa
augggccaagggaaggcuaucagagacccuggugcugccaccugccccuacucaagugucua

SEQ ID NO: 130443 - RNA, 62 nt, hsa
agggagggccuggggagccccacccuagcccuugcugccacaccacauugccucaacaaccg

SEQ ID NO: 130444 - RNA, 62 nt, hsa
aacguggugucaucugaugcauuuggaccauaugcugccagacugcagaacgggggagccgg

SEQ ID NO: 130445 - RNA, 62 nt, hsa
gccuagcgaugccgcuggccagaccgugaccaugcugccagugugcucgccaugagcugggu

SEQ ID NO: 130446 - RNA, 62 nt, hsa
agucuccuuggugauuaagguccugcuugaacugcugccaacuccaugucagggaagucgcu

SEQ ID NO: 130447 - RNA, 62 nt, hsa
aggucuauggcucaugucugaaaaaugccugcugcugccaaguuagcuauugggagcaaucu

SEQ ID NO: 130448 - RNA, 62 nt, hsa
cacaaccugucucccaguccugcucucaccccugcugccacacacaugcccugagcagccag

SEQ ID NO: 130449 - RNA, 62 nt, hsa
cugcacuagggcucugugcuggaacccaggcaugcugccagccuuuucucuggaucugucag

SEQ ID NO: 130450 - RNA, 62 nt, hsa
ccugcugcaucuccaguugcugccgccccaacugcugccagaccaugugcugccgcccaacc

SEQ ID NO: 130451 - RNA, 62 nt, hsa
ccugcugccaccccagcuauugcauuuccagcugcugccagccuuccugcaguaucucuagc

SEQ ID NO: 130452 - RNA, 62 nt, hsa
ucugcuggcaaaccaccugcuacaggaccaccugcugccaccccagcuauugcauuuccagc

SEQ ID NO: 130453 - RNA, 62 nt, hsa
cacugugcugaggcccugcagugucugcucacugcugccaucuucgcugcuagucaggguuc

SEQ ID NO: 130454 - RNA, 62 nt, hsa
auuccuguguggggagaagcucaguggccguuugcugccacugacaaggauuucacaugcag

SEQ ID NO: 130455 - RNA, 62 nt, hsa
cggaaaacagaccucggggcuggcguaaacccugcugccaggcccucuccccacugccccaa

SEQ ID NO: 130456 - RNA, 62 nt, hsa
aguaaccaaacacauacauggauuuugccaagugcugccaguagccaaaacaaagucuuuuu

SEQ ID NO: 130457 - RNA, 62 nt, hsa
agccuacugcugcucuccacucaacuggccucugcugccaggccacugccugucucugcuuc

SEQ ID NO: 130458 - RNA, 62 nt, hsa
ugagccucccuggagaagguauuuuauaugucugcugccagcugcuggucuccacacccuca

SEQ ID NO: 130459 - RNA, 62 nt, hsa
ggggagaugcugccagcacacaggggcccuccugcugccagcagguuggggugguuaagucu

SEQ ID NO: 130460 - RNA, 62 nt, hsa
gggugcaggugagccggcguguccuggggagaugcugccagcacacaggggcccuccugcug

SEQ ID NO: 130461 - RNA, 62 nt, hsa
ugcugccaggcuuacaucuucccagagaacuaugcugccacuucacauccacucaccacauc

SEQ ID NO: 130462 - RNA, 62 nt, hsa
accacccauagcccugcugcugccaccugcccugcugccaggcuuacaucuucccagagaac

SEQ ID NO: 130463 - RNA, 62 nt, hsa
uuacaaacugcgcagaccacccauagcccugcugcugccaccugcccugcugccaggcuuac

SEQ ID NO: 130464 - RNA, 62 nt, hsa
cagaaacacccacaggcaugucccaugugagcugcugccaugaacugucaaguguguguugu

SEQ ID NO: 130465 - RNA, 62 nt, hsa
guccccagaacucugccugcccuuuguccuccugcugccaguaccagccccacccuguuuug

SEQ ID NO: 130466 - RNA, 64 nt, hsa
gcugaguucucacagaagcauuuuccccauguggcucucucacugugcguugcuaccuugcuuc

SEQ ID NO: 130467 - RNA, 64 nt, hsa
gaccugaccucaaaccagcuuaaggcuuuaaguccucucucagaacuuggcauuuccaacuucu

SEQ ID NO: 130468 - RNA, 64 nt, hsa
uccauccuuagcuuuggcgcccuggacccacuuucucucucaaacugucuuuucucacugcuuu

SEQ ID NO: 130469 - RNA, 64 nt, hsa
ccugccugcugucccccagucugccugcccuucucucucucaccuuucuccaggcucccuaccu

SEQ ID NO: 130470 - RNA, 64 nt, hsa
gucccccucccaccuguugaauacauagggauggcucucucagggcccugggaaugggaaugga

SEQ ID NO: 130471 - RNA, 64 nt, hsa
ggaccuauugcugccugcccucucuccuccugaacucucucaucugcaguggggcaucgucugu

SEQ ID NO: 130472 - RNA, 64 nt, hsa
cacugcacuccagccugggcgacagagcaggacucucucucaaaaaaacacaaaaaaacaaaaa

SEQ ID NO: 130473 - RNA, 64 nt, hsa
auuaggauugcagauaaauguuugaauucugcuccucucucaucaauccaggacaguauuugaa

SEQ ID NO: 130474 - RNA, 64 nt, hsa
uccagcacuccagccugggugacagagcaagacucucucucaaaaaaaaaaaaaaaaaaaaauu

SEQ ID NO: 130475 - RNA, 64 nt, hsa
acugauguuuacagaacccaaaugaugucuuccucucucucaaaauaaacuaaccuauucauau

SEQ ID NO: 130476 - RNA, 64 nt, hsa
aaugaucaccuuugacuccacgucucacaaucaucucucucaaguucgaaguuccacaaaucuc

SEQ ID NO: 130477 - RNA, 64 nt, hsa
aaucuagaaagaccuuagagaaccagccaaccaacucucucauuuuaaaagugaaggauucaua

SEQ ID NO: 130478 - RNA, 64 nt, hsa
cuccagaaagccaggagucgacaguuuuggaagccucucucaggauugagauucuaggaugaga

SEQ ID NO: 130479 - RNA, 64 nt, hsa
ucuuuggaggguggggcaggaguauaugagcauccucucucacauggaacgcuuucauaaacuu

SEQ ID NO: 130480 - RNA, 64 nt, hsa
ugcaaccuccgccucccaaguucaagcgauucuccucucucagccuccuggguagcugggauua

SEQ ID NO: 130481 - RNA, 64 nt, hsa
gacagugacagauguguuugcaaggcugggauggcucucucaucauacucuuguuucuuagaaa

SEQ ID NO: 130482 - RNA, 64 nt, hsa
uuaguaggagcucaaauuguuggggccccucuaccucucucagggcuagaacugccugacucuu

SEQ ID NO: 130483 - RNA, 64 nt, hsa
aaauccgaaccauugcccuuguuucccccacguucucucucagaucuuugucucgaagggaaaa

SEQ ID NO: 130484 - RNA, 64 nt, hsa
accuaggcugucagucucucucaucuuucucucucucucucaucauccuccucaugccagauag

SEQ ID NO: 130485 - RNA, 64 nt, hsa
aucuauaccuccccaugacaccuaggcugucagucucucucaucuuucucucucucucucauca

SEQ ID NO: 130486 - RNA, 64 nt, hsa
ucucaccugcucccaguccugccugaacagcccucucucucacuccccucuccuccccuuccug

SEQ ID NO: 130487 - RNA, 64 nt, hsa
cuaugggccagaguugucuuuauuguccaccaugcucucucaccugcucccaguccugccugaa

SEQ ID NO: 130488 - RNA, 64 nt, hsa
auugauguucccucuugcacugaauaauacaugccucucucagguaagccauuuuauaaaacaa

SEQ ID NO: 130489 - RNA, 64 nt, hsa
cugaggaagccccacuucucuguaggagcccggacucucucaggcaugccccauucacagcuga

SEQ ID NO: 130490 - RNA, 64 nt, hsa
cacgauguauccggguguggaaaucucacugggucucucucaaggccacucggcuacucaggac

SEQ ID NO: 130491 - RNA, 64 nt, hsa
ucagguaucaugucucaauuaaggcccuguaauucucucucauuuacucucguuuugcccguug

SEQ ID NO: 130492 - RNA, 64 nt, hsa
aaggaaacaaucuauuacuuuuuuccuuaaaaggagaauuuauagcacuguaauacagcuuaaa

SEQ ID NO: 130493 - RNA, 64 nt, hsa
uuuauaaaguaggaaguuaagugaaucauagauuagaauuuaauacucuuauggaaauaauuuu

SEQ ID NO: 130494 - RNA, 64 nt, hsa
uauauuuauuuacaaaacacuucauuauuuauaaagaauuuacuaacaguuuaucuuauuuaua

SEQ ID NO: 130495 - RNA, 64 nt, hsa
aaacuuuuucuuuaaaauucaauuaaguuacaccagaauuuacaggcaagauuuuuuuuuucau

SEQ ID NO: 130496 - RNA, 64 nt, hsa
uaccuuacaguuaaucguuucuuaauaaagaagcagaauuuagaaaccacaggauaguguaccc

SEQ ID NO: 130497 - RNA, 64 nt, hsa
uaaaauuugaauccauaauauaucuaauuacaggagaauuuacaacaucucaaguacguaaauu

SEQ ID NO: 130498 - RNA, 64 nt, hsa
cauuuacugauuugcagugaugaauauuuuuaugagaauuuaaacuuagcaagaauggccaugg

SEQ ID NO: 130499 - RNA, 64 nt, hsa
cacugcgccuggcccagcguuacuuuucuugauaagaauuuacagauaagacacucagagagac

SEQ ID NO: 130500 - RNA, 64 nt, hsa
accauauaaaaacgauaauugcuuuauuuggaaaagaauuuaggaauacuaaggacaauuauuu

SEQ ID NO: 130501 - RNA, 64 nt, hsa
uuuucugagcucuaagaauuaucagaaacaggaaagaauuuagaaaaacuugagaaaaccuaau

SEQ ID NO: 130502 - RNA, 64 nt, hsa
guguucaguuucuacacaacuuuaucauccgcuaagaauuuaaaaaucacauucucuguucagc

SEQ ID NO: 130503 - RNA, 64 nt, hsa
uguuaauaaauuucaguuuaguucuguaaugucaagaauuuaagaauuaaaaaacggauugguu

SEQ ID NO: 130504 - RNA, 64 nt, hsa
caaacuuaaauggaagaauucugaaagagaggauagaauuuaaagaacaagaguauauaaaguu

SEQ ID NO: 130505 - RNA, 64 nt, hsa
uuucucccauaaccuuuguacacuaaaaaaugaaagaauuuagaauguauuugaugauagcauu

SEQ ID NO: 130506 - RNA, 64 nt, hsa
guauuugaugauagcauucucacuaagacacaugagaauuuaacuuuauaaccgcgugaguuaa

SEQ ID NO: 130507 - RNA, 64 nt, hsa
cucuugcuacagucgccuuugcuacugcuuuaagagaauuuacagguauugauaaagaacaaga

SEQ ID NO: 130508 - RNA, 64 nt, hsa
ggccucgagccugcaacaguccaaaccggaagggagaauuuauuuuuugaaacugaaggaaguc

SEQ ID NO: 130509 - RNA, 64 nt, hsa
gucuagagccuguugguguucugucccuacuuuaagaauuuaauugcucacuuauucugaaagc

SEQ ID NO: 130510 - RNA, 64 nt, hsa
uguuguggcuuuuaaugccagaagaaaaguuaccagaauuuauaauuuauaguaauuuuuugau

SEQ ID NO: 130511 - RNA, 64 nt, hsa
gggaaaugcacaauuuuuuuuuguuaggcuguaaagaauuuaagcuguaaauuacauaaguuag

SEQ ID NO: 130512 - RNA, 64 nt, hsa
uggucauauuauuauuaauuuugccaaaagaagaagaauuuauugaauauuuauacuauaaaau

SEQ ID NO: 130513 - RNA, 64 nt, hsa
aauccagcaaauucaaggaaccaggcuaugacuaagaauuuagguggaauugaugucugggcaa

SEQ ID NO: 130514 - RNA, 64 nt, hsa
aaggcuuuguaguacaagauugaaaaacucaacaagaauuuaauucuaaaagcaaaaauugguu

SEQ ID NO: 130515 - RNA, 64 nt, hsa
aaauauccucuuauuguugaucaaaggaggcaaaagaauuuagaggcaaaugacaagcgauagg

SEQ ID NO: 130516 - RNA, 64 nt, hsa
uugugcaccuaagcugcagaccaagccuuugcccagaauuuaaggauuccaauggacgaccuau

SEQ ID NO: 130517 - RNA, 64 nt, hsa
uauggcccaaaaugaccaacgaaauuguuacaauagaauuuauccaauuuugaucuuuuuauau

SEQ ID NO: 130518 - RNA, 64 nt, hsa
uucauagccuacauuuuaguuucuaaagccaagaagaauuuauuacaaaucagaacuuuggagg

SEQ ID NO: 130519 - RNA, 64 nt, hsa
gguguauaugguccacugguuucaggccaaaucuagaauuuagugauacuggcucagaagaauu

SEQ ID NO: 130520 - RNA, 64 nt, hsa
ggccaaaucuagaauuuagugauacuggcucagaagaauuuaaguucuauucagccuuccuggg

SEQ ID NO: 130521 - RNA, 64 nt, hsa
acuucugaaguucaaauuagugccucggaaauguagaauuuauuauuugucauuuuuuuuuuuu

SEQ ID NO: 130522 - RNA, 64 nt, hsa
acuacuagggcaugauacaguaagguguaauuacagaauuuacgaaauguaaauggccucuaca

SEQ ID NO: 130523 - RNA, 64 nt, hsa
uuaacagauuguuuauagagugauuuuacuagaaagaauuuaauaaacucgaaguuuagguuua

SEQ ID NO: 130524 - RNA, 64 nt, hsa
uuuuugucuuauagacuuuuuaaaauguacauaaagaauuuaagaaagaauauauuugucaaau

SEQ ID NO: 130525 - RNA, 64 nt, hsa
cagaaacguggcaucauuugggaagaaccaagguagaauuuaauuuucuggacuuuaaaucucc

SEQ ID NO: 130526 - RNA, 64 nt, hsa
gucugcauguuuauuuuuacuucccuggguggacagaauuuaauuucucgagcuguuuuucuca

SEQ ID NO: 130527 - RNA, 64 nt, hsa
acaguacauucuaguuggaaucguuuacucugcuagaauuuaggugugagauuuuuuguuuccc

SEQ ID NO: 130528 - RNA, 64 nt, hsa
ugacaaagcaguugaacaaaaauuauggcauuuaagaauuuaacaugucuuagcuguaaaaaug

SEQ ID NO: 130529 - RNA, 64 nt, hsa
agugaguggugugacucuuacuccuuaggugcccagaauuuaccaucaucucugaaggaguuac

SEQ ID NO: 130530 - RNA, 64 nt, hsa
uccuuauguccugucauauaauuaaagacucaagagaauuuaugugaaaugcuuucuguaugcc

SEQ ID NO: 130531 - RNA, 64 nt, hsa
cuugggggaagggcuugaauugaagcuuuacuuuagaauuuagcccugguuugaaauuuuccau

SEQ ID NO: 130532 - RNA, 64 nt, hsa
aacugguaguucauuguaaaugaacauaaugaacagaauuuaugacuccacuguggaaaaugcu

SEQ ID NO: 130533 - RNA, 64 nt, hsa
aaaaguaacauuuggguuucacuccauaucuagaagaauuuagcucacaaaacaauuuuugugu

SEQ ID NO: 130534 - RNA, 64 nt, hsa
acaaauugcuuaugggagauagcacuguaauuagagaauuuauuucauauaaaauaauaauaua

SEQ ID NO: 130535 - RNA, 64 nt, hsa
auuuaaaaagaaauucacugguucuuuacaaaauagaauuuaucaucaaguuauuacacaaacu

SEQ ID NO: 130536 - RNA, 64 nt, hsa
ucugucuuuugcugaucuacaaauaaaugaauugagaauuuaguccauagaggucccuggcuac

SEQ ID NO: 130537 - RNA, 64 nt, hsa
uuuuccacucuuauuagcacugcaaaagcuccugagaauuuaaaaacacaguaauucucuggau

SEQ ID NO: 130538 - RNA, 64 nt, hsa
uguuauuuaauugaaaucugcuugugugcuuauaagaauuuacugaguucucacuucccuuaca

SEQ ID NO: 130539 - RNA, 64 nt, hsa
ggaaaagacuaguauuugggcaauauuugaagaaagaauuuaacaggcacugauggggagaaag

SEQ ID NO: 130540 - RNA, 64 nt, hsa
aaagcucuccacaucucuuggcuggaucauagcaagaauuuacuguuggcucuucucucugccg

SEQ ID NO: 130541 - RNA, 64 nt, hsa
uuugcuccaacaagggcuuuauguugcugguaagagaauuuauuuacuaaaugcacuauguaua

SEQ ID NO: 130542 - RNA, 64 nt, hsa
cugucaccagcacaagagaauuagagcuucagugagaauuuagaaaaauuauacuaaagugaga

SEQ ID NO: 130543 - RNA, 64 nt, hsa
auaauauucaauacaauuguaauguagaaauauaagaauuuagaaaaaaguaaacuugccauuu

SEQ ID NO: 130544 - RNA, 64 nt, hsa
caguuaaagcaaaguuauuaauuauuaauauaugagaauuuaaaauuuuauaaauaaguuagaa

SEQ ID NO: 130545 - RNA, 64 nt, hsa
gggauagaaacuacaaaugcaacaaaugcgucaaagaauuuagugugcacucaagccuuacuac

SEQ ID NO: 130546 - RNA, 64 nt, hsa
ucuucaaacacaaguuuuucuaauaacucauuagagaauuuauacuggagagacuucacaauua

SEQ ID NO: 130547 - RNA, 64 nt, hsa
uuacauuuuaauuuuugaaacugaugucuuucccagaauuuauguacucuauaacggugugaau

SEQ ID NO: 130548 - RNA, 64 nt, hsa
ggggagaaaaaaugaccacugaacuuacauuaagagaauuuacaacuauauauuaacauggcuu

SEQ ID NO: 130549 - RNA, 64 nt, hsa
aggaaagugaaauuguuacaauacuguuaacuacagaauuuauuuggaaaucaccaguuuuaac

SEQ ID NO: 130550 - RNA, 64 nt, hsa
cauucaauguagaagacuuuuaggaaaauaucagagaauuuaaugaaggaaagaagccuuggca

SEQ ID NO: 130551 - RNA, 64 nt, hsa
cuucagucaagcuucauccuaugcaaaacauaggagaauuuauacaggagagaaaccucacaag

SEQ ID NO: 130552 - RNA, 64 nt, hsa
uuuccauuuggaaaucacaccuuaaagacauaggagaauuuauacuggagagaaagcuuacaaa

SEQ ID NO: 130553 - RNA, 64 nt, hsa
cggggaauggguuuuuguuuuuccuucauuguugagaauuuaaggaccuuugauacugcugcac

SEQ ID NO: 130554 - RNA, 64 nt, hsa
uuuuccaguugaaaacaaacuaagaaguccuuuaagaauuuauaauccguuccccauuaacuua

SEQ ID NO: 130555 - RNA, 64 nt, hsa
aggauuuucuguauagauuacucaugucagaccaagaauuuaaauuauuuugagagaggcauuu

SEQ ID NO: 130556 - RNA, 64 nt, hsa
uucuuugcuuuguuuuuauaaaugaauuuuucauagaauuuacaguauauucaaaggaagaaag

SEQ ID NO: 130557 - RNA, 64 nt, hsa
aauuauuggucaucauuuguaccuuagaaguacaagaauuuaaguaaaagaaauguucauuuuu

SEQ ID NO: 130558 - RNA, 64 nt, hsa
uuagaaaaguuuguuuugugaaguuaggaauauuagaauuuagguacuguuaaguaaguaaugu

SEQ ID NO: 130559 - RNA, 64 nt, hsa
auuagaauuuagguacuguuaaguaaguaauguuagaauuuaagauucauguuauuaacgauga

SEQ ID NO: 130560 - RNA, 57 nt, hsa
ccaucggccgcuucacguagcucggagcccuuccacuccucccagguaagaacccuc

SEQ ID NO: 130561 - RNA, 64 nt, hsa
ugaggccuucuugucuucaaccuggccuguccagcccuuccagauauggccaaacccauggccu

SEQ ID NO: 130562 - RNA, 64 nt, hsa
auacuuggggaaaaaacaaggccauauguaaaaacccuuccaaugccuaagugucuuucuccug

SEQ ID NO: 130563 - RNA, 64 nt, hsa
ucgucucuuacauacucucaucuucucccccgcucccuuccacuccaaggagcgaggagggcaa

SEQ ID NO: 130564 - RNA, 64 nt, hsa
cccacuacguguccuggguucucucuacucagaucccuuccagaaacuuuauauggguagagga

SEQ ID NO: 130565 - RNA, 64 nt, hsa
gauggauuuaggagccacugcucagugcacuucucccuuccaacugcaucaacuaacucucggg

SEQ ID NO: 130566 - RNA, 64 nt, hsa
uugcccaucaucccuucuuccauccuuagagggacccuuccaaggucccgaccccaucccuauc

SEQ ID NO: 130567 - RNA, 64 nt, hsa
ccccagaaacuccaaccccugcccuuccucuucccccuuccacccucacauccccauccccuuc

SEQ ID NO: 130568 - RNA, 64 nt, hsa
gucuccugagcccugagggauggaugucuccugacccuuccaccccgccucacucccuccgucc

SEQ ID NO: 130569 - RNA, 64 nt, hsa
acggcccccagaacaacauucucccugcuggcagcccuuccaugucuccaaaccugggucagag

SEQ ID NO: 130570 - RNA, 64 nt, hsa
cuguagugaccggcagggcuggggugagaccccucccuuccagaauccaggccccaucuccccc

SEQ ID NO: 130571 - RNA, 64 nt, hsa
gcccacccaccuccgguuccccugugccuccugucccuuccacgcuuaaacaggguucucuguc

SEQ ID NO: 130572 - RNA, 64 nt, hsa
gcuuaguuugguaccuggagcgagagcuucuccgcccuuccaccaaccccacaggccgcuucgc

SEQ ID NO: 130573 - RNA, 64 nt, hsa
uugcacauggaggacuuuucaagaugucaggauacccuuccaucaccccaccaccgccacccca

SEQ ID NO: 130574 - RNA, 64 nt, hsa
cuggaccuuggcaccugcuaggaagagccuuggacccuuccaguugcguaaagcaaaccuaccc

SEQ ID NO: 130575 - RNA, 64 nt, hsa
cugacucccgcuuagcacacccuuaggcaggcgccccuuccaccuuuccccgagaccgucgucg

SEQ ID NO: 130576 - RNA, 64 nt, hsa
agcaaagcccacugccaguaagaaggccaaagggcccuuccauccuagcccucugcaggcaugc

SEQ ID NO: 130577 - RNA, 64 nt, hsa
ugacuguaacugaaguggccgggcccagacaugccccuuccaaaacuggaacaccuagcuaaca

SEQ ID NO: 130578 - RNA, 64 nt, hsa
uguuuucuauaugguuuuuccagcuagcaguacucccuuccauaccugugacugggcagugcuu

SEQ ID NO: 130579 - RNA, 64 nt, hsa
gaaaauaauucuuugagacagauuucagcuaccucccuuccagguucgauuuaacuugguugua

SEQ ID NO: 130580 - RNA, 64 nt, hsa
auucccacauggggagcaccaggagcccuggagccccuuccacccaaucccaucucgcaggaga

SEQ ID NO: 130581 - RNA, 64 nt, hsa
gagccgacugugccacccacuugcgagccucagucccuuccaagcugcacuggucauugggaau

SEQ ID NO: 130582 - RNA, 64 nt, hsa
ugcacguaguccagaugccugggaaggaacaucucccuuccagcaucugcugguagcaggcugg

SEQ ID NO: 130583 - RNA, 64 nt, hsa
cuggucagcugguccaggcugguccccgccgguccccuuccaguccagccaccaagaguccacu

SEQ ID NO: 130584 - RNA, 64 nt, hsa
gauguucuaagucuuuccauuggaucucauuggacccuuccauggugugaucgucugacuggug

SEQ ID NO: 130585 - RNA, 64 nt, hsa
gaguaagucaaccugccugacauuuggaguguuccccuuccacugagggcagucgauagagcug

SEQ ID NO: 130586 - RNA, 64 nt, hsa
uccguuggcuucugaacuggaauucugcagcuaacccuuccacgacuagaaccuuaggcauugg

SEQ ID NO: 130587 - RNA, 64 nt, hsa
caggccugucgggccccccgacgccgccccauuucccuuccagcaaacucaacucggcaaucca

SEQ ID NO: 130588 - RNA, 64 nt, hsa
cuuccucccgcucucugcuggcacgcgaggcuuccccuuccaccccauguggguauucccacaa

SEQ ID NO: 130589 - RNA, 64 nt, hsa
agucugugugcacagaguggguguuccuucgagccccuuccacucagagggccacacccagcga

SEQ ID NO: 130590 - RNA, 64 nt, hsa
uacuuuaaacuuuuuugcucugcagccuuccuugcccuuccaccuccuccuccuaauauucacu

SEQ ID NO: 130591 - RNA, 64 nt, hsa
cuuuccccccaggcucuuuguuucccuccacccacccuuccauauccucuggagcaggagacaa

SEQ ID NO: 130592 - RNA, 64 nt, hsa
caucguggagcccauggagucccacccuccuucccccuuccacccugcgcaaaaggggacggcc

SEQ ID NO: 130593 - RNA, 64 nt, hsa
gaguaugucccaucacuaccaugaagugugcucacccuuccagccuccucugcccucacccccg

SEQ ID NO: 130594 - RNA, 64 nt, hsa
uauuucgguugauuucauuuucuccccucucuuccccuuccacgaacugcaauaccaguaaccu

SEQ ID NO: 130595 - RNA, 64 nt, hsa
cccccugcggcggcugucagaccugggcggaggccccuuccacgcggugccggcggggcucgcc

SEQ ID NO: 130596 - RNA, 64 nt, hsa
caccaugcuccaacucccacacaaacgcuucuaccccuuccagaacuuacccaucaucccccca

SEQ ID NO: 130597 - RNA, 64 nt, hsa
cucacuguuauuuccccguucaacucccuguugucccuuccauccugggcaaaacugaaaggga

SEQ ID NO: 130598 - RNA, 64 nt, hsa
gaguggggaagauuuccccuuuagaucaaacugccccuuccauggaaaagcuggaaaaaaacuc

SEQ ID NO: 130599 - RNA, 64 nt, hsa
cagagggugugacccaguuacccuuuaacccccacccuuccagucgggugugagggccugaccg

SEQ ID NO: 130600 - RNA, 64 nt, hsa
uuuuuuguaggucugugauaaagaacuuagucaucccuuccaccuccuacugugaagaacagac

SEQ ID NO: 130601 - RNA, 64 nt, hsa
agucaggcagccacaccuugguccucaucuuggucccuuccaaucugaaaccucgugccuggcu

SEQ ID NO: 130602 - RNA, 64 nt, hsa
ucccuugcccgcgugggaccccaauagaacucagcccuuccaugccagcccuuccugcugccuc

SEQ ID NO: 130603 - RNA, 64 nt, hsa
cuccauuucccaaaguccucugcuccagcaacugcccuuccaggugggugugggacaccuggga

SEQ ID NO: 130604 - RNA, 64 nt, hsa
uggugcuucccccaccccuccacguguccguccacccuuccaucagcgggucuccucccagcgg

SEQ ID NO: 130605 - RNA, 64 nt, hsa
gaggcuuauccuggcaaugggguagucacugccacccuuccacacacacacacacacacacaca

SEQ ID NO: 130606 - RNA, 64 nt, hsa
agugccaggugggagagggagcagaacagccagccccuuccagguggcagucggaaggguuuuu

SEQ ID NO: 130607 - RNA, 64 nt, hsa
cuccccccacccuccccucacaccccgcacucaccccuuccacccaccuccccccauggcccgc

SEQ ID NO: 130608 - RNA, 64 nt, hsa
gggcucccuauuuggaagcaagcggggcaaggggcccuuccagaugccaccaccgccaacaggc

SEQ ID NO: 130609 - RNA, 64 nt, hsa
agcucccucaaagaggcaguugcccagccucuuucccuuccaguuuauuccagagcugccagug

SEQ ID NO: 130610 - RNA, 64 nt, hsa
caaacucccaucagcccaaucccugaucccugaucccuuccaccugcucugcugaugacccccc

SEQ ID NO: 130611 - RNA, 64 nt, hsa
uuuuauaaggacuuccugauugguuucucuucuccccuuccauuucugccuuuuguucauuuca

SEQ ID NO: 130612 - RNA, 64 nt, hsa; identical to SEQ ID NO: 73390

SEQ ID NO: 130613 - RNA, 64 nt, hsa; identical to SEQ ID NO: 73391

SEQ ID NO: 130614 - RNA, 64 nt, hsa; identical to SEQ ID NO: 73392

SEQ ID NO: 130615 - RNA, 64 nt, hsa; identical to SEQ ID NO: 73393

SEQ ID NO: 130616 - RNA, 64 nt, hsa; identical to SEQ ID NO: 73394

SEQ ID NO: 130617 - RNA, 64 nt, hsa; identical to SEQ ID NO: 73395

SEQ ID NO: 130618 - RNA, 64 nt, hsa; identical to SEQ ID NO: 73396

SEQ ID NO: 130619 - RNA, 64 nt, hsa; identical to SEQ ID NO: 73397

SEQ ID NO: 130620 - RNA, 64 nt, hsa; identical to SEQ ID NO: 73398

SEQ ID NO: 130621 - RNA, 64 nt, hsa; identical to SEQ ID NO: 73399

SEQ ID NO: 130622 - RNA, 64 nt, hsa; identical to SEQ ID NO: 73400

SEQ ID NO: 130623 - RNA, 64 nt, hsa; identical to SEQ ID NO: 73401

SEQ ID NO: 130624 - RNA, 64 nt, hsa; identical to SEQ ID NO: 73402

SEQ ID NO: 130625 - RNA, 64 nt, hsa; identical to SEQ ID NO: 73403

SEQ ID NO: 130626 - RNA, 64 nt, hsa; identical to SEQ ID NO: 73404

SEQ ID NO: 130627 - RNA, 64 nt, hsa; identical to SEQ ID NO: 73405

SEQ ID NO: 130628 - RNA, 64 nt, hsa; identical to SEQ ID NO: 73406

SEQ ID NO: 130629 - RNA, 64 nt, hsa; identical to SEQ ID NO: 73407

SEQ ID NO: 130630 - RNA, 64 nt, hsa; identical to SEQ ID NO: 73408

SEQ ID NO: 130631 - RNA, 64 nt, hsa; identical to SEQ ID NO: 73409

SEQ ID NO: 130632 - RNA, 64 nt, hsa
gccuucagggaaagacuaccagcucugucuuucuacccucuaauuuaacaaugcauaagaguca

SEQ ID NO: 130633 - RNA, 64 nt, hsa
cuaugacuuuuuauuucucuuccugggauccaccacccucuacucucagcugacugcugcauuu

SEQ ID NO: 130634 - RNA, 64 nt, hsa
acuccggggggagguagucccagccucccccggaacccucuaccaaugccuucugaccuucuga

SEQ ID NO: 130635 - RNA, 58 nt, hsa
ggcagaccccugggugcuagaagcccacacccucuacccuguuccucagcauggagcu

SEQ ID NO: 130636 - RNA, 64 nt, hsa
gguacaccaaagaggaagaagagcuguggaggccacccucuacaaagcuuuauagaacuucugg

SEQ ID NO: 130637 - RNA, 64 nt, hsa
uuuggaagauuuaaaaaccuagcauccuguucucacccucuaagcugcauugagaaaugacucg

SEQ ID NO: 130638 - RNA, 64 nt, hsa
ugauccagccccaccaaggggccuccagagaccccaggaacaauaagugucuccucccaccaga

SEQ ID NO: 130639 - RNA, 64 nt, hsa
ccucuauucacagaccagcaucuccucuccuuaucaggaacauuccuuccugaacauauucugc

SEQ ID NO: 130640 - RNA, 64 nt, hsa
uggcuugcuucccccagggcagcacaggcuaagucaggaacaucggaugccagggagggaggag

SEQ ID NO: 130641 - RNA, 64 nt, hsa
gaaugggugcccuacggggcccuccuucccccaccaggaacagauggaaccugccacccaggau

SEQ ID NO: 130642 - RNA, 64 nt, hsa
aacccaggaccaagcugugccugggcuccaaggacaggaacacugguccccccaucacacucac

SEQ ID NO: 130643 - RNA, 64 nt, hsa
gcuggagggauggccuaggacaccagggucacaccaggaacaugggagggccgugcuugucucu

SEQ ID NO: 130644 - RNA, 64 nt, hsa
acccugcugcucagcuuucucagggaagcaacuccaggaacacuccuuccacuccccucucuac

SEQ ID NO: 130645 - RNA, 64 nt, hsa
aaauggagaccucccacuguuuuugcuaaaguuacaggaacacgaucccuaguuuucauugaua

SEQ ID NO: 130646 - RNA, 64 nt, hsa
ucccuuuuauagcacuuuagcacaggcaaugcuacaggaacaaaguuucaaugcugcugagagu

SEQ ID NO: 130647 - RNA, 64 nt, hsa
aauuaccuucagaggccaacugacagaauccuggcaggaacagacauuaucuugccaguuagaa

SEQ ID NO: 130648 - RNA, 64 nt, hsa
uuaaggaauaagaggaaaauuauguuaugaagugcaggaacagcacagacccagacgaggggau

SEQ ID NO: 130649 - RNA, 64 nt, hsa
agcuguggaaagaagucacaaaacacugggccaccaggaacacaccuguagcccagcaaaguug

SEQ ID NO: 130650 - RNA, 64 nt, hsa
uguugcuauucagaguuuaaguuucaggagaaaacaggaacaauagaacacucugccuguuauu

SEQ ID NO: 130651 - RNA, 64 nt, hsa
ccacaguucuugaaaaguacuauguuucaaauuucaggaacaccagcguuagcuguaaaaguug

SEQ ID NO: 130652 - RNA, 64 nt, hsa
uuguauugauaaccacugggguuccgcauugaagcaggaacaaauugccucuuuuucuggccuu

SEQ ID NO: 130653 - RNA, 64 nt, hsa
cagcaguugaagccugacaggccucaguggugaccaggaacagaagcagccuuccuguuaguag

SEQ ID NO: 130654 - RNA, 64 nt, hsa
aggugggggcaggcugggcccugcauuucuggggcaggaacagagggugaaagggacagauaga

SEQ ID NO: 130655 - RNA, 64 nt, hsa
uccucugccaggugcuuggcucucugagagcaaacaggaacacuagagaccaaaaaggggacaa

SEQ ID NO: 130656 - RNA, 64 nt, hsa
cgcuucucucaccaggaacauucgcuucucucaccaggaacauuuaugguaguaugagggguug

SEQ ID NO: 130657 - RNA, 64 nt, hsa
ugagccaggagaugcacaccuucgcuucucucaccaggaacauucgcuucucucaccaggaaca

SEQ ID NO: 130658 - RNA, 64 nt, hsa
ggcacuucccucuggaaaucacaguguugugcaccaggaacacaaagaugagucaaaucuuuau

SEQ ID NO: 130659 - RNA, 64 nt, hsa
uacaugagaugccuuaggcuaaggcccuggcacacaggaacacaugugcuacaaaggagcuuug

SEQ ID NO: 130660 - RNA, 64 nt, hsa
auauuacacacaugugcgcauuacacacacacaauacacauacaugcauauagacgcaucuauu

SEQ ID NO: 130661 - RNA, 64 nt, hsa
uuuguguguguauauauauguuuguguauauauauacacauaugcauacauaugauuuuuuuuu

SEQ ID NO: 130662 - RNA, 64 nt, hsa
uguuuucauuauucugauagauuguauacauauguacacauacauauacacauaugcacaguca

SEQ ID NO: 130663 - RNA, 64 nt, hsa
ucugauagauuguauacauauguacacauacauauacacauaugcacagucaaggucaugaugu

SEQ ID NO: 130664 - RNA, 64 nt, hsa
uguguguauguauacacacauauacauauauauauacacauacauacacauacauacauacaua

SEQ ID NO: 130665 - RNA, 64 nt, hsa
uauacacacauauacauauauauauacacauacauacacauacauacauacauacauauauauc

SEQ ID NO: 130666 - RNA, 64 nt, hsa
ucuucuaaaacauauacauauauacauacacacauacacauauucuucaggucucuaagccccu

SEQ ID NO: 130667 - RNA, 64 nt, hsa
ccaugcugcuucagccuugagagaccuagguucuuacacauaugcacacacgcauacacacaug

SEQ ID NO: 130668 - RNA, 64 nt, hsa
gaguauuauugaagaugugaucaauagauuguaauacacauaucuaaaaauaguuaacacagau

SEQ ID NO: 130669 - RNA, 64 nt, hsa
cuuauuacugagagugcaaauuguacaagguauuuacacauacaacuucauauaacugagauga

SEQ ID NO: 130670 - RNA, 64 nt, hsa
cauauacauauauacauaucuacacauacauauauacacauauauguguguauguagauaugua

SEQ ID NO: 130671 - RNA, 64 nt, hsa
uguaaauguguguacauauacauauauacauaucuacacauacauauauacacauauaugugug

SEQ ID NO: 130672 - RNA, 64 nt, hsa
uauauacauguagauguacauauacauguacacauacacauaaauauuauugcaauuaagugau

SEQ ID NO: 130673 - RNA, 64 nt, hsa
caaacauauauacauguagauguacauauacauguacacauacacauaaauauuauugcaauua

SEQ ID NO: 130674 - RNA, 64 nt, hsa
cguguguauauguguauauauauacacauauauauacacauacacaaauauaugcauauuucaa

SEQ ID NO: 130675 - RNA, 64 nt, hsa
aauauguguguacguguguauauguguauauauauacacauauauauacacauacacaaauaua

SEQ ID NO: 130676 - RNA, 64 nt, hsa
uuuccuaguagauauauauauacacauacauauauacacauauacaaauguauauuuuugcaaa

SEQ ID NO: 130677 - RNA, 64 nt, hsa
cuuaagcaauauauuuuccuaguagauauauauauacacauacauauauacacauauacaaaug

SEQ ID NO: 130678 - RNA, 64 nt, hsa
guauggcaaaacuuaauugauccuacaagcuuacuacacauaggaaaauucauacuggagagaa

SEQ ID NO: 130679 - RNA, 64 nt, hsa
guggcaaugccuuuaaucaguccucacaccuuucuacacauaagauaauuuauacuggagagga

SEQ ID NO: 130680 - RNA, 64 nt, hsa
guggcaaagccuuuaaccaguuuucaacccuuauuacacauaagauaauucauagcggagagaa

SEQ ID NO: 130681 - RNA, 64 nt, hsa
guggaaaagcuuuucaccgauacucaauccuuaguacacauaagaaaauucauacuggggagaa

SEQ ID NO: 130682 - RNA, 64 nt, hsa
gcggaaaagccuuuaacugguccucaacucuuauuacacauaagauaauucacaguggagaaaa

SEQ ID NO: 130683 - RNA, 64 nt, hsa
uaaaguuuaaauuaacuaaaaauaugcauuuucuuacacauaauuuaaauguuaucauacuuuu

SEQ ID NO: 130684 - RNA, 64 nt, hsa
uagcaaacuuuugaaucuuucuuuuauugcuauuuacacauacauacacacauacaaaaccuuu

SEQ ID NO: 130685 - RNA, 64 nt, hsa
caaaauaagaucuguuccucauagcuauacuguguacacauaagacgcauauaggguuuuacug

SEQ ID NO: 130686 - RNA, 64 nt, hsa
cucugcaaggcuaaacugucauucacaacuuggcuacacauagacucuagucaguuuugucucc

SEQ ID NO: 130687 - RNA, 64 nt, hsa
aggauauucuaaagcaaauuaaaggagauuucuguacacauagucaguaauaauaaaacucagc

SEQ ID NO: 130688 - RNA, 64 nt, hsa
guaaaaacaaaaagaaaaccuuucuuuuguuuuuuacacauaagaaacaguauugaaaaauccc

SEQ ID NO: 130689 - RNA, 64 nt, hsa
cacauauacacaucuauguauggauauguguguauacacauauacacaucucuguccaaaauuu

SEQ ID NO: 130690 - RNA, 64 nt, hsa
cauaucuguacauauacaugugaguguacauauauacacauauacacaucuauguauggauaug

SEQ ID NO: 130691 - RNA, 64 nt, hsa
uuuuuaaaaaauagagcuuggucaaccucuauacuacacauauuacaagauauagcacuuucaa

SEQ ID NO: 130692 - RNA, 64 nt, hsa
uacauauuuucaggaucguucaucuagugagcaauacacauauuauaggccaauauuuuuuuaa

SEQ ID NO: 130693 - RNA, 64 nt, hsa
aagggagagaggccuuuuaaaauauauauauauauacacauauauauguauauauacacauaua

SEQ ID NO: 130694 - RNA, 64 nt, hsa
aauauauauauauauacacauauauauguauauauacacauauauguauguauacacauauaca

SEQ ID NO: 130695 - RNA, 64 nt, hsa
cauauauauguauauauacacauauauguauguauacacauauacacauguauauauacaugug

SEQ ID NO: 130696 - RNA, 64 nt, hsa
cauguguguauguauacauguauauauauauacauacacauauauguauacauauauacacaua

SEQ ID NO: 130697 - RNA, 64 nt, hsa
uauauauauacauacacauauauguauacauauauacacauauauguauacauauauacacaua

SEQ ID NO: 130698 - RNA, 64 nt, hsa
uguauacauauauacacauauauguauacauauauacacauauguauacauauauauauauucu

SEQ ID NO: 130699 - RNA, 64 nt, hsa
guggaauucaccuguguuucguguauaugccucauacacauaauuuugugcaugaaacagaguu

SEQ ID NO: 130700 - RNA, 64 nt, hsa
accagaauuguuuugcauuuuuugaauauuuguauacacauaaugagaccuuggggaugggacc

SEQ ID NO: 130701 - RNA, 64 nt, hsa
gaaccuuugaacuauauguauguguauaaggguauacacauacauauauggcauauaacaagug

SEQ ID NO: 130702 - RNA, 64 nt, hsa
gguauacacauacauauauggcauauaacaaguguacacauauacacauaacaaguguagaagu

SEQ ID NO: 130703 - RNA, 64 nt, hsa
cauacauauauggcauauaacaaguguacacauauacacauaacaaguguagaaguauauauua

SEQ ID NO: 130704 - RNA, 64 nt, hsa
gugguggccagcuuggaggauggacauuucuggauacacauacacauacaaaacagaaaacauu

SEQ ID NO: 130705 - RNA, 64 nt, hsa
gccagcuuggaggauggacauuucuggauacacauacacauacaaaacagaaaacauuuuuuaa

SEQ ID NO: 130706 - RNA, 64 nt, hsa
cacacaugcacacacguguagcucacacacaguauacacauacacaagugcacagaccacacac

SEQ ID NO: 130707 - RNA, 64 nt, hsa
gugcacugaccacaccuguauagaccaugcacaguacacauacgugcauacacaugccugcaua

SEQ ID NO: 130708 - RNA, 64 nt, hsa
ggcuauuguaaaauuuaaaagaaauauuuauauauacacauauauacacauacacacauguaua

SEQ ID NO: 130709 - RNA, 64 nt, hsa
aaauuuaaaagaaauauuuauauauacacauauauacacauacacacauguauauauauauucu

SEQ ID NO: 130710 - RNA, 64 nt, hsa
aucuugacaccugacuuuccaggaugcacauuuucauacguagaccaguuuccucuugguuucu

SEQ ID NO: 130711 - RNA, 64 nt, hsa
gauacacacacacacacacauauauauacacacacauacguauacacacacauacauauauaua

SEQ ID NO: 130712 - RNA, 64 nt, hsa
aaaaacaaaaaccuacuagucuugaacaaacugucauacguaugggaccuacacuuaaucuaua

SEQ ID NO: 130713 - RNA, 64 nt, hsa
gaaaaccagaguuuuugaaaaggcuuauuuuauacauacguauuauauagagaaacaaauguuu

SEQ ID NO: 130714 - RNA, 64 nt, hsa
ucauuuuuuauguauuguuuuacuccuuuuuauucauacguaaaauuuuggauuaauuugugaa

SEQ ID NO: 130715 - RNA, 64 nt, hsa
uucauuuuuaaguauuguuuuacuccuuuuuauucauacguaaaauuuuggauuaauuugugaa

SEQ ID NO: 130716 - RNA, 64 nt, hsa
ucugccuaucuucuuucacauauguguuuuuuuacauacguacuuuucccccuuaguuuguuuc

SEQ ID NO: 130717 - RNA, 64 nt, hsa
aguaaguuaauuuguuucugcauauaugcacauacauacguaaggaucuuaaacccagucuuga

SEQ ID NO: 130718 - RNA, 64 nt, hsa
aaaacaagcaaaaccaaagaauauguagucuaagcauacguauacaauaaaacuaugcuauuaa

SEQ ID NO: 130719 - RNA, 64 nt, hsa
uaaguuauuuuagugugaaggucaugggaaauggcauacguagcuuuuuaacuauuuggaacuc

SEQ ID NO: 130720 - RNA, 64 nt, hsa
ccauccugcucagcugcgucaugggccccccaugcauacguacauuccuggacacccucaccac

SEQ ID NO: 130721 - RNA, 64 nt, hsa
caaugacugcuuucaaaaaacaccagaauaaauacauacguaguguaagcaagcgaccacuguu

SEQ ID NO: 130722 - RNA, 64 nt, hsa
uuuucguaacagucgucgaacuaggccucaaaaacauacguaacgaaaaggccuagcgaggcaa

SEQ ID NO: 130723 - RNA, 64 nt, hsa
cccagugccagcuggugaauccaugaucaaaaugcauacguauuguuaaaugauaagguuuaga

SEQ ID NO: 130724 - RNA, 64 nt, hsa
ucacuggaaacuuccucucucgacauucucucuacauacguauauguguguguauaucgaugug

SEQ ID NO: 130725 - RNA, 64 nt, hsa
uuuuuaccuguuuguggauguguguuuguaugugcauacguaugagauaggcacaugcaucuuc

SEQ ID NO: 130726 - RNA, 64 nt, hsa
uauaaguggccucucuuagcucaguuacucaauucauacguaguauuuuuuaaaauaauuuuau

SEQ ID NO: 130727 - RNA, 64 nt, hsa
cccagacaaaucuaauauccugagguggccuuuacauacguaggaccaaacccucucuaccaug

SEQ ID NO: 130728 - RNA, 64 nt, hsa
cuuaucaagaaguuagcagguaugauauguauaucauacguauauaaacuggcauagguuacau

SEQ ID NO: 130729 - RNA, 64 nt, hsa
uugcauucuucuuggccaccugcauagucugacacauacguauguacaguuagacuugcaggcu

SEQ ID NO: 130730 - RNA, 64 nt, hsa
ugagggaccagcacucagucuaacauguaaacaucauacguaauaaagguuguguuucaaaccu

SEQ ID NO: 130731 - RNA, 64 nt, hsa
ucauaaaaugcuauuuuaaaauucauggaacuuucauacguaaaggugcaguugcucauuguag

SEQ ID NO: 130732 - RNA, 64 nt, hsa
uucauucuuucuuugcacguucauaaacauucuacauacguauucucuuuugucucuucauuua

SEQ ID NO: 130733 - RNA, 64 nt, hsa
aauggugcuguguuuuaaacuuacacaauugggacauacguauguguuuucuuaguaaaauggu

SEQ ID NO: 130734 - RNA, 64 nt, hsa
uguuaaugcacaaaugaucucuaauauauacuuacauacguaaaaucauaaaguuugguaaugc

SEQ ID NO: 130735 - RNA, 64 nt, hsa
uuguguuugucauuugucuauuauaguuuuacaacauacguauguaucuguaagugaaauguua

SEQ ID NO: 130736 - RNA, 64 nt, hsa
auaauaugcuaaaaauauuuucauauuuaaauaacauacguaaaggugugcuuucuguguuuua

SEQ ID NO: 130737 - RNA, 64 nt, hsa
uuacaauugauuaaaaguauccaugucuuggauacauacguaucuauagagcuggcauguaauu

SEQ ID NO: 130738 - RNA, 64 nt, hsa
cuggggacugugcucacuaccugggugacaggaucauacguaccccaaaccucaacaucacaca

SEQ ID NO: 130739 - RNA, 64 nt, hsa
ucccugagaccuggccucaaagggcugacccagccauacguagauccuggggucuuucuaggac

SEQ ID NO: 130740 - RNA, 64 nt, hsa
uaguucugguugauucacucaagaguucagugcucauacguaucugcucauuuugacaaagugc

SEQ ID NO: 130741 - RNA, 64 nt, hsa
caggacacauacauuuauagagugugaggcugugcauacguacauucaucccuuaauguucuca

SEQ ID NO: 130742 - RNA, 64 nt, hsa
agaaagacgauucagcuguguccagccugccacccauacguaggccaaccaagcacuucaugaa

SEQ ID NO: 130743 - RNA, 64 nt, hsa
gaagacuuuguuagaaaauuacuaauaaacuugccauacguauuacagcagaagugcuucaguc

SEQ ID NO: 130744 - RNA, 64 nt, hsa
gcauccucucaguuacuccugaauauucugauuucauacguacccagggagcaugcuguuuugu

SEQ ID NO: 130745 - RNA, 64 nt, hsa
gcgaauucccucaaacucuauuugaccugacagccauacguauuccccucugguagccacagac

SEQ ID NO: 130746 - RNA, 64 nt, hsa
cuuaauuuccaauaaaugauguauuugugcuauacauacguacugcuauacuauacauuagcuu

SEQ ID NO: 130747 - RNA, 64 nt, hsa
uguguuggcagugaacaagggcacgguuuuuauacauacguacauauauauauauaaacacaca

SEQ ID NO: 130748 - RNA, 64 nt, hsa
aagacggauuaucuagagaauaaucauauauaugcauacguaaaaauggaccacagugacuuau

SEQ ID NO: 130749 - RNA, 64 nt, hsa
ugugauacuugaaggaggaagcguuuaccauacacauacguauuuuccguagugcucugggugg

SEQ ID NO: 130750 - RNA, 64 nt, hsa
uuuacuuuuuuaaaaaagcaaauacauauauacacauacguaugcaaauauuauaguauaauag

SEQ ID NO: 130751 - RNA, 64 nt, hsa
accuucagauauauuuucaccagauauaaaaugacauacguaagaaguuauuacugcaucauuu

SEQ ID NO: 130752 - RNA, 64 nt, hsa
ucuucccaauuuaguaacuuagaugcuuccagcacauacguagguagcuaccccagccgguuug

SEQ ID NO: 130753 - RNA, 64 nt, hsa
cacuguuucaaacuuuacuauggcccuggccuagcauacguacacauuuuauuuuauuaugcau

SEQ ID NO: 130754 - RNA, 64 nt, hsa
ggcagccaggagaccccaggugaguuucugagcgcauacguaguugguucuuacccccaggugu

SEQ ID NO: 130755 - RNA, 64 nt, hsa
ccucagcccaauucgggcccuccaauuacugaggcauacguaacagauguaagugcuuuugggc

SEQ ID NO: 130756 - RNA, 64 nt, hsa
cuucagcccaauucggguccuccaauuacugaggcauacguaacaguuguaagugcuuuugggc

SEQ ID NO: 130757 - RNA, 64 nt, hsa
uugccuuguaaucaacagagagagaaacuaaacacauacguaagauggugcuugcucuauuugg

SEQ ID NO: 130758 - RNA, 64 nt, hsa
agcauuuucaugccaugguaauccaugagcuacacauacguagcccggcaccgugaugcaaguu

SEQ ID NO: 130759 - RNA, 64 nt, hsa
guuuauucaaggauguguggcaacuuucaacuuccauacguauauauguauguauggaaggcca

SEQ ID NO: 130760 - RNA, 64 nt, hsa
ucaugccagugcgagggcgucccgugcccacguacauacguaugucuccaugaguucugggcuc

SEQ ID NO: 130761 - RNA, 64 nt, hsa
ugaaucucuaguauguguguauacuuuauuuacccauacguauauuuuaugaccaugagcuaag

SEQ ID NO: 130762 - RNA, 64 nt, hsa
ucuuccuucucgccgucuugcaguugaagagcuacauacguagucaguuucgauuuguuacaga

SEQ ID NO: 130763 - RNA, 64 nt, hsa
gguuggaagauagcaguauuauuagcauaagcugcauacguaauauucaguaacugccauauua

SEQ ID NO: 130764 - RNA, 64 nt, hsa
uuaacugcuuccuauaauuuugauagugggaccacauacguaaaaaucucucauuuguguggag

SEQ ID NO: 130765 - RNA, 64 nt, hsa; identical to SEQ ID NO: 46370

SEQ ID NO: 130766 - RNA, 64 nt, hsa; identical to SEQ ID NO: 46371

SEQ ID NO: 130767 - RNA, 64 nt, hsa; identical to SEQ ID NO: 46372

SEQ ID NO: 130768 - RNA, 64 nt, hsa; identical to SEQ ID NO: 46373

SEQ ID NO: 130769 - RNA, 64 nt, hsa; identical to SEQ ID NO: 46374

SEQ ID NO: 130770 - RNA, 64 nt, hsa; identical to SEQ ID NO: 46375

SEQ ID NO: 130771 - RNA, 64 nt, hsa; identical to SEQ ID NO: 46376

SEQ ID NO: 130772 - RNA, 64 nt, hsa; identical to SEQ ID NO: 46377

SEQ ID NO: 130773 - RNA, 64 nt, hsa; identical to SEQ ID NO: 46378

SEQ ID NO: 130774 - RNA, 64 nt, hsa; identical to SEQ ID NO: 46379

SEQ ID NO: 130775 - RNA, 64 nt, hsa; identical to SEQ ID NO: 46380

SEQ ID NO: 130776 - RNA, 64 nt, hsa; identical to SEQ ID NO: 46381

SEQ ID NO: 130777 - RNA, 64 nt, hsa; identical to SEQ ID NO: 46382

SEQ ID NO: 130778 - RNA, 64 nt, hsa; identical to SEQ ID NO: 46383

SEQ ID NO: 130779 - RNA, 64 nt, hsa; identical to SEQ ID NO: 46384

SEQ ID NO: 130780 - RNA, 64 nt, hsa; identical to SEQ ID NO: 46385

SEQ ID NO: 130781 - RNA, 64 nt, hsa; identical to SEQ ID NO: 46386

SEQ ID NO: 130782 - RNA, 64 nt, hsa; identical to SEQ ID NO: 46387

SEQ ID NO: 130783 - RNA, 64 nt, hsa; identical to SEQ ID NO: 46388

SEQ ID NO: 130784 - RNA, 64 nt, hsa; identical to SEQ ID NO: 46389

SEQ ID NO: 130785 - RNA, 64 nt, hsa; identical to SEQ ID NO: 46390

SEQ ID NO: 130786 - RNA, 64 nt, hsa; identical to SEQ ID NO: 46391

SEQ ID NO: 130787 - RNA, 64 nt, hsa; identical to SEQ ID NO: 46392

SEQ ID NO: 130788 - RNA, 64 nt, hsa; identical to SEQ ID NO: 46393

SEQ ID NO: 130789 - RNA, 64 nt, hsa; identical to SEQ ID NO: 46394

SEQ ID NO: 130790 - RNA, 64 nt, hsa; identical to SEQ ID NO: 46395

SEQ ID NO: 130791 - RNA, 64 nt, hsa; identical to SEQ ID NO: 46396

SEQ ID NO: 130792 - RNA, 64 nt, hsa; identical to SEQ ID NO: 46397

SEQ ID NO: 130793 - RNA, 64 nt, hsa; identical to SEQ ID NO: 46398

SEQ ID NO: 130794 - RNA, 64 nt, hsa; identical to SEQ ID NO: 46399

SEQ ID NO: 130795 - RNA, 64 nt, hsa; identical to SEQ ID NO: 46400

SEQ ID NO: 130796 - RNA, 64 nt, hsa; identical to SEQ ID NO: 46401

SEQ ID NO: 130797 - RNA, 64 nt, hsa; identical to SEQ ID NO: 46402

SEQ ID NO: 130798 - RNA, 64 nt, hsa; identical to SEQ ID NO: 46403

SEQ ID NO: 130799 - RNA, 64 nt, hsa; identical to SEQ ID NO: 46404

SEQ ID NO: 130800 - RNA, 64 nt, hsa; identical to SEQ ID NO: 46405

SEQ ID NO: 130801 - RNA, 64 nt, hsa; identical to SEQ ID NO: 46406

SEQ ID NO: 130802 - RNA, 64 nt, hsa; identical to SEQ ID NO: 46407

SEQ ID NO: 130803 - RNA, 64 nt, hsa; identical to SEQ ID NO: 46408

SEQ ID NO: 130804 - RNA, 64 nt, hsa; identical to SEQ ID NO: 46409

SEQ ID NO: 130805 - RNA, 64 nt, hsa; identical to SEQ ID NO: 46410

SEQ ID NO: 130806 - RNA, 64 nt, hsa; identical to SEQ ID NO: 46411

SEQ ID NO: 130807 - RNA, 64 nt, hsa; identical to SEQ ID NO: 46412

SEQ ID NO: 130808 - RNA, 64 nt, hsa; identical to SEQ ID NO: 46413

SEQ ID NO: 130809 - RNA, 64 nt, hsa; identical to SEQ ID NO: 46414

SEQ ID NO: 130810 - RNA, 64 nt, hsa; identical to SEQ ID NO: 46415

SEQ ID NO: 130811 - RNA, 64 nt, hsa; identical to SEQ ID NO: 46416

SEQ ID NO: 130812 - RNA, 64 nt, hsa; identical to SEQ ID NO: 46417

SEQ ID NO: 130813 - RNA, 64 nt, hsa; identical to SEQ ID NO: 46418

SEQ ID NO: 130814 - RNA, 64 nt, hsa; identical to SEQ ID NO: 46419

SEQ ID NO: 130815 - RNA, 64 nt, hsa; identical to SEQ ID NO: 46420

SEQ ID NO: 130816 - RNA, 64 nt, hsa; identical to SEQ ID NO: 46421

SEQ ID NO: 130817 - RNA, 64 nt, hsa; identical to SEQ ID NO: 46422

SEQ ID NO: 130818 - RNA, 64 nt, hsa; identical to SEQ ID NO: 46423

SEQ ID NO: 130819 - RNA, 64 nt, hsa; identical to SEQ ID NO: 46424

SEQ ID NO: 130820 - RNA, 64 nt, hsa; identical to SEQ ID NO: 46425

SEQ ID NO: 130821 - RNA, 64 nt, hsa; identical to SEQ ID NO: 46426

SEQ ID NO: 130822 - RNA, 64 nt, hsa; identical to SEQ ID NO: 46427

SEQ ID NO: 130823 - RNA, 64 nt, hsa; identical to SEQ ID NO: 46428

SEQ ID NO: 130824 - RNA, 64 nt, hsa; identical to SEQ ID NO: 46429

SEQ ID NO: 130825 - RNA, 64 nt, hsa; identical to SEQ ID NO: 46430

SEQ ID NO: 130826 - RNA, 64 nt, hsa; identical to SEQ ID NO: 46431

SEQ ID NO: 130827 - RNA, 64 nt, hsa; identical to SEQ ID NO: 46432

SEQ ID NO: 130828 - RNA, 64 nt, hsa; identical to SEQ ID NO: 46433

SEQ ID NO: 130829 - RNA, 64 nt, hsa; identical to SEQ ID NO: 46434

SEQ ID NO: 130830 - RNA, 64 nt, hsa; identical to SEQ ID NO: 46435

SEQ ID NO: 130831 - RNA, 64 nt, hsa; identical to SEQ ID NO: 46436

SEQ ID NO: 130832 - RNA, 64 nt, hsa; identical to SEQ ID NO: 46437

SEQ ID NO: 130833 - RNA, 64 nt, hsa; identical to SEQ ID NO: 46438

SEQ ID NO: 130834 - RNA, 64 nt, hsa; identical to SEQ ID NO: 46439

SEQ ID NO: 130835 - RNA, 64 nt, hsa; identical to SEQ ID NO: 46440

SEQ ID NO: 130836 - RNA, 64 nt, hsa; identical to SEQ ID NO: 46441

SEQ ID NO: 130837 - RNA, 64 nt, hsa; identical to SEQ ID NO: 46442

SEQ ID NO: 130838 - RNA, 64 nt, hsa; identical to SEQ ID NO: 46443

SEQ ID NO: 130839 - RNA, 64 nt, hsa; identical to SEQ ID NO: 46444

SEQ ID NO: 130840 - RNA, 64 nt, hsa; identical to SEQ ID NO: 46445

SEQ ID NO: 130841 - RNA, 64 nt, hsa; identical to SEQ ID NO: 46446

SEQ ID NO: 130842 - RNA, 64 nt, hsa; identical to SEQ ID NO: 46447

SEQ ID NO: 130843 - RNA, 64 nt, hsa; identical to SEQ ID NO: 46448

SEQ ID NO: 130844 - RNA, 64 nt, hsa; identical to SEQ ID NO: 46449

SEQ ID NO: 130845 - RNA, 64 nt, hsa; identical to SEQ ID NO: 46450

SEQ ID NO: 130846 - RNA, 64 nt, hsa; identical to SEQ ID NO: 46451

SEQ ID NO: 130847 - RNA, 64 nt, hsa; identical to SEQ ID NO: 46452

SEQ ID NO: 130848 - RNA, 64 nt, hsa; identical to SEQ ID NO: 46453

SEQ ID NO: 130849 - RNA, 64 nt, hsa; identical to SEQ ID NO: 46454

SEQ ID NO: 130850 - RNA, 64 nt, hsa; identical to SEQ ID NO: 46455

SEQ ID NO: 130851 - RNA, 64 nt, hsa; identical to SEQ ID NO: 46456

SEQ ID NO: 130852 - RNA, 64 nt, hsa; identical to SEQ ID NO: 46457

SEQ ID NO: 130853 - RNA, 64 nt, hsa; identical to SEQ ID NO: 46458

SEQ ID NO: 130854 - RNA, 64 nt, hsa; identical to SEQ ID NO: 46459

SEQ ID NO: 130855 - RNA, 64 nt, hsa; identical to SEQ ID NO: 46460

SEQ ID NO: 130856 - RNA, 64 nt, hsa; identical to SEQ ID NO: 46461

SEQ ID NO: 130857 - RNA, 64 nt, hsa; identical to SEQ ID NO: 46462

SEQ ID NO: 130858 - RNA, 64 nt, hsa; identical to SEQ ID NO: 46463

SEQ ID NO: 130859 - RNA, 64 nt, hsa; identical to SEQ ID NO: 46464

SEQ ID NO: 130860 - RNA, 64 nt, hsa; identical to SEQ ID NO: 46465

SEQ ID NO: 130861 - RNA, 64 nt, hsa; identical to SEQ ID NO: 46466

SEQ ID NO: 130862 - RNA, 64 nt, hsa; identical to SEQ ID NO: 46467

SEQ ID NO: 130863 - RNA, 64 nt, hsa; identical to SEQ ID NO: 46468

SEQ ID NO: 130864 - RNA, 64 nt, hsa; identical to SEQ ID NO: 46469

SEQ ID NO: 130865 - RNA, 64 nt, hsa; identical to SEQ ID NO: 46470

SEQ ID NO: 130866 - RNA, 64 nt, hsa; identical to SEQ ID NO: 46471

SEQ ID NO: 130867 - RNA, 64 nt, hsa; identical to SEQ ID NO: 46472

SEQ ID NO: 130868 - RNA, 64 nt, hsa; identical to SEQ ID NO: 46473

SEQ ID NO: 130869 - RNA, 64 nt, hsa; identical to SEQ ID NO: 46474

SEQ ID NO: 130870 - RNA, 60 nt, hsa; identical to SEQ ID NO: 46475

SEQ ID NO: 130871 - RNA, 64 nt, hsa; identical to SEQ ID NO: 46476

SEQ ID NO: 130872 - RNA, 64 nt, hsa; identical to SEQ ID NO: 46477

SEQ ID NO: 130873 - RNA, 64 nt, hsa; identical to SEQ ID NO: 46478

SEQ ID NO: 130874 - RNA, 64 nt, hsa; identical to SEQ ID NO: 46479

SEQ ID NO: 130875 - RNA, 64 nt, hsa; identical to SEQ ID NO: 46480

SEQ ID NO: 130876 - RNA, 64 nt, hsa; identical to SEQ ID NO: 46481

SEQ ID NO: 130877 - RNA, 64 nt, hsa; identical to SEQ ID NO: 46482

SEQ ID NO: 130878 - RNA, 64 nt, hsa; identical to SEQ ID NO: 46483

SEQ ID NO: 130879 - RNA, 64 nt, hsa; identical to SEQ ID NO: 46484

SEQ ID NO: 130880 - RNA, 64 nt, hsa; identical to SEQ ID NO: 46485

SEQ ID NO: 130881 - RNA, 64 nt, hsa; identical to SEQ ID NO: 46486

SEQ ID NO: 130882 - RNA, 64 nt, hsa; identical to SEQ ID NO: 46487

SEQ ID NO: 130883 - RNA, 64 nt, hsa; identical to SEQ ID NO: 46488

SEQ ID NO: 130884 - RNA, 64 nt, hsa; identical to SEQ ID NO: 46489

SEQ ID NO: 130885 - RNA, 64 nt, hsa; identical to SEQ ID NO: 46490

SEQ ID NO: 130886 - RNA, 64 nt, hsa; identical to SEQ ID NO: 46491

SEQ ID NO: 130887 - RNA, 64 nt, hsa; identical to SEQ ID NO: 46492

SEQ ID NO: 130888 - RNA, 64 nt, hsa; identical to SEQ ID NO: 46493

SEQ ID NO: 130889 - RNA, 64 nt, hsa; identical to SEQ ID NO: 46494

SEQ ID NO: 130890 - RNA, 64 nt, hsa; identical to SEQ ID NO: 46495

SEQ ID NO: 130891 - RNA, 64 nt, hsa; identical to SEQ ID NO: 46496

SEQ ID NO: 130892 - RNA, 64 nt, hsa; identical to SEQ ID NO: 46497

SEQ ID NO: 130893 - RNA, 64 nt, hsa; identical to SEQ ID NO: 46498

SEQ ID NO: 130894 - RNA, 64 nt, hsa; identical to SEQ ID NO: 46499

SEQ ID NO: 130895 - RNA, 64 nt, hsa; identical to SEQ ID NO: 46500

SEQ ID NO: 130896 - RNA, 64 nt, hsa; identical to SEQ ID NO: 46501

SEQ ID NO: 130897 - RNA, 64 nt, hsa; identical to SEQ ID NO: 46502

SEQ ID NO: 130898 - RNA, 64 nt, hsa; identical to SEQ ID NO: 46503

SEQ ID NO: 130899 - RNA, 64 nt, hsa; identical to SEQ ID NO: 46504

SEQ ID NO: 130900 - RNA, 64 nt, hsa; identical to SEQ ID NO: 46505

SEQ ID NO: 130901 - RNA, 64 nt, hsa; identical to SEQ ID NO: 46506

SEQ ID NO: 130902 - RNA, 64 nt, hsa; identical to SEQ ID NO: 46507

SEQ ID NO: 130903 - RNA, 64 nt, hsa; identical to SEQ ID NO: 46508

SEQ ID NO: 130904 - RNA, 64 nt, hsa; identical to SEQ ID NO: 46509

SEQ ID NO: 130905 - RNA, 64 nt, hsa; identical to SEQ ID NO: 46510

SEQ ID NO: 130906 - RNA, 64 nt, hsa; identical to SEQ ID NO: 46511

SEQ ID NO: 130907 - RNA, 64 nt, hsa; identical to SEQ ID NO: 46512

SEQ ID NO: 130908 - RNA, 64 nt, hsa; identical to SEQ ID NO: 46513

SEQ ID NO: 130909 - RNA, 64 nt, hsa; identical to SEQ ID NO: 46514

SEQ ID NO: 130910 - RNA, 64 nt, hsa; identical to SEQ ID NO: 46515

SEQ ID NO: 130911 - RNA, 64 nt, hsa; identical to SEQ ID NO: 46516

SEQ ID NO: 130912 - RNA, 64 nt, hsa; identical to SEQ ID NO: 46517

SEQ ID NO: 130913 - RNA, 64 nt, hsa; identical to SEQ ID NO: 46518

SEQ ID NO: 130914 - RNA, 64 nt, hsa; identical to SEQ ID NO: 46519

SEQ ID NO: 130915 - RNA, 64 nt, hsa; identical to SEQ ID NO: 46520

SEQ ID NO: 130916 - RNA, 64 nt, hsa; identical to SEQ ID NO: 46521

SEQ ID NO: 130917 - RNA, 64 nt, hsa; identical to SEQ ID NO: 46522

SEQ ID NO: 130918 - RNA, 64 nt, hsa; identical to SEQ ID NO: 46523

SEQ ID NO: 130919 - RNA, 64 nt, hsa; identical to SEQ ID NO: 46524

SEQ ID NO: 130920 - RNA, 64 nt, hsa; identical to SEQ ID NO: 46525

SEQ ID NO: 130921 - RNA, 64 nt, hsa; identical to SEQ ID NO: 46526

SEQ ID NO: 130922 - RNA, 64 nt, hsa; identical to SEQ ID NO: 46527

SEQ ID NO: 130923 - RNA, 64 nt, hsa; identical to SEQ ID NO: 46528

SEQ ID NO: 130924 - RNA, 64 nt, hsa; identical to SEQ ID NO: 46529

SEQ ID NO: 130925 - RNA, 50 nt, hsa; identical to SEQ ID NO: 46530

SEQ ID NO: 130926 - RNA, 64 nt, hsa; identical to SEQ ID NO: 46531

SEQ ID NO: 130927 - RNA, 62 nt, hsa
agcagauggccuauuugaggaagagggugucugcccuucacaaacaccucucucuccccugc

SEQ ID NO: 130928 - RNA, 62 nt, hsa
cugcacuagcugucccaagcuuacauacagaggcccuucaggagggccuccugugccgcagg

SEQ ID NO: 130929 - RNA, 62 nt, hsa
uacuacccuggagggacagcucugcccuugaggcccuucagaaauuugugcugauuuggucc

SEQ ID NO: 130930 - RNA, 62 nt, hsa
acugcaguguagggaauaggucaccaggaggagcccuucauccuggcaggccggauugugga

SEQ ID NO: 130931 - RNA, 62 nt, hsa
ccuuucccaucuggagagaagcuuccagaccagcccuucacacaccacagccaggaggggcc

SEQ ID NO: 130932 - RNA, 62 nt, hsa
ccguuccugccuggagagaagcuuccagaccagcccuucacaccacagccaggagaggccuu

SEQ ID NO: 130933 - RNA, 62 nt, hsa
cgagacucagcuuaucugaucaaggugaacuugcccuucaauagacuugcccuuguuacugc

SEQ ID NO: 130934 - RNA, 62 nt, hsa
uagaagucagucaugacucuucauucuauuucgcccuucacaaagaguuagcugccagcucu

SEQ ID NO: 130935 - RNA, 62 nt, hsa
ggccaagccuggcccuuaaacaacugcagaaagcccuucaacuucagaaggccucacucaag

SEQ ID NO: 130936 - RNA, 62 nt, hsa
uggguucagccucucccacaauaagaguucuugcccuucauacccucuaccuggauggaugg

SEQ ID NO: 130937 - RNA, 62 nt, hsa
cugugucaucucagucauuugacuuagaaagugcccuucaaaaggacccuguucacugcugc

SEQ ID NO: 130938 - RNA, 62 nt, hsa
uuccauguuaagaaggugagguccauguuggugcccuucagaguagagaaccauguaaacau

SEQ ID NO: 130939 - RNA, 62 nt, hsa
uucacaaagucagagcgauaggaaagcacccugcccuucaucuucauguucucccaaaugga

SEQ ID NO: 130940 - RNA, 62 nt, hsa
cagauuucguuuccgucaacuuaaacauuguugcccuucaacaaggcucuugaauuaauaaa

SEQ ID NO: 130941 - RNA, 62 nt, hsa
cuuaaaaaccuauacaacaauaagaggagugcgcccuucagcagcauguauacaaaaauugc

SEQ ID NO: 130942 - RNA, 62 nt, hsa
aauaggaggagcacuucgagucgaguguaagggcccuucacaaaagcagaaggaacacuggc

SEQ ID NO: 130943 - RNA, 64 nt, hsa
uuuuauucaggcuauauauuguagcuuaauuuuuauuugcaauuaauuuauuuaaacuaaguaa

SEQ ID NO: 130944 - RNA, 64 nt, hsa
ugaaugguagcuuagugagcaaccuagcucaaggauuugcaaaguuaggaagaaggacgagaga

SEQ ID NO: 130945 - RNA, 64 nt, hsa
aaaacacauugccuaacuacuaguuuuuacuuuuauuugcaacauuuacaguccuucaaaaucc

SEQ ID NO: 130946 - RNA, 64 nt, hsa
cuauucugccacuccugacagggugaccuuggguauuugcaauauuccuuugggccucugcuuc

SEQ ID NO: 130947 - RNA, 64 nt, hsa
aaaugugauagcugugcaugcauuauauauuugcauuugcaaauuucccauuguuuuaacagcu

SEQ ID NO: 130948 - RNA, 64 nt, hsa
cauaggacaauuaauggaaaaaaaaauucucauuauuugcaaagaaugaacaaguuaaugaaca

SEQ ID NO: 130949 - RNA, 64 nt, hsa
auauuuugauuuccccucauuuuaguuuaauauaauuugcaauaaauguacauauuguuguuug

SEQ ID NO: 130950 - RNA, 64 nt, hsa
gauuuuuaucagagugagaaaauuaaaauuauugauuugcaaguaguaaacaguucauauuuug

SEQ ID NO: 130951 - RNA, 56 nt, hsa
uauucuuaacccuaagguaaaaaugcauuugcaaagggagaaaaugaaggccaaac

SEQ ID NO: 130952 - RNA, 64 nt, hsa
auaaggcaaagcagaaucuguuguccuuaauuauauuugcaauuuggaauuugugugaguugau

SEQ ID NO: 130953 - RNA, 64 nt, hsa
guucuuuugguuuccccccucagaagaaucaugaauuugcaacagaccuaauuuuugguuacuu

SEQ ID NO: 130954 - RNA, 64 nt, hsa
auuuuuauuccagccuacuuggaaacauguuuuuauuugcaauauaugccugacugaauuaagc

SEQ ID NO: 130955 - RNA, 64 nt, hsa
agccuggcacucccaaaucugggaagcauaguuuauuugcaaguguucaccuuccaaaucauga

SEQ ID NO: 130956 - RNA, 64 nt, hsa
ucuccauaggucaaaauauuguuggaauacuaaaauuugcaaccuuguuuacuuuaaaagguug

SEQ ID NO: 130957 - RNA, 64 nt, hsa
gcaguacucugaauggaccacaguguuugcacauauuugcaauuuuuugcuguuuuggaagugu

SEQ ID NO: 130958 - RNA, 64 nt, hsa
uagagaugacuguuuuuugccacagcccuauggaauuugcaaucugugauugccuuguaaaaag

SEQ ID NO: 130959 - RNA, 64 nt, hsa
uauucauuuaauggcauagaccauaccagaccuaauuugcaaguauugggucuuaaacuucaag

SEQ ID NO: 130960 - RNA, 64 nt, hsa
aaaaguucauguaauauuucugauuuuucagaauauuugcaauaagagucuggauuuuaaaaaa

SEQ ID NO: 130961 - RNA, 64 nt, hsa
auuuggaagcuaccaggaaugcuuucuaauuaucauuugcaacuagaacuguaaucagaaagaa

SEQ ID NO: 130962 - RNA, 64 nt, hsa
uaacagaagaugugauuugcaaacuccuuguuuuauuugcaagugcuucugacaucaccagagc

SEQ ID NO: 130963 - RNA, 64 nt, hsa
ugcugcccacuccuccccuauaacagaagaugugauuugcaaacuccuuguuuuauuugcaagu

SEQ ID NO: 130964 - RNA, 64 nt, hsa
acacacagcuucaacaauugucaccauauggccaauuugcaacaaugggacucuuaugaaaaac

SEQ ID NO: 130965 - RNA, 64 nt, hsa
acaccuggacuccuugacauccaauucaaacugcauuugcaaaaugugcaaagaccucuuauga

SEQ ID NO: 130966 - RNA, 64 nt, hsa
ccagaaaauaacugugccccaagaagugcuccagauuugcaaggaauagccccaagagaauacc

SEQ ID NO: 130967 - RNA, 64 nt, hsa
agaggcugguuauaaauuugaacucccucagcccauuugcaacucugccucuguucucuugcau

SEQ ID NO: 130968 - RNA, 64 nt, hsa
ucaauuggcuuauuuuuuagaucaccugcaauucauuugcaaauugcaauaaaacacauuuuag

SEQ ID NO: 130969 - RNA, 64 nt, hsa
ugagaugaucacgguuucuuuuguuuaucacgccauuugcaaaucagagcaagagcucuuucuc

SEQ ID NO: 130970 - RNA, 64 nt, hsa
guauuuuuuuccuuguaucaagaugcaaaacauaauuugcaaaauuuuauaauugaaauaaaac

SEQ ID NO: 130971 - RNA, 64 nt, hsa
uagcguacaauuuaucauaaauauaugagguaaaauuugcaaaacuuuccacaguacuuucuug

SEQ ID NO: 130972 - RNA, 64 nt, hsa
auacauccaauaugucaaguuaaaccauucugggauuugcaaaguuuaauacauccaauauguc

SEQ ID NO: 130973 - RNA, 64 nt, hsa; identical to SEQ ID NO: 130972

SEQ ID NO: 130974 - RNA, 64 nt, hsa
gccauuuaaauuauauccucauuuuaaaaguuacauuugcaaauauuucucccuaugauaaugu

SEQ ID NO: 130975 - RNA, 64 nt, hsa
cuuuaguucuuacauuucuaauagccuuggguuuauuugcaaaggaagcuugaaaaauaugaga

SEQ ID NO: 130976 - RNA, 64 nt, hsa
uucaaaacuuauuagaacaguagcuucugcuggaauuugcaaucacugaagucauagaaaauag

SEQ ID NO: 130977 - RNA, 64 nt, hsa
cuagaauugugaacuuuuaagagucugacuagaaauuugcaacuuauaaaaaaguuacuuuuaa

SEQ ID NO: 130978 - RNA, 64 nt, hsa
uaucaaggaaauaauaaagcagaaaccccaagaaauuugcaacuuaacaguuugagacugucuc

SEQ ID NO: 130979 - RNA, 64 nt, hsa
ucuguucucagguuuuaacuccauguuuaccaucauuugcaaaaagguaccaaaaaaauccaua

SEQ ID NO: 130980 - RNA, 64 nt, hsa
uaggccugucaggucuccuugggaaaggcuucauauuugcaacuuugaugauucuauguccagc

SEQ ID NO: 130981 - RNA, 64 nt, hsa
uuccaguucugguugcuguuaguuucccugagguauuugcaaccaccauggcuggguaaccacc

SEQ ID NO: 130982 - RNA, 64 nt, hsa
ucagaaaugguagcuauucuauaccuaugguuuaaguaaauauuucugaauaaggcuucaccau

SEQ ID NO: 130983 - RNA, 64 nt, hsa
ggaggucaguaaacuuucuguggaagggccagagaguaaauauuuuaggcuuugcagcccauac

SEQ ID NO: 130984 - RNA, 64 nt, hsa
gguuugaaaugaagacuuugucguguacuuaggaaguaaauaucuuuugaauuagagaaagugu

SEQ ID NO: 130985 - RNA, 64 nt, hsa
agcuauaugaauuuuggcauguuucagagagaucaguaaauaaaauauuagauaaaauauauau

SEQ ID NO: 130986 - RNA, 64 nt, hsa
ugaauaaacaaauaaguaguaaaauaagguaagaaguaaauauguaaaagagauaauuucaagc

SEQ ID NO: 130987 - RNA, 64 nt, hsa
uuaauaagauagcacauugacuuuuaaagggaaaaguaaauauaacuuagcauguaaacucauu

SEQ ID NO: 130988 - RNA, 64 nt, hsa
uucagugaaggaaaggaauugagagauuuuucuuaguaaauagauuauuguuaaguaaauaguu

SEQ ID NO: 130989 - RNA, 64 nt, hsa
ugagagauuuuucuuaguaaauagauuauuguuaaguaaauaguuauuaaaaauauaucucacu

SEQ ID NO: 130990 - RNA, 64 nt, hsa
agaaggaaauaaauaggaguaaaaagaccauuguaguaaauaaguucaaggggaacuugggacc

SEQ ID NO: 130991 - RNA, 64 nt, hsa
uaguuugucuuuggcaaaaaaaaaaaaaaaaaaaaguaaauauccagggaacccugcccagacu

SEQ ID NO: 130992 - RNA, 64 nt, hsa
ccaucuaucuuauuagucuugugccaauaagagaaguaaauaucaaacauuaaaauggucacuu

SEQ ID NO: 130993 - RNA, 64 nt, hsa
gggugaguuuuauagauuuauuaaauuuugauaaaguaaauauuuugaccacuauuuucaacaa

SEQ ID NO: 130994 - RNA, 64 nt, hsa
uuuagaucucauaaugcuuuguuaaauguuuacaaguaaauaguuugaauucaguaaauauuau

SEQ ID NO: 130995 - RNA, 64 nt, hsa
uuguuaaauguuuacaaguaaauaguuugaauucaguaaauauuauugguuguuguauugauca

SEQ ID NO: 130996 - RNA, 64 nt, hsa
uuuuaaaaauuuaaaaguaggucaguuuauaacgaguaaauaccuaacacaccaagaaugugca

SEQ ID NO: 130997 - RNA, 64 nt, hsa
ucaaugccaucugaagauuuuguaauugaguagcaguaaauauacagauuuacaauguuuuaac

SEQ ID NO: 130998 - RNA, 64 nt, hsa
ccggucuugagaccugugaacugcugcccuguuuaguaaauaaaauuaaugcauuucuagaggg

SEQ ID NO: 130999 - RNA, 64 nt, hsa
gagaacaaauaggaaaaaaaaaacuuauuuuucuaguaaauauuaauguauuacauuucaaaua

SEQ ID NO: 131000 - RNA, 64 nt, hsa
cucuaaaaaaugaaguguauuaaguaaauaaauaaguaaauaaccaaccaacccugaggaacau

SEQ ID NO: 131001 - RNA, 64 nt, hsa
acccuaaagcugcucuaaaaaaugaaguguauuaaguaaauaaauaaguaaauaaccaaccaac

SEQ ID NO: 131002 - RNA, 64 nt, hsa
cccaguccaccacagaaucagcuaaugugacagaaguaaauauagugcgucauaauugcuaaaa

SEQ ID NO: 131003 - RNA, 64 nt, hsa
uuauuggcauauacugacugacugcaauauuuguaguaaauagggaaaauaaguauuuaguugg

SEQ ID NO: 131004 - RNA, 64 nt, hsa
uaguguagaauugucuguguuuauuguuuuuaugaguaaauacaugcauugucauaauaaaaug

SEQ ID NO: 131005 - RNA, 64 nt, hsa
guaaacaguauuauaaaaucaaaauauggguaaaaguaaauauuuaccagcaacuuaacuuuua

SEQ ID NO: 131006 - RNA, 64 nt, hsa
cagguucugaauaacaauauuuuuccaaauugaaaguaaauauuccagaaguugauagccuggu

SEQ ID NO: 131007 - RNA, 64 nt, hsa
aaaauggagaaaagaaaguuuucugaaaaaaugcaguaaauauaagccacauuucuaaaguuua

SEQ ID NO: 131008 - RNA, 64 nt, hsa
ccuggccuugccuucacagggcucaccauacacaaguaaauaaaaaauauguaauguuuggaau

SEQ ID NO: 131009 - RNA, 64 nt, hsa
ggcgauuguggagggccuccugaaggaggagaugaguaaauauauuuuuuuggagacagggucu

SEQ ID NO: 131010 - RNA, 64 nt, hsa
cacgucgcucuuccugcggguucuuggcgagacacagcuugagaacagaagggcgucgggggaa

SEQ ID NO: 131011 - RNA, 64 nt, hsa
uuggaaaaaaauaaauaaauaaauaaauaaaaggcagcuugaguuuccaaacgugugauucacu

SEQ ID NO: 131012 - RNA, 64 nt, hsa
guaucuguguauccacauaggauuucucuuaauucagcuugaauugauggggagggagguaaga

SEQ ID NO: 131013 - RNA, 64 nt, hsa
caccucuccccucaaauuccgugaccaaguugugcagcuugagcaaaugccgaaagaggguauu

SEQ ID NO: 131014 - RNA, 64 nt, hsa
aagagguaugauuccuaagcccuaaggagcuccucagcuugaaauggggcugcaucccuauaaa

SEQ ID NO: 131015 - RNA, 64 nt, hsa
aacguuagcaacacagcagucuccuaauuaaugacagcuugacuuaacaauuuuccaacuuuac

SEQ ID NO: 131016 - RNA, 64 nt, hsa
uuaaguaaugaauauauaagaacuguacucuucucagcuugagcuuacauagguaaauaucacc

SEQ ID NO: 131017 - RNA, 64 nt, hsa
ucuggcaaccauauuucuggaaguugagauguuucagcuugaagaaccaaaacagaaggaauau

SEQ ID NO: 131018 - RNA, 64 nt, hsa; identical to SEQ ID NO: 77261

SEQ ID NO: 131019 - RNA, 64 nt, hsa; identical to SEQ ID NO: 77262

SEQ ID NO: 131020 - RNA, 64 nt, hsa; identical to SEQ ID NO: 77263

SEQ ID NO: 131021 - RNA, 64 nt, hsa; identical to SEQ ID NO: 77264

SEQ ID NO: 131022 - RNA, 64 nt, hsa; identical to SEQ ID NO: 77265

SEQ ID NO: 131023 - RNA, 64 nt, hsa; identical to SEQ ID NO: 77266

SEQ ID NO: 131024 - RNA, 64 nt, hsa; identical to SEQ ID NO: 77267

SEQ ID NO: 131025 - RNA, 64 nt, hsa; identical to SEQ ID NO: 77268

SEQ ID NO: 131026 - RNA, 64 nt, hsa; identical to SEQ ID NO: 77269

SEQ ID NO: 131027 - RNA, 64 nt, hsa; identical to SEQ ID NO: 77270

SEQ ID NO: 131028 - RNA, 64 nt, hsa; identical to SEQ ID NO: 77271

SEQ ID NO: 131029 - RNA, 64 nt, hsa; identical to SEQ ID NO: 77272

SEQ ID NO: 131030 - RNA, 64 nt, hsa; identical to SEQ ID NO: 77273

SEQ ID NO: 131031 - RNA, 64 nt, hsa; identical to SEQ ID NO: 77274

SEQ ID NO: 131032 - RNA, 64 nt, hsa; identical to SEQ ID NO: 77275

SEQ ID NO: 131033 - RNA, 64 nt, hsa; identical to SEQ ID NO: 77276

SEQ ID NO: 131034 - RNA, 64 nt, hsa
cuuaugagaaaaccuguguggacaucccuugguguacacuaagacagagcagagcccagcgcuc

SEQ ID NO: 131035 - RNA, 64 nt, hsa
ccuugugccggccaggcccaguuuccuugugugauacacuaauguauuugcuuuuuuuggaaau

SEQ ID NO: 131036 - RNA, 64 nt, hsa
ugguauauguucuuuauauuuuaaugugaguauauacacuaagaacaaacuaaauugugauuua

SEQ ID NO: 131037 - RNA, 64 nt, hsa
auuuuuucugugaaacuucauauugcugaagacauacacuaagaauuuauguagauaauguacu

SEQ ID NO: 131038 - RNA, 64 nt, hsa
ggggccuucagcuggagcuguggacuuuuguacauacacuaaaauucugaaguuaaagcucugc

SEQ ID NO: 131039 - RNA, 64 nt, hsa
guuuuguuuuguuuuguuuuuaaaucaaucauguuacacuaauagaaacuuggcacuccugugc

SEQ ID NO: 131040 - RNA, 64 nt, hsa
uaugcucguuucucucaauuugaaacacaagaauuacacuaauaguaacaggccuugagcacaa

SEQ ID NO: 131041 - RNA, 64 nt, hsa
cuggaacacaauaauguguccuucuacauuuuauuacacuaaaugauauucauauucaagcaac

SEQ ID NO: 131042 - RNA, 64 nt, hsa
aaaagcuaaaauggcuuaacaucaugcuacacuuuacacuaaaaaucuauuacugugagugguc

SEQ ID NO: 131043 - RNA, 64 nt, hsa
gauguugaaaggaugaaaaaagguauaguagacauacacuaaccaaaaauguagcucuuugaau

SEQ ID NO: 131044 - RNA, 64 nt, hsa
aaccuauguuauaugauacaugcauaacuugagcuacacuaaaccacaugacaguguuuaguua

SEQ ID NO: 131045 - RNA, 64 nt, hsa
ccuuguggaaagacauguucauaugucacuccucuacacuaacugagauguguuaaauaaacug

SEQ ID NO: 131046 - RNA, 64 nt, hsa; identical to SEQ ID NO: 24182

SEQ ID NO: 131047 - RNA, 64 nt, hsa; identical to SEQ ID NO: 24183

SEQ ID NO: 131048 - RNA, 64 nt, hsa; identical to SEQ ID NO: 24184

SEQ ID NO: 131049 - RNA, 64 nt, hsa; identical to SEQ ID NO: 24185

SEQ ID NO: 131050 - RNA, 64 nt, hsa; identical to SEQ ID NO: 24186

SEQ ID NO: 131051 - RNA, 64 nt, hsa; identical to SEQ ID NO: 24187

SEQ ID NO: 131052 - RNA, 64 nt, hsa; identical to SEQ ID NO: 24188

SEQ ID NO: 131053 - RNA, 64 nt, hsa; identical to SEQ ID NO: 24189

SEQ ID NO: 131054 - RNA, 64 nt, hsa; identical to SEQ ID NO: 24190

SEQ ID NO: 131055 - RNA, 64 nt, hsa; identical to SEQ ID NO: 24191

SEQ ID NO: 131056 - RNA, 64 nt, hsa; identical to SEQ ID NO: 24192

SEQ ID NO: 131057 - RNA, 64 nt, hsa; identical to SEQ ID NO: 24193

SEQ ID NO: 131058 - RNA, 64 nt, hsa; identical to SEQ ID NO: 24194

SEQ ID NO: 131059 - RNA, 64 nt, hsa; identical to SEQ ID NO: 24195

SEQ ID NO: 131060 - RNA, 64 nt, hsa; identical to SEQ ID NO: 24196

SEQ ID NO: 131061 - RNA, 64 nt, hsa; identical to SEQ ID NO: 24197

SEQ ID NO: 131062 - RNA, 64 nt, hsa; identical to SEQ ID NO: 24198

SEQ ID NO: 131063 - RNA, 64 nt, hsa; identical to SEQ ID NO: 24199

SEQ ID NO: 131064 - RNA, 64 nt, hsa; identical to SEQ ID NO: 24200

SEQ ID NO: 131065 - RNA, 64 nt, hsa; identical to SEQ ID NO: 24201

SEQ ID NO: 131066 - RNA, 64 nt, hsa; identical to SEQ ID NO: 24202

SEQ ID NO: 131067 - RNA, 64 nt, hsa; identical to SEQ ID NO: 24203

SEQ ID NO: 131068 - RNA, 64 nt, hsa; identical to SEQ ID NO: 24204

SEQ ID NO: 131069 - RNA, 64 nt, hsa; identical to SEQ ID NO: 24205

SEQ ID NO: 131070 - RNA, 64 nt, hsa; identical to SEQ ID NO: 24206

SEQ ID NO: 131071 - RNA, 64 nt, hsa; identical to SEQ ID NO: 24207

SEQ ID NO: 131072 - RNA, 64 nt, hsa; identical to SEQ ID NO: 24208

SEQ ID NO: 131073 - RNA, 64 nt, hsa; identical to SEQ ID NO: 24209

SEQ ID NO: 131074 - RNA, 64 nt, hsa; identical to SEQ ID NO: 24210

SEQ ID NO: 131075 - RNA, 64 nt, hsa; identical to SEQ ID NO: 24211

SEQ ID NO: 131076 - RNA, 64 nt, hsa; identical to SEQ ID NO: 24212

SEQ ID NO: 131077 - RNA, 64 nt, hsa; identical to SEQ ID NO: 24213

SEQ ID NO: 131078 - RNA, 64 nt, hsa; identical to SEQ ID NO: 24214

SEQ ID NO: 131079 - RNA, 64 nt, hsa; identical to SEQ ID NO: 24215

SEQ ID NO: 131080 - RNA, 64 nt, hsa; identical to SEQ ID NO: 24216

SEQ ID NO: 131081 - RNA, 64 nt, hsa; identical to SEQ ID NO: 24217

SEQ ID NO: 131082 - RNA, 64 nt, hsa; identical to SEQ ID NO: 24218

SEQ ID NO: 131083 - RNA, 64 nt, hsa; identical to SEQ ID NO: 24219

SEQ ID NO: 131084 - RNA, 64 nt, hsa; identical to SEQ ID NO: 24220

SEQ ID NO: 131085 - RNA, 64 nt, hsa; identical to SEQ ID NO: 24221

SEQ ID NO: 131086 - RNA, 64 nt, hsa; identical to SEQ ID NO: 24222

SEQ ID NO: 131087 - RNA, 64 nt, hsa; identical to SEQ ID NO: 24223

SEQ ID NO: 131088 - RNA, 64 nt, hsa; identical to SEQ ID NO: 24224

SEQ ID NO: 131089 - RNA, 64 nt, hsa; identical to SEQ ID NO: 24225

SEQ ID NO: 131090 - RNA, 64 nt, hsa; identical to SEQ ID NO: 24226

SEQ ID NO: 131091 - RNA, 64 nt, hsa; identical to SEQ ID NO: 24227

SEQ ID NO: 131092 - RNA, 64 nt, hsa; identical to SEQ ID NO: 24228

SEQ ID NO: 131093 - RNA, 64 nt, hsa; identical to SEQ ID NO: 24229

SEQ ID NO: 131094 - RNA, 64 nt, hsa; identical to SEQ ID NO: 24230

SEQ ID NO: 131095 - RNA, 64 nt, hsa; identical to SEQ ID NO: 24231

SEQ ID NO: 131096 - RNA, 64 nt, hsa; identical to SEQ ID NO: 24232

SEQ ID NO: 131097 - RNA, 64 nt, hsa; identical to SEQ ID NO: 24233

SEQ ID NO: 131098 - RNA, 64 nt, hsa; identical to SEQ ID NO: 24234

SEQ ID NO: 131099 - RNA, 64 nt, hsa; identical to SEQ ID NO: 24235

SEQ ID NO: 131100 - RNA, 64 nt, hsa; identical to SEQ ID NO: 24236

SEQ ID NO: 131101 - RNA, 64 nt, hsa; identical to SEQ ID NO: 24237

SEQ ID NO: 131102 - RNA, 64 nt, hsa; identical to SEQ ID NO: 24238

SEQ ID NO: 131103 - RNA, 64 nt, hsa; identical to SEQ ID NO: 24239

SEQ ID NO: 131104 - RNA, 64 nt, hsa; identical to SEQ ID NO: 24240

SEQ ID NO: 131105 - RNA, 64 nt, hsa; identical to SEQ ID NO: 24241

SEQ ID NO: 131106 - RNA, 64 nt, hsa; identical to SEQ ID NO: 24242

SEQ ID NO: 131107 - RNA, 64 nt, hsa; identical to SEQ ID NO: 24243

SEQ ID NO: 131108 - RNA, 64 nt, hsa; identical to SEQ ID NO: 24244

SEQ ID NO: 131109 - RNA, 64 nt, hsa; identical to SEQ ID NO: 24245

SEQ ID NO: 131110 - RNA, 64 nt, hsa; identical to SEQ ID NO: 24246

SEQ ID NO: 131111 - RNA, 64 nt, hsa; identical to SEQ ID NO: 24247

SEQ ID NO: 131112 - RNA, 64 nt, hsa; identical to SEQ ID NO: 24248

SEQ ID NO: 131113 - RNA, 64 nt, hsa; identical to SEQ ID NO: 24249

SEQ ID NO: 131114 - RNA, 64 nt, hsa; identical to SEQ ID NO: 24250

SEQ ID NO: 131115 - RNA, 64 nt, hsa; identical to SEQ ID NO: 24247

SEQ ID NO: 131116 - RNA, 64 nt, hsa; identical to SEQ ID NO: 24252

SEQ ID NO: 131117 - RNA, 64 nt, hsa; identical to SEQ ID NO: 24253

SEQ ID NO: 131118 - RNA, 64 nt, hsa; identical to SEQ ID NO: 24254

SEQ ID NO: 131119 - RNA, 64 nt, hsa; identical to SEQ ID NO: 24255

SEQ ID NO: 131120 - RNA, 64 nt, hsa; identical to SEQ ID NO: 24256

SEQ ID NO: 131121 - RNA, 64 nt, hsa; identical to SEQ ID NO: 24257

SEQ ID NO: 131122 - RNA, 64 nt, hsa; identical to SEQ ID NO: 24258

SEQ ID NO: 131123 - RNA, 64 nt, hsa; identical to SEQ ID NO: 24259

SEQ ID NO: 131124 - RNA, 64 nt, hsa; identical to SEQ ID NO: 24260

SEQ ID NO: 131125 - RNA, 64 nt, hsa; identical to SEQ ID NO: 24261

SEQ ID NO: 131126 - RNA, 64 nt, hsa; identical to SEQ ID NO: 24262

SEQ ID NO: 131127 - RNA, 64 nt, hsa; identical to SEQ ID NO: 24263

SEQ ID NO: 131128 - RNA, 64 nt, hsa; identical to SEQ ID NO: 24264

SEQ ID NO: 131129 - RNA, 64 nt, hsa; identical to SEQ ID NO: 24265

SEQ ID NO: 131130 - RNA, 64 nt, hsa; identical to SEQ ID NO: 24266

SEQ ID NO: 131131 - RNA, 64 nt, hsa; identical to SEQ ID NO: 24267

SEQ ID NO: 131132 - RNA, 64 nt, hsa; identical to SEQ ID NO: 24268

SEQ ID NO: 131133 - RNA, 64 nt, hsa; identical to SEQ ID NO: 24269

SEQ ID NO: 131134 - RNA, 64 nt, hsa; identical to SEQ ID NO: 24270

SEQ ID NO: 131135 - RNA, 64 nt, hsa; identical to SEQ ID NO: 24271

SEQ ID NO: 131136 - RNA, 64 nt, hsa; identical to SEQ ID NO: 24272

SEQ ID NO: 131137 - RNA, 64 nt, hsa; identical to SEQ ID NO: 24273

SEQ ID NO: 131138 - RNA, 64 nt, hsa; identical to SEQ ID NO: 24274

SEQ ID NO: 131139 - RNA, 64 nt, hsa; identical to SEQ ID NO: 24275

SEQ ID NO: 131140 - RNA, 64 nt, hsa; identical to SEQ ID NO: 24276

SEQ ID NO: 131141 - RNA, 64 nt, hsa; identical to SEQ ID NO: 24277

SEQ ID NO: 131142 - RNA, 64 nt, hsa; identical to SEQ ID NO: 24278

SEQ ID NO: 131143 - RNA, 64 nt, hsa; identical to SEQ ID NO: 24279

SEQ ID NO: 131144 - RNA, 64 nt, hsa; identical to SEQ ID NO: 24280

SEQ ID NO: 131145 - RNA, 64 nt, hsa; identical to SEQ ID NO: 24281

SEQ ID NO: 131146 - RNA, 64 nt, hsa; identical to SEQ ID NO: 24282

SEQ ID NO: 131147 - RNA, 64 nt, hsa; identical to SEQ ID NO: 24283

SEQ ID NO: 131148 - RNA, 64 nt, hsa; identical to SEQ ID NO: 24284

SEQ ID NO: 131149 - RNA, 64 nt, hsa; identical to SEQ ID NO: 24285

SEQ ID NO: 131150 - RNA, 64 nt, hsa; identical to SEQ ID NO: 24286

SEQ ID NO: 131151 - RNA, 64 nt, hsa; identical to SEQ ID NO: 24287

SEQ ID NO: 131152 - RNA, 64 nt, hsa; identical to SEQ ID NO: 24288

SEQ ID NO: 131153 - RNA, 64 nt, hsa; identical to SEQ ID NO: 24289

SEQ ID NO: 131154 - RNA, 64 nt, hsa; identical to SEQ ID NO: 24290

SEQ ID NO: 131155 - RNA, 64 nt, hsa; identical to SEQ ID NO: 24291

SEQ ID NO: 131156 - RNA, 64 nt, hsa; identical to SEQ ID NO: 24292

SEQ ID NO: 131157 - RNA, 64 nt, hsa; identical to SEQ ID NO: 24293

SEQ ID NO: 131158 - RNA, 64 nt, hsa; identical to SEQ ID NO: 24294

SEQ ID NO: 131159 - RNA, 64 nt, hsa; identical to SEQ ID NO: 24295

SEQ ID NO: 131160 - RNA, 64 nt, hsa; identical to SEQ ID NO: 24296

SEQ ID NO: 131161 - RNA, 64 nt, hsa; identical to SEQ ID NO: 24297

SEQ ID NO: 131162 - RNA, 64 nt, hsa; identical to SEQ ID NO: 24298

SEQ ID NO: 131163 - RNA, 64 nt, hsa; identical to SEQ ID NO: 24299

SEQ ID NO: 131164 - RNA, 64 nt, hsa; identical to SEQ ID NO: 24300

SEQ ID NO: 131165 - RNA, 64 nt, hsa; identical to SEQ ID NO: 24301

SEQ ID NO: 131166 - RNA, 64 nt, hsa; identical to SEQ ID NO: 24302

SEQ ID NO: 131167 - RNA, 64 nt, hsa; identical to SEQ ID NO: 24303

SEQ ID NO: 131168 - RNA, 64 nt, hsa; identical to SEQ ID NO: 24304

SEQ ID NO: 131169 - RNA, 64 nt, hsa; identical to SEQ ID NO: 24305

SEQ ID NO: 131170 - RNA, 64 nt, hsa; identical to SEQ ID NO: 24306

SEQ ID NO: 131171 - RNA, 64 nt, hsa; identical to SEQ ID NO: 24307

SEQ ID NO: 131172 - RNA, 64 nt, hsa; identical to SEQ ID NO: 24308

SEQ ID NO: 131173 - RNA, 64 nt, hsa; identical to SEQ ID NO: 24309

SEQ ID NO: 131174 - RNA, 64 nt, hsa; identical to SEQ ID NO: 24310

SEQ ID NO: 131175 - RNA, 64 nt, hsa; identical to SEQ ID NO: 24311

SEQ ID NO: 131176 - RNA, 64 nt, hsa; identical to SEQ ID NO: 24312

SEQ ID NO: 131177 - RNA, 64 nt, hsa; identical to SEQ ID NO: 24313

SEQ ID NO: 131178 - RNA, 64 nt, hsa; identical to SEQ ID NO: 24314

SEQ ID NO: 131179 - RNA, 64 nt, hsa; identical to SEQ ID NO: 24315

SEQ ID NO: 131180 - RNA, 64 nt, hsa; identical to SEQ ID NO: 24316

SEQ ID NO: 131181 - RNA, 64 nt, hsa; identical to SEQ ID NO: 24317

SEQ ID NO: 131182 - RNA, 64 nt, hsa; identical to SEQ ID NO: 24318

SEQ ID NO: 131183 - RNA, 64 nt, hsa; identical to SEQ ID NO: 24319

SEQ ID NO: 131184 - RNA, 64 nt, hsa; identical to SEQ ID NO: 24320

SEQ ID NO: 131185 - RNA, 64 nt, hsa; identical to SEQ ID NO: 24321

SEQ ID NO: 131186 - RNA, 64 nt, hsa; identical to SEQ ID NO: 24322

SEQ ID NO: 131187 - RNA, 64 nt, hsa; identical to SEQ ID NO: 24323

SEQ ID NO: 131188 - RNA, 64 nt, hsa; identical to SEQ ID NO: 24324

SEQ ID NO: 131189 - RNA, 64 nt, hsa; identical to SEQ ID NO: 24325

SEQ ID NO: 131190 - RNA, 64 nt, hsa; identical to SEQ ID NO: 24326

SEQ ID NO: 131191 - RNA, 64 nt, hsa; identical to SEQ ID NO: 24327

SEQ ID NO: 131192 - RNA, 64 nt, hsa
uguuaacuuugugaaauaacuuccacauuucaacacacuucacaguacaggaaauaaaguaaua

SEQ ID NO: 131193 - RNA, 64 nt, hsa
gcgugaacucaacggugugaacaggucaagaauaacacuucaaagucaucuugccagccaggcg

SEQ ID NO: 131194 - RNA, 64 nt, hsa
uugugguggugauuuucucaugagaagguagacaacacuucaguuuuucuugagggggaaaaaa

SEQ ID NO: 131195 - RNA, 64 nt, hsa
uccccaguuggcugaaguuagaauugcuugacugacacuucauugcuauacaugaaggggcacu

SEQ ID NO: 131196 - RNA, 64 nt, hsa
uauacugacauuuauaaaugaaccuuuauuaaagacacuucaaugccauuuguuagacacuuca

SEQ ID NO: 131197 - RNA, 64 nt, hsa
ccuuuauuaaagacacuucaaugccauuuguuagacacuucaauauuuuacaugguuuucaaug

SEQ ID NO: 131198 - RNA, 64 nt, hsa
gacauuaagugagagugaaucccuuaggacuggaacacuucaagcucaaccaacugacucaguu

SEQ ID NO: 131199 - RNA, 64 nt, hsa
ugcagccacuguuacuuuuaauugacauuaagagacacuucauagguucccacaauucaguaug

SEQ ID NO: 131200 - RNA, 64 nt, hsa
cugcugacuggagagcugggaauauggcauuuggacacuucauuuguaaauaguguacauuuua

SEQ ID NO: 131201 - RNA, 64 nt, hsa
aacuuguucaaguucugaaucccagcacaugacaacacuucagaagggucccccugcugacugg

SEQ ID NO: 131202 - RNA, 64 nt, hsa
cugaagagugagauaaagccuuuaaaugguugucacacuucauuguagguaagauaauucauac

SEQ ID NO: 131203 - RNA, 64 nt, hsa
cagagaauuuaugguagaaauauauaagguacugacacuucagauauacuaaaucagagugcua

SEQ ID NO: 131204 - RNA, 64 nt, hsa
accauuguaacagauguggaaagacuuuuuacguacacuucagucaacauccaagaauuccuau

SEQ ID NO: 131205 - RNA, 64 nt, hsa
aaggauguacauaugaaugggcacauuuuacugcacacuucagacgcuuugacuuuuuuaaaaa

SEQ ID NO: 131206 - RNA, 64 nt, hsa
gaacuaaaguucacaggcagaucacugauccagaacacuucaagaacucgucaaacagcucgau

SEQ ID NO: 131207 - RNA, 64 nt, hsa
gcagcaccuaagaucaaggaugcguuccauuuucacacuucacagucaugaaaacugagaagac

SEQ ID NO: 131208 - RNA, 64 nt, hsa
uuuuaucaugacauguuauauauuuuuuguaggggucaaagaaaugcugauggauaaccuauau

SEQ ID NO: 131209 - RNA, 64 nt, hsa
uuagaaaccuuaauauguggacguaaucuccacagucaaagaaggauggcaccuaaaccaccag

SEQ ID NO: 131210 - RNA, 64 nt, hsa
cacuaacgauguagacucuggaaaugccuaauaagucaaagaagacguauuaaagcucuuuucu

SEQ ID NO: 131211 - RNA, 64 nt, hsa
guucuacaucccuaagauuaucuagguaggacaugucaaagaugacuguugucauucuggaggu

SEQ ID NO: 131212 - RNA, 64 nt, hsa
gagaauugugaaacagauaguuauauguauacaagucaaagaacaacuuaacuauugcugcaac

SEQ ID NO: 131213 - RNA, 64 nt, hsa
agcagguuacucagcaguuugugccuccuacacagucaaagaaagagaaaaaagauaaaguaga

SEQ ID NO: 131214 - RNA, 64 nt, hsa; identical to SEQ ID NO: 117533

SEQ ID NO: 131215 - RNA, 64 nt, hsa; identical to SEQ ID NO: 117534

SEQ ID NO: 131216 - RNA, 64 nt, hsa; identical to SEQ ID NO: 117535

SEQ ID NO: 131217 - RNA, 64 nt, hsa; identical to SEQ ID NO: 117536

SEQ ID NO: 131218 - RNA, 64 nt, hsa; identical to SEQ ID NO: 117537

SEQ ID NO: 131219 - RNA, 64 nt, hsa; identical to SEQ ID NO: 117538

SEQ ID NO: 131220 - RNA, 64 nt, hsa; identical to SEQ ID NO: 117539

SEQ ID NO: 131221 - RNA, 64 nt, hsa; identical to SEQ ID NO: 117540

SEQ ID NO: 131222 - RNA, 64 nt, hsa; identical to SEQ ID NO: 117541

SEQ ID NO: 131223 - RNA, 64 nt, hsa; identical to SEQ ID NO: 117542

SEQ ID NO: 131224 - RNA, 64 nt, hsa; identical to SEQ ID NO: 117543

SEQ ID NO: 131225 - RNA, 64 nt, hsa; identical to SEQ ID NO: 117544

SEQ ID NO: 131226 - RNA, 64 nt, hsa; identical to SEQ ID NO: 117545

SEQ ID NO: 131227 - RNA, 64 nt, hsa; identical to SEQ ID NO: 117546

SEQ ID NO: 131228 - RNA, 64 nt, hsa; identical to SEQ ID NO: 117547

SEQ ID NO: 131229 - RNA, 64 nt, hsa; identical to SEQ ID NO: 117548

SEQ ID NO: 131230 - RNA, 64 nt, hsa; identical to SEQ ID NO: 117549

SEQ ID NO: 131231 - RNA, 64 nt, hsa; identical to SEQ ID NO: 117550

SEQ ID NO: 131232 - RNA, 64 nt, hsa; identical to SEQ ID NO: 117551

SEQ ID NO: 131233 - RNA, 64 nt, hsa; identical to SEQ ID NO: 117552

SEQ ID NO: 131234 - RNA, 64 nt, hsa; identical to SEQ ID NO: 117553

SEQ ID NO: 131235 - RNA, 64 nt, hsa; identical to SEQ ID NO: 117554

SEQ ID NO: 131236 - RNA, 64 nt, hsa; identical to SEQ ID NO: 117555

SEQ ID NO: 131237 - RNA, 64 nt, hsa; identical to SEQ ID NO: 117556

SEQ ID NO: 131238 - RNA, 64 nt, hsa; identical to SEQ ID NO: 117557

SEQ ID NO: 131239 - RNA, 64 nt, hsa; identical to SEQ ID NO: 117558

SEQ ID NO: 131240 - RNA, 64 nt, hsa; identical to SEQ ID NO: 117559

SEQ ID NO: 131241 - RNA, 64 nt, hsa; identical to SEQ ID NO: 117560

SEQ ID NO: 131242 - RNA, 64 nt, hsa; identical to SEQ ID NO: 117561

SEQ ID NO: 131243 - RNA, 64 nt, hsa; identical to SEQ ID NO: 117562

SEQ ID NO: 131244 - RNA, 64 nt, hsa; identical to SEQ ID NO: 117563

SEQ ID NO: 131245 - RNA, 64 nt, hsa; identical to SEQ ID NO: 117564

SEQ ID NO: 131246 - RNA, 64 nt, hsa; identical to SEQ ID NO: 117565

SEQ ID NO: 131247 - RNA, 64 nt, hsa; identical to SEQ ID NO: 117566

SEQ ID NO: 131248 - RNA, 64 nt, hsa; identical to SEQ ID NO: 117567

SEQ ID NO: 131249 - RNA, 64 nt, hsa; identical to SEQ ID NO: 117568

SEQ ID NO: 131250 - RNA, 64 nt, hsa; identical to SEQ ID NO: 117569

SEQ ID NO: 131251 - RNA, 64 nt, hsa; identical to SEQ ID NO: 117570

SEQ ID NO: 131252 - RNA, 64 nt, hsa; identical to SEQ ID NO: 117571

SEQ ID NO: 131253 - RNA, 64 nt, hsa; identical to SEQ ID NO: 117572

SEQ ID NO: 131254 - RNA, 64 nt, hsa; identical to SEQ ID NO: 117573

SEQ ID NO: 131255 - RNA, 64 nt, hsa; identical to SEQ ID NO: 117574

SEQ ID NO: 131256 - RNA, 64 nt, hsa; identical to SEQ ID NO: 117575

SEQ ID NO: 131257 - RNA, 64 nt, hsa; identical to SEQ ID NO: 117576

SEQ ID NO: 131258 - RNA, 64 nt, hsa; identical to SEQ ID NO: 117577

SEQ ID NO: 131259 - RNA, 64 nt, hsa; identical to SEQ ID NO: 117578

SEQ ID NO: 131260 - RNA, 64 nt, hsa; identical to SEQ ID NO: 117579

SEQ ID NO: 131261 - RNA, 64 nt, hsa; identical to SEQ ID NO: 117580

SEQ ID NO: 131262 - RNA, 64 nt, hsa; identical to SEQ ID NO: 117581

SEQ ID NO: 131263 - RNA, 64 nt, hsa; identical to SEQ ID NO: 117582

SEQ ID NO: 131264 - RNA, 64 nt, hsa; identical to SEQ ID NO: 117583

SEQ ID NO: 131265 - RNA, 64 nt, hsa; identical to SEQ ID NO: 117584

SEQ ID NO: 131266 - RNA, 64 nt, hsa; identical to SEQ ID NO: 117585

SEQ ID NO: 131267 - RNA, 64 nt, hsa; identical to SEQ ID NO: 117586

SEQ ID NO: 131268 - RNA, 64 nt, hsa; identical to SEQ ID NO: 117587

SEQ ID NO: 131269 - RNA, 64 nt, hsa; identical to SEQ ID NO: 117588

SEQ ID NO: 131270 - RNA, 64 nt, hsa; identical to SEQ ID NO: 117589

SEQ ID NO: 131271 - RNA, 64 nt, hsa; identical to SEQ ID NO: 117590

SEQ ID NO: 131272 - RNA, 64 nt, hsa; identical to SEQ ID NO: 117591

SEQ ID NO: 131273 - RNA, 64 nt, hsa; identical to SEQ ID NO: 117592

SEQ ID NO: 131274 - RNA, 64 nt, hsa; identical to SEQ ID NO: 117593

SEQ ID NO: 131275 - RNA, 64 nt, hsa; identical to SEQ ID NO: 117594

SEQ ID NO: 131276 - RNA, 64 nt, hsa; identical to SEQ ID NO: 117595

SEQ ID NO: 131277 - RNA, 64 nt, hsa; identical to SEQ ID NO: 117596

SEQ ID NO: 131278 - RNA, 64 nt, hsa; identical to SEQ ID NO: 117597

SEQ ID NO: 131279 - RNA, 64 nt, hsa; identical to SEQ ID NO: 117598

SEQ ID NO: 131280 - RNA, 64 nt, hsa; identical to SEQ ID NO: 117599

SEQ ID NO: 131281 - RNA, 64 nt, hsa; identical to SEQ ID NO: 117600

SEQ ID NO: 131282 - RNA, 64 nt, hsa; identical to SEQ ID NO: 117601

SEQ ID NO: 131283 - RNA, 64 nt, hsa; identical to SEQ ID NO: 117602

SEQ ID NO: 131284 - RNA, 64 nt, hsa; identical to SEQ ID NO: 117603

SEQ ID NO: 131285 - RNA, 64 nt, hsa; identical to SEQ ID NO: 117604

SEQ ID NO: 131286 - RNA, 64 nt, hsa; identical to SEQ ID NO: 117605

SEQ ID NO: 131287 - RNA, 64 nt, hsa; identical to SEQ ID NO: 117606

SEQ ID NO: 131288 - RNA, 64 nt, hsa; identical to SEQ ID NO: 117607

SEQ ID NO: 131289 - RNA, 64 nt, hsa; identical to SEQ ID NO: 117608

SEQ ID NO: 131290 - RNA, 64 nt, hsa; identical to SEQ ID NO: 117609

SEQ ID NO: 131291 - RNA, 64 nt, hsa; identical to SEQ ID NO: 117610

SEQ ID NO: 131292 - RNA, 64 nt, hsa; identical to SEQ ID NO: 117611

SEQ ID NO: 131293 - RNA, 64 nt, hsa; identical to SEQ ID NO: 117612

SEQ ID NO: 131294 - RNA, 64 nt, hsa; identical to SEQ ID NO: 117613

SEQ ID NO: 131295 - RNA, 64 nt, hsa; identical to SEQ ID NO: 117614

SEQ ID NO: 131296 - RNA, 64 nt, hsa; identical to SEQ ID NO: 117615

SEQ ID NO: 131297 - RNA, 64 nt, hsa; identical to SEQ ID NO: 117616

SEQ ID NO: 131298 - RNA, 64 nt, hsa; identical to SEQ ID NO: 117617

SEQ ID NO: 131299 - RNA, 64 nt, hsa; identical to SEQ ID NO: 117618

SEQ ID NO: 131300 - RNA, 64 nt, hsa; identical to SEQ ID NO: 117619

SEQ ID NO: 131301 - RNA, 64 nt, hsa; identical to SEQ ID NO: 117620

SEQ ID NO: 131302 - RNA, 64 nt, hsa; identical to SEQ ID NO: 117621

SEQ ID NO: 131303 - RNA, 64 nt, hsa; identical to SEQ ID NO: 117622

SEQ ID NO: 131304 - RNA, 64 nt, hsa; identical to SEQ ID NO: 117623

SEQ ID NO: 131305 - RNA, 64 nt, hsa; identical to SEQ ID NO: 117624

SEQ ID NO: 131306 - RNA, 64 nt, hsa; identical to SEQ ID NO: 117625

SEQ ID NO: 131307 - RNA, 64 nt, hsa; identical to SEQ ID NO: 117626

SEQ ID NO: 131308 - RNA, 64 nt, hsa; identical to SEQ ID NO: 117627

SEQ ID NO: 131309 - RNA, 64 nt, hsa; identical to SEQ ID NO: 117628

SEQ ID NO: 131310 - RNA, 64 nt, hsa; identical to SEQ ID NO: 117629

SEQ ID NO: 131311 - RNA, 64 nt, hsa; identical to SEQ ID NO: 117630

SEQ ID NO: 131312 - RNA, 64 nt, hsa; identical to SEQ ID NO: 117631

SEQ ID NO: 131313 - RNA, 64 nt, hsa; identical to SEQ ID NO: 117632

SEQ ID NO: 131314 - RNA, 64 nt, hsa; identical to SEQ ID NO: 117633

SEQ ID NO: 131315 - RNA, 64 nt, hsa; identical to SEQ ID NO: 117634

SEQ ID NO: 131316 - RNA, 64 nt, hsa; identical to SEQ ID NO: 117635

SEQ ID NO: 131317 - RNA, 64 nt, hsa; identical to SEQ ID NO: 117636

SEQ ID NO: 131318 - RNA, 64 nt, hsa; identical to SEQ ID NO: 117637

SEQ ID NO: 131319 - RNA, 64 nt, hsa; identical to SEQ ID NO: 117638

SEQ ID NO: 131320 - RNA, 64 nt, hsa; identical to SEQ ID NO: 117639

SEQ ID NO: 131321 - RNA, 64 nt, hsa; identical to SEQ ID NO: 117640

SEQ ID NO: 131322 - RNA, 64 nt, hsa; identical to SEQ ID NO: 117641

SEQ ID NO: 131323 - RNA, 64 nt, hsa; identical to SEQ ID NO: 117642

SEQ ID NO: 131324 - RNA, 64 nt, hsa; identical to SEQ ID NO: 117643

SEQ ID NO: 131325 - RNA, 64 nt, hsa; identical to SEQ ID NO: 117644

SEQ ID NO: 131326 - RNA, 64 nt, hsa; identical to SEQ ID NO: 117645

SEQ ID NO: 131327 - RNA, 64 nt, hsa; identical to SEQ ID NO: 117646

SEQ ID NO: 131328 - RNA, 64 nt, hsa; identical to SEQ ID NO: 117647

SEQ ID NO: 131329 - RNA, 64 nt, hsa; identical to SEQ ID NO: 117648

SEQ ID NO: 131330 - RNA, 64 nt, hsa; identical to SEQ ID NO: 117649

SEQ ID NO: 131331 - RNA, 64 nt, hsa; identical to SEQ ID NO: 117650

SEQ ID NO: 131332 - RNA, 64 nt, hsa; identical to SEQ ID NO: 117651

SEQ ID NO: 131333 - RNA, 64 nt, hsa; identical to SEQ ID NO: 117652

SEQ ID NO: 131334 - RNA, 64 nt, hsa; identical to SEQ ID NO: 117653

SEQ ID NO: 131335 - RNA, 64 nt, hsa; identical to SEQ ID NO: 117654

SEQ ID NO: 131336 - RNA, 64 nt, hsa; identical to SEQ ID NO: 117655

SEQ ID NO: 131337 - RNA, 64 nt, hsa; identical to SEQ ID NO: 117656

SEQ ID NO: 131338 - RNA, 64 nt, hsa; identical to SEQ ID NO: 117657

SEQ ID NO: 131339 - RNA, 64 nt, hsa; identical to SEQ ID NO: 117658

SEQ ID NO: 131340 - RNA, 64 nt, hsa; identical to SEQ ID NO: 117659

SEQ ID NO: 131341 - RNA, 64 nt, hsa; identical to SEQ ID NO: 117660

SEQ ID NO: 131342 - RNA, 64 nt, hsa; identical to SEQ ID NO: 117661

SEQ ID NO: 131343 - RNA, 64 nt, hsa
auuuccagguccguauuucucuguagcccagggucugggguagagcugacugcuguucacccuu

SEQ ID NO: 131344 - RNA, 64 nt, hsa
gggccccaggccauccagccuuugccuuugagcccugggguaaggccuggugagugagucacug

SEQ ID NO: 131345 - RNA, 64 nt, hsa
gcuccuuccuccagcugggggacucuuaaaggggcugggguagagacuaagagugcccguagga

SEQ ID NO: 131346 - RNA, 64 nt, hsa
acccuugcuccuguacugcccccagcagcgcagucugggguauuuccccugcugaggagugaca

SEQ ID NO: 131347 - RNA, 64 nt, hsa
guaaagacaacaaaguaaauacaacccaaggcaacugggguacucacugggagugaaaaugacu

SEQ ID NO: 131348 - RNA, 64 nt, hsa
agggagagaaaugcuacaguugauccucaucugucugggguaaagacaacaaaguaaauacaac

SEQ ID NO: 131349 - RNA, 64 nt, hsa
gaagcccagaagggcuucugcaagcugcacagaacugggguaagaagacaaagaguagccaccg

SEQ ID NO: 131350 - RNA, 64 nt, hsa
aggagcuccugauagcaggcgucuuugagccuagcugggguagaggcacugcccaucucuucuc

SEQ ID NO: 131351 - RNA, 64 nt, hsa; identical to SEQ ID NO: 50739

SEQ ID NO: 131352 - RNA, 64 nt, hsa; identical to SEQ ID NO: 50740

SEQ ID NO: 131353 - RNA, 64 nt, hsa; identical to SEQ ID NO: 50741

SEQ ID NO: 131354 - RNA, 64 nt, hsa; identical to SEQ ID NO: 50742

SEQ ID NO: 131355 - RNA, 64 nt, hsa; identical to SEQ ID NO: 50743

SEQ ID NO: 131356 - RNA, 64 nt, hsa; identical to SEQ ID NO: 50744

SEQ ID NO: 131357 - RNA, 64 nt, hsa; identical to SEQ ID NO: 50745

SEQ ID NO: 131358 - RNA, 64 nt, hsa; identical to SEQ ID NO: 50746

SEQ ID NO: 131359 - RNA, 64 nt, hsa; identical to SEQ ID NO: 50747

SEQ ID NO: 131360 - RNA, 64 nt, hsa; identical to SEQ ID NO: 50748

SEQ ID NO: 131361 - RNA, 64 nt, hsa
auaaauucccagugcucaucaugagggaaacaugugacuauaccuuuccuaugaggaaagccag

SEQ ID NO: 131362 - RNA, 64 nt, hsa
aaacuguuccucagauccaauuguuagcacaaaaugacuauauacuccuuuuaagaagcaggaa

SEQ ID NO: 131363 - RNA, 64 nt, hsa
ccuuuugaaaggaauguaaugaagauucagcaucugacuauaugugugucuauccugaaauaau

SEQ ID NO: 131364 - RNA, 64 nt, hsa
gguuuuagaaacuaaacuuucuagagcaauaaaaugacuauaauguuaaguaaacauaauguug

SEQ ID NO: 131365 - RNA, 64 nt, hsa
uugguuuauuucacuuuucauuaaaugaacauugaugagagaagaugccacuuacccaagcuuu

SEQ ID NO: 131366 - RNA, 64 nt, hsa
guuuuuaagugugacuugaaaaauaugccaaaaaaugagagauacaaaugagcuagaggaagau

SEQ ID NO: 131367 - RNA, 64 nt, hsa
cuauaugcuuuuuucugugaauuuuccuugguacaugagagaaauaaguacucucaucaacuua

SEQ ID NO: 131368 - RNA, 64 nt, hsa
uuuuuugagcauugcucuauagaagggaagggugaugagagaacagaacuggccccuguacagg

SEQ ID NO: 131369 - RNA, 64 nt, hsa
guuuuguguggagggggagguaggacugggcuggaugagagagcacagcugugacuuccuccua

SEQ ID NO: 131370 - RNA, 64 nt, hsa
gguagaucacaggggucuguguaccucugaauucaugagagaugaaugacagaugcucucaugg

SEQ ID NO: 131371 - RNA, 64 nt, hsa
guucuuguguuuuggaguccuagucauauuaaacaugagagauacucuuaauuucaguaguaca

SEQ ID NO: 131372 - RNA, 64 nt, hsa
guauugcaaaaugaauugaacggauggugcuuuaaugagagaaguaaaggaauauaugccuccu

SEQ ID NO: 131373 - RNA, 64 nt, hsa
uaccuccuuauagaagccagaaggaucacauuggaugagagaaggugucuauaacuggguucuu

SEQ ID NO: 131374 - RNA, 64 nt, hsa
cgagcaugaacaugaaauacauuagaacuuggcaaugagagaucccaucuguugguuuccaggg

SEQ ID NO: 131375 - RNA, 64 nt, hsa
cuucccuuccuuaccuuuguaucuccuuuacaucaugagagaucaaaaauccauuuugccuuac

SEQ ID NO: 131376 - RNA, 64 nt, hsa
gccagcagaguuccugcccauggucuugagcugaaugagagaauaaaaugccaaucccaaggga

SEQ ID NO: 131377 - RNA, 64 nt, hsa
uguguguguguguguguguguacucuguguguguaugagagagagaaaugcuaaccuuguagca

SEQ ID NO: 131378 - RNA, 64 nt, hsa
gggguguuguauggcugagcaagagagagagagaaugagagagagacugugugugugugugugu

SEQ ID NO: 131379 - RNA, 64 nt, hsa
agaauuugcagguacuacagauuuucaaaacugaaugagagaaaauuguauaaccauccugcug

SEQ ID NO: 131380 - RNA, 64 nt, hsa
cuucgcuugaauauuaucccuguauauugcaugaaugagagauuucccauauuuccaucagagu

SEQ ID NO: 131381 - RNA, 64 nt, hsa
aaauuuguguauuuuuugugugccugggcuggagaugagagacugagucauaacugauuuaaaa

SEQ ID NO: 131382 - RNA, 64 nt, hsa
agcuuaccuuggaguaugaaucuacccaugaaggaugagagauguuuugaaaaacuagccagga

SEQ ID NO: 131383 - RNA, 64 nt, hsa
cuugaacaacuuuggaaaaauggauuugacaguacauaaucaguucuacuaaccaaagcuugua

SEQ ID NO: 131384 - RNA, 64 nt, hsa
aaacagcaaauuuuaaagaggacauauuuaaguucauaaucauauuuuucaguaaauauugcuc

SEQ ID NO: 131385 - RNA, 64 nt, hsa
uuuuagcauaucuccaaccuugcaauuugauuggcauaaucacuccaguuugcuuucuaggucc

SEQ ID NO: 131386 - RNA, 64 nt, hsa
aguuugcuuucuagguccucaagugcucgugacacauaaucauuccauccaaugaucgccuuug

SEQ ID NO: 131387 - RNA, 64 nt, hsa
gaaggugaggggcuguauuuucaccaagccuuuucauaaucaaguuugcuuugcaaaccuuaug

SEQ ID NO: 131388 - RNA, 64 nt, hsa
aucacugcgcaaaauguggaggaaaauucauuaccauaaucacaacauuuguaucagaaaaaca

SEQ ID NO: 131389 - RNA, 64 nt, hsa
auuaaaccaaguccauuuugaaugaccuaaaaugaaguaacacaaucagaaaucccaugugccc

SEQ ID NO: 131390 - RNA, 64 nt, hsa
aacuugauauaaagauuuuauuugucccuugaaaaaguaacaaaugugcauagaucaauuugua

SEQ ID NO: 131391 - RNA, 64 nt, hsa
cacaaauauguuuuaaguaacaucgcucaaguuuaaguaacaucgcucaaguugauaaucucuu

SEQ ID NO: 131392 - RNA, 64 nt, hsa
gcuuuaguuuuagcaaacaccacaaauauguuuuaaguaacaucgcucaaguuuaaguaacauc

SEQ ID NO: 131393 - RNA, 64 nt, hsa
aauuggaauaacuuuauucugcagaucauuuaagaaguaacaggccgggcgcgguggcucacgc

SEQ ID NO: 131394 - RNA, 64 nt, hsa
agagugaaacuccaucuccaaaaaaaaaaagaaaaaguaacaaaaggaaauuauuuguuuuuga

SEQ ID NO: 131395 - RNA, 64 nt, hsa
acacuuaauuuuguuaauccugucugggacacuuaaguaacaucuaaagcauuauugcuuuaga

SEQ ID NO: 131396 - RNA, 64 nt, hsa
guacuuugugggucucucuuucgucgguggcuuaaaguaacaucuauuuccauugauccuaggu

SEQ ID NO: 131397 - RNA, 64 nt, hsa
accacuaggcugucacuauaaauuccuugaauauaaguaacaguuauuaaugaacuucuaaauu

SEQ ID NO: 131398 - RNA, 64 nt, hsa
uaucuguuuguauaucuuacuauagauuauguacaaguaacaucuaaauaaaauuacacuuuua

SEQ ID NO: 131399 - RNA, 64 nt, hsa
aucaacaugauggugacugggaaaaaauuacuucaaguaacaugcuuagcuuucccuccuuaau

SEQ ID NO: 131400 - RNA, 64 nt, hsa
ggagaguggaguucccguagggcauaggccugugaaguaacacuggggcagauauguauguuau

SEQ ID NO: 131401 - RNA, 64 nt, hsa
gcuccacgugguaagauccuccaagcugcuuuagaaguaacaaugaagaacguggacguuuuua

SEQ ID NO: 131402 - RNA, 64 nt, hsa
uuaaaaaaaaaaucaaugguggggaacuauaaagaaguaacaaaagaagugacaucuucagcaa

SEQ ID NO: 131403 - RNA, 64 nt, hsa
uugcuuugggaccuuuuuauuuugguguugcaaaaaguaacauauuuucaucauugcuucauac

SEQ ID NO: 131404 - RNA, 64 nt, hsa
uuuccaaagcaaugucuaaaaacucuuuuuuuuaaaguaacaguuugguauguuuauuguagau

SEQ ID NO: 131405 - RNA, 64 nt, hsa
aggaaccacgguuccuucguccauuaguuggaaaaaguaacagaccuaaaacucuaccaagcua

SEQ ID NO: 131406 - RNA, 64 nt, hsa
aucguguaaauacauuagcuaaacugaaaaguauaaguaacaugcuuuguugcagccaaaaaau

SEQ ID NO: 131407 - RNA, 64 nt, hsa; identical to SEQ ID NO: 50725

SEQ ID NO: 131408 - RNA, 64 nt, hsa; identical to SEQ ID NO: 50726

SEQ ID NO: 131409 - RNA, 64 nt, hsa; identical to SEQ ID NO: 50727

SEQ ID NO: 131410 - RNA, 64 nt, hsa; identical to SEQ ID NO: 50728

SEQ ID NO: 131411 - RNA, 64 nt, hsa; identical to SEQ ID NO: 50729

SEQ ID NO: 131412 - RNA, 64 nt, hsa; identical to SEQ ID NO: 50730

SEQ ID NO: 131413 - RNA, 64 nt, hsa; identical to SEQ ID NO: 50731

SEQ ID NO: 131414 - RNA, 64 nt, hsa; identical to SEQ ID NO: 50732

SEQ ID NO: 131415 - RNA, 64 nt, hsa; identical to SEQ ID NO: 50733

SEQ ID NO: 131416 - RNA, 64 nt, hsa; identical to SEQ ID NO: 50734

SEQ ID NO: 131417 - RNA, 51 nt, hsa; identical to SEQ ID NO: 50735

SEQ ID NO: 131418 - RNA, 64 nt, hsa; identical to SEQ ID NO: 50736

SEQ ID NO: 131419 - RNA, 64 nt, hsa; identical to SEQ ID NO: 50737

SEQ ID NO: 131420 - RNA, 64 nt, hsa; identical to SEQ ID NO: 50738

SEQ ID NO: 131421 - RNA, 64 nt, hsa
uagguggaagaaauuuaggaagcgaaauauuacaguagugcauuggugggucucaauccuuaac

SEQ ID NO: 131422 - RNA, 64 nt, hsa
uguuucaccauacuucauucagaccagugaaagaguagugcauuuaauuggaguaucuaaagcc

SEQ ID NO: 131423 - RNA, 64 nt, hsa
aguagauucccccuuuuccuguguuuaggauuuaguagugcauaaagcauuaauauccauaaac

SEQ ID NO: 131424 - RNA, 64 nt, hsa
uuccacagaaggccucuagccagagaucuugaguguagugcaagggacucauuuuuugcgaacu

SEQ ID NO: 131425 - RNA, 64 nt, hsa
ucucuacuaaaaauacaaaaauuagcuaggcgggguagugcaugccuguaaucccagcuacuca

SEQ ID NO: 131426 - RNA, 64 nt, hsa
aauugccaccugcacuuuguuucugcacuauuauguagugcauuuuaacuuaaauuuuuuccag

SEQ ID NO: 131427 - RNA, 64 nt, hsa
auguuucaagcuucagccuuuaaccuauaccuuuguagugcaccauauggugugugacuuucac

SEQ ID NO: 131428 - RNA, 64 nt, hsa
auuguccuuagcggcuguaacaugucucuugacaguagugcacuuggaauaauaaagguugggu

SEQ ID NO: 131429 - RNA, 64 nt, hsa; identical to SEQ ID NO: 53626

SEQ ID NO: 131430 - RNA, 64 nt, hsa; identical to SEQ ID NO: 53627

SEQ ID NO: 131431 - RNA, 64 nt, hsa; identical to SEQ ID NO: 53628

SEQ ID NO: 131432 - RNA, 64 nt, hsa; identical to SEQ ID NO: 53629

SEQ ID NO: 131433 - RNA, 64 nt, hsa; identical to SEQ ID NO: 53630

SEQ ID NO: 131434 - RNA, 64 nt, hsa; identical to SEQ ID NO: 53631

SEQ ID NO: 131435 - RNA, 64 nt, hsa; identical to SEQ ID NO: 53632

SEQ ID NO: 131436 - RNA, 64 nt, hsa; identical to SEQ ID NO: 53633

SEQ ID NO: 131437 - RNA, 64 nt, hsa; identical to SEQ ID NO: 53634

SEQ ID NO: 131438 - RNA, 64 nt, hsa; identical to SEQ ID NO: 53635

SEQ ID NO: 131439 - RNA, 64 nt, hsa; identical to SEQ ID NO: 53636

SEQ ID NO: 131440 - RNA, 64 nt, hsa; identical to SEQ ID NO: 53637

SEQ ID NO: 131441 - RNA, 64 nt, hsa; identical to SEQ ID NO: 53638

SEQ ID NO: 131442 - RNA, 64 nt, hsa; identical to SEQ ID NO: 53639

SEQ ID NO: 131443 - RNA, 64 nt, hsa; identical to SEQ ID NO: 53640

SEQ ID NO: 131444 - RNA, 64 nt, hsa; identical to SEQ ID NO: 53641

SEQ ID NO: 131445 - RNA, 64 nt, hsa; identical to SEQ ID NO: 53642

SEQ ID NO: 131446 - RNA, 64 nt, hsa; identical to SEQ ID NO: 53643

SEQ ID NO: 131447 - RNA, 64 nt, hsa; identical to SEQ ID NO: 53644

SEQ ID NO: 131448 - RNA, 64 nt, hsa; identical to SEQ ID NO: 53645

SEQ ID NO: 131449 - RNA, 64 nt, hsa; identical to SEQ ID NO: 53646

SEQ ID NO: 131450 - RNA, 64 nt, hsa; identical to SEQ ID NO: 53647

SEQ ID NO: 131451 - RNA, 64 nt, hsa; identical to SEQ ID NO: 53648

SEQ ID NO: 131452 - RNA, 64 nt, hsa; identical to SEQ ID NO: 53649

SEQ ID NO: 131453 - RNA, 64 nt, hsa; identical to SEQ ID NO: 53650

SEQ ID NO: 131454 - RNA, 64 nt, hsa; identical to SEQ ID NO: 53651

SEQ ID NO: 131455 - RNA, 64 nt, hsa; identical to SEQ ID NO: 53652

SEQ ID NO: 131456 - RNA, 64 nt, hsa; identical to SEQ ID NO: 53653

SEQ ID NO: 131457 - RNA, 64 nt, hsa; identical to SEQ ID NO: 53654

SEQ ID NO: 131458 - RNA, 64 nt, hsa; identical to SEQ ID NO: 53655

SEQ ID NO: 131459 - RNA, 64 nt, hsa; identical to SEQ ID NO: 53656

SEQ ID NO: 131460 - RNA, 64 nt, hsa; identical to SEQ ID NO: 53657

SEQ ID NO: 131461 - RNA, 64 nt, hsa; identical to SEQ ID NO: 53658

SEQ ID NO: 131462 - RNA, 64 nt, hsa; identical to SEQ ID NO: 53659

SEQ ID NO: 131463 - RNA, 64 nt, hsa; identical to SEQ ID NO: 53660

SEQ ID NO: 131464 - RNA, 64 nt, hsa; identical to SEQ ID NO: 53661

SEQ ID NO: 131465 - RNA, 64 nt, hsa; identical to SEQ ID NO: 53662

SEQ ID NO: 131466 - RNA, 64 nt, hsa; identical to SEQ ID NO: 53663

SEQ ID NO: 131467 - RNA, 64 nt, hsa; identical to SEQ ID NO: 53664

SEQ ID NO: 131468 - RNA, 64 nt, hsa; identical to SEQ ID NO: 53665

SEQ ID NO: 131469 - RNA, 64 nt, hsa; identical to SEQ ID NO: 53666

SEQ ID NO: 131470 - RNA, 64 nt, hsa; identical to SEQ ID NO: 53667

SEQ ID NO: 131471 - RNA, 64 nt, hsa; identical to SEQ ID NO: 53668

SEQ ID NO: 131472 - RNA, 64 nt, hsa; identical to SEQ ID NO: 53669

SEQ ID NO: 131473 - RNA, 64 nt, hsa; identical to SEQ ID NO: 53670

SEQ ID NO: 131474 - RNA, 64 nt, hsa; identical to SEQ ID NO: 53671

SEQ ID NO: 131475 - RNA, 64 nt, hsa; identical to SEQ ID NO: 53672

SEQ ID NO: 131476 - RNA, 64 nt, hsa
gacaaggaaccugcagaauguggacaugaagauugggguguaacaccuacaccauuaucuugga

SEQ ID NO: 131477 - RNA, 64 nt, hsa
cccugggcauugcuuuccacugagguuggggguugggguguacuaguuacacaucuucaacaga

SEQ ID NO: 131478 - RNA, 64 nt, hsa
ugacuuggcuguacugaaaagugaacagcauggauuaacucauccugcugcugagggcagugca

SEQ ID NO: 131479 - RNA, 64 nt, hsa
gugguugugcauagaaaguaaauacauggcguaauuaacucagcuguucuagcugcaguacugc

SEQ ID NO: 131480 - RNA, 64 nt, hsa
uugaaacuuuuguagcaaucuggucuauagacuuuuaacucaagaagcuaaggcuagacuuguu

SEQ ID NO: 131481 - RNA, 64 nt, hsa
gacacuuuuaaaagaaaagacaaguuuguuguguuuaacucaccaacacgugguguauaaugaa

SEQ ID NO: 131482 - RNA, 64 nt, hsa
auuauuguuuaauuagaauauuaaacccuacccuuuaacucagcaguccccaaccuuuuuugca

SEQ ID NO: 131483 - RNA, 64 nt, hsa
agaaacaucagcauuguauacacauauuuucacuuuaacucaagaauuccaggagguaauuugu

SEQ ID NO: 131484 - RNA, 64 nt, hsa
ccaugcguccuuucuuuuaagggcauuuuuagaauuaacucagaccuggaagacuccucaguuc

SEQ ID NO: 131485 - RNA, 64 nt, hsa
uccaagguaacuggguaggaaaucuuuugacaucuuaacucauguugaguuugugcuguggugu

SEQ ID NO: 131486 - RNA, 64 nt, hsa
cuccccacccaccaugguucauuccgacuuuuccaauggaaacucagaucccaaaagucccuaa

SEQ ID NO: 131487 - RNA, 64 nt, hsa
gcuaacuccuuggauugucaacccccaucccccaaauggaaauuccgaaggaggccuccucgca

SEQ ID NO: 131488 - RNA, 64 nt, hsa
ugagggaaaguaaauccucaugaggaaaaguacaaauggaaaucguauuaauuugugaggcagg

SEQ ID NO: 131489 - RNA, 64 nt, hsa
ugccuuugcugaacuccaaguuaguggauugcagaauggaaacuuggcuuuugcggcacugggu

SEQ ID NO: 131490 - RNA, 64 nt, hsa
agauaccacuuuaucagggaaguuagucaaaugaaauggaaauugguaaauggacaaaagcuag

SEQ ID NO: 131491 - RNA, 64 nt, hsa
ugguagacaguucaugcaguauaugaauugccauaauggaaauaaucugauuuuauuuuuacaa

SEQ ID NO: 131492 - RNA, 64 nt, hsa
acuuaaaaucuaugaguuuuuacuuuuuacugggaauggaaaguguggugaagaucauucaaca

SEQ ID NO: 131493 - RNA, 64 nt, hsa
agagauugaaauuucaaacuaucucuaguuuuucaauggaaauauaucagcuagggaaaaacca

SEQ ID NO: 131494 - RNA, 64 nt, hsa
accacagggcucagacuuacuagauaaaaccagaaauggaaauaaggaauucaggggaguucca

SEQ ID NO: 131495 - RNA, 64 nt, hsa
uuuuauucauaaauuaaaugucuacaugugccagaauggaaaggaaacaaggggagacaacuuu

SEQ ID NO: 131496 - RNA, 64 nt, hsa
cuggcuguuggaaaccugaaugcuuuuagacccaaauggaaaauuucugaaaugcuggauuauc

SEQ ID NO: 131497 - RNA, 64 nt, hsa
guaaacauagccuauuuuugugcuuaagauacugaauggaaaacuccauuguguguugcuggac

SEQ ID NO: 131498 - RNA, 64 nt, hsa
uuuuccauacuuguauauugaacauucaaacuugaauggaaaguugauuuugucuguauuugaa

SEQ ID NO: 131499 - RNA, 64 nt, hsa
augucaguuacauucagcagaaaaagugacauuuaauggaaagcaaaacaaaucagguccugau

SEQ ID NO: 131500 - RNA, 64 nt, hsa
uguggcuaggcgaggagcuggaguggcuguucuuaauggaaaacuguuuguaugugguggcuuu

SEQ ID NO: 131501 - RNA, 64 nt, hsa
uuuauuuuauacuuacauaggagugugugcucugaauggaaaguuauacaucguugguggcucu

SEQ ID NO: 131502 - RNA, 64 nt, hsa
gccaaguagaaaguuuaacugaaauuaauaagccaauggaaagaaagaaauauuaauaacugcu

SEQ ID NO: 131503 - RNA, 64 nt, hsa
aucagaaguugcaaaagaugguauagccgaauauaauggaaauaggaaaaauuagucgaaaaua

SEQ ID NO: 131504 - RNA, 64 nt, hsa
aaaggaagacugaaaaaagguuuuaaagaacauaaauggaaagauacaaaugcuuugaaggaau

SEQ ID NO: 131505 - RNA, 64 nt, hsa
aaagaucaauuuggcacuuuuuuucauuuuuuuuaauggaaauaagauuuggucucucauuuua

SEQ ID NO: 131506 - RNA, 64 nt, hsa
uauaauuuauagaauuucagugcaguucauucuuaauggaaaaucugaaaccuaaauugcagau

SEQ ID NO: 131507 - RNA, 64 nt, hsa
augcuuuuauguauuucaaaacuuucauauguuaaauggaaauuguuuuaaauguguuugaguu

SEQ ID NO: 131508 - RNA, 64 nt, hsa
gauuucagcauucagcaguugacacaggcuaagaaauggaaagaaguagaucuguuuuuucuca

SEQ ID NO: 131509 - RNA, 64 nt, hsa
acaaggguugugaaugugaaagggggaauggaggaauggaaauaaaauugggaugagcccuaau

SEQ ID NO: 131510 - RNA, 64 nt, hsa
aacaccugaccaccauuuaaggacucuaagccagaauggaaaauucaccaggacuccauucuua

SEQ ID NO: 131511 - RNA, 64 nt, hsa
acaaaccuccuugggaauccacauuuuuugggggaauggaaaagcucugucucccuaacucaac

SEQ ID NO: 131512 - RNA, 64 nt, hsa
gugauccaguuuuucauaagauauuuuauuuugaaauggaaauuaauguccucucaaaguaaaa

SEQ ID NO: 131513 - RNA, 64 nt, hsa
augccaaaauuguccaucugccucugaguagggcaauggaaauaccaaaccuucugacuuugcc

SEQ ID NO: 131514 - RNA, 64 nt, hsa
uuucuuagauaugauaccaaagacacaagcaaccaauggaaaaauagguaaauuggacuuaauc

SEQ ID NO: 131515 - RNA, 64 nt, hsa
caaaauuggaaagaaauuaaagaaggcuuaaauaaauggaaagacauccuguguucauggauca

SEQ ID NO: 131516 - RNA, 64 nt, hsa
gcaggcaggcacucaagaaaugaauuaacuacauaauggaaaaguaugguuuaauguguccaaa

SEQ ID NO: 131517 - RNA, 64 nt, hsa
auuaauaucaaauucacuuaugaauaaacuugauaauggaaacggacaaaaaaaaucaagugcg

SEQ ID NO: 131518 - RNA, 64 nt, hsa
auuugauuuuauucuugcagagggaauggaaaggaauggaaagauuuguuggcguaauuuuuga

SEQ ID NO: 131519 - RNA, 64 nt, hsa
ccuaacaguuauuugauuuuauucuugcagagggaauggaaaggaauggaaagauuuguuggcg

SEQ ID NO: 131520 - RNA, 64 nt, hsa
gaaaaaaccuaagaaauuuccccuuuuuuuaaaaaauggaaauauucaauugagacuugagggg

SEQ ID NO: 131521 - RNA, 64 nt, hsa
cucuuccaacccuccauuagcucaauuuugagauaauggaaaauugacuggaaauucaaaacuc

SEQ ID NO: 131522 - RNA, 64 nt, hsa
ucaguauuuugagaauugccauauuaauuuuuauaauggaaaacuuaauaaauugcuacuguuu

SEQ ID NO: 131523 - RNA, 64 nt, hsa
agagacaugaaauguacuagaggagcccuuuuccaauggaaauauuauauaccacauuuuuugu

SEQ ID NO: 131524 - RNA, 64 nt, hsa
uccaauggaaauauuauauaccacauuuuuuguuaauggaaauaaaugucuucauucccauguu

SEQ ID NO: 131525 - RNA, 64 nt, hsa
gacgugauaggcugcaugcaagaggcauacagaaaauggaaauaguauuucgcuguccugaaac

SEQ ID NO: 131526 - RNA, 64 nt, hsa
gucauaauauucucucccucccuaaguauucuacaauggaaagaauggaggaagcacuucaagu

SEQ ID NO: 131527 - RNA, 64 nt, hsa
uugacagugcugcugccuucggugacuauaugagaauggaaacuucuaaggaagccagguuguu

SEQ ID NO: 131528 - RNA, 64 nt, hsa
acauuuauuuucuucagccugugcaaaacaaagcaauggaaaaggaaacuaaaaaauauacaua

SEQ ID NO: 131529 - RNA, 64 nt, hsa
ugauacuauaauagaaugagacauaaaaugaauuaauggaaacauauccacacuguacugugau

SEQ ID NO: 131530 - RNA, 64 nt, hsa
cguaauucuucauaguuuuuuuaaucuauggauaaauggaaaccuaauuauuuguaaugaauua

SEQ ID NO: 131531 - RNA, 64 nt, hsa
ggggaaaacauuuuuuaucauuuucuauuaagaaaauggaaaacuuaaauaugguguuaaaaau

SEQ ID NO: 131532 - RNA, 64 nt, hsa
uuaagaaaauggaaaacuuaaauaugguguuaaaaauggaaauauaugugauauuugcauuauu

SEQ ID NO: 131533 - RNA, 64 nt, hsa
cuguuaucaccuauccugaagaugugauacacugaauggaaauaaauagauguaaauaaaauug

SEQ ID NO: 131534 - RNA, 64 nt, hsa
aacuuuacauauuugucuauugucaagaugcuacaauggaaaccauuucugguuuuaucuucaa

SEQ ID NO: 131535 - RNA, 64 nt, hsa
cccggaccaguuacauucguuccuggcaaaagcaaauggaaauggucuccugucuccagccugc

SEQ ID NO: 131536 - RNA, 64 nt, hsa
auuugaaauaauuucaccaggcuaaauaaaggaaaauggaaaccaguuaagaggcacaguguac

SEQ ID NO: 131537 - RNA, 64 nt, hsa
ugaaucaaacugaaaaaguauuuccuuauagcuuaauggaaaggcuacuaggaaaaaccagaag

SEQ ID NO: 131538 - RNA, 64 nt, hsa
agcuuuccagucacacaucaaggcgcuugaucacaauggaaaaggugaagaaauuugagguaaa

SEQ ID NO: 131539 - RNA, 64 nt, hsa
ggaugaauuaugaaguauuccuuccaaagaugucaauggaaacuaaucgagucuuacaccuaau

SEQ ID NO: 131540 - RNA, 64 nt, hsa
auuuuaaauuuauauuugaacacagucaaaucugaauggaaauacauuuaaauaagcauuucuu

SEQ ID NO: 131541 - RNA, 64 nt, hsa
guuuuggaaugucccccacuuggagaguuugaggaauggaaaugagaaucggaggagaaauaag

SEQ ID NO: 131542 - RNA, 64 nt, hsa
uuuuggaaaguacuuaaaaguuaccagaauuuucaauggaaaaugagggguuucuccccacuga

SEQ ID NO: 131543 - RNA, 64 nt, hsa
cugcuuucauuuuucugaccuaauaauuacgggaaauggaaagucugggccagcaucaauaaaa

SEQ ID NO: 131544 - RNA, 64 nt, hsa
uuuauaacuuuuaaauggaaaaaccuauuagguaaauggaaauaauccuugaaaauaguuuuug

SEQ ID NO: 131545 - RNA, 64 nt, hsa
cuguuuucucuuuuuaaauauuuuauaacuuuuaaauggaaaaaccuauuagguaaauggaaau

SEQ ID NO: 131546 - RNA, 64 nt, hsa
uagaugcuauuguucugauggcccggcugaauaaaauggaaauucuaguuuguuagaauuaugc

SEQ ID NO: 131547 - RNA, 64 nt, hsa
gccuaacuuauuggagcacaucaguuucuuggguaauggaaaacauuaccuagaguugccagug

SEQ ID NO: 131548 - RNA, 64 nt, hsa
agguuuuaaucauucuucuauaaaauacauuuaaaauggaaaaauacuuaauaucacuaaauau

SEQ ID NO: 131549 - RNA, 64 nt, hsa
aaauguuguauuucauauuuauuuauauaauacaaauggaaaucaaaacugaaauagccucccu

SEQ ID NO: 131550 - RNA, 64 nt, hsa
auugacuuuuggaaaccaaccaaauuacuuaagaaauggaaaaguagucacagagaaauuuagu

SEQ ID NO: 131551 - RNA, 64 nt, hsa
ucagggacccccacgccuuuguuguuugaauggaaauggaaaagccaguauucuuuuauaaaau

SEQ ID NO: 131552 - RNA, 64 nt, hsa
cccuucucagggacccccacgccuuuguuguuugaauggaaauggaaaagccaguauucuuuua

SEQ ID NO: 131553 - RNA, 64 nt, hsa
aauuuauuggaguaacucaaauugccugaggaaaaauggaaaaauuauccaccagucgauucaa

SEQ ID NO: 131554 - RNA, 64 nt, hsa
gucagccagaaaucacagauacugcuuucacuuaaauggaaacaauucuccgauaaugcuuugc

SEQ ID NO: 131555 - RNA, 64 nt, hsa
gauuugagaaaagggaggaggggaagauagucugaauggaaaucugaaauacggaauguuuuag

SEQ ID NO: 131556 - RNA, 64 nt, hsa
uaacuagcuuuaaguuuaaagauggaagcuaagcaauggaaaugcuauacguuuuugacauuua

SEQ ID NO: 131557 - RNA, 64 nt, hsa
guagcuagaaauaauuauguggaaaaaaaugaauaauggaaaauagugagucucaaauuguucu

SEQ ID NO: 131558 - RNA, 64 nt, hsa
gcagccauugggaaauugggagaaaugauaaacaaauggaaaaagaagaugucccuaaccuaca

SEQ ID NO: 131559 - RNA, 64 nt, hsa
uugauuaucuucagcccaggcuuuugcuagauggaauggaaaagcaacuucauuugacacaaag

SEQ ID NO: 131560 - RNA, 64 nt, hsa
uuuuuuuggguuaaaagaugguuguagcauuuaaaauggaaaauuuucuccuugguuugcuagu

SEQ ID NO: 131561 - RNA, 64 nt, hsa
ucccaggagccgcggaggaggacagugagggaggaauggaaacgagagaugugaaguuggcagc

SEQ ID NO: 131562 - RNA, 64 nt, hsa
cuuguuaacccaagaugcugcuacacagaugccaaauggaaaucuuccacagggcuuuuucagu

SEQ ID NO: 131563 - RNA, 64 nt, hsa
ucuguaggguacuguaauuugucaaaaugcagagaauggaaaacagugaacggaaaacacagag

SEQ ID NO: 131564 - RNA, 64 nt, hsa
cauuugaguaaccaucaacacaauuaguuuacagaauggaaaaggagucugagaucuguacugu

SEQ ID NO: 131565 - RNA, 64 nt, hsa
cacagccuggauugagaauuuuuauaagauuggcaauggaaaaacauuuauucuuuuaaauaau

SEQ ID NO: 131566 - RNA, 64 nt, hsa
gcuaugcaugcucuaagucugcaugggauaugggaauggaaaagggcaauaagaaauuaauacc

SEQ ID NO: 131567 - RNA, 64 nt, hsa
uuggcaaaagcuggugccugguaaguagaaacgaaauggaaacagaaauaacauuugugaaauc

SEQ ID NO: 131568 - RNA, 64 nt, hsa
guauuuugaucugcauugacaccagcucuuaauaaauggaaacuuauuuauuuucacaguugaa

SEQ ID NO: 131569 - RNA, 64 nt, hsa
guaguaugaaaacuauuuguugaagaaauaaaugaauggaaagacauagggaagaaugggcugu

SEQ ID NO: 131570 - RNA, 64 nt, hsa
ugucuggaggggcaguguacaggugcucuauuuuaauggaaaacacuccccucucccucuuucu

SEQ ID NO: 131571 - RNA, 64 nt, hsa
gaaaauguugccuuguauuuaaaaggguuucaugaauggaaaccuaaguaaaacuaagcucauu

SEQ ID NO: 131572 - RNA, 64 nt, hsa
uagguauucuaauguauuuuguuaguugcuuagaaauggaaauaaaauauaugugcuuauuaaa

SEQ ID NO: 131573 - RNA, 64 nt, hsa
ggaaaagaauuuuacaugcacuuuaaaauaguaaaauggaaagugaauuuuuaaaauauaugca

SEQ ID NO: 131574 - RNA, 64 nt, hsa
uauuucccuucuucaaauuaauuaccuaccaaaaaauggaaaagaauuuuacaugcacuuuaaa

SEQ ID NO: 131575 - RNA, 64 nt, hsa
uauauuuguauaaguaaaugggugggugcuauacaauggaaagaugaaaauggaaaggaagagc

SEQ ID NO: 131576 - RNA, 64 nt, hsa
uaaaugggugggugcuauacaauggaaagaugaaaauggaaaggaagagcuuauuuaagagacg

SEQ ID NO: 131577 - RNA, 64 nt, hsa
uaugguggaccuauuacccuauggguaagaaauaaauggaaauaugacaucggauguuucagca

SEQ ID NO: 131578 - RNA, 64 nt, hsa
caccacucagugugauaauugugucuacagcuaaaauggaaauaguuuuaucuguacaguugug

SEQ ID NO: 131579 - RNA, 64 nt, hsa
gcucuagagagaggucaugauaucauaccaaccaaauggaaaugacaaauguuuuaugucaagu

SEQ ID NO: 131580 - RNA, 64 nt, hsa
aauugugcuauccugaauggaaaauagaggauacaauggaaaauagaggauaccaacuguaugc

SEQ ID NO: 131581 - RNA, 64 nt, hsa
auaaaaagaaaaaaauggaaaaaaauuacaaggcaauggaaacuauuauaaggccauuuccuuu

SEQ ID NO: 131582 - RNA, 64 nt, hsa
ccaaaauauuauauuuuuucuauaaaaagaaaaaaauggaaaaaaauuacaaggcaauggaaac

SEQ ID NO: 131583 - RNA, 64 nt, hsa
uaaaagguagagaaacuuguaguguucuccacauaauggaaaauguacaaaugccuaguugugu

SEQ ID NO: 131584 - RNA, 64 nt, hsa
uaucccaaaaggaagaacugucuugaacaagaugaauggaaaauugugguuaauucugaauuuc

SEQ ID NO: 131585 - RNA, 64 nt, hsa
aauaccacaguauuuuauucauuguuaucuugccaauggaaauaaaguaugauauugcauuuaa

SEQ ID NO: 131586 - RNA, 64 nt, hsa
aaagaggaacugaaggacgcgguuaaugccuaaaaauggaaacguuaagaaguuggaauguugg

SEQ ID NO: 131587 - RNA, 64 nt, hsa
uuuguaaauagcaguucacauuuuuccacaguauaauggaaaauaauggguaggggugcauugc

SEQ ID NO: 131588 - RNA, 64 nt, hsa
aaaucacuuaauuaguaccauuaagugagagaguaauggaaaacuguuauccaucaaaagugau

SEQ ID NO: 131589 - RNA, 64 nt, hsa
gaauguauccccugccuauuuuccuuguguaacaaauggaaaacauucuccccugugagaaaua

SEQ ID NO: 131590 - RNA, 64 nt, hsa
ugcaugggaaagcaaagcagaaaacagugccccaaauggaaaaaagauacucacacagaacaaa

SEQ ID NO: 131591 - RNA, 64 nt, hsa
agauagaaaaauuuuuauuacucaaaguaaaauaaauggaaauaucacugagcaguuguuuaua

SEQ ID NO: 131592 - RNA, 64 nt, hsa
accauguucaaccaucugucaugacuguuuggcaaauggaaaccgcuggagaaacaaaauugcu

SEQ ID NO: 131593 - RNA, 64 nt, hsa
caaagucaacagcccaauaagaaugaagaauggaaauggaaaaggguggcugcgacucaagaau

SEQ ID NO: 131594 - RNA, 64 nt, hsa
augucucaaagucaacagcccaauaagaaugaagaauggaaauggaaaaggguggcugcgacuc

SEQ ID NO: 131595 - RNA, 64 nt, hsa
uuacuuugacauaggaauugacuucuuuuccuugaauggaaaacacuuugaaauaauaauaaac

SEQ ID NO: 131596 - RNA, 64 nt, hsa
auauuugucauauauuuaagaaaaagcuaaaaagaauggaaaucgcaugacuauaacuuaaguc

SEQ ID NO: 131597 - RNA, 64 nt, hsa
uuauggaaaagaggugagccuuugugaagaacauaauggaaaagugcauguacgggaaauaaca

SEQ ID NO: 131598 - RNA, 64 nt, hsa
acaaacaaacaacguaucuuacugacuaaacuggaauggaaaucuuauaauuaguguuguauuu

SEQ ID NO: 131599 - RNA, 64 nt, hsa
auauuugucguauauugaagaaaaagcuaaaaagaauggaaaucgcaugacuauaacuuaaguc

SEQ ID NO: 131600 - RNA, 64 nt, hsa; identical to SEQ ID NO: 131595

SEQ ID NO: 131601 - RNA, 64 nt, hsa
agacaaguccugugucuaccugcgucagccugaaaauggaaauauuggcuguugacucuuguca

SEQ ID NO: 131602 - RNA, 64 nt, hsa
aaaaaaacaagcaagaagaccauuugaccauaugaauggaaaagggaagaaaguauaauagaaa

SEQ ID NO: 131603 - RNA, 64 nt, hsa
gccauguguuaauauaaaguaggcauggcuucccaauggaaaucucugagaaugacaguggagu

SEQ ID NO: 131604 - RNA, 64 nt, hsa
acuaacuuuuagcuaacaauaagggcugugccccaauggaaacugaguucauuuucugagaaag

SEQ ID NO: 131605 - RNA, 64 nt, hsa
uuaugaauguaacugugcacaggaaaugacugguaauggaaaaaauguuguaauaaaauaaucu

SEQ ID NO: 131606 - RNA, 64 nt, hsa
uuuaucuaccaucaaccugauaaggcacaugugaaauggaaauguucucuuuccucugaagcag

SEQ ID NO: 131607 - RNA, 64 nt, hsa
agcuucacucacugucaaugauuauuuucauuacaauggaaacaaucuuuuuuacucuaugccc

SEQ ID NO: 131608 - RNA, 64 nt, hsa
cuuuuuaaaccaguuuagauuucaagaaaaaauaaauggaaaucaucgaaaauucauuucacau

SEQ ID NO: 131609 - RNA, 64 nt, hsa
gggcuuuuauuuuuucuuuuguaauuguguaaaaaauggaaaaaaacauaaaaagcagaauuuu

SEQ ID NO: 131610 - RNA, 62 nt, hsa
acuguagguuauuuaaaauaaauuccuacaacuuaauggaaacuuaagugucugccucuuug

SEQ ID NO: 131611 - RNA, 64 nt, hsa
aagcaaaaggauguuauuucauuaaauuugguuuaauggaaagaauaaaaguaaaugaaaaaca

SEQ ID NO: 131612 - RNA, 64 nt, hsa
agccgaggcaguuccugcguucugcuacaaaaggaauggaaagggaagggaauuuccccccacc

SEQ ID NO: 131613 - RNA, 64 nt, hsa
uuauuuucuuuuugcuuuguucacugcuuauuaaaauggaaauccuggagaauaguaguucugg

SEQ ID NO: 131614 - RNA, 64 nt, hsa
guggagaugagaaggugguggacacucgugauggaauggaaaucguccuaccgugcagccacac

SEQ ID NO: 131615 - RNA, 64 nt, hsa
ggagcgggggugaggggggcagugugcucgugggaauggaaaggacagcaagcacaggugaguc

SEQ ID NO: 131616 - RNA, 64 nt, hsa
gaaauuguauaguuucauugauuuaaucauaaauaauggaaauggucuccaagaaguuuuauuu

SEQ ID NO: 131617 - RNA, 64 nt, hsa
aaaaucugaaguacuauagaacauuaaguugaagaauggaaauuaagaguacguauucaugguu

SEQ ID NO: 131618 - RNA, 64 nt, hsa; identical to SEQ ID NO: 100733

SEQ ID NO: 131619 - RNA, 64 nt, hsa; identical to SEQ ID NO: 100734

SEQ ID NO: 131620 - RNA, 64 nt, hsa; identical to SEQ ID NO: 100735

SEQ ID NO: 131621 - RNA, 64 nt, hsa; identical to SEQ ID NO: 100736

SEQ ID NO: 131622 - RNA, 64 nt, hsa; identical to SEQ ID NO: 100737

SEQ ID NO: 131623 - RNA, 64 nt, hsa; identical to SEQ ID NO: 100738

SEQ ID NO: 131624 - RNA, 64 nt, hsa; identical to SEQ ID NO: 100739

SEQ ID NO: 131625 - RNA, 64 nt, hsa; identical to SEQ ID NO: 100740

SEQ ID NO: 131626 - RNA, 64 nt, hsa; identical to SEQ ID NO: 100741

SEQ ID NO: 131627 - RNA, 64 nt, hsa; identical to SEQ ID NO: 100742

SEQ ID NO: 131628 - RNA, 64 nt, hsa; identical to SEQ ID NO: 100743

SEQ ID NO: 131629 - RNA, 64 nt, hsa; identical to SEQ ID NO: 100744

SEQ ID NO: 131630 - RNA, 64 nt, hsa; identical to SEQ ID NO: 100745

SEQ ID NO: 131631 - RNA, 64 nt, hsa; identical to SEQ ID NO: 100746

SEQ ID NO: 131632 - RNA, 64 nt, hsa; identical to SEQ ID NO: 100747

SEQ ID NO: 131633 - RNA, 64 nt, hsa; identical to SEQ ID NO: 100748

SEQ ID NO: 131634 - RNA, 64 nt, hsa; identical to SEQ ID NO: 100749

SEQ ID NO: 131635 - RNA, 64 nt, hsa; identical to SEQ ID NO: 100750

SEQ ID NO: 131636 - RNA, 64 nt, hsa; identical to SEQ ID NO: 100751

SEQ ID NO: 131637 - RNA, 64 nt, hsa; identical to SEQ ID NO: 100752

SEQ ID NO: 131638 - RNA, 64 nt, hsa; identical to SEQ ID NO: 100753

SEQ ID NO: 131639 - RNA, 64 nt, hsa; identical to SEQ ID NO: 100754

SEQ ID NO: 131640 - RNA, 64 nt, hsa; identical to SEQ ID NO: 100755

SEQ ID NO: 131641 - RNA, 64 nt, hsa; identical to SEQ ID NO: 100756

SEQ ID NO: 131642 - RNA, 64 nt, hsa; identical to SEQ ID NO: 100757

SEQ ID NO: 131643 - RNA, 64 nt, hsa; identical to SEQ ID NO: 100758

SEQ ID NO: 131644 - RNA, 64 nt, hsa; identical to SEQ ID NO: 100759

SEQ ID NO: 131645 - RNA, 64 nt, hsa; identical to SEQ ID NO: 100760

SEQ ID NO: 131646 - RNA, 64 nt, hsa; identical to SEQ ID NO: 100761

SEQ ID NO: 131647 - RNA, 64 nt, hsa; identical to SEQ ID NO: 100762

SEQ ID NO: 131648 - RNA, 64 nt, hsa; identical to SEQ ID NO: 100763

SEQ ID NO: 131649 - RNA, 64 nt, hsa; identical to SEQ ID NO: 100764

SEQ ID NO: 131650 - RNA, 64 nt, hsa; identical to SEQ ID NO: 100765

SEQ ID NO: 131651 - RNA, 64 nt, hsa; identical to SEQ ID NO: 100766

SEQ ID NO: 131652 - RNA, 64 nt, hsa; identical to SEQ ID NO: 100767

SEQ ID NO: 131653 - RNA, 64 nt, hsa; identical to SEQ ID NO: 100768

SEQ ID NO: 131654 - RNA, 64 nt, hsa; identical to SEQ ID NO: 100769

SEQ ID NO: 131655 - RNA, 64 nt, hsa; identical to SEQ ID NO: 100770

SEQ ID NO: 131656 - RNA, 64 nt, hsa; identical to SEQ ID NO: 100771

SEQ ID NO: 131657 - RNA, 64 nt, hsa; identical to SEQ ID NO: 100772

SEQ ID NO: 131658 - RNA, 64 nt, hsa; identical to SEQ ID NO: 100773

SEQ ID NO: 131659 - RNA, 64 nt, hsa; identical to SEQ ID NO: 100774

SEQ ID NO: 131660 - RNA, 64 nt, hsa; identical to SEQ ID NO: 100775

SEQ ID NO: 131661 - RNA, 64 nt, hsa; identical to SEQ ID NO: 100776

SEQ ID NO: 131662 - RNA, 64 nt, hsa; identical to SEQ ID NO: 100777

SEQ ID NO: 131663 - RNA, 64 nt, hsa
gacuuacuaaaaauaguugaaaauuauucaccuaagaauagaaucucagcauuguguuaaauaa

SEQ ID NO: 131664 - RNA, 64 nt, hsa
uuagggaguguaccucagauagauuuuaaaaaaaagaauagaaagccuuuauuuccugguuuga

SEQ ID NO: 131665 - RNA, 64 nt, hsa
gauugcuugagaaaauaacauauaaacauagaauagaauagacugaccaagaugguucacaguu

SEQ ID NO: 131666 - RNA, 64 nt, hsa
gaagcgauugcuugagaaaauaacauauaaacauagaauagaauagacugaccaagaugguuca

SEQ ID NO: 131667 - RNA, 64 nt, hsa
acgcugaaaacccguuugauucuauacccaaucaagaauagacccuucacacaggaaaugugaa

SEQ ID NO: 131668 - RNA, 64 nt, hsa
uuaccaccaaaaggcaauggcaguccuacauuuaagaauagagcuaugcaaacucuguuaaaaa

SEQ ID NO: 131669 - RNA, 64 nt, hsa
ucucugagaccacagaggcucagacucacuguuaagaauagaaaacuggguaugcguuucaugu

SEQ ID NO: 131670 - RNA, 64 nt, hsa
aacuuggcuuuccuguuucuaucuuucauuaaaaagaauagaaggauucagucauaaagaggua

SEQ ID NO: 131671 - RNA, 64 nt, hsa
auucuggggacaaucugacuggauaugacacugcagaauagauuuaagucgcuguguuuucugu

SEQ ID NO: 131672 - RNA, 64 nt, hsa
uuuuagggauagagucagcugccgaacggagaucagaauagacuucagaaagcuucgguggaag

SEQ ID NO: 131673 - RNA, 64 nt, hsa
aucccaaccucuuggauguauacagagauuuuauagaauagaaccuauagcuucuaccaugagu

SEQ ID NO: 131674 - RNA, 64 nt, hsa
cuuaagaauaagaccugagauuaacacuaacccuagaauagaaauguaauagggagaugguaau

SEQ ID NO: 131675 - RNA, 64 nt, hsa
agauaguuugugacacauaagcuucccaaaaacuagaauagauuuuuacugaauagugguauau

SEQ ID NO: 131676 - RNA, 64 nt, hsa
aaaaaauuacuuuuuuaccagguuuuccaaagacagaauagaucacaaagcucaaggaauuuaa

SEQ ID NO: 131677 - RNA, 64 nt, hsa
uagaaguguaugaauugcugcgacaauuuugaaaagaauagaggaaacacccucacuguaugau

SEQ ID NO: 131678 - RNA, 64 nt, hsa
uuaguacauuaguagguaaaugagcagauuuuaaagaauagaauauccagaagcagauucauga

SEQ ID NO: 131679 - RNA, 64 nt, hsa
auuauugaaaauuguauguaaaacuauuuaaaauagaauagaaggauacacacccaauuauuga

SEQ ID NO: 131680 - RNA, 64 nt, hsa
ucagcucccugggagcugaaagugaggauacuccgugcuccaggccacagggugaauguggcca

SEQ ID NO: 131681 - RNA, 64 nt, hsa
auaaaauauuucaugggaaucgaaccuagggauagugcuccacuucugacgauggagugaagac

SEQ ID NO: 131682 - RNA, 64 nt, hsa
uguguuugccuugcagcugagggauuuucacagugugcuccagauggugcuagaggaaguccca

SEQ ID NO: 131683 - RNA, 64 nt, hsa
ugaggaggagacagccucagcggacaagcagcuggugcuccaagcacaggagaacaugcugguc

SEQ ID NO: 131684 - RNA, 64 nt, hsa
acuugggugaccagucuccgucuuccuccugcuagugcuccaccccccggacuuggaugaccag

SEQ ID NO: 131685 - RNA, 64 nt, hsa
cuuggaugaccaguuucccaccuuccuccugcuggugcuccaucccccaauaccaggcugggcc

SEQ ID NO: 131686 - RNA, 64 nt, hsa
accuccugcugggcagggggcaugaugcgggccagugcuccagccacagaaaagaaaguucaug

SEQ ID NO: 131687 - RNA, 64 nt, hsa
ccugacuuuucagugacugacagcggaaagcccugugcuccauggcugccaucucaccuccugc

SEQ ID NO: 131688 - RNA, 64 nt, hsa
aggaguuugaggcucuggaacucucacauauucaagucuuuaacuuaguggugaugggugauuu

SEQ ID NO: 131689 - RNA, 64 nt, hsa
cugaaaguauccaugcugacuuucaugauuuagaagucuuuaacugaauuauuaaaauugccuu

SEQ ID NO: 131690 - RNA, 64 nt, hsa
cccagcaacaaaccucccggcuaggagcuuuagaagucuuuauguucuuccugccaucauuccu

SEQ ID NO: 131691 - RNA, 64 nt, hsa
acaaauaacuugucacaccuuuuguuucauucugagucuuuaguuuuagucaugggcuuucuuc

SEQ ID NO: 131692 - RNA, 64 nt, hsa
uuauaaauguuuuuaauuguguucuguuuuuugcagucuuuaagugccaugccaauuguucuua

SEQ ID NO: 131693 - RNA, 64 nt, hsa
auuucuguaccuuuuuuuuuuuuuuuuacuuugaagucuuuaaauaaaauguauaauacccauu

SEQ ID NO: 131694 - RNA, 64 nt, hsa
aaauuguaaaauguaaagauugcucuuuuuauuaagucuuuaacagggauguauuucauuguau

SEQ ID NO: 131695 - RNA, 64 nt, hsa
ugugcgucuaccucugucagcaugaaaguauuccagucuuuaauuucaaaaacuucaaauuagc

SEQ ID NO: 131696 - RNA, 64 nt, hsa
gagcaaaaugcuucacaugcgaagaauguggcacagucuuuaccacauccucaaacuuuguuaa

SEQ ID NO: 131697 - RNA, 64 nt, hsa
uggaggaaagucuuacaaaugugaagaauguggcagucuuuaaaucuuccucagucuuuucuaa

SEQ ID NO: 131698 - RNA, 64 nt, hsa
augugguuuaucuuuacauuuuaaagaucaaagaagucuuuacaaccugaauccaggucuaaaa

SEQ ID NO: 131699 - RNA, 64 nt, hsa
guuuguuuaacuaaguuguguuuaacuuaugugcagucuuuauaauguauguauguuauuacag

SEQ ID NO: 131700 - RNA, 64 nt, hsa
acugaagggcuguaacugaaaauuauuaaauguuagucuuuagucaaaucucugcauuguuuca

SEQ ID NO: 131701 - RNA, 64 nt, hsa
ccaauaaucucucaauaccuuccuauuucucaauagucuuuaaacccuaaaucugagucaguaa

SEQ ID NO: 131702 - RNA, 64 nt, hsa
aacccagucucucaauaccuuccuauuucucaauagucuuuaagcccuaaaucugagucaguaa

SEQ ID NO: 131703 - RNA, 64 nt, hsa
cuguaacagaaaauaaauuuugaauguguacuuaagucuuuauuauauuugaagcaauuuuuuu

SEQ ID NO: 131704 - RNA, 64 nt, hsa
acugcgcuaugauuaaaaccauucauauagaguuagucuuuacaacuacuauucuguuauuuuu

SEQ ID NO: 131705 - RNA, 64 nt, hsa
acacacacacacacacacacacacacacacacacagucuuuauugcagaagacaguguguugcc

SEQ ID NO: 131706 - RNA, 64 nt, hsa
acagacacacauacacacacauacacacacacagagucuuuauugcagaagacaguguguugcc

SEQ ID NO: 131707 - RNA, 64 nt, hsa
accuuuuuuuaacugcaucugaaauuauguuaagagucuuuaacccauuugcauuaucugcaga

SEQ ID NO: 131708 - RNA, 64 nt, hsa
ggguucuugccuuaaaagugaaaccuucauggauagucuuuaaucucugaucuuuuuggaacaa

SEQ ID NO: 131709 - RNA, 64 nt, hsa
gagaaaagccuuaugagugcagugaaugugggaaagucuuuagauacaacuccagccucauuaa

SEQ ID NO: 131710 - RNA, 64 nt, hsa
gagagagaccuuaucagugcagugaauguggaagagucuuuaaccaaaauucucaucucauuca

SEQ ID NO: 131711 - RNA, 64 nt, hsa
uauuuaaaaaguauauaacauacuauauauguuacauacuaacauauauauacacaacagaaag

SEQ ID NO: 131712 - RNA, 64 nt, hsa
uaggugcaucugccuccucuucucuaagaauaugcauacuaauguuuguuucuauaaaucaaau

SEQ ID NO: 131713 - RNA, 64 nt, hsa
guggaaaguuauagcuugauugggagauagaaguugaauugaguucuuucuugcaacucuuagu

SEQ ID NO: 131714 - RNA, 64 nt, hsa
auuuagcuuuuucuuuucuuugaacaauucggcaugaauugaaaccagguuuuccuguggaaag

SEQ ID NO: 131715 - RNA, 64 nt, hsa
cccuccagacuacuuuaaaugucucugcucugacugaauugaaggaauuguaaguuucaguugc

SEQ ID NO: 131716 - RNA, 64 nt, hsa
cuucuguuccucuguuccccuucaugccuccuuuugaauugauaucucagcugucaauauuucu

SEQ ID NO: 131717 - RNA, 64 nt, hsa
cuuugggaguuuguaaaaugaggugauacaguucugaauugagcauuccuuuaugauauucacu

SEQ ID NO: 131718 - RNA, 64 nt, hsa
gaguaaaagguccaauuuugugaaagauugaaaaugaauugaaugccuaguagaguauaggaga

SEQ ID NO: 131719 - RNA, 64 nt, hsa
uugcuuuguauauuuggugauuuuguaauguaagugaauugauucuuauuucacugauacuauu

SEQ ID NO: 131720 - RNA, 64 nt, hsa
aaaaaacauucuguugcaaacagugguguugcauugaauugaacuuuggcaaugagaacacagc

SEQ ID NO: 131721 - RNA, 64 nt, hsa
auuuaaugcaggcagguguguaauaaauuauuuuugaauugaacauuaaaauucugcuucuuaa

SEQ ID NO: 131722 - RNA, 64 nt, hsa
cucucuugcaaaaaaagaaauggguuucugcuaaugaauugagcagacaucuaauauuuuauau

SEQ ID NO: 131723 - RNA, 64 nt, hsa
uaauauguuuguguguauauaugugccucacaccugaauugaaaauuaaagacugguuuaaaag

SEQ ID NO: 131724 - RNA, 64 nt, hsa
acugcuuccuugcaaaaaaagucgaauccugcauugaauugaauaugaauuucucuaacucucu

SEQ ID NO: 131725 - RNA, 64 nt, hsa
gcuucaaggggagcucuucuccagguucacuaggugaauugauuuauuauuaucauauugauaa

SEQ ID NO: 131726 - RNA, 64 nt, hsa
ugugggcuggggagaaacaguagucaaagcuuucugaauugagauacuuugaaauuccaagugu

SEQ ID NO: 131727 - RNA, 64 nt, hsa
uauguuaaauguagcuuuuuugaaacagaagccuugaauugaaauuuaacuaauacuugaacau

SEQ ID NO: 131728 - RNA, 64 nt, hsa
caacaaguauuuuaacucucaguccaacauuauuugaauugagcaccucaagcaugcuuagcaa

SEQ ID NO: 131729 - RNA, 64 nt, hsa
uaaauaacccauucauagcauagcuagagauuggugaauugaaugcuccugacaucucaguucu

SEQ ID NO: 131730 - RNA, 64 nt, hsa
uugcaguucagggaagggaaacaauaaaucucgcugaauugaagagacaggacuggcaguuggg

SEQ ID NO: 131731 - RNA, 64 nt, hsa
aaacccuauugaggcagugacuguugaaaaagcuugaauugaggagucaagagucacuaagcag

SEQ ID NO: 131732 - RNA, 64 nt, hsa
aguuuaugguauuauguuguuuuauuuaaagcauugaauugauagaaaaauuugcucuguaaua

SEQ ID NO: 131733 - RNA, 64 nt, hsa
guuucucuuaauauaguucuccagucacugaccuugaauugacuuacauaaacuacugccaaug

SEQ ID NO: 131734 - RNA, 62 nt, hsa
cgacacagugagacucugucucaaaaaaacaaaacaaacaaacaaaaauacaaaaaauuagc

SEQ ID NO: 131735 - RNA, 62 nt, hsa
acagugagacucugucucaaaaaaacaaaacaaacaaacaaaaauacaaaaaauuagccggg

SEQ ID NO: 131736 - RNA, 62 nt, hsa
ggccuaggcaacgagagcaaaacuccaauacaaacaaacaaacaaacaccugugcuagguca

SEQ ID NO: 131737 - RNA, 62 nt, hsa
uaggcaacgagagcaaaacuccaauacaaacaaacaaacaaacaccugugcuaggucagucu

SEQ ID NO: 131738 - RNA, 62 nt, hsa
caacgagagcaaaacuccaauacaaacaaacaaacaaacaccugugcuaggucagucuggca

SEQ ID NO: 131739 - RNA, 62 nt, hsa
cuucaucugcuggggggaaaaaguaaauuacaaacaaacaaacaaagcagaacuaaaauauu

SEQ ID NO: 131740 - RNA, 62 nt, hsa
aucugcuggggggaaaaaguaaauuacaaacaaacaaacaaagcagaacuaaaauauuggga

SEQ ID NO: 131741 - RNA, 62 nt, hsa
cccuauaacaaaagacagauugacaagagaaaaacaaacauaaauuuauuagcggguauaug

SEQ ID NO: 131742 - RNA, 62 nt, hsa
aaaauacuauagcagacagcacuaaugucaucaacaaacauuguucuucuccguguccuggg

SEQ ID NO: 131743 - RNA, 62 nt, hsa
guguuaauuuggcuguaauggcauuuaaagcaaacaaacaaacaaaaaaagcugugaaaaug

SEQ ID NO: 131744 - RNA, 62 nt, hsa
uaauuuggcuguaauggcauuuaaagcaaacaaacaaacaaaaaaagcugugaaaauggccu

SEQ ID NO: 131745 - RNA, 62 nt, hsa
cagagcaaacccuguuuccaaacaaacaaacaaacaaacaaauacacagacagaaguaguua

SEQ ID NO: 131746 - RNA, 62 nt, hsa
gcgacagagcaaacccuguuuccaaacaaacaaacaaacaaacaaauacacagacagaagua

SEQ ID NO: 131747 - RNA, 62 nt, hsa
cugggcgacagagcaaacccuguuuccaaacaaacaaacaaacaaacaaauacacagacaga

SEQ ID NO: 131748 - RNA, 62 nt, hsa
cagccugggcgacagagcaaacccuguuuccaaacaaacaaacaaacaaacaaauacacaga

SEQ ID NO: 131749 - RNA, 62 nt, hsa
gcaacagaacaagaacccaucucaaacaaacaaacaaacaaaaaaaaaaaacucuugucucc

SEQ ID NO: 131750 - RNA, 62 nt, hsa
cugggcaacagaacaagaacccaucucaaacaaacaaacaaacaaaaaaaaaaaacucuugu

SEQ ID NO: 131751 - RNA, 62 nt, hsa
caaccugggcaacagaacaagaacccaucucaaacaaacaaacaaacaaaaaaaaaaaacuc

SEQ ID NO: 131752 - RNA, 62 nt, hsa
uagauuuuucacacaccucauuauuaaaaaaaaacaaacaugcuggugucuugguuacccau

SEQ ID NO: 131753 - RNA, 62 nt, hsa
ucggucuuauaaaacucguuggugucuuauaaaacaaacagugauaaucucaaguuagaaaa

SEQ ID NO: 131754 - RNA, 62 nt, hsa
auaacauuauuacauauaggucauuguuaacaaacaaacaucccugaaaaccucugugaaaa

SEQ ID NO: 131755 - RNA, 62 nt, hsa
acaaauaacauuauuacauauaggucauuguuaacaaacaaacaucccugaaaaccucugug

SEQ ID NO: 131756 - RNA, 62 nt, hsa
acuaaagcauuugcuauaauuauuuuuaaaaaaacaaacagaugaaaaccucagagaaggca

SEQ ID NO: 131757 - RNA, 62 nt, hsa
acuuagugaaauaaaauaagaggaaagccaaaaacaaacaaacaaaaagcauauggggagcu

SEQ ID NO: 131758 - RNA, 62 nt, hsa
agugaaauaaaauaagaggaaagccaaaaacaaacaaacaaaaagcauauggggagcuggua

SEQ ID NO: 131759 - RNA, 62 nt, hsa
ugauuaaugcaaggggaaauuuuuauacugaaaacaaacaaacaaacuagcagcuacuaaaa

SEQ ID NO: 131760 - RNA, 62 nt, hsa
uaaugcaaggggaaauuuuuauacugaaaacaaacaaacaaacuagcagcuacuaaaauaga

SEQ ID NO: 131761 - RNA, 62 nt, hsa
aguaacuagaugcagugugaauuuuuuccauuaacaaacaaacaagucaguggcuuaaaugu

SEQ ID NO: 131762 - RNA, 62 nt, hsa
acuagaugcagugugaauuuuuuccauuaacaaacaaacaagucaguggcuuaaaugugauu

SEQ ID NO: 131763 - RNA, 62 nt, hsa
cagacugccuugguacugccgaguccucucaaaacaaacacccucuugcaaccagcuuugga

SEQ ID NO: 131764 - RNA, 62 nt, hsa
acaucugcuccuagcagugcaucagccaguaaaacaaacacauuuacaagaaaaauguuuua

SEQ ID NO: 131765 - RNA, 62 nt, hsa
cagauacugaagaccaacggacugaaaaaaagaacaaacauuagcuauuuuaugcugcaaga

SEQ ID NO: 131766 - RNA, 62 nt, hsa
guguuuucuguacccaaccagacuuuaaauaaaacaaacaugaaaccuaauguacguauuua

SEQ ID NO: 131767 - RNA, 62 nt, hsa
ggcaaacugagguagcgacacaaaguuaaacaaacaaacaaaaaacacaaaacauaauaaaa

SEQ ID NO: 131768 - RNA, 62 nt, hsa
ugggggcaaacugagguagcgacacaaaguuaaacaaacaaacaaaaaacacaaaacauaau

SEQ ID NO: 131769 - RNA, 62 nt, hsa
uucuagucccaugugauuuaaacaaacaaacaaacaaacagaaguaacgaagcuaagaauau

SEQ ID NO: 131770 - RNA, 62 nt, hsa
uuuuuucuagucccaugugauuuaaacaaacaaacaaacaaacagaaguaacgaagcuaaga

SEQ ID NO: 131771 - RNA, 62 nt, hsa
ggauuuuuuucuagucccaugugauuuaaacaaacaaacaaacaaacagaaguaacgaagcu

SEQ ID NO: 131772 - RNA, 62 nt, hsa
uguaggauuuuuuucuagucccaugugauuuaaacaaacaaacaaacaaacagaaguaacga

SEQ ID NO: 131773 - RNA, 62 nt, hsa
cuagcccccuugaucccuaaagaaaacaaacaaacaaacaaaaacuguugcuauuuccuaac

SEQ ID NO: 131774 - RNA, 62 nt, hsa
ccuccuagcccccuugaucccuaaagaaaacaaacaaacaaacaaaaacuguugcuauuucc

SEQ ID NO: 131775 - RNA, 62 nt, hsa
uaacccuccuagcccccuugaucccuaaagaaaacaaacaaacaaacaaaaacuguugcuau

SEQ ID NO: 131776 - RNA, 62 nt, hsa
guuacaccucaagccccucagggguaacaacuaacaaacacccaaacuguuuggauugauug

SEQ ID NO: 131777 - RNA, 62 nt, hsa
acacaaugcaaagugagcgcagcauagcuguuaacaaacauacaacuuuuuucuagggcuuu

SEQ ID NO: 131778 - RNA, 62 nt, hsa
gcuuuuuguucuguuggugugauucaaagcaaaacaaacaaacaaaaacaaauuuuaagaac

SEQ ID NO: 131779 - RNA, 62 nt, hsa
uuuguucuguuggugugauucaaagcaaaacaaacaaacaaaaacaaauuuuaagaacacaa

SEQ ID NO: 131780 - RNA, 62 nt, hsa
ugaagucucuuuaugguuagagaagaccaaaaaacaaacaaacaaacuuagaaacauaaaag

SEQ ID NO: 131781 - RNA, 62 nt, hsa
gucucuuuaugguuagagaagaccaaaaaacaaacaaacaaacuuagaaacauaaaaggaaa

SEQ ID NO: 131782 - RNA, 62 nt, hsa
ggagcuggggccuggccuuucugcccauucucaacaaacacucuugucuggagacaggcagg

SEQ ID NO: 131783 - RNA, 62 nt, hsa
ccaguauaguggggacaaucaguuaauaagcaaacaaacacauuucuauuuauaaaugguga

SEQ ID NO: 131784 - RNA, 62 nt, hsa
agggccagccuuguuucucuaacaaacaaacaaacaaacagccuuguuucucuagucacauc

SEQ ID NO: 131785 - RNA, 62 nt, hsa
ccgcagggccagccuuguuucucuaacaaacaaacaaacaaacagccuuguuucucuaguca

SEQ ID NO: 131786 - RNA, 62 nt, hsa
ggggccgcagggccagccuuguuucucuaacaaacaaacaaacaaacagccuuguuucucua

SEQ ID NO: 131787 - RNA, 62 nt, hsa
gggcggggccgcagggccagccuuguuucucuaacaaacaaacaaacaaacagccuuguuuc

SEQ ID NO: 131788 - RNA, 62 nt, hsa
aucagaccaucugagcccacuacuaucaaacaaacaaacaaaaacuguuaauauauuagcca

SEQ ID NO: 131789 - RNA, 62 nt, hsa
ccaaaucagaccaucugagcccacuacuaucaaacaaacaaacaaaaacuguuaauauauua

SEQ ID NO: 131790 - RNA, 62 nt, hsa
cccuguaagcuaaacaaacaaacaaacaaacaaacaaacaguucuauauauaauaguuucaa

SEQ ID NO: 131791 - RNA, 62 nt, hsa
cuaucccuguaagcuaaacaaacaaacaaacaaacaaacaaacaguucuauauauaauaguu

SEQ ID NO: 131792 - RNA, 62 nt, hsa
ccaccuaucccuguaagcuaaacaaacaaacaaacaaacaaacaaacaguucuauauauaau

SEQ ID NO: 131793 - RNA, 62 nt, hsa
aaugccaccuaucccuguaagcuaaacaaacaaacaaacaaacaaacaaacaguucuauaua

SEQ ID NO: 131794 - RNA, 62 nt, hsa
uuauaaugccaccuaucccuguaagcuaaacaaacaaacaaacaaacaaacaaacaguucua

SEQ ID NO: 131795 - RNA, 62 nt, hsa
uuucuuauaaugccaccuaucccuguaagcuaaacaaacaaacaaacaaacaaacaaacagu

SEQ ID NO: 131796 - RNA, 62 nt, hsa
uuaugaacaaaacaaaacaacaacaaaaaacaaacaaacaaaaaagcuauggcacuagaauu

SEQ ID NO: 131797 - RNA, 62 nt, hsa
uuucuuaugaacaaaacaaaacaacaacaaaaaacaaacaaacaaaaaagcuauggcacuag

SEQ ID NO: 131798 - RNA, 62 nt, hsa
augaagauguuucaaaaaaucugaccaaaacaaacaaacagaaaacagaaaacaaaaaaacc

SEQ ID NO: 131799 - RNA, 62 nt, hsa
cacuaugaagauguuucaaaaaaucugaccaaaacaaacaaacagaaaacagaaaacaaaaa

SEQ ID NO: 131800 - RNA, 62 nt, hsa
guaaucugaaguaugguauuacaaaacaaacaaacaaacaaaaaacccauguguuaaaauac

SEQ ID NO: 131801 - RNA, 62 nt, hsa
uauuguaaucugaaguaugguauuacaaaacaaacaaacaaacaaaaaacccauguguuaaa

SEQ ID NO: 131802 - RNA, 62 nt, hsa
uggguauuguaaucugaaguaugguauuacaaaacaaacaaacaaacaaaaaacccaugugu

SEQ ID NO: 131803 - RNA, 62 nt, hsa
uuagauaaauuucaaucaggguuuuuagauuaaacaaacaaacaauuggguacccaguuaaa

SEQ ID NO: 131804 - RNA, 62 nt, hsa
auaaauuucaaucaggguuuuuagauuaaacaaacaaacaauuggguacccaguuaaauuuu

SEQ ID NO: 131805 - RNA, 62 nt, hsa
cugggugacagagucagacuccgucccaaaaaaacaaacaaacaaaacaaaacaaaaaaaaa

SEQ ID NO: 131806 - RNA, 62 nt, hsa
gugacagagucagacuccgucccaaaaaaacaaacaaacaaaacaaaacaaaaaaaaacaga

SEQ ID NO: 131807 - RNA, 62 nt, hsa
gaugauaagccuaaaaaaagcacaauuauuaaaacaaacagauccauguuaggacauuucug

SEQ ID NO: 131808 - RNA, 62 nt, hsa
aaggaaucugaagcacaggagaacacagagccaacaaacagaaugaagaacaaucaucuauu

SEQ ID NO: 131809 - RNA, 62 nt, hsa
aggaaggccuuuaggaagacaaauaaauaacaaacaaacagccacaaauacuuuuuuuucaa

SEQ ID NO: 131810 - RNA, 62 nt, hsa
guuuaggaaggccuuuaggaagacaaauaaauaacaaacaaacagccacaaauacuuuuuuu

SEQ ID NO: 131811 - RNA, 62 nt, hsa
auacaagaugugacacacccuucuuuauuugaaacaaacaaacauuuagcuagaccuuugcu

SEQ ID NO: 131812 - RNA, 62 nt, hsa
aagaugugacacacccuucuuuauuugaaacaaacaaacauuuagcuagaccuuugcuuccu

SEQ ID NO: 131813 - RNA, 62 nt, hsa
cuacuacaucuugccagaagguuucccucgccaacaaacaguugaaauuuaagggaagaagc

SEQ ID NO: 131814 - RNA, 62 nt, hsa
cagccugggugacagagcgagacuccgucucaaacaaacaaacaaaaaacuguuuucauuug

SEQ ID NO: 131815 - RNA, 62 nt, hsa
cugggugacagagcgagacuccgucucaaacaaacaaacaaaaaacuguuuucauuugcucu

SEQ ID NO: 131816 - RNA, 62 nt, hsa
ucugaaguaggacuuuuaccuuaaaaaacaacaacaaacaaaacuaucacacaggauagaua

SEQ ID NO: 131817 - RNA, 62 nt, hsa
ugugauacgcacaaacccuuugaaaauagcaaaacaaacaugcccuuuuucuaaaauugaua

SEQ ID NO: 131818 - RNA, 62 nt, hsa
gauaauaaacaucauuuuaaaagaucaaaacaaacaaacaaaaaaaacaagggugggugggg

SEQ ID NO: 131819 - RNA, 62 nt, hsa
uccugauaauaaacaucauuuuaaaagaucaaaacaaacaaacaaaaaaaacaagggugggu

SEQ ID NO: 131820 - RNA, 62 nt, hsa
uuuauuguauguaaggaaaaauuuuaccugaaaacaaacaaacaaacccuaaaacucagcac

SEQ ID NO: 131821 - RNA, 62 nt, hsa
uuguauguaaggaaaaauuuuaccugaaaacaaacaaacaaacccuaaaacucagcaccacu

SEQ ID NO: 131822 - RNA, 62 nt, hsa
ccagccuggcaacagagcuagaauccgucucaaacaaacaaacaaaaaaucccacagcuauu

SEQ ID NO: 131823 - RNA, 62 nt, hsa
ccuggcaacagagcuagaauccgucucaaacaaacaaacaaaaaaucccacagcuauuggau

SEQ ID NO: 131824 - RNA, 62 nt, hsa
ugggugacagacucugucuccaaaacaaaacaaacaaacaaaaagauuuuauuaaagauauu

SEQ ID NO: 131825 - RNA, 62 nt, hsa
aaccugggugacagacucugucuccaaaacaaaacaaacaaacaaaaagauuuuauuaaaga

SEQ ID NO: 131826 - RNA, 62 nt, hsa
auacuaaaaaggccaccuagcuuuuugcagauaacaaacaagaaagcuauuccaagacucag

SEQ ID NO: 131827 - RNA, 62 nt, hsa
acugagggguggcacgggaccacuccagguggaacaaacagaaaugacugugguguggaggg

SEQ ID NO: 131828 - RNA, 62 nt, hsa
gucuuguuugauaaugugggcauccacaaacaaacaaacaaauaacagaaacaaaaucugua

SEQ ID NO: 131829 - RNA, 62 nt, hsa
auuggucuuguuugauaaugugggcauccacaaacaaacaaacaaauaacagaaacaaaauc

SEQ ID NO: 131830 - RNA, 62 nt, hsa
aaguccugcuauguuaaaaacaaacaacaaaaaacaaacaacaaaaaaaaaauuaaaaaaaa

SEQ ID NO: 131831 - RNA, 62 nt, hsa
aaauaucaccaaagaaguccugcuauguuaaaaacaaacaacaaaaaacaaacaacaaaaaa

SEQ ID NO: 131832 - RNA, 62 nt, hsa
acuaagaagccuuaauacucuguaaacaaacaaacaaacaaaaaacaaccuuagcauuaaga

SEQ ID NO: 131833 - RNA, 62 nt, hsa
cuuuacuaagaagccuuaauacucuguaaacaaacaaacaaacaaaaaacaaccuuagcauu

SEQ ID NO: 131834 - RNA, 62 nt, hsa
caagcuuuacuaagaagccuuaauacucuguaaacaaacaaacaaacaaaaaacaaccuuag

SEQ ID NO: 131835 - RNA, 62 nt, hsa
ccuaguaacacauauguaguauaauuucuagaaacaaacaucuaauaaguauauaauccugu

SEQ ID NO: 131836 - RNA, 62 nt, hsa
ucaugugcaguagagaugcaguuucaucaaagaacaaacauccuugcaaaugggugugacgc

SEQ ID NO: 131837 - RNA, 62 nt, hsa
uggaaauguacauauccaauaugaaauacuaaaacaaacaaacaaacaaaaaaccagaaugc

SEQ ID NO: 131838 - RNA, 62 nt, hsa
aauguacauauccaauaugaaauacuaaaacaaacaaacaaacaaaaaaccagaaugcauug

SEQ ID NO: 131839 - RNA, 62 nt, hsa
uacauauccaauaugaaauacuaaaacaaacaaacaaacaaaaaaccagaaugcauuguaua

SEQ ID NO: 131840 - RNA, 62 nt, hsa
gaaagacugcaguugugcuaaaaacaaaacaaaacaaacaaacaaacaaaaaaguaaaaaaa

SEQ ID NO: 131841 - RNA, 62 nt, hsa
gacugcaguugugcuaaaaacaaaacaaaacaaacaaacaaacaaaaaaguaaaaaaagauu

SEQ ID NO: 131842 - RNA, 62 nt, hsa
gcaguugugcuaaaaacaaaacaaaacaaacaaacaaacaaaaaaguaaaaaaagauuacuu

SEQ ID NO: 131843 - RNA, 62 nt, hsa
uguaugacacccagcuuuaaaacaaacaaacaaacaaacaaaaaaagggugggggagggagg

SEQ ID NO: 131844 - RNA, 62 nt, hsa
gaaauguaugacacccagcuuuaaaacaaacaaacaaacaaacaaaaaaagggugggggagg

SEQ ID NO: 131845 - RNA, 62 nt, hsa
cucugaaauguaugacacccagcuuuaaaacaaacaaacaaacaaacaaaaaaagggugggg

SEQ ID NO: 131846 - RNA, 62 nt, hsa
ugcucucugaaauguaugacacccagcuuuaaaacaaacaaacaaacaaacaaaaaaagggu

SEQ ID NO: 131847 - RNA, 62 nt, hsa
uggcgaaauccccgucuuuacaaaaacaaacaaacaaacaaaaaagauauugcaguuguguu

SEQ ID NO: 131848 - RNA, 62 nt, hsa
aacguggcgaaauccccgucuuuacaaaaacaaacaaacaaacaaaaaagauauugcaguug

SEQ ID NO: 131849 - RNA, 62 nt, hsa
gggcaacguggcgaaauccccgucuuuacaaaaacaaacaaacaaacaaaaaagauauugca

SEQ ID NO: 131850 - RNA, 62 nt, hsa
gaauucuuacuucauuaugaauguauuuaaaaaacaaacaccaaauaauuggaauauauugc

SEQ ID NO: 131851 - RNA, 62 nt, hsa
gcagguaugcguaaguguguaugcuuguuuuaaacaaacacucaacguacauauguacauaa

SEQ ID NO: 131852 - RNA, 62 nt, hsa
uugaaagaacaaaacaaaacaaaacaaacacaaacaaacaaaaaaccuucaacugccuuaug

SEQ ID NO: 131853 - RNA, 62 nt, hsa
uuggugcugauugaaagaacaaaacaaaacaaaacaaacacaaacaaacaaaaaaccuucaa

SEQ ID NO: 131854 - RNA, 62 nt, hsa
uguauuuucucuggcuuuaaaauuuuaaaacaaacaaacaaaaaagccauagagagcagaac

SEQ ID NO: 131855 - RNA, 62 nt, hsa
uguguguauuuucucuggcuuuaaaauuuuaaaacaaacaaacaaaaaagccauagagagca

SEQ ID NO: 131856 - RNA, 62 nt, hsa
augguguaagucuuugacaagaaaaaaaaacaaacaaacacuucuuuccaucaguaacacug

SEQ ID NO: 131857 - RNA, 62 nt, hsa
aacuaugguguaagucuuugacaagaaaaaaaaacaaacaaacacuucuuuccaucaguaac

SEQ ID NO: 131858 - RNA, 62 nt, hsa
gccugggugacagagugaaacucguaucuccaaacaaacaaacaaaaaguccuuaaacauau

SEQ ID NO: 131859 - RNA, 62 nt, hsa
gggugacagagugaaacucguaucuccaaacaaacaaacaaaaaguccuuaaacauauguga

SEQ ID NO: 131860 - RNA, 62 nt, hsa
gugucaagggucccucgcauucuuuuacuguaaacaaacaaugccuuaaauugugucuuguu

SEQ ID NO: 131861 - RNA, 62 nt, hsa
ucugaucccugcccucauggaccugaccacucaacaaacaguccccaccacaccuaucuccu

SEQ ID NO: 131862 - RNA, 62 nt, hsa
cauuucuagccuucuuuuuagagucaacugccaacaaacacacaguaaucacucuguacaca

SEQ ID NO: 131863 - RNA, 62 nt, hsa
uacagggaaugaguaacuuugaguggagaagaaacaaacauaguggguauaaucauggaucg

SEQ ID NO: 131864 - RNA, 62 nt, hsa
aagacuaaaauuuugccuauaccuuuaagacaaacaaacaaacacacacacaaacaagcucu

SEQ ID NO: 131865 - RNA, 62 nt, hsa
cuaaaauuuugccuauaccuuuaagacaaacaaacaaacacacacacaaacaagcucuaagc

SEQ ID NO: 131866 - RNA, 62 nt, hsa
uagcuucuugucuuaggccugaaccaaaaaacaacaaacaaacaaaaaacaagaaugaaaaa

SEQ ID NO: 131867 - RNA, 62 nt, hsa
uucuugucuuaggccugaaccaaaaaacaacaaacaaacaaaaaacaagaaugaaaaacaga

SEQ ID NO: 131868 - RNA, 62 nt, hsa
acuucaggucuuaagugcaaaucaaagcaaaaaacaaacaaaacuuacauggaaaaacugua

SEQ ID NO: 131869 - RNA, 62 nt, hsa
uucucaaaggucucagaccuacaaagaguuaaaacaaacagacaaacaaaaaaaaacacuac

SEQ ID NO: 131870 - RNA, 62 nt, hsa
cuuuucuuuguuuguuuguuuuuuucucuaaaaacaaacagcaaaagacagcugaaaacaag

SEQ ID NO: 131871 - RNA, 62 nt, hsa
ggaaaaucugaauggaggcagcaaacagccaaaacaaacauuccccacccggcccugugcau

SEQ ID NO: 131872 - RNA, 62 nt, hsa
acgaagcauugauguuauggaagaaagaaagaaacaaacaaaauauauauauauauguccaa

SEQ ID NO: 131873 - RNA, 62 nt, hsa
cgacggagcgagacucugucucaaaacaaacaaacaaacaaaagacccaaucugagucuuau

SEQ ID NO: 131874 - RNA, 62 nt, hsa
ugggcgacggagcgagacucugucucaaaacaaacaaacaaacaaaagacccaaucugaguc

SEQ ID NO: 131875 - RNA, 62 nt, hsa
agccugggcgacggagcgagacucugucucaaaacaaacaaacaaacaaaagacccaaucug

SEQ ID NO: 131876 - RNA, 62 nt, hsa
uaaaauauaaacaaucaaaauccaaacaaacaaacaaacacucacugcaucgggacuuuuua

SEQ ID NO: 131877 - RNA, 62 nt, hsa
aacauaaaauauaaacaaucaaaauccaaacaaacaaacaaacacucacugcaucgggacuu

SEQ ID NO: 131878 - RNA, 62 nt, hsa
acaaaacauaaaauauaaacaaucaaaauccaaacaaacaaacaaacacucacugcaucggg

SEQ ID NO: 131879 - RNA, 62 nt, hsa
cccuuuggcuucugauuuuucucuuuuuuaaaaacaaacaaacaaacuguugcagauuauga

SEQ ID NO: 131880 - RNA, 62 nt, hsa
uuggcuucugauuuuucucuuuuuuaaaaacaaacaaacaaacuguugcagauuaugaguga

SEQ ID NO: 131881 - RNA, 62 nt, hsa
uuguggucugugcuugcucagaaaaacaaacaaacaaacaguuuuuccaauuauaaauaaau

SEQ ID NO: 131882 - RNA, 62 nt, hsa
gugcuuguggucugugcuugcucagaaaaacaaacaaacaaacaguuuuuccaauuauaaau

SEQ ID NO: 131883 - RNA, 62 nt, hsa
ugacgugcuuguggucugugcuugcucagaaaaacaaacaaacaaacaguuuuuccaauuau

SEQ ID NO: 131884 - RNA, 62 nt, hsa
uaaucacaaccucaaguguuaaaacaaaaacaaacaaacacguuuguagguucuuacuggac

SEQ ID NO: 131885 - RNA, 62 nt, hsa
uguuuaaucacaaccucaaguguuaaaacaaaaacaaacaaacacguuuguagguucuuacu

SEQ ID NO: 131886 - RNA, 62 nt, hsa
auuccuugagaauguauuuaucugaagaucaaaacaaacaauccagauguauaaguacuagg

SEQ ID NO: 131887 - RNA, 62 nt, hsa
ucagauuuggggaaaugacauuuuuauacuaaaacaaacaccaaaauauuuuagaauaaauu

SEQ ID NO: 131888 - RNA, 62 nt, hsa
agagagacuccaucucaaaacaaaaacaaacaaacaaacagaaagcaccgucgagaaauggc

SEQ ID NO: 131889 - RNA, 62 nt, hsa
acagagagagacuccaucucaaaacaaaaacaaacaaacaaacagaaagcaccgucgagaaa

SEQ ID NO: 131890 - RNA, 62 nt, hsa
ggcgacagagagagacuccaucucaaaacaaaaacaaacaaacaaacagaaagcaccgucga

SEQ ID NO: 131891 - RNA, 62 nt, hsa
guaaagagaaaugccuagugucuauuuuauuaaacaaacaaacacagaguuugaacuauaau

SEQ ID NO: 131892 - RNA, 62 nt, hsa
agagaaaugccuagugucuauuuuauuaaacaaacaaacacagaguuugaacuauaauacua

SEQ ID NO: 131893 - RNA, 62 nt, hsa
aaaaaaaacugucagagcgaauucaugcauucaacaaacacuuaugagugccuggaguaugc

SEQ ID NO: 131894 - RNA, 62 nt, hsa
aagugcugagaagguuauggguaccaggaagaaacaaacagaagucuuaagauuagaaugag

SEQ ID NO: 131895 - RNA, 62 nt, hsa
gcaauuuuaaaacagacuccuuuaaaaaaacaaacaaacaaaaaaaacauagacuucuuuau

SEQ ID NO: 131896 - RNA, 62 nt, hsa
auaggcaauuuuaaaacagacuccuuuaaaaaaacaaacaaacaaaaaaaacauagacuucu

SEQ ID NO: 131897 - RNA, 62 nt, hsa
gacucugucucaaaaaaaaaaaaacaaaaacaaacaaacaaaaaaaacaccucaccaugagu

SEQ ID NO: 131898 - RNA, 62 nt, hsa
guaagacucugucucaaaaaaaaaaaaacaaaaacaaacaaacaaaaaaaacaccucaccau

SEQ ID NO: 131899 - RNA, 62 nt, hsa
acuuccuugaaaauuuuauuaaaaaacaaacaaacaaacaaaaagccuguccacccuugaga

SEQ ID NO: 131900 - RNA, 62 nt, hsa
aaucacuuccuugaaaauuuuauuaaaaaacaaacaaacaaacaaaaagccuguccacccuu

SEQ ID NO: 131901 - RNA, 62 nt, hsa
aagaaaucacuuccuugaaaauuuuauuaaaaaacaaacaaacaaacaaaaagccuguccac

SEQ ID NO: 131902 - RNA, 62 nt, hsa
ugaaaaugagccuuuggaccagucuuuauuaaaacaaacaaacaugaguagucugcauaucg

SEQ ID NO: 131903 - RNA, 62 nt, hsa
aaugagccuuuggaccagucuuuauuaaaacaaacaaacaugaguagucugcauaucgaaua

SEQ ID NO: 131904 - RNA, 62 nt, hsa
ucugaauaaguugguuuuagagggaaagguucaacaaacagggagaauccaguguuucugcu

SEQ ID NO: 131905 - RNA, 62 nt, hsa
uuuguaauucuggaugaaagauaacuguguugaacaaacaggugcuccaggcuuugauuaua

SEQ ID NO: 131906 - RNA, 62 nt, hsa
acauucccuagauucaaaggcaaaacagaagaaacaaacaaacaaacaaaaaaagcuugcaa

SEQ ID NO: 131907 - RNA, 62 nt, hsa
ucccuagauucaaaggcaaaacagaagaaacaaacaaacaaacaaaaaaagcuugcaaaaua

SEQ ID NO: 131908 - RNA, 62 nt, hsa
uagauucaaaggcaaaacagaagaaacaaacaaacaaacaaaaaaagcuugcaaaauauuuu

SEQ ID NO: 131909 - RNA, 62 nt, hsa
guguucuuuugccuucaaucuguugucuucaaaacaaacaaacaaaaaaagcuucuugcgcc

SEQ ID NO: 131910 - RNA, 62 nt, hsa
ucuuuugccuucaaucuguugucuucaaaacaaacaaacaaaaaaagcuucuugcgccuuuc

SEQ ID NO: 131911 - RNA, 62 nt, hsa
aaaaaaaaaaaaaaaaaaaaauccuaaaaacaaacaaacaaaaaaaacaauucuucauucag

SEQ ID NO: 131912 - RNA, 62 nt, hsa
aaaaaaaaaaaaaaaaaaaaaaaaauccuaaaaacaaacaaacaaaaaaaacaauucuucau

SEQ ID NO: 131913 - RNA, 62 nt, hsa
acugagcugcuuuaguccuugagaaauugugaaacaaacacaaauaucauaaaaggagcugg

SEQ ID NO: 131914 - RNA, 62 nt, hsa
gaauuuggaaauaaaaagaaaaaaaaaacaaaaacaaacaggcugccauaauauauuuuuuu

SEQ ID NO: 131915 - RNA, 62 nt, hsa
caggauaauuuuuaaaccaaucaaaugaaaaaaacaaacaaacaaaaaaggaaaugucaugu

SEQ ID NO: 131916 - RNA, 62 nt, hsa
auaauuuuuaaaccaaucaaaugaaaaaaacaaacaaacaaaaaaggaaaugucaugugagg

SEQ ID NO: 131917 - RNA, 62 nt, hsa
augacagagugagacccuguuucuaaaaacaaaacaaacaaacaaacaaacaacguaucuua

SEQ ID NO: 131918 - RNA, 62 nt, hsa
cagagugagacccuguuucuaaaaacaaaacaaacaaacaaacaaacaacguaucuuacuga

SEQ ID NO: 131919 - RNA, 62 nt, hsa
gugagacccuguuucuaaaaacaaaacaaacaaacaaacaaacaacguaucuuacugacuaa

SEQ ID NO: 131920 - RNA, 62 nt, hsa
gacccuguuucuaaaaacaaaacaaacaaacaaacaaacaacguaucuuacugacuaaacug

SEQ ID NO: 131921 - RNA, 62 nt, hsa
acuccuccuaccccccaagguaagaaacaaaaaacaaacaaacaaacaaaaauagaagacaa

SEQ ID NO: 131922 - RNA, 62 nt, hsa
cuccuaccccccaagguaagaaacaaaaaacaaacaaacaaacaaaaauagaagacaaaaga

SEQ ID NO: 131923 - RNA, 62 nt, hsa
uaccccccaagguaagaaacaaaaaacaaacaaacaaacaaaaauagaagacaaaagaaaga

SEQ ID NO: 131924 - RNA, 62 nt, hsa
gugacagagcaagaccccaucucaaaaaaaaaaacaaacaaacaaaaaaaaaaccauauaua

SEQ ID NO: 131925 - RNA, 62 nt, hsa
cagagcaagaccccaucucaaaaaaaaaaacaaacaaacaaaaaaaaaaccauauauauaca

SEQ ID NO: 131926 - RNA, 62 nt, hsa
uauauaucuauauaaauuaaaacaaagaaacaaacaaacaaaaaacaagacaaacaacuaca

SEQ ID NO: 131927 - RNA, 62 nt, hsa
aauauauauaucuauauaaauuaaaacaaagaaacaaacaaacaaaaaacaagacaaacaac

SEQ ID NO: 131928 - RNA, 62 nt, hsa
gucauuuuguuuuaugacagacacacguaucuaacaaacaaacaaacagugaccuucuccau

SEQ ID NO: 131929 - RNA, 62 nt, hsa
uuuuguuuuaugacagacacacguaucuaacaaacaaacaaacagugaccuucuccaugggu

SEQ ID NO: 131930 - RNA, 62 nt, hsa
guuuuaugacagacacacguaucuaacaaacaaacaaacagugaccuucuccaugggucaag

SEQ ID NO: 131931 - RNA, 62 nt, hsa
uaagguuuucuggcuuauugaggaaauuuccuaacaaacaaacaaacaaacaaacagaagag

SEQ ID NO: 131932 - RNA, 62 nt, hsa
guuuucuggcuuauugaggaaauuuccuaacaaacaaacaaacaaacaaacagaagagaaga

SEQ ID NO: 131933 - RNA, 62 nt, hsa
ucuggcuuauugaggaaauuuccuaacaaacaaacaaacaaacaaacagaagagaagaucau

SEQ ID NO: 131934 - RNA, 62 nt, hsa
gcuuauugaggaaauuuccuaacaaacaaacaaacaaacaaacagaagagaagaucauuaac

SEQ ID NO: 131935 - RNA, 62 nt, hsa
auugaggaaauuuccuaacaaacaaacaaacaaacaaacagaagagaagaucauuaaccacu

SEQ ID NO: 131936 - RNA, 62 nt, hsa
ugggcgacagaucaagacucugucacacacaaaacaaacaaacaaauuuucccguuucucuc

SEQ ID NO: 131937 - RNA, 62 nt, hsa
cgacagaucaagacucugucacacacaaaacaaacaaacaaauuuucccguuucucucuguc

SEQ ID NO: 131938 - RNA, 62 nt, hsa
gcaccacggcaagaaaaccaaaaaccaaaacaaacaaacaaaaaaaacccaacaacaaccca

SEQ ID NO: 131939 - RNA, 62 nt, hsa
uuuugcaccacggcaagaaaaccaaaaaccaaaacaaacaaacaaaaaaaacccaacaacaa

SEQ ID NO: 131940 - RNA, 62 nt, hsa
aauccguuuuucccuuuuccuuuuuuuaaacaaacaaacauacaaaaaaaaaaaaaaaaaaa

SEQ ID NO: 131941 - RNA, 62 nt, hsa
cuagaauccguuuuucccuuuuccuuuuuuuaaacaaacaaacauacaaaaaaaaaaaaaaa

SEQ ID NO: 131942 - RNA, 62 nt, hsa
uuuuuuuuuuaacauggaacaaugaaaccaacaacaaacauuuuuaaaauuaaaauggauaa

SEQ ID NO: 131943 - RNA, 62 nt, hsa
uuacauugccagauaaaaaguguuacuuaaccaacaaacaaauguaagacuacaaaaucguu

SEQ ID NO: 131944 - RNA, 62 nt, hsa
uuaagacuaagacuuugaagguaaaacaaacaaacaaacaucagucuuagucucuugcuagu

SEQ ID NO: 131945 - RNA, 62 nt, hsa
caauuuaagacuaagacuuugaagguaaaacaaacaaacaaacaucagucuuagucucuugc

SEQ ID NO: 131946 - RNA, 62 nt, hsa
uugucaauuuaagacuaagacuuugaagguaaaacaaacaaacaaacaucagucuuagucuc

SEQ ID NO: 131947 - RNA, 62 nt, hsa
aggauggaggaagaucuacgaagcaaauggaaaacaaacaaaaaaagaggcagggguugcaa

SEQ ID NO: 131948 - RNA, 62 nt, hsa
gaaucuacaaugaacucaaacaaauuuacaggaacaaacaaccccaucaaaaagucggcaaa

SEQ ID NO: 131949 - RNA, 62 nt, hsa
cuccucgcucugugaacucuuuagacacacaaaacaaacaaacacaugggggagagagacuu

SEQ ID NO: 131950 - RNA, 62 nt, hsa
ucgcucugugaacucuuuagacacacaaaacaaacaaacacaugggggagagagacuuggaa

SEQ ID NO: 131951 - RNA, 62 nt, hsa
ccugggcaacagagggagcccccgucucaacaaacaaacaaaaagagccagugggggaggga

SEQ ID NO: 131952 - RNA, 62 nt, hsa
ccagccugggcaacagagggagcccccgucucaacaaacaaacaaaaagagccaguggggga

SEQ ID NO: 131953 - RNA, 62 nt, hsa
agacuccaacucagaaaaagcaaaacaaaacaaacaaacaagcaaaaaaccacaauuagacu

SEQ ID NO: 131954 - RNA, 62 nt, hsa
agcgagacuccaacucagaaaaagcaaaacaaaacaaacaaacaagcaaaaaaccacaauua

SEQ ID NO: 131955 - RNA, 62 nt, hsa
gaaagccuggcgauaccccaucucuauuuagaaacaaacaaacaaacaaauaaaaaaccugg

SEQ ID NO: 131956 - RNA, 62 nt, hsa
gccuggcgauaccccaucucuauuuagaaacaaacaaacaaacaaauaaaaaaccuggcacc

SEQ ID NO: 131957 - RNA, 62 nt, hsa
ccugagugacagagcgagacccugucucaaaaaacaaacaaacaaacaaacaaaaacagaac

SEQ ID NO: 131958 - RNA, 62 nt, hsa
agugacagagcgagacccugucucaaaaaacaaacaaacaaacaaacaaaaacagaacauuc

SEQ ID NO: 131959 - RNA, 62 nt, hsa
acagagcgagacccugucucaaaaaacaaacaaacaaacaaacaaaaacagaacauucuggg

SEQ ID NO: 131960 - RNA, 62 nt, hsa
agcgagacccugucucaaaaaacaaacaaacaaacaaacaaaaacagaacauucugggcacg

SEQ ID NO: 131961 - RNA, 62 nt, hsa
gcuucaauuagaauuauuuuucucaaaaaacaaacaaacaaaaaacacaaaaaaaaccacuc

SEQ ID NO: 131962 - RNA, 62 nt, hsa
ugaggcuucaauuagaauuauuuuucucaaaaaacaaacaaacaaaaaacacaaaaaaaacc

SEQ ID NO: 131963 - RNA, 62 nt, hsa
agacauugcuggaguugacuuucuucuguccaaacaaacaaacaaaaacuaaacacacacac

SEQ ID NO: 131964 - RNA, 62 nt, hsa
auugcuggaguugacuuucuucuguccaaacaaacaaacaaaaacuaaacacacacacaaac

SEQ ID NO: 131965 - RNA, 62 nt, hsa
agccuggugacagaacgagacucugucuuaaaaacaaacaaacaaaaaaaaaaucuguuaga

SEQ ID NO: 131966 - RNA, 62 nt, hsa
uggugacagaacgagacucugucuuaaaaacaaacaaacaaaaaaaaaaucuguuagauaag

SEQ ID NO: 131967 - RNA, 62 nt, hsa
ccagacuccgucucuaaacaaacaaacaaacaaacaaacaaauaaagaaagaacauuggaca

SEQ ID NO: 131968 - RNA, 62 nt, hsa
agagccagacuccgucucuaaacaaacaaacaaacaaacaaacaaauaaagaaagaacauug

SEQ ID NO: 131969 - RNA, 62 nt, hsa
caacagagccagacuccgucucuaaacaaacaaacaaacaaacaaacaaauaaagaaagaac

SEQ ID NO: 131970 - RNA, 62 nt, hsa
ugggcaacagagccagacuccgucucuaaacaaacaaacaaacaaacaaacaaauaaagaaa

SEQ ID NO: 131971 - RNA, 62 nt, hsa
agccugggcaacagagccagacuccgucucuaaacaaacaaacaaacaaacaaacaaauaaa

SEQ ID NO: 131972 - RNA, 62 nt, hsa
cucuauagcaagaugaagaggaaaaacaaacaaacaaacaaaaaaaaacacaaaaaaagaaa

SEQ ID NO: 131973 - RNA, 62 nt, hsa
ggaacucuauagcaagaugaagaggaaaaacaaacaaacaaacaaaaaaaaacacaaaaaaa

SEQ ID NO: 131974 - RNA, 62 nt, hsa
uagaggaacucuauagcaagaugaagaggaaaaacaaacaaacaaacaaaaaaaaacacaaa

SEQ ID NO: 131975 - RNA, 62 nt, hsa
uguugauaaugggcuuuguuagcacuuuuuaaaacaaacaaacaaacaaaacaaaaaagcaa

SEQ ID NO: 131976 - RNA, 62 nt, hsa
gauaaugggcuuuguuagcacuuuuuaaaacaaacaaacaaacaaaacaaaaaagcaaacca

SEQ ID NO: 131977 - RNA, 62 nt, hsa
augggcuuuguuagcacuuuuuaaaacaaacaaacaaacaaaacaaaaaagcaaaccacauu

SEQ ID NO: 131978 - RNA, 62 nt, hsa
auuccaucugaaaaacaaaaacaaaaacagaaaacaaacaaacaaaaaacaaaaaaucccca

SEQ ID NO: 131979 - RNA, 62 nt, hsa
caucugaaaaacaaaaacaaaaacagaaaacaaacaaacaaaaaacaaaaaauccccacaac

SEQ ID NO: 131980 - RNA, 62 nt, hsa
aucuucuauaguagguuaauggaaaauacaaaaacaaacaaacauacaaugaaacugccucc

SEQ ID NO: 131981 - RNA, 62 nt, hsa
ucuauaguagguuaauggaaaauacaaaaacaaacaaacauacaaugaaacugccuccucuc

SEQ ID NO: 131982 - RNA, 62 nt, hsa
aaaaaacucagccaacagguaguauugguaaaaacaaacaaacaaaaauccuuugcccucag

SEQ ID NO: 131983 - RNA, 62 nt, hsa
aacucagccaacagguaguauugguaaaaacaaacaaacaaaaauccuuugcccucagaagu

SEQ ID NO: 131984 - RNA, 62 nt, hsa
uugguggauuagacagguuaaauauauaaacaaacaaacaaaaauugcucaaaaaagaggag

SEQ ID NO: 131985 - RNA, 62 nt, hsa
cuucuugguggauuagacagguuaaauauauaaacaaacaaacaaaaauugcucaaaaaaga

SEQ ID NO: 131986 - RNA, 62 nt, hsa
aaaaaguuguuuauaaaaaccccuaaaaacaaaacaaacacacacacacacacauacacaca

SEQ ID NO: 131987 - RNA, 62 nt, hsa
ccaucucaaaacaaaacaaaacaaaacaaacaaacaaacaaaacuugcaucuaaccaaaaag

SEQ ID NO: 131988 - RNA, 62 nt, hsa
aacuccaucucaaaacaaaacaaaacaaaacaaacaaacaaacaaaacuugcaucuaaccaa

SEQ ID NO: 131989 - RNA, 62 nt, hsa
acgaaacuccaucucaaaacaaaacaaaacaaaacaaacaaacaaacaaaacuugcaucuaa

SEQ ID NO: 131990 - RNA, 62 nt, hsa
gaaaauguaaaagaccacaauuguucuucaaaaacaaacaaaacaaaacaaaacaaaauuaa

SEQ ID NO: 131991 - RNA, 62 nt, hsa
caaaaguucaaauuugucagugacauuuaccaaacaaacaggcagaguucacuauucuaucu

SEQ ID NO: 131992 - RNA, 62 nt, hsa
uauugucggcaggcggugagggguagaaaaaaaacaaacaaacaaacagaaaaaaaaaccaa

SEQ ID NO: 131993 - RNA, 62 nt, hsa
gucggcaggcggugagggguagaaaaaaaacaaacaaacaaacagaaaaaaaaaccaaaaaa

SEQ ID NO: 131994 - RNA, 62 nt, hsa
gcaggcggugagggguagaaaaaaaacaaacaaacaaacagaaaaaaaaaccaaaaaaaacc

SEQ ID NO: 131995 - RNA, 64 nt, hsa
uguugauaaauuccacuggacuugagcuuggcagcugaacuauuggagggugggagagcccagc

SEQ ID NO: 131996 - RNA, 64 nt, hsa
ccacucagacaguguacaaacuaagaaggccuaacugaacuaagccauauuuaucacccgugga

SEQ ID NO: 131997 - RNA, 64 nt, hsa
uuccugccacuguguaacauagcugagguaaaaacugaacuauguaaaugacucuacuaaaagu

SEQ ID NO: 131998 - RNA, 64 nt, hsa
cccuugcccugccaagcucccugcccuguugaugcugaacuacagccuugggacaggcaggcuu

SEQ ID NO: 131999 - RNA, 64 nt, hsa
auucauucauucagcaaauaaucugaaauccagucugaacuaaggccugagcuguggauaccau

SEQ ID NO: 132000 - RNA, 64 nt, hsa
uauaagaauuuugcuuuagagaaugccacuuuggcugaacuacaaguguaggccaccauuauaa

SEQ ID NO: 132001 - RNA, 64 nt, hsa
gcacuagaugauuacgaagaucacaucccacucucugaacuacaaucacugugcucccuggggg

SEQ ID NO: 132002 - RNA, 64 nt, hsa
auuagccaugacuguauuggacuuugaacauuuucugaacuaaaaaccucuauucuaaacuaau

SEQ ID NO: 132003 - RNA, 64 nt, hsa
aaaaugaccagacaccuguuugauaaauaguuuacugaacuagcagacguguggaaaaagaauc

SEQ ID NO: 132004 - RNA, 64 nt, hsa
acauauacauaaauuuucagcuauuucuguuccccugaacuaauuugagauuagacccaaacau

SEQ ID NO: 132005 - RNA, 64 nt, hsa
ucuuuauuuuuauucgcacaucccaccccauccccugaacuacuugggagguggggagggguac

SEQ ID NO: 132006 - RNA, 64 nt, hsa
uucaaauuaaguagaaagugagacucaauaauaacugaacuacagcaaaaggcagagaauuaca

SEQ ID NO: 132007 - RNA, 64 nt, hsa
guguuuuuugacaaucacuuccuuaaagacucuucugaacuaguuggaccugguuaaucauaga

SEQ ID NO: 132008 - RNA, 64 nt, hsa
ucaucagaaagacacuaaucugacuucaagaauucugaacuauuaaauagaaaauuuaaaugcu

SEQ ID NO: 132009 - RNA, 64 nt, hsa
caaugaggguauuuuugagugaauuuuaacugcucugaacuaaguauaagcucaugggccugca

SEQ ID NO: 132010 - RNA, 64 nt, hsa
acuacauaggucuuaccauugaccuaagaucaaucugaacuaucuuagcccagucagggagcuc

SEQ ID NO: 132011 - RNA, 64 nt, hsa
gacuuugccauaaugauagacucaauuuagcucucugaacuaguugguaauuuuuuuuuuuuaa

SEQ ID NO: 132012 - RNA, 64 nt, hsa
augugucuugcggcagcugcagcaaguggaggggcugaacuacuggccagcucacuggaugaug

SEQ ID NO: 132013 - RNA, 64 nt, hsa
uuucuguagucaaaguauaccaaaaccaauuuaucugaacuaaauucuaaaguaugguuauaca

SEQ ID NO: 132014 - RNA, 64 nt, hsa
gccuacaacaggcagguacugcugccagggggcucugaacuagugccugcuacccaggacaccc

SEQ ID NO: 132015 - RNA, 64 nt, hsa
gagggggguggccacaggagauggggagaggagucugaacuaaaccccuggcuuuugugcacac

SEQ ID NO: 132016 - RNA, 64 nt, hsa
gggggccacauuucaccuccuuagucccccuggucugaacuaguugagagaguaguuuugaaca

SEQ ID NO: 132017 - RNA, 64 nt, hsa
ugaacaaauccacagaauggguaaagaguagaaucugaacuauaucuugacaaauauuauucaa

SEQ ID NO: 132018 - RNA, 64 nt, hsa
uccgcgcugccccugcccugccucuguccuggcucugaacuaguagaugauggugccagagggc

SEQ ID NO: 132019 - RNA, 64 nt, hsa
auuaacuugagcauaagauaugagauacaugaaccugaacuauuaaaauaaaauauuauauuua

SEQ ID NO: 132020 - RNA, 64 nt, hsa
aaugaagauuuauaccauugugguuuaagcuguacugaacuaaaucuguggaaugcauugugaa

SEQ ID NO: 132021 - RNA, 64 nt, hsa
gccagugacugcugcgcugugcuggucucuaggccugaacuaggugcuggcaugucugggucgu

SEQ ID NO: 132022 - RNA, 64 nt, hsa
aaacccagauccucugguccaaguuguaugugcacugaacuaaucaggcaggaaaaaagcccag

SEQ ID NO: 132023 - RNA, 64 nt, hsa
caguugugcaacaauaugaauauacauaacaauacugaacuauacacugaaaugguuaagaugg

SEQ ID NO: 132024 - RNA, 64 nt, hsa
auuaaccucugcaugugaaaacuuuuaacaguuacugaacuauguaaauaugugaauuuuuuua

SEQ ID NO: 132025 - RNA, 64 nt, hsa
ugugccugacuaagaugugaccagcucaggcagacugaacuaagcaccccucccauccugcgac

SEQ ID NO: 132026 - RNA, 64 nt, hsa
ugaaagagaaaagaaaacucagaaagggaugaaucugaacuauaugauuacuuguagucagaau

SEQ ID NO: 132027 - RNA, 64 nt, hsa
cuuuucucuggcacuccagucccaggccuugggccugaacuacuggaaaaggucuggcggcugg

SEQ ID NO: 132028 - RNA, 64 nt, hsa
aggguucccuggcaggggaagcugagagccauggcugaacuaucagggacaaaggcccaugucc

SEQ ID NO: 132029 - RNA, 64 nt, hsa
cugcagugcaaacccucuuccgcugagcagcugucugaacuauaggccccagugcugaagacca

SEQ ID NO: 132030 - RNA, 64 nt, hsa
agagagggaguauuguauugggaagaaaauguuacugaacuauugacugaaaguaaauuuagau

SEQ ID NO: 132031 - RNA, 64 nt, hsa
caauaccugucaccaugcagccgcugauaguucucugaacuaaaaggacuaauuguacuuugag

SEQ ID NO: 132032 - RNA, 64 nt, hsa
auauuagaagcaauuauaauuacaucugugauuucugaacuaauggugcuaauucagagaaaug

SEQ ID NO: 132033 - RNA, 64 nt, hsa
aacagaaagaacucaggacauauuaaaaaauaaacugaacuaaaacaacuuuugcccccugacu

SEQ ID NO: 132034 - RNA, 64 nt, hsa
uaagcugaauuagucauguccauucagacauaaccugaacuacugaaaagaucaauuuccagaa

SEQ ID NO: 132035 - RNA, 64 nt, hsa
ggcgguggcagugggugccuguagugugaugugucugaacuaauaaaguggcugaagaggcagg

SEQ ID NO: 132036 - RNA, 64 nt, hsa
uaguaaaaaguaguauuguguauuugcucaguaucugaacuauaagcccauuuauacuguucca

SEQ ID NO: 132037 - RNA, 64 nt, hsa
gagggaaggacagacaucaagugccagauguugucugaacuaaucgagcacuucucaccaaacu

SEQ ID NO: 132038 - RNA, 64 nt, hsa
ugagggccuccacacugccuggcagaacauaccacugaacuaguaugugcuagaggagggcaca

SEQ ID NO: 132039 - RNA, 64 nt, hsa
uuuugccccuugcagugggacgccuucagcaugccugaacuacauaacuuccuacguauccugc

SEQ ID NO: 132040 - RNA, 64 nt, hsa
gcaguccuguggcugaggggcacagauugaacugcugaacuaguuggaggucuagaugaggugc

SEQ ID NO: 132041 - RNA, 64 nt, hsa
ccacucuaaucauuggccucaugauugaagcauccugaacuaugaauuagacaucaguuagcaa

SEQ ID NO: 132042 - RNA, 55 nt, hsa; identical to SEQ ID NO: 116681

SEQ ID NO: 132043 - RNA, 64 nt, hsa
cgucugacaugaaaacuucucaccgccucagcagcugaacuaaaaaccugaauagccaugacaa

SEQ ID NO: 132044 - RNA, 64 nt, hsa
caugggaauauucagucaaggagcagacuuuggucugaacuagccauugaugauuguuaaguuu

SEQ ID NO: 132045 - RNA, 64 nt, hsa
auauuguaugcaaucuuuauguguaacuccaaaacugaacuauaagauaauucauaagaauuug

SEQ ID NO: 132046 - RNA, 64 nt, hsa
gcugcucuugaagaagaaaaacgaagacaacaggcugaacuagaagcuuuugaaaacagacuga

SEQ ID NO: 132047 - RNA, 64 nt, hsa
cauaugacaaagccucaauuacuaauuguaaaaacugaacuauucccagaaucauguucaaaaa

SEQ ID NO: 132048 - RNA, 64 nt, hsa
auauucucaaguccuuuuacaaucagugugucuccugaacuagcacacaggcuguagaaacagu

SEQ ID NO: 132049 - RNA, 64 nt, hsa
gccucauaguuauuauccagaggacccaacugaacugaacuaauccuucuggcagauucaaauc

SEQ ID NO: 132050 - RNA, 64 nt, hsa
gacuucaucugaaugugcucugccgccuucuuaucugaacuagaugaauuggccauaauuauga

SEQ ID NO: 132051 - RNA, 64 nt, hsa
uccauuuuaguagggauucacugacuagauuuuacugaacuaugaaaauaaauacacauaauuu

SEQ ID NO: 132052 - RNA, 64 nt, hsa
uguaacuguaaaacauugaaugaaacuauuuuaccugaacuagauuuuaucugaaaguagguag

SEQ ID NO: 132053 - RNA, 64 nt, hsa
aaggagccccagauaaacaugauggggaaaagcacugaacuaagagucccaugguuucucuucu

SEQ ID NO: 132054 - RNA, 64 nt, hsa
guguagcuggucagggacuuuuuuuucuuuucuccugaacuacaugauucuaauuggaauguuc

SEQ ID NO: 132055 - RNA, 64 nt, hsa
gucauauucacaaaccaauacugucauugcuaaucugaacuauuauuuuuauacuauauauugu

SEQ ID NO: 132056 - RNA, 64 nt, hsa
uugguuaaacaguuuuguguagaucuuuuuggugcugaacuaugacaugagccuuauagauugu

SEQ ID NO: 132057 - RNA, 64 nt, hsa
aaaggaagcuaagcaguggguaccugggaucucucugaacuauuuuuauaacuucuugugaguc

SEQ ID NO: 132058 - RNA, 64 nt, hsa
auuuuaauuauuacaaguugcuccugcccccucccugaacuauuuugugcuguguauaucacug

SEQ ID NO: 132059 - RNA, 64 nt, hsa
aauuuuguucauuuuuaauuugcaaaucgauaaccugaacuaauuuguucuuauuuuuugccac

SEQ ID NO: 132060 - RNA, 64 nt, hsa
gaucccuuccuucuuccacuuucacagcuuuucucugaacuaggagaaccuggggguggauuug

SEQ ID NO: 132061 - RNA, 64 nt, hsa
uguuuauuuauuuauuuauuuuugcauucugaggcugaacuaauaaaaacucuucuuuguaauc

SEQ ID NO: 132062 - RNA, 64 nt, hsa
uugcuacauuacaaacuuuggacgagacucucaucugaacuaacuuggggaaacaauuucuagg

SEQ ID NO: 132063 - RNA, 64 nt, hsa
auggguaacucagguaaagaugcuuuucuuuuaucugaacuacuuaaugauugcuuuacuuuua

SEQ ID NO: 132064 - RNA, 64 nt, hsa
cacuaucauguuauggaauggaaaguacauugggcugaacuaauccaauuguuauuaagccacu

SEQ ID NO: 132065 - RNA, 64 nt, hsa
gaaaaguaacaucaacacugucccauccucagcccugaacuagcuaccaucugauccccucaga

SEQ ID NO: 132066 - RNA, 64 nt, hsa
cauaaaagcaaaucaacacuuuauaguuauucuucugaacuaagacaugucaauauucuuuuuu

SEQ ID NO: 132067 - RNA, 64 nt, hsa
uuaaaccuuuuuuaaaaaagguucacucuaaaagcugaacuacauccuuaguuuucagucuacu

SEQ ID NO: 132068 - RNA, 64 nt, hsa
agccauuaugauaaauuaagcaugaaaaauauugcugaacuacuuuuggugcuuaaaguuguca

SEQ ID NO: 132069 - RNA, 64 nt, hsa
uucuuguucagauuaagaguugccaaaauaccuucugaacuacacugcauuguugugccgagaa

SEQ ID NO: 132070 - RNA, 64 nt, hsa
ggcauaagccuuuuauggcccucuugcagaucuucugaacuaugcacauuugugcuuuuuuugu

SEQ ID NO: 132071 - RNA, 64 nt, hsa
gaaaaugucauguuaagcaauuucagaacauuaacugaacuauuuucaaagcagaaaaauugac

SEQ ID NO: 132072 - RNA, 64 nt, hsa
auaaguaaauauuuauuuaggaauacugugaacacugaacuaauuauuccugugucagucuaug

SEQ ID NO: 132073 - RNA, 64 nt, hsa
auuuugugccugaaaauaauagagcuugagcugucugaacuauuuuacauuuuauggugucuca

SEQ ID NO: 132074 - RNA, 64 nt, hsa
guguaagaaagggagaauauaguuuuagaggaagcugaacuaugacgaugcugggcgaagcggu

SEQ ID NO: 132075 - RNA, 64 nt, hsa
uguagagagacaggggaguugucaacuugggcuacugaacuacaugcauaaacuaaaaacuaac

SEQ ID NO: 132076 - RNA, 64 nt, hsa
aauauuuaaaacaaaguucaauuuagcuggauuucugaacuaugguuuugaauguuuaaagaag

SEQ ID NO: 132077 - RNA, 64 nt, hsa
ugcuuuucucuugugagggaagacuguaacacagcugaacuauuucagugucaacuauucagaa

SEQ ID NO: 132078 - RNA, 64 nt, hsa
guuaaaaaucaguaaucaguacuuuauuacaucacugaacuaaaauauggagacauccucauug

SEQ ID NO: 132079 - RNA, 64 nt, hsa
cacauaaagagaguguuauauaaaaauccgacagcugaacuagguugcucuuuuuuggcaggga

SEQ ID NO: 132080 - RNA, 64 nt, hsa
uccacaagcgaggguagcagaggcucuccucagucugaacuaaggcuuggccuuggggagggcu

SEQ ID NO: 132081 - RNA, 60 nt, hsa; identical to SEQ ID NO: 116720

SEQ ID NO: 132082 - RNA, 64 nt, hsa
aagggccuauacuuuuauuuuucaacucuauuaacugaacuaugcuuggagagagcccugaauc

SEQ ID NO: 132083 - RNA, 64 nt, hsa
caauccacuguuagaauaccuaugguuagggcuucugaacuaaaauaauggaaaauuuuaacaa

SEQ ID NO: 132084 - RNA, 64 nt, hsa
cuggaauugagcuucccucccauuuuccuuguuccugaacuaauacuacuguaccuguuaugga

SEQ ID NO: 132085 - RNA, 64 nt, hsa
agugucaaaagguuuauguaaacuugaauuuuaucugaacuaaauuguaucuuaaaauucauac

SEQ ID NO: 132086 - RNA, 64 nt, hsa
aaccaaauuuuugccauuaaaaacuggcauuauacugaacuauacauugagaaaucaaucaaaa

SEQ ID NO: 132087 - RNA, 64 nt, hsa
uggaauucaccaagauuggguagaacugguaucacugaacuacuaaaguuuuacagaaaguagu

SEQ ID NO: 132088 - RNA, 64 nt, hsa
gaauuaccuagaaguuugucacugacuuguguuccugaacuaugacacaugaauaugugggcua

SEQ ID NO: 132089 - RNA, 64 nt, hsa
cugucauagaauucccaaauuucauuuguagauacugaacuaagggcuaaugucaggagcugau

SEQ ID NO: 132090 - RNA, 64 nt, hsa
ugccguguucugccagcaccgcccuucacccggccugaacuaaggagcaguggcagaagguggg

SEQ ID NO: 132091 - RNA, 64 nt, hsa
caccccugcucaacagagguuuaguuuacagucucugaacuaaaguaguaaccucccaaauugu

SEQ ID NO: 132092 - RNA, 64 nt, hsa
uucaggacuacauaugacccagagagcaagguggcugaacuauagucuggaagcccucagguaa

SEQ ID NO: 132093 - RNA, 64 nt, hsa
uucucgacaauaaagauauuccgugucuuuaccccugaacuaagacacagggaguauuucagag

SEQ ID NO: 132094 - RNA, 64 nt, hsa
aaagauguggacagcuugauguuuuagacaaccacugaacuagaugacuguuguacuguagcuc

SEQ ID NO: 132095 - RNA, 64 nt, hsa
ccucgcccccagccugaggugaucuuucccuccucugaacuauuagagcaguuacugucuguuc

SEQ ID NO: 132096 - RNA, 64 nt, hsa; identical to SEQ ID NO: 132063

SEQ ID NO: 132097 - RNA, 64 nt, hsa
aucuagauuaaauuaaaauugguugcauuauuuucugaacuauaauaggguuuuucuucaggug

SEQ ID NO: 132098 - RNA, 61 nt, hsa; identical to SEQ ID NO: 116737

SEQ ID NO: 132099 - RNA, 64 nt, hsa
augauaugcauuugacuuguuaaacagccuauuccugaacuauaacaccugccaccacuauaaa

SEQ ID NO: 132100 - RNA, 64 nt, hsa
aagcacaauaucuucacacugugcuguauugcugcugaacuaaaugcacuuuuccccacauaug

SEQ ID NO: 132101 - RNA, 64 nt, hsa
cuccuuaucguucuauguaccagguauuuuauuacugaacuagcaacuagccuuuuccaccuuu

SEQ ID NO: 132102 - RNA, 64 nt, hsa
acagcacuauguaggaaagaccauuuuuccuccacugaacuaggguggugcauuuuuguaaguu

SEQ ID NO: 132103 - RNA, 64 nt, hsa
ucuucaguccuguggucccuggacuggugggaaccugaacuaggaguccugggagagcuguggu

SEQ ID NO: 132104 - RNA, 64 nt, hsa
uuguaaauauguuuuaggaagaaagcaaaagggacugaacuagccucugguaggauugcagggg

SEQ ID NO: 132105 - RNA, 64 nt, hsa
uuaauaauuuugugaauuuuuugguuguuguucccugaacuacugucuauauuuaaaauuagau

SEQ ID NO: 132106 - RNA, 64 nt, hsa
gagccauaaaugaccuaacguuucccguuagucucugaacuaggugaucucaguucucuuucaa

SEQ ID NO: 132107 - RNA, 64 nt, hsa
cucccuuguucuuggagggaccauuauuacaucucugaacuaccuuuguauccaacauguuuua

SEQ ID NO: 132108 - RNA, 64 nt, hsa
acccccagccaaucaggacuuuccagacuuggcccugaacuacugacguuccuaccucuuauuu

SEQ ID NO: 132109 - RNA, 64 nt, hsa
aaauuuugccuuagcuacugcaguggaaagagcacugaacuaggaguuggaagacaaggaugug

SEQ ID NO: 132110 - RNA, 64 nt, hsa
gucagggugucuggggcaggaggaggccaacucacugaacuagugcaggguauguggguggcac

SEQ ID NO: 132111 - RNA, 64 nt, hsa
uagcucgcauuaguuucuguugcugccaacagaucugaacuaaugcuaacagaucccccugagg

SEQ ID NO: 132112 - RNA, 63 nt, hsa
cuuguacacauuuuaauaaaauaaggguuggcuucugaacuacaaaacaaaugugcuaugcuc

SEQ ID NO: 132113 - RNA, 64 nt, hsa
uucauuuagaauuagcagagcuaauauggaggggcugaacuaguagccacaucuuguucaucac

SEQ ID NO: 132114 - RNA, 64 nt, hsa
ccuaguuggucuaagggucuguauuggacuaauucugaacuacagacaaauuggaccucaaugu

SEQ ID NO: 132115 - RNA, 64 nt, hsa
ucugaaucuuaauauuucaaagccaggugaaaaucugaacuagauauucuuuguuggaauaugc

SEQ ID NO: 132116 - RNA, 64 nt, hsa
uuuccuggcuguugugaaagaauuuuucuacauccugaacuauuuuuccuauuucuuuucaccu

SEQ ID NO: 132117 - RNA, 64 nt, hsa
ccaaauuaaguuuuggguaaguguguuguuuaaucugaacuauaguaacuuaauacucuaaaca

SEQ ID NO: 132118 - RNA, 64 nt, hsa
gucagcagagcugagauuaauaucugggcuuuuccugaacuauucugguuauugagcccuuccu

SEQ ID NO: 132119 - RNA, 64 nt, hsa
ucacauaacuaacuuucgaggcacuggaacauaccugaacuaagaauuaaaucuuuuacuuuau

SEQ ID NO: 132120 - RNA, 64 nt, hsa
uucuucggcuugugaggcuucccacuauuuauuacugaacuauuauguuaaugaagauggacau

SEQ ID NO: 132121 - RNA, 64 nt, hsa
uaauaguuuuaucuggguacaaauaaacaggugccugaacuaguucacagacaaggaaacuucu

SEQ ID NO: 132122 - RNA, 64 nt, hsa
accguuucaaugaaacaauguauguuuguuuuaacugaacuaaaauaaauacaugcuuaauccu

SEQ ID NO: 132123 - RNA, 64 nt, hsa
uuuuaaguaccugagcucucgaagcuacccagaacugaacuagacuccccuaccuuagacuggu

SEQ ID NO: 132124 - RNA, 60 nt, hsa; identical to SEQ ID NO: 116763

SEQ ID NO: 132125 - RNA, 64 nt, hsa
uucuaaccaucaacaauugcaugguuaaaugacccugaacuaaaacugauggguucccuaucaa

SEQ ID NO: 132126 - RNA, 64 nt, hsa
guacaguuaguauucuaaugaaaggaugaagagucugaacuagaagguagguuuaagccaucac

SEQ ID NO: 132127 - RNA, 64 nt, hsa
uuucuuuauuaaaaccucagcaugucucccugaucugaacuauuugcuuucucuucaagauaag

SEQ ID NO: 132128 - RNA, 64 nt, hsa
gguguguagguagauuccauauuaaugaggaacacugaacuaguuggaaauuacugcuuucucu

SEQ ID NO: 132129 - RNA, 64 nt, hsa
uguauguauuuuaaagaaauuucaucugcuucuacugaacuaugcguacugcauagcaucaagu

SEQ ID NO: 132130 - RNA, 64 nt, hsa
aggaauuuaacuuuuugauuuguauaauagaaaacugaacuaggaauuguuagcgggguuuuga

SEQ ID NO: 132131 - RNA, 64 nt, hsa
aaacccuuuuggaauuagaauucuuguucugaugcugaacuauuugguaauaaagugcuuauuu

SEQ ID NO: 132132 - RNA, 64 nt, hsa
cauaugggauuuguggacacagcuguuucuguuccugaacuagaagucuuccccagcucugacg

SEQ ID NO: 132133 - RNA, 64 nt, hsa
aaguguuucuucauaucuaggagauuuggaaauucugaacuaaggucuuauaagaacaagaaau

SEQ ID NO: 132134 - RNA, 64 nt, hsa
ugaauuacuucuuguacagcugagauagcuucuucugaacuauuauuaaauaagugaauacaaa

SEQ ID NO: 132135 - RNA, 64 nt, hsa
aguuuacagaucaauaaaagcaccuguucuccaucugaacuagacaauggaaauaaugcugcau

SEQ ID NO: 132136 - RNA, 64 nt, hsa
aagaacucagggaacaauacuguaaacugucuuccugaacuacuguagggccucucuaagaauu

SEQ ID NO: 132137 - RNA, 64 nt, hsa
acagcauuaauacuaguccaaaaaaugucauaaacugaacuaaaaugaugaacuauuuuaugua

SEQ ID NO: 132138 - RNA, 64 nt, hsa
uuuuacaaauugaggauuaccaauuaaacuuuaacugaacuaaggcuaccaaauacauucccug

SEQ ID NO: 132139 - RNA, 64 nt, hsa
agugucugauaagcaucuuaaagucacucaauuccugaacuaaucaauauauauguuuaaccca

SEQ ID NO: 132140 - RNA, 64 nt, hsa
caccuuuuuaaggggaggagagagcacuuaguuucugaacuagucuggggacauccuggacuug

SEQ ID NO: 132141 - RNA, 64 nt, hsa
auugccuuuguuuugaaauuauaucaccuguguucugaacuaaaaugaugggaguucauuuugu

SEQ ID NO: 132142 - RNA, 64 nt, hsa
aaauucuuucacaagguacaaaaucuugcauaagcugaacuaaaauaaaaaugaaaaggagaga

SEQ ID NO: 132143 - RNA, 64 nt, hsa
agauauacucuugggagagagcaugaaugguauucugaacuaucaccugauucaaggacuuugc

SEQ ID NO: 132144 - RNA, 64 nt, hsa
ccuugccucugccugguacccacaugacuuggaacugaacuaacauuuuucuuuaaaaagcaaa

SEQ ID NO: 132145 - RNA, 64 nt, hsa
uguuugccuugauaaagguaagauaaaugaaacgcugaacuaugcuaaucuggaauuuguuuuu

SEQ ID NO: 132146 - RNA, 64 nt, hsa
ucacaacuguccaggcugagauaaaucccgggaccugaacuauuagcacgucacuagagacugg

SEQ ID NO: 132147 - RNA, 64 nt, hsa
uggcccacguggaggcccaccugccucugucucacugaacuagaagccgagccuagaaacuaac

SEQ ID NO: 132148 - RNA, 64 nt, hsa
aaccaauacuccaaguccuugaguuuuguuauaucugaacuaguugaacugugacugacaggua

SEQ ID NO: 132149 - RNA, 64 nt, hsa
ucagggugggcaauucacagccuuucugaacugacugaacuagagcuugcagugaaguguucug

SEQ ID NO: 132150 - RNA, 64 nt, hsa
cucuucguaauucuaauguguacugcugguauagcugaacuacugaccuggaucuuaguccuag

SEQ ID NO: 132151 - RNA, 64 nt, hsa
uuucuuaguuucuguaaauucaugacuugucuuacugaacuacagccugguuuguagacuucca

SEQ ID NO: 132152 - RNA, 64 nt, hsa
cccucccucaggccgaaggaggagucagggagagcugaacuauuagagcugccugugccuuuug

SEQ ID NO: 132153 - RNA, 64 nt, hsa
aaccuaacauaaaacacagcaagaaucugguugucugaacuauuuuaaauuaaggagccagaug

SEQ ID NO: 132154 - RNA, 64 nt, hsa
ucauguuuauaaacuauacagaaaacuguauuugcugaacuaaggauuguauuggugauuucua

SEQ ID NO: 132155 - RNA, 64 nt, hsa
aaaauagaaugaaacacaaaauucaauuccucggcugaacuagccacauuucaacugcucagua

SEQ ID NO: 132156 - RNA, 64 nt, hsa
guuguuuuacgcuaaagauggaaaagaacuaggacugaacuauuuuaaauaaaauauuggcaaa

SEQ ID NO: 132157 - RNA, 64 nt, hsa
cuuccuucgucucuccaacugccuuucccauccucugaacuaggcauuaacagcccccgugggc

SEQ ID NO: 132158 - RNA, 64 nt, hsa
acuuauauacaguuuuaggggacaauugagauggcugaacuacugaauaaaaaaaaaacaacgc

SEQ ID NO: 132159 - RNA, 64 nt, hsa
uucuccugcaucccaugcuaagcagggucauggucugaacuacucagauuggauuuccaaacca

SEQ ID NO: 132160 - RNA, 64 nt, hsa
ccgagaagagaauaaaagugacaugaacacuguacugaacuacaucuucucucacgcucaaguc

SEQ ID NO: 132161 - RNA, 64 nt, hsa
cacagagggacugucaucuaaaccaggggaaccacugaacuaaagcccaauuugcuugcauuuu

SEQ ID NO: 132162 - RNA, 64 nt, hsa
caguuaaccugauuucaauuuugauaccguuuuccugaacuaauaaaucuacccaaugagacuu

SEQ ID NO: 132163 - RNA, 64 nt, hsa
ucaugagcuggguacugacugagauaagaaaagccugaacuauuuauuaaaaacaugaccacuc

SEQ ID NO: 132164 - RNA, 64 nt, hsa
uuauuuuggaauugguguauaucaugaagccuugcugaacuaaguuuuguguguauauauuuaa

SEQ ID NO: 132165 - RNA, 64 nt, hsa
aguuauucacaccagcaucaucuuaacuaacauucugaacuaguuagugcagcuuuucauugug

SEQ ID NO: 132166 - RNA, 64 nt, hsa
ccucugccuccaaacaggggacacuucgggaaugcugaacuaaugagaacugccagggaaucuu

SEQ ID NO: 132167 - RNA, 64 nt, hsa
caugauuaaacuagauagaccugguauacagucacugaacuaguagaugucaauaauuauuauu

SEQ ID NO: 132168 - RNA, 64 nt, hsa
guguuuuggaauuugaagcuaauuuuuaaaaggccugaacuauacuuugaagaaaccccuauag

SEQ ID NO: 132169 - RNA, 64 nt, hsa
gucagauuuauuuuuauguggaucccuguguaugcugaacuacagagcaugauguuuaaucuaa

SEQ ID NO: 132170 - RNA, 64 nt, hsa
ggacuuccuagaggaagggacaucgaacuaagaccugaacuaugagaaauaggcaggaagaagu

SEQ ID NO: 132171 - RNA, 64 nt, hsa
guccccucuacuuuaacuuuuacaaaaaaguaaccugaacuaaucugauguuaaccaauguauu

SEQ ID NO: 132172 - RNA, 64 nt, hsa
gcaacuguaugugaaggggagccagggaacguuucugaacuaagcaaggacaaauucagagacc

SEQ ID NO: 132173 - RNA, 64 nt, hsa
ugcagaccugagcuggcuuggacccauuugaggacugaacuaggcaggcaauggcuccagugcc

SEQ ID NO: 132174 - RNA, 64 nt, hsa
ucccgcuccacggagucuuccagaacaccucccucugaacuaaucccggagcaccccaccccca

SEQ ID NO: 132175 - RNA, 64 nt, hsa
uuucucaaaaaggcuacuguuugugacuuucaaccugaacuauggaucuguggcuauuuugcau

SEQ ID NO: 132176 - RNA, 64 nt, hsa
aagguugcauucuccaccaagggaguuaaccuaccugaacuaaguagaaaugccagucuuccac

SEQ ID NO: 132177 - RNA, 64 nt, hsa
aaaauagaacacuucuuggaggcuuucuucagaacugaacuagaaacaagguuuccaggcuccc

SEQ ID NO: 132178 - RNA, 64 nt, hsa
auuguaaguauuuacuuagagcuuuuucuuaaaucugaacuaacuugcuuuuagaagucuuuuu

SEQ ID NO: 132179 - RNA, 64 nt, hsa
cuccucacaccuggcagcuucauggauguuguaucugaacuaaggaccagaggcugccagaugu

SEQ ID NO: 132180 - RNA, 64 nt, hsa
uuagaagaggccuauuaaaaaaaaaaguuguuuucugaacuagaagaggaaaaaaauggcaauu

SEQ ID NO: 132181 - RNA, 64 nt, hsa
uacauuucucccuaauguucuuacccaaauguaccugaacuaaaaaauguuagauguuggugau

SEQ ID NO: 132182 - RNA, 64 nt, hsa
uuuuugcuuaacauuagaugucaugaggaaacuacugaacuagcaauugguuguuuaacacuuc

SEQ ID NO: 132183 - RNA, 64 nt, hsa
cuuccuguuuaaaaaaccacauggcacagagauucugaacuaaagugcugcacucaaaugaugg

SEQ ID NO: 132184 - RNA, 64 nt, hsa
gcacuuaauaaguauuccccccugcgacaccuagcugaacuaugguuuggugucugaucuugag

SEQ ID NO: 132185 - RNA, 64 nt, hsa
ggcaccaagcucuguccaaucagguaggcugggccugaacuagccaaucagaucaacucugucu

SEQ ID NO: 132186 - RNA, 64 nt, hsa
gccuuuauguacauaaucuugauggagcuauuagcugaacuauaaaauaugcucuugguaaaua

SEQ ID NO: 132187 - RNA, 64 nt, hsa
auaaacaucuaugccuuuucucagaaaugauuugcugaacuauguccauauuuuacagcuuaga

SEQ ID NO: 132188 - RNA, 64 nt, hsa
gugaguguuagaaaaaacuggaaacaucugauuucugaacuaucagggcaagcucauagcacau

SEQ ID NO: 132189 - RNA, 64 nt, hsa
agugaaauuuuaaaugcacaguucuauuugcuaucugaacuaauucauuuauuaaguauauuug

SEQ ID NO: 132190 - RNA, 64 nt, hsa
gcaugguuuggccuggggaucuuagaugucugaccugaacuauuguagaacagcgcuggcuuuu

SEQ ID NO: 132191 - RNA, 64 nt, hsa
uguacgguucugugcaaagagguguuuugccagccugaacuauauuuaagagacuuuguaaaaa

SEQ ID NO: 132192 - RNA, 64 nt, hsa
uuucaaaaggaaaguugguuuugagcccaguauacugaacuagaauauucuagaucuuguuuua

SEQ ID NO: 132193 - RNA, 64 nt, hsa
ccauguaacugaccuuaguaaaguccuugacuaacugaacuagaaggaagguuuagccuucuaa

SEQ ID NO: 132194 - RNA, 64 nt, hsa
uguaggguucuguggaaggagguauucugccagccugaacuauauuuaagaaacuuuguaaaaa

SEQ ID NO: 132195 - RNA, 64 nt, hsa
gaggaagacugucuggcuccgcaguguuggguuuuguccugaaucugugcaaaugugcagggaa

SEQ ID NO: 132196 - RNA, 64 nt, hsa
aaaggugggugacguuuucaggaggaaccugggauguccugaugcucaauggguagaugccuuc

SEQ ID NO: 132197 - RNA, 64 nt, hsa
ucucuuuccuuagguugaauuuauuaaugaaauuuguccugagucuggagggguuaguucagag

SEQ ID NO: 132198 - RNA, 64 nt, hsa
aagaggcauacagaaaauggaaauaguauuucgcuguccugaaacuuucagugaaagagaucac

SEQ ID NO: 132199 - RNA, 64 nt, hsa
ucuccaugauguucacccuggggcuggcccacuguguccugaauguuuuuguuauuuuuuguuu

SEQ ID NO: 132200 - RNA, 64 nt, hsa
uccagcugaaccauacccuggcugugggggcaucuguccugagcuuggcugguguaucucacaa

SEQ ID NO: 132201 - RNA, 64 nt, hsa
gucauacugcuggguuuucauggguaggaaagcuuguccugaccccagcagcaaagagguggca

SEQ ID NO: 132202 - RNA, 64 nt, hsa
uaugcucuguucagucugugucaggcaguaugcuuguccugaagagagguuuggcuauccccac

SEQ ID NO: 132203 - RNA, 64 nt, hsa
aguucagaaggcaggaaagacagucacaccgacguguccugaagguguaggcucuccacuuagg

SEQ ID NO: 132204 - RNA, 64 nt, hsa
cugguugauuagaaucucagguuucagcuccugcuguccugagcgaacuugccugaugcagggc

SEQ ID NO: 132205 - RNA, 64 nt, hsa
ccuggcaggaugccaauccuguuuguuguccguauguccugaaaacaugagggacuggcagaug

SEQ ID NO: 132206 - RNA, 64 nt, hsa
gacacccuuucccaccuggugccuaugcuaggcuuguccugagaacaucccucaguaacuugau

SEQ ID NO: 132207 - RNA, 64 nt, hsa
ucaccacccccagguucccugcagaugucguguguguccugaguguuucuuugguucuuugcac

SEQ ID NO: 132208 - RNA, 64 nt, hsa
cucuccuccagcccuucccagggcucagcccugcuguccugagcgucuccugggccagagagag

SEQ ID NO: 132209 - RNA, 64 nt, hsa
cugcacaugaggaaauaggcugucacuaucacauuguccugaaaacagcaucugcuuuccucuu

SEQ ID NO: 132210 - RNA, 64 nt, hsa
aaggagcccugcuccuuuaguuuccugacaccuguguccugagugagccgcaggaguucuuagc

SEQ ID NO: 132211 - RNA, 64 nt, hsa
ggagcccccagccugucagauccaggagcuccaguguccugagcucagcguggagggguagggg

SEQ ID NO: 132212 - RNA, 64 nt, hsa
ugcaaggcagccgugggccccacccucggggauguguccugacacugcaauuggcaccgaagcc

SEQ ID NO: 132213 - RNA, 64 nt, hsa
cuuaguguccccacaugaggaaagcacuucauuauguccugaggaacaguugguuauagaaagg

SEQ ID NO: 132214 - RNA, 64 nt, hsa
agcgguuacuccauuaaaacgugcagguuggcaauguccugagugcaaagugugccagaacugc

SEQ ID NO: 132215 - RNA, 64 nt, hsa; identical to SEQ ID NO: 46653

SEQ ID NO: 132216 - RNA, 64 nt, hsa; identical to SEQ ID NO: 46654

SEQ ID NO: 132217 - RNA, 64 nt, hsa; identical to SEQ ID NO: 46655

SEQ ID NO: 132218 - RNA, 64 nt, hsa; identical to SEQ ID NO: 46656

SEQ ID NO: 132219 - RNA, 64 nt, hsa; identical to SEQ ID NO: 46657

SEQ ID NO: 132220 - RNA, 64 nt, hsa; identical to SEQ ID NO: 46658

SEQ ID NO: 132221 - RNA, 64 nt, hsa; identical to SEQ ID NO: 46659

SEQ ID NO: 132222 - RNA, 64 nt, hsa; identical to SEQ ID NO: 46660

SEQ ID NO: 132223 - RNA, 64 nt, hsa; identical to SEQ ID NO: 46661

SEQ ID NO: 132224 - RNA, 64 nt, hsa; identical to SEQ ID NO: 46662

SEQ ID NO: 132225 - RNA, 64 nt, hsa; identical to SEQ ID NO: 46663

SEQ ID NO: 132226 - RNA, 64 nt, hsa; identical to SEQ ID NO: 46664

SEQ ID NO: 132227 - RNA, 64 nt, hsa; identical to SEQ ID NO: 46665

SEQ ID NO: 132228 - RNA, 64 nt, hsa; identical to SEQ ID NO: 46666

SEQ ID NO: 132229 - RNA, 64 nt, hsa; identical to SEQ ID NO: 46667

SEQ ID NO: 132230 - RNA, 64 nt, hsa; identical to SEQ ID NO: 46668

SEQ ID NO: 132231 - RNA, 64 nt, hsa
aagagccagcuggcgugucgggaaggauccaggaucugcaaacacaacugcucaggccuucuca

SEQ ID NO: 132232 - RNA, 64 nt, hsa
ggcguccucugccuuccccgcuuccccaugagcgucugcaaaacacuugccugaauacauauca

SEQ ID NO: 132233 - RNA, 64 nt, hsa
uggccagugaacaccaucccagaagcauuuucccucugcaaaaugacguuucuucccacgucug

SEQ ID NO: 132234 - RNA, 64 nt, hsa
cgucuauauaagggaaugucuuccuuccuaucuaucugcaaaauggaaaucuagaccuccuucu

SEQ ID NO: 132235 - RNA, 64 nt, hsa
acauuacuaaucuagguccuauuacuaaucuaugucugcaaacauuaaaggaaugaaacaauga

SEQ ID NO: 132236 - RNA, 64 nt, hsa
uggucagaugugcagaccauuacuaaggucuaugucugcaaacauuacuaaucuagguccuauu

SEQ ID NO: 132237 - RNA, 64 nt, hsa
uacacacauacagcuacggauauaaugaaaauuaucugcaaacaccuaaauuaaagagaaaaaa

SEQ ID NO: 132238 - RNA, 64 nt, hsa
ccugacuugaggagcuguuuuguuguuguuguugucugcaaauuucaugaauuugugaugucuu

SEQ ID NO: 132239 - RNA, 64 nt, hsa
aaaagaaagcauacaugcuuaugcaugaaacaauucugcaaaaaaaggaugaauuuccuccauc

SEQ ID NO: 132240 - RNA, 64 nt, hsa
cugcgucaauuaagucaagcugaagcuacugacuucugcaaaguauuagugguacaguaaaaag

SEQ ID NO: 132241 - RNA, 64 nt, hsa
cuuuuauguauaauucuuucugccugccuacuuuucugcaaaaaugagauguacagauuucggu

SEQ ID NO: 132242 - RNA, 64 nt, hsa
gaaaaugaaggccaaacagaagcaggcuccagcuucugcaaaaacuuggauucacaaauguccc

SEQ ID NO: 132243 - RNA, 64 nt, hsa
gcccuauccaugagaugccuuuucaucugcaaacucugcaaaaugugucucauguuucgcaacu

SEQ ID NO: 132244 - RNA, 64 nt, hsa
cugaaagaugcccuauccaugagaugccuuuucaucugcaaacucugcaaaaugugucucaugu

SEQ ID NO: 132245 - RNA, 64 nt, hsa
aaaccauucgugucccuucacucucugaacauagucugcaaaucucucccucucugguauguuu

SEQ ID NO: 132246 - RNA, 64 nt, hsa
ugccaauacugugcuggcuccagugggauuccucucugcaaagcugcuggcuuagcuugacugu

SEQ ID NO: 132247 - RNA, 64 nt, hsa
aauaaaacaauuuuagccuuucucaguuuauuuuucugcaaaaagauuaaaaauuguacaugaa

SEQ ID NO: 132248 - RNA, 64 nt, hsa
gaggauuguucacucacuguuaccuguguuaguaucugcaaaugcaugaaugguugaacuccca

SEQ ID NO: 132249 - RNA, 64 nt, hsa
ucuauugccauuagaucuuacaauaauguuccacucugcaaauuuuuaagguucaaauaaaguu

SEQ ID NO: 132250 - RNA, 64 nt, hsa
uuucuccugcagaaaaggaaaauucuucugcuugucugcaaaugcuuuggauuuagaagcguca

SEQ ID NO: 132251 - RNA, 64 nt, hsa
acagacccacagaagguguucaaacacaaccuacucugcaaaccuugguaaaggaaccagucag

SEQ ID NO: 132252 - RNA, 64 nt, hsa
agagauuuuucauuuuuccaugacauuuuuccucucugcaaauggcuuagcuacuuguguuuuu

SEQ ID NO: 132253 - RNA, 64 nt, hsa
cucagaauucuuuuuaauugaagaugucuugagcucugcaaagaucagagcaggugagcaucca

SEQ ID NO: 132254 - RNA, 64 nt, hsa
ggaucgugcccagcuuugcuuagcuuucuuuauuucugcaaaucuguuagcauaauuccaaggu

SEQ ID NO: 132255 - RNA, 64 nt, hsa
guggaugaauguucuuuaaauuuguguaaauacuucugcaaagguacugaugcuguaaagucaa

SEQ ID NO: 132256 - RNA, 64 nt, hsa
uguaauggaauuaaagugcuuuugcacaauaaguucugcaaaacccucucauucaugaaaaggu

SEQ ID NO: 132257 - RNA, 64 nt, hsa
ccaccauguuccugacaccuaucuauuaaaccauucugcaaauacgguuuuucuaccugauugc

SEQ ID NO: 132258 - RNA, 64 nt, hsa
aaacaacagaacuuuaugcuuaauuuagauccuuucugcaaagugcacugaauugcugaaaguu

SEQ ID NO: 132259 - RNA, 64 nt, hsa
uguuaaaggacaaaugcccacucuucuauucugaucugcaaauagcuuaaaugucucuugcaaa

SEQ ID NO: 132260 - RNA, 64 nt, hsa
gagacaggcuuuguucucuuguucauaacauuucucugcaaagaauucucuauggagugaagcg

SEQ ID NO: 132261 - RNA, 64 nt, hsa
uguaucaaaauucccaggucuugcuacauugcccucugcaaauguauucaaagaagaaccuccu

SEQ ID NO: 132262 - RNA, 64 nt, hsa
gcaucccuuugaaugaguuuacagacugccagugucugcaaaaguugaaagcaaaugggagaug

SEQ ID NO: 132263 - RNA, 64 nt, hsa
uaugugucauagaauacuuaguucugcuagauauucugcaaauauauuugggaauuacuuccug

SEQ ID NO: 132264 - RNA, 64 nt, hsa
ucauauacccaauaauaagcuacagaacuaauauucugcaaaugucucuuggaacacacugccu

SEQ ID NO: 132265 - RNA, 64 nt, hsa
agguggcuuuggcccagaggcucaggccgggacugagauggacagacccagggugggguggggu

SEQ ID NO: 132266 - RNA, 64 nt, hsa
uuucuuuucuuuucuuuuuuuuuuuuuuuuuuuugagauggagucucgcucugucgcccaggcu

SEQ ID NO: 132267 - RNA, 64 nt, hsa
ccaugcccggcuaauuuuguuuguauuuuuaguagagauggaguuucaccauguuggccagggu

SEQ ID NO: 132268 - RNA, 64 nt, hsa
agacaaauauccccaagugaaauauguugcgguagagauggaauguauaaaauccgccaguagu

SEQ ID NO: 132269 - RNA, 64 nt, hsa
uuaggccugcuguucccuuugcucuugauuaggagagauggaaggagaugagcucccauaacug

SEQ ID NO: 132270 - RNA, 64 nt, hsa
ccuggcuaauuuuuacuuuuuuuuuuuuuugguagagauggagucuugcuauauugcccaggcu

SEQ ID NO: 132271 - RNA, 64 nt, hsa
guagccacaguauggauggguggauggguuuuaugagauggaucacauauuuuauuaagaacuc

SEQ ID NO: 132272 - RNA, 64 nt, hsa
gcaggacacauuggcaagucaagcaggaaggagggagauggaaaggggauaucagauugguuuc

SEQ ID NO: 132273 - RNA, 64 nt, hsa
guggcuaucuuaugugaggacuagaggugaagaggagauggacacugccucuggagccagccug

SEQ ID NO: 132274 - RNA, 64 nt, hsa
ccaccaugcccagcuaauuuuuguauuuuuaguagagauggaauuuugccauguuggccaggcu

SEQ ID NO: 132275 - RNA, 64 nt, hsa
uuuauuuauuuauuuuuauuuuauuuuauuuuuugagauggaguuucacucuuguugcccaggc

SEQ ID NO: 132276 - RNA, 64 nt, hsa
gcuucagaaguaagagccaaccaacugaaaaccugagauggagauauguucaaagaaugagaua

SEQ ID NO: 132277 - RNA, 64 nt, hsa
ugcugaacuuuuaaaagaggucucuaacugaagagagauggaagccagcccugccaaaggaugg

SEQ ID NO: 132278 - RNA, 64 nt, hsa
ccaccaugcccagcuaauuuuuguguuuuuaguagagauggagucucaccacauaggccaggca

SEQ ID NO: 132279 - RNA, 64 nt, hsa
uguucauaauggcucauguauuauuauuauuuuugagauggaguuuugcucuuaaugauauuau

SEQ ID NO: 132280 - RNA, 64 nt, hsa
ucaccugcucuaggugcaaaggcauguugggaaagagauggauguuggggaggaagagaggaga

SEQ ID NO: 132281 - RNA, 64 nt, hsa
uugggaaagagauggauguuggggaggaagagaggagauggauuucaguugggaguuaggagga

SEQ ID NO: 132282 - RNA, 64 nt, hsa
aaaugaaacaaaauaagcaguggaucuugcauuggagauggaguuaaacuauguugcccaggcu

SEQ ID NO: 132283 - RNA, 64 nt, hsa
ccaccacaccuggcuaauuuuuguguuuuuuguagagauggagauucacucgacuaauucuuuu

SEQ ID NO: 132284 - RNA, 64 nt, hsa
accacgcccagcuaauuuuuuuuuuuuuuuucuugagauggagucucucucugucgccaggcug

SEQ ID NO: 132285 - RNA, 64 nt, hsa
aaaggaaguaauauaaauuuugugggguuuuuuugagauggagucuuacucuuuugccaggcua

SEQ ID NO: 132286 - RNA, 64 nt, hsa
caccguaucuuggugcagaacagauaauuauacagagauggaaugggacaaccgcaguuuuacu

SEQ ID NO: 132287 - RNA, 64 nt, hsa
gauacagaaacacuccuuagcacuuuaagaaagugagauggaacugccagauuucuggaaggag

SEQ ID NO: 132288 - RNA, 64 nt, hsa
uggacauuaugugauuuacuauauaaggaggucagagauggacuguggccaggcuuccacauuc

SEQ ID NO: 132289 - RNA, 64 nt, hsa
uuaacauauaaaguuauaaaugaaggacaaggaggagauggaaaauguguauuuauuguuaauu

SEQ ID NO: 132290 - RNA, 64 nt, hsa
gggcaguaugucucagcuggaauggaaagaaugugagauggaaccucaagucacuguuuuuacc

SEQ ID NO: 132291 - RNA, 64 nt, hsa
ggaacagggagcagagagacccaacugggagccagagauggaacuucaggucuuaagugcaaau

SEQ ID NO: 132292 - RNA, 64 nt, hsa
gacugauauuuaaacuaagaaaaauguuuagucugagauggaucauaaguaaaugagcagugug

SEQ ID NO: 132293 - RNA, 64 nt, hsa
uuuuuguuuguuuuguuuuuuguuuuuuuuguuugagauggagucucacucugucaccuaggcu

SEQ ID NO: 132294 - RNA, 64 nt, hsa
uccuuuuugguucaguauuagugagagggagagggagauggauggugggguagguuuucuaguc

SEQ ID NO: 132295 - RNA, 64 nt, hsa
aaguggccagaacuccuauuccuaaaaggauuuugagauggaggaacacauauuuaauuccccu

SEQ ID NO: 132296 - RNA, 64 nt, hsa
aguuaauuauaaaaauuaaaagauuuuuuuuuuugagauggaauauugcucuguugcccaggcu

SEQ ID NO: 132297 - RNA, 64 nt, hsa
ucagaugugucuugugcccaccucuuccugagaagagauggaaguggagcugugacuaguacaa

SEQ ID NO: 132298 - RNA, 64 nt, hsa
gacugccccgugcagacuggaggggacgcugguagagauggaggaggaggcaauugggauggcg

SEQ ID NO: 132299 - RNA, 64 nt, hsa
ucccugauuccuguuguuauggaaacuguugccagagauggagguucucucggaguaucuggga

SEQ ID NO: 132300 - RNA, 64 nt, hsa
ccaccauacccagcuaauuucuguauuuuuaguagagauggaguuucaccauguuggccaggcu

SEQ ID NO: 132301 - RNA, 64 nt, hsa
cccucuccugauccaaaucuuuuuuuguuuguuugagauggagucucacucugucucccaggcu

SEQ ID NO: 132302 - RNA, 64 nt, hsa
gugcacggagacacgcaccuuggagaaaugaggggagauggaccaagaaagacguggaccugga

SEQ ID NO: 132303 - RNA, 64 nt, hsa
aaugauugacaacucacuuuuuuuuuuuuuuuuugagauggagucucgcucugucgcccaggcu

SEQ ID NO: 132304 - RNA, 64 nt, hsa
uuuucuuuuucuuuucuuuucuuuuuuuuuuuuugagauggagucucgcucugucgcccaggcu

SEQ ID NO: 132305 - RNA, 64 nt, hsa
cagcuaguuuuuuuuuuuuuuuguauuuuuaguagagauggaguuucaccauguuagccaggau

SEQ ID NO: 132306 - RNA, 64 nt, hsa
ccagggccugccggcaucaccugcggccacaccugagauggaccccacgcagcccugaucgcag

SEQ ID NO: 132307 - RNA, 64 nt, hsa
cauguuuuuggauuuuuuuuuuuuuucuuuuuuugagauggaguuucauucuuguuacccaggc

SEQ ID NO: 132308 - RNA, 64 nt, hsa
ucaagcuuucgaagacacaugacaaugcacacuggagauggaccucacaaaaugcaagauaugu

SEQ ID NO: 132309 - RNA, 64 nt, hsa
ggaagcuuccaaagacacaugauaaggcacacuagagauggaccucauaaauguaagauaugug

SEQ ID NO: 132310 - RNA, 64 nt, hsa
ggaaaccuucaaagacacauggcagugcagcauggagauggaccuuauaaauguaaguugugug

SEQ ID NO: 132311 - RNA, 64 nt, hsa
auagugagcccaugcagcaccucucacccacccagagauggagcugcucugccuuccagcgggg

SEQ ID NO: 132312 - RNA, 64 nt, hsa
cucaaucuagaaagaacuugcuuuguacagggcugagauggaggagaaaaaaaugcccccuuca

SEQ ID NO: 132313 - RNA, 64 nt, hsa
uaguuuuuuauauaaaugacuuuuuuuuuuuuuugagauggaguuucacccuuguugcccaggc

SEQ ID NO: 132314 - RNA, 64 nt, hsa
cauuagcugcgccccugaagugucuccagcagaagagauggaugaauggaaggacacacagaug

SEQ ID NO: 132315 - RNA, 64 nt, hsa
ugcccuuucuuuuuuuuuuuuuuuuuuuuuuuccgagauggagucucucucugucacccaggug

SEQ ID NO: 132316 - RNA, 64 nt, hsa
uuuuuuuuucuguuucuguuucuguuuuuuuuuugagauggagucucgcucugucgcccaggcu

SEQ ID NO: 132317 - RNA, 64 nt, hsa
gaaugacauuuuguuuguuuguuuuguuuuguuugagauggagucucgcucuguugcccagggu

SEQ ID NO: 132318 - RNA, 64 nt, hsa
uggucucuuuauuuuuuuauuuuuguauuuuuucgagauggaguuuugcucuuguugcccaggc

SEQ ID NO: 132319 - RNA, 64 nt, hsa
auagguugaucuuugggguuuuuuuuuuuuuuuugagauggaguuucgcucuguuguccaggcu

SEQ ID NO: 132320 - RNA, 64 nt, hsa
guuuuuguuuuuguuuuuuguuuuuuguuuuuuugagauggagucuugcuccuguugugcaggc

SEQ ID NO: 132321 - RNA, 64 nt, hsa
aaaaauugggaauaagcucgcuuuuuuuuuuuuugagauggagucuugcuccuguugugcaggc

SEQ ID NO: 132322 - RNA, 64 nt, hsa
aauugucauuuaauucuuaaacugucauuuauuugagauggaaauaagaucuaaaguuaguugc

SEQ ID NO: 132323 - RNA, 64 nt, hsa
uggcaguuuucaacuuccucuuccucauuuucuugagauggaugacuccagauucuaucauuga

SEQ ID NO: 132324 - RNA, 64 nt, hsa
ccuucuaauaacccugccaugugguuugcagaaagagauggauauaguagccucagaagaaaua

SEQ ID NO: 132325 - RNA, 64 nt, hsa
aggaggcugaggcacgagaaucacuugaacucaggagauggagguuucagugagccaagaucac

SEQ ID NO: 132326 - RNA, 64 nt, hsa
cuccagggcgcagccuccugaguagcugggaggacaggcauaugccaccacaucacugagaaga

SEQ ID NO: 132327 - RNA, 64 nt, hsa
acaccccgucucuacuaaaaauacaaaaauuacccaggcauaguggcacacgccuguaguccca

SEQ ID NO: 132328 - RNA, 64 nt, hsa
ucaagaaagauguggccaaucagauugagucauccaggcauaccuuuuuagcuucuguuugugg

SEQ ID NO: 132329 - RNA, 64 nt, hsa
ucuccugccucagccucccaaguagcugggauuacaggcauacaccaccacgccccacuaauuu

SEQ ID NO: 132330 - RNA, 64 nt, hsa
uucuccugccucagccucccaaguagcuggauuacaggcauacaccaccacgccuggcuauguu

SEQ ID NO: 132331 - RNA, 64 nt, hsa
ucucccaccucaggcacccaaauagcuggaacuacaggcauauaccgccacacccagcuaauuu

SEQ ID NO: 132332 - RNA, 64 nt, hsa
uggaugccuuagaagggagagggaaggagggaggcaggcauagcaucugaacccaguguggggg

SEQ ID NO: 132333 - RNA, 64 nt, hsa
gagaauagaagggccuggacagauuaugauugcucaggcauaccagguuauagcuccaaguucc

SEQ ID NO: 132334 - RNA, 64 nt, hsa
cuuuacaauuuauguuuagagauugcaguaaagacaggcauaagaaauuauaaaaguauuaauu

SEQ ID NO: 132335 - RNA, 64 nt, hsa
cucagcugacaggauugagagauuaaaguaaagacaggcauaggaaaucacaaggguauugacu

SEQ ID NO: 132336 - RNA, 64 nt, hsa
ccucuugaagagaaaacacacagcuucacacauccaggcauagggggcaagcucuuggggcauc

SEQ ID NO: 132337 - RNA, 64 nt, hsa
accugcuccucccgagacucucucugacugcagccaggcauaguaccuuugccuguguuugcuc

SEQ ID NO: 132338 - RNA, 64 nt, hsa
ucaaauuagccagaaggaagaagagacguuaagaauggcagauaaauuuaacagguaaugauac

SEQ ID NO: 132339 - RNA, 64 nt, hsa
uuauaccaguguuguccaagguugcuagcaggaaauggcagagccaggaguuggaccuagguuu

SEQ ID NO: 132340 - RNA, 64 nt, hsa
uccuauguauaaauuaaaugagguggcuucagaaauggcagaauaaaucuaaaguguuuauuaa

SEQ ID NO: 132341 - RNA, 64 nt, hsa
ggcuggauucggaaacaucugcccauguguauugauggcagagcuguugcccacaagcgccuuu

SEQ ID NO: 132342 - RNA, 64 nt, hsa
augguucagauauuuuuucauuaaaaaacaagguauggcagauggacuuuuccaugggucaaau

SEQ ID NO: 132343 - RNA, 64 nt, hsa
caccucuuaagugcauuugcauuuuauuuugguaauggcagagaccucauguggccaguuugau

SEQ ID NO: 132344 - RNA, 64 nt, hsa
gugacaaugucccccauaucuguaugucaccaggauggcagagagccagggcagagagagacug

SEQ ID NO: 132345 - RNA, 64 nt, hsa
gcacucuuggugcaucaccggacaucuuagaccuauggcagagcauccucucugcccuggguga

SEQ ID NO: 132346 - RNA, 64 nt, hsa
uuuuaguuuuuuuaaaaaaaacaaaaacaaaaacauggcagaugcauauugugucugguuauau

SEQ ID NO: 132347 - RNA, 64 nt, hsa
aggcuggggguaaggccaagaagguaggaggaaaauggcagaccugggcuggagaagaaccuuc

SEQ ID NO: 132348 - RNA, 64 nt, hsa
guuuuggagguccccccagagagcagagugggccauggcagaaguaggggguugguuggaccug

SEQ ID NO: 132349 - RNA, 64 nt, hsa
cacuuuaccugcaguuucuucccagcucgggcagauggcagaagggaccccuuggacuuuuucu

SEQ ID NO: 132350 - RNA, 64 nt, hsa
uguaaauuuuuccuccuuuaccuuugcuaauaucauggcagaauuuuucuuaucccuugugagg

SEQ ID NO: 132351 - RNA, 64 nt, hsa
gcauuaauagcuaaucacugggacuugaauucugauggcagauagucucuugcuuagugagaug

SEQ ID NO: 132352 - RNA, 64 nt, hsa
ccagaaaauauccaucuucuuuuuguggcugcuaauggcagaagugccugugcuagaguuccaa

SEQ ID NO: 132353 - RNA, 64 nt, hsa
acgggaugcuaagcagugcaccugcagugguuuaauggcagauaagcuccgucugcaguuccag

SEQ ID NO: 132354 - RNA, 64 nt, hsa
aaacauuguuuuugacuaugggagucaacucaacauggcagaaccauuuuugagaugaugauac

SEQ ID NO: 132355 - RNA, 64 nt, hsa
uagguucacacccuguuuuauaaacaacaucaaaauggcagaaccauugcugacuuuagguuca

SEQ ID NO: 132356 - RNA, 64 nt, hsa; identical to SEQ ID NO: 86065

SEQ ID NO: 132357 - RNA, 64 nt, hsa; identical to SEQ ID NO: 86066

SEQ ID NO: 132358 - RNA, 64 nt, hsa; identical to SEQ ID NO: 86067

SEQ ID NO: 132359 - RNA, 64 nt, hsa; identical to SEQ ID NO: 86068

SEQ ID NO: 132360 - RNA, 64 nt, hsa; identical to SEQ ID NO: 86069

SEQ ID NO: 132361 - RNA, 64 nt, hsa; identical to SEQ ID NO: 86070

SEQ ID NO: 132362 - RNA, 64 nt, hsa; identical to SEQ ID NO: 86071

SEQ ID NO: 132363 - RNA, 64 nt, hsa; identical to SEQ ID NO: 86072

SEQ ID NO: 132364 - RNA, 64 nt, hsa; identical to SEQ ID NO: 86073

SEQ ID NO: 132365 - RNA, 64 nt, hsa; identical to SEQ ID NO: 86074

SEQ ID NO: 132366 - RNA, 64 nt, hsa; identical to SEQ ID NO: 86075

SEQ ID NO: 132367 - RNA, 64 nt, hsa; identical to SEQ ID NO: 86076

SEQ ID NO: 132368 - RNA, 64 nt, hsa; identical to SEQ ID NO: 86077

SEQ ID NO: 132369 - RNA, 64 nt, hsa; identical to SEQ ID NO: 86078

SEQ ID NO: 132370 - RNA, 64 nt, hsa; identical to SEQ ID NO: 86079

SEQ ID NO: 132371 - RNA, 64 nt, hsa; identical to SEQ ID NO: 86080

SEQ ID NO: 132372 - RNA, 64 nt, hsa; identical to SEQ ID NO: 86081

SEQ ID NO: 132373 - RNA, 64 nt, hsa; identical to SEQ ID NO: 86082

SEQ ID NO: 132374 - RNA, 64 nt, hsa; identical to SEQ ID NO: 86083

SEQ ID NO: 132375 - RNA, 64 nt, hsa; identical to SEQ ID NO: 86084

SEQ ID NO: 132376 - RNA, 64 nt, hsa; identical to SEQ ID NO: 86085

SEQ ID NO: 132377 - RNA, 64 nt, hsa; identical to SEQ ID NO: 86086

SEQ ID NO: 132378 - RNA, 64 nt, hsa; identical to SEQ ID NO: 86087

SEQ ID NO: 132379 - RNA, 64 nt, hsa; identical to SEQ ID NO: 86088

SEQ ID NO: 132380 - RNA, 64 nt, hsa; identical to SEQ ID NO: 86089

SEQ ID NO: 132381 - RNA, 64 nt, hsa; identical to SEQ ID NO: 86090

SEQ ID NO: 132382 - RNA, 64 nt, hsa; identical to SEQ ID NO: 86091

SEQ ID NO: 132383 - RNA, 64 nt, hsa; identical to SEQ ID NO: 86092

SEQ ID NO: 132384 - RNA, 64 nt, hsa; identical to SEQ ID NO: 86093

SEQ ID NO: 132385 - RNA, 64 nt, hsa; identical to SEQ ID NO: 86094

SEQ ID NO: 132386 - RNA, 64 nt, hsa; identical to SEQ ID NO: 86095

SEQ ID NO: 132387 - RNA, 64 nt, hsa; identical to SEQ ID NO: 86096

SEQ ID NO: 132388 - RNA, 64 nt, hsa; identical to SEQ ID NO: 86097

SEQ ID NO: 132389 - RNA, 64 nt, hsa; identical to SEQ ID NO: 86098

SEQ ID NO: 132390 - RNA, 64 nt, hsa; identical to SEQ ID NO: 86099

SEQ ID NO: 132391 - RNA, 64 nt, hsa; identical to SEQ ID NO: 86100

SEQ ID NO: 132392 - RNA, 64 nt, hsa; identical to SEQ ID NO: 86101

SEQ ID NO: 132393 - RNA, 64 nt, hsa; identical to SEQ ID NO: 86102

SEQ ID NO: 132394 - RNA, 64 nt, hsa; identical to SEQ ID NO: 86103

SEQ ID NO: 132395 - RNA, 64 nt, hsa; identical to SEQ ID NO: 86104

SEQ ID NO: 132396 - RNA, 64 nt, hsa; identical to SEQ ID NO: 86105

SEQ ID NO: 132397 - RNA, 64 nt, hsa; identical to SEQ ID NO: 86106

SEQ ID NO: 132398 - RNA, 64 nt, hsa; identical to SEQ ID NO: 86107

SEQ ID NO: 132399 - RNA, 64 nt, hsa; identical to SEQ ID NO: 86108

SEQ ID NO: 132400 - RNA, 64 nt, hsa; identical to SEQ ID NO: 86109

SEQ ID NO: 132401 - RNA, 64 nt, hsa; identical to SEQ ID NO: 86110

SEQ ID NO: 132402 - RNA, 64 nt, hsa; identical to SEQ ID NO: 86111

SEQ ID NO: 132403 - RNA, 64 nt, hsa; identical to SEQ ID NO: 86112

SEQ ID NO: 132404 - RNA, 64 nt, hsa; identical to SEQ ID NO: 86113

SEQ ID NO: 132405 - RNA, 64 nt, hsa; identical to SEQ ID NO: 86114

SEQ ID NO: 132406 - RNA, 64 nt, hsa; identical to SEQ ID NO: 86115

SEQ ID NO: 132407 - RNA, 64 nt, hsa; identical to SEQ ID NO: 86116

SEQ ID NO: 132408 - RNA, 64 nt, hsa; identical to SEQ ID NO: 86117

SEQ ID NO: 132409 - RNA, 64 nt, hsa; identical to SEQ ID NO: 86118

SEQ ID NO: 132410 - RNA, 64 nt, hsa; identical to SEQ ID NO: 86119

SEQ ID NO: 132411 - RNA, 64 nt, hsa; identical to SEQ ID NO: 86120

SEQ ID NO: 132412 - RNA, 64 nt, hsa; identical to SEQ ID NO: 86121

SEQ ID NO: 132413 - RNA, 64 nt, hsa; identical to SEQ ID NO: 86122

SEQ ID NO: 132414 - RNA, 64 nt, hsa; identical to SEQ ID NO: 86123

SEQ ID NO: 132415 - RNA, 64 nt, hsa; identical to SEQ ID NO: 86124

SEQ ID NO: 132416 - RNA, 64 nt, hsa
ucuaugaugagaaacaaugaaauuaugacuaaaauuuaacaaauaguauuuucuuauagaagca

SEQ ID NO: 132417 - RNA, 64 nt, hsa
aguuuagccuuuacuugaauguauacuguagauuuuuaacaaagcgaguucuauauuuauuaug

SEQ ID NO: 132418 - RNA, 64 nt, hsa
gagaauaaauaggcauaugauacccacuuggacuuuuaacaaaaguaaaggaauaaauuugcau

SEQ ID NO: 132419 - RNA, 64 nt, hsa
acagauguauuuugcacagugcacuuaugucuauuuuaacaauccuccugcaucuguauuuuau

SEQ ID NO: 132420 - RNA, 64 nt, hsa
uaauucauugugguaagaaugauugaaaugcagauuuaacaaucuuauaaucuauugaaugcca

SEQ ID NO: 132421 - RNA, 64 nt, hsa
ugaagaaaguauuuaaauccaacuuuugaacagauuuaacaaacaugaggaacuuuuuuauuua

SEQ ID NO: 132422 - RNA, 64 nt, hsa
cuuuauacagagaauucuacaaguuugcaaauauuuuaacaauauuaaaugugcaauagaacuu

SEQ ID NO: 132423 - RNA, 64 nt, hsa
ugcauuccaaugcuaaauagaaguuaugaguggguuuaacaauuuuagaugauucagcuuuugu

SEQ ID NO: 132424 - RNA, 64 nt, hsa
agccagauguguaucagauguuucacugacaguuuuuaacaauaaauucuuuucacuguauuuu

SEQ ID NO: 132425 - RNA, 64 nt, hsa
aaguacaaaaggaacuaugaaaaccagaacaaauuuuaacaaaaggacaaccacagagggauau

SEQ ID NO: 132426 - RNA, 64 nt, hsa
uuauauuguauuuucucagauaagaaaaauguuuuuuaacaauauuauuuuaaucuguuuuaag

SEQ ID NO: 132427 - RNA, 64 nt, hsa
cuaauauagaagauaaaauugguguccucauaacuuuaacaaagaaaacccucaguccuauuua

SEQ ID NO: 132428 - RNA, 64 nt, hsa
aacuugucaggugcuuuacaacuacauaguacuuuuuaacaacaaaauaauaauuuuaagaaug

SEQ ID NO: 132429 - RNA, 64 nt, hsa
uguccuaauuuaacaucuuguuacauaaauaugguuuaacaaacacuguuuaaccuuucuuuau

SEQ ID NO: 132430 - RNA, 64 nt, hsa
ugaaaacaacaacaacaaaaguccauucauauuuuuuaacaauuguauaagugcccaaguaauu

SEQ ID NO: 132431 - RNA, 64 nt, hsa
gucgcagcacuaaaaauggaugacaucaaacauuuuuaacaaaaugauguacaaacuaaggacu

SEQ ID NO: 132432 - RNA, 64 nt, hsa
uccauaggucuccuuucuauaaaucaucuugauguuuaacaacucuuauuauauuaaaaucuca

SEQ ID NO: 132433 - RNA, 64 nt, hsa
ucagaagcucugagaguaaggccuaccaaucugguuuaacaagcccgucaggugauucugauuu

SEQ ID NO: 132434 - RNA, 64 nt, hsa
auuuuucccucacagucaguagcuuuguuugauauuuaacaauaaguauauggugauauacuug

SEQ ID NO: 132435 - RNA, 64 nt, hsa
uugaaguuucugggaacacauaauauguagccaguuuaacaaagaagcugucaggugcacagcc

SEQ ID NO: 132436 - RNA, 64 nt, hsa
uuuacucaaaucaaaguuaaguacagaguuuauuuuuaacaaaugucauagcuaugucaccuua

SEQ ID NO: 132437 - RNA, 64 nt, hsa
caaaucucuuuagcacuauuuuaaguuugaaaacuuuaacaaugaaggggaaggggaagauuuc

SEQ ID NO: 132438 - RNA, 64 nt, hsa
uuuuaaauguuuuuuaaaagacacaucugacauuuuuaacaacuuaguaaaaguugaaaugacc

SEQ ID NO: 132439 - RNA, 64 nt, hsa
gagaugggaaggaauguugacuugcuaacauuccuuuaacaaguuaagaaaacuuguuaaaugu

SEQ ID NO: 132440 - RNA, 64 nt, hsa
aguauuuaagccucaacaauccaaaucuacaaacuuuaacaaugcaagucuuacucuaauuuuu

SEQ ID NO: 132441 - RNA, 64 nt, hsa
auuaagugaaaaucuucccuuuguuaaggagcuuuuuaacaagagugucuuugcugggugguga

SEQ ID NO: 132442 - RNA, 64 nt, hsa
uaguacauggcagauugccuguaagucuguucauuuuaacaacauacagggcugggcacggugg

SEQ ID NO: 132443 - RNA, 64 nt, hsa
uuaaucuguuguaauuguaguauuguuuuuguaauuuaacaauaaauaagccugcuacauguaa

SEQ ID NO: 132444 - RNA, 64 nt, hsa
auauauuuguugaauaacagaacgaguguaaaauuuuaacaacggaaaggguuaaauuaacucu

SEQ ID NO: 132445 - RNA, 64 nt, hsa
uuuuuaacaaaaauaaucuuaggauaagaauuauuuuaacaacauauaaaacuguuucaagccc

SEQ ID NO: 132446 - RNA, 64 nt, hsa
uacagcugagugggaaccggaaaccuauucucuuuuuaacaaaaauaaucuuaggauaagaauu

SEQ ID NO: 132447 - RNA, 64 nt, hsa
aaauggcaacaauggauaaaccaaggauuuuguguuuaacaauccauuuccagugucuucgcca

SEQ ID NO: 132448 - RNA, 64 nt, hsa
cccaccuacauuucuguuuggugacauugcucauuuuaacaaauaugaccgagucuaguuuuuc

SEQ ID NO: 132449 - RNA, 64 nt, hsa
agauggaguaccaugaggguugcuauuuguuguuuuuaacaacuaaucaagagugagugaacaa

SEQ ID NO: 132450 - RNA, 64 nt, hsa
ucucacagagccaacucacucuuaugaaaugggcuuuaacaaaacaagaaagaaacguacuuaa

SEQ ID NO: 132451 - RNA, 64 nt, hsa
uaaaugcauccuaccauucaagguuaucauauaauuuaacaaaauuguacaaccuuaaggcucu

SEQ ID NO: 132452 - RNA, 64 nt, hsa
augcacugcuuucauguaaaaugauauaaucuucuuuaacaaauauuuucuucauugauaacug

SEQ ID NO: 132453 - RNA, 64 nt, hsa
agaaagagcaauugauaaaguaaaugagguaaaauuuaacaauaaucugagcaaaagguauaug

SEQ ID NO: 132454 - RNA, 64 nt, hsa
aaagagagcaauugauaaggcaaauaagguaacauuuaacaauaaucugauacacauaaauaga

SEQ ID NO: 132455 - RNA, 64 nt, hsa
uugucucuuuuuuguuuaacaagguaacuuuuuguuuaacaagguaacuuuuuguuuaaccuag

SEQ ID NO: 132456 - RNA, 64 nt, hsa
uaagaugccccugcuugucuuugucucuuuuuuguuuaacaagguaacuuuuuguuuaacaagg

SEQ ID NO: 132457 - RNA, 64 nt, hsa
uuuauccaugaaggacugagugaccuuuguuguauuuaacaaaauccaggugcaucaauuucug

SEQ ID NO: 132458 - RNA, 64 nt, hsa
uauguuccauggcugaauuuuaaagcuguuuagguuuaacaaugaagggauuuauucuuuaguc

SEQ ID NO: 132459 - RNA, 64 nt, hsa
gccuugauaaauauauaugaucauugaaauacuuuuuaacaaaaaacagauucuauauuauuau

SEQ ID NO: 132460 - RNA, 64 nt, hsa
auauccuauauaggaaacuaagcauuguauuuuuuuuaacaaaucuaaaaaagcacuaugaacu

SEQ ID NO: 132461 - RNA, 64 nt, hsa
aagaaguguauauuuucaaacaauuuuuuaaugauuuaacaauuuuuguaaaucauuuucaggc

SEQ ID NO: 132462 - RNA, 64 nt, hsa
caaggccuaauuugcaguaacuauugcuguuuuauuuaacaaugccuuguugcuuuguaugcau

SEQ ID NO: 132463 - RNA, 64 nt, hsa
agugguuaauuaccuuuaugugaacuuugaaugguuuaacaaaagauuuguuuuuguagagauu

SEQ ID NO: 132464 - RNA, 64 nt, hsa
caugcuacuaaauuuuuauaauaauugaaaagauuuuaacaaguauaaaaaauucucauaggaa

SEQ ID NO: 132465 - RNA, 64 nt, hsa
uuuuuaauagccaaguaguucugcaaauaguucuuuuaacaauuugaccucucuccaaaacaga

SEQ ID NO: 132466 - RNA, 64 nt, hsa
gucaaaucaguuuccuuuuaacauaauuaaucccuuuaacaaaaagccgucuaugggauuaaaa

SEQ ID NO: 132467 - RNA, 64 nt, hsa
gaaacccuacaaaugugaagaacguggccuggcuuuuaacaaauccucaacauuuacuaagcau

SEQ ID NO: 132468 - RNA, 64 nt, hsa
gcgaaacuacaauccugaaugaugucacagugcuuuuaacaauaccucaaacuuuucuaaacau

SEQ ID NO: 132469 - RNA, 64 nt, hsa
aauuuucaaaaacucaaucaauguaauucaguauuuuaacaaaaggaaugaaaaauuaucaucu

SEQ ID NO: 132470 - RNA, 64 nt, hsa
cuguguccauguguucucauuguuauacgaacauuuuaacaauguuaauucuugcagaccauga

SEQ ID NO: 132471 - RNA, 64 nt, hsa
acaguuaaacaaccagauugcaagauuccugaaauuuaacaauugguuuucagggcccagucca

SEQ ID NO: 132472 - RNA, 64 nt, hsa
aaugcauguguccacuuacaugagaugguaaauguuuaacaauggacuuucugaaagggaaaaa

SEQ ID NO: 132473 - RNA, 64 nt, hsa
cuauauaauauguacuuugaguauaacaucaagcuuuaacaaauauuuaaagacaaaaaaauca

SEQ ID NO: 132474 - RNA, 64 nt, hsa
auugcugacuuuagguucacaugaggaauguacuuuuaacaauucccaguacuaucaguauugu

SEQ ID NO: 132475 - RNA, 64 nt, hsa
guagcuuuacaaaccauucacugauuuuguguaauuuaacaauagauaugaaauaaaguuuaaa

SEQ ID NO: 132476 - RNA, 64 nt, hsa
aaaugaaacauaaaaccuuuuauuuucuucugauuuuaacaaggaaucuauuuaaauagaauaa

SEQ ID NO: 132477 - RNA, 64 nt, hsa
accuguaaagguuuuaaaguugaaaaaccuucucuucagaaaagaagaaaaauucagaaaucag

SEQ ID NO: 132478 - RNA, 64 nt, hsa
guugaaaaaccuucucuucagaaaagaagaaaaauucagaaaucaguagaucuuggcaauucag

SEQ ID NO: 132479 - RNA, 64 nt, hsa
uuauggcaggucuaaucaaaaggcuaaauacaauuucagaaaagguucugauacucuuguuuuu

SEQ ID NO: 132480 - RNA, 64 nt, hsa
ugaaagcuguuucuguuuucauuuuacauuauuauucagaaaugguagcuauucuauaccuaug

SEQ ID NO: 132481 - RNA, 64 nt, hsa
ucaauuacaaacuccugggcuuucuggggagggguucagaaaacaucaaaacacugcagcaguu

SEQ ID NO: 132482 - RNA, 64 nt, hsa
acguccugcuucuugguugagacuacugggauccuucagaaaagaaacacugggucccauagcu

SEQ ID NO: 132483 - RNA, 64 nt, hsa
uuuagacacuccccaaauuucuaaauuaaucuuuuucagaaauaucgaaggagccaaaaauaua

SEQ ID NO: 132484 - RNA, 64 nt, hsa
auuuuuauuguguaaugaucuuuaaacgcuauauuucagaaauauuaaauggaagaaaucaaua

SEQ ID NO: 132485 - RNA, 64 nt, hsa
cuggaaaugggaaagggagggguagaaguuccuuuucagaaauaaagaggcauucaugaaggcu

SEQ ID NO: 132486 - RNA, 64 nt, hsa
gacucucucugauggucacuuuguggucugugcuuucagaaauacaggaaucugauaucaacau

SEQ ID NO: 132487 - RNA, 64 nt, hsa
ugaaugguggcccagccaacaggaagcccagccuuucagaaagagccuggcaaggcccuguuga

SEQ ID NO: 132488 - RNA, 64 nt, hsa
gagagggaacaagaugccaucugucaacugcaccuucagaaaagucuaccugggagacuaguua

SEQ ID NO: 132489 - RNA, 64 nt, hsa
caagucucacugagaucacccuacugcuuaauaauucagaaaauuuucacaugcaaaguguuug

SEQ ID NO: 132490 - RNA, 64 nt, hsa
aguagaguaaaaauaaaaaacagugucauuuucauucagaaacugagcaguuucuaacuuagcu

SEQ ID NO: 132491 - RNA, 64 nt, hsa
uggccagagcuugaagucuggucucucauuuuguuucagaaaugagugagaggccuuccugcag

SEQ ID NO: 132492 - RNA, 64 nt, hsa
uugagcauaguagcucccuaaacucuuggagccuuucagaaauuccauguagugcuaauaaccu

SEQ ID NO: 132493 - RNA, 64 nt, hsa
ccuaguuacaaauaacuccauugaacagcaucuauucagaaacuaugccgaauaaaaagauugg

SEQ ID NO: 132494 - RNA, 64 nt, hsa
gacacucaguuacaaacauuaucuccuuuaguuuuucagaaaaugcaucccugauuucauucau

SEQ ID NO: 132495 - RNA, 64 nt, hsa
gaguggacugugcuugucaacggauguguagcuuuucagaaacuuaauuggggaugaauagaaa

SEQ ID NO: 132496 - RNA, 64 nt, hsa
cugguuacuucuaguaaauuccugucaaaaucaauucagaaauucuaacuuggagaauuuaaca

SEQ ID NO: 132497 - RNA, 64 nt, hsa
aauuaauaagaagcacaacuuguucacaaacucauucagaaaugauucucccaacaaugcguau

SEQ ID NO: 132498 - RNA, 64 nt, hsa
auauggaaagcagagcaguacauauucaaauguauucagaaagucaaaagauuaccuaucguuc

SEQ ID NO: 132499 - RNA, 64 nt, hsa
acucaguugugcugaggucaauagaguguagaguuucagaaaggauuccagcagguuuauaugu

SEQ ID NO: 132500 - RNA, 64 nt, hsa
ucagaugacguggcuuugucuagacagcacgcaguucagaaagaaaugucuuuauacaaaagac

SEQ ID NO: 132501 - RNA, 64 nt, hsa
ugcugggccugcucacagagccacaggaagaucauucagaaacuaggaaaggaggcccccacag

SEQ ID NO: 132502 - RNA, 64 nt, hsa
caguuugcaaaagugcuuuuauacauuuucuaauuucagaaacaggauaauuuguuaagugggu

SEQ ID NO: 132503 - RNA, 64 nt, hsa
ccucuuccaauuccuccucuucuucagaaucaucuucagaaagugaacuugaacaugagagaag

SEQ ID NO: 132504 - RNA, 64 nt, hsa
aucagagcacuuauucaaaauacagugauagaaguucagaaagcucaccaaggucaaggagcag

SEQ ID NO: 132505 - RNA, 64 nt, hsa
acuugucuuugauacaaaagagugcugacaguauuucagaaagcugagagaguuuuauacaugg

SEQ ID NO: 132506 - RNA, 64 nt, hsa
aaaacauugccucuuugcaucacauaccucguuuuucagaaacuuuccaaacugcuuuacauag

SEQ ID NO: 132507 - RNA, 64 nt, hsa
uaauguucauuuugauuuauuuuaaaucuuuacauucagaaaugagauacuguauuaucagacc

SEQ ID NO: 132508 - RNA, 64 nt, hsa
uugauaccuauuuugggguauaaacaugguguuuuucagaaauaaaaauuauuucauuaaccuu

SEQ ID NO: 132509 - RNA, 64 nt, hsa
acugucuauuaauauucaggguaaauaggaaucauucagaaauguugagucuguacuaaacagu

SEQ ID NO: 132510 - RNA, 64 nt, hsa
ugggaaaacauguuaaugacaauauuccagaucuuucagaaauauaacacauuuuuuugcaugc

SEQ ID NO: 132511 - RNA, 64 nt, hsa
ccugccugggcguucuacuuggcugcaagggcucuucagaaagcaccuaguuccuuuuggcuuu

SEQ ID NO: 132512 - RNA, 64 nt, hsa
guacaccccuccguucaguuccuuggggguauuuuucagaaauccaaaggcaacccuucgugca

SEQ ID NO: 132513 - RNA, 64 nt, hsa
uggaucucuuaguuggucacuuaauucuuucuuuuucagaaagauaguauguucacugguauau

SEQ ID NO: 132514 - RNA, 64 nt, hsa
cuggguuuugggucuaauuaugaauaaggacugauucagaaaacgaguuuaugguagguagacu

SEQ ID NO: 132515 - RNA, 64 nt, hsa
gacuuucuagugaauuauuaccauaaauaacaauuucagaaacuuaguuuuuagaauaaauauu

SEQ ID NO: 132516 - RNA, 64 nt, hsa
auucagauagauaauaugaaucauuauggguugauucagaaauaaaauuugugaggugauuuug

SEQ ID NO: 132517 - RNA, 64 nt, hsa
caccuaagagaaaaagaucgaauuuuucagaugauucagaaauuuucauucagguauuuguaau

SEQ ID NO: 132518 - RNA, 64 nt, hsa
guuucuuucauaugaaaaaaaugcauuuuauaaauucagaaagucauagauuucugaaggcguc

SEQ ID NO: 132519 - RNA, 64 nt, hsa
guaaaccuuccugaaagauaaacguuuuccugaauucagaaacuaguagcuaacauugcuucug

SEQ ID NO: 132520 - RNA, 64 nt, hsa
gggucuuuaaaucuuuuagauauauacuggucauuucagaaaauucuucauagugguauuggcc

SEQ ID NO: 132521 - RNA, 64 nt, hsa
uuauugugacaaaaggaaauaaaaagccuaaauguucagaaaauuauuuuaaaagaugaaagag

SEQ ID NO: 132522 - RNA, 64 nt, hsa
ggacucucaagagaacugaaacauaaucaauggauucagaaaugacucagaaaaaagaagcugc

SEQ ID NO: 132523 - RNA, 64 nt, hsa
uucuaagagcacaugacauguggcugccuccccuuucagaaacaagcugaguaacccagccugc

SEQ ID NO: 132524 - RNA, 64 nt, hsa
guggaacccaaacuguauggggauauuugauguuuucagaaagaggaagaaaauaugguccaaa

SEQ ID NO: 132525 - RNA, 64 nt, hsa
caggggaacuaugucacaguuuaccucuuccugauucagaaauguguaugguuugcagcuuuua

SEQ ID NO: 132526 - RNA, 64 nt, hsa
ucugaaaauaaaaauuauacaguaguaaagauaauucagaaagaaaaagcuaccuguuagaauu

SEQ ID NO: 132527 - RNA, 64 nt, hsa
uuuucccccugcuucagguuaauuuuuuggauauuucagaaacccauagcaauucagugauuuu

SEQ ID NO: 132528 - RNA, 63 nt, hsa
auuuccuccaaacaaaauaaugcaggaauuuauuucagaaaauguaguuuacaagaauaaaga

SEQ ID NO: 132529 - RNA, 54 nt, hsa
uugaaccaauggauccuuaagauuuucagaaaacacuuauuuuguuucuuaagu

SEQ ID NO: 132530 - RNA, 64 nt, hsa
gauaauccuucauaauuuauuauacaauuuaucauucagaaagcaauaauuaaaaaaguuuaca

SEQ ID NO: 132531 - RNA, 64 nt, hsa
cauguuugcaaaaggucacugugaggcugcauauuucagaaagauguccuuaauaagggaaguc

SEQ ID NO: 132532 - RNA, 64 nt, hsa
caagucacugcugccauguguguacuguauuauuuucagaaaaaaauauaauagucugagucca

SEQ ID NO: 132533 - RNA, 64 nt, hsa
uuuauaaagcacauauucauaauaacgagaagaauucagaaaaccacuuaagcaagacccuucu

SEQ ID NO: 132534 - RNA, 64 nt, hsa
aaaauuguuuuucuaauacuuuauagggcccaacuucagaaaauacuucgcuuuuuucuuuuua

SEQ ID NO: 132535 - RNA, 64 nt, hsa
uggucuuuuccuguuaacaagcuggcagcaaagcuucagaaaauauauaugcaagcacaacuug

SEQ ID NO: 132536 - RNA, 64 nt, hsa
gaguguuuacucacucuggauagcuaggugauuauucagaaaauacgguuacauagcuauuuau

SEQ ID NO: 132537 - RNA, 64 nt, hsa
uuuaugcaguacagugggcuuauuguguuaacacuucagaaagauucaaacucauaaacucagu

SEQ ID NO: 132538 - RNA, 64 nt, hsa
gcuaguaauauuacuuauaacuguaauauauagauucagaaauacauuuucauuauccaaaauc

SEQ ID NO: 132539 - RNA, 64 nt, hsa
cccauaauuuagaaaaggaugucgacuugcuaauuucagaaauaauuauucauuuuuaaaaagc

SEQ ID NO: 132540 - RNA, 64 nt, hsa
gcucaccccuuauugcacaggaaagcauuuauacuucagaaagauuguacaaauacaaggaaug

SEQ ID NO: 132541 - RNA, 64 nt, hsa
aagcauuauaaaugcaauuuuugucaagagaucuuucagaaaauauaagccuuuaaagugaaga

SEQ ID NO: 132542 - RNA, 64 nt, hsa
uuuccuucuuucagaaacauuccucuucuggggcuucagaaagcuggcaaggccacuagcagag

SEQ ID NO: 132543 - RNA, 64 nt, hsa
cacacacaguuggcagcacauagcguuuccuucuuucagaaacauuccucuucuggggcuucag

SEQ ID NO: 132544 - RNA, 64 nt, hsa
uuuaaaaaggacauuucuaucagggauauauaccuucagaaauaaggaaauaggggaaaaaaag

SEQ ID NO: 132545 - RNA, 64 nt, hsa
ggcgugagccaccaggcccugccugguuuucaaauucagaaaucuuauuauuuaacccagaagu

SEQ ID NO: 132546 - RNA, 64 nt, hsa
uaaguuauaauuuaggauugucuuuaaacagccauucagaaacaaaacuguagaacuguguauu

SEQ ID NO: 132547 - RNA, 64 nt, hsa
uauuaauaagaaaauuugcacauaacuuaguugauucagaaaggacuuguaugcuguuuuucuc

SEQ ID NO: 132548 - RNA, 64 nt, hsa
uggacuugugaauuuuugaguacauacuauguguuucagaaauauguagaaauaaaaauguugc

SEQ ID NO: 132549 - RNA, 64 nt, hsa
augaguaacaacuuugcuuaaguguuuaucuuaguucagaaauacauaaugucauauguuaaaa

SEQ ID NO: 132550 - RNA, 64 nt, hsa
aguucaauguaacauuuuaaaugcaauuuauuauuucagaaauuucccaugaaacuaaaaauag

SEQ ID NO: 132551 - RNA, 64 nt, hsa
uuuuuucagagagugaccgaauaggaagaagggauucagaaauaugauguaguagaacaugccc

SEQ ID NO: 132552 - RNA, 64 nt, hsa
ggauauggaguuguaguagaaaaagcaccugcuuuucagaaagacuauuauuuccuaaccauga

SEQ ID NO: 132553 - RNA, 64 nt, hsa
cucagaaaggaagaccaugccauggggccagaaauucagaaacguaauucuuacauugugauug

SEQ ID NO: 132554 - RNA, 64 nt, hsa
aucagacugaacacagugaaauaugugcccaaaguucagaaagaugaaguuuccagaaacuaag

SEQ ID NO: 132555 - RNA, 64 nt, hsa
gugucauaauuccauuaagguuuaauuauauuuuuucagaaaacagugaugaauucuguagucc

SEQ ID NO: 132556 - RNA, 64 nt, hsa
aggaccacaaugcccccggccuaaaguacugccauucagaaaagcagguuuuucuuccucucuu

SEQ ID NO: 132557 - RNA, 64 nt, hsa
aauauaaaagcuauauuuugaagacuugaguuauuucagaaaaaacuacagcccuuuuugucuu

SEQ ID NO: 132558 - RNA, 64 nt, hsa
uucauuuuuuguuuuguuuuuuucaaucaugauauucagaaaaauccaggauccaaaauguggc

SEQ ID NO: 132559 - RNA, 64 nt, hsa
ucagggcaaaaguaugggcauuuuucuugcuauguucagaaaguacaguucucuccaacuugca

SEQ ID NO: 132560 - RNA, 64 nt, hsa
gaaccucgggaucccaaagaaugaggggaauuucuucagaaagacaaucucggcaugcauuauu

SEQ ID NO: 132561 - RNA, 64 nt, hsa
cuguagggucgauugaauuggaccuuuucaguuguucagaaaaauaaaaauaauuucucauauu

SEQ ID NO: 132562 - RNA, 64 nt, hsa
uagaaucaguucauaucaccauuaaaaucauccauucagaaaccaaggccuugucugcagaaau

SEQ ID NO: 132563 - RNA, 64 nt, hsa
gaagacagcuguauuugggagaagucaugucagauucagaaauuugccauuauguauuuuuaug

SEQ ID NO: 132564 - RNA, 64 nt, hsa
uagcacuuggucuccucccuugucucuagugucuuucagaaaguuggcaauaccuuaacaaaug

SEQ ID NO: 132565 - RNA, 64 nt, hsa
cuguauauucccuguggaauguaccuaugugaguuucagaaauucucaaaauacguguucaaaa

SEQ ID NO: 132566 - RNA, 64 nt, hsa
caaugagugugccagaguuauuagugccaaguuuuucagaaaguuugaagcaccaugguguguc

SEQ ID NO: 132567 - RNA, 64 nt, hsa
uaggaaagaaaaugauauuuucuaaguaaguuuauucagaaaaauauauauuaauuuaauucug

SEQ ID NO: 132568 - RNA, 64 nt, hsa
uagagucagcugccgaacggagaucagaauagacuucagaaagcuucgguggaaggucacuauu

SEQ ID NO: 132569 - RNA, 64 nt, hsa
uucugauuguuuugaacuggagcaugcacuuauuuucagaaacuuagagaguugccccuaggac

SEQ ID NO: 132570 - RNA, 64 nt, hsa
aauacacuaaaugggaaaaauaagcaaggacacguucagaaaugacacugaaucccuguguuga

SEQ ID NO: 132571 - RNA, 64 nt, hsa
acuagauggaagacuugcaucaguugcuuaaacuuucagaaaauuuguagagaaacccaacaaa

SEQ ID NO: 132572 - RNA, 64 nt, hsa
cuuaaggagaugugacauaugggaagacaacagauucagaaauuuacguggauaggacuuuaga

SEQ ID NO: 132573 - RNA, 64 nt, hsa
aauacaugcaauguggcuggugaacacuucugaauucagaaacuaucccagaucucagcuagaa

SEQ ID NO: 132574 - RNA, 64 nt, hsa
cucagcuuucuccaccuuucaguuucucaguuguuucagaaacauagcaaugacauaaaaacug

SEQ ID NO: 132575 - RNA, 64 nt, hsa
gugcauaugugugcauugccacucucccaaguuuuucagaaaccagcagagcugucaacucuuc

SEQ ID NO: 132576 - RNA, 64 nt, hsa
ggcuuucuuccauuguuguuuuuguagcauuuauuucagaaauguguauuuccauaauccagag

SEQ ID NO: 132577 - RNA, 64 nt, hsa
guuuucuuaaugccagugugaauuugcagauguuuucagaaaaucaagucacaguaacaauuug

SEQ ID NO: 132578 - RNA, 64 nt, hsa
guguuuuuaugggaauguaauuugaaaucacuacuucagaaauuugacuuaaaauucuugagca

SEQ ID NO: 132579 - RNA, 64 nt, hsa
augggaucguugauguuuaucagaacuguucacuuucagaaaugauuuuuuaaagcauuuuguu

SEQ ID NO: 132580 - RNA, 64 nt, hsa
gcagccaggacccgguaggccugagccucaacucuucagaaaauaguguuuuuaauauuccucu

SEQ ID NO: 132581 - RNA, 64 nt, hsa
aacucuucagaaaauaguguuuuuaauauuccucuucagaaaauaguguuuuuaauauuccgag

SEQ ID NO: 132582 - RNA, 64 nt, hsa
uucaacuaaaguuauaaauaaagagaaaaacucauucagaaaucauggauuuuaaaaauauuuu

SEQ ID NO: 132583 - RNA, 64 nt, hsa
ucuguucuugcuacccaugacuuuauauggaugauucagaaauuggaacagaauguuuuacugu

SEQ ID NO: 132584 - RNA, 64 nt, hsa
uuuucauugcacuucuaaaauucagccuuguucauucagaaaauaaggauggauuuugugaaua

SEQ ID NO: 132585 - RNA, 64 nt, hsa
ugugauuucucacauuuuuauuugcugagaaacauucagaaaauuauuccaaaaaugaagguac

SEQ ID NO: 132586 - RNA, 64 nt, hsa
uagggcuggcucuaggaagaagccugugucuuuuuucagaaaucccuggagcaacuuaaauguc

SEQ ID NO: 132587 - RNA, 64 nt, hsa
auaacaugucauugaagucauaaaaaguuuuuucuucagaaagguacucuaguguuaaguguau

SEQ ID NO: 132588 - RNA, 64 nt, hsa
auacauuugagaauaagaaauuacucucaagaacuucagaaaucugcaacauaauuuuauaaau

SEQ ID NO: 132589 - RNA, 64 nt, hsa
acauguauguaugucaaaacacuacauauacacuuucagaaagaauaaacuuucucaagucauu

SEQ ID NO: 132590 - RNA, 64 nt, hsa
uaauaauuuuuuuuaaaacauuaaggaauuggaauucagaaagguuacccccuuccucuguguc

SEQ ID NO: 132591 - RNA, 64 nt, hsa
cuuuguaaggauacauuuggaagaacauacaguauucagaaacuaaccuauauaaaauguaaac

SEQ ID NO: 132592 - RNA, 64 nt, hsa
uuuuuguuuaaucaaauacuugcuuaugaaggauuucagaaauuuguaauaaaugucagcuuuu

SEQ ID NO: 132593 - RNA, 64 nt, hsa
uuaucccuuuguaagcuacuuaucuccaaaaaacuucagaaauagaaaacuacauuuuggcagg

SEQ ID NO: 132594 - RNA, 64 nt, hsa
ucagcucuggauuugcagucaguuugggauucucuucagaaagauggcaucuaagugucugugu

SEQ ID NO: 132595 - RNA, 64 nt, hsa
cagcuggaaggcacaaggggaggacauuguggcauucagaaacugcaggagacaagaugaauuu

SEQ ID NO: 132596 - RNA, 64 nt, hsa
agugacagcuucuggcugaagacuuuugguucuauucagaaaccugugucguuuuuuugguguu

SEQ ID NO: 132597 - RNA, 64 nt, hsa
ugcucaguguagucugugaugaauaguuuaaguguucagaaauugguaaaccaacacacgggau

SEQ ID NO: 132598 - RNA, 64 nt, hsa
gucaguucacauuaguuuagcacuauagauaguauucagaaauugcuuucucuuugguaaagaa

SEQ ID NO: 132599 - RNA, 64 nt, hsa
aguagaaaaaggcuaaaggcuaugcgauaugaauuucagaaauggacugaaaauggagagcuau

SEQ ID NO: 132600 - RNA, 64 nt, hsa
ugggcacaguggcucaugccgauaaucccagcaauucagaaagcugaggcaggaggauuacuug

SEQ ID NO: 132601 - RNA, 64 nt, hsa
ucacuucuagacuuucacggugggacgaaacggguucagaaacugccaggggccucauacaggg

SEQ ID NO: 132602 - RNA, 64 nt, hsa
cccuuugacacaaaccauguguucugauuuuugguucagaaaauauugaaacugugaguuguuu

SEQ ID NO: 132603 - RNA, 64 nt, hsa
gugcaauuaacacugaaagagaccuguuaaaccauucagaaaaagcuuaagaaaugcgauauga

SEQ ID NO: 132604 - RNA, 64 nt, hsa
gcucugaagugucacaaggacaaguuuaaucugcuucagaaagcgccugugugcaacucaaauu

SEQ ID NO: 132605 - RNA, 64 nt, hsa
gcagcauagaauuuuggaauuuuggggcuuucuuuucagaaauugcuaccauaguaauuaaugu

SEQ ID NO: 132606 - RNA, 64 nt, hsa
ggaauauucucaccaucugaugccauguacccacuucagaaauaagcaauacuuguuccucugu

SEQ ID NO: 132607 - RNA, 64 nt, hsa
agccuucaaaagaauuggcacugggauaagauuuuucagaaaaagaaaaacaucggcaaacugu

SEQ ID NO: 132608 - RNA, 64 nt, hsa
aucgcugagcaaauggagcuugcuauguuuuaauuucagaaaauuuccucauauacguagugug

SEQ ID NO: 132609 - RNA, 64 nt, hsa
gauauuuuuaaaauccaagagcuucucuauacuuuucagaaauauccagaugcagugaacugcc

SEQ ID NO: 132610 - RNA, 64 nt, hsa
cuuacuuuuaaauuccaacuuaaaauuaugagguuucagaaauauauugaaaguuuaacaaugu

SEQ ID NO: 132611 - RNA, 64 nt, hsa
acaguguagaaucugaaguuuacaagcaccucucuucagaaaacaauacugcugaccaucaagc

SEQ ID NO: 132612 - RNA, 64 nt, hsa
gcagaaagccagaggacuagagccaaaaacuuguuucagaaagauaggagauagcucuguagaa

SEQ ID NO: 132613 - RNA, 64 nt, hsa
acagaaagccagaggacuagauccaaagacuuguuucagaaagaugagagagaacucuguggau

SEQ ID NO: 132614 - RNA, 64 nt, hsa
gcagaaagccagaggacuagaggccaagacuuguuucagaaagauggaagagaguucuuuggaa

SEQ ID NO: 132615 - RNA, 64 nt, hsa
uuuucucuagaguagagguauaauugugugauauuucagaaauacagauaaaugauucaaaaag

SEQ ID NO: 132616 - RNA, 64 nt, hsa
guugcugauuuuauucuugaucaguaguuugcauuucagaaagccuuucauuuugcuuuaauuu

SEQ ID NO: 132617 - RNA, 64 nt, hsa
caaacugagcaguuucuguguauauauagaagguagaaaugaaaagugagaaaauauuugaaag

SEQ ID NO: 132618 - RNA, 64 nt, hsa
uaaaacagagauaugugcaugaaaucaagaaaaaagaaaugaacaaaagcaaagcauuaguggc

SEQ ID NO: 132619 - RNA, 64 nt, hsa
ggaaaagaaaaaucaugucaucuucuauuuguacagaaaugaaaauaaaauaugaaaauaauga

SEQ ID NO: 132620 - RNA, 64 nt, hsa
uacagaaaugaaaauaaaauaugaaaauaaugaaagaaaugaaaagauagcuuuuaauuguggu

SEQ ID NO: 132621 - RNA, 64 nt, hsa
auguauuauaccuaaauguuuauuaaaaguuagaagaaaugaguaccaacaggaaggaauggaa

SEQ ID NO: 132622 - RNA, 64 nt, hsa
aggagaagaaauuacucccugcaacaggaggaauagaaaugaagcagugaguguucagaaauua

SEQ ID NO: 132623 - RNA, 64 nt, hsa
gguuaccucucugaauauuauguaaacaauccaaagaaaugauuguauuaagauuugugaauaa

SEQ ID NO: 132624 - RNA, 64 nt, hsa
gaaaacaguuuuuauucuguuuuauaaaccagagagaaaugaguuuugacgucuuuuuacuuga

SEQ ID NO: 132625 - RNA, 64 nt, hsa
guuuuugaaaguguuccuuccuaauagaggucuaagaaaugauauuuuucucaucuuaaaugag

SEQ ID NO: 132626 - RNA, 64 nt, hsa
aaaagccauuguuuauuauccuauaauucuuuaaagaaaugaugacuguuuuugaaaguguucc

SEQ ID NO: 132627 - RNA, 64 nt, hsa
aaauaaauaaggauggugauagagagguugaagaagaaaugaagaagcaugaaaguaauaaugu

SEQ ID NO: 132628 - RNA, 64 nt, hsa
guauuuuccagcuagaaaauuuuauggcuaucgaagaaaugaagaagcacggaaguacucaugu

SEQ ID NO: 132629 - RNA, 64 nt, hsa
uaauaagaagcacaacuuguucacaaacucauucagaaaugauucucccaacaaugcguaucag

SEQ ID NO: 132630 - RNA, 64 nt, hsa
uauaugauuguauuagaaaugcucagacuuccccagaaaugaaccauaaauuuuggaacuuccu

SEQ ID NO: 132631 - RNA, 64 nt, hsa
gaaguaauaauuuguuuacuuguaaauugaugggagaaaugaggaaaagaaaaucuuuuuaaaa

SEQ ID NO: 132632 - RNA, 64 nt, hsa
uaaaaaagaacuuuagcaugguauugaaggaauuagaaaugaauuuggagugcuuuuuauguau

SEQ ID NO: 132633 - RNA, 64 nt, hsa
ugguguuuacugcugcagcauguaucacaagauaagaaaugaaaaaucaaucuuucuuaccacc

SEQ ID NO: 132634 - RNA, 64 nt, hsa
aacguuuuucuucauguucuauuuuugauuuuacagaaaugauuuugccuccuuguggauacug

SEQ ID NO: 132635 - RNA, 64 nt, hsa
uuaacuuuuuaacuaaaguuaguauuuguuuuucagaaaugaccacugaagauucauucugauu

SEQ ID NO: 132636 - RNA, 64 nt, hsa
uacaaauuacucugucuccaaaggcaacgugaaaagaaaugauggggaggaaaaaaccccauag

SEQ ID NO: 132637 - RNA, 64 nt, hsa
ugccuaugcauugaugccugaaaaauauguauaaagaaaugagguugacucuucugagcaguuc

SEQ ID NO: 132638 - RNA, 64 nt, hsa
uuggugcacagauugcugaaacuguggggcuuacagaaaugacugccggucauuugaaugagac

SEQ ID NO: 132639 - RNA, 64 nt, hsa
cuuuuuuuacuucgucuucgcccucugaaauuaaagaaaugaaaaaaaaaaacaauaucugcag

SEQ ID NO: 132640 - RNA, 64 nt, hsa
cuccuugcugaugcuguguuaugugucaucuaacagaaaugacuccuuugaaauaaguaaaucu

SEQ ID NO: 132641 - RNA, 64 nt, hsa
uguuauaugcacauugccaagaauuacugucaagagaaaugauaaguaaaagucauuuaugaaa

SEQ ID NO: 132642 - RNA, 64 nt, hsa
uguccacgcaauggaacauuauuagacucuaaaaagaaaugaaguacucacacaugccacaaca

SEQ ID NO: 132643 - RNA, 64 nt, hsa
acccaggaaugccacuccuagguauuuacccaagagaaaugaaaacguacauacacacaaaaac

SEQ ID NO: 132644 - RNA, 64 nt, hsa
ugcaacagaccaacagauaacucauccuaaacagagaaaugagaaagagucugugggugggccu

SEQ ID NO: 132645 - RNA, 64 nt, hsa
ucugcccuaaggauaaaugaucacuuacuggggaagaaaugagagagcaggggcaccccccuag

SEQ ID NO: 132646 - RNA, 64 nt, hsa
uuaaguuuuagaaaugagaaaaauacagaguuuuagaaaugagaucuagagaacacgucuucua

SEQ ID NO: 132647 - RNA, 64 nt, hsa
uaguaaggucaguuugauuggauacuuaaguuuuagaaaugagaaaaauacagaguuuuagaaa

SEQ ID NO: 132648 - RNA, 64 nt, hsa
cuugucaccuguauggggaauacuuuuacuacucagaaaugaauuuaugugcugccauuugcua

SEQ ID NO: 132649 - RNA, 64 nt, hsa
uugcuauaaaguugaacuuuguauggcuugaaaaagaaaugacaauauggaacaucccaaggcu

SEQ ID NO: 132650 - RNA, 64 nt, hsa
uucuacaaaucuuacagaguguaaagagauaaaaagaaaugauuuuuuuucuuaccuuuacaua

SEQ ID NO: 132651 - RNA, 64 nt, hsa
aauguguucuggguguuuuagggaacauauugauagaaaugaccaccuugcagacaaaaucucu

SEQ ID NO: 132652 - RNA, 64 nt, hsa
auaaauacacauuuuggccuauuagcaaagauuaagaaaugauaacauuaaauacucaauaaau

SEQ ID NO: 132653 - RNA, 64 nt, hsa
cucucaagagaacugaaacauaaucaauggauucagaaaugacucagaaaaaagaagcugccag

SEQ ID NO: 132654 - RNA, 64 nt, hsa
acguaccuaugugcauacacuuauuuuauauguuagaaaugacguguuuuaaugagaggccucc

SEQ ID NO: 132655 - RNA, 64 nt, hsa
agucccuaagccacccccuccaaagauggaguguagaaaugaugacagcacuuaguaaguucaa

SEQ ID NO: 132656 - RNA, 64 nt, hsa
gaguuucgcacuugauuuucaauauuuuauaguaagaaaugacaaacugcuuuguuucauuuca

SEQ ID NO: 132657 - RNA, 64 nt, hsa
agaugccacacaaggaacuacauuccagauuuaaagaaaugaaaggauaccauuaguguguaua

SEQ ID NO: 132658 - RNA, 64 nt, hsa
auucugugaauguaccuuuuuuauuaacagggaaagaaaugaauuaauuugauaugcucuaaau

SEQ ID NO: 132659 - RNA, 64 nt, hsa
cuaguccgauggauccuggauugauacaagguugagaaaugaaugcuccuggccuuaaacauca

SEQ ID NO: 132660 - RNA, 64 nt, hsa
uccaccagccaucaugggugccagccagggucccagaaaugaggccauggcucacuguuucugg

SEQ ID NO: 132661 - RNA, 64 nt, hsa
uacaguuccaguaucaaauauuuauaaucuuaugagaaaugaaugaauguuucuauuuacaacu

SEQ ID NO: 132662 - RNA, 64 nt, hsa
aauugcaguaacuagccuugccuuucuauucuguagaaaugacagggucuucacaauccuucac

SEQ ID NO: 132663 - RNA, 64 nt, hsa
aucgccucuucuauauuuuaaauggauuuucaguagaaaugauuuuuacuaaucaaguuaaucc

SEQ ID NO: 132664 - RNA, 64 nt, hsa
ucugacugucuuccaguuacuguggugaaaaagaagaaaugaacuuaaauccacucccuuucua

SEQ ID NO: 132665 - RNA, 64 nt, hsa
agccccaagggcuuaaugaccccauuuguaacugagaaaugauucuuguuuuaguaaucauucu

SEQ ID NO: 132666 - RNA, 64 nt, hsa
agauagauagauagauagauagauagauagauagagaaaugagaagguuucucuuuugcaauag

SEQ ID NO: 132667 - RNA, 64 nt, hsa
ugccaaaauggcuuagacacaaaaacaccucagcagaaaugaauauaccuagcacucagaucuu

SEQ ID NO: 132668 - RNA, 64 nt, hsa
acaggggccagaggagauauggggaaggagcaucagaaaugaggcaagcuaggagaaugggcua

SEQ ID NO: 132669 - RNA, 64 nt, hsa
cugacuaugagaaguagaaauaaucagaaaaaucagaaaugauugcauuggaagaucauucgaa

SEQ ID NO: 132670 - RNA, 64 nt, hsa
gauuaaucucaacauguugauuguaaauguagguagaaaugaguacaaacugauucaguucuaa

SEQ ID NO: 132671 - RNA, 64 nt, hsa
agcaugauauuuacuguuuuguugucuggguuugagaaaugaaauauuguuuccaauuauuuau

SEQ ID NO: 132672 - RNA, 64 nt, hsa
cauuacucugauuuuugauacaguuuucagaaaaagaaaugaacauaaucaaguaaggauguau

SEQ ID NO: 132673 - RNA, 64 nt, hsa
guuuuguuuuuuuuuuuguuuucccccacuaaauagaaaugaggguccuuagucuguuucugac

SEQ ID NO: 132674 - RNA, 64 nt, hsa
gcgaggguuaaucuucucuugagaauggcagucaagaaaugagaugguucacuugacuacugag

SEQ ID NO: 132675 - RNA, 64 nt, hsa
cuguuacccauuaggggugauaacauuaaugggaagaaaugauggcaacuuugaaugcuaggug

SEQ ID NO: 132676 - RNA, 64 nt, hsa
cuuuggaaaguaugguugaguucagauacuuauaagaaaugacuuaaacaaauccuugccuugg

SEQ ID NO: 132677 - RNA, 64 nt, hsa
aacucuuauaaauuucuauuuuuaucugaguuacagaaaugauuacuaaggaagauuacucagu

SEQ ID NO: 132678 - RNA, 57 nt, hsa
gccuggaagcugaaguuuagaugagacagaaaugaggagacacaccugaggcugguu

SEQ ID NO: 132679 - RNA, 64 nt, hsa
caaucaguauugcaaugaaagaaaaacuaaaaacagaaaugauauucucaauuuugggcaaugu

SEQ ID NO: 132680 - RNA, 64 nt, hsa
uuuuaguauaaaaucuaaacuuuuuccauuuaucagaaaugauaaaauccaguuaccacauauc

SEQ ID NO: 132681 - RNA, 64 nt, hsa
gugaguuguugagcgagaaccccuucauuugaaaagaaaugaguaugcuacuauagggagaguu

SEQ ID NO: 132682 - RNA, 64 nt, hsa
augcuacuauagggagaguuguugcugagaauuaagaaaugauacaguuaaugcaacaaaagau

SEQ ID NO: 132683 - RNA, 64 nt, hsa
cagagaucuugaucucucucugaggaaaaaaccuagaaaugaugguuagaaucaggagacuuga

SEQ ID NO: 132684 - RNA, 64 nt, hsa
cagacaguuaagagaaaugagcuugaccuuuaagagaaaugagcugcacuccaugagugcagcu

SEQ ID NO: 132685 - RNA, 64 nt, hsa
acugauuacaacugcuacagagcagacaguuaagagaaaugagcuugaccuuuaagagaaauga

SEQ ID NO: 132686 - RNA, 64 nt, hsa
guuauuacuuucaauugaaaguucuaugggaucuagaaaugagacauacuggcauggagaguga

SEQ ID NO: 132687 - RNA, 64 nt, hsa
aagugccauauauaauuaguucucagaagaagggagaaaugaucauaggacugggaauuguuuu

SEQ ID NO: 132688 - RNA, 64 nt, hsa
ucugccagacugagggugcuuuuuggggggugggagaaaugaacugacagauaaacaguaacuc

SEQ ID NO: 132689 - RNA, 64 nt, hsa
acaaugcuguugacaguggaauucaccuuacaauagaaaugaacaagucugcuaccucuucauc

SEQ ID NO: 132690 - RNA, 64 nt, hsa
augaucugaagaaaugauggaauggggaguguagagaaaugagagucuguaugauucuggaaca

SEQ ID NO: 132691 - RNA, 55 nt, hsa
agcaaauucaguuuucaugaucugaagaaaugauggaauggggaguguagagaaa

SEQ ID NO: 132692 - RNA, 64 nt, hsa
ccaccagaauuugcuguggagauacuuuuuggcgagaaaugacuuccaaugauguuguagcugg

SEQ ID NO: 132693 - RNA, 64 nt, hsa
gucuuuuauucaaaauaacaggcuuugucuaccaagaaaugaauuggauaauccacauaaacaa

SEQ ID NO: 132694 - RNA, 64 nt, hsa
gaaaucuggaagugugagaucuguaagaaaugaaagaaaugacucuuggagucaagagaucugg

SEQ ID NO: 132695 - RNA, 64 nt, hsa
ugcuaaagagaaaucuggaagugugagaucuguaagaaaugaaagaaaugacucuuggagucaa

SEQ ID NO: 132696 - RNA, 64 nt, hsa
gugcagacaauucucccugagguuagcccaauggagaaaugaagcagaggaaggaaacauagaa

SEQ ID NO: 132697 - RNA, 64 nt, hsa
uuaauuucuaggcagguggagagagugguaaaaaagaaaugaaauugacaagcuaggaaagagg

SEQ ID NO: 132698 - RNA, 64 nt, hsa
cagugacuccagaagaaaugagccuccaccaccaagaaaugaacuuagagaaucagacaggcga

SEQ ID NO: 132699 - RNA, 64 nt, hsa
cgaaagauaucccaaaaauuucagugacuccagaagaaaugagccuccaccaccaagaaaugaa

SEQ ID NO: 132700 - RNA, 64 nt, hsa
gaaccuuucagguaaaaggugaucccucuaagaaagaaaugaagaaagaaaaugaugaaaagag

SEQ ID NO: 132701 - RNA, 64 nt, hsa
ccagguaauugaaugaagaaaggucacuaaagggagaaaugacauguuuucuauuuucuuuuca

SEQ ID NO: 132702 - RNA, 64 nt, hsa
ggcuuauauuuaauuaaagccuuacugaagaauaagaaaugagcuuagaaugacuaguguucuu

SEQ ID NO: 132703 - RNA, 64 nt, hsa
guaaauacauauaugcagugcuuguuguccaaauagaaaugaaaauaaguggaagagagaggaa

SEQ ID NO: 132704 - RNA, 64 nt, hsa
uggggguuucauuuuccauuccucagcacagagcagaaaugauagauuuuuauuguuuggagua

SEQ ID NO: 132705 - RNA, 64 nt, hsa
uuuaaguuguuaagcaaaugugaguuuuuuuuuaagaaaugaggcuuucacugagauuugugug

SEQ ID NO: 132706 - RNA, 64 nt, hsa
ugacucugagggcgauuucggaaauguuuucagcagaaaugaaggauaagcaucgcacaugucc

SEQ ID NO: 132707 - RNA, 64 nt, hsa
agcaagacuccaucucaaaaaaaaaaaaagaaaaagaaaugaauggguucaaagaccauaauca

SEQ ID NO: 132708 - RNA, 64 nt, hsa
ugucacauacccaugugacccgauaggaggcaaaagaaaugagacuucugggauuaguuuagcc

SEQ ID NO: 132709 - RNA, 64 nt, hsa
gugcugaugagauucaugcuaccuaaaaauuaacagaaaugacacugugaacaauguaguugga

SEQ ID NO: 132710 - RNA, 64 nt, hsa
ggaagccuggucuaagaagauacugucuuucaauagaaaugauuucuaaacugcuacagauuaa

SEQ ID NO: 132711 - RNA, 64 nt, hsa
cacugguggugagaggcggaauccaaaaaaauucagaaaugacuuggccucauuuuggauuuca

SEQ ID NO: 132712 - RNA, 64 nt, hsa
auguuugguuuuaugugcagcaccuugacuucuaagaaaugaaucaugucccuuugccccuuau

SEQ ID NO: 132713 - RNA, 64 nt, hsa; identical to SEQ ID NO: 44480

SEQ ID NO: 132714 - RNA, 64 nt, hsa; identical to SEQ ID NO: 44481

SEQ ID NO: 132715 - RNA, 64 nt, hsa; identical to SEQ ID NO: 44482

SEQ ID NO: 132716 - RNA, 64 nt, hsa; identical to SEQ ID NO: 44483

SEQ ID NO: 132717 - RNA, 64 nt, hsa; identical to SEQ ID NO: 44484

SEQ ID NO: 132718 - RNA, 64 nt, hsa; identical to SEQ ID NO: 44485

SEQ ID NO: 132719 - RNA, 64 nt, hsa; identical to SEQ ID NO: 44486

SEQ ID NO: 132720 - RNA, 64 nt, hsa; identical to SEQ ID NO: 44487

SEQ ID NO: 132721 - RNA, 64 nt, hsa; identical to SEQ ID NO: 44488

SEQ ID NO: 132722 - RNA, 64 nt, hsa; identical to SEQ ID NO: 44489

SEQ ID NO: 132723 - RNA, 64 nt, hsa; identical to SEQ ID NO: 44490

SEQ ID NO: 132724 - RNA, 64 nt, hsa; identical to SEQ ID NO: 44491

SEQ ID NO: 132725 - RNA, 64 nt, hsa; identical to SEQ ID NO: 44492

SEQ ID NO: 132726 - RNA, 64 nt, hsa; identical to SEQ ID NO: 44493

SEQ ID NO: 132727 - RNA, 64 nt, hsa; identical to SEQ ID NO: 44494

SEQ ID NO: 132728 - RNA, 64 nt, hsa; identical to SEQ ID NO: 44495

SEQ ID NO: 132729 - RNA, 64 nt, hsa; identical to SEQ ID NO: 44496

SEQ ID NO: 132730 - RNA, 64 nt, hsa; identical to SEQ ID NO: 44497

SEQ ID NO: 132731 - RNA, 64 nt, hsa; identical to SEQ ID NO: 44498

SEQ ID NO: 132732 - RNA, 64 nt, hsa; identical to SEQ ID NO: 44499

SEQ ID NO: 132733 - RNA, 64 nt, hsa
cgaggcccgcaugcggcccaggauggcuuugaaugcggcccaacgcaaauucgcaaacuuucuu

SEQ ID NO: 132734 - RNA, 64 nt, hsa
auuagaccaagcuuguccaacccgaggcccgcaugcggcccaggauggcuuugaaugcggccca

SEQ ID NO: 132735 - RNA, 64 nt, hsa
cuuagccaacuugaccccucucaucccacucccggcggcccaggcacagaagggcagggccaua

SEQ ID NO: 132736 - RNA, 64 nt, hsa
cuuuccauccacucaccuuaccccauagcaucuugcggcccagaaaccagagccauuugucuca

SEQ ID NO: 132737 - RNA, 64 nt, hsa
ugguccucccauuucuaaagcugaaugucaaacagugccaaaugcuggggcagggggugaagaa

SEQ ID NO: 132738 - RNA, 64 nt, hsa
ccagugggaugggacagggaggccacacgcacuggugccaaaaccaggccucugcugccgcccu

SEQ ID NO: 132739 - RNA, 64 nt, hsa
accaaucgcaugguucuccuggcaggccugcugugugccaaaaacucccacccaaggucccuca

SEQ ID NO: 132740 - RNA, 64 nt, hsa
uuucucuuucccauauuccuuuucuuuuucucuugugccaaacugacagaaaccgucaccacac

SEQ ID NO: 132741 - RNA, 64 nt, hsa
uauaaugcaucuaaaccaccuguccccaguuaaugugccaaaaugucaauuuuuaacuuaucuc

SEQ ID NO: 132742 - RNA, 64 nt, hsa
aaccugugcuuucauguuuaagaaaugagaaauugugccaaagauagcagaagaguagauaagu

SEQ ID NO: 132743 - RNA, 64 nt, hsa
gucuuccauggcauauuuacucuuacuuuacuucgugccaaaucaaaugaaacaagccgucuua

SEQ ID NO: 132744 - RNA, 64 nt, hsa
uauuucuacugauuuuauuuuggauacuaaggaugugccaaaugauucggauacuaagaugcau

SEQ ID NO: 132745 - RNA, 64 nt, hsa
ugugguagcaaaaggagggagaggaguccuuuuugugccaaaucccuaagugccguucgggggc

SEQ ID NO: 132746 - RNA, 64 nt, hsa
gaugucaggucaggagcuggaaguucaccugcaggugccaaagagcaggccggccagggcuggg

SEQ ID NO: 132747 - RNA, 64 nt, hsa
cagcuuuggccauauuucaggagaauguuuccaugugccaaaucuuagucccaugaucuguccc

SEQ ID NO: 132748 - RNA, 64 nt, hsa
uaagcacagccucccggguauguaacugaacuuggugccaaaguacuuguguacuaauuucuau

SEQ ID NO: 132749 - RNA, 64 nt, hsa
aggacugugccauuggaaauuucauuacaaugaagugccaaacucacuacaccauauaauugca

SEQ ID NO: 132750 - RNA, 64 nt, hsa
gccuuuuccccaggccucagagcauugcucauccgugccaaacuggguagguggauuugagcgg

SEQ ID NO: 132751 - RNA, 64 nt, hsa
gaguccucaucugcuggcauuuugugggguguuagugccaaacuugaauaggggcuggggugcu

SEQ ID NO: 132752 - RNA, 64 nt, hsa
ccccguggcucccggucuccugugggccugcugugugccaaaccugagcuaccugcacccgagc

SEQ ID NO: 132753 - RNA, 64 nt, hsa
caagcaaucauguuugcguccccguccgucacaugugccaaaucccuggcaggcagauggcucc

SEQ ID NO: 132754 - RNA, 64 nt, hsa
gccucugagucccguggggccccggcucccaccggugccaaacccagccccugcggccgucacc

SEQ ID NO: 132755 - RNA, 64 nt, hsa
cagccaggagugcggacaccauguucccagcucagugccaaagaggggucaccagggggagcug

SEQ ID NO: 132756 - RNA, 64 nt, hsa
uuugguaaaaggccuacagcuuuguacuuacauugugccaaaggcugaggaaauguuuucuuuc

SEQ ID NO: 132757 - RNA, 64 nt, hsa
auguggccgggcugcagagccgggccacaccucagugccaaagaccccaugggagugggaggga

SEQ ID NO: 132758 - RNA, 64 nt, hsa
cugagguccacaucauggcaguucauuuacucuugugccaaauggcaacaccacgucuaaagca

SEQ ID NO: 132759 - RNA, 64 nt, hsa
uucaaaggguauauauaaaagguaaaaaacuagugugccaaaugguauaggaacaacuguacuu

SEQ ID NO: 132760 - RNA, 64 nt, hsa
gcuuuauauuaaauucuuuuaguauuauagguuggugccaaaauauuuucaguuguacuguaga

SEQ ID NO: 132761 - RNA, 64 nt, hsa
ucaggaugcucauaacuuuguaugucugacccaagugccaaaggcagacgugcuuuauagcuaa

SEQ ID NO: 132762 - RNA, 64 nt, hsa
augauguagagcuauuaagggaguauuuucacuugugccaaagaggguaagcguuuauuagccu

SEQ ID NO: 132763 - RNA, 64 nt, hsa
uaaaaaaugaaauuagucuauuuucuacuugccagcagaguaucugucuuauuuuaggaugcag

SEQ ID NO: 132764 - RNA, 64 nt, hsa
auaccauguauucacacuuuaaaaaauacacauagcagaguaucggaaaguauguaccaaaaca

SEQ ID NO: 132765 - RNA, 64 nt, hsa
ugcagaggcagaccauuccuuaguaucucacaaagcagaguaauacuggaggcagaguaggggg

SEQ ID NO: 132766 - RNA, 64 nt, hsa
ccuuaguaucucacaaagcagaguaauacuggaggcagaguagggggugguuggagagcaguua

SEQ ID NO: 132767 - RNA, 64 nt, hsa
gaggcuugcugaacauggauaucuacauuauaccgcagaguauuugaagucacacuguaaccuc

SEQ ID NO: 132768 - RNA, 64 nt, hsa
uucugggaugugguauuggugcuuugugucuagggcagaguauguucuugaagaaaggcaaauc

SEQ ID NO: 132769 - RNA, 64 nt, hsa
uuuucuacaacacagaguacugacucugccugguuccugagagaggcuccuaagucacagaccu

SEQ ID NO: 132770 - RNA, 64 nt, hsa
ugaagacagcguccuggcuccaguuggaacacuuuccugagaugcacuuacuucucagcuucug

SEQ ID NO: 132771 - RNA, 64 nt, hsa
gaaaucaccuucucaagggagccuugucuaauguuccugagacuauuucacacucuccaugcuu

SEQ ID NO: 132772 - RNA, 64 nt, hsa
uguguggcauacaguuccuaguuaagaucccaaauccugagauauugcugauuugcuauggcag

SEQ ID NO: 132773 - RNA, 64 nt, hsa
uccgauuuugugcauaguaaugacacagcaccauuccugagaaauaggaaauauaugugugugg

SEQ ID NO: 132774 - RNA, 64 nt, hsa
aaacucugaguuuauaaaauaacuacuucugaacuccugagaucuaguggauaccauguauccu

SEQ ID NO: 132775 - RNA, 64 nt, hsa
gggguucugugcguguaccauguugccugacacguccugagaaaucuucuuaaacucugaguuu

SEQ ID NO: 132776 - RNA, 64 nt, hsa
uuccauuuuugauucauuccugagaauggcuuaguccugagaaucugcaaagucucugaagaga

SEQ ID NO: 132777 - RNA, 64 nt, hsa
ccccagagagccaucucuuccauuuuugauucauuccugagaauggcuuaguccugagaaucug

SEQ ID NO: 132778 - RNA, 64 nt, hsa
uaccagggaacauagcauaaauuagucugaaauuuccugagagugacuuugucuuagaacuuag

SEQ ID NO: 132779 - RNA, 64 nt, hsa
cuauuuguauuauuuuaugcauuuaaaaacacaguccugagagggauggaccagacugccacag

SEQ ID NO: 132780 - RNA, 64 nt, hsa
uaacuuccccacuccacccuacaagcagugggacuccugagaacacgguucucuccuagccuca

SEQ ID NO: 132781 - RNA, 64 nt, hsa
acauggagccccucccuuggucagacucugggacuccugagaugggagaggcagggaucagagg

SEQ ID NO: 132782 - RNA, 64 nt, hsa
gaguaggaagacucaaacacgauauuacccaaguuccugagacuagagaaguguauaagucuga

SEQ ID NO: 132783 - RNA, 64 nt, hsa
uauccaguccaauauaaguaugaaggauucucucuccugagauuguagcaggcagccaaacauu

SEQ ID NO: 132784 - RNA, 64 nt, hsa
ccuggggagcagaauucuugucaucuaugagggguccugagaaagacuugucauuuuuuuuccu

SEQ ID NO: 132785 - RNA, 64 nt, hsa
guccaucagcucagcagagcucgacagccacaaguccugagaagcuuugaccuugaagggcuuc

SEQ ID NO: 132786 - RNA, 64 nt, hsa
uugucuucagaugagaauggagucugaauggccuuccugagagcgagugcgacccguuccuuug

SEQ ID NO: 132787 - RNA, 64 nt, hsa
cacccuuucccaccuggugccuaugcuaggcuuguccugagaacaucccucaguaacuugauau

SEQ ID NO: 132788 - RNA, 64 nt, hsa
cugagaacuuuucuuguaaugcagcuuuuucucuuccugagaaacaguguguucuaaugggauu

SEQ ID NO: 132789 - RNA, 64 nt, hsa
agcucugaaauaacaguccuaagaacuccuaaaguccugagaacuuuucuuguaaugcagcuuu

SEQ ID NO: 132790 - RNA, 64 nt, hsa
ccugcagacaccagcucuccuuccugccuuuagauccugagaaggagggaaaugaggggugcug

SEQ ID NO: 132791 - RNA, 64 nt, hsa
cccugucuucucugauucuuuucccucaaaauaguccugagaacuaauugucacacuggcucau

SEQ ID NO: 132792 - RNA, 64 nt, hsa
uccuuguacuugauccuccugaaaugagagauuuuccugagaugacugaguauggagauuacca

SEQ ID NO: 132793 - RNA, 64 nt, hsa
caacaaguucuuguugacucagggcauaaugaguuccugagacaugcucuuuugggggcugggg

SEQ ID NO: 132794 - RNA, 64 nt, hsa
gaaauuccacgaagaaaauccugauuccaagauguccugagaucuugugguuccaugagaauua

SEQ ID NO: 132795 - RNA, 64 nt, hsa
gagaguacugucuuaggaauuauuaggaguugauuccugagaaacaacacauuuuuccccauga

SEQ ID NO: 132796 - RNA, 64 nt, hsa
ccuggcacccaguccacuggcaguggaauugcuuuccugagaaucauucugaggcugggcuauu

SEQ ID NO: 132797 - RNA, 64 nt, hsa
cagaucaccaggucaagcaccuaggccuggcuucuccugagacagaggacucagaaguggccuu

SEQ ID NO: 132798 - RNA, 64 nt, hsa
ugcuuauuuccugggugccuggcucuaggcuauguccugagacauacaguggacagggucucua

SEQ ID NO: 132799 - RNA, 64 nt, hsa
ugucuuuuaucaauacaaugauaagacaccuuaauccugagagagaaaauuaaguacuguauau

SEQ ID NO: 132800 - RNA, 64 nt, hsa
gccaagcugcacaauuuaauauauucaagaguggggggaggaagcagaggucuucagggcucuu

SEQ ID NO: 132801 - RNA, 64 nt, hsa
uccugucuggcuucuagagaugugccugugggagggggaggaaguuggcugagccauugagugc

SEQ ID NO: 132802 - RNA, 64 nt, hsa
uucucuggcuuccuuggcuugccuggugggggaaggggaggaggggaagaaggaaagggaagag

SEQ ID NO: 132803 - RNA, 64 nt, hsa
gcaacugugaacagagaggucgggauuugcccugggggaggaagagaggccaaguucagagcuc

SEQ ID NO: 132804 - RNA, 64 nt, hsa
gccaggaaucuaaagcuuuggguuuucugaggggggggaggagggaacuggagguuauuggggu

SEQ ID NO: 132805 - RNA, 64 nt, hsa
ccaccacucugcuuugcccaagugugacagcacuggggaggagagacaggauaaagggcagaug

SEQ ID NO: 132806 - RNA, 64 nt, hsa
ccacgggcacagggagagggacaacugcagcaguggggaggaggcacagcuagcugcacaguuc

SEQ ID NO: 132807 - RNA, 64 nt, hsa
uagaccccggguacugcgggaggggagggcugcuggggaggauggggggauguuauauaaauau

SEQ ID NO: 132808 - RNA, 64 nt, hsa
uccaaccccuggggaagacauuugcaacugacuuggggaggacacagcuucagcacagccucuc

SEQ ID NO: 132809 - RNA, 64 nt, hsa
agguugcccuguucaggggacagaugcaagcuguggggaggacucugccuguguccuguguucc

SEQ ID NO: 132810 - RNA, 64 nt, hsa
gugcccugggcuugccaccagcucugcccuggcuggggaggacacucggugccccacacccagu

SEQ ID NO: 132811 - RNA, 64 nt, hsa
uagacagacaggccuggggacacuggccccaugaggggaggaaggcaggcgcacgagguccagg

SEQ ID NO: 132812 - RNA, 64 nt, hsa
ccugcccugacccaccuggcaaagcagggcacauggggaggaagagacuggaaccuuucuuuga

SEQ ID NO: 132813 - RNA, 64 nt, hsa
caguaagauggaugguuccggccagagucgauguggggaggaacagagggcugaagggagaggg

SEQ ID NO: 132814 - RNA, 64 nt, hsa
aauucaauuuguaaguagcgcagcagccucugugggggaggauaggcugaaaaaaaaaaguggg

SEQ ID NO: 132815 - RNA, 64 nt, hsa
cauguucuggcagcaacuucacuuuuccuaaggaggggaggaggcagcagggaagcaacccugg

SEQ ID NO: 132816 - RNA, 64 nt, hsa
gguuuucagaagguccuucugauggcuaggcuaaggggaggaagaauuccugccaugccccagc

SEQ ID NO: 132817 - RNA, 64 nt, hsa
cugcuguaguuggggagcaggaguaccuuugggaggggaggacuuuauuuaaacagugguucua

SEQ ID NO: 132818 - RNA, 64 nt, hsa
ugaugacugagaacaggcuuggaaaagguuuucuggggaggaggaggcuggaggccaggacacu

SEQ ID NO: 132819 - RNA, 64 nt, hsa
agcagaagggaggggagacagaggggauuaaagaggggaggagagagugcagagcuccaggaaa

SEQ ID NO: 132820 - RNA, 64 nt, hsa
gccaucaccaguuucucaggcuggggagcacagaggggaggaggaggacuaaaugaaaaguugu

SEQ ID NO: 132821 - RNA, 64 nt, hsa
cccacuuuucuaccaguaaaagacauagaccaauggggaggaggggaggagagauggauauuuc

SEQ ID NO: 132822 - RNA, 64 nt, hsa
ucuaccaguaaaagacauagaccaauggggaggaggggaggagagauggauauuucagcccucu

SEQ ID NO: 132823 - RNA, 64 nt, hsa
auacaaauggggcagugugcaugcaacacacuuaggggaggaguggccccagaauucagcacgc

SEQ ID NO: 132824 - RNA, 64 nt, hsa
cugcuuccuuucaaugugucagugccuggggggaggggaggagcacccccucagccccccugaa

SEQ ID NO: 132825 - RNA, 64 nt, hsa
uugcccccucugcagccggaggaggagauguugaggggaggaggccagccagugugaccggcgc

SEQ ID NO: 132826 - RNA, 64 nt, hsa
caguguccacccuccggcccccgucuuguaaaaaggggaggagaauuagccaaacacuguaagc

SEQ ID NO: 132827 - RNA, 64 nt, hsa
ucuccccugugccguaguuugucuccugggacugggggaggaguccgaggugggguugguuacc

SEQ ID NO: 132828 - RNA, 64 nt, hsa
cggccugauggcucugugcaguaccugguugaguggggaggagggggcaucuucugaacagccu

SEQ ID NO: 132829 - RNA, 64 nt, hsa
uuacacacacguugacgggccgcaggagggaggcggggaggaggaacgggcagccacaggacug

SEQ ID NO: 132830 - RNA, 64 nt, hsa
ccaucacucacucacuccccacucccccacccauggggaggagaccuuugaugaauucuuccuc

SEQ ID NO: 132831 - RNA, 64 nt, hsa
caaaguaggagaagaaauggggaggacucgggugggggaggacgucccggcugggaugaagucu

SEQ ID NO: 132832 - RNA, 64 nt, hsa
acaccuggaacugcggcaaaguaggagaagaaauggggaggacucgggugggggaggacguccc

SEQ ID NO: 132833 - RNA, 64 nt, hsa
cucugucuccaccccaugggcccacacccaggugggggaggaggaagccacugcaucuguuggc

SEQ ID NO: 132834 - RNA, 64 nt, hsa
ggagaggcaagaacugggggaacacaggaaccuaggggaggaggggagcgcugggcauccucag

SEQ ID NO: 132835 - RNA, 64 nt, hsa
gaggaagcugcuccaauggaugggggagaagccuggggaggagggggaggaagacaagaaggaa

SEQ ID NO: 132836 - RNA, 64 nt, hsa
gcuccaauggaugggggagaagccuggggaggagggggaggaagacaagaaggaagaggaggag

SEQ ID NO: 132837 - RNA, 64 nt, hsa
ccaaguucacugggcuccacccccaccuccaggaggggaggagaggaccugacaucuguaggug

SEQ ID NO: 132838 - RNA, 64 nt, hsa
ugucaccuccaucucagucuuggccuggcuaugaggggaggaggaaugggagagggggcucagg

SEQ ID NO: 132839 - RNA, 64 nt, hsa
aacagacagggagaaguugagcagguaucaacuaggggaggagagagggucuccaguguucccc

SEQ ID NO: 132840 - RNA, 64 nt, hsa
gcucucucuccuggagucugaagccugcagguccggggaggagguucgggauucccuggugggc

SEQ ID NO: 132841 - RNA, 64 nt, hsa
agugcuuagagcacaggccccucuguugggggauggggaggagagcagucugcccuugggagcg

SEQ ID NO: 132842 - RNA, 64 nt, hsa
cggguguucgacaccagacguggggauuucaacaggggaggagccaaggaauucuguggcugug

SEQ ID NO: 132843 - RNA, 64 nt, hsa
caaggagcuggagacuucagggagccccucucauggggaggaaagagcuuccagggggcgaacg

SEQ ID NO: 132844 - RNA, 64 nt, hsa
aaaaggaugugucauuggucaugauauuugaaaaggggaggaggccgaaguuguucccauuuau

SEQ ID NO: 132845 - RNA, 58 nt, hsa
agggcaaggccaagaagugaaggccggcggggaggauacuguccccaggagcacccuc

SEQ ID NO: 132846 - RNA, 64 nt, hsa
gguuuuugcgagugcuuuguuuacuaaggacuuuggggaggaaccaugcuaagccaugaccagu

SEQ ID NO: 132847 - RNA, 64 nt, hsa
ggagggggcagaggcaaaucaccgggcagagggaggggaggagaggaggccgcacucucccugu

SEQ ID NO: 132848 - RNA, 64 nt, hsa
agagggcuccagguucugggccccuggcugagaaggggaggauccuguccuggcuguagccuuc

SEQ ID NO: 132849 - RNA, 64 nt, hsa
gggaucacggcccaggcugcugacacccgcgcguggggaggacucgggccacgaaaggaaagaa

SEQ ID NO: 132850 - RNA, 64 nt, hsa
ggagggcgagcgagggagaggagggagagggggaggggaggaguccagggagaggcgggaucac

SEQ ID NO: 132851 - RNA, 64 nt, hsa
aguccugaaacugcaggaccaguuucucugccaaggggaggaguuggagagcacaguugccccg

SEQ ID NO: 132852 - RNA, 64 nt, hsa
ucacuuuucugugccuuccugaggggguugggccggggaggaaacccaacccucuccugugugu

SEQ ID NO: 132853 - RNA, 64 nt, hsa
guauguuucuuauuguaugucuauauauguauguggggaggacaggagugaauguucacacacu

SEQ ID NO: 132854 - RNA, 64 nt, hsa
aucucucagccugcuuucucaucuguaaaaaaggggggaggauaacuuucacaggguaauuggu

SEQ ID NO: 132855 - RNA, 64 nt, hsa
cauuucuucccauaaugugaguggggaggauuguggggaggaggggcuuuggguuccuguguuu

SEQ ID NO: 132856 - RNA, 64 nt, hsa
uccauuuagugacauuucuucccauaaugugaguggggaggauuguggggaggaggggcuuugg

SEQ ID NO: 132857 - RNA, 64 nt, hsa
ccugcccuucuaucugggagcuagggaagguaugggggaggaaagagaauggauuuauagcuac

SEQ ID NO: 132858 - RNA, 64 nt, hsa
agaagcuuauucagggcugagugccaaaagcuugggggaggagggacagguccucggcaauaaa

SEQ ID NO: 132859 - RNA, 64 nt, hsa
gaggugugauugggcccuccggcuggauguucugggggaggaggcaaucgcuguagcugccagg

SEQ ID NO: 132860 - RNA, 64 nt, hsa
gaccccuuagguauacccuggaagagcuggggugggggaggagggagcgugaagguagugacuc

SEQ ID NO: 132861 - RNA, 64 nt, hsa
ugacuccugaacacacccagguggaaccaucuuuggggaggagaggcccgugugaggggucuga

SEQ ID NO: 132862 - RNA, 64 nt, hsa
ccggcacugaggaugcuguucucaguuugacuguggggaggagagagaaugggguacuagcacc

SEQ ID NO: 132863 - RNA, 64 nt, hsa
ggcagagagaggagacgaagaguuugggacagugggggaggagaugggaagggaugggauuucu

SEQ ID NO: 132864 - RNA, 64 nt, hsa
gucaggcugcugaggaaacaccacaggcugaacgggggaggaaugcacaugccacgcugggugu

SEQ ID NO: 132865 - RNA, 64 nt, hsa
gcuaucgagauagccagagggucaggagagaaugggggaggaggcggucaggcugcugaggaaa

SEQ ID NO: 132866 - RNA, 64 nt, hsa
acacucuagguugcuggguccauggggaggauugggggaggagaagcagugccuucccucucgu

SEQ ID NO: 132867 - RNA, 64 nt, hsa
ugccuacugggacacucuagguugcuggguccauggggaggauugggggaggagaagcagugcc

SEQ ID NO: 132868 - RNA, 64 nt, hsa
uggugguaucggugucgagggagaggaggggguuggggaggacccaccucuccagaauggcgac

SEQ ID NO: 132869 - RNA, 64 nt, hsa
agcacuaagggcugaggucaauaccgcagaccuuggggaggaagcugagcaucccccgggaugu

SEQ ID NO: 132870 - RNA, 64 nt, hsa
uccagagggucuucagaagccccccugggagggaggggaggaugagcacgcccagcuccccucc

SEQ ID NO: 132871 - RNA, 64 nt, hsa
uggcggagggagggaagaggagggagugacgggaggggaggaggucagcgaccuggggccguag

SEQ ID NO: 132872 - RNA, 64 nt, hsa
agcccauggucgggacagugcccuggccuuugccggggaggaggaugcucugagauucagggug

SEQ ID NO: 132873 - RNA, 64 nt, hsa
gcauuguccccgucuuucccaucgccuagcguuuggggaggaacagggagagagcuucggggcg

SEQ ID NO: 132874 - RNA, 64 nt, hsa
agaccugugaagcuacagacugacagccagggcaggggaggagggaggggcgccagcaccugau

SEQ ID NO: 132875 - RNA, 64 nt, hsa
aaccacccugggcccagaaacagaggccugccgaggggaggagccuggccucuguccacccguc

SEQ ID NO: 132876 - RNA, 64 nt, hsa
gcagcagacucccucagccaugagaaccagcuuuggggaggaggccgggaaucaaagcgagucc

SEQ ID NO: 132877 - RNA, 64 nt, hsa
ccccagcccucagggagcuccgcucagccccggcggggaggagcgggugggugugcgcgcaagg

SEQ ID NO: 132878 - RNA, 64 nt, hsa
uguagggugaaauggcaauuauucucuccaugcuggggaggaggggaggagggucucagacagc

SEQ ID NO: 132879 - RNA, 64 nt, hsa
gaaauggcaauuauucucuccaugcuggggaggaggggaggagggucucagacagcuuucgugc

SEQ ID NO: 132880 - RNA, 64 nt, hsa
agcuucgguaugccuucagggaaaggucacagcuggggaggaagcggggggacgccugucaccc

SEQ ID NO: 132881 - RNA, 64 nt, hsa
accagccagagcacaggaagccacccugccugcuggggaggagggacccacacaagcccccucg

SEQ ID NO: 132882 - RNA, 64 nt, hsa
gcuaccaaggaagagagcacacagauaagacagaggggaggaggugggcauuuccuacauuccu

SEQ ID NO: 132883 - RNA, 64 nt, hsa
aguauuuauugcaauguaaauguauccugaagguggggaggaauguuuaaucuaccauguccgu

SEQ ID NO: 132884 - RNA, 64 nt, hsa
gcagggcugcuccaggcaggucagagcagugcagggggaggagaggagaaagggaggaagcugg

SEQ ID NO: 132885 - RNA, 64 nt, hsa
gggugucggguagagggaagagggcagggggcuaggggaggacucagaggccaucugcagggcc

SEQ ID NO: 132886 - RNA, 64 nt, hsa
ccaaacaucuuggcauccccaccccaggaagugcggggaggagguuaugaucccugggcgcuuc

SEQ ID NO: 132887 - RNA, 64 nt, hsa
gcccugcgaguguguccccuguccccaccugaguggggaggagcgucucaagugaacaguggga

SEQ ID NO: 132888 - RNA, 64 nt, hsa
gagcagcaguggaagaccucgggccaugcggccuggggaggacuugguggcgauccgcaaccug

SEQ ID NO: 132889 - RNA, 64 nt, hsa
acuccccucuccacugauggcugggaagggaguuggggaggaagagugggagggagggcugggg

SEQ ID NO: 132890 - RNA, 64 nt, hsa
guuuuguuucacugugcagagauuucucuguaagggcaacgaacgugcuggcaucaaagaauau

SEQ ID NO: 132891 - RNA, 64 nt, hsa
ucccaaacagcccggaguauuugcagaaggcucaggcaacgagugggccacaucucacuucugc

SEQ ID NO: 132892 - RNA, 64 nt, hsa
gugagcugagauggcaccacugcacuccggccuaggcaacgagagcaaaacuccaauacaaaca

SEQ ID NO: 132893 - RNA, 64 nt, hsa
aaacauuuugaagagagaccgucgggggcugaggggcaacgaagaaaaaaaauaacacagagag

SEQ ID NO: 132894 - RNA, 61 nt, hsa
uccaaguucguccuuuguaggaaugaagaauggcaacgaaagauggggccuuaaauuggau

SEQ ID NO: 132895 - RNA, 64 nt, hsa
acucugacugcggagagugaguggagagaggagaggcaacgaaguccuuagcacuggcagcucc

SEQ ID NO: 132896 - RNA, 52 nt, hsa
acggccgaggggagcagugaggggcaacgaggcggcugggaugccgcccuca

SEQ ID NO: 132897 - RNA, 64 nt, hsa
gugagccgagauugcgccauugcacuccagccugggcaacgagugaaacuccgucucaaaaaaa

SEQ ID NO: 132898 - RNA, 64 nt, hsa
uauauaauaauagcauuuuauguaauaaaauaugggcaacgauuaucuuggaaauuaaagaguc

SEQ ID NO: 132899 - RNA, 64 nt, hsa
gugagccaagauugugccauugcacuccagccugggcaacgagcgaaacuacaucucaaaaaaa

SEQ ID NO: 132900 - RNA, 64 nt, hsa
aguuccugaauggugcuaaggaucugcagcaguuggcaacgagcuggggcugggggcggccucc

SEQ ID NO: 132901 - RNA, 64 nt, hsa
uguccuggcaucgcgcacacuguauguacauacuggcaacgaugucaaauguaauuuauuuuaa

SEQ ID NO: 132902 - RNA, 64 nt, hsa
aacaaaagucaucaccuuuucugcuugcuacacaggcaacgauucccccaucagcugcccggac

SEQ ID NO: 132903 - RNA, 64 nt, hsa
agaaagaaacugaaaagugagguguggaacuccaggcaacgacccaagcacuuauuuuuuaaga

SEQ ID NO: 132904 - RNA, 64 nt, hsa
auaaacaguuuauguaaaauuaguaaugaaugauggcaacgagggcacuguuaucuucguuugu

SEQ ID NO: 132905 - RNA, 64 nt, hsa
gaacacgagacuuucuuugacacccagaagacccggcaacgaggaggaaggccucgcggugagg

SEQ ID NO: 132906 - RNA, 64 nt, hsa
gugagccgagauugcaccuuuguacuccagccugggcaacgagcaaaaaacucugucucaaaaa

SEQ ID NO: 132907 - RNA, 64 nt, hsa
augagcugagaucaugccauugcacuccagccugggcaacgagagugaaacuccguccccaccc

SEQ ID NO: 132908 - RNA, 64 nt, hsa
ccgcaucgccucucuccuaggauacagaaaccauggcaacgaaaguagaauguaaaacucgcag

SEQ ID NO: 132909 - RNA, 64 nt, hsa
gcggccccgcccguagaucauccccgagggcgggggcaacgauucacagccuccgcggacuggg

SEQ ID NO: 132910 - RNA, 64 nt, hsa
acccuccacagccaccuggucagccaccagcuggggcaacgaggguggaggucccacugagccu

SEQ ID NO: 132911 - RNA, 64 nt, hsa
agcucugagucauucagcccuggggacaccccuaggcaacgauuccgacagcgccauccaggcc

SEQ ID NO: 132912 - RNA, 64 nt, hsa
ggcuggauucauguucaaaccacuggacuggcagggcaacgacuucuucccaccucaagaugag

SEQ ID NO: 132913 - RNA, 64 nt, hsa
ccucagguuugccaaguacuacagagaccuggcuggcaacgagcagcgcacgcucaucaaggcc

SEQ ID NO: 132914 - RNA, 64 nt, hsa
gugagccaagaccaugccauuacacucaagcuugggcaacgagagcaaaacucugucucaaaaa

SEQ ID NO: 132915 - RNA, 63 nt, hsa
uuuuuaauaaagaaaagaagauguguauauuuuuggcaacgacagaaacguagugcagauaua

SEQ ID NO: 132916 - RNA, 64 nt, hsa
aaagugauagaauuuuugucuagaaucccaaacuggcaacgauagucuccaagggaccuggccu

SEQ ID NO: 132917 - RNA, 64 nt, hsa
aggcucuagguuuugucuaucaucucaguucagaggcaacgaaacuggacucauuacuccaaau

SEQ ID NO: 132918 - RNA, 64 nt, hsa
gggcgguggccaggacaacgggcuggagggucugggcaacgacagccgagacauguacauggag

SEQ ID NO: 132919 - RNA, 64 nt, hsa
gggcaagggguuuccacaguugcugcuccuuuggggcaacgacgguuucaaaccaggauuuugu

SEQ ID NO: 132920 - RNA, 64 nt, hsa
gugagcuaagaucacgccauugcacuccagccugggcaacgagagggaaacucuguuucaaaaa

SEQ ID NO: 132921 - RNA, 64 nt, hsa
uccguggggcuccaccagccagaagccucuggaaggcaacgaaggcaaugcugcucccugaguc

SEQ ID NO: 132922 - RNA, 53 nt, hsa
ucgauagcagggagccaugaccuggcaacgauuccacgcucaaaggggcaccc

SEQ ID NO: 132923 - RNA, 64 nt, hsa
gugagccgagaucacgccauugcauucuagccugggcaacgagagcgaaacucugucucaaaaa

SEQ ID NO: 132924 - RNA, 64 nt, hsa
uauuuuauucacaaaggucaauaacauggcaagauaaaauuauuuguauaguuuugucugaaug

SEQ ID NO: 132925 - RNA, 64 nt, hsa
ugaauucccaagugccaggaguaggauuucauuauaaaauuaauagcuaaucuuauucuaucuc

SEQ ID NO: 132926 - RNA, 64 nt, hsa
caggaagauuuuuaaagauagauugagguugguuuaaaauuauuccuguaaaccaacaauaaag

SEQ ID NO: 132927 - RNA, 64 nt, hsa
caugcauaguuuuagacaaaaaaagauguuucaauaaaauuacugucuuguaauauaaauguug

SEQ ID NO: 132928 - RNA, 64 nt, hsa
uaauuauggucugggguaaaauugaguuucagaauaaaauuaggaacaguaaaauccaaagaac

SEQ ID NO: 132929 - RNA, 64 nt, hsa
acuucaugucauuaaucaauuucucaauaguucuuaaaauuagugagauuaaaaaucuaaaaau

SEQ ID NO: 132930 - RNA, 64 nt, hsa
uuuuuaauuuuagccauucuucugccucauuucuuaaaauuagagaauuaaggucccgaaggug

SEQ ID NO: 132931 - RNA, 64 nt, hsa
cagccuggccaauaugcugaaacccugucucuacuaaaauuacaaaaauuagccggccauggug

SEQ ID NO: 132932 - RNA, 64 nt, hsa
acaaauucuaugguagcuuuguuguauauuauuguaaaauuauuuuaauaagucauggggauga

SEQ ID NO: 132933 - RNA, 64 nt, hsa
auaagaaguaaguagcauaaaucaguauuuaaccuaaaauuacauauuugaaacagaagauauu

SEQ ID NO: 132934 - RNA, 64 nt, hsa
agggcaucuuucuucuuaucucugacaguguucuuaaaauuauuugaauaucauaagagccuug

SEQ ID NO: 132935 - RNA, 64 nt, hsa
agaguuuuugagcauuugacuauuuuuagaaucauaaaauuaguuacuaaguauuuugaucaaa

SEQ ID NO: 132936 - RNA, 64 nt, hsa
cauuuucuauauaauaucuugauggacucuuuuauaaaauuauuuuauaaaaaacaauguuaca

SEQ ID NO: 132937 - RNA, 64 nt, hsa
uuaaugcaauaagguuauacauaguuaugaacuguaaaauuaaagucaguaugaacuauaauaa

SEQ ID NO: 132938 - RNA, 64 nt, hsa
ugugauguagcuuucuucuguaacaguuauguuuuaaaauuaagugaguuuuuuuuuugccuua

SEQ ID NO: 132939 - RNA, 64 nt, hsa
uuguacuuguuuuaaauuguauacaagcuguacauaaaauuagccaaaugaaucauuucuuaua

SEQ ID NO: 132940 - RNA, 64 nt, hsa
cuuuccuauucuagcauuuaaauuuaaauuuuauuaaaauuaaauaauuuaaaucuagcauuua

SEQ ID NO: 132941 - RNA, 64 nt, hsa
uauguaaaauguggauuauguugcaaauugagauuaaaauuauuugggguuuuguaacaauaua

SEQ ID NO: 132942 - RNA, 64 nt, hsa
auuauaaauuauaaauaugacuuuauccuggcuauaaaauuauugaaccaaaaugaauucuuuc

SEQ ID NO: 132943 - RNA, 64 nt, hsa
aauaauuaauagaaauggggaacaaguuagaagauaaaauuauuccuagaaaagauuuaaguaa

SEQ ID NO: 132944 - RNA, 64 nt, hsa
auauguguuauugcaguuucauuuaagaaaaguuuaaaauuaaaaagcaaauuucaaagaauau

SEQ ID NO: 132945 - RNA, 64 nt, hsa
ugucaagacauggaggguguuuguaauuuuaugguaaaauuaauccuucuuacacauaauggug

SEQ ID NO: 132946 - RNA, 64 nt, hsa
auuuucucuaacccuuaacuaaaguguaggauuuuaaaauuaaaugugagguaaaauaaguuua

SEQ ID NO: 132947 - RNA, 64 nt, hsa
uucacgauucuuaaaaacacaaaguuacacuuacuaaaauuaggacauguuuucucuuugaaau

SEQ ID NO: 132948 - RNA, 64 nt, hsa
agggggguuaauggaacugggucugggauuauuuuaaaauuauauauauauauauaaagauaua

SEQ ID NO: 132949 - RNA, 64 nt, hsa
uuaaaauuaaguaauuuuuuaaagaaggcacuuuuaaaauuaacacacacaugaacugcacacc

SEQ ID NO: 132950 - RNA, 64 nt, hsa
agucaccugaggaaguuuccccacuuuuauuuuuuaaaauuaaguaauuuuuuaaagaaggcac

SEQ ID NO: 132951 - RNA, 64 nt, hsa
uuuuauuuuuaggucucuguccauugcuuuuaauuaaaauuaucuguuuucaaaucaacaagug

SEQ ID NO: 132952 - RNA, 64 nt, hsa
auuccuuccaaugagagauuauaacauaaacuauuaaaauuauucugcuaauauaccuagauuu

SEQ ID NO: 132953 - RNA, 64 nt, hsa
guuguuaugcauugauuaagggcuagagcaaauauaaaauuaaaugucuuuuuccuccaaauaa

SEQ ID NO: 132954 - RNA, 64 nt, hsa
guuacaguuuaucugguacuucauuuuucuuaacuaaaauuacuuuuuacuuuaagcuugaaua

SEQ ID NO: 132955 - RNA, 64 nt, hsa
uggugaauuuggagcagacgacuucuguuuaacuuaaaauuagucguauuuuaauggcuuggga

SEQ ID NO: 132956 - RNA, 64 nt, hsa
uauuaacagcugagguagcuaaaguuauuuaaaauaaaauuaaauuuaugauccaaguagcuua

SEQ ID NO: 132957 - RNA, 64 nt, hsa
auaauugcacuguuuguuuuauguauguacagauuaaaauuauugcuacauuugaggaaaauaa

SEQ ID NO: 132958 - RNA, 64 nt, hsa
cuuaucugugugucugacgugccaucuuuaauguuaaaauuaagguguuaaaauuaagccuagu

SEQ ID NO: 132959 - RNA, 64 nt, hsa
ugacgugccaucuuuaauguuaaaauuaagguguuaaaauuaagccuaguuauauagacgaaau

SEQ ID NO: 132960 - RNA, 64 nt, hsa
ugcauuugauacauuuuuguacuaacuagcauuguaaaauuauuucaugauuagaaauuaccug

SEQ ID NO: 132961 - RNA, 64 nt, hsa
ucguaacacagcauuguauaugugaagcaaacucuaaaauuauaaaugacaaccugaauuaucu

SEQ ID NO: 132962 - RNA, 64 nt, hsa
uuugaaaucaugacaagcagucuuagaacaaaguuaaaauuaaaaagucuuuauccaagucacc

SEQ ID NO: 132963 - RNA, 64 nt, hsa
uugagaccagugguucccacuaaguauagaacauuaaaauuaauacuuuauaauaaaacacuuu

SEQ ID NO: 132964 - RNA, 64 nt, hsa
gaugagaauuuugaggaaaaaaauuaaaaauauguaaaauuaauaauuugcaugaacacagaug

SEQ ID NO: 132965 - RNA, 64 nt, hsa
caaugcugcugauaugacacaccuuugaauuuguuaaaauuaaaaacaacguauuccuuuguag

SEQ ID NO: 132966 - RNA, 64 nt, hsa
acaaaaaguaaaaauuaaaaaaugaaauuaaaaauaaaauuaccuaggugugguggcacgcauc

SEQ ID NO: 132967 - RNA, 58 nt, hsa
uacuuagccaaaaugauuaaguguuccuuaaaauuaaguugaaaaaggaaauauucuu

SEQ ID NO: 132968 - RNA, 64 nt, hsa
auauuuccacuuagauauuuuacaugguuuuguuuaaaauuaccauuacuuguuuuuuaaaaac

SEQ ID NO: 132969 - RNA, 64 nt, hsa
gaugggcuugagcgauucaagaggcaacuaaaaauaaaauuaggacccagcaccuuguuugaca

SEQ ID NO: 132970 - RNA, 64 nt, hsa
aaagaaauauggaggaagguuaaaaggggauuaguaaaauuaaugcgauagguaacauguuugu

SEQ ID NO: 132971 - RNA, 64 nt, hsa
auuugaacaucucaaaguuauauauacuggguauuaaaauuaaaagcaaguuauaucagugaag

SEQ ID NO: 132972 - RNA, 64 nt, hsa
cacauacuggagauauauauauaauagauauauauaaaauuauuuuaaugcauuguaguguaau

SEQ ID NO: 132973 - RNA, 64 nt, hsa
uguaaucacaacuuacuuucugcuuguaguugcuuaaaauuauguauuuugucuugggcugcaa

SEQ ID NO: 132974 - RNA, 64 nt, hsa
acucauuguccuugauaguuuuuauuuuucauuauaaaauuauaccaggagauuucuuuuaaga

SEQ ID NO: 132975 - RNA, 64 nt, hsa
uuauuauuuagauauuucucaacacuuaaauucauaaaauuaagaccauguaaggguauguuuu

SEQ ID NO: 132976 - RNA, 64 nt, hsa
aaguuaaagcaaaagaggaaaaagcugaaucuuguaaaauuauaacuucauuaaauguuuccac

SEQ ID NO: 132977 - RNA, 64 nt, hsa
aagaaugacauauuuauaaggcaaauuuuaaguuuaaaauuagcaaaaaccuugggaauaaucu

SEQ ID NO: 132978 - RNA, 64 nt, hsa
aucucaaaaguuaaaauuauccauucucaaaaguuaaaauuauauauauauauauauauacaca

SEQ ID NO: 132979 - RNA, 64 nt, hsa
uguuuuaugcaggcugaauguuuaucucaaaaguuaaaauuauccauucucaaaaguuaaaauu

SEQ ID NO: 132980 - RNA, 64 nt, hsa
gaauuaguaauuuuuuuuuggcugacagaucagauaaaauuacuuucuauucauuaauuuuucu

SEQ ID NO: 132981 - RNA, 64 nt, hsa
ugugcuaggauaccugaaaccugaugguuaucuuuaaaauuaaugguuuuucuccugaaauguu

SEQ ID NO: 132982 - RNA, 64 nt, hsa
guacugcauaaugacauauacaauaguggucccauaaaauuauaauggagcagaaaaucuauug

SEQ ID NO: 132983 - RNA, 64 nt, hsa
ucuucacugaaguuauacugaacaaaauauuauuuaaaauuacuucaacuuuguguuuuuaaau

SEQ ID NO: 132984 - RNA, 64 nt, hsa
aaggauuaaacaguuacaagccuccaaauucaaauaaaauuaaaucacaguucagaugaaacug

SEQ ID NO: 132985 - RNA, 64 nt, hsa
gauuugggggguuaaaaaagaaaacuuaacuuuauaaaauuauuuauucuauuuuaagccuucu

SEQ ID NO: 132986 - RNA, 64 nt, hsa
guguuacuccaaaggacaugaaaaagcucaagaguaaaauuaaaauucucaaaaaaaaacccca

SEQ ID NO: 132987 - RNA, 64 nt, hsa
uuccaaaaccaaaaaaagugccuguggauguauauaaaauuaagaugauaagaaagugcuccug

SEQ ID NO: 132988 - RNA, 64 nt, hsa
uguauuuucuccaaguuauuuuuauauguaaaguuaaaauuagauaugagaauguuuugcguag

SEQ ID NO: 132989 - RNA, 64 nt, hsa
uggagaaggggaaauauacagauggcuaguugcauaaaauuaaauuuuaccuuuauaagacaau

SEQ ID NO: 132990 - RNA, 64 nt, hsa
uauaugugaaaaguuggacauuucuguaaguuuuuaaaauuauccauuuguuacuuuaacauuu

SEQ ID NO: 132991 - RNA, 64 nt, hsa
uuuuuaaaauuauccauuuguuacuuuaacauuuuaaaauuaugguguuuuccugauuuuaaaa

SEQ ID NO: 132992 - RNA, 64 nt, hsa
uguguauguuuuaacaucucugaugcuguguuacuaaaauuacaaggaccugcuuuuuaaaagg

SEQ ID NO: 132993 - RNA, 64 nt, hsa
aaacaaauuauuuuuuacaaaaaaacaaaauaaauaaaauuagacuuccuucccucacuauaua

SEQ ID NO: 132994 - RNA, 64 nt, hsa
caggaaucauuaauuucaaaauuuaaagccaugcuaaaauuaaaaagaaaauauuaaauuacac

SEQ ID NO: 132995 - RNA, 64 nt, hsa
uuauuuuaaguaacuagaaccaccaaauaucaaauaaaauuauuugguuaugguuauguucauc

SEQ ID NO: 132996 - RNA, 64 nt, hsa
uauguaaaacccaaacaaguagaacccaagcaaauaaaauuauuuaaaauaauuuuaaaguggc

SEQ ID NO: 132997 - RNA, 64 nt, hsa
aauauagguguucucuggaccuauucuaaccacuuaaaauuaucuuaaguaugcauacauaaaa

SEQ ID NO: 132998 - RNA, 64 nt, hsa
cagucccaaccccccaauuuaaaauugauucuaguaaaauuagguccaguaacaccuguauaua

SEQ ID NO: 132999 - RNA, 64 nt, hsa
uuuuuuuaagguuuaauaacuaaggggaauauuuuaaaauuaagagagcagcaaaugaaaggag

SEQ ID NO: 133000 - RNA, 64 nt, hsa
cuauaaaagcuuuuugccuacagauuuuacauuuuaaaauuaucuauggcuguuuuaaauuguc

SEQ ID NO: 133001 - RNA, 64 nt, hsa
agcuguuuuaaauacugguguauuuucagaacaguaaaauuacugaauaucagaaaaaauguua

SEQ ID NO: 133002 - RNA, 64 nt, hsa
augucuauauauuuuuaguuugauauaauuauaguaaaauuacuaugcaagcuguuuacuuuua

SEQ ID NO: 133003 - RNA, 64 nt, hsa
aauuugcauauuuuagauuguagaaaaguaaauauaaaauuaugugcuccuuuuuuguuuuuuu

SEQ ID NO: 133004 - RNA, 64 nt, hsa
aaugaucaguuagugucaaggagucaaaacagauuaaaauuaauuucauguguauaugguggaa

SEQ ID NO: 133005 - RNA, 64 nt, hsa
uucuaaccucuuacccaaccuguuucuccuugguuaaaauuauacuugaaggcccagaacacuc

SEQ ID NO: 133006 - RNA, 64 nt, hsa
ugcugagaaauuuuucagaaaguccauuuuuguuuaaaauuagaacuuuucagaaugccaaaug

SEQ ID NO: 133007 - RNA, 64 nt, hsa
caaaaguuacuauugcucauaaugacuuacaggcuaaaauuaguuuuaaaauacuauauuaaau

SEQ ID NO: 133008 - RNA, 64 nt, hsa
auguugcuauccugcaggaaauauaaacuuaaaauaaaauuauauaccccacaggcuguguacu

SEQ ID NO: 133009 - RNA, 64 nt, hsa
cuucacagugaaaaaaagaaaaaucuuucauuuuuaaaauuaggagauguuacguaacuuggca

SEQ ID NO: 133010 - RNA, 64 nt, hsa
auuuaggcgucuagaaaaucucaguucccaccaguaaaauuauccugaguagcuaaugcaccuu

SEQ ID NO: 133011 - RNA, 64 nt, hsa
ucuguacuuuucuggccagcuuuuccaggauuuauaaaauuagagcuucggcuugaccucugug

SEQ ID NO: 133012 - RNA, 64 nt, hsa
agauuucuuacaugcauguauuaaauggccauuuuaaaauuagcuaguuucaugcucagauguc

SEQ ID NO: 133013 - RNA, 64 nt, hsa
auauuuuguaagcuauaacauauuuauugugcauuaaaauuaaauacuuuuuccccaaaggcau

SEQ ID NO: 133014 - RNA, 64 nt, hsa
aaauauaccuaccucuuccguuggaaagaacauuuaaaauuaaauaaauuuuaauuaaaaaauc

SEQ ID NO: 133015 - RNA, 64 nt, hsa
aauuuaggaauuauuuaaaaguuaccauuagcucuaaaauuaagauucggaugcuuuauuuaua

SEQ ID NO: 133016 - RNA, 64 nt, hsa
uuuucuuacgccucauuuuaauuuauaaugaagguaaaauuaaaauguauuuuaccacguuucu

SEQ ID NO: 133017 - RNA, 64 nt, hsa
uaaguaucaguuuaaaaauuuauauuaaauuuauuaaaauuaaaauccaguuccuuguugcaug

SEQ ID NO: 133018 - RNA, 64 nt, hsa
acaaugcugauggggaguaggggguaaucuacucuaaaauuaauagagccuuuccaucaauugu

SEQ ID NO: 133019 - RNA, 64 nt, hsa
aaaguuuuuacuucuaagauuugcauuuacaucauaaaauuaaaccauuuucaggaaaaucaga

SEQ ID NO: 133020 - RNA, 64 nt, hsa
agugggacacauuuuaacgucuucuuauguugacuaaaauuauaguuagagcugagaaaaaaaa

SEQ ID NO: 133021 - RNA, 64 nt, hsa
uuuauuauuuuuuuccuuuuucuaaucuuuuccuuaaaauuaauagauaacaaacuaaguuacu

SEQ ID NO: 133022 - RNA, 64 nt, hsa
aaaauuuggaaaauacagaaaauauagggaagaauaaaauuaacccacaguucugucaccuaaa

SEQ ID NO: 133023 - RNA, 64 nt, hsa
gauauguuuuuagaugagagagaaaaauuaaagcuaaaauuagcugcaaagaaguauuaauaau

SEQ ID NO: 133024 - RNA, 64 nt, hsa
aauuugccaucaagccauuucccccuuuuguuucuaaaauuauuucagagaugugugcuccugg

SEQ ID NO: 133025 - RNA, 64 nt, hsa
cagccuggccaacaugguaaaaucccgucucuacuaaaauuauaaaaauuagccgggcaugaug

SEQ ID NO: 133026 - RNA, 64 nt, hsa
ggaaacagguuucaaaugaauauauauacauggguaaaauuacucugugcuaguguagucuuac

SEQ ID NO: 133027 - RNA, 64 nt, hsa
uaagaaaguaugguucuguauggcaauagguuuuuaaaauuauuagcuauucaucauguguggg

SEQ ID NO: 133028 - RNA, 64 nt, hsa
accaaaucaaucuggcuaacuaggaauuuauguguaaaauuaucugauuaaaacagcucaaguu

SEQ ID NO: 133029 - RNA, 64 nt, hsa
gcaauuccauacauauuuuagaguuuuuucuaucuaaaauuaguuaaauacuuagaauguuugu

SEQ ID NO: 133030 - RNA, 64 nt, hsa
aaagaaagcaggauuuucuccuguaucugaauuuuaaaauuaaaaaggcagauaagacauaaau

SEQ ID NO: 133031 - RNA, 64 nt, hsa
uucuacauacucauuugacuggauaaacuuuacauaaaauuaacuaauuuuuuaaauaaaugca

SEQ ID NO: 133032 - RNA, 64 nt, hsa
uguugcacugguggcaauucaucauggagcauaauaaaauuaauuugacccaaauagaauaaaa

SEQ ID NO: 133033 - RNA, 64 nt, hsa
ccugcacauuuguuaugcauacuaaaugguguguuaaaauuaggguuucuuugccucucuacac

SEQ ID NO: 133034 - RNA, 64 nt, hsa
aauacuaaacacuacuuucugucuguggauucuguaaaauuaucauguaaauguucuaccaauu

SEQ ID NO: 133035 - RNA, 64 nt, hsa
gugaaauaggagauacauaguaguauuuuauuuuuaaaauuaauuucucauuugguuuugaaga

SEQ ID NO: 133036 - RNA, 64 nt, hsa
uuugugcuagaauaguuguaucuaaaucauauuuuaaaauuauuuuuauuuuuaaaaaauuaug

SEQ ID NO: 133037 - RNA, 64 nt, hsa
auucaggaaauaaugcagacuagugauuuugcuauaaaauuauuuuugaaggaagcagacacag

SEQ ID NO: 133038 - RNA, 64 nt, hsa
uaaauuuaccagauuaauaaaaauuuaugaauauuaaaauuaucauuaauaauauaaaacacuu

SEQ ID NO: 133039 - RNA, 64 nt, hsa
ugauagggaguuuuaaagaaauuuuaguaguuacuaaaauuauguuacuguauuuuucagaaau

SEQ ID NO: 133040 - RNA, 64 nt, hsa
auaacagccuuuuccuucugguucuaacugcuguuaaaauuaauauaucauuaucuuugcuguu

SEQ ID NO: 133041 - RNA, 64 nt, hsa
gggcuccuauuuuuuccccuacugucuugcauuauaaaauuagaaguguauuuucaguggaaga

SEQ ID NO: 133042 - RNA, 64 nt, hsa
cagugugguaaaagggugauuucaguuuaaaacuuaaaauuaguacuguuuuauugagagaauu

SEQ ID NO: 133043 - RNA, 64 nt, hsa
gaauauuuuuuuaaaaaaaauucuauauauacuguaaaauuauaaauuuuuuuguuuguaauuu

SEQ ID NO: 133044 - RNA, 64 nt, hsa
agaaauggcaucccuaucuacuuacuuuaaugcuuaaaauuauacauaaaaugcuuuauuuaga

SEQ ID NO: 133045 - RNA, 64 nt, hsa
gagacacuaguaguauauguuuguaauguuacuuuaaaauuaucuuuuuauuuuauaaggccca

SEQ ID NO: 133046 - RNA, 64 nt, hsa
uugagaccugugaacugcugcccuguuuaguaaauaaaauuaaugcauuucuagagggggaaua

SEQ ID NO: 133047 - RNA, 64 nt, hsa
aaaauugugugccauuuaaaaacugaaaauauuuuaaaauuauuugucuauauucuaaauugag

SEQ ID NO: 133048 - RNA, 64 nt, hsa
agucuugcaacaaaaugucuuuuaaguuuccuguuaaaauuauaaaaagauuuucauggugaga

SEQ ID NO: 133049 - RNA, 64 nt, hsa
cuuugguuauuucuauugcacagaaaaggauuuuuaaaauuagauuaguauaauaucuggccau

SEQ ID NO: 133050 - RNA, 64 nt, hsa; identical to SEQ ID NO: 132958

SEQ ID NO: 133051 - RNA, 64 nt, hsa; identical to SEQ ID NO: 132959

SEQ ID NO: 133052 - RNA, 64 nt, hsa
auuuguaacucacauccuuugagcuaaacuaaauuaaaauuacaguauuuaauaauucuuuggg

SEQ ID NO: 133053 - RNA, 64 nt, hsa
aggauuucuucuuacuggcguucuuaaaggucucuaaaauuaaagaacaagaugugguuuuuug

SEQ ID NO: 133054 - RNA, 64 nt, hsa; identical to SEQ ID NO: 132959

SEQ ID NO: 133055 - RNA, 64 nt, hsa; identical to SEQ ID NO: 132958

SEQ ID NO: 133056 - RNA, 64 nt, hsa
auucuauacucuuuuugaaacuuuucuauaauucuaaaauuauuuuuuaaaguuaaacaguaua

SEQ ID NO: 133057 - RNA, 64 nt, hsa
ggguagcuuucauuucuuccauuaauuacauguguaaaauuaaaacacuacuguaauguuaauu

SEQ ID NO: 133058 - RNA, 64 nt, hsa
acccugcaaugugcacauuaaaauauggaaauuuuaaaauuaugaccaagggcuugaaacauau

SEQ ID NO: 133059 - RNA, 64 nt, hsa
ugaacacuuacuuaguucuuagcuacacccacucuaaaauuaacuggacauuaguguacagccc

SEQ ID NO: 133060 - RNA, 64 nt, hsa
gaaucuagaugcaauuaauuuuauuccuuccaacuaaaauuacaauauuuuuagguuaaaauua

SEQ ID NO: 133061 - RNA, 64 nt, hsa
auuccuuccaacuaaaauuacaauauuuuuagguuaaaauuauugagauauaaagcagccauug

SEQ ID NO: 133062 - RNA, 64 nt, hsa
gugauuuaauucuccauuccuccaauguaacucuuaaaauuauuauguauguguguguguuuua

SEQ ID NO: 133063 - RNA, 64 nt, hsa
cugauggacaugugaaaaguaaguauaaauggaauaaaauuaauuaggcuaauaggcuuaaccc

SEQ ID NO: 133064 - RNA, 64 nt, hsa
auguucagcaaccugaaugguuauuuuuguuaauuaaaauuaaauuuuuaagagauauuuucaa

SEQ ID NO: 133065 - RNA, 64 nt, hsa
ccauuacaugauuaugaaaugacugugaagaauauaaaauuaaacuuagugacuuaauuaguca

SEQ ID NO: 133066 - RNA, 64 nt, hsa
gaagaauaucuaagcuuuuucugagaugggcuuuuaaaauuauaauaagggaaguuuauuuucu

SEQ ID NO: 133067 - RNA, 64 nt, hsa
gcccauggaauuuaauuuuucauugugaucagauuaaaauuacuauuugugcaaaacaaauucc

SEQ ID NO: 133068 - RNA, 64 nt, hsa
caaaaacaaacauuauuggaguuucaguguaaaauaaaauuaaaauuggaggguugguuagauu

SEQ ID NO: 133069 - RNA, 64 nt, hsa
agaaauccuuagcuaguagaauggcagcacgcuguaaaauuauuacuguauuguguacuggcua

SEQ ID NO: 133070 - RNA, 64 nt, hsa
aaggagauggaaugaucaaaucacagagaaacacuaaaauuacuaaaucuacaacagcucgccu

SEQ ID NO: 133071 - RNA, 64 nt, hsa
auacuuuuaaaaacauauugguaaaugauacccguaaaauuaaauuaguuauauuuuauuuuaa

SEQ ID NO: 133072 - RNA, 64 nt, hsa
uuugguuguuguucccugaacuacugucuauauuuaaaauuagauggaauccaaagauacacgg

SEQ ID NO: 133073 - RNA, 64 nt, hsa
gagaugaaacuuuuauaugacguguauacuuaaauaaaauuaauauaaaauuugcucugguguc

SEQ ID NO: 133074 - RNA, 64 nt, hsa
ugaagcauuauauauauaaguaauuaugugucuuuaaaauuaugagaugaaacuuuuauaugac

SEQ ID NO: 133075 - RNA, 64 nt, hsa
cacugcaauuuacaaagaucucuuuacgguuuuauaaaauuaucuuccaguuuguacauuuaua

SEQ ID NO: 133076 - RNA, 64 nt, hsa
caucauuauguaaaagaaaauauauuuuagccccuaaaauuaggaagaauguaaucucagaaua

SEQ ID NO: 133077 - RNA, 64 nt, hsa
aaguugucagggaaugucauuacacucugauuuuuaaaauuaugcaguauuuuccaguucucag

SEQ ID NO: 133078 - RNA, 64 nt, hsa
ugugcccagggaaguguguugcauuaacuaaagcuaaaauuaucagaauccuauuuacauaaag

SEQ ID NO: 133079 - RNA, 64 nt, hsa
uguuuuucuauaaccuggauuuuuuaaaucauauuaaaauuacagaugugaaaauaaagcagaa

SEQ ID NO: 133080 - RNA, 64 nt, hsa
gauuucaggauguccucauaucuauuuauaggucuaaaauuauaucuuaagguauguuguagaa

SEQ ID NO: 133081 - RNA, 64 nt, hsa
augagagaaaauauuuuuugaagaagcauuucuguaaaauuagaaauuacuuuuuuuaaucuau

SEQ ID NO: 133082 - RNA, 64 nt, hsa
uuaguaauauauuaaagugaauguaaauggugguuaaaauuacauuacugugaaauucaucuuc

SEQ ID NO: 133083 - RNA, 64 nt, hsa
augcugugcagaauucugauuuauuuuuguuuccuaaaauuaagauagcuugaauauuauuuca

SEQ ID NO: 133084 - RNA, 64 nt, hsa
uggagauuauauuaggaaguuucaucagauuguauaaaauuaugauuuuguaucaaaaguauuc

SEQ ID NO: 133085 - RNA, 64 nt, hsa
uuuuaacauuggcaucuaaaguguuauuugaaaauaaaauuauuuuccuguucauugauuuuaa

SEQ ID NO: 133086 - RNA, 64 nt, hsa
uguucuuuaucacuuccgagcaaauacucagauuuaaaauuacuuuaaaguccugguacuuaac

SEQ ID NO: 133087 - RNA, 64 nt, hsa
uuggaaaauagcacuuuucacuucuguguguuuuuaaaauuaauguuauagaagacucaugauu

SEQ ID NO: 133088 - RNA, 64 nt, hsa
cuuauacaauaaaaaggacacauuuguguauguuuaaaauuacuuaugcagauaccguaauuua

SEQ ID NO: 133089 - RNA, 64 nt, hsa
ggcugucauuauuuaaacacauucucaccaaaucuaaaauuaguuuaaugagcuguuucugaca

SEQ ID NO: 133090 - RNA, 64 nt, hsa
aagcacuuggucuuugauuaucagauacugucucuaaaauuauuuuaaagauuaauauuuguuc

SEQ ID NO: 133091 - RNA, 64 nt, hsa
accuagcuagauuucuagcauuugcuguauuuauuaaaauuauuauuuuuuugguaaaacauua

SEQ ID NO: 133092 - RNA, 64 nt, hsa
ugucaggauuuauucuauuuauaucuuauuacaauaaaauuaguggcacuuuauucauaaauau

SEQ ID NO: 133093 - RNA, 64 nt, hsa
ucuuacuauagauuauguacaaguaacaucuaaauaaaauuacacuuuuaacccuaagagguuu

SEQ ID NO: 133094 - RNA, 64 nt, hsa
auauaaucuggacagaaaauuucacaaaauucaauaaaauuacaacuguugucuaaauaaguga

SEQ ID NO: 133095 - RNA, 64 nt, hsa
aauuucuaguuuucacucaugguuaacacgcauuuaaaauuauuucaugagucuaguaguucuu

SEQ ID NO: 133096 - RNA, 64 nt, hsa
uuaauauuguaauuuaauguagacuuacuuugaauaaaauuaguuuaauuggccuuaaaauuac

SEQ ID NO: 133097 - RNA, 64 nt, hsa
gacuuacuuugaauaaaauuaguuuaauuggccuuaaaauuacauuaauaaaacuuugugauau

SEQ ID NO: 133098 - RNA, 64 nt, hsa
guacaauaugaaaaaaaagaauaaaaaguagcaguaaaauuauauacugaaaacaccaaaaauu

SEQ ID NO: 133099 - RNA, 64 nt, hsa
gucaugcuuacuccuuagaguucagaugaauucuuaaaauuaaaaaaaaacuccauaguacuaa

SEQ ID NO: 133100 - RNA, 64 nt, hsa
aaaugauauauaguuauguugucuuuuauaguguuaaaauuaguauuuauaugaaagucaagau

SEQ ID NO: 133101 - RNA, 64 nt, hsa
agaggauggagcuaagagaaauaagaucaaauauuaaaauuaggaauuuaggcauuaccucagg

SEQ ID NO: 133102 - RNA, 64 nt, hsa
aauggucauugaaaacacuuguuuagcauuagaauaaaauuauauauguccuugggaaauauua

SEQ ID NO: 133103 - RNA, 64 nt, hsa
gucauacuguacacuguauuguaaaaauaaaaaguaaaauuauauuucaaauuuuaaaagccac

SEQ ID NO: 133104 - RNA, 64 nt, hsa
aaaacccccuuuaaaacaaaacaaaaaaaugaaauaaaauuaggcaaauugacagacagugaga

SEQ ID NO: 133105 - RNA, 64 nt, hsa
uuucuucguuguagaucagaauuucaccagggaguaaaauuaccugaaaacguaagaaguuuua

SEQ ID NO: 133106 - RNA, 64 nt, hsa
cuugcucugucuaccuugacagaaauuggaguuuuaaaauuauguguuaauauuuuuauuugca

SEQ ID NO: 133107 - RNA, 64 nt, hsa
acauuguugcccuucaacaaggcucuugaauuaauaaaauuauagucucuaagaauuccacauu

SEQ ID NO: 133108 - RNA, 64 nt, hsa
aauacaucuuugugcguagagccaaaaaaagagauaaaauuaauaauaguucacuuguuauuug

SEQ ID NO: 133109 - RNA, 64 nt, hsa
uuaaaaauagggauuaaaugucuaggcuuccauuuaaaauuauaugaaugguuugggaucuuuu

SEQ ID NO: 133110 - RNA, 64 nt, hsa
uuucuuuacagcugaaauugcuuuaaaugaugguuaaaauuacaaauuaaauuguuaauuuuua

SEQ ID NO: 133111 - RNA, 64 nt, hsa
ccauggucaugucauucugaggucacauaacacauaaaauuaguuucuaugaguguauaccauu

SEQ ID NO: 133112 - RNA, 64 nt, hsa
uugcuaaagaacuacuguuuaguugguaaugguguaaaauuacauucagcuccuucuugucaua

SEQ ID NO: 133113 - RNA, 64 nt, hsa
uuaaaauuuuauuccaccuguacauuugucacuuuaaaauuaaaauugagcugguaugagagau

SEQ ID NO: 133114 - RNA, 64 nt, hsa
aauacuagccuagaaauauagagcauuaacaaaguaaaauuaauauauuaaguuauaauuggaa

SEQ ID NO: 133115 - RNA, 64 nt, hsa
aaagaaaacacccuuaugaauugaugacuauauauaaaauuauauucacuacuuuugaacacau

SEQ ID NO: 133116 - RNA, 64 nt, hsa
aagauauaaaacugguuaggguccuacagggaaauaaaauuauaaccguggagguacauuucuc

SEQ ID NO: 133117 - RNA, 64 nt, hsa
uaauuacuauuuaaaaacucagguuuagauuguuuaaaauuaguugcuuuugauacucagcugu

SEQ ID NO: 133118 - RNA, 64 nt, hsa
ugaacucguauguacuaucaaauacauaaagguguaaaauuacaacaaaaggcauuauaauuuu

SEQ ID NO: 133119 - RNA, 64 nt, hsa
acuugcuuuuugcugagcuuaauucagauaucaguaaaauuaagucauaaaauaaucauguguc

SEQ ID NO: 133120 - RNA, 64 nt, hsa
guacagcacuuuacacacaagagguuuauugauguaaaauuaucggcuagggaagcagcagcgg

SEQ ID NO: 133121 - RNA, 64 nt, hsa
ugcauccacaagcuggaucugaguuuugucacucuaaaauuaaacaagaaaaaaagugggaaaa

SEQ ID NO: 133122 - RNA, 64 nt, hsa
ggaaucaacaaugaguuuauuguucaugguagauuaaaauuaagcuugcauaaagguugggcua

SEQ ID NO: 133123 - RNA, 64 nt, hsa
ugcugaugcaagaauucuacauuuuaaugaguuauaaaauuauucugcaucucaucacgucaca

SEQ ID NO: 133124 - RNA, 64 nt, hsa
uaccauuuugaggggauuuauacauauuuuuagauaaaauuaaaugcucuuauuuuuccaacag

SEQ ID NO: 133125 - RNA, 64 nt, hsa
caccagcaguuaaccuucaagacauuccacuugcuaaaauuauuuauuuuguaaggagagguuu

SEQ ID NO: 133126 - RNA, 64 nt, hsa
auuuuguaaauuuaguuaacaaauacauaaauuuuaaaauuauucuuccucucaaacauagggg

SEQ ID NO: 133127 - RNA, 64 nt, hsa
auaauuaauaguauguuuaauuuuaaagaucauuuaaaauuaacaucagguauauuuuguaaau

SEQ ID NO: 133128 - RNA, 64 nt, hsa
aaacucuuaaucuguguguauauugagaaucccuuaaaauuaccagacaaaaaaauuuaaaauu

SEQ ID NO: 133129 - RNA, 64 nt, hsa
ugagaaucccuuaaaauuaccagacaaaaaaauuuaaaauuacguuuguuauuccuaguggaug

SEQ ID NO: 133130 - RNA, 64 nt, hsa
auucccuguuuaaaauuacugaaucguacauuauuaaaauuauucugacaguauacaaacaaca

SEQ ID NO: 133131 - RNA, 64 nt, hsa
uuuaccugcauuuaauucagccagauucccuguuuaaaauuacugaaucguacauuauuaaaau

SEQ ID NO: 133132 - RNA, 64 nt, hsa
uccuaaaguccagguaugauuggauuaauauuuauaaaauuauuauuaggaauuauuuaagugg

SEQ ID NO: 133133 - RNA, 64 nt, hsa
uguaucuuauuaaaauaggaugauuugcauuuuguaaaauuauccugcacaucaagcugcaugc

SEQ ID NO: 133134 - RNA, 64 nt, hsa
cgacagagcaagacugucucaaaaaaauuaaaauuaaaauuaaaaacaaauaauccugccuuuu

SEQ ID NO: 133135 - RNA, 64 nt, hsa
ccugggcgacagagcaagacugucucaaaaaaauuaaaauuaaaauuaaaaacaaauaauccug

SEQ ID NO: 133136 - RNA, 64 nt, hsa
aacccaguuuuauacuuuuaguuauuuuaaaauguaaaauuaaauuguuauugauuacaguguu

SEQ ID NO: 133137 - RNA, 64 nt, hsa
uuaugagaaaacuuaauuucauuuauaaguaaauuaaaauuaguauauuuuacuaauacuuuua

SEQ ID NO: 133138 - RNA, 64 nt, hsa
aacuucaggcaauaauauuuucuguguaagcuuuuaaaauuauuuuuggggaucauagcuuguu

SEQ ID NO: 133139 - RNA, 64 nt, hsa
uuuuggggaucauagcuuguuuuauuuugugcuauaaaauuaacaguauuaaaugacuuauauu

SEQ ID NO: 133140 - RNA, 64 nt, hsa
uuucaguuacguugcuuggguuaagacacuuugcuaaaauuacagccugaauccuuucuuuagu

SEQ ID NO: 133141 - RNA, 64 nt, hsa
cgucauguaucauugguuugaggugaaauagcaauaaaauuaauagaauggugccugguacuag

SEQ ID NO: 133142 - RNA, 64 nt, hsa
aguaaauacccauuacuccuuuacucauagcugguaaaauuauucccacuguuuuauugccuuu

SEQ ID NO: 133143 - RNA, 64 nt, hsa
ucugguuuuauaaacugaguuucuuagcauucguuaaaauuaagggguuuguuuggaauaauau

SEQ ID NO: 133144 - RNA, 64 nt, hsa
auggaaaagauguucaugguacauuguaaaaaaauaaaauuaaaauuaaaaaaaguuugcagaa

SEQ ID NO: 133145 - RNA, 64 nt, hsa
aagauguucaugguacauuguaaaaaaauaaaauuaaaauuaaaaaaaguuugcagaaccgcau

SEQ ID NO: 133146 - RNA, 64 nt, hsa
acuuuuagaaacuuaucuuacaaaguguauuuuauaaaauuaaagaaaauaaaauuaagaaugu

SEQ ID NO: 133147 - RNA, 64 nt, hsa
ucuuacaaaguguauuuuauaaaauuaaagaaaauaaaauuaagaauguucucaaucaaacauc

SEQ ID NO: 133148 - RNA, 64 nt, hsa
aagcaaaauauucauuuuuacuuuuucuuauuuuuaaaauuaggcugaauguacuucaugugau

SEQ ID NO: 133149 - RNA, 64 nt, hsa
uucaugaauuagucuacagaaaaaaaauguucuguaaaauuagucuguugaaaauguuuuccaa

SEQ ID NO: 133150 - RNA, 64 nt, hsa
uugaaaauugaguuuauguuugaccuaaaugggcuaaaauuacauuagauaaacuaaaauucug

SEQ ID NO: 133151 - RNA, 64 nt, hsa
auuagagugugggaauagggaucuaaauuuuaaauaaaauuauauauauauauaaauuggugcu

SEQ ID NO: 133152 - RNA, 64 nt, hsa
uuguuuaguuuuuucuuacuuuuaaauuccaacuuaaaauuaugagguuucagaaauauauuga

SEQ ID NO: 133153 - RNA, 64 nt, hsa
ggaaauaguuguggauguacuaagaguaaugaaauaaaauuauagcuucauucacuugccuuuu

SEQ ID NO: 133154 - RNA, 64 nt, hsa
cugagccaaucagaaauauauuuuucaauaaugcuaaaauuagcuacaauucugcugacccuac

SEQ ID NO: 133155 - RNA, 64 nt, hsa
cugacaaaauacuugucuguuuuaaaaaccuguucaagucuaccaaccuguucaagucuaccaa

SEQ ID NO: 133156 - RNA, 64 nt, hsa
guuuuaaaaaccuguucaagucuaccaaccuguucaagucuaccaauuauaagggcaaauugga

SEQ ID NO: 133157 - RNA, 64 nt, hsa
guuucuugcucucucucccugccuuuaaaugaaacaagucuagucuucugguuuucuagccccu

SEQ ID NO: 133158 - RNA, 64 nt, hsa
gauaauggagaauguaucagccagccuuccccaccaagucuaaaaagaccuggccuuucacuuu

SEQ ID NO: 133159 - RNA, 64 nt, hsa
gcugcucuagcuggcaggacacaucccggccucuuccacccauucccccauguggcugaagaca

SEQ ID NO: 133160 - RNA, 64 nt, hsa
ucugagcccaggccguuccccuuggcuuccuccguccacccaggcugcacugcagugauggcgc

SEQ ID NO: 133161 - RNA, 64 nt, hsa
caggguccgcaccagcugcucugccccuugggcauccacccagugcugccaugccacugccagg

SEQ ID NO: 133162 - RNA, 64 nt, hsa
cuuaaugucuucuuccucucaagccaaauucgccuccacccacucccucugaagaacugggcau

SEQ ID NO: 133163 - RNA, 64 nt, hsa
ucugccaaggucucucccuccagggaccucugcuuccacccacauauguccacuuagucaccca

SEQ ID NO: 133164 - RNA, 64 nt, hsa
aacuauuaaccuggggcccuggcagauugggguauccacccagucauguaaaggcaggagaccu

SEQ ID NO: 133165 - RNA, 64 nt, hsa
ucugaagaccucacccuggcagggugggcuucuauccacccaugaggcaccuggggcuucucag

SEQ ID NO: 133166 - RNA, 64 nt, hsa
gccaggcuggucucgaacuccugaccucaagcgauccacccaccucggccucccaaagugcugg

SEQ ID NO: 133167 - RNA, 64 nt, hsa
guuuucuuccguuggaaccacccagacaucugcuuccacccagccaagcccacaucacaucucc

SEQ ID NO: 133168 - RNA, 64 nt, hsa
ccuucgccuuugcugaagucuccccgcagcccucuccacccagaggucucccuauaccgagacc

SEQ ID NO: 133169 - RNA, 64 nt, hsa
cgcugacagccuccuaggcucccugagguaccuuuccacccagacccuccuuccccaccccaua

SEQ ID NO: 133170 - RNA, 64 nt, hsa
gccacacuugauaaaucauggggaacagauguguuccacccaacaaaugugauaagugaucaug

SEQ ID NO: 133171 - RNA, 64 nt, hsa
uggccaggauggucucgaucucuugaccucaugauccacccaccucggucucccaaagugcugg

SEQ ID NO: 133172 - RNA, 64 nt, hsa
aaaccugccuguaaacgcucuguaaauacucccuuccacccaucccagccccugggcagccggg

SEQ ID NO: 133173 - RNA, 64 nt, hsa
cuccuguuuuuugcaaguacauuuuugucccuccuccacccagguaucugccuauuuucuugcu

SEQ ID NO: 133174 - RNA, 64 nt, hsa
ccuacagaugcagaaccagaaugagggggacaauuccacccacucgagggcugcccccucuucc

SEQ ID NO: 133175 - RNA, 64 nt, hsa
uagccaggauggucucgaucuccugaccucgugauccacccaccucggccucccaaagugcugg

SEQ ID NO: 133176 - RNA, 64 nt, hsa
caaccucucuccccgccccuguauccugcauuccuccacccacccucuaucccccaccgcucca

SEQ ID NO: 133177 - RNA, 64 nt, hsa
accccuguaccucccaccccuguauccccaccccuccacccaccccucucccaaccucucuccc

SEQ ID NO: 133178 - RNA, 64 nt, hsa
gagugcaguggcaugaucucagcucacugcaaccuccacccacuggguucaagcgauucuucug

SEQ ID NO: 133179 - RNA, 64 nt, hsa
ugcaggacaggacuauucuagcauaccugcuucguccacccaggcaggguuugggguggucucu

SEQ ID NO: 133180 - RNA, 64 nt, hsa
caaacuaccagccguaucuagcauauccccacccuccacccacuaccuccuccaacaaaggagu

SEQ ID NO: 133181 - RNA, 64 nt, hsa
cccagcugugauuuuuaucaguaauggccaugccuccacccaccuuaguuaggagcuacuucca

SEQ ID NO: 133182 - RNA, 64 nt, hsa
uaguuuguccuccuuuaauuguuugcccaaaucuuccacccaucuuuuuucuucccucauuuuc

SEQ ID NO: 133183 - RNA, 64 nt, hsa
gagagggacaaaaggaguaauuauuugguauagauccacccaucccaaccuuucucuccucagu

SEQ ID NO: 133184 - RNA, 64 nt, hsa
gugcugguaagguccuagcaucuuccccucaccuuccacccaugagaacagcgugagcuggugg

SEQ ID NO: 133185 - RNA, 64 nt, hsa
cuccuccugagcauaaaaccauggcagccuugucuccacccaugacucacuacaaccuugugcu

SEQ ID NO: 133186 - RNA, 64 nt, hsa
gcccaguuggguggaugccugguggcagcugcgguccacccaggagccccgaggccuucucuga

SEQ ID NO: 133187 - RNA, 64 nt, hsa
gccaggcuggucucaaacucuugaccucaggugauccacccaccucagccucccaaagugcugg

SEQ ID NO: 133188 - RNA, 64 nt, hsa
ggaagcaacuaauucuggugcucaggcugggcucuccacccaaguuaggccugcucuggccuaa

SEQ ID NO: 133189 - RNA, 64 nt, hsa
acagugaggcagucucccuuccugaccauucuucuccacccagucacagauaagggaauaaccu

SEQ ID NO: 133190 - RNA, 64 nt, hsa
guuggagaucauggagcuaagaagcagagccaaguccacccauguccuuggcagagaugacagg

SEQ ID NO: 133191 - RNA, 64 nt, hsa
uagccaggauggucucgaucuccugaccucgugauccacccaacucggccucccaaagugcugg

SEQ ID NO: 133192 - RNA, 64 nt, hsa
cagggggccucgggcacuccacuaccaacccagcuccacccagcaguguccuggggagaaggaa

SEQ ID NO: 133193 - RNA, 64 nt, hsa
gccuuccaccggagagacuacugaccuucucaccuccacccauaccuucuccccacagccucug

SEQ ID NO: 133194 - RNA, 64 nt, hsa
ugaccaggauggucucaaucuccugaccuugugauccacccaccucggucuccccaaagugcug

SEQ ID NO: 133195 - RNA, 64 nt, hsa
accaggcugaucuuaaacucuugaccucaaaugauccacccaccuuggccucccaaauuguucg

SEQ ID NO: 133196 - RNA, 64 nt, hsa
cccaggcuggucucgaacuccugggcucaagugauccacccaucuccaccucccaaagugcuag

SEQ ID NO: 133197 - RNA, 64 nt, hsa
cccaggcuggucucaaacuccugcccucaggugauccacccaccucagccucucaaagugcugg

SEQ ID NO: 133198 - RNA, 64 nt, hsa
uccuccccuggggacagccccaccuccgggucccuccacccacaucccccugguccuaccccug

SEQ ID NO: 133199 - RNA, 64 nt, hsa
agguaugggagagcgcugggggcccaucccccuguccacccaguguccacuggccuguccuuca

SEQ ID NO: 133200 - RNA, 64 nt, hsa
cugcucuucugucuauuguaccgacuuaaccucuuccacccaaguccgcaucuguguguaucau

SEQ ID NO: 133201 - RNA, 64 nt, hsa
cauaaacggcccucucgaacacaaugggacggaauccacccacaacgcgcuugguuugcagaug

SEQ ID NO: 133202 - RNA, 64 nt, hsa
agccacaugcugcugcccugaucucagugggaaauccacccagcaaccuaauacagccccuuuu

SEQ ID NO: 133203 - RNA, 64 nt, hsa
ugauuuuaaacuucaggccagaacccccaaugacuccacccauagucucacuuuaggucucauu

SEQ ID NO: 133204 - RNA, 63 nt, hsa
uagagacaaaacaagcagacaccugaaacaaucaacgcccaauaaaacaaaguaggaugaaaa

SEQ ID NO: 133205 - RNA, 63 nt, hsa
uggcugggguuccugguggauuucuuacuaccuaacgcccaagaaaaccaacuaaggacucuc

SEQ ID NO: 133206 - RNA, 63 nt, hsa
uuagcuguagucuauauuagggcaguucucuagaacgcccacauuuccaccaacucaguaaac

SEQ ID NO: 133207 - RNA, 63 nt, hsa
cucuggaaauggugaggcgaggggcuugagaggaacgcccacccacgaaggcccagggcgcca

SEQ ID NO: 133208 - RNA, 51 nt, hsa
ugaagcgcaaagcugaaugaaaacgcccaaaauaauuaguaggaguucauc

SEQ ID NO: 133209 - RNA, 63 nt, hsa
uguagguagcaauguacagauaaagaguacuuuaacgcccaugcguguucaagacuguucaag

SEQ ID NO: 133210 - RNA, 63 nt, hsa
aggagacuccacccuggggucccaaacgccgcuaacgcccagacgcauggaugcacccccuac

SEQ ID NO: 133211 - RNA, 63 nt, hsa
cuuaaauguagauaugugcugaaagaaaaaaaaaacgcccaacucuugaaguccauugcugaa

SEQ ID NO: 133212 - RNA, 63 nt, hsa
ggucugggcugccaagcuucuuccccccugacaaacgcccaccugaccugaggccccagcuuc

SEQ ID NO: 133213 - RNA, 63 nt, hsa
aaauucuagacaucaguucuuuaagucucagaaaacgcccagugaauugguaaacuuaguucu

SEQ ID NO: 133214 - RNA, 63 nt, hsa
aauagggggcacucauuuuguuucaacgguccaaacgcccaaccuucagaaagaggaagucag

SEQ ID NO: 133215 - RNA, 63 nt, hsa
acugggcucuguccugcagacaccucuuucagaaacgcccaagcccagccccuaggagggggu

SEQ ID NO: 133216 - RNA, 63 nt, hsa
uucccuucauaaggacuuuuuuugucuuucuuuaacgcccaggcuucgucuuauuucuacugu

SEQ ID NO: 133217 - RNA, 63 nt, hsa
ucucacgucauauuauaggaaacucugacacagaacgcccaacguggacacaggugccaguuc

SEQ ID NO: 133218 - RNA, 63 nt, hsa
uuauuuuuuguaagugucauuuguauaacucuaaacgcccaugauaguagcuucaaacuggaa

SEQ ID NO: 133219 - RNA, 63 nt, hsa
uggcagucucagccucccuccacggucaccuucaacgcccagacacucccuucucccaccuua

SEQ ID NO: 133220 - RNA, 63 nt, hsa
uguucuauacauugugaaucuucccgucugaagaacgcccagccugcccagacaaagccccgc

SEQ ID NO: 133221 - RNA, 63 nt, hsa
auguauucucuauaaggcauucaauaaaugcacaacgcccaaaggaaauaaaauccuaucuaa

SEQ ID NO: 133222 - RNA, 63 nt, hsa
ggugccgcgccgugccgccuggcccucucccccaacgcccaggucuuggccuuggccaguggc

SEQ ID NO: 133223 - RNA, 63 nt, hsa
caggggcuguuggugucugagccgggagggucgaacgcccagggcacugcgccccgcaacuga

SEQ ID NO: 133224 - RNA, 63 nt, hsa
ucagcaugaacaccaggcaccccugggacaccuaacgcccaguucccgugaccccaacugcag

SEQ ID NO: 133225 - RNA, 63 nt, hsa
uugccuugcuguuuaaaaguaaugcaauaugugaacgcccagagaacaagcacuguggaacug

SEQ ID NO: 133226 - RNA, 63 nt, hsa
ccuggcugccaggcucgccaggagcccacuggaaacgcccaccacgggggcuccuuguuacac

SEQ ID NO: 133227 - RNA, 63 nt, hsa
ugagaauauuuuauuuucauggugagucuagaaaacgcccacuucauucugauuaaaaauucu

SEQ ID NO: 133228 - RNA, 63 nt, hsa
acucggucaugugcucagacaacgacugaugaaaacgcccaugcgguuugcaucgacugauag

SEQ ID NO: 133229 - RNA, 63 nt, hsa
gcaagccccagguugugacaggugcagguagacaacgcccauaaacagagaugguccugaacu

SEQ ID NO: 133230 - RNA, 63 nt, hsa
gggggucccacccuucuuaccccacccgggaggaacgcccagggccccgggcuuguuucuccu

SEQ ID NO: 133231 - RNA, 63 nt, hsa
ccacgggauuuguagccagccagcucccaggccaacgcccaaagcccugaugaccugguucuu

SEQ ID NO: 133232 - RNA, 63 nt, hsa
cauaggaccugccacacaagcagccguggacacaacgcccacuaccaccucccacauggaaau

SEQ ID NO: 133233 - RNA, 63 nt, hsa
uggcuagaggucccugccccugucuggaggcacaacgcccauccuuaggccaaacaguaccca

SEQ ID NO: 133234 - RNA, 63 nt, hsa
ccauuuccccagggcacgugguugaguggggggaacgcccacuucccuggguuagacugccag

SEQ ID NO: 133235 - RNA, 63 nt, hsa
gucgccucugccacugucagggaccagccggccaacgcccacccgcaaaggugucuaaaaacu

SEQ ID NO: 133236 - RNA, 63 nt, hsa
cucuuuccugagacuggaucuguucaaacagcaaacgcccacagauggcccagaggugguggu

SEQ ID NO: 133237 - RNA, 63 nt, hsa
ucccaaagugcugggauuacagguaugagccacaacgcccagccaucauuuaucuuuuucacu

SEQ ID NO: 133238 - RNA, 63 nt, hsa
uuuuuuggggggggggggacggagucuugcugcaacgcccaggcuggagugcaauggcacuau

SEQ ID NO: 133239 - RNA, 63 nt, hsa
uaagcacuucucagagaaugcuauucaagggauaacgcccagggaacaaugaagaggauaaga

SEQ ID NO: 133240 - RNA, 63 nt, hsa
uucguuaugaacaagaaaaaaggaauuccuugaaacgcccacgugauguagaucauagguagu

SEQ ID NO: 133241 - RNA, 63 nt, hsa
ccaccggcaccagugccucgcuccauuggcaccaacgcccagcuccaccgguacuggcucccu

SEQ ID NO: 133242 - RNA, 63 nt, hsa
ucucggugauaaaggcgcccacuggacccucccaacgcccaaugcuuugcuuuucuccuccuc

SEQ ID NO: 133243 - RNA, 63 nt, hsa
gagggaaugaggaagcuacagguagguccacccaacgcccaggcaccccagucuacuugcugg

SEQ ID NO: 133244 - RNA, 63 nt, hsa
auacuaaaugcagcuauguaaaaauaaaauucaaacgcccaggauuaaaauaaaauauaaucu

SEQ ID NO: 133245 - RNA, 63 nt, hsa
gugugugugugcacaagugagugagagauuucgaacgcccaccccucgacuuugaaaucugag

SEQ ID NO: 133246 - RNA, 63 nt, hsa
ggagauaaucaacacucaggaccuucagccuugaacgcccauuagugcuauguuauagaaccu

SEQ ID NO: 133247 - RNA, 63 nt, hsa
gcccagagcagcgggaugagcuggcggccagagaacgcccagcccagcccacccccgcucacg

SEQ ID NO: 133248 - RNA, 63 nt, hsa
gccuuagccagcuagugacgaguacaacgagauaacgcccauguguuuuggaacauuuaugua

SEQ ID NO: 133249 - RNA, 63 nt, hsa
uaugcacauagaccuuagaguguauaguuaacaaacgcccaucugcucacccaugcccaccca

SEQ ID NO: 133250 - RNA, 63 nt, hsa
ggccccuggugacggcacagcccucacagcucaaacgcccacccccacucccaccaucugcag

SEQ ID NO: 133251 - RNA, 63 nt, hsa
cacaucuccagcaaguucucaagcucagagacgaacgcccagcgcuuuggaaaccacauccgc

SEQ ID NO: 133252 - RNA, 64 nt, hsa
agcugucuuuucaguuaugguaaacucuuaaaguucagaacacucaacagauuccuucagugau

SEQ ID NO: 133253 - RNA, 64 nt, hsa
augaccaguuaucucgaguagauuuucuuggauuucagaacaucuagcaugacucugaaggaua

SEQ ID NO: 133254 - RNA, 64 nt, hsa
cugcuuccucagccuucuuugaugagcuggucccucagaacaugacuccuugggagauccccau

SEQ ID NO: 133255 - RNA, 64 nt, hsa
aggccuugggaucaggaaaucuacugaauuacugucagaacaagagccagcaagcuuuacugca

SEQ ID NO: 133256 - RNA, 64 nt, hsa
ccagagacaagacuucgggaaggugucuggacauucagaacaccaagacuugaaggugccuugc

SEQ ID NO: 133257 - RNA, 64 nt, hsa
gguagagcccuguaucaacccagaaacaccuagaucagaacaggaauccacauugccagugaca

SEQ ID NO: 133258 - RNA, 64 nt, hsa
guaagcugcuuuugacggaaggaccuauguuugcucagaacacauucuuucccccccucccccu

SEQ ID NO: 133259 - RNA, 64 nt, hsa
cuuggucacugcagaauuuuaaaaggcaaacuucucagaacagaugugcacaucuuaauuuggu

SEQ ID NO: 133260 - RNA, 64 nt, hsa
agcauuuuguuuuuagagaacuauucugguacuaucagaacaaauacauaaaauaacuucccau

SEQ ID NO: 133261 - RNA, 64 nt, hsa
gcauuucauguggccauggguaccuagaaagacaucagaacaagucggucaaauuaaaaguaga

SEQ ID NO: 133262 - RNA, 64 nt, hsa
gccaucuuaguaaaaauuuugaaaggaugaccacucagaacaacucucuugaugaccauucugu

SEQ ID NO: 133263 - RNA, 57 nt, hsa
ccaucuaugaauuccggugacaacgguucagaacagcaaccaaauaaaacugaacuu

SEQ ID NO: 133264 - RNA, 64 nt, hsa
uuaaagggaaaaauaauucauucccagagaugagucagaacagucuccucaauccugaaauuca

SEQ ID NO: 133265 - RNA, 64 nt, hsa
uuauuagaggacaagaucaggacugcuuucagcuucagaacacuuuugguucagaacagcgauu

SEQ ID NO: 133266 - RNA, 64 nt, hsa
uguuuuuaaauuguagcuucagaacacuuuugguucagaacagcgauugaccaguaacugugag

SEQ ID NO: 133267 - RNA, 64 nt, hsa
ucauauauuaccguuaugucuuuggaaaucggguucagaacacuuuuuaugacaaaaauugggu

SEQ ID NO: 133268 - RNA, 64 nt, hsa
ucuuguguuugagaaccaugacuuaugacuuuccucagaacaugagacuguaaaacaaaaacaa

SEQ ID NO: 133269 - RNA, 64 nt, hsa
gcagauagcacauacccccacccaguaccaaauuucagaacacaagaagguccaguucuucccc

SEQ ID NO: 133270 - RNA, 64 nt, hsa
aggucaacucugaagaguauuugaaagcaggacuucagaacaguguuugauuuuuauuuuauaa

SEQ ID NO: 133271 - RNA, 64 nt, hsa
ccgagagggccggcgccuaccugagggccccugugucccgaacccggagcggaggcgcccaacc

SEQ ID NO: 133272 - RNA, 64 nt, hsa
cccccaugggccgcccaguaccaugcacacuccugucccgaacucccugaggccuccccucccu

SEQ ID NO: 133273 - RNA, 64 nt, hsa
ccccacgcugcagugggcuugugugugaugugcagucccgaagccacacccucccuuuuccuca

SEQ ID NO: 133274 - RNA, 64 nt, hsa
cuucugccucauuucuuaaaauuagagaauuaaggucccgaagguggaacaugcuucaugguca

SEQ ID NO: 133275 - RNA, 64 nt, hsa
cagagaaggaggcugggggaucaccagccccaaggucccgaagggcaggucagagggagagagg

SEQ ID NO: 133276 - RNA, 64 nt, hsa
ggacgaguggucaccaaacaggguggcuccccaggucccgaagccugagacccggaaggcccug

SEQ ID NO: 133277 - RNA, 64 nt, hsa
ggaaucugagugguuuuauuuuuuagauuucucagucccgaagaucuaagauaaauaaacaaga

SEQ ID NO: 133278 - RNA, 64 nt, hsa
gaggcagccccccauaggcuuccgccaagcucuggucccgaagaggcugugcgagcccuucccg

SEQ ID NO: 133279 - RNA, 64 nt, hsa
uucuucagucagccuguggcacuguucaucugcugucccgaagaaaccgagaacacauuuggug

SEQ ID NO: 133280 - RNA, 64 nt, hsa
gucgccaccuuccaugugaagcagcaaggcccaggucccgaaagaugcagugacuuuuugucgu

SEQ ID NO: 133281 - RNA, 64 nt, hsa
gcccccaaaaucugucacuacaauuuaaacaccagucccgaaauuuggaucuucuuucuuuuug

SEQ ID NO: 133282 - RNA, 64 nt, hsa
gccacagauggucaucaggggaagccaccagggagucccgaagcccuucugagaucaggaaauc

SEQ ID NO: 133283 - RNA, 64 nt, hsa
uucgaugucugagaaagaggccccacgcuguagagucccgaaagcccaggagugaaggggguuc

SEQ ID NO: 133284 - RNA, 64 nt, hsa
gcagcccuggucucuggcgcaucucuucccucuugucccgaagaucugcgccucuagugccuuu

SEQ ID NO: 133285 - RNA, 64 nt, hsa
guagagacgggguuucaccauguugaccaggcuggucccgaacuccugaccucaggugauccgc

SEQ ID NO: 133286 - RNA, 64 nt, hsa
ccacugccugcauuccaguccccagagcuugguggucccgaaacgggaaguacauauuggggca

SEQ ID NO: 133287 - RNA, 64 nt, hsa
guugaaggugccaucgcagggucaggccugcccugucccgaagugaucuccuggaagacaagug

SEQ ID NO: 133288 - RNA, 64 nt, hsa
cccuggcaccagggucugccucucacucgcccaggucccgaaggacacugccacagggacgccu

SEQ ID NO: 133289 - RNA, 64 nt, hsa
ugaacuccugaccuccugauccacccaccucagcgucccgaagugcugggauuacaggugugag

SEQ ID NO: 133290 - RNA, 64 nt, hsa
guagagacaggguuucuccaugucggucaggguagucccgaacuccugaccucaagugaucugc

SEQ ID NO: 133291 - RNA, 58 nt, hsa
caggaaaggaagcucccugaauccuugcgucccgaaggacggagguucaagcagagug

SEQ ID NO: 133292 - RNA, 64 nt, hsa
ucuuuugauuuuagcuuuauaaaaucauccacuugucccgaaugacugcagcuuuuuuucaugc

SEQ ID NO: 133293 - RNA, 64 nt, hsa
aaggucaacaaaagacugguugugaguugcagcugucccgaaggccccaguugggaagccaugg

SEQ ID NO: 133294 - RNA, 64 nt, hsa
uuucuuucaugggcaccaaccugcauuuguaugugucccgaauccacagucguacugauucuaa

SEQ ID NO: 133295 - RNA, 64 nt, hsa
aaagccgaagccccuuuccuuaaggcccugguuugucccgaaggggccuaguguucccagcacu

SEQ ID NO: 133296 - RNA, 64 nt, hsa
ggacccuugccugccuccuaggcuggaagccauggucccgaaguguagggcaagggugccucag

SEQ ID NO: 133297 - RNA, 64 nt, hsa
aucacugccuauaccccucaucacacgucacaaugucccgaauucccagccucaccaccccuuc

SEQ ID NO: 133298 - RNA, 64 nt, hsa
ccugccccccacucugcacagccuagacauccaggucccgaaaggggcacugguggccguggug

SEQ ID NO: 133299 - RNA, 64 nt, hsa
agacccuuggagagaaaccguugcuagcuugcuggucccgaaagauugcaacuuuggcugcuac

SEQ ID NO: 133300 - RNA, 64 nt, hsa
ggggcgcacaagcucggccccgccccggcuuuuagucccgaacuccggaccccgccuucuuggg

SEQ ID NO: 133301 - RNA, 64 nt, hsa
ggcugcacaucugaggcuuuggggccccuuaguugucccgaaaccccaagaaaaaucagaauga

SEQ ID NO: 133302 - RNA, 64 nt, hsa
ucaccuagccauuucccaacccuaguccuccaccgucccgaagccaacuucacccaugucccca

SEQ ID NO: 133303 - RNA, 64 nt, hsa
auggacaaggccaucccggccgugggagaccccagucccgaagucuugccugcaggaguacugg

SEQ ID NO: 133304 - RNA, 64 nt, hsa
uacuucuguguugugauuccccggagcugggaaggucccgaauggaguccagaccugggcccug

SEQ ID NO: 133305 - RNA, 64 nt, hsa
gugagcccagaaaggaagacagcagccaccgucugucccgaagaggcaggccguccuguagguc

SEQ ID NO: 133306 - RNA, 64 nt, hsa
ggcuucaugaguguaaugaaaucucaccagaagugucccgaaaucggcucagauagggcucaaa

SEQ ID NO: 133307 - RNA, 64 nt, hsa; identical to SEQ ID NO: 60353

SEQ ID NO: 133308 - RNA, 64 nt, hsa; identical to SEQ ID NO: 60354

SEQ ID NO: 133309 - RNA, 64 nt, hsa; identical to SEQ ID NO: 60355

SEQ ID NO: 133310 - RNA, 64 nt, hsa; identical to SEQ ID NO: 60356

SEQ ID NO: 133311 - RNA, 64 nt, hsa; identical to SEQ ID NO: 60357

SEQ ID NO: 133312 - RNA, 64 nt, hsa; identical to SEQ ID NO: 60358

SEQ ID NO: 133313 - RNA, 64 nt, hsa; identical to SEQ ID NO: 60359

SEQ ID NO: 133314 - RNA, 64 nt, hsa; identical to SEQ ID NO: 60360

SEQ ID NO: 133315 - RNA, 64 nt, hsa; identical to SEQ ID NO: 60361

SEQ ID NO: 133316 - RNA, 64 nt, hsa; identical to SEQ ID NO: 60362

SEQ ID NO: 133317 - RNA, 64 nt, hsa; identical to SEQ ID NO: 60363

SEQ ID NO: 133318 - RNA, 64 nt, hsa; identical to SEQ ID NO: 60364

SEQ ID NO: 133319 - RNA, 64 nt, hsa; identical to SEQ ID NO: 60365

SEQ ID NO: 133320 - RNA, 64 nt, hsa; identical to SEQ ID NO: 60366

SEQ ID NO: 133321 - RNA, 64 nt, hsa; identical to SEQ ID NO: 60367

SEQ ID NO: 133322 - RNA, 64 nt, hsa; identical to SEQ ID NO: 60368

SEQ ID NO: 133323 - RNA, 64 nt, hsa; identical to SEQ ID NO: 60369

SEQ ID NO: 133324 - RNA, 64 nt, hsa; identical to SEQ ID NO: 60370

SEQ ID NO: 133325 - RNA, 64 nt, hsa; identical to SEQ ID NO: 60371

SEQ ID NO: 133326 - RNA, 64 nt, hsa; identical to SEQ ID NO: 60372

SEQ ID NO: 133327 - RNA, 64 nt, hsa; identical to SEQ ID NO: 60373

SEQ ID NO: 133328 - RNA, 64 nt, hsa; identical to SEQ ID NO: 60374

SEQ ID NO: 133329 - RNA, 64 nt, hsa; identical to SEQ ID NO: 49066

SEQ ID NO: 133330 - RNA, 64 nt, hsa; identical to SEQ ID NO: 49067

SEQ ID NO: 133331 - RNA, 64 nt, hsa; identical to SEQ ID NO: 49068

SEQ ID NO: 133332 - RNA, 64 nt, hsa; identical to SEQ ID NO: 49069

SEQ ID NO: 133333 - RNA, 64 nt, hsa; identical to SEQ ID NO: 49070

SEQ ID NO: 133334 - RNA, 64 nt, hsa; identical to SEQ ID NO: 49071

SEQ ID NO: 133335 - RNA, 64 nt, hsa; identical to SEQ ID NO: 49072

SEQ ID NO: 133336 - RNA, 64 nt, hsa; identical to SEQ ID NO: 49073

SEQ ID NO: 133337 - RNA, 64 nt, hsa; identical to SEQ ID NO: 49074

SEQ ID NO: 133338 - RNA, 64 nt, hsa; identical to SEQ ID NO: 49075

SEQ ID NO: 133339 - RNA, 64 nt, hsa; identical to SEQ ID NO: 49076

SEQ ID NO: 133340 - RNA, 64 nt, hsa; identical to SEQ ID NO: 49077

SEQ ID NO: 133341 - RNA, 64 nt, hsa; identical to SEQ ID NO: 49078

SEQ ID NO: 133342 - RNA, 64 nt, hsa; identical to SEQ ID NO: 49079

SEQ ID NO: 133343 - RNA, 64 nt, hsa; identical to SEQ ID NO: 49080

SEQ ID NO: 133344 - RNA, 64 nt, hsa; identical to SEQ ID NO: 49081

SEQ ID NO: 133345 - RNA, 64 nt, hsa; identical to SEQ ID NO: 49082

SEQ ID NO: 133346 - RNA, 64 nt, hsa; identical to SEQ ID NO: 49083

SEQ ID NO: 133347 - RNA, 64 nt, hsa; identical to SEQ ID NO: 49084

SEQ ID NO: 133348 - RNA, 64 nt, hsa; identical to SEQ ID NO: 49085

SEQ ID NO: 133349 - RNA, 64 nt, hsa; identical to SEQ ID NO: 49086

SEQ ID NO: 133350 - RNA, 64 nt, hsa; identical to SEQ ID NO: 49087

SEQ ID NO: 133351 - RNA, 64 nt, hsa; identical to SEQ ID NO: 49088

SEQ ID NO: 133352 - RNA, 64 nt, hsa; identical to SEQ ID NO: 49089

SEQ ID NO: 133353 - RNA, 64 nt, hsa; identical to SEQ ID NO: 49090

SEQ ID NO: 133354 - RNA, 64 nt, hsa; identical to SEQ ID NO: 49091

SEQ ID NO: 133355 - RNA, 64 nt, hsa; identical to SEQ ID NO: 49092

SEQ ID NO: 133356 - RNA, 64 nt, hsa; identical to SEQ ID NO: 49093

SEQ ID NO: 133357 - RNA, 64 nt, hsa; identical to SEQ ID NO: 49094

SEQ ID NO: 133358 - RNA, 64 nt, hsa; identical to SEQ ID NO: 49095

SEQ ID NO: 133359 - RNA, 64 nt, hsa; identical to SEQ ID NO: 49096

SEQ ID NO: 133360 - RNA, 64 nt, hsa; identical to SEQ ID NO: 49097

SEQ ID NO: 133361 - RNA, 64 nt, hsa; identical to SEQ ID NO: 49098

SEQ ID NO: 133362 - RNA, 64 nt, hsa; identical to SEQ ID NO: 49099

SEQ ID NO: 133363 - RNA, 64 nt, hsa; identical to SEQ ID NO: 49100

SEQ ID NO: 133364 - RNA, 64 nt, hsa; identical to SEQ ID NO: 49101

SEQ ID NO: 133365 - RNA, 64 nt, hsa; identical to SEQ ID NO: 49102

SEQ ID NO: 133366 - RNA, 64 nt, hsa; identical to SEQ ID NO: 49103

SEQ ID NO: 133367 - RNA, 64 nt, hsa; identical to SEQ ID NO: 49104

SEQ ID NO: 133368 - RNA, 64 nt, hsa; identical to SEQ ID NO: 49105

SEQ ID NO: 133369 - RNA, 64 nt, hsa; identical to SEQ ID NO: 49106

SEQ ID NO: 133370 - RNA, 64 nt, hsa; identical to SEQ ID NO: 49107

SEQ ID NO: 133371 - RNA, 64 nt, hsa; identical to SEQ ID NO: 49108

SEQ ID NO: 133372 - RNA, 64 nt, hsa; identical to SEQ ID NO: 49109

SEQ ID NO: 133373 - RNA, 64 nt, hsa; identical to SEQ ID NO: 49110

SEQ ID NO: 133374 - RNA, 64 nt, hsa; identical to SEQ ID NO: 49111

SEQ ID NO: 133375 - RNA, 64 nt, hsa; identical to SEQ ID NO: 49112

SEQ ID NO: 133376 - RNA, 64 nt, hsa; identical to SEQ ID NO: 49113

SEQ ID NO: 133377 - RNA, 64 nt, hsa; identical to SEQ ID NO: 49114

SEQ ID NO: 133378 - RNA, 64 nt, hsa; identical to SEQ ID NO: 49115

SEQ ID NO: 133379 - RNA, 64 nt, hsa; identical to SEQ ID NO: 49116

SEQ ID NO: 133380 - RNA, 64 nt, hsa; identical to SEQ ID NO: 49117

SEQ ID NO: 133381 - RNA, 64 nt, hsa; identical to SEQ ID NO: 49118

SEQ ID NO: 133382 - RNA, 64 nt, hsa; identical to SEQ ID NO: 49119

SEQ ID NO: 133383 - RNA, 64 nt, hsa; identical to SEQ ID NO: 49120

SEQ ID NO: 133384 - RNA, 64 nt, hsa; identical to SEQ ID NO: 49121

SEQ ID NO: 133385 - RNA, 64 nt, hsa; identical to SEQ ID NO: 49122

SEQ ID NO: 133386 - RNA, 64 nt, hsa; identical to SEQ ID NO: 49123

SEQ ID NO: 133387 - RNA, 64 nt, hsa; identical to SEQ ID NO: 49124

SEQ ID NO: 133388 - RNA, 64 nt, hsa; identical to SEQ ID NO: 49125

SEQ ID NO: 133389 - RNA, 64 nt, hsa; identical to SEQ ID NO: 49126

SEQ ID NO: 133390 - RNA, 64 nt, hsa; identical to SEQ ID NO: 49127

SEQ ID NO: 133391 - RNA, 64 nt, hsa; identical to SEQ ID NO: 49128

SEQ ID NO: 133392 - RNA, 64 nt, hsa; identical to SEQ ID NO: 49129

SEQ ID NO: 133393 - RNA, 64 nt, hsa; identical to SEQ ID NO: 49130

SEQ ID NO: 133394 - RNA, 64 nt, hsa; identical to SEQ ID NO: 49131

SEQ ID NO: 133395 - RNA, 64 nt, hsa; identical to SEQ ID NO: 49132

SEQ ID NO: 133396 - RNA, 64 nt, hsa; identical to SEQ ID NO: 49133

SEQ ID NO: 133397 - RNA, 64 nt, hsa; identical to SEQ ID NO: 49134

SEQ ID NO: 133398 - RNA, 64 nt, hsa; identical to SEQ ID NO: 49135

SEQ ID NO: 133399 - RNA, 64 nt, hsa; identical to SEQ ID NO: 49136

SEQ ID NO: 133400 - RNA, 64 nt, hsa; identical to SEQ ID NO: 49137

SEQ ID NO: 133401 - RNA, 64 nt, hsa; identical to SEQ ID NO: 49138

SEQ ID NO: 133402 - RNA, 64 nt, hsa
aauuuuucucucuuagaucuuccagcagccccagggguaggaagcuccucuuaguacuaagaga

SEQ ID NO: 133403 - RNA, 64 nt, hsa
uacuacccccuucuacacucagcucccagacacaggguaggaggggggacugcuggcuacugca

SEQ ID NO: 133404 - RNA, 64 nt, hsa
uuuuacaugucuguguauucaugacuuugggaguggguaggaucauuggagagagaauugcaca

SEQ ID NO: 133405 - RNA, 64 nt, hsa
ccccuaugucagaggaggucuuacggacaccauaggguaggaauagccuuuccucagucugaga

SEQ ID NO: 133406 - RNA, 64 nt, hsa; identical to SEQ ID NO: 105086

SEQ ID NO: 133407 - RNA, 64 nt, hsa; identical to SEQ ID NO: 105087

SEQ ID NO: 133408 - RNA, 64 nt, hsa; identical to SEQ ID NO: 105088

SEQ ID NO: 133409 - RNA, 64 nt, hsa; identical to SEQ ID NO: 105089

SEQ ID NO: 133410 - RNA, 64 nt, hsa
augcacaaacuuggcuucuuuaaccaagaauauuauuggaaaauucucuaaaaguuaauagggu

SEQ ID NO: 133411 - RNA, 64 nt, hsa
ugggccaaagaaacauugccuugaggaagauaugauuggaaaaucaagaguguagaagaauaaa

SEQ ID NO: 133412 - RNA, 64 nt, hsa
uuauuguauuuguuucuggucuuuguuaaguucuauuggaaaaaccacugucuguguuuuuuug

SEQ ID NO: 133413 - RNA, 64 nt, hsa
cauugccaaaaacuaaauggugcuuuauauuuagauuggaaagaauuucauaugcaaagcauau

SEQ ID NO: 133414 - RNA, 64 nt, hsa
cuaaaugucugucucuaaaggguuaaauguaucaauuggaaaggaagaaaaaaggccuugaauu

SEQ ID NO: 133415 - RNA, 64 nt, hsa
uaaauauauuuugcaaauuguuguucaaaagauaauuggaaaaaauugaauauauuguaggauu

SEQ ID NO: 133416 - RNA, 59 nt, hsa
cacuaauuaaagaagauugaauaaacuuuauuggaaaaugcuaaaauuuuaauauaguu

SEQ ID NO: 133417 - RNA, 64 nt, hsa
aucugugagauuugacacuaaguuuuuguuagagauuggaaauuauacuaguccuuuuaagggg

SEQ ID NO: 133418 - RNA, 64 nt, hsa
uucaaauaaacauauauucuugcuugcauccuagauuggaaauuaaaauuuuucaaagaacaaa

SEQ ID NO: 133419 - RNA, 64 nt, hsa
auauuaacaggguagcuccugagccuuucccuuuauuggaaacuuuaacugcaguguuaauaua

SEQ ID NO: 133420 - RNA, 64 nt, hsa
uuaucuuuuuuuggagggguggaugcugcauuucauuggaaaugucauuuuuccaaaguuucua

SEQ ID NO: 133421 - RNA, 64 nt, hsa
uuuuaaaaagaaauuauucucauugcuguauuauauuggaaaaguuuuaaacaaccaagcuaaa

SEQ ID NO: 133422 - RNA, 64 nt, hsa
ucaaaccauuaaggguuaaaaauacaucuuaaacauuggaaagcucuucuagcugaaucugaaa

SEQ ID NO: 133423 - RNA, 64 nt, hsa
acucauuucaauguuuuccugagguggagccuucauuggaaaggggaaagagggauucuagggu

SEQ ID NO: 133424 - RNA, 64 nt, hsa
uuuuggucugacauuuuuguagccuucuguuauuauuggaaauagucucuuacauaagcugauu

SEQ ID NO: 133425 - RNA, 64 nt, hsa
uucuuucaagaaucuuuagagauaaggauugcacauuggaaaaguaaaccauguuucauuccuu

SEQ ID NO: 133426 - RNA, 64 nt, hsa
cuuagccaguuuguuuuucagagccuguagucuuauuggaaaucuauuuuaucagugugcuuua

SEQ ID NO: 133427 - RNA, 64 nt, hsa
uucccagaacuuauuagaaacgauuccggauggcauuggaaaacuaaagaaacugucaaucuug

SEQ ID NO: 133428 - RNA, 64 nt, hsa
gaaauuguuauuuuaacagacccugccuaaaagcauuggaaaacuaaagaaguugagcaacuug

SEQ ID NO: 133429 - RNA, 64 nt, hsa
uuuucucuguccugaacccccagguaugggugaaauuggaaauuacuaaucuauuggaaaucag

SEQ ID NO: 133430 - RNA, 64 nt, hsa
cccagguaugggugaaauuggaaauuacuaaucuauuggaaaucaguuccugacauaguaaagu

SEQ ID NO: 133431 - RNA, 64 nt, hsa
cugugacaucuguugaacauaugugguuguauauauuggaaauguacauauccaauaugaaaua

SEQ ID NO: 133432 - RNA, 64 nt, hsa
cugcaccuguauucauuguggaacuuccucuuucauuggaaacuuucuuacucaagaaugacgg

SEQ ID NO: 133433 - RNA, 64 nt, hsa
gccagaaaucuuugccaagguccugguuaaaaaaauuggaaacgguuuucuuagccccagcuuu

SEQ ID NO: 133434 - RNA, 64 nt, hsa
gauggcccugcuccuuuucugcugaacauuuaguauuggaaacuccuacuucccuuuucauuaa

SEQ ID NO: 133435 - RNA, 64 nt, hsa
gauggcucacugauuuuugaaaagccugaauaaaauuggaaagacuggaaaguuaggagaacug

SEQ ID NO: 133436 - RNA, 64 nt, hsa
auagaaucaagagcaaaacugcacaaacuugcacauuggaaagugcaacaaguucccgugauug

SEQ ID NO: 133437 - RNA, 64 nt, hsa
caaguucuugacauuggucuguuuugcugugaauauuggaaaugcuuaggaucuucagacccaa

SEQ ID NO: 133438 - RNA, 64 nt, hsa
acuacuucuauaaugcuuauuaugguaaaauaaaauuggaaaaaauuaaaacugaccuauaaga

SEQ ID NO: 133439 - RNA, 64 nt, hsa
aggguacaugcuuuaaaaccgacccgcaacaaguauuggaaaaauguauccagucugaagaugu

SEQ ID NO: 133440 - RNA, 64 nt, hsa
aacaagauaccaggcacuuaaagccuuuuccugaauuggaaaggaaaagaggcccaagugcaaa

SEQ ID NO: 133441 - RNA, 64 nt, hsa
uguauaaaaugaguauucccauuaauagucacugauuggaaauuauucuguugcuguuugucaa

SEQ ID NO: 133442 - RNA, 64 nt, hsa
gcuuuguuuuuguuuuucuuuuguaccuagucucauuggaaaugacuaguauucugccucauuu

SEQ ID NO: 133443 - RNA, 64 nt, hsa
cugcuccuuuacgauauuccaaauaguuuuuuacauuggaaaaacuaauucuugggauucuuuc

SEQ ID NO: 133444 - RNA, 64 nt, hsa
acuauauauauauauacacacauaguuuuagcaaauuggaaauaauauauucauuuguauggca

SEQ ID NO: 133445 - RNA, 64 nt, hsa
caguugucuugaggguaugauaaguccacaaaaaauuggaaagcaucuuacccauuuucuucac

SEQ ID NO: 133446 - RNA, 64 nt, hsa
ucugaaaacacuugcugagaaccaaauuuauuccauuggaaaaacccucuguggagcuauaagc

SEQ ID NO: 133447 - RNA, 64 nt, hsa
auuuuauuuuaccugagaaaauuaaacaaaucacauuggaaauaaacucuauggcuugggcacg

SEQ ID NO: 133448 - RNA, 64 nt, hsa
ucucucagcuccuugcacagacacaaaaggacucauuggaaagauacucuauaaauguguggaa

SEQ ID NO: 133449 - RNA, 64 nt, hsa
uuagguauuaaacacuucagaauaucaauguaaaauuggaaaauaaggaacugggggcauuugu

SEQ ID NO: 133450 - RNA, 64 nt, hsa
agccggcuucccugagggaggagaacacuggauuauuggaaauguuuuaaucacucuugccauu

SEQ ID NO: 133451 - RNA, 64 nt, hsa
gcuguucaucccagcacugucuaagcuaguaaaaauuggaaacaauuuaaguaucuagcacauu

SEQ ID NO: 133452 - RNA, 64 nt, hsa
aaaagaaaaguguugggaaugaagcaagugauugauuggaaaacauacugaauggaagaaauau

SEQ ID NO: 133453 - RNA, 64 nt, hsa
aacuuugaaauauauggucuaauguuuaagcagaauuggaaaagacuaagaucgguuaacaaau

SEQ ID NO: 133454 - RNA, 64 nt, hsa
agaaaguguucuguuacaaaauguaacuguuaccauuggaaauuucacgucauaggaaguuagc

SEQ ID NO: 133455 - RNA, 64 nt, hsa
gaaaauacuaguaguuuuauauuuggaugacauaauuggaaaagcagauuagcugcuacuacuu

SEQ ID NO: 133456 - RNA, 64 nt, hsa
cauuacaucacuaaauucauuagauuuugucugcauuggaaagauacucuucuagcauaucuuu

SEQ ID NO: 133457 - RNA, 64 nt, hsa
uagccaguugaggaaguagaaggaauuuccagauauuggaaacaguaugcaugaagacaugaag

SEQ ID NO: 133458 - RNA, 64 nt, hsa
uuguuuuaaugcuuguacguacauaugugaacucauuggaaauauuguguguuuaaugcaaaug

SEQ ID NO: 133459 - RNA, 64 nt, hsa
cacauuauucuuuaauaaucuguuuauuaauaagccaugauauguguauguaaauauucuuaca

SEQ ID NO: 133460 - RNA, 64 nt, hsa
aaaauguauagccugccaaauguuguuuucauaaccaugauauuguuuugaaaaaauuuuaucu

SEQ ID NO: 133461 - RNA, 64 nt, hsa
ucuuuaaugucuaagaaauccagcuucauaauuuccaugauacaaagaucuuuuuucaggugga

SEQ ID NO: 133462 - RNA, 64 nt, hsa
uucacaauauccaaugaagaaggucucauuaucuccaugauaaagauggggaaacuaaggucag

SEQ ID NO: 133463 - RNA, 64 nt, hsa
aaggaaccaacuguaggcaccucuccagggccuagggagacaaguguccucucuucugcauaca

SEQ ID NO: 133464 - RNA, 64 nt, hsa
gucucagaaugggacugccaacuggcucauuggugggagacacaguauccucaaaccuguggcc

SEQ ID NO: 133465 - RNA, 64 nt, hsa
agagagguauccucagccccuccugccccaggucgggagacagcagcuuuggagacacaaaaga

SEQ ID NO: 133466 - RNA, 64 nt, hsa
gaugagacgccaugcagaucccggcugcgagagagggagacacccggaggagcaggugggaaga

SEQ ID NO: 133467 - RNA, 64 nt, hsa
aauauauaauugaaucagaguaaucauaaugcaggggagacauucaaauuagagacaagggaga

SEQ ID NO: 133468 - RNA, 64 nt, hsa
uguuccauuuugcaacauccugcaacaccauccugggagacaagagcauuacccagcuuggcuu

SEQ ID NO: 133469 - RNA, 64 nt, hsa
gccucccauucugcaccacaccuggcauggugcagggagacaucugcaccccugaguugggcag

SEQ ID NO: 133470 - RNA, 64 nt, hsa
cuccucaggcccagcugcuccccuggaggacagagggagacagggcugcuccccaacaccugcc

SEQ ID NO: 133471 - RNA, 64 nt, hsa
uaguuauaagugaagcaugguugaauaccagcuggggagacacuagggaagggagcuuuguaag

SEQ ID NO: 133472 - RNA, 64 nt, hsa
aacggaugcaagucacagucuuaacacagccugugggagacaagcaguuugugugcucacagua

SEQ ID NO: 133473 - RNA, 64 nt, hsa
ccaccugcagagguccccagacccaaagcaggacgggagacaacugcuuggaggagcgaagagc

SEQ ID NO: 133474 - RNA, 64 nt, hsa
agcugauucacaggaggaggggagguuggggggcgggagacaaaaaccacaccucuuuuuauau

SEQ ID NO: 133475 - RNA, 64 nt, hsa
uugaggggacggcaggcccggcugcccuggaacugggagacagggagaauccccugccgggguc

SEQ ID NO: 133476 - RNA, 64 nt, hsa
ugagggggcugaggcaugagaaucacuugaaccugggagacagagguugcaaugaaccgagaua

SEQ ID NO: 133477 - RNA, 64 nt, hsa
accuuucccaugccuccucuggagccuucgccuggggagacagaacccagagagaaacaagaga

SEQ ID NO: 133478 - RNA, 64 nt, hsa
gaugagcccagauuucuucccccuccaucucucagggagacaaagaaccuccuuccuggaccaa

SEQ ID NO: 133479 - RNA, 64 nt, hsa
acucaauggacauccguugcagugacaucauccagggagacacacaagguaugccugauggcug

SEQ ID NO: 133480 - RNA, 64 nt, hsa
acuucucaccaaucagacuuuauggagaacagaagggagacaagaaaucucauccacagcuacc

SEQ ID NO: 133481 - RNA, 64 nt, hsa
gagacgcagaagagaggaacagaaauccagaguggggagacagagaccaagagcaggggauaga

SEQ ID NO: 133482 - RNA, 64 nt, hsa
gacccaaagggagagaaacagagacucagggagagggagacaaugaccuggagggugggguaug

SEQ ID NO: 133483 - RNA, 64 nt, hsa
uuuuuuaaagcaaauccuguauauguaucuacaugggagacagguagacacuacuuauuuguua

SEQ ID NO: 133484 - RNA, 64 nt, hsa
caauauuggaggcugacuguagggcugggcagcugggagacaggcucauggcucauggcucaug

SEQ ID NO: 133485 - RNA, 64 nt, hsa
gaaaaauuacuuuuuguuuguuuauaaacucagacuugccuauuuuauuuuaaaagcggcuuac

SEQ ID NO: 133486 - RNA, 64 nt, hsa
auaauaccaagagcuuguauuguuaccuuagucacuugccuagcaguguguggcuuuaaaaacu

SEQ ID NO: 133487 - RNA, 64 nt, hsa
uaauagauggggucaaauucugugugaaugugaacuugccuaguaagcacuuugucucuguuca

SEQ ID NO: 133488 - RNA, 64 nt, hsa
auuucuuuguuccuucuccauucccacugcuucacuugccuagucuugaagaaaaaaaacaaaa

SEQ ID NO: 133489 - RNA, 64 nt, hsa
augcccaggcagccacagaaacccacucuuccccgccucacagggcuccuccgguuggccugga

SEQ ID NO: 133490 - RNA, 64 nt, hsa
aucccucaccuaguccugcugcacagggcaggaggccucacagaagagauacuugcaguuccag

SEQ ID NO: 133491 - RNA, 64 nt, hsa
caauuaacugccuugaacauagagaaaaauuaaggccucacaggaugagucuccauucucugua

SEQ ID NO: 133492 - RNA, 64 nt, hsa
uguucccacaacaauggcccuuucacaagcucuugccucacaaccccugcagaaguccuucaac

SEQ ID NO: 133493 - RNA, 64 nt, hsa
aagcccggcucuccuacucugcuuccaggcuggggccucacagguggggcuguuaccuuccuca

SEQ ID NO: 133494 - RNA, 64 nt, hsa
ggacuggaugugccgugggcagugccuuccuccagccucacaaccuuucugcuggggcugaagu

SEQ ID NO: 133495 - RNA, 64 nt, hsa
gauucaucuucauaaucuccaguuuuuucacagugccucacagaguuaaucaugccuuuuggag

SEQ ID NO: 133496 - RNA, 64 nt, hsa
agagauuccucaguaaucuccaaucucucauagugccucacaggguuggucaauggcuuuugga

SEQ ID NO: 133497 - RNA, 64 nt, hsa
uuuccacacgugccuuugauuucggacagauugggccucacagccaccgauucagcugccaggg

SEQ ID NO: 133498 - RNA, 64 nt, hsa
uauuuuagggguuguuugggggccuggguggucggccucacaugggaaggggauggguagugga

SEQ ID NO: 133499 - RNA, 64 nt, hsa
cccggagggccugcucccggccccccugcacucugccucacaaaggucuauauuauauaaaucu

SEQ ID NO: 133500 - RNA, 64 nt, hsa
uugagcugcugcugucacuccuccaccgagggaggccucacaaaccacaggacgcugcaacggg

SEQ ID NO: 133501 - RNA, 64 nt, hsa
cgcugaguuggguuugugacucuucccucucccugccucacaggauugugacuccccagccccu

SEQ ID NO: 133502 - RNA, 64 nt, hsa
ggaucugagaugguuuuugcaucuuuccaggagagccucacauucuucuuccagguuguaucac

SEQ ID NO: 133503 - RNA, 64 nt, hsa
auguaaaucagaaaugcagacaccccagacgagagccucacaggagggagggggccccacaggc

SEQ ID NO: 133504 - RNA, 64 nt, hsa
accuguuugcauggagaaaugggcuggccccacagccucacaggagcaguuugugggcugguuu

SEQ ID NO: 133505 - RNA, 64 nt, hsa
uggcaaccugagccacacaggccuccaccccugcgccucacaggggucgcuggcguuggagcgg

SEQ ID NO: 133506 - RNA, 64 nt, hsa
gcuucuuaacagauggcauuuucugugacucuaggccucacaaaagagccagaguucuggaccc

SEQ ID NO: 133507 - RNA, 64 nt, hsa
gguucccacuaggaugcagagaugaccucucgcugccucacaagcagugacaccucggguccuu

SEQ ID NO: 133508 - RNA, 64 nt, hsa
agggagaaaucgguaacaguugccgaaccaggccgccucacagccaggaaauuuggaaauccua

SEQ ID NO: 133509 - RNA, 64 nt, hsa
agggagaagacaaggccccagcccuccucugggagccucacaccugagaccagcaggacaaggc

SEQ ID NO: 133510 - RNA, 64 nt, hsa
ccaccaugcgggccucagguggcagagaggcccagccucacaggccuguggccccacacaccag

SEQ ID NO: 133511 - RNA, 62 nt, hsa
aaacuaugaagaaacagaagucccauuaccagaaagaccaaaauuaaacuccuggaucuuca

SEQ ID NO: 133512 - RNA, 62 nt, hsa
guguccuuguuuuuccuuguuuuucucuuuuuaaagaccaacuucccuuugauggcugugug

SEQ ID NO: 133513 - RNA, 62 nt, hsa
gaaguugucauucagggccccucauguagccaaaagaccaagaaaaaucuggcccacagaua

SEQ ID NO: 133514 - RNA, 62 nt, hsa
uuuuauucagguugaucuguugaauauuugcuaaagaccaguucuuuaagcuaagacaugua

SEQ ID NO: 133515 - RNA, 62 nt, hsa
aguaaaaccaugcuguagaauuuuugucuuaaaaagaccacauacccagcacccaugaaaua

SEQ ID NO: 133516 - RNA, 62 nt, hsa
gaaagaaccucuuuccugaauauugacauguaaaagaccaaaguaauuuuucugaacuucug

SEQ ID NO: 133517 - RNA, 62 nt, hsa
uauguaaccauuuuaaacgugguuucuauaggaaagaccaacauuuguuuagcuugcuuggc

SEQ ID NO: 133518 - RNA, 62 nt, hsa
auggaaaccccaguggaaucagauuuucccucaaagaccaugaugguaucggacuaguuuuc

SEQ ID NO: 133519 - RNA, 62 nt, hsa
ucaaagccaaggacgucgaugaguacaaacugaaagaccacuaucuggaguuugaggugugu

SEQ ID NO: 133520 - RNA, 62 nt, hsa
aguacugaggagaaagcuaacggaacacauccaaagaccaucagucguauuggaaguacuac

SEQ ID NO: 133521 - RNA, 62 nt, hsa
ccaugccuucaagucagcaucaggcuuagggcaaagaccaggccucugaagcugccucuugu

SEQ ID NO: 133522 - RNA, 62 nt, hsa
agcuucuugggacuucaaccaucuucuuucugaaagaccaaaucuaauguaaccaguaacgu

SEQ ID NO: 133523 - RNA, 62 nt, hsa
auuuuuuaucuagagaccagcauguucuccccaaagaccaagauauucugccaaaauaucag

SEQ ID NO: 133524 - RNA, 62 nt, hsa
auuuuuugucuagagaccagcauguucuccccaaagaccagaauauucuaccuaaauaucaa

SEQ ID NO: 133525 - RNA, 62 nt, hsa
uaccuaaauaucaaggccaggauuuucuaccuaaagaccaggacuuuuuaucuagagaccag

SEQ ID NO: 133526 - RNA, 62 nt, hsa
auuuucuacccagagaccaagguguucuucccaaagaccaaaauauucuacccauaugucag

SEQ ID NO: 133527 - RNA, 62 nt, hsa
auuuucuacccagagaccaagguuaucuuccuaaagaccaaaauauucuacccauaugucag

SEQ ID NO: 133528 - RNA, 62 nt, hsa
aaccauguauauucaccacuaggacagguuaaaaagaccauuguauguuuuucuauuucuga

SEQ ID NO: 133529 - RNA, 62 nt, hsa
auggcuauuagaaauccacauucuuacacaagaaagaccauauuagaaucuaaggaaaacau

SEQ ID NO: 133530 - RNA, 62 nt, hsa
acaaagucuccaagaaauaugggacuaugugaaaagaccaaaucuaccucugauugguguac

SEQ ID NO: 133531 - RNA, 62 nt, hsa
auaccagccgcugcaaaaucaugccaaaauguaaagaccaucgagacuaggaagaaacugca

SEQ ID NO: 133532 - RNA, 64 nt, hsa
ggucaaaugcuuuccaaaaaguaaucuaauaaauccauucuagaaaaauauaucuaaaguauug

SEQ ID NO: 133533 - RNA, 64 nt, hsa
acuacaccaaacaccuuuaguacaguccuugcauccauucuauuuuuaacuuccauaucugcca

SEQ ID NO: 133534 - RNA, 64 nt, hsa
auuuuaaugcauagcaguauguuugaaaaauagaccauucuaaaaagcccaugauaccuuacug

SEQ ID NO: 133535 - RNA, 64 nt, hsa
ggugccaugaaguuggggaguugggugaauuaucccauucuaguuacagaggagcuuuccuuaa

SEQ ID NO: 133536 - RNA, 64 nt, hsa
uacaugccuucacaucacaaccuguacugugaguccauucuagaggucacugaaaggcccugua

SEQ ID NO: 133537 - RNA, 64 nt, hsa
uuaaacuauucugucuagaugucccagauaguucccauucuacuuggagauuuggcuuuuccaa

SEQ ID NO: 133538 - RNA, 64 nt, hsa
uauuuuauaauugagaacucuuacauaguagaauccauucuauaauacauguguugacaaagcu

SEQ ID NO: 133539 - RNA, 64 nt, hsa
uugauagccugguuaaaaguuagauccucuauuaccauucuaagcacauucacuucuauauuga

SEQ ID NO: 133540 - RNA, 63 nt, hsa
uguccuugugcccacacugagccagcaaguccugcuguccacacccacaagcuaccuggaggg

SEQ ID NO: 133541 - RNA, 63 nt, hsa
cugccucucggccccuccgccuucuccccuccugcuguccaugcuuggcccccucguccccau

SEQ ID NO: 133542 - RNA, 63 nt, hsa
gacuuggggcugagagaguauaaauaacccugggcuguccagccuuaauagacuucucuuaca

SEQ ID NO: 133543 - RNA, 63 nt, hsa
uuuccgacacauuuaccaaauugcuugagccuggcuguccaaccagacuuugagccugcaucu

SEQ ID NO: 133544 - RNA, 63 nt, hsa
accuggaggcugagcaggccggaguggauggaugcuguccagacguagccaccuggccucugu

SEQ ID NO: 133545 - RNA, 63 nt, hsa
accagaacccuggggucagacccaucuccuguagcuguccaucacacugacaggcuucuuccu

SEQ ID NO: 133546 - RNA, 63 nt, hsa
uucugcuauggaaacaaugcugcuuuucucucagcuguccaaaguucagccguuccuccuucc

SEQ ID NO: 133547 - RNA, 63 nt, hsa
cuaggagaggaggauggggggcugagcacucaggcuguccauugaaaccccuuguccaugaau

SEQ ID NO: 133548 - RNA, 63 nt, hsa
auucccacaucuugccaagacagccuuuguccagcuguccacauugagucagacugcucccgg

SEQ ID NO: 133549 - RNA, 63 nt, hsa
gccaggagauggggugaagggacacagucuugagcuguccacaugcaugugacuccucaaacc

SEQ ID NO: 133550 - RNA, 64 nt, hsa
gcuagcgucccuacugccucccgacuccucaguggaggaggagcugcggucccucuggugucug

SEQ ID NO: 133551 - RNA, 64 nt, hsa
agcuaaucccauggcgagaugggggcucacuccggaggaggagccaggcagcagggccuuccug

SEQ ID NO: 133552 - RNA, 64 nt, hsa
gcuugagguuccaaccuggagccacagugugugagaggaggaggagagggagaauucuguucuc

SEQ ID NO: 133553 - RNA, 64 nt, hsa
ugagguuccaaccuggagccacagugugugagaggaggaggagagggagaauucuguucuccca

SEQ ID NO: 133554 - RNA, 64 nt, hsa
aacuuggauaggcaguagauauuuuugcccaccugaggaggaacucagucaagcuguugcuuaa

SEQ ID NO: 133555 - RNA, 64 nt, hsa
cauuuguucuuuccagagcuaacugauaagaguggaggaggaaugccuucuccuaagagucagu

SEQ ID NO: 133556 - RNA, 64 nt, hsa
cagauacauggggaacugcauaucggaggugguggaggaggaggaggaggaggaaggcaaagcc

SEQ ID NO: 133557 - RNA, 64 nt, hsa
auacauggggaacugcauaucggaggugguggaggaggaggaggaggaggaaggcaaagccccu

SEQ ID NO: 133558 - RNA, 64 nt, hsa
cauggggaacugcauaucggaggugguggaggaggaggaggaggaggaaggcaaagccccugga

SEQ ID NO: 133559 - RNA, 64 nt, hsa
ggggaacugcauaucggaggugguggaggaggaggaggaggaggaaggcaaagccccuggaaau

SEQ ID NO: 133560 - RNA, 64 nt, hsa
gaacugcauaucggaggugguggaggaggaggaggaggaggaaggcaaagccccuggaaaugug

SEQ ID NO: 133561 - RNA, 64 nt, hsa
ccacagcuucaugacccacccugaauucgccauagaggaggaguugccacgaacaccacuccug

SEQ ID NO: 133562 - RNA, 64 nt, hsa
ggaguugccacgaacaccacuccuggaugaggaagaggaggaaaauccugacaaggcuucuaag

SEQ ID NO: 133563 - RNA, 64 nt, hsa
ucuuuuaggacagauucucagaugggaugaucuggaggaggaggaaaaagauacacucccuugg

SEQ ID NO: 133564 - RNA, 64 nt, hsa
uuuaggacagauucucagaugggaugaucuggaggaggaggaaaaagauacacucccuuggggc

SEQ ID NO: 133565 - RNA, 64 nt, hsa
ugagcaggaggaggaagaggaggaggaggaggaggaggaggaaggcgaggacaguggcacuuca

SEQ ID NO: 133566 - RNA, 64 nt, hsa
ggaugagcaggaggaggaagaggaggaggaggaggaggaggaggaaggcgaggacaguggcacu

SEQ ID NO: 133567 - RNA, 64 nt, hsa
ggaggaugagcaggaggaggaagaggaggaggaggaggaggaggaggaaggcgaggacaguggc

SEQ ID NO: 133568 - RNA, 64 nt, hsa
ggaggaggaugagcaggaggaggaagaggaggaggaggaggaggaggaggaaggcgaggacagu

SEQ ID NO: 133569 - RNA, 64 nt, hsa
agaggaggaggaugagcaggaggaggaagaggaggaggaggaggaggaggaggaaggcgaggac

SEQ ID NO: 133570 - RNA, 64 nt, hsa
ggaagaggaggaggaugagcaggaggaggaagaggaggaggaggaggaggaggaggaaggcgag

SEQ ID NO: 133571 - RNA, 64 nt, hsa
ccuggaagaggaggaggaugagcaggaggaggaagaggaggaggaggaggaggaggaggaaggc

SEQ ID NO: 133572 - RNA, 64 nt, hsa
ccugcagagccuggaagaggaggaggaugagcaggaggaggaagaggaggaggaggaggaggag

SEQ ID NO: 133573 - RNA, 64 nt, hsa
aggcagucagcagccccugcagagccuggaagaggaggaggaugagcaggaggaggaagaggag

SEQ ID NO: 133574 - RNA, 64 nt, hsa
cccaggcagucagcagccccugcagagccuggaagaggaggaggaugagcaggaggaggaagag

SEQ ID NO: 133575 - RNA, 64 nt, hsa
ggccgggagacagaugaggcgagaggaggaggaggaggaggagaaggcucugggcuccucugca

SEQ ID NO: 133576 - RNA, 64 nt, hsa
ucaggccgggagacagaugaggcgagaggaggaggaggaggaggagaaggcucugggcuccucu

SEQ ID NO: 133577 - RNA, 64 nt, hsa
guaucaggccgggagacagaugaggcgagaggaggaggaggaggaggagaaggcucugggcucc

SEQ ID NO: 133578 - RNA, 64 nt, hsa
cugguaucaggccgggagacagaugaggcgagaggaggaggaggaggaggagaaggcucugggc

SEQ ID NO: 133579 - RNA, 64 nt, hsa
uaucugguaucaggccgggagacagaugaggcgagaggaggaggaggaggaggagaaggcucug

SEQ ID NO: 133580 - RNA, 64 nt, hsa
ucagacacugaccuucugcugggaaagcagcccugaggaggaagaggaggcgagggaaucagaa

SEQ ID NO: 133581 - RNA, 64 nt, hsa
gaaggaccuugcagaggacgaagaggaggaggaugaggaggacacagaagauggcgucagcuuc

SEQ ID NO: 133582 - RNA, 64 nt, hsa
aagauggaagaaggaccuugcagaggacgaagaggaggaggaugaggaggacacagaagauggc

SEQ ID NO: 133583 - RNA, 64 nt, hsa
gacaagauggaagaaggaccuugcagaggacgaagaggaggaggaugaggaggacacagaagau

SEQ ID NO: 133584 - RNA, 64 nt, hsa
ggaaaggaggaggggagugguggguuuauagggggaggaggaggcagguggucuaagugcugac

SEQ ID NO: 133585 - RNA, 64 nt, hsa
ucagcaacaaacaaacuuuguuugggaagcuauggaggaggacuuuuagauuuagugaagaugg

SEQ ID NO: 133586 - RNA, 64 nt, hsa
gaaaagcaagaagaaaagacagcagcaucaagaggaggaggacaucuuggauguaagggaugag

SEQ ID NO: 133587 - RNA, 64 nt, hsa
caggaaaagcaagaagaaaagacagcagcaucaagaggaggaggacaucuuggauguaagggau

SEQ ID NO: 133588 - RNA, 64 nt, hsa
augcagccgaagaaagaagaggcagcaacaggaggaggaggacuugaaccuagaagauagaggu

SEQ ID NO: 133589 - RNA, 64 nt, hsa
cccaugcagccgaagaaagaagaggcagcaacaggaggaggaggacuugaaccuagaagauaga

SEQ ID NO: 133590 - RNA, 64 nt, hsa
ccccaaaaaaaagaaaaagaaaaggaggcagaaagaggaggaagaagcuacagcaucugaaagg

SEQ ID NO: 133591 - RNA, 64 nt, hsa
ucaaagcaaacacgugggugcagaagacccaugggaggaggagguggggcccacucaacacacc

SEQ ID NO: 133592 - RNA, 64 nt, hsa
gcuucucagccaccccgugguguaacaaguggaggaggaggagggggugagaacaccuuuccuc

SEQ ID NO: 133593 - RNA, 64 nt, hsa
ggggcuucucagccaccccgugguguaacaaguggaggaggaggagggggugagaacaccuuuc

SEQ ID NO: 133594 - RNA, 64 nt, hsa
cugcuguugccaucagaggaggaugaccgugcuugaggaggaagaauggguucaagaucaucau

SEQ ID NO: 133595 - RNA, 64 nt, hsa
gguuccuuucccagagguucugcuguugccaucagaggaggaugaccgugcuugaggaggaaga

SEQ ID NO: 133596 - RNA, 64 nt, hsa
ggggcgcaggacucggucaagggaggggcaagaggaggaggagagccugccguuccaacuugcc

SEQ ID NO: 133597 - RNA, 64 nt, hsa
cugggggcgcaggacucggucaagggaggggcaagaggaggaggagagccugccguuccaacuu

SEQ ID NO: 133598 - RNA, 64 nt, hsa
ugggaagagguuucuguaaccccugcccuggugugaggaggaaauggcucuggccuggcugccu

SEQ ID NO: 133599 - RNA, 64 nt, hsa
caggcaagcuggaacuuggguggggaggggacaugaggaggauaaacagcugacuguggcuuca

SEQ ID NO: 133600 - RNA, 64 nt, hsa
ccugucccagcuccaggaaggggaguucuggguggaggaggaggaguuccucagggaguuugac

SEQ ID NO: 133601 - RNA, 64 nt, hsa
gucccagcuccaggaaggggaguucuggguggaggaggaggaguuccucagggaguuugacgag

SEQ ID NO: 133602 - RNA, 64 nt, hsa
cuggccucuggccugggaaaagggcaggagccuagaggaggaaaaaggcugguggacagaccca

SEQ ID NO: 133603 - RNA, 64 nt, hsa
gcaguugaccuuugccaaacacuuuacaguucuggaggaggagguaacauagaugccugggccu

SEQ ID NO: 133604 - RNA, 64 nt, hsa
auuucacuggcagccuccacuagaauuuggugaagaggaggaggaggagauugaugacaagcaa

SEQ ID NO: 133605 - RNA, 64 nt, hsa
ucacuggcagccuccacuagaauuuggugaagaggaggaggaggagauugaugacaagcaaguu

SEQ ID NO: 133606 - RNA, 64 nt, hsa
cuggcagccuccacuagaauuuggugaagaggaggaggaggagauugaugacaagcaaguuacu

SEQ ID NO: 133607 - RNA, 64 nt, hsa
ggagaaacccuugaaaagacaucaagcacagaaggaggaggaggagguuuaggucaagaagaag

SEQ ID NO: 133608 - RNA, 64 nt, hsa
gaaacccuugaaaagacaucaagcacagaaggaggaggaggagguuuaggucaagaagaagaug

SEQ ID NO: 133609 - RNA, 64 nt, hsa
gccagcacgccuguccucccccggggccaaggcagaggaggaggacgacauccugaccugcugc

SEQ ID NO: 133610 - RNA, 64 nt, hsa
agcacgccuguccucccccggggccaaggcagaggaggaggacgacauccugaccugcugcuga

SEQ ID NO: 133611 - RNA, 52 nt, hsa
gauucagcagaagauccugauggaggaggaggauaccaagagagaggugccc

SEQ ID NO: 133612 - RNA, 55 nt, hsa
gauucagcagaagauccugauggaggaggaggauaccaagagagaggugcccaag

SEQ ID NO: 133613 - RNA, 64 nt, hsa
cacaccucccucaccgcgcaggacccugagugaggaggaggagcuggaaaccugggguggguug

SEQ ID NO: 133614 - RNA, 64 nt, hsa
ccccacaccucccucaccgcgcaggacccugagugaggaggaggagcuggaaaccugggguggg

SEQ ID NO: 133615 - RNA, 64 nt, hsa
uggagaaguuccuuagcagggaggaggaagaggagaggaggaagcaaagaaucacaaggaaccu

SEQ ID NO: 133616 - RNA, 64 nt, hsa
aacauuuguaccccuggagaaguuccuuagcagggaggaggaagaggagaggaggaagcaaaga

SEQ ID NO: 133617 - RNA, 64 nt, hsa
ugacugagaacaggcuuggaaaagguuuucuggggaggaggaggcuggaggccaggacacuguu

SEQ ID NO: 133618 - RNA, 64 nt, hsa
gcgaguugccuuagagcgcaagggccaggcccuggaggaggaugaagacacagagacaagguga

SEQ ID NO: 133619 - RNA, 64 nt, hsa
cucacaguacagcaugugccuuaaugcuucauaugaggaggaugucccugggccagggucugug

SEQ ID NO: 133620 - RNA, 64 nt, hsa
acuacauaacuuccuacguauccugcagcgggaggaggaggagcaccuccgccagauccugcag

SEQ ID NO: 133621 - RNA, 64 nt, hsa
ugaacuacauaacuuccuacguauccugcagcgggaggaggaggagcaccuccgccagauccug

SEQ ID NO: 133622 - RNA, 64 nt, hsa
ggguccucugggaaguuacucuagaaaacgaagggaggaggagcacaagauccucagcaacgaa

SEQ ID NO: 133623 - RNA, 64 nt, hsa
ugcugggaggucagcuggucaaggcagaggaggagaggaggaaaggaugggggcugaagagcag

SEQ ID NO: 133624 - RNA, 64 nt, hsa
gugcugucugcugggaggucagcuggucaaggcagaggaggagaggaggaaaggaugggggcug

SEQ ID NO: 133625 - RNA, 64 nt, hsa
accaguuucucaggcuggggagcacagaggggaggaggaggacuaaaugaaaaguuguucccag

SEQ ID NO: 133626 - RNA, 64 nt, hsa
aucaccaguuucucaggcuggggagcacagaggggaggaggaggacuaaaugaaaaguuguucc

SEQ ID NO: 133627 - RNA, 64 nt, hsa
cugacuuaggagucagagcccggcaggggcugaggaggaggagcagggggugcugcguggaagg

SEQ ID NO: 133628 - RNA, 64 nt, hsa
ugccugacuuaggagucagagcccggcaggggcugaggaggaggagcagggggugcugcgugga

SEQ ID NO: 133629 - RNA, 64 nt, hsa
aaacuuaguuaaauaauuccauccacuuauggaggaggaggagaauguggaagagguaaaaagc

SEQ ID NO: 133630 - RNA, 64 nt, hsa
aucaaacuuaguuaaauaauuccauccacuuauggaggaggaggagaauguggaagagguaaaa

SEQ ID NO: 133631 - RNA, 64 nt, hsa
aguggcuugacuuugagcuaaggcugaaguacaggaggaggaggaggagagggccggauguggg

SEQ ID NO: 133632 - RNA, 64 nt, hsa
ggcuugacuuugagcuaaggcugaaguacaggaggaggaggaggagagggccggaugugggugu

SEQ ID NO: 133633 - RNA, 64 nt, hsa
uugacuuugagcuaaggcugaaguacaggaggaggaggaggagagggccggaugugggugugga

SEQ ID NO: 133634 - RNA, 64 nt, hsa
uuuccccacugcaggacccacuuugagaaggaccgaggaggaggauuuggguuguuuuguuagg

SEQ ID NO: 133635 - RNA, 64 nt, hsa
ccccacugcaggacccacuuugagaaggaccgaggaggaggauuuggguuguuuuguuaggggu

SEQ ID NO: 133636 - RNA, 64 nt, hsa
uacugugcugaaagucagcccacgucggagcggugaggaggagccacagcacauggggugccac

SEQ ID NO: 133637 - RNA, 64 nt, hsa
cuccagaguguucucagcuagauuugauuugguugaggaggaacuguggcccuccguaaguuau

SEQ ID NO: 133638 - RNA, 64 nt, hsa
cuggagcucaagcagugaggaggaggagaaggaggaggaggagagcgcgagugagcaggggcca

SEQ ID NO: 133639 - RNA, 63 nt, hsa
cccuggagcucaagcagugaggaggaggagaaggaggaggaggagagcgcgagugagcagggg

SEQ ID NO: 133640 - RNA, 51 nt, hsa
cccuggagcucaagcagugaggaggaggagaaggaggaggaggagagcgcg

SEQ ID NO: 133641 - RNA, 64 nt, hsa
cacucuccaauugacccgccugggaacaagggaugaggaggaguugggggcuggggggaauccu

SEQ ID NO: 133642 - RNA, 64 nt, hsa
aaguaagcugcuuagaaggcccuggaagggaagugaggaggagggacaaggaagaugacuaguu

SEQ ID NO: 133643 - RNA, 64 nt, hsa
cuggggacagaagggcccauguacuuguugggaggaggaggaaagggaaggcuggcagguaggu

SEQ ID NO: 133644 - RNA, 64 nt, hsa
ccacuggggacagaagggcccauguacuuguugggaggaggaggaaagggaaggcuggcaggua

SEQ ID NO: 133645 - RNA, 64 nt, hsa
ccggggacccacucugcccagccggagggacgcggaggaggaagaggguagacaggggcgaccu

SEQ ID NO: 133646 - RNA, 64 nt, hsa
ccucccucuuuuccccuugcccccucugcagccggaggaggagauguugaggggaggaggccag

SEQ ID NO: 133647 - RNA, 64 nt, hsa
ggaagcgcagcagcgggagcuaggggcgggggcggaggaggacacgaacuggaaggggguucac

SEQ ID NO: 133648 - RNA, 64 nt, hsa
ucgggccuuuggcgagagcuccacggaaagugaugaggaggaagaagagggcuguggucauaca

SEQ ID NO: 133649 - RNA, 64 nt, hsa
uucccucucuucugccugauagagggaagaggaagaggaggacgaacagagauccugaaauucu

SEQ ID NO: 133650 - RNA, 64 nt, hsa
agacucugucucaauuaauuuuuuuuuuuuaaaggaggaggaucuccauggguaagugguuucu

SEQ ID NO: 133651 - RNA, 64 nt, hsa
gggggcagagaagugaugaagggaaauguucuuagaggaggaaauauccuuuguccuguucaga

SEQ ID NO: 133652 - RNA, 64 nt, hsa
ucaugcuggagggaggcugggcggguacagcgcggaggaggagggaggccaggcgggcauggcg

SEQ ID NO: 133653 - RNA, 64 nt, hsa
cggaggaggagggaggccaggcgggcauggcguggaggaggagggaggccgggcggucacagca

SEQ ID NO: 133654 - RNA, 64 nt, hsa
uggaggaggagggaggccgggcggucacagcauggaggaggagggaggcgcugcugguguucuu

SEQ ID NO: 133655 - RNA, 64 nt, hsa
cggucccacagcucuccucccagggcagccugaggaggaggaggccgggugccuguuugguggc

SEQ ID NO: 133656 - RNA, 64 nt, hsa
aggcggucccacagcucuccucccagggcagccugaggaggaggaggccgggugccuguuuggu

SEQ ID NO: 133657 - RNA, 64 nt, hsa
cccagccacguuuacaggaaggugugccccagaggaggaggaaucagcucccucgcuccagugg

SEQ ID NO: 133658 - RNA, 64 nt, hsa
ggccccagccacguuuacaggaaggugugccccagaggaggaggaaucagcucccucgcuccag

SEQ ID NO: 133659 - RNA, 64 nt, hsa
ugucuccaccccaugggcccacacccaggugggggaggaggaagccacugcaucuguuggcuca

SEQ ID NO: 133660 - RNA, 64 nt, hsa
gggcaucugucugugggagcccagaggcugcagggaggaggaggagggagguaucuggugugag

SEQ ID NO: 133661 - RNA, 64 nt, hsa
caucugucugugggagcccagaggcugcagggaggaggaggagggagguaucuggugugagcgu

SEQ ID NO: 133662 - RNA, 64 nt, hsa
gagggcccaggcaggcggccuauccugauccuuggaggaggaggaagaggaggccacuguggcc

SEQ ID NO: 133663 - RNA, 64 nt, hsa
ggcccaggcaggcggccuauccugauccuuggaggaggaggaagaggaggccacuguggcccgu

SEQ ID NO: 133664 - RNA, 64 nt, hsa
gauucuguagugaagaggucugacaccauguguggaggaggaggaacgaucagucaagagaugu

SEQ ID NO: 133665 - RNA, 64 nt, hsa
ucuguagugaagaggucugacaccauguguggaggaggaggaacgaucagucaagagauguccu

SEQ ID NO: 133666 - RNA, 64 nt, hsa
gccuggggaggagggggaggaagacaagaaggaagaggaggaggagaaggaagacgaggagcug

SEQ ID NO: 133667 - RNA, 64 nt, hsa
uggggaggagggggaggaagacaagaaggaagaggaggaggagaaggaagacgaggagcuggac

SEQ ID NO: 133668 - RNA, 64 nt, hsa
aaggcucaucuugagaagcaggcggguugggugggaggaggaagaaagggaagaauuagguuug

SEQ ID NO: 133669 - RNA, 64 nt, hsa
uuuguugccacugagaagcaggcggguugggugggaggaggaagaaagggaagaauuagguuug

SEQ ID NO: 133670 - RNA, 64 nt, hsa
ucaacuaaauuuuaaugaacgaaugaaugacagagaggaggaaaaaagaugaggauugcauaca

SEQ ID NO: 133671 - RNA, 64 nt, hsa
guauuuaaguggauugaauaacugagucuacauggaggaggaaaugcuagagaacagcaggucu

SEQ ID NO: 133672 - RNA, 64 nt, hsa
cagggcacauuucugaccgaacccucucaaggcagaggaggaguuugguggguuucauacaccc

SEQ ID NO: 133673 - RNA, 64 nt, hsa
ggcaguuaacuggcuuuacaguaaacauugaagagaggaggauuuguuuauugucacugggaau

SEQ ID NO: 133674 - RNA, 64 nt, hsa
gauuguaccuucccaagcccgcccagugggaugggaggaggaggagaaggggggccuugggccg

SEQ ID NO: 133675 - RNA, 64 nt, hsa
uguaccuucccaagcccgcccagugggaugggaggaggaggagaaggggggccuugggccgcug

SEQ ID NO: 133676 - RNA, 64 nt, hsa
ggucuuuuagccugcccuugcauggcgccugcuggaggaggagagagcucugcuggcaugagcc

SEQ ID NO: 133677 - RNA, 50 nt, hsa
aacgccauguguggaacuaggaggaggaauauuccaucuuggcagaaacc

SEQ ID NO: 133678 - RNA, 64 nt, hsa
cugcucccuuacagaccugguaguuuggggaaaggaggaggagagcccuucagguuugcugaaa

SEQ ID NO: 133679 - RNA, 64 nt, hsa
cuucuggcuuccaacuggagacucacaggccuuggaggaggaggcagguacccucuaugccaau

SEQ ID NO: 133680 - RNA, 64 nt, hsa
aagaagaaaagagaagaaggagaaggagaugaaggaggaggaggaggagaaggagaagaagaag

SEQ ID NO: 133681 - RNA, 64 nt, hsa
aagaaaagagaagaaggagaaggagaugaaggaggaggaggaggagaaggagaagaagaagaag

SEQ ID NO: 133682 - RNA, 64 nt, hsa
aaaagagaagaaggagaaggagaugaaggaggaggaggaggagaaggagaagaagaagaagaag

SEQ ID NO: 133683 - RNA, 64 nt, hsa
ugggacagaagaagaggaugaggaugagauggaagaggaggaggaggaggagcuggaggaggag

SEQ ID NO: 133684 - RNA, 64 nt, hsa
gacagaagaagaggaugaggaugagauggaagaggaggaggaggaggagcuggaggaggagguc

SEQ ID NO: 133685 - RNA, 64 nt, hsa
agaagaagaggaugaggaugagauggaagaggaggaggaggaggagcuggaggaggaggucgac

SEQ ID NO: 133686 - RNA, 64 nt, hsa
agaagaggaugaggaugagauggaagaggaggaggaggaggagcuggaggaggaggucgacgag

SEQ ID NO: 133687 - RNA, 64 nt, hsa
ggaugagauggaagaggaggaggaggaggagcuggaggaggaggucgacgagcugcagacgaca

SEQ ID NO: 133688 - RNA, 64 nt, hsa
uccacagcccuggaggaacuggggcuccuggaaggaggaggaggcucuccacuguccacccuaa

SEQ ID NO: 133689 - RNA, 64 nt, hsa
ggccggacgaguucauggggaucugggggguggggaggaggaagccguugaaucugggagggaa

SEQ ID NO: 133690 - RNA, 64 nt, hsa
auauuuagcucuguggaauucagugacaaaaugggaggaggaaagagaguuuguaaggucaugc

SEQ ID NO: 133691 - RNA, 64 nt, hsa
gccugugccacccucagagaagaagaaaggagcugaggaggagaagccaaagaggaggaggcag

SEQ ID NO: 133692 - RNA, 64 nt, hsa
agaagaagaaaggagcugaggaggagaagccaaagaggaggaggcaggagaagcaggcagccug

SEQ ID NO: 133693 - RNA, 64 nt, hsa
caacaccagcaacucgagagcugggaaacucaaggaggaggaagaaaaucaaaaccacccuacu

SEQ ID NO: 133694 - RNA, 64 nt, hsa
cccuacucccuggggugaggaaagaacaggaggggaggaggaggagugugcucugcacuugccu

SEQ ID NO: 133695 - RNA, 64 nt, hsa
uacucccuggggugaggaaagaacaggaggggaggaggaggagugugcucugcacuugccuugc

SEQ ID NO: 133696 - RNA, 64 nt, hsa
accugggcucuccacagccccaucaaagaacagagaggaggaggagggagaaauggccaccaca

SEQ ID NO: 133697 - RNA, 64 nt, hsa
ugggcucuccacagccccaucaaagaacagagaggaggaggagggagaaauggccaccacauca

SEQ ID NO: 133698 - RNA, 64 nt, hsa
cgguagcgacuauuacgacccgucagagccgacggaggaggaggagccuuccaaacagagaggu

SEQ ID NO: 133699 - RNA, 64 nt, hsa
uagcgacuauuacgacccgucagagccgacggaggaggaggagccuuccaaacagagaggugag

SEQ ID NO: 133700 - RNA, 64 nt, hsa
ggagagugaggggccccgccagcccgauggggaugaggaggagagcacagcccucagcaucaac

SEQ ID NO: 133701 - RNA, 64 nt, hsa
gggggggcggaagcgggagcgcaaggcugccgucgaggaggacaccucccugucggagagugag

SEQ ID NO: 133702 - RNA, 64 nt, hsa
ccuccagaagcccucgucugggaauucgagagaggaggaggacccagggccaaaggaauccuca

SEQ ID NO: 133703 - RNA, 64 nt, hsa
ugcccuccagaagcccucgucugggaauucgagagaggaggaggacccagggccaaaggaaucc

SEQ ID NO: 133704 - RNA, 64 nt, hsa
gaagucugugacaagaagcugcuuauuagaggaggaggaggagucaggugaggaggcugcagaa

SEQ ID NO: 133705 - RNA, 64 nt, hsa
ccagaagucugugacaagaagcugcuuauuagaggaggaggaggagucaggugaggaggcugca

SEQ ID NO: 133706 - RNA, 64 nt, hsa
uauccagaagucugugacaagaagcugcuuauuagaggaggaggaggagucaggugaggaggcu

SEQ ID NO: 133707 - RNA, 64 nt, hsa
ugccaugaagacuguccggagcuucgccaaugaggaggaggaggcagagguguaccugcggaag

SEQ ID NO: 133708 - RNA, 64 nt, hsa
cagugccaugaagacuguccggagcuucgccaaugaggaggaggaggcagagguguaccugcgg

SEQ ID NO: 133709 - RNA, 64 nt, hsa
uagaugaaguuuacugaaucagaggaaucagacagaggaggauagcucuuuccagaauccacac

SEQ ID NO: 133710 - RNA, 64 nt, hsa
gcuucuugugcugcagaagcucguugacaagacugaggaggauuucaagagcaaccaaguaaag

SEQ ID NO: 133711 - RNA, 64 nt, hsa
cguaggacagaaugugaggaggaaguaacacacagaggaggauguguguguaugcauguguuug

SEQ ID NO: 133712 - RNA, 64 nt, hsa
uuuguguaacuauuuguaccguaggacagaaugugaggaggaaguaacacacagaggaggaugu

SEQ ID NO: 133713 - RNA, 64 nt, hsa
aucuuuuuuuaauugccauuugauuuuuauuguggaggaggaggaucuaauauauaauauucaa

SEQ ID NO: 133714 - RNA, 64 nt, hsa
uuuuuuuaauugccauuugauuuuuauuguggaggaggaggaucuaauauauaauauucaauac

SEQ ID NO: 133715 - RNA, 64 nt, hsa
ucgagaagaagugaccaugggcugggaggagguggaggaggaggaagaggagaaggaaaaguga

SEQ ID NO: 133716 - RNA, 64 nt, hsa
agaagaagugaccaugggcugggaggagguggaggaggaggaagaggagaaggaaaagugacga

SEQ ID NO: 133717 - RNA, 64 nt, hsa
aggaggaagaggagaaggaaaagugacgaagagagaggaggaggggggccccagauggcccuuc

SEQ ID NO: 133718 - RNA, 64 nt, hsa
caguucgguuaugcagucaauuauuucuuuuuaagaggaggaggauucacuuggguguugggau

SEQ ID NO: 133719 - RNA, 64 nt, hsa
uucgguuaugcagucaauuauuucuuuuuaagaggaggaggauucacuuggguguugggaucaa

SEQ ID NO: 133720 - RNA, 64 nt, hsa
caucuuucguaagaucagugaugugaagaaagaggaggaggagcgccuccggcagaagaaugag

SEQ ID NO: 133721 - RNA, 64 nt, hsa
gaucaucuuucguaagaucagugaugugaagaaagaggaggaggagcgccuccggcagaagaau

SEQ ID NO: 133722 - RNA, 64 nt, hsa
ugccagcaaugaguuggcacuggcagagcuggaggaggaggagggcaaacccgagggcccagcg

SEQ ID NO: 133723 - RNA, 64 nt, hsa
gcgugccagcaaugaguuggcacuggcagagcuggaggaggaggagggcaaacccgagggccca

SEQ ID NO: 133724 - RNA, 64 nt, hsa
ucacugagugaaggcacauaaagcaauugaggaggaggaggaaccccucgucccccuaggagca

SEQ ID NO: 133725 - RNA, 64 nt, hsa
gguucacugagugaaggcacauaaagcaauugaggaggaggaggaaccccucgucccccuagga

SEQ ID NO: 133726 - RNA, 64 nt, hsa
uuggguucacugagugaaggcacauaaagcaauugaggaggaggaggaaccccucgucccccua

SEQ ID NO: 133727 - RNA, 64 nt, hsa
auaccaaauauuggggaaagugggauaaagggaggaggaggagcuagcagacacauccaguauc

SEQ ID NO: 133728 - RNA, 64 nt, hsa
aucauaccaaauauuggggaaagugggauaaagggaggaggaggagcuagcagacacauccagu

SEQ ID NO: 133729 - RNA, 64 nt, hsa
cacccccauaggagauggacuggagagugaggaggaggaggagccuugguccaugcugagcauc

SEQ ID NO: 133730 - RNA, 64 nt, hsa
ccccacccccauaggagauggacuggagagugaggaggaggaggagccuugguccaugcugagc

SEQ ID NO: 133731 - RNA, 64 nt, hsa
ccgccccacccccauaggagauggacuggagagugaggaggaggaggagccuugguccaugcug

SEQ ID NO: 133732 - RNA, 64 nt, hsa
ucuucugcagcaguacuaucagcagcugaucucugaggaggaggcacugcacaggcaguuauuu

SEQ ID NO: 133733 - RNA, 64 nt, hsa
uggagaacucuuggccaaagguuuuugcggggaggaggaggaaaccagcuuucugguuaagguu

SEQ ID NO: 133734 - RNA, 64 nt, hsa
caguggagaacucuuggccaaagguuuuugcggggaggaggaggaaaccagcuuucugguuaag

SEQ ID NO: 133735 - RNA, 64 nt, hsa
cagccauugccauccaguggggagauggguuagggaggaggacgggcugacuccucuccuguaa

SEQ ID NO: 133736 - RNA, 64 nt, hsa
gaaaguuguggggcauaagacaccgggaaugagggaggaggaagacaguuguguuuucucuuua

SEQ ID NO: 133737 - RNA, 64 nt, hsa
cggggugguggcaauggucguggaggccgagggcgaggaggacccaugggccguggaggcuaug

SEQ ID NO: 133738 - RNA, 64 nt, hsa
ggcuauggaggugguggcagugguggugguggccgaggaggauuucccaguggaggugguggcg

SEQ ID NO: 133739 - RNA, 64 nt, hsa
cuuaacuagccgagagaugcugccucuaggcagagaggaggagagguguugccggcuggagggc

SEQ ID NO: 133740 - RNA, 64 nt, hsa
caaccagugaacaccagcugugaaggccuugggagaggaggaacaggcccuugggcagaugcag

SEQ ID NO: 133741 - RNA, 64 nt, hsa
cccucugagcaacagacugcuugucuugcuaggagaggaggauggggggcugagcacucaggcu

SEQ ID NO: 133742 - RNA, 64 nt, hsa
uacucuuggcccaccgcagaucuguagccagucagaggaggaggagaaggagccccucagcaga

SEQ ID NO: 133743 - RNA, 64 nt, hsa
ucuuggcccaccgcagaucuguagccagucagaggaggaggagaaggagccccucagcagagug

SEQ ID NO: 133744 - RNA, 64 nt, hsa
uaaauuuuuuacauuccgagcaagggauaaguuugaggaggaucguaucuaucgucaucuggag

SEQ ID NO: 133745 - RNA, 64 nt, hsa
guuggauauccaguaaugaucaaggccucagagggaggaggagggaagggaauuagaaaaguca

SEQ ID NO: 133746 - RNA, 64 nt, hsa
cccgugcagacuggaggggacgcugguagagauggaggaggaggcaauugggauggcgcuaggc

SEQ ID NO: 133747 - RNA, 64 nt, hsa
cuggaggggcauggccagcagcuugcguuagaaugaggaggaaggagagaaggggaggagggcg

SEQ ID NO: 133748 - RNA, 64 nt, hsa
caaacugcucagcgcgucucagcucagugccgaggaggaggaagaaaaacaggccgagugaagg

SEQ ID NO: 133749 - RNA, 64 nt, hsa
gagcaaacugcucagcgcgucucagcucagugccgaggaggaggaagaaaaacaggccgaguga

SEQ ID NO: 133750 - RNA, 64 nt, hsa
gaggcaccaggaaaggggugguagucagaggagggaggaggaauaaggggaaggaagagagagg

SEQ ID NO: 133751 - RNA, 64 nt, hsa
aagggagcagggcuuacugagcaguggguugcaggaggaggagcugggcagggccugcaccagg

SEQ ID NO: 133752 - RNA, 64 nt, hsa
cuugcucccugccccagaccuguuucuucuaagggaggaggacaugguggagaccagggacagg

SEQ ID NO: 133753 - RNA, 64 nt, hsa
ucccuagaguccagcacacugcaggaggcguucggaggaggaguuccgccccacccucuacagc

SEQ ID NO: 133754 - RNA, 64 nt, hsa
aucgggggcagagucguuggagacugaagaggaagaggaggaggagaaggggagugagcggccg

SEQ ID NO: 133755 - RNA, 64 nt, hsa
gggggcagagucguuggagacugaagaggaagaggaggaggagaaggggagugagcggccgccc

SEQ ID NO: 133756 - RNA, 64 nt, hsa
aacaaacaaacacaugggggagagagacuuggaagaggaggaggaggaggagaaggaggagaga

SEQ ID NO: 133757 - RNA, 64 nt, hsa
aaacaaacacaugggggagagagacuuggaagaggaggaggaggaggagaaggaggagagagag

SEQ ID NO: 133758 - RNA, 64 nt, hsa
caaacacaugggggagagagacuuggaagaggaggaggaggaggagaaggaggagagagagggg

SEQ ID NO: 133759 - RNA, 64 nt, hsa
acacaugggggagagagacuuggaagaggaggaggaggaggagaaggaggagagagaggggaag

SEQ ID NO: 133760 - RNA, 64 nt, hsa
ccauggucgggacagugcccuggccuuugccggggaggaggaugcucugagauucagggugggg

SEQ ID NO: 133761 - RNA, 64 nt, hsa
ccagugacuuccccaggaguguggaggggguggugaggaggagcaccugggcucucuaccccuc

SEQ ID NO: 133762 - RNA, 64 nt, hsa
ccggcagcuggcgcaccaggcccagcagcagcuggaggaggaggaggaggauacgccagucagc

SEQ ID NO: 133763 - RNA, 64 nt, hsa
gcagcuggcgcaccaggcccagcagcagcuggaggaggaggaggaggauacgccagucagcccc

SEQ ID NO: 133764 - RNA, 64 nt, hsa
gcuggcgcaccaggcccagcagcagcuggaggaggaggaggaggauacgccagucagccccaag

SEQ ID NO: 133765 - RNA, 64 nt, hsa
ggcgcaccaggcccagcagcagcuggaggaggaggaggaggauacgccagucagccccaaggag

SEQ ID NO: 133766 - RNA, 60 nt, hsa
agugucuuccaguccccugacgaggacgaggaggaggacuaugagcaguggcuggagauc

SEQ ID NO: 133767 - RNA, 57 nt, hsa
agugucuuccaguccccugacgaggacgaggaggaggacuaugagcaguggcuggag

SEQ ID NO: 133768 - RNA, 64 nt, hsa
ggccaaguugggggcccaggaggcggggagggaggaggaggagaagaugcgcaguuaccucaug

SEQ ID NO: 133769 - RNA, 64 nt, hsa
uagggccaaguugggggcccaggaggcggggagggaggaggaggagaagaugcgcaguuaccuc

SEQ ID NO: 133770 - RNA, 64 nt, hsa
gugcuaaugccccuuggggaaauggggcugugaggaggaggauuauaacuuaggccuagccucu

SEQ ID NO: 133771 - RNA, 64 nt, hsa
cuggugcuaaugccccuuggggaaauggggcugugaggaggaggauuauaacuuaggccuagcc

SEQ ID NO: 133772 - RNA, 64 nt, hsa
uucaucuggaaguuaaagugaggccacugaagaggaggaggagggucuagaggccugaaauccu

SEQ ID NO: 133773 - RNA, 64 nt, hsa
aacuucaucuggaaguuaaagugaggccacugaagaggaggaggagggucuagaggccugaaau

SEQ ID NO: 133774 - RNA, 64 nt, hsa
guguggagugaaagagucacuguggugggggcgagaggaggacuugggagcuggaggugugaca

SEQ ID NO: 133775 - RNA, 64 nt, hsa
acccagccugucacgacagagccugggcacuucagaggaggagccaggaucgaauggaaggggg

SEQ ID NO: 133776 - RNA, 64 nt, hsa
agacuccaaggagcuacugacauuccuaagaguggaggaggaggaggagccuugcugggccagg

SEQ ID NO: 133777 - RNA, 64 nt, hsa
cuccaaggagcuacugacauuccuaagaguggaggaggaggaggagccuugcugggccagggaa

SEQ ID NO: 133778 - RNA, 64 nt, hsa
caaggagcuacugacauuccuaagaguggaggaggaggaggagccuugcugggccagggaaaca

SEQ ID NO: 133779 - RNA, 64 nt, hsa
uagggccugcauggagaaggguucugcccugccugaggaggaggacacagcacaagggcacauu

SEQ ID NO: 133780 - RNA, 64 nt, hsa
ggccugcauggagaaggguucugcccugccugaggaggaggacacagcacaagggcacauugcc

SEQ ID NO: 133781 - RNA, 64 nt, hsa
cggguucaacuaaauccaggaggagcuguggucagaggaggagccggcgccuggccacgccaac

SEQ ID NO: 133782 - RNA, 64 nt, hsa
gcagaguugcagaggucccuguagagauaaagcugaggaggaggcugugugugauggcucuggc

SEQ ID NO: 133783 - RNA, 64 nt, hsa
gcuuuucccugugggccagggaugcucggucccagaggaggaccuagugacaucaugggacagg

SEQ ID NO: 133784 - RNA, 64 nt, hsa
ugcguuggcagaacccugggugggcaggcacccggaggaggagcagcagcugugucauccugug

SEQ ID NO: 133785 - RNA, 64 nt, hsa
gugacaucgccgggggagguugugggcaacgguggaggaggagagacgggaggggaccauuugg

SEQ ID NO: 133786 - RNA, 64 nt, hsa
ugcugccagagagaccugcugccggagagaaggggaggaggacuccagcugggcucgguccccc

SEQ ID NO: 133787 - RNA, 64 nt, hsa
ugccuuaucgucugcaaguguucuccaagggaaggaggaggaaacugugguguuccuuucuucc

SEQ ID NO: 133788 - RNA, 64 nt, hsa
aauaguagcaagagcugcaaagcaggcaggaagggaggaggagagccaggugagcaguggagag

SEQ ID NO: 133789 - RNA, 64 nt, hsa
gagugccugaggcaggagaauugcaugaacccgggaggaggaggaggagguugcagugagccga

SEQ ID NO: 133790 - RNA, 64 nt, hsa
ugccugaggcaggagaauugcaugaacccgggaggaggaggaggagguugcagugagccgagau

SEQ ID NO: 133791 - RNA, 64 nt, hsa
cugaggcaggagaauugcaugaacccgggaggaggaggaggagguugcagugagccgagauagc

SEQ ID NO: 133792 - RNA, 64 nt, hsa
ugagcgugugauuguagacagaggggugaagaaggaggaggaagaggcagagaaggaggagacc

SEQ ID NO: 133793 - RNA, 64 nt, hsa
ugggagggaguuacugaagucuuacuacagaaaugaggaggaugcuaaaaaugucacgaauaug

SEQ ID NO: 133794 - RNA, 64 nt, hsa
agcugaccuguuggcugaaaaggcccagaucaccgaggaggaggcaaaacuucuggcccagaag

SEQ ID NO: 133795 - RNA, 64 nt, hsa
aaugcagcgcaucaaggccacagcgauucgcacggaggaggagaagcgccugauggagcagaag

SEQ ID NO: 133796 - RNA, 64 nt, hsa
cccgccgaccguggcguuggcccugcuguccucagaggaggaggaggaggaggcagcuccggca

SEQ ID NO: 133797 - RNA, 64 nt, hsa
gccgaccguggcguuggcccugcuguccucagaggaggaggaggaggaggcagcuccggcagcc

SEQ ID NO: 133798 - RNA, 64 nt, hsa
gaccguggcguuggcccugcuguccucagaggaggaggaggaggaggcagcuccggcagccaca

SEQ ID NO: 133799 - RNA, 64 nt, hsa
cguggcguuggcccugcuguccucagaggaggaggaggaggaggcagcuccggcagccacagaa

SEQ ID NO: 133800 - RNA, 64 nt, hsa
uagacuggggggaucagcugcccauugcucccaagaggaggagagggaggcugcagaugccugg

SEQ ID NO: 133801 - RNA, 64 nt, hsa
aagccaccuucaggccugggaaggaagacacugggaggaggagaggccuggaaagcuuugguag

SEQ ID NO: 133802 - RNA, 64 nt, hsa
augaccagaggauuauuuuccugccuuggcagaggaggaggagucaagggagcagggcagcucu

SEQ ID NO: 133803 - RNA, 64 nt, hsa
uccaugaccagaggauuauuuuccugccuuggcagaggaggaggagucaagggagcagggcagc

SEQ ID NO: 133804 - RNA, 64 nt, hsa
ccagaggguggaaggcccuggcaggaagcaggaggaggaggagagggggguccaggucuuuuca

SEQ ID NO: 133805 - RNA, 64 nt, hsa
gguccagaggguggaaggcccuggcaggaagcaggaggaggaggagagggggguccaggucuuu

SEQ ID NO: 133806 - RNA, 64 nt, hsa
uggaaccucuccauauacuuucuaagcucugggggaggaggaggaugggaccuccuggacccag

SEQ ID NO: 133807 - RNA, 64 nt, hsa
aaccucuccauauacuuucuaagcucugggggaggaggaggaugggaccuccuggacccagcuu

SEQ ID NO: 133808 - RNA, 64 nt, hsa
aaaugugaagaaacuccuuucaucucagcagguagaggaggacugaugacacgagcugccaugg

SEQ ID NO: 133809 - RNA, 64 nt, hsa
ccaguccugagagaacuccaucaauccaguccaagaggaggaggacgaaggccuagacucagcu

SEQ ID NO: 133810 - RNA, 64 nt, hsa
guccugagagaacuccaucaauccaguccaagaggaggaggacgaaggccuagacucagcugaa

SEQ ID NO: 133811 - RNA, 64 nt, hsa
aggguggcugugaagggaagucuuuguugcaaaggaggaggaggaaaagggaggacuugguagg

SEQ ID NO: 133812 - RNA, 64 nt, hsa
guggcugugaagggaagucuuuguugcaaaggaggaggaggaaaagggaggacuugguaggguu

SEQ ID NO: 133813 - RNA, 64 nt, hsa
gcuccucauccggacugaggaagacgaggacagggaggaggaaaaggaggaagaggaggacaaa

SEQ ID NO: 133814 - RNA, 64 nt, hsa
ggaagacgaggacagggaggaggaaaaggaggaagaggaggacaaaaagggggaggagaagguu

SEQ ID NO: 133815 - RNA, 64 nt, hsa
agaagaggaggaggaggaggaggaggaggaggaggaggaggaggccagguccugguggagccuu

SEQ ID NO: 133816 - RNA, 64 nt, hsa
ggaagaagaggaggaggaggaggaggaggaggaggaggaggaggaggccagguccugguggagc

SEQ ID NO: 133817 - RNA, 64 nt, hsa
ggaggaagaagaggaggaggaggaggaggaggaggaggaggaggaggaggccagguccuggugg

SEQ ID NO: 133818 - RNA, 64 nt, hsa
ggaggaggaagaagaggaggaggaggaggaggaggaggaggaggaggaggaggccagguccugg

SEQ ID NO: 133819 - RNA, 64 nt, hsa
ggaggaggaggaagaagaggaggaggaggaggaggaggaggaggaggaggaggaggccaggucc

SEQ ID NO: 133820 - RNA, 64 nt, hsa
ggaggaggaggaggaagaagaggaggaggaggaggaggaggaggaggaggaggaggaggccagg

SEQ ID NO: 133821 - RNA, 64 nt, hsa
ggaggaggaggaggaggaagaagaggaggaggaggaggaggaggaggaggaggaggaggaggcc

SEQ ID NO: 133822 - RNA, 64 nt, hsa
cccaaccccaugggaggaggaggaagaggaggaggaggaggaggaggaggaggaggaggaggag

SEQ ID NO: 133823 - RNA, 64 nt, hsa
aaccccaaccccaugggaggaggaggaagaggaggaggaggaggaggaggaggaggaggaggag

SEQ ID NO: 133824 - RNA, 64 nt, hsa
cccaaccccaaccccaugggaggaggaggaagaggaggaggaggaggaggaggaggaggaggag

SEQ ID NO: 133825 - RNA, 64 nt, hsa
aaucccaaccccaaccccaugggaggaggaggaagaggaggaggaggaggaggaggaggaggag

SEQ ID NO: 133826 - RNA, 64 nt, hsa
cauggcccuaaucccaaccccaaccccaugggaggaggaggaagaggaggaggaggaggaggag

SEQ ID NO: 133827 - RNA, 64 nt, hsa
gaucauggcccuaaucccaaccccaaccccaugggaggaggaggaggaggaagaagaggaggag

SEQ ID NO: 133828 - RNA, 64 nt, hsa
guccugagagaacuccaucaauccaguccaagaggaggaggacgaaggauccucacaggaggau

SEQ ID NO: 133829 - RNA, 64 nt, hsa
ccaguccugagagaacuccaucaauccaguccaagaggaggaggacgaaggauccucacaggag

SEQ ID NO: 133830 - RNA, 64 nt, hsa
aaucaguagaucuuggcaauucagauaauauguuuuuuccuacuucaacagaagaacaauauaa

SEQ ID NO: 133831 - RNA, 64 nt, hsa
guuaucuuuuccuuaaauaucccucuagagguauuuuuccuaagugguauuguacgguguauac

SEQ ID NO: 133832 - RNA, 64 nt, hsa
ccauaauauauuugagcagucccugcugacauuuuuuuccuaaccuuuugcuauuauaaauaau

SEQ ID NO: 133833 - RNA, 64 nt, hsa
agccgacauuccaugcccugaccaauccuacugcuuuuccuaaaaacagaauaauuuggugugc

SEQ ID NO: 133834 - RNA, 64 nt, hsa
aaacagaauaauuuggugugcauucuuucagacuuuuuccuauacauuuuauauguagaaaugu

SEQ ID NO: 133835 - RNA, 64 nt, hsa
agauuuguuucuuaaugggugugaccaauccuguuuuuccuaugcucugggugaauagagccug

SEQ ID NO: 133836 - RNA, 64 nt, hsa
uuuucauguaaguuuaauuaucugcauuuaucuuuuuuccuaguuuuucuaauacuaauguuau

SEQ ID NO: 133837 - RNA, 64 nt, hsa
uauuuuaucuuuauauaguuuguuugcaagaguauuuuccuaauaacuucacaguaugaaugug

SEQ ID NO: 133838 - RNA, 64 nt, hsa
caacuuucaauggaagagaauuuuagugcuuuuuuuuuccuaaaauagauauuaagcugcuguu

SEQ ID NO: 133839 - RNA, 64 nt, hsa
gugcgugcguguguauguucugaguccacuucuuuuuuccuaaauaacacuacagggauuuugu

SEQ ID NO: 133840 - RNA, 64 nt, hsa
ucuuuacaugauagcauuaucuuuuuauaauuuuuuuuccuaagauaaacaaaugcauaguuuu

SEQ ID NO: 133841 - RNA, 64 nt, hsa
agggagcuacauagagcaauuuaaaugcaaauuuuuuuccuaacaacuuacaaggugacuagcu

SEQ ID NO: 133842 - RNA, 64 nt, hsa
cuaauuuaucuuuagaaauuuaugugaaaaaugguuuuccuauacuggauaaagcaauuccccu

SEQ ID NO: 133843 - RNA, 64 nt, hsa
guguuugcaccugucuuucauuugucauaagagauuuuccuauuucuucuacccaauagaauau

SEQ ID NO: 133844 - RNA, 64 nt, hsa
gagcugguuggacuaaugagacugaggaagcagcuuuuccuacgaucugcauuauguaaucaca

SEQ ID NO: 133845 - RNA, 64 nt, hsa
uuuauauacagggucuuuuuucuuuaccgauguauuuuccuacucauagccaaccaauaaauuc

SEQ ID NO: 133846 - RNA, 64 nt, hsa
uuaugaacuaccucucagucucugggguuuguccuuuuccuacccugaugucaaacuuaugcau

SEQ ID NO: 133847 - RNA, 64 nt, hsa
uuuagccauuugugaaauggguuugcuuuuucccuuuuccuacagacguauaugcuagauguca

SEQ ID NO: 133848 - RNA, 64 nt, hsa
aaaauggccagcauaaaugcuguuuauauucacguuuuccuaggugugugugugcaggccacag

SEQ ID NO: 133849 - RNA, 64 nt, hsa
gaacccuaucaacugucuuauguacguuacaugauuuuccuacacucuguaauuuugcugaggu

SEQ ID NO: 133850 - RNA, 64 nt, hsa
agacauauaaauaagcucaucuagggucaccucauuuuccuaaauauguuuuuaaagcaauuau

SEQ ID NO: 133851 - RNA, 64 nt, hsa
gguacugcagugagggccuugauuccagagcucuuuuuccuacugaaaucaugguuuaguaaac

SEQ ID NO: 133852 - RNA, 64 nt, hsa
uuuuuaaagguacaguauauggggauuguuucguuuuuccuagcaggggaaccuuaguuaauaa

SEQ ID NO: 133853 - RNA, 64 nt, hsa
gcaaauuuugucucaaucuuuuuucccuccaugauuuuccuaugugcuuccucuggcauucacu

SEQ ID NO: 133854 - RNA, 64 nt, hsa
ccucuuaccagucagcugccugcgagcagucauuuuuuccuaaagguuuacaaguauuuagaac

SEQ ID NO: 133855 - RNA, 64 nt, hsa
cuuaaauacccacaccuuuuuuucguaggugggcuuuuccuaucagagcuuggcucauaaccaa

SEQ ID NO: 133856 - RNA, 64 nt, hsa
ggacaccugaggaaaggguacuaccuuaaaaaucuuuuccuauagucuugguaaauuuuaaaug

SEQ ID NO: 133857 - RNA, 64 nt, hsa
agcuaagucugucuuuuuucuuaggaaauaaagguuuuccuaggauacauuuaaguguuuugcu

SEQ ID NO: 133858 - RNA, 64 nt, hsa
aaggaauagcaggagaaauuuuacugaagugcuguuuuccuaggugcuacuuuggcagagcuaa

SEQ ID NO: 133859 - RNA, 64 nt, hsa
gggaugucaggugcaucauuacauugggugucucuuuuccuagauuuaugcuuuugggauacag

SEQ ID NO: 133860 - RNA, 64 nt, hsa
uuguuuugaagcuggcaucuaagcauucuuuuuuuuuuccuaguugaugccuuccuuuauuaca

SEQ ID NO: 133861 - RNA, 64 nt, hsa
cagaauucuuuuuuaaaauuuuaauuagauuuccuuuuccuaguaagaguugaugucugcuagu

SEQ ID NO: 133862 - RNA, 64 nt, hsa
gaaguaauaugcucucauuucuuuguaaucuagauuuuccuauguugaaugcuuaaagcaaggc

SEQ ID NO: 133863 - RNA, 64 nt, hsa
auuuugagcaaaccacauaaucucucuagguccauuuuccuaaccacaagauaaagauguuaca

SEQ ID NO: 133864 - RNA, 64 nt, hsa
uuucgcaagugauuuuagcuaauugaagagauuauuuuccuauguaauuucacauucuaauaua

SEQ ID NO: 133865 - RNA, 64 nt, hsa
cugacuuaucauucauaaguugcaaauauuacuauuuuccuaaaccaggguacacaauuuaagu

SEQ ID NO: 133866 - RNA, 64 nt, hsa
gugguacuaaaauuugcuacuguuuuagaccauauuuuccuauuauuuaucuguucaaauuugu

SEQ ID NO: 133867 - RNA, 64 nt, hsa
ccugaaaccuuuccgguguguuuugucuucaacuuuuuccuagcuauccuauuagccuguaaau

SEQ ID NO: 133868 - RNA, 64 nt, hsa
ucuacuauccuuuuuuauugaauaacgcacaguauuuuccuaagguugcuggguuugggaguaa

SEQ ID NO: 133869 - RNA, 64 nt, hsa
augcuuuuuagcuguggcuaugauggauuuuauuuuuuccuaggucaagcuguguaaaagucau

SEQ ID NO: 133870 - RNA, 64 nt, hsa
guuugaggauuuuccaagcguguaauaaugauguuuuuccuaacaugacagaugaguaguaaau

SEQ ID NO: 133871 - RNA, 64 nt, hsa
guucugugucaaaagauggccuauuggcccucaguuuuccuacagaguaguggcuuaucucuga

SEQ ID NO: 133872 - RNA, 64 nt, hsa
gaauauuguacccagugacuucagugguauccuuuuuuccuaagaccauuuauaauuauuagug

SEQ ID NO: 133873 - RNA, 64 nt, hsa
auucugugugaguauaccacaauuuaaguguucauuuuccuaucaguugacauuuguuuuuagu

SEQ ID NO: 133874 - RNA, 64 nt, hsa
uuauauuuugggaacacauagaacugauggaggcuuuuccuaaggccaaggauaauguacuagu

SEQ ID NO: 133875 - RNA, 64 nt, hsa
guuuuuuuuaguaacuaugcacauaucagcucuauuuuccuacaucuacuuuauaucucauauu

SEQ ID NO: 133876 - RNA, 64 nt, hsa
cuucacaaugaaaauucauuguauugaucagcauuuuuccuaagaggucuagaaaugcuuaaac

SEQ ID NO: 133877 - RNA, 64 nt, hsa
uugguuaugugcagggaaucaucucacaugcuguuuuuccuauuugguuugagaaacaggcuga

SEQ ID NO: 133878 - RNA, 64 nt, hsa
gguugggguacuacgaucacagacacagacauacuuuuccuaaaguugaagcauuuguucccag

SEQ ID NO: 133879 - RNA, 64 nt, hsa
gaacuuuuguaucuuuuauccugggagcacugcguuuuccuagcuguguuauuccugguuuaau

SEQ ID NO: 133880 - RNA, 64 nt, hsa
cagacaauauuuuagaaggacggauucaaguaccuuuuccuacacagguaaaacugggcuuuua

SEQ ID NO: 133881 - RNA, 64 nt, hsa
uaaacccuuauacuaucuuuuuauuaucugagccuuuuccuaaugcagcucauaggugcuagcu

SEQ ID NO: 133882 - RNA, 64 nt, hsa
uaagauuccuacacuuuauuucugccauugaugcuuuuccuaaacccuuauacuaucuuuuuau

SEQ ID NO: 133883 - RNA, 64 nt, hsa
aaggaagauccucuuuguuuguucaaaggaccaguuuuccuaggccaaagaagucucuucccca

SEQ ID NO: 133884 - RNA, 64 nt, hsa
ccaugacccacagccaucugguuaugucuuauuuuuuuccuaaaagauaauguuuauuuuuaaa

SEQ ID NO: 133885 - RNA, 64 nt, hsa
cagggaaguccuuugguaacugcaauauacaagauuuuccuauuaagccucuugguaagaggca

SEQ ID NO: 133886 - RNA, 64 nt, hsa
uuauaaaguuccuucagugguugccucacuugcguuuuccuacaagauguaagacuguuuauaa

SEQ ID NO: 133887 - RNA, 64 nt, hsa
uacaaccugcccuccagggacacgucuccaugguuuuuccuacacaugaaugcgagaaauggcu

SEQ ID NO: 133888 - RNA, 64 nt, hsa
ucucaaaacuggccacugccucagccaccaagcuuuuuccuaccacuaccuuauaaaccugccu

SEQ ID NO: 133889 - RNA, 64 nt, hsa
uucuucuccucccccuacccgguuucccucccuguuuuccuaccucuacggcaagcccaaagug

SEQ ID NO: 133890 - RNA, 64 nt, hsa
gcacauuuguucugcagacuauugcaggaauguuuuuuccuagcauuucuauauuaucugucca

SEQ ID NO: 133891 - RNA, 64 nt, hsa
guuuagaauacugguuuucuauuuacgcaugauauuuuccuaaguaaaauugccaaguggacuu

SEQ ID NO: 133892 - RNA, 64 nt, hsa
uauuauugugcuucauggagaauuuuccccucuguuuuccuaaauuguaugagagcuuucacac

SEQ ID NO: 133893 - RNA, 64 nt, hsa
uauacuuccuuaaaguaaauguaaugauuucuucuuuuccuauugaccaguacagauagauaug

SEQ ID NO: 133894 - RNA, 64 nt, hsa
agggggaagcaccagccucagugcagcccccuccugaccccaccuagaauggaagccuccaccu

SEQ ID NO: 133895 - RNA, 64 nt, hsa
ucguggagcucuaacugauucagggccccugaagugaccccagcuccaggcaggaaaccccgag

SEQ ID NO: 133896 - RNA, 64 nt, hsa
uguggcugccaggccaaggcagucacaggggcccugaccccaggccacacagacggacaugggc

SEQ ID NO: 133897 - RNA, 64 nt, hsa
agugaugaggcugguuagcggaugugggaggcugugaccccagggggccauagggugcggugga

SEQ ID NO: 133898 - RNA, 64 nt, hsa
cugucacuggcuggcuccuaggggaacagaccagugaccccagaaaagcauaacaccaauccca

SEQ ID NO: 133899 - RNA, 64 nt, hsa
gcuggacuucugugggccccucaacagccaagugugaccccacugccaaguggggauggggccu

SEQ ID NO: 133900 - RNA, 64 nt, hsa
ugguuaugacagggagcucccaggccaggccacaugaccccacagguaggcugaccccauggac

SEQ ID NO: 133901 - RNA, 64 nt, hsa
ucccaggccaggccacaugaccccacagguaggcugaccccauggacccacuggagacuuugag

SEQ ID NO: 133902 - RNA, 64 nt, hsa
aucucagaguccagucaaguucccuccugcagccugaccccaggcagcucgagcaugcccugag

SEQ ID NO: 133903 - RNA, 64 nt, hsa
agggucccagccuggccaccagcuucccucugccugaccccaggccaccugucuucucucccac

SEQ ID NO: 133904 - RNA, 64 nt, hsa
acugcuggguuuucauggguaggaaagcuuguccugaccccagcagcaaagagguggcaggucg

SEQ ID NO: 133905 - RNA, 64 nt, hsa
acuuuuuuuucucucucucucuaguauucuaaacugaccccaugaccaacugagaauuuauuuu

SEQ ID NO: 133906 - RNA, 64 nt, hsa
uccuuccagcuagugacccacaugccauuuguacugaccccaucaccuacucacacaggcauuu

SEQ ID NO: 133907 - RNA, 64 nt, hsa
uggccaagcugaggugcccaggagaagaaagaggugaccccagggcacaggagcuaccugugug

SEQ ID NO: 133908 - RNA, 64 nt, hsa
cagguuccuccacugccccaccccuuagacaccaugaccccaucagguuaauccccuguugcca

SEQ ID NO: 133909 - RNA, 64 nt, hsa
gcagaccaguggggaucugaucccaaagauggggugaccccagggucagggaggcugcccccag

SEQ ID NO: 133910 - RNA, 64 nt, hsa
gccuuccagaaaccuguccucugcagcucggucuugaccccaagccugcuggugaccugaacuu

SEQ ID NO: 133911 - RNA, 64 nt, hsa
gcuggugcuggcgcugcugggucagggcugcccgugaccccagacaccacuguccauccuguga

SEQ ID NO: 133912 - RNA, 64 nt, hsa
ccuacagcgggacacccugaccccacggcugcccugaccccaggaggcuccaguucugggcugg

SEQ ID NO: 133913 - RNA, 64 nt, hsa
caauaaagcagacuauuccuacagcgggacacccugaccccacggcugcccugaccccaggagg

SEQ ID NO: 133914 - RNA, 64 nt, hsa
accccccaccccccacagcgucagcuccuaccucugaccccagcuucucucugauucccacagg

SEQ ID NO: 133915 - RNA, 64 nt, hsa
uuuaaccccccaccugagccccagcuccuaccucugaccccaacuucucuuugaucucugaauc

SEQ ID NO: 133916 - RNA, 64 nt, hsa
ugugcaauuccuuguuaaagaaaugcuacuuuauuaagaagaugcuggcugcuuuguguuagaa

SEQ ID NO: 133917 - RNA, 64 nt, hsa
uugagccuaaaucaaagcaaaccaauaccauugauaagaagaagauaaaaacaaaauauuuugg

SEQ ID NO: 133918 - RNA, 64 nt, hsa
agucaacugaggaaaaaaaauaauuaaacaggccuaagaagaaaucaaaaaccauaagacaccu

SEQ ID NO: 133919 - RNA, 64 nt, hsa
gaacuuuggagguuuggagcuugaagagaauggcuaagaagauuugaauuauagggagggaaca

SEQ ID NO: 133920 - RNA, 64 nt, hsa
ugaugguucacguuggggugauuuaauccaguuauaagaagaaguucauguccaaacguccucu

SEQ ID NO: 133921 - RNA, 64 nt, hsa
aaggggaagaaugaaagcuguuccuugguccuaguaagaagacaaacugcuucccuuacuuugc

SEQ ID NO: 133922 - RNA, 64 nt, hsa
aaaacagggugcuccuccuggcuucuggcuuccauaagaagaaauggagaaaaaaauauauaua

SEQ ID NO: 133923 - RNA, 64 nt, hsa
gagagcacaaguuggccuacauuuuuauauuuuuuaagaagauacuuugagaugcauuaugaga

SEQ ID NO: 133924 - RNA, 64 nt, hsa
ggcuagggaguuuaucccuuuuucgaauuauuuuuaagaagaugccaauauaauuuuuguaaga

SEQ ID NO: 133925 - RNA, 64 nt, hsa
auggaauauauucugcguuuauaaaacuaguuuuuaagaagaaauuuuuuuuggccuaugaaau

SEQ ID NO: 133926 - RNA, 64 nt, hsa
guuuaagaauuaauuuacauuaaaguguuuauguuaagaagauugggccaggugggguggcuca

SEQ ID NO: 133927 - RNA, 64 nt, hsa
aggugcaacuucuaagaguuuuccuguaaguaauuaagaagacuaaguagccccagagauaaga

SEQ ID NO: 133928 - RNA, 64 nt, hsa
uucagaaacuaaagcccucacugucauuauucuuuaagaagaugaaauuacucuggauguuugg

SEQ ID NO: 133929 - RNA, 64 nt, hsa
uuaauucaugcaaaaugaaggaggaagccuggucuaagaagauacugucuuucaauagaaauga

SEQ ID NO: 133930 - RNA, 64 nt, hsa
auagaaccaacagcaucugagcccucaacaccaacagcaccauccucuguagcagacaggccuc

SEQ ID NO: 133931 - RNA, 64 nt, hsa
ggcucccucugggucauauggugcagacugugaccagcaccaggcaggcaguccugucugcgug

SEQ ID NO: 133932 - RNA, 64 nt, hsa
gcucugagugggccugcucucuguagacugaauucagcaccagugaaaggcuuugagaaggacg

SEQ ID NO: 133933 - RNA, 64 nt, hsa
ccauagaggcccaggcaccaccaggagcagcagccagcaccaccuacacaggagucuucagacc

SEQ ID NO: 133934 - RNA, 64 nt, hsa
ggacccagugcccucugcagaccccucccagccgcagcaccaagggcuugcugccuuguuuccu

SEQ ID NO: 133935 - RNA, 64 nt, hsa
uucugauuuggcccccugcccgcuuggagccucccagcaccagacagggcagguuuggggagcc

SEQ ID NO: 133936 - RNA, 64 nt, hsa
agaacguguacgacgagcuggggggcagcccaggcagcaccagcgcggccacgugcacgcgccg

SEQ ID NO: 133937 - RNA, 64 nt, hsa
augccaggaaagaccaaagcagaugcugcugacccagcaccacuucccagccaggagcccccca

SEQ ID NO: 133938 - RNA, 64 nt, hsa
ggugagccgccugccaguggaggacagcaccccucagcaccacccacccucauucagagcacac

SEQ ID NO: 133939 - RNA, 64 nt, hsa
gguucugagucagggugaucuguggacgggaccccagcaccaagucuacgggugccagaucagu

SEQ ID NO: 133940 - RNA, 64 nt, hsa
guuccaguuccaagcauggaggcucauucugaagcagcaccaacugagcaaaccccuguggucc

SEQ ID NO: 133941 - RNA, 64 nt, hsa
aucccgguuccaagccuagaggauccuuccaaaccagcaccaacagagccaaggccuugggagc

SEQ ID NO: 133942 - RNA, 64 nt, hsa
cucccucugcccucccgucugugagcucccugcccagcaccaccuccugcacugcacuucugcc

SEQ ID NO: 133943 - RNA, 64 nt, hsa
auccccaguucuuagccaguugagccagcgacaacagcaccagagccaggcagucacuguuccu

SEQ ID NO: 133944 - RNA, 64 nt, hsa
auuacuaccuuuuaaaauauuuuagauaaaugcacagcaccacagcaccacaucuaagcauuag

SEQ ID NO: 133945 - RNA, 64 nt, hsa
cuuuuaaaauauuuuagauaaaugcacagcaccacagcaccacaucuaagcauuagugaugggu

SEQ ID NO: 133946 - RNA, 64 nt, hsa
agcauguucaccacuggucguucagcagccacgacagcaccaugugagauggcgagguggcugg

SEQ ID NO: 133947 - RNA, 64 nt, hsa
cgacagcaccaugugagauggcgagguggcuggacagcaccagcagcgcaucccggcgggaacc

SEQ ID NO: 133948 - RNA, 64 nt, hsa
gcggcccucggaagucuggucgcaguggcaaagccagcaccauggccagcagagcggugagcag

SEQ ID NO: 133949 - RNA, 64 nt, hsa
caugaaaguucagccaaugcccagagugaccaagcagcaccagcaggccugcccaggaugcuga

SEQ ID NO: 133950 - RNA, 64 nt, hsa
agagagccaaaauguguggcccuguccccaagcucagcaccaccggccaugaccagagguugcu

SEQ ID NO: 133951 - RNA, 64 nt, hsa
aagguagggccaauuaaggauucuaacccuaacccagcaccacaaagccccccuggagcaucuu

SEQ ID NO: 133952 - RNA, 64 nt, hsa
acagguggucugguggauagcggggagcauggcucagcaccagagcagaggcccagccagcccu

SEQ ID NO: 133953 - RNA, 64 nt, hsa
auguccuccuuucuccuuugugcccagccugagucagcaccaaucccgcauucagaaccuccca

SEQ ID NO: 133954 - RNA, 64 nt, hsa
aucugaaaagccagauaugccuguuuccuuuucccagcaccaugccuguggaggggacagucag

SEQ ID NO: 133955 - RNA, 64 nt, hsa
aggaaugugacucccugggcccccagauggcgagcagcaccaccuccaagccgucaucaucauc

SEQ ID NO: 133956 - RNA, 64 nt, hsa
gucccucuacuacaggcaguggaccuuggcccggcagcaccacgcugacuauagcaaccagcug

SEQ ID NO: 133957 - RNA, 64 nt, hsa
agcugcguaccucccgcugcuucuccuugugguccagcaccaccugcuggucaguggcagaacu

SEQ ID NO: 133958 - RNA, 64 nt, hsa
acaagaggcugguuuuuaauaacgaaugcagccacagcaccagaccaggggcuauuuuugugac

SEQ ID NO: 133959 - RNA, 64 nt, hsa
cugugcccguccucggccccccacccugaagugccagcaccaccagcaccagauccuccgccgc

SEQ ID NO: 133960 - RNA, 64 nt, hsa
uccucggccccccacccugaagugccagcaccaccagcaccagauccuccgccgccacaccgca

SEQ ID NO: 133961 - RNA, 64 nt, hsa
ugagccccggacucugcuuacccugauggcugcucagcaccacagagugcuugggcugagggac

SEQ ID NO: 133962 - RNA, 64 nt, hsa
aucagccagacaugucuagggugagaccagugcucagcaccacccgccaaggaacacugaugag

SEQ ID NO: 133963 - RNA, 64 nt, hsa
uaggcaccgcauucugaucuggacaaagucgggacagcaccaucccagccccgaagccagggcc

SEQ ID NO: 133964 - RNA, 64 nt, hsa
cugacaucgccagccgacgcccugaaucuuggugcagcaccaaccgcgugccuguguggcggga

SEQ ID NO: 133965 - RNA, 64 nt, hsa
acccacuuggagccccugcaaggagcgaaccggucagcaccaaguaacaccacacacacgcagc

SEQ ID NO: 133966 - RNA, 64 nt, hsa
ugccgaaauucaagagccagcucugauagaaagccagcaccagccucgggagcugcugagccac

SEQ ID NO: 133967 - RNA, 64 nt, hsa; identical to SEQ ID NO: 97553

SEQ ID NO: 133968 - RNA, 64 nt, hsa; identical to SEQ ID NO: 97554

SEQ ID NO: 133969 - RNA, 64 nt, hsa; identical to SEQ ID NO: 97555

SEQ ID NO: 133970 - RNA, 64 nt, hsa; identical to SEQ ID NO: 97556

SEQ ID NO: 133971 - RNA, 64 nt, hsa
ucuauuguucaagaguaacagguuuaacucaugaccaagugauguacauccaagugauguauuc

SEQ ID NO: 133972 - RNA, 64 nt, hsa
uaacagguuuaacucaugaccaagugauguacauccaagugauguauucuggaaacgauggaau

SEQ ID NO: 133973 - RNA, 64 nt, hsa
guuaccuuuacaauggagacaucuaccagaucauccaagugauuaaauuuaacaucaucaauga

SEQ ID NO: 133974 - RNA, 64 nt, hsa
ggccaggcuggagugcagccucaaccuccuggguccaagugauccucccaccucagcacacaac

SEQ ID NO: 133975 - RNA, 64 nt, hsa
gacugccaucauugaugaucacugugaaaauugaccaagugauguguuuacauuuacugaaaug

SEQ ID NO: 133976 - RNA, 64 nt, hsa
caguaauuaauaucuccuggaacacuauagagaaccaagugaccgacucauuuacaacugaaac

SEQ ID NO: 133977 - RNA, 64 nt, hsa
agacauuagcucuauggaauucugcuagcaauuuccaagugacagugaggaauuauggauauau

SEQ ID NO: 133978 - RNA, 64 nt, hsa
ugucagaaaucuugaacauguucugaugaaagaaccaagugacccaaagugaccuggacaagau

SEQ ID NO: 133979 - RNA, 64 nt, hsa
accaccucuuauaaugcuccuuuuccacugugagccaagugaccuugggagagguaagauggug

SEQ ID NO: 133980 - RNA, 64 nt, hsa
aacaaggugcuucucuacuuccaccaauaaacuuccaagugagucccuaauuuuugcagguugg

SEQ ID NO: 133981 - RNA, 64 nt, hsa
auuuaaaaacaaauuggaagaauaaccaggacagccaagugaagcagccacagggacccaagca

SEQ ID NO: 133982 - RNA, 64 nt, hsa
ggugagcucagaaaccuacuguuaaccaacacccccaagugacugacacagguggucuaaaaau

SEQ ID NO: 133983 - RNA, 64 nt, hsa
gaugcuggcaaggagcgggaaggugcuggagaucccaagugaagugugugcauuuuuuauaacu

SEQ ID NO: 133984 - RNA, 64 nt, hsa
gggaagaaauguaaaagaauuuuacaaaugcuuuccaagugaugaauaugcucaguuaauuuca

SEQ ID NO: 133985 - RNA, 64 nt, hsa
uaaauaagauuacagagaaaauuuuuuguuaaaaccaagugauuuccagcugauguaucuaaua

SEQ ID NO: 133986 - RNA, 64 nt, hsa
cacugagauguauuuaugcaugcugaccguguguccaagugagccagugucuucaucacaagau

SEQ ID NO: 133987 - RNA, 64 nt, hsa
acagaucuuuuucugucuaucaaaacuauuugauccaagugaaaaaaaaaaaaaaacuagaaag

SEQ ID NO: 133988 - RNA, 64 nt, hsa
ugauggggaaaacaagcugugucuucuuaacugcccaagugaaaagcaaccaaguccaggaaau

SEQ ID NO: 133989 - RNA, 64 nt, hsa
gauccauuucuguguguucccccaaccuuuauuuccaagugacauuuucagucuuucaaauagc

SEQ ID NO: 133990 - RNA, 64 nt, hsa
guggucaacaggaagacccagcagcuccacccucccaagugacaggccauuuucggacgcagcc

SEQ ID NO: 133991 - RNA, 64 nt, hsa
ugccuacccacgugccugcuuaccugccagauaaccaagugagaugucugcgaguggcuaguuu

SEQ ID NO: 133992 - RNA, 64 nt, hsa
ccucagcacauccgacaccucccagcgugggaccccaagugaagacgaggccaaggcugaaacc

SEQ ID NO: 133993 - RNA, 64 nt, hsa
uuuuaaauauuguguauggccgcuuugugcuacaguagcagaguugagucauugcaagggagac

SEQ ID NO: 133994 - RNA, 64 nt, hsa
guuaaauaacuuaucugugguuacaagcuaguaaguagcagagccaagauuuuuuuuaauauag

SEQ ID NO: 133995 - RNA, 64 nt, hsa
gcucagcucaugggccucaucccuucucucccagguagcagaaaacgcuuuuuauuguauucaa

SEQ ID NO: 133996 - RNA, 64 nt, hsa
accuugcaaagaugcagucaccauagauguccacguagcagagacugacuuaggaucugagaua

SEQ ID NO: 133997 - RNA, 64 nt, hsa
augcucacaugcacauauauggacauacaguuucguagcagaacguggcugcccaggggcugcc

SEQ ID NO: 133998 - RNA, 64 nt, hsa
uaguacaucauagcacuuuauuuuaugaaaacauguagcagauuuuccacaaaaaugcuuauuu

SEQ ID NO: 133999 - RNA, 64 nt, hsa
aaucuuuucacaggaagaauuguauuugcaacggguagcagaauuggacaaaauuacuuaugaa

SEQ ID NO: 134000 - RNA, 64 nt, hsa
gcuucuagauuacaaaaauaugacaaucuuguaaguagcagacuauggagaaaaaugaguuacc

SEQ ID NO: 134001 - RNA, 64 nt, hsa
cagucaguaaaccugugagacugcuggaggaaauguagcagacagcauggaggcugggacccag

SEQ ID NO: 134002 - RNA, 64 nt, hsa
aaacugauguuacauuagguuccaauucgcaauaguagcagagacugacaugcuuuuauugacc

SEQ ID NO: 134003 - RNA, 64 nt, hsa
aacaggugcuaugugaccaggaaucuagccgggaguagcagaggcccugucuucugaagucuca

SEQ ID NO: 134004 - RNA, 64 nt, hsa
auggugcugguaggagguuaucagaguaaggaagguagcagauauaggugcagggugccuguca

SEQ ID NO: 134005 - RNA, 64 nt, hsa
agaggggaacuugauucaaaaauuugggauucauguagcagagacagagcuagacuguaaaggu

SEQ ID NO: 134006 - RNA, 64 nt, hsa
ugaguuaaaaauggcacuuuugauaugagacaauguagcagaauaccaggcagacagaaccuug

SEQ ID NO: 134007 - RNA, 64 nt, hsa
cucucucgaccugauguguagacgcucacuuccaguagcagaaccaccuuaguugugucuuaca

SEQ ID NO: 134008 - RNA, 64 nt, hsa
agacucagaagguauauuaggacauuuggaaucaguagcagagcaaagccucuuugaaaaaaac

SEQ ID NO: 134009 - RNA, 64 nt, hsa
cuggcucuggugcugccaucuacgcaugugggacccucguuaucgcuguugcucaaaauguauu

SEQ ID NO: 134010 - RNA, 64 nt, hsa
ggagaagcuuuagcuucauuuuacuaaaaagauuccucguuauuguuguugccaaagagaaaca

SEQ ID NO: 134011 - RNA, 64 nt, hsa
caagaaacuguucgaaaaagaacaaaaacacuucccucguuauuuucucucauuuuuugaugag

SEQ ID NO: 134012 - RNA, 64 nt, hsa
ugauguggaaaccauauugguaaaguuguuaaucccucguuauggagaacugaucuuaagcuau

SEQ ID NO: 134013 - RNA, 64 nt, hsa
uccugugggcgcucugcccuguguccuucgcguuccucguuaagcagaagaagucaguaguuau

SEQ ID NO: 134014 - RNA, 64 nt, hsa
uuuaguaucuguuccccaacuuacccuguagaaaccucguuauuaaccaguguuccagucuuaa

SEQ ID NO: 134015 - RNA, 64 nt, hsa
guuagguauaaagacauaaaaaugugugucaagcccucguuagcugaugagguaaaugcaugga

SEQ ID NO: 134016 - RNA, 64 nt, hsa
gcugcuccuucccaccccucagaacagcucugauccucguuaauaccuggcugcgugugcagcu

SEQ ID NO: 134017 - RNA, 64 nt, hsa
gcaaaccacgccaugacccauauacgccaaauucccucguuaugccacgaccagauaagaauca

SEQ ID NO: 134018 - RNA, 64 nt, hsa
aaugauuguuauuuuuaaaaaccagcuuauaauuccucguuaugcaugauuuauccaaaguuuc

SEQ ID NO: 134019 - RNA, 64 nt, hsa
ucuucaccccuagcugucaguuuggcagauuuucccucguuaccuccaguucgacucagaaccu

SEQ ID NO: 134020 - RNA, 64 nt, hsa
agcucgagaagggccugaccuaaaggucagguccccucguuaaaaaaauauguacgucuagcuc

SEQ ID NO: 134021 - RNA, 64 nt, hsa
ggagcucaugugagucaggacccugaauguuaggccucguuagcucuaugguucauaugcuucu

SEQ ID NO: 134022 - RNA, 64 nt, hsa
gaaaguaacaagcucagaggaagccacuccuugcccucguuaaagaggguccuguuccucucuu

SEQ ID NO: 134023 - RNA, 64 nt, hsa
cugcaaacaguggaacauggcuuagguuuugaagccucguuauuggauauagucuuuauccuaa

SEQ ID NO: 134024 - RNA, 64 nt, hsa
ugcacuuuaugaauuaaaaaacugaauugccugaccucguuaucacaugagcuuauauuuuggg

SEQ ID NO: 134025 - RNA, 64 nt, hsa
gcauacauaacugaagcaugugaaacaguaucauccucguuaguagaggaaaaccaaaacccuu

SEQ ID NO: 134026 - RNA, 64 nt, hsa
cuauccaccaccccacccaccuuugcagggaauaccucguuagagaauggccugagacagugcg

SEQ ID NO: 134027 - RNA, 64 nt, hsa
ucccacgcacaccugagcuuucggcaugcucccaccucguuaaaggugauuucccucuccccau

SEQ ID NO: 134028 - RNA, 64 nt, hsa
acguccuuggccagcuuaauggccuuccccucggccucguuaagcaucccugugacgcucucaa

SEQ ID NO: 134029 - RNA, 64 nt, hsa
cuggaacagcuuuuuguccuguacccaguguuacccucguuauuuuguaaccuuccaauuccug

SEQ ID NO: 134030 - RNA, 64 nt, hsa
acuguaaaaugguaaacguguguauuauaucuggccucguuauauaguguauauauauguauac

SEQ ID NO: 134031 - RNA, 64 nt, hsa
cuagagugguucuauuuggucuucaguguuuuagccucguuaguucauauuuggcaugcagcuu

SEQ ID NO: 134032 - RNA, 64 nt, hsa
cuccaagcgccuggagugcuuuuuagcagagacaccucguuaagcuccgggaugaccuuguagg

SEQ ID NO: 134033 - RNA, 64 nt, hsa
uguaccuuugggguauuauuuuguggcccgugacccucguuauuguuacagcugaguguauguu

SEQ ID NO: 134034 - RNA, 64 nt, hsa
ucuuucuguugaaaagcacacacaauaaagaaccccucguuagccuuccucugauuuacauuca

SEQ ID NO: 134035 - RNA, 64 nt, hsa
aaacccagccugaccgcuucugacgccgggauggccucguuacuagacuuuucuuuuuaaggaa

SEQ ID NO: 134036 - RNA, 64 nt, hsa
uaaucgcugccucuaggggagcugauuguagcagccucguuagugucacccccuccucccugau

SEQ ID NO: 134037 - RNA, 64 nt, hsa
uguguuuccaucagcucccuguccuccuuucuucccucguuauugaucuauagacauuaggaag

SEQ ID NO: 134038 - RNA, 64 nt, hsa
cugcacuccgugaccucugagaacccagcuggccccucguuagccccagggucugccgucuaga

SEQ ID NO: 134039 - RNA, 64 nt, hsa
aaggccagaaaaggcagccagauccccagggcagccucguuaggacaaggcugugccaggcugg

SEQ ID NO: 134040 - RNA, 64 nt, hsa
uuuccaaaaucaggcuuugucugcucccaauucaccucguuacucucaccucgugauauccaca

SEQ ID NO: 134041 - RNA, 64 nt, hsa
caguaagugaaguacagauagcaaaauuuuacuaccucguuaacccuuuucuuaaaauauucuc

SEQ ID NO: 134042 - RNA, 64 nt, hsa
uuaucccugcacacggcacagagcauccgucuccccucguuaacacauggcuuccuaaauggcc

SEQ ID NO: 134043 - RNA, 64 nt, hsa
uguguguugcaggggggcaguaacuccccaacucccucguuaaucacaggaucccacgaauuua

SEQ ID NO: 134044 - RNA, 64 nt, hsa
aucuguguagacgaagggggcaucuggccuuacaccucguuagggaagagaaacaggguguugu

SEQ ID NO: 134045 - RNA, 64 nt, hsa
cuuucaguuauguauauuuguuuuccuuguuuuuccucguuaccaauauuacaacagcauuguu

SEQ ID NO: 134046 - RNA, 64 nt, hsa
guaguuccuuuuuguuucauuuucuucugucucaccucguuagaaaauuccucccagucagggg

SEQ ID NO: 134047 - RNA, 64 nt, hsa
ucugauccaauguaauuggcugcgucuggcuaauucuaagcacuaaagucuacaucuaagcuau

SEQ ID NO: 134048 - RNA, 64 nt, hsa
acugcuggugaaccaauaccauaagcauguauuaucuaagcacuugaucaagaaauauacaugu

SEQ ID NO: 134049 - RNA, 64 nt, hsa
caggucggugagaggacaagagggacucccauguucuaagcaccuguuccuggccaggcucuag

SEQ ID NO: 134050 - RNA, 64 nt, hsa
gcaccuguuccuggccaggcucuaggccaggcucucuaagcacauuucuccuuucauucccccu

SEQ ID NO: 134051 - RNA, 64 nt, hsa
ggggcuuucggggagggcgccuaguccccccagcucuaagcagccaggagggaccugcaucuaa

SEQ ID NO: 134052 - RNA, 64 nt, hsa
ccccccagcucuaagcagccaggagggaccugcaucuaagcaucuggguugccauggcaauggc

SEQ ID NO: 134053 - RNA, 64 nt, hsa
ucaauuggacuccuuccagaaagguggccgugccucuaagcauguuuuucccaguaugcccuag

SEQ ID NO: 134054 - RNA, 64 nt, hsa
ucuuuucuccagguaguaggacaaugaaaauuguucuaagcaaaggaaagaaaacugacuuugu

SEQ ID NO: 134055 - RNA, 64 nt, hsa
aggagucuccugcugaugcgugauagcuuaagcuuggggagaaggucuuuuccacugccuagcu

SEQ ID NO: 134056 - RNA, 64 nt, hsa
gagaaggucuuuuccacugccuagcuaagcagucuggggagagcauggggaucauuucuaugug

SEQ ID NO: 134057 - RNA, 64 nt, hsa
aggucuucauggcagaccaggccuucacagcuaauggggagaggaacucauguuaccucugcag

SEQ ID NO: 134058 - RNA, 64 nt, hsa
cucgccuuuccugccccagccggcagaagcuguguggggagauaugaaugguacgggugaggag

SEQ ID NO: 134059 - RNA, 64 nt, hsa
ggguugggggagaggcugaggagagugugacauguggggagaggaccagcugggugcuugggca

SEQ ID NO: 134060 - RNA, 64 nt, hsa
acugagaacucccucuggaauucuugggggguguuggggagagacugugggccuggagauaaaa

SEQ ID NO: 134061 - RNA, 64 nt, hsa
gaauugaauugugcaauguugcuguucuggggacuggggagauuagcaucccauuugcccacac

SEQ ID NO: 134062 - RNA, 64 nt, hsa
aucuuuaccucugauagaggucagaaugagguccuggggagaaucuaagcccuccgaugugugu

SEQ ID NO: 134063 - RNA, 64 nt, hsa
cuucacccucaguuuccucacuugaggagugggauggggagaacagagaguagcuguguuugaa

SEQ ID NO: 134064 - RNA, 64 nt, hsa
agagcaauuuauacuuuacccucaggcuguccucuggggagaaggugccauggucuuagguguc

SEQ ID NO: 134065 - RNA, 64 nt, hsa
gccauggugagggcuaucugcugcaggggggucuuggggagaguggugacuccauugacccagc

SEQ ID NO: 134066 - RNA, 64 nt, hsa
uuccagagaguggcuggaagagacuccaggccccuggggagacuguacuguuccugaacacugg

SEQ ID NO: 134067 - RNA, 64 nt, hsa
gaugugcucccugaaacagacaaccacacgcuguuggggagagaaggauggagauaggauggag

SEQ ID NO: 134068 - RNA, 64 nt, hsa
ccacuguuuuccuugcuguuauuuuuccaagucuuggggagaaaacauccuccucugauggcca

SEQ ID NO: 134069 - RNA, 64 nt, hsa
ucugaaaagacaguugugugcauggaugugugcguggggagaaagaacguggguaagauguccc

SEQ ID NO: 134070 - RNA, 64 nt, hsa
uccagucccacuccugucaccccacgcucugcacuggggagaaaacgggaggugcucgugcugg

SEQ ID NO: 134071 - RNA, 64 nt, hsa
cucccuucccccuaagccaaccgcacugaaggaguggggagaagagcauacgccaggagccucc

SEQ ID NO: 134072 - RNA, 64 nt, hsa
ggcuagaaugcccgggcuggugcccaccaggggcuggggagaaggagggguggcaugaugagga

SEQ ID NO: 134073 - RNA, 64 nt, hsa
gucuucuuggcagcuuaacauugacuucuugguuuggggagaaauaaauuuuguuucagaauuu

SEQ ID NO: 134074 - RNA, 64 nt, hsa
uguaggaauccuuugagaaugugauuccuuuugauggggagaaagggcaaauuauuuuaauauu

SEQ ID NO: 134075 - RNA, 64 nt, hsa
guggacagccagaggggccacuucaggauggauguggggagaguggaagaggcagggaguaauc

SEQ ID NO: 134076 - RNA, 64 nt, hsa
ucuguauggaggcugcucaccccacagacacugguggggagaccauggcucagaggaagggugg

SEQ ID NO: 134077 - RNA, 64 nt, hsa
aacuaagccaggccuggcuggaggagcagcagcuuggggagagggauuucccugcagaccucaa

SEQ ID NO: 134078 - RNA, 64 nt, hsa
ucaccgcuggcccuuagagaccccgagguagggguggggagaugcuucucuccuugccccccgc

SEQ ID NO: 134079 - RNA, 64 nt, hsa
caugcagugugaguagaaggaagucaacaauauguggggagagcacucgguugucuuuacuuuu

SEQ ID NO: 134080 - RNA, 64 nt, hsa
agccuuucugaaucuauaauaaugguacuucuacuggggagaguguaauauuuuggacugcugu

SEQ ID NO: 134081 - RNA, 64 nt, hsa
agcuuucagagucuucacuggcaguagggggagauggggagaggaaugaucucugcccagcccc

SEQ ID NO: 134082 - RNA, 64 nt, hsa
aagagagaguggguuugggaagagugagggugguuggggagaggggaccgaugugccucauugu

SEQ ID NO: 134083 - RNA, 64 nt, hsa
uauuaaacaugggaaacugaagcccuugaagguuuggggagagggggguaucaggcagggaggg

SEQ ID NO: 134084 - RNA, 64 nt, hsa
ugccauugcccagggguagcccuucgguaugggcuggggagaaggguuggucuucugccagggu

SEQ ID NO: 134085 - RNA, 64 nt, hsa
ggccccccagccagggaucccagaggcugaggguuggggagaggaagccaucaucucauuaccu

SEQ ID NO: 134086 - RNA, 64 nt, hsa
gaaggcugggugcuucuugcucugacagccagucuggggagaugacucuuacguugcuugaguc

SEQ ID NO: 134087 - RNA, 64 nt, hsa
cucgccugcagagcagcccagaaagagcccugacuggggagagaacauuuuagaaucucuagug

SEQ ID NO: 134088 - RNA, 64 nt, hsa
agauguuuugaguuauuucccuuaaguguuucacuggggagagaacagggagugcuccuccagc

SEQ ID NO: 134089 - RNA, 64 nt, hsa
cucagaauguguggacaggucagcuuagaagagauggggagauucaggaucccccugugccaga

SEQ ID NO: 134090 - RNA, 64 nt, hsa
gaccuggacacuagggucaggcggggugcugugguggggagaggcauggcuggggugggggugg

SEQ ID NO: 134091 - RNA, 64 nt, hsa
gcugugguggggagaggcauggcugggguggggguggggagaccugguuggccgugguccagcu

SEQ ID NO: 134092 - RNA, 64 nt, hsa
uacagcccuauccccccuccuugcuucugugaaauggggagacaaagcacuuuugcucuccaaa

SEQ ID NO: 134093 - RNA, 64 nt, hsa
ucugaagcugaugcuuauuaaaacaaaugauguauggggagaggagaaggaagggcaaggaagg

SEQ ID NO: 134094 - RNA, 64 nt, hsa
cucugcugcuucccaaggauggcuguuuauaauuuggggagagauagggugggaggcagggcaa

SEQ ID NO: 134095 - RNA, 64 nt, hsa
ugcucuccuguugguguguaugucacuagggcaguggggagacgucuuaacucugcugcuuccc

SEQ ID NO: 134096 - RNA, 64 nt, hsa
ggagcccucaucuugaagggcccaggagggucuauggggagaggaacuccuuggccuagcccac

SEQ ID NO: 134097 - RNA, 64 nt, hsa
uuucucuuuguggggcuuggcguggagcaggcgguggggagagauggacaguucacacccugca

SEQ ID NO: 134098 - RNA, 64 nt, hsa
ccaaucccugccucugcccaucagauugccaauuuggggagacagcaauaucaucugggagauu

SEQ ID NO: 134099 - RNA, 64 nt, hsa
gagaaaccugccaugcucugggacgugugggcccuggggagaggagagaaagggcucccaccug

SEQ ID NO: 134100 - RNA, 64 nt, hsa
cuaacaagguguggagugucagcgaggugcaauguggggagaauacauuguagaauauaagguu

SEQ ID NO: 134101 - RNA, 64 nt, hsa
ugguggacgcagaccuugagaacaaccuaaauuauggggagaauuuuaaaauguuaaacuguaa

SEQ ID NO: 134102 - RNA, 64 nt, hsa
aaggagaaagagugagggcaaugaagggcgaugguggggagacucggugggugaauggggagac

SEQ ID NO: 134103 - RNA, 64 nt, hsa
ugaagggcgaugguggggagacucggugggugaauggggagaccagaaagaaagaguccacaga

SEQ ID NO: 134104 - RNA, 64 nt, hsa
uguacacuagcaggaugggucuugggaguuggcauggggagauuguaagggcuguaucuccgcg

SEQ ID NO: 134105 - RNA, 64 nt, hsa
ggagagaggagugaccgggacuggagccagggucuggggagagcaacagcaccaggcuuuuccu

SEQ ID NO: 134106 - RNA, 64 nt, hsa
caaccuuggccgacaugcagcauccacccccggcuggggagaggccccgcggucgcucaggggc

SEQ ID NO: 134107 - RNA, 64 nt, hsa
ggcuagcugcggugcuccuugcugguuuuuaacuuggggagaaacaccggguuucagcuuucuu

SEQ ID NO: 134108 - RNA, 64 nt, hsa
ugagccaccaugccuggccaggacauauuugaaauggggagauuuuaaaaauucugaugauuag

SEQ ID NO: 134109 - RNA, 64 nt, hsa
gugggcucagcuuuggcugugcauuggaaucaccuggggagauuuguaagcuucugcugucugg

SEQ ID NO: 134110 - RNA, 64 nt, hsa
uggaccugucacaugaaauggaucagcacuugaauggggagaaguggagggagaggcccugggc

SEQ ID NO: 134111 - RNA, 64 nt, hsa
uuguuugcacuauuggacuuaggagugccgaggguggggagauggagcugcccgucucagugug

SEQ ID NO: 134112 - RNA, 64 nt, hsa
cuucuguucucugcugagggccaauacccuacuguggggagagauggcacaccagaugcuuuug

SEQ ID NO: 134113 - RNA, 64 nt, hsa
uaaucacucugagucacaggugugggauggagaguggggagaggcacuuaaucuguaaccccca

SEQ ID NO: 134114 - RNA, 64 nt, hsa
cccagcccagcugcucugcccagagcugggugaguggggagacaccucagagccccgcaaaacc

SEQ ID NO: 134115 - RNA, 64 nt, hsa
uguccuuuccaguggccuggcuccgcuguguggauggggagaucggggccagaggcagaacccu

SEQ ID NO: 134116 - RNA, 64 nt, hsa
ggcccugccaccaaguugagagcuggaggggagguggggagagaacaucacagagcagccagcc

SEQ ID NO: 134117 - RNA, 64 nt, hsa
augccuguaaucccagcuacuuuggaggcugagguggggagaauugcuugaaccugggaggugg

SEQ ID NO: 134118 - RNA, 64 nt, hsa
aaaaauuggaugcguaaaguaauauuuacagauguggggagauguaauaaaacaauauuaacuu

SEQ ID NO: 134119 - RNA, 64 nt, hsa
gggagcugaggggaggaucuuacugaaagcacccuggggagauugauuguccuuaaaccuaagc

SEQ ID NO: 134120 - RNA, 64 nt, hsa
aagccauccccgaaagaggugaaagagaucacuuuggggagagcuggagaacaggauucuaggc

SEQ ID NO: 134121 - RNA, 64 nt, hsa
uuggcuggaguagaauuaagucagagccaacagguggggagagacagagaagugggcaggggca

SEQ ID NO: 134122 - RNA, 64 nt, hsa
ggcuuugugguuuuuagaguugcaucuaugaaccuggggagauuaugugcuuucccaagcguuc

SEQ ID NO: 134123 - RNA, 64 nt, hsa
aggacaacguucuaaaaguacaauuauuucuuauuggggagauuacagguaguuuggcaaagca

SEQ ID NO: 134124 - RNA, 64 nt, hsa
gcggguacuccagcuuguggcauucccaugugacuggggagaagacaaaauugguguuuagauu

SEQ ID NO: 134125 - RNA, 64 nt, hsa
acuaacaauucaacagugauguucuuugcauuuguggggagaugugugauguucuugguuuucu

SEQ ID NO: 134126 - RNA, 64 nt, hsa
cuggcucugucuacacuggccgagucucugggucugucuacacuggccgagucuccgacugucu

SEQ ID NO: 134127 - RNA, 64 nt, hsa
ggggccagcgucgccgggcugcccagccuggcucugucuacacuggccgagucucugggucugu

SEQ ID NO: 134128 - RNA, 64 nt, hsa
agcuggugacuauaaauaauauuuuaaaaugcugugucuacaccaucaagacugugucuacacu

SEQ ID NO: 134129 - RNA, 64 nt, hsa
auuuuaaaaugcugugucuacaccaucaagacugugucuacacuaucuuggcugaacgagaaga

SEQ ID NO: 134130 - RNA, 64 nt, hsa
uuacagaagccaggaaaaguguauuagaaacuguugucuacaccacuuuuaauuggugaacaau

SEQ ID NO: 134131 - RNA, 64 nt, hsa
aaacauuguaucuucucuguggaugcucaggccuugucuacaaugaggcuuuacaaccuuccuu

SEQ ID NO: 134132 - RNA, 64 nt, hsa
agguugcaaacugcucacuucuugcauuuucccaugucuacagcuagagaacucuuugggaucc

SEQ ID NO: 134133 - RNA, 64 nt, hsa
uuguuauaaagaugggagcaguguucuuuccagaugucuacaugcuaggcagaaacuagaaguc

SEQ ID NO: 134134 - RNA, 64 nt, hsa
uuaacuagcauguuaacugcacuuuucauuacgugaauggaacuuaccuaaccacagggcucag

SEQ ID NO: 134135 - RNA, 64 nt, hsa
guuuuauucauaaauuaaaugucuacaugugccagaauggaaaggaaacaaggggagacaacuu

SEQ ID NO: 134136 - RNA, 64 nt, hsa
uuaaaaguuagaagaaaugaguaccaacaggaaggaauggaagagaggagaggggcuaagacau

SEQ ID NO: 134137 - RNA, 64 nt, hsa
ucuaauguccagcugcuccaucgauauacucauagaauggaagugagcaaaggaaaauuuuaag

SEQ ID NO: 134138 - RNA, 64 nt, hsa
caucuuuaaagcuuuuacuaaaagauuuucagcugaauggaacucauuagcugugugcauauaa

SEQ ID NO: 134139 - RNA, 64 nt, hsa
uuuuucuuugaaaaccugggauugagagguugaugaauggaaauucuuucacuucauuauaugc

SEQ ID NO: 134140 - RNA, 64 nt, hsa
caguuguguggaaauguaugauccaacuagaaaugaauggaagaugaugggaaauaugacuuca

SEQ ID NO: 134141 - RNA, 64 nt, hsa
gaacuaaccguuguaaugcaggagugugugcucugaauggaaaguuauacaucguugguggcuc

SEQ ID NO: 134142 - RNA, 64 nt, hsa
ccuuucacucuuggcuuucuuauguugcuuucaugaauggaauggaaaaaagaugacucaguua

SEQ ID NO: 134143 - RNA, 64 nt, hsa
cacucuuggcuuucuuauguugcuuucaugaauggaauggaaaaaagaugacucaguuaaggca

SEQ ID NO: 134144 - RNA, 64 nt, hsa
aacagagcuccgucauguagccugcugaggaauggaauggaauggagaugcccacaggaggucc

SEQ ID NO: 134145 - RNA, 64 nt, hsa
uacugaacagagcuccgucauguagccugcugaggaauggaauggaauggagaugcccacagga

SEQ ID NO: 134146 - RNA, 64 nt, hsa
aaacaccugaccaccauuuaaggacucuaagccagaauggaaaauucaccaggacuccauucuu

SEQ ID NO: 134147 - RNA, 64 nt, hsa
aacaaaccuccuugggaauccacauuuuuugggggaauggaaaagcucugucucccuaacucaa

SEQ ID NO: 134148 - RNA, 64 nt, hsa
uauuugauuuuauucuugcagagggaauggaaaggaauggaaagauuuguuggcguaauuuuug

SEQ ID NO: 134149 - RNA, 64 nt, hsa
gccuaacaguuauuugauuuuauucuugcagagggaauggaaaggaauggaaagauuuguuggc

SEQ ID NO: 134150 - RNA, 64 nt, hsa
uauuuuaaauuuauauuugaacacagucaaaucugaauggaaauacauuuaaauaagcauuucu

SEQ ID NO: 134151 - RNA, 64 nt, hsa
uguuuuggaaugucccccacuuggagaguuugaggaauggaaaugagaaucggaggagaaauaa

SEQ ID NO: 134152 - RNA, 64 nt, hsa
caauuuuuuaaacuaacaaaauggaauguuaacugaauggaauuaaacauagcaauugucaagc

SEQ ID NO: 134153 - RNA, 64 nt, hsa
ugcaggacuguuacucacuacuaaacucuaccaagaauggaaacaaagaauauuuucugaagau

SEQ ID NO: 134154 - RNA, 64 nt, hsa
cucuguaggguacuguaauuugucaaaaugcagagaauggaaaacagugaacggaaaacacaga

SEQ ID NO: 134155 - RNA, 64 nt, hsa
acauuugaguaaccaucaacacaauuaguuuacagaauggaaaaggagucugagaucuguacug

SEQ ID NO: 134156 - RNA, 64 nt, hsa
ugucaauuuuuucaggaccuuaguuccagcagcagaauggaaaaauccuugaagcccaggcuga

SEQ ID NO: 134157 - RNA, 64 nt, hsa
uggaauguacaguauuuugcuagugcauuucaaggaauggaaucuucuccaguaugaaauuacc

SEQ ID NO: 134158 - RNA, 64 nt, hsa
uuguaugggagaagauacuguggcaaccaggaaggaauggaaaaaaaauucuuuucucuacagc

SEQ ID NO: 134159 - RNA, 64 nt, hsa
uucagacugaaauguuugugucuucaacuuauuagaauggaagauaaugcagauauuucugugg

SEQ ID NO: 134160 - RNA, 64 nt, hsa
uguaucuucuccccagugacagaaguagagaagagaauggaaagcagcacacuccguccccucu

SEQ ID NO: 134161 - RNA, 64 nt, hsa
aaaaaaaugugacagaauguuccauagucugagagaauggaaucguugagcauuuaguacaagu

SEQ ID NO: 134162 - RNA, 64 nt, hsa
aaaauucaccuuacagugcuaagaaagugcauuagaauggaauugcccuuuccuuaaggagaca

SEQ ID NO: 134163 - RNA, 64 nt, hsa
agggcacaagauggucugugaucuuugcacagaugaauggaaguugaugcacaccaacaagagg

SEQ ID NO: 134164 - RNA, 62 nt, hsa
aacagauaauucugaaauaaucagcagaaacggaauggaaugccaagaaucugcauugagaa

SEQ ID NO: 134165 - RNA, 64 nt, hsa
uaaaaccgauaccuguccugcaggucuaaaauuugaauggaaauucaagcacaaguacugggga

SEQ ID NO: 134166 - RNA, 64 nt, hsa
guuacuuugacauaggaauugacuucuuuuccuugaauggaaaacacuuugaaauaauaauaaa

SEQ ID NO: 134167 - RNA, 64 nt, hsa
gauauuugucauauauuuaagaaaaagcuaaaaagaauggaaaucgcaugacuauaacuuaagu

SEQ ID NO: 134168 - RNA, 64 nt, hsa
gauauuugucguauauugaagaaaaagcuaaaaagaauggaaaucgcaugacuauaacuuaagu

SEQ ID NO: 134169 - RNA, 64 nt, hsa; identical to SEQ ID NO: 134166

SEQ ID NO: 134170 - RNA, 64 nt, hsa
auguaaaagaagagauacuuaacaauaauugggagaauggaauauugacaauauuagauaauau

SEQ ID NO: 134171 - RNA, 64 nt, hsa
caagagccaacucccaguuuagagaaaauucaaggaauggaagaguaaauuacaugacacaaaa

SEQ ID NO: 134172 - RNA, 64 nt, hsa
ggaaauuauuuugugucucaggugucagucuuaggaauggaaguuuaauaacaaaugggccaaa

SEQ ID NO: 134173 - RNA, 64 nt, hsa
acaaaaaggaggugccccccugugcugucacugugaauggaaaggaugggucaccucucuucau

SEQ ID NO: 134174 - RNA, 64 nt, hsa
uaaagacccgccccccgguuggauguccuuccaagaauggaauccuucccuggugauggucucu

SEQ ID NO: 134175 - RNA, 64 nt, hsa
gaauaagggaggagaggggacuggagaguguggggaauggaaagaagcaguuuacucuagacua

SEQ ID NO: 134176 - RNA, 64 nt, hsa
uguggagaugagaaggugguggacacucgugauggaauggaaaucguccuaccgugcagccaca

SEQ ID NO: 134177 - RNA, 64 nt, hsa
cggagcgggggugaggggggcagugugcucgugggaauggaaaggacagcaagcacaggugagu

SEQ ID NO: 134178 - RNA, 64 nt, hsa
cugccuggugaaguuucaaguguucagcagaccucucugguaacauaucuggaauauuguuguu

SEQ ID NO: 134179 - RNA, 64 nt, hsa
aaggguuggucuucuguauccucugcuguugagccucugguaagcuuucaucucccaugaacuc

SEQ ID NO: 134180 - RNA, 64 nt, hsa
ccuuggggcuggcccauagcagugccugccgugccucugguacaucuguagccaauucccauau

SEQ ID NO: 134181 - RNA, 64 nt, hsa
ccagcccagcccacgccgagcugggcagcgucugcucugguaggacugucagacgcacacgcgc

SEQ ID NO: 134182 - RNA, 64 nt, hsa
aaaaacaauuuguauucaauauugucacauuucucucugguagaaaaaucaaauaccuuagaga

SEQ ID NO: 134183 - RNA, 64 nt, hsa
guugauuuuuaauauauuugauuggaaaagaacucucugguauuauuaagacucacacagaauc

SEQ ID NO: 134184 - RNA, 64 nt, hsa
agaacuuaaugaaccugaacccaggcuucucuagcucugguaacgugugauuguuuucacuaca

SEQ ID NO: 134185 - RNA, 64 nt, hsa
agguagcuaccauggcuuguuucaaggaaggaaacucugguacgguggcacccucaggagugga

SEQ ID NO: 134186 - RNA, 64 nt, hsa
auucugugcccuuaaugcuuaacuggucuucuuccucugguaucaguguccucuuuguuuuugu

SEQ ID NO: 134187 - RNA, 64 nt, hsa
auggaggccaauuacauggcggguguauugacaacucugguauuuguuucaggaagcucuucua

SEQ ID NO: 134188 - RNA, 64 nt, hsa
agauuuuaagcauuuuguaaauguauaaacucaccucugguaacaguggcccagacgcugcuuu

SEQ ID NO: 134189 - RNA, 64 nt, hsa
ugccauuugccagccuaaugcgcaugcuuucugccucugguaacaggagugagugagccccuca

SEQ ID NO: 134190 - RNA, 64 nt, hsa
aaaugacagcuucacagccccuugaggagugaccaagccacaaaguaaauccuaaagccacaac

SEQ ID NO: 134191 - RNA, 64 nt, hsa
cuugaggagugaccaagccacaaaguaaauccuaaagccacaaccccuucuaccacugagcugc

SEQ ID NO: 134192 - RNA, 64 nt, hsa
aaguagucuuaaaaucaaaguauccaauauuuuaaagccacaaaguagauuacauaauuagcag

SEQ ID NO: 134193 - RNA, 64 nt, hsa
cuagauaaauguguguugaaugaaugugccuaugaagccacaaagaugccacauguuaguauau

SEQ ID NO: 134194 - RNA, 64 nt, hsa
cucugggcaaguggauauuuauuaggcuauuucaaagccacagcauaagaaugucagccuagcc

SEQ ID NO: 134195 - RNA, 64 nt, hsa
auagaagcugccaaggcuuggggcuuccacucugaagccacagcccgagcuguauguuggcccc

SEQ ID NO: 134196 - RNA, 64 nt, hsa
acgaaagccacagaguugaaagccacagaguugaaagccacagaguuaagugaccucagguaac

SEQ ID NO: 134197 - RNA, 64 nt, hsa
auaccgccaucuuacacgaaagccacagaguugaaagccacagaguugaaagccacagaguuaa

SEQ ID NO: 134198 - RNA, 64 nt, hsa
gguguccauggcccuauaccgccaucuuacacgaaagccacagaguugaaagccacagaguuga

SEQ ID NO: 134199 - RNA, 64 nt, hsa
aaggagaagaggccaugcacuuuccaaaaggucaaagccacauagaauaggaaggcaaucucua

SEQ ID NO: 134200 - RNA, 64 nt, hsa
caauuacuuuuagcuguaacauccgauucuguauaagccacauagaaaaaaguugccuuucuuu

SEQ ID NO: 134201 - RNA, 64 nt, hsa
uuagaccccccaccuguguuccucaaucacacugaagccacagcugggcccaccgaggugcuau

SEQ ID NO: 134202 - RNA, 64 nt, hsa
gcccuucaguuuggucugcuccgccuggggcagaaagccacaaacuccauccagauccggaacg

SEQ ID NO: 134203 - RNA, 64 nt, hsa
acacuaccagucauucccaucgcuuugcaaucacaagccacaggaugagaaguucugacucacu

SEQ ID NO: 134204 - RNA, 64 nt, hsa
uuaauaacugaaggccagagagauuaauuugccaaagccacaccuuuaugcuaauuaugauugg

SEQ ID NO: 134205 - RNA, 64 nt, hsa
caacuucugucccauuuuucagagcuaaagugacaagccacauccacgucccugguuaaaggug

SEQ ID NO: 134206 - RNA, 64 nt, hsa
accucaggcucagagagguuaugugguuuucucaaagccacacagcaagauuuggcaggugagc

SEQ ID NO: 134207 - RNA, 64 nt, hsa
uucuacaauaguguggaaagccacaucacaaaaaaagccacaucacaaaaaaaagccagugccu

SEQ ID NO: 134208 - RNA, 64 nt, hsa
uaaaugggauucuggacuucuacaauaguguggaaagccacaucacaaaaaaagccacaucaca

SEQ ID NO: 134209 - RNA, 64 nt, hsa
acacacaugcuuaccuaaugcaucacugugacaaaagccacacgcauuaucaguaacuuugcuu

SEQ ID NO: 134210 - RNA, 64 nt, hsa
guucaaauggaugacugaucuccugaguacacugaagccacaggcugguggccauguucucuga

SEQ ID NO: 134211 - RNA, 64 nt, hsa
ccuaaaaauccagacucuuucgauacccaggaccaagccacagcagguccuccaucccaacagc

SEQ ID NO: 134212 - RNA, 64 nt, hsa
aguucauccaggcccaacugugagcaaggagcacaagccacaagucuuccagaggaugcuugau

SEQ ID NO: 134213 - RNA, 64 nt, hsa
guguucacacuucuucaguaaugucugaacuugaaagccacagaguggcauaaaacaaugugug

SEQ ID NO: 134214 - RNA, 64 nt, hsa
auauauaggauauuggacucugcuuagcauuuucaagccacauagcaugacuguuuuuugaaua

SEQ ID NO: 134215 - RNA, 64 nt, hsa
guuuccaaauuuagagcuucugcauacagucuuaaagccacagaggcuuguaaaaauauagguu

SEQ ID NO: 134216 - RNA, 64 nt, hsa
uugguuuuguuuuuuuggaaaugagugggccacuaagccacacuuucccuucauccugcuuaau

SEQ ID NO: 134217 - RNA, 64 nt, hsa
acacucuugacccuacacugaaggcugaaggcagaagccacaagaggccuugagugccaccccc

SEQ ID NO: 134218 - RNA, 64 nt, hsa
acccagaugguggaggaugugaagggauugcaccaagccacauucacucucucuguggccuuuc

SEQ ID NO: 134219 - RNA, 64 nt, hsa
gugauggacucugugacauggucagguugagcugaagccacaguuucucugugcuguguuuucu

SEQ ID NO: 134220 - RNA, 64 nt, hsa
gggacugcucaauuucuaaugugaucuauucaagaagccacauauaaaaaggcauugagggcuc

SEQ ID NO: 134221 - RNA, 64 nt, hsa
guuuucuuucuuuaaaaaaaaaaaauuccaacagaagccacaggccggagccccugggagcccu

SEQ ID NO: 134222 - RNA, 64 nt, hsa
ccacggacgacgcgagggccccacgucccugcggaagccacagggugagcacucugggguggga

SEQ ID NO: 134223 - RNA, 64 nt, hsa
ugagaaaaagaaaagaaagcaagaacagaaaacgaagccacaggaagggaaguagacauuguau

SEQ ID NO: 134224 - RNA, 64 nt, hsa
cauacaccagguucuuucuacaauccugguggaaaagccacagaaccuucuuccugcccuucuu

SEQ ID NO: 134225 - RNA, 64 nt, hsa
ugcugaguauucugucacagacaagccuccauuaaagccacagcagugcuacccaccacacaca

SEQ ID NO: 134226 - RNA, 64 nt, hsa
auuccaggaccccuuucuuguuguggcugccaugaagccacagcuccuuggggaagugaccugc

SEQ ID NO: 134227 - RNA, 64 nt, hsa
agaggaagcaggccgagagacuugcaccuuggccaagccacacaaucaguggggcagccagagc

SEQ ID NO: 134228 - RNA, 64 nt, hsa
agcagggccugguguggaaccagggagcugugggaagccacagcagaaauggaagaaaaacagg

SEQ ID NO: 134229 - RNA, 62 nt, hsa
gcacugcuaaaaugauucacagggagaguggccaguuggaagaaggauccuaaggaugugac

SEQ ID NO: 134230 - RNA, 62 nt, hsa
ggccgugaagauuuucauccucaucccacucucaguuggauuuucuggcacucuuccugcau

SEQ ID NO: 134231 - RNA, 62 nt, hsa
ccauugauacaaggcugcugaggccuggucuccaguuggaaauauaauuaaggguggcaagg

SEQ ID NO: 134232 - RNA, 62 nt, hsa
gaaauauaauuaaggguggcaaggacuggagucaguuggagagugcauagccagucugugaa

SEQ ID NO: 134233 - RNA, 62 nt, hsa
aagacauuuaggagaaccugcuguaucuaacccaguuggauuuucuuucaugcuuaacacag

SEQ ID NO: 134234 - RNA, 62 nt, hsa
guguacaagucauuuugugauaugauucugaacaguuggaauagaaucauaguuaaguggua

SEQ ID NO: 134235 - RNA, 62 nt, hsa
cuaucaaagcacauaaaaccaguuauaggacacaguuggaagcagagccagucuuccuccuc

SEQ ID NO: 134236 - RNA, 62 nt, hsa
auuauuauuugaauggaugcugcuggaggaaucaguuggaauugaagacacguucuugccag

SEQ ID NO: 134237 - RNA, 62 nt, hsa
uggagaaguuaucaacugguguuuucagaccucaguuggaugaacccauuccacuguaugag

SEQ ID NO: 134238 - RNA, 62 nt, hsa
gaggccacuggguaacaacagaagaaaaccuucaguuggauccuccagauagccacugccuu

SEQ ID NO: 134239 - RNA, 62 nt, hsa
uggacagcuaaaaugugauuauuuuccaagcucaguuggaccuccagacccaucacugacca

SEQ ID NO: 134240 - RNA, 62 nt, hsa
aacaccuuggggggugaagcugucaaugccaccaguuggaccuccauacauucugagcuaac

SEQ ID NO: 134241 - RNA, 62 nt, hsa
ccuuauuuccagagaaccagacguuuguuucccaguuggaaagaagacaguugagcacuuca

SEQ ID NO: 134242 - RNA, 64 nt, hsa
cuguggcugucuggaaagcccccccuuauaguuugggcuucagccuaguggcuuguccucacca

SEQ ID NO: 134243 - RNA, 64 nt, hsa
gagugauauggagcaagagauauuuugggcaugugggcuucaacuccucgacaucacuguucau

SEQ ID NO: 134244 - RNA, 64 nt, hsa
agccaggagggcguucuuaggcugcugggauggugggcuucagggcagguggggugagaauugg

SEQ ID NO: 134245 - RNA, 64 nt, hsa
ugccaccaugcccagcugauuuuuuguagagacagggcuucaccauguugccaagcuagucuac

SEQ ID NO: 134246 - RNA, 52 nt, hsa
augcgcugaaagacgaguaaaggggcuucacaaguuaaaagacuggggucuu

SEQ ID NO: 134247 - RNA, 64 nt, hsa
uaauaauaauaaaaccaugucuauagcuguagaugggcuucacaucuguaaagcaaucaauugu

SEQ ID NO: 134248 - RNA, 64 nt, hsa
uacauuguuuucacuguaucacauuaaaguacuugggcuucagaaguaagagccaaccaacuga

SEQ ID NO: 134249 - RNA, 64 nt, hsa
uuggcucgucauuuccucuuaaaaaggaggagcugggcuucagcucuaagaacuucauugcccu

SEQ ID NO: 134250 - RNA, 64 nt, hsa
guuccccugagagggugcuaagaggaaggaugaagggcuucaggcugggggcaguggacaggga

SEQ ID NO: 134251 - RNA, 64 nt, hsa
gagaccaugaguggggcuggcaucuugccagccugggcuucagggauguuuggggggggugguu

SEQ ID NO: 134252 - RNA, 64 nt, hsa
cauccuaggugcucuccaggcugugucauuggcagggcuucacaugcaggaggccucucucagg

SEQ ID NO: 134253 - RNA, 64 nt, hsa
cuucaucucuagcugcagaaacacuaagucucaagggcuucagccccaugcuggucccuuggug

SEQ ID NO: 134254 - RNA, 64 nt, hsa
uaauugucuugcucucuaugggaaaaaaacaaaagggcuucagucucauggauguuauuuggug

SEQ ID NO: 134255 - RNA, 64 nt, hsa
aaugucauuuuuuuuuuaauaaguccuaggagcugggcuucauuccuccagcgggaguccaguc

SEQ ID NO: 134256 - RNA, 64 nt, hsa
auggcucacguagcugaaaaggaugggcuagauugggcuucaggcugcaucccaggacuccaaa

SEQ ID NO: 134257 - RNA, 64 nt, hsa
cagcucugcuuucauuugaguuggcuuuauucuugggcuucacaguguggccccacagcaccag

SEQ ID NO: 134258 - RNA, 64 nt, hsa
uucgcgugagaaguccccuuccaucccagagggugggcuucagggcgcacagcaugagaggcuc

SEQ ID NO: 134259 - RNA, 64 nt, hsa
uccagugaauuagugucaugucagcaucagcucagggcuucaucguggggcucucaguuccgau

SEQ ID NO: 134260 - RNA, 64 nt, hsa
gccagccuguggauccaagagacaguccccaccugggcuucacggcauccuugcagccaccucu

SEQ ID NO: 134261 - RNA, 64 nt, hsa
gcaucugugucauggccaucgcccggcggucagugggcuucagaugggccugugcauccuggcc

SEQ ID NO: 134262 - RNA, 64 nt, hsa
uucccaaacaguuguccaacaguuagacauugaggggcuucacuguuaccaggcauguaacaga

SEQ ID NO: 134263 - RNA, 64 nt, hsa
ugcccuugaguuggucuccccggcugcucugcgggggcuucacuggcuucggagugagcgcgaa

SEQ ID NO: 134264 - RNA, 64 nt, hsa
uaaacaagccugauuuaggcacugcuuuauccaggggcuucacccaugaaauuaauaaaacuua

SEQ ID NO: 134265 - RNA, 64 nt, hsa
ugcccggcuaauguuuguauuuuuaguagagacggggcuucaccaucuuggccaggcuggucuu

SEQ ID NO: 134266 - RNA, 64 nt, hsa
gcaauaaccuugccuuugcuaagacccccuccgagggcuucaggggggccugccaagggggggc

SEQ ID NO: 134267 - RNA, 64 nt, hsa
ggcuguguggccugggaauaccauguggaagguugggcuucaaguuaacaggaucagacaccag

SEQ ID NO: 134268 - RNA, 64 nt, hsa
agucugaagcaggcgccagggccucugguguacggggcuucagccugcuugcuugugguggcug

SEQ ID NO: 134269 - RNA, 64 nt, hsa
gcuucagccugcuugcuugugguggcugucuguggggcuucagccugacuguccgugguggcug

SEQ ID NO: 134270 - RNA, 64 nt, hsa
ccccuccuccaaacacacacagaaugggcugguuucuuucaaguuuaaaaaaagcccccuucuc

SEQ ID NO: 134271 - RNA, 64 nt, hsa
cugacagcugccuuugaaacccaaagccucggguucuuucaagcuacauguacuaaauugucga

SEQ ID NO: 134272 - RNA, 64 nt, hsa
acuucuaacggcugauugguauggaccgagauuaucuuucaauugaagugacuaaucgagaugu

SEQ ID NO: 134273 - RNA, 64 nt, hsa
agugcaagagcagaagagccccaagcagacuaugucuuucaagauguacagaagacugacaaca

SEQ ID NO: 134274 - RNA, 64 nt, hsa
uuuguagcagcuucaagugaccaaaagacuaaaaucuuucaacgucaaugccaaaagccaaggg

SEQ ID NO: 134275 - RNA, 64 nt, hsa
guuuuacuuguauaugauguagucaccuuaacuaucuuucaauuccauacuucccccgccccca

SEQ ID NO: 134276 - RNA, 64 nt, hsa
caguugugugcaaaggcaaggcuugcuuuuccugucuuucaacccuaucuugcuuuuccugucu

SEQ ID NO: 134277 - RNA, 64 nt, hsa
uuuccugucuuucaacccuaucuugcuuuuccugucuuucaacccuaucuugcuuucauugucu

SEQ ID NO: 134278 - RNA, 64 nt, hsa
uguaaggagcuaaagcugaaaauuaaauuuuagaucuuucaauacucuuaaauuuuauauguaa

SEQ ID NO: 134279 - RNA, 64 nt, hsa
augaguuuuaagaaggugcuuagcuguauauuuaucuuucaaaauguauuagaagauuuuagaa

SEQ ID NO: 134280 - RNA, 64 nt, hsa
aucacuggaaauucauuuuccuuacucgauguuuucuuucaacugagaagccuaaaacaaacaa

SEQ ID NO: 134281 - RNA, 64 nt, hsa
auuucucuaugauggucauucaagguaguaggucucuuucaacugagugcaacauugagaauaa

SEQ ID NO: 134282 - RNA, 64 nt, hsa
ucaguagauaagguguauuuuucccuaucugguuucuuucaauacuuuuucuuuguuugauuuu

SEQ ID NO: 134283 - RNA, 64 nt, hsa
uuuuccuucccuccagagaacuucuuuuaaugcuucuuucaaggcaugucuacuggcaacuaau

SEQ ID NO: 134284 - RNA, 64 nt, hsa
caaaauauuaaaauauaagugaggaucuucaacaucuuucaaaaaugcauuuauauagucuuac

SEQ ID NO: 134285 - RNA, 64 nt, hsa
aauuaagaauuuuuuaucuuaggcaaagugugucucuuucaauucauuaacuuauuaauuuuau

SEQ ID NO: 134286 - RNA, 64 nt, hsa
ugguuuaaauaggcugguccuacauguauuagguucuuucaaguuugacugggaggucaccuuu

SEQ ID NO: 134287 - RNA, 64 nt, hsa
ccaaacucuggugaacuguuggacuggguagaaaucuuucaagaagcuugaaaauaaggccaua

SEQ ID NO: 134288 - RNA, 64 nt, hsa
uccuuucaaaucauguucuuauaccuaauuuuagucuuucaaaugaauguacuguaaugcuugu

SEQ ID NO: 134289 - RNA, 64 nt, hsa
ugaacuauuuuuaucacaguauuauuuauugcuuucuuucaauaaaguacugaagcauuuucca

SEQ ID NO: 134290 - RNA, 64 nt, hsa
ccccuggucuaccgcguugauguguauacacugaucuuucaagucugggagacagauaaggagg

SEQ ID NO: 134291 - RNA, 64 nt, hsa
accaagaugaagccacugguuccugccuucaaguucuuucaaguuuuuauuuuaaagaaaacuc

SEQ ID NO: 134292 - RNA, 64 nt, hsa
guacaggcugugcauuuuaagauacuaguuucagucuuucaaagccagccaggcuacacacaga

SEQ ID NO: 134293 - RNA, 64 nt, hsa
gauuauaauuaagguucauuuuaguuuuuuuuuuucuuucaaccagugugccaucuccaauauu

SEQ ID NO: 134294 - RNA, 64 nt, hsa
gugauaaaucauaauacuagacaaaauugucuucucuuucaaaccagagccauauauaugucug

SEQ ID NO: 134295 - RNA, 64 nt, hsa
uagugcacgucguggguauuaggaaagccuguauucuuucaaugaaugucaguaggaccuuccu

SEQ ID NO: 134296 - RNA, 64 nt, hsa
auaugagguccuaaugaaguacuacaguuuucauucuuucaaggguagacuaaaauauaguuua

SEQ ID NO: 134297 - RNA, 64 nt, hsa
auacuguacuucauuuaacagaaugauugauuuuucuuucaaucagcauguucaccaaaaauag

SEQ ID NO: 134298 - RNA, 64 nt, hsa
agucaacauuuuauauaauguuucaauaaauguuucuuucaauaaagauacuaugugcccuuca

SEQ ID NO: 134299 - RNA, 64 nt, hsa
cuguuauaaauuaaggucuuaauaccuuuucugcucuuucaaauaacucuaaugaauauucaag

SEQ ID NO: 134300 - RNA, 64 nt, hsa
cgagauaauuacauaauucagauaccuuuaaucaucuuucaagaaagaggcuccucccauucaa

SEQ ID NO: 134301 - RNA, 64 nt, hsa
gggaagauacaacuuacacaguggggccuauuguucuuucaagaacccuuuuuuuagcuuauag

SEQ ID NO: 134302 - RNA, 64 nt, hsa
gcccagguaauuuuuuguuucauggacuauggacucuuucaaagggaucugauccuuuugaauu

SEQ ID NO: 134303 - RNA, 64 nt, hsa
uacugcugaauguuuuccagagcauauauuacaaucuuucaaagucgcacacuagacuucagug

SEQ ID NO: 134304 - RNA, 64 nt, hsa
uuuuuuuuucagaauaaacaacuaaauaacuguauuagaaaaaaaagaaacuuacuaaauauca

SEQ ID NO: 134305 - RNA, 64 nt, hsa
acauuuacuguuucuguuauaauaaaaggguauguuagaaaaacaaaaaggaggcugggcaugg

SEQ ID NO: 134306 - RNA, 64 nt, hsa
uucucacaucagaguucucuggcccuagaaaggcuuagaaaaggcguaagggaacucauaaagg

SEQ ID NO: 134307 - RNA, 64 nt, hsa
caaaaaaaaaacaaaacaguuuuuaaaacugauuuuagaaaaagaagcuuaaucuaacguuuuc

SEQ ID NO: 134308 - RNA, 64 nt, hsa
uacagauaaaauacauucuuuuaauucugggaaauuagaaaaaguggggugaucuuuccaggaa

SEQ ID NO: 134309 - RNA, 64 nt, hsa
auuucuuugaacacuucugaaaguuuuuggaaacuuagaaaagagggaaaaaaauccaguguua

SEQ ID NO: 134310 - RNA, 64 nt, hsa
uaaugacauuuaucuucaaaacaccaaauugucuuuagaaaaauuaaugugauuacagguagag

SEQ ID NO: 134311 - RNA, 64 nt, hsa
gaaauuuauuucuuauuuccuaacauugaauucguuagaaaaaacagcgucaccucacucuuca

SEQ ID NO: 134312 - RNA, 64 nt, hsa
gucauguugauuuuccuuaugaacccgaagccauuuagaaaaucccugugugucaaaauuacau

SEQ ID NO: 134313 - RNA, 64 nt, hsa
ugaaagcauacuguugaaacccgcaguguugcauuuagaaaacaguugaacagaaugucaaugu

SEQ ID NO: 134314 - RNA, 64 nt, hsa
auucaugcaaaaaaacauuuaaucugcaucuguuuuagaaaagggggaaaugaagcaacuuguc

SEQ ID NO: 134315 - RNA, 64 nt, hsa
aaagccuauuccaucaacugugaaagcuggggaauuagaaaaaauaauaagucgcugucaggug

SEQ ID NO: 134316 - RNA, 64 nt, hsa
uaugccuagggaaacucagggcuucuaguuucucuuagaaaagcuaagagaagauaaggucuga

SEQ ID NO: 134317 - RNA, 64 nt, hsa
uguuaacuucacuucuuuguauauuauguauaaauuagaaaaugaaaaaugugugaauaacauu

SEQ ID NO: 134318 - RNA, 64 nt, hsa
gcccucuguuggcacaggcauuaucucugcaauuuuagaaaaugacaaguagagaauacuacau

SEQ ID NO: 134319 - RNA, 64 nt, hsa
gagauauucauaauucugcaauacuuuaaaacauuuagaaaacaccccaggguaggucuguggc

SEQ ID NO: 134320 - RNA, 64 nt, hsa
uggaagacgucaaacaagcugaaugaaggggcgcuuagaaaacguuaauagaaguucuaagcgg

SEQ ID NO: 134321 - RNA, 64 nt, hsa
gacugcuugugucuuuuuaugaccuguuugccuuuuagaaaauugguaaauaaagcaaguauau

SEQ ID NO: 134322 - RNA, 64 nt, hsa
aauggacacauaugcucauguugcuuuuuuuguuuuagaaaaaaaaacaacauaguuuucugaa

SEQ ID NO: 134323 - RNA, 64 nt, hsa
aaacuuccauuuuuaaaaauuuagaguuuagucauuagaaaaaauaauggacuggaaaguuaua

SEQ ID NO: 134324 - RNA, 64 nt, hsa
ucuacuuuuaguaggcuaaucaacaaugaaaggguuagaaaauugcuguggaacauccagguga

SEQ ID NO: 134325 - RNA, 64 nt, hsa
uucauugccuaaguucauuucaaagaauuuguauuuagaaaagguuuauauuauuagugaaaac

SEQ ID NO: 134326 - RNA, 64 nt, hsa
uuuugcaucuuuuuucaaaguuuaaugugaacuuuuagaaaagugauuaauguugcccuaauac

SEQ ID NO: 134327 - RNA, 64 nt, hsa
cuuuauauguuuuuaauggauuuuuuuuuaaguauuagaaaaugacacauaacacgggcagcug

SEQ ID NO: 134328 - RNA, 64 nt, hsa
ucggaugagagguuggaaauguagcugcuuuucuuuagaaaauauguagcugucaucauuuggu

SEQ ID NO: 134329 - RNA, 64 nt, hsa
uacaugguucuuaacuauucaaauauuuauucuguuagaaaaaaaaauuuucuguuuugcaaua

SEQ ID NO: 134330 - RNA, 64 nt, hsa
acaguuuuauuaugacacuagauacaguaaauuuuuagaaaaaaauaccauuuacaguauuauu

SEQ ID NO: 134331 - RNA, 64 nt, hsa
uagucuuuugccagagaaacugagguaacugucauuagaaaagguuucuuaaaauacucacaaa

SEQ ID NO: 134332 - RNA, 64 nt, hsa
guuggguuuuuuucuuauuguuuucuccccaggguuagaaaaauugguauaaguuccuaauuaa

SEQ ID NO: 134333 - RNA, 64 nt, hsa
ugcuaaagguucugggaagcuaauaauugaauuauuagaaaaacauuucagaauaggaaguaaa

SEQ ID NO: 134334 - RNA, 64 nt, hsa
guaucuucguaacuucauauuaauauaaguuucuuuagaaaacccaaguuuuuaaucguuuuug

SEQ ID NO: 134335 - RNA, 64 nt, hsa
uuuuccuguguauuaaaccuuuccauuuuacguuuuagaaaauuuuauguauuuuaaaauaagg

SEQ ID NO: 134336 - RNA, 64 nt, hsa
auuggaaauauucccaucaaaugguuaaucuuauuuagaaaaugggcauauuagaaaaaguccu

SEQ ID NO: 134337 - RNA, 64 nt, hsa
ucaaaugguuaaucuuauuuagaaaaugggcauauuagaaaaaguccuuccaagaugauuuugg

SEQ ID NO: 134338 - RNA, 64 nt, hsa
uuuaaaagaggucuuucuccccgaaauacaaguuuuagaaaaucuuagaagaggggugggugca

SEQ ID NO: 134339 - RNA, 64 nt, hsa
ggugcaauaaaguuccuuucuaaccauuucugguuuagaaaacauucagccauccuagaaacua

SEQ ID NO: 134340 - RNA, 64 nt, hsa
gaaagaggcagaaacagguaagggggauaguaucuuagaaaaccuguugguuaaggcagcugca

SEQ ID NO: 134341 - RNA, 64 nt, hsa
caugcuuguguuuauuuuuguugguaguauaugauuagaaaaacuagauaauucccauaagaug

SEQ ID NO: 134342 - RNA, 64 nt, hsa
uacuuuagggagcagccacacauacaggaagcucuuagaaaagaacuuuuuuuuuuuuuugaga

SEQ ID NO: 134343 - RNA, 64 nt, hsa
guugucuauacucaacuggauauguguauguaaauuagaaaauacauaccuauccagacauaaa

SEQ ID NO: 134344 - RNA, 64 nt, hsa
ugauauaucaugguaaaauugauuucucacuagcuuagaaaaugucagacuuuuguuuuugggg

SEQ ID NO: 134345 - RNA, 64 nt, hsa
agagaacaaauuaaaauugaaaaauugauuucacuuagaaaaacuucuaggaacagggugaacc

SEQ ID NO: 134346 - RNA, 64 nt, hsa
auuuuuuuucucucuugaacaaaacugagauaauuuagaaaacaggugcuuaauugcaauaaaa

SEQ ID NO: 134347 - RNA, 64 nt, hsa
uggaggugguacucaacagccuuauucaugaggcuuagaaaacacaaagacauuagaauaccua

SEQ ID NO: 134348 - RNA, 64 nt, hsa
cuguaaacaggcuuuagucauuaaugugagagacuuagaaaaaaugcuuagaguggacuauuaa

SEQ ID NO: 134349 - RNA, 64 nt, hsa
uguguucuuuugcauguaaacugccauuuauauuuuagaaaacuauuguauagaauggauuuag

SEQ ID NO: 134350 - RNA, 64 nt, hsa
uuucccuuuuauguuuucucuguuugugauacaauuagaaaauauaaaaucacaguagauuuua

SEQ ID NO: 134351 - RNA, 64 nt, hsa
uuaaugcagauaaaacaaguuuacaugugcagaguuagaaaaugacauguucaauucuguaagu

SEQ ID NO: 134352 - RNA, 64 nt, hsa
cagaaauucuauuuugguauguuuguauuagccuuuagaaaaaacacuccguuucagaauuguu

SEQ ID NO: 134353 - RNA, 64 nt, hsa
gguccuuagaaaagacuuugcuuuuauaaagcauuuagaaaaaaugcauacuuuuaaaacaagu

SEQ ID NO: 134354 - RNA, 64 nt, hsa
aguuguguauauagagaccauaauuauaugguccuuagaaaagacuuugcuuuuauaaagcauu

SEQ ID NO: 134355 - RNA, 64 nt, hsa
acaauuauuccaaaccaaauuuuaauuuuugcuuuuagaaaagggaguuuaaaaaugguaucaa

SEQ ID NO: 134356 - RNA, 64 nt, hsa
aaaacuuuaucagggaaacuaagauucuuuuaaauuagaaaauauucucuauuugaauuauuuc

SEQ ID NO: 134357 - RNA, 64 nt, hsa
augaauagagacauauuaaaauaauguuuacaucuuagaaaaaacauagauagugcuaguaaua

SEQ ID NO: 134358 - RNA, 64 nt, hsa
uaaauuuaauuuuaccaauaaauauucccauaauuuagaaaaggaugucgacuugcuaauuuca

SEQ ID NO: 134359 - RNA, 64 nt, hsa
gauuguaauuaguuuuguauuuucuauacugguguuagaaaacauauguuuacauuugauuaac

SEQ ID NO: 134360 - RNA, 64 nt, hsa
uucauaauguccuguauaaauguuuuuacugcuuuuagaaaauaaagaaaaaaaacuugguuca

SEQ ID NO: 134361 - RNA, 64 nt, hsa
ucuuuggauauuguaauucuuaacugguuguaaauuagaaaagcugggauuacauauggugugc

SEQ ID NO: 134362 - RNA, 64 nt, hsa
auuuuuuuuuuauuuuauuuuauuguuuuuuuuuuuagaaaaacaccacuuuuauuauguacaa

SEQ ID NO: 134363 - RNA, 64 nt, hsa
gagagaaaaaaaaaucaaagggcagucucaauacuuagaaaauuauuguuugucuguugcgcau

SEQ ID NO: 134364 - RNA, 64 nt, hsa
cacuggaccgccauuaggcaaagaggagcaaccauuagaaaaugcaggauuugucccacucugu

SEQ ID NO: 134365 - RNA, 64 nt, hsa
gauugcuucguuuuuaaaauaacgcauguccauuuuagaaaauuagaaaaucagucccaccacc

SEQ ID NO: 134366 - RNA, 64 nt, hsa
cguuuuuaaaauaacgcauguccauuuuagaaaauuagaaaaucagucccaccacccaaagauu

SEQ ID NO: 134367 - RNA, 64 nt, hsa
uaaacuuugaacauugauauccaugggaauaggauuagaaaaggauugcuuucuauauauaaua

SEQ ID NO: 134368 - RNA, 64 nt, hsa
gguauuuuuucccagcugacaugauuucucaguguuagaaaacaaacccuuagaacuuuccuuu

SEQ ID NO: 134369 - RNA, 64 nt, hsa
cuaaguuuuuaaaaauaaauuauaaacuuggagauuagaaaaauaaagcaguugcuguagaaua

SEQ ID NO: 134370 - RNA, 64 nt, hsa
cuuugcuuuagaguuaaauauuccuaucuuaaguuuagaaaaauacaaaaaaccauuccaagga

SEQ ID NO: 134371 - RNA, 64 nt, hsa
aagagaggaaucuauuucuuucuccugaaacaauuuagaaaauaguuauccauugacuagaaau

SEQ ID NO: 134372 - RNA, 64 nt, hsa
agugcaaaacagguguucuuaucuaaaacgucaauuagaaaauuaucugcgguuguuaaucuac

SEQ ID NO: 134373 - RNA, 64 nt, hsa
uuaugcaggaaaccuccugcaaagcugaaacugauuagaaaauucuuuauauuuuaaaauagcu

SEQ ID NO: 134374 - RNA, 64 nt, hsa
ucugaugauugauugauuacuguccagguacauuuuagaaaaaguguucuucuuccaguuuguu

SEQ ID NO: 134375 - RNA, 64 nt, hsa
gaaaaaugucucuuucaguuuguucuguaaauauuuagaaaagugacagcugucaaccucagag

SEQ ID NO: 134376 - RNA, 64 nt, hsa
aauagcuauagucucuucagcauuuguuuaaauuuuagaaaaccuguauaaauuacuggugcau

SEQ ID NO: 134377 - RNA, 64 nt, hsa
acuuuugaaauuuuuguagcuuuuagcugauuaauuagaaaaauuuaauauuucagugaaaguu

SEQ ID NO: 134378 - RNA, 64 nt, hsa
uauguuaugaggauauaaugugugcuuuauugaauuagaaaauuagugaccauuauucacaggu

SEQ ID NO: 134379 - RNA, 64 nt, hsa
uuuucuguagacucuaagauacacugcacuuuguuuagaaaaaaaacugaagaugaaauauaua

SEQ ID NO: 134380 - RNA, 64 nt, hsa
uaugagggagcaaaaguuagacugagaacaaacguuagaaaaucacuucagauuguguuugaaa

SEQ ID NO: 134381 - RNA, 64 nt, hsa
augacuuuggaagugcagaaacagaaggauacuguuagaaaauccuaacauuggucuccgugca

SEQ ID NO: 134382 - RNA, 64 nt, hsa
acaucuccuagggaaugaugaaaacagcaggcuauuagaaaauuauuucauauaguucucgugu

SEQ ID NO: 134383 - RNA, 64 nt, hsa
agcuuccuaaugcauguguugcauuauugcagcauuagaaaaggagagguagcauuuuugcuga

SEQ ID NO: 134384 - RNA, 64 nt, hsa
agcacuuugauucuauguugaguuuguuucuauauuagaaaagcagcaagucaguaaucccccg

SEQ ID NO: 134385 - RNA, 64 nt, hsa
cgugacuaucagugaaagaaguuuaauuuucagguuagaaaaugugaucuggcaguuuaugcau

SEQ ID NO: 134386 - RNA, 64 nt, hsa
uagucagugauucuuuacuugcaaauucaggggcuuagaaaaugaaagcaaacacaaaaccuug

SEQ ID NO: 134387 - RNA, 64 nt, hsa
guuacucugguuguugugccaaauugugguacacuuagaaaauucuacagucgucgauuuuuag

SEQ ID NO: 134388 - RNA, 64 nt, hsa
uucugagaaggugaacuguuacgacccaggacaauuagaaaaauucacccaccaugccgcacau

SEQ ID NO: 134389 - RNA, 64 nt, hsa
aaaacccaauacagucuaguuuccugguuccguuuuagaaaaggaaaacgugaacaaacuuaga

SEQ ID NO: 134390 - RNA, 64 nt, hsa
gcugauuguauuuuaucucuaaagauuuagaacuuuagaaaaugccgacuucuuccaucuauuu

SEQ ID NO: 134391 - RNA, 64 nt, hsa
cuaguccaaaggccaaagcuaauuuauuuccacuuuagaaaaguuagcacaugcuuuugaaaau

SEQ ID NO: 134392 - RNA, 64 nt, hsa
aucuaaccuggcuuguuuagggccauaccacuaauuagaaaaucugugcuagaaccugugucuu

SEQ ID NO: 134393 - RNA, 64 nt, hsa
aaaauuuagaguauaaauugucuuauauuucaaauuagaaaaguucaaaugaaguuuaauugug

SEQ ID NO: 134394 - RNA, 64 nt, hsa
gguagagccaagcugaggaauccuuuuaagauuauuagaaaacaugcccugaagagaguuguuc

SEQ ID NO: 134395 - RNA, 64 nt, hsa
caccuggcccauaguuguauuuuuuuuaggucacuuagaaaaauaugucauguauuuuacauuu

SEQ ID NO: 134396 - RNA, 64 nt, hsa
guuuauccaauauugaguaaguucugaaacaguuuuagaaaaaauuuucuuuuuguuaaaugug

SEQ ID NO: 134397 - RNA, 64 nt, hsa
aaaaaagauuacccuuaguguauguguuuuaauauuagaaaauuggcauauguacuuuauuuuu

SEQ ID NO: 134398 - RNA, 64 nt, hsa
agcuuugcaccucuuugguagaaaccaggucuauuuagaaaauggcuuuaugauaaauguugcc

SEQ ID NO: 134399 - RNA, 64 nt, hsa
ccuaaaaauaaauuaugacauuuaguaucuaagguuagaaaaccacgcccacaugcuaauaugg

SEQ ID NO: 134400 - RNA, 64 nt, hsa
ugugguguuuuuuuuguuuguuuguuuguuuguuuuagaaaaauugggauuuccccccaccccg

SEQ ID NO: 134401 - RNA, 64 nt, hsa
accagcacaagagaauuagagcuucagugagaauuuagaaaaauuauacuaaagugagaugcau

SEQ ID NO: 134402 - RNA, 64 nt, hsa
auauguauauuuuuuuaauuuaacaugaacacccuuagaaaauguguccuaucuaucuuccaaa

SEQ ID NO: 134403 - RNA, 64 nt, hsa
ugaacucuucugcaaaaauggauauuauuagaaauuagaaaaaaauuacuaauuuuacacauua

SEQ ID NO: 134404 - RNA, 64 nt, hsa
uuuugugcaaaagcuucaaauuaaaacagcugcauuagaaaaagaggcgcuucuccccuccccu

SEQ ID NO: 134405 - RNA, 64 nt, hsa
cucagaauuauuuuuaaaaagaaaucuggucuuguuagaaaacaaaauuuuauuuugugcucau

SEQ ID NO: 134406 - RNA, 64 nt, hsa
gauuuagauguauagaaaaguaagaaaaucuuacuuagaaaaaagccccuugaaacuugcagga

SEQ ID NO: 134407 - RNA, 64 nt, hsa
ccaaauagcauucuuauucacuuuaugccgguauuuagaaaaaauaaauuauagcaaguaugau

SEQ ID NO: 134408 - RNA, 64 nt, hsa
cuccagcuuuggcaacagaacgagaucccaucucuuagaaaaacaaaguugauaguuaaagaac

SEQ ID NO: 134409 - RNA, 64 nt, hsa
aggagaggaaaaguugauuaacuucugguuugguuuagaaaaaguaauguuugaaauacgaagg

SEQ ID NO: 134410 - RNA, 64 nt, hsa
cauaaaucugccuuuauguugcauaagugaaaauuuagaaaauuaaaagcaauuaucuuucaga

SEQ ID NO: 134411 - RNA, 64 nt, hsa
auuuauauuugucacuuuaaaaaauccauuucuuuuagaaaaaauuagggugauaggauauuca

SEQ ID NO: 134412 - RNA, 64 nt, hsa
auucaauacaauuguaauguagaaauauaagaauuuagaaaaaaguaaacuugccauuugguua

SEQ ID NO: 134413 - RNA, 64 nt, hsa
guauccauuaaaguaacuuuuuuaacuaugagaauuagaaaauaagggacaacagggguuaaaa

SEQ ID NO: 134414 - RNA, 64 nt, hsa
uccaaacaaaucuuucuacgcuuaaaugaucaaauuagaaaaaccaauuccuauaauuaauaug

SEQ ID NO: 134415 - RNA, 64 nt, hsa
ucuugugcuugcuucggcagcauauauacugaaauuagaaaaagaaaacuuuucuuuuuuauua

SEQ ID NO: 134416 - RNA, 64 nt, hsa
uucccaacucacaggcaagcaacuguuagaaaaauuagaaaauuuaaaauggaaauaacaaagc

SEQ ID NO: 134417 - RNA, 64 nt, hsa
aucacaguauucccaacucacaggcaagcaacuguuagaaaaauuagaaaauuuaaaauggaaa

SEQ ID NO: 134418 - RNA, 64 nt, hsa
gguuugagaaacaggcugacacuauucucuuugauuagaaaauaaacucauaaaacucauaaug

SEQ ID NO: 134419 - RNA, 64 nt, hsa
uccagaagccagaggauggacuaagugggagaaauuagaaaacaaaacgaacucugguuggggu

SEQ ID NO: 134420 - RNA, 64 nt, hsa
caggaaacuuguuuuuuuaacgucagccagauauuuagaaaauaaccucaaaaguguuuauaug

SEQ ID NO: 134421 - RNA, 64 nt, hsa
accaaaagagguuguuaauuagcacauauuccuuuuagaaaaauguuucagaaaccucagucuu

SEQ ID NO: 134422 - RNA, 64 nt, hsa
aacaccaaaccaaaagaagguaggagugccauuuuuagaaaagacacaacuuuaauuccuguca

SEQ ID NO: 134423 - RNA, 64 nt, hsa
uauuuaaguguugucuaaacaguugauuuuuacuuuagaaaagaucaucuucaacuguuuauug

SEQ ID NO: 134424 - RNA, 64 nt, hsa
caguuccgugguugaauauauuugagaugguaccuuagaaaaaguuucacgcagauccuugguu

SEQ ID NO: 134425 - RNA, 64 nt, hsa
cccaaucccaggccuugugauuugagaugguaccuuagaaaaaguuacacgcaguuccgugguu

SEQ ID NO: 134426 - RNA, 64 nt, hsa
ugggacugcagugcccaaggaauuucugcucugguuagaaaaaggacucugcuucaguccacuu

SEQ ID NO: 134427 - RNA, 64 nt, hsa
aaaaggacucugcuucaguccacuucugcucugguuagaaaaaggacucugcuucaguccacag

SEQ ID NO: 134428 - RNA, 64 nt, hsa
aagaaagugcacugcaugcuguuuucacuuauucuuagaaaacaagcaugaaagauuccgccca

SEQ ID NO: 134429 - RNA, 64 nt, hsa
uugggggaauucccucccaaauuugauuuuguuauuagaaaaaugauuccgugaacacagaugu

SEQ ID NO: 134430 - RNA, 64 nt, hsa
uucugaaaaucaacaaccuuagaaggauuuugucuuagaaaauuuccuuggcuuuaguuuuaua

SEQ ID NO: 134431 - RNA, 64 nt, hsa
agaaaauuuccuuggcuuuaguuuuauaucauauuuagaaaauaauaaugaaaagcauccccaa

SEQ ID NO: 134432 - RNA, 64 nt, hsa
cuaaugaaugcagaaagaauaauagaaaauuauauuagaaaaacuauuguguaacacauaauga

SEQ ID NO: 134433 - RNA, 64 nt, hsa
caaccagaaguuaaggagguaaaguucuucuuuauuagaaaauuccaggcuaaugaaugcagaa

SEQ ID NO: 134434 - RNA, 64 nt, hsa
ggauggggagguuuuggacagagggaggagagaguuagaaaaauuuuugguagagagaaucagg

SEQ ID NO: 134435 - RNA, 64 nt, hsa
uaucaaguuaaagguuaaccaguuacagaggguguuagaaaacaaagggcagagaguccuggag

SEQ ID NO: 134436 - RNA, 64 nt, hsa
guacacacuguuggcaaaaggcuaacaccugacuuuagaaaaugcugauuugagaacaaaagga

SEQ ID NO: 134437 - RNA, 64 nt, hsa
uguguuuuuguucuuuugaagaauagagugguauuuagaaaauaaauugcauugcaaagcucuu

SEQ ID NO: 134438 - RNA, 64 nt, hsa
acuuuacuaaauuaauacuccuccuuuuacagaauuagaaaaguuaacauuuaucuuuaggugg

SEQ ID NO: 134439 - RNA, 64 nt, hsa
ugauucacagcuuauuauccaauucaaaaauaaauuagaaaaauauaugcuuacauuuuucacu

SEQ ID NO: 134440 - RNA, 64 nt, hsa
cagcaaacugcacugcacuuauaaagcaaaucuauuagaaaaaaagcauuuuucuaaaugcuca

SEQ ID NO: 134441 - RNA, 64 nt, hsa
ggagacaguaguagccauaaaaaguacuuauacuuuagaaaacaguccuuauucagaaacuuuu

SEQ ID NO: 134442 - RNA, 64 nt, hsa
caugaaucugaaaggagaaaggacuauuucucaguuagaaaacuuuugccgauaccuuguacac

SEQ ID NO: 134443 - RNA, 64 nt, hsa
ugauguauuuaugcccuuauaucccaaaaaugucuuagaaaauaaaaauucugggccuuacuug

SEQ ID NO: 134444 - RNA, 64 nt, hsa
acugcagugggcucggauaggcccauugagguuuuuagaaaagcaggauuuguuuuguuaggga

SEQ ID NO: 134445 - RNA, 64 nt, hsa
uaauuuaagcagagcuuagcauuuauuuuauucuuuagaaaacuuaaguauuuacuuuuuuaaa

SEQ ID NO: 134446 - RNA, 64 nt, hsa
ccucauucucuuucuaaucuugcugguuucaagauuagaaaauggcauuauuugaucugaaaug

SEQ ID NO: 134447 - RNA, 64 nt, hsa
gccucuuagguuuuaacgaugucaacaguguaguuuagaaaauggcccguuaguggcucuauug

SEQ ID NO: 134448 - RNA, 64 nt, hsa
aguuuacaaccuuauuccaugcugucuuucagauuuagaaaagaucuaauuucugucucagcug

SEQ ID NO: 134449 - RNA, 64 nt, hsa
ucagcucuuacaacaagaacagaaaacaugcuaauuagaaaaaguccugcuuuaaguaauaugu

SEQ ID NO: 134450 - RNA, 64 nt, hsa
auuccuaccaaggacaauuuauuaaucaauugacuuagaaaauagggggagaaaucauucauug

SEQ ID NO: 134451 - RNA, 64 nt, hsa
uagggggagaaaucauucauuggagcuucuuucuuuagaaaagacuuugguuauaagccuuuug

SEQ ID NO: 134452 - RNA, 64 nt, hsa
uuuaucaucuuuuaaacagguucaugggacagaguuagaaaacugggaaugaauaagacaucca

SEQ ID NO: 134453 - RNA, 64 nt, hsa
cuucuggguaguaauuacauugugguauuaauauuuagaaaaauggaccucagcaguguauuua

SEQ ID NO: 134454 - RNA, 64 nt, hsa
augauguaaagaaaucagauacaaacuacugcaauuagaaaauaaaauaugaacaacuuucaac

SEQ ID NO: 134455 - RNA, 64 nt, hsa
auauuuuacaaaauaccaacuguucuauauuucuuuagaaaaagauuauaguuauuaauauuga

SEQ ID NO: 134456 - RNA, 64 nt, hsa
uuauuuaauuggguggggcagguguguauuuacuuuagaaaaaaugaaaaagacaagauuuaug

SEQ ID NO: 134457 - RNA, 64 nt, hsa
ugcuucauccuguugcuggcagugggauguggacuuagaaaaucaaguucuagcauuuuaguag

SEQ ID NO: 134458 - RNA, 64 nt, hsa
cacccaggcuagagugcaauggcaccaucuuggcucacugcaaccucuaccuccuggguucaag

SEQ ID NO: 134459 - RNA, 64 nt, hsa
ucaccaggcuggagugcagugccgcaaucucggcucacugcaaccuccgccucccagguucaag

SEQ ID NO: 134460 - RNA, 64 nt, hsa
cacccaggcugcagugcaauggcgcgaucucagcucacugcaaccuccaccuccggguucaagc

SEQ ID NO: 134461 - RNA, 64 nt, hsa
uugccagacuggagugcaguggcacgaucucggcucacugcaaccucugccucccggguucaag

SEQ ID NO: 134462 - RNA, 64 nt, hsa
uucaguugugggccuccagucuucuggaaugucuucacugcagcugcuggaaaucacugcuuuc

SEQ ID NO: 134463 - RNA, 64 nt, hsa
uagccaggcuggagugcaguggcauaaucucagcucacugcaaccucugcuucccggguucaag

SEQ ID NO: 134464 - RNA, 64 nt, hsa
cgcccaggcuggaguguaguggcgcagucucagcucacugcaaccuccaccucccggguucaag

SEQ ID NO: 134465 - RNA, 64 nt, hsa
ugcccaggcuggagugcguuggcguggucuuggcucacugcaaccucugccuccuugguucaag

SEQ ID NO: 134466 - RNA, 64 nt, hsa
cgcgcaggguggagugcgguggcacgaucucggcucacugcaaccucugccuccugggugcaag

SEQ ID NO: 134467 - RNA, 64 nt, hsa
cacucaggcuggagugcagugguacgaucuuggcucacugcaaccuccaccucccggguucaag

SEQ ID NO: 134468 - RNA, 64 nt, hsa
uuuuguuuuuauuuuuguuuuuugagaugaagucucacugcacucaggcuggagugcaguggua

SEQ ID NO: 134469 - RNA, 64 nt, hsa
cacccaggcuggagugcuguggugugaucuuagcucacugcaaccuccgccucccagguucaag

SEQ ID NO: 134470 - RNA, 64 nt, hsa
gcccugcgccaccucacugcaguagugcaccaucucacugcaguagcacgcccuccugggccgu

SEQ ID NO: 134471 - RNA, 64 nt, hsa
cuuuugugcccaagcucaccagcccugcgccaccucacugcaguagugcaccaucucacugcag

SEQ ID NO: 134472 - RNA, 64 nt, hsa
ucgcuauugucaccagggcuggaaugauuucagcucacugcaaccuucgccaccuggguuccag

SEQ ID NO: 134473 - RNA, 64 nt, hsa
cgcccaggcuggagugcaauggcacaaucucggcucacugcauccuccgccucccggguucaag

SEQ ID NO: 134474 - RNA, 64 nt, hsa
agagauuuuuuucaacccuaaaagagaguaccuuucacugcauuggauggaugaacaucagugc

SEQ ID NO: 134475 - RNA, 64 nt, hsa
cgccaaggcuggagugcaguggugugaucucggcucacugcaaccuccgccuccuggguucagg

SEQ ID NO: 134476 - RNA, 64 nt, hsa
gauggaacaugugcuuggccacaggcagguccagucacugcaaaagugaccaagccagcagguc

SEQ ID NO: 134477 - RNA, 64 nt, hsa
cacccaggcuguagugcaguggcauaaucucagcucacugcagucucugccucccggguucgag

SEQ ID NO: 134478 - RNA, 64 nt, hsa
cgcccaggcuggagugcaguggcgcgaacucggcucacugcaaccuccgccuccuggguucaag

SEQ ID NO: 134479 - RNA, 64 nt, hsa
gcccaggcugggggugcaauggcgcaaucuuugcucacugcaaccccugccucccgggcucaag

SEQ ID NO: 134480 - RNA, 64 nt, hsa
auugaaaaauggcauucacucuuacagaugguguucacugcaagccccagaagcauauggcaug

SEQ ID NO: 134481 - RNA, 64 nt, hsa
cccccaagcuggaguacaaugacaggaucucggcucacugcaagcucugccucccggguucaag

SEQ ID NO: 134482 - RNA, 64 nt, hsa
cacccaggcuggagugcaguggugcgaucucggcucacugcaagcuccgccucccggguucuca

SEQ ID NO: 134483 - RNA, 64 nt, hsa
ccaggcuggagugcaauggugcaaugaccucggcucacugcaaccucugccuccuggguucaag

SEQ ID NO: 134484 - RNA, 64 nt, hsa
cacccaggcuggagugcaauggcgcaaucucagcucacugcaaccucugccucccggguucaag

SEQ ID NO: 134485 - RNA, 64 nt, hsa
ugcccaggcuggagugcaguggcgugaucuuggcucacugcaaccucugccucccagcuucaag

SEQ ID NO: 134486 - RNA, 64 nt, hsa
cacccaggcuggagagcaguggcgugaucucggcucacugcaagcuccgccucccggguucacg

SEQ ID NO: 134487 - RNA, 64 nt, hsa
cacccaggcuggaaugcaauggcaccaucuuggcucacugcaaccucugcuuccuggguucaag

SEQ ID NO: 134488 - RNA, 64 nt, hsa
cacccaggcuagagugcgguggugugaucuuggcucacugcaaccucccccuccuggguucaag

SEQ ID NO: 134489 - RNA, 64 nt, hsa
ugcucaggcuggagugcaguggugcaaucuuggcucacugcaaccuacaccucccggguucaag

SEQ ID NO: 134490 - RNA, 64 nt, hsa
ugcccaggcuggacaacaauggcgcgaucucggcucacugcaaccuccaccucccggauucaag

SEQ ID NO: 134491 - RNA, 64 nt, hsa
cauccaggcugaaguccaaucccacaaucauggcucacugcagccaccaccuccugagcucaag

SEQ ID NO: 134492 - RNA, 64 nt, hsa
cacccaggcuggagugcaguggcaccaucuuggcucacugcagccucugccuccugggcucaaa

SEQ ID NO: 134493 - RNA, 64 nt, hsa
ucuugcucugucacccaggccgugcaaucucggcucacugcaaccuccgccuccugggucaaau

SEQ ID NO: 134494 - RNA, 64 nt, hsa
cgcucgcgcuggagugcaguggcaugaucucggcucacugcaagcuccgccucccagguucaug

SEQ ID NO: 134495 - RNA, 64 nt, hsa
cacccaggcuggaaugcaguggugugaucuuggcucacugcaaccuccacuucccggguucaag

SEQ ID NO: 134496 - RNA, 64 nt, hsa
cccccaggcuggagugcaguggcacaaugacgacucacugcagccucaaccuccuggggccaag

SEQ ID NO: 134497 - RNA, 64 nt, hsa
ccaaguuacuggacaccaggacaaaccagguagaucacugcauccgguuccuccucuuucugcc

SEQ ID NO: 134498 - RNA, 64 nt, hsa
ugcccaggcuggagugcaauggugcaauuucagcucacugcaaucucugccacccggauucaag

SEQ ID NO: 134499 - RNA, 64 nt, hsa
uuuguaauauggaaaucuuuuacauuuuuccuauucacugcacuuuuuuauuguuuuuauuucu

SEQ ID NO: 134500 - RNA, 64 nt, hsa
ucaccaggcuggagugcaguggcaugaucucggcucacugcaaccuccaacucccugguuuaag

SEQ ID NO: 134501 - RNA, 64 nt, hsa
ucuccaggcuggagugcaguggcgucaucucggcucacugcaaccuccgccucccagguucaag

SEQ ID NO: 134502 - RNA, 64 nt, hsa
cagcuucccaaagugcugggauuacaggugugagucacugcacccagccgaguugcuuucuuac

SEQ ID NO: 134503 - RNA, 64 nt, hsa
ccaggcuggaggagugcaguggugugaucucagcucacugcaaccuccaccucccagguucaag

SEQ ID NO: 134504 - RNA, 64 nt, hsa
cgcccaggcuggaacgcaguggugacaucucggcucacugcaaccuccaccucccagguucaag

SEQ ID NO: 134505 - RNA, 64 nt, hsa
ugcccagacuagaguacaauauugcaaucacagcucacugcagccucaaacuccugggcucaag

SEQ ID NO: 134506 - RNA, 64 nt, hsa
auauagcaauacaaccaauaauuuguuuuauguuucacugcauauaaauauuuccauuaaauca

SEQ ID NO: 134507 - RNA, 64 nt, hsa
cguccaggcuggagugcgcuggcuugaucuuggcucacugcagccucaauguccccaggcucag

SEQ ID NO: 134508 - RNA, 64 nt, hsa
cacccaggcuggaguacaguggguugaucauggcucacugcauccuugacuuccugggcucaag

SEQ ID NO: 134509 - RNA, 64 nt, hsa
ugccagggcuggagugcaauggcgugaucuuggcucacugcaaccuccgccucccggguucaag

SEQ ID NO: 134510 - RNA, 64 nt, hsa
cgcccuggcuggagugcaauggugugaucucagcucacugcacccuccgccucucggguucaag

SEQ ID NO: 134511 - RNA, 64 nt, hsa
cacccagacuagaggucaguggcaggaucucagcucacugcaaccucugccuccugggcucaag

SEQ ID NO: 134512 - RNA, 64 nt, hsa
cacacaggcuggaaugcagugaugccaucucagcucacugcaaccuccaccuccuggguucaag

SEQ ID NO: 134513 - RNA, 64 nt, hsa
ugcccaggcuggaguacaguggcgcgaucucagcucacugcaagcuccgccucccaaguucacu

SEQ ID NO: 134514 - RNA, 64 nt, hsa
uacccaggcuggagugcaauggugcgaucucagcucacugcaaccuccgccucccaguucaagu

SEQ ID NO: 134515 - RNA, 64 nt, hsa
cuacaaaaugaauauuaucaagaguuucaugugaucacugcaguguugucacagcucauaaaua

SEQ ID NO: 134516 - RNA, 64 nt, hsa
auggugggggcccuuacugugguagaaaccauugucacugcaaggcagcccugcuugggauuca

SEQ ID NO: 134517 - RNA, 64 nt, hsa
gugucuagaaaaguaaggauaauuuucuuccuucucacugcagccccaagcucuuauuaaccuu

SEQ ID NO: 134518 - RNA, 64 nt, hsa
cacccaggcuggaguguaguggcaugaucugggcucacugcaaccuccuccuccuggauucaag

SEQ ID NO: 134519 - RNA, 64 nt, hsa
cgcccaggcuggagugcaguggcucgaucucggcucacugcaagcuccgccucccggguucacg

SEQ ID NO: 134520 - RNA, 64 nt, hsa
ugcugaggcuggagugaaauggcaugaucucagcucacugcaaccuccgucucuuagguucaag

SEQ ID NO: 134521 - RNA, 64 nt, hsa
uugcucugcuggagugcgguggugcaaucucggcucacugcaaccuccaccucccagguucaag

SEQ ID NO: 134522 - RNA, 64 nt, hsa
cacccaggcuagagugcaauggcacgaucucggcucacugcaagcucugcguccuggguugacg

SEQ ID NO: 134523 - RNA, 64 nt, hsa
cgcccaggcuggagugcaguggcgcgaucucgacucacugcaagcuccgccucccggguucacg

SEQ ID NO: 134524 - RNA, 64 nt, hsa
ucgccaggcuggagugcaguggugccaucucggcucacugcagcacugucucggcucacugcag

SEQ ID NO: 134525 - RNA, 64 nt, hsa
gugccaucucggcucacugcagcacugucucggcucacugcagccuccgccucccguauucaag

SEQ ID NO: 134526 - RNA, 64 nt, hsa
caugggaacagugcagcaacaugcuagaaaauccucacugcacuccagcagaggcuagaggaau

SEQ ID NO: 134527 - RNA, 64 nt, hsa
ugcccaggagggagugcaguggugcaaccucggcucacugcaaccuuugccuccuagguucaag

SEQ ID NO: 134528 - RNA, 64 nt, hsa; identical to SEQ ID NO: 134525

SEQ ID NO: 134529 - RNA, 64 nt, hsa; identical to SEQ ID NO: 134524

SEQ ID NO: 134530 - RNA, 64 nt, hsa
ugcccaggcuggagugcaguggugcgaucucagcucacugcauccucugccucccggguucaag

SEQ ID NO: 134531 - RNA, 64 nt, hsa
aggaaaaagaaauccuuuggaauuuuaacuaaaaucacugcauaugggaaauuaagagauccag

SEQ ID NO: 134532 - RNA, 64 nt, hsa
aaaagcuugaugaaaggacaguuaaguauuuugaucacugcauuuuguuugaaacuugugucau

SEQ ID NO: 134533 - RNA, 64 nt, hsa
ugcccaggcuggagugcaguggcgcaauuucagcucacugcaaccucugccucccagguucaag

SEQ ID NO: 134534 - RNA, 64 nt, hsa
caccuaggcuacagugcaguggugugaucacagcucacugcagccucgacuucccaggcucaag

SEQ ID NO: 134535 - RNA, 64 nt, hsa
cgcccaggcuagagugcaauggcgugaucucggcucacugcaaccuccaccucccagauucaag

SEQ ID NO: 134536 - RNA, 64 nt, hsa
ugauuuaguuuuuggguuucuuugagacagggucucacugcauugcccuugcugaccucaaauu

SEQ ID NO: 134537 - RNA, 64 nt, hsa
acccaggcuagaguacagugggaacagucauggcucacugcagcuuaagcucacugccugggcu

SEQ ID NO: 134538 - RNA, 64 nt, hsa
cacccaggcuggagugcaguggugcaaucucagcucacugcaaccuccgccucccagguucaag

SEQ ID NO: 134539 - RNA, 64 nt, hsa
ccaggcuagagugcaguggcacaaaaaucucggcucacugcagccuugacuucccaggcucagg

SEQ ID NO: 134540 - RNA, 64 nt, hsa
cgcccaggcuggagugcaguggcgcgaucucggcucacugcaaccucugcccccuggguucaag

SEQ ID NO: 134541 - RNA, 64 nt, hsa
uugcccgggcuggaaugcaauggcgcgauucagcucacugcaaucuccgccucccggguucaag

SEQ ID NO: 134542 - RNA, 64 nt, hsa
uacauuuuuaugaaaaauuucauugucagcugccucacugcauacucuuuaauaguaccaggca

SEQ ID NO: 134543 - RNA, 64 nt, hsa
uagguuccaggaaagcucguggaagcuuuggggcucacugcagaaaucaugugacugucacgug

SEQ ID NO: 134544 - RNA, 64 nt, hsa
auuaagugccuucugugugucagucccuggccacucacugcaguucaaggcccccuuuccgcuc

SEQ ID NO: 134545 - RNA, 64 nt, hsa
ggaggaccgggaugcuggauucuguuuuccgaagucacugcagcggaugauggaacugaaucga

SEQ ID NO: 134546 - RNA, 64 nt, hsa
ugcucaggcuggaguacaguggcauaaucacagcucacugcaaccucaauccugggcucaagug

SEQ ID NO: 134547 - RNA, 64 nt, hsa
cccccaggcuggagugcaguggcucgaucucugcucacugcaagcuccgccuccuggguucaug

SEQ ID NO: 134548 - RNA, 64 nt, hsa
cgcccaggcuugagugcaguggcgcgaucucggcucacugcaagcucugucuccuggguucaug

SEQ ID NO: 134549 - RNA, 64 nt, hsa
uugccaggcuggagugcgguggugcaaucucagcucacugcaaucuccaccuccuggguucaag

SEQ ID NO: 134550 - RNA, 64 nt, hsa
ucuuugguccagccagacccugggcccucucuccucacugcaccaggaccugaugccaagaaag

SEQ ID NO: 134551 - RNA, 64 nt, hsa
ucugaaaagaagcugaguugucuccaggcugcugucacugcauccaggacucugucagcucugc

SEQ ID NO: 134552 - RNA, 64 nt, hsa
ugcccagcccagaguacaguggcacuaucucagcucacugcaaucuccgccucccugguucaag

SEQ ID NO: 134553 - RNA, 64 nt, hsa
cacccaggcuggagugcuguggugcaaucucggcucacugcaaccucugccucccgaguucaag

SEQ ID NO: 134554 - RNA, 64 nt, hsa
cacugaggcuggagugcaguggcgcaauuucagcucacugcaaccucugccucccagguucaag

SEQ ID NO: 134555 - RNA, 64 nt, hsa
cacccagacuggagugcaguggcgcgaucucggcucacugcaagcucagccuccccgauucacg

SEQ ID NO: 134556 - RNA, 64 nt, hsa
ucaucaggcuggagugcaguggcgcaauuucggcucacugcaaccuccaccuccuggguucaag

SEQ ID NO: 134557 - RNA, 64 nt, hsa
ucgaggaugcaauuaauugugguugugucacaguucacugcagccugggugacacuccagccug

SEQ ID NO: 134558 - RNA, 64 nt, hsa
cucccaggcuagagugcaguggugcaaucucagcucacugcagccucaacugccccagguuuaa

SEQ ID NO: 134559 - RNA, 64 nt, hsa
caccuaggcuagagugcaguggugugaucucggcucacugcaaccucugccucuuggguucaag

SEQ ID NO: 134560 - RNA, 64 nt, hsa
cacccagguuggagugccauggcaugaucuuggcucacugcaaccuccaccuccugggucaagc

SEQ ID NO: 134561 - RNA, 64 nt, hsa
ugcccaugcuggagugcaguggcgugaucauagcucacugcagccuugaauuccuaggcuccag

SEQ ID NO: 134562 - RNA, 64 nt, hsa
ugcccaggcuggagugcaguggcacaaucucagcucacugcaagcuccgccuccuggguucacg

SEQ ID NO: 134563 - RNA, 64 nt, hsa
uguccaggcuggagugcaauggugugaucucggcucacugcaaccuccgccuuccggguucaag

SEQ ID NO: 134564 - RNA, 64 nt, hsa
ugcccaggcuagagugcaauggugcaaucacagcucacugcagccucaaccuccuggguucaag

SEQ ID NO: 134565 - RNA, 64 nt, hsa
cacccgggcuggagugcaguggcgugaucucggcucacugcaacuuccaccuccuggguuccag

SEQ ID NO: 134566 - RNA, 64 nt, hsa
cacccaggcuggagugcaauggcaugaucucagcucacugcaaccuucgccuccuggguucaag

SEQ ID NO: 134567 - RNA, 64 nt, hsa
cgcccaggcuggagugcaguggcaugaucucggcucacugcaacuucugccucccagguucaag

SEQ ID NO: 134568 - RNA, 64 nt, hsa
acccaggcuguguagugcagugguugaucuuggcucacugcaaccucugccuccuagauucaag

SEQ ID NO: 134569 - RNA, 64 nt, hsa
ugcccaggcuggagggcaauggcgcgaucucagcucacugcaaccuccgucuccuggguucuug

SEQ ID NO: 134570 - RNA, 64 nt, hsa
ugcccaggcuggaguacaauggugcgaucuuggcucacugcaaccuccaccuccuggguucaag

SEQ ID NO: 134571 - RNA, 64 nt, hsa
ugucacccaggcuggagugcaguggugcgaucgcucacugcaaccucagccuccuggauuuaag

SEQ ID NO: 134572 - RNA, 64 nt, hsa
cacccaggcuggagugcaguggcgugaucuuggcucacugcaaccucugccuccuggguucaag

SEQ ID NO: 134573 - RNA, 64 nt, hsa
cgcccaggcuggagugcaguggcaggaucucggcucacugcaaucuagguggaggucuuuuuaa

SEQ ID NO: 134574 - RNA, 64 nt, hsa
ugaaaguguuuuugagaauuuuuauauauauuacucacugcagagaucauguucauuuacauuc

SEQ ID NO: 134575 - RNA, 64 nt, hsa
cacccagguuggagugcaguggcgugaucucagcucacugcaaccuccaccucgcagguucaag

SEQ ID NO: 134576 - RNA, 64 nt, hsa
cuccuaagcuggagugcaguggcaucaucucagcucacugcaaccucugccucccagguucaag

SEQ ID NO: 134577 - RNA, 64 nt, hsa
ugcccaggcuggagugcaguggugcgaucuuggcucacugcaaccucugccuccuggguucaag

SEQ ID NO: 134578 - RNA, 64 nt, hsa
caccugagcucuagugcaguagugcaaucacagcucacugcaaccuuacuccuaggcucaaguu

SEQ ID NO: 134579 - RNA, 64 nt, hsa
caccuaggcuggaaugcaguggugcaaucauagcucacugcagccuugacccccucccugaccu

SEQ ID NO: 134580 - RNA, 64 nt, hsa
cgcccaggauggagugcaguggcgcgaucuuagcucacugcaagcuccgccucccagguucaca

SEQ ID NO: 134581 - RNA, 64 nt, hsa
ugcccaggcuggcgugcaguggugcgaucuggguucacugcaaccuccgccucuuggguucaag

SEQ ID NO: 134582 - RNA, 64 nt, hsa
cgcccagucuggaaugcagugguaugaucacggcucacugcagccucaaccuccugggcuaagu

SEQ ID NO: 134583 - RNA, 64 nt, hsa
cuccccggcuggagcgcaguggcacgaucgcggcucacugcagccuccauccucuggguucaag

SEQ ID NO: 134584 - RNA, 64 nt, hsa
cgcccaggcuggaaugcaguugugagaucucggcucacugcaagcuccgccucccggguucacg

SEQ ID NO: 134585 - RNA, 64 nt, hsa
cacccaggcuggagugcaguggcaugauuucggcucacugcaaccucugucuccuggguucaaa

SEQ ID NO: 134586 - RNA, 64 nt, hsa
cuucacuuucuucaaagccacauuuuuugagguaucacugcagucaccucuucuacccucauca

SEQ ID NO: 134587 - RNA, 64 nt, hsa
ucuccagggaauucuuacagccaaguugugacagucacugcauuugccugcuucuuuccagaaa

SEQ ID NO: 134588 - RNA, 64 nt, hsa
guuucaguuugaaaauauuuuguugccuucaucuucacugcaauuuuguguaaauuucucaaag

SEQ ID NO: 134589 - RNA, 64 nt, hsa
uacccaggcuggagugcaguggugugaucucggcucacugcaaccucugccucccagguuccag

SEQ ID NO: 134590 - RNA, 64 nt, hsa
caacagaagccuaguccuguucagagcagcacugucacugcaaguccagcccccuuugccaggg

SEQ ID NO: 134591 - RNA, 64 nt, hsa
cacccaggcuggagugcaguggcgcgaucucggcucacugcaagcuccaccuccuggguucaug

SEQ ID NO: 134592 - RNA, 64 nt, hsa
agccgaagcuggacuguacugcugccaucucggcucacugcaaccucccugccugauucuccug

SEQ ID NO: 134593 - RNA, 64 nt, hsa
ugugagagugaacugggacacaagcuagucuagcucacugcagccaagcaaacccuguugaugg

SEQ ID NO: 134594 - RNA, 64 nt, hsa
cacccaggcuggagugcaguggugccaucaugacucacugcagccuugaccucccaggcgcaca

SEQ ID NO: 134595 - RNA, 64 nt, hsa
cucccaggcuggagugcaguggcgugaucuuggcucacugcaaccuccaccucccugauucaag

SEQ ID NO: 134596 - RNA, 64 nt, hsa
cucccaggcuggagcguaguaaugcaaucauagcucacugcagccuggaacuccuuggcucaag

SEQ ID NO: 134597 - RNA, 64 nt, hsa
cacccaggcuggagugcaguagcaugaucagggaucacugcaaccucugccuccuggguucaag

SEQ ID NO: 134598 - RNA, 64 nt, hsa
ugcccacgcaggagugcaguggcaugcucucagcucacugcagcccugacugccuaggcuccag

SEQ ID NO: 134599 - RNA, 64 nt, hsa
cuggaaugacgaagugaaguagugcaaacauagcucacugcagcuuugaccuccugggcuuagg

SEQ ID NO: 134600 - RNA, 64 nt, hsa
ugcccaggcuggagugcaguggcgugaucucggcucacugcaaccuccacaucccggguucaag

SEQ ID NO: 134601 - RNA, 64 nt, hsa
uggagcuggggcuggggcugcauucccuggagacucacugcaaguuccugcccaggaggcugag

SEQ ID NO: 134602 - RNA, 64 nt, hsa
ugcccaggcuggagugcaguggcgugaucucggcucacugcaagcucggccuccuggguucaaa

SEQ ID NO: 134603 - RNA, 64 nt, hsa
ugcccaggcuggagugcaguggcgugaucucggcucacugcaaccuccacccccggggaucaag

SEQ ID NO: 134604 - RNA, 64 nt, hsa
cucccaggcuggagugcuauggugcaauuuuuguucacugcaaccucugccuuccaagaucaag

SEQ ID NO: 134605 - RNA, 64 nt, hsa
cgcccagguuggagugcaguggcgcaaucucggcucacugcaagcuccgccucccggguucacg

SEQ ID NO: 134606 - RNA, 64 nt, hsa
cacccaggcuggagugcaguggugugaucuuggcucacugcaaccuccgccuccuggguuccaa

SEQ ID NO: 134607 - RNA, 64 nt, hsa
caacagagaugcccugagggguuguguagguuguucacugcaggaaguccccugguuaagaagg

SEQ ID NO: 134608 - RNA, 64 nt, hsa
cccccaggcuggagugcaguggcaugaucuuggcucacugcagccuccgccucccagguucaag

SEQ ID NO: 134609 - RNA, 64 nt, hsa
ugcccaggcuggaguguagugguguguucuuggcucacugcacccuccgccuccugggcucaag

SEQ ID NO: 134610 - RNA, 64 nt, hsa
cacccaggcuguagugcgguggcgcgaucucggcucacugcaaccuccgccucccggguucaag

SEQ ID NO: 134611 - RNA, 64 nt, hsa
uaaccaggcuggagugcaguggugggaucucggcucacugcaagcuccgccucccagauucacg

SEQ ID NO: 134612 - RNA, 64 nt, hsa
cgcccagacuggaguccaguggcacaaucucggcucacugcauccuccaccuccuggguucaag

SEQ ID NO: 134613 - RNA, 64 nt, hsa
ucgccaggcuggagugcaguggcgcgaucuaggcucacugcaacuuccgccucccggguucaag

SEQ ID NO: 134614 - RNA, 64 nt, hsa
cgcucaggcuggagugccauggcgcgaucuuggcucacugcaaccucugccucccggguucaag

SEQ ID NO: 134615 - RNA, 64 nt, hsa
uugccaggcuggagugcaguggcacaaucuuggcucacugcaaccuccacuucucagguucaag

SEQ ID NO: 134616 - RNA, 64 nt, hsa
ugcccaggcuggagugcaguggcgcgaucucagcucacugcaagcuccgccuccuggguucacg

SEQ ID NO: 134617 - RNA, 64 nt, hsa
accuggaugcugcuggagggugugcaccucuuccucacugcacggaaccugacaguggucaacu

SEQ ID NO: 134618 - RNA, 64 nt, hsa
ucuccuguguaaagccauccggaacaccagcaccucacugcaucugcagcucucgcucugccuc

SEQ ID NO: 134619 - RNA, 64 nt, hsa
caucuaggcuggagugcaguggugugaucucagcucacugcagccucugucucccgggcucaag

SEQ ID NO: 134620 - RNA, 64 nt, hsa
uacccaggcuggagugcaguggugcgaucucagcucacugcaaccucugccuccugguucaagc

SEQ ID NO: 134621 - RNA, 64 nt, hsa
agcccaggccagagugcaguggcgcgaucucagcucacugcaagcucugccucccggguucaug

SEQ ID NO: 134622 - RNA, 64 nt, hsa
ugcccaggcuggagugcaguggcgugaucuuggcucacugcaacuuccgccuccuguguucaag

SEQ ID NO: 134623 - RNA, 64 nt, hsa
cgcccaggcuggaguacaauggcacgaucuuggcucacugcaaccuccgccucccggguucaag

SEQ ID NO: 134624 - RNA, 64 nt, hsa
ugcccaggcuggagugcaguggcgccaucucggcucacugcaaccuccgccucccagguucaag

SEQ ID NO: 134625 - RNA, 64 nt, hsa
cgcccgggcugcaguucaguggugcaaucucagcucacugcaagcucugccucccagguuccaa

SEQ ID NO: 134626 - RNA, 64 nt, hsa
aggccauuugaggcugcagugagcuaugauuguaucacugcacuccagccuagaugacagaacg

SEQ ID NO: 134627 - RNA, 64 nt, hsa
ggcccucggugugaagaugaaccuuccaccgucuucacugcauccuggagugcaaaaauaaaau

SEQ ID NO: 134628 - RNA, 64 nt, hsa
cacccaggcuggagugcaguggcacauucucggcucacugcaacuuccgccuccuggguucaag

SEQ ID NO: 134629 - RNA, 64 nt, hsa
aaagacgcaccagcccagaagugcagaacugcagucacugcacguuuucaucucuagggaccag

SEQ ID NO: 134630 - RNA, 64 nt, hsa
ugcccaggcuggagugcaguggcgaaaucccugcucacugcagccuccgcuucccugguucaag

SEQ ID NO: 134631 - RNA, 64 nt, hsa
cacccaggugggagugugguggcacaaucucggcucacugcaaccuccaccuccugaguucaag

SEQ ID NO: 134632 - RNA, 64 nt, hsa
cgcccaggcuggagugcagugucacgaucucagcucacugcaaccuccgccucccagguacaag

SEQ ID NO: 134633 - RNA, 64 nt, hsa
accgggugaggcuggacggucacccaugguggcuucacugcaaggagcaggacugccgagcuca

SEQ ID NO: 134634 - RNA, 64 nt, hsa
cugagcucgcgugcagccacccagagcgcaggggucacugcacgcugcagggcucuugcugcca

SEQ ID NO: 134635 - RNA, 64 nt, hsa
cuguucccaucucuauucaggugccauguggccuucacugcagcccugcagccacccacgcacc

SEQ ID NO: 134636 - RNA, 64 nt, hsa
gcuuccucuuacgugcuagcuuuguaccuaucgcucacugcaugcucgccucccucuugcuggc

SEQ ID NO: 134637 - RNA, 64 nt, hsa
agaccguccuugugacuuuuuaaagagguggggcucacugcaacuggggagaacacuuagcaua

SEQ ID NO: 134638 - RNA, 64 nt, hsa
cacccaggcuggagugcaguggugugaucucggcucacugcaaccuccaccucccggauucaag

SEQ ID NO: 134639 - RNA, 64 nt, hsa
cucagaaugaaaguucauguugguucugaaugguucacugcagcuccugucacaagcugggaug

SEQ ID NO: 134640 - RNA, 64 nt, hsa
ggauaacucagaagucacuguacuccacagagccucacugcagugucuaaagguagaugcaaau

SEQ ID NO: 134641 - RNA, 64 nt, hsa
ugugcaggcuggagugcaguggcacagucuuggcucacugcaaccuccaccuccuggguucaag

SEQ ID NO: 134642 - RNA, 64 nt, hsa
ugugcaggcuguagugcaguggcacgaucuuggcucacugcaaccuccaccucccggguucaag

SEQ ID NO: 134643 - RNA, 64 nt, hsa
uugccaggcuggagugcaguggcgcaaucuuggcucacugcaaccuccgccucccagguucagg

SEQ ID NO: 134644 - RNA, 64 nt, hsa
uuaaaaaucauuuuaguagaauucaguaccauugucacugcaauaaguggguuuuagaaaauaa

SEQ ID NO: 134645 - RNA, 64 nt, hsa
gccagggucaaggacucgugacuccuagcucuuuucacugcaucauacugcugucagaugaaua

SEQ ID NO: 134646 - RNA, 64 nt, hsa
gaacaggaucuacaggucuuugaucuggaaacuaagacuagagaagucuuaagagaugacugcu

SEQ ID NO: 134647 - RNA, 64 nt, hsa
ggaagacucaaacacgauauuacccaaguuccugagacuagagaaguguauaagucugaggaca

SEQ ID NO: 134648 - RNA, 64 nt, hsa
guccuaauaguacucuauucguauuaggaaagagagacuagauaccaaacaucacgagaucaua

SEQ ID NO: 134649 - RNA, 64 nt, hsa
ugucucugcuguacagggccucucagccuccaguagacuagacgaaucuucuuuccauaguaga

SEQ ID NO: 134650 - RNA, 64 nt, hsa
cuucaguuauauuuaauuauuguuaaggaguuuaagacuagaaagacuagagugcuuucuaguc

SEQ ID NO: 134651 - RNA, 64 nt, hsa
uauuuaauuauuguuaaggaguuuaagacuagaaagacuagagugcuuucuaguccaaauagag

SEQ ID NO: 134652 - RNA, 64 nt, hsa
acgugugguucauccaucaucugcugcacauagcagacuagaauucugggaacccugugcaauu

SEQ ID NO: 134653 - RNA, 64 nt, hsa
uugaccggcugccguuugaggacuuuggucacccagacuagacaccuucugugcucauguuugg

SEQ ID NO: 134654 - RNA, 64 nt, hsa
gagggguggagggauguuccccugagccaggcugagacuagaaccccaucuucccugagccagg

SEQ ID NO: 134655 - RNA, 64 nt, hsa
gagacuagaaccccaucuucccugagccaggcugagacuagaaccccaucuuccccaccacgcc

SEQ ID NO: 134656 - RNA, 64 nt, hsa
aaauauguuuccugagagauaagagaaauaauguuccuacaauaguuguauguaucuaagauaa

SEQ ID NO: 134657 - RNA, 64 nt, hsa
gucucuuucgaaagcauuaauucacuuuccuuuuuccuacaaugaaaccuguuuuccauuugua

SEQ ID NO: 134658 - RNA, 64 nt, hsa
uuuuugaugaauuucuagguguuugggucacaguuccuacaaauacggaaaaggggguuaaaaa

SEQ ID NO: 134659 - RNA, 64 nt, hsa
augauauuuuucucugauaauuuaauaucuacucuccuacaaaagcucaagccugaagauacaa

SEQ ID NO: 134660 - RNA, 54 nt, hsa
gugaguauggcaaaacuuaauugauccuacaagcuuacuacacauaggaaaauu

SEQ ID NO: 134661 - RNA, 64 nt, hsa
uacugaaaguugagaaaauucguacuggagagaauccuacaaaugugaaaaauguggcaaaucc

SEQ ID NO: 134662 - RNA, 64 nt, hsa
cuuugguuucguuuuuaagaaguaacccaacauuuccuacaacacuaaauaaaaugguacuuac

SEQ ID NO: 134663 - RNA, 64 nt, hsa
uuaggagacauuagugaauuggagcacuggagaauccuacaaauggccuaugucucagaagagc

SEQ ID NO: 134664 - RNA, 64 nt, hsa
uacuaaacauaagagaauucauaccauagagaaauccuacaaauaugaagaaugugacaaagcu

SEQ ID NO: 134665 - RNA, 64 nt, hsa
cuugauuauagguaauauucauauuggaaaaauuuccuacaaguaagaacaauguggcaaaguu

SEQ ID NO: 134666 - RNA, 64 nt, hsa
ugagaaccucgggguuugagguggccaugggcagacagccgaaagggagggagggugugggugu

SEQ ID NO: 134667 - RNA, 64 nt, hsa
aaccuguacagucauuuuucuacugacuuaauaaacagccgagcugucccuugaugcugagugu

SEQ ID NO: 134668 - RNA, 64 nt, hsa
uucucaaagguugaaaaaaugcuuuuaauuuuucacagccgagaaacagugcagcaguauaugu

SEQ ID NO: 134669 - RNA, 64 nt, hsa
uguccagggagaauacuggcuucauuacacuuguacagccgaguucuucccgcauuacugcugu

SEQ ID NO: 134670 - RNA, 64 nt, hsa
cuuugaucagaggaugcauauuauucagcaucagacagccgacacuggggaggagccuuaucaa

SEQ ID NO: 134671 - RNA, 64 nt, hsa
cuggauucuacugaaguagaggccuggugguuuaacagccgaagacacacgccuagggaugagc

SEQ ID NO: 134672 - RNA, 64 nt, hsa
cuucagccugccuggggugagaggucagugcaccacagccgaggcuggagcacagggagcuucu

SEQ ID NO: 134673 - RNA, 64 nt, hsa
ucacccucuaggcccugugccuggaggugccuccacagccgaccagcagccaccccgccugcuu

SEQ ID NO: 134674 - RNA, 64 nt, hsa
ggcagccucugucaggccuucaggguucagcaguacagccgagacucgacucugugccucccuc

SEQ ID NO: 134675 - RNA, 64 nt, hsa
gugcuuguggagggccugacuguccugcucacccacagccgaucugcugcaggucagcaacugu

SEQ ID NO: 134676 - RNA, 64 nt, hsa
ccuccuccuuccugccugugaugcuccgucucaaacagccgaaaccugucuugcaaugggggga

SEQ ID NO: 134677 - RNA, 64 nt, hsa
ccugcgcccagugauguuuccacggugccuguacacagccgagcagcauuuccguugaaggacu

SEQ ID NO: 134678 - RNA, 63 nt, hsa
agaugcccaugccuguguagccgccaccgagggacagccgagggaccgauggacgaggggaca

SEQ ID NO: 134679 - RNA, 64 nt, hsa
caucauuuaucuugaacauuccgacguguaacucacagccgaagcacuccaucccagauuuguu

SEQ ID NO: 134680 - RNA, 64 nt, hsa
guuggagaugcucaacagcuagacacagaugcucacagccgaccuguggccucuugcucugaag

SEQ ID NO: 134681 - RNA, 64 nt, hsa
ugaagcgcaggaaagaaaggcccauuccccucgcacagccgagcuuuuacucccugagcacggg

SEQ ID NO: 134682 - RNA, 64 nt, hsa
gacaggcccacccugcagcucaggcaccaagaaaacagccgauacuggcagccauugcagcucc

SEQ ID NO: 134683 - RNA, 64 nt, hsa
agagagcagcucagugucacacugggagcugggcacagccgaucuccuuccagaaggguucugu

SEQ ID NO: 134684 - RNA, 64 nt, hsa
auaagugcuuuuggaagucaccuaccuuuuuaacacagccgaacuagucccaacgcguuugcaa

SEQ ID NO: 134685 - RNA, 64 nt, hsa
cccgccacugauucagugagcuggagauuggaucacagccgaaggaguaaaggugcugcaauga

SEQ ID NO: 134686 - RNA, 64 nt, hsa
uuuuauauggcaccuuucugagggaggggauuuuacagccgagggaccuccaaagggaacgucc

SEQ ID NO: 134687 - RNA, 64 nt, hsa
cuccugccggaggcaugucuacuugugaucccggacagccgaacccaagagcugguggcucuga

SEQ ID NO: 134688 - RNA, 64 nt, hsa
acuuacuccaccuuccauuccucgcccuguccccacagccgaguccugcaucagcccuuuaucc

SEQ ID NO: 134689 - RNA, 64 nt, hsa
agauccaucucuuggggcuccccugacagagaagacagccgaagucaaagccacauccucuugc

SEQ ID NO: 134690 - RNA, 64 nt, hsa
agcuguggaagccagaaguugggcgguuucagggacagccgagaauaauguugaccugucagau

SEQ ID NO: 134691 - RNA, 64 nt, hsa
auccaaagcugauucacaaacccacgcucaccugacagccgagggacacgagcaucacucugcu

SEQ ID NO: 134692 - RNA, 64 nt, hsa
ccucuaccacugggcacugagacgaagcucccugacagccgagacuggcagcccuccaucuggu

SEQ ID NO: 134693 - RNA, 64 nt, hsa
augcagggagccagggugagggcagaguguggugacagccgaacuuggaguaauguccguguag

SEQ ID NO: 134694 - RNA, 64 nt, hsa
aacugaggcucaggagagcuagacuaguuugugcacagccgagaaguggucaagcuagaauggg

SEQ ID NO: 134695 - RNA, 64 nt, hsa
ggggagugcagggccagauggggacuccauggagacagccgaccggcgacagccuucagcuccg

SEQ ID NO: 134696 - RNA, 64 nt, hsa
gguuaauggacuuguuaccaaaccuuaaggauauacagccgaagauugucugagguugcuggcu

SEQ ID NO: 134697 - RNA, 64 nt, hsa
gcacacccacucagcuccgugaacuugugagaacacagccgauucaccugagcaggaccucuga

SEQ ID NO: 134698 - RNA, 64 nt, hsa
gucagaccaugaggagccaagaccagcaggucccacagccgacagugcccagagcaugcaggga

SEQ ID NO: 134699 - RNA, 64 nt, hsa
cugacccacgcuugggcaucaauggcaccuccacacagccgaagcacccggcaucuuggugggg

SEQ ID NO: 134700 - RNA, 64 nt, hsa
gaaacuugugccuuuaaacuuuguaaacuuaaacacagccgagaaguugcuucuuuguacuuuu

SEQ ID NO: 134701 - RNA, 64 nt, hsa
ugagccaggcaccucuguuuccugcuguuuauugacagccgacggcagcgccuugcccagaccu

SEQ ID NO: 134702 - RNA, 64 nt, hsa
uccccaccuuucucggaugcagggccagagugacacagccgaaaaauugcaguuugucuguacu

SEQ ID NO: 134703 - RNA, 64 nt, hsa
gugccugggaaccuuccugucuucauccuuagcaacagccgaguggauagaugcccugcuagau

SEQ ID NO: 134704 - RNA, 64 nt, hsa
caaggucgcagaaaggcauucuguugacagaugaacagccgaaagcuggccagacccuccugua

SEQ ID NO: 134705 - RNA, 64 nt, hsa
accaaccaaaaagaguccaggaccagauggauucacagccgaauucuaccagagguacaaggag

SEQ ID NO: 134706 - RNA, 64 nt, hsa
ggccaggacaacgggcuggagggucugggcaacgacagccgagacauguacauggagucugagg

SEQ ID NO: 134707 - RNA, 64 nt, hsa
uuuggccuuagucaaugucuaugcccgucacauaacagccgaggcaccgaggcccacagggaag

SEQ ID NO: 134708 - RNA, 64 nt, hsa
gccagagauacaucaauuacacccccguggggggacagccgaugggagccagcaccagcaggau

SEQ ID NO: 134709 - RNA, 64 nt, hsa
ugacucucgggugaucuuccuuguaucaauaaauacagccgagguugcugagcgcgcuuugaaa

SEQ ID NO: 134710 - RNA, 64 nt, hsa
uugagaaaugcauagcauuauuuaacacuauugaacagccgacuuugagcauuguuucuucuaa

SEQ ID NO: 134711 - RNA, 64 nt, hsa
gagacccagauguuggacaccaggaaggggccccacagccgagacgacguguccagugaccauc

SEQ ID NO: 134712 - RNA, 64 nt, hsa
uggccacauugcugccagccaagaccagaaauaaacagccgaugcugacaucuugaucacugga

SEQ ID NO: 134713 - RNA, 64 nt, hsa
ugggcugguucuucccaccacuucccaggcucugacagccgagacucauuuccaaggcacagca

SEQ ID NO: 134714 - RNA, 64 nt, hsa
aguucuaccuaacuuacuauguagguguaugucuacagccgaugaccucauuucguuuauuuua

SEQ ID NO: 134715 - RNA, 64 nt, hsa
gcgccuuccugcagaacacacagugccuuaugccacagccgaagaauccguggggccggcaagc

SEQ ID NO: 134716 - RNA, 64 nt, hsa
gcugaggugccccggggggugaucucuggugcucacagccgaggagccguggcuccauggccag

SEQ ID NO: 134717 - RNA, 64 nt, hsa
cuucaauuaggacacagccagauggacaucuaagacagccgaucaucuuuccuugccuaugaca

SEQ ID NO: 134718 - RNA, 64 nt, hsa
cccauuuguacuucagcgcuagccccuguuuugcacagccgaguacuggcgaguauguucuaug

SEQ ID NO: 134719 - RNA, 64 nt, hsa
cuauuucuucccuuauaguuuucuaugggaaugaggcggauacaggaaacacccuaucuccucu

SEQ ID NO: 134720 - RNA, 64 nt, hsa
cagcccauagcuuugaguugacauuuucauucuuggcggauagccuacuuuaugaagguaagga

SEQ ID NO: 134721 - RNA, 64 nt, hsa
gccuguaaucccagcacuuugggaggcugaugugggcggauaguugagcccaggaguucgagac

SEQ ID NO: 134722 - RNA, 64 nt, hsa
gcccuggaggggccugacaguggguuccuuccauggcggauacucccuugaaauuucacauucc

SEQ ID NO: 134723 - RNA, 64 nt, hsa
ugauucucuuuucucuucguggcgacuuagaguuggcggauauucggaacugugaauguacaua

SEQ ID NO: 134724 - RNA, 64 nt, hsa
uuauuucugccucuaguuuuguaagcuccuggagggcggauaacaucuuauacuacucuuguau

SEQ ID NO: 134725 - RNA, 64 nt, hsa
ggagaaaacuuaauaauugugccuaaaaacuaugggcggauaguauaagacuauacuagacaaa

SEQ ID NO: 134726 - RNA, 64 nt, hsa
cagccacagcccaaacacaucaaacuugcuaagcggcggauacccccagcuucuaaggugggca

SEQ ID NO: 134727 - RNA, 64 nt, hsa
caaaagcugacccgccuuuugcugcgucaggcugggcggauauuuucauaugaucccucccuca

SEQ ID NO: 134728 - RNA, 64 nt, hsa
cuuauuugccgugaguuuggacggcaccccugcuggcggauagcaagacucuguggaguuuguu

SEQ ID NO: 134729 - RNA, 64 nt, hsa
uuguaaagcugcauauucacugaauggauccucaggcggauaaaagggugcauuuuaaagguau

SEQ ID NO: 134730 - RNA, 64 nt, hsa
cguaggugucuaacacagaggagaguaggaacagggcggauaccugaaggugacuccgagucca

SEQ ID NO: 134731 - RNA, 64 nt, hsa
gaccaacgaaguggagauucgauacguggacuacggcggauauaagagggugaaaguagacgug

SEQ ID NO: 134732 - RNA, 64 nt, hsa
caccuguagucccagcuacucgggggcugagccaggcggauagcuugagcucagggggccaagg

SEQ ID NO: 134733 - RNA, 64 nt, hsa
cuuuuuguuggggguggggugggggcagaggagaggcggauacagaaacuugugagaaugugau

SEQ ID NO: 134734 - RNA, 64 nt, hsa
agucuucagggcuuggcaacugaaauagcuauguggcggauacggaaaacagaggacaauuuga

SEQ ID NO: 134735 - RNA, 64 nt, hsa
acucacaagggucuuaucagacgcccgucuuaaaguccagcaugcucagggacccuguguagga

SEQ ID NO: 134736 - RNA, 64 nt, hsa
aaguccuuaccucuccccuugagauguaaaaaugguccagcagagacaagcucccguggaaaac

SEQ ID NO: 134737 - RNA, 64 nt, hsa
accaaacucugccaggggucccagaaagcccaggguccagcagucucagcacuuggccccuugc

SEQ ID NO: 134738 - RNA, 64 nt, hsa
aucuucuucaggcagcugucuccaccuccaggauguccagcaggcugcaaggagaaggaugcca

SEQ ID NO: 134739 - RNA, 64 nt, hsa
gaagaaucccccauggaaacugcccuuauccgcuguccagcagcugccagaggccccaggucac

SEQ ID NO: 134740 - RNA, 64 nt, hsa
ggaagacgcuuccuuccaggacagcaggcuuugaguccagcacccccagccugccuuugccacc

SEQ ID NO: 134741 - RNA, 64 nt, hsa
cuccuucugggcuaacuccaagguccagcagaguguccagcaaaaguaggcguuagagcauuca

SEQ ID NO: 134742 - RNA, 64 nt, hsa
aggguugcaguccuccuucugggcuaacuccaagguccagcagaguguccagcaaaaguaggcg

SEQ ID NO: 134743 - RNA, 64 nt, hsa
cccuggcccaccuucuggagcgaacugcaccgugguccagcagaggcgcugggugggagggcac

SEQ ID NO: 134744 - RNA, 64 nt, hsa
gacaaacccuuggggcuuuuuuauuuggagaaccguccagcaugcauccuggcccacggccuga

SEQ ID NO: 134745 - RNA, 64 nt, hsa
uagggcuggcucacauccagucacucccaacagcguccagcacacaaauaaaagacccuugggc

SEQ ID NO: 134746 - RNA, 64 nt, hsa
aggccacagggagcuccaccuucucuggucuucaguccagcacugggugcccauccccaucucu

SEQ ID NO: 134747 - RNA, 64 nt, hsa
agaggaagcugaaugaagaggacgccgccagcgaguccagcagggaguccagcaacgaggauga

SEQ ID NO: 134748 - RNA, 64 nt, hsa
augaagaggacgccgccagcgaguccagcagggaguccagcaacgaggaugagggcagcagcuc

SEQ ID NO: 134749 - RNA, 64 nt, hsa
cggagcugcguaccucccgcugcuucuccuugugguccagcaccaccugcuggucaguggcaga

SEQ ID NO: 134750 - RNA, 64 nt, hsa
uuuucagcagaaaugaaggauaagcaucgcacauguccagcaaugucuuugagaaugcagucau

SEQ ID NO: 134751 - RNA, 64 nt, hsa
cgugccguuucugggcaggagaagacaucaugguguccagcaacucagcaaagccauucuuaag

SEQ ID NO: 134752 - RNA, 64 nt, hsa
gaaccacuaggaugugaucugcccuugugggcagguccagcauaguuaggaguuaggcuuuagc

SEQ ID NO: 134753 - RNA, 64 nt, hsa
gcuccagccggccggggaugugagucaucccuugguccagcacauccacgcuguauacgccacc

SEQ ID NO: 134754 - RNA, 64 nt, hsa
acacugggccaaaggcucacuaccccugugcguuguccagcacacagacacuaugugcauuauu

SEQ ID NO: 134755 - RNA, 64 nt, hsa; identical to SEQ ID NO: 53500

SEQ ID NO: 134756 - RNA, 64 nt, hsa; identical to SEQ ID NO: 53501

SEQ ID NO: 134757 - RNA, 64 nt, hsa; identical to SEQ ID NO: 53502

SEQ ID NO: 134758 - RNA, 64 nt, hsa; identical to SEQ ID NO: 53503

SEQ ID NO: 134759 - RNA, 64 nt, hsa; identical to SEQ ID NO: 53504

SEQ ID NO: 134760 - RNA, 64 nt, hsa; identical to SEQ ID NO: 53505

SEQ ID NO: 134761 - RNA, 64 nt, hsa; identical to SEQ ID NO: 53506

SEQ ID NO: 134762 - RNA, 64 nt, hsa; identical to SEQ ID NO: 53507

SEQ ID NO: 134763 - RNA, 64 nt, hsa; identical to SEQ ID NO: 53508

SEQ ID NO: 134764 - RNA, 64 nt, hsa; identical to SEQ ID NO: 53509

SEQ ID NO: 134765 - RNA, 64 nt, hsa; identical to SEQ ID NO: 53510

SEQ ID NO: 134766 - RNA, 64 nt, hsa; identical to SEQ ID NO: 53511

SEQ ID NO: 134767 - RNA, 64 nt, hsa; identical to SEQ ID NO: 53512

SEQ ID NO: 134768 - RNA, 64 nt, hsa; identical to SEQ ID NO: 53513

SEQ ID NO: 134769 - RNA, 64 nt, hsa; identical to SEQ ID NO: 53514

SEQ ID NO: 134770 - RNA, 64 nt, hsa; identical to SEQ ID NO: 53515

SEQ ID NO: 134771 - RNA, 64 nt, hsa; identical to SEQ ID NO: 53516

SEQ ID NO: 134772 - RNA, 64 nt, hsa; identical to SEQ ID NO: 53517

SEQ ID NO: 134773 - RNA, 64 nt, hsa; identical to SEQ ID NO: 53518

SEQ ID NO: 134774 - RNA, 64 nt, hsa; identical to SEQ ID NO: 53519

SEQ ID NO: 134775 - RNA, 64 nt, hsa; identical to SEQ ID NO: 53520

SEQ ID NO: 134776 - RNA, 54 nt, hsa; identical to SEQ ID NO: 53521

SEQ ID NO: 134777 - RNA, 64 nt, hsa; identical to SEQ ID NO: 53522

SEQ ID NO: 134778 - RNA, 64 nt, hsa; identical to SEQ ID NO: 53523

SEQ ID NO: 134779 - RNA, 64 nt, hsa; identical to SEQ ID NO: 53524

SEQ ID NO: 134780 - RNA, 64 nt, hsa; identical to SEQ ID NO: 53525

SEQ ID NO: 134781 - RNA, 64 nt, hsa; identical to SEQ ID NO: 53526

SEQ ID NO: 134782 - RNA, 64 nt, hsa; identical to SEQ ID NO: 53527

SEQ ID NO: 134783 - RNA, 64 nt, hsa; identical to SEQ ID NO: 53528

SEQ ID NO: 134784 - RNA, 64 nt, hsa; identical to SEQ ID NO: 53529

SEQ ID NO: 134785 - RNA, 64 nt, hsa; identical to SEQ ID NO: 53530

SEQ ID NO: 134786 - RNA, 64 nt, hsa; identical to SEQ ID NO: 53531

SEQ ID NO: 134787 - RNA, 64 nt, hsa; identical to SEQ ID NO: 53532

SEQ ID NO: 134788 - RNA, 64 nt, hsa; identical to SEQ ID NO: 53533

SEQ ID NO: 134789 - RNA, 64 nt, hsa; identical to SEQ ID NO: 53534

SEQ ID NO: 134790 - RNA, 64 nt, hsa; identical to SEQ ID NO: 53535

SEQ ID NO: 134791 - RNA, 64 nt, hsa; identical to SEQ ID NO: 53536

SEQ ID NO: 134792 - RNA, 64 nt, hsa; identical to SEQ ID NO: 53537

SEQ ID NO: 134793 - RNA, 64 nt, hsa; identical to SEQ ID NO: 53538

SEQ ID NO: 134794 - RNA, 64 nt, hsa; identical to SEQ ID NO: 53539

SEQ ID NO: 134795 - RNA, 64 nt, hsa; identical to SEQ ID NO: 53540

SEQ ID NO: 134796 - RNA, 64 nt, hsa; identical to SEQ ID NO: 53541

SEQ ID NO: 134797 - RNA, 64 nt, hsa; identical to SEQ ID NO: 53542

SEQ ID NO: 134798 - RNA, 64 nt, hsa; identical to SEQ ID NO: 53543

SEQ ID NO: 134799 - RNA, 64 nt, hsa; identical to SEQ ID NO: 128175

SEQ ID NO: 134800 - RNA, 64 nt, hsa; identical to SEQ ID NO: 128176

SEQ ID NO: 134801 - RNA, 64 nt, hsa; identical to SEQ ID NO: 128177

SEQ ID NO: 134802 - RNA, 64 nt, hsa; identical to SEQ ID NO: 128178

SEQ ID NO: 134803 - RNA, 64 nt, hsa; identical to SEQ ID NO: 128179

SEQ ID NO: 134804 - RNA, 64 nt, hsa; identical to SEQ ID NO: 128180

SEQ ID NO: 134805 - RNA, 64 nt, hsa; identical to SEQ ID NO: 128181

SEQ ID NO: 134806 - RNA, 64 nt, hsa; identical to SEQ ID NO: 128182

SEQ ID NO: 134807 - RNA, 64 nt, hsa; identical to SEQ ID NO: 128183

SEQ ID NO: 134808 - RNA, 64 nt, hsa; identical to SEQ ID NO: 128184

SEQ ID NO: 134809 - RNA, 64 nt, hsa; identical to SEQ ID NO: 128185

SEQ ID NO: 134810 - RNA, 64 nt, hsa; identical to SEQ ID NO: 128186

SEQ ID NO: 134811 - RNA, 64 nt, hsa; identical to SEQ ID NO: 128187

SEQ ID NO: 134812 - RNA, 64 nt, hsa; identical to SEQ ID NO: 128188

SEQ ID NO: 134813 - RNA, 64 nt, hsa; identical to SEQ ID NO: 128189

SEQ ID NO: 134814 - RNA, 64 nt, hsa; identical to SEQ ID NO: 128190

SEQ ID NO: 134815 - RNA, 64 nt, hsa; identical to SEQ ID NO: 128191

SEQ ID NO: 134816 - RNA, 64 nt, hsa; identical to SEQ ID NO: 128192

SEQ ID NO: 134817 - RNA, 64 nt, hsa; identical to SEQ ID NO: 128193

SEQ ID NO: 134818 - RNA, 64 nt, hsa; identical to SEQ ID NO: 128194

SEQ ID NO: 134819 - RNA, 64 nt, hsa; identical to SEQ ID NO: 128195

SEQ ID NO: 134820 - RNA, 64 nt, hsa; identical to SEQ ID NO: 128196

SEQ ID NO: 134821 - RNA, 64 nt, hsa; identical to SEQ ID NO: 128197

SEQ ID NO: 134822 - RNA, 64 nt, hsa; identical to SEQ ID NO: 128198

SEQ ID NO: 134823 - RNA, 64 nt, hsa; identical to SEQ ID NO: 128199

SEQ ID NO: 134824 - RNA, 64 nt, hsa; identical to SEQ ID NO: 128200

SEQ ID NO: 134825 - RNA, 64 nt, hsa; identical to SEQ ID NO: 128201

SEQ ID NO: 134826 - RNA, 64 nt, hsa; identical to SEQ ID NO: 128202

SEQ ID NO: 134827 - RNA, 64 nt, hsa; identical to SEQ ID NO: 128203

SEQ ID NO: 134828 - RNA, 64 nt, hsa; identical to SEQ ID NO: 128204

SEQ ID NO: 134829 - RNA, 64 nt, hsa; identical to SEQ ID NO: 128205

SEQ ID NO: 134830 - RNA, 64 nt, hsa; identical to SEQ ID NO: 128206

SEQ ID NO: 134831 - RNA, 64 nt, hsa; identical to SEQ ID NO: 39347

SEQ ID NO: 134832 - RNA, 64 nt, hsa; identical to SEQ ID NO: 39348

SEQ ID NO: 134833 - RNA, 64 nt, hsa; identical to SEQ ID NO: 39349

SEQ ID NO: 134834 - RNA, 64 nt, hsa; identical to SEQ ID NO: 39350

SEQ ID NO: 134835 - RNA, 64 nt, hsa; identical to SEQ ID NO: 39351

SEQ ID NO: 134836 - RNA, 64 nt, hsa; identical to SEQ ID NO: 39352

SEQ ID NO: 134837 - RNA, 64 nt, hsa; identical to SEQ ID NO: 39353

SEQ ID NO: 134838 - RNA, 64 nt, hsa; identical to SEQ ID NO: 39354

SEQ ID NO: 134839 - RNA, 64 nt, hsa; identical to SEQ ID NO: 39355

SEQ ID NO: 134840 - RNA, 64 nt, hsa; identical to SEQ ID NO: 39356

SEQ ID NO: 134841 - RNA, 64 nt, hsa; identical to SEQ ID NO: 39357

SEQ ID NO: 134842 - RNA, 64 nt, hsa; identical to SEQ ID NO: 39358

SEQ ID NO: 134843 - RNA, 64 nt, hsa; identical to SEQ ID NO: 39359

SEQ ID NO: 134844 - RNA, 64 nt, hsa; identical to SEQ ID NO: 39360

SEQ ID NO: 134845 - RNA, 64 nt, hsa; identical to SEQ ID NO: 39361

SEQ ID NO: 134846 - RNA, 64 nt, hsa; identical to SEQ ID NO: 39362

SEQ ID NO: 134847 - RNA, 64 nt, hsa; identical to SEQ ID NO: 39363

SEQ ID NO: 134848 - RNA, 64 nt, hsa; identical to SEQ ID NO: 39364

SEQ ID NO: 134849 - RNA, 64 nt, hsa; identical to SEQ ID NO: 39365

SEQ ID NO: 134850 - RNA, 64 nt, hsa; identical to SEQ ID NO: 39366

SEQ ID NO: 134851 - RNA, 64 nt, hsa; identical to SEQ ID NO: 39367

SEQ ID NO: 134852 - RNA, 64 nt, hsa; identical to SEQ ID NO: 39368

SEQ ID NO: 134853 - RNA, 64 nt, hsa; identical to SEQ ID NO: 39369

SEQ ID NO: 134854 - RNA, 64 nt, hsa; identical to SEQ ID NO: 39370

SEQ ID NO: 134855 - RNA, 64 nt, hsa; identical to SEQ ID NO: 39371

SEQ ID NO: 134856 - RNA, 64 nt, hsa; identical to SEQ ID NO: 39372

SEQ ID NO: 134857 - RNA, 64 nt, hsa; identical to SEQ ID NO: 39373

SEQ ID NO: 134858 - RNA, 64 nt, hsa; identical to SEQ ID NO: 39374

SEQ ID NO: 134859 - RNA, 64 nt, hsa; identical to SEQ ID NO: 39375

SEQ ID NO: 134860 - RNA, 64 nt, hsa; identical to SEQ ID NO: 39376

SEQ ID NO: 134861 - RNA, 64 nt, hsa; identical to SEQ ID NO: 39377

SEQ ID NO: 134862 - RNA, 64 nt, hsa; identical to SEQ ID NO: 39378

SEQ ID NO: 134863 - RNA, 64 nt, hsa; identical to SEQ ID NO: 39379

SEQ ID NO: 134864 - RNA, 64 nt, hsa; identical to SEQ ID NO: 39380

SEQ ID NO: 134865 - RNA, 64 nt, hsa; identical to SEQ ID NO: 39381

SEQ ID NO: 134866 - RNA, 64 nt, hsa; identical to SEQ ID NO: 39382

SEQ ID NO: 134867 - RNA, 64 nt, hsa; identical to SEQ ID NO: 39383

SEQ ID NO: 134868 - RNA, 64 nt, hsa; identical to SEQ ID NO: 39384

SEQ ID NO: 134869 - RNA, 64 nt, hsa; identical to SEQ ID NO: 39385

SEQ ID NO: 134870 - RNA, 64 nt, hsa; identical to SEQ ID NO: 39386

SEQ ID NO: 134871 - RNA, 64 nt, hsa; identical to SEQ ID NO: 39387

SEQ ID NO: 134872 - RNA, 64 nt, hsa; identical to SEQ ID NO: 39388

SEQ ID NO: 134873 - RNA, 64 nt, hsa; identical to SEQ ID NO: 39389

SEQ ID NO: 134874 - RNA, 64 nt, hsa; identical to SEQ ID NO: 39390

SEQ ID NO: 134875 - RNA, 64 nt, hsa; identical to SEQ ID NO: 39391

SEQ ID NO: 134876 - RNA, 64 nt, hsa; identical to SEQ ID NO: 39392

SEQ ID NO: 134877 - RNA, 64 nt, hsa; identical to SEQ ID NO: 39393

SEQ ID NO: 134878 - RNA, 64 nt, hsa; identical to SEQ ID NO: 39394

SEQ ID NO: 134879 - RNA, 64 nt, hsa; identical to SEQ ID NO: 39395

SEQ ID NO: 134880 - RNA, 64 nt, hsa; identical to SEQ ID NO: 39396

SEQ ID NO: 134881 - RNA, 64 nt, hsa; identical to SEQ ID NO: 39397

SEQ ID NO: 134882 - RNA, 64 nt, hsa; identical to SEQ ID NO: 39398

SEQ ID NO: 134883 - RNA, 64 nt, hsa; identical to SEQ ID NO: 39399

SEQ ID NO: 134884 - RNA, 64 nt, hsa; identical to SEQ ID NO: 39400

SEQ ID NO: 134885 - RNA, 64 nt, hsa; identical to SEQ ID NO: 39401

SEQ ID NO: 134886 - RNA, 64 nt, hsa; identical to SEQ ID NO: 39402

SEQ ID NO: 134887 - RNA, 64 nt, hsa; identical to SEQ ID NO: 39403

SEQ ID NO: 134888 - RNA, 64 nt, hsa; identical to SEQ ID NO: 39404

SEQ ID NO: 134889 - RNA, 64 nt, hsa; identical to SEQ ID NO: 39405

SEQ ID NO: 134890 - RNA, 64 nt, hsa; identical to SEQ ID NO: 39406

SEQ ID NO: 134891 - RNA, 64 nt, hsa; identical to SEQ ID NO: 39407

SEQ ID NO: 134892 - RNA, 64 nt, hsa; identical to SEQ ID NO: 39408

SEQ ID NO: 134893 - RNA, 64 nt, hsa; identical to SEQ ID NO: 39409

SEQ ID NO: 134894 - RNA, 64 nt, hsa; identical to SEQ ID NO: 39410

SEQ ID NO: 134895 - RNA, 64 nt, hsa; identical to SEQ ID NO: 39411

SEQ ID NO: 134896 - RNA, 64 nt, hsa; identical to SEQ ID NO: 39412

SEQ ID NO: 134897 - RNA, 64 nt, hsa; identical to SEQ ID NO: 39413

SEQ ID NO: 134898 - RNA, 64 nt, hsa; identical to SEQ ID NO: 39414

SEQ ID NO: 134899 - RNA, 64 nt, hsa; identical to SEQ ID NO: 39415

SEQ ID NO: 134900 - RNA, 64 nt, hsa; identical to SEQ ID NO: 39416

SEQ ID NO: 134901 - RNA, 64 nt, hsa; identical to SEQ ID NO: 39417

SEQ ID NO: 134902 - RNA, 64 nt, hsa; identical to SEQ ID NO: 39418

SEQ ID NO: 134903 - RNA, 64 nt, hsa; identical to SEQ ID NO: 39419

SEQ ID NO: 134904 - RNA, 64 nt, hsa; identical to SEQ ID NO: 39420

SEQ ID NO: 134905 - RNA, 64 nt, hsa; identical to SEQ ID NO: 39421

SEQ ID NO: 134906 - RNA, 64 nt, hsa; identical to SEQ ID NO: 39422

SEQ ID NO: 134907 - RNA, 64 nt, hsa; identical to SEQ ID NO: 39423

SEQ ID NO: 134908 - RNA, 64 nt, hsa; identical to SEQ ID NO: 39424

SEQ ID NO: 134909 - RNA, 64 nt, hsa; identical to SEQ ID NO: 39425

SEQ ID NO: 134910 - RNA, 64 nt, hsa; identical to SEQ ID NO: 39426

SEQ ID NO: 134911 - RNA, 64 nt, hsa; identical to SEQ ID NO: 39427

SEQ ID NO: 134912 - RNA, 64 nt, hsa; identical to SEQ ID NO: 39428

SEQ ID NO: 134913 - RNA, 64 nt, hsa; identical to SEQ ID NO: 39429

SEQ ID NO: 134914 - RNA, 64 nt, hsa; identical to SEQ ID NO: 39430

SEQ ID NO: 134915 - RNA, 64 nt, hsa; identical to SEQ ID NO: 39431

SEQ ID NO: 134916 - RNA, 64 nt, hsa; identical to SEQ ID NO: 39432

SEQ ID NO: 134917 - RNA, 64 nt, hsa; identical to SEQ ID NO: 39433

SEQ ID NO: 134918 - RNA, 64 nt, hsa; identical to SEQ ID NO: 39434

SEQ ID NO: 134919 - RNA, 64 nt, hsa; identical to SEQ ID NO: 39435

SEQ ID NO: 134920 - RNA, 64 nt, hsa; identical to SEQ ID NO: 39436

SEQ ID NO: 134921 - RNA, 64 nt, hsa; identical to SEQ ID NO: 39437

SEQ ID NO: 134922 - RNA, 64 nt, hsa; identical to SEQ ID NO: 39438

SEQ ID NO: 134923 - RNA, 64 nt, hsa; identical to SEQ ID NO: 39439

SEQ ID NO: 134924 - RNA, 64 nt, hsa; identical to SEQ ID NO: 39440

SEQ ID NO: 134925 - RNA, 64 nt, hsa; identical to SEQ ID NO: 39441

SEQ ID NO: 134926 - RNA, 64 nt, hsa; identical to SEQ ID NO: 39442

SEQ ID NO: 134927 - RNA, 64 nt, hsa; identical to SEQ ID NO: 39443

SEQ ID NO: 134928 - RNA, 64 nt, hsa; identical to SEQ ID NO: 39444

SEQ ID NO: 134929 - RNA, 64 nt, hsa; identical to SEQ ID NO: 39445

SEQ ID NO: 134930 - RNA, 64 nt, hsa; identical to SEQ ID NO: 39446

SEQ ID NO: 134931 - RNA, 64 nt, hsa; identical to SEQ ID NO: 39447

SEQ ID NO: 134932 - RNA, 64 nt, hsa; identical to SEQ ID NO: 39448

SEQ ID NO: 134933 - RNA, 64 nt, hsa; identical to SEQ ID NO: 39449

SEQ ID NO: 134934 - RNA, 64 nt, hsa; identical to SEQ ID NO: 39450

SEQ ID NO: 134935 - RNA, 64 nt, hsa; identical to SEQ ID NO: 39451

SEQ ID NO: 134936 - RNA, 64 nt, hsa; identical to SEQ ID NO: 39452

SEQ ID NO: 134937 - RNA, 64 nt, hsa; identical to SEQ ID NO: 39453

SEQ ID NO: 134938 - RNA, 64 nt, hsa; identical to SEQ ID NO: 39454

SEQ ID NO: 134939 - RNA, 64 nt, hsa; identical to SEQ ID NO: 39455

SEQ ID NO: 134940 - RNA, 64 nt, hsa; identical to SEQ ID NO: 39456

SEQ ID NO: 134941 - RNA, 64 nt, hsa; identical to SEQ ID NO: 39457

SEQ ID NO: 134942 - RNA, 64 nt, hsa; identical to SEQ ID NO: 39458

SEQ ID NO: 134943 - RNA, 64 nt, hsa; identical to SEQ ID NO: 39459

SEQ ID NO: 134944 - RNA, 64 nt, hsa; identical to SEQ ID NO: 39460

SEQ ID NO: 134945 - RNA, 64 nt, hsa; identical to SEQ ID NO: 39461

SEQ ID NO: 134946 - RNA, 64 nt, hsa; identical to SEQ ID NO: 39462

SEQ ID NO: 134947 - RNA, 64 nt, hsa; identical to SEQ ID NO: 39463

SEQ ID NO: 134948 - RNA, 64 nt, hsa; identical to SEQ ID NO: 39464

SEQ ID NO: 134949 - RNA, 64 nt, hsa; identical to SEQ ID NO: 39465

SEQ ID NO: 134950 - RNA, 64 nt, hsa; identical to SEQ ID NO: 39466

SEQ ID NO: 134951 - RNA, 64 nt, hsa; identical to SEQ ID NO: 39467

SEQ ID NO: 134952 - RNA, 64 nt, hsa; identical to SEQ ID NO: 39468

SEQ ID NO: 134953 - RNA, 64 nt, hsa; identical to SEQ ID NO: 39469

SEQ ID NO: 134954 - RNA, 64 nt, hsa; identical to SEQ ID NO: 39470

SEQ ID NO: 134955 - RNA, 64 nt, hsa; identical to SEQ ID NO: 39471

SEQ ID NO: 134956 - RNA, 64 nt, hsa; identical to SEQ ID NO: 39472

SEQ ID NO: 134957 - RNA, 64 nt, hsa; identical to SEQ ID NO: 39473

SEQ ID NO: 134958 - RNA, 64 nt, hsa; identical to SEQ ID NO: 39474

SEQ ID NO: 134959 - RNA, 64 nt, hsa; identical to SEQ ID NO: 39475

SEQ ID NO: 134960 - RNA, 64 nt, hsa; identical to SEQ ID NO: 39476

SEQ ID NO: 134961 - RNA, 64 nt, hsa; identical to SEQ ID NO: 39477

SEQ ID NO: 134962 - RNA, 64 nt, hsa; identical to SEQ ID NO: 39478

SEQ ID NO: 134963 - RNA, 64 nt, hsa; identical to SEQ ID NO: 39479

SEQ ID NO: 134964 - RNA, 64 nt, hsa; identical to SEQ ID NO: 39480

SEQ ID NO: 134965 - RNA, 64 nt, hsa; identical to SEQ ID NO: 39481

SEQ ID NO: 134966 - RNA, 64 nt, hsa; identical to SEQ ID NO: 39482

SEQ ID NO: 134967 - RNA, 64 nt, hsa; identical to SEQ ID NO: 39483

SEQ ID NO: 134968 - RNA, 64 nt, hsa; identical to SEQ ID NO: 39484

SEQ ID NO: 134969 - RNA, 64 nt, hsa; identical to SEQ ID NO: 39485

SEQ ID NO: 134970 - RNA, 64 nt, hsa; identical to SEQ ID NO: 39486

SEQ ID NO: 134971 - RNA, 64 nt, hsa; identical to SEQ ID NO: 39487

SEQ ID NO: 134972 - RNA, 64 nt, hsa; identical to SEQ ID NO: 39488

SEQ ID NO: 134973 - RNA, 64 nt, hsa; identical to SEQ ID NO: 39489

SEQ ID NO: 134974 - RNA, 64 nt, hsa; identical to SEQ ID NO: 39490

SEQ ID NO: 134975 - RNA, 64 nt, hsa; identical to SEQ ID NO: 39491

SEQ ID NO: 134976 - RNA, 64 nt, hsa; identical to SEQ ID NO: 39492

SEQ ID NO: 134977 - RNA, 64 nt, hsa; identical to SEQ ID NO: 39493

SEQ ID NO: 134978 - RNA, 64 nt, hsa; identical to SEQ ID NO: 39494

SEQ ID NO: 134979 - RNA, 64 nt, hsa; identical to SEQ ID NO: 39495

SEQ ID NO: 134980 - RNA, 64 nt, hsa; identical to SEQ ID NO: 39496

SEQ ID NO: 134981 - RNA, 64 nt, hsa; identical to SEQ ID NO: 39497

SEQ ID NO: 134982 - RNA, 64 nt, hsa; identical to SEQ ID NO: 39498

SEQ ID NO: 134983 - RNA, 64 nt, hsa; identical to SEQ ID NO: 39499

SEQ ID NO: 134984 - RNA, 64 nt, hsa; identical to SEQ ID NO: 39500

SEQ ID NO: 134985 - RNA, 64 nt, hsa; identical to SEQ ID NO: 39501

SEQ ID NO: 134986 - RNA, 64 nt, hsa; identical to SEQ ID NO: 39502

SEQ ID NO: 134987 - RNA, 64 nt, hsa; identical to SEQ ID NO: 39503

SEQ ID NO: 134988 - RNA, 64 nt, hsa; identical to SEQ ID NO: 39504

SEQ ID NO: 134989 - RNA, 64 nt, hsa; identical to SEQ ID NO: 39505

SEQ ID NO: 134990 - RNA, 64 nt, hsa; identical to SEQ ID NO: 39506

SEQ ID NO: 134991 - RNA, 64 nt, hsa; identical to SEQ ID NO: 39507

SEQ ID NO: 134992 - RNA, 64 nt, hsa; identical to SEQ ID NO: 39508

SEQ ID NO: 134993 - RNA, 64 nt, hsa; identical to SEQ ID NO: 39509

SEQ ID NO: 134994 - RNA, 64 nt, hsa; identical to SEQ ID NO: 39510

SEQ ID NO: 134995 - RNA, 64 nt, hsa; identical to SEQ ID NO: 39511

SEQ ID NO: 134996 - RNA, 64 nt, hsa; identical to SEQ ID NO: 39512

SEQ ID NO: 134997 - RNA, 64 nt, hsa; identical to SEQ ID NO: 39513

SEQ ID NO: 134998 - RNA, 64 nt, hsa; identical to SEQ ID NO: 39514

SEQ ID NO: 134999 - RNA, 64 nt, hsa; identical to SEQ ID NO: 39515

SEQ ID NO: 135000 - RNA, 64 nt, hsa; identical to SEQ ID NO: 39516

SEQ ID NO: 135001 - RNA, 64 nt, hsa; identical to SEQ ID NO: 39517

SEQ ID NO: 135002 - RNA, 64 nt, hsa; identical to SEQ ID NO: 39518

SEQ ID NO: 135003 - RNA, 64 nt, hsa; identical to SEQ ID NO: 39519

SEQ ID NO: 135004 - RNA, 64 nt, hsa; identical to SEQ ID NO: 39520

SEQ ID NO: 135005 - RNA, 64 nt, hsa; identical to SEQ ID NO: 39521

SEQ ID NO: 135006 - RNA, 64 nt, hsa; identical to SEQ ID NO: 39522

SEQ ID NO: 135007 - RNA, 64 nt, hsa; identical to SEQ ID NO: 39523

SEQ ID NO: 135008 - RNA, 64 nt, hsa; identical to SEQ ID NO: 39524

SEQ ID NO: 135009 - RNA, 64 nt, hsa; identical to SEQ ID NO: 39525

SEQ ID NO: 135010 - RNA, 64 nt, hsa; identical to SEQ ID NO: 39526

SEQ ID NO: 135011 - RNA, 64 nt, hsa; identical to SEQ ID NO: 39527

SEQ ID NO: 135012 - RNA, 64 nt, hsa; identical to SEQ ID NO: 39528

SEQ ID NO: 135013 - RNA, 64 nt, hsa; identical to SEQ ID NO: 39529

SEQ ID NO: 135014 - RNA, 64 nt, hsa; identical to SEQ ID NO: 39530

SEQ ID NO: 135015 - RNA, 64 nt, hsa; identical to SEQ ID NO: 39531

SEQ ID NO: 135016 - RNA, 64 nt, hsa; identical to SEQ ID NO: 39532

SEQ ID NO: 135017 - RNA, 64 nt, hsa; identical to SEQ ID NO: 39533

SEQ ID NO: 135018 - RNA, 64 nt, hsa; identical to SEQ ID NO: 39534

SEQ ID NO: 135019 - RNA, 64 nt, hsa; identical to SEQ ID NO: 39535

SEQ ID NO: 135020 - RNA, 64 nt, hsa; identical to SEQ ID NO: 39536

SEQ ID NO: 135021 - RNA, 64 nt, hsa; identical to SEQ ID NO: 39537

SEQ ID NO: 135022 - RNA, 64 nt, hsa; identical to SEQ ID NO: 39538

SEQ ID NO: 135023 - RNA, 64 nt, hsa; identical to SEQ ID NO: 39539

SEQ ID NO: 135024 - RNA, 64 nt, hsa; identical to SEQ ID NO: 39540

SEQ ID NO: 135025 - RNA, 64 nt, hsa; identical to SEQ ID NO: 39541

SEQ ID NO: 135026 - RNA, 64 nt, hsa; identical to SEQ ID NO: 39542

SEQ ID NO: 135027 - RNA, 64 nt, hsa; identical to SEQ ID NO: 39543

SEQ ID NO: 135028 - RNA, 64 nt, hsa; identical to SEQ ID NO: 39544

SEQ ID NO: 135029 - RNA, 64 nt, hsa; identical to SEQ ID NO: 39545

SEQ ID NO: 135030 - RNA, 64 nt, hsa; identical to SEQ ID NO: 39546

SEQ ID NO: 135031 - RNA, 64 nt, hsa; identical to SEQ ID NO: 39547

SEQ ID NO: 135032 - RNA, 64 nt, hsa; identical to SEQ ID NO: 39548

SEQ ID NO: 135033 - RNA, 64 nt, hsa; identical to SEQ ID NO: 39549

SEQ ID NO: 135034 - RNA, 64 nt, hsa; identical to SEQ ID NO: 39550

SEQ ID NO: 135035 - RNA, 64 nt, hsa; identical to SEQ ID NO: 39551

SEQ ID NO: 135036 - RNA, 64 nt, hsa; identical to SEQ ID NO: 39552

SEQ ID NO: 135037 - RNA, 64 nt, hsa; identical to SEQ ID NO: 39553

SEQ ID NO: 135038 - RNA, 64 nt, hsa; identical to SEQ ID NO: 39554

SEQ ID NO: 135039 - RNA, 64 nt, hsa; identical to SEQ ID NO: 39555

SEQ ID NO: 135040 - RNA, 64 nt, hsa; identical to SEQ ID NO: 39556

SEQ ID NO: 135041 - RNA, 64 nt, hsa; identical to SEQ ID NO: 39557

SEQ ID NO: 135042 - RNA, 64 nt, hsa; identical to SEQ ID NO: 39558

SEQ ID NO: 135043 - RNA, 64 nt, hsa; identical to SEQ ID NO: 39559

SEQ ID NO: 135044 - RNA, 64 nt, hsa; identical to SEQ ID NO: 39560

SEQ ID NO: 135045 - RNA, 64 nt, hsa; identical to SEQ ID NO: 39561

SEQ ID NO: 135046 - RNA, 64 nt, hsa; identical to SEQ ID NO: 39562

SEQ ID NO: 135047 - RNA, 64 nt, hsa; identical to SEQ ID NO: 39563

SEQ ID NO: 135048 - RNA, 64 nt, hsa; identical to SEQ ID NO: 39564

SEQ ID NO: 135049 - RNA, 64 nt, hsa; identical to SEQ ID NO: 39565

SEQ ID NO: 135050 - RNA, 64 nt, hsa; identical to SEQ ID NO: 39566

SEQ ID NO: 135051 - RNA, 64 nt, hsa; identical to SEQ ID NO: 39567

SEQ ID NO: 135052 - RNA, 64 nt, hsa; identical to SEQ ID NO: 39568

SEQ ID NO: 135053 - RNA, 64 nt, hsa; identical to SEQ ID NO: 39569

SEQ ID NO: 135054 - RNA, 64 nt, hsa; identical to SEQ ID NO: 39570

SEQ ID NO: 135055 - RNA, 64 nt, hsa; identical to SEQ ID NO: 39571

SEQ ID NO: 135056 - RNA, 64 nt, hsa; identical to SEQ ID NO: 39572

SEQ ID NO: 135057 - RNA, 64 nt, hsa; identical to SEQ ID NO: 39573

SEQ ID NO: 135058 - RNA, 64 nt, hsa; identical to SEQ ID NO: 39574

SEQ ID NO: 135059 - RNA, 64 nt, hsa; identical to SEQ ID NO: 39575

SEQ ID NO: 135060 - RNA, 64 nt, hsa; identical to SEQ ID NO: 39576

SEQ ID NO: 135061 - RNA, 64 nt, hsa; identical to SEQ ID NO: 39577

SEQ ID NO: 135062 - RNA, 64 nt, hsa; identical to SEQ ID NO: 39578

SEQ ID NO: 135063 - RNA, 64 nt, hsa; identical to SEQ ID NO: 39579

SEQ ID NO: 135064 - RNA, 64 nt, hsa; identical to SEQ ID NO: 39580

SEQ ID NO: 135065 - RNA, 64 nt, hsa; identical to SEQ ID NO: 39581

SEQ ID NO: 135066 - RNA, 64 nt, hsa; identical to SEQ ID NO: 39582

SEQ ID NO: 135067 - RNA, 64 nt, hsa; identical to SEQ ID NO: 39583

SEQ ID NO: 135068 - RNA, 64 nt, hsa; identical to SEQ ID NO: 39584

SEQ ID NO: 135069 - RNA, 64 nt, hsa; identical to SEQ ID NO: 39585

SEQ ID NO: 135070 - RNA, 64 nt, hsa; identical to SEQ ID NO: 39586

SEQ ID NO: 135071 - RNA, 64 nt, hsa; identical to SEQ ID NO: 39587

SEQ ID NO: 135072 - RNA, 64 nt, hsa; identical to SEQ ID NO: 39588

SEQ ID NO: 135073 - RNA, 64 nt, hsa; identical to SEQ ID NO: 39589

SEQ ID NO: 135074 - RNA, 64 nt, hsa; identical to SEQ ID NO: 39590

SEQ ID NO: 135075 - RNA, 64 nt, hsa; identical to SEQ ID NO: 39591

SEQ ID NO: 135076 - RNA, 64 nt, hsa; identical to SEQ ID NO: 39592

SEQ ID NO: 135077 - RNA, 64 nt, hsa; identical to SEQ ID NO: 39593

SEQ ID NO: 135078 - RNA, 64 nt, hsa; identical to SEQ ID NO: 39594

SEQ ID NO: 135079 - RNA, 64 nt, hsa; identical to SEQ ID NO: 39595

SEQ ID NO: 135080 - RNA, 64 nt, hsa; identical to SEQ ID NO: 39596

SEQ ID NO: 135081 - RNA, 64 nt, hsa; identical to SEQ ID NO: 39597

SEQ ID NO: 135082 - RNA, 64 nt, hsa; identical to SEQ ID NO: 39598

SEQ ID NO: 135083 - RNA, 64 nt, hsa; identical to SEQ ID NO: 39599

SEQ ID NO: 135084 - RNA, 64 nt, hsa; identical to SEQ ID NO: 39600

SEQ ID NO: 135085 - RNA, 64 nt, hsa; identical to SEQ ID NO: 39601

SEQ ID NO: 135086 - RNA, 64 nt, hsa; identical to SEQ ID NO: 39602

SEQ ID NO: 135087 - RNA, 64 nt, hsa; identical to SEQ ID NO: 39603

SEQ ID NO: 135088 - RNA, 64 nt, hsa; identical to SEQ ID NO: 39604

SEQ ID NO: 135089 - RNA, 64 nt, hsa; identical to SEQ ID NO: 39605

SEQ ID NO: 135090 - RNA, 64 nt, hsa; identical to SEQ ID NO: 39606

SEQ ID NO: 135091 - RNA, 64 nt, hsa; identical to SEQ ID NO: 39607

SEQ ID NO: 135092 - RNA, 64 nt, hsa; identical to SEQ ID NO: 39608

SEQ ID NO: 135093 - RNA, 64 nt, hsa; identical to SEQ ID NO: 39609

SEQ ID NO: 135094 - RNA, 64 nt, hsa; identical to SEQ ID NO: 39610

SEQ ID NO: 135095 - RNA, 64 nt, hsa; identical to SEQ ID NO: 39611

SEQ ID NO: 135096 - RNA, 64 nt, hsa; identical to SEQ ID NO: 39612

SEQ ID NO: 135097 - RNA, 64 nt, hsa; identical to SEQ ID NO: 39613

SEQ ID NO: 135098 - RNA, 64 nt, hsa; identical to SEQ ID NO: 39614

SEQ ID NO: 135099 - RNA, 64 nt, hsa; identical to SEQ ID NO: 39615

SEQ ID NO: 135100 - RNA, 64 nt, hsa; identical to SEQ ID NO: 39616

SEQ ID NO: 135101 - RNA, 64 nt, hsa; identical to SEQ ID NO: 39617

SEQ ID NO: 135102 - RNA, 64 nt, hsa; identical to SEQ ID NO: 39618

SEQ ID NO: 135103 - RNA, 64 nt, hsa; identical to SEQ ID NO: 39619

SEQ ID NO: 135104 - RNA, 64 nt, hsa; identical to SEQ ID NO: 39620

SEQ ID NO: 135105 - RNA, 64 nt, hsa; identical to SEQ ID NO: 39621

SEQ ID NO: 135106 - RNA, 64 nt, hsa; identical to SEQ ID NO: 39622

SEQ ID NO: 135107 - RNA, 64 nt, hsa; identical to SEQ ID NO: 39623

SEQ ID NO: 135108 - RNA, 64 nt, hsa; identical to SEQ ID NO: 39624

SEQ ID NO: 135109 - RNA, 64 nt, hsa; identical to SEQ ID NO: 39625

SEQ ID NO: 135110 - RNA, 64 nt, hsa; identical to SEQ ID NO: 39626

SEQ ID NO: 135111 - RNA, 64 nt, hsa; identical to SEQ ID NO: 39627

SEQ ID NO: 135112 - RNA, 64 nt, hsa; identical to SEQ ID NO: 39628

SEQ ID NO: 135113 - RNA, 64 nt, hsa; identical to SEQ ID NO: 39629

SEQ ID NO: 135114 - RNA, 64 nt, hsa; identical to SEQ ID NO: 39630

SEQ ID NO: 135115 - RNA, 64 nt, hsa; identical to SEQ ID NO: 39631

SEQ ID NO: 135116 - RNA, 64 nt, hsa; identical to SEQ ID NO: 39632

SEQ ID NO: 135117 - RNA, 64 nt, hsa; identical to SEQ ID NO: 39633

SEQ ID NO: 135118 - RNA, 64 nt, hsa; identical to SEQ ID NO: 39634

SEQ ID NO: 135119 - RNA, 64 nt, hsa; identical to SEQ ID NO: 39635

SEQ ID NO: 135120 - RNA, 64 nt, hsa; identical to SEQ ID NO: 39636

SEQ ID NO: 135121 - RNA, 64 nt, hsa; identical to SEQ ID NO: 39637

SEQ ID NO: 135122 - RNA, 64 nt, hsa; identical to SEQ ID NO: 39638

SEQ ID NO: 135123 - RNA, 64 nt, hsa; identical to SEQ ID NO: 39639

SEQ ID NO: 135124 - RNA, 64 nt, hsa; identical to SEQ ID NO: 39640

SEQ ID NO: 135125 - RNA, 64 nt, hsa; identical to SEQ ID NO: 39641

SEQ ID NO: 135126 - RNA, 64 nt, hsa; identical to SEQ ID NO: 39642

SEQ ID NO: 135127 - RNA, 64 nt, hsa; identical to SEQ ID NO: 39643

SEQ ID NO: 135128 - RNA, 64 nt, hsa; identical to SEQ ID NO: 39644

SEQ ID NO: 135129 - RNA, 64 nt, hsa; identical to SEQ ID NO: 39645

SEQ ID NO: 135130 - RNA, 64 nt, hsa; identical to SEQ ID NO: 39646

SEQ ID NO: 135131 - RNA, 64 nt, hsa; identical to SEQ ID NO: 39647

SEQ ID NO: 135132 - RNA, 64 nt, hsa; identical to SEQ ID NO: 39648

SEQ ID NO: 135133 - RNA, 64 nt, hsa; identical to SEQ ID NO: 39649

SEQ ID NO: 135134 - RNA, 64 nt, hsa; identical to SEQ ID NO: 39650

SEQ ID NO: 135135 - RNA, 64 nt, hsa; identical to SEQ ID NO: 39651

SEQ ID NO: 135136 - RNA, 64 nt, hsa; identical to SEQ ID NO: 39652

SEQ ID NO: 135137 - RNA, 64 nt, hsa; identical to SEQ ID NO: 39653

SEQ ID NO: 135138 - RNA, 64 nt, hsa; identical to SEQ ID NO: 39654

SEQ ID NO: 135139 - RNA, 64 nt, hsa; identical to SEQ ID NO: 39655

SEQ ID NO: 135140 - RNA, 64 nt, hsa; identical to SEQ ID NO: 39656

SEQ ID NO: 135141 - RNA, 64 nt, hsa; identical to SEQ ID NO: 39657

SEQ ID NO: 135142 - RNA, 64 nt, hsa; identical to SEQ ID NO: 39658

SEQ ID NO: 135143 - RNA, 64 nt, hsa; identical to SEQ ID NO: 39659

SEQ ID NO: 135144 - RNA, 64 nt, hsa; identical to SEQ ID NO: 39660

SEQ ID NO: 135145 - RNA, 64 nt, hsa; identical to SEQ ID NO: 39661

SEQ ID NO: 135146 - RNA, 64 nt, hsa; identical to SEQ ID NO: 39662

SEQ ID NO: 135147 - RNA, 64 nt, hsa; identical to SEQ ID NO: 39663

SEQ ID NO: 135148 - RNA, 64 nt, hsa; identical to SEQ ID NO: 39664

SEQ ID NO: 135149 - RNA, 64 nt, hsa; identical to SEQ ID NO: 39665

SEQ ID NO: 135150 - RNA, 64 nt, hsa; identical to SEQ ID NO: 39666

SEQ ID NO: 135151 - RNA, 64 nt, hsa; identical to SEQ ID NO: 39667

SEQ ID NO: 135152 - RNA, 64 nt, hsa; identical to SEQ ID NO: 39668

SEQ ID NO: 135153 - RNA, 64 nt, hsa; identical to SEQ ID NO: 39669

SEQ ID NO: 135154 - RNA, 64 nt, hsa; identical to SEQ ID NO: 39670

SEQ ID NO: 135155 - RNA, 64 nt, hsa; identical to SEQ ID NO: 39671

SEQ ID NO: 135156 - RNA, 64 nt, hsa; identical to SEQ ID NO: 39672

SEQ ID NO: 135157 - RNA, 64 nt, hsa; identical to SEQ ID NO: 39673

SEQ ID NO: 135158 - RNA, 64 nt, hsa; identical to SEQ ID NO: 39674

SEQ ID NO: 135159 - RNA, 64 nt, hsa; identical to SEQ ID NO: 39675

SEQ ID NO: 135160 - RNA, 64 nt, hsa; identical to SEQ ID NO: 39676

SEQ ID NO: 135161 - RNA, 64 nt, hsa; identical to SEQ ID NO: 39677

SEQ ID NO: 135162 - RNA, 64 nt, hsa; identical to SEQ ID NO: 39678

SEQ ID NO: 135163 - RNA, 64 nt, hsa; identical to SEQ ID NO: 39679

SEQ ID NO: 135164 - RNA, 64 nt, hsa; identical to SEQ ID NO: 39680

SEQ ID NO: 135165 - RNA, 64 nt, hsa; identical to SEQ ID NO: 39681

SEQ ID NO: 135166 - RNA, 64 nt, hsa; identical to SEQ ID NO: 39682

SEQ ID NO: 135167 - RNA, 64 nt, hsa; identical to SEQ ID NO: 39683

SEQ ID NO: 135168 - RNA, 64 nt, hsa; identical to SEQ ID NO: 39684

SEQ ID NO: 135169 - RNA, 64 nt, hsa; identical to SEQ ID NO: 39685

SEQ ID NO: 135170 - RNA, 64 nt, hsa; identical to SEQ ID NO: 39686

SEQ ID NO: 135171 - RNA, 64 nt, hsa; identical to SEQ ID NO: 39687

SEQ ID NO: 135172 - RNA, 64 nt, hsa; identical to SEQ ID NO: 39688

SEQ ID NO: 135173 - RNA, 64 nt, hsa; identical to SEQ ID NO: 39689

SEQ ID NO: 135174 - RNA, 64 nt, hsa; identical to SEQ ID NO: 39690

SEQ ID NO: 135175 - RNA, 64 nt, hsa; identical to SEQ ID NO: 39691

SEQ ID NO: 135176 - RNA, 64 nt, hsa; identical to SEQ ID NO: 39692

SEQ ID NO: 135177 - RNA, 64 nt, hsa; identical to SEQ ID NO: 39693

SEQ ID NO: 135178 - RNA, 64 nt, hsa; identical to SEQ ID NO: 39694

SEQ ID NO: 135179 - RNA, 64 nt, hsa; identical to SEQ ID NO: 39695

SEQ ID NO: 135180 - RNA, 64 nt, hsa; identical to SEQ ID NO: 39696

SEQ ID NO: 135181 - RNA, 64 nt, hsa; identical to SEQ ID NO: 39697

SEQ ID NO: 135182 - RNA, 64 nt, hsa; identical to SEQ ID NO: 39698

SEQ ID NO: 135183 - RNA, 64 nt, hsa; identical to SEQ ID NO: 39699

SEQ ID NO: 135184 - RNA, 64 nt, hsa; identical to SEQ ID NO: 39700

SEQ ID NO: 135185 - RNA, 64 nt, hsa; identical to SEQ ID NO: 39701

SEQ ID NO: 135186 - RNA, 64 nt, hsa; identical to SEQ ID NO: 39702

SEQ ID NO: 135187 - RNA, 64 nt, hsa; identical to SEQ ID NO: 39703

SEQ ID NO: 135188 - RNA, 64 nt, hsa; identical to SEQ ID NO: 39704

SEQ ID NO: 135189 - RNA, 64 nt, hsa; identical to SEQ ID NO: 39705

SEQ ID NO: 135190 - RNA, 64 nt, hsa; identical to SEQ ID NO: 39706

SEQ ID NO: 135191 - RNA, 64 nt, hsa; identical to SEQ ID NO: 39707

SEQ ID NO: 135192 - RNA, 64 nt, hsa; identical to SEQ ID NO: 39708

SEQ ID NO: 135193 - RNA, 64 nt, hsa; identical to SEQ ID NO: 39709

SEQ ID NO: 135194 - RNA, 64 nt, hsa; identical to SEQ ID NO: 39710

SEQ ID NO: 135195 - RNA, 64 nt, hsa; identical to SEQ ID NO: 39711

SEQ ID NO: 135196 - RNA, 64 nt, hsa; identical to SEQ ID NO: 39712

SEQ ID NO: 135197 - RNA, 64 nt, hsa; identical to SEQ ID NO: 39713

SEQ ID NO: 135198 - RNA, 64 nt, hsa; identical to SEQ ID NO: 39714

SEQ ID NO: 135199 - RNA, 64 nt, hsa; identical to SEQ ID NO: 39715

SEQ ID NO: 135200 - RNA, 64 nt, hsa; identical to SEQ ID NO: 39716

SEQ ID NO: 135201 - RNA, 64 nt, hsa; identical to SEQ ID NO: 39717

SEQ ID NO: 135202 - RNA, 64 nt, hsa; identical to SEQ ID NO: 39718

SEQ ID NO: 135203 - RNA, 64 nt, hsa; identical to SEQ ID NO: 39719

SEQ ID NO: 135204 - RNA, 64 nt, hsa; identical to SEQ ID NO: 39720

SEQ ID NO: 135205 - RNA, 64 nt, hsa; identical to SEQ ID NO: 39721

SEQ ID NO: 135206 - RNA, 64 nt, hsa; identical to SEQ ID NO: 39722

SEQ ID NO: 135207 - RNA, 64 nt, hsa; identical to SEQ ID NO: 39723

SEQ ID NO: 135208 - RNA, 64 nt, hsa; identical to SEQ ID NO: 39724

SEQ ID NO: 135209 - RNA, 64 nt, hsa; identical to SEQ ID NO: 39725

SEQ ID NO: 135210 - RNA, 64 nt, hsa; identical to SEQ ID NO: 39726

SEQ ID NO: 135211 - RNA, 64 nt, hsa; identical to SEQ ID NO: 39727

SEQ ID NO: 135212 - RNA, 64 nt, hsa; identical to SEQ ID NO: 39728

SEQ ID NO: 135213 - RNA, 64 nt, hsa; identical to SEQ ID NO: 39729

SEQ ID NO: 135214 - RNA, 64 nt, hsa; identical to SEQ ID NO: 39730

SEQ ID NO: 135215 - RNA, 64 nt, hsa; identical to SEQ ID NO: 39731

SEQ ID NO: 135216 - RNA, 64 nt, hsa; identical to SEQ ID NO: 39732

SEQ ID NO: 135217 - RNA, 64 nt, hsa; identical to SEQ ID NO: 39733

SEQ ID NO: 135218 - RNA, 64 nt, hsa; identical to SEQ ID NO: 39734

SEQ ID NO: 135219 - RNA, 64 nt, hsa; identical to SEQ ID NO: 39735

SEQ ID NO: 135220 - RNA, 64 nt, hsa; identical to SEQ ID NO: 39736

SEQ ID NO: 135221 - RNA, 64 nt, hsa; identical to SEQ ID NO: 39737

SEQ ID NO: 135222 - RNA, 64 nt, hsa; identical to SEQ ID NO: 39738

SEQ ID NO: 135223 - RNA, 64 nt, hsa; identical to SEQ ID NO: 39739

SEQ ID NO: 135224 - RNA, 64 nt, hsa; identical to SEQ ID NO: 39740

SEQ ID NO: 135225 - RNA, 64 nt, hsa; identical to SEQ ID NO: 39741

SEQ ID NO: 135226 - RNA, 64 nt, hsa; identical to SEQ ID NO: 39742

SEQ ID NO: 135227 - RNA, 64 nt, hsa; identical to SEQ ID NO: 39743

SEQ ID NO: 135228 - RNA, 64 nt, hsa; identical to SEQ ID NO: 39744

SEQ ID NO: 135229 - RNA, 64 nt, hsa; identical to SEQ ID NO: 39745

SEQ ID NO: 135230 - RNA, 64 nt, hsa; identical to SEQ ID NO: 39746

SEQ ID NO: 135231 - RNA, 64 nt, hsa; identical to SEQ ID NO: 39747

SEQ ID NO: 135232 - RNA, 64 nt, hsa; identical to SEQ ID NO: 39748

SEQ ID NO: 135233 - RNA, 64 nt, hsa; identical to SEQ ID NO: 39749

SEQ ID NO: 135234 - RNA, 64 nt, hsa; identical to SEQ ID NO: 39750

SEQ ID NO: 135235 - RNA, 64 nt, hsa; identical to SEQ ID NO: 39751

SEQ ID NO: 135236 - RNA, 64 nt, hsa; identical to SEQ ID NO: 39752

SEQ ID NO: 135237 - RNA, 64 nt, hsa; identical to SEQ ID NO: 39753

SEQ ID NO: 135238 - RNA, 64 nt, hsa; identical to SEQ ID NO: 39754

SEQ ID NO: 135239 - RNA, 64 nt, hsa; identical to SEQ ID NO: 39755

SEQ ID NO: 135240 - RNA, 64 nt, hsa; identical to SEQ ID NO: 39756

SEQ ID NO: 135241 - RNA, 64 nt, hsa; identical to SEQ ID NO: 39757

SEQ ID NO: 135242 - RNA, 64 nt, hsa; identical to SEQ ID NO: 39758

SEQ ID NO: 135243 - RNA, 64 nt, hsa; identical to SEQ ID NO: 39759

SEQ ID NO: 135244 - RNA, 64 nt, hsa; identical to SEQ ID NO: 39760

SEQ ID NO: 135245 - RNA, 64 nt, hsa; identical to SEQ ID NO: 39761

SEQ ID NO: 135246 - RNA, 64 nt, hsa; identical to SEQ ID NO: 39762

SEQ ID NO: 135247 - RNA, 64 nt, hsa; identical to SEQ ID NO: 39763

SEQ ID NO: 135248 - RNA, 64 nt, hsa; identical to SEQ ID NO: 39764

SEQ ID NO: 135249 - RNA, 64 nt, hsa; identical to SEQ ID NO: 39765

SEQ ID NO: 135250 - RNA, 64 nt, hsa; identical to SEQ ID NO: 39766

SEQ ID NO: 135251 - RNA, 64 nt, hsa; identical to SEQ ID NO: 39767

SEQ ID NO: 135252 - RNA, 64 nt, hsa; identical to SEQ ID NO: 39768

SEQ ID NO: 135253 - RNA, 64 nt, hsa; identical to SEQ ID NO: 39769

SEQ ID NO: 135254 - RNA, 64 nt, hsa; identical to SEQ ID NO: 39770

SEQ ID NO: 135255 - RNA, 64 nt, hsa; identical to SEQ ID NO: 39771

SEQ ID NO: 135256 - RNA, 64 nt, hsa; identical to SEQ ID NO: 39772

SEQ ID NO: 135257 - RNA, 64 nt, hsa; identical to SEQ ID NO: 39773

SEQ ID NO: 135258 - RNA, 64 nt, hsa; identical to SEQ ID NO: 39774

SEQ ID NO: 135259 - RNA, 64 nt, hsa; identical to SEQ ID NO: 39775

SEQ ID NO: 135260 - RNA, 64 nt, hsa; identical to SEQ ID NO: 39776

SEQ ID NO: 135261 - RNA, 64 nt, hsa; identical to SEQ ID NO: 39777

SEQ ID NO: 135262 - RNA, 64 nt, hsa; identical to SEQ ID NO: 39778

SEQ ID NO: 135263 - RNA, 64 nt, hsa; identical to SEQ ID NO: 39779

SEQ ID NO: 135264 - RNA, 64 nt, hsa; identical to SEQ ID NO: 39780

SEQ ID NO: 135265 - RNA, 64 nt, hsa; identical to SEQ ID NO: 39781

SEQ ID NO: 135266 - RNA, 64 nt, hsa; identical to SEQ ID NO: 39782

SEQ ID NO: 135267 - RNA, 64 nt, hsa; identical to SEQ ID NO: 39783

SEQ ID NO: 135268 - RNA, 64 nt, hsa; identical to SEQ ID NO: 39784

SEQ ID NO: 135269 - RNA, 64 nt, hsa; identical to SEQ ID NO: 39785

SEQ ID NO: 135270 - RNA, 64 nt, hsa; identical to SEQ ID NO: 39786

SEQ ID NO: 135271 - RNA, 64 nt, hsa; identical to SEQ ID NO: 39787

SEQ ID NO: 135272 - RNA, 64 nt, hsa; identical to SEQ ID NO: 39788

SEQ ID NO: 135273 - RNA, 64 nt, hsa; identical to SEQ ID NO: 39789

SEQ ID NO: 135274 - RNA, 64 nt, hsa; identical to SEQ ID NO: 39790

SEQ ID NO: 135275 - RNA, 64 nt, hsa; identical to SEQ ID NO: 39791

SEQ ID NO: 135276 - RNA, 64 nt, hsa; identical to SEQ ID NO: 39792

SEQ ID NO: 135277 - RNA, 64 nt, hsa; identical to SEQ ID NO: 39793

SEQ ID NO: 135278 - RNA, 64 nt, hsa; identical to SEQ ID NO: 39794

SEQ ID NO: 135279 - RNA, 64 nt, hsa; identical to SEQ ID NO: 39795

SEQ ID NO: 135280 - RNA, 64 nt, hsa; identical to SEQ ID NO: 39796

SEQ ID NO: 135281 - RNA, 64 nt, hsa; identical to SEQ ID NO: 39797

SEQ ID NO: 135282 - RNA, 64 nt, hsa; identical to SEQ ID NO: 39798

SEQ ID NO: 135283 - RNA, 64 nt, hsa; identical to SEQ ID NO: 39799

SEQ ID NO: 135284 - RNA, 64 nt, hsa; identical to SEQ ID NO: 39800

SEQ ID NO: 135285 - RNA, 64 nt, hsa; identical to SEQ ID NO: 39801

SEQ ID NO: 135286 - RNA, 64 nt, hsa; identical to SEQ ID NO: 39802

SEQ ID NO: 135287 - RNA, 64 nt, hsa; identical to SEQ ID NO: 39803

SEQ ID NO: 135288 - RNA, 64 nt, hsa; identical to SEQ ID NO: 39804

SEQ ID NO: 135289 - RNA, 64 nt, hsa; identical to SEQ ID NO: 39805

SEQ ID NO: 135290 - RNA, 64 nt, hsa; identical to SEQ ID NO: 39806

SEQ ID NO: 135291 - RNA, 64 nt, hsa; identical to SEQ ID NO: 39807

SEQ ID NO: 135292 - RNA, 64 nt, hsa; identical to SEQ ID NO: 39808

SEQ ID NO: 135293 - RNA, 64 nt, hsa; identical to SEQ ID NO: 39809

SEQ ID NO: 135294 - RNA, 64 nt, hsa; identical to SEQ ID NO: 39810

SEQ ID NO: 135295 - RNA, 64 nt, hsa; identical to SEQ ID NO: 39811

SEQ ID NO: 135296 - RNA, 64 nt, hsa; identical to SEQ ID NO: 39812

SEQ ID NO: 135297 - RNA, 64 nt, hsa; identical to SEQ ID NO: 39813

SEQ ID NO: 135298 - RNA, 64 nt, hsa; identical to SEQ ID NO: 39814

SEQ ID NO: 135299 - RNA, 64 nt, hsa; identical to SEQ ID NO: 39815

SEQ ID NO: 135300 - RNA, 64 nt, hsa; identical to SEQ ID NO: 39816

SEQ ID NO: 135301 - RNA, 64 nt, hsa; identical to SEQ ID NO: 39817

SEQ ID NO: 135302 - RNA, 64 nt, hsa; identical to SEQ ID NO: 39818

SEQ ID NO: 135303 - RNA, 64 nt, hsa; identical to SEQ ID NO: 39819

SEQ ID NO: 135304 - RNA, 64 nt, hsa; identical to SEQ ID NO: 39820

SEQ ID NO: 135305 - RNA, 64 nt, hsa; identical to SEQ ID NO: 39821

SEQ ID NO: 135306 - RNA, 64 nt, hsa; identical to SEQ ID NO: 39822

SEQ ID NO: 135307 - RNA, 64 nt, hsa; identical to SEQ ID NO: 39823

SEQ ID NO: 135308 - RNA, 64 nt, hsa; identical to SEQ ID NO: 39824

SEQ ID NO: 135309 - RNA, 64 nt, hsa; identical to SEQ ID NO: 39825

SEQ ID NO: 135310 - RNA, 64 nt, hsa; identical to SEQ ID NO: 39826

SEQ ID NO: 135311 - RNA, 64 nt, hsa; identical to SEQ ID NO: 39827

SEQ ID NO: 135312 - RNA, 64 nt, hsa; identical to SEQ ID NO: 39828

SEQ ID NO: 135313 - RNA, 64 nt, hsa; identical to SEQ ID NO: 39829

SEQ ID NO: 135314 - RNA, 64 nt, hsa; identical to SEQ ID NO: 39830

SEQ ID NO: 135315 - RNA, 64 nt, hsa; identical to SEQ ID NO: 39831

SEQ ID NO: 135316 - RNA, 64 nt, hsa; identical to SEQ ID NO: 39832

SEQ ID NO: 135317 - RNA, 64 nt, hsa; identical to SEQ ID NO: 39833

SEQ ID NO: 135318 - RNA, 64 nt, hsa; identical to SEQ ID NO: 39834

SEQ ID NO: 135319 - RNA, 64 nt, hsa; identical to SEQ ID NO: 39835

SEQ ID NO: 135320 - RNA, 64 nt, hsa; identical to SEQ ID NO: 39836

SEQ ID NO: 135321 - RNA, 64 nt, hsa; identical to SEQ ID NO: 39837

SEQ ID NO: 135322 - RNA, 64 nt, hsa; identical to SEQ ID NO: 39838

SEQ ID NO: 135323 - RNA, 64 nt, hsa; identical to SEQ ID NO: 39839

SEQ ID NO: 135324 - RNA, 64 nt, hsa; identical to SEQ ID NO: 39840

SEQ ID NO: 135325 - RNA, 64 nt, hsa; identical to SEQ ID NO: 39841

SEQ ID NO: 135326 - RNA, 64 nt, hsa; identical to SEQ ID NO: 39842

SEQ ID NO: 135327 - RNA, 64 nt, hsa; identical to SEQ ID NO: 39843

SEQ ID NO: 135328 - RNA, 64 nt, hsa; identical to SEQ ID NO: 39844

SEQ ID NO: 135329 - RNA, 64 nt, hsa; identical to SEQ ID NO: 39845

SEQ ID NO: 135330 - RNA, 64 nt, hsa; identical to SEQ ID NO: 39846

SEQ ID NO: 135331 - RNA, 64 nt, hsa; identical to SEQ ID NO: 39847

SEQ ID NO: 135332 - RNA, 64 nt, hsa; identical to SEQ ID NO: 39848

SEQ ID NO: 135333 - RNA, 64 nt, hsa; identical to SEQ ID NO: 39849

SEQ ID NO: 135334 - RNA, 64 nt, hsa; identical to SEQ ID NO: 39850

SEQ ID NO: 135335 - RNA, 64 nt, hsa; identical to SEQ ID NO: 39851

SEQ ID NO: 135336 - RNA, 64 nt, hsa; identical to SEQ ID NO: 39852

SEQ ID NO: 135337 - RNA, 64 nt, hsa; identical to SEQ ID NO: 39853

SEQ ID NO: 135338 - RNA, 64 nt, hsa; identical to SEQ ID NO: 39854

SEQ ID NO: 135339 - RNA, 64 nt, hsa; identical to SEQ ID NO: 39855

SEQ ID NO: 135340 - RNA, 64 nt, hsa; identical to SEQ ID NO: 39856

SEQ ID NO: 135341 - RNA, 64 nt, hsa; identical to SEQ ID NO: 39857

SEQ ID NO: 135342 - RNA, 64 nt, hsa; identical to SEQ ID NO: 39858

SEQ ID NO: 135343 - RNA, 64 nt, hsa; identical to SEQ ID NO: 39859

SEQ ID NO: 135344 - RNA, 64 nt, hsa; identical to SEQ ID NO: 39860

SEQ ID NO: 135345 - RNA, 64 nt, hsa; identical to SEQ ID NO: 39861

SEQ ID NO: 135346 - RNA, 64 nt, hsa; identical to SEQ ID NO: 39862

SEQ ID NO: 135347 - RNA, 64 nt, hsa; identical to SEQ ID NO: 39863

SEQ ID NO: 135348 - RNA, 64 nt, hsa; identical to SEQ ID NO: 39864

SEQ ID NO: 135349 - RNA, 64 nt, hsa; identical to SEQ ID NO: 39865

SEQ ID NO: 135350 - RNA, 64 nt, hsa; identical to SEQ ID NO: 39866

SEQ ID NO: 135351 - RNA, 64 nt, hsa; identical to SEQ ID NO: 39867

SEQ ID NO: 135352 - RNA, 64 nt, hsa; identical to SEQ ID NO: 39868

SEQ ID NO: 135353 - RNA, 64 nt, hsa; identical to SEQ ID NO: 39869

SEQ ID NO: 135354 - RNA, 64 nt, hsa; identical to SEQ ID NO: 39870

SEQ ID NO: 135355 - RNA, 64 nt, hsa; identical to SEQ ID NO: 39871

SEQ ID NO: 135356 - RNA, 64 nt, hsa; identical to SEQ ID NO: 39872

SEQ ID NO: 135357 - RNA, 64 nt, hsa; identical to SEQ ID NO: 39873

SEQ ID NO: 135358 - RNA, 64 nt, hsa; identical to SEQ ID NO: 39874

SEQ ID NO: 135359 - RNA, 64 nt, hsa; identical to SEQ ID NO: 39875

SEQ ID NO: 135360 - RNA, 64 nt, hsa; identical to SEQ ID NO: 39876

SEQ ID NO: 135361 - RNA, 64 nt, hsa; identical to SEQ ID NO: 39877

SEQ ID NO: 135362 - RNA, 64 nt, hsa; identical to SEQ ID NO: 39878

SEQ ID NO: 135363 - RNA, 64 nt, hsa; identical to SEQ ID NO: 39879

SEQ ID NO: 135364 - RNA, 64 nt, hsa; identical to SEQ ID NO: 39880

SEQ ID NO: 135365 - RNA, 64 nt, hsa; identical to SEQ ID NO: 39881

SEQ ID NO: 135366 - RNA, 64 nt, hsa; identical to SEQ ID NO: 39882

SEQ ID NO: 135367 - RNA, 64 nt, hsa; identical to SEQ ID NO: 39883

SEQ ID NO: 135368 - RNA, 64 nt, hsa; identical to SEQ ID NO: 39884

SEQ ID NO: 135369 - RNA, 64 nt, hsa; identical to SEQ ID NO: 39885

SEQ ID NO: 135370 - RNA, 64 nt, hsa; identical to SEQ ID NO: 39886

SEQ ID NO: 135371 - RNA, 64 nt, hsa; identical to SEQ ID NO: 39887

SEQ ID NO: 135372 - RNA, 64 nt, hsa; identical to SEQ ID NO: 39888

SEQ ID NO: 135373 - RNA, 64 nt, hsa; identical to SEQ ID NO: 39889

SEQ ID NO: 135374 - RNA, 64 nt, hsa; identical to SEQ ID NO: 39890

SEQ ID NO: 135375 - RNA, 64 nt, hsa; identical to SEQ ID NO: 39891

SEQ ID NO: 135376 - RNA, 64 nt, hsa; identical to SEQ ID NO: 39892

SEQ ID NO: 135377 - RNA, 64 nt, hsa; identical to SEQ ID NO: 39893

SEQ ID NO: 135378 - RNA, 64 nt, hsa; identical to SEQ ID NO: 39894

SEQ ID NO: 135379 - RNA, 64 nt, hsa; identical to SEQ ID NO: 39895

SEQ ID NO: 135380 - RNA, 64 nt, hsa; identical to SEQ ID NO: 39896

SEQ ID NO: 135381 - RNA, 64 nt, hsa; identical to SEQ ID NO: 39897

SEQ ID NO: 135382 - RNA, 64 nt, hsa; identical to SEQ ID NO: 39898

SEQ ID NO: 135383 - RNA, 64 nt, hsa; identical to SEQ ID NO: 39899

SEQ ID NO: 135384 - RNA, 64 nt, hsa; identical to SEQ ID NO: 39900

SEQ ID NO: 135385 - RNA, 64 nt, hsa; identical to SEQ ID NO: 39901

SEQ ID NO: 135386 - RNA, 64 nt, hsa; identical to SEQ ID NO: 39902

SEQ ID NO: 135387 - RNA, 64 nt, hsa; identical to SEQ ID NO: 39903

SEQ ID NO: 135388 - RNA, 64 nt, hsa; identical to SEQ ID NO: 39904

SEQ ID NO: 135389 - RNA, 64 nt, hsa; identical to SEQ ID NO: 39905

SEQ ID NO: 135390 - RNA, 64 nt, hsa; identical to SEQ ID NO: 39906

SEQ ID NO: 135391 - RNA, 64 nt, hsa; identical to SEQ ID NO: 39907

SEQ ID NO: 135392 - RNA, 64 nt, hsa; identical to SEQ ID NO: 39908

SEQ ID NO: 135393 - RNA, 64 nt, hsa; identical to SEQ ID NO: 39909

SEQ ID NO: 135394 - RNA, 64 nt, hsa; identical to SEQ ID NO: 39910

SEQ ID NO: 135395 - RNA, 64 nt, hsa; identical to SEQ ID NO: 39911

SEQ ID NO: 135396 - RNA, 64 nt, hsa; identical to SEQ ID NO: 39912

SEQ ID NO: 135397 - RNA, 64 nt, hsa; identical to SEQ ID NO: 39913

SEQ ID NO: 135398 - RNA, 64 nt, hsa; identical to SEQ ID NO: 39914

SEQ ID NO: 135399 - RNA, 64 nt, hsa; identical to SEQ ID NO: 39915

SEQ ID NO: 135400 - RNA, 64 nt, hsa; identical to SEQ ID NO: 39916

SEQ ID NO: 135401 - RNA, 64 nt, hsa; identical to SEQ ID NO: 39917

SEQ ID NO: 135402 - RNA, 64 nt, hsa; identical to SEQ ID NO: 39918

SEQ ID NO: 135403 - RNA, 64 nt, hsa; identical to SEQ ID NO: 39919

SEQ ID NO: 135404 - RNA, 64 nt, hsa; identical to SEQ ID NO: 39920

SEQ ID NO: 135405 - RNA, 64 nt, hsa; identical to SEQ ID NO: 39921

SEQ ID NO: 135406 - RNA, 64 nt, hsa; identical to SEQ ID NO: 39922

SEQ ID NO: 135407 - RNA, 64 nt, hsa; identical to SEQ ID NO: 39923

SEQ ID NO: 135408 - RNA, 64 nt, hsa; identical to SEQ ID NO: 39924

SEQ ID NO: 135409 - RNA, 64 nt, hsa; identical to SEQ ID NO: 39925

SEQ ID NO: 135410 - RNA, 64 nt, hsa; identical to SEQ ID NO: 39926

SEQ ID NO: 135411 - RNA, 64 nt, hsa; identical to SEQ ID NO: 39927

SEQ ID NO: 135412 - RNA, 64 nt, hsa; identical to SEQ ID NO: 39928

SEQ ID NO: 135413 - RNA, 64 nt, hsa; identical to SEQ ID NO: 39929

SEQ ID NO: 135414 - RNA, 64 nt, hsa; identical to SEQ ID NO: 39930

SEQ ID NO: 135415 - RNA, 64 nt, hsa; identical to SEQ ID NO: 39931

SEQ ID NO: 135416 - RNA, 64 nt, hsa; identical to SEQ ID NO: 39932

SEQ ID NO: 135417 - RNA, 64 nt, hsa; identical to SEQ ID NO: 39933

SEQ ID NO: 135418 - RNA, 64 nt, hsa; identical to SEQ ID NO: 39934

SEQ ID NO: 135419 - RNA, 64 nt, hsa; identical to SEQ ID NO: 39935

SEQ ID NO: 135420 - RNA, 64 nt, hsa; identical to SEQ ID NO: 39936

SEQ ID NO: 135421 - RNA, 64 nt, hsa; identical to SEQ ID NO: 39937

SEQ ID NO: 135422 - RNA, 64 nt, hsa; identical to SEQ ID NO: 39938

SEQ ID NO: 135423 - RNA, 64 nt, hsa; identical to SEQ ID NO: 39939

SEQ ID NO: 135424 - RNA, 64 nt, hsa; identical to SEQ ID NO: 39940

SEQ ID NO: 135425 - RNA, 64 nt, hsa; identical to SEQ ID NO: 39941

SEQ ID NO: 135426 - RNA, 64 nt, hsa; identical to SEQ ID NO: 39942

SEQ ID NO: 135427 - RNA, 64 nt, hsa; identical to SEQ ID NO: 39943

SEQ ID NO: 135428 - RNA, 64 nt, hsa; identical to SEQ ID NO: 39944

SEQ ID NO: 135429 - RNA, 64 nt, hsa; identical to SEQ ID NO: 39945

SEQ ID NO: 135430 - RNA, 64 nt, hsa; identical to SEQ ID NO: 39946

SEQ ID NO: 135431 - RNA, 64 nt, hsa; identical to SEQ ID NO: 39947

SEQ ID NO: 135432 - RNA, 64 nt, hsa; identical to SEQ ID NO: 39948

SEQ ID NO: 135433 - RNA, 64 nt, hsa; identical to SEQ ID NO: 39949

SEQ ID NO: 135434 - RNA, 64 nt, hsa; identical to SEQ ID NO: 39950

SEQ ID NO: 135435 - RNA, 64 nt, hsa; identical to SEQ ID NO: 39951

SEQ ID NO: 135436 - RNA, 64 nt, hsa; identical to SEQ ID NO: 39952

SEQ ID NO: 135437 - RNA, 64 nt, hsa; identical to SEQ ID NO: 39953

SEQ ID NO: 135438 - RNA, 64 nt, hsa; identical to SEQ ID NO: 39954

SEQ ID NO: 135439 - RNA, 64 nt, hsa; identical to SEQ ID NO: 39955

SEQ ID NO: 135440 - RNA, 64 nt, hsa; identical to SEQ ID NO: 39956

SEQ ID NO: 135441 - RNA, 64 nt, hsa; identical to SEQ ID NO: 39957

SEQ ID NO: 135442 - RNA, 64 nt, hsa; identical to SEQ ID NO: 39958

SEQ ID NO: 135443 - RNA, 64 nt, hsa; identical to SEQ ID NO: 39959

SEQ ID NO: 135444 - RNA, 64 nt, hsa; identical to SEQ ID NO: 39960

SEQ ID NO: 135445 - RNA, 64 nt, hsa; identical to SEQ ID NO: 39961

SEQ ID NO: 135446 - RNA, 64 nt, hsa; identical to SEQ ID NO: 39962

SEQ ID NO: 135447 - RNA, 64 nt, hsa; identical to SEQ ID NO: 39963

SEQ ID NO: 135448 - RNA, 64 nt, hsa; identical to SEQ ID NO: 39964

SEQ ID NO: 135449 - RNA, 64 nt, hsa; identical to SEQ ID NO: 39965

SEQ ID NO: 135450 - RNA, 64 nt, hsa; identical to SEQ ID NO: 39966

SEQ ID NO: 135451 - RNA, 64 nt, hsa; identical to SEQ ID NO: 39967

SEQ ID NO: 135452 - RNA, 64 nt, hsa; identical to SEQ ID NO: 39968

SEQ ID NO: 135453 - RNA, 64 nt, hsa; identical to SEQ ID NO: 39969

SEQ ID NO: 135454 - RNA, 64 nt, hsa; identical to SEQ ID NO: 39970

SEQ ID NO: 135455 - RNA, 64 nt, hsa; identical to SEQ ID NO: 39971

SEQ ID NO: 135456 - RNA, 64 nt, hsa; identical to SEQ ID NO: 39972

SEQ ID NO: 135457 - RNA, 64 nt, hsa; identical to SEQ ID NO: 39973

SEQ ID NO: 135458 - RNA, 64 nt, hsa; identical to SEQ ID NO: 39974

SEQ ID NO: 135459 - RNA, 64 nt, hsa; identical to SEQ ID NO: 39975

SEQ ID NO: 135460 - RNA, 64 nt, hsa; identical to SEQ ID NO: 39976

SEQ ID NO: 135461 - RNA, 64 nt, hsa; identical to SEQ ID NO: 39977

SEQ ID NO: 135462 - RNA, 64 nt, hsa; identical to SEQ ID NO: 39978

SEQ ID NO: 135463 - RNA, 64 nt, hsa; identical to SEQ ID NO: 39979

SEQ ID NO: 135464 - RNA, 64 nt, hsa; identical to SEQ ID NO: 39980

SEQ ID NO: 135465 - RNA, 64 nt, hsa; identical to SEQ ID NO: 39981

SEQ ID NO: 135466 - RNA, 64 nt, hsa; identical to SEQ ID NO: 39982

SEQ ID NO: 135467 - RNA, 64 nt, hsa; identical to SEQ ID NO: 39983

SEQ ID NO: 135468 - RNA, 64 nt, hsa; identical to SEQ ID NO: 39984

SEQ ID NO: 135469 - RNA, 64 nt, hsa; identical to SEQ ID NO: 39985

SEQ ID NO: 135470 - RNA, 64 nt, hsa; identical to SEQ ID NO: 39986

SEQ ID NO: 135471 - RNA, 64 nt, hsa; identical to SEQ ID NO: 39987

SEQ ID NO: 135472 - RNA, 64 nt, hsa; identical to SEQ ID NO: 39988

SEQ ID NO: 135473 - RNA, 64 nt, hsa; identical to SEQ ID NO: 39989

SEQ ID NO: 135474 - RNA, 64 nt, hsa; identical to SEQ ID NO: 39990

SEQ ID NO: 135475 - RNA, 64 nt, hsa; identical to SEQ ID NO: 39991

SEQ ID NO: 135476 - RNA, 64 nt, hsa; identical to SEQ ID NO: 39992

SEQ ID NO: 135477 - RNA, 64 nt, hsa; identical to SEQ ID NO: 39993

SEQ ID NO: 135478 - RNA, 64 nt, hsa; identical to SEQ ID NO: 39994

SEQ ID NO: 135479 - RNA, 64 nt, hsa; identical to SEQ ID NO: 39995

SEQ ID NO: 135480 - RNA, 64 nt, hsa; identical to SEQ ID NO: 39996

SEQ ID NO: 135481 - RNA, 64 nt, hsa; identical to SEQ ID NO: 39997

SEQ ID NO: 135482 - RNA, 64 nt, hsa; identical to SEQ ID NO: 39998

SEQ ID NO: 135483 - RNA, 64 nt, hsa; identical to SEQ ID NO: 39999

SEQ ID NO: 135484 - RNA, 64 nt, hsa; identical to SEQ ID NO: 40000

SEQ ID NO: 135485 - RNA, 64 nt, hsa; identical to SEQ ID NO: 40001

SEQ ID NO: 135486 - RNA, 64 nt, hsa; identical to SEQ ID NO: 40002

SEQ ID NO: 135487 - RNA, 64 nt, hsa; identical to SEQ ID NO: 40003

SEQ ID NO: 135488 - RNA, 64 nt, hsa; identical to SEQ ID NO: 40004

SEQ ID NO: 135489 - RNA, 64 nt, hsa; identical to SEQ ID NO: 40005

SEQ ID NO: 135490 - RNA, 64 nt, hsa; identical to SEQ ID NO: 40006

SEQ ID NO: 135491 - RNA, 64 nt, hsa; identical to SEQ ID NO: 40007

SEQ ID NO: 135492 - RNA, 64 nt, hsa; identical to SEQ ID NO: 40008

SEQ ID NO: 135493 - RNA, 64 nt, hsa; identical to SEQ ID NO: 40009

SEQ ID NO: 135494 - RNA, 64 nt, hsa; identical to SEQ ID NO: 40010

SEQ ID NO: 135495 - RNA, 64 nt, hsa; identical to SEQ ID NO: 40011

SEQ ID NO: 135496 - RNA, 64 nt, hsa; identical to SEQ ID NO: 40012

SEQ ID NO: 135497 - RNA, 64 nt, hsa; identical to SEQ ID NO: 40013

SEQ ID NO: 135498 - RNA, 64 nt, hsa; identical to SEQ ID NO: 40014

SEQ ID NO: 135499 - RNA, 64 nt, hsa; identical to SEQ ID NO: 40015

SEQ ID NO: 135500 - RNA, 64 nt, hsa; identical to SEQ ID NO: 40016

SEQ ID NO: 135501 - RNA, 64 nt, hsa; identical to SEQ ID NO: 40017

SEQ ID NO: 135502 - RNA, 64 nt, hsa; identical to SEQ ID NO: 40018

SEQ ID NO: 135503 - RNA, 64 nt, hsa; identical to SEQ ID NO: 40019

SEQ ID NO: 135504 - RNA, 64 nt, hsa; identical to SEQ ID NO: 40020

SEQ ID NO: 135505 - RNA, 64 nt, hsa; identical to SEQ ID NO: 40021

SEQ ID NO: 135506 - RNA, 64 nt, hsa; identical to SEQ ID NO: 40022

SEQ ID NO: 135507 - RNA, 64 nt, hsa; identical to SEQ ID NO: 40023

SEQ ID NO: 135508 - RNA, 64 nt, hsa; identical to SEQ ID NO: 40024

SEQ ID NO: 135509 - RNA, 64 nt, hsa; identical to SEQ ID NO: 40025

SEQ ID NO: 135510 - RNA, 64 nt, hsa; identical to SEQ ID NO: 40026

SEQ ID NO: 135511 - RNA, 64 nt, hsa; identical to SEQ ID NO: 40027

SEQ ID NO: 135512 - RNA, 64 nt, hsa; identical to SEQ ID NO: 40028

SEQ ID NO: 135513 - RNA, 64 nt, hsa; identical to SEQ ID NO: 40029

SEQ ID NO: 135514 - RNA, 64 nt, hsa; identical to SEQ ID NO: 40030

SEQ ID NO: 135515 - RNA, 64 nt, hsa; identical to SEQ ID NO: 40031

SEQ ID NO: 135516 - RNA, 64 nt, hsa; identical to SEQ ID NO: 40032

SEQ ID NO: 135517 - RNA, 64 nt, hsa; identical to SEQ ID NO: 40033

SEQ ID NO: 135518 - RNA, 64 nt, hsa; identical to SEQ ID NO: 40034

SEQ ID NO: 135519 - RNA, 64 nt, hsa; identical to SEQ ID NO: 40035

SEQ ID NO: 135520 - RNA, 64 nt, hsa; identical to SEQ ID NO: 40036

SEQ ID NO: 135521 - RNA, 64 nt, hsa; identical to SEQ ID NO: 40037

SEQ ID NO: 135522 - RNA, 64 nt, hsa; identical to SEQ ID NO: 40038

SEQ ID NO: 135523 - RNA, 64 nt, hsa; identical to SEQ ID NO: 40039

SEQ ID NO: 135524 - RNA, 64 nt, hsa; identical to SEQ ID NO: 40040

SEQ ID NO: 135525 - RNA, 64 nt, hsa; identical to SEQ ID NO: 40041

SEQ ID NO: 135526 - RNA, 64 nt, hsa; identical to SEQ ID NO: 40042

SEQ ID NO: 135527 - RNA, 64 nt, hsa; identical to SEQ ID NO: 40043

SEQ ID NO: 135528 - RNA, 64 nt, hsa; identical to SEQ ID NO: 40044

SEQ ID NO: 135529 - RNA, 64 nt, hsa; identical to SEQ ID NO: 40045

SEQ ID NO: 135530 - RNA, 64 nt, hsa; identical to SEQ ID NO: 40046

SEQ ID NO: 135531 - RNA, 64 nt, hsa; identical to SEQ ID NO: 40047

SEQ ID NO: 135532 - RNA, 64 nt, hsa; identical to SEQ ID NO: 40048

SEQ ID NO: 135533 - RNA, 64 nt, hsa; identical to SEQ ID NO: 40049

SEQ ID NO: 135534 - RNA, 64 nt, hsa; identical to SEQ ID NO: 40050

SEQ ID NO: 135535 - RNA, 64 nt, hsa; identical to SEQ ID NO: 40051

SEQ ID NO: 135536 - RNA, 64 nt, hsa; identical to SEQ ID NO: 40052

SEQ ID NO: 135537 - RNA, 64 nt, hsa; identical to SEQ ID NO: 40053

SEQ ID NO: 135538 - RNA, 64 nt, hsa; identical to SEQ ID NO: 40054

SEQ ID NO: 135539 - RNA, 64 nt, hsa; identical to SEQ ID NO: 40055

SEQ ID NO: 135540 - RNA, 64 nt, hsa; identical to SEQ ID NO: 40056

SEQ ID NO: 135541 - RNA, 64 nt, hsa; identical to SEQ ID NO: 40057

SEQ ID NO: 135542 - RNA, 64 nt, hsa; identical to SEQ ID NO: 40058

SEQ ID NO: 135543 - RNA, 64 nt, hsa; identical to SEQ ID NO: 40059

SEQ ID NO: 135544 - RNA, 64 nt, hsa; identical to SEQ ID NO: 40060

SEQ ID NO: 135545 - RNA, 64 nt, hsa; identical to SEQ ID NO: 40061

SEQ ID NO: 135546 - RNA, 64 nt, hsa; identical to SEQ ID NO: 40062

SEQ ID NO: 135547 - RNA, 64 nt, hsa; identical to SEQ ID NO: 40063

SEQ ID NO: 135548 - RNA, 64 nt, hsa; identical to SEQ ID NO: 40064

SEQ ID NO: 135549 - RNA, 64 nt, hsa; identical to SEQ ID NO: 40065

SEQ ID NO: 135550 - RNA, 64 nt, hsa; identical to SEQ ID NO: 40066

SEQ ID NO: 135551 - RNA, 64 nt, hsa; identical to SEQ ID NO: 40067

SEQ ID NO: 135552 - RNA, 64 nt, hsa; identical to SEQ ID NO: 40068

SEQ ID NO: 135553 - RNA, 64 nt, hsa; identical to SEQ ID NO: 40069

SEQ ID NO: 135554 - RNA, 64 nt, hsa; identical to SEQ ID NO: 40070

SEQ ID NO: 135555 - RNA, 64 nt, hsa; identical to SEQ ID NO: 40071

SEQ ID NO: 135556 - RNA, 64 nt, hsa; identical to SEQ ID NO: 40072

SEQ ID NO: 135557 - RNA, 64 nt, hsa; identical to SEQ ID NO: 40073

SEQ ID NO: 135558 - RNA, 64 nt, hsa; identical to SEQ ID NO: 40074

SEQ ID NO: 135559 - RNA, 64 nt, hsa; identical to SEQ ID NO: 40075

SEQ ID NO: 135560 - RNA, 64 nt, hsa; identical to SEQ ID NO: 40076

SEQ ID NO: 135561 - RNA, 64 nt, hsa; identical to SEQ ID NO: 40077

SEQ ID NO: 135562 - RNA, 64 nt, hsa; identical to SEQ ID NO: 40078

SEQ ID NO: 135563 - RNA, 64 nt, hsa; identical to SEQ ID NO: 40079

SEQ ID NO: 135564 - RNA, 64 nt, hsa; identical to SEQ ID NO: 40080

SEQ ID NO: 135565 - RNA, 64 nt, hsa; identical to SEQ ID NO: 40081

SEQ ID NO: 135566 - RNA, 64 nt, hsa; identical to SEQ ID NO: 40082

SEQ ID NO: 135567 - RNA, 64 nt, hsa; identical to SEQ ID NO: 40083

SEQ ID NO: 135568 - RNA, 64 nt, hsa; identical to SEQ ID NO: 40084

SEQ ID NO: 135569 - RNA, 64 nt, hsa; identical to SEQ ID NO: 40085

SEQ ID NO: 135570 - RNA, 64 nt, hsa; identical to SEQ ID NO: 40086

SEQ ID NO: 135571 - RNA, 64 nt, hsa; identical to SEQ ID NO: 40087

SEQ ID NO: 135572 - RNA, 64 nt, hsa; identical to SEQ ID NO: 40088

SEQ ID NO: 135573 - RNA, 64 nt, hsa; identical to SEQ ID NO: 40089

SEQ ID NO: 135574 - RNA, 64 nt, hsa; identical to SEQ ID NO: 40090

SEQ ID NO: 135575 - RNA, 64 nt, hsa; identical to SEQ ID NO: 40091

SEQ ID NO: 135576 - RNA, 64 nt, hsa; identical to SEQ ID NO: 40092

SEQ ID NO: 135577 - RNA, 64 nt, hsa; identical to SEQ ID NO: 40093

SEQ ID NO: 135578 - RNA, 64 nt, hsa; identical to SEQ ID NO: 40094

SEQ ID NO: 135579 - RNA, 64 nt, hsa; identical to SEQ ID NO: 40095

SEQ ID NO: 135580 - RNA, 64 nt, hsa; identical to SEQ ID NO: 40096

SEQ ID NO: 135581 - RNA, 64 nt, hsa; identical to SEQ ID NO: 40097

SEQ ID NO: 135582 - RNA, 64 nt, hsa; identical to SEQ ID NO: 40098

SEQ ID NO: 135583 - RNA, 64 nt, hsa; identical to SEQ ID NO: 40099

SEQ ID NO: 135584 - RNA, 64 nt, hsa; identical to SEQ ID NO: 40100

SEQ ID NO: 135585 - RNA, 64 nt, hsa; identical to SEQ ID NO: 40101

SEQ ID NO: 135586 - RNA, 64 nt, hsa; identical to SEQ ID NO: 40102

SEQ ID NO: 135587 - RNA, 64 nt, hsa; identical to SEQ ID NO: 40103

SEQ ID NO: 135588 - RNA, 64 nt, hsa; identical to SEQ ID NO: 40104

SEQ ID NO: 135589 - RNA, 64 nt, hsa; identical to SEQ ID NO: 40105

SEQ ID NO: 135590 - RNA, 64 nt, hsa; identical to SEQ ID NO: 40106

SEQ ID NO: 135591 - RNA, 64 nt, hsa; identical to SEQ ID NO: 40107

SEQ ID NO: 135592 - RNA, 64 nt, hsa; identical to SEQ ID NO: 40108

SEQ ID NO: 135593 - RNA, 64 nt, hsa; identical to SEQ ID NO: 40109

SEQ ID NO: 135594 - RNA, 64 nt, hsa; identical to SEQ ID NO: 40110

SEQ ID NO: 135595 - RNA, 64 nt, hsa; identical to SEQ ID NO: 40111

SEQ ID NO: 135596 - RNA, 64 nt, hsa; identical to SEQ ID NO: 40112

SEQ ID NO: 135597 - RNA, 64 nt, hsa; identical to SEQ ID NO: 40113

SEQ ID NO: 135598 - RNA, 64 nt, hsa; identical to SEQ ID NO: 40114

SEQ ID NO: 135599 - RNA, 64 nt, hsa; identical to SEQ ID NO: 40115

SEQ ID NO: 135600 - RNA, 64 nt, hsa; identical to SEQ ID NO: 40116

SEQ ID NO: 135601 - RNA, 64 nt, hsa; identical to SEQ ID NO: 40117

SEQ ID NO: 135602 - RNA, 64 nt, hsa; identical to SEQ ID NO: 40118

SEQ ID NO: 135603 - RNA, 64 nt, hsa; identical to SEQ ID NO: 40119

SEQ ID NO: 135604 - RNA, 64 nt, hsa; identical to SEQ ID NO: 40120

SEQ ID NO: 135605 - RNA, 64 nt, hsa; identical to SEQ ID NO: 40121

SEQ ID NO: 135606 - RNA, 64 nt, hsa; identical to SEQ ID NO: 40122

SEQ ID NO: 135607 - RNA, 64 nt, hsa; identical to SEQ ID NO: 40123

SEQ ID NO: 135608 - RNA, 64 nt, hsa; identical to SEQ ID NO: 40124

SEQ ID NO: 135609 - RNA, 64 nt, hsa; identical to SEQ ID NO: 40125

SEQ ID NO: 135610 - RNA, 64 nt, hsa; identical to SEQ ID NO: 40126

SEQ ID NO: 135611 - RNA, 64 nt, hsa; identical to SEQ ID NO: 40127

SEQ ID NO: 135612 - RNA, 64 nt, hsa; identical to SEQ ID NO: 40128

SEQ ID NO: 135613 - RNA, 64 nt, hsa; identical to SEQ ID NO: 40129

SEQ ID NO: 135614 - RNA, 64 nt, hsa; identical to SEQ ID NO: 40130

SEQ ID NO: 135615 - RNA, 64 nt, hsa; identical to SEQ ID NO: 40131

SEQ ID NO: 135616 - RNA, 64 nt, hsa; identical to SEQ ID NO: 40132

SEQ ID NO: 135617 - RNA, 64 nt, hsa; identical to SEQ ID NO: 40133

SEQ ID NO: 135618 - RNA, 64 nt, hsa; identical to SEQ ID NO: 40134

SEQ ID NO: 135619 - RNA, 64 nt, hsa; identical to SEQ ID NO: 40135

SEQ ID NO: 135620 - RNA, 64 nt, hsa; identical to SEQ ID NO: 40136

SEQ ID NO: 135621 - RNA, 64 nt, hsa; identical to SEQ ID NO: 40137

SEQ ID NO: 135622 - RNA, 64 nt, hsa; identical to SEQ ID NO: 40138

SEQ ID NO: 135623 - RNA, 64 nt, hsa; identical to SEQ ID NO: 40139

SEQ ID NO: 135624 - RNA, 64 nt, hsa; identical to SEQ ID NO: 40140

SEQ ID NO: 135625 - RNA, 64 nt, hsa; identical to SEQ ID NO: 40141

SEQ ID NO: 135626 - RNA, 64 nt, hsa; identical to SEQ ID NO: 40142

SEQ ID NO: 135627 - RNA, 64 nt, hsa; identical to SEQ ID NO: 40143

SEQ ID NO: 135628 - RNA, 64 nt, hsa; identical to SEQ ID NO: 40144

SEQ ID NO: 135629 - RNA, 64 nt, hsa; identical to SEQ ID NO: 40145

SEQ ID NO: 135630 - RNA, 64 nt, hsa; identical to SEQ ID NO: 40146

SEQ ID NO: 135631 - RNA, 64 nt, hsa; identical to SEQ ID NO: 40147

SEQ ID NO: 135632 - RNA, 64 nt, hsa; identical to SEQ ID NO: 40148

SEQ ID NO: 135633 - RNA, 64 nt, hsa; identical to SEQ ID NO: 40149

SEQ ID NO: 135634 - RNA, 64 nt, hsa; identical to SEQ ID NO: 40150

SEQ ID NO: 135635 - RNA, 64 nt, hsa; identical to SEQ ID NO: 40151

SEQ ID NO: 135636 - RNA, 64 nt, hsa; identical to SEQ ID NO: 40152

SEQ ID NO: 135637 - RNA, 64 nt, hsa; identical to SEQ ID NO: 40153

SEQ ID NO: 135638 - RNA, 64 nt, hsa; identical to SEQ ID NO: 40154

SEQ ID NO: 135639 - RNA, 64 nt, hsa; identical to SEQ ID NO: 40155

SEQ ID NO: 135640 - RNA, 64 nt, hsa; identical to SEQ ID NO: 40156

SEQ ID NO: 135641 - RNA, 64 nt, hsa; identical to SEQ ID NO: 40157

SEQ ID NO: 135642 - RNA, 64 nt, hsa; identical to SEQ ID NO: 40158

SEQ ID NO: 135643 - RNA, 64 nt, hsa; identical to SEQ ID NO: 40159

SEQ ID NO: 135644 - RNA, 64 nt, hsa; identical to SEQ ID NO: 40160

SEQ ID NO: 135645 - RNA, 64 nt, hsa; identical to SEQ ID NO: 40161

SEQ ID NO: 135646 - RNA, 64 nt, hsa; identical to SEQ ID NO: 40162

SEQ ID NO: 135647 - RNA, 64 nt, hsa; identical to SEQ ID NO: 40163

SEQ ID NO: 135648 - RNA, 64 nt, hsa; identical to SEQ ID NO: 40164

SEQ ID NO: 135649 - RNA, 64 nt, hsa; identical to SEQ ID NO: 40165

SEQ ID NO: 135650 - RNA, 64 nt, hsa; identical to SEQ ID NO: 40166

SEQ ID NO: 135651 - RNA, 64 nt, hsa; identical to SEQ ID NO: 40167

SEQ ID NO: 135652 - RNA, 64 nt, hsa; identical to SEQ ID NO: 40168

SEQ ID NO: 135653 - RNA, 64 nt, hsa; identical to SEQ ID NO: 40169

SEQ ID NO: 135654 - RNA, 64 nt, hsa; identical to SEQ ID NO: 40170

SEQ ID NO: 135655 - RNA, 64 nt, hsa; identical to SEQ ID NO: 40171

SEQ ID NO: 135656 - RNA, 64 nt, hsa; identical to SEQ ID NO: 40172

SEQ ID NO: 135657 - RNA, 64 nt, hsa; identical to SEQ ID NO: 40173

SEQ ID NO: 135658 - RNA, 64 nt, hsa; identical to SEQ ID NO: 40174

SEQ ID NO: 135659 - RNA, 64 nt, hsa; identical to SEQ ID NO: 40175

SEQ ID NO: 135660 - RNA, 64 nt, hsa; identical to SEQ ID NO: 40176

SEQ ID NO: 135661 - RNA, 64 nt, hsa; identical to SEQ ID NO: 40177

SEQ ID NO: 135662 - RNA, 64 nt, hsa; identical to SEQ ID NO: 40178

SEQ ID NO: 135663 - RNA, 64 nt, hsa; identical to SEQ ID NO: 40179

SEQ ID NO: 135664 - RNA, 64 nt, hsa; identical to SEQ ID NO: 40180

SEQ ID NO: 135665 - RNA, 64 nt, hsa; identical to SEQ ID NO: 40181

SEQ ID NO: 135666 - RNA, 64 nt, hsa; identical to SEQ ID NO: 40182

SEQ ID NO: 135667 - RNA, 64 nt, hsa; identical to SEQ ID NO: 40183

SEQ ID NO: 135668 - RNA, 64 nt, hsa; identical to SEQ ID NO: 40184

SEQ ID NO: 135669 - RNA, 64 nt, hsa; identical to SEQ ID NO: 40185

SEQ ID NO: 135670 - RNA, 64 nt, hsa; identical to SEQ ID NO: 40186

SEQ ID NO: 135671 - RNA, 64 nt, hsa; identical to SEQ ID NO: 40187

SEQ ID NO: 135672 - RNA, 64 nt, hsa; identical to SEQ ID NO: 40188

SEQ ID NO: 135673 - RNA, 64 nt, hsa; identical to SEQ ID NO: 40189

SEQ ID NO: 135674 - RNA, 64 nt, hsa; identical to SEQ ID NO: 40190

SEQ ID NO: 135675 - RNA, 64 nt, hsa; identical to SEQ ID NO: 40191

SEQ ID NO: 135676 - RNA, 64 nt, hsa; identical to SEQ ID NO: 40192

SEQ ID NO: 135677 - RNA, 64 nt, hsa; identical to SEQ ID NO: 40193

SEQ ID NO: 135678 - RNA, 64 nt, hsa; identical to SEQ ID NO: 40194

SEQ ID NO: 135679 - RNA, 64 nt, hsa; identical to SEQ ID NO: 40195

SEQ ID NO: 135680 - RNA, 64 nt, hsa; identical to SEQ ID NO: 40196

SEQ ID NO: 135681 - RNA, 64 nt, hsa; identical to SEQ ID NO: 40197

SEQ ID NO: 135682 - RNA, 64 nt, hsa; identical to SEQ ID NO: 40198

SEQ ID NO: 135683 - RNA, 64 nt, hsa; identical to SEQ ID NO: 40199

SEQ ID NO: 135684 - RNA, 64 nt, hsa; identical to SEQ ID NO: 40200

SEQ ID NO: 135685 - RNA, 64 nt, hsa; identical to SEQ ID NO: 40201

SEQ ID NO: 135686 - RNA, 64 nt, hsa; identical to SEQ ID NO: 40202

SEQ ID NO: 135687 - RNA, 64 nt, hsa; identical to SEQ ID NO: 40203

SEQ ID NO: 135688 - RNA, 64 nt, hsa; identical to SEQ ID NO: 40204

SEQ ID NO: 135689 - RNA, 64 nt, hsa; identical to SEQ ID NO: 40205

SEQ ID NO: 135690 - RNA, 64 nt, hsa; identical to SEQ ID NO: 40206

SEQ ID NO: 135691 - RNA, 64 nt, hsa; identical to SEQ ID NO: 40207

SEQ ID NO: 135692 - RNA, 64 nt, hsa; identical to SEQ ID NO: 40208

SEQ ID NO: 135693 - RNA, 64 nt, hsa; identical to SEQ ID NO: 40209

SEQ ID NO: 135694 - RNA, 64 nt, hsa; identical to SEQ ID NO: 40210

SEQ ID NO: 135695 - RNA, 64 nt, hsa; identical to SEQ ID NO: 40211

SEQ ID NO: 135696 - RNA, 64 nt, hsa; identical to SEQ ID NO: 40212

SEQ ID NO: 135697 - RNA, 64 nt, hsa; identical to SEQ ID NO: 40213

SEQ ID NO: 135698 - RNA, 64 nt, hsa; identical to SEQ ID NO: 40214

SEQ ID NO: 135699 - RNA, 64 nt, hsa; identical to SEQ ID NO: 40215

SEQ ID NO: 135700 - RNA, 64 nt, hsa; identical to SEQ ID NO: 40216

SEQ ID NO: 135701 - RNA, 64 nt, hsa; identical to SEQ ID NO: 40217

SEQ ID NO: 135702 - RNA, 64 nt, hsa; identical to SEQ ID NO: 40218

SEQ ID NO: 135703 - RNA, 64 nt, hsa; identical to SEQ ID NO: 40219

SEQ ID NO: 135704 - RNA, 64 nt, hsa; identical to SEQ ID NO: 40220

SEQ ID NO: 135705 - RNA, 64 nt, hsa; identical to SEQ ID NO: 40221

SEQ ID NO: 135706 - RNA, 64 nt, hsa; identical to SEQ ID NO: 40222

SEQ ID NO: 135707 - RNA, 64 nt, hsa; identical to SEQ ID NO: 40223

SEQ ID NO: 135708 - RNA, 64 nt, hsa; identical to SEQ ID NO: 40224

SEQ ID NO: 135709 - RNA, 64 nt, hsa; identical to SEQ ID NO: 40225

SEQ ID NO: 135710 - RNA, 64 nt, hsa; identical to SEQ ID NO: 40226

SEQ ID NO: 135711 - RNA, 64 nt, hsa; identical to SEQ ID NO: 40227

SEQ ID NO: 135712 - RNA, 64 nt, hsa; identical to SEQ ID NO: 40228

SEQ ID NO: 135713 - RNA, 64 nt, hsa; identical to SEQ ID NO: 40229

SEQ ID NO: 135714 - RNA, 64 nt, hsa; identical to SEQ ID NO: 40230

SEQ ID NO: 135715 - RNA, 64 nt, hsa; identical to SEQ ID NO: 40231

SEQ ID NO: 135716 - RNA, 64 nt, hsa; identical to SEQ ID NO: 40232

SEQ ID NO: 135717 - RNA, 64 nt, hsa; identical to SEQ ID NO: 40233

SEQ ID NO: 135718 - RNA, 64 nt, hsa; identical to SEQ ID NO: 40234

SEQ ID NO: 135719 - RNA, 64 nt, hsa; identical to SEQ ID NO: 40235

SEQ ID NO: 135720 - RNA, 64 nt, hsa; identical to SEQ ID NO: 40236

SEQ ID NO: 135721 - RNA, 64 nt, hsa; identical to SEQ ID NO: 40237

SEQ ID NO: 135722 - RNA, 64 nt, hsa; identical to SEQ ID NO: 40238

SEQ ID NO: 135723 - RNA, 64 nt, hsa; identical to SEQ ID NO: 40239

SEQ ID NO: 135724 - RNA, 64 nt, hsa; identical to SEQ ID NO: 40240

SEQ ID NO: 135725 - RNA, 64 nt, hsa; identical to SEQ ID NO: 40241

SEQ ID NO: 135726 - RNA, 64 nt, hsa; identical to SEQ ID NO: 40242

SEQ ID NO: 135727 - RNA, 64 nt, hsa; identical to SEQ ID NO: 40243

SEQ ID NO: 135728 - RNA, 64 nt, hsa; identical to SEQ ID NO: 40244

SEQ ID NO: 135729 - RNA, 64 nt, hsa; identical to SEQ ID NO: 40245

SEQ ID NO: 135730 - RNA, 64 nt, hsa; identical to SEQ ID NO: 40246

SEQ ID NO: 135731 - RNA, 64 nt, hsa; identical to SEQ ID NO: 40247

SEQ ID NO: 135732 - RNA, 64 nt, hsa; identical to SEQ ID NO: 40248

SEQ ID NO: 135733 - RNA, 64 nt, hsa; identical to SEQ ID NO: 40249

SEQ ID NO: 135734 - RNA, 64 nt, hsa; identical to SEQ ID NO: 40250

SEQ ID NO: 135735 - RNA, 64 nt, hsa; identical to SEQ ID NO: 40251

SEQ ID NO: 135736 - RNA, 64 nt, hsa; identical to SEQ ID NO: 40252

SEQ ID NO: 135737 - RNA, 64 nt, hsa; identical to SEQ ID NO: 40253

SEQ ID NO: 135738 - RNA, 64 nt, hsa; identical to SEQ ID NO: 40254

SEQ ID NO: 135739 - RNA, 64 nt, hsa; identical to SEQ ID NO: 40255

SEQ ID NO: 135740 - RNA, 64 nt, hsa; identical to SEQ ID NO: 40256

SEQ ID NO: 135741 - RNA, 64 nt, hsa; identical to SEQ ID NO: 40257

SEQ ID NO: 135742 - RNA, 64 nt, hsa; identical to SEQ ID NO: 40258

SEQ ID NO: 135743 - RNA, 64 nt, hsa; identical to SEQ ID NO: 40259

SEQ ID NO: 135744 - RNA, 64 nt, hsa; identical to SEQ ID NO: 40260

SEQ ID NO: 135745 - RNA, 64 nt, hsa; identical to SEQ ID NO: 40261

SEQ ID NO: 135746 - RNA, 64 nt, hsa; identical to SEQ ID NO: 40262

SEQ ID NO: 135747 - RNA, 64 nt, hsa; identical to SEQ ID NO: 40263

SEQ ID NO: 135748 - RNA, 64 nt, hsa; identical to SEQ ID NO: 40264

SEQ ID NO: 135749 - RNA, 64 nt, hsa; identical to SEQ ID NO: 40265

SEQ ID NO: 135750 - RNA, 64 nt, hsa; identical to SEQ ID NO: 40266

SEQ ID NO: 135751 - RNA, 64 nt, hsa; identical to SEQ ID NO: 40267

SEQ ID NO: 135752 - RNA, 64 nt, hsa; identical to SEQ ID NO: 40268

SEQ ID NO: 135753 - RNA, 64 nt, hsa; identical to SEQ ID NO: 40269

SEQ ID NO: 135754 - RNA, 64 nt, hsa; identical to SEQ ID NO: 40270

SEQ ID NO: 135755 - RNA, 64 nt, hsa; identical to SEQ ID NO: 40271

SEQ ID NO: 135756 - RNA, 64 nt, hsa; identical to SEQ ID NO: 40272

SEQ ID NO: 135757 - RNA, 64 nt, hsa; identical to SEQ ID NO: 40273

SEQ ID NO: 135758 - RNA, 64 nt, hsa; identical to SEQ ID NO: 40274

SEQ ID NO: 135759 - RNA, 64 nt, hsa; identical to SEQ ID NO: 40275

SEQ ID NO: 135760 - RNA, 64 nt, hsa; identical to SEQ ID NO: 40276

SEQ ID NO: 135761 - RNA, 64 nt, hsa; identical to SEQ ID NO: 40277

SEQ ID NO: 135762 - RNA, 64 nt, hsa; identical to SEQ ID NO: 40278

SEQ ID NO: 135763 - RNA, 64 nt, hsa; identical to SEQ ID NO: 40279

SEQ ID NO: 135764 - RNA, 64 nt, hsa; identical to SEQ ID NO: 40280

SEQ ID NO: 135765 - RNA, 64 nt, hsa; identical to SEQ ID NO: 40281

SEQ ID NO: 135766 - RNA, 64 nt, hsa; identical to SEQ ID NO: 40282

SEQ ID NO: 135767 - RNA, 64 nt, hsa; identical to SEQ ID NO: 40283

SEQ ID NO: 135768 - RNA, 64 nt, hsa; identical to SEQ ID NO: 40284

SEQ ID NO: 135769 - RNA, 64 nt, hsa; identical to SEQ ID NO: 40285

SEQ ID NO: 135770 - RNA, 64 nt, hsa; identical to SEQ ID NO: 40286

SEQ ID NO: 135771 - RNA, 64 nt, hsa; identical to SEQ ID NO: 40287

SEQ ID NO: 135772 - RNA, 64 nt, hsa; identical to SEQ ID NO: 40288

SEQ ID NO: 135773 - RNA, 64 nt, hsa; identical to SEQ ID NO: 40289

SEQ ID NO: 135774 - RNA, 64 nt, hsa; identical to SEQ ID NO: 40290

SEQ ID NO: 135775 - RNA, 64 nt, hsa; identical to SEQ ID NO: 40291

SEQ ID NO: 135776 - RNA, 64 nt, hsa; identical to SEQ ID NO: 40292

SEQ ID NO: 135777 - RNA, 64 nt, hsa; identical to SEQ ID NO: 40293

SEQ ID NO: 135778 - RNA, 64 nt, hsa; identical to SEQ ID NO: 40294

SEQ ID NO: 135779 - RNA, 64 nt, hsa; identical to SEQ ID NO: 40295

SEQ ID NO: 135780 - RNA, 64 nt, hsa; identical to SEQ ID NO: 40296

SEQ ID NO: 135781 - RNA, 64 nt, hsa; identical to SEQ ID NO: 40297

SEQ ID NO: 135782 - RNA, 64 nt, hsa; identical to SEQ ID NO: 40298

SEQ ID NO: 135783 - RNA, 64 nt, hsa; identical to SEQ ID NO: 40299

SEQ ID NO: 135784 - RNA, 64 nt, hsa; identical to SEQ ID NO: 40300

SEQ ID NO: 135785 - RNA, 64 nt, hsa; identical to SEQ ID NO: 40301

SEQ ID NO: 135786 - RNA, 64 nt, hsa; identical to SEQ ID NO: 40302

SEQ ID NO: 135787 - RNA, 64 nt, hsa; identical to SEQ ID NO: 40303

SEQ ID NO: 135788 - RNA, 64 nt, hsa; identical to SEQ ID NO: 40304

SEQ ID NO: 135789 - RNA, 64 nt, hsa; identical to SEQ ID NO: 40305

SEQ ID NO: 135790 - RNA, 64 nt, hsa; identical to SEQ ID NO: 40306

SEQ ID NO: 135791 - RNA, 64 nt, hsa; identical to SEQ ID NO: 40307

SEQ ID NO: 135792 - RNA, 64 nt, hsa; identical to SEQ ID NO: 40308

SEQ ID NO: 135793 - RNA, 64 nt, hsa; identical to SEQ ID NO: 40309

SEQ ID NO: 135794 - RNA, 64 nt, hsa; identical to SEQ ID NO: 40310

SEQ ID NO: 135795 - RNA, 64 nt, hsa; identical to SEQ ID NO: 40311

SEQ ID NO: 135796 - RNA, 64 nt, hsa; identical to SEQ ID NO: 40312

SEQ ID NO: 135797 - RNA, 64 nt, hsa; identical to SEQ ID NO: 40313

SEQ ID NO: 135798 - RNA, 64 nt, hsa; identical to SEQ ID NO: 40314

SEQ ID NO: 135799 - RNA, 64 nt, hsa; identical to SEQ ID NO: 40315

SEQ ID NO: 135800 - RNA, 64 nt, hsa; identical to SEQ ID NO: 40316

SEQ ID NO: 135801 - RNA, 64 nt, hsa; identical to SEQ ID NO: 40317

SEQ ID NO: 135802 - RNA, 64 nt, hsa; identical to SEQ ID NO: 40318

SEQ ID NO: 135803 - RNA, 64 nt, hsa; identical to SEQ ID NO: 40319

SEQ ID NO: 135804 - RNA, 64 nt, hsa; identical to SEQ ID NO: 40320

SEQ ID NO: 135805 - RNA, 64 nt, hsa; identical to SEQ ID NO: 40321

SEQ ID NO: 135806 - RNA, 64 nt, hsa; identical to SEQ ID NO: 40322

SEQ ID NO: 135807 - RNA, 64 nt, hsa; identical to SEQ ID NO: 40323

SEQ ID NO: 135808 - RNA, 64 nt, hsa; identical to SEQ ID NO: 40324

SEQ ID NO: 135809 - RNA, 64 nt, hsa; identical to SEQ ID NO: 40325

SEQ ID NO: 135810 - RNA, 64 nt, hsa; identical to SEQ ID NO: 40326

SEQ ID NO: 135811 - RNA, 64 nt, hsa; identical to SEQ ID NO: 40327

SEQ ID NO: 135812 - RNA, 64 nt, hsa; identical to SEQ ID NO: 40328

SEQ ID NO: 135813 - RNA, 64 nt, hsa; identical to SEQ ID NO: 40329

SEQ ID NO: 135814 - RNA, 64 nt, hsa; identical to SEQ ID NO: 40330

SEQ ID NO: 135815 - RNA, 64 nt, hsa; identical to SEQ ID NO: 40331

SEQ ID NO: 135816 - RNA, 64 nt, hsa; identical to SEQ ID NO: 40332

SEQ ID NO: 135817 - RNA, 64 nt, hsa; identical to SEQ ID NO: 40333

SEQ ID NO: 135818 - RNA, 64 nt, hsa; identical to SEQ ID NO: 40334

SEQ ID NO: 135819 - RNA, 64 nt, hsa; identical to SEQ ID NO: 40335

SEQ ID NO: 135820 - RNA, 64 nt, hsa; identical to SEQ ID NO: 40336

SEQ ID NO: 135821 - RNA, 64 nt, hsa; identical to SEQ ID NO: 40337

SEQ ID NO: 135822 - RNA, 64 nt, hsa; identical to SEQ ID NO: 40338

SEQ ID NO: 135823 - RNA, 64 nt, hsa; identical to SEQ ID NO: 40339

SEQ ID NO: 135824 - RNA, 64 nt, hsa; identical to SEQ ID NO: 40340

SEQ ID NO: 135825 - RNA, 64 nt, hsa; identical to SEQ ID NO: 40341

SEQ ID NO: 135826 - RNA, 64 nt, hsa; identical to SEQ ID NO: 40342

SEQ ID NO: 135827 - RNA, 64 nt, hsa; identical to SEQ ID NO: 40343

SEQ ID NO: 135828 - RNA, 64 nt, hsa; identical to SEQ ID NO: 40344

SEQ ID NO: 135829 - RNA, 64 nt, hsa; identical to SEQ ID NO: 40345

SEQ ID NO: 135830 - RNA, 64 nt, hsa; identical to SEQ ID NO: 40346

SEQ ID NO: 135831 - RNA, 64 nt, hsa; identical to SEQ ID NO: 40347

SEQ ID NO: 135832 - RNA, 64 nt, hsa; identical to SEQ ID NO: 40348

SEQ ID NO: 135833 - RNA, 64 nt, hsa; identical to SEQ ID NO: 40349

SEQ ID NO: 135834 - RNA, 64 nt, hsa; identical to SEQ ID NO: 40350

SEQ ID NO: 135835 - RNA, 64 nt, hsa; identical to SEQ ID NO: 40351

SEQ ID NO: 135836 - RNA, 64 nt, hsa; identical to SEQ ID NO: 40352

SEQ ID NO: 135837 - RNA, 64 nt, hsa; identical to SEQ ID NO: 40353

SEQ ID NO: 135838 - RNA, 64 nt, hsa; identical to SEQ ID NO: 40354

SEQ ID NO: 135839 - RNA, 64 nt, hsa; identical to SEQ ID NO: 40355

SEQ ID NO: 135840 - RNA, 64 nt, hsa; identical to SEQ ID NO: 40356

SEQ ID NO: 135841 - RNA, 64 nt, hsa; identical to SEQ ID NO: 40357

SEQ ID NO: 135842 - RNA, 64 nt, hsa; identical to SEQ ID NO: 40358

SEQ ID NO: 135843 - RNA, 64 nt, hsa; identical to SEQ ID NO: 40359

SEQ ID NO: 135844 - RNA, 64 nt, hsa; identical to SEQ ID NO: 40360

SEQ ID NO: 135845 - RNA, 64 nt, hsa; identical to SEQ ID NO: 40361

SEQ ID NO: 135846 - RNA, 64 nt, hsa; identical to SEQ ID NO: 40362

SEQ ID NO: 135847 - RNA, 64 nt, hsa; identical to SEQ ID NO: 40363

SEQ ID NO: 135848 - RNA, 64 nt, hsa; identical to SEQ ID NO: 40364

SEQ ID NO: 135849 - RNA, 64 nt, hsa; identical to SEQ ID NO: 40365

SEQ ID NO: 135850 - RNA, 64 nt, hsa; identical to SEQ ID NO: 40366

SEQ ID NO: 135851 - RNA, 64 nt, hsa; identical to SEQ ID NO: 40367

SEQ ID NO: 135852 - RNA, 64 nt, hsa; identical to SEQ ID NO: 40368

SEQ ID NO: 135853 - RNA, 64 nt, hsa; identical to SEQ ID NO: 40369

SEQ ID NO: 135854 - RNA, 64 nt, hsa; identical to SEQ ID NO: 40370

SEQ ID NO: 135855 - RNA, 64 nt, hsa; identical to SEQ ID NO: 40371

SEQ ID NO: 135856 - RNA, 64 nt, hsa; identical to SEQ ID NO: 40372

SEQ ID NO: 135857 - RNA, 64 nt, hsa; identical to SEQ ID NO: 40373

SEQ ID NO: 135858 - RNA, 64 nt, hsa; identical to SEQ ID NO: 40374

SEQ ID NO: 135859 - RNA, 64 nt, hsa; identical to SEQ ID NO: 40375

SEQ ID NO: 135860 - RNA, 64 nt, hsa; identical to SEQ ID NO: 40376

SEQ ID NO: 135861 - RNA, 64 nt, hsa; identical to SEQ ID NO: 40377

SEQ ID NO: 135862 - RNA, 64 nt, hsa; identical to SEQ ID NO: 40378

SEQ ID NO: 135863 - RNA, 64 nt, hsa; identical to SEQ ID NO: 40379

SEQ ID NO: 135864 - RNA, 64 nt, hsa; identical to SEQ ID NO: 40380

SEQ ID NO: 135865 - RNA, 64 nt, hsa; identical to SEQ ID NO: 40381

SEQ ID NO: 135866 - RNA, 64 nt, hsa; identical to SEQ ID NO: 40382

SEQ ID NO: 135867 - RNA, 64 nt, hsa; identical to SEQ ID NO: 40383

SEQ ID NO: 135868 - RNA, 64 nt, hsa; identical to SEQ ID NO: 40384

SEQ ID NO: 135869 - RNA, 64 nt, hsa; identical to SEQ ID NO: 40385

SEQ ID NO: 135870 - RNA, 64 nt, hsa; identical to SEQ ID NO: 40386

SEQ ID NO: 135871 - RNA, 64 nt, hsa; identical to SEQ ID NO: 40387

SEQ ID NO: 135872 - RNA, 64 nt, hsa; identical to SEQ ID NO: 40388

SEQ ID NO: 135873 - RNA, 64 nt, hsa; identical to SEQ ID NO: 40389

SEQ ID NO: 135874 - RNA, 64 nt, hsa; identical to SEQ ID NO: 40390

SEQ ID NO: 135875 - RNA, 64 nt, hsa; identical to SEQ ID NO: 40391

SEQ ID NO: 135876 - RNA, 64 nt, hsa; identical to SEQ ID NO: 40392

SEQ ID NO: 135877 - RNA, 64 nt, hsa; identical to SEQ ID NO: 40393

SEQ ID NO: 135878 - RNA, 64 nt, hsa; identical to SEQ ID NO: 40394

SEQ ID NO: 135879 - RNA, 64 nt, hsa; identical to SEQ ID NO: 40395

SEQ ID NO: 135880 - RNA, 64 nt, hsa; identical to SEQ ID NO: 40396

SEQ ID NO: 135881 - RNA, 64 nt, hsa; identical to SEQ ID NO: 40397

SEQ ID NO: 135882 - RNA, 64 nt, hsa; identical to SEQ ID NO: 40398

SEQ ID NO: 135883 - RNA, 64 nt, hsa; identical to SEQ ID NO: 40399

SEQ ID NO: 135884 - RNA, 64 nt, hsa; identical to SEQ ID NO: 40400

SEQ ID NO: 135885 - RNA, 64 nt, hsa; identical to SEQ ID NO: 40401

SEQ ID NO: 135886 - RNA, 64 nt, hsa; identical to SEQ ID NO: 40402

SEQ ID NO: 135887 - RNA, 64 nt, hsa; identical to SEQ ID NO: 40403

SEQ ID NO: 135888 - RNA, 64 nt, hsa; identical to SEQ ID NO: 40404

SEQ ID NO: 135889 - RNA, 64 nt, hsa; identical to SEQ ID NO: 40405

SEQ ID NO: 135890 - RNA, 64 nt, hsa; identical to SEQ ID NO: 40406

SEQ ID NO: 135891 - RNA, 64 nt, hsa; identical to SEQ ID NO: 40407

SEQ ID NO: 135892 - RNA, 64 nt, hsa; identical to SEQ ID NO: 40408

SEQ ID NO: 135893 - RNA, 64 nt, hsa; identical to SEQ ID NO: 40409

SEQ ID NO: 135894 - RNA, 64 nt, hsa; identical to SEQ ID NO: 40410

SEQ ID NO: 135895 - RNA, 64 nt, hsa; identical to SEQ ID NO: 40411

SEQ ID NO: 135896 - RNA, 64 nt, hsa; identical to SEQ ID NO: 40412

SEQ ID NO: 135897 - RNA, 64 nt, hsa; identical to SEQ ID NO: 40413

SEQ ID NO: 135898 - RNA, 64 nt, hsa; identical to SEQ ID NO: 40414

SEQ ID NO: 135899 - RNA, 64 nt, hsa; identical to SEQ ID NO: 40415

SEQ ID NO: 135900 - RNA, 64 nt, hsa; identical to SEQ ID NO: 40416

SEQ ID NO: 135901 - RNA, 64 nt, hsa; identical to SEQ ID NO: 40417

SEQ ID NO: 135902 - RNA, 64 nt, hsa; identical to SEQ ID NO: 40418

SEQ ID NO: 135903 - RNA, 64 nt, hsa; identical to SEQ ID NO: 40419

SEQ ID NO: 135904 - RNA, 64 nt, hsa; identical to SEQ ID NO: 40420

SEQ ID NO: 135905 - RNA, 64 nt, hsa; identical to SEQ ID NO: 40421

SEQ ID NO: 135906 - RNA, 64 nt, hsa; identical to SEQ ID NO: 40422

SEQ ID NO: 135907 - RNA, 64 nt, hsa; identical to SEQ ID NO: 40423

SEQ ID NO: 135908 - RNA, 64 nt, hsa; identical to SEQ ID NO: 40424

SEQ ID NO: 135909 - RNA, 64 nt, hsa; identical to SEQ ID NO: 40425

SEQ ID NO: 135910 - RNA, 64 nt, hsa; identical to SEQ ID NO: 40426

SEQ ID NO: 135911 - RNA, 64 nt, hsa; identical to SEQ ID NO: 40427

SEQ ID NO: 135912 - RNA, 64 nt, hsa; identical to SEQ ID NO: 40428

SEQ ID NO: 135913 - RNA, 64 nt, hsa; identical to SEQ ID NO: 40429

SEQ ID NO: 135914 - RNA, 64 nt, hsa; identical to SEQ ID NO: 40430

SEQ ID NO: 135915 - RNA, 64 nt, hsa; identical to SEQ ID NO: 40431

SEQ ID NO: 135916 - RNA, 64 nt, hsa; identical to SEQ ID NO: 40432

SEQ ID NO: 135917 - RNA, 64 nt, hsa; identical to SEQ ID NO: 40433

SEQ ID NO: 135918 - RNA, 64 nt, hsa; identical to SEQ ID NO: 40434

SEQ ID NO: 135919 - RNA, 64 nt, hsa; identical to SEQ ID NO: 40435

SEQ ID NO: 135920 - RNA, 64 nt, hsa; identical to SEQ ID NO: 40436

SEQ ID NO: 135921 - RNA, 64 nt, hsa; identical to SEQ ID NO: 40437

SEQ ID NO: 135922 - RNA, 64 nt, hsa; identical to SEQ ID NO: 40438

SEQ ID NO: 135923 - RNA, 64 nt, hsa; identical to SEQ ID NO: 40439

SEQ ID NO: 135924 - RNA, 64 nt, hsa; identical to SEQ ID NO: 40440

SEQ ID NO: 135925 - RNA, 64 nt, hsa; identical to SEQ ID NO: 40441

SEQ ID NO: 135926 - RNA, 64 nt, hsa; identical to SEQ ID NO: 40442

SEQ ID NO: 135927 - RNA, 64 nt, hsa; identical to SEQ ID NO: 40443

SEQ ID NO: 135928 - RNA, 64 nt, hsa; identical to SEQ ID NO: 40444

SEQ ID NO: 135929 - RNA, 64 nt, hsa; identical to SEQ ID NO: 40445

SEQ ID NO: 135930 - RNA, 64 nt, hsa; identical to SEQ ID NO: 40446

SEQ ID NO: 135931 - RNA, 64 nt, hsa; identical to SEQ ID NO: 40447

SEQ ID NO: 135932 - RNA, 64 nt, hsa; identical to SEQ ID NO: 40448

SEQ ID NO: 135933 - RNA, 64 nt, hsa; identical to SEQ ID NO: 40449

SEQ ID NO: 135934 - RNA, 64 nt, hsa; identical to SEQ ID NO: 40450

SEQ ID NO: 135935 - RNA, 64 nt, hsa; identical to SEQ ID NO: 40451

SEQ ID NO: 135936 - RNA, 64 nt, hsa; identical to SEQ ID NO: 40452

SEQ ID NO: 135937 - RNA, 64 nt, hsa; identical to SEQ ID NO: 40453

SEQ ID NO: 135938 - RNA, 64 nt, hsa; identical to SEQ ID NO: 40454

SEQ ID NO: 135939 - RNA, 64 nt, hsa; identical to SEQ ID NO: 40455

SEQ ID NO: 135940 - RNA, 64 nt, hsa; identical to SEQ ID NO: 40456

SEQ ID NO: 135941 - RNA, 64 nt, hsa; identical to SEQ ID NO: 40457

SEQ ID NO: 135942 - RNA, 64 nt, hsa; identical to SEQ ID NO: 40458

SEQ ID NO: 135943 - RNA, 64 nt, hsa; identical to SEQ ID NO: 40459

SEQ ID NO: 135944 - RNA, 64 nt, hsa; identical to SEQ ID NO: 40460

SEQ ID NO: 135945 - RNA, 64 nt, hsa; identical to SEQ ID NO: 40461

SEQ ID NO: 135946 - RNA, 64 nt, hsa; identical to SEQ ID NO: 40462

SEQ ID NO: 135947 - RNA, 64 nt, hsa; identical to SEQ ID NO: 40463

SEQ ID NO: 135948 - RNA, 64 nt, hsa; identical to SEQ ID NO: 40464

SEQ ID NO: 135949 - RNA, 64 nt, hsa; identical to SEQ ID NO: 40465

SEQ ID NO: 135950 - RNA, 64 nt, hsa; identical to SEQ ID NO: 40466

SEQ ID NO: 135951 - RNA, 64 nt, hsa; identical to SEQ ID NO: 40467

SEQ ID NO: 135952 - RNA, 64 nt, hsa; identical to SEQ ID NO: 40468

SEQ ID NO: 135953 - RNA, 64 nt, hsa; identical to SEQ ID NO: 40469

SEQ ID NO: 135954 - RNA, 64 nt, hsa; identical to SEQ ID NO: 40470

SEQ ID NO: 135955 - RNA, 64 nt, hsa; identical to SEQ ID NO: 40471

SEQ ID NO: 135956 - RNA, 64 nt, hsa; identical to SEQ ID NO: 40472

SEQ ID NO: 135957 - RNA, 64 nt, hsa; identical to SEQ ID NO: 40473

SEQ ID NO: 135958 - RNA, 64 nt, hsa; identical to SEQ ID NO: 40474

SEQ ID NO: 135959 - RNA, 64 nt, hsa; identical to SEQ ID NO: 40475

SEQ ID NO: 135960 - RNA, 64 nt, hsa; identical to SEQ ID NO: 40476

SEQ ID NO: 135961 - RNA, 64 nt, hsa; identical to SEQ ID NO: 40477

SEQ ID NO: 135962 - RNA, 64 nt, hsa; identical to SEQ ID NO: 40478

SEQ ID NO: 135963 - RNA, 64 nt, hsa; identical to SEQ ID NO: 40479

SEQ ID NO: 135964 - RNA, 64 nt, hsa; identical to SEQ ID NO: 40480

SEQ ID NO: 135965 - RNA, 64 nt, hsa; identical to SEQ ID NO: 40481

SEQ ID NO: 135966 - RNA, 64 nt, hsa; identical to SEQ ID NO: 40482

SEQ ID NO: 135967 - RNA, 64 nt, hsa; identical to SEQ ID NO: 40483

SEQ ID NO: 135968 - RNA, 64 nt, hsa; identical to SEQ ID NO: 40484

SEQ ID NO: 135969 - RNA, 64 nt, hsa; identical to SEQ ID NO: 40485

SEQ ID NO: 135970 - RNA, 64 nt, hsa; identical to SEQ ID NO: 40486

SEQ ID NO: 135971 - RNA, 64 nt, hsa; identical to SEQ ID NO: 40487

SEQ ID NO: 135972 - RNA, 64 nt, hsa; identical to SEQ ID NO: 40488

SEQ ID NO: 135973 - RNA, 64 nt, hsa; identical to SEQ ID NO: 40489

SEQ ID NO: 135974 - RNA, 64 nt, hsa; identical to SEQ ID NO: 40490

SEQ ID NO: 135975 - RNA, 64 nt, hsa; identical to SEQ ID NO: 40491

SEQ ID NO: 135976 - RNA, 64 nt, hsa; identical to SEQ ID NO: 40492

SEQ ID NO: 135977 - RNA, 64 nt, hsa; identical to SEQ ID NO: 40493

SEQ ID NO: 135978 - RNA, 64 nt, hsa; identical to SEQ ID NO: 40494

SEQ ID NO: 135979 - RNA, 64 nt, hsa; identical to SEQ ID NO: 40495

SEQ ID NO: 135980 - RNA, 64 nt, hsa; identical to SEQ ID NO: 40496

SEQ ID NO: 135981 - RNA, 64 nt, hsa; identical to SEQ ID NO: 40497

SEQ ID NO: 135982 - RNA, 64 nt, hsa; identical to SEQ ID NO: 40498

SEQ ID NO: 135983 - RNA, 64 nt, hsa; identical to SEQ ID NO: 40499

SEQ ID NO: 135984 - RNA, 64 nt, hsa; identical to SEQ ID NO: 40500

SEQ ID NO: 135985 - RNA, 64 nt, hsa; identical to SEQ ID NO: 40501

SEQ ID NO: 135986 - RNA, 64 nt, hsa; identical to SEQ ID NO: 40502

SEQ ID NO: 135987 - RNA, 64 nt, hsa; identical to SEQ ID NO: 40503

SEQ ID NO: 135988 - RNA, 64 nt, hsa; identical to SEQ ID NO: 40504

SEQ ID NO: 135989 - RNA, 64 nt, hsa; identical to SEQ ID NO: 40505

SEQ ID NO: 135990 - RNA, 64 nt, hsa; identical to SEQ ID NO: 40506

SEQ ID NO: 135991 - RNA, 64 nt, hsa; identical to SEQ ID NO: 40507

SEQ ID NO: 135992 - RNA, 64 nt, hsa; identical to SEQ ID NO: 40508

SEQ ID NO: 135993 - RNA, 64 nt, hsa; identical to SEQ ID NO: 40509

SEQ ID NO: 135994 - RNA, 64 nt, hsa; identical to SEQ ID NO: 40510

SEQ ID NO: 135995 - RNA, 64 nt, hsa; identical to SEQ ID NO: 40511

SEQ ID NO: 135996 - RNA, 64 nt, hsa; identical to SEQ ID NO: 40512

SEQ ID NO: 135997 - RNA, 64 nt, hsa; identical to SEQ ID NO: 40513

SEQ ID NO: 135998 - RNA, 64 nt, hsa; identical to SEQ ID NO: 40514

SEQ ID NO: 135999 - RNA, 64 nt, hsa; identical to SEQ ID NO: 40515

SEQ ID NO: 136000 - RNA, 64 nt, hsa; identical to SEQ ID NO: 40516

SEQ ID NO: 136001 - RNA, 64 nt, hsa; identical to SEQ ID NO: 40517

SEQ ID NO: 136002 - RNA, 64 nt, hsa; identical to SEQ ID NO: 40518

SEQ ID NO: 136003 - RNA, 64 nt, hsa; identical to SEQ ID NO: 40519

SEQ ID NO: 136004 - RNA, 64 nt, hsa; identical to SEQ ID NO: 40520

SEQ ID NO: 136005 - RNA, 64 nt, hsa; identical to SEQ ID NO: 40521

SEQ ID NO: 136006 - RNA, 64 nt, hsa; identical to SEQ ID NO: 40522

SEQ ID NO: 136007 - RNA, 64 nt, hsa; identical to SEQ ID NO: 40523

SEQ ID NO: 136008 - RNA, 64 nt, hsa; identical to SEQ ID NO: 40524

SEQ ID NO: 136009 - RNA, 64 nt, hsa; identical to SEQ ID NO: 40525

SEQ ID NO: 136010 - RNA, 64 nt, hsa; identical to SEQ ID NO: 40526

SEQ ID NO: 136011 - RNA, 64 nt, hsa; identical to SEQ ID NO: 40527

SEQ ID NO: 136012 - RNA, 64 nt, hsa; identical to SEQ ID NO: 40528

SEQ ID NO: 136013 - RNA, 64 nt, hsa; identical to SEQ ID NO: 40529

SEQ ID NO: 136014 - RNA, 64 nt, hsa; identical to SEQ ID NO: 40530

SEQ ID NO: 136015 - RNA, 64 nt, hsa; identical to SEQ ID NO: 40531

SEQ ID NO: 136016 - RNA, 64 nt, hsa; identical to SEQ ID NO: 40532

SEQ ID NO: 136017 - RNA, 64 nt, hsa; identical to SEQ ID NO: 40533

SEQ ID NO: 136018 - RNA, 64 nt, hsa; identical to SEQ ID NO: 40534

SEQ ID NO: 136019 - RNA, 64 nt, hsa; identical to SEQ ID NO: 40535

SEQ ID NO: 136020 - RNA, 64 nt, hsa; identical to SEQ ID NO: 40536

SEQ ID NO: 136021 - RNA, 64 nt, hsa; identical to SEQ ID NO: 40537

SEQ ID NO: 136022 - RNA, 64 nt, hsa; identical to SEQ ID NO: 40538

SEQ ID NO: 136023 - RNA, 64 nt, hsa; identical to SEQ ID NO: 40539

SEQ ID NO: 136024 - RNA, 64 nt, hsa; identical to SEQ ID NO: 40540

SEQ ID NO: 136025 - RNA, 64 nt, hsa; identical to SEQ ID NO: 40541

SEQ ID NO: 136026 - RNA, 64 nt, hsa; identical to SEQ ID NO: 40542

SEQ ID NO: 136027 - RNA, 64 nt, hsa; identical to SEQ ID NO: 40543

SEQ ID NO: 136028 - RNA, 64 nt, hsa; identical to SEQ ID NO: 40544

SEQ ID NO: 136029 - RNA, 64 nt, hsa; identical to SEQ ID NO: 40545

SEQ ID NO: 136030 - RNA, 64 nt, hsa; identical to SEQ ID NO: 40546

SEQ ID NO: 136031 - RNA, 64 nt, hsa; identical to SEQ ID NO: 40547

SEQ ID NO: 136032 - RNA, 64 nt, hsa; identical to SEQ ID NO: 40548

SEQ ID NO: 136033 - RNA, 64 nt, hsa; identical to SEQ ID NO: 40549

SEQ ID NO: 136034 - RNA, 64 nt, hsa; identical to SEQ ID NO: 40550

SEQ ID NO: 136035 - RNA, 64 nt, hsa; identical to SEQ ID NO: 40551

SEQ ID NO: 136036 - RNA, 64 nt, hsa; identical to SEQ ID NO: 40552

SEQ ID NO: 136037 - RNA, 64 nt, hsa; identical to SEQ ID NO: 40553

SEQ ID NO: 136038 - RNA, 64 nt, hsa; identical to SEQ ID NO: 40554

SEQ ID NO: 136039 - RNA, 64 nt, hsa; identical to SEQ ID NO: 40555

SEQ ID NO: 136040 - RNA, 64 nt, hsa; identical to SEQ ID NO: 40556

SEQ ID NO: 136041 - RNA, 64 nt, hsa; identical to SEQ ID NO: 40557

SEQ ID NO: 136042 - RNA, 64 nt, hsa; identical to SEQ ID NO: 40558

SEQ ID NO: 136043 - RNA, 64 nt, hsa; identical to SEQ ID NO: 40559

SEQ ID NO: 136044 - RNA, 64 nt, hsa; identical to SEQ ID NO: 40560

SEQ ID NO: 136045 - RNA, 64 nt, hsa; identical to SEQ ID NO: 40561

SEQ ID NO: 136046 - RNA, 64 nt, hsa; identical to SEQ ID NO: 40562

SEQ ID NO: 136047 - RNA, 64 nt, hsa; identical to SEQ ID NO: 40563

SEQ ID NO: 136048 - RNA, 64 nt, hsa; identical to SEQ ID NO: 40564

SEQ ID NO: 136049 - RNA, 64 nt, hsa; identical to SEQ ID NO: 40565

SEQ ID NO: 136050 - RNA, 64 nt, hsa; identical to SEQ ID NO: 40566

SEQ ID NO: 136051 - RNA, 64 nt, hsa; identical to SEQ ID NO: 40567

SEQ ID NO: 136052 - RNA, 64 nt, hsa; identical to SEQ ID NO: 40568

SEQ ID NO: 136053 - RNA, 64 nt, hsa; identical to SEQ ID NO: 40569

SEQ ID NO: 136054 - RNA, 64 nt, hsa; identical to SEQ ID NO: 40570

SEQ ID NO: 136055 - RNA, 64 nt, hsa; identical to SEQ ID NO: 40571

SEQ ID NO: 136056 - RNA, 64 nt, hsa; identical to SEQ ID NO: 40572

SEQ ID NO: 136057 - RNA, 64 nt, hsa; identical to SEQ ID NO: 40573

SEQ ID NO: 136058 - RNA, 64 nt, hsa; identical to SEQ ID NO: 40574

SEQ ID NO: 136059 - RNA, 64 nt, hsa; identical to SEQ ID NO: 40575

SEQ ID NO: 136060 - RNA, 64 nt, hsa; identical to SEQ ID NO: 40576

SEQ ID NO: 136061 - RNA, 64 nt, hsa; identical to SEQ ID NO: 40577

SEQ ID NO: 136062 - RNA, 64 nt, hsa; identical to SEQ ID NO: 40578

SEQ ID NO: 136063 - RNA, 64 nt, hsa; identical to SEQ ID NO: 40579

SEQ ID NO: 136064 - RNA, 64 nt, hsa; identical to SEQ ID NO: 40580

SEQ ID NO: 136065 - RNA, 64 nt, hsa; identical to SEQ ID NO: 40581

SEQ ID NO: 136066 - RNA, 64 nt, hsa; identical to SEQ ID NO: 40582

SEQ ID NO: 136067 - RNA, 64 nt, hsa; identical to SEQ ID NO: 40583

SEQ ID NO: 136068 - RNA, 64 nt, hsa; identical to SEQ ID NO: 40584

SEQ ID NO: 136069 - RNA, 64 nt, hsa; identical to SEQ ID NO: 40585

SEQ ID NO: 136070 - RNA, 64 nt, hsa; identical to SEQ ID NO: 40586

SEQ ID NO: 136071 - RNA, 64 nt, hsa; identical to SEQ ID NO: 40587

SEQ ID NO: 136072 - RNA, 64 nt, hsa; identical to SEQ ID NO: 40588

SEQ ID NO: 136073 - RNA, 64 nt, hsa; identical to SEQ ID NO: 40589

SEQ ID NO: 136074 - RNA, 64 nt, hsa; identical to SEQ ID NO: 40590

SEQ ID NO: 136075 - RNA, 64 nt, hsa; identical to SEQ ID NO: 40591

SEQ ID NO: 136076 - RNA, 64 nt, hsa; identical to SEQ ID NO: 40592

SEQ ID NO: 136077 - RNA, 64 nt, hsa; identical to SEQ ID NO: 40593

SEQ ID NO: 136078 - RNA, 64 nt, hsa; identical to SEQ ID NO: 40594

SEQ ID NO: 136079 - RNA, 64 nt, hsa; identical to SEQ ID NO: 40595

SEQ ID NO: 136080 - RNA, 64 nt, hsa; identical to SEQ ID NO: 40596

SEQ ID NO: 136081 - RNA, 64 nt, hsa; identical to SEQ ID NO: 40597

SEQ ID NO: 136082 - RNA, 64 nt, hsa; identical to SEQ ID NO: 40598

SEQ ID NO: 136083 - RNA, 64 nt, hsa; identical to SEQ ID NO: 40599

SEQ ID NO: 136084 - RNA, 64 nt, hsa; identical to SEQ ID NO: 40600

SEQ ID NO: 136085 - RNA, 64 nt, hsa; identical to SEQ ID NO: 40601

SEQ ID NO: 136086 - RNA, 64 nt, hsa; identical to SEQ ID NO: 40602

SEQ ID NO: 136087 - RNA, 64 nt, hsa; identical to SEQ ID NO: 40603

SEQ ID NO: 136088 - RNA, 64 nt, hsa; identical to SEQ ID NO: 40604

SEQ ID NO: 136089 - RNA, 64 nt, hsa; identical to SEQ ID NO: 40605

SEQ ID NO: 136090 - RNA, 64 nt, hsa; identical to SEQ ID NO: 40606

SEQ ID NO: 136091 - RNA, 64 nt, hsa; identical to SEQ ID NO: 40607

SEQ ID NO: 136092 - RNA, 64 nt, hsa; identical to SEQ ID NO: 40608

SEQ ID NO: 136093 - RNA, 64 nt, hsa; identical to SEQ ID NO: 40609

SEQ ID NO: 136094 - RNA, 64 nt, hsa; identical to SEQ ID NO: 40610

SEQ ID NO: 136095 - RNA, 64 nt, hsa; identical to SEQ ID NO: 40611

SEQ ID NO: 136096 - RNA, 64 nt, hsa; identical to SEQ ID NO: 40612

SEQ ID NO: 136097 - RNA, 64 nt, hsa; identical to SEQ ID NO: 40613

SEQ ID NO: 136098 - RNA, 64 nt, hsa; identical to SEQ ID NO: 40614

SEQ ID NO: 136099 - RNA, 64 nt, hsa; identical to SEQ ID NO: 40615

SEQ ID NO: 136100 - RNA, 64 nt, hsa; identical to SEQ ID NO: 40616

SEQ ID NO: 136101 - RNA, 64 nt, hsa; identical to SEQ ID NO: 40617

SEQ ID NO: 136102 - RNA, 64 nt, hsa; identical to SEQ ID NO: 40618

SEQ ID NO: 136103 - RNA, 64 nt, hsa; identical to SEQ ID NO: 40619

SEQ ID NO: 136104 - RNA, 64 nt, hsa; identical to SEQ ID NO: 40620

SEQ ID NO: 136105 - RNA, 64 nt, hsa; identical to SEQ ID NO: 40621

SEQ ID NO: 136106 - RNA, 64 nt, hsa; identical to SEQ ID NO: 40622

SEQ ID NO: 136107 - RNA, 64 nt, hsa; identical to SEQ ID NO: 40623

SEQ ID NO: 136108 - RNA, 64 nt, hsa; identical to SEQ ID NO: 40624

SEQ ID NO: 136109 - RNA, 64 nt, hsa; identical to SEQ ID NO: 40625

SEQ ID NO: 136110 - RNA, 64 nt, hsa; identical to SEQ ID NO: 40626

SEQ ID NO: 136111 - RNA, 64 nt, hsa; identical to SEQ ID NO: 40627

SEQ ID NO: 136112 - RNA, 64 nt, hsa; identical to SEQ ID NO: 40628

SEQ ID NO: 136113 - RNA, 64 nt, hsa; identical to SEQ ID NO: 40629

SEQ ID NO: 136114 - RNA, 64 nt, hsa; identical to SEQ ID NO: 40630

SEQ ID NO: 136115 - RNA, 64 nt, hsa; identical to SEQ ID NO: 40631

SEQ ID NO: 136116 - RNA, 64 nt, hsa; identical to SEQ ID NO: 40632

SEQ ID NO: 136117 - RNA, 64 nt, hsa; identical to SEQ ID NO: 40633

SEQ ID NO: 136118 - RNA, 64 nt, hsa; identical to SEQ ID NO: 40634

SEQ ID NO: 136119 - RNA, 64 nt, hsa; identical to SEQ ID NO: 40635

SEQ ID NO: 136120 - RNA, 64 nt, hsa; identical to SEQ ID NO: 40636

SEQ ID NO: 136121 - RNA, 64 nt, hsa; identical to SEQ ID NO: 40637

SEQ ID NO: 136122 - RNA, 64 nt, hsa; identical to SEQ ID NO: 40638

SEQ ID NO: 136123 - RNA, 64 nt, hsa; identical to SEQ ID NO: 40639

SEQ ID NO: 136124 - RNA, 64 nt, hsa; identical to SEQ ID NO: 40640

SEQ ID NO: 136125 - RNA, 64 nt, hsa; identical to SEQ ID NO: 40641

SEQ ID NO: 136126 - RNA, 64 nt, hsa; identical to SEQ ID NO: 40642

SEQ ID NO: 136127 - RNA, 64 nt, hsa; identical to SEQ ID NO: 40643

SEQ ID NO: 136128 - RNA, 64 nt, hsa; identical to SEQ ID NO: 40644

SEQ ID NO: 136129 - RNA, 64 nt, hsa; identical to SEQ ID NO: 40645

SEQ ID NO: 136130 - RNA, 64 nt, hsa; identical to SEQ ID NO: 40646

SEQ ID NO: 136131 - RNA, 64 nt, hsa; identical to SEQ ID NO: 40647

SEQ ID NO: 136132 - RNA, 64 nt, hsa; identical to SEQ ID NO: 40648

SEQ ID NO: 136133 - RNA, 64 nt, hsa; identical to SEQ ID NO: 40649

SEQ ID NO: 136134 - RNA, 64 nt, hsa; identical to SEQ ID NO: 40650

SEQ ID NO: 136135 - RNA, 64 nt, hsa; identical to SEQ ID NO: 40651

SEQ ID NO: 136136 - RNA, 64 nt, hsa; identical to SEQ ID NO: 40652

SEQ ID NO: 136137 - RNA, 64 nt, hsa; identical to SEQ ID NO: 40653

SEQ ID NO: 136138 - RNA, 64 nt, hsa; identical to SEQ ID NO: 40654

SEQ ID NO: 136139 - RNA, 64 nt, hsa; identical to SEQ ID NO: 40655

SEQ ID NO: 136140 - RNA, 64 nt, hsa; identical to SEQ ID NO: 40656

SEQ ID NO: 136141 - RNA, 64 nt, hsa; identical to SEQ ID NO: 40657

SEQ ID NO: 136142 - RNA, 64 nt, hsa; identical to SEQ ID NO: 40658

SEQ ID NO: 136143 - RNA, 64 nt, hsa; identical to SEQ ID NO: 40659

SEQ ID NO: 136144 - RNA, 64 nt, hsa; identical to SEQ ID NO: 40660

SEQ ID NO: 136145 - RNA, 64 nt, hsa; identical to SEQ ID NO: 40661

SEQ ID NO: 136146 - RNA, 64 nt, hsa; identical to SEQ ID NO: 40662

SEQ ID NO: 136147 - RNA, 64 nt, hsa; identical to SEQ ID NO: 40663

SEQ ID NO: 136148 - RNA, 64 nt, hsa; identical to SEQ ID NO: 40664

SEQ ID NO: 136149 - RNA, 64 nt, hsa; identical to SEQ ID NO: 40665

SEQ ID NO: 136150 - RNA, 64 nt, hsa; identical to SEQ ID NO: 40666

SEQ ID NO: 136151 - RNA, 64 nt, hsa; identical to SEQ ID NO: 40667

SEQ ID NO: 136152 - RNA, 64 nt, hsa; identical to SEQ ID NO: 40668

SEQ ID NO: 136153 - RNA, 64 nt, hsa; identical to SEQ ID NO: 40669

SEQ ID NO: 136154 - RNA, 64 nt, hsa; identical to SEQ ID NO: 40670

SEQ ID NO: 136155 - RNA, 64 nt, hsa; identical to SEQ ID NO: 40671

SEQ ID NO: 136156 - RNA, 64 nt, hsa; identical to SEQ ID NO: 40672

SEQ ID NO: 136157 - RNA, 64 nt, hsa; identical to SEQ ID NO: 40673

SEQ ID NO: 136158 - RNA, 64 nt, hsa; identical to SEQ ID NO: 40674

SEQ ID NO: 136159 - RNA, 64 nt, hsa; identical to SEQ ID NO: 40675

SEQ ID NO: 136160 - RNA, 64 nt, hsa; identical to SEQ ID NO: 40676

SEQ ID NO: 136161 - RNA, 64 nt, hsa; identical to SEQ ID NO: 40677

SEQ ID NO: 136162 - RNA, 64 nt, hsa; identical to SEQ ID NO: 40678

SEQ ID NO: 136163 - RNA, 64 nt, hsa; identical to SEQ ID NO: 40679

SEQ ID NO: 136164 - RNA, 64 nt, hsa; identical to SEQ ID NO: 40680

SEQ ID NO: 136165 - RNA, 64 nt, hsa; identical to SEQ ID NO: 40681

SEQ ID NO: 136166 - RNA, 64 nt, hsa; identical to SEQ ID NO: 40682

SEQ ID NO: 136167 - RNA, 64 nt, hsa; identical to SEQ ID NO: 40683

SEQ ID NO: 136168 - RNA, 64 nt, hsa; identical to SEQ ID NO: 40684

SEQ ID NO: 136169 - RNA, 64 nt, hsa; identical to SEQ ID NO: 40685

SEQ ID NO: 136170 - RNA, 64 nt, hsa; identical to SEQ ID NO: 40686

SEQ ID NO: 136171 - RNA, 64 nt, hsa; identical to SEQ ID NO: 40687

SEQ ID NO: 136172 - RNA, 64 nt, hsa; identical to SEQ ID NO: 40688

SEQ ID NO: 136173 - RNA, 64 nt, hsa; identical to SEQ ID NO: 40689

SEQ ID NO: 136174 - RNA, 64 nt, hsa; identical to SEQ ID NO: 40690

SEQ ID NO: 136175 - RNA, 64 nt, hsa; identical to SEQ ID NO: 40691

SEQ ID NO: 136176 - RNA, 64 nt, hsa; identical to SEQ ID NO: 40692

SEQ ID NO: 136177 - RNA, 64 nt, hsa; identical to SEQ ID NO: 40693

SEQ ID NO: 136178 - RNA, 64 nt, hsa; identical to SEQ ID NO: 40694

SEQ ID NO: 136179 - RNA, 64 nt, hsa; identical to SEQ ID NO: 40695

SEQ ID NO: 136180 - RNA, 64 nt, hsa; identical to SEQ ID NO: 40696

SEQ ID NO: 136181 - RNA, 64 nt, hsa; identical to SEQ ID NO: 40697

SEQ ID NO: 136182 - RNA, 64 nt, hsa; identical to SEQ ID NO: 40698

SEQ ID NO: 136183 - RNA, 64 nt, hsa; identical to SEQ ID NO: 40699

SEQ ID NO: 136184 - RNA, 64 nt, hsa; identical to SEQ ID NO: 40700

SEQ ID NO: 136185 - RNA, 64 nt, hsa; identical to SEQ ID NO: 40701

SEQ ID NO: 136186 - RNA, 64 nt, hsa; identical to SEQ ID NO: 40702

SEQ ID NO: 136187 - RNA, 64 nt, hsa; identical to SEQ ID NO: 40703

SEQ ID NO: 136188 - RNA, 64 nt, hsa; identical to SEQ ID NO: 40704

SEQ ID NO: 136189 - RNA, 64 nt, hsa; identical to SEQ ID NO: 40705

SEQ ID NO: 136190 - RNA, 64 nt, hsa; identical to SEQ ID NO: 40706

SEQ ID NO: 136191 - RNA, 64 nt, hsa; identical to SEQ ID NO: 40707

SEQ ID NO: 136192 - RNA, 64 nt, hsa; identical to SEQ ID NO: 40708

SEQ ID NO: 136193 - RNA, 64 nt, hsa; identical to SEQ ID NO: 40709

SEQ ID NO: 136194 - RNA, 64 nt, hsa; identical to SEQ ID NO: 40710

SEQ ID NO: 136195 - RNA, 64 nt, hsa; identical to SEQ ID NO: 40711

SEQ ID NO: 136196 - RNA, 64 nt, hsa; identical to SEQ ID NO: 40712

SEQ ID NO: 136197 - RNA, 64 nt, hsa; identical to SEQ ID NO: 40713

SEQ ID NO: 136198 - RNA, 64 nt, hsa; identical to SEQ ID NO: 40714

SEQ ID NO: 136199 - RNA, 64 nt, hsa; identical to SEQ ID NO: 40715

SEQ ID NO: 136200 - RNA, 64 nt, hsa; identical to SEQ ID NO: 40716

SEQ ID NO: 136201 - RNA, 64 nt, hsa; identical to SEQ ID NO: 40717

SEQ ID NO: 136202 - RNA, 64 nt, hsa; identical to SEQ ID NO: 40718

SEQ ID NO: 136203 - RNA, 64 nt, hsa; identical to SEQ ID NO: 40719

SEQ ID NO: 136204 - RNA, 64 nt, hsa; identical to SEQ ID NO: 40720

SEQ ID NO: 136205 - RNA, 64 nt, hsa; identical to SEQ ID NO: 40721

SEQ ID NO: 136206 - RNA, 64 nt, hsa; identical to SEQ ID NO: 40722

SEQ ID NO: 136207 - RNA, 64 nt, hsa; identical to SEQ ID NO: 40723

SEQ ID NO: 136208 - RNA, 64 nt, hsa; identical to SEQ ID NO: 40724

SEQ ID NO: 136209 - RNA, 64 nt, hsa; identical to SEQ ID NO: 40725

SEQ ID NO: 136210 - RNA, 64 nt, hsa; identical to SEQ ID NO: 40726

SEQ ID NO: 136211 - RNA, 64 nt, hsa; identical to SEQ ID NO: 40727

SEQ ID NO: 136212 - RNA, 64 nt, hsa; identical to SEQ ID NO: 40728

SEQ ID NO: 136213 - RNA, 64 nt, hsa; identical to SEQ ID NO: 40729

SEQ ID NO: 136214 - RNA, 64 nt, hsa; identical to SEQ ID NO: 40730

SEQ ID NO: 136215 - RNA, 64 nt, hsa; identical to SEQ ID NO: 40731

SEQ ID NO: 136216 - RNA, 64 nt, hsa; identical to SEQ ID NO: 40732

SEQ ID NO: 136217 - RNA, 64 nt, hsa; identical to SEQ ID NO: 40733

SEQ ID NO: 136218 - RNA, 64 nt, hsa; identical to SEQ ID NO: 40734

SEQ ID NO: 136219 - RNA, 64 nt, hsa; identical to SEQ ID NO: 40735

SEQ ID NO: 136220 - RNA, 64 nt, hsa; identical to SEQ ID NO: 40736

SEQ ID NO: 136221 - RNA, 64 nt, hsa; identical to SEQ ID NO: 40737

SEQ ID NO: 136222 - RNA, 64 nt, hsa; identical to SEQ ID NO: 40738

SEQ ID NO: 136223 - RNA, 64 nt, hsa; identical to SEQ ID NO: 40739

SEQ ID NO: 136224 - RNA, 64 nt, hsa; identical to SEQ ID NO: 40740

SEQ ID NO: 136225 - RNA, 64 nt, hsa; identical to SEQ ID NO: 40741

SEQ ID NO: 136226 - RNA, 64 nt, hsa; identical to SEQ ID NO: 40742

SEQ ID NO: 136227 - RNA, 64 nt, hsa; identical to SEQ ID NO: 40743

SEQ ID NO: 136228 - RNA, 64 nt, hsa; identical to SEQ ID NO: 40744

SEQ ID NO: 136229 - RNA, 64 nt, hsa; identical to SEQ ID NO: 40745

SEQ ID NO: 136230 - RNA, 64 nt, hsa; identical to SEQ ID NO: 40746

SEQ ID NO: 136231 - RNA, 64 nt, hsa; identical to SEQ ID NO: 40747

SEQ ID NO: 136232 - RNA, 64 nt, hsa; identical to SEQ ID NO: 40748

SEQ ID NO: 136233 - RNA, 64 nt, hsa; identical to SEQ ID NO: 40749

SEQ ID NO: 136234 - RNA, 64 nt, hsa; identical to SEQ ID NO: 40750

SEQ ID NO: 136235 - RNA, 64 nt, hsa; identical to SEQ ID NO: 40751

SEQ ID NO: 136236 - RNA, 64 nt, hsa; identical to SEQ ID NO: 40752

SEQ ID NO: 136237 - RNA, 64 nt, hsa; identical to SEQ ID NO: 40753

SEQ ID NO: 136238 - RNA, 64 nt, hsa; identical to SEQ ID NO: 40754

SEQ ID NO: 136239 - RNA, 64 nt, hsa; identical to SEQ ID NO: 40755

SEQ ID NO: 136240 - RNA, 64 nt, hsa; identical to SEQ ID NO: 40756

SEQ ID NO: 136241 - RNA, 64 nt, hsa; identical to SEQ ID NO: 40757

SEQ ID NO: 136242 - RNA, 64 nt, hsa; identical to SEQ ID NO: 40758

SEQ ID NO: 136243 - RNA, 64 nt, hsa; identical to SEQ ID NO: 40759

SEQ ID NO: 136244 - RNA, 64 nt, hsa; identical to SEQ ID NO: 40760

SEQ ID NO: 136245 - RNA, 64 nt, hsa; identical to SEQ ID NO: 40761

SEQ ID NO: 136246 - RNA, 64 nt, hsa; identical to SEQ ID NO: 40762

SEQ ID NO: 136247 - RNA, 64 nt, hsa; identical to SEQ ID NO: 40763

SEQ ID NO: 136248 - RNA, 64 nt, hsa; identical to SEQ ID NO: 40764

SEQ ID NO: 136249 - RNA, 64 nt, hsa; identical to SEQ ID NO: 40765

SEQ ID NO: 136250 - RNA, 64 nt, hsa; identical to SEQ ID NO: 40766

SEQ ID NO: 136251 - RNA, 64 nt, hsa; identical to SEQ ID NO: 40767

SEQ ID NO: 136252 - RNA, 64 nt, hsa; identical to SEQ ID NO: 40768

SEQ ID NO: 136253 - RNA, 64 nt, hsa; identical to SEQ ID NO: 40769

SEQ ID NO: 136254 - RNA, 64 nt, hsa; identical to SEQ ID NO: 40770

SEQ ID NO: 136255 - RNA, 64 nt, hsa; identical to SEQ ID NO: 40771

SEQ ID NO: 136256 - RNA, 64 nt, hsa; identical to SEQ ID NO: 40772

SEQ ID NO: 136257 - RNA, 64 nt, hsa; identical to SEQ ID NO: 40773

SEQ ID NO: 136258 - RNA, 64 nt, hsa; identical to SEQ ID NO: 40774

SEQ ID NO: 136259 - RNA, 64 nt, hsa; identical to SEQ ID NO: 40775

SEQ ID NO: 136260 - RNA, 64 nt, hsa; identical to SEQ ID NO: 40776

SEQ ID NO: 136261 - RNA, 64 nt, hsa; identical to SEQ ID NO: 40777

SEQ ID NO: 136262 - RNA, 64 nt, hsa; identical to SEQ ID NO: 40778

SEQ ID NO: 136263 - RNA, 64 nt, hsa; identical to SEQ ID NO: 40779

SEQ ID NO: 136264 - RNA, 64 nt, hsa; identical to SEQ ID NO: 40780

SEQ ID NO: 136265 - RNA, 64 nt, hsa; identical to SEQ ID NO: 40781

SEQ ID NO: 136266 - RNA, 64 nt, hsa; identical to SEQ ID NO: 40782

SEQ ID NO: 136267 - RNA, 64 nt, hsa; identical to SEQ ID NO: 40783

SEQ ID NO: 136268 - RNA, 64 nt, hsa; identical to SEQ ID NO: 40784

SEQ ID NO: 136269 - RNA, 64 nt, hsa; identical to SEQ ID NO: 40785

SEQ ID NO: 136270 - RNA, 64 nt, hsa; identical to SEQ ID NO: 40786

SEQ ID NO: 136271 - RNA, 64 nt, hsa; identical to SEQ ID NO: 40787

SEQ ID NO: 136272 - RNA, 64 nt, hsa; identical to SEQ ID NO: 40788

SEQ ID NO: 136273 - RNA, 64 nt, hsa; identical to SEQ ID NO: 40789

SEQ ID NO: 136274 - RNA, 64 nt, hsa; identical to SEQ ID NO: 40790

SEQ ID NO: 136275 - RNA, 64 nt, hsa; identical to SEQ ID NO: 40791

SEQ ID NO: 136276 - RNA, 64 nt, hsa; identical to SEQ ID NO: 40792

SEQ ID NO: 136277 - RNA, 64 nt, hsa; identical to SEQ ID NO: 40793

SEQ ID NO: 136278 - RNA, 64 nt, hsa; identical to SEQ ID NO: 40794

SEQ ID NO: 136279 - RNA, 64 nt, hsa; identical to SEQ ID NO: 40795

SEQ ID NO: 136280 - RNA, 64 nt, hsa; identical to SEQ ID NO: 40796

SEQ ID NO: 136281 - RNA, 64 nt, hsa; identical to SEQ ID NO: 40797

SEQ ID NO: 136282 - RNA, 64 nt, hsa; identical to SEQ ID NO: 40798

SEQ ID NO: 136283 - RNA, 64 nt, hsa; identical to SEQ ID NO: 40799

SEQ ID NO: 136284 - RNA, 64 nt, hsa; identical to SEQ ID NO: 40800

SEQ ID NO: 136285 - RNA, 64 nt, hsa; identical to SEQ ID NO: 40801

SEQ ID NO: 136286 - RNA, 64 nt, hsa; identical to SEQ ID NO: 40802

SEQ ID NO: 136287 - RNA, 64 nt, hsa; identical to SEQ ID NO: 40803

SEQ ID NO: 136288 - RNA, 64 nt, hsa; identical to SEQ ID NO: 40804

SEQ ID NO: 136289 - RNA, 64 nt, hsa; identical to SEQ ID NO: 40805

SEQ ID NO: 136290 - RNA, 64 nt, hsa; identical to SEQ ID NO: 40806

SEQ ID NO: 136291 - RNA, 64 nt, hsa; identical to SEQ ID NO: 40807

SEQ ID NO: 136292 - RNA, 64 nt, hsa; identical to SEQ ID NO: 40808

SEQ ID NO: 136293 - RNA, 64 nt, hsa; identical to SEQ ID NO: 40809

SEQ ID NO: 136294 - RNA, 64 nt, hsa; identical to SEQ ID NO: 40810

SEQ ID NO: 136295 - RNA, 64 nt, hsa; identical to SEQ ID NO: 40811

SEQ ID NO: 136296 - RNA, 64 nt, hsa; identical to SEQ ID NO: 40812

SEQ ID NO: 136297 - RNA, 64 nt, hsa; identical to SEQ ID NO: 40813

SEQ ID NO: 136298 - RNA, 64 nt, hsa; identical to SEQ ID NO: 40814

SEQ ID NO: 136299 - RNA, 64 nt, hsa; identical to SEQ ID NO: 40815

SEQ ID NO: 136300 - RNA, 64 nt, hsa; identical to SEQ ID NO: 40816

SEQ ID NO: 136301 - RNA, 64 nt, hsa; identical to SEQ ID NO: 40817

SEQ ID NO: 136302 - RNA, 64 nt, hsa; identical to SEQ ID NO: 40818

SEQ ID NO: 136303 - RNA, 64 nt, hsa; identical to SEQ ID NO: 40819

SEQ ID NO: 136304 - RNA, 64 nt, hsa; identical to SEQ ID NO: 40820

SEQ ID NO: 136305 - RNA, 64 nt, hsa; identical to SEQ ID NO: 40821

SEQ ID NO: 136306 - RNA, 64 nt, hsa; identical to SEQ ID NO: 40822

SEQ ID NO: 136307 - RNA, 64 nt, hsa; identical to SEQ ID NO: 40823

SEQ ID NO: 136308 - RNA, 64 nt, hsa; identical to SEQ ID NO: 40824

SEQ ID NO: 136309 - RNA, 64 nt, hsa; identical to SEQ ID NO: 40825

SEQ ID NO: 136310 - RNA, 64 nt, hsa; identical to SEQ ID NO: 40826

SEQ ID NO: 136311 - RNA, 64 nt, hsa; identical to SEQ ID NO: 40827

SEQ ID NO: 136312 - RNA, 64 nt, hsa; identical to SEQ ID NO: 40828

SEQ ID NO: 136313 - RNA, 64 nt, hsa; identical to SEQ ID NO: 40829

SEQ ID NO: 136314 - RNA, 64 nt, hsa; identical to SEQ ID NO: 40830

SEQ ID NO: 136315 - RNA, 64 nt, hsa; identical to SEQ ID NO: 40831

SEQ ID NO: 136316 - RNA, 64 nt, hsa; identical to SEQ ID NO: 40832

SEQ ID NO: 136317 - RNA, 64 nt, hsa; identical to SEQ ID NO: 40833

SEQ ID NO: 136318 - RNA, 64 nt, hsa; identical to SEQ ID NO: 40834

SEQ ID NO: 136319 - RNA, 64 nt, hsa; identical to SEQ ID NO: 40835

SEQ ID NO: 136320 - RNA, 64 nt, hsa; identical to SEQ ID NO: 40836

SEQ ID NO: 136321 - RNA, 64 nt, hsa; identical to SEQ ID NO: 40837

SEQ ID NO: 136322 - RNA, 64 nt, hsa; identical to SEQ ID NO: 40838

SEQ ID NO: 136323 - RNA, 64 nt, hsa; identical to SEQ ID NO: 40839

SEQ ID NO: 136324 - RNA, 64 nt, hsa; identical to SEQ ID NO: 40840

SEQ ID NO: 136325 - RNA, 64 nt, hsa; identical to SEQ ID NO: 40841

SEQ ID NO: 136326 - RNA, 64 nt, hsa; identical to SEQ ID NO: 40842

SEQ ID NO: 136327 - RNA, 64 nt, hsa; identical to SEQ ID NO: 40843

SEQ ID NO: 136328 - RNA, 64 nt, hsa; identical to SEQ ID NO: 40844

SEQ ID NO: 136329 - RNA, 64 nt, hsa; identical to SEQ ID NO: 40845

SEQ ID NO: 136330 - RNA, 64 nt, hsa; identical to SEQ ID NO: 40846

SEQ ID NO: 136331 - RNA, 64 nt, hsa; identical to SEQ ID NO: 40847

SEQ ID NO: 136332 - RNA, 64 nt, hsa; identical to SEQ ID NO: 40848

SEQ ID NO: 136333 - RNA, 64 nt, hsa; identical to SEQ ID NO: 40849

SEQ ID NO: 136334 - RNA, 64 nt, hsa; identical to SEQ ID NO: 40850

SEQ ID NO: 136335 - RNA, 64 nt, hsa; identical to SEQ ID NO: 40851

SEQ ID NO: 136336 - RNA, 64 nt, hsa; identical to SEQ ID NO: 40852

SEQ ID NO: 136337 - RNA, 64 nt, hsa; identical to SEQ ID NO: 40853

SEQ ID NO: 136338 - RNA, 64 nt, hsa; identical to SEQ ID NO: 40854

SEQ ID NO: 136339 - RNA, 64 nt, hsa; identical to SEQ ID NO: 40855

SEQ ID NO: 136340 - RNA, 64 nt, hsa; identical to SEQ ID NO: 40856

SEQ ID NO: 136341 - RNA, 64 nt, hsa; identical to SEQ ID NO: 40857

SEQ ID NO: 136342 - RNA, 64 nt, hsa; identical to SEQ ID NO: 40858

SEQ ID NO: 136343 - RNA, 64 nt, hsa; identical to SEQ ID NO: 40859

SEQ ID NO: 136344 - RNA, 64 nt, hsa; identical to SEQ ID NO: 40860

SEQ ID NO: 136345 - RNA, 64 nt, hsa; identical to SEQ ID NO: 40861

SEQ ID NO: 136346 - RNA, 64 nt, hsa; identical to SEQ ID NO: 40862

SEQ ID NO: 136347 - RNA, 64 nt, hsa; identical to SEQ ID NO: 40863

SEQ ID NO: 136348 - RNA, 64 nt, hsa; identical to SEQ ID NO: 40864

SEQ ID NO: 136349 - RNA, 64 nt, hsa; identical to SEQ ID NO: 40865

SEQ ID NO: 136350 - RNA, 64 nt, hsa; identical to SEQ ID NO: 40866

SEQ ID NO: 136351 - RNA, 64 nt, hsa; identical to SEQ ID NO: 40867

SEQ ID NO: 136352 - RNA, 64 nt, hsa; identical to SEQ ID NO: 40868

SEQ ID NO: 136353 - RNA, 64 nt, hsa; identical to SEQ ID NO: 40869

SEQ ID NO: 136354 - RNA, 64 nt, hsa; identical to SEQ ID NO: 40870

SEQ ID NO: 136355 - RNA, 64 nt, hsa; identical to SEQ ID NO: 40871

SEQ ID NO: 136356 - RNA, 64 nt, hsa; identical to SEQ ID NO: 40872

SEQ ID NO: 136357 - RNA, 64 nt, hsa; identical to SEQ ID NO: 40873

SEQ ID NO: 136358 - RNA, 64 nt, hsa; identical to SEQ ID NO: 40874

SEQ ID NO: 136359 - RNA, 64 nt, hsa; identical to SEQ ID NO: 40875

SEQ ID NO: 136360 - RNA, 64 nt, hsa; identical to SEQ ID NO: 40876

SEQ ID NO: 136361 - RNA, 64 nt, hsa; identical to SEQ ID NO: 40877

SEQ ID NO: 136362 - RNA, 64 nt, hsa; identical to SEQ ID NO: 40878

SEQ ID NO: 136363 - RNA, 64 nt, hsa; identical to SEQ ID NO: 40879

SEQ ID NO: 136364 - RNA, 64 nt, hsa; identical to SEQ ID NO: 40880

SEQ ID NO: 136365 - RNA, 64 nt, hsa; identical to SEQ ID NO: 40881

SEQ ID NO: 136366 - RNA, 64 nt, hsa; identical to SEQ ID NO: 40882

SEQ ID NO: 136367 - RNA, 64 nt, hsa; identical to SEQ ID NO: 40883

SEQ ID NO: 136368 - RNA, 64 nt, hsa; identical to SEQ ID NO: 40884

SEQ ID NO: 136369 - RNA, 64 nt, hsa; identical to SEQ ID NO: 40885

SEQ ID NO: 136370 - RNA, 64 nt, hsa; identical to SEQ ID NO: 40886

SEQ ID NO: 136371 - RNA, 64 nt, hsa; identical to SEQ ID NO: 40887

SEQ ID NO: 136372 - RNA, 64 nt, hsa; identical to SEQ ID NO: 40888

SEQ ID NO: 136373 - RNA, 64 nt, hsa; identical to SEQ ID NO: 40889

SEQ ID NO: 136374 - RNA, 64 nt, hsa; identical to SEQ ID NO: 40890

SEQ ID NO: 136375 - RNA, 64 nt, hsa; identical to SEQ ID NO: 40891

SEQ ID NO: 136376 - RNA, 64 nt, hsa; identical to SEQ ID NO: 40892

SEQ ID NO: 136377 - RNA, 64 nt, hsa; identical to SEQ ID NO: 40893

SEQ ID NO: 136378 - RNA, 64 nt, hsa; identical to SEQ ID NO: 40894

SEQ ID NO: 136379 - RNA, 64 nt, hsa; identical to SEQ ID NO: 40895

SEQ ID NO: 136380 - RNA, 64 nt, hsa; identical to SEQ ID NO: 40896

SEQ ID NO: 136381 - RNA, 64 nt, hsa; identical to SEQ ID NO: 40897

SEQ ID NO: 136382 - RNA, 64 nt, hsa; identical to SEQ ID NO: 40898

SEQ ID NO: 136383 - RNA, 64 nt, hsa; identical to SEQ ID NO: 40899

SEQ ID NO: 136384 - RNA, 64 nt, hsa; identical to SEQ ID NO: 40900

SEQ ID NO: 136385 - RNA, 64 nt, hsa; identical to SEQ ID NO: 40901

SEQ ID NO: 136386 - RNA, 64 nt, hsa; identical to SEQ ID NO: 40902

SEQ ID NO: 136387 - RNA, 64 nt, hsa; identical to SEQ ID NO: 40903

SEQ ID NO: 136388 - RNA, 64 nt, hsa; identical to SEQ ID NO: 40904

SEQ ID NO: 136389 - RNA, 64 nt, hsa; identical to SEQ ID NO: 40905

SEQ ID NO: 136390 - RNA, 64 nt, hsa; identical to SEQ ID NO: 40906

SEQ ID NO: 136391 - RNA, 64 nt, hsa; identical to SEQ ID NO: 40907

SEQ ID NO: 136392 - RNA, 64 nt, hsa; identical to SEQ ID NO: 40908

SEQ ID NO: 136393 - RNA, 64 nt, hsa; identical to SEQ ID NO: 40909

SEQ ID NO: 136394 - RNA, 64 nt, hsa; identical to SEQ ID NO: 40910

SEQ ID NO: 136395 - RNA, 64 nt, hsa; identical to SEQ ID NO: 40911

SEQ ID NO: 136396 - RNA, 64 nt, hsa; identical to SEQ ID NO: 40912

SEQ ID NO: 136397 - RNA, 64 nt, hsa; identical to SEQ ID NO: 40913

SEQ ID NO: 136398 - RNA, 64 nt, hsa; identical to SEQ ID NO: 40914

SEQ ID NO: 136399 - RNA, 64 nt, hsa; identical to SEQ ID NO: 40915

SEQ ID NO: 136400 - RNA, 64 nt, hsa; identical to SEQ ID NO: 40916

SEQ ID NO: 136401 - RNA, 64 nt, hsa; identical to SEQ ID NO: 40917

SEQ ID NO: 136402 - RNA, 64 nt, hsa; identical to SEQ ID NO: 40918

SEQ ID NO: 136403 - RNA, 64 nt, hsa; identical to SEQ ID NO: 40919

SEQ ID NO: 136404 - RNA, 64 nt, hsa; identical to SEQ ID NO: 40920

SEQ ID NO: 136405 - RNA, 64 nt, hsa; identical to SEQ ID NO: 40921

SEQ ID NO: 136406 - RNA, 64 nt, hsa; identical to SEQ ID NO: 40922

SEQ ID NO: 136407 - RNA, 64 nt, hsa; identical to SEQ ID NO: 40923

SEQ ID NO: 136408 - RNA, 64 nt, hsa; identical to SEQ ID NO: 40924

SEQ ID NO: 136409 - RNA, 64 nt, hsa; identical to SEQ ID NO: 40925

SEQ ID NO: 136410 - RNA, 64 nt, hsa; identical to SEQ ID NO: 40926

SEQ ID NO: 136411 - RNA, 64 nt, hsa; identical to SEQ ID NO: 40927

SEQ ID NO: 136412 - RNA, 64 nt, hsa; identical to SEQ ID NO: 40928

SEQ ID NO: 136413 - RNA, 64 nt, hsa; identical to SEQ ID NO: 40929

SEQ ID NO: 136414 - RNA, 64 nt, hsa; identical to SEQ ID NO: 40930

SEQ ID NO: 136415 - RNA, 64 nt, hsa; identical to SEQ ID NO: 40931

SEQ ID NO: 136416 - RNA, 64 nt, hsa; identical to SEQ ID NO: 40932

SEQ ID NO: 136417 - RNA, 64 nt, hsa; identical to SEQ ID NO: 40933

SEQ ID NO: 136418 - RNA, 64 nt, hsa; identical to SEQ ID NO: 40934

SEQ ID NO: 136419 - RNA, 64 nt, hsa; identical to SEQ ID NO: 40935

SEQ ID NO: 136420 - RNA, 64 nt, hsa; identical to SEQ ID NO: 40936

SEQ ID NO: 136421 - RNA, 64 nt, hsa; identical to SEQ ID NO: 40937

SEQ ID NO: 136422 - RNA, 64 nt, hsa; identical to SEQ ID NO: 40938

SEQ ID NO: 136423 - RNA, 64 nt, hsa; identical to SEQ ID NO: 40939

SEQ ID NO: 136424 - RNA, 64 nt, hsa; identical to SEQ ID NO: 40940

SEQ ID NO: 136425 - RNA, 64 nt, hsa; identical to SEQ ID NO: 40941

SEQ ID NO: 136426 - RNA, 64 nt, hsa; identical to SEQ ID NO: 40942

SEQ ID NO: 136427 - RNA, 64 nt, hsa; identical to SEQ ID NO: 40943

SEQ ID NO: 136428 - RNA, 64 nt, hsa; identical to SEQ ID NO: 40944

SEQ ID NO: 136429 - RNA, 64 nt, hsa; identical to SEQ ID NO: 40945

SEQ ID NO: 136430 - RNA, 64 nt, hsa; identical to SEQ ID NO: 40946

SEQ ID NO: 136431 - RNA, 64 nt, hsa; identical to SEQ ID NO: 40947

SEQ ID NO: 136432 - RNA, 64 nt, hsa; identical to SEQ ID NO: 40948

SEQ ID NO: 136433 - RNA, 64 nt, hsa; identical to SEQ ID NO: 40949

SEQ ID NO: 136434 - RNA, 64 nt, hsa; identical to SEQ ID NO: 40950

SEQ ID NO: 136435 - RNA, 64 nt, hsa; identical to SEQ ID NO: 40951

SEQ ID NO: 136436 - RNA, 64 nt, hsa; identical to SEQ ID NO: 40952

SEQ ID NO: 136437 - RNA, 64 nt, hsa; identical to SEQ ID NO: 40953

SEQ ID NO: 136438 - RNA, 64 nt, hsa; identical to SEQ ID NO: 40954

SEQ ID NO: 136439 - RNA, 64 nt, hsa; identical to SEQ ID NO: 40955

SEQ ID NO: 136440 - RNA, 64 nt, hsa; identical to SEQ ID NO: 40956

SEQ ID NO: 136441 - RNA, 64 nt, hsa; identical to SEQ ID NO: 40957

SEQ ID NO: 136442 - RNA, 64 nt, hsa; identical to SEQ ID NO: 40958

SEQ ID NO: 136443 - RNA, 64 nt, hsa; identical to SEQ ID NO: 40959

SEQ ID NO: 136444 - RNA, 64 nt, hsa; identical to SEQ ID NO: 40960

SEQ ID NO: 136445 - RNA, 64 nt, hsa; identical to SEQ ID NO: 40961

SEQ ID NO: 136446 - RNA, 64 nt, hsa; identical to SEQ ID NO: 40962

SEQ ID NO: 136447 - RNA, 64 nt, hsa; identical to SEQ ID NO: 40963

SEQ ID NO: 136448 - RNA, 64 nt, hsa; identical to SEQ ID NO: 40964

SEQ ID NO: 136449 - RNA, 64 nt, hsa; identical to SEQ ID NO: 40965

SEQ ID NO: 136450 - RNA, 64 nt, hsa; identical to SEQ ID NO: 40966

SEQ ID NO: 136451 - RNA, 64 nt, hsa; identical to SEQ ID NO: 40967

SEQ ID NO: 136452 - RNA, 64 nt, hsa; identical to SEQ ID NO: 40968

SEQ ID NO: 136453 - RNA, 64 nt, hsa; identical to SEQ ID NO: 40969

SEQ ID NO: 136454 - RNA, 64 nt, hsa; identical to SEQ ID NO: 40970

SEQ ID NO: 136455 - RNA, 64 nt, hsa; identical to SEQ ID NO: 40971

SEQ ID NO: 136456 - RNA, 64 nt, hsa; identical to SEQ ID NO: 40972

SEQ ID NO: 136457 - RNA, 64 nt, hsa; identical to SEQ ID NO: 40973

SEQ ID NO: 136458 - RNA, 64 nt, hsa; identical to SEQ ID NO: 40974

SEQ ID NO: 136459 - RNA, 64 nt, hsa; identical to SEQ ID NO: 40975

SEQ ID NO: 136460 - RNA, 64 nt, hsa; identical to SEQ ID NO: 40976

SEQ ID NO: 136461 - RNA, 64 nt, hsa; identical to SEQ ID NO: 40977

SEQ ID NO: 136462 - RNA, 64 nt, hsa; identical to SEQ ID NO: 40978

SEQ ID NO: 136463 - RNA, 64 nt, hsa; identical to SEQ ID NO: 40979

SEQ ID NO: 136464 - RNA, 64 nt, hsa; identical to SEQ ID NO: 40980

SEQ ID NO: 136465 - RNA, 64 nt, hsa; identical to SEQ ID NO: 40981

SEQ ID NO: 136466 - RNA, 64 nt, hsa; identical to SEQ ID NO: 40982

SEQ ID NO: 136467 - RNA, 64 nt, hsa; identical to SEQ ID NO: 40983

SEQ ID NO: 136468 - RNA, 64 nt, hsa; identical to SEQ ID NO: 40984

SEQ ID NO: 136469 - RNA, 64 nt, hsa; identical to SEQ ID NO: 40985

SEQ ID NO: 136470 - RNA, 64 nt, hsa; identical to SEQ ID NO: 40986

SEQ ID NO: 136471 - RNA, 64 nt, hsa; identical to SEQ ID NO: 40987

SEQ ID NO: 136472 - RNA, 64 nt, hsa; identical to SEQ ID NO: 40988

SEQ ID NO: 136473 - RNA, 64 nt, hsa; identical to SEQ ID NO: 40989

SEQ ID NO: 136474 - RNA, 64 nt, hsa; identical to SEQ ID NO: 40990

SEQ ID NO: 136475 - RNA, 64 nt, hsa; identical to SEQ ID NO: 40991

SEQ ID NO: 136476 - RNA, 64 nt, hsa; identical to SEQ ID NO: 40992

SEQ ID NO: 136477 - RNA, 64 nt, hsa; identical to SEQ ID NO: 40993

SEQ ID NO: 136478 - RNA, 64 nt, hsa; identical to SEQ ID NO: 40994

SEQ ID NO: 136479 - RNA, 64 nt, hsa; identical to SEQ ID NO: 40995

SEQ ID NO: 136480 - RNA, 64 nt, hsa; identical to SEQ ID NO: 40996

SEQ ID NO: 136481 - RNA, 64 nt, hsa; identical to SEQ ID NO: 40997

SEQ ID NO: 136482 - RNA, 64 nt, hsa; identical to SEQ ID NO: 40998

SEQ ID NO: 136483 - RNA, 64 nt, hsa; identical to SEQ ID NO: 40999

SEQ ID NO: 136484 - RNA, 64 nt, hsa; identical to SEQ ID NO: 41000

SEQ ID NO: 136485 - RNA, 64 nt, hsa; identical to SEQ ID NO: 41001

SEQ ID NO: 136486 - RNA, 64 nt, hsa; identical to SEQ ID NO: 41002

SEQ ID NO: 136487 - RNA, 64 nt, hsa; identical to SEQ ID NO: 41003

SEQ ID NO: 136488 - RNA, 64 nt, hsa; identical to SEQ ID NO: 41004

SEQ ID NO: 136489 - RNA, 64 nt, hsa; identical to SEQ ID NO: 41005

SEQ ID NO: 136490 - RNA, 64 nt, hsa; identical to SEQ ID NO: 41006

SEQ ID NO: 136491 - RNA, 63 nt, hsa; identical to SEQ ID NO: 41007

SEQ ID NO: 136492 - RNA, 64 nt, hsa; identical to SEQ ID NO: 41008

SEQ ID NO: 136493 - RNA, 64 nt, hsa; identical to SEQ ID NO: 41009

SEQ ID NO: 136494 - RNA, 64 nt, hsa; identical to SEQ ID NO: 41010

SEQ ID NO: 136495 - RNA, 64 nt, hsa; identical to SEQ ID NO: 41011

SEQ ID NO: 136496 - RNA, 64 nt, hsa; identical to SEQ ID NO: 41012

SEQ ID NO: 136497 - RNA, 64 nt, hsa; identical to SEQ ID NO: 41013

SEQ ID NO: 136498 - RNA, 64 nt, hsa; identical to SEQ ID NO: 41014

SEQ ID NO: 136499 - RNA, 64 nt, hsa; identical to SEQ ID NO: 41015

SEQ ID NO: 136500 - RNA, 64 nt, hsa; identical to SEQ ID NO: 41016

SEQ ID NO: 136501 - RNA, 64 nt, hsa; identical to SEQ ID NO: 41017

SEQ ID NO: 136502 - RNA, 64 nt, hsa; identical to SEQ ID NO: 41018

SEQ ID NO: 136503 - RNA, 64 nt, hsa; identical to SEQ ID NO: 41019

SEQ ID NO: 136504 - RNA, 64 nt, hsa; identical to SEQ ID NO: 41020

SEQ ID NO: 136505 - RNA, 64 nt, hsa; identical to SEQ ID NO: 41021

SEQ ID NO: 136506 - RNA, 64 nt, hsa; identical to SEQ ID NO: 41022

SEQ ID NO: 136507 - RNA, 64 nt, hsa; identical to SEQ ID NO: 41023

SEQ ID NO: 136508 - RNA, 64 nt, hsa; identical to SEQ ID NO: 41024

SEQ ID NO: 136509 - RNA, 64 nt, hsa; identical to SEQ ID NO: 41025

SEQ ID NO: 136510 - RNA, 64 nt, hsa; identical to SEQ ID NO: 41026

SEQ ID NO: 136511 - RNA, 64 nt, hsa; identical to SEQ ID NO: 41027

SEQ ID NO: 136512 - RNA, 64 nt, hsa; identical to SEQ ID NO: 41028

SEQ ID NO: 136513 - RNA, 64 nt, hsa; identical to SEQ ID NO: 41029

SEQ ID NO: 136514 - RNA, 64 nt, hsa; identical to SEQ ID NO: 41030

SEQ ID NO: 136515 - RNA, 64 nt, hsa; identical to SEQ ID NO: 41031

SEQ ID NO: 136516 - RNA, 64 nt, hsa; identical to SEQ ID NO: 41032

SEQ ID NO: 136517 - RNA, 64 nt, hsa; identical to SEQ ID NO: 41033

SEQ ID NO: 136518 - RNA, 64 nt, hsa; identical to SEQ ID NO: 41034

SEQ ID NO: 136519 - RNA, 64 nt, hsa; identical to SEQ ID NO: 41035

SEQ ID NO: 136520 - RNA, 64 nt, hsa; identical to SEQ ID NO: 41036

SEQ ID NO: 136521 - RNA, 64 nt, hsa; identical to SEQ ID NO: 41037

SEQ ID NO: 136522 - RNA, 64 nt, hsa; identical to SEQ ID NO: 41038

SEQ ID NO: 136523 - RNA, 64 nt, hsa; identical to SEQ ID NO: 41039

SEQ ID NO: 136524 - RNA, 64 nt, hsa; identical to SEQ ID NO: 41040

SEQ ID NO: 136525 - RNA, 64 nt, hsa; identical to SEQ ID NO: 41041

SEQ ID NO: 136526 - RNA, 64 nt, hsa; identical to SEQ ID NO: 41042

SEQ ID NO: 136527 - RNA, 64 nt, hsa; identical to SEQ ID NO: 41043

SEQ ID NO: 136528 - RNA, 64 nt, hsa; identical to SEQ ID NO: 41044

SEQ ID NO: 136529 - RNA, 64 nt, hsa; identical to SEQ ID NO: 41045

SEQ ID NO: 136530 - RNA, 64 nt, hsa; identical to SEQ ID NO: 41046

SEQ ID NO: 136531 - RNA, 64 nt, hsa; identical to SEQ ID NO: 41047

SEQ ID NO: 136532 - RNA, 64 nt, hsa; identical to SEQ ID NO: 41048

SEQ ID NO: 136533 - RNA, 64 nt, hsa; identical to SEQ ID NO: 41049

SEQ ID NO: 136534 - RNA, 64 nt, hsa; identical to SEQ ID NO: 41050

SEQ ID NO: 136535 - RNA, 64 nt, hsa; identical to SEQ ID NO: 41051

SEQ ID NO: 136536 - RNA, 64 nt, hsa; identical to SEQ ID NO: 41052

SEQ ID NO: 136537 - RNA, 64 nt, hsa; identical to SEQ ID NO: 41053

SEQ ID NO: 136538 - RNA, 64 nt, hsa; identical to SEQ ID NO: 41054

SEQ ID NO: 136539 - RNA, 64 nt, hsa; identical to SEQ ID NO: 41055

SEQ ID NO: 136540 - RNA, 64 nt, hsa; identical to SEQ ID NO: 41056

SEQ ID NO: 136541 - RNA, 64 nt, hsa; identical to SEQ ID NO: 41057

SEQ ID NO: 136542 - RNA, 64 nt, hsa; identical to SEQ ID NO: 41058

SEQ ID NO: 136543 - RNA, 64 nt, hsa; identical to SEQ ID NO: 41059

SEQ ID NO: 136544 - RNA, 64 nt, hsa; identical to SEQ ID NO: 41060

SEQ ID NO: 136545 - RNA, 64 nt, hsa; identical to SEQ ID NO: 41061

SEQ ID NO: 136546 - RNA, 64 nt, hsa; identical to SEQ ID NO: 41062

SEQ ID NO: 136547 - RNA, 64 nt, hsa; identical to SEQ ID NO: 41063

SEQ ID NO: 136548 - RNA, 64 nt, hsa; identical to SEQ ID NO: 41064

SEQ ID NO: 136549 - RNA, 64 nt, hsa; identical to SEQ ID NO: 41065

SEQ ID NO: 136550 - RNA, 64 nt, hsa; identical to SEQ ID NO: 41066

SEQ ID NO: 136551 - RNA, 64 nt, hsa; identical to SEQ ID NO: 41067

SEQ ID NO: 136552 - RNA, 64 nt, hsa; identical to SEQ ID NO: 41068

SEQ ID NO: 136553 - RNA, 64 nt, hsa; identical to SEQ ID NO: 41069

SEQ ID NO: 136554 - RNA, 64 nt, hsa; identical to SEQ ID NO: 41070

SEQ ID NO: 136555 - RNA, 64 nt, hsa; identical to SEQ ID NO: 41071

SEQ ID NO: 136556 - RNA, 64 nt, hsa; identical to SEQ ID NO: 41072

SEQ ID NO: 136557 - RNA, 64 nt, hsa; identical to SEQ ID NO: 41073

SEQ ID NO: 136558 - RNA, 64 nt, hsa; identical to SEQ ID NO: 41074

SEQ ID NO: 136559 - RNA, 64 nt, hsa; identical to SEQ ID NO: 41075

SEQ ID NO: 136560 - RNA, 64 nt, hsa; identical to SEQ ID NO: 41076

SEQ ID NO: 136561 - RNA, 64 nt, hsa; identical to SEQ ID NO: 41077

SEQ ID NO: 136562 - RNA, 64 nt, hsa; identical to SEQ ID NO: 41078

SEQ ID NO: 136563 - RNA, 64 nt, hsa; identical to SEQ ID NO: 41079

SEQ ID NO: 136564 - RNA, 64 nt, hsa; identical to SEQ ID NO: 41080

SEQ ID NO: 136565 - RNA, 64 nt, hsa; identical to SEQ ID NO: 41081

SEQ ID NO: 136566 - RNA, 64 nt, hsa; identical to SEQ ID NO: 41082

SEQ ID NO: 136567 - RNA, 64 nt, hsa; identical to SEQ ID NO: 41083

SEQ ID NO: 136568 - RNA, 64 nt, hsa; identical to SEQ ID NO: 41084

SEQ ID NO: 136569 - RNA, 64 nt, hsa; identical to SEQ ID NO: 41085

SEQ ID NO: 136570 - RNA, 64 nt, hsa; identical to SEQ ID NO: 41086

SEQ ID NO: 136571 - RNA, 64 nt, hsa; identical to SEQ ID NO: 41087

SEQ ID NO: 136572 - RNA, 64 nt, hsa; identical to SEQ ID NO: 41088

SEQ ID NO: 136573 - RNA, 64 nt, hsa; identical to SEQ ID NO: 41089

SEQ ID NO: 136574 - RNA, 64 nt, hsa; identical to SEQ ID NO: 41090

SEQ ID NO: 136575 - RNA, 64 nt, hsa; identical to SEQ ID NO: 41091

SEQ ID NO: 136576 - RNA, 64 nt, hsa; identical to SEQ ID NO: 41092

SEQ ID NO: 136577 - RNA, 64 nt, hsa; identical to SEQ ID NO: 41093

SEQ ID NO: 136578 - RNA, 64 nt, hsa; identical to SEQ ID NO: 41094

SEQ ID NO: 136579 - RNA, 64 nt, hsa; identical to SEQ ID NO: 41095

SEQ ID NO: 136580 - RNA, 64 nt, hsa; identical to SEQ ID NO: 41096

SEQ ID NO: 136581 - RNA, 64 nt, hsa; identical to SEQ ID NO: 41097

SEQ ID NO: 136582 - RNA, 64 nt, hsa; identical to SEQ ID NO: 41098

SEQ ID NO: 136583 - RNA, 64 nt, hsa; identical to SEQ ID NO: 41099

SEQ ID NO: 136584 - RNA, 64 nt, hsa; identical to SEQ ID NO: 41100

SEQ ID NO: 136585 - RNA, 64 nt, hsa; identical to SEQ ID NO: 41101

SEQ ID NO: 136586 - RNA, 64 nt, hsa; identical to SEQ ID NO: 41102

SEQ ID NO: 136587 - RNA, 64 nt, hsa; identical to SEQ ID NO: 41103

SEQ ID NO: 136588 - RNA, 64 nt, hsa; identical to SEQ ID NO: 41104

SEQ ID NO: 136589 - RNA, 64 nt, hsa; identical to SEQ ID NO: 41105

SEQ ID NO: 136590 - RNA, 64 nt, hsa; identical to SEQ ID NO: 41106

SEQ ID NO: 136591 - RNA, 64 nt, hsa; identical to SEQ ID NO: 41107

SEQ ID NO: 136592 - RNA, 64 nt, hsa; identical to SEQ ID NO: 41108

SEQ ID NO: 136593 - RNA, 64 nt, hsa; identical to SEQ ID NO: 41109

SEQ ID NO: 136594 - RNA, 64 nt, hsa; identical to SEQ ID NO: 41110

SEQ ID NO: 136595 - RNA, 64 nt, hsa; identical to SEQ ID NO: 41111

SEQ ID NO: 136596 - RNA, 64 nt, hsa; identical to SEQ ID NO: 41112

SEQ ID NO: 136597 - RNA, 64 nt, hsa; identical to SEQ ID NO: 41113

SEQ ID NO: 136598 - RNA, 64 nt, hsa; identical to SEQ ID NO: 41114

SEQ ID NO: 136599 - RNA, 64 nt, hsa; identical to SEQ ID NO: 41115

SEQ ID NO: 136600 - RNA, 64 nt, hsa; identical to SEQ ID NO: 41116

SEQ ID NO: 136601 - RNA, 64 nt, hsa; identical to SEQ ID NO: 41117

SEQ ID NO: 136602 - RNA, 64 nt, hsa; identical to SEQ ID NO: 41118

SEQ ID NO: 136603 - RNA, 64 nt, hsa; identical to SEQ ID NO: 41119

SEQ ID NO: 136604 - RNA, 64 nt, hsa; identical to SEQ ID NO: 41120

SEQ ID NO: 136605 - RNA, 64 nt, hsa; identical to SEQ ID NO: 41121

SEQ ID NO: 136606 - RNA, 64 nt, hsa; identical to SEQ ID NO: 41122

SEQ ID NO: 136607 - RNA, 64 nt, hsa; identical to SEQ ID NO: 41123

SEQ ID NO: 136608 - RNA, 64 nt, hsa; identical to SEQ ID NO: 41124

SEQ ID NO: 136609 - RNA, 64 nt, hsa; identical to SEQ ID NO: 41125

SEQ ID NO: 136610 - RNA, 64 nt, hsa; identical to SEQ ID NO: 41126

SEQ ID NO: 136611 - RNA, 64 nt, hsa; identical to SEQ ID NO: 41127

SEQ ID NO: 136612 - RNA, 64 nt, hsa; identical to SEQ ID NO: 41128

SEQ ID NO: 136613 - RNA, 64 nt, hsa; identical to SEQ ID NO: 41129

SEQ ID NO: 136614 - RNA, 64 nt, hsa; identical to SEQ ID NO: 41130

SEQ ID NO: 136615 - RNA, 64 nt, hsa; identical to SEQ ID NO: 41131

SEQ ID NO: 136616 - RNA, 64 nt, hsa; identical to SEQ ID NO: 41132

SEQ ID NO: 136617 - RNA, 64 nt, hsa; identical to SEQ ID NO: 41133

SEQ ID NO: 136618 - RNA, 64 nt, hsa; identical to SEQ ID NO: 41134

SEQ ID NO: 136619 - RNA, 64 nt, hsa; identical to SEQ ID NO: 41135

SEQ ID NO: 136620 - RNA, 64 nt, hsa; identical to SEQ ID NO: 41136

SEQ ID NO: 136621 - RNA, 64 nt, hsa; identical to SEQ ID NO: 41137

SEQ ID NO: 136622 - RNA, 64 nt, hsa; identical to SEQ ID NO: 41138

SEQ ID NO: 136623 - RNA, 64 nt, hsa; identical to SEQ ID NO: 41139

SEQ ID NO: 136624 - RNA, 64 nt, hsa; identical to SEQ ID NO: 41140

SEQ ID NO: 136625 - RNA, 64 nt, hsa; identical to SEQ ID NO: 41141

SEQ ID NO: 136626 - RNA, 64 nt, hsa; identical to SEQ ID NO: 41142

SEQ ID NO: 136627 - RNA, 64 nt, hsa; identical to SEQ ID NO: 41143

SEQ ID NO: 136628 - RNA, 64 nt, hsa; identical to SEQ ID NO: 41144

SEQ ID NO: 136629 - RNA, 64 nt, hsa; identical to SEQ ID NO: 41145

SEQ ID NO: 136630 - RNA, 64 nt, hsa; identical to SEQ ID NO: 41146

SEQ ID NO: 136631 - RNA, 64 nt, hsa; identical to SEQ ID NO: 41147

SEQ ID NO: 136632 - RNA, 64 nt, hsa; identical to SEQ ID NO: 41148

SEQ ID NO: 136633 - RNA, 64 nt, hsa; identical to SEQ ID NO: 41149

SEQ ID NO: 136634 - RNA, 64 nt, hsa; identical to SEQ ID NO: 41150

SEQ ID NO: 136635 - RNA, 64 nt, hsa; identical to SEQ ID NO: 41151

SEQ ID NO: 136636 - RNA, 64 nt, hsa; identical to SEQ ID NO: 41152

SEQ ID NO: 136637 - RNA, 64 nt, hsa; identical to SEQ ID NO: 41153

SEQ ID NO: 136638 - RNA, 64 nt, hsa; identical to SEQ ID NO: 41154

SEQ ID NO: 136639 - RNA, 64 nt, hsa; identical to SEQ ID NO: 41155

SEQ ID NO: 136640 - RNA, 64 nt, hsa; identical to SEQ ID NO: 41156

SEQ ID NO: 136641 - RNA, 64 nt, hsa; identical to SEQ ID NO: 41157

SEQ ID NO: 136642 - RNA, 64 nt, hsa; identical to SEQ ID NO: 41158

SEQ ID NO: 136643 - RNA, 64 nt, hsa; identical to SEQ ID NO: 41159

SEQ ID NO: 136644 - RNA, 64 nt, hsa; identical to SEQ ID NO: 41160

SEQ ID NO: 136645 - RNA, 64 nt, hsa; identical to SEQ ID NO: 41161

SEQ ID NO: 136646 - RNA, 64 nt, hsa; identical to SEQ ID NO: 41162

SEQ ID NO: 136647 - RNA, 64 nt, hsa; identical to SEQ ID NO: 41163

SEQ ID NO: 136648 - RNA, 64 nt, hsa; identical to SEQ ID NO: 41164

SEQ ID NO: 136649 - RNA, 64 nt, hsa; identical to SEQ ID NO: 41165

SEQ ID NO: 136650 - RNA, 64 nt, hsa; identical to SEQ ID NO: 41166

SEQ ID NO: 136651 - RNA, 64 nt, hsa; identical to SEQ ID NO: 41167

SEQ ID NO: 136652 - RNA, 64 nt, hsa; identical to SEQ ID NO: 41168

SEQ ID NO: 136653 - RNA, 64 nt, hsa; identical to SEQ ID NO: 41169

SEQ ID NO: 136654 - RNA, 64 nt, hsa; identical to SEQ ID NO: 41170

SEQ ID NO: 136655 - RNA, 64 nt, hsa; identical to SEQ ID NO: 41171

SEQ ID NO: 136656 - RNA, 64 nt, hsa; identical to SEQ ID NO: 41172

SEQ ID NO: 136657 - RNA, 64 nt, hsa; identical to SEQ ID NO: 41173

SEQ ID NO: 136658 - RNA, 64 nt, hsa; identical to SEQ ID NO: 41174

SEQ ID NO: 136659 - RNA, 64 nt, hsa; identical to SEQ ID NO: 41175

SEQ ID NO: 136660 - RNA, 64 nt, hsa; identical to SEQ ID NO: 41176

SEQ ID NO: 136661 - RNA, 64 nt, hsa; identical to SEQ ID NO: 41177

SEQ ID NO: 136662 - RNA, 64 nt, hsa; identical to SEQ ID NO: 41178

SEQ ID NO: 136663 - RNA, 64 nt, hsa; identical to SEQ ID NO: 41179

SEQ ID NO: 136664 - RNA, 64 nt, hsa; identical to SEQ ID NO: 41180

SEQ ID NO: 136665 - RNA, 64 nt, hsa; identical to SEQ ID NO: 41181

SEQ ID NO: 136666 - RNA, 64 nt, hsa; identical to SEQ ID NO: 41182

SEQ ID NO: 136667 - RNA, 64 nt, hsa; identical to SEQ ID NO: 41183

SEQ ID NO: 136668 - RNA, 64 nt, hsa; identical to SEQ ID NO: 41184

SEQ ID NO: 136669 - RNA, 64 nt, hsa; identical to SEQ ID NO: 41185

SEQ ID NO: 136670 - RNA, 64 nt, hsa; identical to SEQ ID NO: 41186

SEQ ID NO: 136671 - RNA, 64 nt, hsa; identical to SEQ ID NO: 41187

SEQ ID NO: 136672 - RNA, 64 nt, hsa; identical to SEQ ID NO: 41188

SEQ ID NO: 136673 - RNA, 64 nt, hsa; identical to SEQ ID NO: 41189

SEQ ID NO: 136674 - RNA, 64 nt, hsa; identical to SEQ ID NO: 41190

SEQ ID NO: 136675 - RNA, 64 nt, hsa; identical to SEQ ID NO: 41191

SEQ ID NO: 136676 - RNA, 64 nt, hsa; identical to SEQ ID NO: 41192

SEQ ID NO: 136677 - RNA, 64 nt, hsa; identical to SEQ ID NO: 41193

SEQ ID NO: 136678 - RNA, 64 nt, hsa; identical to SEQ ID NO: 41194

SEQ ID NO: 136679 - RNA, 64 nt, hsa; identical to SEQ ID NO: 41195

SEQ ID NO: 136680 - RNA, 64 nt, hsa; identical to SEQ ID NO: 41196

SEQ ID NO: 136681 - RNA, 64 nt, hsa; identical to SEQ ID NO: 41197

SEQ ID NO: 136682 - RNA, 64 nt, hsa; identical to SEQ ID NO: 41198

SEQ ID NO: 136683 - RNA, 64 nt, hsa; identical to SEQ ID NO: 41199

SEQ ID NO: 136684 - RNA, 64 nt, hsa; identical to SEQ ID NO: 41200

SEQ ID NO: 136685 - RNA, 64 nt, hsa; identical to SEQ ID NO: 41201

SEQ ID NO: 136686 - RNA, 64 nt, hsa; identical to SEQ ID NO: 41202

SEQ ID NO: 136687 - RNA, 64 nt, hsa; identical to SEQ ID NO: 41203

SEQ ID NO: 136688 - RNA, 64 nt, hsa; identical to SEQ ID NO: 41204

SEQ ID NO: 136689 - RNA, 64 nt, hsa; identical to SEQ ID NO: 41205

SEQ ID NO: 136690 - RNA, 64 nt, hsa; identical to SEQ ID NO: 41206

SEQ ID NO: 136691 - RNA, 64 nt, hsa; identical to SEQ ID NO: 41207

SEQ ID NO: 136692 - RNA, 64 nt, hsa; identical to SEQ ID NO: 41208

SEQ ID NO: 136693 - RNA, 64 nt, hsa; identical to SEQ ID NO: 41209

SEQ ID NO: 136694 - RNA, 64 nt, hsa; identical to SEQ ID NO: 41210

SEQ ID NO: 136695 - RNA, 64 nt, hsa; identical to SEQ ID NO: 41211

SEQ ID NO: 136696 - RNA, 64 nt, hsa; identical to SEQ ID NO: 41212

SEQ ID NO: 136697 - RNA, 64 nt, hsa; identical to SEQ ID NO: 41213

SEQ ID NO: 136698 - RNA, 64 nt, hsa; identical to SEQ ID NO: 41214

SEQ ID NO: 136699 - RNA, 64 nt, hsa; identical to SEQ ID NO: 41215

SEQ ID NO: 136700 - RNA, 64 nt, hsa; identical to SEQ ID NO: 41216

SEQ ID NO: 136701 - RNA, 64 nt, hsa; identical to SEQ ID NO: 41217

SEQ ID NO: 136702 - RNA, 64 nt, hsa; identical to SEQ ID NO: 41218

SEQ ID NO: 136703 - RNA, 64 nt, hsa; identical to SEQ ID NO: 41219

SEQ ID NO: 136704 - RNA, 64 nt, hsa; identical to SEQ ID NO: 41220

SEQ ID NO: 136705 - RNA, 64 nt, hsa; identical to SEQ ID NO: 41221

SEQ ID NO: 136706 - RNA, 64 nt, hsa; identical to SEQ ID NO: 41222

SEQ ID NO: 136707 - RNA, 64 nt, hsa; identical to SEQ ID NO: 41223

SEQ ID NO: 136708 - RNA, 64 nt, hsa; identical to SEQ ID NO: 41224

SEQ ID NO: 136709 - RNA, 64 nt, hsa; identical to SEQ ID NO: 41225

SEQ ID NO: 136710 - RNA, 64 nt, hsa; identical to SEQ ID NO: 41226

SEQ ID NO: 136711 - RNA, 64 nt, hsa; identical to SEQ ID NO: 41227

SEQ ID NO: 136712 - RNA, 64 nt, hsa; identical to SEQ ID NO: 41228

SEQ ID NO: 136713 - RNA, 64 nt, hsa; identical to SEQ ID NO: 41229

SEQ ID NO: 136714 - RNA, 64 nt, hsa; identical to SEQ ID NO: 41230

SEQ ID NO: 136715 - RNA, 64 nt, hsa; identical to SEQ ID NO: 41231

SEQ ID NO: 136716 - RNA, 64 nt, hsa; identical to SEQ ID NO: 41232

SEQ ID NO: 136717 - RNA, 64 nt, hsa; identical to SEQ ID NO: 41233

SEQ ID NO: 136718 - RNA, 64 nt, hsa; identical to SEQ ID NO: 41234

SEQ ID NO: 136719 - RNA, 64 nt, hsa; identical to SEQ ID NO: 41235

SEQ ID NO: 136720 - RNA, 62 nt, hsa; identical to SEQ ID NO: 41236

SEQ ID NO: 136721 - RNA, 60 nt, hsa; identical to SEQ ID NO: 41237

SEQ ID NO: 136722 - RNA, 58 nt, hsa; identical to SEQ ID NO: 41238

SEQ ID NO: 136723 - RNA, 56 nt, hsa; identical to SEQ ID NO: 41239

SEQ ID NO: 136724 - RNA, 54 nt, hsa; identical to SEQ ID NO: 41240

SEQ ID NO: 136725 - RNA, 64 nt, hsa; identical to SEQ ID NO: 41241

SEQ ID NO: 136726 - RNA, 64 nt, hsa; identical to SEQ ID NO: 41242

SEQ ID NO: 136727 - RNA, 64 nt, hsa; identical to SEQ ID NO: 41243

SEQ ID NO: 136728 - RNA, 64 nt, hsa; identical to SEQ ID NO: 41244

SEQ ID NO: 136729 - RNA, 64 nt, hsa; identical to SEQ ID NO: 41245

SEQ ID NO: 136730 - RNA, 64 nt, hsa; identical to SEQ ID NO: 41246

SEQ ID NO: 136731 - RNA, 64 nt, hsa; identical to SEQ ID NO: 41247

SEQ ID NO: 136732 - RNA, 64 nt, hsa; identical to SEQ ID NO: 41248

SEQ ID NO: 136733 - RNA, 64 nt, hsa; identical to SEQ ID NO: 41249

SEQ ID NO: 136734 - RNA, 64 nt, hsa; identical to SEQ ID NO: 41250

SEQ ID NO: 136735 - RNA, 64 nt, hsa; identical to SEQ ID NO: 41251

SEQ ID NO: 136736 - RNA, 64 nt, hsa; identical to SEQ ID NO: 41252

SEQ ID NO: 136737 - RNA, 64 nt, hsa; identical to SEQ ID NO: 41253

SEQ ID NO: 136738 - RNA, 64 nt, hsa; identical to SEQ ID NO: 41254

SEQ ID NO: 136739 - RNA, 64 nt, hsa; identical to SEQ ID NO: 41255

SEQ ID NO: 136740 - RNA, 64 nt, hsa; identical to SEQ ID NO: 41256

SEQ ID NO: 136741 - RNA, 64 nt, hsa; identical to SEQ ID NO: 41257

SEQ ID NO: 136742 - RNA, 64 nt, hsa; identical to SEQ ID NO: 41258

SEQ ID NO: 136743 - RNA, 64 nt, hsa; identical to SEQ ID NO: 41259

SEQ ID NO: 136744 - RNA, 64 nt, hsa; identical to SEQ ID NO: 41260

SEQ ID NO: 136745 - RNA, 64 nt, hsa; identical to SEQ ID NO: 41261

SEQ ID NO: 136746 - RNA, 64 nt, hsa; identical to SEQ ID NO: 41262

SEQ ID NO: 136747 - RNA, 64 nt, hsa; identical to SEQ ID NO: 41263

SEQ ID NO: 136748 - RNA, 64 nt, hsa; identical to SEQ ID NO: 41264

SEQ ID NO: 136749 - RNA, 64 nt, hsa; identical to SEQ ID NO: 41265

SEQ ID NO: 136750 - RNA, 64 nt, hsa; identical to SEQ ID NO: 41266

SEQ ID NO: 136751 - RNA, 64 nt, hsa; identical to SEQ ID NO: 41267

SEQ ID NO: 136752 - RNA, 64 nt, hsa; identical to SEQ ID NO: 41268

SEQ ID NO: 136753 - RNA, 64 nt, hsa; identical to SEQ ID NO: 41269

SEQ ID NO: 136754 - RNA, 64 nt, hsa; identical to SEQ ID NO: 41270

SEQ ID NO: 136755 - RNA, 64 nt, hsa; identical to SEQ ID NO: 41271

SEQ ID NO: 136756 - RNA, 64 nt, hsa; identical to SEQ ID NO: 41272

SEQ ID NO: 136757 - RNA, 64 nt, hsa; identical to SEQ ID NO: 41273

SEQ ID NO: 136758 - RNA, 64 nt, hsa; identical to SEQ ID NO: 41274

SEQ ID NO: 136759 - RNA, 64 nt, hsa; identical to SEQ ID NO: 41275

SEQ ID NO: 136760 - RNA, 64 nt, hsa; identical to SEQ ID NO: 41276

SEQ ID NO: 136761 - RNA, 64 nt, hsa; identical to SEQ ID NO: 41277

SEQ ID NO: 136762 - RNA, 64 nt, hsa; identical to SEQ ID NO: 41278

SEQ ID NO: 136763 - RNA, 64 nt, hsa; identical to SEQ ID NO: 41279

SEQ ID NO: 136764 - RNA, 64 nt, hsa; identical to SEQ ID NO: 41280

SEQ ID NO: 136765 - RNA, 64 nt, hsa; identical to SEQ ID NO: 41281

SEQ ID NO: 136766 - RNA, 64 nt, hsa; identical to SEQ ID NO: 41282

SEQ ID NO: 136767 - RNA, 64 nt, hsa; identical to SEQ ID NO: 41283

SEQ ID NO: 136768 - RNA, 64 nt, hsa; identical to SEQ ID NO: 41284

SEQ ID NO: 136769 - RNA, 64 nt, hsa; identical to SEQ ID NO: 41285

SEQ ID NO: 136770 - RNA, 64 nt, hsa; identical to SEQ ID NO: 41286

SEQ ID NO: 136771 - RNA, 64 nt, hsa; identical to SEQ ID NO: 41287

SEQ ID NO: 136772 - RNA, 64 nt, hsa; identical to SEQ ID NO: 41288

SEQ ID NO: 136773 - RNA, 64 nt, hsa; identical to SEQ ID NO: 41289

SEQ ID NO: 136774 - RNA, 64 nt, hsa; identical to SEQ ID NO: 41290

SEQ ID NO: 136775 - RNA, 64 nt, hsa; identical to SEQ ID NO: 41291

SEQ ID NO: 136776 - RNA, 64 nt, hsa; identical to SEQ ID NO: 41292

SEQ ID NO: 136777 - RNA, 64 nt, hsa; identical to SEQ ID NO: 41293

SEQ ID NO: 136778 - RNA, 64 nt, hsa; identical to SEQ ID NO: 41294

SEQ ID NO: 136779 - RNA, 64 nt, hsa; identical to SEQ ID NO: 41295

SEQ ID NO: 136780 - RNA, 64 nt, hsa; identical to SEQ ID NO: 41296

SEQ ID NO: 136781 - RNA, 64 nt, hsa; identical to SEQ ID NO: 41297

SEQ ID NO: 136782 - RNA, 64 nt, hsa; identical to SEQ ID NO: 41298

SEQ ID NO: 136783 - RNA, 64 nt, hsa; identical to SEQ ID NO: 41299

SEQ ID NO: 136784 - RNA, 64 nt, hsa; identical to SEQ ID NO: 41300

SEQ ID NO: 136785 - RNA, 64 nt, hsa; identical to SEQ ID NO: 41301

SEQ ID NO: 136786 - RNA, 64 nt, hsa; identical to SEQ ID NO: 41302

SEQ ID NO: 136787 - RNA, 64 nt, hsa; identical to SEQ ID NO: 41303

SEQ ID NO: 136788 - RNA, 64 nt, hsa; identical to SEQ ID NO: 41304

SEQ ID NO: 136789 - RNA, 64 nt, hsa; identical to SEQ ID NO: 41305

SEQ ID NO: 136790 - RNA, 64 nt, hsa; identical to SEQ ID NO: 41306

SEQ ID NO: 136791 - RNA, 64 nt, hsa; identical to SEQ ID NO: 41307

SEQ ID NO: 136792 - RNA, 64 nt, hsa; identical to SEQ ID NO: 41308

SEQ ID NO: 136793 - RNA, 64 nt, hsa; identical to SEQ ID NO: 41309

SEQ ID NO: 136794 - RNA, 64 nt, hsa; identical to SEQ ID NO: 41310

SEQ ID NO: 136795 - RNA, 64 nt, hsa; identical to SEQ ID NO: 41311

SEQ ID NO: 136796 - RNA, 64 nt, hsa; identical to SEQ ID NO: 41312

SEQ ID NO: 136797 - RNA, 64 nt, hsa; identical to SEQ ID NO: 41313

SEQ ID NO: 136798 - RNA, 64 nt, hsa; identical to SEQ ID NO: 41314

SEQ ID NO: 136799 - RNA, 64 nt, hsa; identical to SEQ ID NO: 41315

SEQ ID NO: 136800 - RNA, 64 nt, hsa; identical to SEQ ID NO: 41316

SEQ ID NO: 136801 - RNA, 64 nt, hsa; identical to SEQ ID NO: 41317

SEQ ID NO: 136802 - RNA, 64 nt, hsa; identical to SEQ ID NO: 41318

SEQ ID NO: 136803 - RNA, 64 nt, hsa; identical to SEQ ID NO: 41319

SEQ ID NO: 136804 - RNA, 64 nt, hsa; identical to SEQ ID NO: 41320

SEQ ID NO: 136805 - RNA, 64 nt, hsa; identical to SEQ ID NO: 41321

SEQ ID NO: 136806 - RNA, 64 nt, hsa; identical to SEQ ID NO: 41322

SEQ ID NO: 136807 - RNA, 64 nt, hsa; identical to SEQ ID NO: 41323

SEQ ID NO: 136808 - RNA, 64 nt, hsa; identical to SEQ ID NO: 41324

SEQ ID NO: 136809 - RNA, 64 nt, hsa; identical to SEQ ID NO: 41325

SEQ ID NO: 136810 - RNA, 64 nt, hsa; identical to SEQ ID NO: 41326

SEQ ID NO: 136811 - RNA, 64 nt, hsa; identical to SEQ ID NO: 41327

SEQ ID NO: 136812 - RNA, 64 nt, hsa; identical to SEQ ID NO: 41328

SEQ ID NO: 136813 - RNA, 64 nt, hsa; identical to SEQ ID NO: 41329

SEQ ID NO: 136814 - RNA, 64 nt, hsa; identical to SEQ ID NO: 41330

SEQ ID NO: 136815 - RNA, 64 nt, hsa; identical to SEQ ID NO: 41331

SEQ ID NO: 136816 - RNA, 64 nt, hsa; identical to SEQ ID NO: 41332

SEQ ID NO: 136817 - RNA, 64 nt, hsa; identical to SEQ ID NO: 41333

SEQ ID NO: 136818 - RNA, 64 nt, hsa; identical to SEQ ID NO: 41334

SEQ ID NO: 136819 - RNA, 64 nt, hsa; identical to SEQ ID NO: 41335

SEQ ID NO: 136820 - RNA, 64 nt, hsa; identical to SEQ ID NO: 41336

SEQ ID NO: 136821 - RNA, 64 nt, hsa; identical to SEQ ID NO: 41337

SEQ ID NO: 136822 - RNA, 64 nt, hsa; identical to SEQ ID NO: 41338

SEQ ID NO: 136823 - RNA, 64 nt, hsa; identical to SEQ ID NO: 41339

SEQ ID NO: 136824 - RNA, 64 nt, hsa; identical to SEQ ID NO: 41340

SEQ ID NO: 136825 - RNA, 64 nt, hsa; identical to SEQ ID NO: 41341

SEQ ID NO: 136826 - RNA, 64 nt, hsa; identical to SEQ ID NO: 41342

SEQ ID NO: 136827 - RNA, 64 nt, hsa; identical to SEQ ID NO: 41343

SEQ ID NO: 136828 - RNA, 64 nt, hsa; identical to SEQ ID NO: 41344

SEQ ID NO: 136829 - RNA, 64 nt, hsa; identical to SEQ ID NO: 41345

SEQ ID NO: 136830 - RNA, 64 nt, hsa; identical to SEQ ID NO: 41346

SEQ ID NO: 136831 - RNA, 64 nt, hsa; identical to SEQ ID NO: 41347

SEQ ID NO: 136832 - RNA, 64 nt, hsa; identical to SEQ ID NO: 41348

SEQ ID NO: 136833 - RNA, 64 nt, hsa; identical to SEQ ID NO: 41349

SEQ ID NO: 136834 - RNA, 64 nt, hsa; identical to SEQ ID NO: 41350

SEQ ID NO: 136835 - RNA, 64 nt, hsa; identical to SEQ ID NO: 41351

SEQ ID NO: 136836 - RNA, 64 nt, hsa; identical to SEQ ID NO: 41352

SEQ ID NO: 136837 - RNA, 64 nt, hsa; identical to SEQ ID NO: 41353

SEQ ID NO: 136838 - RNA, 64 nt, hsa; identical to SEQ ID NO: 41354

SEQ ID NO: 136839 - RNA, 64 nt, hsa; identical to SEQ ID NO: 41355

SEQ ID NO: 136840 - RNA, 64 nt, hsa; identical to SEQ ID NO: 41356

SEQ ID NO: 136841 - RNA, 64 nt, hsa; identical to SEQ ID NO: 41357

SEQ ID NO: 136842 - RNA, 64 nt, hsa; identical to SEQ ID NO: 41358

SEQ ID NO: 136843 - RNA, 64 nt, hsa; identical to SEQ ID NO: 41359

SEQ ID NO: 136844 - RNA, 64 nt, hsa; identical to SEQ ID NO: 41360

SEQ ID NO: 136845 - RNA, 64 nt, hsa; identical to SEQ ID NO: 41361

SEQ ID NO: 136846 - RNA, 64 nt, hsa; identical to SEQ ID NO: 41362

SEQ ID NO: 136847 - RNA, 64 nt, hsa; identical to SEQ ID NO: 41363

SEQ ID NO: 136848 - RNA, 64 nt, hsa; identical to SEQ ID NO: 41364

SEQ ID NO: 136849 - RNA, 64 nt, hsa; identical to SEQ ID NO: 41365

SEQ ID NO: 136850 - RNA, 64 nt, hsa; identical to SEQ ID NO: 41366

SEQ ID NO: 136851 - RNA, 64 nt, hsa; identical to SEQ ID NO: 41367

SEQ ID NO: 136852 - RNA, 64 nt, hsa; identical to SEQ ID NO: 41368

SEQ ID NO: 136853 - RNA, 64 nt, hsa; identical to SEQ ID NO: 41369

SEQ ID NO: 136854 - RNA, 64 nt, hsa; identical to SEQ ID NO: 41370

SEQ ID NO: 136855 - RNA, 64 nt, hsa; identical to SEQ ID NO: 41371

SEQ ID NO: 136856 - RNA, 64 nt, hsa; identical to SEQ ID NO: 41372

SEQ ID NO: 136857 - RNA, 64 nt, hsa; identical to SEQ ID NO: 41373

SEQ ID NO: 136858 - RNA, 64 nt, hsa; identical to SEQ ID NO: 41374

SEQ ID NO: 136859 - RNA, 64 nt, hsa; identical to SEQ ID NO: 41375

SEQ ID NO: 136860 - RNA, 64 nt, hsa; identical to SEQ ID NO: 41376

SEQ ID NO: 136861 - RNA, 64 nt, hsa; identical to SEQ ID NO: 41377

SEQ ID NO: 136862 - RNA, 64 nt, hsa; identical to SEQ ID NO: 41378

SEQ ID NO: 136863 - RNA, 64 nt, hsa; identical to SEQ ID NO: 41379

SEQ ID NO: 136864 - RNA, 64 nt, hsa; identical to SEQ ID NO: 41380

SEQ ID NO: 136865 - RNA, 64 nt, hsa; identical to SEQ ID NO: 41381

SEQ ID NO: 136866 - RNA, 64 nt, hsa; identical to SEQ ID NO: 41382

SEQ ID NO: 136867 - RNA, 64 nt, hsa; identical to SEQ ID NO: 41383

SEQ ID NO: 136868 - RNA, 64 nt, hsa; identical to SEQ ID NO: 41384

SEQ ID NO: 136869 - RNA, 64 nt, hsa; identical to SEQ ID NO: 41385

SEQ ID NO: 136870 - RNA, 64 nt, hsa; identical to SEQ ID NO: 41386

SEQ ID NO: 136871 - RNA, 64 nt, hsa; identical to SEQ ID NO: 41387

SEQ ID NO: 136872 - RNA, 64 nt, hsa; identical to SEQ ID NO: 41388

SEQ ID NO: 136873 - RNA, 64 nt, hsa; identical to SEQ ID NO: 41389

SEQ ID NO: 136874 - RNA, 64 nt, hsa; identical to SEQ ID NO: 41390

SEQ ID NO: 136875 - RNA, 64 nt, hsa; identical to SEQ ID NO: 41391

SEQ ID NO: 136876 - RNA, 64 nt, hsa; identical to SEQ ID NO: 41392

SEQ ID NO: 136877 - RNA, 64 nt, hsa; identical to SEQ ID NO: 41393

SEQ ID NO: 136878 - RNA, 64 nt, hsa; identical to SEQ ID NO: 41394

SEQ ID NO: 136879 - RNA, 64 nt, hsa; identical to SEQ ID NO: 41395

SEQ ID NO: 136880 - RNA, 64 nt, hsa; identical to SEQ ID NO: 41396

SEQ ID NO: 136881 - RNA, 64 nt, hsa; identical to SEQ ID NO: 41397

SEQ ID NO: 136882 - RNA, 64 nt, hsa; identical to SEQ ID NO: 41398

SEQ ID NO: 136883 - RNA, 64 nt, hsa; identical to SEQ ID NO: 41399

SEQ ID NO: 136884 - RNA, 64 nt, hsa; identical to SEQ ID NO: 41400

SEQ ID NO: 136885 - RNA, 64 nt, hsa; identical to SEQ ID NO: 41401

SEQ ID NO: 136886 - RNA, 64 nt, hsa; identical to SEQ ID NO: 41402

SEQ ID NO: 136887 - RNA, 64 nt, hsa; identical to SEQ ID NO: 41403

SEQ ID NO: 136888 - RNA, 64 nt, hsa; identical to SEQ ID NO: 41404

SEQ ID NO: 136889 - RNA, 64 nt, hsa; identical to SEQ ID NO: 41405

SEQ ID NO: 136890 - RNA, 64 nt, hsa; identical to SEQ ID NO: 41406

SEQ ID NO: 136891 - RNA, 64 nt, hsa; identical to SEQ ID NO: 41407

SEQ ID NO: 136892 - RNA, 64 nt, hsa; identical to SEQ ID NO: 41408

SEQ ID NO: 136893 - RNA, 64 nt, hsa; identical to SEQ ID NO: 41409

SEQ ID NO: 136894 - RNA, 64 nt, hsa; identical to SEQ ID NO: 41410

SEQ ID NO: 136895 - RNA, 64 nt, hsa; identical to SEQ ID NO: 41411

SEQ ID NO: 136896 - RNA, 64 nt, hsa; identical to SEQ ID NO: 41412

SEQ ID NO: 136897 - RNA, 64 nt, hsa; identical to SEQ ID NO: 41413

SEQ ID NO: 136898 - RNA, 64 nt, hsa; identical to SEQ ID NO: 41414

SEQ ID NO: 136899 - RNA, 64 nt, hsa; identical to SEQ ID NO: 41415

SEQ ID NO: 136900 - RNA, 64 nt, hsa; identical to SEQ ID NO: 41416

SEQ ID NO: 136901 - RNA, 64 nt, hsa; identical to SEQ ID NO: 41417

SEQ ID NO: 136902 - RNA, 64 nt, hsa; identical to SEQ ID NO: 41418

SEQ ID NO: 136903 - RNA, 64 nt, hsa; identical to SEQ ID NO: 41419

SEQ ID NO: 136904 - RNA, 64 nt, hsa; identical to SEQ ID NO: 41420

SEQ ID NO: 136905 - RNA, 64 nt, hsa; identical to SEQ ID NO: 41421

SEQ ID NO: 136906 - RNA, 64 nt, hsa; identical to SEQ ID NO: 41422

SEQ ID NO: 136907 - RNA, 64 nt, hsa; identical to SEQ ID NO: 41423

SEQ ID NO: 136908 - RNA, 64 nt, hsa; identical to SEQ ID NO: 41424

SEQ ID NO: 136909 - RNA, 64 nt, hsa; identical to SEQ ID NO: 41425

SEQ ID NO: 136910 - RNA, 64 nt, hsa; identical to SEQ ID NO: 41426

SEQ ID NO: 136911 - RNA, 64 nt, hsa; identical to SEQ ID NO: 41427

SEQ ID NO: 136912 - RNA, 64 nt, hsa; identical to SEQ ID NO: 41428

SEQ ID NO: 136913 - RNA, 64 nt, hsa; identical to SEQ ID NO: 41429

SEQ ID NO: 136914 - RNA, 64 nt, hsa; identical to SEQ ID NO: 41430

SEQ ID NO: 136915 - RNA, 64 nt, hsa; identical to SEQ ID NO: 41431

SEQ ID NO: 136916 - RNA, 64 nt, hsa; identical to SEQ ID NO: 41432

SEQ ID NO: 136917 - RNA, 64 nt, hsa; identical to SEQ ID NO: 41433

SEQ ID NO: 136918 - RNA, 64 nt, hsa; identical to SEQ ID NO: 41434

SEQ ID NO: 136919 - RNA, 64 nt, hsa; identical to SEQ ID NO: 41435

SEQ ID NO: 136920 - RNA, 64 nt, hsa; identical to SEQ ID NO: 41436

SEQ ID NO: 136921 - RNA, 64 nt, hsa; identical to SEQ ID NO: 41437

SEQ ID NO: 136922 - RNA, 64 nt, hsa; identical to SEQ ID NO: 41438

SEQ ID NO: 136923 - RNA, 64 nt, hsa; identical to SEQ ID NO: 41439

SEQ ID NO: 136924 - RNA, 64 nt, hsa; identical to SEQ ID NO: 41440

SEQ ID NO: 136925 - RNA, 64 nt, hsa; identical to SEQ ID NO: 41441

SEQ ID NO: 136926 - RNA, 64 nt, hsa; identical to SEQ ID NO: 41442

SEQ ID NO: 136927 - RNA, 64 nt, hsa; identical to SEQ ID NO: 41443

SEQ ID NO: 136928 - RNA, 64 nt, hsa; identical to SEQ ID NO: 41444

SEQ ID NO: 136929 - RNA, 64 nt, hsa; identical to SEQ ID NO: 41445

SEQ ID NO: 136930 - RNA, 64 nt, hsa; identical to SEQ ID NO: 41446

SEQ ID NO: 136931 - RNA, 64 nt, hsa; identical to SEQ ID NO: 41447

SEQ ID NO: 136932 - RNA, 64 nt, hsa; identical to SEQ ID NO: 41448

SEQ ID NO: 136933 - RNA, 64 nt, hsa; identical to SEQ ID NO: 41449

SEQ ID NO: 136934 - RNA, 64 nt, hsa; identical to SEQ ID NO: 41450

SEQ ID NO: 136935 - RNA, 64 nt, hsa; identical to SEQ ID NO: 41451

SEQ ID NO: 136936 - RNA, 64 nt, hsa; identical to SEQ ID NO: 41452

SEQ ID NO: 136937 - RNA, 64 nt, hsa; identical to SEQ ID NO: 41453

SEQ ID NO: 136938 - RNA, 64 nt, hsa; identical to SEQ ID NO: 41454

SEQ ID NO: 136939 - RNA, 64 nt, hsa; identical to SEQ ID NO: 41455

SEQ ID NO: 136940 - RNA, 64 nt, hsa; identical to SEQ ID NO: 41456

SEQ ID NO: 136941 - RNA, 64 nt, hsa; identical to SEQ ID NO: 41457

SEQ ID NO: 136942 - RNA, 64 nt, hsa; identical to SEQ ID NO: 41458

SEQ ID NO: 136943 - RNA, 64 nt, hsa; identical to SEQ ID NO: 41459

SEQ ID NO: 136944 - RNA, 64 nt, hsa; identical to SEQ ID NO: 41460

SEQ ID NO: 136945 - RNA, 64 nt, hsa; identical to SEQ ID NO: 41461

SEQ ID NO: 136946 - RNA, 64 nt, hsa; identical to SEQ ID NO: 41462

SEQ ID NO: 136947 - RNA, 64 nt, hsa; identical to SEQ ID NO: 41463

SEQ ID NO: 136948 - RNA, 64 nt, hsa; identical to SEQ ID NO: 41464

SEQ ID NO: 136949 - RNA, 64 nt, hsa; identical to SEQ ID NO: 41465

SEQ ID NO: 136950 - RNA, 64 nt, hsa; identical to SEQ ID NO: 41466

SEQ ID NO: 136951 - RNA, 64 nt, hsa; identical to SEQ ID NO: 41467

SEQ ID NO: 136952 - RNA, 64 nt, hsa; identical to SEQ ID NO: 41468

SEQ ID NO: 136953 - RNA, 64 nt, hsa; identical to SEQ ID NO: 41469

SEQ ID NO: 136954 - RNA, 64 nt, hsa; identical to SEQ ID NO: 41470

SEQ ID NO: 136955 - RNA, 64 nt, hsa; identical to SEQ ID NO: 41471

SEQ ID NO: 136956 - RNA, 64 nt, hsa; identical to SEQ ID NO: 41472

SEQ ID NO: 136957 - RNA, 64 nt, hsa; identical to SEQ ID NO: 41473

SEQ ID NO: 136958 - RNA, 64 nt, hsa; identical to SEQ ID NO: 41474

SEQ ID NO: 136959 - RNA, 64 nt, hsa; identical to SEQ ID NO: 41475

SEQ ID NO: 136960 - RNA, 64 nt, hsa; identical to SEQ ID NO: 41476

SEQ ID NO: 136961 - RNA, 64 nt, hsa; identical to SEQ ID NO: 41477

SEQ ID NO: 136962 - RNA, 64 nt, hsa; identical to SEQ ID NO: 41478

SEQ ID NO: 136963 - RNA, 64 nt, hsa; identical to SEQ ID NO: 41479

SEQ ID NO: 136964 - RNA, 64 nt, hsa; identical to SEQ ID NO: 41480

SEQ ID NO: 136965 - RNA, 64 nt, hsa; identical to SEQ ID NO: 41481

SEQ ID NO: 136966 - RNA, 64 nt, hsa; identical to SEQ ID NO: 41482

SEQ ID NO: 136967 - RNA, 64 nt, hsa; identical to SEQ ID NO: 41483

SEQ ID NO: 136968 - RNA, 64 nt, hsa; identical to SEQ ID NO: 41484

SEQ ID NO: 136969 - RNA, 64 nt, hsa; identical to SEQ ID NO: 41485

SEQ ID NO: 136970 - RNA, 64 nt, hsa; identical to SEQ ID NO: 41486

SEQ ID NO: 136971 - RNA, 64 nt, hsa; identical to SEQ ID NO: 41487

SEQ ID NO: 136972 - RNA, 64 nt, hsa; identical to SEQ ID NO: 41488

SEQ ID NO: 136973 - RNA, 64 nt, hsa; identical to SEQ ID NO: 41489

SEQ ID NO: 136974 - RNA, 64 nt, hsa; identical to SEQ ID NO: 41490

SEQ ID NO: 136975 - RNA, 64 nt, hsa; identical to SEQ ID NO: 41491

SEQ ID NO: 136976 - RNA, 64 nt, hsa; identical to SEQ ID NO: 41492

SEQ ID NO: 136977 - RNA, 64 nt, hsa; identical to SEQ ID NO: 41493

SEQ ID NO: 136978 - RNA, 64 nt, hsa; identical to SEQ ID NO: 41494

SEQ ID NO: 136979 - RNA, 64 nt, hsa; identical to SEQ ID NO: 41495

SEQ ID NO: 136980 - RNA, 64 nt, hsa; identical to SEQ ID NO: 41496

SEQ ID NO: 136981 - RNA, 64 nt, hsa; identical to SEQ ID NO: 41497

SEQ ID NO: 136982 - RNA, 64 nt, hsa; identical to SEQ ID NO: 41498

SEQ ID NO: 136983 - RNA, 64 nt, hsa; identical to SEQ ID NO: 41499

SEQ ID NO: 136984 - RNA, 64 nt, hsa; identical to SEQ ID NO: 41500

SEQ ID NO: 136985 - RNA, 64 nt, hsa; identical to SEQ ID NO: 41501

SEQ ID NO: 136986 - RNA, 64 nt, hsa; identical to SEQ ID NO: 41502

SEQ ID NO: 136987 - RNA, 64 nt, hsa; identical to SEQ ID NO: 41503

SEQ ID NO: 136988 - RNA, 64 nt, hsa; identical to SEQ ID NO: 41504

SEQ ID NO: 136989 - RNA, 64 nt, hsa; identical to SEQ ID NO: 41505

SEQ ID NO: 136990 - RNA, 64 nt, hsa; identical to SEQ ID NO: 41506

SEQ ID NO: 136991 - RNA, 64 nt, hsa; identical to SEQ ID NO: 41507

SEQ ID NO: 136992 - RNA, 64 nt, hsa; identical to SEQ ID NO: 41508

SEQ ID NO: 136993 - RNA, 64 nt, hsa; identical to SEQ ID NO: 41509

SEQ ID NO: 136994 - RNA, 64 nt, hsa; identical to SEQ ID NO: 41510

SEQ ID NO: 136995 - RNA, 64 nt, hsa; identical to SEQ ID NO: 41511

SEQ ID NO: 136996 - RNA, 64 nt, hsa; identical to SEQ ID NO: 41512

SEQ ID NO: 136997 - RNA, 64 nt, hsa; identical to SEQ ID NO: 41513

SEQ ID NO: 136998 - RNA, 64 nt, hsa; identical to SEQ ID NO: 41514

SEQ ID NO: 136999 - RNA, 64 nt, hsa; identical to SEQ ID NO: 41515

SEQ ID NO: 137000 - RNA, 64 nt, hsa; identical to SEQ ID NO: 41516

SEQ ID NO: 137001 - RNA, 64 nt, hsa; identical to SEQ ID NO: 41517

SEQ ID NO: 137002 - RNA, 64 nt, hsa; identical to SEQ ID NO: 41518

SEQ ID NO: 137003 - RNA, 64 nt, hsa; identical to SEQ ID NO: 41519

SEQ ID NO: 137004 - RNA, 64 nt, hsa; identical to SEQ ID NO: 41520

SEQ ID NO: 137005 - RNA, 64 nt, hsa; identical to SEQ ID NO: 41521

SEQ ID NO: 137006 - RNA, 64 nt, hsa; identical to SEQ ID NO: 41522

SEQ ID NO: 137007 - RNA, 64 nt, hsa; identical to SEQ ID NO: 41523

SEQ ID NO: 137008 - RNA, 64 nt, hsa; identical to SEQ ID NO: 41524

SEQ ID NO: 137009 - RNA, 64 nt, hsa; identical to SEQ ID NO: 41525

SEQ ID NO: 137010 - RNA, 64 nt, hsa; identical to SEQ ID NO: 41526

SEQ ID NO: 137011 - RNA, 64 nt, hsa; identical to SEQ ID NO: 41527

SEQ ID NO: 137012 - RNA, 64 nt, hsa; identical to SEQ ID NO: 41528

SEQ ID NO: 137013 - RNA, 64 nt, hsa; identical to SEQ ID NO: 41529

SEQ ID NO: 137014 - RNA, 64 nt, hsa; identical to SEQ ID NO: 41530

SEQ ID NO: 137015 - RNA, 64 nt, hsa; identical to SEQ ID NO: 41531

SEQ ID NO: 137016 - RNA, 64 nt, hsa; identical to SEQ ID NO: 41532

SEQ ID NO: 137017 - RNA, 64 nt, hsa; identical to SEQ ID NO: 41533

SEQ ID NO: 137018 - RNA, 64 nt, hsa; identical to SEQ ID NO: 41534

SEQ ID NO: 137019 - RNA, 64 nt, hsa; identical to SEQ ID NO: 41535

SEQ ID NO: 137020 - RNA, 64 nt, hsa; identical to SEQ ID NO: 41536

SEQ ID NO: 137021 - RNA, 64 nt, hsa; identical to SEQ ID NO: 41537

SEQ ID NO: 137022 - RNA, 64 nt, hsa; identical to SEQ ID NO: 41538

SEQ ID NO: 137023 - RNA, 64 nt, hsa; identical to SEQ ID NO: 41539

SEQ ID NO: 137024 - RNA, 64 nt, hsa; identical to SEQ ID NO: 41540

SEQ ID NO: 137025 - RNA, 64 nt, hsa; identical to SEQ ID NO: 41541

SEQ ID NO: 137026 - RNA, 64 nt, hsa; identical to SEQ ID NO: 41542

SEQ ID NO: 137027 - RNA, 64 nt, hsa; identical to SEQ ID NO: 41543

SEQ ID NO: 137028 - RNA, 64 nt, hsa; identical to SEQ ID NO: 41544

SEQ ID NO: 137029 - RNA, 64 nt, hsa; identical to SEQ ID NO: 41545

SEQ ID NO: 137030 - RNA, 64 nt, hsa; identical to SEQ ID NO: 41546

SEQ ID NO: 137031 - RNA, 64 nt, hsa; identical to SEQ ID NO: 41547

SEQ ID NO: 137032 - RNA, 64 nt, hsa; identical to SEQ ID NO: 41548

SEQ ID NO: 137033 - RNA, 64 nt, hsa; identical to SEQ ID NO: 41549

SEQ ID NO: 137034 - RNA, 64 nt, hsa; identical to SEQ ID NO: 41550

SEQ ID NO: 137035 - RNA, 64 nt, hsa; identical to SEQ ID NO: 41551

SEQ ID NO: 137036 - RNA, 64 nt, hsa; identical to SEQ ID NO: 41552

SEQ ID NO: 137037 - RNA, 64 nt, hsa; identical to SEQ ID NO: 41553

SEQ ID NO: 137038 - RNA, 64 nt, hsa; identical to SEQ ID NO: 41554

SEQ ID NO: 137039 - RNA, 64 nt, hsa; identical to SEQ ID NO: 41555

SEQ ID NO: 137040 - RNA, 64 nt, hsa; identical to SEQ ID NO: 41556

SEQ ID NO: 137041 - RNA, 64 nt, hsa; identical to SEQ ID NO: 41557

SEQ ID NO: 137042 - RNA, 64 nt, hsa; identical to SEQ ID NO: 41558

SEQ ID NO: 137043 - RNA, 64 nt, hsa; identical to SEQ ID NO: 41559

SEQ ID NO: 137044 - RNA, 64 nt, hsa; identical to SEQ ID NO: 41560

SEQ ID NO: 137045 - RNA, 64 nt, hsa; identical to SEQ ID NO: 41561

SEQ ID NO: 137046 - RNA, 64 nt, hsa; identical to SEQ ID NO: 41562

SEQ ID NO: 137047 - RNA, 64 nt, hsa; identical to SEQ ID NO: 41563

SEQ ID NO: 137048 - RNA, 64 nt, hsa; identical to SEQ ID NO: 41564

SEQ ID NO: 137049 - RNA, 64 nt, hsa; identical to SEQ ID NO: 41565

SEQ ID NO: 137050 - RNA, 64 nt, hsa; identical to SEQ ID NO: 41566

SEQ ID NO: 137051 - RNA, 64 nt, hsa; identical to SEQ ID NO: 41567

SEQ ID NO: 137052 - RNA, 64 nt, hsa; identical to SEQ ID NO: 41568

SEQ ID NO: 137053 - RNA, 64 nt, hsa; identical to SEQ ID NO: 41569

SEQ ID NO: 137054 - RNA, 64 nt, hsa; identical to SEQ ID NO: 41570

SEQ ID NO: 137055 - RNA, 64 nt, hsa; identical to SEQ ID NO: 41571

SEQ ID NO: 137056 - RNA, 64 nt, hsa; identical to SEQ ID NO: 41572

SEQ ID NO: 137057 - RNA, 64 nt, hsa; identical to SEQ ID NO: 41573

SEQ ID NO: 137058 - RNA, 64 nt, hsa; identical to SEQ ID NO: 41574

SEQ ID NO: 137059 - RNA, 64 nt, hsa; identical to SEQ ID NO: 41575

SEQ ID NO: 137060 - RNA, 64 nt, hsa; identical to SEQ ID NO: 41576

SEQ ID NO: 137061 - RNA, 64 nt, hsa; identical to SEQ ID NO: 41577

SEQ ID NO: 137062 - RNA, 64 nt, hsa; identical to SEQ ID NO: 41578

SEQ ID NO: 137063 - RNA, 64 nt, hsa; identical to SEQ ID NO: 41579

SEQ ID NO: 137064 - RNA, 64 nt, hsa; identical to SEQ ID NO: 41580

SEQ ID NO: 137065 - RNA, 64 nt, hsa; identical to SEQ ID NO: 41581

SEQ ID NO: 137066 - RNA, 64 nt, hsa; identical to SEQ ID NO: 41582

SEQ ID NO: 137067 - RNA, 64 nt, hsa; identical to SEQ ID NO: 41583

SEQ ID NO: 137068 - RNA, 64 nt, hsa; identical to SEQ ID NO: 41584

SEQ ID NO: 137069 - RNA, 64 nt, hsa; identical to SEQ ID NO: 41585

SEQ ID NO: 137070 - RNA, 64 nt, hsa; identical to SEQ ID NO: 41586

SEQ ID NO: 137071 - RNA, 64 nt, hsa; identical to SEQ ID NO: 41587

SEQ ID NO: 137072 - RNA, 64 nt, hsa; identical to SEQ ID NO: 41588

SEQ ID NO: 137073 - RNA, 64 nt, hsa; identical to SEQ ID NO: 41589

SEQ ID NO: 137074 - RNA, 64 nt, hsa; identical to SEQ ID NO: 41590

SEQ ID NO: 137075 - RNA, 64 nt, hsa; identical to SEQ ID NO: 41591

SEQ ID NO: 137076 - RNA, 64 nt, hsa; identical to SEQ ID NO: 41592

SEQ ID NO: 137077 - RNA, 64 nt, hsa; identical to SEQ ID NO: 41593

SEQ ID NO: 137078 - RNA, 64 nt, hsa; identical to SEQ ID NO: 41594

SEQ ID NO: 137079 - RNA, 64 nt, hsa; identical to SEQ ID NO: 41595

SEQ ID NO: 137080 - RNA, 64 nt, hsa; identical to SEQ ID NO: 41596

SEQ ID NO: 137081 - RNA, 64 nt, hsa; identical to SEQ ID NO: 41597

SEQ ID NO: 137082 - RNA, 64 nt, hsa; identical to SEQ ID NO: 41598

SEQ ID NO: 137083 - RNA, 64 nt, hsa; identical to SEQ ID NO: 41599

SEQ ID NO: 137084 - RNA, 64 nt, hsa; identical to SEQ ID NO: 41600

SEQ ID NO: 137085 - RNA, 64 nt, hsa; identical to SEQ ID NO: 41601

SEQ ID NO: 137086 - RNA, 64 nt, hsa; identical to SEQ ID NO: 41602

SEQ ID NO: 137087 - RNA, 64 nt, hsa; identical to SEQ ID NO: 41603

SEQ ID NO: 137088 - RNA, 64 nt, hsa; identical to SEQ ID NO: 41604

SEQ ID NO: 137089 - RNA, 64 nt, hsa; identical to SEQ ID NO: 41605

SEQ ID NO: 137090 - RNA, 64 nt, hsa; identical to SEQ ID NO: 41606

SEQ ID NO: 137091 - RNA, 64 nt, hsa; identical to SEQ ID NO: 41607

SEQ ID NO: 137092 - RNA, 64 nt, hsa; identical to SEQ ID NO: 41608

SEQ ID NO: 137093 - RNA, 64 nt, hsa; identical to SEQ ID NO: 41609

SEQ ID NO: 137094 - RNA, 64 nt, hsa; identical to SEQ ID NO: 41610

SEQ ID NO: 137095 - RNA, 64 nt, hsa; identical to SEQ ID NO: 41611

SEQ ID NO: 137096 - RNA, 64 nt, hsa; identical to SEQ ID NO: 41612

SEQ ID NO: 137097 - RNA, 64 nt, hsa; identical to SEQ ID NO: 41613

SEQ ID NO: 137098 - RNA, 64 nt, hsa; identical to SEQ ID NO: 41614

SEQ ID NO: 137099 - RNA, 64 nt, hsa; identical to SEQ ID NO: 41615

SEQ ID NO: 137100 - RNA, 64 nt, hsa; identical to SEQ ID NO: 41616

SEQ ID NO: 137101 - RNA, 64 nt, hsa; identical to SEQ ID NO: 41617

SEQ ID NO: 137102 - RNA, 64 nt, hsa; identical to SEQ ID NO: 41618

SEQ ID NO: 137103 - RNA, 64 nt, hsa; identical to SEQ ID NO: 41619

SEQ ID NO: 137104 - RNA, 64 nt, hsa; identical to SEQ ID NO: 41620

SEQ ID NO: 137105 - RNA, 64 nt, hsa; identical to SEQ ID NO: 41621

SEQ ID NO: 137106 - RNA, 63 nt, hsa; identical to SEQ ID NO: 41622

SEQ ID NO: 137107 - RNA, 64 nt, hsa; identical to SEQ ID NO: 41623

SEQ ID NO: 137108 - RNA, 64 nt, hsa; identical to SEQ ID NO: 41624

SEQ ID NO: 137109 - RNA, 64 nt, hsa; identical to SEQ ID NO: 41625

SEQ ID NO: 137110 - RNA, 64 nt, hsa; identical to SEQ ID NO: 41626

SEQ ID NO: 137111 - RNA, 64 nt, hsa; identical to SEQ ID NO: 41627

SEQ ID NO: 137112 - RNA, 64 nt, hsa; identical to SEQ ID NO: 41628

SEQ ID NO: 137113 - RNA, 64 nt, hsa; identical to SEQ ID NO: 41629

SEQ ID NO: 137114 - RNA, 64 nt, hsa; identical to SEQ ID NO: 41630

SEQ ID NO: 137115 - RNA, 64 nt, hsa; identical to SEQ ID NO: 41631

SEQ ID NO: 137116 - RNA, 64 nt, hsa; identical to SEQ ID NO: 41632

SEQ ID NO: 137117 - RNA, 64 nt, hsa; identical to SEQ ID NO: 41633

SEQ ID NO: 137118 - RNA, 64 nt, hsa; identical to SEQ ID NO: 41634

SEQ ID NO: 137119 - RNA, 64 nt, hsa; identical to SEQ ID NO: 41635

SEQ ID NO: 137120 - RNA, 64 nt, hsa; identical to SEQ ID NO: 41636

SEQ ID NO: 137121 - RNA, 64 nt, hsa; identical to SEQ ID NO: 41637

SEQ ID NO: 137122 - RNA, 64 nt, hsa; identical to SEQ ID NO: 41638

SEQ ID NO: 137123 - RNA, 64 nt, hsa; identical to SEQ ID NO: 41639

SEQ ID NO: 137124 - RNA, 64 nt, hsa; identical to SEQ ID NO: 41640

SEQ ID NO: 137125 - RNA, 64 nt, hsa; identical to SEQ ID NO: 41641

SEQ ID NO: 137126 - RNA, 64 nt, hsa; identical to SEQ ID NO: 41642

SEQ ID NO: 137127 - RNA, 64 nt, hsa; identical to SEQ ID NO: 41643

SEQ ID NO: 137128 - RNA, 64 nt, hsa; identical to SEQ ID NO: 41644

SEQ ID NO: 137129 - RNA, 64 nt, hsa; identical to SEQ ID NO: 41645

SEQ ID NO: 137130 - RNA, 64 nt, hsa; identical to SEQ ID NO: 41646

SEQ ID NO: 137131 - RNA, 64 nt, hsa; identical to SEQ ID NO: 41647

SEQ ID NO: 137132 - RNA, 64 nt, hsa; identical to SEQ ID NO: 41648

SEQ ID NO: 137133 - RNA, 64 nt, hsa; identical to SEQ ID NO: 41649

SEQ ID NO: 137134 - RNA, 64 nt, hsa; identical to SEQ ID NO: 41650

SEQ ID NO: 137135 - RNA, 64 nt, hsa; identical to SEQ ID NO: 41651

SEQ ID NO: 137136 - RNA, 64 nt, hsa; identical to SEQ ID NO: 41652

SEQ ID NO: 137137 - RNA, 64 nt, hsa; identical to SEQ ID NO: 41653

SEQ ID NO: 137138 - RNA, 64 nt, hsa; identical to SEQ ID NO: 41654

SEQ ID NO: 137139 - RNA, 64 nt, hsa; identical to SEQ ID NO: 41655

SEQ ID NO: 137140 - RNA, 64 nt, hsa; identical to SEQ ID NO: 41656

SEQ ID NO: 137141 - RNA, 64 nt, hsa; identical to SEQ ID NO: 41657

SEQ ID NO: 137142 - RNA, 64 nt, hsa; identical to SEQ ID NO: 41658

SEQ ID NO: 137143 - RNA, 64 nt, hsa; identical to SEQ ID NO: 41659

SEQ ID NO: 137144 - RNA, 64 nt, hsa; identical to SEQ ID NO: 41660

SEQ ID NO: 137145 - RNA, 64 nt, hsa; identical to SEQ ID NO: 41661

SEQ ID NO: 137146 - RNA, 64 nt, hsa; identical to SEQ ID NO: 41662

SEQ ID NO: 137147 - RNA, 64 nt, hsa; identical to SEQ ID NO: 41663

SEQ ID NO: 137148 - RNA, 64 nt, hsa; identical to SEQ ID NO: 41664

SEQ ID NO: 137149 - RNA, 64 nt, hsa; identical to SEQ ID NO: 41665

SEQ ID NO: 137150 - RNA, 64 nt, hsa; identical to SEQ ID NO: 41666

SEQ ID NO: 137151 - RNA, 64 nt, hsa; identical to SEQ ID NO: 41667

SEQ ID NO: 137152 - RNA, 64 nt, hsa; identical to SEQ ID NO: 41668

SEQ ID NO: 137153 - RNA, 64 nt, hsa; identical to SEQ ID NO: 41669

SEQ ID NO: 137154 - RNA, 64 nt, hsa; identical to SEQ ID NO: 41670

SEQ ID NO: 137155 - RNA, 64 nt, hsa; identical to SEQ ID NO: 41671

SEQ ID NO: 137156 - RNA, 64 nt, hsa; identical to SEQ ID NO: 41672

SEQ ID NO: 137157 - RNA, 64 nt, hsa; identical to SEQ ID NO: 41673

SEQ ID NO: 137158 - RNA, 64 nt, hsa; identical to SEQ ID NO: 41674

SEQ ID NO: 137159 - RNA, 64 nt, hsa; identical to SEQ ID NO: 41675

SEQ ID NO: 137160 - RNA, 64 nt, hsa; identical to SEQ ID NO: 41676

SEQ ID NO: 137161 - RNA, 64 nt, hsa; identical to SEQ ID NO: 41677

SEQ ID NO: 137162 - RNA, 64 nt, hsa; identical to SEQ ID NO: 41678

SEQ ID NO: 137163 - RNA, 64 nt, hsa; identical to SEQ ID NO: 41679

SEQ ID NO: 137164 - RNA, 64 nt, hsa; identical to SEQ ID NO: 41680

SEQ ID NO: 137165 - RNA, 64 nt, hsa; identical to SEQ ID NO: 41681

SEQ ID NO: 137166 - RNA, 64 nt, hsa; identical to SEQ ID NO: 41682

SEQ ID NO: 137167 - RNA, 64 nt, hsa; identical to SEQ ID NO: 41683

SEQ ID NO: 137168 - RNA, 64 nt, hsa; identical to SEQ ID NO: 41684

SEQ ID NO: 137169 - RNA, 64 nt, hsa; identical to SEQ ID NO: 41685

SEQ ID NO: 137170 - RNA, 64 nt, hsa; identical to SEQ ID NO: 41686

SEQ ID NO: 137171 - RNA, 64 nt, hsa; identical to SEQ ID NO: 41687

SEQ ID NO: 137172 - RNA, 64 nt, hsa; identical to SEQ ID NO: 41688

SEQ ID NO: 137173 - RNA, 64 nt, hsa; identical to SEQ ID NO: 41689

SEQ ID NO: 137174 - RNA, 64 nt, hsa; identical to SEQ ID NO: 41690

SEQ ID NO: 137175 - RNA, 64 nt, hsa; identical to SEQ ID NO: 41691

SEQ ID NO: 137176 - RNA, 64 nt, hsa; identical to SEQ ID NO: 41692

SEQ ID NO: 137177 - RNA, 64 nt, hsa; identical to SEQ ID NO: 41693

SEQ ID NO: 137178 - RNA, 64 nt, hsa; identical to SEQ ID NO: 41694

SEQ ID NO: 137179 - RNA, 64 nt, hsa; identical to SEQ ID NO: 41695

SEQ ID NO: 137180 - RNA, 64 nt, hsa; identical to SEQ ID NO: 41696

SEQ ID NO: 137181 - RNA, 64 nt, hsa; identical to SEQ ID NO: 41697

SEQ ID NO: 137182 - RNA, 64 nt, hsa; identical to SEQ ID NO: 41698

SEQ ID NO: 137183 - RNA, 64 nt, hsa; identical to SEQ ID NO: 41699

SEQ ID NO: 137184 - RNA, 64 nt, hsa; identical to SEQ ID NO: 41700

SEQ ID NO: 137185 - RNA, 64 nt, hsa; identical to SEQ ID NO: 41701

SEQ ID NO: 137186 - RNA, 64 nt, hsa; identical to SEQ ID NO: 41702

SEQ ID NO: 137187 - RNA, 64 nt, hsa; identical to SEQ ID NO: 41703

SEQ ID NO: 137188 - RNA, 64 nt, hsa; identical to SEQ ID NO: 41704

SEQ ID NO: 137189 - RNA, 64 nt, hsa; identical to SEQ ID NO: 41705

SEQ ID NO: 137190 - RNA, 64 nt, hsa; identical to SEQ ID NO: 41706

SEQ ID NO: 137191 - RNA, 64 nt, hsa; identical to SEQ ID NO: 41707

SEQ ID NO: 137192 - RNA, 64 nt, hsa; identical to SEQ ID NO: 41708

SEQ ID NO: 137193 - RNA, 64 nt, hsa; identical to SEQ ID NO: 41709

SEQ ID NO: 137194 - RNA, 64 nt, hsa; identical to SEQ ID NO: 41710

SEQ ID NO: 137195 - RNA, 64 nt, hsa; identical to SEQ ID NO: 41711

SEQ ID NO: 137196 - RNA, 64 nt, hsa; identical to SEQ ID NO: 41712

SEQ ID NO: 137197 - RNA, 64 nt, hsa; identical to SEQ ID NO: 41713

SEQ ID NO: 137198 - RNA, 64 nt, hsa; identical to SEQ ID NO: 41714

SEQ ID NO: 137199 - RNA, 64 nt, hsa; identical to SEQ ID NO: 41715

SEQ ID NO: 137200 - RNA, 64 nt, hsa; identical to SEQ ID NO: 41716

SEQ ID NO: 137201 - RNA, 64 nt, hsa; identical to SEQ ID NO: 41717

SEQ ID NO: 137202 - RNA, 64 nt, hsa; identical to SEQ ID NO: 41718

SEQ ID NO: 137203 - RNA, 64 nt, hsa; identical to SEQ ID NO: 41719

SEQ ID NO: 137204 - RNA, 64 nt, hsa; identical to SEQ ID NO: 41720

SEQ ID NO: 137205 - RNA, 64 nt, hsa; identical to SEQ ID NO: 41721

SEQ ID NO: 137206 - RNA, 64 nt, hsa; identical to SEQ ID NO: 41722

SEQ ID NO: 137207 - RNA, 64 nt, hsa; identical to SEQ ID NO: 41723

SEQ ID NO: 137208 - RNA, 64 nt, hsa; identical to SEQ ID NO: 41724

SEQ ID NO: 137209 - RNA, 64 nt, hsa; identical to SEQ ID NO: 41725

SEQ ID NO: 137210 - RNA, 64 nt, hsa; identical to SEQ ID NO: 41726

SEQ ID NO: 137211 - RNA, 64 nt, hsa; identical to SEQ ID NO: 41727

SEQ ID NO: 137212 - RNA, 64 nt, hsa; identical to SEQ ID NO: 41728

SEQ ID NO: 137213 - RNA, 64 nt, hsa; identical to SEQ ID NO: 41729

SEQ ID NO: 137214 - RNA, 64 nt, hsa; identical to SEQ ID NO: 41730

SEQ ID NO: 137215 - RNA, 64 nt, hsa; identical to SEQ ID NO: 41731

SEQ ID NO: 137216 - RNA, 64 nt, hsa; identical to SEQ ID NO: 41732

SEQ ID NO: 137217 - RNA, 64 nt, hsa; identical to SEQ ID NO: 41733

SEQ ID NO: 137218 - RNA, 64 nt, hsa; identical to SEQ ID NO: 41734

SEQ ID NO: 137219 - RNA, 64 nt, hsa; identical to SEQ ID NO: 41735

SEQ ID NO: 137220 - RNA, 64 nt, hsa; identical to SEQ ID NO: 41736

SEQ ID NO: 137221 - RNA, 64 nt, hsa; identical to SEQ ID NO: 41737

SEQ ID NO: 137222 - RNA, 64 nt, hsa; identical to SEQ ID NO: 41738

SEQ ID NO: 137223 - RNA, 64 nt, hsa; identical to SEQ ID NO: 41739

SEQ ID NO: 137224 - RNA, 64 nt, hsa; identical to SEQ ID NO: 41740

SEQ ID NO: 137225 - RNA, 64 nt, hsa; identical to SEQ ID NO: 41741

SEQ ID NO: 137226 - RNA, 64 nt, hsa; identical to SEQ ID NO: 41742

SEQ ID NO: 137227 - RNA, 64 nt, hsa; identical to SEQ ID NO: 41743

SEQ ID NO: 137228 - RNA, 64 nt, hsa; identical to SEQ ID NO: 41744

SEQ ID NO: 137229 - RNA, 64 nt, hsa; identical to SEQ ID NO: 41745

SEQ ID NO: 137230 - RNA, 64 nt, hsa; identical to SEQ ID NO: 41746

SEQ ID NO: 137231 - RNA, 64 nt, hsa; identical to SEQ ID NO: 41747

SEQ ID NO: 137232 - RNA, 64 nt, hsa; identical to SEQ ID NO: 41748

SEQ ID NO: 137233 - RNA, 64 nt, hsa; identical to SEQ ID NO: 41749

SEQ ID NO: 137234 - RNA, 64 nt, hsa; identical to SEQ ID NO: 41750

SEQ ID NO: 137235 - RNA, 64 nt, hsa; identical to SEQ ID NO: 41751

SEQ ID NO: 137236 - RNA, 64 nt, hsa; identical to SEQ ID NO: 41752

SEQ ID NO: 137237 - RNA, 64 nt, hsa; identical to SEQ ID NO: 41753

SEQ ID NO: 137238 - RNA, 64 nt, hsa; identical to SEQ ID NO: 41754

SEQ ID NO: 137239 - RNA, 64 nt, hsa; identical to SEQ ID NO: 41755

SEQ ID NO: 137240 - RNA, 64 nt, hsa; identical to SEQ ID NO: 41756

SEQ ID NO: 137241 - RNA, 64 nt, hsa; identical to SEQ ID NO: 41757

SEQ ID NO: 137242 - RNA, 64 nt, hsa; identical to SEQ ID NO: 41758

SEQ ID NO: 137243 - RNA, 64 nt, hsa; identical to SEQ ID NO: 41759

SEQ ID NO: 137244 - RNA, 64 nt, hsa; identical to SEQ ID NO: 41760

SEQ ID NO: 137245 - RNA, 64 nt, hsa; identical to SEQ ID NO: 41761

SEQ ID NO: 137246 - RNA, 64 nt, hsa; identical to SEQ ID NO: 41762

SEQ ID NO: 137247 - RNA, 64 nt, hsa; identical to SEQ ID NO: 41763

SEQ ID NO: 137248 - RNA, 64 nt, hsa; identical to SEQ ID NO: 41764

SEQ ID NO: 137249 - RNA, 64 nt, hsa; identical to SEQ ID NO: 41765

SEQ ID NO: 137250 - RNA, 64 nt, hsa; identical to SEQ ID NO: 41766

SEQ ID NO: 137251 - RNA, 64 nt, hsa; identical to SEQ ID NO: 41767

SEQ ID NO: 137252 - RNA, 64 nt, hsa; identical to SEQ ID NO: 41768

SEQ ID NO: 137253 - RNA, 64 nt, hsa; identical to SEQ ID NO: 41769

SEQ ID NO: 137254 - RNA, 64 nt, hsa; identical to SEQ ID NO: 41770

SEQ ID NO: 137255 - RNA, 64 nt, hsa; identical to SEQ ID NO: 41771

SEQ ID NO: 137256 - RNA, 64 nt, hsa; identical to SEQ ID NO: 41772

SEQ ID NO: 137257 - RNA, 64 nt, hsa; identical to SEQ ID NO: 41773

SEQ ID NO: 137258 - RNA, 64 nt, hsa; identical to SEQ ID NO: 41774

SEQ ID NO: 137259 - RNA, 64 nt, hsa; identical to SEQ ID NO: 41775

SEQ ID NO: 137260 - RNA, 64 nt, hsa; identical to SEQ ID NO: 41776

SEQ ID NO: 137261 - RNA, 64 nt, hsa; identical to SEQ ID NO: 41777

SEQ ID NO: 137262 - RNA, 64 nt, hsa; identical to SEQ ID NO: 41778

SEQ ID NO: 137263 - RNA, 64 nt, hsa; identical to SEQ ID NO: 41779

SEQ ID NO: 137264 - RNA, 64 nt, hsa; identical to SEQ ID NO: 41780

SEQ ID NO: 137265 - RNA, 64 nt, hsa; identical to SEQ ID NO: 41781

SEQ ID NO: 137266 - RNA, 64 nt, hsa; identical to SEQ ID NO: 41782

SEQ ID NO: 137267 - RNA, 64 nt, hsa; identical to SEQ ID NO: 41783

SEQ ID NO: 137268 - RNA, 64 nt, hsa; identical to SEQ ID NO: 41784

SEQ ID NO: 137269 - RNA, 64 nt, hsa; identical to SEQ ID NO: 41785

SEQ ID NO: 137270 - RNA, 64 nt, hsa; identical to SEQ ID NO: 41786

SEQ ID NO: 137271 - RNA, 64 nt, hsa; identical to SEQ ID NO: 41787

SEQ ID NO: 137272 - RNA, 64 nt, hsa; identical to SEQ ID NO: 41788

SEQ ID NO: 137273 - RNA, 64 nt, hsa; identical to SEQ ID NO: 41789

SEQ ID NO: 137274 - RNA, 64 nt, hsa; identical to SEQ ID NO: 41790

SEQ ID NO: 137275 - RNA, 64 nt, hsa; identical to SEQ ID NO: 41791

SEQ ID NO: 137276 - RNA, 64 nt, hsa; identical to SEQ ID NO: 41792

SEQ ID NO: 137277 - RNA, 64 nt, hsa; identical to SEQ ID NO: 41793

SEQ ID NO: 137278 - RNA, 64 nt, hsa; identical to SEQ ID NO: 41794

SEQ ID NO: 137279 - RNA, 64 nt, hsa; identical to SEQ ID NO: 41795

SEQ ID NO: 137280 - RNA, 64 nt, hsa; identical to SEQ ID NO: 41796

SEQ ID NO: 137281 - RNA, 64 nt, hsa; identical to SEQ ID NO: 41797

SEQ ID NO: 137282 - RNA, 64 nt, hsa; identical to SEQ ID NO: 41798

SEQ ID NO: 137283 - RNA, 64 nt, hsa; identical to SEQ ID NO: 41799

SEQ ID NO: 137284 - RNA, 64 nt, hsa; identical to SEQ ID NO: 41800

SEQ ID NO: 137285 - RNA, 64 nt, hsa; identical to SEQ ID NO: 41801

SEQ ID NO: 137286 - RNA, 64 nt, hsa; identical to SEQ ID NO: 41802

SEQ ID NO: 137287 - RNA, 64 nt, hsa; identical to SEQ ID NO: 41803

SEQ ID NO: 137288 - RNA, 64 nt, hsa; identical to SEQ ID NO: 41804

SEQ ID NO: 137289 - RNA, 64 nt, hsa; identical to SEQ ID NO: 41805

SEQ ID NO: 137290 - RNA, 64 nt, hsa; identical to SEQ ID NO: 41806

SEQ ID NO: 137291 - RNA, 64 nt, hsa; identical to SEQ ID NO: 41807

SEQ ID NO: 137292 - RNA, 64 nt, hsa; identical to SEQ ID NO: 41808

SEQ ID NO: 137293 - RNA, 64 nt, hsa; identical to SEQ ID NO: 41809

SEQ ID NO: 137294 - RNA, 64 nt, hsa; identical to SEQ ID NO: 41810

SEQ ID NO: 137295 - RNA, 64 nt, hsa; identical to SEQ ID NO: 41811

SEQ ID NO: 137296 - RNA, 64 nt, hsa; identical to SEQ ID NO: 41812

SEQ ID NO: 137297 - RNA, 64 nt, hsa; identical to SEQ ID NO: 41813

SEQ ID NO: 137298 - RNA, 64 nt, hsa; identical to SEQ ID NO: 41814

SEQ ID NO: 137299 - RNA, 64 nt, hsa; identical to SEQ ID NO: 41815

SEQ ID NO: 137300 - RNA, 64 nt, hsa; identical to SEQ ID NO: 41816

SEQ ID NO: 137301 - RNA, 64 nt, hsa; identical to SEQ ID NO: 41817

SEQ ID NO: 137302 - RNA, 64 nt, hsa; identical to SEQ ID NO: 41818

SEQ ID NO: 137303 - RNA, 64 nt, hsa; identical to SEQ ID NO: 41819

SEQ ID NO: 137304 - RNA, 64 nt, hsa; identical to SEQ ID NO: 41820

SEQ ID NO: 137305 - RNA, 64 nt, hsa; identical to SEQ ID NO: 41821

SEQ ID NO: 137306 - RNA, 64 nt, hsa; identical to SEQ ID NO: 41822

SEQ ID NO: 137307 - RNA, 64 nt, hsa; identical to SEQ ID NO: 41823

SEQ ID NO: 137308 - RNA, 64 nt, hsa; identical to SEQ ID NO: 41824

SEQ ID NO: 137309 - RNA, 64 nt, hsa; identical to SEQ ID NO: 41825

SEQ ID NO: 137310 - RNA, 64 nt, hsa; identical to SEQ ID NO: 41826

SEQ ID NO: 137311 - RNA, 64 nt, hsa; identical to SEQ ID NO: 41827

SEQ ID NO: 137312 - RNA, 64 nt, hsa; identical to SEQ ID NO: 41828

SEQ ID NO: 137313 - RNA, 64 nt, hsa; identical to SEQ ID NO: 41829

SEQ ID NO: 137314 - RNA, 64 nt, hsa; identical to SEQ ID NO: 41830

SEQ ID NO: 137315 - RNA, 64 nt, hsa; identical to SEQ ID NO: 41831

SEQ ID NO: 137316 - RNA, 64 nt, hsa; identical to SEQ ID NO: 41832

SEQ ID NO: 137317 - RNA, 64 nt, hsa; identical to SEQ ID NO: 41833

SEQ ID NO: 137318 - RNA, 64 nt, hsa; identical to SEQ ID NO: 41834

SEQ ID NO: 137319 - RNA, 64 nt, hsa; identical to SEQ ID NO: 41835

SEQ ID NO: 137320 - RNA, 64 nt, hsa; identical to SEQ ID NO: 41836

SEQ ID NO: 137321 - RNA, 64 nt, hsa; identical to SEQ ID NO: 41837

SEQ ID NO: 137322 - RNA, 64 nt, hsa; identical to SEQ ID NO: 41838

SEQ ID NO: 137323 - RNA, 64 nt, hsa; identical to SEQ ID NO: 41839

SEQ ID NO: 137324 - RNA, 64 nt, hsa; identical to SEQ ID NO: 41840

SEQ ID NO: 137325 - RNA, 64 nt, hsa; identical to SEQ ID NO: 41841

SEQ ID NO: 137326 - RNA, 64 nt, hsa; identical to SEQ ID NO: 41842

SEQ ID NO: 137327 - RNA, 64 nt, hsa; identical to SEQ ID NO: 41843

SEQ ID NO: 137328 - RNA, 64 nt, hsa; identical to SEQ ID NO: 41844

SEQ ID NO: 137329 - RNA, 64 nt, hsa; identical to SEQ ID NO: 41845

SEQ ID NO: 137330 - RNA, 64 nt, hsa; identical to SEQ ID NO: 41846

SEQ ID NO: 137331 - RNA, 64 nt, hsa; identical to SEQ ID NO: 41847

SEQ ID NO: 137332 - RNA, 64 nt, hsa; identical to SEQ ID NO: 41848

SEQ ID NO: 137333 - RNA, 64 nt, hsa; identical to SEQ ID NO: 41849

SEQ ID NO: 137334 - RNA, 64 nt, hsa; identical to SEQ ID NO: 41850

SEQ ID NO: 137335 - RNA, 64 nt, hsa; identical to SEQ ID NO: 41851

SEQ ID NO: 137336 - RNA, 64 nt, hsa; identical to SEQ ID NO: 41852

SEQ ID NO: 137337 - RNA, 64 nt, hsa; identical to SEQ ID NO: 41853

SEQ ID NO: 137338 - RNA, 64 nt, hsa; identical to SEQ ID NO: 41854

SEQ ID NO: 137339 - RNA, 64 nt, hsa; identical to SEQ ID NO: 41855

SEQ ID NO: 137340 - RNA, 64 nt, hsa; identical to SEQ ID NO: 41856

SEQ ID NO: 137341 - RNA, 64 nt, hsa; identical to SEQ ID NO: 41857

SEQ ID NO: 137342 - RNA, 64 nt, hsa; identical to SEQ ID NO: 41858

SEQ ID NO: 137343 - RNA, 64 nt, hsa; identical to SEQ ID NO: 41859

SEQ ID NO: 137344 - RNA, 64 nt, hsa; identical to SEQ ID NO: 41860

SEQ ID NO: 137345 - RNA, 64 nt, hsa; identical to SEQ ID NO: 41861

SEQ ID NO: 137346 - RNA, 64 nt, hsa; identical to SEQ ID NO: 41862

SEQ ID NO: 137347 - RNA, 64 nt, hsa; identical to SEQ ID NO: 41863

SEQ ID NO: 137348 - RNA, 64 nt, hsa; identical to SEQ ID NO: 41864

SEQ ID NO: 137349 - RNA, 64 nt, hsa; identical to SEQ ID NO: 41865

SEQ ID NO: 137350 - RNA, 64 nt, hsa; identical to SEQ ID NO: 41866

SEQ ID NO: 137351 - RNA, 64 nt, hsa; identical to SEQ ID NO: 41867

SEQ ID NO: 137352 - RNA, 64 nt, hsa; identical to SEQ ID NO: 41868

SEQ ID NO: 137353 - RNA, 64 nt, hsa; identical to SEQ ID NO: 41869

SEQ ID NO: 137354 - RNA, 64 nt, hsa; identical to SEQ ID NO: 41870

SEQ ID NO: 137355 - RNA, 64 nt, hsa; identical to SEQ ID NO: 41871

SEQ ID NO: 137356 - RNA, 64 nt, hsa; identical to SEQ ID NO: 41872

SEQ ID NO: 137357 - RNA, 64 nt, hsa; identical to SEQ ID NO: 41873

SEQ ID NO: 137358 - RNA, 64 nt, hsa; identical to SEQ ID NO: 41874

SEQ ID NO: 137359 - RNA, 64 nt, hsa; identical to SEQ ID NO: 41875

SEQ ID NO: 137360 - RNA, 64 nt, hsa; identical to SEQ ID NO: 41876

SEQ ID NO: 137361 - RNA, 64 nt, hsa; identical to SEQ ID NO: 41877

SEQ ID NO: 137362 - RNA, 64 nt, hsa; identical to SEQ ID NO: 41878

SEQ ID NO: 137363 - RNA, 64 nt, hsa; identical to SEQ ID NO: 41879

SEQ ID NO: 137364 - RNA, 64 nt, hsa; identical to SEQ ID NO: 41880

SEQ ID NO: 137365 - RNA, 64 nt, hsa; identical to SEQ ID NO: 41881

SEQ ID NO: 137366 - RNA, 64 nt, hsa; identical to SEQ ID NO: 41882

SEQ ID NO: 137367 - RNA, 64 nt, hsa; identical to SEQ ID NO: 41883

SEQ ID NO: 137368 - RNA, 64 nt, hsa; identical to SEQ ID NO: 41884

SEQ ID NO: 137369 - RNA, 64 nt, hsa; identical to SEQ ID NO: 41885

SEQ ID NO: 137370 - RNA, 64 nt, hsa; identical to SEQ ID NO: 41886

SEQ ID NO: 137371 - RNA, 64 nt, hsa; identical to SEQ ID NO: 41887

SEQ ID NO: 137372 - RNA, 64 nt, hsa; identical to SEQ ID NO: 41888

SEQ ID NO: 137373 - RNA, 64 nt, hsa; identical to SEQ ID NO: 41889

SEQ ID NO: 137374 - RNA, 64 nt, hsa; identical to SEQ ID NO: 41890

SEQ ID NO: 137375 - RNA, 64 nt, hsa; identical to SEQ ID NO: 41891

SEQ ID NO: 137376 - RNA, 64 nt, hsa; identical to SEQ ID NO: 41892

SEQ ID NO: 137377 - RNA, 64 nt, hsa; identical to SEQ ID NO: 41893

SEQ ID NO: 137378 - RNA, 64 nt, hsa; identical to SEQ ID NO: 41894

SEQ ID NO: 137379 - RNA, 64 nt, hsa; identical to SEQ ID NO: 41895

SEQ ID NO: 137380 - RNA, 64 nt, hsa; identical to SEQ ID NO: 41896

SEQ ID NO: 137381 - RNA, 64 nt, hsa; identical to SEQ ID NO: 41897

SEQ ID NO: 137382 - RNA, 64 nt, hsa; identical to SEQ ID NO: 41898

SEQ ID NO: 137383 - RNA, 64 nt, hsa; identical to SEQ ID NO: 41899

SEQ ID NO: 137384 - RNA, 64 nt, hsa; identical to SEQ ID NO: 41900

SEQ ID NO: 137385 - RNA, 64 nt, hsa; identical to SEQ ID NO: 41901

SEQ ID NO: 137386 - RNA, 64 nt, hsa; identical to SEQ ID NO: 41902

SEQ ID NO: 137387 - RNA, 64 nt, hsa; identical to SEQ ID NO: 41903

SEQ ID NO: 137388 - RNA, 64 nt, hsa; identical to SEQ ID NO: 41904

SEQ ID NO: 137389 - RNA, 64 nt, hsa; identical to SEQ ID NO: 41905

SEQ ID NO: 137390 - RNA, 64 nt, hsa; identical to SEQ ID NO: 41906

SEQ ID NO: 137391 - RNA, 64 nt, hsa; identical to SEQ ID NO: 41907

SEQ ID NO: 137392 - RNA, 64 nt, hsa; identical to SEQ ID NO: 41908

SEQ ID NO: 137393 - RNA, 64 nt, hsa; identical to SEQ ID NO: 41909

SEQ ID NO: 137394 - RNA, 64 nt, hsa; identical to SEQ ID NO: 41910

SEQ ID NO: 137395 - RNA, 64 nt, hsa; identical to SEQ ID NO: 41911

SEQ ID NO: 137396 - RNA, 64 nt, hsa; identical to SEQ ID NO: 41912

SEQ ID NO: 137397 - RNA, 64 nt, hsa; identical to SEQ ID NO: 41913

SEQ ID NO: 137398 - RNA, 64 nt, hsa; identical to SEQ ID NO: 41914

SEQ ID NO: 137399 - RNA, 64 nt, hsa; identical to SEQ ID NO: 41915

SEQ ID NO: 137400 - RNA, 64 nt, hsa; identical to SEQ ID NO: 41916

SEQ ID NO: 137401 - RNA, 64 nt, hsa; identical to SEQ ID NO: 41917

SEQ ID NO: 137402 - RNA, 64 nt, hsa; identical to SEQ ID NO: 41918

SEQ ID NO: 137403 - RNA, 64 nt, hsa; identical to SEQ ID NO: 41919

SEQ ID NO: 137404 - RNA, 64 nt, hsa; identical to SEQ ID NO: 41920

SEQ ID NO: 137405 - RNA, 64 nt, hsa; identical to SEQ ID NO: 41921

SEQ ID NO: 137406 - RNA, 64 nt, hsa; identical to SEQ ID NO: 41922

SEQ ID NO: 137407 - RNA, 64 nt, hsa; identical to SEQ ID NO: 41923

SEQ ID NO: 137408 - RNA, 64 nt, hsa; identical to SEQ ID NO: 41924

SEQ ID NO: 137409 - RNA, 64 nt, hsa; identical to SEQ ID NO: 41925

SEQ ID NO: 137410 - RNA, 64 nt, hsa; identical to SEQ ID NO: 41926

SEQ ID NO: 137411 - RNA, 64 nt, hsa; identical to SEQ ID NO: 41927

SEQ ID NO: 137412 - RNA, 64 nt, hsa; identical to SEQ ID NO: 41928

SEQ ID NO: 137413 - RNA, 64 nt, hsa; identical to SEQ ID NO: 41929

SEQ ID NO: 137414 - RNA, 64 nt, hsa; identical to SEQ ID NO: 41930

SEQ ID NO: 137415 - RNA, 64 nt, hsa; identical to SEQ ID NO: 41931

SEQ ID NO: 137416 - RNA, 64 nt, hsa; identical to SEQ ID NO: 41932

SEQ ID NO: 137417 - RNA, 64 nt, hsa; identical to SEQ ID NO: 41933

SEQ ID NO: 137418 - RNA, 64 nt, hsa; identical to SEQ ID NO: 41934

SEQ ID NO: 137419 - RNA, 64 nt, hsa; identical to SEQ ID NO: 41935

SEQ ID NO: 137420 - RNA, 64 nt, hsa; identical to SEQ ID NO: 41936

SEQ ID NO: 137421 - RNA, 64 nt, hsa; identical to SEQ ID NO: 41937

SEQ ID NO: 137422 - RNA, 64 nt, hsa; identical to SEQ ID NO: 41938

SEQ ID NO: 137423 - RNA, 64 nt, hsa; identical to SEQ ID NO: 41939

SEQ ID NO: 137424 - RNA, 64 nt, hsa; identical to SEQ ID NO: 41940

SEQ ID NO: 137425 - RNA, 64 nt, hsa; identical to SEQ ID NO: 41941

SEQ ID NO: 137426 - RNA, 64 nt, hsa; identical to SEQ ID NO: 41942

SEQ ID NO: 137427 - RNA, 64 nt, hsa; identical to SEQ ID NO: 41943

SEQ ID NO: 137428 - RNA, 64 nt, hsa; identical to SEQ ID NO: 41944

SEQ ID NO: 137429 - RNA, 64 nt, hsa; identical to SEQ ID NO: 41945

SEQ ID NO: 137430 - RNA, 64 nt, hsa; identical to SEQ ID NO: 41946

SEQ ID NO: 137431 - RNA, 64 nt, hsa; identical to SEQ ID NO: 41947

SEQ ID NO: 137432 - RNA, 64 nt, hsa; identical to SEQ ID NO: 41948

SEQ ID NO: 137433 - RNA, 64 nt, hsa; identical to SEQ ID NO: 41949

SEQ ID NO: 137434 - RNA, 64 nt, hsa; identical to SEQ ID NO: 41950

SEQ ID NO: 137435 - RNA, 64 nt, hsa; identical to SEQ ID NO: 41951

SEQ ID NO: 137436 - RNA, 64 nt, hsa; identical to SEQ ID NO: 41952

SEQ ID NO: 137437 - RNA, 64 nt, hsa; identical to SEQ ID NO: 41953

SEQ ID NO: 137438 - RNA, 64 nt, hsa; identical to SEQ ID NO: 41954

SEQ ID NO: 137439 - RNA, 64 nt, hsa; identical to SEQ ID NO: 41955

SEQ ID NO: 137440 - RNA, 64 nt, hsa; identical to SEQ ID NO: 41956

SEQ ID NO: 137441 - RNA, 64 nt, hsa; identical to SEQ ID NO: 41957

SEQ ID NO: 137442 - RNA, 64 nt, hsa; identical to SEQ ID NO: 41958

SEQ ID NO: 137443 - RNA, 64 nt, hsa; identical to SEQ ID NO: 41959

SEQ ID NO: 137444 - RNA, 64 nt, hsa; identical to SEQ ID NO: 41960

SEQ ID NO: 137445 - RNA, 64 nt, hsa; identical to SEQ ID NO: 41961

SEQ ID NO: 137446 - RNA, 64 nt, hsa; identical to SEQ ID NO: 41962

SEQ ID NO: 137447 - RNA, 64 nt, hsa; identical to SEQ ID NO: 41963

SEQ ID NO: 137448 - RNA, 64 nt, hsa; identical to SEQ ID NO: 41964

SEQ ID NO: 137449 - RNA, 64 nt, hsa; identical to SEQ ID NO: 41965

SEQ ID NO: 137450 - RNA, 64 nt, hsa; identical to SEQ ID NO: 41966

SEQ ID NO: 137451 - RNA, 64 nt, hsa; identical to SEQ ID NO: 41967

SEQ ID NO: 137452 - RNA, 64 nt, hsa; identical to SEQ ID NO: 41968

SEQ ID NO: 137453 - RNA, 64 nt, hsa; identical to SEQ ID NO: 41969

SEQ ID NO: 137454 - RNA, 64 nt, hsa; identical to SEQ ID NO: 41970

SEQ ID NO: 137455 - RNA, 64 nt, hsa; identical to SEQ ID NO: 41971

SEQ ID NO: 137456 - RNA, 64 nt, hsa; identical to SEQ ID NO: 41972

SEQ ID NO: 137457 - RNA, 64 nt, hsa; identical to SEQ ID NO: 41973

SEQ ID NO: 137458 - RNA, 64 nt, hsa; identical to SEQ ID NO: 41974

SEQ ID NO: 137459 - RNA, 64 nt, hsa; identical to SEQ ID NO: 41975

SEQ ID NO: 137460 - RNA, 64 nt, hsa; identical to SEQ ID NO: 41976

SEQ ID NO: 137461 - RNA, 64 nt, hsa; identical to SEQ ID NO: 41977

SEQ ID NO: 137462 - RNA, 64 nt, hsa; identical to SEQ ID NO: 41978

SEQ ID NO: 137463 - RNA, 64 nt, hsa; identical to SEQ ID NO: 41979

SEQ ID NO: 137464 - RNA, 64 nt, hsa; identical to SEQ ID NO: 41980

SEQ ID NO: 137465 - RNA, 64 nt, hsa; identical to SEQ ID NO: 41981

SEQ ID NO: 137466 - RNA, 64 nt, hsa; identical to SEQ ID NO: 41982

SEQ ID NO: 137467 - RNA, 64 nt, hsa; identical to SEQ ID NO: 41983

SEQ ID NO: 137468 - RNA, 64 nt, hsa; identical to SEQ ID NO: 41984

SEQ ID NO: 137469 - RNA, 64 nt, hsa; identical to SEQ ID NO: 41985

SEQ ID NO: 137470 - RNA, 64 nt, hsa; identical to SEQ ID NO: 41986

SEQ ID NO: 137471 - RNA, 64 nt, hsa; identical to SEQ ID NO: 41987

SEQ ID NO: 137472 - RNA, 64 nt, hsa; identical to SEQ ID NO: 41988

SEQ ID NO: 137473 - RNA, 64 nt, hsa; identical to SEQ ID NO: 41989

SEQ ID NO: 137474 - RNA, 64 nt, hsa; identical to SEQ ID NO: 41990

SEQ ID NO: 137475 - RNA, 64 nt, hsa; identical to SEQ ID NO: 41991

SEQ ID NO: 137476 - RNA, 64 nt, hsa; identical to SEQ ID NO: 41992

SEQ ID NO: 137477 - RNA, 64 nt, hsa; identical to SEQ ID NO: 41993

SEQ ID NO: 137478 - RNA, 64 nt, hsa; identical to SEQ ID NO: 41994

SEQ ID NO: 137479 - RNA, 64 nt, hsa; identical to SEQ ID NO: 41995

SEQ ID NO: 137480 - RNA, 64 nt, hsa; identical to SEQ ID NO: 41996

SEQ ID NO: 137481 - RNA, 64 nt, hsa; identical to SEQ ID NO: 41997

SEQ ID NO: 137482 - RNA, 64 nt, hsa; identical to SEQ ID NO: 41998

SEQ ID NO: 137483 - RNA, 64 nt, hsa; identical to SEQ ID NO: 41999

SEQ ID NO: 137484 - RNA, 64 nt, hsa; identical to SEQ ID NO: 42000

SEQ ID NO: 137485 - RNA, 64 nt, hsa; identical to SEQ ID NO: 42001

SEQ ID NO: 137486 - RNA, 64 nt, hsa; identical to SEQ ID NO: 42002

SEQ ID NO: 137487 - RNA, 64 nt, hsa; identical to SEQ ID NO: 42003

SEQ ID NO: 137488 - RNA, 64 nt, hsa; identical to SEQ ID NO: 42004

SEQ ID NO: 137489 - RNA, 64 nt, hsa; identical to SEQ ID NO: 42005

SEQ ID NO: 137490 - RNA, 64 nt, hsa; identical to SEQ ID NO: 42006

SEQ ID NO: 137491 - RNA, 64 nt, hsa; identical to SEQ ID NO: 42007

SEQ ID NO: 137492 - RNA, 64 nt, hsa; identical to SEQ ID NO: 42008

SEQ ID NO: 137493 - RNA, 64 nt, hsa; identical to SEQ ID NO: 42009

SEQ ID NO: 137494 - RNA, 64 nt, hsa; identical to SEQ ID NO: 42010

SEQ ID NO: 137495 - RNA, 64 nt, hsa; identical to SEQ ID NO: 42011

SEQ ID NO: 137496 - RNA, 64 nt, hsa; identical to SEQ ID NO: 42012

SEQ ID NO: 137497 - RNA, 64 nt, hsa; identical to SEQ ID NO: 42013

SEQ ID NO: 137498 - RNA, 64 nt, hsa; identical to SEQ ID NO: 42014

SEQ ID NO: 137499 - RNA, 64 nt, hsa; identical to SEQ ID NO: 42015

SEQ ID NO: 137500 - RNA, 64 nt, hsa; identical to SEQ ID NO: 42016

SEQ ID NO: 137501 - RNA, 64 nt, hsa; identical to SEQ ID NO: 42017

SEQ ID NO: 137502 - RNA, 64 nt, hsa; identical to SEQ ID NO: 42018

SEQ ID NO: 137503 - RNA, 64 nt, hsa; identical to SEQ ID NO: 42019

SEQ ID NO: 137504 - RNA, 64 nt, hsa; identical to SEQ ID NO: 42020

SEQ ID NO: 137505 - RNA, 64 nt, hsa; identical to SEQ ID NO: 42021

SEQ ID NO: 137506 - RNA, 64 nt, hsa; identical to SEQ ID NO: 42022

SEQ ID NO: 137507 - RNA, 64 nt, hsa; identical to SEQ ID NO: 42023

SEQ ID NO: 137508 - RNA, 64 nt, hsa; identical to SEQ ID NO: 42024

SEQ ID NO: 137509 - RNA, 64 nt, hsa; identical to SEQ ID NO: 42025

SEQ ID NO: 137510 - RNA, 64 nt, hsa; identical to SEQ ID NO: 42026

SEQ ID NO: 137511 - RNA, 64 nt, hsa; identical to SEQ ID NO: 42027

SEQ ID NO: 137512 - RNA, 64 nt, hsa; identical to SEQ ID NO: 42028

SEQ ID NO: 137513 - RNA, 64 nt, hsa; identical to SEQ ID NO: 42029

SEQ ID NO: 137514 - RNA, 64 nt, hsa; identical to SEQ ID NO: 42030

SEQ ID NO: 137515 - RNA, 64 nt, hsa; identical to SEQ ID NO: 42031

SEQ ID NO: 137516 - RNA, 64 nt, hsa; identical to SEQ ID NO: 42032

SEQ ID NO: 137517 - RNA, 64 nt, hsa; identical to SEQ ID NO: 42033

SEQ ID NO: 137518 - RNA, 64 nt, hsa; identical to SEQ ID NO: 42034

SEQ ID NO: 137519 - RNA, 64 nt, hsa; identical to SEQ ID NO: 42035

SEQ ID NO: 137520 - RNA, 64 nt, hsa; identical to SEQ ID NO: 42036

SEQ ID NO: 137521 - RNA, 64 nt, hsa; identical to SEQ ID NO: 42037

SEQ ID NO: 137522 - RNA, 64 nt, hsa; identical to SEQ ID NO: 42038

SEQ ID NO: 137523 - RNA, 64 nt, hsa; identical to SEQ ID NO: 42039

SEQ ID NO: 137524 - RNA, 64 nt, hsa; identical to SEQ ID NO: 42040

SEQ ID NO: 137525 - RNA, 64 nt, hsa; identical to SEQ ID NO: 42041

SEQ ID NO: 137526 - RNA, 64 nt, hsa; identical to SEQ ID NO: 42042

SEQ ID NO: 137527 - RNA, 64 nt, hsa; identical to SEQ ID NO: 42043

SEQ ID NO: 137528 - RNA, 64 nt, hsa; identical to SEQ ID NO: 42044

SEQ ID NO: 137529 - RNA, 64 nt, hsa; identical to SEQ ID NO: 42045

SEQ ID NO: 137530 - RNA, 64 nt, hsa; identical to SEQ ID NO: 42046

SEQ ID NO: 137531 - RNA, 64 nt, hsa; identical to SEQ ID NO: 42047

SEQ ID NO: 137532 - RNA, 64 nt, hsa; identical to SEQ ID NO: 42048

SEQ ID NO: 137533 - RNA, 64 nt, hsa; identical to SEQ ID NO: 42049

SEQ ID NO: 137534 - RNA, 64 nt, hsa; identical to SEQ ID NO: 42050

SEQ ID NO: 137535 - RNA, 64 nt, hsa; identical to SEQ ID NO: 42051

SEQ ID NO: 137536 - RNA, 64 nt, hsa; identical to SEQ ID NO: 42052

SEQ ID NO: 137537 - RNA, 64 nt, hsa; identical to SEQ ID NO: 42053

SEQ ID NO: 137538 - RNA, 64 nt, hsa; identical to SEQ ID NO: 42054

SEQ ID NO: 137539 - RNA, 64 nt, hsa; identical to SEQ ID NO: 42055

SEQ ID NO: 137540 - RNA, 64 nt, hsa; identical to SEQ ID NO: 42056

SEQ ID NO: 137541 - RNA, 64 nt, hsa; identical to SEQ ID NO: 42057

SEQ ID NO: 137542 - RNA, 64 nt, hsa; identical to SEQ ID NO: 42058

SEQ ID NO: 137543 - RNA, 64 nt, hsa; identical to SEQ ID NO: 42059

SEQ ID NO: 137544 - RNA, 64 nt, hsa; identical to SEQ ID NO: 42060

SEQ ID NO: 137545 - RNA, 64 nt, hsa; identical to SEQ ID NO: 42061

SEQ ID NO: 137546 - RNA, 64 nt, hsa; identical to SEQ ID NO: 42062

SEQ ID NO: 137547 - RNA, 64 nt, hsa; identical to SEQ ID NO: 42063

SEQ ID NO: 137548 - RNA, 64 nt, hsa; identical to SEQ ID NO: 42064

SEQ ID NO: 137549 - RNA, 64 nt, hsa; identical to SEQ ID NO: 42065

SEQ ID NO: 137550 - RNA, 64 nt, hsa; identical to SEQ ID NO: 42066

SEQ ID NO: 137551 - RNA, 64 nt, hsa; identical to SEQ ID NO: 42067

SEQ ID NO: 137552 - RNA, 64 nt, hsa; identical to SEQ ID NO: 42068

SEQ ID NO: 137553 - RNA, 64 nt, hsa; identical to SEQ ID NO: 42069

SEQ ID NO: 137554 - RNA, 64 nt, hsa; identical to SEQ ID NO: 42070

SEQ ID NO: 137555 - RNA, 64 nt, hsa; identical to SEQ ID NO: 42071

SEQ ID NO: 137556 - RNA, 64 nt, hsa; identical to SEQ ID NO: 42072

SEQ ID NO: 137557 - RNA, 64 nt, hsa; identical to SEQ ID NO: 42073

SEQ ID NO: 137558 - RNA, 64 nt, hsa; identical to SEQ ID NO: 42074

SEQ ID NO: 137559 - RNA, 64 nt, hsa; identical to SEQ ID NO: 42075

SEQ ID NO: 137560 - RNA, 64 nt, hsa; identical to SEQ ID NO: 42076

SEQ ID NO: 137561 - RNA, 64 nt, hsa; identical to SEQ ID NO: 42077

SEQ ID NO: 137562 - RNA, 64 nt, hsa; identical to SEQ ID NO: 42078

SEQ ID NO: 137563 - RNA, 64 nt, hsa; identical to SEQ ID NO: 42079

SEQ ID NO: 137564 - RNA, 64 nt, hsa; identical to SEQ ID NO: 42080

SEQ ID NO: 137565 - RNA, 64 nt, hsa; identical to SEQ ID NO: 42081

SEQ ID NO: 137566 - RNA, 64 nt, hsa; identical to SEQ ID NO: 42082

SEQ ID NO: 137567 - RNA, 64 nt, hsa; identical to SEQ ID NO: 42083

SEQ ID NO: 137568 - RNA, 64 nt, hsa; identical to SEQ ID NO: 42084

SEQ ID NO: 137569 - RNA, 64 nt, hsa; identical to SEQ ID NO: 42085

SEQ ID NO: 137570 - RNA, 64 nt, hsa; identical to SEQ ID NO: 42086

SEQ ID NO: 137571 - RNA, 64 nt, hsa; identical to SEQ ID NO: 42087

SEQ ID NO: 137572 - RNA, 64 nt, hsa; identical to SEQ ID NO: 42088

SEQ ID NO: 137573 - RNA, 64 nt, hsa; identical to SEQ ID NO: 42089

SEQ ID NO: 137574 - RNA, 64 nt, hsa; identical to SEQ ID NO: 42090

SEQ ID NO: 137575 - RNA, 64 nt, hsa; identical to SEQ ID NO: 42091

SEQ ID NO: 137576 - RNA, 64 nt, hsa; identical to SEQ ID NO: 42092

SEQ ID NO: 137577 - RNA, 64 nt, hsa; identical to SEQ ID NO: 42093

SEQ ID NO: 137578 - RNA, 64 nt, hsa; identical to SEQ ID NO: 42094

SEQ ID NO: 137579 - RNA, 64 nt, hsa; identical to SEQ ID NO: 42095

SEQ ID NO: 137580 - RNA, 64 nt, hsa; identical to SEQ ID NO: 42096

SEQ ID NO: 137581 - RNA, 64 nt, hsa; identical to SEQ ID NO: 42097

SEQ ID NO: 137582 - RNA, 64 nt, hsa; identical to SEQ ID NO: 42098

SEQ ID NO: 137583 - RNA, 64 nt, hsa; identical to SEQ ID NO: 42099

SEQ ID NO: 137584 - RNA, 64 nt, hsa; identical to SEQ ID NO: 42100

SEQ ID NO: 137585 - RNA, 64 nt, hsa; identical to SEQ ID NO: 42101

SEQ ID NO: 137586 - RNA, 64 nt, hsa; identical to SEQ ID NO: 41907

SEQ ID NO: 137587 - RNA, 64 nt, hsa; identical to SEQ ID NO: 41906

SEQ ID NO: 137588 - RNA, 64 nt, hsa; identical to SEQ ID NO: 41905

SEQ ID NO: 137589 - RNA, 64 nt, hsa; identical to SEQ ID NO: 41904

SEQ ID NO: 137590 - RNA, 64 nt, hsa; identical to SEQ ID NO: 42106

SEQ ID NO: 137591 - RNA, 64 nt, hsa; identical to SEQ ID NO: 42107

SEQ ID NO: 137592 - RNA, 64 nt, hsa; identical to SEQ ID NO: 42108

SEQ ID NO: 137593 - RNA, 64 nt, hsa; identical to SEQ ID NO: 42109

SEQ ID NO: 137594 - RNA, 64 nt, hsa; identical to SEQ ID NO: 42110

SEQ ID NO: 137595 - RNA, 64 nt, hsa; identical to SEQ ID NO: 42111

SEQ ID NO: 137596 - RNA, 64 nt, hsa; identical to SEQ ID NO: 42112

SEQ ID NO: 137597 - RNA, 64 nt, hsa; identical to SEQ ID NO: 42113

SEQ ID NO: 137598 - RNA, 64 nt, hsa; identical to SEQ ID NO: 42114

SEQ ID NO: 137599 - RNA, 64 nt, hsa; identical to SEQ ID NO: 42115

SEQ ID NO: 137600 - RNA, 64 nt, hsa; identical to SEQ ID NO: 42116

SEQ ID NO: 137601 - RNA, 64 nt, hsa; identical to SEQ ID NO: 42117

SEQ ID NO: 137602 - RNA, 64 nt, hsa; identical to SEQ ID NO: 42118

SEQ ID NO: 137603 - RNA, 64 nt, hsa; identical to SEQ ID NO: 42119

SEQ ID NO: 137604 - RNA, 64 nt, hsa; identical to SEQ ID NO: 42120

SEQ ID NO: 137605 - RNA, 64 nt, hsa; identical to SEQ ID NO: 42121

SEQ ID NO: 137606 - RNA, 64 nt, hsa; identical to SEQ ID NO: 42122

SEQ ID NO: 137607 - RNA, 64 nt, hsa; identical to SEQ ID NO: 42123

SEQ ID NO: 137608 - RNA, 64 nt, hsa; identical to SEQ ID NO: 42124

SEQ ID NO: 137609 - RNA, 64 nt, hsa; identical to SEQ ID NO: 42125

SEQ ID NO: 137610 - RNA, 64 nt, hsa; identical to SEQ ID NO: 42126

SEQ ID NO: 137611 - RNA, 64 nt, hsa; identical to SEQ ID NO: 42127

SEQ ID NO: 137612 - RNA, 64 nt, hsa; identical to SEQ ID NO: 42128

SEQ ID NO: 137613 - RNA, 64 nt, hsa; identical to SEQ ID NO: 42129

SEQ ID NO: 137614 - RNA, 64 nt, hsa; identical to SEQ ID NO: 42130

SEQ ID NO: 137615 - RNA, 64 nt, hsa; identical to SEQ ID NO: 42131

SEQ ID NO: 137616 - RNA, 64 nt, hsa; identical to SEQ ID NO: 42132

SEQ ID NO: 137617 - RNA, 64 nt, hsa; identical to SEQ ID NO: 42133

SEQ ID NO: 137618 - RNA, 64 nt, hsa; identical to SEQ ID NO: 42134

SEQ ID NO: 137619 - RNA, 64 nt, hsa; identical to SEQ ID NO: 42135

SEQ ID NO: 137620 - RNA, 64 nt, hsa; identical to SEQ ID NO: 42136

SEQ ID NO: 137621 - RNA, 64 nt, hsa; identical to SEQ ID NO: 42137

SEQ ID NO: 137622 - RNA, 64 nt, hsa; identical to SEQ ID NO: 42138

SEQ ID NO: 137623 - RNA, 64 nt, hsa; identical to SEQ ID NO: 42139

SEQ ID NO: 137624 - RNA, 64 nt, hsa; identical to SEQ ID NO: 42140

SEQ ID NO: 137625 - RNA, 64 nt, hsa; identical to SEQ ID NO: 42141

SEQ ID NO: 137626 - RNA, 64 nt, hsa; identical to SEQ ID NO: 42142

SEQ ID NO: 137627 - RNA, 64 nt, hsa; identical to SEQ ID NO: 42143

SEQ ID NO: 137628 - RNA, 64 nt, hsa; identical to SEQ ID NO: 42144

SEQ ID NO: 137629 - RNA, 64 nt, hsa; identical to SEQ ID NO: 42145

SEQ ID NO: 137630 - RNA, 64 nt, hsa; identical to SEQ ID NO: 42146

SEQ ID NO: 137631 - RNA, 64 nt, hsa; identical to SEQ ID NO: 42147

SEQ ID NO: 137632 - RNA, 64 nt, hsa; identical to SEQ ID NO: 42148

SEQ ID NO: 137633 - RNA, 64 nt, hsa; identical to SEQ ID NO: 42149

SEQ ID NO: 137634 - RNA, 64 nt, hsa; identical to SEQ ID NO: 42150

SEQ ID NO: 137635 - RNA, 64 nt, hsa; identical to SEQ ID NO: 42151

SEQ ID NO: 137636 - RNA, 64 nt, hsa; identical to SEQ ID NO: 42152

SEQ ID NO: 137637 - RNA, 64 nt, hsa; identical to SEQ ID NO: 42153

SEQ ID NO: 137638 - RNA, 64 nt, hsa; identical to SEQ ID NO: 42154

SEQ ID NO: 137639 - RNA, 64 nt, hsa; identical to SEQ ID NO: 42155

SEQ ID NO: 137640 - RNA, 64 nt, hsa; identical to SEQ ID NO: 42156

SEQ ID NO: 137641 - RNA, 64 nt, hsa; identical to SEQ ID NO: 42157

SEQ ID NO: 137642 - RNA, 64 nt, hsa; identical to SEQ ID NO: 42158

SEQ ID NO: 137643 - RNA, 64 nt, hsa; identical to SEQ ID NO: 42159

SEQ ID NO: 137644 - RNA, 64 nt, hsa; identical to SEQ ID NO: 42160

SEQ ID NO: 137645 - RNA, 64 nt, hsa; identical to SEQ ID NO: 42161

SEQ ID NO: 137646 - RNA, 64 nt, hsa; identical to SEQ ID NO: 42162

SEQ ID NO: 137647 - RNA, 64 nt, hsa; identical to SEQ ID NO: 42163

SEQ ID NO: 137648 - RNA, 64 nt, hsa; identical to SEQ ID NO: 42164

SEQ ID NO: 137649 - RNA, 64 nt, hsa; identical to SEQ ID NO: 42165

SEQ ID NO: 137650 - RNA, 64 nt, hsa; identical to SEQ ID NO: 42166

SEQ ID NO: 137651 - RNA, 64 nt, hsa; identical to SEQ ID NO: 42167

SEQ ID NO: 137652 - RNA, 64 nt, hsa; identical to SEQ ID NO: 42168

SEQ ID NO: 137653 - RNA, 64 nt, hsa; identical to SEQ ID NO: 42169

SEQ ID NO: 137654 - RNA, 64 nt, hsa; identical to SEQ ID NO: 42170

SEQ ID NO: 137655 - RNA, 64 nt, hsa; identical to SEQ ID NO: 42171

SEQ ID NO: 137656 - RNA, 64 nt, hsa; identical to SEQ ID NO: 42172

SEQ ID NO: 137657 - RNA, 64 nt, hsa; identical to SEQ ID NO: 42173

SEQ ID NO: 137658 - RNA, 64 nt, hsa; identical to SEQ ID NO: 42174

SEQ ID NO: 137659 - RNA, 64 nt, hsa; identical to SEQ ID NO: 42175

SEQ ID NO: 137660 - RNA, 64 nt, hsa; identical to SEQ ID NO: 42176

SEQ ID NO: 137661 - RNA, 64 nt, hsa; identical to SEQ ID NO: 42177

SEQ ID NO: 137662 - RNA, 64 nt, hsa; identical to SEQ ID NO: 42178

SEQ ID NO: 137663 - RNA, 64 nt, hsa; identical to SEQ ID NO: 42179

SEQ ID NO: 137664 - RNA, 64 nt, hsa; identical to SEQ ID NO: 42180

SEQ ID NO: 137665 - RNA, 64 nt, hsa; identical to SEQ ID NO: 42181

SEQ ID NO: 137666 - RNA, 64 nt, hsa; identical to SEQ ID NO: 42182

SEQ ID NO: 137667 - RNA, 64 nt, hsa; identical to SEQ ID NO: 42183

SEQ ID NO: 137668 - RNA, 64 nt, hsa; identical to SEQ ID NO: 42184

SEQ ID NO: 137669 - RNA, 64 nt, hsa; identical to SEQ ID NO: 42185

SEQ ID NO: 137670 - RNA, 64 nt, hsa; identical to SEQ ID NO: 42186

SEQ ID NO: 137671 - RNA, 64 nt, hsa; identical to SEQ ID NO: 42187

SEQ ID NO: 137672 - RNA, 64 nt, hsa; identical to SEQ ID NO: 42188

SEQ ID NO: 137673 - RNA, 64 nt, hsa; identical to SEQ ID NO: 42189

SEQ ID NO: 137674 - RNA, 64 nt, hsa; identical to SEQ ID NO: 42190

SEQ ID NO: 137675 - RNA, 64 nt, hsa; identical to SEQ ID NO: 42191

SEQ ID NO: 137676 - RNA, 64 nt, hsa; identical to SEQ ID NO: 42192

SEQ ID NO: 137677 - RNA, 64 nt, hsa; identical to SEQ ID NO: 42193

SEQ ID NO: 137678 - RNA, 64 nt, hsa; identical to SEQ ID NO: 42194

SEQ ID NO: 137679 - RNA, 64 nt, hsa; identical to SEQ ID NO: 42195

SEQ ID NO: 137680 - RNA, 64 nt, hsa; identical to SEQ ID NO: 42196

SEQ ID NO: 137681 - RNA, 64 nt, hsa; identical to SEQ ID NO: 42197

SEQ ID NO: 137682 - RNA, 64 nt, hsa; identical to SEQ ID NO: 42198

SEQ ID NO: 137683 - RNA, 64 nt, hsa; identical to SEQ ID NO: 42199

SEQ ID NO: 137684 - RNA, 64 nt, hsa; identical to SEQ ID NO: 42200

SEQ ID NO: 137685 - RNA, 64 nt, hsa; identical to SEQ ID NO: 42201

SEQ ID NO: 137686 - RNA, 64 nt, hsa; identical to SEQ ID NO: 42202

SEQ ID NO: 137687 - RNA, 64 nt, hsa; identical to SEQ ID NO: 42203

SEQ ID NO: 137688 - RNA, 64 nt, hsa; identical to SEQ ID NO: 42204

SEQ ID NO: 137689 - RNA, 64 nt, hsa; identical to SEQ ID NO: 42205

SEQ ID NO: 137690 - RNA, 64 nt, hsa; identical to SEQ ID NO: 42206

SEQ ID NO: 137691 - RNA, 64 nt, hsa; identical to SEQ ID NO: 42207

SEQ ID NO: 137692 - RNA, 64 nt, hsa; identical to SEQ ID NO: 42208

SEQ ID NO: 137693 - RNA, 64 nt, hsa; identical to SEQ ID NO: 42209

SEQ ID NO: 137694 - RNA, 64 nt, hsa; identical to SEQ ID NO: 42210

SEQ ID NO: 137695 - RNA, 64 nt, hsa; identical to SEQ ID NO: 42211

SEQ ID NO: 137696 - RNA, 64 nt, hsa; identical to SEQ ID NO: 42212

SEQ ID NO: 137697 - RNA, 64 nt, hsa; identical to SEQ ID NO: 42213

SEQ ID NO: 137698 - RNA, 64 nt, hsa; identical to SEQ ID NO: 42214

SEQ ID NO: 137699 - RNA, 64 nt, hsa; identical to SEQ ID NO: 42215

SEQ ID NO: 137700 - RNA, 64 nt, hsa; identical to SEQ ID NO: 42216

SEQ ID NO: 137701 - RNA, 64 nt, hsa; identical to SEQ ID NO: 42217

SEQ ID NO: 137702 - RNA, 64 nt, hsa; identical to SEQ ID NO: 42218

SEQ ID NO: 137703 - RNA, 64 nt, hsa; identical to SEQ ID NO: 42219

SEQ ID NO: 137704 - RNA, 64 nt, hsa; identical to SEQ ID NO: 42220

SEQ ID NO: 137705 - RNA, 64 nt, hsa; identical to SEQ ID NO: 42221

SEQ ID NO: 137706 - RNA, 64 nt, hsa; identical to SEQ ID NO: 42222

SEQ ID NO: 137707 - RNA, 64 nt, hsa; identical to SEQ ID NO: 42223

SEQ ID NO: 137708 - RNA, 64 nt, hsa; identical to SEQ ID NO: 42224

SEQ ID NO: 137709 - RNA, 64 nt, hsa; identical to SEQ ID NO: 42225

SEQ ID NO: 137710 - RNA, 64 nt, hsa; identical to SEQ ID NO: 42226

SEQ ID NO: 137711 - RNA, 64 nt, hsa; identical to SEQ ID NO: 42227

SEQ ID NO: 137712 - RNA, 64 nt, hsa; identical to SEQ ID NO: 42228

SEQ ID NO: 137713 - RNA, 64 nt, hsa; identical to SEQ ID NO: 42229

SEQ ID NO: 137714 - RNA, 64 nt, hsa; identical to SEQ ID NO: 42230

SEQ ID NO: 137715 - RNA, 64 nt, hsa; identical to SEQ ID NO: 42231

SEQ ID NO: 137716 - RNA, 64 nt, hsa; identical to SEQ ID NO: 42232

SEQ ID NO: 137717 - RNA, 64 nt, hsa; identical to SEQ ID NO: 42233

SEQ ID NO: 137718 - RNA, 64 nt, hsa; identical to SEQ ID NO: 42234

SEQ ID NO: 137719 - RNA, 64 nt, hsa; identical to SEQ ID NO: 42235

SEQ ID NO: 137720 - RNA, 64 nt, hsa
gguucaguagaggccccgguuucccaguuguugacugugacaggcucagcaugggcucagcaga

SEQ ID NO: 137721 - RNA, 64 nt, hsa
caguggcuggucaagcuuuucucacauggcaucacugugacacuggcccucccacuucccucuu

SEQ ID NO: 137722 - RNA, 64 nt, hsa
auucuaauaaacaaggacuauugcugauaguaggcugugacauacugucuugugaaaugguuuc

SEQ ID NO: 137723 - RNA, 64 nt, hsa
uguugggagcauuuccaggcaucuuuuaagggaacugugacaaacagccucgggcagaugaaca

SEQ ID NO: 137724 - RNA, 64 nt, hsa
gaagauguuuguguaucuguuuacauccagaguucugugacacaugccccccagauugcugcaa

SEQ ID NO: 137725 - RNA, 64 nt, hsa
augcguuucauguagccagcagaacugaagugugcugugacaagccaaugugaauuucuaccaa

SEQ ID NO: 137726 - RNA, 64 nt, hsa
ucugccaggccucgagcauccaagcaugauuuugcugugacaaaucuaaaaucaaccaggcuac

SEQ ID NO: 137727 - RNA, 64 nt, hsa
gccaggccccaagcaucugagcaugaugauuuugcugugacaauucuaagaucaaccagguuac

SEQ ID NO: 137728 - RNA, 64 nt, hsa
aaugagaaugucgcuuuagcugaaauucaaauggcugugacaauuuaccgaaaugaugaaguaa

SEQ ID NO: 137729 - RNA, 64 nt, hsa
ucucuccugcuccucuucggaguagaaauaaaggcugugacacaaggaagccagugggguggga

SEQ ID NO: 137730 - RNA, 64 nt, hsa
uuuuacagcuuagacuuuguacuuacugcccugccugugacaguuguaugccuucauuuuguau

SEQ ID NO: 137731 - RNA, 64 nt, hsa
ugacccgacuccacuccaggaaggccaucugacccugugacaggcauagcucauaaacuacccc

SEQ ID NO: 137732 - RNA, 64 nt, hsa
aggcauuaaauaaaaccgaggguuguugauuuugcugugacaguacacuaaaucaauacuauau

SEQ ID NO: 137733 - RNA, 64 nt, hsa
uaugagacucgaugauaacaguaugguacugcuucugugacaaauaucgugccuuaacaaugug

SEQ ID NO: 137734 - RNA, 64 nt, hsa
gggucuccauccuccaugggggcucagccaggugcugugacaccccccuucugaaugaagccuu

SEQ ID NO: 137735 - RNA, 64 nt, hsa
ccaugagacagucccagaacacggcagcugcuggcugugacaaugguuucaccauccuuagacc

SEQ ID NO: 137736 - RNA, 64 nt, hsa
cuuccggggggagccuguccucagaggggacaaccugugacacccugaguccaaacccuugugc

SEQ ID NO: 137737 - RNA, 64 nt, hsa
cagcccagguaggggcaggauggagggcugagcccugugacaaccugcuguuaccaacugaaga

SEQ ID NO: 137738 - RNA, 64 nt, hsa
agcagcaucuguuuuuuguugcguguuuccauuuuaaagugaguugaguucucaaauuggaaag

SEQ ID NO: 137739 - RNA, 64 nt, hsa
gugguuugaaauuaccucuuucauauguuuuaaauaaagugaaauuuauguauguuuuguacau

SEQ ID NO: 137740 - RNA, 64 nt, hsa
guuaauuuuauguccuuuuuuuccuaaagugaauuaaagugaaucauggaagcagcauuacuuu

SEQ ID NO: 137741 - RNA, 64 nt, hsa
uggaauuuuuguuaauuuuauguccuuuuuuuccuaaagugaauuaaagugaaucauggaagca

SEQ ID NO: 137742 - RNA, 64 nt, hsa
uucaaauauuguuuaauggaaugaugagccugcauaaagugaagcugcaauguaacauagguau

SEQ ID NO: 137743 - RNA, 64 nt, hsa
uuccucuggucauuucagacucucaucucucuauuaaagugaauauucuguagaucagaugaau

SEQ ID NO: 137744 - RNA, 64 nt, hsa
auuaugaauuugaaguuaagugauagcucacuuguaaagugacuaccuuaauguguauagagac

SEQ ID NO: 137745 - RNA, 64 nt, hsa
uuaauauaucaugcaguaaaaggaagaaucuuuuuaaagugacccaccuuucaugcugcuccag

SEQ ID NO: 137746 - RNA, 64 nt, hsa
uuugucaagagaucuuucagaaaauauaagccuuuaaagugaagaagaggagccaguugugcug

SEQ ID NO: 137747 - RNA, 64 nt, hsa
guaagagaaaaccauuuuuaaucuuaguuaaaauuaaagugaauuaguaguauaucauuuuacu

SEQ ID NO: 137748 - RNA, 64 nt, hsa
agaaguccauauacugaagagcguuugauuaaaauaaagugacuauuaaccagaaaagaaacau

SEQ ID NO: 137749 - RNA, 64 nt, hsa
uauaacaaccguguuuuauuugugaaaaaaauauuaaagugauuugcucucaaauaucaaauuu

SEQ ID NO: 137750 - RNA, 64 nt, hsa
cuacaauaaaaggcugcggcagcgccuuucuucuuaaagugaggaggacaaauuugcaaaagaa

SEQ ID NO: 137751 - RNA, 64 nt, hsa
aaaggaaagagaaaaauuaaguuagggcagucaguaaagugagcuuuagaaagaaacuggaauu

SEQ ID NO: 137752 - RNA, 64 nt, hsa
aauagugugacaacgaugaaaaugcuugguuauguaaagugauuggaaauguaauggauaauug

SEQ ID NO: 137753 - RNA, 64 nt, hsa
uuuuuaaaagcuggaagauuguacagcauaaagcuaaagugaaggcaaaaaacauuguccugaa

SEQ ID NO: 137754 - RNA, 64 nt, hsa
cucuguuauauauugugaaauuuauuuuauauaguaaagugauuaugucuaacugugaucaaac

SEQ ID NO: 137755 - RNA, 64 nt, hsa
gacuugcuuacaucuagauuauccagcacaaucauaaagugaaugacaaacccuuugaaugaaa

SEQ ID NO: 137756 - RNA, 64 nt, hsa
gagauuuagauaaacuacauuuuaacugaaugucuaaagugauuaucuuuuuuccccccaaguu

SEQ ID NO: 137757 - RNA, 64 nt, hsa
gccuuuagucguggguuacauaugcuugagcuuuuaaagugauguugucaaguuucuagcuuca

SEQ ID NO: 137758 - RNA, 64 nt, hsa
ggcucaaugaauaguagcuguuuuuauuucuauguaaagugaguagcgguaguugaugggagcu

SEQ ID NO: 137759 - RNA, 64 nt, hsa
aaaauagauguuacaguucuuaaaggcagugcuuuaaagugaaguucauucuguuuccaaaggc

SEQ ID NO: 137760 - RNA, 64 nt, hsa
uuaaaugguuaaucauggccuuuuaaaaauaaaauaaagugauaccuuuacaaugaagacaaaa

SEQ ID NO: 137761 - RNA, 64 nt, hsa
ugaucaacagcaaaauagaguucugaauuucuuuuaaagugaugauauauuauuuugugaaacu

SEQ ID NO: 137762 - RNA, 64 nt, hsa
gguaagagaauuuauuuacuaaaugcacuauguauaaagugaaagauaguuuacuuaucugacu

SEQ ID NO: 137763 - RNA, 64 nt, hsa
uuagagcuucagugagaauuuagaaaaauuauacuaaagugagaugcauuuuuucucauuuuca

SEQ ID NO: 137764 - RNA, 64 nt, hsa
guugcagcccaccacaauaaagcaaauauugcuauaaagugagucacaaaaaugguuuuguuuc

SEQ ID NO: 137765 - RNA, 64 nt, hsa
ugauuuguacaaaaaucacuugacgucauaaccuuaaagugacacugcucugccuauggaguag

SEQ ID NO: 137766 - RNA, 64 nt, hsa
guaguugaaacuuaaacuauuuaaugucauuuaauaaagugaccaaaauguguugugcucuuua

SEQ ID NO: 137767 - RNA, 64 nt, hsa
augaaauacuuuuguacuuaauccauuucuugauuaaagugauugaaaugguuuuaauguucuu

SEQ ID NO: 137768 - RNA, 64 nt, hsa; identical to SEQ ID NO: 120916

SEQ ID NO: 137769 - RNA, 64 nt, hsa; identical to SEQ ID NO: 120917

SEQ ID NO: 137770 - RNA, 64 nt, hsa; identical to SEQ ID NO: 120918

SEQ ID NO: 137771 - RNA, 64 nt, hsa; identical to SEQ ID NO: 120919

SEQ ID NO: 137772 - RNA, 64 nt, hsa; identical to SEQ ID NO: 120920

SEQ ID NO: 137773 - RNA, 64 nt, hsa; identical to SEQ ID NO: 120921

SEQ ID NO: 137774 - RNA, 64 nt, hsa; identical to SEQ ID NO: 120922

SEQ ID NO: 137775 - RNA, 64 nt, hsa; identical to SEQ ID NO: 120923

SEQ ID NO: 137776 - RNA, 64 nt, hsa; identical to SEQ ID NO: 120924

SEQ ID NO: 137777 - RNA, 64 nt, hsa; identical to SEQ ID NO: 120925

SEQ ID NO: 137778 - RNA, 60 nt, hsa
uguaggaacuaucuaacuggcauuuguguuucuugcgaguauuuugaagaaacaggccgu

SEQ ID NO: 137779 - RNA, 60 nt, hsa
ccccaagccuccugggaggauccagccaaaucuugcgacuccuggcacacaccugucugu

SEQ ID NO: 137780 - RNA, 60 nt, hsa
uuuuaaaugaacugauugauauauguuauuucuugcgagguuuuccucuggccuuuaacu

SEQ ID NO: 137781 - RNA, 60 nt, hsa
agugagaauaugcgguguuugguuuuuuguucuugcgauaguuuacugagaaugaugguu

SEQ ID NO: 137782 - RNA, 60 nt, hsa
augucuuuuauucaaagcugagucaguggcucuugcgaaugccccauagcagaagucccg

SEQ ID NO: 137783 - RNA, 60 nt, hsa
cccgcuacaauucugcagaaaaagaaugugucuugcgagcuguuguaguuacaguaaaua

SEQ ID NO: 137784 - RNA, 60 nt, hsa
ugcaaaggaagcaguagagugacuuaaacaucuugcgaggcagccugccugguuuauggg

SEQ ID NO: 137785 - RNA, 60 nt, hsa
agugagaauaugcaguguuugguuuuuuguucuugcgauaguuuacugagaaugaugauu

SEQ ID NO: 137786 - RNA, 60 nt, hsa
aggaacagaaguuccaacuauugccugggaucuugcgaaaagcgagguucccugaucccu

SEQ ID NO: 137787 - RNA, 60 nt, hsa
acgcccuaagcgcacauucaugugggcauuucuugcgagccucgcagccuccggaagcug

SEQ ID NO: 137788 - RNA, 60 nt, hsa
guccccgaugucgcuggggccccuacccccucuugcgaagacggugacuuuuuuuccaau

SEQ ID NO: 137789 - RNA, 60 nt, hsa
uuccucaguccuuugaagagaaguacagucucuugcgauuuuguauauaucguguucgac

SEQ ID NO: 137790 - RNA, 60 nt, hsa
gaguauauuuccgcacuucagaauuccauaucuugcgaauccaagcucccugccccaaau

SEQ ID NO: 137791 - RNA, 60 nt, hsa
cgccccagcgccggagcacggucagggucuucuugcgacccggcccgcuccagaucccca

SEQ ID NO: 137792 - RNA, 60 nt, hsa
guaccgaugcagcucucuuucucccccaccucuugcgagauaagagggaucauucaugua

SEQ ID NO: 137793 - RNA, 60 nt, hsa
aaagaaaaacaaggaaggggaaaagaaaacucuugcgauuugggaggguucaguguugag

SEQ ID NO: 137794 - RNA, 60 nt, hsa
gaacuucgagccagaaaggggcaugagggcucuugcgagacugaagugcuaucuucucug

SEQ ID NO: 137795 - RNA, 60 nt, hsa
ugcucucuccuaaggcucucauucagccuaucuugcgaggcccgggcagcuggaaagucc

SEQ ID NO: 137796 - RNA, 60 nt, hsa
ucuauuugaacuguuuuauuuuccugugagucuugcgagguggaaguaaugauuaaauac

SEQ ID NO: 137797 - RNA, 60 nt, hsa
aauuccuuagguucucaggguuagaaacagucuugcgagguaggcccuccucccagucac

SEQ ID NO: 137798 - RNA, 60 nt, hsa
ccuccuccuccuccuccucugguagagcacucuugcgaugcugacacugccaaccuccag

SEQ ID NO: 137799 - RNA, 60 nt, hsa
gggacucuaccuuccagauucagucccuagucuugcgaugaauucugcauuguucggugu

SEQ ID NO: 137800 - RNA, 60 nt, hsa
gccaggccccggccccgucugggaagcucaucuugcgaagcugagggagcucagggcaaa

SEQ ID NO: 137801 - RNA, 60 nt, hsa
aucagacaccagucaagcagccucaggucaucuugcgacuccacugagcagccuuuccug

SEQ ID NO: 137802 - RNA, 60 nt, hsa
aacuacagaaauuuaaaaaugccauaacaaucuugcgagacuaacuuuaaaauauacuuu

SEQ ID NO: 137803 - RNA, 60 nt, hsa
uucaauaugagucucaauaaacugaauuuuucuugcgaauguugaauacgucuuauuuuu

SEQ ID NO: 137804 - RNA, 60 nt, hsa
cuucuguucacggcggauucuuuguuuuaaucuugcgaugugcuuugcuuguugcugggc

SEQ ID NO: 137805 - RNA, 64 nt, hsa
cuguuaauggcgaaagaauggaagcgaauaaaguuuuacugauuuuugagacacuagcaccuag

SEQ ID NO: 137806 - RNA, 64 nt, hsa
cuuagaucacugcagcuucuaggacccgguuucuuuuacugauuuaaaaacaaaacaaaaaaaa

SEQ ID NO: 137807 - RNA, 64 nt, hsa
gaacaggcaucccuguugccccugccugcccagauuuacugaccccauuugucgacauggcccc

SEQ ID NO: 137808 - RNA, 64 nt, hsa
cugcagacucuuccagauuuuucugcccaaggccuuuacugagcucaggacuccagcuaaauca

SEQ ID NO: 137809 - RNA, 64 nt, hsa
gagaugcuuucuaauauaagacugauguguugauuuuacugauuguacuguacaucuauuaaag

SEQ ID NO: 137810 - RNA, 64 nt, hsa
ugaauauucguauuguuaacuaaaugauuuauauuuuacugauuuaauauuacaguguaagaau

SEQ ID NO: 137811 - RNA, 64 nt, hsa
uguacaggguggcugugguccuagaaguucaguuuuuacugaggaaauauuuccauuaacagca

SEQ ID NO: 137812 - RNA, 64 nt, hsa
agacauuacuauagcauagauugucaaauguaaauuuacugagcguguuuuauaaaaaacucac

SEQ ID NO: 137813 - RNA, 64 nt, hsa
accuaccaucugcauugagcagaaagacuuuuguuuuacugaagacaaaagauguuuuuauuuu

SEQ ID NO: 137814 - RNA, 64 nt, hsa
gaagaccagauaaugaaacugaaaagcaaacaauuuuacugaaucugucuacccuucauucaug

SEQ ID NO: 137815 - RNA, 64 nt, hsa
ugccccggucuagucccauuugaaacaguucugcuuuacugagacccuaggccggucuccuugc

SEQ ID NO: 137816 - RNA, 64 nt, hsa
caacuuguacugcgccugaauagucaugugauaauuuacugaagaaaucuaguguacuuuaaau

SEQ ID NO: 137817 - RNA, 64 nt, hsa
gaaaaggucuguucucuaguuuuguccaguucaguuuacugaaggaauauauuuaauuauauuc

SEQ ID NO: 137818 - RNA, 64 nt, hsa
uuguauauuuuaugccaugacuaaaagugccauuuuuacugaugcuauuagacugauaauuucu

SEQ ID NO: 137819 - RNA, 64 nt, hsa
gcauaaaaugguuuacuguguucauuugaacccauuuacugaucucuguuguauauuuuucaug

SEQ ID NO: 137820 - RNA, 64 nt, hsa
ugcagugagccaccgcggcaggcacguugacuguuuuacugacaucacucaaaagcuaaagcaa

SEQ ID NO: 137821 - RNA, 64 nt, hsa
aggcucccagcugaauuucacucacaggacacaguuuacugaucucuguucuagugaguggguc

SEQ ID NO: 137822 - RNA, 64 nt, hsa
uuguuuauuuuuuaauucuuuuguuuaccgaacguuuacugagcaucuacccugugccagcccu

SEQ ID NO: 137823 - RNA, 64 nt, hsa
cuggagcuagaagcacuugugauucuuguuuuaauuuacugauggcuucagggguuaacaguag

SEQ ID NO: 137824 - RNA, 64 nt, hsa
uuucaucuaaguaaagcucaguucuuuaucacaauuuacugaccaaauaccuagcaccaguucc

SEQ ID NO: 137825 - RNA, 64 nt, hsa
ucuuaucaauuaccuaaaucucaacgaaaaacaauuuacugaagccgacuccccuccccaucuc

SEQ ID NO: 137826 - RNA, 64 nt, hsa
auggugguggccuggugauggggaccgucuuucuuuuacugacacaugaccaaucauaugguau

SEQ ID NO: 137827 - RNA, 64 nt, hsa
aaaguguuuucagguaucuuuguagcgguuucccuuuacugaauaagaugacacguggugauug

SEQ ID NO: 137828 - RNA, 64 nt, hsa
aaaagaaauugacaaagaaauauuucaucuggccuuuacugacuccuguuaaaugcaguuuuaa

SEQ ID NO: 137829 - RNA, 64 nt, hsa
uuaagugccugacacaguagguauucaauaaaaauuuacugaauuaaaggauuaaauuagguga

SEQ ID NO: 137830 - RNA, 64 nt, hsa
uauuuuauaucucaauaucuuuaauauaaaucuuuuuacugagagaucauuauagaaacauguu

SEQ ID NO: 137831 - RNA, 64 nt, hsa
cuuuucacauaugauguguuuggaacccaaauuuuuuacugauuuuauuguguuguugguaacu

SEQ ID NO: 137832 - RNA, 64 nt, hsa
ccauuuauaaaguacugagagaaugauauuggauuuugcugaacaggccuaucuugaacuuugg

SEQ ID NO: 137833 - RNA, 64 nt, hsa
uuauuuuugacagaauacucuuuucaaaauggcauuugcugauuucauaaaccuuucacgucug

SEQ ID NO: 137834 - RNA, 64 nt, hsa
ucuuuauuucagagaugugggcuuucagugggaauuugcugacuccuacuuuauaggcugaguc

SEQ ID NO: 137835 - RNA, 64 nt, hsa
gguaugcagguggccugggcugcucggcagauacuuugcugauucccagcugaggggagcaugg

SEQ ID NO: 137836 - RNA, 64 nt, hsa
aauaagcuuuaacuuaauuugggggauuaacacuuuugcugagggagaaaaagaaaacauacau

SEQ ID NO: 137837 - RNA, 64 nt, hsa
ucuuauugugaggaaucuguuaaaaguuuaaagcuuugcugaaaacugaauucauucucaggaa

SEQ ID NO: 137838 - RNA, 64 nt, hsa
guucugucuagaggauacaacugaauguuuuuaauuugcugacuuacagacacaggcuguuuac

SEQ ID NO: 137839 - RNA, 64 nt, hsa
uguuccauuacuacgcaaacacauauuagaggccuuugcugaugacacauuagcuggaucuuag

SEQ ID NO: 137840 - RNA, 64 nt, hsa
uuugauggaaggguccauacauuuuuuuuuuuuuuuugcugauguugcuaucuagauguuucuc

SEQ ID NO: 137841 - RNA, 64 nt, hsa
aggcgugagccacugcaccuggccuguaacaugauuugcugaaauuuuuaaaaaucuuaaauaa

SEQ ID NO: 137842 - RNA, 64 nt, hsa
aaagauuuuuguguuugaauauaggagaaaucaguuugcugaaaaguuagucuuaauuaucuau

SEQ ID NO: 137843 - RNA, 64 nt, hsa
cucuccauuucucuuuccccuuccaccugccaguuuugcugacucucaacuugucaugagugua

SEQ ID NO: 137844 - RNA, 64 nt, hsa
aauauaaggaucagugcuuuguucugcagcagaguuugcugauaaaugucuguuggauucuuuu

SEQ ID NO: 137845 - RNA, 64 nt, hsa
uuuaauuagcaguagauggugcuacuggcuuucauuugcugacuugauuauucccuuucucuua

SEQ ID NO: 137846 - RNA, 64 nt, hsa
ucacuuuaggauauauucacauuguuuuggugaauuugcugaauugaauuguuuuucuuucuca

SEQ ID NO: 137847 - RNA, 64 nt, hsa
uccugguuaaaauggaugauuuuucauugaaaguuuugcugauuaacaauuaaagugggaugau

SEQ ID NO: 137848 - RNA, 64 nt, hsa
augaauucuuaacaagaagacucaucuguagcuguuugcugacuccuaugagcccauaaggguu

SEQ ID NO: 137849 - RNA, 64 nt, hsa
auucaauuggugauuuggguagaaagcaguauguuuugcugacauuaagauguagguuauagau

SEQ ID NO: 137850 - RNA, 64 nt, hsa
uuggguuuuuuuuuuaguugccaacaguuguauguuugcugauuauuuaugaccugaaauaaua

SEQ ID NO: 137851 - RNA, 64 nt, hsa
uaagcaguuauggugaugacuuagcgucaagacauuugcugaacucagcacauucgggaccaau

SEQ ID NO: 137852 - RNA, 64 nt, hsa
acaggccauucgacgccuucuccaaggggucugauuugcugagacaccagcuucaccuucuuaa

SEQ ID NO: 137853 - RNA, 64 nt, hsa
auguacguuacaugauuuuccuacacucuguaauuuugcugaggugcaauuuggaacucugcaa

SEQ ID NO: 137854 - RNA, 64 nt, hsa
ugacugagcauugcucagaucacuguggccacacuuugcugaaagagaugcugggacauagaac

SEQ ID NO: 137855 - RNA, 64 nt, hsa
acaacugguuugauaguuacuauuuucugaccuguuugcugaagugauuugcgaauugacuuuc

SEQ ID NO: 137856 - RNA, 64 nt, hsa
auuuuacuuuuuugauauaaaaucaagauauuucuuugcugaaguauuuaaaucuuauccuugu

SEQ ID NO: 137857 - RNA, 64 nt, hsa
uuuuguagaauucauuucggcagcucacuaggauuuugcugaacauuaaaaagugugauagcga

SEQ ID NO: 137858 - RNA, 64 nt, hsa
ugugagcaaaugcuaauacaguaaauauauuguguuugcugacaaucagccggccuauaaaucu

SEQ ID NO: 137859 - RNA, 64 nt, hsa
ugaaggguaaaaucuuucuuugcagagacaguauuuugcugaauacuuuuuauaaugugaugau

SEQ ID NO: 137860 - RNA, 64 nt, hsa
uauccaaauggcauucacgugucacuuagcaagguuugcugaugcuucaaagagcuuaguuugc

SEQ ID NO: 137861 - RNA, 64 nt, hsa
uucuauucuagucuuuuuuuauugaguccuccucuuugcugaucccuuccaaggguucaauaua

SEQ ID NO: 137862 - RNA, 64 nt, hsa
cagacaaagcuuguacaaauuccugaaccgcaaauuugcugaagugaccguauauauuauauuc

SEQ ID NO: 137863 - RNA, 64 nt, hsa
aaggcaaaauagagguggaaacagaaggaagucauuugcugagucugcagaauggaaugcagcu

SEQ ID NO: 137864 - RNA, 64 nt, hsa
cacuauggggaagcaguugccccacaaaaugugguuugcugaccuauuucuaaacuguugaaua

SEQ ID NO: 137865 - RNA, 64 nt, hsa
uucccuuuccucagugaugugaaaauaauuguguuuugcugaacuuguuaucuucauucaauuu

SEQ ID NO: 137866 - RNA, 64 nt, hsa
uaguuuggggaaaggaggaggagagcccuucagguuugcugaaaagcauucagaugcacacccu

SEQ ID NO: 137867 - RNA, 64 nt, hsa
gggcggcggagucccugagccuugagcuccgcuuuuugcugagaucacagcagccgcccacaga

SEQ ID NO: 137868 - RNA, 64 nt, hsa
uucuagcuuaucuacuuccaaacuaauuuuuauuuuugcugagacuaaucuuauucauuuucuc

SEQ ID NO: 137869 - RNA, 64 nt, hsa
aauuuguuuaaaaaguaauaaaauucaacaaacauuugcugaauagcuacuauaugucaagugc

SEQ ID NO: 137870 - RNA, 64 nt, hsa
auuauaacugccuuuaauuaacauaauauuaacuuuugcugagguuuaugagauuuucucaccc

SEQ ID NO: 137871 - RNA, 64 nt, hsa
agucuuuacugacaggagcagcagcuaucugucuuuugcugaucuacaaauaaaugaauugaga

SEQ ID NO: 137872 - RNA, 64 nt, hsa
gggcuucugagcugaugcaggccccaaggaccccuuugcugaccucugccaggacccacacagc

SEQ ID NO: 137873 - RNA, 64 nt, hsa
guuggugggcaccaauauuccaagggcagcucucuuugcugaaugagggccuucucgugaggua

SEQ ID NO: 137874 - RNA, 64 nt, hsa
cuuuuaauggugggaauuuacaguagaagcauccuuugcugaguuauacauuccuuuaucaauc

SEQ ID NO: 137875 - RNA, 64 nt, hsa
acagcaggauuaugaauuaucaaaggaaaaaguauuugcugaggugaaaaaaucugauguuuga

SEQ ID NO: 137876 - RNA, 64 nt, hsa
uaagugcagaguucauuuuugccccugaaaaguuuuugcugaguuugcugaagaaauuguauuu

SEQ ID NO: 137877 - RNA, 64 nt, hsa
aguucauuuuugccccugaaaaguuuuugcugaguuugcugaagaaauuguauuucaaccacau

SEQ ID NO: 137878 - RNA, 64 nt, hsa
ccaggccuggcacgucaaagaggcuccagaaauguuugcugagugagugaugaaucagcaauuu

SEQ ID NO: 137879 - RNA, 64 nt, hsa
gucuguguuucuuuuugccagcuauugacuaaucuuugcugaagcugagcuagaauucuggugu

SEQ ID NO: 137880 - RNA, 64 nt, hsa
uuucagaaagaaagacccuucaguuuugaugcauuuugcugaacacuuggguagugagugggau

SEQ ID NO: 137881 - RNA, 64 nt, hsa
ugcuuuaucuuugguaacuuuuacuugaaugggauuugcugaauuaaugacuauugaauuuaaa

SEQ ID NO: 137882 - RNA, 64 nt, hsa
gggauauuuccaguaccuacuuuuuuuuuuuuuuuuugcugaauccaaagauauauaaauaaaa

SEQ ID NO: 137883 - RNA, 64 nt, hsa
aaaugacuuaugggggauggugagcugugacugcuuugcugaccauuuuggaugucauuguaaa

SEQ ID NO: 137884 - RNA, 64 nt, hsa
gacagguggggagcagcugacaggcauuagggucuuugcugacaucuacuaaccuugaagaguu

SEQ ID NO: 137885 - RNA, 64 nt, hsa
uaaggaaggagggauuuaaaccuuuuaaaaaacuuuugcugacuuauauuacuguaaagauuug

SEQ ID NO: 137886 - RNA, 64 nt, hsa
ucaguguggagagcaaaaaagcugacuguggugauuugcugagugcuguggcccacaggcaggg

SEQ ID NO: 137887 - RNA, 64 nt, hsa
aauacacuuuucccucacuacgacugcuucuuuauuugcugauaaaucuuaaaacaacuaagua

SEQ ID NO: 137888 - RNA, 64 nt, hsa
cuccagcgucugccauaggaaugugagagggguguuugcugagcgcuccgggcacggccagagg

SEQ ID NO: 137889 - RNA, 64 nt, hsa
agcaaugugaacucucagcgcugguccugguggguuugcugaccaugacugggcaagccguucu

SEQ ID NO: 137890 - RNA, 64 nt, hsa
cuccugggucccggccaccuguccauauuccacauuugcugacugugcucccugcacuccacuc

SEQ ID NO: 137891 - RNA, 64 nt, hsa
guaaauaaacaucuaugccuuuucucagaaaugauuugcugaacuauguccauauuuuacagcu

SEQ ID NO: 137892 - RNA, 64 nt, hsa
aagacacauguauacaaggcacuauuguacacacuuugcugaauauuuugucaguuguauuuac

SEQ ID NO: 137893 - RNA, 64 nt, hsa
uugugugauaccggccccccgccagacaauagccuuugcugacaccccagccuacuuccccgau

SEQ ID NO: 137894 - RNA, 64 nt, hsa
agucaggcuggaaucuugggccaccccaaagugcuuugcugaaggauuuagacggggaugaagu

SEQ ID NO: 137895 - RNA, 64 nt, hsa
cuuguuuguuuauuuugguuacauugaauacagauuugcugaacaguuuugauguuauuuuuuu

SEQ ID NO: 137896 - RNA, 64 nt, hsa
uuuuccaucacuucuuugucccagauucaugaaauuugcugauguccauuuuaugucuacuuuu

SEQ ID NO: 137897 - RNA, 64 nt, hsa; identical to SEQ ID NO: 88257

SEQ ID NO: 137898 - RNA, 64 nt, hsa; identical to SEQ ID NO: 88258

SEQ ID NO: 137899 - RNA, 64 nt, hsa; identical to SEQ ID NO: 88259

SEQ ID NO: 137900 - RNA, 64 nt, hsa; identical to SEQ ID NO: 88260

SEQ ID NO: 137901 - RNA, 64 nt, hsa; identical to SEQ ID NO: 88261

SEQ ID NO: 137902 - RNA, 64 nt, hsa; identical to SEQ ID NO: 88262

SEQ ID NO: 137903 - RNA, 64 nt, hsa; identical to SEQ ID NO: 88263

SEQ ID NO: 137904 - RNA, 64 nt, hsa; identical to SEQ ID NO: 88264

SEQ ID NO: 137905 - RNA, 64 nt, hsa; identical to SEQ ID NO: 88265

SEQ ID NO: 137906 - RNA, 64 nt, hsa; identical to SEQ ID NO: 88266

SEQ ID NO: 137907 - RNA, 64 nt, hsa; identical to SEQ ID NO: 88267

SEQ ID NO: 137908 - RNA, 64 nt, hsa; identical to SEQ ID NO: 88268

SEQ ID NO: 137909 - RNA, 64 nt, hsa; identical to SEQ ID NO: 88269

SEQ ID NO: 137910 - RNA, 64 nt, hsa; identical to SEQ ID NO: 88270

SEQ ID NO: 137911 - RNA, 64 nt, hsa; identical to SEQ ID NO: 88271

SEQ ID NO: 137912 - RNA, 64 nt, hsa; identical to SEQ ID NO: 88269

SEQ ID NO: 137913 - RNA, 64 nt, hsa; identical to SEQ ID NO: 88273

SEQ ID NO: 137914 - RNA, 64 nt, hsa; identical to SEQ ID NO: 88274

SEQ ID NO: 137915 - RNA, 64 nt, hsa; identical to SEQ ID NO: 88275

SEQ ID NO: 137916 - RNA, 64 nt, hsa; identical to SEQ ID NO: 88276

SEQ ID NO: 137917 - RNA, 64 nt, hsa; identical to SEQ ID NO: 88277

SEQ ID NO: 137918 - RNA, 64 nt, hsa; identical to SEQ ID NO: 88278

SEQ ID NO: 137919 - RNA, 64 nt, hsa; identical to SEQ ID NO: 88279

SEQ ID NO: 137920 - RNA, 64 nt, hsa; identical to SEQ ID NO: 88280

SEQ ID NO: 137921 - RNA, 64 nt, hsa; identical to SEQ ID NO: 88281

SEQ ID NO: 137922 - RNA, 64 nt, hsa; identical to SEQ ID NO: 88282

SEQ ID NO: 137923 - RNA, 64 nt, hsa; identical to SEQ ID NO: 88283

SEQ ID NO: 137924 - RNA, 64 nt, hsa; identical to SEQ ID NO: 88284

SEQ ID NO: 137925 - RNA, 64 nt, hsa; identical to SEQ ID NO: 88285

SEQ ID NO: 137926 - RNA, 64 nt, hsa; identical to SEQ ID NO: 88286

SEQ ID NO: 137927 - RNA, 64 nt, hsa; identical to SEQ ID NO: 88287

SEQ ID NO: 137928 - RNA, 64 nt, hsa; identical to SEQ ID NO: 88288

SEQ ID NO: 137929 - RNA, 64 nt, hsa; identical to SEQ ID NO: 88289

SEQ ID NO: 137930 - RNA, 64 nt, hsa; identical to SEQ ID NO: 88290

SEQ ID NO: 137931 - RNA, 64 nt, hsa; identical to SEQ ID NO: 88291

SEQ ID NO: 137932 - RNA, 64 nt, hsa; identical to SEQ ID NO: 88292

SEQ ID NO: 137933 - RNA, 64 nt, hsa; identical to SEQ ID NO: 88293

SEQ ID NO: 137934 - RNA, 64 nt, hsa; identical to SEQ ID NO: 88294

SEQ ID NO: 137935 - RNA, 64 nt, hsa; identical to SEQ ID NO: 88295

SEQ ID NO: 137936 - RNA, 64 nt, hsa; identical to SEQ ID NO: 88296

SEQ ID NO: 137937 - RNA, 64 nt, hsa; identical to SEQ ID NO: 88297

SEQ ID NO: 137938 - RNA, 64 nt, hsa; identical to SEQ ID NO: 88298

SEQ ID NO: 137939 - RNA, 64 nt, hsa; identical to SEQ ID NO: 88299

SEQ ID NO: 137940 - RNA, 64 nt, hsa; identical to SEQ ID NO: 88300

SEQ ID NO: 137941 - RNA, 64 nt, hsa; identical to SEQ ID NO: 88298

SEQ ID NO: 137942 - RNA, 64 nt, hsa; identical to SEQ ID NO: 88302

SEQ ID NO: 137943 - RNA, 64 nt, hsa; identical to SEQ ID NO: 88300

SEQ ID NO: 137944 - RNA, 64 nt, hsa; identical to SEQ ID NO: 88304

SEQ ID NO: 137945 - RNA, 64 nt, hsa; identical to SEQ ID NO: 88305

SEQ ID NO: 137946 - RNA, 64 nt, hsa; identical to SEQ ID NO: 88306

SEQ ID NO: 137947 - RNA, 64 nt, hsa; identical to SEQ ID NO: 88307

SEQ ID NO: 137948 - RNA, 64 nt, hsa; identical to SEQ ID NO: 88299

SEQ ID NO: 137949 - RNA, 64 nt, hsa; identical to SEQ ID NO: 88309

SEQ ID NO: 137950 - RNA, 64 nt, hsa; identical to SEQ ID NO: 88310

SEQ ID NO: 137951 - RNA, 64 nt, hsa; identical to SEQ ID NO: 88311

SEQ ID NO: 137952 - RNA, 64 nt, hsa; identical to SEQ ID NO: 88312

SEQ ID NO: 137953 - RNA, 64 nt, hsa; identical to SEQ ID NO: 88313

SEQ ID NO: 137954 - RNA, 64 nt, hsa; identical to SEQ ID NO: 88314

SEQ ID NO: 137955 - RNA, 64 nt, hsa; identical to SEQ ID NO: 88315

SEQ ID NO: 137956 - RNA, 64 nt, hsa; identical to SEQ ID NO: 88316

SEQ ID NO: 137957 - RNA, 64 nt, hsa; identical to SEQ ID NO: 88317

SEQ ID NO: 137958 - RNA, 64 nt, hsa; identical to SEQ ID NO: 88318

SEQ ID NO: 137959 - RNA, 64 nt, hsa; identical to SEQ ID NO: 88319

SEQ ID NO: 137960 - RNA, 64 nt, hsa; identical to SEQ ID NO: 88320

SEQ ID NO: 137961 - RNA, 64 nt, hsa; identical to SEQ ID NO: 88321

SEQ ID NO: 137962 - RNA, 64 nt, hsa; identical to SEQ ID NO: 88322

SEQ ID NO: 137963 - RNA, 64 nt, hsa; identical to SEQ ID NO: 88323

SEQ ID NO: 137964 - RNA, 64 nt, hsa; identical to SEQ ID NO: 88324

SEQ ID NO: 137965 - RNA, 64 nt, hsa; identical to SEQ ID NO: 88325

SEQ ID NO: 137966 - RNA, 64 nt, hsa; identical to SEQ ID NO: 88326

SEQ ID NO: 137967 - RNA, 64 nt, hsa; identical to SEQ ID NO: 88327

SEQ ID NO: 137968 - RNA, 64 nt, hsa; identical to SEQ ID NO: 88328

SEQ ID NO: 137969 - RNA, 64 nt, hsa; identical to SEQ ID NO: 88329

SEQ ID NO: 137970 - RNA, 64 nt, hsa; identical to SEQ ID NO: 88330

SEQ ID NO: 137971 - RNA, 64 nt, hsa
ugacucugagaauaacacauagugaagaucugugggcuuuuaaaauuguucacagccaauuuaa

SEQ ID NO: 137972 - RNA, 64 nt, hsa
auauuuuaauuaggggaguagauuauuguccaaaggcuuuuauuuagagaaacggguaauuaaa

SEQ ID NO: 137973 - RNA, 64 nt, hsa
aaguuuuuccaacucuucacuaccaauuaccuuaggcuuuuauaaugcuccgccuacuucaguc

SEQ ID NO: 137974 - RNA, 64 nt, hsa
ugaggaauggaagaauggaccuugaaacuaccuaggcuuuuaugcauggcaccucuuuauaaug

SEQ ID NO: 137975 - RNA, 64 nt, hsa
cuucuccccagaggaacuuagggauuucaccccuggcuuuuaaaaaaaacgaaauaccgacaag

SEQ ID NO: 137976 - RNA, 64 nt, hsa
uuuugaugccauauuuucaguguuacacuuuuauggcuuuuaauuuucgauuugacagauguaa

SEQ ID NO: 137977 - RNA, 64 nt, hsa
gcugcagugccagaggggccucuggagcaggccuggcuuuuaaauggggggcugaauuccagcu

SEQ ID NO: 137978 - RNA, 64 nt, hsa
gaauacauuucuuguaaaaccuggcuuguugcuuggcuuuuaaagaugguguauguuuguaaaa

SEQ ID NO: 137979 - RNA, 64 nt, hsa
auggauggguuuucuuguuuuguugauuauuugaggcuuuuaaaacaaguaguucaugaaagaa

SEQ ID NO: 137980 - RNA, 64 nt, hsa
gcagcauuagagccaucguucaugggggacacaaggcuuuuaugcuccuagaucuucaacgcag

SEQ ID NO: 137981 - RNA, 64 nt, hsa
cuggcaguuucuucagcuguguauauacggaucuggcuuuuaauugaugaaucaacuucuacag

SEQ ID NO: 137982 - RNA, 64 nt, hsa
aauaauguccuugauacugaguugggaccagacuggcuuuuauagugacaggcaaagaggaauu

SEQ ID NO: 137983 - RNA, 64 nt, hsa
agaaagaccuuauaaauguaagacaugugggaaaggcuuuuauucucccacgucauuucaaaga

SEQ ID NO: 137984 - RNA, 64 nt, hsa
agaaagaccuuauaaauguaagauaugugggaaaggcuuuuauucugccaagucauuucaaaua

SEQ ID NO: 137985 - RNA, 64 nt, hsa
caccucuucccaacccuuacaagcaagggugcuaggggcucagcuauacgaccauucucccuga

SEQ ID NO: 137986 - RNA, 64 nt, hsa
ucuguggcccugcaccuuaugggaagccauuaagggggcucaucuaggaauucugguuacagcc

SEQ ID NO: 137987 - RNA, 64 nt, hsa
guagcucuucacagcugaacucagucuauggguuggggcucagauaacucugugcauuuaagcu

SEQ ID NO: 137988 - RNA, 64 nt, hsa
gcaaguuaaaauguaaaagaugugauuuaucuggggggcucagguaugguggggaaguggauuc

SEQ ID NO: 137989 - RNA, 64 nt, hsa
guuuacuggggugggguggcgagaugggcuugagggggcucagagcauaaggcuucagggccca

SEQ ID NO: 137990 - RNA, 64 nt, hsa
uucaggaagggggagcacugagaagcacagcacaggggcucagccugggauccggugauggucu

SEQ ID NO: 137991 - RNA, 64 nt, hsa
cugauguuagagaggccuggggagagcagccgauggggcucagacuacauauggcaggccgauc

SEQ ID NO: 137992 - RNA, 64 nt, hsa
cccauucuucucuacccagaaccugucaugggcuggggcucagauuuuccuggcuuugggagca

SEQ ID NO: 137993 - RNA, 64 nt, hsa
accuagccugcuccucugcucucuggguuacugaggggcucaggaaggggccccucgagccuuc

SEQ ID NO: 137994 - RNA, 64 nt, hsa
ccugccccccauggcucugugcugcucacuuuagggggcucaauucuccacucugcucaguccc

SEQ ID NO: 137995 - RNA, 64 nt, hsa
agcguugugucaugccuguccacaggggauucguggggcucacuucaucagaguuugaagccca

SEQ ID NO: 137996 - RNA, 64 nt, hsa
uuuccagcuacugugcccuugggcagcugcgucuggggcucaaccccccaauccuguuccccuc

SEQ ID NO: 137997 - RNA, 64 nt, hsa
aaaaugucuuuccuuuuaugcugcgcccagucuuggggcucaaagauuugcccaaaccucauug

SEQ ID NO: 137998 - RNA, 64 nt, hsa
cgccuccagugugcaugagcgugucugaagauggggggcucagggggcacguuugcguuuggac

SEQ ID NO: 137999 - RNA, 64 nt, hsa
cggggcugcagguuguugagggcugugacuccguggggcucagccaggcuccagcagggucaga

SEQ ID NO: 138000 - RNA, 64 nt, hsa
gggacucggggcggccaguaccaccgccugaggcggggcucagcagcguugcauguacgggccu

SEQ ID NO: 138001 - RNA, 64 nt, hsa
gucccuggggggcaggggccaggccaggggggagggggcucagccccuccaccccucccuucau

SEQ ID NO: 138002 - RNA, 64 nt, hsa
acaacacuugaggccaaaggacaccccuguccccggggcucagccucccccugggccgaggccu

SEQ ID NO: 138003 - RNA, 64 nt, hsa
acaacgcugcugccugcuuugugcaggguccuccggggcucagcccugaguuggcaucaccugc

SEQ ID NO: 138004 - RNA, 64 nt, hsa
gcccugaguuggcaucaccugcgcagggcccucuggggcucagcccugagcuagugucaccugc

SEQ ID NO: 138005 - RNA, 64 nt, hsa
gcccugagcuggcgucaccugugcagggcccucuggggcucagcccugagcuggccucaccugg

SEQ ID NO: 138006 - RNA, 64 nt, hsa
uuggcccuggcuaaugucucucagucauuccccuggggcucaagcgcugggccgcccacuccug

SEQ ID NO: 138007 - RNA, 64 nt, hsa
auugaaaaagggcagggggcacuugagcugggcuggggcucagggguccuaacccuuuaggcag

SEQ ID NO: 138008 - RNA, 64 nt, hsa
cucccacccugacccccgaccccuggguggggaaggggcucacaugggcccaggcugaguguga

SEQ ID NO: 138009 - RNA, 64 nt, hsa
cagggccaggguccccuuggugaagccgugccagggggcucagcugcuucagggaauguguccc

SEQ ID NO: 138010 - RNA, 64 nt, hsa
uagccugagacaugaugcaagagcugcaggccggggggcucagugccauggaagcuacuccaag

SEQ ID NO: 138011 - RNA, 64 nt, hsa
ugcccagcaguguuggugcccagagaugacaagggccagggagccuggcccgggugugagaauu

SEQ ID NO: 138012 - RNA, 64 nt, hsa
cagccuugugggggagggcaaggcucuccucccagccagggacgccaggacauagcugcuccug

SEQ ID NO: 138013 - RNA, 64 nt, hsa
gcagaccuccugggagacccacgaaggguuuuuagccagggaaaacugagccccaggaaaaccu

SEQ ID NO: 138014 - RNA, 64 nt, hsa
gcuuucauucagggcaacaaaugauacaaauggugccagggaguggcaaggccauggggguagg

SEQ ID NO: 138015 - RNA, 64 nt, hsa
ccugcccagaaguggaugaugugggaguugacaggccagggagagggugaagcagguaucagag

SEQ ID NO: 138016 - RNA, 59 nt, hsa
gggacagcaaagagaucuagcaccauaaggccagggagcugcugccagaaugaaguagg

SEQ ID NO: 138017 - RNA, 64 nt, hsa
augucacagaugaggcugccccugccccccccccgccagggagguuucaugagcucaugucuau

SEQ ID NO: 138018 - RNA, 64 nt, hsa
cccaaccccgguggguacuggcugccugcccugggccagggaauggcuccuuauaccaaagaug

SEQ ID NO: 138019 - RNA, 64 nt, hsa
ccccacccagaccugccugucucccacccuuucugccagggauggcaguggcugugaaggagua

SEQ ID NO: 138020 - RNA, 64 nt, hsa
ggggacacuguggcagcaggagggacucugucuggccagggaggagccccaguggugagaagac

SEQ ID NO: 138021 - RNA, 64 nt, hsa
gggauggguacacuuacugcaguguugggguuuugccagggaaguaaaaggaguugagagaaag

SEQ ID NO: 138022 - RNA, 64 nt, hsa
aaauagaggguaugaccugggguugcuggccagagccagggaggagccuuaagaagugaaaucu

SEQ ID NO: 138023 - RNA, 64 nt, hsa
agugcagggagccagcuggaagggaaggagaggggccagggaggccacaggcccggccauauga

SEQ ID NO: 138024 - RNA, 64 nt, hsa
gagaaggugaaaugugagcaaagacgugaaggaagccagggagguagcagguagcucucuaggg

SEQ ID NO: 138025 - RNA, 64 nt, hsa
gauucgaagauccuagaccagggagacacugugagccagggauacaacaaaauacuagguaagu

SEQ ID NO: 138026 - RNA, 64 nt, hsa
gacaugacugcugaccuaaagaucccuggcauuggccagggauccuguggaaccucuucuaguu

SEQ ID NO: 138027 - RNA, 64 nt, hsa
gggaggacacgcuccacugaccacccagagcugggccagggacucaacaauggggacagaaguc

SEQ ID NO: 138028 - RNA, 64 nt, hsa
acacggacacgcucugcugaccacccagagcugggccagggaggacacgcuccacugaccaccc

SEQ ID NO: 138029 - RNA, 64 nt, hsa
gaccugagcugcugugaaagccccugcacaaucagccagggagaacugggcggguuuaguggcc

SEQ ID NO: 138030 - RNA, 64 nt, hsa
gcugcaggccaaggccaaaauugggcuaguccuggccagggaaaucagaagcucuucuugggug

SEQ ID NO: 138031 - RNA, 64 nt, hsa
gcugcccuccccucacaguuccugcaccucagcagccagggaagcagggcccagaggagaccca

SEQ ID NO: 138032 - RNA, 64 nt, hsa
ccgggagguaauugggggugaggaagaugugcgggccagggaauguguuccacagagagggaca

SEQ ID NO: 138033 - RNA, 64 nt, hsa
ccaggacccccgcaccugcccucuggcaccagaugccagggaagggacagaggaaaacagccac

SEQ ID NO: 138034 - RNA, 64 nt, hsa
ccugccauagggaggggaggacccugagggcucagccagggaggggucccaggacucaacuggg

SEQ ID NO: 138035 - RNA, 64 nt, hsa
aaguaggugaugccagcccucaagucugucuucagccagggacuugagaaguuauauugggcag

SEQ ID NO: 138036 - RNA, 64 nt, hsa
uccuauguaucagguuaagagcaagggagagcuggccagggacagcaguuugcacagcagaggg

SEQ ID NO: 138037 - RNA, 64 nt, hsa
acuuuccugagcugucgcugccuccauggcagcagccagggacccccagaacaagaagaccccg

SEQ ID NO: 138038 - RNA, 64 nt, hsa
ugaccauaauccuagccccgagacaccauccugagccagggaacagccccaggguuggggggug

SEQ ID NO: 138039 - RNA, 64 nt, hsa
aaacucugguacgaaucucaucccucaacugagggccagggacccaggugugccugugcuccug

SEQ ID NO: 138040 - RNA, 64 nt, hsa
uugacauuuccauuacacacagcacugcugcggugccagggaccuagcgcaggacuuuugguaa

SEQ ID NO: 138041 - RNA, 64 nt, hsa
ucucuccaccgccucaguguagggaaggguccaggccagggaaggagcacccucuaguggaggc

SEQ ID NO: 138042 - RNA, 64 nt, hsa
aaccuccagucacugcgcccggcaggagucaggagccagggacugugcagccuggaaccuccag

SEQ ID NO: 138043 - RNA, 64 nt, hsa
ugcuggggccuccuuguuggugcuguaggcacccgccagggagcagggacccgacuugcagacg

SEQ ID NO: 138044 - RNA, 64 nt, hsa
agggacucacuggagggcaccaagccagcccacagccagggaaguggggagggggggcggaaac

SEQ ID NO: 138045 - RNA, 64 nt, hsa
gggacacuucgggaaugcugaacuaaugagaacugccagggaaucuucaaacuuuccaacggaa

SEQ ID NO: 138046 - RNA, 64 nt, hsa
gcucugaucagcgcaggggccagccagggacauagccagggaggggccacaucacuucccacug

SEQ ID NO: 138047 - RNA, 64 nt, hsa
ccacuuucuguggcucugaucagcgcaggggccagccagggacauagccagggaggggccacau

SEQ ID NO: 138048 - RNA, 64 nt, hsa
augggcugcagcagaggcacugggggcagcgggggccagggaaguccccgaguuuccccagaca

SEQ ID NO: 138049 - RNA, 64 nt, hsa
gguuugagauggacacacugguguggauuaaccugccagggagacagagcucacaauaaaaaug

SEQ ID NO: 138050 - RNA, 64 nt, hsa
ccuugucgccuucacuucuacaggaggggaaggggccagggaggggauucucccuuuaucauca

SEQ ID NO: 138051 - RNA, 64 nt, hsa
gguauaggggaguccagaggugaugccugccucagccagggagggcuuccuggaggagaaggag

SEQ ID NO: 138052 - RNA, 64 nt, hsa
ugcguuuuaggcacagcaaauggcacauacaagggccagggagcaagagagaggacagguccuc

SEQ ID NO: 138053 - RNA, 64 nt, hsa
caugggugaagucuagauggggaggagaagugaggccagggacagucuugccagacgacucuga

SEQ ID NO: 138054 - RNA, 64 nt, hsa
agggcaccucauggaccaggggcugguggcccaggccagggagggaacccugggcagggcucug

SEQ ID NO: 138055 - RNA, 64 nt, hsa
caauucccuguuccuucaggcuaugaauggaccagccagggaaacucucgaccuugaucucuag

SEQ ID NO: 138056 - RNA, 64 nt, hsa
gagggaaccaacauuugcuaagucucuacuguaugccagggaucaugcuuggcacuuuccauag

SEQ ID NO: 138057 - RNA, 64 nt, hsa
uaggugcacggugcaaggcccugggagggcacuggccagggaaggugguauagauggcccucag

SEQ ID NO: 138058 - RNA, 64 nt, hsa
caaguccacugcccggaagucuugucagcccuaagccagggaagccuggagcguggccuggcgg

SEQ ID NO: 138059 - RNA, 64 nt, hsa
aauuacugcuugguacgcagagcaccgaggccgagccagggaugaagcugaaauggaauaucug

SEQ ID NO: 138060 - RNA, 64 nt, hsa
cgauucuuuggaaguucagcagaugaaagcccaggccagggaggagaaggcuagaaagcaggug

SEQ ID NO: 138061 - RNA, 64 nt, hsa
gguacccacccgcuguucuccaugcaaacaaagcgccagggaaaugacccacagggaucgcagc

SEQ ID NO: 138062 - RNA, 64 nt, hsa
gaaaugacccacagggaucgcagcugcagggagggccagggagguugggggugggagugaaugc

SEQ ID NO: 138063 - RNA, 64 nt, hsa
gccauggagacuccaccuggauccccuguaggaggccagggaggggaacucagcaguucaggag

SEQ ID NO: 138064 - RNA, 64 nt, hsa
accaggugcgggggcagagggugacuuaccaagagccagggagggcagcccaggcccaagugac

SEQ ID NO: 138065 - RNA, 64 nt, hsa
ggagaguacauugaaggccuggaauuagcuuggggccagggaagggacugggaggggagagaag

SEQ ID NO: 138066 - RNA, 64 nt, hsa
uggggggggauguggaucagguuuacuagcaccugccagggaggccaucuggggcuccuucucc

SEQ ID NO: 138067 - RNA, 64 nt, hsa
uaagaaacuuccuguacauaaauucaagaaaggagaugaguaugauguaugugccauuuguuug

SEQ ID NO: 138068 - RNA, 64 nt, hsa
aggagaugaguaugauguaugugccauuuguuuggaugaguaugaagauggagacaaacucaga

SEQ ID NO: 138069 - RNA, 64 nt, hsa; identical to SEQ ID NO: 72083

SEQ ID NO: 138070 - RNA, 64 nt, hsa; identical to SEQ ID NO: 72084

SEQ ID NO: 138071 - RNA, 64 nt, hsa; identical to SEQ ID NO: 72085

SEQ ID NO: 138072 - RNA, 64 nt, hsa; identical to SEQ ID NO: 72086

SEQ ID NO: 138073 - RNA, 64 nt, hsa; identical to SEQ ID NO: 72087

SEQ ID NO: 138074 - RNA, 64 nt, hsa; identical to SEQ ID NO: 72088

SEQ ID NO: 138075 - RNA, 64 nt, hsa; identical to SEQ ID NO: 72089

SEQ ID NO: 138076 - RNA, 64 nt, hsa; identical to SEQ ID NO: 72090

SEQ ID NO: 138077 - RNA, 64 nt, hsa; identical to SEQ ID NO: 72091

SEQ ID NO: 138078 - RNA, 64 nt, hsa; identical to SEQ ID NO: 72092

SEQ ID NO: 138079 - RNA, 64 nt, hsa; identical to SEQ ID NO: 72093

SEQ ID NO: 138080 - RNA, 64 nt, hsa; identical to SEQ ID NO: 72094

SEQ ID NO: 138081 - RNA, 64 nt, hsa; identical to SEQ ID NO: 72095

SEQ ID NO: 138082 - RNA, 64 nt, hsa; identical to SEQ ID NO: 72096

SEQ ID NO: 138083 - RNA, 64 nt, hsa; identical to SEQ ID NO: 72097

SEQ ID NO: 138084 - RNA, 64 nt, hsa; identical to SEQ ID NO: 72098

SEQ ID NO: 138085 - RNA, 64 nt, hsa; identical to SEQ ID NO: 72099

SEQ ID NO: 138086 - RNA, 64 nt, hsa; identical to SEQ ID NO: 72100

SEQ ID NO: 138087 - RNA, 64 nt, hsa; identical to SEQ ID NO: 72101

SEQ ID NO: 138088 - RNA, 64 nt, hsa; identical to SEQ ID NO: 72102

SEQ ID NO: 138089 - RNA, 64 nt, hsa; identical to SEQ ID NO: 72103

SEQ ID NO: 138090 - RNA, 64 nt, hsa; identical to SEQ ID NO: 72104

SEQ ID NO: 138091 - RNA, 64 nt, hsa; identical to SEQ ID NO: 72105

SEQ ID NO: 138092 - RNA, 64 nt, hsa; identical to SEQ ID NO: 72106

SEQ ID NO: 138093 - RNA, 64 nt, hsa; identical to SEQ ID NO: 72107

SEQ ID NO: 138094 - RNA, 64 nt, hsa; identical to SEQ ID NO: 72108

SEQ ID NO: 138095 - RNA, 64 nt, hsa; identical to SEQ ID NO: 72109

SEQ ID NO: 138096 - RNA, 64 nt, hsa
ugcagugagcugagaucgcaccacugcacuccagccugguuacagagcaagacucugucucaaa

SEQ ID NO: 138097 - RNA, 64 nt, hsa
aaauagggacucugaagaugucgaaaucuuuauuccugguuaggaaggugggccgcuacccuuc

SEQ ID NO: 138098 - RNA, 64 nt, hsa
aaucauggagggaaaacauuguuaccucggaucuccugguuacccagcacauaguaguacugga

SEQ ID NO: 138099 - RNA, 64 nt, hsa
guuaaccagaggggcuuccuuuguauguuacaugccugguuacaugggccuggacagcaugucc

SEQ ID NO: 138100 - RNA, 64 nt, hsa
aauucuguuaugcaauuuauucuugaugcucaggccugguuaagcugaggcuuaccuuuaauaa

SEQ ID NO: 138101 - RNA, 64 nt, hsa
uaggcgugaauguaaaugccuuaauauugaagguccugguuagaagcaugauacaagacaucua

SEQ ID NO: 138102 - RNA, 64 nt, hsa
ucgcaacucuaagauuuuuuuaaaccacaaaaacccugguuagccaucucaugcucagccuuau

SEQ ID NO: 138103 - RNA, 64 nt, hsa
cuguugagcccaucaauaaaacuauugcaccuguccugguuagcaagaaacugaacgucacaga

SEQ ID NO: 138104 - RNA, 64 nt, hsa
aacaaacuggucuccaggcugucuugccuuuauuccugguuagggcaggugguccuagacagca

SEQ ID NO: 138105 - RNA, 64 nt, hsa
cagguguguggaggccguggucggacccugguguccugguuacugcugcccgggugucuuuuuu

SEQ ID NO: 138106 - RNA, 64 nt, hsa
cucccaggccucgccagggcucccuucuccucugccugguuagacucgggcacccaggaaagcc

SEQ ID NO: 138107 - RNA, 64 nt, hsa
ccuacacauaccgccacugcuggccucacaagccccugguuacugguaaguacacacacccaca

SEQ ID NO: 138108 - RNA, 64 nt, hsa
uaaaacagagauuccucagaaaguucuucagggaccugguuauuagaaucaggauaaaaauaag

SEQ ID NO: 138109 - RNA, 64 nt, hsa
cuuuuuagagaagagggcauuuagacugcauuuuccugguuaaagaagguuaaagcaaauguuu

SEQ ID NO: 138110 - RNA, 64 nt, hsa
acccuguguccuccaccaugcacucaccccuagcccugguuagcugacagucagcuguggggaa

SEQ ID NO: 138111 - RNA, 64 nt, hsa
agauuaagagcagaaauugaaguuuuaacagauuccugguuaggaacugcauuaaaguccuuac

SEQ ID NO: 138112 - RNA, 64 nt, hsa
ccuugccuuccuuccucccacuucuuucuccaggccugguuaacucuuccguugucagcuucuc

SEQ ID NO: 138113 - RNA, 64 nt, hsa
uauauuguacaauguuaaacuucaauuccuguaaccugguuaguauuaaugucagugacuaaaa

SEQ ID NO: 138114 - RNA, 64 nt, hsa
uauguuccuaacaaaaugagaugauaggauagauccugguuaccacucuuuugcugugcacaua

SEQ ID NO: 138115 - RNA, 64 nt, hsa
acuccccacaccuaagaccagauucuuauaucucccugguuacagugcaauuuggagauuuuuu

SEQ ID NO: 138116 - RNA, 64 nt, hsa
ugaaaugaaucuuguuuuuuuuuauaaguagccgccugguuacuguguccuguaaaauacagac

SEQ ID NO: 138117 - RNA, 64 nt, hsa
agagaaccaaauagccugaggaagcaggagaguuccugguuauggcaguuucuuggugauuugg

SEQ ID NO: 138118 - RNA, 64 nt, hsa
uguuaagugcaguagggcuuccccucuugacuuuccugguuauagcuuuccaucacagcucccc

SEQ ID NO: 138119 - RNA, 64 nt, hsa
ucagagacuuuagcauugggggcagauaucuuggccugguuaugggguaggacacccagauuuu

SEQ ID NO: 138120 - RNA, 64 nt, hsa
ucacuuccuuaaagacucuucugaacuaguuggaccugguuaaucauagagaguagccuuuaau

SEQ ID NO: 138121 - RNA, 64 nt, hsa
uaauugucacuugguucuguuuggcagugaugcuccugguuaacugaauaaucaguggcaauuu

SEQ ID NO: 138122 - RNA, 64 nt, hsa
guacauuugaaugccagaauuucuaaauaaauccccugguuaggaaauuuuaaaagucaaagcu

SEQ ID NO: 138123 - RNA, 64 nt, hsa
auuaaaguuacacacuaguauguuggucuggugaccugguuacauuuuauuauacacauuauug

SEQ ID NO: 138124 - RNA, 64 nt, hsa
ggguccauguggcaaguagggccacagggcagcaccugguuacaacuugcugguggguuuuaug

SEQ ID NO: 138125 - RNA, 64 nt, hsa
ggucauuaaauauaucauauguuaggcacagugaccugguuauuuucacauguuacuucauuuu

SEQ ID NO: 138126 - RNA, 64 nt, hsa
uuuuugagagaagcaucuuuuuauuucccauauuccugguuauuuucaucauugcuuugaauug

SEQ ID NO: 138127 - RNA, 64 nt, hsa
caaaaucacugcaguagauguuauuuggccaucuccugguuauauacaaaugugacccgugaua

SEQ ID NO: 138128 - RNA, 64 nt, hsa
gcuguuccccaucugguacuaaugaccuacuagcccugguuauuuugaaaguguaauuccccuc

SEQ ID NO: 138129 - RNA, 64 nt, hsa
ccguggagucgagcuggccgacggaccccuuucaccugguuaugagccgacuucuuugguguuc

SEQ ID NO: 138130 - RNA, 64 nt, hsa
uuggcaucagcauuaccucuuucuuuaucuuuuuccugguuaauuguuuucugaguuuuuuggg

SEQ ID NO: 138131 - RNA, 64 nt, hsa
aggucccagaaaugaccagaacgccuacuucugcccugguuaauuuagcccuaacucucaucug

SEQ ID NO: 138132 - RNA, 64 nt, hsa
ccagggaauggucccauacaguuaucuccccugcccugguuacagacagcuucgagaaccagag

SEQ ID NO: 138133 - RNA, 64 nt, hsa
cugcugcaaaaaagaaguaugucaguuauaauaaccugguuaucuaaccuguuccauuccaugg

SEQ ID NO: 138134 - RNA, 64 nt, hsa
ucugcacucuuuaaaccuguuuaaggcucuucauccugguuagcaaaaggugugaauguaaugu

SEQ ID NO: 138135 - RNA, 64 nt, hsa
uugcauggcaaagacccagucaaaaugauuuaccccugguuaaguuucugaagacuuuguacau

SEQ ID NO: 138136 - RNA, 64 nt, hsa
uucugguaauaauucuugcauuuuuuccccauaaccugguuaaaauaaauacgccauuggcaau

SEQ ID NO: 138137 - RNA, 64 nt, hsa
uuucaugcuuuuuaucaguguccucgcuguccuuccugguuagacacuuggcuuucaucaugaa

SEQ ID NO: 138138 - RNA, 64 nt, hsa
agcuuucuccugagcuccagucccugcuggauucccugguuaauucagcuugagcugaaaagcu

SEQ ID NO: 138139 - RNA, 64 nt, hsa
ugcccaaccaaguauguuccuccugaauuccucuccugguuacuucaucacaaucuacauaggc

SEQ ID NO: 138140 - RNA, 64 nt, hsa
aaggacagguaguugagaugaaacacuucaaaacccugguuauagauguacuguuuggauguag

SEQ ID NO: 138141 - RNA, 64 nt, hsa
gcguuuagaguugggauauacauuuaaacauuuuccugguuaagguucccaagagaguguaaag

SEQ ID NO: 138142 - RNA, 64 nt, hsa
ugauugaaaaguaaacaaaacccacauuuccuauccugguuagaagaaaauuaauguucugaca

SEQ ID NO: 138143 - RNA, 64 nt, hsa
gagacacacacagcacuucaguagcauuugcauuccugguuaaagaaucaccaauauuuaaaau

SEQ ID NO: 138144 - RNA, 64 nt, hsa
uuucagagcuaaagugacaagccacauccacgucccugguuaaaggugcucccccugcaggaaa

SEQ ID NO: 138145 - RNA, 64 nt, hsa
ccuguagauguugugauaugcaaauaucccauucccugguuacuggcauuccuaagauucuuca

SEQ ID NO: 138146 - RNA, 64 nt, hsa
aauagcauauaaaugguucuugacauuuuaaaagccugguuaugaucaguugacacuuugagua

SEQ ID NO: 138147 - RNA, 64 nt, hsa
uuccuaauaauggcauggguagggaacagauacaccugguuagaaggucuaggguucuguauau

SEQ ID NO: 138148 - RNA, 64 nt, hsa
ugcagcuacagcugcuucauucccugcauuagugccugguuacuggguaccuccugaguggcug

SEQ ID NO: 138149 - RNA, 64 nt, hsa
ucuguuguaggguugccagaugcaauacaagauuccugguuaaauuugaauuucaguaaacaau

SEQ ID NO: 138150 - RNA, 64 nt, hsa
cgccaucaaacuuaugggcagggauaacagugugccugguuaauauuaauauucccauuuuauu

SEQ ID NO: 138151 - RNA, 64 nt, hsa
cagaaugauuuuccaacuagcaaauauaaguaugccugguuaagauaucuucccuuuguagaaa

SEQ ID NO: 138152 - RNA, 64 nt, hsa
cacccagauuuauacuuagagucagacgaagucgccugguuaaagaugcucugcgucaauuaag

SEQ ID NO: 138153 - RNA, 64 nt, hsa
cucagagcugggacuacaggcgugcaccaccacgccugguuaauuguuuuuuuuuaauuuaucu

SEQ ID NO: 138154 - RNA, 64 nt, hsa
cugguuauguggaagauucuuaguggauguuccgccugguuagcugguucucuucagagaauau

SEQ ID NO: 138155 - RNA, 64 nt, hsa
ucacauuauaaagggaaggacagucuucauuccuccugguuauugguuuguuugucauuaaaga

SEQ ID NO: 138156 - RNA, 61 nt, hsa
ucagaauacuaucugauugaaugugaaccugccugguuaauuuauuaccugauuugaugaa

SEQ ID NO: 138157 - RNA, 64 nt, hsa
ggaaggaaggcaggcccuuccuauccacagugaaccugguuacgaagaaaacucaccaaucauc

SEQ ID NO: 138158 - RNA, 64 nt, hsa
aaaaaaaaauacaccuucaguuuccuggugugauccugguuaaaauggaugauuuuucauugaa

SEQ ID NO: 138159 - RNA, 64 nt, hsa
gaccagaacccaaguacugguacuugcuuuguguccugguuacuauguauguugccagcuagug

SEQ ID NO: 138160 - RNA, 64 nt, hsa
cgugcauuaaaauggaguucuuauuauagaauaaccugguuaaacagauauuaaagcugcuuuu

SEQ ID NO: 138161 - RNA, 64 nt, hsa
uuggacaucacaugugaaugcaugauaugaagagccugguuacaguuucuacuguucucugcaa

SEQ ID NO: 138162 - RNA, 64 nt, hsa
auguuaccaugguacuccuaaagcauaugccucaccugguuaaaaaagaacaaacauguuuuug

SEQ ID NO: 138163 - RNA, 64 nt, hsa
cccagguccccagugcgcccccuaguggccauagccugguuaaaguuccccagugccuccuugu

SEQ ID NO: 138164 - RNA, 64 nt, hsa
aaaagagaggaacccaguugaauaggauccaaucccugguuagccucuacacaauaauagggag

SEQ ID NO: 138165 - RNA, 64 nt, hsa
cugaaaauaauaguagcucuggcuuggugcuugaccugguuaaauacugucuuaaagcucauac

SEQ ID NO: 138166 - RNA, 64 nt, hsa
uggggauugcgugaagccacaaguuugagaccagccugguuagcaaggcaagauccccaacucu

SEQ ID NO: 138167 - RNA, 64 nt, hsa
ccaguuuuagaagagagagacuuuaacgccauugccugguuacuuguuuuaugcuguaaucuag

SEQ ID NO: 138168 - RNA, 64 nt, hsa
aguuugguugccagaaaaaugugcuucauuccccccugguuaauuuuuacacacccuaggaaac

SEQ ID NO: 138169 - RNA, 64 nt, hsa
ggucuuucuaugcugguuguauuuauauuaaaccccugguuaguauauacuugugucugugcug

SEQ ID NO: 138170 - RNA, 64 nt, hsa
agaaaaaaguucaucacgugacuguuaauguaaaccugguuauuaaaauaacuaugaaauuacc

SEQ ID NO: 138171 - RNA, 64 nt, hsa
accugcuuagacuuuuaugugacuuguauggucuccugguuaaagggaauggugucagaauauu

SEQ ID NO: 138172 - RNA, 64 nt, hsa
acugagagguauacaugaggcuaguguuugcauuccugguuauauguaaugugauaaauuagcu

SEQ ID NO: 138173 - RNA, 64 nt, hsa
aggugccuuccacaaucucauggucuuucaggucccugguuacuuuucucaaaggccauuucca

SEQ ID NO: 138174 - RNA, 64 nt, hsa
gaggagucuaugccauuuuaagaaaaacaauuaaccugguuaaagagaaaugucuuauguaaau

SEQ ID NO: 138175 - RNA, 64 nt, hsa
cauuuuuaaaaacuauucuuucugaacuuaucuaccugguuaugauacuguggguccauacaca

SEQ ID NO: 138176 - RNA, 64 nt, hsa
agcgcccgagaagaagaaugaaacgccuguauauccugguuaaguuucuauaaaauaagaacau

SEQ ID NO: 138177 - RNA, 64 nt, hsa
agugauuuugaccaaugccuuuccagcaccuuccccugguuaugacagggagcucccaggccag

SEQ ID NO: 138178 - RNA, 64 nt, hsa
ucuucuuuccuccaaccucuuaccuuagaugcauccugguuaucuggaagcaugggaaagaagg

SEQ ID NO: 138179 - RNA, 64 nt, hsa
ugccauuuaaacugccagaaaucuuugccaagguccugguuaaaaaaauuggaaacgguuuucu

SEQ ID NO: 138180 - RNA, 64 nt, hsa
caagguagaauuuaauuuucuggacuuuaaaucuccugguuaaauaaugcuaaucacuguacca

SEQ ID NO: 138181 - RNA, 64 nt, hsa
caagaaaaguggaucucagggaggacuagcagccccugguuaagggagaucuggcugugaguca

SEQ ID NO: 138182 - RNA, 64 nt, hsa
aguauugaaaagacaggagaaaagaaaacagaaaccugguuauaaccugacgcuaaaacuaaaa

SEQ ID NO: 138183 - RNA, 64 nt, hsa
acagcaggguuaaucuauuaucaagaacagucacccugguuaauaacaaguuuuacugaucagu

SEQ ID NO: 138184 - RNA, 64 nt, hsa
agagaaaugggguuagccauagagguuaaaacuaccugguuaucccauauaauaacacaaacug

SEQ ID NO: 138185 - RNA, 64 nt, hsa
aauccuggcugucgaggcuuugaagcauguguuaccugguuaagcuuguuuucucuugcuuuag

SEQ ID NO: 138186 - RNA, 64 nt, hsa
gcuaauaggagucugacccgagggccugcugcuuccugguuaaguaucuuuugagauucuagaa

SEQ ID NO: 138187 - RNA, 55 nt, hsa
auggcguuggaaagaaaugaaaaacccugguuaaucaaagauguuccagagugcc

SEQ ID NO: 138188 - RNA, 64 nt, hsa
caggagucugaguuuacagagccaacuugcagcaccugguuaugccuccuuucaucucaaagcc

SEQ ID NO: 138189 - RNA, 64 nt, hsa
auggccacgcaccuucucucaggccuucgggcccccugguuaaacugcaccaaggguguuuccu

SEQ ID NO: 138190 - RNA, 64 nt, hsa
uuugcuuuauacccgggccaaauagcacauaacaccugguuauauaugaaauacucauauguuu

SEQ ID NO: 138191 - RNA, 64 nt, hsa
gcuuccuaacuaaaaauacaugagugauauccaaccugguuaaaugaaugaaagaaaaggagca

SEQ ID NO: 138192 - RNA, 64 nt, hsa
cuuuucaauggagaagagacaguucacacaauucccugguuagcacagauguggacugagugcu

SEQ ID NO: 138193 - RNA, 64 nt, hsa
uaaauaagaggggcgacguugaucauagaugccaccugguuagcaccgaaucugacuuugguga

SEQ ID NO: 138194 - RNA, 64 nt, hsa
cccagcaggagcugaugccggaggcagugggugcccugguuagggcugaggaccccaagauagg

SEQ ID NO: 138195 - RNA, 64 nt, hsa
gcugcuuuuaagauagagaacccaaaguuuuguaccugguuauuuuucacuuaaguuuguagac

SEQ ID NO: 138196 - RNA, 64 nt, hsa
cacuaaaguaggugguucguguguguucucauuaccugguuaugauagauaugcacaucaaagc

SEQ ID NO: 138197 - RNA, 64 nt, hsa
aaacaugucuuauuacuaaagaaagugauuuacuccugguuaguacauucucagaggauucuga

SEQ ID NO: 138198 - RNA, 64 nt, hsa
aguauucuuguuguuuacgcauggaaucacuauuccugguuaucucaccaacgaaggcuaggag

SEQ ID NO: 138199 - RNA, 64 nt, hsa
uaaaacucugccagcccugcaguaaucuccagggccugguuauuguucagacauuccaugguga

SEQ ID NO: 138200 - RNA, 64 nt, hsa
ucccgugaaaccaguauuuggcgccauauauaagccugguuaaauuggucaucuaaagcuguca

SEQ ID NO: 138201 - RNA, 64 nt, hsa
ucguggagcuacugcccaugaugcuuuccuagugccugguuacucugcgagacuugagucuacc

SEQ ID NO: 138202 - RNA, 64 nt, hsa
uggcaggcagcccccugugcccccuaagccuggcccugguuauugcugagcucugugcucagug

SEQ ID NO: 138203 - RNA, 64 nt, hsa
acugucugggguuucugauauggggauuucagccccugguuaaucagucuugucccuacaaguc

SEQ ID NO: 138204 - RNA, 64 nt, hsa
guaucgucuuugauaauauucaacauuuucaugaccugguuauagccuuugcugguguuuuuaa

SEQ ID NO: 138205 - RNA, 64 nt, hsa
cuuuugugaagguucccccgcugagaucuuuccuccugguuacugugaagccuguugguuugcu

SEQ ID NO: 138206 - RNA, 64 nt, hsa
caucacucuaggaucaugaagugcuaugcuauuuccugguuaugaauauuaagguuggaauuac

SEQ ID NO: 138207 - RNA, 64 nt, hsa
aaguuuuguucauucaugagggccgacugcauuuccugguuacucuaucccagugaccagccac

SEQ ID NO: 138208 - RNA, 64 nt, hsa
agaaaugauggugcucugcaucagugguucagagccugguuauacauauagaucacucagggag

SEQ ID NO: 138209 - RNA, 54 nt, hsa
aguggaaacagacugucugacuucccugguuacucauguccucaaagacgacuc

SEQ ID NO: 138210 - RNA, 64 nt, hsa
ggacggaaggucaguugccaugguuaccgaggacccugguuacucuggugcuguccuguuuuac

SEQ ID NO: 138211 - RNA, 64 nt, hsa
aggcccagcccugacuuccacucuggcucagcaaccugguuauuuauguggggccgugcaggca

SEQ ID NO: 138212 - RNA, 64 nt, hsa
gcccuuguuuuguuuuauggcuagucuuaucuggccugguuauuuccuugcggggaggagaggg

SEQ ID NO: 138213 - RNA, 64 nt, hsa
aguggguacagcccaguggaggaggggguacaguccugguuagguggggacagaggauuucugc

SEQ ID NO: 138214 - RNA, 64 nt, hsa
uuccauguagacuuaccuuuccucauagagcuauccugguuaauaacaggccaagauucuccca

SEQ ID NO: 138215 - RNA, 64 nt, hsa
gcaucuuggccuacaggacagauuuuaggugacaccugguuaugacagucagaaauuugagaag

SEQ ID NO: 138216 - RNA, 64 nt, hsa
cguguucacacacacacaauggcaagcauagucgccugguuacggcccagggggaagaugccaa

SEQ ID NO: 138217 - RNA, 64 nt, hsa
acagaagcuugugggguacauggaggaauugggaccugguuauguuguuauucucggacuguga

SEQ ID NO: 138218 - RNA, 64 nt, hsa
accucuauacaggacuuagaaguaguauguuauuccugguuaagcaggcauugcuuugcccugg

SEQ ID NO: 138219 - RNA, 64 nt, hsa
aauacaauauuccagccaaccaguuaauucucuuccugguuacauucauugggucuauuugccu

SEQ ID NO: 138220 - RNA, 64 nt, hsa
guccugaccacgcaggcccuggggacucaagaccccugguuacccccacucaucuguccucucu

SEQ ID NO: 138221 - RNA, 64 nt, hsa
gcccuaguuuggcgccugcugcuccuugguuuugccugguuagacuuucagugacagauguugg

SEQ ID NO: 138222 - RNA, 64 nt, hsa
gggcucccccaggggcugucccggaggcggugggccugguuaaauaaggcaggguuuauaugca

SEQ ID NO: 138223 - RNA, 64 nt, hsa
cuucuguugcucucugugucugagagcaaagugaccugguuaaacaaaccagaaucccucuaca

SEQ ID NO: 138224 - RNA, 64 nt, hsa
ugucaugguuuggaauguucauuaucgccaagaaccugguuagaggcauaaagaccuuuuuuca

SEQ ID NO: 138225 - RNA, 64 nt, hsa
guguuuccaagucagcuuuccugcaagaagaaauccugguuaaaaaagucuuuuguauuggguc

SEQ ID NO: 138226 - RNA, 64 nt, hsa
gauuuuguuaccagcagugcuaaccugaaugugaccugguuaccuuggaaaugcaggaacuuau

SEQ ID NO: 138227 - RNA, 64 nt, hsa
ccacccccuucagugcccaccaacaucccauugcccugguuauauucucacgggcaguagcugu

SEQ ID NO: 138228 - RNA, 64 nt, hsa
cccauuaucguggggcauccuuuugccuacagccccugguuagggcacuuuggacaggucuugc

SEQ ID NO: 138229 - RNA, 64 nt, hsa
agaaauuagcuuugauggaagccugagcaagucaccugguuauuguaacguggagaucuuugua

SEQ ID NO: 138230 - RNA, 64 nt, hsa
aaauuuuaaaaguucuuccaagagacuuccauguccugguuauuaacaaaaaaggaaaaaugua

SEQ ID NO: 138231 - RNA, 64 nt, hsa
auuuauagcaggaucuugcuugccucauuuguuuccugguuauguucuuaggauucugacuaag

SEQ ID NO: 138232 - RNA, 64 nt, hsa
ugggacccaugcccccuccuuagaggacgggcuuccugguuaggaaaggacacgugggggugcc

SEQ ID NO: 138233 - RNA, 64 nt, hsa
uggggaguauucccaauguaucuuugauauuuaaccugguuaauuuguggacagucacaacaau

SEQ ID NO: 138234 - RNA, 64 nt, hsa
cccagaaacaucucuucucaggaaaggaucuuccccugguuacuuagcaagaccacaguguaga

SEQ ID NO: 138235 - RNA, 64 nt, hsa
guuguuuacagacuaacaaauguguuggcaaaucccugguuagaugcacuuccugguguugaga

SEQ ID NO: 138236 - RNA, 64 nt, hsa
aauuugacucacaguuugaagcauucugugauccccugguuacugaguuaaaaaauaaaaaagu

SEQ ID NO: 138237 - RNA, 64 nt, hsa
ggcugucggugggaccuacgguggucggugggacccugguuauugauguggcccuggcugccgg

SEQ ID NO: 138238 - RNA, 64 nt, hsa
cuggcccugagacucugugagggggcuggagcagccugguuauuuccuaucuguaccaaagagg

SEQ ID NO: 138239 - RNA, 64 nt, hsa
auguccaaagcauugacuguugugucauuagcugccugguuacauuagcucccuggcuucuugu

SEQ ID NO: 138240 - RNA, 64 nt, hsa
ugucgugggccaaccucguucugccuccagcuuuccugguuagcgcaacgcggcuccacgacca

SEQ ID NO: 138241 - RNA, 64 nt, hsa
uacaguguauguauaaagcagaaugccugccuuuccugguuauuuuuuguaccauauuguaaau

SEQ ID NO: 138242 - RNA, 64 nt, hsa
ucccugcccuggcccucuuucuucugucacuaacccugguuaucauuuuacaggcuuguaacug

SEQ ID NO: 138243 - RNA, 64 nt, hsa
aauaauaaauccagauuuccggauaagaauauugccugguuaaaauucugcauugcuuaaagac

SEQ ID NO: 138244 - RNA, 64 nt, hsa
uuuuuacaggggugccccucccaacaguucccuuccugguuaauuaaacccucagacuggugcu

SEQ ID NO: 138245 - RNA, 64 nt, hsa
cagugcaccuguagggaaccaacuagacuucucuccugguuaguccagcucuuuacucuaaacc

SEQ ID NO: 138246 - RNA, 64 nt, hsa
ucucuuguuuccgaggugcugcuuuugcaggugaccugguuacuuagcuaggauuggugauuug

SEQ ID NO: 138247 - RNA, 64 nt, hsa
cccaggcugcuguucucagggaccuuaaaagggaccugguuagucuuggggcagagaguaucua

SEQ ID NO: 138248 - RNA, 64 nt, hsa
accgccucaacacaguucucaacugcgaucacguccugguuauggaaaaugggaagguauagga

SEQ ID NO: 138249 - RNA, 64 nt, hsa
aaagaccuauaugaugcgguuuggauucaaguauccugguuagcaagaccacucccaccucagg

SEQ ID NO: 138250 - RNA, 64 nt, hsa
ucuucagcagggacauuacaaucaaacaccaauuccugguuaaugaagggagagugugggcuua

SEQ ID NO: 138251 - RNA, 64 nt, hsa
cuaauguggugaaucacugaaagucucagaaagaccugguuaguguauguucucauuuaccaca

SEQ ID NO: 138252 - RNA, 64 nt, hsa
aagggcacuauauuuuugggaggagccauagauuccugguuauccuauuuuuaaacaaaaugua

SEQ ID NO: 138253 - RNA, 64 nt, hsa
aguuuuuacaacagauuugcagcucauuccuuacccugguuaggucacuacuuuugcagauuuu

SEQ ID NO: 138254 - RNA, 64 nt, hsa
gcgcagcccugacucccaggcgcugagauuguugccugguuacccaggaagcugcuguuccggc

SEQ ID NO: 138255 - RNA, 64 nt, hsa
aggcaagaaagagauaccaagaugccaucuguguccugguuagcagagcuggaccaguggugcc

SEQ ID NO: 138256 - RNA, 64 nt, hsa
uucuuuuuuauacucaaucauuucuagcgcauggccugguuagaggcugguuuuuucucuuuuc

SEQ ID NO: 138257 - RNA, 64 nt, hsa
gaaucccgggugcuccacugcuuaaaccacaggaccugguuaacuccucaccaagcuucccacg

SEQ ID NO: 138258 - RNA, 64 nt, hsa
aagccaaauuguguuugcuuugguuauaguuacuccugguuaugcagcuucucuugucuucuuc

SEQ ID NO: 138259 - RNA, 64 nt, hsa
ucagcuccagggaaauggagguauugauguugaaccugguuagggaagcugagcgccuguggcc

SEQ ID NO: 138260 - RNA, 64 nt, hsa
ccucccugcccccauguuuuucuggcugggagcuccugguuacccccuugucugacugcuuggu

SEQ ID NO: 138261 - RNA, 64 nt, hsa
ccucaggcgugugcggggcggggacggggggucuccugguuacauuuuggauuaaaccuguuuc

SEQ ID NO: 138262 - RNA, 64 nt, hsa
ccaaauugaaaguaaauauuccagaaguugauagccugguuaaaaguuagauccucuauuacca

SEQ ID NO: 138263 - RNA, 64 nt, hsa
caguugcuauaauucuagacucuaaaucuucucuccugguuacagugaccauuugaacauuggu

SEQ ID NO: 138264 - RNA, 64 nt, hsa
cuuaucagcuacauccucuguaacgugguucaucccugguuaaaaagcaaacaaacacaggcug

SEQ ID NO: 138265 - RNA, 64 nt, hsa
aguuucaaaauauugugguuuaguaaaguugauaccugguuauaaauauuaugccuuuauuuuu

SEQ ID NO: 138266 - RNA, 64 nt, hsa
agggguuguguagguuguucacugcaggaaguccccugguuaagaaggcaagugggguuuaaac

SEQ ID NO: 138267 - RNA, 64 nt, hsa
gugugggacauaucuggcaagauuuuguggcacuccugguuacagauacuggggcagcaaauaa

SEQ ID NO: 138268 - RNA, 64 nt, hsa
uccagcugaggcccacccagguggucccuccagcccugguuaggcacugagggcucuggacggg

SEQ ID NO: 138269 - RNA, 64 nt, hsa
ccccauucccggcuucccuccuccuccccugcagccugguuagguggauaccugcccugacaug

SEQ ID NO: 138270 - RNA, 64 nt, hsa
ggaguagcugggacuacagacaugcaccaccacaccugguuaauuuuuuauuuuuauuuuuugu

SEQ ID NO: 138271 - RNA, 64 nt, hsa
gguggaucacuugaggccaggaguuugagaccaaccugguuaacauggugaaacccugucugua

SEQ ID NO: 138272 - RNA, 64 nt, hsa
ugcugggauuacaggcaugagccaccgcacccagccugguuauuggauuuauuuauuuauuuug

SEQ ID NO: 138273 - RNA, 64 nt, hsa
cacuguguccgccauggucagaacaccuaccuccccugguuauugugaggcuggcgauuacaua

SEQ ID NO: 138274 - RNA, 64 nt, hsa
aguuacguucauuucagguuaaacaugaaagaagccugguuacugauuuguauaaaauguacuc

SEQ ID NO: 138275 - RNA, 64 nt, hsa
uuuuaauuaugcuccuuggcagguaugaaauugcccugguuacauuccauuauugcuuauuagu

SEQ ID NO: 138276 - RNA, 64 nt, hsa
ucaucacacaaccauuccugggcauugagacuguccugguuaggcugugugucuccuacauuaa

SEQ ID NO: 138277 - RNA, 64 nt, hsa
acacccaggguuacugaggacuuaugcugccugaccugguuagauguacauggagguaucuccc

SEQ ID NO: 138278 - RNA, 64 nt, hsa
cucuuaacaggcagaacaugggagaauccuuauuccugguuaaucacuaugcauauuugaaaua

SEQ ID NO: 138279 - RNA, 64 nt, hsa
agcaagaguuugaaauauguuaaacacuagacauccugguuaucaaaaccaaugagcauuacuu

SEQ ID NO: 138280 - RNA, 64 nt, hsa
ccauccugggcccccacucuagacccccccaccaccugguuaagucucgagugaauccaguggc

SEQ ID NO: 138281 - RNA, 64 nt, hsa
ggggcgucccagcuguguuuuuugaugucuccucccugguuaagaguagcuuggagaggacccu

SEQ ID NO: 138282 - RNA, 64 nt, hsa
gggcuggcuagccagaggaguuggcuguaucaccccugguuauuuuagggcaacaacccaguug

SEQ ID NO: 138283 - RNA, 64 nt, hsa
ggacagugcuagugggaaaauaauuuucaaacuaccugguuaaccaaaauacaaaagcagcuga

SEQ ID NO: 138284 - RNA, 64 nt, hsa
acauguuuacuacuuaaacaugaauucaugguauccugguuauuuuuuuuaagucaucuggggg

SEQ ID NO: 138285 - RNA, 64 nt, hsa
ggacagcucaccaaccccugaaggggccguucagccugguuaguuuucuaccuacuccgagugu

SEQ ID NO: 138286 - RNA, 64 nt, hsa; identical to SEQ ID NO: 44260

SEQ ID NO: 138287 - RNA, 64 nt, hsa; identical to SEQ ID NO: 44261

SEQ ID NO: 138288 - RNA, 64 nt, hsa; identical to SEQ ID NO: 44262

SEQ ID NO: 138289 - RNA, 64 nt, hsa; identical to SEQ ID NO: 44263

SEQ ID NO: 138290 - RNA, 64 nt, hsa; identical to SEQ ID NO: 44264

SEQ ID NO: 138291 - RNA, 64 nt, hsa; identical to SEQ ID NO: 44265

SEQ ID NO: 138292 - RNA, 64 nt, hsa; identical to SEQ ID NO: 44266

SEQ ID NO: 138293 - RNA, 64 nt, hsa; identical to SEQ ID NO: 44267

SEQ ID NO: 138294 - RNA, 64 nt, hsa; identical to SEQ ID NO: 44268

SEQ ID NO: 138295 - RNA, 64 nt, hsa; identical to SEQ ID NO: 44269

SEQ ID NO: 138296 - RNA, 64 nt, hsa; identical to SEQ ID NO: 44270

SEQ ID NO: 138297 - RNA, 64 nt, hsa; identical to SEQ ID NO: 44271

SEQ ID NO: 138298 - RNA, 64 nt, hsa; identical to SEQ ID NO: 44272

SEQ ID NO: 138299 - RNA, 64 nt, hsa; identical to SEQ ID NO: 44273

SEQ ID NO: 138300 - RNA, 64 nt, hsa; identical to SEQ ID NO: 44274

SEQ ID NO: 138301 - RNA, 64 nt, hsa; identical to SEQ ID NO: 44275

SEQ ID NO: 138302 - RNA, 64 nt, hsa; identical to SEQ ID NO: 44276

SEQ ID NO: 138303 - RNA, 64 nt, hsa; identical to SEQ ID NO: 44277

SEQ ID NO: 138304 - RNA, 60 nt, hsa; identical to SEQ ID NO: 44278

SEQ ID NO: 138305 - RNA, 64 nt, hsa; identical to SEQ ID NO: 44279

SEQ ID NO: 138306 - RNA, 64 nt, hsa; identical to SEQ ID NO: 44280

SEQ ID NO: 138307 - RNA, 64 nt, hsa; identical to SEQ ID NO: 44281

SEQ ID NO: 138308 - RNA, 64 nt, hsa; identical to SEQ ID NO: 44282

SEQ ID NO: 138309 - RNA, 64 nt, hsa; identical to SEQ ID NO: 44283

SEQ ID NO: 138310 - RNA, 64 nt, hsa; identical to SEQ ID NO: 44284

SEQ ID NO: 138311 - RNA, 64 nt, hsa; identical to SEQ ID NO: 44285

SEQ ID NO: 138312 - RNA, 64 nt, hsa; identical to SEQ ID NO: 44286

SEQ ID NO: 138313 - RNA, 64 nt, hsa; identical to SEQ ID NO: 44287

SEQ ID NO: 138314 - RNA, 64 nt, hsa; identical to SEQ ID NO: 44288

SEQ ID NO: 138315 - RNA, 64 nt, hsa; identical to SEQ ID NO: 44289

SEQ ID NO: 138316 - RNA, 64 nt, hsa; identical to SEQ ID NO: 44290

SEQ ID NO: 138317 - RNA, 64 nt, hsa; identical to SEQ ID NO: 44291

SEQ ID NO: 138318 - RNA, 64 nt, hsa; identical to SEQ ID NO: 44292

SEQ ID NO: 138319 - RNA, 64 nt, hsa; identical to SEQ ID NO: 44293

SEQ ID NO: 138320 - RNA, 64 nt, hsa; identical to SEQ ID NO: 44294

SEQ ID NO: 138321 - RNA, 64 nt, hsa; identical to SEQ ID NO: 44295

SEQ ID NO: 138322 - RNA, 64 nt, hsa; identical to SEQ ID NO: 44296

SEQ ID NO: 138323 - RNA, 64 nt, hsa; identical to SEQ ID NO: 44297

SEQ ID NO: 138324 - RNA, 64 nt, hsa; identical to SEQ ID NO: 44298

SEQ ID NO: 138325 - RNA, 64 nt, hsa; identical to SEQ ID NO: 44299

SEQ ID NO: 138326 - RNA, 64 nt, hsa; identical to SEQ ID NO: 44300

SEQ ID NO: 138327 - RNA, 64 nt, hsa; identical to SEQ ID NO: 44301

SEQ ID NO: 138328 - RNA, 54 nt, hsa; identical to SEQ ID NO: 44302

SEQ ID NO: 138329 - RNA, 64 nt, hsa; identical to SEQ ID NO: 44303

SEQ ID NO: 138330 - RNA, 64 nt, hsa; identical to SEQ ID NO: 44304

SEQ ID NO: 138331 - RNA, 64 nt, hsa; identical to SEQ ID NO: 44305

SEQ ID NO: 138332 - RNA, 64 nt, hsa; identical to SEQ ID NO: 44306

SEQ ID NO: 138333 - RNA, 64 nt, hsa; identical to SEQ ID NO: 44307

SEQ ID NO: 138334 - RNA, 64 nt, hsa; identical to SEQ ID NO: 44308

SEQ ID NO: 138335 - RNA, 64 nt, hsa; identical to SEQ ID NO: 44309

SEQ ID NO: 138336 - RNA, 64 nt, hsa; identical to SEQ ID NO: 44310

SEQ ID NO: 138337 - RNA, 64 nt, hsa
gggauuacaggugugagccacagcgccuggcccaguguaauauuuuugaaagaggagggacaau

SEQ ID NO: 138338 - RNA, 64 nt, hsa
ucuuagugggcauuauggaagaauauauuaaaauguguaauauaccacagguugguauauuuag

SEQ ID NO: 138339 - RNA, 64 nt, hsa
cuccguuuauuauaaacuguaugcucacaacuuaguguaauauaccagcuuguaugcaauggau

SEQ ID NO: 138340 - RNA, 64 nt, hsa
caaaacucacaagugcucaucuguuguagauuuaguguaauaagacuuagauugugcuccuucg

SEQ ID NO: 138341 - RNA, 64 nt, hsa
cccccgccguugguuguugguggucagaauuauuguguaauaaauaauagacauuuuuucuuau

SEQ ID NO: 138342 - RNA, 64 nt, hsa
aagaguuggaaaauuuguaaccaucauaauacagguguaauagguuugggaaagaauccucaaa

SEQ ID NO: 138343 - RNA, 64 nt, hsa
cuugugaacucgauagagcaaggaaaccagaaagguguaauauuuauagguugguaaaauagau

SEQ ID NO: 138344 - RNA, 64 nt, hsa
ugaaucuauaauaaugguacuucuacuggggagaguguaauauuuuggacugcuguuuuccauu

SEQ ID NO: 138345 - RNA, 60 nt, hsa
guauuauauuuggcuucuauuuuuauuauuuuggaucaccauucucccuaucccuucuug

SEQ ID NO: 138346 - RNA, 60 nt, hsa
cagagacugcuacaaaauuguauauaguuuuuggaucaaauagcaugaggggagaggaaa

SEQ ID NO: 138347 - RNA, 60 nt, hsa
ggggaugggguaaaagugguuaacguacuguuggaucaacaaauaaagguuacaguuuug

SEQ ID NO: 138348 - RNA, 60 nt, hsa
uugacuagagacccaagaaaaccuggaacuuuggaucaauuucuuuuucauaggggugga

SEQ ID NO: 138349 - RNA, 60 nt, hsa
gucuuuagaucuacacagaaaugacccuccuuggaucaguuuucuuuccagucuaaucau

SEQ ID NO: 138350 - RNA, 60 nt, hsa
ugucacagguaucugccagcauucaagguuuuggaucauuucaugaggaucuuuccuuug

SEQ ID NO: 138351 - RNA, 60 nt, hsa
auggcuuuuuccuuugcuugaauaaacauuuuggaucaccuccaaagaaugaaaaccagu

SEQ ID NO: 138352 - RNA, 60 nt, hsa
aaagugaaauucagucuuaaguagggugaauuggaucaccauuuacacaagagauggcuu

SEQ ID NO: 138353 - RNA, 60 nt, hsa
cuacucuuuugaaguguuuuagucuaguuauuggaucagugaaaaacauuaguauacguu

SEQ ID NO: 138354 - RNA, 60 nt, hsa
auacguuuuuaaauaggcuaauuuuucaacuuggaucauuaggcuuacguacuacuuguu

SEQ ID NO: 138355 - RNA, 64 nt, hsa; identical to SEQ ID NO: 58312

SEQ ID NO: 138356 - RNA, 64 nt, hsa; identical to SEQ ID NO: 58313

SEQ ID NO: 138357 - RNA, 64 nt, hsa; identical to SEQ ID NO: 58314

SEQ ID NO: 138358 - RNA, 64 nt, hsa; identical to SEQ ID NO: 58315

SEQ ID NO: 138359 - RNA, 64 nt, hsa; identical to SEQ ID NO: 58316

SEQ ID NO: 138360 - RNA, 64 nt, hsa; identical to SEQ ID NO: 58317

SEQ ID NO: 138361 - RNA, 64 nt, hsa; identical to SEQ ID NO: 58318

SEQ ID NO: 138362 - RNA, 64 nt, hsa; identical to SEQ ID NO: 58319

SEQ ID NO: 138363 - RNA, 64 nt, hsa; identical to SEQ ID NO: 58320

SEQ ID NO: 138364 - RNA, 64 nt, hsa; identical to SEQ ID NO: 58321

SEQ ID NO: 138365 - RNA, 64 nt, hsa; identical to SEQ ID NO: 58322

SEQ ID NO: 138366 - RNA, 64 nt, hsa; identical to SEQ ID NO: 58323

SEQ ID NO: 138367 - RNA, 64 nt, hsa; identical to SEQ ID NO: 58324

SEQ ID NO: 138368 - RNA, 64 nt, hsa; identical to SEQ ID NO: 58325

SEQ ID NO: 138369 - RNA, 64 nt, hsa; identical to SEQ ID NO: 58326

SEQ ID NO: 138370 - RNA, 64 nt, hsa; identical to SEQ ID NO: 58327

SEQ ID NO: 138371 - RNA, 64 nt, hsa; identical to SEQ ID NO: 58328

SEQ ID NO: 138372 - RNA, 64 nt, hsa; identical to SEQ ID NO: 58329

SEQ ID NO: 138373 - RNA, 64 nt, hsa; identical to SEQ ID NO: 58330

SEQ ID NO: 138374 - RNA, 64 nt, hsa; identical to SEQ ID NO: 58331

SEQ ID NO: 138375 - RNA, 64 nt, hsa; identical to SEQ ID NO: 58332

SEQ ID NO: 138376 - RNA, 64 nt, hsa; identical to SEQ ID NO: 58333

SEQ ID NO: 138377 - RNA, 64 nt, hsa; identical to SEQ ID NO: 58334

SEQ ID NO: 138378 - RNA, 64 nt, hsa; identical to SEQ ID NO: 58335

SEQ ID NO: 138379 - RNA, 64 nt, hsa; identical to SEQ ID NO: 58336

SEQ ID NO: 138380 - RNA, 64 nt, hsa; identical to SEQ ID NO: 58337

SEQ ID NO: 138381 - RNA, 64 nt, hsa; identical to SEQ ID NO: 58338

SEQ ID NO: 138382 - RNA, 64 nt, hsa; identical to SEQ ID NO: 58339

SEQ ID NO: 138383 - RNA, 64 nt, hsa; identical to SEQ ID NO: 58340

SEQ ID NO: 138384 - RNA, 64 nt, hsa; identical to SEQ ID NO: 58341

SEQ ID NO: 138385 - RNA, 64 nt, hsa; identical to SEQ ID NO: 58342

SEQ ID NO: 138386 - RNA, 64 nt, hsa; identical to SEQ ID NO: 58343

SEQ ID NO: 138387 - RNA, 64 nt, hsa; identical to SEQ ID NO: 58344

SEQ ID NO: 138388 - RNA, 64 nt, hsa; identical to SEQ ID NO: 58345

SEQ ID NO: 138389 - RNA, 64 nt, hsa; identical to SEQ ID NO: 58346

SEQ ID NO: 138390 - RNA, 64 nt, hsa; identical to SEQ ID NO: 58347

SEQ ID NO: 138391 - RNA, 64 nt, hsa; identical to SEQ ID NO: 58348

SEQ ID NO: 138392 - RNA, 64 nt, hsa; identical to SEQ ID NO: 58349

SEQ ID NO: 138393 - RNA, 64 nt, hsa; identical to SEQ ID NO: 58350

SEQ ID NO: 138394 - RNA, 64 nt, hsa; identical to SEQ ID NO: 58351

SEQ ID NO: 138395 - RNA, 64 nt, hsa; identical to SEQ ID NO: 58352

SEQ ID NO: 138396 - RNA, 64 nt, hsa; identical to SEQ ID NO: 58353

SEQ ID NO: 138397 - RNA, 64 nt, hsa; identical to SEQ ID NO: 58354

SEQ ID NO: 138398 - RNA, 64 nt, hsa; identical to SEQ ID NO: 58355

SEQ ID NO: 138399 - RNA, 64 nt, hsa; identical to SEQ ID NO: 58356

SEQ ID NO: 138400 - RNA, 64 nt, hsa; identical to SEQ ID NO: 58357

SEQ ID NO: 138401 - RNA, 64 nt, hsa; identical to SEQ ID NO: 58358

SEQ ID NO: 138402 - RNA, 64 nt, hsa; identical to SEQ ID NO: 58359

SEQ ID NO: 138403 - RNA, 64 nt, hsa; identical to SEQ ID NO: 58360

SEQ ID NO: 138404 - RNA, 64 nt, hsa; identical to SEQ ID NO: 58361

SEQ ID NO: 138405 - RNA, 64 nt, hsa; identical to SEQ ID NO: 58362

SEQ ID NO: 138406 - RNA, 64 nt, hsa; identical to SEQ ID NO: 58363

SEQ ID NO: 138407 - RNA, 64 nt, hsa; identical to SEQ ID NO: 58364

SEQ ID NO: 138408 - RNA, 64 nt, hsa; identical to SEQ ID NO: 58365

SEQ ID NO: 138409 - RNA, 64 nt, hsa; identical to SEQ ID NO: 58366

SEQ ID NO: 138410 - RNA, 64 nt, hsa; identical to SEQ ID NO: 58367

SEQ ID NO: 138411 - RNA, 64 nt, hsa; identical to SEQ ID NO: 58368

SEQ ID NO: 138412 - RNA, 64 nt, hsa; identical to SEQ ID NO: 58369

SEQ ID NO: 138413 - RNA, 64 nt, hsa; identical to SEQ ID NO: 58370

SEQ ID NO: 138414 - RNA, 64 nt, hsa; identical to SEQ ID NO: 58371

SEQ ID NO: 138415 - RNA, 64 nt, hsa; identical to SEQ ID NO: 58372

SEQ ID NO: 138416 - RNA, 64 nt, hsa; identical to SEQ ID NO: 58373

SEQ ID NO: 138417 - RNA, 64 nt, hsa; identical to SEQ ID NO: 58374

SEQ ID NO: 138418 - RNA, 64 nt, hsa; identical to SEQ ID NO: 58375

SEQ ID NO: 138419 - RNA, 64 nt, hsa; identical to SEQ ID NO: 58376

SEQ ID NO: 138420 - RNA, 64 nt, hsa; identical to SEQ ID NO: 58377

SEQ ID NO: 138421 - RNA, 64 nt, hsa; identical to SEQ ID NO: 58378

SEQ ID NO: 138422 - RNA, 64 nt, hsa; identical to SEQ ID NO: 58379

SEQ ID NO: 138423 - RNA, 64 nt, hsa; identical to SEQ ID NO: 58380

SEQ ID NO: 138424 - RNA, 64 nt, hsa; identical to SEQ ID NO: 58381

SEQ ID NO: 138425 - RNA, 64 nt, hsa; identical to SEQ ID NO: 58382

SEQ ID NO: 138426 - RNA, 64 nt, hsa; identical to SEQ ID NO: 58383

SEQ ID NO: 138427 - RNA, 64 nt, hsa; identical to SEQ ID NO: 58384

SEQ ID NO: 138428 - RNA, 64 nt, hsa; identical to SEQ ID NO: 58385

SEQ ID NO: 138429 - RNA, 64 nt, hsa; identical to SEQ ID NO: 58386

SEQ ID NO: 138430 - RNA, 64 nt, hsa; identical to SEQ ID NO: 58387

SEQ ID NO: 138431 - RNA, 64 nt, hsa; identical to SEQ ID NO: 58388

SEQ ID NO: 138432 - RNA, 64 nt, hsa; identical to SEQ ID NO: 58389

SEQ ID NO: 138433 - RNA, 64 nt, hsa; identical to SEQ ID NO: 58390

SEQ ID NO: 138434 - RNA, 64 nt, hsa; identical to SEQ ID NO: 58391

SEQ ID NO: 138435 - RNA, 64 nt, hsa; identical to SEQ ID NO: 58392

SEQ ID NO: 138436 - RNA, 64 nt, hsa; identical to SEQ ID NO: 58393

SEQ ID NO: 138437 - RNA, 64 nt, hsa; identical to SEQ ID NO: 58394

SEQ ID NO: 138438 - RNA, 64 nt, hsa; identical to SEQ ID NO: 58395

SEQ ID NO: 138439 - RNA, 64 nt, hsa; identical to SEQ ID NO: 58396

SEQ ID NO: 138440 - RNA, 64 nt, hsa; identical to SEQ ID NO: 58397

SEQ ID NO: 138441 - RNA, 64 nt, hsa; identical to SEQ ID NO: 58398

SEQ ID NO: 138442 - RNA, 64 nt, hsa; identical to SEQ ID NO: 58399

SEQ ID NO: 138443 - RNA, 64 nt, hsa; identical to SEQ ID NO: 58400

SEQ ID NO: 138444 - RNA, 64 nt, hsa; identical to SEQ ID NO: 58401

SEQ ID NO: 138445 - RNA, 64 nt, hsa; identical to SEQ ID NO: 58402

SEQ ID NO: 138446 - RNA, 64 nt, hsa; identical to SEQ ID NO: 58403

SEQ ID NO: 138447 - RNA, 64 nt, hsa; identical to SEQ ID NO: 58404

SEQ ID NO: 138448 - RNA, 64 nt, hsa; identical to SEQ ID NO: 58405

SEQ ID NO: 138449 - RNA, 64 nt, hsa; identical to SEQ ID NO: 58406

SEQ ID NO: 138450 - RNA, 64 nt, hsa; identical to SEQ ID NO: 58407

SEQ ID NO: 138451 - RNA, 64 nt, hsa; identical to SEQ ID NO: 58408

SEQ ID NO: 138452 - RNA, 64 nt, hsa; identical to SEQ ID NO: 58409

SEQ ID NO: 138453 - RNA, 64 nt, hsa; identical to SEQ ID NO: 58410

SEQ ID NO: 138454 - RNA, 64 nt, hsa; identical to SEQ ID NO: 58411

SEQ ID NO: 138455 - RNA, 64 nt, hsa; identical to SEQ ID NO: 58412

SEQ ID NO: 138456 - RNA, 64 nt, hsa; identical to SEQ ID NO: 58413

SEQ ID NO: 138457 - RNA, 64 nt, hsa; identical to SEQ ID NO: 58414

SEQ ID NO: 138458 - RNA, 64 nt, hsa; identical to SEQ ID NO: 58415

SEQ ID NO: 138459 - RNA, 64 nt, hsa; identical to SEQ ID NO: 58416

SEQ ID NO: 138460 - RNA, 64 nt, hsa; identical to SEQ ID NO: 58417

SEQ ID NO: 138461 - RNA, 64 nt, hsa; identical to SEQ ID NO: 58418

SEQ ID NO: 138462 - RNA, 64 nt, hsa; identical to SEQ ID NO: 58419

SEQ ID NO: 138463 - RNA, 64 nt, hsa; identical to SEQ ID NO: 58420

SEQ ID NO: 138464 - RNA, 64 nt, hsa; identical to SEQ ID NO: 58421

SEQ ID NO: 138465 - RNA, 64 nt, hsa; identical to SEQ ID NO: 58422

SEQ ID NO: 138466 - RNA, 64 nt, hsa; identical to SEQ ID NO: 58423

SEQ ID NO: 138467 - RNA, 64 nt, hsa; identical to SEQ ID NO: 58424

SEQ ID NO: 138468 - RNA, 64 nt, hsa; identical to SEQ ID NO: 58425

SEQ ID NO: 138469 - RNA, 64 nt, hsa; identical to SEQ ID NO: 58426

SEQ ID NO: 138470 - RNA, 64 nt, hsa; identical to SEQ ID NO: 58427

SEQ ID NO: 138471 - RNA, 64 nt, hsa; identical to SEQ ID NO: 58428

SEQ ID NO: 138472 - RNA, 64 nt, hsa; identical to SEQ ID NO: 58429

SEQ ID NO: 138473 - RNA, 64 nt, hsa; identical to SEQ ID NO: 58430

SEQ ID NO: 138474 - RNA, 64 nt, hsa; identical to SEQ ID NO: 58431

SEQ ID NO: 138475 - RNA, 64 nt, hsa; identical to SEQ ID NO: 58432

SEQ ID NO: 138476 - RNA, 64 nt, hsa; identical to SEQ ID NO: 58433

SEQ ID NO: 138477 - RNA, 64 nt, hsa; identical to SEQ ID NO: 58434

SEQ ID NO: 138478 - RNA, 64 nt, hsa; identical to SEQ ID NO: 58435

SEQ ID NO: 138479 - RNA, 50 nt, hsa; identical to SEQ ID NO: 58436

SEQ ID NO: 138480 - RNA, 64 nt, hsa; identical to SEQ ID NO: 58437

SEQ ID NO: 138481 - RNA, 64 nt, hsa; identical to SEQ ID NO: 58438

SEQ ID NO: 138482 - RNA, 64 nt, hsa; identical to SEQ ID NO: 58439

SEQ ID NO: 138483 - RNA, 64 nt, hsa; identical to SEQ ID NO: 58440

SEQ ID NO: 138484 - RNA, 64 nt, hsa; identical to SEQ ID NO: 58441

SEQ ID NO: 138485 - RNA, 64 nt, hsa; identical to SEQ ID NO: 58442

SEQ ID NO: 138486 - RNA, 64 nt, hsa; identical to SEQ ID NO: 58443

SEQ ID NO: 138487 - RNA, 64 nt, hsa; identical to SEQ ID NO: 58444

SEQ ID NO: 138488 - RNA, 64 nt, hsa; identical to SEQ ID NO: 58445

SEQ ID NO: 138489 - RNA, 64 nt, hsa; identical to SEQ ID NO: 58446

SEQ ID NO: 138490 - RNA, 64 nt, hsa; identical to SEQ ID NO: 58447

SEQ ID NO: 138491 - RNA, 64 nt, hsa; identical to SEQ ID NO: 58448

SEQ ID NO: 138492 - RNA, 64 nt, hsa; identical to SEQ ID NO: 58449

SEQ ID NO: 138493 - RNA, 64 nt, hsa; identical to SEQ ID NO: 58450

SEQ ID NO: 138494 - RNA, 64 nt, hsa; identical to SEQ ID NO: 58451

SEQ ID NO: 138495 - RNA, 64 nt, hsa; identical to SEQ ID NO: 58452

SEQ ID NO: 138496 - RNA, 64 nt, hsa; identical to SEQ ID NO: 58453

SEQ ID NO: 138497 - RNA, 64 nt, hsa; identical to SEQ ID NO: 58454

SEQ ID NO: 138498 - RNA, 64 nt, hsa; identical to SEQ ID NO: 58455

SEQ ID NO: 138499 - RNA, 64 nt, hsa; identical to SEQ ID NO: 58456

SEQ ID NO: 138500 - RNA, 64 nt, hsa; identical to SEQ ID NO: 58457

SEQ ID NO: 138501 - RNA, 64 nt, hsa; identical to SEQ ID NO: 58458

SEQ ID NO: 138502 - RNA, 64 nt, hsa; identical to SEQ ID NO: 58459

SEQ ID NO: 138503 - RNA, 64 nt, hsa; identical to SEQ ID NO: 58460

SEQ ID NO: 138504 - RNA, 64 nt, hsa; identical to SEQ ID NO: 58461

SEQ ID NO: 138505 - RNA, 64 nt, hsa; identical to SEQ ID NO: 58462

SEQ ID NO: 138506 - RNA, 64 nt, hsa; identical to SEQ ID NO: 58463

SEQ ID NO: 138507 - RNA, 64 nt, hsa; identical to SEQ ID NO: 58464

SEQ ID NO: 138508 - RNA, 64 nt, hsa; identical to SEQ ID NO: 58465

SEQ ID NO: 138509 - RNA, 64 nt, hsa; identical to SEQ ID NO: 58466

SEQ ID NO: 138510 - RNA, 64 nt, hsa; identical to SEQ ID NO: 58467

SEQ ID NO: 138511 - RNA, 64 nt, hsa
aaagacaacaggcaguaguggcuccucccagcccugggcccaagaggaggcggcugcgggucgu

SEQ ID NO: 138512 - RNA, 64 nt, hsa
ggauugucaccccaagucuuccagcugguggaucugggcccagcaaagacuguucuccucccga

SEQ ID NO: 138513 - RNA, 64 nt, hsa
uagcagcuggauaugggguuccuugauuuuccucugggcccaaauauagcccucacacucuugg

SEQ ID NO: 138514 - RNA, 64 nt, hsa
cccaagagagccuuggauucagugguacacuccuugggcccaagggcuuuagcagcuggauaug

SEQ ID NO: 138515 - RNA, 64 nt, hsa
acauucucccugggcccaaaugacuuugucucccugggcccagauucuuugucucucuucaacc

SEQ ID NO: 138516 - RNA, 64 nt, hsa
ccaccuauugguuccccaaaauccacauucucccugggcccaaaugacuuugucucccugggcc

SEQ ID NO: 138517 - RNA, 64 nt, hsa
ugugaggaguguacaccugcaagggcugaggcccugggcccagucagcccugcugcucagagug

SEQ ID NO: 138518 - RNA, 64 nt, hsa
augaaugggccuacaccugccaaggcugaaucccugggcccagucagcccugcugcacauggca

SEQ ID NO: 138519 - RNA, 64 nt, hsa
ccaggaagaaauggagcgaugacugacuguggggugggcccaggauuuccacaucuuggugaag

SEQ ID NO: 138520 - RNA, 64 nt, hsa
cgucugaucuugaugggggcacuggccuggagccugggcccaccugcuucugggggguugggga

SEQ ID NO: 138521 - RNA, 64 nt, hsa
caccuguguuccucaaucacacugaagccacagcugggcccaccgaggugcuauccugcccagg

SEQ ID NO: 138522 - RNA, 64 nt, hsa
ugcauggugacagucucccccaaacauggccugcugggcccaagugaggagugccagcucaagu

SEQ ID NO: 138523 - RNA, 64 nt, hsa
augugaauaacccuuccuacggggaaucuguguaugggcccaguuccccgcgaguuccuguggu

SEQ ID NO: 138524 - RNA, 58 nt, hsa
cagggacagaaaggggauaguggaguuaugggcccaccaggcaagccugggccuucug

SEQ ID NO: 138525 - RNA, 64 nt, hsa
ccuguguuccagaggaccugaugccaagggguaaugggcccagcagugccucuggagcccaggc

SEQ ID NO: 138526 - RNA, 64 nt, hsa
cugacuaugcuuucucuccuaggagcuguccuggugggcccagguccuuguaucaugccacggu

SEQ ID NO: 138527 - RNA, 64 nt, hsa
caggggcccugaccccaggccacacagacggacaugggcccacaugggagggugagcaggagca

SEQ ID NO: 138528 - RNA, 64 nt, hsa
uuaugucagggaaaccuaaacugaggucagcacuugggcccacugacagugacugacuggggga

SEQ ID NO: 138529 - RNA, 64 nt, hsa
caccagcccggcuccugccucacgcuggccccucugggcccagcucaugccucgcgguggccuc

SEQ ID NO: 138530 - RNA, 64 nt, hsa
uccgggcccagcucuuugcucgcgucugcgcccgugggcccagcucccgucuccaaacagccuc

SEQ ID NO: 138531 - RNA, 64 nt, hsa
gcccgucucucucccauggagccccagcccccuuugggcccagggacaccagccaggcucugug

SEQ ID NO: 138532 - RNA, 64 nt, hsa
agcccgccugccaguccuagcugcacagggcagcugggcccaacccugucuguagagggcccug

SEQ ID NO: 138533 - RNA, 64 nt, hsa
ugggcccugcuucucugcuccccugggugaugggugggcccagaagguggcagucccacaccuu

SEQ ID NO: 138534 - RNA, 64 nt, hsa
acagccucccaagcccaggcuuuggcacucagaaugggcccagugggggcugggcaggcccauu

SEQ ID NO: 138535 - RNA, 64 nt, hsa
accaggacugcccucggugcucauagggaauggcugggcccacggaaggucggccugggaugug

SEQ ID NO: 138536 - RNA, 64 nt, hsa
cgcuguucuacagaaccuacccucucaaugggcaugggcccaaccauccaguuuuccucuuuua

SEQ ID NO: 138537 - RNA, 64 nt, hsa
gcacccgggcguccugagcacuuugcaagagagaugggcccaaggaauucagaagagcuugcag

SEQ ID NO: 138538 - RNA, 64 nt, hsa
acuggccugaccugcaguggccgccagggaggucugggcccagcggggcucccuucugugcaga

SEQ ID NO: 138539 - RNA, 64 nt, hsa
cuuccagcccagaguccucaaguccagggcaccuugggcccagcgcaggcagaauccgaggugg

SEQ ID NO: 138540 - RNA, 64 nt, hsa
ggcaggggcuccccgccgccgaggcugccugcccugggcccaccucugcaugcugcucaugggg

SEQ ID NO: 138541 - RNA, 64 nt, hsa
uugcgucucccugugaugggcccuuaggccuggcugggcccauuacauaucccugugguggcuc

SEQ ID NO: 138542 - RNA, 64 nt, hsa
aaaucucacagccuucucaugcugccggcucaucugggcccauagagugggcuuugccaguugc

SEQ ID NO: 138543 - RNA, 64 nt, hsa
ggccaaccagcaaaauccugauaacaagacucugugggcccaacucuccugaauuaaaggagcc

SEQ ID NO: 138544 - RNA, 64 nt, hsa
ucucucagcugucaauggcuuggagaacaucucaugggcccaagucaucaaauaaccuguuccu

SEQ ID NO: 138545 - RNA, 64 nt, hsa
gugggucuuggggcugggucugccuggagaccagugggcccagggggaagggggaagcugagaa

SEQ ID NO: 138546 - RNA, 64 nt, hsa
guggccccuaccagccugaccugagucggcgccgugggcccagcaggccucgcgcagccuagcu

SEQ ID NO: 138547 - RNA, 64 nt, hsa
ucccuggcucccaugaccauacugagggaccaacugggcccaagacagaugccccagagcuguu

SEQ ID NO: 138548 - RNA, 64 nt, hsa
caugcagcccaugcccaccugcccaucacaggguugggcccagaucuggucccuugcagcuagu

SEQ ID NO: 138549 - RNA, 64 nt, hsa
cucucccuagacucuccuaggguucaggagcugcugggcccagaggugacauuugacuuuuuuc

SEQ ID NO: 138550 - RNA, 64 nt, hsa
ggacagggaguuguaacagagcagugccagagcaugggcccaggucccaggggagagguugggg

SEQ ID NO: 138551 - RNA, 64 nt, hsa
cagucaaagccagaacugagaggggaccccagacugggcccagaggcuggccagaguucaggaa

SEQ ID NO: 138552 - RNA, 64 nt, hsa
uggagcccaaggggccacugcccuugaaguggagugggcccagaguguggcgguccccauggug

SEQ ID NO: 138553 - RNA, 64 nt, hsa
accucucagcccucccaggaaacacacagagcucugggcccaucccagcccuggccuguggccu

SEQ ID NO: 138554 - RNA, 64 nt, hsa
gcuguucugcccucauacccuuaaagggccagccugggcccaguggacacagguaaggcaccau

SEQ ID NO: 138555 - RNA, 64 nt, hsa
cugugaacuucccuacccuacccccacaacacaagcaccccagaccucaccuccaucccccucu

SEQ ID NO: 138556 - RNA, 64 nt, hsa
uaguuuuuucaucuguaaaacagggauaauaacagcaccccauagaguugugacgaggauugag

SEQ ID NO: 138557 - RNA, 64 nt, hsa
caguuguaugcacaaaggagacccaugcaggcaugcaccccagaugggcugcuagacuaccccu

SEQ ID NO: 138558 - RNA, 64 nt, hsa
acccuuggcuguauuucccaucuucacaguucaagcaccccaaaccugcccuuucuccccugca

SEQ ID NO: 138559 - RNA, 64 nt, hsa
uuaguggggcaggggcagggcggcugcucacagagcaccccaguuccucaccagcuacucuggc

SEQ ID NO: 138560 - RNA, 64 nt, hsa
uguguugagaccauugacaacugcucguguacaggcaccccacagccccagagcauggggcaca

SEQ ID NO: 138561 - RNA, 64 nt, hsa
ggcagagguugcagugagccgagauugcgccacugcaccccagccuggacaacagagugagacu

SEQ ID NO: 138562 - RNA, 64 nt, hsa
aguguacacucccccggugacagggugcucacuggcaccccaucuuccugugaauaacucaaau

SEQ ID NO: 138563 - RNA, 64 nt, hsa
gguccaacucuugcuguccuuucuuaccaccugugcaccccacuuggagcagugggaggaaauc

SEQ ID NO: 138564 - RNA, 64 nt, hsa
aguuguugggguaaaucccacauggcagaguaaggcaccccacagaaauuaacuuggagagccu

SEQ ID NO: 138565 - RNA, 64 nt, hsa
acuccccugaccucaccuuugcaaaguuacagaugcaccccaacauugagauguguuuuuaaug

SEQ ID NO: 138566 - RNA, 64 nt, hsa
gugauucaggggcuccccgggggcagacaccugugcaccccaugaguagugcccacuugaggcu

SEQ ID NO: 138567 - RNA, 64 nt, hsa
cguggcuucuccagccauugaacuggucccacacgcaccccaggccccacuccucggcaguuuc

SEQ ID NO: 138568 - RNA, 64 nt, hsa
uuccacagugcugcuaauaucccagcuccagccagcaccccaucugcaccugaauccucuaacu

SEQ ID NO: 138569 - RNA, 64 nt, hsa
cauggcagggacaaugccggcagccugagcccaggcaccccagugcccgcugggcccagccugg

SEQ ID NO: 138570 - RNA, 64 nt, hsa
cagcacagccccgcccguggagggucccuuuuacgcaccccaaggcccacaccuaagcuuccau

SEQ ID NO: 138571 - RNA, 64 nt, hsa
ugacccgaguaacuuucugcugaugaacaaaucugcaccccacuucagaccucggugggcauuc

SEQ ID NO: 138572 - RNA, 64 nt, hsa
ccuugacacuccccuugcaaaccaucccagcacugcaccccaggcagccacuccuagccuuggc

SEQ ID NO: 138573 - RNA, 55 nt, hsa
agugcgauggggccacguagggugggcaccccaugggacucaguggcucacauuu

SEQ ID NO: 138574 - RNA, 64 nt, hsa
cuggaguuggcccugagcucuauccaccaagccagcaccccaccaucccuuugcaggggaguca

SEQ ID NO: 138575 - RNA, 64 nt, hsa
auccucccugaguccccacacagggccucacucugcaccccaccagggucccgcucacaccagg

SEQ ID NO: 138576 - RNA, 64 nt, hsa
ucccuggccaccuugggcagagcugggucaugcagcaccccauccuuacccggugcccucuccu

SEQ ID NO: 138577 - RNA, 64 nt, hsa
caaagcugacugugccccgcugcgggaggggacggcaccccagugguggcagagcuugggggcc

SEQ ID NO: 138578 - RNA, 64 nt, hsa
uacguuucucuuugaugaccaggaagaaaucccagcaccccagccacaggcuguggcugcuccc

SEQ ID NO: 138579 - RNA, 64 nt, hsa
ggcggagguuucagugagccgagauugcaccauugcaccccagccugggcaacagagcgagacu

SEQ ID NO: 138580 - RNA, 64 nt, hsa
gaggaagcuacagguagguccacccaacgcccaggcaccccagucuacuugcugggcugagucc

SEQ ID NO: 138581 - RNA, 64 nt, hsa
ccagaacuaaaccagggagcugucugaaaucauagcaccccauccggguggcggggagaucaac

SEQ ID NO: 138582 - RNA, 64 nt, hsa
cgguggagaaagggcccaugucaagccuuguucugcaccccaagcauuggugguaggacugggu

SEQ ID NO: 138583 - RNA, 64 nt, hsa
cccugacagauggguccccuuuuucucucucagggcaccccagccccacacucacauguacgaa

SEQ ID NO: 138584 - RNA, 64 nt, hsa
cuacucugcucccuagucccaggguggggguggggcaccccagcugcccugacagauggguccc

SEQ ID NO: 138585 - RNA, 64 nt, hsa; identical to SEQ ID NO: 51595

SEQ ID NO: 138586 - RNA, 64 nt, hsa; identical to SEQ ID NO: 51596

SEQ ID NO: 138587 - RNA, 64 nt, hsa; identical to SEQ ID NO: 51597

SEQ ID NO: 138588 - RNA, 64 nt, hsa; identical to SEQ ID NO: 51598

SEQ ID NO: 138589 - RNA, 64 nt, hsa; identical to SEQ ID NO: 51599

SEQ ID NO: 138590 - RNA, 64 nt, hsa; identical to SEQ ID NO: 51600

SEQ ID NO: 138591 - RNA, 64 nt, hsa; identical to SEQ ID NO: 51601

SEQ ID NO: 138592 - RNA, 64 nt, hsa; identical to SEQ ID NO: 51602

SEQ ID NO: 138593 - RNA, 64 nt, hsa; identical to SEQ ID NO: 51603

SEQ ID NO: 138594 - RNA, 64 nt, hsa; identical to SEQ ID NO: 51604

SEQ ID NO: 138595 - RNA, 64 nt, hsa; identical to SEQ ID NO: 51605

SEQ ID NO: 138596 - RNA, 64 nt, hsa; identical to SEQ ID NO: 51606

SEQ ID NO: 138597 - RNA, 64 nt, hsa; identical to SEQ ID NO: 51607

SEQ ID NO: 138598 - RNA, 64 nt, hsa; identical to SEQ ID NO: 51608

SEQ ID NO: 138599 - RNA, 64 nt, hsa; identical to SEQ ID NO: 51609

SEQ ID NO: 138600 - RNA, 64 nt, hsa; identical to SEQ ID NO: 51610

SEQ ID NO: 138601 - RNA, 64 nt, hsa; identical to SEQ ID NO: 51611

SEQ ID NO: 138602 - RNA, 64 nt, hsa; identical to SEQ ID NO: 51612

SEQ ID NO: 138603 - RNA, 64 nt, hsa; identical to SEQ ID NO: 51613

SEQ ID NO: 138604 - RNA, 64 nt, hsa; identical to SEQ ID NO: 51614

SEQ ID NO: 138605 - RNA, 64 nt, hsa; identical to SEQ ID NO: 51615

SEQ ID NO: 138606 - RNA, 64 nt, hsa; identical to SEQ ID NO: 51616

SEQ ID NO: 138607 - RNA, 64 nt, hsa; identical to SEQ ID NO: 51617

SEQ ID NO: 138608 - RNA, 64 nt, hsa; identical to SEQ ID NO: 51618

SEQ ID NO: 138609 - RNA, 64 nt, hsa; identical to SEQ ID NO: 51619

SEQ ID NO: 138610 - RNA, 64 nt, hsa; identical to SEQ ID NO: 51620

SEQ ID NO: 138611 - RNA, 64 nt, hsa; identical to SEQ ID NO: 105615

SEQ ID NO: 138612 - RNA, 64 nt, hsa; identical to SEQ ID NO: 105616

SEQ ID NO: 138613 - RNA, 64 nt, hsa; identical to SEQ ID NO: 105617

SEQ ID NO: 138614 - RNA, 64 nt, hsa; identical to SEQ ID NO: 105618

SEQ ID NO: 138615 - RNA, 64 nt, hsa; identical to SEQ ID NO: 105619

SEQ ID NO: 138616 - RNA, 64 nt, hsa; identical to SEQ ID NO: 105620

SEQ ID NO: 138617 - RNA, 64 nt, hsa; identical to SEQ ID NO: 105621

SEQ ID NO: 138618 - RNA, 64 nt, hsa; identical to SEQ ID NO: 105622

SEQ ID NO: 138619 - RNA, 64 nt, hsa; identical to SEQ ID NO: 105623

SEQ ID NO: 138620 - RNA, 64 nt, hsa; identical to SEQ ID NO: 105624

SEQ ID NO: 138621 - RNA, 64 nt, hsa
aauuaugucacaaaugaauaguugguuuccaaugcacaaauaucauguaaacuaaucuaaagau

SEQ ID NO: 138622 - RNA, 64 nt, hsa
ccgauucugggacaauaaaguuguuuaaagcuggcacaaauaagcauuaaccaaggcugugucc

SEQ ID NO: 138623 - RNA, 64 nt, hsa
ucaggagaguaaaaauucauauaaagugcaauugcacaaauacaagccaagcuagaaggaagca

SEQ ID NO: 138624 - RNA, 64 nt, hsa
aguagguauacaaaagacuaguuuguuauuaauccacaaauaugcuaaauguuagcaagaugau

SEQ ID NO: 138625 - RNA, 64 nt, hsa
ugaacuuuuucucaucaaaacuagcuuuuuuccccacaaauaaauuaucagguuaaacuuucac

SEQ ID NO: 138626 - RNA, 64 nt, hsa
aucgauauauauauucuugugccuaguacuuuaccacaaauacaguguaauaucaucaguccaa

SEQ ID NO: 138627 - RNA, 64 nt, hsa
gcagggccaaaacuagagugauacucaucucaggcacaaauauauauggggacaucaaaacuuc

SEQ ID NO: 138628 - RNA, 64 nt, hsa
uacucuuguaagaaaaacacugaauacuuugaaccacaaauaaguguuuauggacaaaaauuua

SEQ ID NO: 138629 - RNA, 64 nt, hsa
augaaacauuaacucuaacugugacaaagaagaccacaaauaguuaucuuuuaauuacagaaga

SEQ ID NO: 138630 - RNA, 64 nt, hsa
uuacaagagaagaaagugaaagcaaaugggguuucacaaauaguuguaaauauagugaagcaau

SEQ ID NO: 138631 - RNA, 64 nt, hsa
ucuguuaauaguaccuaaaauugcaacuucuaaacacaaauaaaaagaaaauauuuauaggagg

SEQ ID NO: 138632 - RNA, 64 nt, hsa
aacccaagaaauguaauaaauauuuguaauuuuacacaaauauuuaagaggaaagaguauuaag

SEQ ID NO: 138633 - RNA, 64 nt, hsa
agcacaaauagaaaaccuauuuuuaaauagaaaucacaaauagcaaguguggaagcacuacuuu

SEQ ID NO: 138634 - RNA, 64 nt, hsa
ucaccauauaaaaggaaaaaaauuggugacagagcacaaauagaaaaccuauuuuuaaauagaa

SEQ ID NO: 138635 - RNA, 64 nt, hsa
aauuuguuuucaaugccugugccucagcugcugucacaaauacccaucuuaggaucccaucagc

SEQ ID NO: 138636 - RNA, 64 nt, hsa
cucucaucuucccccacagauacacauccaagcucacaaauaggaguagcaauucuagguggua

SEQ ID NO: 138637 - RNA, 64 nt, hsa
caggcuggagucucuacuuuguauucuugugaggcacaaauauaggcuagaauccaggccccac

SEQ ID NO: 138638 - RNA, 64 nt, hsa
ugugaggcacaaauauaggcuagaauccaggccccacaaauauaggcuagaauccggaauguuu

SEQ ID NO: 138639 - RNA, 64 nt, hsa
uuacugagccacagauaauacaagagcguccccucacaaauaaauuaaagcguaaaaggagacc

SEQ ID NO: 138640 - RNA, 64 nt, hsa
guucuguuucaaacuugcauguggagccauguggcacaaauacucaugccagcucauuacagca

SEQ ID NO: 138641 - RNA, 64 nt, hsa
ucucuuaacaauucaagcaguagacaaaguugcucacaaauacagaaaacaucuuuuugucuac

SEQ ID NO: 138642 - RNA, 64 nt, hsa
uaguuucucugacaggcaguuuuuaacuguuuuccacaaauaaaaauaauaugucaugggauua

SEQ ID NO: 138643 - RNA, 64 nt, hsa
auggccagcacaugagggcucaccaaguguaagccacaaauacacaucagcuauagcacaaaua

SEQ ID NO: 138644 - RNA, 64 nt, hsa
ccaaguguaagccacaaauacacaucagcuauagcacaaauauacuuguguuacaagaaaggaa

SEQ ID NO: 138645 - RNA, 64 nt, hsa
cuaacugcacugaaaccauuucuaaccacaacccuuggcccaaggacuugguacaggaagggag

SEQ ID NO: 138646 - RNA, 64 nt, hsa
gaagggacagugcaucuguucauccauccugcacuuggcccacguugaacuccauggugccuga

SEQ ID NO: 138647 - RNA, 64 nt, hsa
guuuuccucuguuuuggucucuugggcaacauuuuuggcccaaguuugggcaacauuuggccca

SEQ ID NO: 138648 - RNA, 64 nt, hsa
ugggcaacauuuuuggcccaaguuugggcaacauuuggcccaaguuugggcauuuuggcaguag

SEQ ID NO: 138649 - RNA, 64 nt, hsa
gugagcccucuugcgucuuccaggguagcucagguuggcccaguuugggccaguccauuuuugg

SEQ ID NO: 138650 - RNA, 64 nt, hsa
ugagugugacuugggaagcuuucagugcugcuguuuggcccagcucauuacuuucucccuuucu

SEQ ID NO: 138651 - RNA, 64 nt, hsa; identical to SEQ ID NO: 125569

SEQ ID NO: 138652 - RNA, 64 nt, hsa; identical to SEQ ID NO: 125570

SEQ ID NO: 138653 - RNA, 64 nt, hsa; identical to SEQ ID NO: 125571

SEQ ID NO: 138654 - RNA, 64 nt, hsa; identical to SEQ ID NO: 125572

SEQ ID NO: 138655 - RNA, 64 nt, hsa; identical to SEQ ID NO: 125573

SEQ ID NO: 138656 - RNA, 64 nt, hsa; identical to SEQ ID NO: 125574

SEQ ID NO: 138657 - RNA, 64 nt, hsa; identical to SEQ ID NO: 125575

SEQ ID NO: 138658 - RNA, 64 nt, hsa; identical to SEQ ID NO: 125576

SEQ ID NO: 138659 - RNA, 64 nt, hsa; identical to SEQ ID NO: 125577

SEQ ID NO: 138660 - RNA, 64 nt, hsa; identical to SEQ ID NO: 125578

SEQ ID NO: 138661 - RNA, 64 nt, hsa; identical to SEQ ID NO: 125579

SEQ ID NO: 138662 - RNA, 64 nt, hsa; identical to SEQ ID NO: 125580

SEQ ID NO: 138663 - RNA, 64 nt, hsa; identical to SEQ ID NO: 125581

SEQ ID NO: 138664 - RNA, 64 nt, hsa; identical to SEQ ID NO: 125582

SEQ ID NO: 138665 - RNA, 64 nt, hsa; identical to SEQ ID NO: 125583

SEQ ID NO: 138666 - RNA, 64 nt, hsa; identical to SEQ ID NO: 125584

SEQ ID NO: 138667 - RNA, 64 nt, hsa; identical to SEQ ID NO: 125585

SEQ ID NO: 138668 - RNA, 64 nt, hsa; identical to SEQ ID NO: 125586

SEQ ID NO: 138669 - RNA, 64 nt, hsa; identical to SEQ ID NO: 125587

SEQ ID NO: 138670 - RNA, 64 nt, hsa; identical to SEQ ID NO: 125588

SEQ ID NO: 138671 - RNA, 64 nt, hsa; identical to SEQ ID NO: 125589

SEQ ID NO: 138672 - RNA, 64 nt, hsa; identical to SEQ ID NO: 125590

SEQ ID NO: 138673 - RNA, 64 nt, hsa; identical to SEQ ID NO: 125591

SEQ ID NO: 138674 - RNA, 64 nt, hsa; identical to SEQ ID NO: 125592

SEQ ID NO: 138675 - RNA, 64 nt, hsa; identical to SEQ ID NO: 125593

SEQ ID NO: 138676 - RNA, 64 nt, hsa; identical to SEQ ID NO: 125594

SEQ ID NO: 138677 - RNA, 64 nt, hsa; identical to SEQ ID NO: 125595

SEQ ID NO: 138678 - RNA, 64 nt, hsa; identical to SEQ ID NO: 125596

SEQ ID NO: 138679 - RNA, 64 nt, hsa; identical to SEQ ID NO: 125597

SEQ ID NO: 138680 - RNA, 64 nt, hsa; identical to SEQ ID NO: 125598

SEQ ID NO: 138681 - RNA, 64 nt, hsa; identical to SEQ ID NO: 125599

SEQ ID NO: 138682 - RNA, 64 nt, hsa; identical to SEQ ID NO: 125600

SEQ ID NO: 138683 - RNA, 64 nt, hsa; identical to SEQ ID NO: 125601

SEQ ID NO: 138684 - RNA, 64 nt, hsa; identical to SEQ ID NO: 125602

SEQ ID NO: 138685 - RNA, 64 nt, hsa; identical to SEQ ID NO: 125603

SEQ ID NO: 138686 - RNA, 64 nt, hsa; identical to SEQ ID NO: 125604

SEQ ID NO: 138687 - RNA, 64 nt, hsa; identical to SEQ ID NO: 125605

SEQ ID NO: 138688 - RNA, 64 nt, hsa; identical to SEQ ID NO: 125606

SEQ ID NO: 138689 - RNA, 64 nt, hsa; identical to SEQ ID NO: 125607

SEQ ID NO: 138690 - RNA, 64 nt, hsa; identical to SEQ ID NO: 125608

SEQ ID NO: 138691 - RNA, 64 nt, hsa; identical to SEQ ID NO: 125609

SEQ ID NO: 138692 - RNA, 64 nt, hsa; identical to SEQ ID NO: 125610

SEQ ID NO: 138693 - RNA, 64 nt, hsa; identical to SEQ ID NO: 125611

SEQ ID NO: 138694 - RNA, 64 nt, hsa; identical to SEQ ID NO: 125612

SEQ ID NO: 138695 - RNA, 64 nt, hsa; identical to SEQ ID NO: 125613

SEQ ID NO: 138696 - RNA, 64 nt, hsa; identical to SEQ ID NO: 125614

SEQ ID NO: 138697 - RNA, 64 nt, hsa; identical to SEQ ID NO: 125615

SEQ ID NO: 138698 - RNA, 64 nt, hsa; identical to SEQ ID NO: 125616

SEQ ID NO: 138699 - RNA, 64 nt, hsa; identical to SEQ ID NO: 125617

SEQ ID NO: 138700 - RNA, 64 nt, hsa; identical to SEQ ID NO: 125618

SEQ ID NO: 138701 - RNA, 64 nt, hsa; identical to SEQ ID NO: 125619

SEQ ID NO: 138702 - RNA, 64 nt, hsa; identical to SEQ ID NO: 125620

SEQ ID NO: 138703 - RNA, 64 nt, hsa; identical to SEQ ID NO: 125621

SEQ ID NO: 138704 - RNA, 64 nt, hsa; identical to SEQ ID NO: 125622

SEQ ID NO: 138705 - RNA, 64 nt, hsa; identical to SEQ ID NO: 125623

SEQ ID NO: 138706 - RNA, 64 nt, hsa; identical to SEQ ID NO: 125624

SEQ ID NO: 138707 - RNA, 64 nt, hsa; identical to SEQ ID NO: 125625

SEQ ID NO: 138708 - RNA, 64 nt, hsa; identical to SEQ ID NO: 125626

SEQ ID NO: 138709 - RNA, 64 nt, hsa; identical to SEQ ID NO: 125627

SEQ ID NO: 138710 - RNA, 64 nt, hsa; identical to SEQ ID NO: 125628

SEQ ID NO: 138711 - RNA, 64 nt, hsa; identical to SEQ ID NO: 125629

SEQ ID NO: 138712 - RNA, 64 nt, hsa; identical to SEQ ID NO: 125630

SEQ ID NO: 138713 - RNA, 64 nt, hsa; identical to SEQ ID NO: 125631

SEQ ID NO: 138714 - RNA, 64 nt, hsa; identical to SEQ ID NO: 125632

SEQ ID NO: 138715 - RNA, 64 nt, hsa; identical to SEQ ID NO: 125633

SEQ ID NO: 138716 - RNA, 64 nt, hsa; identical to SEQ ID NO: 125634

SEQ ID NO: 138717 - RNA, 64 nt, hsa; identical to SEQ ID NO: 125635

SEQ ID NO: 138718 - RNA, 64 nt, hsa; identical to SEQ ID NO: 125636

SEQ ID NO: 138719 - RNA, 64 nt, hsa; identical to SEQ ID NO: 125637

SEQ ID NO: 138720 - RNA, 64 nt, hsa; identical to SEQ ID NO: 125638

SEQ ID NO: 138721 - RNA, 64 nt, hsa; identical to SEQ ID NO: 125639

SEQ ID NO: 138722 - RNA, 64 nt, hsa; identical to SEQ ID NO: 125640

SEQ ID NO: 138723 - RNA, 64 nt, hsa; identical to SEQ ID NO: 125641

SEQ ID NO: 138724 - RNA, 64 nt, hsa; identical to SEQ ID NO: 125642

SEQ ID NO: 138725 - RNA, 64 nt, hsa
cucccaggccucagaugcaggggcccagaacaccugcucucaccugagccccaggugaaggggc

SEQ ID NO: 138726 - RNA, 64 nt, hsa
accugagccccaggugaaggggcccgggaacaccugcucucaccugagccccaggugaaggggc

SEQ ID NO: 138727 - RNA, 64 nt, hsa
accugagccccaggugaaggggcccgggaacaccugcucucaccugaaccccaggugaaggggc

SEQ ID NO: 138728 - RNA, 64 nt, hsa
caccugaaccccaggugaaggggcccggaacaccugcucucaccugagccccaggugaaggggc

SEQ ID NO: 138729 - RNA, 64 nt, hsa
caccugagccccaggugaaggggcccggaacaccugcucucaccugagccccaggugaaggggc

SEQ ID NO: 138730 - RNA, 64 nt, hsa; identical to SEQ ID NO: 138726

SEQ ID NO: 138731 - RNA, 64 nt, hsa; identical to SEQ ID NO: 138727

SEQ ID NO: 138732 - RNA, 64 nt, hsa
caccugaaccccaggugaaggggcccagaacaccugcucucaccugagccccaggugaaggggc

SEQ ID NO: 138733 - RNA, 64 nt, hsa; identical to SEQ ID NO: 138729

SEQ ID NO: 138734 - RNA, 64 nt, hsa
accugagccccaggugaaggggcccgggaacaccugcucucaccugagccccuggugaaggggc

SEQ ID NO: 138735 - RNA, 64 nt, hsa
caccugagccccuggugaaggggcccggaacacuugcucucaccugagccccaggugaaggggc

SEQ ID NO: 138736 - RNA, 64 nt, hsa
caccugagccccaggugaaggggcccggaacaccugcucucaccugagcccccggugaaggggc

SEQ ID NO: 138737 - RNA, 64 nt, hsa
caccugagcccccggugaaggggcccggaacacuugcucucaccugagccccaggugaaggggc

SEQ ID NO: 138738 - RNA, 64 nt, hsa
aagcuacucaagucugggagaugcugcucugagcugcucucaguacucuccucaucauggcagu

SEQ ID NO: 138739 - RNA, 64 nt, hsa
uucauuuggucacccucaguccagccagugggcuugcucucauuuggccuguucucaggggugg

SEQ ID NO: 138740 - RNA, 64 nt, hsa
ugcucucacuggggacccuccuccccuucccaccugcucucauacugcucagugacauggccca

SEQ ID NO: 138741 - RNA, 64 nt, hsa
ccucccuggggcucccaauccccuuugccaucucugcucucacuggggacccuccuccccuucc

SEQ ID NO: 138742 - RNA, 64 nt, hsa
ccaggaaggaugcucucauaaggcccaggaaggaugcucucauaagcaccuuggucauggauua

SEQ ID NO: 138743 - RNA, 64 nt, hsa
ggccuuuucuggcaagagaagggcccaggaaggaugcucucauaaggcccaggaaggaugcucu

SEQ ID NO: 138744 - RNA, 64 nt, hsa
ucucugaagggcuccaccauuccucuagcaaccaugcucucaaagcucagagggaggaaaagga

SEQ ID NO: 138745 - RNA, 64 nt, hsa
ucagaaguaaccacuguuaacauguuggcuuaucugcucucagguguuucugugccuguacaua

SEQ ID NO: 138746 - RNA, 64 nt, hsa
agacuuggcuuuuuacuuagaggacauucugauuugcucucagaaacaucugauuugggguuaa

SEQ ID NO: 138747 - RNA, 64 nt, hsa
gcuucuuugaaccgcgacuacuggaaguggccuuugcucucagggaacauggugauggaggguu

SEQ ID NO: 138748 - RNA, 64 nt, hsa
caagaggugguagguuggaguaagaugcuacagaugcucucaagucaggaauagaaacugauga

SEQ ID NO: 138749 - RNA, 64 nt, hsa
cuuacauuuguacagcaugaugaccuuuacaaagugcucucaaugcauuuacccauucguuaua

SEQ ID NO: 138750 - RNA, 64 nt, hsa
ccacuggacagucauuguggauagagcagccugcugcucucaggaccagagaagggaaaugacu

SEQ ID NO: 138751 - RNA, 64 nt, hsa
aacccaggcuucuaaauuucuaggccaguacuacugcucucaaaagagauuaacugggauuaag

SEQ ID NO: 138752 - RNA, 64 nt, hsa
uuucugugauuguacaaaaacaacaaaaacgaagugcucucagucagguuuuucccuccauauu

SEQ ID NO: 138753 - RNA, 59 nt, hsa
gcuccgacacugacuacugaccgugcgggugcucucacccucccuucucucccucaaua

SEQ ID NO: 138754 - RNA, 64 nt, hsa
uaaaccuuuuguuugauuucagcccauguucuugacaaugcagagcaauucugagcagucacaa

SEQ ID NO: 138755 - RNA, 64 nt, hsa
gcugagcaaacccgcuuuuguuuccuucccagaaacaaugcaaaacaacagguggagauagucu

SEQ ID NO: 138756 - RNA, 64 nt, hsa
uuuagccuguggucuugccagaucuuugcgaauuacaaugcauauaugucuauuuauucaauau

SEQ ID NO: 138757 - RNA, 64 nt, hsa
uuaaaaugauacaagucaaauaaaucuuaaagacacaaugcacacuuaaaaugacucaauaaaa

SEQ ID NO: 138758 - RNA, 64 nt, hsa
gcugcccgaucgccagcccgaggacuuaccauccacaaugcaccacggaagaggccguucuaug

SEQ ID NO: 138759 - RNA, 64 nt, hsa
aaccagugcugaaagguuuugaauccuuuacccaacaaugcaaaaauagagccaaugguuauaa

SEQ ID NO: 138760 - RNA, 64 nt, hsa
auauucacugacccaaaacucuuuauggcauuuuacaaugcacacagccucaugcaaguuuaga

SEQ ID NO: 138761 - RNA, 64 nt, hsa
accguugaaaggcauagaauugacucuguuccuaacaaugcaguauucucaauuguguuacuga

SEQ ID NO: 138762 - RNA, 64 nt, hsa
ugccuucugagccauuugacguagaggaaaagccugcaagcacauuuuguggaaagaggaguug

SEQ ID NO: 138763 - RNA, 64 nt, hsa
aaucaaucaacccaacaccacaagcuugguugggugcaagcagagggugagcaggggcugcccc

SEQ ID NO: 138764 - RNA, 64 nt, hsa
uaccugccuuucacggcugcugacuucucagggcugcaagcagcacagaauguuauccuuacgu

SEQ ID NO: 138765 - RNA, 64 nt, hsa
gguccagaucacugaauucauguuuacauucucgugcaagcagggaccucuugcuucugagaaa

SEQ ID NO: 138766 - RNA, 64 nt, hsa
uuucuuuuucuuuauagauaugaugccagcaaagggauggaaagucuagaggacaccuuuguau

SEQ ID NO: 138767 - RNA, 64 nt, hsa
uugaauuaauagaggccuuauuagaguggauuguggauggaaagcacuccuacccuccagguaa

SEQ ID NO: 138768 - RNA, 64 nt, hsa
uuuuucccccuuucuagcuccaagaggaaaacgaggauggaaaaccuuuuaugcuguacugaag

SEQ ID NO: 138769 - RNA, 64 nt, hsa
guggauucuuggcucggaaaauucaugcagauauggauggaaagaagaguaaguaucaugcguu

SEQ ID NO: 138770 - RNA, 64 nt, hsa
gaauacauacucuuuccaugcauauauggaacauggauggaaacugaccaccuacuuuguccag

SEQ ID NO: 138771 - RNA, 64 nt, hsa
gagagagagugaagugaaugcaagauaaaaagugggauggaagaauuaaauccagaguuccagg

SEQ ID NO: 138772 - RNA, 64 nt, hsa
acuuacaauaucucaaggaacagcaaugucaacaggauggaaaccagcccuaucugagucuucg

SEQ ID NO: 138773 - RNA, 64 nt, hsa
auagccucaaaauagguuauucguuucuaaacuuggauggaauuagagaauacaaucaaacuuu

SEQ ID NO: 138774 - RNA, 64 nt, hsa
ccuaucucauggaugugauaguggaaggaauuguggauggaagacaagcagaaaagcugaagac

SEQ ID NO: 138775 - RNA, 64 nt, hsa
cuuuguacugcucucugggagccucccugcuugaggauggaaggaugaaauuugacgaauauau

SEQ ID NO: 138776 - RNA, 64 nt, hsa
uauguguuacaacaguaguuuaaaaacuuguacuggauggaacccauuuuauaaacagucuuau

SEQ ID NO: 138777 - RNA, 64 nt, hsa
cauggacuucacuuucggcaacaaaacuaaauaaggauggaacauuuauugaaugaaaaaugca

SEQ ID NO: 138778 - RNA, 64 nt, hsa
aauauaaaccaccgucgugaggcauuuaccuguuggauggaagguagacagcaacaagauuuua

SEQ ID NO: 138779 - RNA, 64 nt, hsa
ucaagaccucauccagcucguccaaaggcuucagggauggaaacaaaccagcucgucucagagg

SEQ ID NO: 138780 - RNA, 64 nt, hsa
ugucuucccagacccaccaugccuggagaggucaggauggaacuaccucauucggcaaauuagc

SEQ ID NO: 138781 - RNA, 64 nt, hsa
aagggggcuuagaauuugugggguauucccaaaaggauggaaguuaagacucagagucucauua

SEQ ID NO: 138782 - RNA, 64 nt, hsa
guuccuggaaucaaccaaaucauguuuuccucuuggauggaagugucaaaggcagaagggugug

SEQ ID NO: 138783 - RNA, 64 nt, hsa; identical to SEQ ID NO: 47773

SEQ ID NO: 138784 - RNA, 64 nt, hsa; identical to SEQ ID NO: 47774

SEQ ID NO: 138785 - RNA, 64 nt, hsa; identical to SEQ ID NO: 47775

SEQ ID NO: 138786 - RNA, 64 nt, hsa; identical to SEQ ID NO: 47776

SEQ ID NO: 138787 - RNA, 64 nt, hsa; identical to SEQ ID NO: 47777

SEQ ID NO: 138788 - RNA, 64 nt, hsa; identical to SEQ ID NO: 47778

SEQ ID NO: 138789 - RNA, 64 nt, hsa; identical to SEQ ID NO: 47779

SEQ ID NO: 138790 - RNA, 64 nt, hsa; identical to SEQ ID NO: 47780

SEQ ID NO: 138791 - RNA, 64 nt, hsa; identical to SEQ ID NO: 47781

SEQ ID NO: 138792 - RNA, 64 nt, hsa; identical to SEQ ID NO: 47782

SEQ ID NO: 138793 - RNA, 64 nt, hsa; identical to SEQ ID NO: 47783

SEQ ID NO: 138794 - RNA, 64 nt, hsa; identical to SEQ ID NO: 47784

SEQ ID NO: 138795 - RNA, 64 nt, hsa
cugccgcccaaagagaaaucacaggggcggggcaggaaugcaaaguguuuucucagaacagcug

SEQ ID NO: 138796 - RNA, 64 nt, hsa
gcuguggcacagacuucuggaaggcuggcugaguggaaugcagggaagagggcaguaccuggga

SEQ ID NO: 138797 - RNA, 64 nt, hsa
uccugagauuuggugccugugagcucugauuguaggaaugcaugugacagucccaguccuaugg

SEQ ID NO: 138798 - RNA, 64 nt, hsa
gugacagucccaguccuaugguaaugacuuaggaggaaugcagauaaaaguaccuuguaagaua

SEQ ID NO: 138799 - RNA, 64 nt, hsa
ucccgugccuuuagaggaaggagaggauugcugaggaaugcagggacgccuguuucuguccuca

SEQ ID NO: 138800 - RNA, 64 nt, hsa
uuuugaaacggaguuuugcucugucacccaggcuggaaugcaauggcaccaucuuggcucacug

SEQ ID NO: 138801 - RNA, 64 nt, hsa
gagcugucuacaguggaauagggggucucccuggggaaugcaggccaaguccuuuuauuuuaac

SEQ ID NO: 138802 - RNA, 64 nt, hsa
ugccggcccauguucucucuccggaggucaccaaggaaugcacagguuucgacuaccagaaagg

SEQ ID NO: 138803 - RNA, 64 nt, hsa
ccaccuuccuaggucguucaaccagguuuugugaggaaugcauucaaaguggcuuuauaaaaga

SEQ ID NO: 138804 - RNA, 64 nt, hsa
uaaccgcuuaaggcauugaagccauaugggauggggaaugcauuucuucaguguuucuccgaga

SEQ ID NO: 138805 - RNA, 64 nt, hsa
aaacugccaugccccccugugaugcucccgugaaggaaugcacuuugccuuguaaguuccuggg

SEQ ID NO: 138806 - RNA, 64 nt, hsa
uugcagccaguuuuuacugaguuuguggcaaucaggaaugcauuugcuaagcaaguaugacuuu

SEQ ID NO: 138807 - RNA, 64 nt, hsa
auggggucugugaaagccacgcagccccuggucuggaaugcaguucaggcucagcaaacuguca

SEQ ID NO: 138808 - RNA, 64 nt, hsa
cgaggugcaguuuggcaaccuguguccuggcugaggaaugcacucacagcaccccuuuccgagc

SEQ ID NO: 138809 - RNA, 64 nt, hsa
caaugccugggacuggagguugauaguuuaaguguguucuuaccgccuccuuuuuccuuuaauc

SEQ ID NO: 138810 - RNA, 64 nt, hsa
cccaaaaugcaaccuugaaaggcacuacugacuuuguucuuauuggauacuccucuuauuauuu

SEQ ID NO: 138811 - RNA, 64 nt, hsa
augcccugaaagaauaauagggauuauaccugucuguucuuaaagauuucaugguuggcucaga

SEQ ID NO: 138812 - RNA, 64 nt, hsa
gugaaaauaugguauaaagguguuuucauuuuccuguucuuaccuauuauuguauagagcuauu

SEQ ID NO: 138813 - RNA, 64 nt, hsa
cuggcacuauaauguaagcucuacugaggugcuauguucuuaguggauguucugacccugcuuc

SEQ ID NO: 138814 - RNA, 64 nt, hsa
acuucccuacauggaguauaugucaagccauaauuguucuuaguuugcaguuacacuaaaaggu

SEQ ID NO: 138815 - RNA, 64 nt, hsa
uuugauauuucuucuauuuuucuuuugaaaccgguguucuuauugguuugccauccuuguucau

SEQ ID NO: 138816 - RNA, 64 nt, hsa
gaauaaaauucuaugaaaaaagacacuagaaugcuguucuuaauuuuaauaguguuaagauagg

SEQ ID NO: 138817 - RNA, 64 nt, hsa
aacauaccucaggucuauuuuaccuuacacugaauguucuuaauaugauuugguaccuaaagua

SEQ ID NO: 138818 - RNA, 64 nt, hsa
auaagcaauuuauuuagcuuaaguuccaacuuacuguucuuauuauaaauugcaaagcaaccug

SEQ ID NO: 138819 - RNA, 64 nt, hsa
gacauuuucuuuaugguuccaagugcaaaacagguguucuuaucuaaaacgucaauuagaaaau

SEQ ID NO: 138820 - RNA, 64 nt, hsa
accucauuugcagauguccaaacuuaaauucaucuguucuuaaaaugcuacuuaaaacuuuggu

SEQ ID NO: 138821 - RNA, 64 nt, hsa
gcuauucgauguaauucuuacuccuaaaacuggcuguucuuagccugaaaucuaaugcuuuguu

SEQ ID NO: 138822 - RNA, 64 nt, hsa
aacguuugccaacucugaaauuucagagauucauuguucuuaaccauauuggacuaaagucugu

SEQ ID NO: 138823 - RNA, 64 nt, hsa
acacuuuaccagcacccagggacauggacuuggguguucuuauuuaugguguguauguaaagag

SEQ ID NO: 138824 - RNA, 64 nt, hsa
cgucauuuuuaaguccagugagcauugugguaguuguucuuagauugcaguuucuuauguuuug

SEQ ID NO: 138825 - RNA, 64 nt, hsa
ucuuauguuuugaguuugaaguugauuuucagaauguucuuagaaaagaacugcauuuuuuucc

SEQ ID NO: 138826 - RNA, 64 nt, hsa
auuuauuuguguuuaaaugcugcugucagacgauuguucuuagaccuccuaaaugccccauauu

SEQ ID NO: 138827 - RNA, 64 nt, hsa
gucucucuuuuuuuaauagcuauuugcuaaaugcuguucuuacacauaauuucuuaauuuucac

SEQ ID NO: 138828 - RNA, 64 nt, hsa
uuaagauuauuagaaaacaugcccugaagagaguuguucuuagguuacacaugaaauccuaccg

SEQ ID NO: 138829 - RNA, 64 nt, hsa
acugauaaaucugucugacugggcuacaauccauuguucuuaguccaauauggacacugccuua

SEQ ID NO: 138830 - RNA, 64 nt, hsa
uuagauuucccuccacgaggucagcaaacuaucauguucuuauguaaacuuaggccaaggccag

SEQ ID NO: 138831 - RNA, 64 nt, hsa
uuugcccacguauauuauguagucuauuugcaacuguucuuaaaaaaaugacauuaaaagaaua

SEQ ID NO: 138832 - RNA, 64 nt, hsa
uagucgucuccucuuggccucagcagcucuucccuguucuuacugguugacauuuugaucacuc

SEQ ID NO: 138833 - RNA, 64 nt, hsa
gcucaguaaauguuuguggaauaagugcauaaaauguucuuaaccuuugauucuacuuacagcc

SEQ ID NO: 138834 - RNA, 64 nt, hsa
gcugaauuuguagcauacagcuuaccugcuagaauguucuuacccucuuaccucuccuguagcg

SEQ ID NO: 138835 - RNA, 64 nt, hsa
agccuaaggaugugccguggaggcgccagcugccuguucuuaccuccgccugcgagagccacag

SEQ ID NO: 138836 - RNA, 64 nt, hsa
cagugagacgagacgagcaaugggaaaccuuuucuguucuuaagaagugacuuuaauuuuauug

SEQ ID NO: 138837 - RNA, 64 nt, hsa
agccugccaugagguaggauccuagggguuuggcuguucuuacuccacugcucagaaagcuucc

SEQ ID NO: 138838 - RNA, 64 nt, hsa
gaguaucaacuuucauacugacgcgucuguaaucuguucuuaugcucauuuuguauuuuccuuu

SEQ ID NO: 138839 - RNA, 64 nt, hsa
augagauaaaauaggagaaguuccuggcuuaaccuguucuuacauauuaaagaaaaguuacuua

SEQ ID NO: 138840 - RNA, 64 nt, hsa
uaaaacagcccauccucugcaaguccaucuauguuguucuuaggcauucuaucuuugcucaaau

SEQ ID NO: 138841 - RNA, 64 nt, hsa
ucaccauuuuuguccuguaucuguaaacacuuuuuguucuuagucuuuuucuuguaaaauugau

SEQ ID NO: 138842 - RNA, 64 nt, hsa
gucuacuuuugaacucuucucuuuguguuuguuuuguucuuauuacaaacuccaagacauuucu

SEQ ID NO: 138843 - RNA, 64 nt, hsa
uuuuuaauuuuauuuugguagcuagguuuuauauuguucuuaaauuuauuuuacucuauuuuau

SEQ ID NO: 138844 - RNA, 64 nt, hsa
uggaagaauucauuaauaaggaacuuuuaauuaugucacaaaugaauaguugguuuccaaugca

SEQ ID NO: 138845 - RNA, 64 nt, hsa
ccuugguggacucuucuaagaauacaguuugcuagucacaaagaauagucuacaaauaugcuuu

SEQ ID NO: 138846 - RNA, 64 nt, hsa
cugugagcuacuuaagguauauaggaaaggaguggucacaaacuugcauccuaauccuuggugg

SEQ ID NO: 138847 - RNA, 64 nt, hsa
auaaaauccauauuuuaagacaauaguucuucaugucacaaacacaaucuauucuacaugagga

SEQ ID NO: 138848 - RNA, 64 nt, hsa
aggaaagaaauacuguuucugggacucucccacagucacaaagcuguuuucacuguggccccua

SEQ ID NO: 138849 - RNA, 64 nt, hsa
cauaguauagggaaacuugacuaauauaaugauugucacaaaguuuucaguaaugcuacaacca

SEQ ID NO: 138850 - RNA, 64 nt, hsa
ucuuacaaaugugaagacugugacaaaguugucagucacaaaucacagcuugaaagacaggaga

SEQ ID NO: 138851 - RNA, 64 nt, hsa
ggcaacaccuuccaucacaauucaacccuuguaagucacaaagccauucauacuggagagaaac

SEQ ID NO: 138852 - RNA, 64 nt, hsa
ugcugagaugggcgcucccgacacagcgcagacccaccaggaggaaagaggcccagcucucagc

SEQ ID NO: 138853 - RNA, 64 nt, hsa
guuucaggggcauuugacauccccuccugguucucaccaggaaaacauccaaagcuuuggagga

SEQ ID NO: 138854 - RNA, 64 nt, hsa
gucaugcagugggucgagcgccugagauccuguucaccaggacuccacagagcuggcucugcuc

SEQ ID NO: 138855 - RNA, 64 nt, hsa
ccuugggucugggaaaaagcuuuaaccugcagggcaccaggacccaaggcaggcuguuccuugg

SEQ ID NO: 138856 - RNA, 64 nt, hsa
uccaccccagcucuggucugugcagacucauggccaccaggaggccugcagauccagccuuccu

SEQ ID NO: 138857 - RNA, 64 nt, hsa
gacucaagugcaccugaucccugcgcaacagccacaccaggagaacaggcuguccuuggcggca

SEQ ID NO: 138858 - RNA, 64 nt, hsa
cuuaauccacgucggagccggcaggugcuucucacaccaggagccucugggggcaggggcuggc

SEQ ID NO: 138859 - RNA, 64 nt, hsa
gcuggccaugggcacugggcucgccuugcacgcccaccaggagggccaggggcauacgcagucc

SEQ ID NO: 138860 - RNA, 64 nt, hsa
accaggagagagggacagguucuguugggggugacaccaggacacaggaauagguucugucggg

SEQ ID NO: 138861 - RNA, 64 nt, hsa
accaggagagagggacagguucugucaggggugacaccaggagagagggacagguucuguuggg

SEQ ID NO: 138862 - RNA, 64 nt, hsa
aagaggagacagggacagguucugucgggggugacaccaggagagagggacagguucugucagg

SEQ ID NO: 138863 - RNA, 64 nt, hsa
acgaggacacagggacagguucuaucaugggugacaccaggagagagggacagguucuguuggg

SEQ ID NO: 138864 - RNA, 64 nt, hsa
accaggacacagggacagguucugucgggggugacaccaggacacagggacagguucugucaug

SEQ ID NO: 138865 - RNA, 64 nt, hsa
accaggagagagggacagguucugucaggggugacaccaggacacagggacagguucugucggg

SEQ ID NO: 138866 - RNA, 64 nt, hsa
guggggacgagggacacugaggagaggugcugggcaccaggacgcugccuccuggucccugguu

SEQ ID NO: 138867 - RNA, 64 nt, hsa
guuugaggaggugaucgaggacugguacaggaaccaccaggaggaagaccugacugaauuccuc

SEQ ID NO: 138868 - RNA, 64 nt, hsa
ugugaacucaggaggggcaggugucagaacugggcaccaggacuggagcccccuccggagacca

SEQ ID NO: 138869 - RNA, 64 nt, hsa
ugaaaccaaagauauauacacaggauccuauucucaccaggaaggggguccacccagcaaagag

SEQ ID NO: 138870 - RNA, 64 nt, hsa
ugcuaggcgagugccaggacuccccaggccaggccaccaggauggcccuucccacuggagguca

SEQ ID NO: 138871 - RNA, 64 nt, hsa
agggugggucucaagugggaggauaaggcuucaccaccaggagauuccccucugcccgaugacu

SEQ ID NO: 138872 - RNA, 64 nt, hsa
cucacagucagucagacgcugcaggcaccacuaucaccaggaguggccaaguaaaccgagacac

SEQ ID NO: 138873 - RNA, 64 nt, hsa
auccccggaagggggcaaugccagugccuggacccaccaggaugcagggcaagcugggaucggg

SEQ ID NO: 138874 - RNA, 64 nt, hsa
uccucaauccagucaacaccuacuauguaccaggcaccaggaagccagaagcucagggcccagc

SEQ ID NO: 138875 - RNA, 64 nt, hsa
gaggaggacgguugacggcccugcuuggauccaccaccaggacgcugugcucggccauggcgcg

SEQ ID NO: 138876 - RNA, 64 nt, hsa
gcaugcccuccugcaguugcuggauggauagggacaccaggaagaggacaaacugcauggacuc

SEQ ID NO: 138877 - RNA, 64 nt, hsa
guggucccgccgcaccucugcaucuccugggcgucaccaggaaggcucugaagucccgggcugc

SEQ ID NO: 138878 - RNA, 64 nt, hsa
agacugaagacucuggacucauugcugauuggaacaccaggaggagguuggauuucugccagug

SEQ ID NO: 138879 - RNA, 64 nt, hsa
ggcgccuggaucuugcccagcugccagcuccccccaccaggacugugguuccucaguuucuccu

SEQ ID NO: 138880 - RNA, 64 nt, hsa
uacugauguggccacccuauucccacauggggagcaccaggagcccuggagccccuuccaccca

SEQ ID NO: 138881 - RNA, 64 nt, hsa
cccugauuugacccugugugggaaaugcugaaagcaccaggaggaagccgguucccgugagaua

SEQ ID NO: 138882 - RNA, 64 nt, hsa
aaaauccgucucccauuuguuacagccucaccugcaccaggauagaaagcacgugauggaaucu

SEQ ID NO: 138883 - RNA, 64 nt, hsa
auaugaaagccagggggcagugccaaacacgcggcaccaggagauggaggaugucaucaggcug

SEQ ID NO: 138884 - RNA, 64 nt, hsa
uaugaagugagccuggacaacaacguggagccugcaccaggagcggccagggaggguucucccc

SEQ ID NO: 138885 - RNA, 64 nt, hsa
uuggccucuugguuggccaggcccaccaggaagucaccaggacaguccacccgcccuguuggca

SEQ ID NO: 138886 - RNA, 64 nt, hsa
ggugaggccacuuggccucuugguuggccaggcccaccaggaagucaccaggacaguccacccg

SEQ ID NO: 138887 - RNA, 64 nt, hsa
ucucccaccaccucaccaguuuccaggugguaagcaccaggacgcccucgagguugcucuggga

SEQ ID NO: 138888 - RNA, 64 nt, hsa
uucaagaaauuacuggaaggcuuccacuaggguccaccaggaguucucccaccaccucaccagu

SEQ ID NO: 138889 - RNA, 64 nt, hsa
aaccucaggucucccccuacauauuaauaccagucaccaggagcccaccaccucccucuaggau

SEQ ID NO: 138890 - RNA, 64 nt, hsa
aggagaugccucccuagcccagauggcaccuggacaccaggaugggacugcaaccucaggucuc

SEQ ID NO: 138891 - RNA, 64 nt, hsa
cuucgcuucucucaccaggaacauucgcuucucucaccaggaacauuuaugguaguaugagggg

SEQ ID NO: 138892 - RNA, 64 nt, hsa
ggcugagccaggagaugcacaccuucgcuucucucaccaggaacauucgcuucucucaccagga

SEQ ID NO: 138893 - RNA, 62 nt, hsa
cuggaccuaauugggcauugggcuuuagugagaccacagaccaggcccgucucuccuguagg

SEQ ID NO: 138894 - RNA, 62 nt, hsa
gaucccacuuacucuuuuuuuuuuuuucagagaccacagaccacagugauuuuucuuuuccc

SEQ ID NO: 138895 - RNA, 62 nt, hsa
gugaugucauaauuguacuaauccacauaaguaccacagagaaggguuugaacugugcuauu

SEQ ID NO: 138896 - RNA, 62 nt, hsa
agcuacagcuucuuugcguuuaacuuuuucaaaccacagaccagaacugguugcauguuacu

SEQ ID NO: 138897 - RNA, 62 nt, hsa
ugcuuuuuaaaggcuaaauauuguuugugggaaccacagaugguugggguugaacaguaagc

SEQ ID NO: 138898 - RNA, 62 nt, hsa
cuacucaacucuguuucugaagcaggaaagccaccacagacaguacauaaaggaauaugugu

SEQ ID NO: 138899 - RNA, 62 nt, hsa
auuugacuccuacagcagaaguucugagccugaccacagaugguguguaaucuaucaaacac

SEQ ID NO: 138900 - RNA, 62 nt, hsa
cugcagcccacaggaguccagggaaggcggggaccacagaggcacagaguccagcacuuggc

SEQ ID NO: 138901 - RNA, 62 nt, hsa
gggacuguucuuuuacaagacaggacccugggaccacagagggcaggaacuugcacaaaauc

SEQ ID NO: 138902 - RNA, 62 nt, hsa
augcugcccgcuucucacccuaugugggugggaccacagacucacauccugaccuugcacaa

SEQ ID NO: 138903 - RNA, 62 nt, hsa
uuaugcgaaauacccaagauucaugcuacuguaccacagauuuguuuucacagcaauaaauc

SEQ ID NO: 138904 - RNA, 62 nt, hsa
aucaguuuuauuuuucucugauuuuuuuuaauaccacagaaucaccugagugucaauugaaa

SEQ ID NO: 138905 - RNA, 62 nt, hsa
ugagagaguccacacagugcuguacugcacacaccacagaaugugugagauuuuccuguuug

SEQ ID NO: 138906 - RNA, 62 nt, hsa
acuggaaugaaaugugcaaacaugggggugacaccacagagagaaccugugaaugcauucag

SEQ ID NO: 138907 - RNA, 62 nt, hsa
uauauuaaaaaaaaaaaagagaaaauacugaaaccacagacagugcaaagacucuccugcuu

SEQ ID NO: 138908 - RNA, 62 nt, hsa
gaccccaccccaccaucucagcacacacccucaccacagacuggaggcugccaacacccagg

SEQ ID NO: 138909 - RNA, 64 nt, hsa
caguggcucagcuaagugcucccccuagcucccaucucaggagaccaaaucucacagaaaaaua

SEQ ID NO: 138910 - RNA, 64 nt, hsa
cgugggacaggcuuaggggaaagagcuuguccuaucucaggaacaaaauuauaggcugugggca

SEQ ID NO: 138911 - RNA, 64 nt, hsa
gugacugcauugaggcgcucuauucuucuucaccucucaggaacugacuuuuauuuuuucuguc

SEQ ID NO: 138912 - RNA, 64 nt, hsa
uuuccuugugacaagaaauuugcaagcuuuucaaucucaggaauacuggauucuauagccaaga

SEQ ID NO: 138913 - RNA, 64 nt, hsa
agguaaugauacagagauuggccauuacgccagcucucaggagaaaaacaacuaggaugucuug

SEQ ID NO: 138914 - RNA, 64 nt, hsa
uuaagaugccaaugaaaaguauugugaacauuauucucaggacacuuuuaccauacuugaguag

SEQ ID NO: 138915 - RNA, 64 nt, hsa
ccugggggaaaagccuggguuggguuuagaaagaucucaggaaaaugaguuucucuucccucag

SEQ ID NO: 138916 - RNA, 64 nt, hsa
ucucacagucggccacuggauuucccucacuggcucucaggagugugaccagaguagacuuggg

SEQ ID NO: 138917 - RNA, 64 nt, hsa
cacagcacuucaaagaagcugucuuggaagucugucucaggagcacccugucuucuuaauucuc

SEQ ID NO: 138918 - RNA, 64 nt, hsa
augaaauacucaggguuaggaauccuagcacuugucucaggacucugaaaaggaacggcuuccu

SEQ ID NO: 138919 - RNA, 64 nt, hsa
uacauaaaugugaaaaguuguugaucuugaaauaucucaggauagcacuuuuggcaaacucuua

SEQ ID NO: 138920 - RNA, 64 nt, hsa
aggaucccaaacuguaaaagauugaaauaaucuuucucaggauuuuuuaaaugucuaagauuau

SEQ ID NO: 138921 - RNA, 64 nt, hsa
auguucuauuuuugacuguagccacagcugcuguucucaggacagcaucccuucccacaugccu

SEQ ID NO: 138922 - RNA, 64 nt, hsa
ucccagacuaaaggauccagagagcagcucccuuucucaggagcuugggcagugccccagggag

SEQ ID NO: 138923 - RNA, 64 nt, hsa
cagacagcccuccacuccagcucugagacccuuuucucaggaccucuguaggcagcagagagag

SEQ ID NO: 138924 - RNA, 64 nt, hsa
gguucuucaugauccacacuuugggcuuaguauuucucaggaagagcuauggcccagaaacaac

SEQ ID NO: 138925 - RNA, 64 nt, hsa
ugcccuucuaucccagauuaccuaaauguucccuucucaggaauucugucucaucaguucuuca

SEQ ID NO: 138926 - RNA, 64 nt, hsa
agcugcugccuuccauuccucagcugaaagaacaucucaggaagcacuggacacagugauucug

SEQ ID NO: 138927 - RNA, 64 nt, hsa
agaacaagugccacaaaaaugaaaacaggccacuucucaggaguugaauaaucaggggucaccg

SEQ ID NO: 138928 - RNA, 64 nt, hsa
aucccuccccccacauuuucauacuuuuccccauucucaggacuuuucaccauccaucacccac

SEQ ID NO: 138929 - RNA, 64 nt, hsa
aacgugacguuccaguugcucaacuacugcaggaucucaggacuaaggagagagaaggcuaaau

SEQ ID NO: 138930 - RNA, 64 nt, hsa
gcagcggggagugguggugcuggccaagagcuucucucaggagagaaucaaagagaacuuccag

SEQ ID NO: 138931 - RNA, 64 nt, hsa
caggcagucugcucucucucaggaucaccacgcaucucaggauuggucuaaacuucaagucuca

SEQ ID NO: 138932 - RNA, 64 nt, hsa
uauggaccauuuaccuggcaggcagucugcucucucucaggaucaccacgcaucucaggauugg

SEQ ID NO: 138933 - RNA, 64 nt, hsa
augaggcucccucccaaccugauccaaaagccagucucaggaguuuaccccugggaugggggau

SEQ ID NO: 138934 - RNA, 64 nt, hsa
ccacgugcccuguggcaccccagcucacugggagucucaggagggauaaccggauuucugcucu

SEQ ID NO: 138935 - RNA, 64 nt, hsa
cucugcuucaugcccaagaugacuugcgaggcaaucucaggagcuguggacuuaaccguugcaa

SEQ ID NO: 138936 - RNA, 64 nt, hsa
caccacaucgcuagguggugcuuacuaauuaccuucucaggauuuuccucagauugaaaagcuu

SEQ ID NO: 138937 - RNA, 64 nt, hsa
acuccucugccgccuccccucaugccucaccgugucucaggagagaggggugcacguuucaugg

SEQ ID NO: 138938 - RNA, 64 nt, hsa
aaaaaucauugacgucauagaauauucuucuuccucucaggagaagacggaagcuggaguugga

SEQ ID NO: 138939 - RNA, 64 nt, hsa
ggcauaacagcacauucaucccuuugguuugggaucucaggaauacagucccaugcaaagauuc

SEQ ID NO: 138940 - RNA, 64 nt, hsa
uuucucauggaguuucuuaucuuuuuugguuuauucucaggaguugcuuguacauucuugggca

SEQ ID NO: 138941 - RNA, 64 nt, hsa; identical to SEQ ID NO: 42317

SEQ ID NO: 138942 - RNA, 64 nt, hsa; identical to SEQ ID NO: 42318

SEQ ID NO: 138943 - RNA, 64 nt, hsa; identical to SEQ ID NO: 42319

SEQ ID NO: 138944 - RNA, 64 nt, hsa; identical to SEQ ID NO: 42320

SEQ ID NO: 138945 - RNA, 64 nt, hsa; identical to SEQ ID NO: 42321

SEQ ID NO: 138946 - RNA, 64 nt, hsa; identical to SEQ ID NO: 42322

SEQ ID NO: 138947 - RNA, 64 nt, hsa; identical to SEQ ID NO: 42323

SEQ ID NO: 138948 - RNA, 64 nt, hsa; identical to SEQ ID NO: 42324

SEQ ID NO: 138949 - RNA, 64 nt, hsa; identical to SEQ ID NO: 42325

SEQ ID NO: 138950 - RNA, 64 nt, hsa; identical to SEQ ID NO: 42326

SEQ ID NO: 138951 - RNA, 64 nt, hsa; identical to SEQ ID NO: 42327

SEQ ID NO: 138952 - RNA, 64 nt, hsa; identical to SEQ ID NO: 42328

SEQ ID NO: 138953 - RNA, 64 nt, hsa; identical to SEQ ID NO: 42329

SEQ ID NO: 138954 - RNA, 64 nt, hsa; identical to SEQ ID NO: 42330

SEQ ID NO: 138955 - RNA, 64 nt, hsa; identical to SEQ ID NO: 42331

SEQ ID NO: 138956 - RNA, 64 nt, hsa; identical to SEQ ID NO: 42332

SEQ ID NO: 138957 - RNA, 64 nt, hsa
uucaacacugcuucaagguuucuuuuguauauaauucuuagaaugcucauuucuuuuaaauggu

SEQ ID NO: 138958 - RNA, 64 nt, hsa
ugugugugggaaaucucuguagagcaccuuuucuuucuuagacuaaguaacccaguacaauagu

SEQ ID NO: 138959 - RNA, 64 nt, hsa
accaaguggaagaaacgucuucuugccaagcucauucuuagaacuuacacaucuagaacagcuu

SEQ ID NO: 138960 - RNA, 64 nt, hsa
aauguuucaucaaaugguuaaauggaccacugguuucuuagagaaauguuuuuaggcuuaauuc

SEQ ID NO: 138961 - RNA, 64 nt, hsa
aaaauuuucaagguuauaguacuuauuucaacaauucuuagagaugcuagcuaguguugaagcu

SEQ ID NO: 138962 - RNA, 64 nt, hsa
augccaagagaauagauacauuauggaccucuuguucuuagauaugggccucucagccuggcag

SEQ ID NO: 138963 - RNA, 64 nt, hsa
gagcacuuuaacaaguugagcauuccauguuucauucuuagaaccuucuuuaauagagggucuu

SEQ ID NO: 138964 - RNA, 64 nt, hsa
ucaagaaagcaugcgucuugucagcuacauuguuuucuuagauggauuucuccuguuaauccuc

SEQ ID NO: 138965 - RNA, 64 nt, hsa
agacucuaugacaugcccucagaauaucagaaucuucuuagaaauaaacuaggaaaugcagaug

SEQ ID NO: 138966 - RNA, 64 nt, hsa
gcuaaugaauguauaggagaccacauuguaauuguucuuagaugauggaguccaugcaguuucu

SEQ ID NO: 138967 - RNA, 64 nt, hsa
uguaauuguucuuagaugauggaguccaugcaguuucuuagaaaucggucucagugcaugcugu

SEQ ID NO: 138968 - RNA, 64 nt, hsa
cuuucaagcagcagucgacauguaaaugaagguguucuuagaauucgcauuuugccagcucagc

SEQ ID NO: 138969 - RNA, 64 nt, hsa
guuucacaagcuuuaauccauguggauuuuuuuuuucuuagagaaccacaaaacauaaaaggag

SEQ ID NO: 138970 - RNA, 64 nt, hsa
cuaagaaucuuuguuagauauuaggucccaucaauucuuagaauaucuaaacaucuuuguugau

SEQ ID NO: 138971 - RNA, 64 nt, hsa
acauuucacugaugcuucuaucaggucccaucaauucuuagaauaucuaagaaucuuuguuaga

SEQ ID NO: 138972 - RNA, 64 nt, hsa
gaugacuaauuuuaaaagaaccugcccugaaaaguucuuagaaacgcagugaaagggaggaacu

SEQ ID NO: 138973 - RNA, 64 nt, hsa
cuccaugaaaagcucacugcugccccagccgggcuucuuagaggaggucaguuguccuauguau

SEQ ID NO: 138974 - RNA, 64 nt, hsa
ucauuuuuaaguccagugagcauugugguaguuguucuuagauugcaguuucuuauguuuugag

SEQ ID NO: 138975 - RNA, 64 nt, hsa
uuauguuuugaguuugaaguugauuuucagaauguucuuagaaaagaacugcauuuuuuuccuu

SEQ ID NO: 138976 - RNA, 64 nt, hsa
uguauuuaaaaggguaauguggccuuggcauuucuucuuagaaaaaaacuaauuuuuggugcug

SEQ ID NO: 138977 - RNA, 64 nt, hsa
uauucagcguacuugaauuuuucuuccucuccacuucuuagaggcauucaguuagcaaagaggu

SEQ ID NO: 138978 - RNA, 64 nt, hsa
gugguaagucuuuuuucuuagauugcgcuaaaauuucuuagauuguucagcgcucagaacaaaa

SEQ ID NO: 138979 - RNA, 64 nt, hsa
aauguuauuuuaggugcuuugugguaagucuuuuuucuuagauugcgcuaaaauuucuuagauu

SEQ ID NO: 138980 - RNA, 64 nt, hsa
ugagaggugauacccgaugaucuucucuauaauauucuuagaguaaaacaaaaucucaaaagua

SEQ ID NO: 138981 - RNA, 64 nt, hsa
uuauuaacuuaauuugacucuuaauguguauauguucuuagauuagaauaaugcaacuucgagu

SEQ ID NO: 138982 - RNA, 64 nt, hsa
gcugggcaggggugggaguggccaguguuggcgguucuuagagcagaugugucauuguguucau

SEQ ID NO: 138983 - RNA, 64 nt, hsa
agaaaaacaaaagacagcagaaaauaaccagguauucuuagagcuauagauuuuuggucacuug

SEQ ID NO: 138984 - RNA, 64 nt, hsa
aggcaagagcuuccuucuuuugucucacgaguuuuucuuagagcucuugccugagcuggcuucc

SEQ ID NO: 138985 - RNA, 64 nt, hsa
cauuugagcaugcuguaauuaagaugagaucaguuucuuagaaaaagcuuuccugaaucccucu

SEQ ID NO: 138986 - RNA, 64 nt, hsa
uuacaguggcuuccgugggaucgucaauuucuuguucuuagaguuucggguguuuuucuccagu

SEQ ID NO: 138987 - RNA, 64 nt, hsa
augacugaaacucauuuaacuggguuaauuucauuucuuagacugaauauauuauuguuaagau

SEQ ID NO: 138988 - RNA, 64 nt, hsa
aucguugucccuacaggaggaacaguggccuugcuucuuagacggucuucacuguguguuuuaa

SEQ ID NO: 138989 - RNA, 64 nt, hsa
gugcuauaaaauuaacaguauuaaaugacuuauauucuuagaauacaucgagugucuuuucuua

SEQ ID NO: 138990 - RNA, 64 nt, hsa
gaaguauuuauccaccuguuuuauuuucaugaaguucuuagacuagcugaauuugucuuuaaaa

SEQ ID NO: 138991 - RNA, 64 nt, hsa
caugagccauugugccuagccuauuuugauuuuuuucuuagagucaaggucuugcucuguugcc

SEQ ID NO: 138992 - RNA, 64 nt, hsa
guggaagguaucauccguguggguucuucccuccugcccucaauuguuuuucugggccuuguuu

SEQ ID NO: 138993 - RNA, 64 nt, hsa
cuuucaaaggcuaccuuuaugaaguagacacuauugcccucagaaugagagaacauuaaacuac

SEQ ID NO: 138994 - RNA, 64 nt, hsa
ccccagauccuuaauguaguucucauccuccgcaugcccucagccacaagcgggugacugacug

SEQ ID NO: 138995 - RNA, 64 nt, hsa
ggagcaccauccugcccuagcagagcccaggccuugcccucaugaagcaucauugaaauagcag

SEQ ID NO: 138996 - RNA, 64 nt, hsa
gcuuucuuuaucaaccugcucacucacaaaugugugcccucagccagagaguaagaaagcccaa

SEQ ID NO: 138997 - RNA, 64 nt, hsa
auauguguguacacgcgcacgccuguaugugcgcugcccucagacaugcaagugaaaggaggag

SEQ ID NO: 138998 - RNA, 64 nt, hsa
gacugcauccgaaaggcccccacucaccauggucugcccucaccccacauauguguguacacgc

SEQ ID NO: 138999 - RNA, 64 nt, hsa
ggccuuugauugcucaccccugcuccccaggcccugcccucacuuuuaccaaagguucucccuc

SEQ ID NO: 139000 - RNA, 64 nt, hsa
cuugcugaaguuaguaguacuguacuaagagcucugcccucaugugaauuccugcccuggcgcc

SEQ ID NO: 139001 - RNA, 64 nt, hsa
caguagaaccuuuccagguucucuuagagccauaugcccucaucaucccaggggagaacuacau

SEQ ID NO: 139002 - RNA, 64 nt, hsa
ugguguuacacauugaggcugucuuuaaggggccugcccucaucaucaacgucucagcccuuca

SEQ ID NO: 139003 - RNA, 64 nt, hsa
ccuuccgguggagcugccucguuccuuugaacuaugcccucacccuucugcccucacuugauuu

SEQ ID NO: 139004 - RNA, 64 nt, hsa
ugccucguuccuuugaacuaugcccucacccuucugcccucacuugauuugaaagggucguuaa

SEQ ID NO: 139005 - RNA, 64 nt, hsa
aaggaggaguggcauuggcauccugacccagcucugcccucaagguggggauggaugggcaaag

SEQ ID NO: 139006 - RNA, 64 nt, hsa
guuggggcuggucccagccugaggcuccagcugaugcccucagcucccagagagggggugcccc

SEQ ID NO: 139007 - RNA, 64 nt, hsa
uucucaggaacaaaaccugaggcagcccuuuggaugcccucacagccuugcuucucucagccua

SEQ ID NO: 139008 - RNA, 64 nt, hsa
cucaggcagggacagacccagaaagaacacagucugcccucagagagcucuuugcaguguagug

SEQ ID NO: 139009 - RNA, 64 nt, hsa
cuccauuccaaaggccaucuuguggucaguuucaugcccucaccugauuuuuuuuuuuuuuuuu

SEQ ID NO: 139010 - RNA, 64 nt, hsa
gggagaaacucacagcuccuccgggauacauaugugcccucagcagcagcucccaggugaaguu

SEQ ID NO: 139011 - RNA, 64 nt, hsa
uucgaaugcacacucaaauaaaaaaccaaacagcugcccucauuagcggauuccguuccauuau

SEQ ID NO: 139012 - RNA, 64 nt, hsa
aacuucauuucucuuccaacccauuguguuccucugcccucauucuuuaccuuuguuguaagaa

SEQ ID NO: 139013 - RNA, 64 nt, hsa
gucuccucggccauccuguggggccccgaggccuugcccucacuucagugccugggugcucagg

SEQ ID NO: 139014 - RNA, 64 nt, hsa
aaguaauaaaccguggguggugauagugacccagugcccucacugcccagccccgccuguccuc

SEQ ID NO: 139015 - RNA, 64 nt, hsa
ccaggccagcuuucugcauggauggucagucucuugcccucaaacacuacagcaaacaagcuac

SEQ ID NO: 139016 - RNA, 64 nt, hsa
gcagagaaacaaagucuggacccacuccaugcucugcccucagaccuggccaggugaugcucug

SEQ ID NO: 139017 - RNA, 64 nt, hsa
ggagcugucugcauccgccacccccuccaaccacugcccucagcccccgaccuuauuuauuacc

SEQ ID NO: 139018 - RNA, 64 nt, hsa
agacccugcccggcuccucccugaccgguccuugugcccucaccagacacccuguuggccauga

SEQ ID NO: 139019 - RNA, 64 nt, hsa
ccuccccaaugcugacccuaggauuuuccuucccugcccucaccugcaaaugaguuaaagaaga

SEQ ID NO: 139020 - RNA, 64 nt, hsa
ggggacacagugguaaucaagacagccccaacacugcccucauagagcucacaguccaauggag

SEQ ID NO: 139021 - RNA, 64 nt, hsa
cuguccaucccacagcucagccuggaugcccaccugcccucaggcaagguagagguggcagggg

SEQ ID NO: 139022 - RNA, 64 nt, hsa
ggaauccaggucccccagguggagcugccugccuugcccucacugcccacucugcccacacuuc

SEQ ID NO: 139023 - RNA, 64 nt, hsa
cuaagggccacucugguuaucugccaagguugcuugcccucaccccaaugcuccaacagccauu

SEQ ID NO: 139024 - RNA, 64 nt, hsa
auaccuccucccguugggcugugacuuuuccuccugcccucagccucugaaacagaaaucuuug

SEQ ID NO: 139025 - RNA, 64 nt, hsa
uaagaaucuucccaaaauccuuuaauuuaccugaugcccucaucaggucguuaaaaauucaaau

SEQ ID NO: 139026 - RNA, 64 nt, hsa
gugacagccucacagggucugguaccagggguugugcccucagcagugacagcagcuuaggugu

SEQ ID NO: 139027 - RNA, 64 nt, hsa
ucaucugaacuuccguuuccccagggccuccagcugcccucagacacugaugucuguccccagg

SEQ ID NO: 139028 - RNA, 64 nt, hsa
gaagggugagggggucagacacaggcccugccccugcccucagugacuggccaguccagcccag

SEQ ID NO: 139029 - RNA, 64 nt, hsa; identical to SEQ ID NO: 58216

SEQ ID NO: 139030 - RNA, 64 nt, hsa; identical to SEQ ID NO: 58217

SEQ ID NO: 139031 - RNA, 64 nt, hsa; identical to SEQ ID NO: 58218

SEQ ID NO: 139032 - RNA, 64 nt, hsa; identical to SEQ ID NO: 58219

SEQ ID NO: 139033 - RNA, 64 nt, hsa; identical to SEQ ID NO: 58220

SEQ ID NO: 139034 - RNA, 64 nt, hsa; identical to SEQ ID NO: 58221

SEQ ID NO: 139035 - RNA, 64 nt, hsa; identical to SEQ ID NO: 58222

SEQ ID NO: 139036 - RNA, 64 nt, hsa; identical to SEQ ID NO: 58223

SEQ ID NO: 139037 - RNA, 64 nt, hsa; identical to SEQ ID NO: 58224

SEQ ID NO: 139038 - RNA, 64 nt, hsa; identical to SEQ ID NO: 58225

SEQ ID NO: 139039 - RNA, 64 nt, hsa; identical to SEQ ID NO: 58226

SEQ ID NO: 139040 - RNA, 64 nt, hsa; identical to SEQ ID NO: 58227

SEQ ID NO: 139041 - RNA, 64 nt, hsa; identical to SEQ ID NO: 58228

SEQ ID NO: 139042 - RNA, 64 nt, hsa; identical to SEQ ID NO: 58229

SEQ ID NO: 139043 - RNA, 64 nt, hsa; identical to SEQ ID NO: 58230

SEQ ID NO: 139044 - RNA, 64 nt, hsa; identical to SEQ ID NO: 58231

SEQ ID NO: 139045 - RNA, 64 nt, hsa; identical to SEQ ID NO: 58232

SEQ ID NO: 139046 - RNA, 64 nt, hsa; identical to SEQ ID NO: 58233

SEQ ID NO: 139047 - RNA, 64 nt, hsa; identical to SEQ ID NO: 58234

SEQ ID NO: 139048 - RNA, 64 nt, hsa; identical to SEQ ID NO: 58235

SEQ ID NO: 139049 - RNA, 64 nt, hsa; identical to SEQ ID NO: 58236

SEQ ID NO: 139050 - RNA, 64 nt, hsa; identical to SEQ ID NO: 58237

SEQ ID NO: 139051 - RNA, 64 nt, hsa; identical to SEQ ID NO: 58238

SEQ ID NO: 139052 - RNA, 64 nt, hsa; identical to SEQ ID NO: 58239

SEQ ID NO: 139053 - RNA, 64 nt, hsa; identical to SEQ ID NO: 58240

SEQ ID NO: 139054 - RNA, 64 nt, hsa; identical to SEQ ID NO: 58241

SEQ ID NO: 139055 - RNA, 64 nt, hsa; identical to SEQ ID NO: 58242

SEQ ID NO: 139056 - RNA, 64 nt, hsa; identical to SEQ ID NO: 58243

SEQ ID NO: 139057 - RNA, 64 nt, hsa; identical to SEQ ID NO: 58244

SEQ ID NO: 139058 - RNA, 64 nt, hsa; identical to SEQ ID NO: 58245

SEQ ID NO: 139059 - RNA, 64 nt, hsa; identical to SEQ ID NO: 58246

SEQ ID NO: 139060 - RNA, 64 nt, hsa; identical to SEQ ID NO: 58247

SEQ ID NO: 139061 - RNA, 64 nt, hsa; identical to SEQ ID NO: 58248

SEQ ID NO: 139062 - RNA, 64 nt, hsa; identical to SEQ ID NO: 58249

SEQ ID NO: 139063 - RNA, 64 nt, hsa; identical to SEQ ID NO: 58250

SEQ ID NO: 139064 - RNA, 64 nt, hsa; identical to SEQ ID NO: 58251

SEQ ID NO: 139065 - RNA, 64 nt, hsa; identical to SEQ ID NO: 58252

SEQ ID NO: 139066 - RNA, 64 nt, hsa; identical to SEQ ID NO: 58253

SEQ ID NO: 139067 - RNA, 64 nt, hsa; identical to SEQ ID NO: 58254

SEQ ID NO: 139068 - RNA, 64 nt, hsa; identical to SEQ ID NO: 58255

SEQ ID NO: 139069 - RNA, 64 nt, hsa; identical to SEQ ID NO: 58256

SEQ ID NO: 139070 - RNA, 64 nt, hsa; identical to SEQ ID NO: 58257

SEQ ID NO: 139071 - RNA, 64 nt, hsa; identical to SEQ ID NO: 58258

SEQ ID NO: 139072 - RNA, 64 nt, hsa; identical to SEQ ID NO: 58259

SEQ ID NO: 139073 - RNA, 64 nt, hsa; identical to SEQ ID NO: 58260

SEQ ID NO: 139074 - RNA, 64 nt, hsa; identical to SEQ ID NO: 58261

SEQ ID NO: 139075 - RNA, 64 nt, hsa; identical to SEQ ID NO: 58262

SEQ ID NO: 139076 - RNA, 64 nt, hsa; identical to SEQ ID NO: 58263

SEQ ID NO: 139077 - RNA, 64 nt, hsa; identical to SEQ ID NO: 58264

SEQ ID NO: 139078 - RNA, 64 nt, hsa; identical to SEQ ID NO: 58265

SEQ ID NO: 139079 - RNA, 64 nt, hsa; identical to SEQ ID NO: 58266

SEQ ID NO: 139080 - RNA, 64 nt, hsa; identical to SEQ ID NO: 58267

SEQ ID NO: 139081 - RNA, 64 nt, hsa; identical to SEQ ID NO: 58268

SEQ ID NO: 139082 - RNA, 60 nt, hsa
aauggcuauggcguuagguugaaauggccaggcacaaauuuagucuggucauuuuguuua

SEQ ID NO: 139083 - RNA, 60 nt, hsa
gaugugaaacugacaauccuguggccacauggcacaaaacaccaaauauugguuaugaug

SEQ ID NO: 139084 - RNA, 60 nt, hsa
uauauuucucucacccuauuuugagacagaggcacaaagacucagcaauuuuuuucccuc

SEQ ID NO: 139085 - RNA, 60 nt, hsa
aaacuauuuucuucuucuccaugaagccagggcacaaagaauuugacaguacaagucaaa

SEQ ID NO: 139086 - RNA, 60 nt, hsa
cccaggcucugcucaggcugggaggcagagggcacaaaccuuauaauuuuuuaaaugaaa

SEQ ID NO: 139087 - RNA, 60 nt, hsa
caaggagucccuccagccugaauaacacguggcacaaaugggcccggccuuuggcagagg

SEQ ID NO: 139088 - RNA, 60 nt, hsa
gugagucugggauauucuuuagcuuaccugggcacaaacagaauuuuccauuuauuaagc

SEQ ID NO: 139089 - RNA, 60 nt, hsa
gccaguuacuugggcuucaacagccaagcuggcacaaaagacagcuggcggaggcugcuc

SEQ ID NO: 139090 - RNA, 64 nt, hsa
ggugaacacccaccgagacagcgccuucauauuccucagccagagccuggaguaugccaagaac

SEQ ID NO: 139091 - RNA, 64 nt, hsa
ccuggcugccgcacgggaacucauggguguguuacucagccaccacccaccgcuggagccccag

SEQ ID NO: 139092 - RNA, 64 nt, hsa
caaucuccugggccuuaaaggaugcggacucauccucagccagcgcccauguugugauacaggg

SEQ ID NO: 139093 - RNA, 64 nt, hsa
ccucacugcagcugccagcacuuggucagucacucucagccauagcacuuuguucacuguccug

SEQ ID NO: 139094 - RNA, 64 nt, hsa
ggucccagggcccuuccuuguuucucagaggccccucagccacuggaaccccaucuucagccca

SEQ ID NO: 139095 - RNA, 64 nt, hsa
cucucccgagggcugggcagggaggcgccguggacucagccaggcugggggagccggacauggc

SEQ ID NO: 139096 - RNA, 64 nt, hsa
agauccuuaauguaguucucauccuccgcaugcccucagccacaagcgggugacugacuguucc

SEQ ID NO: 139097 - RNA, 64 nt, hsa
ucuuuaucaaccugcucacucacaaaugugugcccucagccagagaguaagaaagcccaaaucu

SEQ ID NO: 139098 - RNA, 64 nt, hsa
ucccacuauaagucaaguugcaguuuaagguggucucagccaauuguuacaagcuacagaauau

SEQ ID NO: 139099 - RNA, 64 nt, hsa
aauuauaccuucugaucaaauaaccauggcuucccucagccauuccugagacuugguauaaaau

SEQ ID NO: 139100 - RNA, 64 nt, hsa
aagagugggauuaggcugaaguggcuuagaaggccucagccaugcuuggauacucacauuagga

SEQ ID NO: 139101 - RNA, 64 nt, hsa
gaauguauuuuuuucuggacaagcuuacaucuuccucagccaucuuugugaguccuucaagagc

SEQ ID NO: 139102 - RNA, 64 nt, hsa
uggauucuucauugcaagugaaggagccucccagcucagccacgugggaugugacaagaagcag

SEQ ID NO: 139103 - RNA, 64 nt, hsa
ucugaaccuucuucaaacaguaguacaagcuccccucagccagccugccugcccagcgaggccc

SEQ ID NO: 139104 - RNA, 64 nt, hsa
ucucagcccgccccguguggccgcccggguguggcucagccauguccccuccccagguccuuca

SEQ ID NO: 139105 - RNA, 64 nt, hsa
auguuuauguccccccuucucuuccugagugauucucagccaaguccagacagugcucggcggg

SEQ ID NO: 139106 - RNA, 64 nt, hsa
gagccauugugggguccccaggaaagggcaagggcucagccacaucuuggggucugggaggccc

SEQ ID NO: 139107 - RNA, 64 nt, hsa
cuugcccugcuggccacacucuggagaagcacuucucagccaaggcaccccugcccugggacug

SEQ ID NO: 139108 - RNA, 64 nt, hsa
uccaguauggccccaccauguuugucccuccagccucagccaagcaacauggggugaaccucag

SEQ ID NO: 139109 - RNA, 64 nt, hsa
gacucugcauccccugcacccgcuaccacaccagcucagccacagcagagccaaucacagaccc

SEQ ID NO: 139110 - RNA, 64 nt, hsa
augccaguguggagagcgccucuucccaccaguccucagccaccuucuccacggcagcgaccuc

SEQ ID NO: 139111 - RNA, 64 nt, hsa
gcacacugcagggcugcuguggcccagucguccgcucagccaaggagucagauggcaaugggua

SEQ ID NO: 139112 - RNA, 64 nt, hsa
ugagcuuucuagccuaaguguggagaaggauagccucagccacaaaacucugucaggcauugaa

SEQ ID NO: 139113 - RNA, 64 nt, hsa
aguauuuuuuguuuuuguuccuuaacugcugagccucagccagcguggguccugggggaaauac

SEQ ID NO: 139114 - RNA, 64 nt, hsa
acaaugucacucacccuccccuuguaguauccugcucagccaagaucugccuaagauuaugauu

SEQ ID NO: 139115 - RNA, 64 nt, hsa
gaacucugcugauggggacccaagcgcccacgugcucagccacccucuggcucagcggggccca

SEQ ID NO: 139116 - RNA, 52 nt, hsa; identical to SEQ ID NO: 112167

SEQ ID NO: 139117 - RNA, 64 nt, hsa
gugcugagccaccauuucagacugagucugcacccucagccacaugaacaaucuccccuaccuc

SEQ ID NO: 139118 - RNA, 64 nt, hsa
acagcauuuucuuacacccccuccccagcgugcccucagccaagugcuuuggcccggugcuucc

SEQ ID NO: 139119 - RNA, 64 nt, hsa
gucacucagccaaaucugucugcugcucccucuccucagccaguugggugugcgcagagcuguc

SEQ ID NO: 139120 - RNA, 64 nt, hsa
ucuuccuugccuuuagagugacccugcagagucacucagccaaaucugucugcugcucccucuc

SEQ ID NO: 139121 - RNA, 64 nt, hsa
aaccaacauuguuuacauuccaggagacuuguagcucagccacacacgcaguaaugaccugugc

SEQ ID NO: 139122 - RNA, 64 nt, hsa
ucgcauguaugaauaucuaguccuuucugugguucucagccaagacauaaaaacuaggacucag

SEQ ID NO: 139123 - RNA, 64 nt, hsa
gagaacuacaaaaauacaaaaugcuuguccaggacucagccaugcacaccuugagcagcgccgg

SEQ ID NO: 139124 - RNA, 64 nt, hsa
uaucuucagggucacucugggcaaagagaagguccucagccaugcccccagcaccuugcacaua

SEQ ID NO: 139125 - RNA, 64 nt, hsa
gcucucuggugccagcacgggaucccugaagugacucagccaggcagacaugagacauggcgga

SEQ ID NO: 139126 - RNA, 64 nt, hsa
cuuugcaccccaugcagaggugcucuccuccuuucucagccauggccccccaucccugaccuca

SEQ ID NO: 139127 - RNA, 64 nt, hsa
uccccuccucccguccaccccagaggggaaguuccucagccagacucuucagccaaaugcccca

SEQ ID NO: 139128 - RNA, 64 nt, hsa
uugugaauauccagacuguuucagcccagcccaucucagccaacccuccuuagacugagcuguc

SEQ ID NO: 139129 - RNA, 64 nt, hsa
uggagaugcccauggcaugggcacugcccacaggcucagccagaaccucuugguguacccgaua

SEQ ID NO: 139130 - RNA, 64 nt, hsa
gaggaaacgaucucccuauucccuuacccuguuacucagccacgccguguguaggcuuagccuc

SEQ ID NO: 139131 - RNA, 64 nt, hsa
ccagcggggggacggaggcggcgggcccaggagccucagccagccacgugggcauccacuccuu

SEQ ID NO: 139132 - RNA, 64 nt, hsa
auaaucuccaaagaaagaauaagucuccaaggagcacaaaaaaaucauauguaccaaggauguu

SEQ ID NO: 139133 - RNA, 64 nt, hsa
gaaauuaucuugagucuacacauuauuuuuaaaacacaaaaauuguucggcuggaacugaccca

SEQ ID NO: 139134 - RNA, 64 nt, hsa
ggcaggguaguaagcugacacuaaauauuuuuuacacaaaaauguauugaagcaacaaauauuu

SEQ ID NO: 139135 - RNA, 64 nt, hsa
aggcuggcagagauuuauguaugacuugcacagacacaaaaauauacagacaaucaaaacauug

SEQ ID NO: 139136 - RNA, 64 nt, hsa
auagacgaggcacuuuggaaccacaagcuuggcucacaaaaagagcuuucuggguuguaggccc

SEQ ID NO: 139137 - RNA, 64 nt, hsa
aguauccuaaggacaggggauaucaagaugccagcacaaaaauucgagaaaucuuccaccaugc

SEQ ID NO: 139138 - RNA, 64 nt, hsa
caaggcacaacacaaaaaccaacacaaaacauaacacaaaaaagaagcuaccuaugauccugga

SEQ ID NO: 139139 - RNA, 64 nt, hsa
uaaagcaaaggaguacuacagcaucaaggcacaacacaaaaaccaacacaaaacauaacacaaa

SEQ ID NO: 139140 - RNA, 64 nt, hsa
agaaucucucaauaaaauuuuucuaaauaaauuccacaaaaacaaagggugaagauggucucuc

SEQ ID NO: 139141 - RNA, 64 nt, hsa
augcauauuuuuaaugaaagaugacauguauuugcacaaaaauucucaggcacauuaaauuauu

SEQ ID NO: 139142 - RNA, 64 nt, hsa
cugcucaaagucauugccaaggucugauuuuucacacaaaaaauugcaacccccagcauaaaug

SEQ ID NO: 139143 - RNA, 64 nt, hsa
auuuuaaaugugccuauuucacagcucucuuggucacaaaaacaugcuauuuuuauuggaacuu

SEQ ID NO: 139144 - RNA, 64 nt, hsa
gagggauggaccagacugccacagcagcucauagcacaaaaaaagguuaagaaguccuaguuga

SEQ ID NO: 139145 - RNA, 64 nt, hsa
agauaccauuauauuuauaugagcuauguacugccacaaaaaaagaugaaauguaauuucuaaa

SEQ ID NO: 139146 - RNA, 64 nt, hsa
aguguggaaagccacaucacaaaaaaagccacaucacaaaaaaaagccagugccuauugaguau

SEQ ID NO: 139147 - RNA, 64 nt, hsa
uucuggacuucuacaauaguguggaaagccacaucacaaaaaaagccacaucacaaaaaaaagc

SEQ ID NO: 139148 - RNA, 64 nt, hsa
ugucauuuuguugucacagcacuacagugaaauacacaaaaaaugaaauucauauaaugacuua

SEQ ID NO: 139149 - RNA, 64 nt, hsa
cagaguuuguuuuucuauaugugaaggauuacaacacaaaaaguuauccugccauucgagugcu

SEQ ID NO: 139150 - RNA, 64 nt, hsa
gauacugugagccagagagaaaguaaaagcacuucacaaaaaaaugaaaauucuaaggacauac

SEQ ID NO: 139151 - RNA, 64 nt, hsa
augagaguuuuuacagcucaucauucaaauaacgcacaaaaaacaaaagccgcuaugaccggcg

SEQ ID NO: 139152 - RNA, 64 nt, hsa
gaauucugaaucaucuugaaaauaagauuccaaccacaaaaaaaauuuagccauuucuuuacua

SEQ ID NO: 139153 - RNA, 64 nt, hsa
uucacaucauguauugugauguuucaaugugagacacaaaaacaauggcuugaaacuuguguau

SEQ ID NO: 139154 - RNA, 64 nt, hsa
aauuguuaauacauagucccaaucuuuuucauugcacaaaaaucuaggguugacuugguaaaug

SEQ ID NO: 139155 - RNA, 64 nt, hsa
cugggcgacagagcaggacucucucucaaaaaaacacaaaaaaacaaaaacaaaaaaccauaca

SEQ ID NO: 139156 - RNA, 64 nt, hsa
caauggaauauaauggaauauucuugagacugaucacaaaaaaaaaaaccuuuuuaauauuucu

SEQ ID NO: 139157 - RNA, 64 nt, hsa
acaaugcauccaaaaaaucuuuuuaaacagauuacacaaaaauuauuuccagaaaggcuaccau

SEQ ID NO: 139158 - RNA, 64 nt, hsa
cuaaauauuacuuuacacaguaagaugugaaauucacaaaaaguaaaccaaacaaaacgaauga

SEQ ID NO: 139159 - RNA, 64 nt, hsa
augcaaauguuuauuuugaagcaggcauugacaacacaaaaacuguguaguggucuugaugcug

SEQ ID NO: 139160 - RNA, 64 nt, hsa
gugacguuauguuaaaaaaaaaaagguguuaagucacaaaaagcgguaauaaauauuucauuuu

SEQ ID NO: 139161 - RNA, 64 nt, hsa
acaaaacaaucuuaaguugggcagcuuuccucaacacaaaaaaaaguuauuaauggucauugaa

SEQ ID NO: 139162 - RNA, 64 nt, hsa
guuuuaaagcuauaaauggaauuuuguguaaauucacaaaaaugugauauaaacaggaucuaag

SEQ ID NO: 139163 - RNA, 64 nt, hsa
uaccauacaaucuagugucaaaaacauaaauggccacaaaaaaguaguuugaguguuaugaaua

SEQ ID NO: 139164 - RNA, 64 nt, hsa
cugggaacgcucuuguugcuuggugcaacagaagcacaaaaaucaauaaacacugugauugcac

SEQ ID NO: 139165 - RNA, 64 nt, hsa
gcuaaccaauuugagauucaugauuaauuauguacacaaaaauauuuuccuuguagaaaauagu

SEQ ID NO: 139166 - RNA, 64 nt, hsa
gaaaauucaaggaauggaagaguaaauuacaugacacaaaaaggagcaauuaaaucuaaaauaa

SEQ ID NO: 139167 - RNA, 64 nt, hsa
ugacaacgucugaacccacucaucaucucaacuucacaaaaagcaagagaguaaaaauuacgug

SEQ ID NO: 139168 - RNA, 64 nt, hsa
cauuuccuuggccaaacaaaaauagcuacaaauccacaaaaauuuacuauuccaguaaggcaga

SEQ ID NO: 139169 - RNA, 64 nt, hsa
aguuugaaaaaaauacauaacuaauuuaauuuuacacaaaaauauuuaugcagauuuucagaau

SEQ ID NO: 139170 - RNA, 64 nt, hsa
caggaggaaagaaacgauuuuaaaucauuaaaaacacaaaaacuaagugcgaacggaacagagu

SEQ ID NO: 139171 - RNA, 64 nt, hsa
gucccucccagcuuuagguuaugaagauuuuacucacaaaaaaaaucaacaaaaaucacgaaac

SEQ ID NO: 139172 - RNA, 64 nt, hsa
uauuacguugaguuugcaaccagaugggaaaaaucacaaaaaugagaaggggagcagauaucuu

SEQ ID NO: 139173 - RNA, 64 nt, hsa
agcccuggucagucaagucccaauaaauggucagcacaaaaaagauauucuugaaaauugcucu

SEQ ID NO: 139174 - RNA, 64 nt, hsa
ugcuaaaauagauacaaacucaauuuugcauagaaagguguauuuugaauaguucccauguugu

SEQ ID NO: 139175 - RNA, 64 nt, hsa
aaauauuuaacuagagcaugauauuuuaaauguuaagguguaacauauguuaaauaaaacuguu

SEQ ID NO: 139176 - RNA, 64 nt, hsa
uuaucugauaucaagucaaaaucaguuugaaaagaagguguaucauauuuuauauugucacuag

SEQ ID NO: 139177 - RNA, 64 nt, hsa
uaaaauauuuauauuucuaaauccgagguauuucaagguguaguauccuauuucaaaggagaua

SEQ ID NO: 139178 - RNA, 64 nt, hsa; identical to SEQ ID NO: 83525

SEQ ID NO: 139179 - RNA, 64 nt, hsa; identical to SEQ ID NO: 83526

SEQ ID NO: 139180 - RNA, 64 nt, hsa; identical to SEQ ID NO: 83527

SEQ ID NO: 139181 - RNA, 64 nt, hsa; identical to SEQ ID NO: 83528

SEQ ID NO: 139182 - RNA, 64 nt, hsa; identical to SEQ ID NO: 83529

SEQ ID NO: 139183 - RNA, 64 nt, hsa; identical to SEQ ID NO: 83530

SEQ ID NO: 139184 - RNA, 64 nt, hsa; identical to SEQ ID NO: 83531

SEQ ID NO: 139185 - RNA, 64 nt, hsa; identical to SEQ ID NO: 83532

SEQ ID NO: 139186 - RNA, 64 nt, hsa; identical to SEQ ID NO: 83533

SEQ ID NO: 139187 - RNA, 64 nt, hsa; identical to SEQ ID NO: 83534

SEQ ID NO: 139188 - RNA, 64 nt, hsa; identical to SEQ ID NO: 83535

SEQ ID NO: 139189 - RNA, 64 nt, hsa; identical to SEQ ID NO: 83536

SEQ ID NO: 139190 - RNA, 64 nt, hsa; identical to SEQ ID NO: 83537

SEQ ID NO: 139191 - RNA, 64 nt, hsa; identical to SEQ ID NO: 83538

SEQ ID NO: 139192 - RNA, 64 nt, hsa; identical to SEQ ID NO: 83539

SEQ ID NO: 139193 - RNA, 64 nt, hsa; identical to SEQ ID NO: 83540

SEQ ID NO: 139194 - RNA, 64 nt, hsa; identical to SEQ ID NO: 83541

SEQ ID NO: 139195 - RNA, 64 nt, hsa; identical to SEQ ID NO: 83542

SEQ ID NO: 139196 - RNA, 64 nt, hsa; identical to SEQ ID NO: 83543

SEQ ID NO: 139197 - RNA, 64 nt, hsa; identical to SEQ ID NO: 83544

SEQ ID NO: 139198 - RNA, 64 nt, hsa; identical to SEQ ID NO: 83545

SEQ ID NO: 139199 - RNA, 64 nt, hsa; identical to SEQ ID NO: 83546

SEQ ID NO: 139200 - RNA, 64 nt, hsa; identical to SEQ ID NO: 83547

SEQ ID NO: 139201 - RNA, 64 nt, hsa; identical to SEQ ID NO: 83548

SEQ ID NO: 139202 - RNA, 64 nt, hsa; identical to SEQ ID NO: 83549

SEQ ID NO: 139203 - RNA, 64 nt, hsa; identical to SEQ ID NO: 83550

SEQ ID NO: 139204 - RNA, 64 nt, hsa; identical to SEQ ID NO: 83551

SEQ ID NO: 139205 - RNA, 64 nt, hsa; identical to SEQ ID NO: 83552

SEQ ID NO: 139206 - RNA, 64 nt, hsa; identical to SEQ ID NO: 83553

SEQ ID NO: 139207 - RNA, 64 nt, hsa; identical to SEQ ID NO: 83554

SEQ ID NO: 139208 - RNA, 64 nt, hsa; identical to SEQ ID NO: 83555

SEQ ID NO: 139209 - RNA, 64 nt, hsa; identical to SEQ ID NO: 83556

SEQ ID NO: 139210 - RNA, 64 nt, hsa; identical to SEQ ID NO: 83557

SEQ ID NO: 139211 - RNA, 64 nt, hsa; identical to SEQ ID NO: 83558

SEQ ID NO: 139212 - RNA, 64 nt, hsa; identical to SEQ ID NO: 83559

SEQ ID NO: 139213 - RNA, 64 nt, hsa; identical to SEQ ID NO: 83560

SEQ ID NO: 139214 - RNA, 64 nt, hsa; identical to SEQ ID NO: 83561

SEQ ID NO: 139215 - RNA, 64 nt, hsa
ggaaacuugauuugagauuuuuaugccugugacuuccuuggaaaucaaauguaaaguuuaauug

SEQ ID NO: 139216 - RNA, 64 nt, hsa
cugcauaguucccaugcacgcugggcaaugagaauccuuggaaacauuggugaugcuaucaguu

SEQ ID NO: 139217 - RNA, 64 nt, hsa
gcuaucuuuuaagaagagaugauguugaaccugcuccuuggaccucugaaggaauagaacgguc

SEQ ID NO: 139218 - RNA, 64 nt, hsa
uuugauuuuacagaaaaggaaaugacacuugagauccuuggaaugaacacagcuucuaaagugu

SEQ ID NO: 139219 - RNA, 64 nt, hsa
aggggucaugagguccaucagucuucuggagcccuccuuggagcuggagagcaccucagagacc

SEQ ID NO: 139220 - RNA, 64 nt, hsa
ccacgcuccccugacacugaagaggauccacaacuccuuggagaaacacccucacgucuguugc

SEQ ID NO: 139221 - RNA, 64 nt, hsa
aagcgaggaccuggagauaaacgcuggagcaaucuccuuggaaggauucagcacgaguagaugg

SEQ ID NO: 139222 - RNA, 64 nt, hsa
agguuuggauuggagagggcucacuggaucccaauccuuggagcuggaucauuggauucaaauc

SEQ ID NO: 139223 - RNA, 64 nt, hsa
aaugauacucaucaaguaugcuuggauccuuugguccuuggaugcuucucagccaaguggcggu

SEQ ID NO: 139224 - RNA, 64 nt, hsa
acaaaagcaaggggcauuuccucuccaacuuucuuccuuggaggccaaguucucacccugucca

SEQ ID NO: 139225 - RNA, 64 nt, hsa
aggggugggagggguggagggagggaaccagccauccuuggaaaagaccacucucuugugggac

SEQ ID NO: 139226 - RNA, 64 nt, hsa
ucacccacuuguaagccagcgcuucuucucuccauccuuggaccuucacaaaugcccugagacg

SEQ ID NO: 139227 - RNA, 64 nt, hsa
guuucccugguguagagcuuguguucuuggcccauccuuggagcuuuauaagugaccugagugg

SEQ ID NO: 139228 - RNA, 64 nt, hsa
ccagacagucuuugaguaacaucuguucccaucuuccuuggaagcaggacacaccagcuccucc

SEQ ID NO: 139229 - RNA, 64 nt, hsa
gggcagcccucuaccugggccccgggagccgugcuccuuggaacgcaaagggccgaggagcauc

SEQ ID NO: 139230 - RNA, 64 nt, hsa; identical to SEQ ID NO: 52440

SEQ ID NO: 139231 - RNA, 64 nt, hsa; identical to SEQ ID NO: 52441

SEQ ID NO: 139232 - RNA, 64 nt, hsa; identical to SEQ ID NO: 52442

SEQ ID NO: 139233 - RNA, 50 nt, hsa; identical to SEQ ID NO: 52443

SEQ ID NO: 139234 - RNA, 64 nt, hsa; identical to SEQ ID NO: 52444

SEQ ID NO: 139235 - RNA, 64 nt, hsa; identical to SEQ ID NO: 52445

SEQ ID NO: 139236 - RNA, 64 nt, hsa; identical to SEQ ID NO: 52446

SEQ ID NO: 139237 - RNA, 64 nt, hsa; identical to SEQ ID NO: 52447

SEQ ID NO: 139238 - RNA, 64 nt, hsa; identical to SEQ ID NO: 52448

SEQ ID NO: 139239 - RNA, 64 nt, hsa; identical to SEQ ID NO: 52449

SEQ ID NO: 139240 - RNA, 64 nt, hsa; identical to SEQ ID NO: 52450

SEQ ID NO: 139241 - RNA, 64 nt, hsa; identical to SEQ ID NO: 52451

SEQ ID NO: 139242 - RNA, 64 nt, hsa; identical to SEQ ID NO: 52452

SEQ ID NO: 139243 - RNA, 64 nt, hsa; identical to SEQ ID NO: 52453

SEQ ID NO: 139244 - RNA, 64 nt, hsa; identical to SEQ ID NO: 52454

SEQ ID NO: 139245 - RNA, 64 nt, hsa; identical to SEQ ID NO: 52455

SEQ ID NO: 139246 - RNA, 64 nt, hsa; identical to SEQ ID NO: 52456

SEQ ID NO: 139247 - RNA, 64 nt, hsa; identical to SEQ ID NO: 52457

SEQ ID NO: 139248 - RNA, 64 nt, hsa; identical to SEQ ID NO: 52458

SEQ ID NO: 139249 - RNA, 64 nt, hsa; identical to SEQ ID NO: 52459

SEQ ID NO: 139250 - RNA, 64 nt, hsa; identical to SEQ ID NO: 52460

SEQ ID NO: 139251 - RNA, 64 nt, hsa; identical to SEQ ID NO: 52461

SEQ ID NO: 139252 - RNA, 64 nt, hsa; identical to SEQ ID NO: 52462

SEQ ID NO: 139253 - RNA, 64 nt, hsa; identical to SEQ ID NO: 52463

SEQ ID NO: 139254 - RNA, 64 nt, hsa; identical to SEQ ID NO: 52464

SEQ ID NO: 139255 - RNA, 64 nt, hsa; identical to SEQ ID NO: 52465

SEQ ID NO: 139256 - RNA, 64 nt, hsa; identical to SEQ ID NO: 52466

SEQ ID NO: 139257 - RNA, 64 nt, hsa; identical to SEQ ID NO: 52467

SEQ ID NO: 139258 - RNA, 64 nt, hsa; identical to SEQ ID NO: 52468

SEQ ID NO: 139259 - RNA, 64 nt, hsa; identical to SEQ ID NO: 52469

SEQ ID NO: 139260 - RNA, 64 nt, hsa; identical to SEQ ID NO: 52470

SEQ ID NO: 139261 - RNA, 64 nt, hsa; identical to SEQ ID NO: 52471

SEQ ID NO: 139262 - RNA, 64 nt, hsa; identical to SEQ ID NO: 52472

SEQ ID NO: 139263 - RNA, 64 nt, hsa; identical to SEQ ID NO: 52473

SEQ ID NO: 139264 - RNA, 64 nt, hsa; identical to SEQ ID NO: 52474

SEQ ID NO: 139265 - RNA, 64 nt, hsa; identical to SEQ ID NO: 52475

SEQ ID NO: 139266 - RNA, 64 nt, hsa; identical to SEQ ID NO: 52476

SEQ ID NO: 139267 - RNA, 64 nt, hsa; identical to SEQ ID NO: 52477

SEQ ID NO: 139268 - RNA, 64 nt, hsa; identical to SEQ ID NO: 52478

SEQ ID NO: 139269 - RNA, 64 nt, hsa; identical to SEQ ID NO: 52479

SEQ ID NO: 139270 - RNA, 64 nt, hsa; identical to SEQ ID NO: 52480

SEQ ID NO: 139271 - RNA, 64 nt, hsa; identical to SEQ ID NO: 52481

SEQ ID NO: 139272 - RNA, 64 nt, hsa; identical to SEQ ID NO: 52482

SEQ ID NO: 139273 - RNA, 64 nt, hsa; identical to SEQ ID NO: 52483

SEQ ID NO: 139274 - RNA, 64 nt, hsa; identical to SEQ ID NO: 52484

SEQ ID NO: 139275 - RNA, 64 nt, hsa; identical to SEQ ID NO: 52485

SEQ ID NO: 139276 - RNA, 64 nt, hsa; identical to SEQ ID NO: 52486

SEQ ID NO: 139277 - RNA, 64 nt, hsa; identical to SEQ ID NO: 52487

SEQ ID NO: 139278 - RNA, 64 nt, hsa; identical to SEQ ID NO: 52488

SEQ ID NO: 139279 - RNA, 64 nt, hsa; identical to SEQ ID NO: 52489

SEQ ID NO: 139280 - RNA, 64 nt, hsa; identical to SEQ ID NO: 52490

SEQ ID NO: 139281 - RNA, 64 nt, hsa; identical to SEQ ID NO: 52491

SEQ ID NO: 139282 - RNA, 64 nt, hsa; identical to SEQ ID NO: 52492

SEQ ID NO: 139283 - RNA, 64 nt, hsa; identical to SEQ ID NO: 52493

SEQ ID NO: 139284 - RNA, 64 nt, hsa; identical to SEQ ID NO: 52494

SEQ ID NO: 139285 - RNA, 64 nt, hsa; identical to SEQ ID NO: 52495

SEQ ID NO: 139286 - RNA, 64 nt, hsa; identical to SEQ ID NO: 52496

SEQ ID NO: 139287 - RNA, 64 nt, hsa; identical to SEQ ID NO: 52497

SEQ ID NO: 139288 - RNA, 64 nt, hsa; identical to SEQ ID NO: 52498

SEQ ID NO: 139289 - RNA, 64 nt, hsa; identical to SEQ ID NO: 52499

SEQ ID NO: 139290 - RNA, 64 nt, hsa; identical to SEQ ID NO: 52500

SEQ ID NO: 139291 - RNA, 64 nt, hsa; identical to SEQ ID NO: 52501

SEQ ID NO: 139292 - RNA, 64 nt, hsa; identical to SEQ ID NO: 52502

SEQ ID NO: 139293 - RNA, 64 nt, hsa; identical to SEQ ID NO: 52503

SEQ ID NO: 139294 - RNA, 64 nt, hsa; identical to SEQ ID NO: 52504

SEQ ID NO: 139295 - RNA, 64 nt, hsa
ugagucuccccuuaauuagacugcaaaugucacuugugaugagugugccauuccaggauaacag

SEQ ID NO: 139296 - RNA, 64 nt, hsa
uuugaaauccuguggugcccccuucccccugccuugugaugaugaugagugagucuccccuuaa

SEQ ID NO: 139297 - RNA, 64 nt, hsa
agggggauaaggagggaacauaucauaacugcacugugaugaagaagcuguuccccacagagga

SEQ ID NO: 139298 - RNA, 64 nt, hsa
uuaacucuggaaaucaccugauguagaagaagacugugaugagcucgucuguggaacaucacaa

SEQ ID NO: 139299 - RNA, 64 nt, hsa
ccucuuucauuucucaguauauauuucaagagcuugugaugaaaucuauaggaugguaaugaug

SEQ ID NO: 139300 - RNA, 64 nt, hsa
gccuacauugagugcuuaaaaaaaaaaaaacaacugugaugaugugagcagaauggcaaguaag

SEQ ID NO: 139301 - RNA, 64 nt, hsa
uuucuacauaauugugaccaauacauuuguauuuugugaugaaucuacauuuguuuguauucau

SEQ ID NO: 139302 - RNA, 64 nt, hsa
aagaauuuuuugauaauuacugaguucagccuuuugugaugacuuauauuuuggacuuacauuu

SEQ ID NO: 139303 - RNA, 64 nt, hsa
ugugcuaucgugcuguuccuacucaguaaacaggugugaugaguuaacaagaaauaacacuguu

SEQ ID NO: 139304 - RNA, 64 nt, hsa
gaaucuucuguuaaaaggugauuuaaaacuugaaugugaugaauuguggcaaguuaacuucaag

SEQ ID NO: 139305 - RNA, 64 nt, hsa
ugcacaauauuucuuaaaaguaaaaugcuguuauugugaugagucuuugguuuaacaucacagu

SEQ ID NO: 139306 - RNA, 64 nt, hsa
uagaacuuaaagcugaaaucugcaaaucuguuugugugaugaaacuaucuuuucucucugugaa

SEQ ID NO: 139307 - RNA, 64 nt, hsa
uuuaggaauuuucucucuuggaaaaggcuuccccugugaugaaaaugaugugccagcuaaaauu

SEQ ID NO: 139308 - RNA, 64 nt, hsa
ugauuucauuuuagccagguauuucuuucuugugugugaugaaccaguauggauuugcuuuucu

SEQ ID NO: 139309 - RNA, 64 nt, hsa
uuucaggauuuaaauuaguaccauaucaauuuucugugaugauguauaccaacuauaaagcacu

SEQ ID NO: 139310 - RNA, 64 nt, hsa
uacugcggguaugaguuguugaauuccuaucauuugugaugauugguuaacuucuuuuagguac

SEQ ID NO: 139311 - RNA, 64 nt, hsa
uuugcacacauuaugauuaaaauugggccucuacugugaugauuccuauuuccucucauguuuu

SEQ ID NO: 139312 - RNA, 64 nt, hsa
acuaauuuaguuauccauugggggguguauuuacugugaugaagaugagacagaugccaucaga

SEQ ID NO: 139313 - RNA, 64 nt, hsa
aaaaguucugaauucauacagaaaacaaguacuaugugaugaaaacauuucauuaaaagauugc

SEQ ID NO: 139314 - RNA, 64 nt, hsa
uuccagaugucugccaacaagaaaugacucauacugugaugauaccuuuugcuuugccuugugg

SEQ ID NO: 139315 - RNA, 64 nt, hsa
guguauauacuuuuggcaagucauacagcucaaaugugaugagauuucugauguuagagggaga

SEQ ID NO: 139316 - RNA, 64 nt, hsa
aaagccuauacuuuggcagguuaugaacuuugaaugugaugaaaugacacguuuggcugcauuu

SEQ ID NO: 139317 - RNA, 64 nt, hsa
ccuuuggagaagagugaaguuuguuuuuucgccaugugaugaagaccacugugauuuuuuaaaa

SEQ ID NO: 139318 - RNA, 64 nt, hsa
cuugggcacauacuccaagauuguauuagauuuuugugaugaagagcuuccauuacuucugaaa

SEQ ID NO: 139319 - RNA, 64 nt, hsa
uagugcuggucagagagaccucauccugcucuuuugugaugaacauauucaugaaauguggaag

SEQ ID NO: 139320 - RNA, 64 nt, hsa
uuuugccugcaggucaguuguaauaaaucuaggaugugaugaugacuuuguaauuugauuuucu

SEQ ID NO: 139321 - RNA, 64 nt, hsa
ccugcaaacaugggguuggcugggcccagaagguugugaugaagaaaagugggccaguguggga

SEQ ID NO: 139322 - RNA, 64 nt, hsa
cacuguaguaaauggcaauucuuugaccucaaccugugaugaggggaggaaacucaccugcugg

SEQ ID NO: 139323 - RNA, 64 nt, hsa
auaggaggauucauacaggagagaaacucacaagugugaugauuguggcaaagcguuuacuuca

SEQ ID NO: 139324 - RNA, 64 nt, hsa
uauuagaauucaaacuggagagaaaccuuacaaaugugaugaguguggcaacaccuuuggucaa

SEQ ID NO: 139325 - RNA, 64 nt, hsa
gggagggaaugauauaauuuucaugacaaugucaugugaugauagaauuucuccauugaugaau

SEQ ID NO: 139326 - RNA, 64 nt, hsa
gacacccucucuggcauuuaucacuguuggccggugugaugaguauagagugccacccaaggca

SEQ ID NO: 139327 - RNA, 63 nt, hsa
uccugagaagcuucaaauucaggccaggagagaagucuuaagaaaagaccuccagcaguuaca

SEQ ID NO: 139328 - RNA, 63 nt, hsa
cugacuauacuuaguuugaaauggugcaggcuuagucuuaagccuccaaaggccuggauuuga

SEQ ID NO: 139329 - RNA, 63 nt, hsa
uuaacugccaaagcuaguuuuagagaaugagaaagucuuaagcaaaauacucccaggucucac

SEQ ID NO: 139330 - RNA, 63 nt, hsa
ggaaagauacagggaacaaaaaucaauuuguacagucuuaauauuaaaagcagcuugacuaaa

SEQ ID NO: 139331 - RNA, 63 nt, hsa
uggaucugucuagucaaucaacauagcagagacagucuuaaaccuaccauugaccugugugua

SEQ ID NO: 139332 - RNA, 63 nt, hsa
gauuuccuugaagcaguuugaaaauuugaauugagucuuaacuuuaggaaaugagguuucaua

SEQ ID NO: 139333 - RNA, 63 nt, hsa
acaaccaggugggaccaaaguuuaugugccuuuagucuuaauuuaccuugcauuguaauauuc

SEQ ID NO: 139334 - RNA, 63 nt, hsa
ggugauucuuucuuuaccauuucuggggacuuuagucuuaauuagguaccuuauuaacaggaa

SEQ ID NO: 139335 - RNA, 63 nt, hsa
ucaaaaaucugcauauaacuuuugauuccccaaagucuuaaguacuaguagccuguuauugac

SEQ ID NO: 139336 - RNA, 63 nt, hsa
uauauugcaaaauuuaauauauuuguucacuugagucuuaagaguaggucaggccaaggcagg

SEQ ID NO: 139337 - RNA, 63 nt, hsa
aaauuaguggaacuuaguucagggacauagaagagucuuaaugaauuaaaaucauucacuuga

SEQ ID NO: 139338 - RNA, 63 nt, hsa
auaaaacaauggcugguucuagcccugagugacagucuuaaggcuagauccuucccauaguau

SEQ ID NO: 139339 - RNA, 63 nt, hsa
acaguuuuauagcugguuccuuuuaggguaaagagucuuaagagaguuuuauugugucuaugg

SEQ ID NO: 139340 - RNA, 63 nt, hsa
gcuuuauuagugaggagaaaacaauuccuuagaagucuuaaauauauuguacucuuuagaucu

SEQ ID NO: 139341 - RNA, 63 nt, hsa
uguuuuuuguguaauucgugaaugucauauaguagucuuaaguuucucuuuuaaagcugcaug

SEQ ID NO: 139342 - RNA, 63 nt, hsa
cccuucgauguaugccauuuagugaaagugcuaagucuuaaguuuccuaccacuuugguuuca

SEQ ID NO: 139343 - RNA, 63 nt, hsa
cuguugauuaaucuauuuucauauuuauaaaggagucuuaauguucugccccauaagacuuuc

SEQ ID NO: 139344 - RNA, 63 nt, hsa
cuaaaauauacccaucaguauaaggcaagcaaaagucuuaacauggcagccauucugccuuug

SEQ ID NO: 139345 - RNA, 63 nt, hsa
ccuuucugacacauaauuuggggcaaaaaagaaagucuuaagaguuuaucuuuucucugcuga

SEQ ID NO: 139346 - RNA, 63 nt, hsa
cuguucaacauccucccuccuuagccccuccuaagucuuaaugcugagauuucuaaagaugcu

SEQ ID NO: 139347 - RNA, 63 nt, hsa
uuaacgaguguuuuaaaaagguuuuuaaugaauagucuuaaaucuaaauuugugugaauaauc

SEQ ID NO: 139348 - RNA, 63 nt, hsa
ccuguuucacucacucacccagcauaugaaacuagucuuaacuguugagccuuuccuuucaua

SEQ ID NO: 139349 - RNA, 63 nt, hsa
guuaaauguauguaagauugauucugauucugaagucuuaacugccagcagaaaaacuccaua

SEQ ID NO: 139350 - RNA, 63 nt, hsa
aauagguugaaaacaaucaucugugaguuuaggagucuuaagauccucacagcacgggagcag

SEQ ID NO: 139351 - RNA, 63 nt, hsa
augguauuccauuagguucuuuucauuuaaaguagucuuaaaaucaaaguauccaauauuuua

SEQ ID NO: 139352 - RNA, 63 nt, hsa
ccacagcucuucuuggcguauuuauacucacugagucuuaacuuuucaccaggggugcucacc

SEQ ID NO: 139353 - RNA, 63 nt, hsa
gugauagaaaacccacacaauacauccucugccagucuuaauagaauaucagagguaagaggg

SEQ ID NO: 139354 - RNA, 63 nt, hsa
ucuuuggauagcugucugagugaccacggacaaagucuuaacaaaacucaggaggaccaaugu

SEQ ID NO: 139355 - RNA, 63 nt, hsa
aaauuuucaacccuuaaucugaaaacagaagacagucuuaauauaaauguacugugaagaaug

SEQ ID NO: 139356 - RNA, 63 nt, hsa
uaguugagucacugagguuuaaacacaaugguaagucuuaaagucugcuauuuacagagcauu

SEQ ID NO: 139357 - RNA, 63 nt, hsa
uuacugaauaagauuugaguaaugaaagucuguagucuuaaaacucuaaaacaguuguacugc

SEQ ID NO: 139358 - RNA, 63 nt, hsa
acgaauagguaauugauagaguuuaugggucuuagucuuaaggguaacagagugaauaccuuc

SEQ ID NO: 139359 - RNA, 63 nt, hsa
aaaucauguuuagaaacuuuggaugaguuaagaagucuuaaguaugcaggcguuuacgugauu

SEQ ID NO: 139360 - RNA, 63 nt, hsa
caugugguauuaauauaccuucaauuuauguugagucuuaaacauaauuaggagauauuuuuc

SEQ ID NO: 139361 - RNA, 63 nt, hsa
uaguugaaauuuuuaauagaaucaaggcacaaaagucuuaaaaccauguggaaaaauuaggua

SEQ ID NO: 139362 - RNA, 63 nt, hsa
caggcugucauagaguuauguguuagucucaggagucuuaacuuuugaaauauguuuuacuug

SEQ ID NO: 139363 - RNA, 63 nt, hsa
uaggguuccacaucauucuaauguauaguuucaagucuuaauagacaaucugaauuccacuac

SEQ ID NO: 139364 - RNA, 63 nt, hsa
ucaaaagggcaauguuuucuuuauauuucuuauagucuuaauuuuguuauccaugugcauaau

SEQ ID NO: 139365 - RNA, 63 nt, hsa
uucauacaaccauuuucaaaugaaccuuagaaaagucuuaacauuuaagguauuuuaugcaca

SEQ ID NO: 139366 - RNA, 63 nt, hsa
aaaaggcaggauguuauugacauuauacacugaagucuuaacauuuuaacauuuauagugcuu

SEQ ID NO: 139367 - RNA, 63 nt, hsa
guuuuugguggaggaagaaguuuaagauacuuuagucuuaaauugagguuugccaaaugagaa

SEQ ID NO: 139368 - RNA, 63 nt, hsa
guuaacuuauuuauuuuucaaacacugagccauagucuuaaauuuaaaugcuaaaaacaauug

SEQ ID NO: 139369 - RNA, 63 nt, hsa
aaaaccaaucaugccuuccuaacagucccccaaagucuuaacucuuuucagcauuaacgcaaa

SEQ ID NO: 139370 - RNA, 63 nt, hsa
agagagaguacugaaaaagcaacuccucuucuuagucuuaauaauuuacuaaaauggucaacu

SEQ ID NO: 139371 - RNA, 63 nt, hsa
uacagcauugcaggaaaaacaaucuguuauuccagucuuaaauuuuucuaaaagaagacaaua

SEQ ID NO: 139372 - RNA, 63 nt, hsa
uuuguuauaaugccugauacacaucuugaauaaagucuuaacauuuuucuuuuaaaaaacauc

SEQ ID NO: 139373 - RNA, 63 nt, hsa
agggcacugaaauguacuagcuggaugugacccagucuuaauaaacagguuuucuaauccaga

SEQ ID NO: 139374 - RNA, 63 nt, hsa
ccccaggguaggucuguggcccuuagacagugaagucuuaauugucaauauuauuuuugucua

SEQ ID NO: 139375 - RNA, 63 nt, hsa
ugaagugaugcaugugugaauuuaagauaccgaagucuuaaagugaccuggacgugaaggaaa

SEQ ID NO: 139376 - RNA, 63 nt, hsa
uauuuuuugaauaauaacuuuucuaaagccuuaagucuuaauauuaaauauaugauuagccag

SEQ ID NO: 139377 - RNA, 63 nt, hsa
guuggcuauaaguacgucauucuuaguccagucagucuuaaaaacaucuuggguuacccacuc

SEQ ID NO: 139378 - RNA, 63 nt, hsa
gccaguugcuguuuuuucaugcagugcccugggagucuuaaaagcagugcuuagcaacauugg

SEQ ID NO: 139379 - RNA, 63 nt, hsa
uugacaaaagccggggucaaaaaaaguaguuuaagucuuaagacugaauaugcauuaaaguau

SEQ ID NO: 139380 - RNA, 63 nt, hsa
cugcuauuucuuuucaguuuuuccaaagucaagagucuuaaccuuguacucagggaauuuuga

SEQ ID NO: 139381 - RNA, 63 nt, hsa
ugugcgccugugagcgcccagcuucuguuucauagucuuaacagguggccauugucgugaaac

SEQ ID NO: 139382 - RNA, 63 nt, hsa
ccugaaauuuuuuauaauauauguaauuugucuagucuuaaagacauuuggagcauggccaac

SEQ ID NO: 139383 - RNA, 63 nt, hsa
aggucuagaaaagcauccugucuggcauuuuguagucuuaacuucuccccauuucccccaucu

SEQ ID NO: 139384 - RNA, 63 nt, hsa
cacagaaaaggauguuuggcaauuugucuuuuaagucuuaaccuugcuaaugugaauacuggg

SEQ ID NO: 139385 - RNA, 63 nt, hsa
ucacagaagggcguauuucgaaaaccagaguacagucuuaagugacagcacugaaccuauucc

SEQ ID NO: 139386 - RNA, 63 nt, hsa
auuuuaauggaguguuaaaauucugauucauauagucuuaaauuaucaacuccuuaaaugugc

SEQ ID NO: 139387 - RNA, 63 nt, hsa
aagauaauuucccugcaaaaggacacagaaggcagucuuaagaagaugaauggaugagagaag

SEQ ID NO: 139388 - RNA, 63 nt, hsa
uuauuguuggguagaaggggaaaccuuugaaauagucuuaauggauaguuuauaaucaggcau

SEQ ID NO: 139389 - RNA, 63 nt, hsa
caaaacauuuuagaaaaucuuagaguaaauuuuagucuuaaagccagaaaauaaguuuauagc

SEQ ID NO: 139390 - RNA, 63 nt, hsa
ugaauauaggagaaaucaguuugcugaaaaguuagucuuaauuaucuauuggccacgaugaaa

SEQ ID NO: 139391 - RNA, 63 nt, hsa
uguauuaauugauuuaaacaucauguagacuaaagucuuaaacaucuaagacucaguuguagu

SEQ ID NO: 139392 - RNA, 63 nt, hsa
aauugcucuuaaacuuuccuagcuauaagcuuaagucuuaauucuggaaauuuuauuagcaau

SEQ ID NO: 139393 - RNA, 63 nt, hsa
uaugacucaguaaguuggcaagguccugacuuuagucuuaauaaaacauugaauuguaguaaa

SEQ ID NO: 139394 - RNA, 63 nt, hsa
agaaaaauguaagaauuuguuuuuaccauaaugagucuuaaguagguucaugaucuacauugg

SEQ ID NO: 139395 - RNA, 63 nt, hsa
gucaaugccagagacggaagccuuuuuccccaaagucuuaaaauaacuuauaucaucagcaua

SEQ ID NO: 139396 - RNA, 63 nt, hsa
cauccaucagaaucuucuggagaauauggucagagucuuaaacaggcccagugcugaguucuu

SEQ ID NO: 139397 - RNA, 63 nt, hsa
ucuuugcuuuaauaaaugagcaacccuggguauagucuuaaaauucugcacaauaaauuuuga

SEQ ID NO: 139398 - RNA, 63 nt, hsa
guuauuaaauuuauuauuuaagaugguagcacuagucuuaaauuguauaaaauauccccuaac

SEQ ID NO: 139399 - RNA, 63 nt, hsa
guuauuaaauuuauuauuaaagauaguagcacuagucuuaaauuugauauaacaucuccuaac

SEQ ID NO: 139400 - RNA, 63 nt, hsa
gcauggcccuguuagagauggcguagaagugaaagucuuaaagggagcauuagagauccuuuu

SEQ ID NO: 139401 - RNA, 63 nt, hsa
gauggucucgaucuccugaccuugaaucacaagagucuuaacagggaauguuucaggaaacaa

SEQ ID NO: 139402 - RNA, 63 nt, hsa
uaaauaauuaaaauaucagacauguuuuggaaaagucuuaauuugagaacaccaaaggaaacu

SEQ ID NO: 139403 - RNA, 63 nt, hsa
aguauaauacccauuuaaugugaaaaacauaagagucuuaaaagaaauuaagccauuuaacau

SEQ ID NO: 139404 - RNA, 63 nt, hsa
acgguggugccuaucuacuuaagggggcauucuagucuuaacuuaaaaguugucuaaacuguc

SEQ ID NO: 139405 - RNA, 63 nt, hsa
gugcacauauuucauaaccaaauuaguagcaccagucuuaauuugauguuuuucaacuuuuau

SEQ ID NO: 139406 - RNA, 63 nt, hsa
cuuuaaaaugaauagguagguuaguagcccuucagucuuaauacuuuaugaugcuaugguuug

SEQ ID NO: 139407 - RNA, 63 nt, hsa
uuagcuuuccaaccaaccaaauuucugcauucgagucuuaaccauauuuaaguguuacugugg

SEQ ID NO: 139408 - RNA, 63 nt, hsa
cuugucagacaauggcuauaaacugaauuaggcagucuuaaaaaaaaaaaaaaacagaaaaag

SEQ ID NO: 139409 - RNA, 63 nt, hsa
aguuuguguuuugucgacaguaucuuuuaaaugagucuuaaaaauaaaggcauauuguucaug

SEQ ID NO: 139410 - RNA, 63 nt, hsa
gguuaccgucucaugugaaccuggagauucaccagucuuaacuuuugggucauuguguuuucu

SEQ ID NO: 139411 - RNA, 63 nt, hsa
uuuccauuuuugucagucugagucaucaaaaagagucuuaauuuucuaaaacaaguuggcuag

SEQ ID NO: 139412 - RNA, 63 nt, hsa
ccaugcaguuguuuaccaaaaauagaggaggagagucuuaacuuuugcucuuggauuuaaguc

SEQ ID NO: 139413 - RNA, 63 nt, hsa
uaggcuuaauucauucaauugucaaguacacuuagucuuaauacacucagguuugaacagauu

SEQ ID NO: 139414 - RNA, 63 nt, hsa
gcauauucuccuuucauccuggcuugccaacgcagucuuaauuccgccuuuuuuuuuucuaau

SEQ ID NO: 139415 - RNA, 63 nt, hsa
uuuuaguuuuauguaaccauaucaauauuauuuagucuuaaacuaguuacguuauuaugcaau

SEQ ID NO: 139416 - RNA, 63 nt, hsa
uuccagcauuucuucauuugauucucuuuuuuuagucuuaaaauaaugacuccuauucagaca

SEQ ID NO: 139417 - RNA, 63 nt, hsa
gauuauguuuuuggauugucaaagaggaugcuuagucuuaaaauaaaaauaaauuuaaaaauc

SEQ ID NO: 139418 - RNA, 63 nt, hsa
acacccuaguaaccucuugagauuaaauuacauagucuuaauauuucuguuccuccaugcaac

SEQ ID NO: 139419 - RNA, 63 nt, hsa
cugucuauccccacgaaauuuaguuuuaucaguagucuuaaaguguugaucucaaacaaguac

SEQ ID NO: 139420 - RNA, 63 nt, hsa
gaaauggaagauuuuuuuuuaacuuguucuagaagucuuaauaugggcuguugccaugaaggc

SEQ ID NO: 139421 - RNA, 63 nt, hsa
auuuauauauucagauacucuagcacuaauuuuagucuuaaaauauucccacgauauucugua

SEQ ID NO: 139422 - RNA, 63 nt, hsa
auaucuuuauuauagccuuaagacuuaauuuuaagucuuaaaaauagcguguauacuugaaua

SEQ ID NO: 139423 - RNA, 63 nt, hsa
gaucucucugaacuauuuuuauaacuucuugugagucuuaaguauuucaaaauaaaagugguu

SEQ ID NO: 139424 - RNA, 63 nt, hsa
caugggaggcaaagaaaggaaauccggaaauauagucuuaaccugguguuguucuaauuuucc

SEQ ID NO: 139425 - RNA, 63 nt, hsa
caucaguccuggggcuuuuucuuuaucacccucagucuuaauccauccaccagagucuagaag

SEQ ID NO: 139426 - RNA, 63 nt, hsa
uacagauuuuuuguuuaccuuggucuuguuuuaagucuuaaaaaauuaaagauaacauuauaa

SEQ ID NO: 139427 - RNA, 63 nt, hsa
uagcaucauauauuaguucauuuucuuuuggacagucuuaagagaaguuucacuaaaaaugua

SEQ ID NO: 139428 - RNA, 63 nt, hsa
agagguuucaguuuuuaauaccaaguccuuaggagucuuaacauuggccagcaucuguuuauc

SEQ ID NO: 139429 - RNA, 63 nt, hsa
cccuguagaaaccucguuauuaaccaguguuccagucuuaaaguagacaaaauauucagagcc

SEQ ID NO: 139430 - RNA, 63 nt, hsa
uuuauuguuuuuaaaaugaaaggaauacuaauaagucuuaaaaguuccuucaugcauaagauu

SEQ ID NO: 139431 - RNA, 63 nt, hsa
caggugugagccacccugcccagccgucaaaagagucuuaauauauauauccagauggcaugu

SEQ ID NO: 139432 - RNA, 63 nt, hsa
ucuucucuccucauggacuuuuucugcaauugcagucuuaagcuucacucuccaccaccugga

SEQ ID NO: 139433 - RNA, 63 nt, hsa
gccugaguugucaccauuaugucuuaagcuguuagucuuaaagauuauuguuaaaaaauucag

SEQ ID NO: 139434 - RNA, 63 nt, hsa
guaagcuuaaacuacaacuugucacauaaaggaagucuuaaguggaguucacagaaugauaau

SEQ ID NO: 139435 - RNA, 63 nt, hsa
uuuaacuagcugccuuuagauuuugauaaucacagucuuaaaauacuaggaaagaaguggaug

SEQ ID NO: 139436 - RNA, 63 nt, hsa
uauucgugugaaaaagaauacaucauuucucacagucuuaaguugauauuuauagaaaugaau

SEQ ID NO: 139437 - RNA, 63 nt, hsa
uuuucugaugaauaguguucaguaaaaugaagcagucuuaagagugacuaauaauuucaaagu

SEQ ID NO: 139438 - RNA, 63 nt, hsa
uuucuguuugaagaaaauagagggagaaacagaagucuuaagucuguggcacacugugucuuc

SEQ ID NO: 139439 - RNA, 63 nt, hsa
gaaagagcguaaauguaaagucacuuuuucaucagucuuaaaacccaaaggcucuuuucagag

SEQ ID NO: 139440 - RNA, 63 nt, hsa
acgagaacucuuauauuggcuuuuuaaggaagcagucuuaacaaaggcucuuuucagagccac

SEQ ID NO: 139441 - RNA, 63 nt, hsa
uccaguacuugagcugaccauugaacuagggcaagucuuaaauguguacauguaguugaauuu

SEQ ID NO: 139442 - RNA, 63 nt, hsa
accauuuuuaaagugcacaaaaauauuauuauuagucuuaacuaaaauuacauauuuuauaau

SEQ ID NO: 139443 - RNA, 63 nt, hsa
gcuggaucugcugcuuccugccuaccuuuugcaagucuuaacuuaccugugcuucaguuuccu

SEQ ID NO: 139444 - RNA, 63 nt, hsa
guuuucacagacaauaacuguucugcucauggaagucuuaaacagaaacuguuacugucccaa

SEQ ID NO: 139445 - RNA, 63 nt, hsa
uugugaaccccugaagauuuuuugaccguuccaagucuuaaugccacaccacuauuccagcga

SEQ ID NO: 139446 - RNA, 63 nt, hsa
uauuccaggcacaagagaaagcucuggggcuugagucuuaauagggcugauaguccaaccagg

SEQ ID NO: 139447 - RNA, 63 nt, hsa
aaaaccuuauuuaugucuuauuugaagaugaauagucuuaaaagauaaagacauaaaugggac

SEQ ID NO: 139448 - RNA, 63 nt, hsa
ugguaaaggaaacccaugcaauuuuaccuagacagucuuaaauaugucugguuuuccaucugu

SEQ ID NO: 139449 - RNA, 63 nt, hsa
uaauguuuaucuugauagacuuuaaauguaucaagucuuaauuguauuuuaaauugaagccuu

SEQ ID NO: 139450 - RNA, 63 nt, hsa
uuucuaugccaaacaggaacaauccauaacuuuagucuuaauguacacauugcauuuugauaa

SEQ ID NO: 139451 - RNA, 63 nt, hsa
ucuccugcggccacaucaacggaugcaagucacagucuuaacacagccugugggagacaagca

SEQ ID NO: 139452 - RNA, 63 nt, hsa
ugaaaaacauauaauuuacuucuuauaaauugaagucuuaaaugugaaaccaagaaauguaau

SEQ ID NO: 139453 - RNA, 63 nt, hsa
uuagaaaguuaaaagaauguagaaaagauacucagucuuaauccuaugcaaaaaaaaaaauca

SEQ ID NO: 139454 - RNA, 63 nt, hsa
acaggucuuugaucuggaaacuaagacuagagaagucuuaagagaugacugcucaggugagua

SEQ ID NO: 139455 - RNA, 63 nt, hsa
guccuuguuguuucuugccugaacuccugccauagucuuaacuggucuccuugcuuccugucu

SEQ ID NO: 139456 - RNA, 63 nt, hsa
cauaagguuauuauaauaaauuauauuaguaaaagucuuaacuggaaaaaagaaucuaaauca

SEQ ID NO: 139457 - RNA, 63 nt, hsa
ugcaccuugaguugagagggcuacauguagaaaagucuuaaaauagagcuaaacaccacagug

SEQ ID NO: 139458 - RNA, 63 nt, hsa
cauucuguuuccugcagugggaacuggccauguagucuuaacagucuuuuguacaaauaucua

SEQ ID NO: 139459 - RNA, 63 nt, hsa
uccaacuuuucccuucucaguuccucucucgaaagucuuaauucugugucaguaagucuuuaa

SEQ ID NO: 139460 - RNA, 63 nt, hsa
auuaagugguaaugucauagugguggguuuuuaagucuuaaccaaucucuaagguuuguuucu

SEQ ID NO: 139461 - RNA, 63 nt, hsa
ccucacagaaaaguuggaaauaaccaaaacugaagucuuaauuuaccuucaguuuaaucugug

SEQ ID NO: 139462 - RNA, 63 nt, hsa
gggcuaaggaaguaucagcacuagaaauugggcagucuuaauguugaaugcugcuuucugcuu

SEQ ID NO: 139463 - RNA, 63 nt, hsa
cccuucuggaauugcuaauguuaguguuuauaaagucuuaaaugugugcauaaaaaacuaaau

SEQ ID NO: 139464 - RNA, 63 nt, hsa
cacugcacuccagucugggugagagugagacucagucuuaaaaaaauaugccuuuuugaagca

SEQ ID NO: 139465 - RNA, 63 nt, hsa
uauugaauuauaccauuuacucuguuuucuuauagucuuaauuuuauuauauuuuguuguuac

SEQ ID NO: 139466 - RNA, 63 nt, hsa
agugccagaccggaaccuauagcuacugcuagaagucuuaaaaaaaccaacagcagcacagga

SEQ ID NO: 139467 - RNA, 63 nt, hsa
gguugaauuguguucccccaaaauauauggugaagucuuaacccccauccccgugaaugggac

SEQ ID NO: 139468 - RNA, 63 nt, hsa
aagaaaauccuuuccucuugggaaaguaauacaagucuuaaguuccauuguagggugcgccuu

SEQ ID NO: 139469 - RNA, 63 nt, hsa
cuguauccucccuggcagacacaacccaauaggagucuuaauuuauuucuuaaccuuugcuau

SEQ ID NO: 139470 - RNA, 63 nt, hsa
gguguauggauaugugauuuugagauuaaaguuagucuuaaaauguaaauaaaaugugaaacg

SEQ ID NO: 139471 - RNA, 63 nt, hsa
cauuauagaauuaucugugaguuguguagacacagucuuaauguuucugguuaugacagauaa

SEQ ID NO: 139472 - RNA, 63 nt, hsa
ucgaauucuagacugaggaguagaguucauuggagucuuaaacucucugauaucacuuaaagc

SEQ ID NO: 139473 - RNA, 63 nt, hsa
cagguggccaugacuacccgugguaccaaucucagucuuaaagcucaggcuuuucguucauua

SEQ ID NO: 139474 - RNA, 63 nt, hsa
cacaucuucagggcaccaguguuaaaauuuuggagucuuaauuuucauguguacaccucuuug

SEQ ID NO: 139475 - RNA, 63 nt, hsa
auuggaaguucuuuguaauuuuaauuccaugaaagucuuaauguuuccaacaugaaaauucuc

SEQ ID NO: 139476 - RNA, 63 nt, hsa
auagucacaaguauuaauaaugccuuagaugauagucuuaaauauuagguugaggucuaccua

SEQ ID NO: 139477 - RNA, 63 nt, hsa
auagcaauaaaccuaacuggauuuggaugaagaagucuuaauacugacauacuggauuuuuaa

SEQ ID NO: 139478 - RNA, 63 nt, hsa
cuaguuagaguuagaccugucuuuggaugaagaagucuuaauacugaaauacugaauuuuuaa

SEQ ID NO: 139479 - RNA, 63 nt, hsa
cuuuguuaaaccccaauuauagauaauuuuuccagucuuaagcucuguccaccuucaagucaa

SEQ ID NO: 139480 - RNA, 63 nt, hsa
ucaaaaugaaaacaaagcaaaugaauacuggacagucuuaacaauuuuauaaguuauaaaaug

SEQ ID NO: 139481 - RNA, 63 nt, hsa
gugagcauuugccugaauaaaaccuaaaagaguagucuuaacacauuacuaacuuuuucuaag

SEQ ID NO: 139482 - RNA, 63 nt, hsa
cagauuaaucuuuuauccuuuccugaaguacaaagucuuaagagugucugaaauccaagacau

SEQ ID NO: 139483 - RNA, 63 nt, hsa
aguuuuacuacuuuucauuuagaacagaguaugagucuuaaucugaagucuuuuucaugcccu

SEQ ID NO: 139484 - RNA, 63 nt, hsa
cguuuuuguuuucuuguacuuugaauuccccaaagucuuaauugcuuuauuuugguguugugu

SEQ ID NO: 139485 - RNA, 63 nt, hsa
acaguccauugugaagugugcuauauuuagaacagucuuaaaauguacaguguauuuuauaga

SEQ ID NO: 139486 - RNA, 63 nt, hsa
gcauugggcuccgugccacaaccaagcuucauuagucuuaaauuucagcauauguugcugcug

SEQ ID NO: 139487 - RNA, 63 nt, hsa
uuuuuuauaauuguuuucagaaaaaaaguuuacagucuuaaggaaaauauucaggucuaucau

SEQ ID NO: 139488 - RNA, 63 nt, hsa
uuacaggcaugagcuaccacaccugguuuggagagucuuaauuaaggaaauuucccuaauguu

SEQ ID NO: 139489 - RNA, 63 nt, hsa
gagagauuggugauuuauauaagguaaucuguuagucuuaaaauaguuaaaaguuuguauuuu

SEQ ID NO: 139490 - RNA, 63 nt, hsa
cacacuuuuacaaauuuaauauaaagcaaguccagucuuaaaaagacaaaccauaucacuccu

SEQ ID NO: 139491 - RNA, 63 nt, hsa
uggaaacugaccaccuacuuuguccagaaaagaagucuuaagauauuucaaggaaucaguguc

SEQ ID NO: 139492 - RNA, 63 nt, hsa
aaugaaucacggcaauuucuuauaaaugagggaagucuuaagaccuuccauuuuuuagagaca

SEQ ID NO: 139493 - RNA, 63 nt, hsa
cauauuuauauuuuuaaauaaaugcauauauugagucuuaaaaucucuuucuggccaaagacu

SEQ ID NO: 139494 - RNA, 63 nt, hsa
gaaucuagcauuuguuuucagagauucaagcauagucuuaaggguagaucagaaaugacaaau

SEQ ID NO: 139495 - RNA, 63 nt, hsa
agaccgaacuguuguauaaauuuauuuacugcuagucuuaagaacugcuuucuuucguuuguu

SEQ ID NO: 139496 - RNA, 63 nt, hsa
ugcuucugugaauuaaguugugguuucaucaugagucuuaauguucuuuguugauaagacaag

SEQ ID NO: 139497 - RNA, 63 nt, hsa
uauauauauaucaguuugaucacacuauuuuagagucuuaaugccaagucagcagauuugcuu

SEQ ID NO: 139498 - RNA, 63 nt, hsa
gguuuuguuaauucuuuucagaaucauugaagcagucuuaaagggucuuuugcagaugguaca

SEQ ID NO: 139499 - RNA, 63 nt, hsa
agaggauaaugguucaccucugcguaaacugcaagucuuaagcagacaucuggaauagagcuu

SEQ ID NO: 139500 - RNA, 63 nt, hsa
ucagggcuuuucuggggcugcucuuggaaaugaagucuuaaguacugaauaacuccccugggg

SEQ ID NO: 139501 - RNA, 63 nt, hsa
uauauuaaugaggagaaaaguaugaaaacaagaagucuuaaguaaauauugaggucauuguuu

SEQ ID NO: 139502 - RNA, 63 nt, hsa
gggcuugagaagguuacugagugaguuauugggagucuuaauaaaauaaacuagauauuaggu

SEQ ID NO: 139503 - RNA, 63 nt, hsa
uuauauuacuauuuuccuuuuuguuguucacauagucuuaaggcaccuauacuuuuaaauuga

SEQ ID NO: 139504 - RNA, 63 nt, hsa
uuagccaggaaagacaaauaauccaacgcugcuagucuuaaccccagaccagagagaacugca

SEQ ID NO: 139505 - RNA, 63 nt, hsa
augcccggcccauaaguaccguuuuugagguucagucuuaaacauuugcuuuaagaaaacagu

SEQ ID NO: 139506 - RNA, 63 nt, hsa
aaaaccaaucaugccuucccaacagucccccaaagucuuaacucauuucagcauuaacccaaa

SEQ ID NO: 139507 - RNA, 63 nt, hsa
gcaaaggaaacuauugucucgcuccuucaaaacagucuuaauuaacuuucauauuagcagauu

SEQ ID NO: 139508 - RNA, 63 nt, hsa
uauuucuuuuucgggguuucugcaugcaguggcagucuuaagugccaaaauucauuauaaccc

SEQ ID NO: 139509 - RNA, 63 nt, hsa
accauuuauauucuaguagccaucuucacuguuagucuuaaauuauaauguaaaguugacauu

SEQ ID NO: 139510 - RNA, 63 nt, hsa
uguacucuuaugugucugauauacacauuuccuagucuuaacuuucaggaguuuacaauugac

SEQ ID NO: 139511 - RNA, 63 nt, hsa
uaggcagggcgaauacuacuuuguaacuuuuaaagucuuaaacuuuucaauaaaauugaguga

SEQ ID NO: 139512 - RNA, 63 nt, hsa
gucuaaagugauuaucuuuuuuccccccaaguuagucuuaaaucuuuuggguuugaaugaagg

SEQ ID NO: 139513 - RNA, 63 nt, hsa
gcggggcugaggaacagggaaaugccgcugugaagucuuaaagcacuucugcuuaaacuccca

SEQ ID NO: 139514 - RNA, 63 nt, hsa
uguuuuauuuuuagaauaguuauaaaaaguauuagucuuaacauaaugugucuuguucuuuuu

SEQ ID NO: 139515 - RNA, 63 nt, hsa
caugucauagagaauaaagcugaugauuguaccagucuuaaauuauucaugauucaauaaaau

SEQ ID NO: 139516 - RNA, 63 nt, hsa
uuuagaguuuccaaauuuagagcuucugcauacagucuuaaagccacagaggcuuguaaaaau

SEQ ID NO: 139517 - RNA, 63 nt, hsa
ucauuucaggguaggagucaaugaagacaucuuagucuuaacaaguuacagauaaucucugac

SEQ ID NO: 139518 - RNA, 63 nt, hsa
uauaaggugagguaacucagaacuuaauuuaaaagucuuaaauauucugauacaauucagcug

SEQ ID NO: 139519 - RNA, 63 nt, hsa
aacaauuggcagaaccuguuugauuacugugacagucuuaaugauaccauaaaucaauauuag

SEQ ID NO: 139520 - RNA, 63 nt, hsa
auuucgcugguucuuuguagucacauauuuuauagucuuaauaucuuguuuuugcaucacugu

SEQ ID NO: 139521 - RNA, 63 nt, hsa
uccauuaucccuuugccuuuaacccugacauucagucuuaacacauuuuaucuuaaauaauuu

SEQ ID NO: 139522 - RNA, 63 nt, hsa
uuuuucguaacuuuugaaucuuaauauuuugaaagucuuaaaggagacacugcaaagucuuag

SEQ ID NO: 139523 - RNA, 63 nt, hsa
ccaucuaugggcuuuagaccuauuacuggguggagucuuaaaguuauaauuguucaauauguu

SEQ ID NO: 139524 - RNA, 63 nt, hsa
uuuguauuauuguuuguuuuguguucaguucaaagucuuaaccaguuuuauugucaaauaaac

SEQ ID NO: 139525 - RNA, 63 nt, hsa
cugauauccccuggcucaguccuaacaagacugagucuuaacaagaugagaaguccuccccuu

SEQ ID NO: 139526 - RNA, 63 nt, hsa
guuauuugcuucuuuuaaucagcaaaggccucaagucuuaaaauaaaaggggagaagaacaaa

SEQ ID NO: 139527 - RNA, 63 nt, hsa
aauggcugaagagaucaagaauuuaaagcuucuagucuuaacauacuugcauccacuucaaau

SEQ ID NO: 139528 - RNA, 63 nt, hsa
gccccaaaauuauaaacucuaaguguaaaaaaaagucuuaacaacagcuucuugcuuguaaaa

SEQ ID NO: 139529 - RNA, 63 nt, hsa
cugguucauucuccauuacugcaagagaauggaagucuuaauagaaggaagcaggagugauua

SEQ ID NO: 139530 - RNA, 52 nt, hsa
cccuucaggacgaggaguaagaagucuuaauugcccucuccugcuucagucg

SEQ ID NO: 139531 - RNA, 63 nt, hsa
uaaggaaagacuugguguauagugugaugguuuagucuuaaggauuaagacauuuuugguacu

SEQ ID NO: 139532 - RNA, 63 nt, hsa
gaaaaauggacauaugaauauuauuaaaaauugagucuuaaauuuaaaugggaagggaagaaa

SEQ ID NO: 139533 - RNA, 63 nt, hsa
gaagguuauggguaccaggaagaaacaaacagaagucuuaagauuagaaugagaaccaaagag

SEQ ID NO: 139534 - RNA, 63 nt, hsa
gauaagaugaccuguguaauaaucuuuguuaguagucuuaaagcugcugccauaguccuccaa

SEQ ID NO: 139535 - RNA, 63 nt, hsa
acauuucacauacuguuacugaagaaagcaccaagucuuaauggaacaaagaccauagaauga

SEQ ID NO: 139536 - RNA, 63 nt, hsa
uuuauugaugaauacaucucugaacguuccagaagucuuaagguuccaaagggauuuagcagu

SEQ ID NO: 139537 - RNA, 63 nt, hsa
acacuauuaugaagcuacuagucauuccauaagagucuuaaaggacugcucuguguaacacug

SEQ ID NO: 139538 - RNA, 63 nt, hsa
auucucauauccaugccuuuuuguccuguuuacagucuuaaaagagguaaaacagcaaauauu

SEQ ID NO: 139539 - RNA, 63 nt, hsa
acaaguuguuuguauuuuauuuuuguuuauaccagucuuaaagauccagguucugaauaaaaa

SEQ ID NO: 139540 - RNA, 63 nt, hsa
aguagacaccacuguacuuuuugauacgagggcagucuuaacuuguguuaaggccugugugua

SEQ ID NO: 139541 - RNA, 63 nt, hsa
guauuggaguuuaaaaaaaaagccaaauuucacagucuuaauaacuuuuuuuaaaaaaaacua

SEQ ID NO: 139542 - RNA, 63 nt, hsa
gguuuucaucaagccccgcccuuucucucucauagucuuaaugcgucuggaccacuggggaaa

SEQ ID NO: 139543 - RNA, 63 nt, hsa
guaaauaauguucaggaaaaacgcagggaacagagucuuaaaguuaauggauauuuaauguga

SEQ ID NO: 139544 - RNA, 63 nt, hsa
cagaaguaauuggccugagagcauucuugaccaagucuuaaaugcuagaaucugagaaggaau

SEQ ID NO: 139545 - RNA, 63 nt, hsa
cuuucucauacacugacuguuacuuuaacuguuagucuuaaauaguugggacaucagcugacu

SEQ ID NO: 139546 - RNA, 63 nt, hsa
uaaauggacauuccagaauauagaugugauuauagucuuaaacuaauuauuauuaaaccaaug

SEQ ID NO: 139547 - RNA, 63 nt, hsa
caacuauaggccuuuuucuugggaugauuuucuagucuuaagguuuggggacauuauaaacuu

SEQ ID NO: 139548 - RNA, 63 nt, hsa
cucagauugaaaagcuuaugaggauuucuugggagucuuaauaaccugccuguuaguacagag

SEQ ID NO: 139549 - RNA, 63 nt, hsa
ggcacuauuucugaacaaagagagcucaucaucagucuuaauauucagagaaaacuucagaga

SEQ ID NO: 139550 - RNA, 63 nt, hsa
acugcucauuuacacucaaauuaaucuugaaguagucuuaaaauguguaagaaguuaaaacuu

SEQ ID NO: 139551 - RNA, 63 nt, hsa
aaguuacacagaccacagugauuuagccaaauaagucuuaaccaaaaaaaggaaucugaaaaa

SEQ ID NO: 139552 - RNA, 63 nt, hsa
uguaaauaguguccauuaguaaaagugaaauucagucuuaaguagggugaauuggaucaccau

SEQ ID NO: 139553 - RNA, 63 nt, hsa
ucuguuauuaaggggcauagcauuaauuuuugcagucuuaaaauuacacuucuugacuucuga

SEQ ID NO: 139554 - RNA, 63 nt, hsa
aaagguccuagucuuucuggcuuuaacacagaaagucuuaauaccauuuggauuaaagauuca

SEQ ID NO: 139555 - RNA, 63 nt, hsa
gagaacugaaagggaaaacaaaauacuugacauagucuuaaguagaagaaggcaguuagagaa

SEQ ID NO: 139556 - RNA, 63 nt, hsa
cacugguaaaauuguugaauauuucucucucccagucuuaaaagcccacaggcaagaauuaau

SEQ ID NO: 139557 - RNA, 63 nt, hsa
caaaaauuuuauucaguguauuuucaguuguugagucuuaaugagggauacaggaggaaaaau

SEQ ID NO: 139558 - RNA, 63 nt, hsa
guucucuguuuugaauauacuuuaauaccugagagucuuaaaauuugugaacaacguuucuau

SEQ ID NO: 139559 - RNA, 63 nt, hsa
uaaacuguggagcuuucauguuuacuguaauuuagucuuaaaauauuuuuuacuuaguaacca

SEQ ID NO: 139560 - RNA, 63 nt, hsa
ucguaggcguuuauauuauaaaauucuguuaguagucuuaaaauugaauugguggaaccacua

SEQ ID NO: 139561 - RNA, 63 nt, hsa
guacgcugcgugaacaugccucaccuuuaagagagucuuaaagguaaagacacgaaaacacuu

SEQ ID NO: 139562 - RNA, 63 nt, hsa
acuaaaauuuuauauauuguaaccaguguuaaaagucuuaaaaaacaaugguauuaauugucc

SEQ ID NO: 139563 - RNA, 63 nt, hsa
cuauaauuuuguguuuuuuuuuuuuaauugucuagucuuaaauuuguacaucuuguauaaaau

SEQ ID NO: 139564 - RNA, 63 nt, hsa
aagcugggugggcugaagaggccuggaaacgagagucuuaauugaggagaugggagacucgaa

SEQ ID NO: 139565 - RNA, 63 nt, hsa
uugaugggaugacugacacaggaaaucuguuaaagucuuaaaauggaaugagaauguuguuuu

SEQ ID NO: 139566 - RNA, 63 nt, hsa
uacauaauucaaaagaacuacuugaugcaguauagucuuaaggguucugcauacauuuuagaa

SEQ ID NO: 139567 - RNA, 63 nt, hsa
aaaugcauccucuagaaaaauaauuaguguuauagucuuaagauuuguuuucuaaaguugaua

SEQ ID NO: 139568 - RNA, 63 nt, hsa
ccauccccaagcaccuccucaugcugugcaugcagucuuaaauucaauggacaaaaauaaaau

SEQ ID NO: 139569 - RNA, 63 nt, hsa
uuuauuuccuaaaugccauacuaugaagaucaaagucuuaaguguguuugcagcucaaaaaua

SEQ ID NO: 139570 - RNA, 63 nt, hsa
gcaaauugaauuggaauaggaauugauaauagcagucuuaaacauuaguagugggauuuggcu

SEQ ID NO: 139571 - RNA, 63 nt, hsa
uggaauuucauucaaaggcauaauagcaaugacagucuuaagccaaacauuuuauauaaaguu

SEQ ID NO: 139572 - RNA, 63 nt, hsa
ggagucucuggcuuaugacuccugguucccauuagucuuaagucuucugguucccauaaaaga

SEQ ID NO: 139573 - RNA, 63 nt, hsa
aacuuaggcccuggcaauuaacugaaagggcaaagucuuaaucaaucaaacaauggaggaauc

SEQ ID NO: 139574 - RNA, 63 nt, hsa
gauugcuuuuguauuuaauucugcagguguucaagucuuaaaaaauaaagauuuauaacagaa

SEQ ID NO: 139575 - RNA, 63 nt, hsa
uucauugcuaagacuaacucaagauaauccuagagucuuaaagcauuucaggccaguguggug

SEQ ID NO: 139576 - RNA, 63 nt, hsa
uuaggaauuacuuuauuauaaaaugcuccuagaagucuuaauuguguuuauuuuuuaaaaaaa

SEQ ID NO: 139577 - RNA, 63 nt, hsa
acucuuccccucuucucacuacugcacuugacuagucuuaaaacaaagaaagaacgaaugaau

SEQ ID NO: 139578 - RNA, 63 nt, hsa
gauaaaauauugauguuguauuuuacacucuuaagucuuaaccacagucagaauuaucuuaau

SEQ ID NO: 139579 - RNA, 63 nt, hsa
gccccacugcaucucaagugaacuguauagccaagucuuaaaccucucacggggcaagccuga

SEQ ID NO: 139580 - RNA, 63 nt, hsa
auacuuucaauauuauucugaauggcugaaguuagucuuaaacucaaauuacuauaugaugau

SEQ ID NO: 139581 - RNA, 63 nt, hsa
uaaguguuucagaaauguuuuauuucacacauaagucuuaauguuauuguuaugauuauacuu

SEQ ID NO: 139582 - RNA, 63 nt, hsa
guauuuuuaaauuuuucuuggguuaguauuuaaagucuuaacauuuauuuaauaauuauauuu

SEQ ID NO: 139583 - RNA, 63 nt, hsa
gcugagugugucucccuaaaauuucuauguugaagucuuaacccuugguaccacagaauauca

SEQ ID NO: 139584 - RNA, 63 nt, hsa
aguacacagacaugaacuguucuuaaacagaacagucuuaaaaugucuguacauaucugucug

SEQ ID NO: 139585 - RNA, 63 nt, hsa
uguguuuuuguaugaaugagcccauucaugguaagucuuaagcuuguuggaaauaauguaccc

SEQ ID NO: 139586 - RNA, 63 nt, hsa
cuauuaggaauggcauauacugagguggucguaagucuuaacuucuaaaauuuuaaauaaaag

SEQ ID NO: 139587 - RNA, 63 nt, hsa
gagcaguguaauuacaaacaaauagguuggcauagucuuaagucuuugagucuagagagauuu

SEQ ID NO: 139588 - RNA, 63 nt, hsa
cuacauaaaagcuccaugugaaaagcuacuccuagucuuaacauuugcaguccuugugucacu

SEQ ID NO: 139589 - RNA, 63 nt, hsa
uuaaaaaaggaaaaaaaaaagaaacuggguuccagucuuaauucauuuuccgugccagguuuu

SEQ ID NO: 139590 - RNA, 63 nt, hsa
cuuuucuuugcaagcgaaccuguuugaagcccaagucuuaacuccuggucucguaagguucca

SEQ ID NO: 139591 - RNA, 63 nt, hsa
uuuugaauguaaaaguugcaacacacaaacggaagucuuaaaaacuuuuugcucuggucaguu

SEQ ID NO: 139592 - RNA, 63 nt, hsa
uaugucugcaccagugaauccauucucaagaaaagucuuaacuaggaaacuaaaagcuuucac

SEQ ID NO: 139593 - RNA, 63 nt, hsa
aaaguauuaauagaaauucucuaucagcuauucagucuuaauuucacuaguaguauaaugggu

SEQ ID NO: 139594 - RNA, 63 nt, hsa
agucuggguuguugggaacagcacagaauuuggagucuuaagcucuaaauuagaggcccugac

SEQ ID NO: 139595 - RNA, 63 nt, hsa
uucuuuucuuuuuuaaaguaaacuuguguauugagucuuaacuguauuucaguauuuuccagc

SEQ ID NO: 139596 - RNA, 63 nt, hsa
gugcauuuccuccugccuuugcuuguucacugcagucuuaagaaagagguaaaaggcaagcaa

SEQ ID NO: 139597 - RNA, 63 nt, hsa
gagcucaguucccauugcuugugcucagggcugagucuuaaagaaggguuugccggcccuaac

SEQ ID NO: 139598 - RNA, 63 nt, hsa
gugauauuuuuuagacugaacugcuccauuccuagucuuaauuaccauauucaggguacgaac

SEQ ID NO: 139599 - RNA, 63 nt, hsa
cgccuuucucaccacccugggggcgccucgugcagucuuaacagggagagggcuuucuggggc

SEQ ID NO: 139600 - RNA, 63 nt, hsa
cauaauugaugcacaugauguucacacagugagagucuuaaagauacaaaaugguauuguuua

SEQ ID NO: 139601 - RNA, 63 nt, hsa
gauucgagcuauauuuaaguauucaagaaagccagucuuaacauuucuaacucugauguaaau

SEQ ID NO: 139602 - RNA, 63 nt, hsa
gcaccuuucuguacaaauacuaauucaauuuuaagucuuaagucacuuuuuuaauauauauga

SEQ ID NO: 139603 - RNA, 63 nt, hsa
gcgguggagggaucaguugccccccaucaccagagucuuaagggucacuggccucuccccagg

SEQ ID NO: 139604 - RNA, 63 nt, hsa
uccguaguguagaagcccacagguguagaacucagucuuaaacuucaguaugaaaccaguuuc

SEQ ID NO: 139605 - RNA, 63 nt, hsa
uagaaugugggcuuuuucaagggugaagauacaagucuuaaccacaguguaacuuacaguuuc

SEQ ID NO: 139606 - RNA, 63 nt, hsa
uauugauacuaaagaggaguuaaaggcacauaaagucuuaacucuauaauguucauuuaguug

SEQ ID NO: 139607 - RNA, 63 nt, hsa
uacauuuaacuuuggaauggcuuuguaauaaucagucuuaagaaaauguugacaagcucuggu

SEQ ID NO: 139608 - RNA, 63 nt, hsa
gaaucuggugaauuuuagucaucccagcuuuuuagucuuaaccacaguucucacucucuuaaa

SEQ ID NO: 139609 - RNA, 63 nt, hsa
uguucuguaaauuuuauuuuaaacuguuaccauagucuuaaguuguuuaugcuuuaucagacu

SEQ ID NO: 139610 - RNA, 63 nt, hsa
uuuuguuuucuuucuauguuccaugcauaauacagucuuaagugaauuucucuuuuuuaauuu

SEQ ID NO: 139611 - RNA, 63 nt, hsa
uacaaaggaaccaaaaugauaaugggagaauuuagucuuaaaaguuuagguugucagaguuua

SEQ ID NO: 139612 - RNA, 63 nt, hsa
uacaagucaggguguuuggcuaaucuacaaauaagucuuaaaccuauguuuuuaaauuuuuuu

SEQ ID NO: 139613 - RNA, 63 nt, hsa
uaaaagugcuaauguguauucgaacccaaugguagucuuaaagaguuuugugcccuggcucua

SEQ ID NO: 139614 - RNA, 63 nt, hsa
agacccaagucaucaugaaaaaggcccaaguacagucuuaaugcgauaaauccacuagcuaag

SEQ ID NO: 139615 - RNA, 63 nt, hsa
ccagcuguccccacgccucugucuuuugggucaagucuuaaucccugcaccugaguugguccu

SEQ ID NO: 139616 - RNA, 63 nt, hsa
aauuguucugugauugaggaccacugaaaaauaagucuuaauaaauguugguaugaaccuacu

SEQ ID NO: 139617 - RNA, 63 nt, hsa
uucuucaaaaugugcauguuaaguauucaaaucagucuuaaauuuuuaaaaauauguaauuuu

SEQ ID NO: 139618 - RNA, 63 nt, hsa
caggaacuauucuaaaagucauaaaagggucacagucuuaagcagagcuuaguuuucuucuca

SEQ ID NO: 139619 - RNA, 63 nt, hsa
uuuuuuuacacauauuaacuuaauaaauguaugagucuuaaauaccucuuaguucucauuaaa

SEQ ID NO: 139620 - RNA, 63 nt, hsa
gggucuuggugcccaagcuggucucaaacuccuagucuuaagcaaucuuccugcuuuggccuc

SEQ ID NO: 139621 - RNA, 63 nt, hsa
gcagccccgccccccugccucacccacaaacuaagucuuaacaaaauccaaauuaccaacaaa

SEQ ID NO: 139622 - RNA, 63 nt, hsa
gacggcagagccuccuucagaaagugcagcucaagucuuaaagacaccaaaacugagccaugg

SEQ ID NO: 139623 - RNA, 63 nt, hsa
ccuucucuaauuucuucuuuuuuuuaaugauaaagucuuaaaaacacggagccaccaacugga

SEQ ID NO: 139624 - RNA, 63 nt, hsa
agauugaaaagagaccgaaugugcagauuccacagucuuaagcuuuccccuucagaugucagu

SEQ ID NO: 139625 - RNA, 63 nt, hsa
auagguaguuuucuauaguaacuugauuaauuuagucuuaauccauuugaaacucucucuucc

SEQ ID NO: 139626 - RNA, 63 nt, hsa
acuugcccucgugccugggggagagaggcagcaagucuuaacaaaccaacaucuuugcgaaaa

SEQ ID NO: 139627 - RNA, 63 nt, hsa
uucuacuacuacauauuuagaguucacugguucagucuuaaaugccugcauggugccuuuuua

SEQ ID NO: 139628 - RNA, 63 nt, hsa
uuucagguaguaauauucaguguaguuaaggccagucuuaacccacuggaugaaaaucuagga

SEQ ID NO: 139629 - RNA, 63 nt, hsa
ucacucacucacucaacaaauacccguuggaagagucuuaaacuggggcuucauguguggccu

SEQ ID NO: 139630 - RNA, 63 nt, hsa
ugggguguuucgccugcaccccugguuucuuuaagucuuaagugaugccccuuccaaaccauc

SEQ ID NO: 139631 - RNA, 63 nt, hsa
uuuuggggggaacauuuuagguuuguauuugguagucuuaauguaucuggcauuugggugaac

SEQ ID NO: 139632 - RNA, 63 nt, hsa
uaccguauucgccguacuaaguugguuucuguuagucuuaacagucuguuuucuuuuaaaagc

SEQ ID NO: 139633 - RNA, 63 nt, hsa
cugucauaauuuaagcauuugaguauauuuugaagucuuaaaagacuuagcccauaggcacuu

SEQ ID NO: 139634 - RNA, 63 nt, hsa
caccccgcaaccugggaucucaaggagcuuuaaagucuuaaugggaacuuggcauuuuccuga

SEQ ID NO: 139635 - RNA, 63 nt, hsa
accuuguaaaagacaguguauguagaagcaugaagucuuaaggacaaagugccaaagaaagug

SEQ ID NO: 139636 - RNA, 63 nt, hsa
acccuggccuccuagggucccuuuuucugaugaagucuuaauucccuaaaagcgccucuuugg

SEQ ID NO: 139637 - RNA, 63 nt, hsa
guuaugagaaccagcgaaaucccccaugucaucagucuuaaaaaaaaaauuuuacaaauccac

SEQ ID NO: 139638 - RNA, 63 nt, hsa
cuccuguuagacaaacacauugaugaagaaauuagucuuaauaggauuguaggcuguguagaa

SEQ ID NO: 139639 - RNA, 63 nt, hsa
ggcucccacuucuugggaggguuacauuuuuuaagucuuaaucauuugugacauauguaucua

SEQ ID NO: 139640 - RNA, 63 nt, hsa
ugguuuauacuuuuucuauucaucaggguaggaagucuuaaauccuuaggcauccaagaagua

SEQ ID NO: 139641 - RNA, 63 nt, hsa
uggaucaccauuauauuuugaaagaagccaucaagucuuaaguuuuucauuucaacuugugaa

SEQ ID NO: 139642 - RNA, 63 nt, hsa
aaugugugaaagaaccucacacaacauaauuggagucuuaaaauagaggaagaguaagcaaag

SEQ ID NO: 139643 - RNA, 63 nt, hsa
gcuuauugcuucuguauuucuucucuacucccuagucuuaauguuuaaccuugaaugcuauua

SEQ ID NO: 139644 - RNA, 63 nt, hsa
aauaaauacaaaaaaaucauuuuucuagagcagagucuuaaaaucagguggggguaggggaug

SEQ ID NO: 139645 - RNA, 63 nt, hsa
cagauuacuccaggauaaucuccucaccucaugagucuuaacuuaauuacaucugcaaggccc

SEQ ID NO: 139646 - RNA, 63 nt, hsa
ugaauuuuaguacuaguuuacacguauaaauacagucuuaaaccuuuaugucugagucugaaa

SEQ ID NO: 139647 - RNA, 63 nt, hsa
uuucgccuuaguggugauuguuuaaacucucacagucuuaaaccgugccaaaguccuguuaug

SEQ ID NO: 139648 - RNA, 63 nt, hsa
gucuccugagacaagcaucgugauagaguucacagucuuaaaagucugcauuuucaggugggg

SEQ ID NO: 139649 - RNA, 63 nt, hsa
ccucggcuccauuguggguuauucuagaaauccagucuuaaaucucuccgcuaaaguggacau

SEQ ID NO: 139650 - RNA, 63 nt, hsa
guuacugaggcuucucccaaaagguaucaguccagucuuaaagauauuucauugugaaagaag

SEQ ID NO: 139651 - RNA, 63 nt, hsa
gcccuugaacaucuccuccaaagagacuagaagagucuuaaauuauaugugggaggaggaggg

SEQ ID NO: 139652 - RNA, 63 nt, hsa
gugaagugccuguguaauugaugacucuuacauagucuuaagcauuuuugcaauuuuuuaaau

SEQ ID NO: 139653 - RNA, 63 nt, hsa
auguaaaguugauauugacuacaauaaaaauccagucuuaauuccagauuuacugaaaauguc

SEQ ID NO: 139654 - RNA, 64 nt, hsa
cuccugagaagcuucaaauucaggccaggagagaagucuuaagaaaagaccuccagcaguuaca

SEQ ID NO: 139655 - RNA, 64 nt, hsa
ucugacuauacuuaguuugaaauggugcaggcuuagucuuaagccuccaaaggccuggauuuga

SEQ ID NO: 139656 - RNA, 64 nt, hsa
guuaacugccaaagcuaguuuuagagaaugagaaagucuuaagcaaaauacucccaggucucac

SEQ ID NO: 139657 - RNA, 64 nt, hsa
aggaaagauacagggaacaaaaaucaauuuguacagucuuaauauuaaaagcagcuugacuaaa

SEQ ID NO: 139658 - RNA, 64 nt, hsa
cuggaucugucuagucaaucaacauagcagagacagucuuaaaccuaccauugaccugugugua

SEQ ID NO: 139659 - RNA, 64 nt, hsa
ugauuuccuugaagcaguuugaaaauuugaauugagucuuaacuuuaggaaaugagguuucaua

SEQ ID NO: 139660 - RNA, 64 nt, hsa
gacaaccaggugggaccaaaguuuaugugccuuuagucuuaauuuaccuugcauuguaauauuc

SEQ ID NO: 139661 - RNA, 64 nt, hsa
aggugauucuuucuuuaccauuucuggggacuuuagucuuaauuagguaccuuauuaacaggaa

SEQ ID NO: 139662 - RNA, 64 nt, hsa
gucaaaaaucugcauauaacuuuugauuccccaaagucuuaaguacuaguagccuguuauugac

SEQ ID NO: 139663 - RNA, 64 nt, hsa
guauauugcaaaauuuaauauauuuguucacuugagucuuaagaguaggucaggccaaggcagg

SEQ ID NO: 139664 - RNA, 64 nt, hsa
caaauuaguggaacuuaguucagggacauagaagagucuuaaugaauuaaaaucauucacuuga

SEQ ID NO: 139665 - RNA, 64 nt, hsa
gauaaaacaauggcugguucuagcccugagugacagucuuaaggcuagauccuucccauaguau

SEQ ID NO: 139666 - RNA, 64 nt, hsa
gacaguuuuauagcugguuccuuuuaggguaaagagucuuaagagaguuuuauugugucuaugg

SEQ ID NO: 139667 - RNA, 64 nt, hsa
ugcuuuauuagugaggagaaaacaauuccuuagaagucuuaaauauauuguacucuuuagaucu

SEQ ID NO: 139668 - RNA, 64 nt, hsa
guguuuuuuguguaauucgugaaugucauauaguagucuuaaguuucucuuuuaaagcugcaug

SEQ ID NO: 139669 - RNA, 64 nt, hsa
gcccuucgauguaugccauuuagugaaagugcuaagucuuaaguuuccuaccacuuugguuuca

SEQ ID NO: 139670 - RNA, 64 nt, hsa
ccuguugauuaaucuauuuucauauuuauaaaggagucuuaauguucugccccauaagacuuuc

SEQ ID NO: 139671 - RNA, 64 nt, hsa
ccuaaaauauacccaucaguauaaggcaagcaaaagucuuaacauggcagccauucugccuuug

SEQ ID NO: 139672 - RNA, 64 nt, hsa
uccuuucugacacauaauuuggggcaaaaaagaaagucuuaagaguuuaucuuuucucugcuga

SEQ ID NO: 139673 - RNA, 64 nt, hsa
gcuguucaacauccucccuccuuagccccuccuaagucuuaaugcugagauuucuaaagaugcu

SEQ ID NO: 139674 - RNA, 64 nt, hsa
auuaacgaguguuuuaaaaagguuuuuaaugaauagucuuaaaucuaaauuugugugaauaauc

SEQ ID NO: 139675 - RNA, 64 nt, hsa
gccuguuucacucacucacccagcauaugaaacuagucuuaacuguugagccuuuccuuucaua

SEQ ID NO: 139676 - RNA, 64 nt, hsa
aguuaaauguauguaagauugauucugauucugaagucuuaacugccagcagaaaaacuccaua

SEQ ID NO: 139677 - RNA, 64 nt, hsa
aaauagguugaaaacaaucaucugugaguuuaggagucuuaagauccucacagcacgggagcag

SEQ ID NO: 139678 - RNA, 64 nt, hsa
uaugguauuccauuagguucuuuucauuuaaaguagucuuaaaaucaaaguauccaauauuuua

SEQ ID NO: 139679 - RNA, 64 nt, hsa
gccacagcucuucuuggcguauuuauacucacugagucuuaacuuuucaccaggggugcucacc

SEQ ID NO: 139680 - RNA, 64 nt, hsa
agugauagaaaacccacacaauacauccucugccagucuuaauagaauaucagagguaagaggg

SEQ ID NO: 139681 - RNA, 64 nt, hsa
gucuuuggauagcugucugagugaccacggacaaagucuuaacaaaacucaggaggaccaaugu

SEQ ID NO: 139682 - RNA, 64 nt, hsa
gaaauuuucaacccuuaaucugaaaacagaagacagucuuaauauaaauguacugugaagaaug

SEQ ID NO: 139683 - RNA, 64 nt, hsa
uuaguugagucacugagguuuaaacacaaugguaagucuuaaagucugcuauuuacagagcauu

SEQ ID NO: 139684 - RNA, 64 nt, hsa
uuuacugaauaagauuugaguaaugaaagucuguagucuuaaaacucuaaaacaguuguacugc

SEQ ID NO: 139685 - RNA, 64 nt, hsa
cacgaauagguaauugauagaguuuaugggucuuagucuuaaggguaacagagugaauaccuuc

SEQ ID NO: 139686 - RNA, 64 nt, hsa
caaaucauguuuagaaacuuuggaugaguuaagaagucuuaaguaugcaggcguuuacgugauu

SEQ ID NO: 139687 - RNA, 64 nt, hsa
ccaugugguauuaauauaccuucaauuuauguugagucuuaaacauaauuaggagauauuuuuc

SEQ ID NO: 139688 - RNA, 64 nt, hsa
cuaguugaaauuuuuaauagaaucaaggcacaaaagucuuaaaaccauguggaaaaauuaggua

SEQ ID NO: 139689 - RNA, 64 nt, hsa
gcaggcugucauagaguuauguguuagucucaggagucuuaacuuuugaaauauguuuuacuug

SEQ ID NO: 139690 - RNA, 64 nt, hsa
uuaggguuccacaucauucuaauguauaguuucaagucuuaauagacaaucugaauuccacuac

SEQ ID NO: 139691 - RNA, 64 nt, hsa
uucaaaagggcaauguuuucuuuauauuucuuauagucuuaauuuuguuauccaugugcauaau

SEQ ID NO: 139692 - RNA, 64 nt, hsa
uuucauacaaccauuuucaaaugaaccuuagaaaagucuuaacauuuaagguauuuuaugcaca

SEQ ID NO: 139693 - RNA, 64 nt, hsa
aaaaaggcaggauguuauugacauuauacacugaagucuuaacauuuuaacauuuauagugcuu

SEQ ID NO: 139694 - RNA, 64 nt, hsa
uguuuuugguggaggaagaaguuuaagauacuuuagucuuaaauugagguuugccaaaugagaa

SEQ ID NO: 139695 - RNA, 64 nt, hsa
uguuaacuuauuuauuuuucaaacacugagccauagucuuaaauuuaaaugcuaaaaacaauug

SEQ ID NO: 139696 - RNA, 64 nt, hsa
caaaaccaaucaugccuuccuaacagucccccaaagucuuaacucuuuucagcauuaacgcaaa

SEQ ID NO: 139697 - RNA, 64 nt, hsa
gagagagaguacugaaaaagcaacuccucuucuuagucuuaauaauuuacuaaaauggucaacu

SEQ ID NO: 139698 - RNA, 64 nt, hsa
uuacagcauugcaggaaaaacaaucuguuauuccagucuuaaauuuuucuaaaagaagacaaua

SEQ ID NO: 139699 - RNA, 64 nt, hsa
uuuuguuauaaugccugauacacaucuugaauaaagucuuaacauuuuucuuuuaaaaaacauc

SEQ ID NO: 139700 - RNA, 64 nt, hsa
aagggcacugaaauguacuagcuggaugugacccagucuuaauaaacagguuuucuaauccaga

SEQ ID NO: 139701 - RNA, 64 nt, hsa
accccaggguaggucuguggcccuuagacagugaagucuuaauugucaauauuauuuuugucua

SEQ ID NO: 139702 - RNA, 64 nt, hsa
uugaagugaugcaugugugaauuuaagauaccgaagucuuaaagugaccuggacgugaaggaaa

SEQ ID NO: 139703 - RNA, 64 nt, hsa
uuauuuuuugaauaauaacuuuucuaaagccuuaagucuuaauauuaaauauaugauuagccag

SEQ ID NO: 139704 - RNA, 64 nt, hsa
aguuggcuauaaguacgucauucuuaguccagucagucuuaaaaacaucuuggguuacccacuc

SEQ ID NO: 139705 - RNA, 64 nt, hsa
ggccaguugcuguuuuuucaugcagugcccugggagucuuaaaagcagugcuuagcaacauugg

SEQ ID NO: 139706 - RNA, 64 nt, hsa
auugacaaaagccggggucaaaaaaaguaguuuaagucuuaagacugaauaugcauuaaaguau

SEQ ID NO: 139707 - RNA, 64 nt, hsa
ucugcuauuucuuuucaguuuuuccaaagucaagagucuuaaccuuguacucagggaauuuuga

SEQ ID NO: 139708 - RNA, 64 nt, hsa
uugugcgccugugagcgcccagcuucuguuucauagucuuaacagguggccauugucgugaaac

SEQ ID NO: 139709 - RNA, 64 nt, hsa
uccugaaauuuuuuauaauauauguaauuugucuagucuuaaagacauuuggagcauggccaac

SEQ ID NO: 139710 - RNA, 64 nt, hsa
aaggucuagaaaagcauccugucuggcauuuuguagucuuaacuucuccccauuucccccaucu

SEQ ID NO: 139711 - RNA, 64 nt, hsa
gcacagaaaaggauguuuggcaauuugucuuuuaagucuuaaccuugcuaaugugaauacuggg

SEQ ID NO: 139712 - RNA, 64 nt, hsa
aucacagaagggcguauuucgaaaaccagaguacagucuuaagugacagcacugaaccuauucc

SEQ ID NO: 139713 - RNA, 64 nt, hsa
uauuuuaauggaguguuaaaauucugauucauauagucuuaaauuaucaacuccuuaaaugugc

SEQ ID NO: 139714 - RNA, 64 nt, hsa
uaagauaauuucccugcaaaaggacacagaaggcagucuuaagaagaugaauggaugagagaag

SEQ ID NO: 139715 - RNA, 64 nt, hsa
guuauuguuggguagaaggggaaaccuuugaaauagucuuaauggauaguuuauaaucaggcau

SEQ ID NO: 139716 - RNA, 64 nt, hsa
acaaaacauuuuagaaaaucuuagaguaaauuuuagucuuaaagccagaaaauaaguuuauagc

SEQ ID NO: 139717 - RNA, 64 nt, hsa
uugaauauaggagaaaucaguuugcugaaaaguuagucuuaauuaucuauuggccacgaugaaa

SEQ ID NO: 139718 - RNA, 64 nt, hsa
auguauuaauugauuuaaacaucauguagacuaaagucuuaaacaucuaagacucaguuguagu

SEQ ID NO: 139719 - RNA, 64 nt, hsa
aaauugcucuuaaacuuuccuagcuauaagcuuaagucuuaauucuggaaauuuuauuagcaau

SEQ ID NO: 139720 - RNA, 64 nt, hsa
uuaugacucaguaaguuggcaagguccugacuuuagucuuaauaaaacauugaauuguaguaaa

SEQ ID NO: 139721 - RNA, 64 nt, hsa
cagaaaaauguaagaauuuguuuuuaccauaaugagucuuaaguagguucaugaucuacauugg

SEQ ID NO: 139722 - RNA, 64 nt, hsa
ggucaaugccagagacggaagccuuuuuccccaaagucuuaaaauaacuuauaucaucagcaua

SEQ ID NO: 139723 - RNA, 64 nt, hsa
acauccaucagaaucuucuggagaauauggucagagucuuaaacaggcccagugcugaguucuu

SEQ ID NO: 139724 - RNA, 64 nt, hsa
gucuuugcuuuaauaaaugagcaacccuggguauagucuuaaaauucugcacaauaaauuuuga

SEQ ID NO: 139725 - RNA, 64 nt, hsa
uguuauuaaauuuauuauuuaagaugguagcacuagucuuaaauuguauaaaauauccccuaac

SEQ ID NO: 139726 - RNA, 64 nt, hsa
uguuauuaaauuuauuauuaaagauaguagcacuagucuuaaauuugauauaacaucuccuaac

SEQ ID NO: 139727 - RNA, 64 nt, hsa
ugcauggcccuguuagagauggcguagaagugaaagucuuaaagggagcauuagagauccuuuu

SEQ ID NO: 139728 - RNA, 64 nt, hsa
ggauggucucgaucuccugaccuugaaucacaagagucuuaacagggaauguuucaggaaacaa

SEQ ID NO: 139729 - RNA, 64 nt, hsa
auaaauaauuaaaauaucagacauguuuuggaaaagucuuaauuugagaacaccaaaggaaacu

SEQ ID NO: 139730 - RNA, 64 nt, hsa
gaguauaauacccauuuaaugugaaaaacauaagagucuuaaaagaaauuaagccauuuaacau

SEQ ID NO: 139731 - RNA, 64 nt, hsa
aacgguggugccuaucuacuuaagggggcauucuagucuuaacuuaaaaguugucuaaacuguc

SEQ ID NO: 139732 - RNA, 64 nt, hsa
agugcacauauuucauaaccaaauuaguagcaccagucuuaauuugauguuuuucaacuuuuau

SEQ ID NO: 139733 - RNA, 64 nt, hsa
ucuuuaaaaugaauagguagguuaguagcccuucagucuuaauacuuuaugaugcuaugguuug

SEQ ID NO: 139734 - RNA, 64 nt, hsa
auuagcuuuccaaccaaccaaauuucugcauucgagucuuaaccauauuuaaguguuacugugg

SEQ ID NO: 139735 - RNA, 64 nt, hsa
ucuugucagacaauggcuauaaacugaauuaggcagucuuaaaaaaaaaaaaaaacagaaaaag

SEQ ID NO: 139736 - RNA, 64 nt, hsa
aaguuuguguuuugucgacaguaucuuuuaaaugagucuuaaaaauaaaggcauauuguucaug

SEQ ID NO: 139737 - RNA, 64 nt, hsa
ggguuaccgucucaugugaaccuggagauucaccagucuuaacuuuugggucauuguguuuucu

SEQ ID NO: 139738 - RNA, 64 nt, hsa
uuuuccauuuuugucagucugagucaucaaaaagagucuuaauuuucuaaaacaaguuggcuag

SEQ ID NO: 139739 - RNA, 64 nt, hsa
accaugcaguuguuuaccaaaaauagaggaggagagucuuaacuuuugcucuuggauuuaaguc

SEQ ID NO: 139740 - RNA, 64 nt, hsa
uuaggcuuaauucauucaauugucaaguacacuuagucuuaauacacucagguuugaacagauu

SEQ ID NO: 139741 - RNA, 64 nt, hsa
ugcauauucuccuuucauccuggcuugccaacgcagucuuaauuccgccuuuuuuuuuucuaau

SEQ ID NO: 139742 - RNA, 64 nt, hsa
uuuuuaguuuuauguaaccauaucaauauuauuuagucuuaaacuaguuacguuauuaugcaau

SEQ ID NO: 139743 - RNA, 64 nt, hsa
uuuccagcauuucuucauuugauucucuuuuuuuagucuuaaaauaaugacuccuauucagaca

SEQ ID NO: 139744 - RNA, 64 nt, hsa
ggauuauguuuuuggauugucaaagaggaugcuuagucuuaaaauaaaaauaaauuuaaaaauc

SEQ ID NO: 139745 - RNA, 64 nt, hsa
cacacccuaguaaccucuugagauuaaauuacauagucuuaauauuucuguuccuccaugcaac

SEQ ID NO: 139746 - RNA, 64 nt, hsa
acugucuauccccacgaaauuuaguuuuaucaguagucuuaaaguguugaucucaaacaaguac

SEQ ID NO: 139747 - RNA, 64 nt, hsa
ggaaauggaagauuuuuuuuuaacuuguucuagaagucuuaauaugggcuguugccaugaaggc

SEQ ID NO: 139748 - RNA, 64 nt, hsa
aauuuauauauucagauacucuagcacuaauuuuagucuuaaaauauucccacgauauucugua

SEQ ID NO: 139749 - RNA, 64 nt, hsa
gauaucuuuauuauagccuuaagacuuaauuuuaagucuuaaaaauagcguguauacuugaaua

SEQ ID NO: 139750 - RNA, 64 nt, hsa
ggaucucucugaacuauuuuuauaacuucuugugagucuuaaguauuucaaaauaaaagugguu

SEQ ID NO: 139751 - RNA, 64 nt, hsa
ccaugggaggcaaagaaaggaaauccggaaauauagucuuaaccugguguuguucuaauuuucc

SEQ ID NO: 139752 - RNA, 64 nt, hsa
ccaucaguccuggggcuuuuucuuuaucacccucagucuuaauccauccaccagagucuagaag

SEQ ID NO: 139753 - RNA, 64 nt, hsa
auacagauuuuuuguuuaccuuggucuuguuuuaagucuuaaaaaauuaaagauaacauuauaa

SEQ ID NO: 139754 - RNA, 64 nt, hsa
auagcaucauauauuaguucauuuucuuuuggacagucuuaagagaaguuucacuaaaaaugua

SEQ ID NO: 139755 - RNA, 64 nt, hsa
gagagguuucaguuuuuaauaccaaguccuuaggagucuuaacauuggccagcaucuguuuauc

SEQ ID NO: 139756 - RNA, 64 nt, hsa
acccuguagaaaccucguuauuaaccaguguuccagucuuaaaguagacaaaauauucagagcc

SEQ ID NO: 139757 - RNA, 64 nt, hsa
auuuauuguuuuuaaaaugaaaggaauacuaauaagucuuaaaaguuccuucaugcauaagauu

SEQ ID NO: 139758 - RNA, 64 nt, hsa
acaggugugagccacccugcccagccgucaaaagagucuuaauauauauauccagauggcaugu

SEQ ID NO: 139759 - RNA, 64 nt, hsa
uucuucucuccucauggacuuuuucugcaauugcagucuuaagcuucacucuccaccaccugga

SEQ ID NO: 139760 - RNA, 64 nt, hsa
agccugaguugucaccauuaugucuuaagcuguuagucuuaaagauuauuguuaaaaaauucag

SEQ ID NO: 139761 - RNA, 64 nt, hsa
aguaagcuuaaacuacaacuugucacauaaaggaagucuuaaguggaguucacagaaugauaau

SEQ ID NO: 139762 - RNA, 64 nt, hsa
cuuuaacuagcugccuuuagauuuugauaaucacagucuuaaaauacuaggaaagaaguggaug

SEQ ID NO: 139763 - RNA, 64 nt, hsa
auauucgugugaaaaagaauacaucauuucucacagucuuaaguugauauuuauagaaaugaau

SEQ ID NO: 139764 - RNA, 64 nt, hsa
uuuuucugaugaauaguguucaguaaaaugaagcagucuuaagagugacuaauaauuucaaagu

SEQ ID NO: 139765 - RNA, 64 nt, hsa
guuucuguuugaagaaaauagagggagaaacagaagucuuaagucuguggcacacugugucuuc

SEQ ID NO: 139766 - RNA, 64 nt, hsa
agaaagagcguaaauguaaagucacuuuuucaucagucuuaaaacccaaaggcucuuuucagag

SEQ ID NO: 139767 - RNA, 64 nt, hsa
aacgagaacucuuauauuggcuuuuuaaggaagcagucuuaacaaaggcucuuuucagagccac

SEQ ID NO: 139768 - RNA, 64 nt, hsa
cuccaguacuugagcugaccauugaacuagggcaagucuuaaauguguacauguaguugaauuu

SEQ ID NO: 139769 - RNA, 64 nt, hsa
aaccauuuuuaaagugcacaaaaauauuauuauuagucuuaacuaaaauuacauauuuuauaau

SEQ ID NO: 139770 - RNA, 64 nt, hsa
ugcuggaucugcugcuuccugccuaccuuuugcaagucuuaacuuaccugugcuucaguuuccu

SEQ ID NO: 139771 - RNA, 64 nt, hsa
cguuuucacagacaauaacuguucugcucauggaagucuuaaacagaaacuguuacugucccaa

SEQ ID NO: 139772 - RNA, 64 nt, hsa
uuugugaaccccugaagauuuuuugaccguuccaagucuuaaugccacaccacuauuccagcga

SEQ ID NO: 139773 - RNA, 64 nt, hsa
auauuccaggcacaagagaaagcucuggggcuugagucuuaauagggcugauaguccaaccagg

SEQ ID NO: 139774 - RNA, 64 nt, hsa
uaaaaccuuauuuaugucuuauuugaagaugaauagucuuaaaagauaaagacauaaaugggac

SEQ ID NO: 139775 - RNA, 64 nt, hsa
augguaaaggaaacccaugcaauuuuaccuagacagucuuaaauaugucugguuuuccaucugu

SEQ ID NO: 139776 - RNA, 64 nt, hsa
uuaauguuuaucuugauagacuuuaaauguaucaagucuuaauuguauuuuaaauugaagccuu

SEQ ID NO: 139777 - RNA, 64 nt, hsa
auuucuaugccaaacaggaacaauccauaacuuuagucuuaauguacacauugcauuuugauaa

SEQ ID NO: 139778 - RNA, 64 nt, hsa
cucuccugcggccacaucaacggaugcaagucacagucuuaacacagccugugggagacaagca

SEQ ID NO: 139779 - RNA, 64 nt, hsa
uugaaaaacauauaauuuacuucuuauaaauugaagucuuaaaugugaaaccaagaaauguaau

SEQ ID NO: 139780 - RNA, 64 nt, hsa
cuuagaaaguuaaaagaauguagaaaagauacucagucuuaauccuaugcaaaaaaaaaaauca

SEQ ID NO: 139781 - RNA, 64 nt, hsa
uacaggucuuugaucuggaaacuaagacuagagaagucuuaagagaugacugcucaggugagua

SEQ ID NO: 139782 - RNA, 64 nt, hsa
gguccuuguuguuucuugccugaacuccugccauagucuuaacuggucuccuugcuuccugucu

SEQ ID NO: 139783 - RNA, 64 nt, hsa
ucauaagguuauuauaauaaauuauauuaguaaaagucuuaacuggaaaaaagaaucuaaauca

SEQ ID NO: 139784 - RNA, 64 nt, hsa
cugcaccuugaguugagagggcuacauguagaaaagucuuaaaauagagcuaaacaccacagug

SEQ ID NO: 139785 - RNA, 64 nt, hsa
ucauucuguuuccugcagugggaacuggccauguagucuuaacagucuuuuguacaaauaucua

SEQ ID NO: 139786 - RNA, 64 nt, hsa
auccaacuuuucccuucucaguuccucucucgaaagucuuaauucugugucaguaagucuuuaa

SEQ ID NO: 139787 - RNA, 64 nt, hsa
gauuaagugguaaugucauagugguggguuuuuaagucuuaaccaaucucuaagguuuguuucu

SEQ ID NO: 139788 - RNA, 64 nt, hsa
uccucacagaaaaguuggaaauaaccaaaacugaagucuuaauuuaccuucaguuuaaucugug

SEQ ID NO: 139789 - RNA, 64 nt, hsa
ugggcuaaggaaguaucagcacuagaaauugggcagucuuaauguugaaugcugcuuucugcuu

SEQ ID NO: 139790 - RNA, 64 nt, hsa
acccuucuggaauugcuaauguuaguguuuauaaagucuuaaaugugugcauaaaaaacuaaau

SEQ ID NO: 139791 - RNA, 64 nt, hsa
ccacugcacuccagucugggugagagugagacucagucuuaaaaaaauaugccuuuuugaagca

SEQ ID NO: 139792 - RNA, 64 nt, hsa
uuauugaauuauaccauuuacucuguuuucuuauagucuuaauuuuauuauauuuuguuguuac

SEQ ID NO: 139793 - RNA, 64 nt, hsa
aagugccagaccggaaccuauagcuacugcuagaagucuuaaaaaaaccaacagcagcacagga

SEQ ID NO: 139794 - RNA, 64 nt, hsa
ugguugaauuguguucccccaaaauauauggugaagucuuaacccccauccccgugaaugggac

SEQ ID NO: 139795 - RNA, 64 nt, hsa
gaagaaaauccuuuccucuugggaaaguaauacaagucuuaaguuccauuguagggugcgccuu

SEQ ID NO: 139796 - RNA, 64 nt, hsa
ccuguauccucccuggcagacacaacccaauaggagucuuaauuuauuucuuaaccuuugcuau

SEQ ID NO: 139797 - RNA, 64 nt, hsa
agguguauggauaugugauuuugagauuaaaguuagucuuaaaauguaaauaaaaugugaaacg

SEQ ID NO: 139798 - RNA, 64 nt, hsa
ucauuauagaauuaucugugaguuguguagacacagucuuaauguuucugguuaugacagauaa

SEQ ID NO: 139799 - RNA, 64 nt, hsa
gucgaauucuagacugaggaguagaguucauuggagucuuaaacucucugauaucacuuaaagc

SEQ ID NO: 139800 - RNA, 64 nt, hsa
gcagguggccaugacuacccgugguaccaaucucagucuuaaagcucaggcuuuucguucauua

SEQ ID NO: 139801 - RNA, 64 nt, hsa
gcacaucuucagggcaccaguguuaaaauuuuggagucuuaauuuucauguguacaccucuuug

SEQ ID NO: 139802 - RNA, 64 nt, hsa
cauuggaaguucuuuguaauuuuaauuccaugaaagucuuaauguuuccaacaugaaaauucuc

SEQ ID NO: 139803 - RNA, 64 nt, hsa
aauagucacaaguauuaauaaugccuuagaugauagucuuaaauauuagguugaggucuaccua

SEQ ID NO: 139804 - RNA, 64 nt, hsa
aauagcaauaaaccuaacuggauuuggaugaagaagucuuaauacugacauacuggauuuuuaa

SEQ ID NO: 139805 - RNA, 64 nt, hsa
ccuaguuagaguuagaccugucuuuggaugaagaagucuuaauacugaaauacugaauuuuuaa

SEQ ID NO: 139806 - RNA, 64 nt, hsa
ucuuuguuaaaccccaauuauagauaauuuuuccagucuuaagcucuguccaccuucaagucaa

SEQ ID NO: 139807 - RNA, 64 nt, hsa
aucaaaaugaaaacaaagcaaaugaauacuggacagucuuaacaauuuuauaaguuauaaaaug

SEQ ID NO: 139808 - RNA, 64 nt, hsa
agugagcauuugccugaauaaaaccuaaaagaguagucuuaacacauuacuaacuuuuucuaag

SEQ ID NO: 139809 - RNA, 64 nt, hsa
ucagauuaaucuuuuauccuuuccugaaguacaaagucuuaagagugucugaaauccaagacau

SEQ ID NO: 139810 - RNA, 64 nt, hsa
uaguuuuacuacuuuucauuuagaacagaguaugagucuuaaucugaagucuuuuucaugcccu

SEQ ID NO: 139811 - RNA, 64 nt, hsa
ucguuuuuguuuucuuguacuuugaauuccccaaagucuuaauugcuuuauuuugguguugugu

SEQ ID NO: 139812 - RNA, 64 nt, hsa
cacaguccauugugaagugugcuauauuuagaacagucuuaaaauguacaguguauuuuauaga

SEQ ID NO: 139813 - RNA, 64 nt, hsa
ugcauugggcuccgugccacaaccaagcuucauuagucuuaaauuucagcauauguugcugcug

SEQ ID NO: 139814 - RNA, 64 nt, hsa
cuuuuuuauaauuguuuucagaaaaaaaguuuacagucuuaaggaaaauauucaggucuaucau

SEQ ID NO: 139815 - RNA, 64 nt, hsa
auuacaggcaugagcuaccacaccugguuuggagagucuuaauuaaggaaauuucccuaauguu

SEQ ID NO: 139816 - RNA, 64 nt, hsa
ugagagauuggugauuuauauaagguaaucuguuagucuuaaaauaguuaaaaguuuguauuuu

SEQ ID NO: 139817 - RNA, 64 nt, hsa
gcacacuuuuacaaauuuaauauaaagcaaguccagucuuaaaaagacaaaccauaucacuccu

SEQ ID NO: 139818 - RNA, 64 nt, hsa
auggaaacugaccaccuacuuuguccagaaaagaagucuuaagauauuucaaggaaucaguguc

SEQ ID NO: 139819 - RNA, 64 nt, hsa
aaaugaaucacggcaauuucuuauaaaugagggaagucuuaagaccuuccauuuuuuagagaca

SEQ ID NO: 139820 - RNA, 64 nt, hsa
ccauauuuauauuuuuaaauaaaugcauauauugagucuuaaaaucucuuucuggccaaagacu

SEQ ID NO: 139821 - RNA, 64 nt, hsa
ugaaucuagcauuuguuuucagagauucaagcauagucuuaaggguagaucagaaaugacaaau

SEQ ID NO: 139822 - RNA, 64 nt, hsa
cagaccgaacuguuguauaaauuuauuuacugcuagucuuaagaacugcuuucuuucguuuguu

SEQ ID NO: 139823 - RNA, 64 nt, hsa
gugcuucugugaauuaaguugugguuucaucaugagucuuaauguucuuuguugauaagacaag

SEQ ID NO: 139824 - RNA, 64 nt, hsa
auauauauauaucaguuugaucacacuauuuuagagucuuaaugccaagucagcagauuugcuu

SEQ ID NO: 139825 - RNA, 64 nt, hsa
ggguuuuguuaauucuuuucagaaucauugaagcagucuuaaagggucuuuugcagaugguaca

SEQ ID NO: 139826 - RNA, 64 nt, hsa
uagaggauaaugguucaccucugcguaaacugcaagucuuaagcagacaucuggaauagagcuu

SEQ ID NO: 139827 - RNA, 64 nt, hsa
gucagggcuuuucuggggcugcucuuggaaaugaagucuuaaguacugaauaacuccccugggg

SEQ ID NO: 139828 - RNA, 64 nt, hsa
uuauauuaaugaggagaaaaguaugaaaacaagaagucuuaaguaaauauugaggucauuguuu

SEQ ID NO: 139829 - RNA, 64 nt, hsa
ggggcuugagaagguuacugagugaguuauugggagucuuaauaaaauaaacuagauauuaggu

SEQ ID NO: 139830 - RNA, 64 nt, hsa
uuuauauuacuauuuuccuuuuuguuguucacauagucuuaaggcaccuauacuuuuaaauuga

SEQ ID NO: 139831 - RNA, 64 nt, hsa
cuuagccaggaaagacaaauaauccaacgcugcuagucuuaaccccagaccagagagaacugca

SEQ ID NO: 139832 - RNA, 64 nt, hsa
caugcccggcccauaaguaccguuuuugagguucagucuuaaacauuugcuuuaagaaaacagu

SEQ ID NO: 139833 - RNA, 64 nt, hsa
caaaaccaaucaugccuucccaacagucccccaaagucuuaacucauuucagcauuaacccaaa

SEQ ID NO: 139834 - RNA, 64 nt, hsa
ugcaaaggaaacuauugucucgcuccuucaaaacagucuuaauuaacuuucauauuagcagauu

SEQ ID NO: 139835 - RNA, 64 nt, hsa
guauuucuuuuucgggguuucugcaugcaguggcagucuuaagugccaaaauucauuauaaccc

SEQ ID NO: 139836 - RNA, 64 nt, hsa
gaccauuuauauucuaguagccaucuucacuguuagucuuaaauuauaauguaaaguugacauu

SEQ ID NO: 139837 - RNA, 64 nt, hsa
uuguacucuuaugugucugauauacacauuuccuagucuuaacuuucaggaguuuacaauugac

SEQ ID NO: 139838 - RNA, 64 nt, hsa
auaggcagggcgaauacuacuuuguaacuuuuaaagucuuaaacuuuucaauaaaauugaguga

SEQ ID NO: 139839 - RNA, 64 nt, hsa
ugucuaaagugauuaucuuuuuuccccccaaguuagucuuaaaucuuuuggguuugaaugaagg

SEQ ID NO: 139840 - RNA, 64 nt, hsa
ggcggggcugaggaacagggaaaugccgcugugaagucuuaaagcacuucugcuuaaacuccca

SEQ ID NO: 139841 - RNA, 64 nt, hsa
auguuuuauuuuuagaauaguuauaaaaaguauuagucuuaacauaaugugucuuguucuuuuu

SEQ ID NO: 139842 - RNA, 64 nt, hsa
ccaugucauagagaauaaagcugaugauuguaccagucuuaaauuauucaugauucaauaaaau

SEQ ID NO: 139843 - RNA, 64 nt, hsa
auuuagaguuuccaaauuuagagcuucugcauacagucuuaaagccacagaggcuuguaaaaau

SEQ ID NO: 139844 - RNA, 64 nt, hsa
gucauuucaggguaggagucaaugaagacaucuuagucuuaacaaguuacagauaaucucugac

SEQ ID NO: 139845 - RNA, 64 nt, hsa
uuauaaggugagguaacucagaacuuaauuuaaaagucuuaaauauucugauacaauucagcug

SEQ ID NO: 139846 - RNA, 64 nt, hsa
aaacaauuggcagaaccuguuugauuacugugacagucuuaaugauaccauaaaucaauauuag

SEQ ID NO: 139847 - RNA, 64 nt, hsa
uauuucgcugguucuuuguagucacauauuuuauagucuuaauaucuuguuuuugcaucacugu

SEQ ID NO: 139848 - RNA, 64 nt, hsa
auccauuaucccuuugccuuuaacccugacauucagucuuaacacauuuuaucuuaaauaauuu

SEQ ID NO: 139849 - RNA, 64 nt, hsa
cuuuuucguaacuuuugaaucuuaauauuuugaaagucuuaaaggagacacugcaaagucuuag

SEQ ID NO: 139850 - RNA, 64 nt, hsa
cccaucuaugggcuuuagaccuauuacuggguggagucuuaaaguuauaauuguucaauauguu

SEQ ID NO: 139851 - RNA, 64 nt, hsa
uuuuguauuauuguuuguuuuguguucaguucaaagucuuaaccaguuuuauugucaaauaaac

SEQ ID NO: 139852 - RNA, 64 nt, hsa
ccugauauccccuggcucaguccuaacaagacugagucuuaacaagaugagaaguccuccccuu

SEQ ID NO: 139853 - RNA, 64 nt, hsa
uguuauuugcuucuuuuaaucagcaaaggccucaagucuuaaaauaaaaggggagaagaacaaa

SEQ ID NO: 139854 - RNA, 64 nt, hsa
gaauggcugaagagaucaagaauuuaaagcuucuagucuuaacauacuugcauccacuucaaau

SEQ ID NO: 139855 - RNA, 64 nt, hsa
ugccccaaaauuauaaacucuaaguguaaaaaaaagucuuaacaacagcuucuugcuuguaaaa

SEQ ID NO: 139856 - RNA, 64 nt, hsa
acugguucauucuccauuacugcaagagaauggaagucuuaauagaaggaagcaggagugauua

SEQ ID NO: 139857 - RNA, 52 nt, hsa; identical to SEQ ID NO: 139530

SEQ ID NO: 139858 - RNA, 64 nt, hsa
auaaggaaagacuugguguauagugugaugguuuagucuuaaggauuaagacauuuuugguacu

SEQ ID NO: 139859 - RNA, 64 nt, hsa
agaaaaauggacauaugaauauuauuaaaaauugagucuuaaauuuaaaugggaagggaagaaa

SEQ ID NO: 139860 - RNA, 64 nt, hsa
agaagguuauggguaccaggaagaaacaaacagaagucuuaagauuagaaugagaaccaaagag

SEQ ID NO: 139861 - RNA, 64 nt, hsa
ggauaagaugaccuguguaauaaucuuuguuaguagucuuaaagcugcugccauaguccuccaa

SEQ ID NO: 139862 - RNA, 64 nt, hsa
cacauuucacauacuguuacugaagaaagcaccaagucuuaauggaacaaagaccauagaauga

SEQ ID NO: 139863 - RNA, 64 nt, hsa
uuuuauugaugaauacaucucugaacguuccagaagucuuaagguuccaaagggauuuagcagu

SEQ ID NO: 139864 - RNA, 64 nt, hsa
gacacuauuaugaagcuacuagucauuccauaagagucuuaaaggacugcucuguguaacacug

SEQ ID NO: 139865 - RNA, 64 nt, hsa
aauucucauauccaugccuuuuuguccuguuuacagucuuaaaagagguaaaacagcaaauauu

SEQ ID NO: 139866 - RNA, 64 nt, hsa
aacaaguuguuuguauuuuauuuuuguuuauaccagucuuaaagauccagguucugaauaaaaa

SEQ ID NO: 139867 - RNA, 64 nt, hsa
caguagacaccacuguacuuuuugauacgagggcagucuuaacuuguguuaaggccugugugua

SEQ ID NO: 139868 - RNA, 64 nt, hsa
gguauuggaguuuaaaaaaaaagccaaauuucacagucuuaauaacuuuuuuuaaaaaaaacua

SEQ ID NO: 139869 - RNA, 64 nt, hsa
agguuuucaucaagccccgcccuuucucucucauagucuuaaugcgucuggaccacuggggaaa

SEQ ID NO: 139870 - RNA, 64 nt, hsa
uguaaauaauguucaggaaaaacgcagggaacagagucuuaaaguuaauggauauuuaauguga

SEQ ID NO: 139871 - RNA, 64 nt, hsa
acagaaguaauuggccugagagcauucuugaccaagucuuaaaugcuagaaucugagaaggaau

SEQ ID NO: 139872 - RNA, 64 nt, hsa
acuuucucauacacugacuguuacuuuaacuguuagucuuaaauaguugggacaucagcugacu

SEQ ID NO: 139873 - RNA, 64 nt, hsa
guaaauggacauuccagaauauagaugugauuauagucuuaaacuaauuauuauuaaaccaaug

SEQ ID NO: 139874 - RNA, 64 nt, hsa
ccaacuauaggccuuuuucuugggaugauuuucuagucuuaagguuuggggacauuauaaacuu

SEQ ID NO: 139875 - RNA, 64 nt, hsa
ccucagauugaaaagcuuaugaggauuucuugggagucuuaauaaccugccuguuaguacagag

SEQ ID NO: 139876 - RNA, 64 nt, hsa
cggcacuauuucugaacaaagagagcucaucaucagucuuaauauucagagaaaacuucagaga

SEQ ID NO: 139877 - RNA, 64 nt, hsa
uacugcucauuuacacucaaauuaaucuugaaguagucuuaaaauguguaagaaguuaaaacuu

SEQ ID NO: 139878 - RNA, 64 nt, hsa
gaaguuacacagaccacagugauuuagccaaauaagucuuaaccaaaaaaaggaaucugaaaaa

SEQ ID NO: 139879 - RNA, 64 nt, hsa
auguaaauaguguccauuaguaaaagugaaauucagucuuaaguagggugaauuggaucaccau

SEQ ID NO: 139880 - RNA, 64 nt, hsa
uucuguuauuaaggggcauagcauuaauuuuugcagucuuaaaauuacacuucuugacuucuga

SEQ ID NO: 139881 - RNA, 64 nt, hsa
uaaagguccuagucuuucuggcuuuaacacagaaagucuuaauaccauuuggauuaaagauuca

SEQ ID NO: 139882 - RNA, 64 nt, hsa
ggagaacugaaagggaaaacaaaauacuugacauagucuuaaguagaagaaggcaguuagagaa

SEQ ID NO: 139883 - RNA, 64 nt, hsa
ucacugguaaaauuguugaauauuucucucucccagucuuaaaagcccacaggcaagaauuaau

SEQ ID NO: 139884 - RNA, 64 nt, hsa
ucaaaaauuuuauucaguguauuuucaguuguugagucuuaaugagggauacaggaggaaaaau

SEQ ID NO: 139885 - RNA, 64 nt, hsa
uguucucuguuuugaauauacuuuaauaccugagagucuuaaaauuugugaacaacguuucuau

SEQ ID NO: 139886 - RNA, 64 nt, hsa
uuaaacuguggagcuuucauguuuacuguaauuuagucuuaaaauauuuuuuacuuaguaacca

SEQ ID NO: 139887 - RNA, 64 nt, hsa
aucguaggcguuuauauuauaaaauucuguuaguagucuuaaaauugaauugguggaaccacua

SEQ ID NO: 139888 - RNA, 64 nt, hsa
uguacgcugcgugaacaugccucaccuuuaagagagucuuaaagguaaagacacgaaaacacuu

SEQ ID NO: 139889 - RNA, 64 nt, hsa
aacuaaaauuuuauauauuguaaccaguguuaaaagucuuaaaaaacaaugguauuaauugucc

SEQ ID NO: 139890 - RNA, 64 nt, hsa
gcuauaauuuuguguuuuuuuuuuuuaauugucuagucuuaaauuuguacaucuuguauaaaau

SEQ ID NO: 139891 - RNA, 64 nt, hsa
gaagcugggugggcugaagaggccuggaaacgagagucuuaauugaggagaugggagacucgaa

SEQ ID NO: 139892 - RNA, 64 nt, hsa
uuugaugggaugacugacacaggaaaucuguuaaagucuuaaaauggaaugagaauguuguuuu

SEQ ID NO: 139893 - RNA, 64 nt, hsa
auacauaauucaaaagaacuacuugaugcaguauagucuuaaggguucugcauacauuuuagaa

SEQ ID NO: 139894 - RNA, 64 nt, hsa
caaaugcauccucuagaaaaauaauuaguguuauagucuuaagauuuguuuucuaaaguugaua

SEQ ID NO: 139895 - RNA, 64 nt, hsa
uccauccccaagcaccuccucaugcugugcaugcagucuuaaauucaauggacaaaaauaaaau

SEQ ID NO: 139896 - RNA, 64 nt, hsa
uuuuauuuccuaaaugccauacuaugaagaucaaagucuuaaguguguuugcagcucaaaaaua

SEQ ID NO: 139897 - RNA, 64 nt, hsa
ugcaaauugaauuggaauaggaauugauaauagcagucuuaaacauuaguagugggauuuggcu

SEQ ID NO: 139898 - RNA, 64 nt, hsa
guggaauuucauucaaaggcauaauagcaaugacagucuuaagccaaacauuuuauauaaaguu

SEQ ID NO: 139899 - RNA, 64 nt, hsa
aggagucucuggcuuaugacuccugguucccauuagucuuaagucuucugguucccauaaaaga

SEQ ID NO: 139900 - RNA, 64 nt, hsa
caacuuaggcccuggcaauuaacugaaagggcaaagucuuaaucaaucaaacaauggaggaauc

SEQ ID NO: 139901 - RNA, 64 nt, hsa
ugauugcuuuuguauuuaauucugcagguguucaagucuuaaaaaauaaagauuuauaacagaa

SEQ ID NO: 139902 - RNA, 64 nt, hsa
uuucauugcuaagacuaacucaagauaauccuagagucuuaaagcauuucaggccaguguggug

SEQ ID NO: 139903 - RNA, 64 nt, hsa
auuaggaauuacuuuauuauaaaaugcuccuagaagucuuaauuguguuuauuuuuuaaaaaaa

SEQ ID NO: 139904 - RNA, 64 nt, hsa
uacucuuccccucuucucacuacugcacuugacuagucuuaaaacaaagaaagaacgaaugaau

SEQ ID NO: 139905 - RNA, 64 nt, hsa
ugauaaaauauugauguuguauuuuacacucuuaagucuuaaccacagucagaauuaucuuaau

SEQ ID NO: 139906 - RNA, 64 nt, hsa
agccccacugcaucucaagugaacuguauagccaagucuuaaaccucucacggggcaagccuga

SEQ ID NO: 139907 - RNA, 64 nt, hsa
aauacuuucaauauuauucugaauggcugaaguuagucuuaaacucaaauuacuauaugaugau

SEQ ID NO: 139908 - RNA, 64 nt, hsa
cuaaguguuucagaaauguuuuauuucacacauaagucuuaauguuauuguuaugauuauacuu

SEQ ID NO: 139909 - RNA, 64 nt, hsa
uguauuuuuaaauuuuucuuggguuaguauuuaaagucuuaacauuuauuuaauaauuauauuu

SEQ ID NO: 139910 - RNA, 64 nt, hsa
agcugagugugucucccuaaaauuucuauguugaagucuuaacccuugguaccacagaauauca

SEQ ID NO: 139911 - RNA, 64 nt, hsa
uaguacacagacaugaacuguucuuaaacagaacagucuuaaaaugucuguacauaucugucug

SEQ ID NO: 139912 - RNA, 64 nt, hsa
guguguuuuuguaugaaugagcccauucaugguaagucuuaagcuuguuggaaauaauguaccc

SEQ ID NO: 139913 - RNA, 64 nt, hsa
ucuauuaggaauggcauauacugagguggucguaagucuuaacuucuaaaauuuuaaauaaaag

SEQ ID NO: 139914 - RNA, 64 nt, hsa
ugagcaguguaauuacaaacaaauagguuggcauagucuuaagucuuugagucuagagagauuu

SEQ ID NO: 139915 - RNA, 64 nt, hsa
ucuacauaaaagcuccaugugaaaagcuacuccuagucuuaacauuugcaguccuugugucacu

SEQ ID NO: 139916 - RNA, 64 nt, hsa
uuuaaaaaaggaaaaaaaaaagaaacuggguuccagucuuaauucauuuuccgugccagguuuu

SEQ ID NO: 139917 - RNA, 64 nt, hsa
acuuuucuuugcaagcgaaccuguuugaagcccaagucuuaacuccuggucucguaagguucca

SEQ ID NO: 139918 - RNA, 64 nt, hsa
guuuugaauguaaaaguugcaacacacaaacggaagucuuaaaaacuuuuugcucuggucaguu

SEQ ID NO: 139919 - RNA, 64 nt, hsa
uuaugucugcaccagugaauccauucucaagaaaagucuuaacuaggaaacuaaaagcuuucac

SEQ ID NO: 139920 - RNA, 64 nt, hsa
aaaaguauuaauagaaauucucuaucagcuauucagucuuaauuucacuaguaguauaaugggu

SEQ ID NO: 139921 - RNA, 64 nt, hsa
gagucuggguuguugggaacagcacagaauuuggagucuuaagcucuaaauuagaggcccugac

SEQ ID NO: 139922 - RNA, 64 nt, hsa
uuucuuuucuuuuuuaaaguaaacuuguguauugagucuuaacuguauuucaguauuuuccagc

SEQ ID NO: 139923 - RNA, 64 nt, hsa
agugcauuuccuccugccuuugcuuguucacugcagucuuaagaaagagguaaaaggcaagcaa

SEQ ID NO: 139924 - RNA, 64 nt, hsa
ggagcucaguucccauugcuugugcucagggcugagucuuaaagaaggguuugccggcccuaac

SEQ ID NO: 139925 - RNA, 64 nt, hsa
ugugauauuuuuuagacugaacugcuccauuccuagucuuaauuaccauauucaggguacgaac

SEQ ID NO: 139926 - RNA, 64 nt, hsa
ccgccuuucucaccacccugggggcgccucgugcagucuuaacagggagagggcuuucuggggc

SEQ ID NO: 139927 - RNA, 64 nt, hsa
gcauaauugaugcacaugauguucacacagugagagucuuaaagauacaaaaugguauuguuua

SEQ ID NO: 139928 - RNA, 64 nt, hsa
ugauucgagcuauauuuaaguauucaagaaagccagucuuaacauuucuaacucugauguaaau

SEQ ID NO: 139929 - RNA, 64 nt, hsa
ugcaccuuucuguacaaauacuaauucaauuuuaagucuuaagucacuuuuuuaauauauauga

SEQ ID NO: 139930 - RNA, 64 nt, hsa
ugcgguggagggaucaguugccccccaucaccagagucuuaagggucacuggccucuccccagg

SEQ ID NO: 139931 - RNA, 64 nt, hsa
uuccguaguguagaagcccacagguguagaacucagucuuaaacuucaguaugaaaccaguuuc

SEQ ID NO: 139932 - RNA, 64 nt, hsa
auagaaugugggcuuuuucaagggugaagauacaagucuuaaccacaguguaacuuacaguuuc

SEQ ID NO: 139933 - RNA, 64 nt, hsa
uuauugauacuaaagaggaguuaaaggcacauaaagucuuaacucuauaauguucauuuaguug

SEQ ID NO: 139934 - RNA, 64 nt, hsa
guacauuuaacuuuggaauggcuuuguaauaaucagucuuaagaaaauguugacaagcucuggu

SEQ ID NO: 139935 - RNA, 64 nt, hsa
ggaaucuggugaauuuuagucaucccagcuuuuuagucuuaaccacaguucucacucucuuaaa

SEQ ID NO: 139936 - RNA, 64 nt, hsa
cuguucuguaaauuuuauuuuaaacuguuaccauagucuuaaguuguuuaugcuuuaucagacu

SEQ ID NO: 139937 - RNA, 64 nt, hsa
guuuuguuuucuuucuauguuccaugcauaauacagucuuaagugaauuucucuuuuuuaauuu

SEQ ID NO: 139938 - RNA, 64 nt, hsa
uuacaaaggaaccaaaaugauaaugggagaauuuagucuuaaaaguuuagguugucagaguuua

SEQ ID NO: 139939 - RNA, 64 nt, hsa
auacaagucaggguguuuggcuaaucuacaaauaagucuuaaaccuauguuuuuaaauuuuuuu

SEQ ID NO: 139940 - RNA, 64 nt, hsa
uuaaaagugcuaauguguauucgaacccaaugguagucuuaaagaguuuugugcccuggcucua

SEQ ID NO: 139941 - RNA, 64 nt, hsa
gagacccaagucaucaugaaaaaggcccaaguacagucuuaaugcgauaaauccacuagcuaag

SEQ ID NO: 139942 - RNA, 64 nt, hsa
cccagcuguccccacgccucugucuuuugggucaagucuuaaucccugcaccugaguugguccu

SEQ ID NO: 139943 - RNA, 64 nt, hsa
uaauuguucugugauugaggaccacugaaaaauaagucuuaauaaauguugguaugaaccuacu

SEQ ID NO: 139944 - RNA, 64 nt, hsa
guucuucaaaaugugcauguuaaguauucaaaucagucuuaaauuuuuaaaaauauguaauuuu

SEQ ID NO: 139945 - RNA, 64 nt, hsa
ucaggaacuauucuaaaagucauaaaagggucacagucuuaagcagagcuuaguuuucuucuca

SEQ ID NO: 139946 - RNA, 64 nt, hsa
guuuuuuuacacauauuaacuuaauaaauguaugagucuuaaauaccucuuaguucucauuaaa

SEQ ID NO: 139947 - RNA, 64 nt, hsa
ggggucuuggugcccaagcuggucucaaacuccuagucuuaagcaaucuuccugcuuuggccuc

SEQ ID NO: 139948 - RNA, 64 nt, hsa
ugcagccccgccccccugccucacccacaaacuaagucuuaacaaaauccaaauuaccaacaaa

SEQ ID NO: 139949 - RNA, 64 nt, hsa
cgacggcagagccuccuucagaaagugcagcucaagucuuaaagacaccaaaacugagccaugg

SEQ ID NO: 139950 - RNA, 64 nt, hsa
cccuucucuaauuucuucuuuuuuuuaaugauaaagucuuaaaaacacggagccaccaacugga

SEQ ID NO: 139951 - RNA, 64 nt, hsa
cagauugaaaagagaccgaaugugcagauuccacagucuuaagcuuuccccuucagaugucagu

SEQ ID NO: 139952 - RNA, 64 nt, hsa
aauagguaguuuucuauaguaacuugauuaauuuagucuuaauccauuugaaacucucucuucc

SEQ ID NO: 139953 - RNA, 64 nt, hsa
cacuugcccucgugccugggggagagaggcagcaagucuuaacaaaccaacaucuuugcgaaaa

SEQ ID NO: 139954 - RNA, 64 nt, hsa
uuucuacuacuacauauuuagaguucacugguucagucuuaaaugccugcauggugccuuuuua

SEQ ID NO: 139955 - RNA, 64 nt, hsa
auuucagguaguaauauucaguguaguuaaggccagucuuaacccacuggaugaaaaucuagga

SEQ ID NO: 139956 - RNA, 64 nt, hsa
uucacucacucacucaacaaauacccguuggaagagucuuaaacuggggcuucauguguggccu

SEQ ID NO: 139957 - RNA, 64 nt, hsa
gugggguguuucgccugcaccccugguuucuuuaagucuuaagugaugccccuuccaaaccauc

SEQ ID NO: 139958 - RNA, 64 nt, hsa
auuuuggggggaacauuuuagguuuguauuugguagucuuaauguaucuggcauuugggugaac

SEQ ID NO: 139959 - RNA, 64 nt, hsa
uuaccguauucgccguacuaaguugguuucuguuagucuuaacagucuguuuucuuuuaaaagc

SEQ ID NO: 139960 - RNA, 64 nt, hsa
gcugucauaauuuaagcauuugaguauauuuugaagucuuaaaagacuuagcccauaggcacuu

SEQ ID NO: 139961 - RNA, 64 nt, hsa
gcaccccgcaaccugggaucucaaggagcuuuaaagucuuaaugggaacuuggcauuuuccuga

SEQ ID NO: 139962 - RNA, 64 nt, hsa
gaccuuguaaaagacaguguauguagaagcaugaagucuuaaggacaaagugccaaagaaagug

SEQ ID NO: 139963 - RNA, 64 nt, hsa
uacccuggccuccuagggucccuuuuucugaugaagucuuaauucccuaaaagcgccucuuugg

SEQ ID NO: 139964 - RNA, 64 nt, hsa
gguuaugagaaccagcgaaaucccccaugucaucagucuuaaaaaaaaaauuuuacaaauccac

SEQ ID NO: 139965 - RNA, 64 nt, hsa
gcuccuguuagacaaacacauugaugaagaaauuagucuuaauaggauuguaggcuguguagaa

SEQ ID NO: 139966 - RNA, 64 nt, hsa
aggcucccacuucuugggaggguuacauuuuuuaagucuuaaucauuugugacauauguaucua

SEQ ID NO: 139967 - RNA, 64 nt, hsa
uugguuuauacuuuuucuauucaucaggguaggaagucuuaaauccuuaggcauccaagaagua

SEQ ID NO: 139968 - RNA, 64 nt, hsa
auggaucaccauuauauuuugaaagaagccaucaagucuuaaguuuuucauuucaacuugugaa

SEQ ID NO: 139969 - RNA, 64 nt, hsa
aaaugugugaaagaaccucacacaacauaauuggagucuuaaaauagaggaagaguaagcaaag

SEQ ID NO: 139970 - RNA, 64 nt, hsa
ugcuuauugcuucuguauuucuucucuacucccuagucuuaauguuuaaccuugaaugcuauua

SEQ ID NO: 139971 - RNA, 64 nt, hsa
uaauaaauacaaaaaaaucauuuuucuagagcagagucuuaaaaucagguggggguaggggaug

SEQ ID NO: 139972 - RNA, 64 nt, hsa
ccagauuacuccaggauaaucuccucaccucaugagucuuaacuuaauuacaucugcaaggccc

SEQ ID NO: 139973 - RNA, 64 nt, hsa
cugaauuuuaguacuaguuuacacguauaaauacagucuuaaaccuuuaugucugagucugaaa

SEQ ID NO: 139974 - RNA, 64 nt, hsa
uuuucgccuuaguggugauuguuuaaacucucacagucuuaaaccgugccaaaguccuguuaug

SEQ ID NO: 139975 - RNA, 64 nt, hsa
ugucuccugagacaagcaucgugauagaguucacagucuuaaaagucugcauuuucaggugggg

SEQ ID NO: 139976 - RNA, 64 nt, hsa
uccucggcuccauuguggguuauucuagaaauccagucuuaaaucucuccgcuaaaguggacau

SEQ ID NO: 139977 - RNA, 64 nt, hsa
aguuacugaggcuucucccaaaagguaucaguccagucuuaaagauauuucauugugaaagaag

SEQ ID NO: 139978 - RNA, 64 nt, hsa
agcccuugaacaucuccuccaaagagacuagaagagucuuaaauuauaugugggaggaggaggg

SEQ ID NO: 139979 - RNA, 64 nt, hsa
ugugaagugccuguguaauugaugacucuuacauagucuuaagcauuuuugcaauuuuuuaaau

SEQ ID NO: 139980 - RNA, 64 nt, hsa
uauguaaaguugauauugacuacaauaaaaauccagucuuaauuccagauuuacugaaaauguc

SEQ ID NO: 139981 - RNA, 65 nt, hsa
gcuccugagaagcuucaaauucaggccaggagagaagucuuaagaaaagaccuccagcaguuaca

SEQ ID NO: 139982 - RNA, 65 nt, hsa
cucugacuauacuuaguuugaaauggugcaggcuuagucuuaagccuccaaaggccuggauuuga

SEQ ID NO: 139983 - RNA, 65 nt, hsa
uguuaacugccaaagcuaguuuuagagaaugagaaagucuuaagcaaaauacucccaggucucac

SEQ ID NO: 139984 - RNA, 65 nt, hsa
gaggaaagauacagggaacaaaaaucaauuuguacagucuuaauauuaaaagcagcuugacuaaa

SEQ ID NO: 139985 - RNA, 65 nt, hsa
ccuggaucugucuagucaaucaacauagcagagacagucuuaaaccuaccauugaccugugugua

SEQ ID NO: 139986 - RNA, 65 nt, hsa
uugauuuccuugaagcaguuugaaaauuugaauugagucuuaacuuuaggaaaugagguuucaua

SEQ ID NO: 139987 - RNA, 65 nt, hsa
ugacaaccaggugggaccaaaguuuaugugccuuuagucuuaauuuaccuugcauuguaauauuc

SEQ ID NO: 139988 - RNA, 65 nt, hsa
aaggugauucuuucuuuaccauuucuggggacuuuagucuuaauuagguaccuuauuaacaggaa

SEQ ID NO: 139989 - RNA, 65 nt, hsa
agucaaaaaucugcauauaacuuuugauuccccaaagucuuaaguacuaguagccuguuauugac

SEQ ID NO: 139990 - RNA, 65 nt, hsa
uguauauugcaaaauuuaauauauuuguucacuugagucuuaagaguaggucaggccaaggcagg

SEQ ID NO: 139991 - RNA, 65 nt, hsa
ucaaauuaguggaacuuaguucagggacauagaagagucuuaaugaauuaaaaucauucacuuga

SEQ ID NO: 139992 - RNA, 65 nt, hsa
ggauaaaacaauggcugguucuagcccugagugacagucuuaaggcuagauccuucccauaguau

SEQ ID NO: 139993 - RNA, 65 nt, hsa
agacaguuuuauagcugguuccuuuuaggguaaagagucuuaagagaguuuuauugugucuaugg

SEQ ID NO: 139994 - RNA, 65 nt, hsa
augcuuuauuagugaggagaaaacaauuccuuagaagucuuaaauauauuguacucuuuagaucu

SEQ ID NO: 139995 - RNA, 65 nt, hsa
aguguuuuuuguguaauucgugaaugucauauaguagucuuaaguuucucuuuuaaagcugcaug

SEQ ID NO: 139996 - RNA, 65 nt, hsa
ugcccuucgauguaugccauuuagugaaagugcuaagucuuaaguuuccuaccacuuugguuuca

SEQ ID NO: 139997 - RNA, 65 nt, hsa
uccuguugauuaaucuauuuucauauuuauaaaggagucuuaauguucugccccauaagacuuuc

SEQ ID NO: 139998 - RNA, 65 nt, hsa
accuaaaauauacccaucaguauaaggcaagcaaaagucuuaacauggcagccauucugccuuug

SEQ ID NO: 139999 - RNA, 65 nt, hsa
uuccuuucugacacauaauuuggggcaaaaaagaaagucuuaagaguuuaucuuuucucugcuga

SEQ ID NO: 140000 - RNA, 65 nt, hsa
ggcuguucaacauccucccuccuuagccccuccuaagucuuaaugcugagauuucuaaagaugcu

SEQ ID NO: 140001 - RNA, 65 nt, hsa
cauuaacgaguguuuuaaaaagguuuuuaaugaauagucuuaaaucuaaauuugugugaauaauc

SEQ ID NO: 140002 - RNA, 65 nt, hsa
ggccuguuucacucacucacccagcauaugaaacuagucuuaacuguugagccuuuccuuucaua

SEQ ID NO: 140003 - RNA, 65 nt, hsa
gaguuaaauguauguaagauugauucugauucugaagucuuaacugccagcagaaaaacuccaua

SEQ ID NO: 140004 - RNA, 65 nt, hsa
uaaauagguugaaaacaaucaucugugaguuuaggagucuuaagauccucacagcacgggagcag

SEQ ID NO: 140005 - RNA, 65 nt, hsa
uuaugguauuccauuagguucuuuucauuuaaaguagucuuaaaaucaaaguauccaauauuuua

SEQ ID NO: 140006 - RNA, 65 nt, hsa
agccacagcucuucuuggcguauuuauacucacugagucuuaacuuuucaccaggggugcucacc

SEQ ID NO: 140007 - RNA, 65 nt, hsa
cagugauagaaaacccacacaauacauccucugccagucuuaauagaauaucagagguaagaggg

SEQ ID NO: 140008 - RNA, 65 nt, hsa
ugucuuuggauagcugucugagugaccacggacaaagucuuaacaaaacucaggaggaccaaugu

SEQ ID NO: 140009 - RNA, 65 nt, hsa
ggaaauuuucaacccuuaaucugaaaacagaagacagucuuaauauaaauguacugugaagaaug

SEQ ID NO: 140010 - RNA, 65 nt, hsa
cuuaguugagucacugagguuuaaacacaaugguaagucuuaaagucugcuauuuacagagcauu

SEQ ID NO: 140011 - RNA, 65 nt, hsa
auuuacugaauaagauuugaguaaugaaagucuguagucuuaaaacucuaaaacaguuguacugc

SEQ ID NO: 140012 - RNA, 65 nt, hsa
ccacgaauagguaauugauagaguuuaugggucuuagucuuaaggguaacagagugaauaccuuc

SEQ ID NO: 140013 - RNA, 65 nt, hsa
ucaaaucauguuuagaaacuuuggaugaguuaagaagucuuaaguaugcaggcguuuacgugauu

SEQ ID NO: 140014 - RNA, 65 nt, hsa
cccaugugguauuaauauaccuucaauuuauguugagucuuaaacauaauuaggagauauuuuuc

SEQ ID NO: 140015 - RNA, 65 nt, hsa
acuaguugaaauuuuuaauagaaucaaggcacaaaagucuuaaaaccauguggaaaaauuaggua

SEQ ID NO: 140016 - RNA, 65 nt, hsa
ggcaggcugucauagaguuauguguuagucucaggagucuuaacuuuugaaauauguuuuacuug

SEQ ID NO: 140017 - RNA, 65 nt, hsa
auuaggguuccacaucauucuaauguauaguuucaagucuuaauagacaaucugaauuccacuac

SEQ ID NO: 140018 - RNA, 65 nt, hsa
guucaaaagggcaauguuuucuuuauauuucuuauagucuuaauuuuguuauccaugugcauaau

SEQ ID NO: 140019 - RNA, 65 nt, hsa
uuuucauacaaccauuuucaaaugaaccuuagaaaagucuuaacauuuaagguauuuuaugcaca

SEQ ID NO: 140020 - RNA, 65 nt, hsa
uaaaaaggcaggauguuauugacauuauacacugaagucuuaacauuuuaacauuuauagugcuu

SEQ ID NO: 140021 - RNA, 65 nt, hsa
guguuuuugguggaggaagaaguuuaagauacuuuagucuuaaauugagguuugccaaaugagaa

SEQ ID NO: 140022 - RNA, 65 nt, hsa
uuguuaacuuauuuauuuuucaaacacugagccauagucuuaaauuuaaaugcuaaaaacaauug

SEQ ID NO: 140023 - RNA, 65 nt, hsa
ucaaaaccaaucaugccuuccuaacagucccccaaagucuuaacucuuuucagcauuaacgcaaa

SEQ ID NO: 140024 - RNA, 65 nt, hsa
agagagagaguacugaaaaagcaacuccucuucuuagucuuaauaauuuacuaaaauggucaacu

SEQ ID NO: 140025 - RNA, 65 nt, hsa
auuacagcauugcaggaaaaacaaucuguuauuccagucuuaaauuuuucuaaaagaagacaaua

SEQ ID NO: 140026 - RNA, 65 nt, hsa
guuuuguuauaaugccugauacacaucuugaauaaagucuuaacauuuuucuuuuaaaaaacauc

SEQ ID NO: 140027 - RNA, 65 nt, hsa
aaagggcacugaaauguacuagcuggaugugacccagucuuaauaaacagguuuucuaauccaga

SEQ ID NO: 140028 - RNA, 65 nt, hsa
caccccaggguaggucuguggcccuuagacagugaagucuuaauugucaauauuauuuuugucua

SEQ ID NO: 140029 - RNA, 65 nt, hsa
cuugaagugaugcaugugugaauuuaagauaccgaagucuuaaagugaccuggacgugaaggaaa

SEQ ID NO: 140030 - RNA, 65 nt, hsa
guuauuuuuugaauaauaacuuuucuaaagccuuaagucuuaauauuaaauauaugauuagccag

SEQ ID NO: 140031 - RNA, 65 nt, hsa
uaguuggcuauaaguacgucauucuuaguccagucagucuuaaaaacaucuuggguuacccacuc

SEQ ID NO: 140032 - RNA, 65 nt, hsa
gggccaguugcuguuuuuucaugcagugcccugggagucuuaaaagcagugcuuagcaacauugg

SEQ ID NO: 140033 - RNA, 65 nt, hsa
uauugacaaaagccggggucaaaaaaaguaguuuaagucuuaagacugaauaugcauuaaaguau

SEQ ID NO: 140034 - RNA, 65 nt, hsa
uucugcuauuucuuuucaguuuuuccaaagucaagagucuuaaccuuguacucagggaauuuuga

SEQ ID NO: 140035 - RNA, 65 nt, hsa
auugugcgccugugagcgcccagcuucuguuucauagucuuaacagguggccauugucgugaaac

SEQ ID NO: 140036 - RNA, 65 nt, hsa
auccugaaauuuuuuauaauauauguaauuugucuagucuuaaagacauuuggagcauggccaac

SEQ ID NO: 140037 - RNA, 65 nt, hsa
aaaggucuagaaaagcauccugucuggcauuuuguagucuuaacuucuccccauuucccccaucu

SEQ ID NO: 140038 - RNA, 65 nt, hsa
agcacagaaaaggauguuuggcaauuugucuuuuaagucuuaaccuugcuaaugugaauacuggg

SEQ ID NO: 140039 - RNA, 65 nt, hsa
caucacagaagggcguauuucgaaaaccagaguacagucuuaagugacagcacugaaccuauucc

SEQ ID NO: 140040 - RNA, 65 nt, hsa
uuauuuuaauggaguguuaaaauucugauucauauagucuuaaauuaucaacuccuuaaaugugc

SEQ ID NO: 140041 - RNA, 65 nt, hsa
guaagauaauuucccugcaaaaggacacagaaggcagucuuaagaagaugaauggaugagagaag

SEQ ID NO: 140042 - RNA, 65 nt, hsa
uguuauuguuggguagaaggggaaaccuuugaaauagucuuaauggauaguuuauaaucaggcau

SEQ ID NO: 140043 - RNA, 65 nt, hsa
uacaaaacauuuuagaaaaucuuagaguaaauuuuagucuuaaagccagaaaauaaguuuauagc

SEQ ID NO: 140044 - RNA, 65 nt, hsa
uuugaauauaggagaaaucaguuugcugaaaaguuagucuuaauuaucuauuggccacgaugaaa

SEQ ID NO: 140045 - RNA, 65 nt, hsa
aauguauuaauugauuuaaacaucauguagacuaaagucuuaaacaucuaagacucaguuguagu

SEQ ID NO: 140046 - RNA, 65 nt, hsa
aaaauugcucuuaaacuuuccuagcuauaagcuuaagucuuaauucuggaaauuuuauuagcaau

SEQ ID NO: 140047 - RNA, 65 nt, hsa
cuuaugacucaguaaguuggcaagguccugacuuuagucuuaauaaaacauugaauuguaguaaa

SEQ ID NO: 140048 - RNA, 65 nt, hsa
acagaaaaauguaagaauuuguuuuuaccauaaugagucuuaaguagguucaugaucuacauugg

SEQ ID NO: 140049 - RNA, 65 nt, hsa
aggucaaugccagagacggaagccuuuuuccccaaagucuuaaaauaacuuauaucaucagcaua

SEQ ID NO: 140050 - RNA, 65 nt, hsa
aacauccaucagaaucuucuggagaauauggucagagucuuaaacaggcccagugcugaguucuu

SEQ ID NO: 140051 - RNA, 65 nt, hsa
agucuuugcuuuaauaaaugagcaacccuggguauagucuuaaaauucugcacaauaaauuuuga

SEQ ID NO: 140052 - RNA, 65 nt, hsa
uuguuauuaaauuuauuauuuaagaugguagcacuagucuuaaauuguauaaaauauccccuaac

SEQ ID NO: 140053 - RNA, 65 nt, hsa
uuguuauuaaauuuauuauuaaagauaguagcacuagucuuaaauuugauauaacaucuccuaac

SEQ ID NO: 140054 - RNA, 65 nt, hsa
cugcauggcccuguuagagauggcguagaagugaaagucuuaaagggagcauuagagauccuuuu

SEQ ID NO: 140055 - RNA, 65 nt, hsa
aggauggucucgaucuccugaccuugaaucacaagagucuuaacagggaauguuucaggaaacaa

SEQ ID NO: 140056 - RNA, 65 nt, hsa
aauaaauaauuaaaauaucagacauguuuuggaaaagucuuaauuugagaacaccaaaggaaacu

SEQ ID NO: 140057 - RNA, 65 nt, hsa
ggaguauaauacccauuuaaugugaaaaacauaagagucuuaaaagaaauuaagccauuuaacau

SEQ ID NO: 140058 - RNA, 65 nt, hsa
uaacgguggugccuaucuacuuaagggggcauucuagucuuaacuuaaaaguugucuaaacuguc

SEQ ID NO: 140059 - RNA, 65 nt, hsa
aagugcacauauuucauaaccaaauuaguagcaccagucuuaauuugauguuuuucaacuuuuau

SEQ ID NO: 140060 - RNA, 65 nt, hsa
aucuuuaaaaugaauagguagguuaguagcccuucagucuuaauacuuuaugaugcuaugguuug

SEQ ID NO: 140061 - RNA, 65 nt, hsa
aauuagcuuuccaaccaaccaaauuucugcauucgagucuuaaccauauuuaaguguuacugugg

SEQ ID NO: 140062 - RNA, 65 nt, hsa
cucuugucagacaauggcuauaaacugaauuaggcagucuuaaaaaaaaaaaaaaacagaaaaag

SEQ ID NO: 140063 - RNA, 65 nt, hsa
aaaguuuguguuuugucgacaguaucuuuuaaaugagucuuaaaaauaaaggcauauuguucaug

SEQ ID NO: 140064 - RNA, 65 nt, hsa
uggguuaccgucucaugugaaccuggagauucaccagucuuaacuuuugggucauuguguuuucu

SEQ ID NO: 140065 - RNA, 65 nt, hsa
guuuuccauuuuugucagucugagucaucaaaaagagucuuaauuuucuaaaacaaguuggcuag

SEQ ID NO: 140066 - RNA, 65 nt, hsa
uaccaugcaguuguuuaccaaaaauagaggaggagagucuuaacuuuugcucuuggauuuaaguc

SEQ ID NO: 140067 - RNA, 65 nt, hsa
uuuaggcuuaauucauucaauugucaaguacacuuagucuuaauacacucagguuugaacagauu

SEQ ID NO: 140068 - RNA, 65 nt, hsa
uugcauauucuccuuucauccuggcuugccaacgcagucuuaauuccgccuuuuuuuuuucuaau

SEQ ID NO: 140069 - RNA, 65 nt, hsa
uuuuuuaguuuuauguaaccauaucaauauuauuuagucuuaaacuaguuacguuauuaugcaau

SEQ ID NO: 140070 - RNA, 65 nt, hsa
uuuuccagcauuucuucauuugauucucuuuuuuuagucuuaaaauaaugacuccuauucagaca

SEQ ID NO: 140071 - RNA, 65 nt, hsa
aggauuauguuuuuggauugucaaagaggaugcuuagucuuaaaauaaaaauaaauuuaaaaauc

SEQ ID NO: 140072 - RNA, 65 nt, hsa
gcacacccuaguaaccucuugagauuaaauuacauagucuuaauauuucuguuccuccaugcaac

SEQ ID NO: 140073 - RNA, 65 nt, hsa
cacugucuauccccacgaaauuuaguuuuaucaguagucuuaaaguguugaucucaaacaaguac

SEQ ID NO: 140074 - RNA, 65 nt, hsa
uggaaauggaagauuuuuuuuuaacuuguucuagaagucuuaauaugggcuguugccaugaaggc

SEQ ID NO: 140075 - RNA, 65 nt, hsa
gaauuuauauauucagauacucuagcacuaauuuuagucuuaaaauauucccacgauauucugua

SEQ ID NO: 140076 - RNA, 65 nt, hsa
ugauaucuuuauuauagccuuaagacuuaauuuuaagucuuaaaaauagcguguauacuugaaua

SEQ ID NO: 140077 - RNA, 65 nt, hsa
gggaucucucugaacuauuuuuauaacuucuugugagucuuaaguauuucaaaauaaaagugguu

SEQ ID NO: 140078 - RNA, 65 nt, hsa
accaugggaggcaaagaaaggaaauccggaaauauagucuuaaccugguguuguucuaauuuucc

SEQ ID NO: 140079 - RNA, 65 nt, hsa
cccaucaguccuggggcuuuuucuuuaucacccucagucuuaauccauccaccagagucuagaag

SEQ ID NO: 140080 - RNA, 65 nt, hsa
aauacagauuuuuuguuuaccuuggucuuguuuuaagucuuaaaaaauuaaagauaacauuauaa

SEQ ID NO: 140081 - RNA, 65 nt, hsa
aauagcaucauauauuaguucauuuucuuuuggacagucuuaagagaaguuucacuaaaaaugua

SEQ ID NO: 140082 - RNA, 65 nt, hsa
ugagagguuucaguuuuuaauaccaaguccuuaggagucuuaacauuggccagcaucuguuuauc

SEQ ID NO: 140083 - RNA, 65 nt, hsa
uacccuguagaaaccucguuauuaaccaguguuccagucuuaaaguagacaaaauauucagagcc

SEQ ID NO: 140084 - RNA, 65 nt, hsa
uauuuauuguuuuuaaaaugaaaggaauacuaauaagucuuaaaaguuccuucaugcauaagauu

SEQ ID NO: 140085 - RNA, 65 nt, hsa
uacaggugugagccacccugcccagccgucaaaagagucuuaauauauauauccagauggcaugu

SEQ ID NO: 140086 - RNA, 65 nt, hsa
cuucuucucuccucauggacuuuuucugcaauugcagucuuaagcuucacucuccaccaccugga

SEQ ID NO: 140087 - RNA, 65 nt, hsa
aagccugaguugucaccauuaugucuuaagcuguuagucuuaaagauuauuguuaaaaaauucag

SEQ ID NO: 140088 - RNA, 65 nt, hsa
aaguaagcuuaaacuacaacuugucacauaaaggaagucuuaaguggaguucacagaaugauaau

SEQ ID NO: 140089 - RNA, 65 nt, hsa
ucuuuaacuagcugccuuuagauuuugauaaucacagucuuaaaauacuaggaaagaaguggaug

SEQ ID NO: 140090 - RNA, 65 nt, hsa
cauauucgugugaaaaagaauacaucauuucucacagucuuaaguugauauuuauagaaaugaau

SEQ ID NO: 140091 - RNA, 65 nt, hsa
guuuuucugaugaauaguguucaguaaaaugaagcagucuuaagagugacuaauaauuucaaagu

SEQ ID NO: 140092 - RNA, 65 nt, hsa
uguuucuguuugaagaaaauagagggagaaacagaagucuuaagucuguggcacacugugucuuc

SEQ ID NO: 140093 - RNA, 65 nt, hsa
gagaaagagcguaaauguaaagucacuuuuucaucagucuuaaaacccaaaggcucuuuucagag

SEQ ID NO: 140094 - RNA, 65 nt, hsa
aaacgagaacucuuauauuggcuuuuuaaggaagcagucuuaacaaaggcucuuuucagagccac

SEQ ID NO: 140095 - RNA, 65 nt, hsa
ucuccaguacuugagcugaccauugaacuagggcaagucuuaaauguguacauguaguugaauuu

SEQ ID NO: 140096 - RNA, 65 nt, hsa
uaaccauuuuuaaagugcacaaaaauauuauuauuagucuuaacuaaaauuacauauuuuauaau

SEQ ID NO: 140097 - RNA, 65 nt, hsa
augcuggaucugcugcuuccugccuaccuuuugcaagucuuaacuuaccugugcuucaguuuccu

SEQ ID NO: 140098 - RNA, 65 nt, hsa
acguuuucacagacaauaacuguucugcucauggaagucuuaaacagaaacuguuacugucccaa

SEQ ID NO: 140099 - RNA, 65 nt, hsa
cuuugugaaccccugaagauuuuuugaccguuccaagucuuaaugccacaccacuauuccagcga

SEQ ID NO: 140100 - RNA, 65 nt, hsa
cauauuccaggcacaagagaaagcucuggggcuugagucuuaauagggcugauaguccaaccagg

SEQ ID NO: 140101 - RNA, 65 nt, hsa
auaaaaccuuauuuaugucuuauuugaagaugaauagucuuaaaagauaaagacauaaaugggac

SEQ ID NO: 140102 - RNA, 65 nt, hsa
uaugguaaaggaaacccaugcaauuuuaccuagacagucuuaaauaugucugguuuuccaucugu

SEQ ID NO: 140103 - RNA, 65 nt, hsa
uuuaauguuuaucuugauagacuuuaaauguaucaagucuuaauuguauuuuaaauugaagccuu

SEQ ID NO: 140104 - RNA, 65 nt, hsa
cauuucuaugccaaacaggaacaauccauaacuuuagucuuaauguacacauugcauuuugauaa

SEQ ID NO: 140105 - RNA, 65 nt, hsa
ccucuccugcggccacaucaacggaugcaagucacagucuuaacacagccugugggagacaagca

SEQ ID NO: 140106 - RNA, 65 nt, hsa
auugaaaaacauauaauuuacuucuuauaaauugaagucuuaaaugugaaaccaagaaauguaau

SEQ ID NO: 140107 - RNA, 65 nt, hsa
ccuuagaaaguuaaaagaauguagaaaagauacucagucuuaauccuaugcaaaaaaaaaaauca

SEQ ID NO: 140108 - RNA, 65 nt, hsa
cuacaggucuuugaucuggaaacuaagacuagagaagucuuaagagaugacugcucaggugagua

SEQ ID NO: 140109 - RNA, 65 nt, hsa
agguccuuguuguuucuugccugaacuccugccauagucuuaacuggucuccuugcuuccugucu

SEQ ID NO: 140110 - RNA, 65 nt, hsa
cucauaagguuauuauaauaaauuauauuaguaaaagucuuaacuggaaaaaagaaucuaaauca

SEQ ID NO: 140111 - RNA, 65 nt, hsa
gcugcaccuugaguugagagggcuacauguagaaaagucuuaaaauagagcuaaacaccacagug

SEQ ID NO: 140112 - RNA, 65 nt, hsa
aucauucuguuuccugcagugggaacuggccauguagucuuaacagucuuuuguacaaauaucua

SEQ ID NO: 140113 - RNA, 65 nt, hsa
cauccaacuuuucccuucucaguuccucucucgaaagucuuaauucugugucaguaagucuuuaa

SEQ ID NO: 140114 - RNA, 65 nt, hsa
agauuaagugguaaugucauagugguggguuuuuaagucuuaaccaaucucuaagguuuguuucu

SEQ ID NO: 140115 - RNA, 65 nt, hsa
auccucacagaaaaguuggaaauaaccaaaacugaagucuuaauuuaccuucaguuuaaucugug

SEQ ID NO: 140116 - RNA, 65 nt, hsa
cugggcuaaggaaguaucagcacuagaaauugggcagucuuaauguugaaugcugcuuucugcuu

SEQ ID NO: 140117 - RNA, 65 nt, hsa
uacccuucuggaauugcuaauguuaguguuuauaaagucuuaaaugugugcauaaaaaacuaaau

SEQ ID NO: 140118 - RNA, 65 nt, hsa
accacugcacuccagucugggugagagugagacucagucuuaaaaaaauaugccuuuuugaagca

SEQ ID NO: 140119 - RNA, 65 nt, hsa
auuauugaauuauaccauuuacucuguuuucuuauagucuuaauuuuauuauauuuuguuguuac

SEQ ID NO: 140120 - RNA, 65 nt, hsa
aaagugccagaccggaaccuauagcuacugcuagaagucuuaaaaaaaccaacagcagcacagga

SEQ ID NO: 140121 - RNA, 65 nt, hsa
gugguugaauuguguucccccaaaauauauggugaagucuuaacccccauccccgugaaugggac

SEQ ID NO: 140122 - RNA, 65 nt, hsa
ggaagaaaauccuuuccucuugggaaaguaauacaagucuuaaguuccauuguagggugcgccuu

SEQ ID NO: 140123 - RNA, 65 nt, hsa
gccuguauccucccuggcagacacaacccaauaggagucuuaauuuauuucuuaaccuuugcuau

SEQ ID NO: 140124 - RNA, 65 nt, hsa
uagguguauggauaugugauuuugagauuaaaguuagucuuaaaauguaaauaaaaugugaaacg

SEQ ID NO: 140125 - RNA, 65 nt, hsa
uucauuauagaauuaucugugaguuguguagacacagucuuaauguuucugguuaugacagauaa

SEQ ID NO: 140126 - RNA, 65 nt, hsa
ugucgaauucuagacugaggaguagaguucauuggagucuuaaacucucugauaucacuuaaagc

SEQ ID NO: 140127 - RNA, 65 nt, hsa
agcagguggccaugacuacccgugguaccaaucucagucuuaaagcucaggcuuuucguucauua

SEQ ID NO: 140128 - RNA, 65 nt, hsa
ggcacaucuucagggcaccaguguuaaaauuuuggagucuuaauuuucauguguacaccucuuug

SEQ ID NO: 140129 - RNA, 65 nt, hsa
ucauuggaaguucuuuguaauuuuaauuccaugaaagucuuaauguuuccaacaugaaaauucuc

SEQ ID NO: 140130 - RNA, 65 nt, hsa
aaauagucacaaguauuaauaaugccuuagaugauagucuuaaauauuagguugaggucuaccua

SEQ ID NO: 140131 - RNA, 65 nt, hsa
uaauagcaauaaaccuaacuggauuuggaugaagaagucuuaauacugacauacuggauuuuuaa

SEQ ID NO: 140132 - RNA, 65 nt, hsa
gccuaguuagaguuagaccugucuuuggaugaagaagucuuaauacugaaauacugaauuuuuaa

SEQ ID NO: 140133 - RNA, 65 nt, hsa
cucuuuguuaaaccccaauuauagauaauuuuuccagucuuaagcucuguccaccuucaagucaa

SEQ ID NO: 140134 - RNA, 65 nt, hsa
aaucaaaaugaaaacaaagcaaaugaauacuggacagucuuaacaauuuuauaaguuauaaaaug

SEQ ID NO: 140135 - RNA, 65 nt, hsa
cagugagcauuugccugaauaaaaccuaaaagaguagucuuaacacauuacuaacuuuuucuaag

SEQ ID NO: 140136 - RNA, 65 nt, hsa
uucagauuaaucuuuuauccuuuccugaaguacaaagucuuaagagugucugaaauccaagacau

SEQ ID NO: 140137 - RNA, 65 nt, hsa
guaguuuuacuacuuuucauuuagaacagaguaugagucuuaaucugaagucuuuuucaugcccu

SEQ ID NO: 140138 - RNA, 65 nt, hsa
aucguuuuuguuuucuuguacuuugaauuccccaaagucuuaauugcuuuauuuugguguugugu

SEQ ID NO: 140139 - RNA, 65 nt, hsa
ccacaguccauugugaagugugcuauauuuagaacagucuuaaaauguacaguguauuuuauaga

SEQ ID NO: 140140 - RNA, 65 nt, hsa
gugcauugggcuccgugccacaaccaagcuucauuagucuuaaauuucagcauauguugcugcug

SEQ ID NO: 140141 - RNA, 65 nt, hsa
acuuuuuuauaauuguuuucagaaaaaaaguuuacagucuuaaggaaaauauucaggucuaucau

SEQ ID NO: 140142 - RNA, 65 nt, hsa
gauuacaggcaugagcuaccacaccugguuuggagagucuuaauuaaggaaauuucccuaauguu

SEQ ID NO: 140143 - RNA, 65 nt, hsa
cugagagauuggugauuuauauaagguaaucuguuagucuuaaaauaguuaaaaguuuguauuuu

SEQ ID NO: 140144 - RNA, 65 nt, hsa
ugcacacuuuuacaaauuuaauauaaagcaaguccagucuuaaaaagacaaaccauaucacuccu

SEQ ID NO: 140145 - RNA, 65 nt, hsa
gauggaaacugaccaccuacuuuguccagaaaagaagucuuaagauauuucaaggaaucaguguc

SEQ ID NO: 140146 - RNA, 65 nt, hsa
uaaaugaaucacggcaauuucuuauaaaugagggaagucuuaagaccuuccauuuuuuagagaca

SEQ ID NO: 140147 - RNA, 65 nt, hsa
uccauauuuauauuuuuaaauaaaugcauauauugagucuuaaaaucucuuucuggccaaagacu

SEQ ID NO: 140148 - RNA, 65 nt, hsa
augaaucuagcauuuguuuucagagauucaagcauagucuuaaggguagaucagaaaugacaaau

SEQ ID NO: 140149 - RNA, 65 nt, hsa
acagaccgaacuguuguauaaauuuauuuacugcuagucuuaagaacugcuuucuuucguuuguu

SEQ ID NO: 140150 - RNA, 65 nt, hsa
ggugcuucugugaauuaaguugugguuucaucaugagucuuaauguucuuuguugauaagacaag

SEQ ID NO: 140151 - RNA, 65 nt, hsa
uauauauauauaucaguuugaucacacuauuuuagagucuuaaugccaagucagcagauuugcuu

SEQ ID NO: 140152 - RNA, 65 nt, hsa
aggguuuuguuaauucuuuucagaaucauugaagcagucuuaaagggucuuuugcagaugguaca

SEQ ID NO: 140153 - RNA, 65 nt, hsa
uuagaggauaaugguucaccucugcguaaacugcaagucuuaagcagacaucuggaauagagcuu

SEQ ID NO: 140154 - RNA, 65 nt, hsa
ugucagggcuuuucuggggcugcucuuggaaaugaagucuuaaguacugaauaacuccccugggg

SEQ ID NO: 140155 - RNA, 65 nt, hsa
uuuauauuaaugaggagaaaaguaugaaaacaagaagucuuaaguaaauauugaggucauuguuu

SEQ ID NO: 140156 - RNA, 65 nt, hsa
aggggcuugagaagguuacugagugaguuauugggagucuuaauaaaauaaacuagauauuaggu

SEQ ID NO: 140157 - RNA, 65 nt, hsa
uuuuauauuacuauuuuccuuuuuguuguucacauagucuuaaggcaccuauacuuuuaaauuga

SEQ ID NO: 140158 - RNA, 65 nt, hsa
ucuuagccaggaaagacaaauaauccaacgcugcuagucuuaaccccagaccagagagaacugca

SEQ ID NO: 140159 - RNA, 65 nt, hsa
ccaugcccggcccauaaguaccguuuuugagguucagucuuaaacauuugcuuuaagaaaacagu

SEQ ID NO: 140160 - RNA, 65 nt, hsa
ucaaaaccaaucaugccuucccaacagucccccaaagucuuaacucauuucagcauuaacccaaa

SEQ ID NO: 140161 - RNA, 65 nt, hsa
gugcaaaggaaacuauugucucgcuccuucaaaacagucuuaauuaacuuucauauuagcagauu

SEQ ID NO: 140162 - RNA, 65 nt, hsa
uguauuucuuuuucgggguuucugcaugcaguggcagucuuaagugccaaaauucauuauaaccc

SEQ ID NO: 140163 - RNA, 65 nt, hsa
ugaccauuuauauucuaguagccaucuucacuguuagucuuaaauuauaauguaaaguugacauu

SEQ ID NO: 140164 - RNA, 65 nt, hsa
guuguacucuuaugugucugauauacacauuuccuagucuuaacuuucaggaguuuacaauugac

SEQ ID NO: 140165 - RNA, 65 nt, hsa
uauaggcagggcgaauacuacuuuguaacuuuuaaagucuuaaacuuuucaauaaaauugaguga

SEQ ID NO: 140166 - RNA, 65 nt, hsa
augucuaaagugauuaucuuuuuuccccccaaguuagucuuaaaucuuuuggguuugaaugaagg

SEQ ID NO: 140167 - RNA, 65 nt, hsa
aggcggggcugaggaacagggaaaugccgcugugaagucuuaaagcacuucugcuuaaacuccca

SEQ ID NO: 140168 - RNA, 65 nt, hsa
gauguuuuauuuuuagaauaguuauaaaaaguauuagucuuaacauaaugugucuuguucuuuuu

SEQ ID NO: 140169 - RNA, 65 nt, hsa
cccaugucauagagaauaaagcugaugauuguaccagucuuaaauuauucaugauucaauaaaau

SEQ ID NO: 140170 - RNA, 65 nt, hsa
aauuuagaguuuccaaauuuagagcuucugcauacagucuuaaagccacagaggcuuguaaaaau

SEQ ID NO: 140171 - RNA, 65 nt, hsa
ugucauuucaggguaggagucaaugaagacaucuuagucuuaacaaguuacagauaaucucugac

SEQ ID NO: 140172 - RNA, 65 nt, hsa
uuuauaaggugagguaacucagaacuuaauuuaaaagucuuaaauauucugauacaauucagcug

SEQ ID NO: 140173 - RNA, 65 nt, hsa
aaaacaauuggcagaaccuguuugauuacugugacagucuuaaugauaccauaaaucaauauuag

SEQ ID NO: 140174 - RNA, 65 nt, hsa
uuauuucgcugguucuuuguagucacauauuuuauagucuuaauaucuuguuuuugcaucacugu

SEQ ID NO: 140175 - RNA, 65 nt, hsa
cauccauuaucccuuugccuuuaacccugacauucagucuuaacacauuuuaucuuaaauaauuu

SEQ ID NO: 140176 - RNA, 65 nt, hsa
acuuuuucguaacuuuugaaucuuaauauuuugaaagucuuaaaggagacacugcaaagucuuag

SEQ ID NO: 140177 - RNA, 65 nt, hsa
ucccaucuaugggcuuuagaccuauuacuggguggagucuuaaaguuauaauuguucaauauguu

SEQ ID NO: 140178 - RNA, 65 nt, hsa
uuuuuguauuauuguuuguuuuguguucaguucaaagucuuaaccaguuuuauugucaaauaaac

SEQ ID NO: 140179 - RNA, 65 nt, hsa
cccugauauccccuggcucaguccuaacaagacugagucuuaacaagaugagaaguccuccccuu

SEQ ID NO: 140180 - RNA, 65 nt, hsa
cuguuauuugcuucuuuuaaucagcaaaggccucaagucuuaaaauaaaaggggagaagaacaaa

SEQ ID NO: 140181 - RNA, 65 nt, hsa
agaauggcugaagagaucaagaauuuaaagcuucuagucuuaacauacuugcauccacuucaaau

SEQ ID NO: 140182 - RNA, 65 nt, hsa
cugccccaaaauuauaaacucuaaguguaaaaaaaagucuuaacaacagcuucuugcuuguaaaa

SEQ ID NO: 140183 - RNA, 65 nt, hsa
aacugguucauucuccauuacugcaagagaauggaagucuuaauagaaggaagcaggagugauua

SEQ ID NO: 140184 - RNA, 52 nt, hsa; identical to SEQ ID NO: 139530

SEQ ID NO: 140185 - RNA, 65 nt, hsa
aauaaggaaagacuugguguauagugugaugguuuagucuuaaggauuaagacauuuuugguacu

SEQ ID NO: 140186 - RNA, 65 nt, hsa
uagaaaaauggacauaugaauauuauuaaaaauugagucuuaaauuuaaaugggaagggaagaaa

SEQ ID NO: 140187 - RNA, 65 nt, hsa
gagaagguuauggguaccaggaagaaacaaacagaagucuuaagauuagaaugagaaccaaagag

SEQ ID NO: 140188 - RNA, 65 nt, hsa
uggauaagaugaccuguguaauaaucuuuguuaguagucuuaaagcugcugccauaguccuccaa

SEQ ID NO: 140189 - RNA, 65 nt, hsa
ccacauuucacauacuguuacugaagaaagcaccaagucuuaauggaacaaagaccauagaauga

SEQ ID NO: 140190 - RNA, 65 nt, hsa
uuuuuauugaugaauacaucucugaacguuccagaagucuuaagguuccaaagggauuuagcagu

SEQ ID NO: 140191 - RNA, 65 nt, hsa
ugacacuauuaugaagcuacuagucauuccauaagagucuuaaaggacugcucuguguaacacug

SEQ ID NO: 140192 - RNA, 65 nt, hsa
uaauucucauauccaugccuuuuuguccuguuuacagucuuaaaagagguaaaacagcaaauauu

SEQ ID NO: 140193 - RNA, 65 nt, hsa
uaacaaguuguuuguauuuuauuuuuguuuauaccagucuuaaagauccagguucugaauaaaaa

SEQ ID NO: 140194 - RNA, 65 nt, hsa
ccaguagacaccacuguacuuuuugauacgagggcagucuuaacuuguguuaaggccugugugua

SEQ ID NO: 140195 - RNA, 65 nt, hsa
agguauuggaguuuaaaaaaaaagccaaauuucacagucuuaauaacuuuuuuuaaaaaaaacua

SEQ ID NO: 140196 - RNA, 65 nt, hsa
aagguuuucaucaagccccgcccuuucucucucauagucuuaaugcgucuggaccacuggggaaa

SEQ ID NO: 140197 - RNA, 65 nt, hsa
auguaaauaauguucaggaaaaacgcagggaacagagucuuaaaguuaauggauauuuaauguga

SEQ ID NO: 140198 - RNA, 65 nt, hsa
uacagaaguaauuggccugagagcauucuugaccaagucuuaaaugcuagaaucugagaaggaau

SEQ ID NO: 140199 - RNA, 65 nt, hsa
aacuuucucauacacugacuguuacuuuaacuguuagucuuaaauaguugggacaucagcugacu

SEQ ID NO: 140200 - RNA, 65 nt, hsa
aguaaauggacauuccagaauauagaugugauuauagucuuaaacuaauuauuauuaaaccaaug

SEQ ID NO: 140201 - RNA, 65 nt, hsa
accaacuauaggccuuuuucuugggaugauuuucuagucuuaagguuuggggacauuauaaacuu

SEQ ID NO: 140202 - RNA, 65 nt, hsa
uccucagauugaaaagcuuaugaggauuucuugggagucuuaauaaccugccuguuaguacagag

SEQ ID NO: 140203 - RNA, 65 nt, hsa
gcggcacuauuucugaacaaagagagcucaucaucagucuuaauauucagagaaaacuucagaga

SEQ ID NO: 140204 - RNA, 65 nt, hsa
guacugcucauuuacacucaaauuaaucuugaaguagucuuaaaauguguaagaaguuaaaacuu

SEQ ID NO: 140205 - RNA, 65 nt, hsa
agaaguuacacagaccacagugauuuagccaaauaagucuuaaccaaaaaaaggaaucugaaaaa

SEQ ID NO: 140206 - RNA, 65 nt, hsa
aauguaaauaguguccauuaguaaaagugaaauucagucuuaaguagggugaauuggaucaccau

SEQ ID NO: 140207 - RNA, 65 nt, hsa
guucuguuauuaaggggcauagcauuaauuuuugcagucuuaaaauuacacuucuugacuucuga

SEQ ID NO: 140208 - RNA, 65 nt, hsa
guaaagguccuagucuuucuggcuuuaacacagaaagucuuaauaccauuuggauuaaagauuca

SEQ ID NO: 140209 - RNA, 65 nt, hsa
gggagaacugaaagggaaaacaaaauacuugacauagucuuaaguagaagaaggcaguuagagaa

SEQ ID NO: 140210 - RNA, 65 nt, hsa
uucacugguaaaauuguugaauauuucucucucccagucuuaaaagcccacaggcaagaauuaau

SEQ ID NO: 140211 - RNA, 65 nt, hsa
uucaaaaauuuuauucaguguauuuucaguuguugagucuuaaugagggauacaggaggaaaaau

SEQ ID NO: 140212 - RNA, 65 nt, hsa
auguucucuguuuugaauauacuuuaauaccugagagucuuaaaauuugugaacaacguuucuau

SEQ ID NO: 140213 - RNA, 65 nt, hsa
uuuaaacuguggagcuuucauguuuacuguaauuuagucuuaaaauauuuuuuacuuaguaacca

SEQ ID NO: 140214 - RNA, 65 nt, hsa
uaucguaggcguuuauauuauaaaauucuguuaguagucuuaaaauugaauugguggaaccacua

SEQ ID NO: 140215 - RNA, 65 nt, hsa
uuguacgcugcgugaacaugccucaccuuuaagagagucuuaaagguaaagacacgaaaacacuu

SEQ ID NO: 140216 - RNA, 65 nt, hsa
caacuaaaauuuuauauauuguaaccaguguuaaaagucuuaaaaaacaaugguauuaauugucc

SEQ ID NO: 140217 - RNA, 65 nt, hsa
ggcuauaauuuuguguuuuuuuuuuuuaauugucuagucuuaaauuuguacaucuuguauaaaau

SEQ ID NO: 140218 - RNA, 65 nt, hsa
agaagcugggugggcugaagaggccuggaaacgagagucuuaauugaggagaugggagacucgaa

SEQ ID NO: 140219 - RNA, 65 nt, hsa
guuugaugggaugacugacacaggaaaucuguuaaagucuuaaaauggaaugagaauguuguuuu

SEQ ID NO: 140220 - RNA, 65 nt, hsa
uauacauaauucaaaagaacuacuugaugcaguauagucuuaaggguucugcauacauuuuagaa

SEQ ID NO: 140221 - RNA, 65 nt, hsa
ucaaaugcauccucuagaaaaauaauuaguguuauagucuuaagauuuguuuucuaaaguugaua

SEQ ID NO: 140222 - RNA, 65 nt, hsa
auccauccccaagcaccuccucaugcugugcaugcagucuuaaauucaauggacaaaaauaaaau

SEQ ID NO: 140223 - RNA, 65 nt, hsa
uuuuuauuuccuaaaugccauacuaugaagaucaaagucuuaaguguguuugcagcucaaaaaua

SEQ ID NO: 140224 - RNA, 65 nt, hsa
uugcaaauugaauuggaauaggaauugauaauagcagucuuaaacauuaguagugggauuuggcu

SEQ ID NO: 140225 - RNA, 65 nt, hsa
aguggaauuucauucaaaggcauaauagcaaugacagucuuaagccaaacauuuuauauaaaguu

SEQ ID NO: 140226 - RNA, 65 nt, hsa
gaggagucucuggcuuaugacuccugguucccauuagucuuaagucuucugguucccauaaaaga

SEQ ID NO: 140227 - RNA, 65 nt, hsa
ccaacuuaggcccuggcaauuaacugaaagggcaaagucuuaaucaaucaaacaauggaggaauc

SEQ ID NO: 140228 - RNA, 65 nt, hsa
uugauugcuuuuguauuuaauucugcagguguucaagucuuaaaaaauaaagauuuauaacagaa

SEQ ID NO: 140229 - RNA, 65 nt, hsa
cuuucauugcuaagacuaacucaagauaauccuagagucuuaaagcauuucaggccaguguggug

SEQ ID NO: 140230 - RNA, 65 nt, hsa
aauuaggaauuacuuuauuauaaaaugcuccuagaagucuuaauuguguuuauuuuuuaaaaaaa

SEQ ID NO: 140231 - RNA, 65 nt, hsa
cuacucuuccccucuucucacuacugcacuugacuagucuuaaaacaaagaaagaacgaaugaau

SEQ ID NO: 140232 - RNA, 65 nt, hsa
gugauaaaauauugauguuguauuuuacacucuuaagucuuaaccacagucagaauuaucuuaau

SEQ ID NO: 140233 - RNA, 65 nt, hsa
cagccccacugcaucucaagugaacuguauagccaagucuuaaaccucucacggggcaagccuga

SEQ ID NO: 140234 - RNA, 65 nt, hsa
aaauacuuucaauauuauucugaauggcugaaguuagucuuaaacucaaauuacuauaugaugau

SEQ ID NO: 140235 - RNA, 65 nt, hsa
ccuaaguguuucagaaauguuuuauuucacacauaagucuuaauguuauuguuaugauuauacuu

SEQ ID NO: 140236 - RNA, 65 nt, hsa
uuguauuuuuaaauuuuucuuggguuaguauuuaaagucuuaacauuuauuuaauaauuauauuu

SEQ ID NO: 140237 - RNA, 65 nt, hsa
gagcugagugugucucccuaaaauuucuauguugaagucuuaacccuugguaccacagaauauca

SEQ ID NO: 140238 - RNA, 65 nt, hsa
uuaguacacagacaugaacuguucuuaaacagaacagucuuaaaaugucuguacauaucugucug

SEQ ID NO: 140239 - RNA, 65 nt, hsa
aguguguuuuuguaugaaugagcccauucaugguaagucuuaagcuuguuggaaauaauguaccc

SEQ ID NO: 140240 - RNA, 65 nt, hsa
uucuauuaggaauggcauauacugagguggucguaagucuuaacuucuaaaauuuuaaauaaaag

SEQ ID NO: 140241 - RNA, 65 nt, hsa
uugagcaguguaauuacaaacaaauagguuggcauagucuuaagucuuugagucuagagagauuu

SEQ ID NO: 140242 - RNA, 65 nt, hsa
cucuacauaaaagcuccaugugaaaagcuacuccuagucuuaacauuugcaguccuugugucacu

SEQ ID NO: 140243 - RNA, 65 nt, hsa
uuuuaaaaaaggaaaaaaaaaagaaacuggguuccagucuuaauucauuuuccgugccagguuuu

SEQ ID NO: 140244 - RNA, 65 nt, hsa
gacuuuucuuugcaagcgaaccuguuugaagcccaagucuuaacuccuggucucguaagguucca

SEQ ID NO: 140245 - RNA, 65 nt, hsa
gguuuugaauguaaaaguugcaacacacaaacggaagucuuaaaaacuuuuugcucuggucaguu

SEQ ID NO: 140246 - RNA, 65 nt, hsa
auuaugucugcaccagugaauccauucucaagaaaagucuuaacuaggaaacuaaaagcuuucac

SEQ ID NO: 140247 - RNA, 65 nt, hsa
caaaaguauuaauagaaauucucuaucagcuauucagucuuaauuucacuaguaguauaaugggu

SEQ ID NO: 140248 - RNA, 65 nt, hsa
ugagucuggguuguugggaacagcacagaauuuggagucuuaagcucuaaauuagaggcccugac

SEQ ID NO: 140249 - RNA, 65 nt, hsa
cuuucuuuucuuuuuuaaaguaaacuuguguauugagucuuaacuguauuucaguauuuuccagc

SEQ ID NO: 140250 - RNA, 65 nt, hsa
uagugcauuuccuccugccuuugcuuguucacugcagucuuaagaaagagguaaaaggcaagcaa

SEQ ID NO: 140251 - RNA, 65 nt, hsa
gggagcucaguucccauugcuugugcucagggcugagucuuaaagaaggguuugccggcccuaac

SEQ ID NO: 140252 - RNA, 65 nt, hsa
cugugauauuuuuuagacugaacugcuccauuccuagucuuaauuaccauauucaggguacgaac

SEQ ID NO: 140253 - RNA, 65 nt, hsa
accgccuuucucaccacccugggggcgccucgugcagucuuaacagggagagggcuuucuggggc

SEQ ID NO: 140254 - RNA, 65 nt, hsa
ggcauaauugaugcacaugauguucacacagugagagucuuaaagauacaaaaugguauuguuua

SEQ ID NO: 140255 - RNA, 65 nt, hsa
gugauucgagcuauauuuaaguauucaagaaagccagucuuaacauuucuaacucugauguaaau

SEQ ID NO: 140256 - RNA, 65 nt, hsa
cugcaccuuucuguacaaauacuaauucaauuuuaagucuuaagucacuuuuuuaauauauauga

SEQ ID NO: 140257 - RNA, 65 nt, hsa
cugcgguggagggaucaguugccccccaucaccagagucuuaagggucacuggccucuccccagg

SEQ ID NO: 140258 - RNA, 65 nt, hsa
guuccguaguguagaagcccacagguguagaacucagucuuaaacuucaguaugaaaccaguuuc

SEQ ID NO: 140259 - RNA, 65 nt, hsa
gauagaaugugggcuuuuucaagggugaagauacaagucuuaaccacaguguaacuuacaguuuc

SEQ ID NO: 140260 - RNA, 65 nt, hsa
cuuauugauacuaaagaggaguuaaaggcacauaaagucuuaacucuauaauguucauuuaguug

SEQ ID NO: 140261 - RNA, 65 nt, hsa
uguacauuuaacuuuggaauggcuuuguaauaaucagucuuaagaaaauguugacaagcucuggu

SEQ ID NO: 140262 - RNA, 65 nt, hsa
aggaaucuggugaauuuuagucaucccagcuuuuuagucuuaaccacaguucucacucucuuaaa

SEQ ID NO: 140263 - RNA, 65 nt, hsa
ccuguucuguaaauuuuauuuuaaacuguuaccauagucuuaaguuguuuaugcuuuaucagacu

SEQ ID NO: 140264 - RNA, 65 nt, hsa
aguuuuguuuucuuucuauguuccaugcauaauacagucuuaagugaauuucucuuuuuuaauuu

SEQ ID NO: 140265 - RNA, 65 nt, hsa
uuuacaaaggaaccaaaaugauaaugggagaauuuagucuuaaaaguuuagguugucagaguuua

SEQ ID NO: 140266 - RNA, 65 nt, hsa
cauacaagucaggguguuuggcuaaucuacaaauaagucuuaaaccuauguuuuuaaauuuuuuu

SEQ ID NO: 140267 - RNA, 65 nt, hsa
uuuaaaagugcuaauguguauucgaacccaaugguagucuuaaagaguuuugugcccuggcucua

SEQ ID NO: 140268 - RNA, 65 nt, hsa
ugagacccaagucaucaugaaaaaggcccaaguacagucuuaaugcgauaaauccacuagcuaag

SEQ ID NO: 140269 - RNA, 65 nt, hsa
acccagcuguccccacgccucugucuuuugggucaagucuuaaucccugcaccugaguugguccu

SEQ ID NO: 140270 - RNA, 65 nt, hsa
uuaauuguucugugauugaggaccacugaaaaauaagucuuaauaaauguugguaugaaccuacu

SEQ ID NO: 140271 - RNA, 65 nt, hsa
uguucuucaaaaugugcauguuaaguauucaaaucagucuuaaauuuuuaaaaauauguaauuuu

SEQ ID NO: 140272 - RNA, 65 nt, hsa
uucaggaacuauucuaaaagucauaaaagggucacagucuuaagcagagcuuaguuuucuucuca

SEQ ID NO: 140273 - RNA, 65 nt, hsa
uguuuuuuuacacauauuaacuuaauaaauguaugagucuuaaauaccucuuaguucucauuaaa

SEQ ID NO: 140274 - RNA, 65 nt, hsa
uggggucuuggugcccaagcuggucucaaacuccuagucuuaagcaaucuuccugcuuuggccuc

SEQ ID NO: 140275 - RNA, 65 nt, hsa
gugcagccccgccccccugccucacccacaaacuaagucuuaacaaaauccaaauuaccaacaaa

SEQ ID NO: 140276 - RNA, 65 nt, hsa
ccgacggcagagccuccuucagaaagugcagcucaagucuuaaagacaccaaaacugagccaugg

SEQ ID NO: 140277 - RNA, 65 nt, hsa
ucccuucucuaauuucuucuuuuuuuuaaugauaaagucuuaaaaacacggagccaccaacugga

SEQ ID NO: 140278 - RNA, 65 nt, hsa
ucagauugaaaagagaccgaaugugcagauuccacagucuuaagcuuuccccuucagaugucagu

SEQ ID NO: 140279 - RNA, 65 nt, hsa
uaauagguaguuuucuauaguaacuugauuaauuuagucuuaauccauuugaaacucucucuucc

SEQ ID NO: 140280 - RNA, 65 nt, hsa
ucacuugcccucgugccugggggagagaggcagcaagucuuaacaaaccaacaucuuugcgaaaa

SEQ ID NO: 140281 - RNA, 65 nt, hsa
uuuucuacuacuacauauuuagaguucacugguucagucuuaaaugccugcauggugccuuuuua

SEQ ID NO: 140282 - RNA, 65 nt, hsa
aauuucagguaguaauauucaguguaguuaaggccagucuuaacccacuggaugaaaaucuagga

SEQ ID NO: 140283 - RNA, 65 nt, hsa
cuucacucacucacucaacaaauacccguuggaagagucuuaaacuggggcuucauguguggccu

SEQ ID NO: 140284 - RNA, 65 nt, hsa
ugugggguguuucgccugcaccccugguuucuuuaagucuuaagugaugccccuuccaaaccauc

SEQ ID NO: 140285 - RNA, 65 nt, hsa
aauuuuggggggaacauuuuagguuuguauuugguagucuuaauguaucuggcauuugggugaac

SEQ ID NO: 140286 - RNA, 65 nt, hsa
auuaccguauucgccguacuaaguugguuucuguuagucuuaacagucuguuuucuuuuaaaagc

SEQ ID NO: 140287 - RNA, 65 nt, hsa
ugcugucauaauuuaagcauuugaguauauuuugaagucuuaaaagacuuagcccauaggcacuu

SEQ ID NO: 140288 - RNA, 65 nt, hsa
ugcaccccgcaaccugggaucucaaggagcuuuaaagucuuaaugggaacuuggcauuuuccuga

SEQ ID NO: 140289 - RNA, 65 nt, hsa
ugaccuuguaaaagacaguguauguagaagcaugaagucuuaaggacaaagugccaaagaaagug

SEQ ID NO: 140290 - RNA, 65 nt, hsa
uuacccuggccuccuagggucccuuuuucugaugaagucuuaauucccuaaaagcgccucuuugg

SEQ ID NO: 140291 - RNA, 65 nt, hsa
ggguuaugagaaccagcgaaaucccccaugucaucagucuuaaaaaaaaaauuuuacaaauccac

SEQ ID NO: 140292 - RNA, 65 nt, hsa
ggcuccuguuagacaaacacauugaugaagaaauuagucuuaauaggauuguaggcuguguagaa

SEQ ID NO: 140293 - RNA, 65 nt, hsa
gaggcucccacuucuugggaggguuacauuuuuuaagucuuaaucauuugugacauauguaucua

SEQ ID NO: 140294 - RNA, 65 nt, hsa
cuugguuuauacuuuuucuauucaucaggguaggaagucuuaaauccuuaggcauccaagaagua

SEQ ID NO: 140295 - RNA, 65 nt, hsa
gauggaucaccauuauauuuugaaagaagccaucaagucuuaaguuuuucauuucaacuugugaa

SEQ ID NO: 140296 - RNA, 65 nt, hsa
gaaaugugugaaagaaccucacacaacauaauuggagucuuaaaauagaggaagaguaagcaaag

SEQ ID NO: 140297 - RNA, 65 nt, hsa
augcuuauugcuucuguauuucuucucuacucccuagucuuaauguuuaaccuugaaugcuauua

SEQ ID NO: 140298 - RNA, 65 nt, hsa
guaauaaauacaaaaaaaucauuuuucuagagcagagucuuaaaaucagguggggguaggggaug

SEQ ID NO: 140299 - RNA, 65 nt, hsa
cccagauuacuccaggauaaucuccucaccucaugagucuuaacuuaauuacaucugcaaggccc

SEQ ID NO: 140300 - RNA, 65 nt, hsa
ucugaauuuuaguacuaguuuacacguauaaauacagucuuaaaccuuuaugucugagucugaaa

SEQ ID NO: 140301 - RNA, 65 nt, hsa
uuuuucgccuuaguggugauuguuuaaacucucacagucuuaaaccgugccaaaguccuguuaug

SEQ ID NO: 140302 - RNA, 65 nt, hsa
gugucuccugagacaagcaucgugauagaguucacagucuuaaaagucugcauuuucaggugggg

SEQ ID NO: 140303 - RNA, 65 nt, hsa
uuccucggcuccauuguggguuauucuagaaauccagucuuaaaucucuccgcuaaaguggacau

SEQ ID NO: 140304 - RNA, 65 nt, hsa
caguuacugaggcuucucccaaaagguaucaguccagucuuaaagauauuucauugugaaagaag

SEQ ID NO: 140305 - RNA, 65 nt, hsa
cagcccuugaacaucuccuccaaagagacuagaagagucuuaaauuauaugugggaggaggaggg

SEQ ID NO: 140306 - RNA, 65 nt, hsa
augugaagugccuguguaauugaugacucuuacauagucuuaagcauuuuugcaauuuuuuaaau

SEQ ID NO: 140307 - RNA, 65 nt, hsa
auauguaaaguugauauugacuacaauaaaaauccagucuuaauuccagauuuacugaaaauguc

SEQ ID NO: 140308 - RNA, 64 nt, hsa
uugggaauaaauuaaaaacaguauuugggggagaaacgugcaauagcguaaugguggugucccu

SEQ ID NO: 140309 - RNA, 64 nt, hsa
cuauucugcaguugcagagccagccccgcgugagaacgugcauaaugagugcacaccaucaugu

SEQ ID NO: 140310 - RNA, 64 nt, hsa
aggaucacucacauauguacauguacccaccacaaacgugcaagcuccugcacacaugcaugca

SEQ ID NO: 140311 - RNA, 64 nt, hsa
augcacacacacacgcacacguacauucacuacaaacgugcagccuccugcacacgugcacauu

SEQ ID NO: 140312 - RNA, 64 nt, hsa
cugaauuugucuuuuaaaaugaguacauauauaggcaauaaauauauaugcucagaucaauaua

SEQ ID NO: 140313 - RNA, 64 nt, hsa
acauucuugugauuucauaugcuguauucuucaagcaauaaaauugugauguguuuuauaaaug

SEQ ID NO: 140314 - RNA, 64 nt, hsa
gaaacacuagagucauauaagaaauaaaaauugggcaauaaaauaaaaugauucaguguuucuu

SEQ ID NO: 140315 - RNA, 64 nt, hsa
auacauuauuagacugaacugugaccugaaaugagcaauaaacucuguauuaauucacugaaau

SEQ ID NO: 140316 - RNA, 64 nt, hsa
ggccaacuugcuccaguaaugcaauaaagacauugcaauaaaguaauuuuuugucuucaugcua

SEQ ID NO: 140317 - RNA, 64 nt, hsa
agaggggacagucuggccaacuugcuccaguaaugcaauaaagacauugcaauaaaguaauuuu

SEQ ID NO: 140318 - RNA, 64 nt, hsa
uggcaacagagcaagacuccgucucaaaaaaagggcaauaaaugcccucucugaauguuugaac

SEQ ID NO: 140319 - RNA, 64 nt, hsa
aauuuauauuuucccucucuugccuuucuuauuugcaauaaaagguauugagccauuuuuuaaa

SEQ ID NO: 140320 - RNA, 64 nt, hsa
ucaauaugaaggaaaugaaccacauagacuuuaugcaauaaauaacagugcaagugaguauaac

SEQ ID NO: 140321 - RNA, 64 nt, hsa
ugauggugcauuuuauucuugaagugaaaucugugcaauaaaauaacagacugucugcaaaacu

SEQ ID NO: 140322 - RNA, 64 nt, hsa
cuguuguagaauaauaauaaaaagacuauuaagagcaauaaauuauuuuuaagaaaucgagauu

SEQ ID NO: 140323 - RNA, 64 nt, hsa
auuuuuuggcuucuuauuucuaaguagauagaaagcaauaaaaauacuaugaaaugaaagaacu

SEQ ID NO: 140324 - RNA, 64 nt, hsa
acuugugaaguggaaauguucuaaagguggugaggcaauaaaaaucauaguacucuuuguagca

SEQ ID NO: 140325 - RNA, 64 nt, hsa
caacuuaaauaauaaacaguggaauauaaggaaagcaauaaaugaaugggcugagcugccugua

SEQ ID NO: 140326 - RNA, 64 nt, hsa
uuugugagaguaguuuuccuuugcuacuugaauagcaauaaaagcguguuaacuuuuugauuga

SEQ ID NO: 140327 - RNA, 64 nt, hsa
aguauugcaguugcugcuuuguacagagguuacugcaauaaaggaaguggauucauuaaaccua

SEQ ID NO: 140328 - RNA, 64 nt, hsa
uuauaauaaccucccaguucuaggggauauuugugcaauaaauacacaugucaacuugauggau

SEQ ID NO: 140329 - RNA, 64 nt, hsa
auaugucuuaauuuugaguuugaaaauguuaagugcaauaaaaacauacuaguacagauuuugu

SEQ ID NO: 140330 - RNA, 64 nt, hsa
uagguuuucugcuagccaauauuaaaagagaccugcaauaaaaaaauuacccugaucugauaga

SEQ ID NO: 140331 - RNA, 64 nt, hsa
gugaauacuggaagcugcagaucuuugcuaggacgcaauaaauuuauauacuuuuugagggguu

SEQ ID NO: 140332 - RNA, 64 nt, hsa
cagacuauuauuaucuuuguaauaaauuaaccuagcaauaaaaaauauucuguuucuuucguua

SEQ ID NO: 140333 - RNA, 64 nt, hsa
caggucuaguuucgguaacuguuccagacaucaagcaauaaaaaaaugaauaccacaaaagaug

SEQ ID NO: 140334 - RNA, 64 nt, hsa
uaccuucaacaugugcucgcucugcaugauuagugcaauaaaacucccuuccuuaugcauacug

SEQ ID NO: 140335 - RNA, 64 nt, hsa
uugaaaaaauauuguuuaaugcaaaugaaggaaugcaauaaagaguaaauauacuugaaaaugu

SEQ ID NO: 140336 - RNA, 64 nt, hsa
cucuuuccaccuuccccuauccaugcacccccucgcaauaaaaccaacucuaaaaucacagcug

SEQ ID NO: 140337 - RNA, 64 nt, hsa
agagagaaaauccacaaauuccaaugucacaaaagcaauaaaacaaacuagaaaaaaaaaaggu

SEQ ID NO: 140338 - RNA, 64 nt, hsa
cuaagcccggccucgucucgccggaggagacgcugcaauaaagguugggagaaggcgcggaaag

SEQ ID NO: 140339 - RNA, 64 nt, hsa
guguuacuuuuuuagacucccgucugcacaaaaugcaauaaaaauaauuuuauuauacccuuca

SEQ ID NO: 140340 - RNA, 64 nt, hsa
uuugcuuuaugucacuuacacggucaccuggagccggcucaaguggcuaaagcauccuggggcc

SEQ ID NO: 140341 - RNA, 64 nt, hsa
cugucgcccaggcuagaguggauuggcgugaucucggcucaaugcaaaucuccaggguucaauc

SEQ ID NO: 140342 - RNA, 64 nt, hsa; identical to SEQ ID NO: 74579

SEQ ID NO: 140343 - RNA, 64 nt, hsa; identical to SEQ ID NO: 74580

SEQ ID NO: 140344 - RNA, 64 nt, hsa
auggacuuuuccaugggucaaauuuuuugugugagagauagagguacaugucuucugaugaugu

SEQ ID NO: 140345 - RNA, 64 nt, hsa
ugaaucauagcgagccauuugcucuugccaaagugagauagauguacugaggagauaauugaaa

SEQ ID NO: 140346 - RNA, 64 nt, hsa
uuggaagggaagggaggugggcagcagugggucagagauagaccuuuguucucuuauuucugag

SEQ ID NO: 140347 - RNA, 64 nt, hsa
ucccacucuauucaaaguuaucucucugcucacugagauagauacauaucugauugccuccuuu

SEQ ID NO: 140348 - RNA, 64 nt, hsa
auuacugaaaccaaaauauauuugcuucaucugccccuacuaaccaucccccugccugcugccu

SEQ ID NO: 140349 - RNA, 64 nt, hsa
ccugcccugcgugcugguuccuucagaccccuaacccuacuaaccagcaggcucaucucaccuc

SEQ ID NO: 140350 - RNA, 63 nt, hsa
cugugauuuuuagaagaacuguuguaaagccuuugagauuagacagacuagagcuacauuacu

SEQ ID NO: 140351 - RNA, 63 nt, hsa
gauaaccuugugguuaaaagauaaggaaaaauaugagauuaugagaaauuaaauguauacuau

SEQ ID NO: 140352 - RNA, 63 nt, hsa
guugguuagcagggaagacccagaguuguagauugagauuaggguguacuggcugaacugugg

SEQ ID NO: 140353 - RNA, 63 nt, hsa
uggaaaacauacaauucuguguuccucaguaaaugagauuagcgucuaaugaguagcaccccu

SEQ ID NO: 140354 - RNA, 63 nt, hsa
aagugauucuccugccucauccucccaagaagcugagauuacagaugaccaccaccacuccug

SEQ ID NO: 140355 - RNA, 63 nt, hsa
aggugauccaccugccucagccucccaaagugcugagauuacaggcaugagccaccacgccca

SEQ ID NO: 140356 - RNA, 63 nt, hsa
aggcgauucuccugccucagcuucccgaguaacugagauuacaggcacccaccaccaugccca

SEQ ID NO: 140357 - RNA, 63 nt, hsa
aggugaucuaccugccucagccucccaaagugcugagauuacagacaugagccuccgcgccuu

SEQ ID NO: 140358 - RNA, 63 nt, hsa
gcucugugguaagaaaaaaugaacucuuucaauugagauuaaguccauauuuuucaaacauca

SEQ ID NO: 140359 - RNA, 63 nt, hsa
gccugguuuccuuuguacuaaucgggaaggcugugagauuaauccagagcauuaauuguauca

SEQ ID NO: 140360 - RNA, 63 nt, hsa
gugcacccccaacuucauagggguagaggcuccugagauuaggagaacccuuuuuaggcuuua

SEQ ID NO: 140361 - RNA, 63 nt, hsa
aaggggaggggugcuggagauuagauuagacaaugagauuaagagaacuccaaauagcccaag

SEQ ID NO: 140362 - RNA, 63 nt, hsa
uucugcugaaaugguaguuucuugccagcaaggugagauuauggaauccagaaucuuuuuuca

SEQ ID NO: 140363 - RNA, 63 nt, hsa
aagugauucuccuaccucagccucccaaggagcugagauuacgaguacaccacaccaugcccg

SEQ ID NO: 140364 - RNA, 63 nt, hsa
gacuugagcagagggaacgaccugacuuacuugcacugugaucccccuugcuccgcccacugu

SEQ ID NO: 140365 - RNA, 63 nt, hsa
acuuacuugcacugugaucccccuugcuccgcccacugugaccuugaaccccaugcacuguga

SEQ ID NO: 140366 - RNA, 63 nt, hsa
cuugcuccgcccacugugaccuugaaccccaugcacugugaccuccccccuucucccccuucc

SEQ ID NO: 140367 - RNA, 63 nt, hsa
augcacugugaccuccccccuucucccccuucccacugugauuggcacaucgacaagggcugu

SEQ ID NO: 140368 - RNA, 63 nt, hsa
uaugugggugacccuguggaagugagaaggagucacugugaugcuuagcuguccuaaaugaug

SEQ ID NO: 140369 - RNA, 63 nt, hsa
uggagugcugugagcuguccguggugcugaauucacugugacgucacuccugucucucuuugc

SEQ ID NO: 140370 - RNA, 63 nt, hsa
agguuagccagagacagguuuucauuaucaggucacugugaaaucugguaaggcaguccugag

SEQ ID NO: 140371 - RNA, 63 nt, hsa
agcucacugcaaacaacuggaauugagguugcacacugugauuuuuacaccgaaaagccaaaa

SEQ ID NO: 140372 - RNA, 63 nt, hsa
ugugccucagaucauccaccugugugaguccaucacugugaaauugacuguguccaugugaug

SEQ ID NO: 140373 - RNA, 63 nt, hsa
agauuucugagucguacuaugguuuugccuugucacugugaggcccuacuagguguaagcauu

SEQ ID NO: 140374 - RNA, 63 nt, hsa
uuuugcauguguucugauaaaaaucaauucuagcacugugaagcuucagacaccuugaaaguc

SEQ ID NO: 140375 - RNA, 63 nt, hsa
aaaucucuccaucugcauuaguauuuuaaggagcacugugagagaaaucacaaaguauuagag

SEQ ID NO: 140376 - RNA, 63 nt, hsa
ggugccccugccuccagcagagcccccaccauucacugugacaucuuuccgugucacccugcc

SEQ ID NO: 140377 - RNA, 63 nt, hsa
gccuggcggccauggggccugccgugccugccccacugugacccacaggccugggugguguac

SEQ ID NO: 140378 - RNA, 63 nt, hsa
aauggaucccuacaggggggcacuggagaggugcacugugagaaggugcaguguccccggcug

SEQ ID NO: 140379 - RNA, 63 nt, hsa
uguaucaccugcagauguggggcaggggugccucacugugagcgggaugacuguucacugcca

SEQ ID NO: 140380 - RNA, 63 nt, hsa
cccaggcuggagugcagugacacaaucucagcucacugugaccuccgccuccuggguucaaga

SEQ ID NO: 140381 - RNA, 63 nt, hsa
ucuuguguucuguagacugccaucauugaugaucacugugaaaauugaccaagugauguguuu

SEQ ID NO: 140382 - RNA, 63 nt, hsa
cccuguguacaauuuaaaauauuuguaaaauaucacugugaauuuacagaugucuuuuuguca

SEQ ID NO: 140383 - RNA, 63 nt, hsa
accuaaggagcuguccaguucuuggcucuuuuucacugugacugcacagcgguuuccuucuuc

SEQ ID NO: 140384 - RNA, 63 nt, hsa
aggacaguggguguguacuggccucccgggagccacugugaccaggccuuugagcucuuguca

SEQ ID NO: 140385 - RNA, 63 nt, hsa
auccuuuucuucagaccacucuccacaguccugcacugugauuccuucucagcaggcacaugu

SEQ ID NO: 140386 - RNA, 64 nt, hsa
acuaaccuaccccaacucugcccuucucccauccaagagaaaccagcaaaaugauaaagaagcu

SEQ ID NO: 140387 - RNA, 64 nt, hsa
gggcagcagucacuggggcucaagggcagugagcaagagaaaugucuaaagcugcuucucccaa

SEQ ID NO: 140388 - RNA, 64 nt, hsa
ugauaagaagaauuccauugaaaggggaaaaaugaagagaaacaaguauaucugaaauguuuau

SEQ ID NO: 140389 - RNA, 64 nt, hsa
uuugaaaauauaacaguuaaagauauuuuucuaaaagagaaaugauuuaaugaaucuugcuuuc

SEQ ID NO: 140390 - RNA, 64 nt, hsa
gggcacuuuuuaacauugcugauguaguaugcuuaagagaaaugaccuaaauaaggaucaauug

SEQ ID NO: 140391 - RNA, 64 nt, hsa
cuauuauuuuagaguucuaauacacucuaaauuaaagagaaaauugagaguaaaugacugucuu

SEQ ID NO: 140392 - RNA, 64 nt, hsa
gucuuaucacucuuauuugacauuucguagguguaagagaaauggaaaugaaugguuucaacaa

SEQ ID NO: 140393 - RNA, 64 nt, hsa
agaccuuccacuuaaggguaccaauucaauacaaaagagaaaagaagaaccucucagugcuuuu

SEQ ID NO: 140394 - RNA, 64 nt, hsa
uggccugcucucacgugucuguguaagaucaugcaagagaaaucacagugccuucuacagaauu

SEQ ID NO: 140395 - RNA, 64 nt, hsa
ucuauaaaaugaauaaaauguuuaagaaaagagaaagagaaaaggaauuaauucagugaaggau

SEQ ID NO: 140396 - RNA, 64 nt, hsa
aaucucucuauaaaaugaauaaaauguuuaagaaaagagaaagagaaaaggaauuaauucagug

SEQ ID NO: 140397 - RNA, 64 nt, hsa
uaaauucauuguauguuagaauugcaauagaaugaagagaaacauuuagcuaguaacgugaucu

SEQ ID NO: 140398 - RNA, 64 nt, hsa
aggaaauuucaguggcucucugguuucuuaacaaaagagaaagcacagcacuuucugauccaaa

SEQ ID NO: 140399 - RNA, 64 nt, hsa
guuuuauuggagaaaucuugccuauaauucuauaaagagaaaugacauuccacaaaugucaagc

SEQ ID NO: 140400 - RNA, 64 nt, hsa
uauaaaaaauuuaaaacugcuauuuuucuuauagaagagaaaauggguguuggugauuguauuu

SEQ ID NO: 140401 - RNA, 64 nt, hsa
aauaguuuaagcuuuauucauucaugcaauacuaaagagaaauaagaauacugcaauuuugugc

SEQ ID NO: 140402 - RNA, 64 nt, hsa
aagucacuccuaguaucuauuucaccaucuacagaagagaaauacuucacagaauuauuguggg

SEQ ID NO: 140403 - RNA, 64 nt, hsa
auucacuguuagagaguguaggcgcugcaggagaaagagaaagugcccacgaaaauuagucuag

SEQ ID NO: 140404 - RNA, 64 nt, hsa
acugucauuuaaggcugugcuugugcuuuauacaaagagaaagagguggucuuaaggggaugcu

SEQ ID NO: 140405 - RNA, 64 nt, hsa
cugaugcauuaauaaaagcagccaaauagggccaaagagaaaaauaacaggacucuguacugga

SEQ ID NO: 140406 - RNA, 64 nt, hsa
aaauccagacuugggggucauuguguugcuacccaagagaaaaugcuacaguuuuauagauugc

SEQ ID NO: 140407 - RNA, 64 nt, hsa
cugcagccaccagugggagagacaagccaguccuaagagaaaaggugguggcagccacaaauuc

SEQ ID NO: 140408 - RNA, 64 nt, hsa
ggcgggaggugaaaggcacuucuuacauggcagcaagagaaaaugaggaagaagcaaaagugga

SEQ ID NO: 140409 - RNA, 64 nt, hsa
acuggggugagaagagauaagagaaaugaaagagaagagaaaugggacaucuaauagucccuaa

SEQ ID NO: 140410 - RNA, 64 nt, hsa
uguagcgauucguuacacuggggugagaagagauaagagaaaugaaagagaagagaaaugggac

SEQ ID NO: 140411 - RNA, 64 nt, hsa
agauuggaaagaauuucauaugcaaagcauauuaaagagaaagcccgcuuuagucaauacuuuu

SEQ ID NO: 140412 - RNA, 64 nt, hsa
gacuugcauuuaaaugugacauucuuaaaaaaagaagagaaagaauuuuaagaguagcaguaua

SEQ ID NO: 140413 - RNA, 64 nt, hsa
ugggcaacagagugagacccugucuccaaagagaaagagaaacuugagaaggcuugugcccaaa

SEQ ID NO: 140414 - RNA, 64 nt, hsa
ccagccugggcaacagagugagacccugucuccaaagagaaagagaaacuugagaaggcuugug

SEQ ID NO: 140415 - RNA, 64 nt, hsa
uuaaagagacugguagcucaucauccuaccauaaaagagaaaaaaauucggaaagugaucagag

SEQ ID NO: 140416 - RNA, 64 nt, hsa
gaaaaucuuaaaagagaacacaccaaaaaagugaaagagaaauugaaagggaaaaaagacaaaa

SEQ ID NO: 140417 - RNA, 64 nt, hsa
gagauugaugacaagcaaguuacucaggaaucaaaagagaaaaaaguuucugaaaacaaugaaa

SEQ ID NO: 140418 - RNA, 64 nt, hsa
gaaagaagcaaaugacuauucucugaagacaaccaagagaaaauugcaaaaagacaaguaugac

SEQ ID NO: 140419 - RNA, 64 nt, hsa
aacuuagaaguguuucuaagagaacagaaguaauaagagaaacaguuacguguggaauucaaca

SEQ ID NO: 140420 - RNA, 64 nt, hsa
gguucuccuagcugcagcaauacuuugacauuuaaagagaaauuuagagaauauucucauccuc

SEQ ID NO: 140421 - RNA, 64 nt, hsa
aucuugaaucccauuguccuauaguccuagcaauaagagaaauuuccucaaguuuccaugugcg

SEQ ID NO: 140422 - RNA, 64 nt, hsa
uaucaaaacaucucuaagauacaguauuuaguaaaagagaaaguuucaggaaauaaaacuacau

SEQ ID NO: 140423 - RNA, 64 nt, hsa
gauuuuuuuuuuuuaaguaagaagggaacuguaaaagagaaaaaaagaaauucaugcauagcuu

SEQ ID NO: 140424 - RNA, 64 nt, hsa
gaccagggucucacacccuggaggaauguuaaguaagagaaagaaccucuuuccugaauauuga

SEQ ID NO: 140425 - RNA, 64 nt, hsa
aaaaacaugauuucucuaauuuuccaacuagaggaagagaaacuuguggaaaaguucuuuuuuu

SEQ ID NO: 140426 - RNA, 64 nt, hsa
ugcauguuuguuaaaaaaacaaacacauguuuugaagagaaaccagaucugaacauguauuugu

SEQ ID NO: 140427 - RNA, 64 nt, hsa
gguguugccuugccuugcaugaugcugggggaaaaagagaaaagaaaugguuuucuuuuuguac

SEQ ID NO: 140428 - RNA, 64 nt, hsa
ucagucuuuucuaaucauaagauaauucacacugaagagaaacugcaaacguggaaagugugac

SEQ ID NO: 140429 - RNA, 64 nt, hsa
aagcuugcaaccacacucaaucuauucuaaauauaagagaaaugauauuggugagaagccacaa

SEQ ID NO: 140430 - RNA, 63 nt, hsa
cauuuuuuuccuccugguaguaaaugucagaguaagagaaacaaacuguuuagaauuaucaug

SEQ ID NO: 140431 - RNA, 64 nt, hsa
aguaauuaaaaugugccuuuugaagauguuuucuaagagaaaggaaauacguugcagugaugug

SEQ ID NO: 140432 - RNA, 64 nt, hsa
aauauaaagugaaugccuuuagggguagcucugaaagagaaacccaacaacuucauuccuagcc

SEQ ID NO: 140433 - RNA, 64 nt, hsa
gacuuaaguuugugaagguguggugggugaaacuaagagaaauguagcauuagcucucacaaaa

SEQ ID NO: 140434 - RNA, 64 nt, hsa
uauuucaccuuuguuuggaaauccuucccuuuuaaagagaaaaugugacacuugugaaaaggcu

SEQ ID NO: 140435 - RNA, 52 nt, hsa
guggaaacaaggaaaacugauuaagagaaaugagcacgcauggaaaaguuuc

SEQ ID NO: 140436 - RNA, 64 nt, hsa
aauuuguucuuccugauaugauaacuaggucuccaagagaaaauagaaaggcugcuuuagugcc

SEQ ID NO: 140437 - RNA, 64 nt, hsa
ccuccaguucucccugaugacaguagcugucuccaagagaaaaauccucacuuauuaacucucu

SEQ ID NO: 140438 - RNA, 64 nt, hsa
ggggcugaaaaacugaauaaggaaacaacuuuauaagagaaacaguggucuucaaucuuuuaaa

SEQ ID NO: 140439 - RNA, 64 nt, hsa
aaagaaaggaauacuuuuguuagaaugagaauuaaagagaaaacaaaagaaucuuggcaaaauu

SEQ ID NO: 140440 - RNA, 64 nt, hsa
ucgcuguuuguuguuucauagauuuauuuaaaaaaagagaaagucuauagcuauaaaucuuuaa

SEQ ID NO: 140441 - RNA, 64 nt, hsa
aaaaaaagagaaagucuauagcuauaaaucuuuaaagagaaauaugaauacaauuccccuaaac

SEQ ID NO: 140442 - RNA, 64 nt, hsa
caacauuuucuuagaggagagagagaaauauuaaaagagaaaugaaacaauagaguauuuuggg

SEQ ID NO: 140443 - RNA, 64 nt, hsa
gugcacuggcaaugcuauuuuagagucugcagagaagagaaagcauguugcuuaaacauccuuc

SEQ ID NO: 140444 - RNA, 64 nt, hsa
aauguccuuugauuuuuuuuaauacauuaagagaaagagaaauauauauauauccacccccagc

SEQ ID NO: 140445 - RNA, 64 nt, hsa
acgugcaauguccuuugauuuuuuuuaauacauuaagagaaagagaaauauauauauauccacc

SEQ ID NO: 140446 - RNA, 64 nt, hsa
accugacuugcuaugaaaaaacucaucacacaagaagagaaacaguaaccucacuuugaaaauu

SEQ ID NO: 140447 - RNA, 64 nt, hsa
aauguaaggaaagcuuaaauucuuguaucuuuaaaagagaaaaucuuauuuaacccuuuugugu

SEQ ID NO: 140448 - RNA, 64 nt, hsa
ucuguuucacuguuugcuuucuccugucaugguuaagagaaaugugcaauucgauccucaauca

SEQ ID NO: 140449 - RNA, 64 nt, hsa
cugaugaguacagaaaaaaaaagaaaaagaaaagaagagaaaaaauuaagaaaaaaaucaaaaa

SEQ ID NO: 140450 - RNA, 64 nt, hsa
acugaaaaggggugggaguuggaaaucagaaagaaagagaaauauuucauuauguuaaugaaga

SEQ ID NO: 140451 - RNA, 64 nt, hsa
agaaagagaaauauuucauuauguuaaugaagaaaagagaaaauugaagcauaaauguauuuuu

SEQ ID NO: 140452 - RNA, 64 nt, hsa
aauuauuuaaaguguggaaagcaaaauaacaaaaaagagaaacgccaacaaaaaucagcagaug

SEQ ID NO: 140453 - RNA, 64 nt, hsa
cucaccucccaaucaccccaaacaaauggaagagaagagaaaggacauggcguauuuuguauuu

SEQ ID NO: 140454 - RNA, 64 nt, hsa
cauuuuaucagggcccaacauguggcaugcaaugaagagaaaauguaaagcuacagagguuaau

SEQ ID NO: 140455 - RNA, 64 nt, hsa
gagaggacaaagcaaguuggaagcugcaggugucaagagaaaugcucucaauaccaaccaggga

SEQ ID NO: 140456 - RNA, 64 nt, hsa
ccuucggcagcauuccagaacaggagggaagagaaagagaaaacuuucuucccuucuacuaaaa

SEQ ID NO: 140457 - RNA, 64 nt, hsa
acaugcccuucggcagcauuccagaacaggagggaagagaaagagaaaacuuucuucccuucua

SEQ ID NO: 140458 - RNA, 64 nt, hsa
uagucauaguaaagucucagucugaauauuuagcaagagaaacaggcagcagaggaacccaaag

SEQ ID NO: 140459 - RNA, 64 nt, hsa
acacaaagaugaccacaaggggcccaaaacagaaaagagaaacacaagcucaccucuuggagcu

SEQ ID NO: 140460 - RNA, 64 nt, hsa
gcaacauuaauugaagcaucaaaaauaaauggcaaagagaaaucaggacaaaaaaucuaauugc

SEQ ID NO: 140461 - RNA, 64 nt, hsa
uacaacaugacaagcugugaguuuguguguuuguaagagaaaaauguguggguacuugcuaaua

SEQ ID NO: 140462 - RNA, 64 nt, hsa
cuucagaaugcauccuuugagauuauguccacuuaagagaaaucaucaguuaagaaaucuacuu

SEQ ID NO: 140463 - RNA, 64 nt, hsa
ucauaccuacuugaacaucagaggguccaucaugaagagaaagccuaugaguaugaugaauaug

SEQ ID NO: 140464 - RNA, 64 nt, hsa
ucaugccuuauucagcaucacaaaaugcauaggaaagagaaaucguaugaauguaaugaguaug

SEQ ID NO: 140465 - RNA, 64 nt, hsa
ccgcuauauugugauuugggaagagaaaguuaucaagagaaagaggugaggauggaaggaugga

SEQ ID NO: 140466 - RNA, 64 nt, hsa
gaaaaugaaaaaguccgcuauauugugauuugggaagagaaaguuaucaagagaaagaggugag

SEQ ID NO: 140467 - RNA, 64 nt, hsa
gauagauguaguuccuucccuuguggcaugucauaagagaaacagaugugcauauacacacaau

SEQ ID NO: 140468 - RNA, 64 nt, hsa
uaaugauuggaaugggcuauaagauauugugcugaagagaaaacaguuguucuguucacugcuu

SEQ ID NO: 140469 - RNA, 64 nt, hsa
ucagggugauaaacagaauauucuucuguagaggaagagaaaggagugaaaguuuagcccacug

SEQ ID NO: 140470 - RNA, 64 nt, hsa
aagaaugagaagcuugaaugggcaguagaugaugaagagaaaaaaaagucucccucagaaagua

SEQ ID NO: 140471 - RNA, 64 nt, hsa
ugcauuuuuuuguuugcauauuaaaaaaagagaaaagagaaagcaagagacagaaaucaggacu

SEQ ID NO: 140472 - RNA, 64 nt, hsa
ucauuuuugcauuuuuuuguuugcauauuaaaaaaagagaaaagagaaagcaagagacagaaau

SEQ ID NO: 140473 - RNA, 64 nt, hsa
uccgugagagucaucucaaacacugcuuaaggaaaagagaaacacuaauggccaaguguacauu

SEQ ID NO: 140474 - RNA, 64 nt, hsa
aguaauaacuguuagaauuagguaauggauaugaaagagaaaaugcuuucucaugcauagacaa

SEQ ID NO: 140475 - RNA, 64 nt, hsa
gagccugcaguuauguacauuuuguccuuuccguaagagaaaaaugaggacuuuggaaauucag

SEQ ID NO: 140476 - RNA, 64 nt, hsa
ccaguuguagucaaaaugcuacaauaaaacaaaaaagagaaagaaaaugaagagcauuugacuc

SEQ ID NO: 140477 - RNA, 64 nt, hsa
cuacaccucagcagccucccccaugcaaaaaggaaagagaaaaauuaaguuagggcagucagua

SEQ ID NO: 140478 - RNA, 64 nt, hsa
uuuaauaaaaaucuuugagcaagugaguuauggcaagagaaacucagccucuuucuguauaaac

SEQ ID NO: 140479 - RNA, 64 nt, hsa
uccccccaucagacucuggacacccaggaaucaaaagagaaaggacuuuuuuggugacucaauc

SEQ ID NO: 140480 - RNA, 64 nt, hsa
caaucuauucuacaugaggaggcugagaaaggggaagagaaaaacaaaccaaauggaugauguu

SEQ ID NO: 140481 - RNA, 64 nt, hsa
augaaaccuacaguugacaagagaauguacagcuaagagaaaagcuuaagaggccacacuauuc

SEQ ID NO: 140482 - RNA, 64 nt, hsa
uuuuccauagcuccucacuuuuuagcccuucugcaagagaaaaacccucauggguccacauggu

SEQ ID NO: 140483 - RNA, 64 nt, hsa
cugugugaaagaaagaaaaagaaagaaagaaagaaagagaaaggaaauuauaaggucaaguuaa

SEQ ID NO: 140484 - RNA, 64 nt, hsa
cagagguauaacugaauaagaaauuuuuuuaagcaagagaaagacaacuguucugcggguugga

SEQ ID NO: 140485 - RNA, 64 nt, hsa
cacugcgcccggcccgagaaaauacaguuuuaaaaagagaaagcuuuauaaccucaccaaugaa

SEQ ID NO: 140486 - RNA, 64 nt, hsa
gggaggcaaaaagcacuucuuacauggcggcagcaagagaaaaugagaaagaagcaaaagugga

SEQ ID NO: 140487 - RNA, 64 nt, hsa
gggaggugaaaagcacuucguacauggugguggcaagagaaaaugaagaagaagcaaaagugga

SEQ ID NO: 140488 - RNA, 64 nt, hsa
aaaccccucugucaugccucuuuaaagagaaaagaagagaaagauuuuuuuuuuuuuuaauggc

SEQ ID NO: 140489 - RNA, 64 nt, hsa
gcuguuggucaaaccccucugucaugccucuuuaaagagaaaagaagagaaagauuuuuuuuuu

SEQ ID NO: 140490 - RNA, 64 nt, hsa
aagauaaaauuugauacagguuuggugucauuauaagagaaaucauuauuaaaugaagcaaguu

SEQ ID NO: 140491 - RNA, 64 nt, hsa
gagcagguagcccaaaauagagaaagauuagauaaagagaaaauaaguauccaucagagacagu

SEQ ID NO: 140492 - RNA, 64 nt, hsa
guauccaucagagacaguaucucuaggcuugggcaagagaaaaguccacagugauaagcaacuc

SEQ ID NO: 140493 - RNA, 64 nt, hsa
uguagccucagguuugaaucagucaccuagggguaagagaaaaaccacaacauaagaccugaaa

SEQ ID NO: 140494 - RNA, 64 nt, hsa
gaaauuuuaggacuugaggacgugaacaacuugaaagagaaaauugauuccccuugaggaaaga

SEQ ID NO: 140495 - RNA, 64 nt, hsa
agaguccuuugggauucuaggaaacccaaggaacaagagaaaaaacuagagccugugcuaaaga

SEQ ID NO: 140496 - RNA, 64 nt, hsa
uuugaaacccauuaggcaugccuaauauuuaggcaagagaaaauaaaccaagauagauccauuu

SEQ ID NO: 140497 - RNA, 64 nt, hsa
uugauauuauuguuauuaucauuauuaauaaauaaagagaaaaggaauuuuuguuuaaaugaga

SEQ ID NO: 140498 - RNA, 64 nt, hsa
gcuucuggcacuuagaaaacaaaaagaacaaaaaaagagaaacccccaagccuggaacgcagag

SEQ ID NO: 140499 - RNA, 64 nt, hsa
cuaaagggaaccugcaauaaucuugaaaaagaaaaagagaaaaauuuuaaaauccugcuauagg

SEQ ID NO: 140500 - RNA, 64 nt, hsa
agaaaaauuuuaaaauccugcuauaggagaaaaaaagagaaaaaaauaaaaaucaaaaaaaaaa

SEQ ID NO: 140501 - RNA, 64 nt, hsa
ucagaauaucaaagcgaaaacugauagaacuacaaagagaaauaaaauccauucucacggcagg

SEQ ID NO: 140502 - RNA, 64 nt, hsa
uugauaaaacauaaagguacaguggucuaugaggaagagaaaagguaccugaggaugcagaagu

SEQ ID NO: 140503 - RNA, 64 nt, hsa
ucuucuucuucuuuuuuuuuuuuuauaaaagcaaaagagaaauacauaaaaaaguguuuacccu

SEQ ID NO: 140504 - RNA, 64 nt, hsa
gcaauacauuuuuuucucuuuccuugaaaauaaaaagagaaacaaguauuuugcuauauauaaa

SEQ ID NO: 140505 - RNA, 64 nt, hsa
cgggaaaagcuggcccaggcgucuaaggagucaaaagagaaacagcuucaagcagaacguaaaa

SEQ ID NO: 140506 - RNA, 64 nt, hsa
ccuucgagcaaaagcaaagauccaccgagagaagaagagaaagaaaagaaaaagaaaaagcaca

SEQ ID NO: 140507 - RNA, 64 nt, hsa
uacuucaccaucauuucugacuuugaccagcuguaagagaaaugcagucaggagcacagcaucc

SEQ ID NO: 140508 - RNA, 64 nt, hsa
aaagaaagagccugacagaaugaguguaggaaggaagagaaaugaugcuacaucucagaaacuu

SEQ ID NO: 140509 - RNA, 64 nt, hsa
gagcagacaguuaagagaaaugagcuugaccuuuaagagaaaugagcugcacuccaugagugca

SEQ ID NO: 140510 - RNA, 64 nt, hsa
aaaacugauuacaacugcuacagagcagacaguuaagagaaaugagcuugaccuuuaagagaaa

SEQ ID NO: 140511 - RNA, 64 nt, hsa
uauuuuagccuuagagccuuacacuuguuucaugaagagaaaggacuugcauaaccaaaauaaa

SEQ ID NO: 140512 - RNA, 64 nt, hsa
uuacgugauagcauacaaagaagaaagcucuagaaagagaaauuauggagaaugauuauuuaaa

SEQ ID NO: 140513 - RNA, 64 nt, hsa
ggagcaacauaaugcucauagaaucuucuagaagaagagaaacaaagggauugauaaaaugcug

SEQ ID NO: 140514 - RNA, 64 nt, hsa
uggauaauagacaaagugaaaacauuuaaaaaggaagagaaacuucagccuuucuaaguugaua

SEQ ID NO: 140515 - RNA, 64 nt, hsa
aaaauucaaauaauuauaagcauuuggcaaaaacaagagaaaagaaacuugccauauuuuacaa

SEQ ID NO: 140516 - RNA, 64 nt, hsa
acucagcaguuugugccuccuacacagucaaagaaagagaaaaaagauaaaguagaaaaagaaa

SEQ ID NO: 140517 - RNA, 64 nt, hsa
uuuuccuacucuaauucaacuaaaguuauaaauaaagagaaaaacucauucagaaaucauggau

SEQ ID NO: 140518 - RNA, 64 nt, hsa
uugggucucauuuagaacuugcagcugauguuggaagagaaagcacgugucucagacugcaugu

SEQ ID NO: 140519 - RNA, 64 nt, hsa
uuuuaaaaaacuaaaccagaagagacuuuaaaauaagagaaagaaaucauaaauguagacauau

SEQ ID NO: 140520 - RNA, 64 nt, hsa
cuggacccauguuuaaauacaguuuuauuucaugaagagaaaugaaaaccccuacacugauauc

SEQ ID NO: 140521 - RNA, 64 nt, hsa
guuaugagaauaucaguugguauaaagagagagaaagagaaaaacauuucagcccuuagaugag

SEQ ID NO: 140522 - RNA, 64 nt, hsa
aaccccugagaaaugaacauugguaggagcauuuaagagaaaacuugcuuauuugcuaaugccu

SEQ ID NO: 140523 - RNA, 64 nt, hsa
uguuacuuucaaugugaggaaugaaugauaaauuaagagaaaaaaauaucaggaaggucaauau

SEQ ID NO: 140524 - RNA, 64 nt, hsa
uauugacuaauaagggaauauguauggaagaaggaagagaaagccuuugucuagcauuuauuag

SEQ ID NO: 140525 - RNA, 64 nt, hsa
uagcuugggaugagaugugugugaaaguauguacaagagaaaacggaagagagaggaaaugagg

SEQ ID NO: 140526 - RNA, 64 nt, hsa
cauccuuuacauucaguuaagaucaaaccucacaaagagaaauagaauguuugaaaggcuaucc

SEQ ID NO: 140527 - RNA, 64 nt, hsa
aaaugagguuuuguuucaccuguuuugcagcaguaagagaaacuagugcugcaagaauguauuu

SEQ ID NO: 140528 - RNA, 64 nt, hsa
agggaaaagauucuuuauuccaauuuccagagagaagagaaaacucacccaggaaguuuaaaaa

SEQ ID NO: 140529 - RNA, 64 nt, hsa
ugcaaagaagggagagaagguacccaaagggaaaaagagaaaagcugaugcuggcaaggagcgg

SEQ ID NO: 140530 - RNA, 64 nt, hsa
cccacaucccgccgccgccgccgccgccaugcccaagagaaagacugaaggggaugcuaaagga

SEQ ID NO: 140531 - RNA, 64 nt, hsa
augacaauauccuuacacauuugucauacuaucaaagagaaagaaacaagauuuccauucccac

SEQ ID NO: 140532 - RNA, 64 nt, hsa
uuauguauagcuucuaaaaggggaaaaaaaaaaaaagagaaacccuuugacuuccacgugccca

SEQ ID NO: 140533 - RNA, 64 nt, hsa
uuuuuuccggcuuaagccuuaagugccaaaucacaagagaaaaagcaguaacaguuuacagaag

SEQ ID NO: 140534 - RNA, 64 nt, hsa
auguuaaaagccuuaaucucauuuggguacucaaaagagaaaucagaguuuauucugguuaacu

SEQ ID NO: 140535 - RNA, 64 nt, hsa
agacucaguuuuauugagguagauacagguuuagaagagaaaagagcaacagauuuucagcguu

SEQ ID NO: 140536 - RNA, 64 nt, hsa
uacgauuacuugcuauuggcccucggauacauuuaagagaaagagacagucacucuuuuuuuuc

SEQ ID NO: 140537 - RNA, 64 nt, hsa
uucuuuaauggcgggggcggggggcggggguacaaagagaaaucucuaaaagaauaugaucuuc

SEQ ID NO: 140538 - RNA, 64 nt, hsa
caaugcauggauuccuuugaagaaaaaaaagaaaaagagaaaaaaaucacaaaaacaaacuuuu

SEQ ID NO: 140539 - RNA, 62 nt, hsa
ugacuuuugaauaauaaaaagaaaagugaagaguaagagaaauuguauuaguuguauguuuc

SEQ ID NO: 140540 - RNA, 64 nt, hsa
cauuuaaaggauuaaaacugagauuugaacaacaaagagaaaggcaagauaaucccaaacuuga

SEQ ID NO: 140541 - RNA, 64 nt, hsa
ucggcugugcaucgcauucgaggcuccuuuuuuaaagagaaaagcauaggccucuguucucauu

SEQ ID NO: 140542 - RNA, 64 nt, hsa
guccugaaguuugcugguucaggaaagaacaggaaagagaaaagccuucugugcccaggcuaaa

SEQ ID NO: 140543 - RNA, 64 nt, hsa
gugcugaugaaguccucuauaagcacaagccaaaaagagaaagagaaaaaaagguaauuauugu

SEQ ID NO: 140544 - RNA, 64 nt, hsa
uaauucuuaaaucccagcacaagccaaaaagagaaagagaaaaaaagguaauuauuguagaacc

SEQ ID NO: 140545 - RNA, 64 nt, hsa
auuuuccucauaucuuauuuaccuaggagcauguaagagaaagaagggagagaaaagguugcau

SEQ ID NO: 140546 - RNA, 64 nt, hsa
aaacauaaugaaagaaacaaacuccaguauggagaagagaaaguuuaauuauuugguuccaucu

SEQ ID NO: 140547 - RNA, 64 nt, hsa
acugauucacaauugaguuaaauuagacaacuguaagagaaaaauuuaugcuuuguauaauguu

SEQ ID NO: 140548 - RNA, 64 nt, hsa
uugaacugaacuuaguuuuuaaaguagcuuuuggaagagaaaugaggauuugcuaugcagacag

SEQ ID NO: 140549 - RNA, 64 nt, hsa
gcggcagcagcagccgcagcagccaaagagaggcaagagaaagagaaagcgggcgguggagggg

SEQ ID NO: 140550 - RNA, 64 nt, hsa
gcagcagccgcagcagccaaagagaggcaagagaaagagaaagcgggcgguggaggggucccgg

SEQ ID NO: 140551 - RNA, 64 nt, hsa
accuugucaauagguucuugaaaacuuguacuucaagagaaaugauguauaacaaaaccauacu

SEQ ID NO: 140552 - RNA, 64 nt, hsa
cuccauaccauuuggcucccaaauuuaaauaaacaagagaaaacgguguucaucuauuaaggac

SEQ ID NO: 140553 - RNA, 64 nt, hsa
gaagacuugaaagaaaggggcaggagcucagaugaagagaaauccuaaguuaccuuucuagguc

SEQ ID NO: 140554 - RNA, 64 nt, hsa
auugaaaaaagaaauucccuggaccagaugcugaaagagaaaagagggguugguaguuggcuau

SEQ ID NO: 140555 - RNA, 64 nt, hsa
uaggcuugaaauaauugacuugucuaaaaggacaaagagaaaaaaaaaauaccucaugacugca

SEQ ID NO: 140556 - RNA, 64 nt, hsa
agggaaguggagagcacaucccuguaaggcccauaagagaaagaggaguuuguuacauuuaauc

SEQ ID NO: 140557 - RNA, 64 nt, hsa
aggaaaacuuugaggaacauucaaugucaccugaaagagaaaugggaaaugagaacauuccaag

SEQ ID NO: 140558 - RNA, 64 nt, hsa
uuugucaauccuagccuuccaagagaagaaaaagaagagaaacuagaaacaguuaaagugucua

SEQ ID NO: 140559 - RNA, 64 nt, hsa
gacaccggacaaaccauugucuuggggagcccagaagagaaagugggcaggguggggucauugg

SEQ ID NO: 140560 - RNA, 64 nt, hsa
uggcugcuguguugggcauggauggagaaucagcaagagaaaugcuguauuaggacuaauaauc

SEQ ID NO: 140561 - RNA, 64 nt, hsa
auacccugggguaaguggaguugggaaauacaagaagagaaagaccaguggggauuuguaagac

SEQ ID NO: 140562 - RNA, 64 nt, hsa
auccuugcuaaguuuucauagaaaauaaggaacaaagagaaacuuguaauggucucugaaaagg

SEQ ID NO: 140563 - RNA, 64 nt, hsa
gaggaaacaucuuaccaucuggucauucauacugaagagaaacuccauaaguaucaucucugug

SEQ ID NO: 140564 - RNA, 64 nt, hsa
gggacauucaaacaaaggaggaggagucauagggaagagaaagaaauggaagcacagcuucuuu

SEQ ID NO: 140565 - RNA, 64 nt, hsa
aagggaacaucuuaccaucuggccauucacacugaagagaaacuucauaagcauccucucuuug

SEQ ID NO: 140566 - RNA, 64 nt, hsa
gggauauuuaaacaaaggaagaggaaauauagggaagagaaagaaaccacagcuucuuuuagac

SEQ ID NO: 140567 - RNA, 64 nt, hsa
uucacacuacagagaaacuugaaauauaaagaagaagagaaagccuucagugaugccucugugu

SEQ ID NO: 140568 - RNA, 64 nt, hsa
aauagcauucaguaacuccuauuaauucacucugaagagaaaccuuuugaggacaaucuguaug

SEQ ID NO: 140569 - RNA, 64 nt, hsa
auucagugauauuucucccauuugcuugugaaagaagagaaauguggcuuuguuccaccuggcu

SEQ ID NO: 140570 - RNA, 64 nt, hsa
cauuauuuauagauuaucugauucucuauguggaaagagaaaagaaucauauuaaguacuuugg

SEQ ID NO: 140571 - RNA, 64 nt, hsa
gagccacugcaccuagccucuauuuguuuuacaaaagagaaauugagauccugaauguuaagug

SEQ ID NO: 140572 - RNA, 64 nt, hsa
ucagauuucccauucagacgccccucucccaugcaagagaaagagcuguucuccuuucucuuuc

SEQ ID NO: 140573 - RNA, 64 nt, hsa
agaagcaagaaggaaagcaccagaagugauuuggaagagaaauccuaaaaugaaugugaacaac

SEQ ID NO: 140574 - RNA, 64 nt, hsa
uuuuauaauuucagaaaaacugcuuaagguugaaaagagaaauuuaagaaauugcugacggaau

SEQ ID NO: 140575 - RNA, 64 nt, hsa
ccaauuuucuggggcuccucacauagcuacccaaaagagaaaaaaaauuaagacaagccuggca

SEQ ID NO: 140576 - RNA, 64 nt, hsa
agaugugggcuuugauuuccaaguaauauaauggaagagaaaucucauacucccccacaguuug

SEQ ID NO: 140577 - RNA, 64 nt, hsa
uuuauaaaauuagaaagcaacuuaucagcuacuuaagagaaauggcaaguuuugauaugaguau

SEQ ID NO: 140578 - RNA, 64 nt, hsa
ucugggaucaguuauaauauauauuuuuuuuagaaagagaaaaugagcugagaguuuacaggca

SEQ ID NO: 140579 - RNA, 64 nt, hsa
uacuuggggagagaucaguagcauuugaggaaguaagagaaaagaaucaugguaccucaggguu

SEQ ID NO: 140580 - RNA, 64 nt, hsa
cacagaaagucuuaggaucaugaacucugaaaaaaagagaaaccuuaucuuugcuuugugguuc

SEQ ID NO: 140581 - RNA, 64 nt, hsa
ccuaaaagggaaaaaacaauauccuuguuuacagaagagaaacaaacaagccccacucagcuca

SEQ ID NO: 140582 - RNA, 64 nt, hsa
aaaugaaaauuuuaacuggaauugucugauauuuaagagaaacauucaggaccucaucauuaug

SEQ ID NO: 140583 - RNA, 64 nt, hsa
uaccuguauuuaaaaauagaaacauaucaaaaacaagagaaaagacacgagagagacuguggcc

SEQ ID NO: 140584 - RNA, 64 nt, hsa
aauauucuuuguuuagagguacuuguuuuuuauuaagagaaaaaccaguguaacguuuauguga

SEQ ID NO: 140585 - RNA, 64 nt, hsa
gcaagggcuccuccaggauugcaaaaaaaaaaggaagagaaaagaugaaccuuuaagcaaauaa

SEQ ID NO: 140586 - RNA, 64 nt, hsa
cagauuauguauaaucauauaugauauauucacaaagagaaaacaaaaggaacuuuuaaaaaaa

SEQ ID NO: 140587 - RNA, 64 nt, hsa
aguguucuucuuucacacuucucaaaagugacacaagagaaauccaguucaccuacagagguag

SEQ ID NO: 140588 - RNA, 64 nt, hsa
agcuuauauaugacgguauauuuacaaaaagagaaagagaaaaucugguauuugcaaugaucug

SEQ ID NO: 140589 - RNA, 64 nt, hsa
aauuuuagcuuauauaugacgguauauuuacaaaaagagaaagagaaaaucugguauuugcaau

SEQ ID NO: 140590 - RNA, 64 nt, hsa
ugucccuuucccugccagcaaaccccaccacccuaagagaaauuuuagcuuauauaugacggua

SEQ ID NO: 140591 - RNA, 64 nt, hsa
ucugaacaacacuaacaugagaacacaagaacuuaagagaaaaagaaaccuacucaagaaaaga

SEQ ID NO: 140592 - RNA, 64 nt, hsa
cugagaaaagaacauaagaacucaaggagaacauaagagaaaaggaaaccuguuacagaaaaga

SEQ ID NO: 140593 - RNA, 64 nt, hsa
guacccuccgagaaagaagaacguaagcacaggaaagagaaaaagaaaucuguugaagaaagga

SEQ ID NO: 140594 - RNA, 64 nt, hsa
ugaccaucaagcaggucauaaacagaaacaucagaagagaaaacgacaccuagaagaaggcaaa

SEQ ID NO: 140595 - RNA, 64 nt, hsa
cucagugccacucaccccucccuccccaaaagacaagagaaauuuggccagauggggaagguca

SEQ ID NO: 140596 - RNA, 64 nt, hsa
gagauggccucagagucuuuuccauucaguaagaaagagaaagggaaugcaggccaguuacuua

SEQ ID NO: 140597 - RNA, 64 nt, hsa; identical to SEQ ID NO: 124497

SEQ ID NO: 140598 - RNA, 64 nt, hsa; identical to SEQ ID NO: 124498

SEQ ID NO: 140599 - RNA, 64 nt, hsa; identical to SEQ ID NO: 124499

SEQ ID NO: 140600 - RNA, 64 nt, hsa; identical to SEQ ID NO: 124500

SEQ ID NO: 140601 - RNA, 64 nt, hsa; identical to SEQ ID NO: 124501

SEQ ID NO: 140602 - RNA, 64 nt, hsa; identical to SEQ ID NO: 124502

SEQ ID NO: 140603 - RNA, 64 nt, hsa; identical to SEQ ID NO: 124503

SEQ ID NO: 140604 - RNA, 64 nt, hsa; identical to SEQ ID NO: 124504

SEQ ID NO: 140605 - RNA, 64 nt, hsa; identical to SEQ ID NO: 124505

SEQ ID NO: 140606 - RNA, 64 nt, hsa; identical to SEQ ID NO: 124506

SEQ ID NO: 140607 - RNA, 64 nt, hsa; identical to SEQ ID NO: 124507

SEQ ID NO: 140608 - RNA, 64 nt, hsa; identical to SEQ ID NO: 124508

SEQ ID NO: 140609 - RNA, 64 nt, hsa; identical to SEQ ID NO: 124509

SEQ ID NO: 140610 - RNA, 64 nt, hsa; identical to SEQ ID NO: 124510

SEQ ID NO: 140611 - RNA, 64 nt, hsa; identical to SEQ ID NO: 124511

SEQ ID NO: 140612 - RNA, 64 nt, hsa; identical to SEQ ID NO: 124512

SEQ ID NO: 140613 - RNA, 64 nt, hsa; identical to SEQ ID NO: 124513

SEQ ID NO: 140614 - RNA, 64 nt, hsa; identical to SEQ ID NO: 124514

SEQ ID NO: 140615 - RNA, 64 nt, hsa; identical to SEQ ID NO: 124515

SEQ ID NO: 140616 - RNA, 64 nt, hsa; identical to SEQ ID NO: 124516

SEQ ID NO: 140617 - RNA, 64 nt, hsa
uacauauaccauguaaacucucaaacucuauuuagcugugaaauaguggugugcaauuccuugu

SEQ ID NO: 140618 - RNA, 64 nt, hsa
aauaacaauugacauuccuugagcaaaauauacugcugugaauuugcaaacaagaaaucugagc

SEQ ID NO: 140619 - RNA, 64 nt, hsa
cagcaaguagcuacugguucacgugcaguuuggggcugugaaaccuaggcagaaggcggcuguc

SEQ ID NO: 140620 - RNA, 64 nt, hsa
uuagugccaccaccuucugaacacaguggggagggcugugaaggcucaugugaccuggaucuga

SEQ ID NO: 140621 - RNA, 64 nt, hsa
uuguuuccauagccuuuuauaaugcauauaugaugcugugaacagaaauaaauuauuuauacaa

SEQ ID NO: 140622 - RNA, 64 nt, hsa
guucuggggggaccaccucuccuugcauucaggggcugugaagcugaguaauuuucggucacag

SEQ ID NO: 140623 - RNA, 64 nt, hsa
cuguagaagacaauuaauuuauuguagagaaguggcugugaaagucguucucugucuuuaaaaa

SEQ ID NO: 140624 - RNA, 64 nt, hsa
uuaugcuuuguugccucugagggucuuuagaccugcugugaaaggaucacauuuguuguggugc

SEQ ID NO: 140625 - RNA, 64 nt, hsa
ugaucacaguggcgagaggagaggaaaaacgaucgcugugaaaaugaggaggauugcuucuugu

SEQ ID NO: 140626 - RNA, 64 nt, hsa
gagcuuguauauacuucacucacuuuucuuuauugcugugaauagucugugugcacaaugggca

SEQ ID NO: 140627 - RNA, 64 nt, hsa
gugaaugugccaacacuaagcugucucgagccaagcugugaaaacccuagacgcacccgcaggg

SEQ ID NO: 140628 - RNA, 64 nt, hsa
ugacuucccaaccuacagcauugacgccaacuuggcugugaaggaagaggaaaggaucuggccu

SEQ ID NO: 140629 - RNA, 64 nt, hsa
auguuauagguuaaggagacaguuccuggguuuagcugugaaacuguuuaggauuuucuuuaag

SEQ ID NO: 140630 - RNA, 64 nt, hsa
ucuguacaacuucacagauggaaucuuguuuaaggcugugaaguuuuaaggaauaaauaauaua

SEQ ID NO: 140631 - RNA, 64 nt, hsa
cgccccaccuugcagcuaaaugugauccugccuugcugugaaauuucuguaccuucaaccuggu

SEQ ID NO: 140632 - RNA, 64 nt, hsa
gcacuccccacccugcucccuucccagagggauugcugugaaauuuuuuugguggcaaauaaag

SEQ ID NO: 140633 - RNA, 64 nt, hsa
ugaaacuucucuauuggagugucuguuucuuuaagcugugaauacugaaauuaugccuugucuc

SEQ ID NO: 140634 - RNA, 64 nt, hsa
auggucugagacuaaguaaaggaaauuuccuaaagcugugaaauuugaauuuugcuuuaaauaa

SEQ ID NO: 140635 - RNA, 64 nt, hsa
gaugacauagccaauggacaagcagugucugucagcugugaaggcuucacucuuauuguccuuc

SEQ ID NO: 140636 - RNA, 64 nt, hsa
ucacagaccucugcuuggaguauuuaggaugacugcugugaaauggagaacaguuucaucagga

SEQ ID NO: 140637 - RNA, 64 nt, hsa
aagagggauaaaccuuuggaggggucaugaugcugcugugaagauaaaaguagaauauaaaagc

SEQ ID NO: 140638 - RNA, 64 nt, hsa
gauuucguaguauauucagagcuuucuuuuaagagcugugaaugaaacuuuuucuaagcacuau

SEQ ID NO: 140639 - RNA, 64 nt, hsa
cuggccgccacgcagaauaccucgaaccaggcgggcugugaaccagccccgcucaccugccagc

SEQ ID NO: 140640 - RNA, 64 nt, hsa
auucccacuccccuuuggccucccuguacucugagcugugaauauuuuuaacccuguaaauacg

SEQ ID NO: 140641 - RNA, 64 nt, hsa
gcacaugcacuacugaaauuuacacaaaaagaaagcugugaaauugaagucccaauuuaagagu

SEQ ID NO: 140642 - RNA, 64 nt, hsa
uugugucuuaagaaaaauaaucuuagaacagauggcugugaaaauuacacccaugcacagaaca

SEQ ID NO: 140643 - RNA, 64 nt, hsa
gugauugaaggagaggauugaggguggaaggugggcugugaagacuuuuugggggcauccugga

SEQ ID NO: 140644 - RNA, 64 nt, hsa
cugcuguguugugugugcuagagagacuuacagggcugugaaagagugaccuuugucagugucc

SEQ ID NO: 140645 - RNA, 64 nt, hsa
gcugugaauggccuaggggcugagucccacaccagcugugaauucuccugcagacaggagggcc

SEQ ID NO: 140646 - RNA, 64 nt, hsa
ccccgugcugaaugaauguacagagccagacaaagcugugaauggccuaggggcugagucccac

SEQ ID NO: 140647 - RNA, 64 nt, hsa; identical to SEQ ID NO: 91418

SEQ ID NO: 140648 - RNA, 64 nt, hsa; identical to SEQ ID NO: 91419

SEQ ID NO: 140649 - RNA, 56 nt, hsa; identical to SEQ ID NO: 91420

SEQ ID NO: 140650 - RNA, 64 nt, hsa; identical to SEQ ID NO: 91421

SEQ ID NO: 140651 - RNA, 64 nt, hsa; identical to SEQ ID NO: 91422

SEQ ID NO: 140652 - RNA, 64 nt, hsa; identical to SEQ ID NO: 91423

SEQ ID NO: 140653 - RNA, 64 nt, hsa; identical to SEQ ID NO: 91424

SEQ ID NO: 140654 - RNA, 64 nt, hsa; identical to SEQ ID NO: 91425

SEQ ID NO: 140655 - RNA, 64 nt, hsa; identical to SEQ ID NO: 91426

SEQ ID NO: 140656 - RNA, 64 nt, hsa; identical to SEQ ID NO: 91427

SEQ ID NO: 140657 - RNA, 64 nt, hsa; identical to SEQ ID NO: 91428

SEQ ID NO: 140658 - RNA, 64 nt, hsa; identical to SEQ ID NO: 91429

SEQ ID NO: 140659 - RNA, 64 nt, hsa; identical to SEQ ID NO: 91430

SEQ ID NO: 140660 - RNA, 64 nt, hsa; identical to SEQ ID NO: 91431

SEQ ID NO: 140661 - RNA, 64 nt, hsa; identical to SEQ ID NO: 91432

SEQ ID NO: 140662 - RNA, 64 nt, hsa; identical to SEQ ID NO: 91433

SEQ ID NO: 140663 - RNA, 64 nt, hsa; identical to SEQ ID NO: 91434

SEQ ID NO: 140664 - RNA, 64 nt, hsa; identical to SEQ ID NO: 91435

SEQ ID NO: 140665 - RNA, 64 nt, hsa; identical to SEQ ID NO: 91436

SEQ ID NO: 140666 - RNA, 64 nt, hsa
cucagguguucucaccugguaaaauuguagaccucgaggcuaaguuucaaggagaucauauuca

SEQ ID NO: 140667 - RNA, 64 nt, hsa
gaauuuaauacuuugaagucaugagaugcaccaucgaggcuacccccaagaagaagcagaagag

SEQ ID NO: 140668 - RNA, 64 nt, hsa
ggaguuguggguugguaagcucccagguacuucccgaggcuauggugugagagcccccguccug

SEQ ID NO: 140669 - RNA, 64 nt, hsa
auaaauucaagaagauacacuuggcaucguguaucgaggcuaaguuuuucaugcauuucccaga

SEQ ID NO: 140670 - RNA, 64 nt, hsa
ggugaggcagaagcauugcuugagcuugggagaucgaggcuacagugagcuaugauuacaccac

SEQ ID NO: 140671 - RNA, 64 nt, hsa
gcuaaggcaggaggaucacuugagccccggaggucgaggcuacagugagccaagagugcacuac

SEQ ID NO: 140672 - RNA, 64 nt, hsa
uggcuccggccgguuguccuggcacacaaggaggcgaggcuaugcguucgaggccaaccuaggc

SEQ ID NO: 140673 - RNA, 64 nt, hsa
aucuggauuaccaaaaucacucugcagcccugcccgaggcuaguaggcugcaacccuggucccc

SEQ ID NO: 140674 - RNA, 64 nt, hsa
caucagcuccuuuacuaaagcugugcagagaauccgaggcuaugagugggggugggggaaagau

SEQ ID NO: 140675 - RNA, 64 nt, hsa
accucuagcccugguggcagaggucccucagcugcgaggcuaauugggugaccaccgauuccag

SEQ ID NO: 140676 - RNA, 64 nt, hsa
uuuuuuuguagagacggggguuuggccauguugccgaggcuaacuccugggauuacaggcauga

SEQ ID NO: 140677 - RNA, 64 nt, hsa
ggccccagcgaguuucccaggaguuagagggaugcgaggcuaacaaguuccaaaaacaucugcc

SEQ ID NO: 140678 - RNA, 64 nt, hsa
caaaacaggaagggggaaaaggugggauucaugucgaggcuagaggcauuuggaacaacaaauc

SEQ ID NO: 140679 - RNA, 64 nt, hsa
cuuuccgacugcccagaaaguggggguggaggaccgaggcuacagcuccacacgccccgguccc

SEQ ID NO: 140680 - RNA, 64 nt, hsa
aguccaugugcauccugagcugugugaucugccucgaggcuaugaucugagcaagcaggagaua

SEQ ID NO: 140681 - RNA, 64 nt, hsa
aucauauguuggccaggucucacugcagccugcccgaggcuaacuggcuagagccuccaggccc

SEQ ID NO: 140682 - RNA, 64 nt, hsa
agggcgguaauggugcccaccuuucgaggcauugcgaggcuagaugguaacacacagaaagcuc

SEQ ID NO: 140683 - RNA, 64 nt, hsa
cugccaugccuucggcaucagaggauggaguggucgaggcuaguggagucccagggaccgcugg

SEQ ID NO: 140684 - RNA, 64 nt, hsa
uuccccacagggccauacgcuggacgagucggaccgaggcuaggacguggccggcgcucuccag

SEQ ID NO: 140685 - RNA, 64 nt, hsa
uuggggagaaacugaagccguguuuuuggccccccgaggcuaacccugauccauagugcuaccu

SEQ ID NO: 140686 - RNA, 64 nt, hsa
ggggcauggcacaaauaagcucaucccucccguccgaggcuaguuuccucuggaaccacauuuu

SEQ ID NO: 140687 - RNA, 64 nt, hsa
gcccacuaugcagaggccaaaggucggcagccagcgaggcuaugaauuggaccuuuuugguauc

SEQ ID NO: 140688 - RNA, 64 nt, hsa
gacucacgccuguaaucccagcacuuugggagggcgaggcuagcagaucacuugagguuaggag

SEQ ID NO: 140689 - RNA, 64 nt, hsa
ccccgagucugcguccauuagagcacaguccacccgaggcuagcaccgugucugugucugucuc

SEQ ID NO: 140690 - RNA, 64 nt, hsa
agaagaugcuugggcuuggagggaggagggccggcgaggcuagcgaggggacaggagacggccc

SEQ ID NO: 140691 - RNA, 64 nt, hsa
cagccccuggggagggucuuuggggagggggugccgaggcuacgcauguccucgagggccgugu

SEQ ID NO: 140692 - RNA, 64 nt, hsa
gucccagcuacuugggaggcugagcccuggaggucgaggcuacagugagcuaugaucacaccau

SEQ ID NO: 140693 - RNA, 64 nt, hsa
ugucauuuuauuuggagguuuccugccuccuucccgaggcuacagcagacccccaugagagaag

SEQ ID NO: 140694 - RNA, 64 nt, hsa
gguggccaggaaguuucagguugaagggaaaugucgaggcuaccugcagauaugacaggugccu

SEQ ID NO: 140695 - RNA, 64 nt, hsa
gcugaggugggaggaucacuugagccuaugaggucgaggcuacagugagcaaagaucacgccac

SEQ ID NO: 140696 - RNA, 64 nt, hsa
cagguccucugagccggcgccccuggccagcaggcgaggcuacaguaccugcugucuuuccagg

SEQ ID NO: 140697 - RNA, 64 nt, hsa
uccguucagcugaacaggaggauggauacagccgcgaggcuaaaaaacggauuuccucuuccua

SEQ ID NO: 140698 - RNA, 64 nt, hsa
ggaauauacccaguguguguucuccccccucuuacgaggcuacauaacacaucuaugaugcugc

SEQ ID NO: 140699 - RNA, 64 nt, hsa
ggcaucugcagaauaucaucagggacaaagaucucgaggcuaacgauguagguuucauuucuca

SEQ ID NO: 140700 - RNA, 64 nt, hsa
uuuauggaacacuuaccacacggcugacgcugcgcgaggcuaagguucuaauacaccgcagcuc

SEQ ID NO: 140701 - RNA, 64 nt, hsa
ugcuggggccuccacaccugccucaucacggcggcgaggcuacgacaauccggcugggagcaug

SEQ ID NO: 140702 - RNA, 64 nt, hsa
auaagucaucagggaaugcaaauugaaaccacagcgaggcuaugacuuacuuaucucaauggcu

SEQ ID NO: 140703 - RNA, 64 nt, hsa
cugcaguauguugccaagagcccgucugcuccugcgaggcuaugagugggaugagugaugcccc

SEQ ID NO: 140704 - RNA, 64 nt, hsa
ugcuguacuauccugaggaauugcgagauauugcugaggggaaaaaaaaaugaccuuuucuuga

SEQ ID NO: 140705 - RNA, 64 nt, hsa
aauucaguggcuuugagucaaggccgguucuaauugaggggacccagugugcuucaguguuaag

SEQ ID NO: 140706 - RNA, 64 nt, hsa
agcaugucugaguuggaugggaaugaggaaggagugaggggaagaacagauucccuaaacuuuc

SEQ ID NO: 140707 - RNA, 64 nt, hsa
ugccccaggagagguaaugcaccccugaaggauaugaggggauggaagagagggcuggcugccc

SEQ ID NO: 140708 - RNA, 64 nt, hsa
auacuauuaaucaaagugcuugcuuucaguccuuugaggggacagauaaucugaaggccagaga

SEQ ID NO: 140709 - RNA, 64 nt, hsa
ucauguuuaagagcauugacagguggggcaccucugaggggaguucauuguuucucaugcauca

SEQ ID NO: 140710 - RNA, 64 nt, hsa
ccaggacaucgggcugcgugaaguccagugacccugaggggauuuuggccaaaggaaacagcca

SEQ ID NO: 140711 - RNA, 64 nt, hsa
gaggggcagugacuuccagagucccauccgucagugaggggacugggcugcgggaugggugagg

SEQ ID NO: 140712 - RNA, 64 nt, hsa
ucccuccuaaggaaaagggaguagcagauugaucugaggggaaagcacaggcugugcugucgag

SEQ ID NO: 140713 - RNA, 64 nt, hsa
ugcccuugcuggguuuuccuuuucuuugggacugugaggggaaaugguuuuuagaggugagggu

SEQ ID NO: 140714 - RNA, 64 nt, hsa
uucuggacacucaaacacaucauaauggauucacugaggggagacaaagggagccgagacccug

SEQ ID NO: 140715 - RNA, 64 nt, hsa
acaaaggcaguucaguccacaggcauggaagcugugaggggacaggccugugcgugccauccag

SEQ ID NO: 140716 - RNA, 64 nt, hsa
aauccagcugaugaguuacagccuguuaguaacaugaggggacauuuuggugagaaaugggacu

SEQ ID NO: 140717 - RNA, 64 nt, hsa
aaccagcuaagaaaagauuuuaaucaaguugaauugaggggauuaauaugaaaacuuaugaccu

SEQ ID NO: 140718 - RNA, 64 nt, hsa
cacccgguuucuccugauuauggcugcuguggggugaggggagggaggggcagccccgaggcag

SEQ ID NO: 140719 - RNA, 64 nt, hsa
augucaucguccagaugagaaaucuuagcccaggugaggggaguaacuugcuugaggucacaca

SEQ ID NO: 140720 - RNA, 64 nt, hsa
uuaggguaugaucucggucacgugucccgggcgcugaggggaaaggaagcgggcaugauuguag

SEQ ID NO: 140721 - RNA, 64 nt, hsa
aggcugggagcaaaugccccaugcggugagaggaugaggggagccuacgccucaggcauguggu

SEQ ID NO: 140722 - RNA, 64 nt, hsa
cagaggcuuaagaugggauacauggccugugcagugaggggaccuggguccuuugcuucugaga

SEQ ID NO: 140723 - RNA, 64 nt, hsa
caguggagaugagggaacggguagauggugugagugaggggaacuuuuagaguggaacugggca

SEQ ID NO: 140724 - RNA, 64 nt, hsa
aaggcaucauuuaguugggcagcuacucuguaucaggugcuaaccacuuuacauacauuaauuu

SEQ ID NO: 140725 - RNA, 64 nt, hsa
uuuuucuguuaaaaggggagauucucaagcuuccaggugcuaccauauggagccuaaggauaaa

SEQ ID NO: 140726 - RNA, 64 nt, hsa
uguucuuuuugcaaagacuugaauacauuggcagaggugcuaaucacaucuucccuaaggcacc

SEQ ID NO: 140727 - RNA, 64 nt, hsa
uugaauaaucauuguaaagcacuuuguauauauaaggugcuauauaagugugaaauaucauuca

SEQ ID NO: 140728 - RNA, 64 nt, hsa
ggcagucucucucuuccucacagucccacugugcaggugcuauuguuacucuuacgaauauuuu

SEQ ID NO: 140729 - RNA, 64 nt, hsa
uuuagaagcccaguaucagaacuugcuacguuucaggugcuagggacuuaaugaaaaacaggac

SEQ ID NO: 140730 - RNA, 64 nt, hsa
agagagaaaaacaauauaacuuucuugagugcaaaggugcuagacaacuaggagcccagcuggg

SEQ ID NO: 140731 - RNA, 64 nt, hsa
agagcuagucauggauaacagacuuuaaccaguuaggugcuagauccuaagaggcacucacaag

SEQ ID NO: 140732 - RNA, 64 nt, hsa
uuuuuuguggauggggacuugugaauuuuucuaaaggugcuauuuaacaugggaggagagcgug

SEQ ID NO: 140733 - RNA, 64 nt, hsa
ggcaggguggaagcggcuccccauuuuauaccaaaggugcuacaucuaugugauggguggggug

SEQ ID NO: 140734 - RNA, 59 nt, hsa
gcccuccucucccaagaaauccaggcuccucucccaagaaauccaggugcuuuccagac

SEQ ID NO: 140735 - RNA, 59 nt, hsa
agaacugauuggggcuuccacagcccuccucucccaagaaauccaggcuccucucccaa

SEQ ID NO: 140736 - RNA, 59 nt, hsa
uuuuuaagauuaaaaaugaauaccuuaaaucucccaaaagagauaaccaguaucugaag

SEQ ID NO: 140737 - RNA, 59 nt, hsa
ccugaccgcaagugauccacacgccuuggucucccaaagugcugggauuacgguguuag

SEQ ID NO: 140738 - RNA, 59 nt, hsa
acugcagccccacuucuguuucccuggagucucccaauggaucauucaggaguguccua

SEQ ID NO: 140739 - RNA, 59 nt, hsa
aaggggaagagggugaccucagcggcuuuucucccaaaaaucggcugaaggcugguugu

SEQ ID NO: 140740 - RNA, 59 nt, hsa
cuacccucagucuacacucacaaucaucuucucccaagacugcucccuuuuguuuugug

SEQ ID NO: 140741 - RNA, 59 nt, hsa
cuuugugcucuguuccuguccagcaggggucucccaacaagugcucuuuccaccccaaa

SEQ ID NO: 140742 - RNA, 59 nt, hsa
cagccccccaugugggagaaauaccugauucucccaaucugcagugggagagcuuugcu

SEQ ID NO: 140743 - RNA, 59 nt, hsa
cugcgccagccuccccgcccgcucucuuuucucccaagcgaaaccaaaugcgccccuuc

SEQ ID NO: 140744 - RNA, 59 nt, hsa
agacaguccacccagagcucucccaagucucucccaaauaccuuagaguagggacacug

SEQ ID NO: 140745 - RNA, 59 nt, hsa
ugaacagggugagacaguccacccagagcucucccaagucucucccaaauaccuuagag

SEQ ID NO: 140746 - RNA, 59 nt, hsa
aacguggaacaguaucacaaaagauuccaucucccaacgauuucagaacucugagcuca

SEQ ID NO: 140747 - RNA, 59 nt, hsa
gaagaaagauaaggaggcucccacccaccucucccaagagcagacauuaaacaucuuug

SEQ ID NO: 140748 - RNA, 59 nt, hsa
gggaaagaaacuacuuuagagccucuuuuucucccaacucauauuuuugauaggaaaaa

SEQ ID NO: 140749 - RNA, 59 nt, hsa
uaugcuuccagguggaggagaaaggggaaucucccaaaauuuaaaaacaaauuggaaga

SEQ ID NO: 140750 - RNA, 59 nt, hsa
caaucugccaaaugugcugcagcucguuuucucccaauuacagcaagacugucagccuc

SEQ ID NO: 140751 - RNA, 59 nt, hsa
uaggagauuuuuauaaacccucuccagccucucccaaaggaagcguuggcagcaaaggg

SEQ ID NO: 140752 - RNA, 59 nt, hsa
cccugggccauaugugcuauggagaggacucucccaaacccccaauagcuagugacagc

SEQ ID NO: 140753 - RNA, 59 nt, hsa
aagcuuccccuuaucguccccugugauuaucucccaaccccgugacaaagguagagcaa

SEQ ID NO: 140754 - RNA, 59 nt, hsa
guuugucacugccguuuauuacauugacuucucccaagaugaaucuuccuuccaaaugu

SEQ ID NO: 140755 - RNA, 59 nt, hsa
ugaagauaaucaaggccaguuacucaucaucucccaaccacuguuuccucaacugcccu

SEQ ID NO: 140756 - RNA, 64 nt, hsa
gccauggcuggaguggcugggacacaagacaccaagucccuaggcugcacacacaugucagggg

SEQ ID NO: 140757 - RNA, 64 nt, hsa
agaaaugaaagagaagagaaaugggacaucuaauagucccuaagugcuauuaaauaccuuauug

SEQ ID NO: 140758 - RNA, 64 nt, hsa
guucaauuugauacaguagaauugcaagucccuaagucccuauucacugugcuuaguagugacu

SEQ ID NO: 140759 - RNA, 64 nt, hsa
aucauaauguucaauuugauacaguagaauugcaagucccuaagucccuauucacugugcuuag

SEQ ID NO: 140760 - RNA, 64 nt, hsa
uauaucauauauaaaagucugaguucucuuucuuagucccuaaucauguuucucccauaggcug

SEQ ID NO: 140761 - RNA, 64 nt, hsa
ccuuggucccauuagcugagguuuaguaaucuaaagucccuauaguauaugauuauaaugcuau

SEQ ID NO: 140762 - RNA, 64 nt, hsa
uuagaacaccaugagauaguuaccccugaucuccagucccuagcugggggcuggacagggggaa

SEQ ID NO: 140763 - RNA, 64 nt, hsa
gcaaaaagccuggcuaccuccccccuagcacgugagucccuacuccccuccccucuguuucugc

SEQ ID NO: 140764 - RNA, 64 nt, hsa; identical to SEQ ID NO: 118026

SEQ ID NO: 140765 - RNA, 64 nt, hsa; identical to SEQ ID NO: 118027

SEQ ID NO: 140766 - RNA, 64 nt, hsa; identical to SEQ ID NO: 118028

SEQ ID NO: 140767 - RNA, 64 nt, hsa; identical to SEQ ID NO: 118029

SEQ ID NO: 140768 - RNA, 64 nt, hsa; identical to SEQ ID NO: 118030

SEQ ID NO: 140769 - RNA, 64 nt, hsa; identical to SEQ ID NO: 118031

SEQ ID NO: 140770 - RNA, 64 nt, hsa; identical to SEQ ID NO: 118032

SEQ ID NO: 140771 - RNA, 64 nt, hsa; identical to SEQ ID NO: 118033

SEQ ID NO: 140772 - RNA, 64 nt, hsa; identical to SEQ ID NO: 118034

SEQ ID NO: 140773 - RNA, 64 nt, hsa; identical to SEQ ID NO: 118035

SEQ ID NO: 140774 - RNA, 64 nt, hsa; identical to SEQ ID NO: 118036

SEQ ID NO: 140775 - RNA, 64 nt, hsa; identical to SEQ ID NO: 118037

SEQ ID NO: 140776 - RNA, 64 nt, hsa; identical to SEQ ID NO: 118038

SEQ ID NO: 140777 - RNA, 64 nt, hsa; identical to SEQ ID NO: 118039

SEQ ID NO: 140778 - RNA, 64 nt, hsa; identical to SEQ ID NO: 118040

SEQ ID NO: 140779 - RNA, 64 nt, hsa; identical to SEQ ID NO: 118041

SEQ ID NO: 140780 - RNA, 64 nt, hsa; identical to SEQ ID NO: 118042

SEQ ID NO: 140781 - RNA, 64 nt, hsa; identical to SEQ ID NO: 118043

SEQ ID NO: 140782 - RNA, 64 nt, hsa; identical to SEQ ID NO: 118044

SEQ ID NO: 140783 - RNA, 64 nt, hsa; identical to SEQ ID NO: 118045

SEQ ID NO: 140784 - RNA, 64 nt, hsa; identical to SEQ ID NO: 118046

SEQ ID NO: 140785 - RNA, 64 nt, hsa; identical to SEQ ID NO: 118047

SEQ ID NO: 140786 - RNA, 64 nt, hsa; identical to SEQ ID NO: 118048

SEQ ID NO: 140787 - RNA, 64 nt, hsa; identical to SEQ ID NO: 118049

SEQ ID NO: 140788 - RNA, 64 nt, hsa; identical to SEQ ID NO: 118050

SEQ ID NO: 140789 - RNA, 64 nt, hsa; identical to SEQ ID NO: 118051

SEQ ID NO: 140790 - RNA, 64 nt, hsa; identical to SEQ ID NO: 118052

SEQ ID NO: 140791 - RNA, 64 nt, hsa; identical to SEQ ID NO: 118053

SEQ ID NO: 140792 - RNA, 64 nt, hsa; identical to SEQ ID NO: 118054

SEQ ID NO: 140793 - RNA, 64 nt, hsa; identical to SEQ ID NO: 118055

SEQ ID NO: 140794 - RNA, 64 nt, hsa; identical to SEQ ID NO: 118056

SEQ ID NO: 140795 - RNA, 64 nt, hsa; identical to SEQ ID NO: 118057

SEQ ID NO: 140796 - RNA, 64 nt, hsa; identical to SEQ ID NO: 118058

SEQ ID NO: 140797 - RNA, 64 nt, hsa; identical to SEQ ID NO: 118059

SEQ ID NO: 140798 - RNA, 64 nt, hsa; identical to SEQ ID NO: 118060

SEQ ID NO: 140799 - RNA, 64 nt, hsa; identical to SEQ ID NO: 118061

SEQ ID NO: 140800 - RNA, 64 nt, hsa; identical to SEQ ID NO: 118062

SEQ ID NO: 140801 - RNA, 64 nt, hsa; identical to SEQ ID NO: 118063

SEQ ID NO: 140802 - RNA, 64 nt, hsa; identical to SEQ ID NO: 118064

SEQ ID NO: 140803 - RNA, 64 nt, hsa; identical to SEQ ID NO: 118065

SEQ ID NO: 140804 - RNA, 64 nt, hsa; identical to SEQ ID NO: 118066

SEQ ID NO: 140805 - RNA, 64 nt, hsa
gaugauuuguuuggcauauaggaagcacgcuggugcuaaguauuuuuuaaaugguuauguaagc

SEQ ID NO: 140806 - RNA, 64 nt, hsa
uggcauaugccauuucugggaaaugcaucuggaggcuaaguauugcuuucuacaaauaauugcc

SEQ ID NO: 140807 - RNA, 64 nt, hsa
gagaauucagagauucuggccuccagcugucaccacaccguaacggggccauguaacugugcag

SEQ ID NO: 140808 - RNA, 64 nt, hsa
ugucuggcccugaauuugcauggcuugagaaggcacaccguaagacuaaguaggaaaaauccaa

SEQ ID NO: 140809 - RNA, 64 nt, hsa
gaacuggcacuagguccaaaucuugugauaaugaacaccguaagguuagcuagcuuccuacuuu

SEQ ID NO: 140810 - RNA, 64 nt, hsa
ggucaccucaccugcaaggcuuuguggacucugcacaccguaugacccccgguuuuacaguuuu

SEQ ID NO: 140811 - RNA, 64 nt, hsa
uuauucaagagccauucggggcacguguguguacacaccguauacguucacacacaugcacuau

SEQ ID NO: 140812 - RNA, 64 nt, hsa
ggaaaaauaagaugacugggaaaaagacacacccacaccguagaacauauauuaaucuacuggc

SEQ ID NO: 140813 - RNA, 64 nt, hsa
ucauuuuuuaaugacuuucaacacucccaugaaaacaccguagucugcuuuuccugaaagguga

SEQ ID NO: 140814 - RNA, 64 nt, hsa
ugugcauucuuagaagaguaagaacaaauaaaguacaccguaauauacauauaaauacauucau

SEQ ID NO: 140815 - RNA, 64 nt, hsa
accucucuaaaagacacaggaggaugacacagaaacaccguaagugucuggaaggcaaaaagau

SEQ ID NO: 140816 - RNA, 64 nt, hsa
aauuuuaauaagaaacuaagcuuuauguaauguaacaccguaauuuaugaauuuguucauuguc

SEQ ID NO: 140817 - RNA, 64 nt, hsa
uccucaguagcuggggcuuuaggugggcacugccacaccguacuaauuuuuguauuuuuuguag

SEQ ID NO: 140818 - RNA, 64 nt, hsa
cuuuagugaugccuccccucuuuaaauaccugucacaccguaugaauauggugagaucagacuc

SEQ ID NO: 140819 - RNA, 64 nt, hsa
uugcuguacacagaugcuacagacuuguacuaacacaccguaauuuggcauuuguuuaaccuca

SEQ ID NO: 140820 - RNA, 64 nt, hsa
ggggcuuuaagagugaaggugaggaggagaucacacaccguauguguuugcuaacuggcuuuac

SEQ ID NO: 140821 - RNA, 64 nt, hsa
gaauuaaugaaguaaaguuguugaugguggugaaacaccguagggcaugugguucaaagagaag

SEQ ID NO: 140822 - RNA, 64 nt, hsa
gcuaugcaaaaggcgcugauacuggaaggcuugaacaccguauguuaauagggguuaagugaca

SEQ ID NO: 140823 - RNA, 64 nt, hsa
uuaucagaauuauuggccuaguaauccuucagaaacaccguaauucuaaauaaaccucuuccca

SEQ ID NO: 140824 - RNA, 64 nt, hsa
cuuuccacacgauuuccuaucucccuugaaaaguacaccguaacacuccguaaacagcccagcu

SEQ ID NO: 140825 - RNA, 64 nt, hsa
ucacuuugucugucuuguucaccuggagccugacacaccguagguacugaguacaaauagcuug

SEQ ID NO: 140826 - RNA, 64 nt, hsa
gacuuucucugaguugggcaaagaagaagcugacacaccguauguuguuagagucuuuuaucug

SEQ ID NO: 140827 - RNA, 64 nt, hsa
ggggagcaaauuccagcucugaaauggaguucucacaccguaucuagggacagaggcaucugga

SEQ ID NO: 140828 - RNA, 64 nt, hsa
ggccuggcucuggaagucacgucuuagcuucugaacaccguagcggguuaugaggaaguuuaau

SEQ ID NO: 140829 - RNA, 64 nt, hsa
acuuuaagguuugcagagauaaaccaauaaauccacaccguacaucugcaauaugaauucaaga

SEQ ID NO: 140830 - RNA, 64 nt, hsa
cuuuguauaaaauauuggcauguaaacagcacagacaccguaacacacucugugcccuguuugg

SEQ ID NO: 140831 - RNA, 64 nt, hsa
gacguuacagggugaaacccucugaccccucgcgacaccguaggacuugacuuuuguuuagucu

SEQ ID NO: 140832 - RNA, 64 nt, hsa; identical to SEQ ID NO: 72441

SEQ ID NO: 140833 - RNA, 64 nt, hsa; identical to SEQ ID NO: 72442

SEQ ID NO: 140834 - RNA, 64 nt, hsa; identical to SEQ ID NO: 72443

SEQ ID NO: 140835 - RNA, 64 nt, hsa; identical to SEQ ID NO: 72444

SEQ ID NO: 140836 - RNA, 64 nt, hsa; identical to SEQ ID NO: 72445

SEQ ID NO: 140837 - RNA, 64 nt, hsa; identical to SEQ ID NO: 72446

SEQ ID NO: 140838 - RNA, 64 nt, hsa; identical to SEQ ID NO: 72447

SEQ ID NO: 140839 - RNA, 64 nt, hsa; identical to SEQ ID NO: 72448

SEQ ID NO: 140840 - RNA, 64 nt, hsa; identical to SEQ ID NO: 72449

SEQ ID NO: 140841 - RNA, 64 nt, hsa; identical to SEQ ID NO: 72450

SEQ ID NO: 140842 - RNA, 64 nt, hsa; identical to SEQ ID NO: 72451

SEQ ID NO: 140843 - RNA, 64 nt, hsa; identical to SEQ ID NO: 72452

SEQ ID NO: 140844 - RNA, 64 nt, hsa; identical to SEQ ID NO: 72453

SEQ ID NO: 140845 - RNA, 64 nt, hsa; identical to SEQ ID NO: 72454

SEQ ID NO: 140846 - RNA, 64 nt, hsa; identical to SEQ ID NO: 72455

SEQ ID NO: 140847 - RNA, 64 nt, hsa; identical to SEQ ID NO: 72456

SEQ ID NO: 140848 - RNA, 64 nt, hsa; identical to SEQ ID NO: 72457

SEQ ID NO: 140849 - RNA, 64 nt, hsa; identical to SEQ ID NO: 72458

SEQ ID NO: 140850 - RNA, 64 nt, hsa; identical to SEQ ID NO: 72459

SEQ ID NO: 140851 - RNA, 64 nt, hsa; identical to SEQ ID NO: 72460

SEQ ID NO: 140852 - RNA, 64 nt, hsa; identical to SEQ ID NO: 72461

SEQ ID NO: 140853 - RNA, 64 nt, hsa; identical to SEQ ID NO: 72462

SEQ ID NO: 140854 - RNA, 64 nt, hsa; identical to SEQ ID NO: 72463

SEQ ID NO: 140855 - RNA, 64 nt, hsa; identical to SEQ ID NO: 72464

SEQ ID NO: 140856 - RNA, 64 nt, hsa; identical to SEQ ID NO: 72465

SEQ ID NO: 140857 - RNA, 64 nt, hsa; identical to SEQ ID NO: 72466

SEQ ID NO: 140858 - RNA, 64 nt, hsa; identical to SEQ ID NO: 72467

SEQ ID NO: 140859 - RNA, 64 nt, hsa; identical to SEQ ID NO: 72468

SEQ ID NO: 140860 - RNA, 64 nt, hsa; identical to SEQ ID NO: 72469

SEQ ID NO: 140861 - RNA, 64 nt, hsa; identical to SEQ ID NO: 72470

SEQ ID NO: 140862 - RNA, 64 nt, hsa; identical to SEQ ID NO: 72471

SEQ ID NO: 140863 - RNA, 64 nt, hsa; identical to SEQ ID NO: 72472

SEQ ID NO: 140864 - RNA, 64 nt, hsa; identical to SEQ ID NO: 72473

SEQ ID NO: 140865 - RNA, 64 nt, hsa; identical to SEQ ID NO: 72474

SEQ ID NO: 140866 - RNA, 64 nt, hsa; identical to SEQ ID NO: 72475

SEQ ID NO: 140867 - RNA, 64 nt, hsa; identical to SEQ ID NO: 72476

SEQ ID NO: 140868 - RNA, 64 nt, hsa; identical to SEQ ID NO: 72477

SEQ ID NO: 140869 - RNA, 64 nt, hsa; identical to SEQ ID NO: 72478

SEQ ID NO: 140870 - RNA, 64 nt, hsa; identical to SEQ ID NO: 72479

SEQ ID NO: 140871 - RNA, 64 nt, hsa; identical to SEQ ID NO: 72480

SEQ ID NO: 140872 - RNA, 64 nt, hsa; identical to SEQ ID NO: 72481

SEQ ID NO: 140873 - RNA, 64 nt, hsa; identical to SEQ ID NO: 72482

SEQ ID NO: 140874 - RNA, 64 nt, hsa; identical to SEQ ID NO: 72483

SEQ ID NO: 140875 - RNA, 64 nt, hsa; identical to SEQ ID NO: 72484

SEQ ID NO: 140876 - RNA, 64 nt, hsa; identical to SEQ ID NO: 72485

SEQ ID NO: 140877 - RNA, 64 nt, hsa; identical to SEQ ID NO: 72486

SEQ ID NO: 140878 - RNA, 64 nt, hsa; identical to SEQ ID NO: 72487

SEQ ID NO: 140879 - RNA, 64 nt, hsa; identical to SEQ ID NO: 72488

SEQ ID NO: 140880 - RNA, 64 nt, hsa; identical to SEQ ID NO: 72489

SEQ ID NO: 140881 - RNA, 64 nt, hsa; identical to SEQ ID NO: 72490

SEQ ID NO: 140882 - RNA, 64 nt, hsa; identical to SEQ ID NO: 72491

SEQ ID NO: 140883 - RNA, 64 nt, hsa; identical to SEQ ID NO: 72492

SEQ ID NO: 140884 - RNA, 64 nt, hsa; identical to SEQ ID NO: 72493

SEQ ID NO: 140885 - RNA, 64 nt, hsa
gcggggugggggggugcaaaucugccagcagcucuuacguaaggcauguuuuauuggggagggc

SEQ ID NO: 140886 - RNA, 64 nt, hsa
augacauuggggcccuucuuuugcugaaacugccuuacguaaugguuuuacuccuugaaagaga

SEQ ID NO: 140887 - RNA, 64 nt, hsa
cucacucacuuuuagguucuauaugcuauucuccuuacguaacguuaaauagauccuuuaguuu

SEQ ID NO: 140888 - RNA, 64 nt, hsa
ggagcuuuguauaauugguaacuuuaaccaacauuuacguaaguacggucuuugcaguauuaca

SEQ ID NO: 140889 - RNA, 64 nt, hsa; identical to SEQ ID NO: 57499

SEQ ID NO: 140890 - RNA, 64 nt, hsa; identical to SEQ ID NO: 57500

SEQ ID NO: 140891 - RNA, 64 nt, hsa; identical to SEQ ID NO: 57501

SEQ ID NO: 140892 - RNA, 64 nt, hsa; identical to SEQ ID NO: 57502

SEQ ID NO: 140893 - RNA, 64 nt, hsa; identical to SEQ ID NO: 57503

SEQ ID NO: 140894 - RNA, 64 nt, hsa; identical to SEQ ID NO: 57504

SEQ ID NO: 140895 - RNA, 64 nt, hsa; identical to SEQ ID NO: 57505

SEQ ID NO: 140896 - RNA, 64 nt, hsa; identical to SEQ ID NO: 57506

SEQ ID NO: 140897 - RNA, 64 nt, hsa; identical to SEQ ID NO: 57507

SEQ ID NO: 140898 - RNA, 64 nt, hsa; identical to SEQ ID NO: 57508

SEQ ID NO: 140899 - RNA, 64 nt, hsa; identical to SEQ ID NO: 57509

SEQ ID NO: 140900 - RNA, 64 nt, hsa; identical to SEQ ID NO: 57510

SEQ ID NO: 140901 - RNA, 64 nt, hsa; identical to SEQ ID NO: 57511

SEQ ID NO: 140902 - RNA, 64 nt, hsa; identical to SEQ ID NO: 57512

SEQ ID NO: 140903 - RNA, 64 nt, hsa; identical to SEQ ID NO: 57513

SEQ ID NO: 140904 - RNA, 64 nt, hsa; identical to SEQ ID NO: 57514

SEQ ID NO: 140905 - RNA, 64 nt, hsa; identical to SEQ ID NO: 57515

SEQ ID NO: 140906 - RNA, 64 nt, hsa; identical to SEQ ID NO: 57516

SEQ ID NO: 140907 - RNA, 64 nt, hsa; identical to SEQ ID NO: 57517

SEQ ID NO: 140908 - RNA, 64 nt, hsa; identical to SEQ ID NO: 57518

SEQ ID NO: 140909 - RNA, 64 nt, hsa; identical to SEQ ID NO: 57519

SEQ ID NO: 140910 - RNA, 64 nt, hsa; identical to SEQ ID NO: 57520

SEQ ID NO: 140911 - RNA, 64 nt, hsa; identical to SEQ ID NO: 57521

SEQ ID NO: 140912 - RNA, 64 nt, hsa; identical to SEQ ID NO: 57522

SEQ ID NO: 140913 - RNA, 64 nt, hsa; identical to SEQ ID NO: 57523

SEQ ID NO: 140914 - RNA, 64 nt, hsa; identical to SEQ ID NO: 57524

SEQ ID NO: 140915 - RNA, 64 nt, hsa; identical to SEQ ID NO: 57525

SEQ ID NO: 140916 - RNA, 64 nt, hsa; identical to SEQ ID NO: 57526

SEQ ID NO: 140917 - RNA, 64 nt, hsa; identical to SEQ ID NO: 57527

SEQ ID NO: 140918 - RNA, 64 nt, hsa; identical to SEQ ID NO: 57528

SEQ ID NO: 140919 - RNA, 64 nt, hsa; identical to SEQ ID NO: 57529

SEQ ID NO: 140920 - RNA, 64 nt, hsa; identical to SEQ ID NO: 57530

SEQ ID NO: 140921 - RNA, 64 nt, hsa; identical to SEQ ID NO: 57531

SEQ ID NO: 140922 - RNA, 64 nt, hsa; identical to SEQ ID NO: 57532

SEQ ID NO: 140923 - RNA, 64 nt, hsa; identical to SEQ ID NO: 57533

SEQ ID NO: 140924 - RNA, 64 nt, hsa; identical to SEQ ID NO: 57534

SEQ ID NO: 140925 - RNA, 64 nt, hsa; identical to SEQ ID NO: 57535

SEQ ID NO: 140926 - RNA, 64 nt, hsa; identical to SEQ ID NO: 57536

SEQ ID NO: 140927 - RNA, 64 nt, hsa; identical to SEQ ID NO: 57537

SEQ ID NO: 140928 - RNA, 64 nt, hsa; identical to SEQ ID NO: 57538

SEQ ID NO: 140929 - RNA, 64 nt, hsa; identical to SEQ ID NO: 57539

SEQ ID NO: 140930 - RNA, 64 nt, hsa; identical to SEQ ID NO: 57540

SEQ ID NO: 140931 - RNA, 64 nt, hsa; identical to SEQ ID NO: 57541

SEQ ID NO: 140932 - RNA, 64 nt, hsa; identical to SEQ ID NO: 57542

SEQ ID NO: 140933 - RNA, 64 nt, hsa; identical to SEQ ID NO: 57543

SEQ ID NO: 140934 - RNA, 64 nt, hsa; identical to SEQ ID NO: 57544

SEQ ID NO: 140935 - RNA, 64 nt, hsa; identical to SEQ ID NO: 57545

SEQ ID NO: 140936 - RNA, 64 nt, hsa; identical to SEQ ID NO: 57546

SEQ ID NO: 140937 - RNA, 64 nt, hsa; identical to SEQ ID NO: 57547

SEQ ID NO: 140938 - RNA, 64 nt, hsa; identical to SEQ ID NO: 57548

SEQ ID NO: 140939 - RNA, 64 nt, hsa; identical to SEQ ID NO: 57549

SEQ ID NO: 140940 - RNA, 64 nt, hsa; identical to SEQ ID NO: 57550

SEQ ID NO: 140941 - RNA, 64 nt, hsa; identical to SEQ ID NO: 57551

SEQ ID NO: 140942 - RNA, 64 nt, hsa; identical to SEQ ID NO: 57552

SEQ ID NO: 140943 - RNA, 64 nt, hsa; identical to SEQ ID NO: 57553

SEQ ID NO: 140944 - RNA, 64 nt, hsa; identical to SEQ ID NO: 57554

SEQ ID NO: 140945 - RNA, 64 nt, hsa; identical to SEQ ID NO: 57555

SEQ ID NO: 140946 - RNA, 64 nt, hsa; identical to SEQ ID NO: 57556

SEQ ID NO: 140947 - RNA, 64 nt, hsa; identical to SEQ ID NO: 57557

SEQ ID NO: 140948 - RNA, 64 nt, hsa; identical to SEQ ID NO: 57558

SEQ ID NO: 140949 - RNA, 64 nt, hsa; identical to SEQ ID NO: 57559

SEQ ID NO: 140950 - RNA, 64 nt, hsa; identical to SEQ ID NO: 57560

SEQ ID NO: 140951 - RNA, 64 nt, hsa; identical to SEQ ID NO: 57561

SEQ ID NO: 140952 - RNA, 64 nt, hsa; identical to SEQ ID NO: 57562

SEQ ID NO: 140953 - RNA, 64 nt, hsa; identical to SEQ ID NO: 57563

SEQ ID NO: 140954 - RNA, 64 nt, hsa; identical to SEQ ID NO: 57564

SEQ ID NO: 140955 - RNA, 64 nt, hsa; identical to SEQ ID NO: 57565

SEQ ID NO: 140956 - RNA, 64 nt, hsa; identical to SEQ ID NO: 57566

SEQ ID NO: 140957 - RNA, 64 nt, hsa; identical to SEQ ID NO: 57567

SEQ ID NO: 140958 - RNA, 64 nt, hsa; identical to SEQ ID NO: 57568

SEQ ID NO: 140959 - RNA, 64 nt, hsa; identical to SEQ ID NO: 57569

SEQ ID NO: 140960 - RNA, 64 nt, hsa; identical to SEQ ID NO: 57570

SEQ ID NO: 140961 - RNA, 64 nt, hsa; identical to SEQ ID NO: 57571

SEQ ID NO: 140962 - RNA, 64 nt, hsa; identical to SEQ ID NO: 57572

SEQ ID NO: 140963 - RNA, 64 nt, hsa; identical to SEQ ID NO: 57573

SEQ ID NO: 140964 - RNA, 64 nt, hsa; identical to SEQ ID NO: 57574

SEQ ID NO: 140965 - RNA, 64 nt, hsa; identical to SEQ ID NO: 57575

SEQ ID NO: 140966 - RNA, 64 nt, hsa; identical to SEQ ID NO: 57576

SEQ ID NO: 140967 - RNA, 64 nt, hsa; identical to SEQ ID NO: 57577

SEQ ID NO: 140968 - RNA, 64 nt, hsa
uugaaugaacugaggcaaauuuaaaaggcaauaauuuaaacauuaaccucauuccaaguuaaug

SEQ ID NO: 140969 - RNA, 64 nt, hsa
gaauuaaauacuguauuaaaauaaguucgcugucuuuaaacaaauggagaugacuacuaaguca

SEQ ID NO: 140970 - RNA, 64 nt, hsa
gauauaugcagacaaauuuuugacaaauucaccuuuuaaacacacuuaaccauuugugaagguu

SEQ ID NO: 140971 - RNA, 64 nt, hsa
uuaaccauuugugaagguuuucuuuagcuuacauuuuaaacauacacaauaaacacuaauccuc

SEQ ID NO: 140972 - RNA, 64 nt, hsa
uaauauuaguuucaagcuuuccuuacccuacaacuuuaaacaaaagcuuuaauuuuguuugcac

SEQ ID NO: 140973 - RNA, 64 nt, hsa
acuaaauuauguagcuauuugacuguuaaguucuuuuaaacaacuguuuccuugggcuucaguu

SEQ ID NO: 140974 - RNA, 64 nt, hsa
ugaggggauaggggaaguaagccaauaagaaccuuuuaaacaaaucguccugucacaaaaugcu

SEQ ID NO: 140975 - RNA, 64 nt, hsa
aauggaaaauuucugaaaugcuggauuaucuauuuuuaaacaagcaguugacuuaaaacuuucu

SEQ ID NO: 140976 - RNA, 64 nt, hsa
aaacuguuuuaauugcuuggguagcaaugugcacuuuaaacaauuuggauauuggaaugcaguc

SEQ ID NO: 140977 - RNA, 64 nt, hsa
guugauugguaagaaauugggcauugcuuggcucuuuaaacacaucagugcuuccacauucacc

SEQ ID NO: 140978 - RNA, 64 nt, hsa
ugaggagugccagcagugugauaauuuaaacauauuuaaacaaaaacaaaaaaaaugaaugcac

SEQ ID NO: 140979 - RNA, 64 nt, hsa
uucaugcaaaugaggagugccagcagugugauaauuuaaacauauuuaaacaaaaacaaaaaaa

SEQ ID NO: 140980 - RNA, 64 nt, hsa
ggauaucacagcaacauugaaaugcuaaaaaguuuuuaaacacucucaauuucuaauucaccau

SEQ ID NO: 140981 - RNA, 64 nt, hsa
ccccugcccauccucccuuuuaccuccucucuuuuuuaaacaccuguuuaucccaaccuuuuug

SEQ ID NO: 140982 - RNA, 64 nt, hsa
ucaugaaguugguuugcuccagcauccgguagucuuuaaacauucuuuuagugaaauugucauu

SEQ ID NO: 140983 - RNA, 64 nt, hsa
agaauaaguauauauuuuuggaguaacaucaauauuuaaacauuuuuacacagaucgguguuug

SEQ ID NO: 140984 - RNA, 64 nt, hsa
uuuucuuccccaaaacagaauuauaaaagcuuacuuuaaacaggaggcagaauaauucuuuuag

SEQ ID NO: 140985 - RNA, 64 nt, hsa
uagauauugacuauccuuaguugagucacugagguuuaaacacaaugguaagucuuaaagucug

SEQ ID NO: 140986 - RNA, 64 nt, hsa
guuauaauugaccuugcauggugugaaauaaaaguuuaaacacugguguauuucagguguacuu

SEQ ID NO: 140987 - RNA, 64 nt, hsa
ugcccuuucauagauauucgauuaauuuuuacauuuuaaacaaguugacuauuuccuuuagggg

SEQ ID NO: 140988 - RNA, 64 nt, hsa
agaaaugggcuguuuugcccaaaguuuuauuuuuuuuaaacaaugauuaaauugaauguguaau

SEQ ID NO: 140989 - RNA, 64 nt, hsa
acucccuguaggauuuuuuucuagucccaugugauuuaaacaaacaaacaaacaaacagaagua

SEQ ID NO: 140990 - RNA, 64 nt, hsa
uuaauuuaauugaccccccgagguggucuuuuguuuuaaacagggggcaacagcuggaucucca

SEQ ID NO: 140991 - RNA, 64 nt, hsa
gagcagcauuacccuaauggauugcaaccaaaacuuuaaacaaguagaaagauaauauuucucc

SEQ ID NO: 140992 - RNA, 64 nt, hsa
uuguugagcuccuauuugcccagagauggucauauuuaaacagaaguauacguuuuucaguuuc

SEQ ID NO: 140993 - RNA, 64 nt, hsa
gaaauuccuacacauacguuugcguauauguuauuuuaaacaucuuuguggugagaauuuuuuc

SEQ ID NO: 140994 - RNA, 64 nt, hsa
gggaaauuggauuuuuguaauaaucuuuugauguuuuaaacauugguucccuagucaccauagu

SEQ ID NO: 140995 - RNA, 64 nt, hsa
uagucaccauaguuaccacuuguauuuuaagucauuuaaacaagccacgguggggcuuuuuucu

SEQ ID NO: 140996 - RNA, 64 nt, hsa
gcucaguuucuauuuuacuauucaaguuguguacuuuaaacaaauauaaaaaucaaaaggcugc

SEQ ID NO: 140997 - RNA, 64 nt, hsa
gcuuuuugcccuuagcacuaugcuugggggccauuuuaaacagugaaaucaaaaaaagaacaga

SEQ ID NO: 140998 - RNA, 64 nt, hsa
auuuauauuacugucuuuucuauuaaucauuugauuuaaacaaugccaagucacucuuuuuuag

SEQ ID NO: 140999 - RNA, 64 nt, hsa
uuauggugagguuuaaaggauaugaaacucuacauuuaaacaaguauuuuauauuuggguacag

SEQ ID NO: 141000 - RNA, 64 nt, hsa
aaguaagaggucauuucuggaauggacucagaccuuuaaacaggagaguugagcacuuccaguc

SEQ ID NO: 141001 - RNA, 64 nt, hsa
uguugucacacccaaagggaugcucugccaaagguuuaaacacccaggagaccaucagccucuc

SEQ ID NO: 141002 - RNA, 64 nt, hsa
caucuaagaggcuaaacucugauaggaaaagcacuuuaaacauaauuaaaagcuuaauguaaau

SEQ ID NO: 141003 - RNA, 64 nt, hsa
ucauauuucccgaagcagaaguuaaagaaaauuuuuuaaacauuugcuuuauuauuguuuucuu

SEQ ID NO: 141004 - RNA, 64 nt, hsa
uagcucugaagugucacauuuaauaucaguuuuuuuuaaacaugauucuaguuaaauguagaag

SEQ ID NO: 141005 - RNA, 64 nt, hsa
auuaaaauggaauaaagaaagagcagcugccacuuuuaaacaacauaaaggaauaucuuuuuuu

SEQ ID NO: 141006 - RNA, 64 nt, hsa
gugaaucaguuucuuguuuauauuuuuuucaccuuuuaaacaaaaaauucuuuaaaauauuuua

SEQ ID NO: 141007 - RNA, 64 nt, hsa
cuugguccuuaaaaaauaugcucuccccucccuuuuuaaacaaauggcuuguucagucacuugu

SEQ ID NO: 141008 - RNA, 64 nt, hsa
cuuguucagucacuuguuuguguuugaauugauuuuuaaacagcagguugugugugugugcagu

SEQ ID NO: 141009 - RNA, 64 nt, hsa
uaauaccucaagauaaucugauuuauuagcuauuuuuaaacauuuuuaaucacaagcuguauua

SEQ ID NO: 141010 - RNA, 64 nt, hsa
ugcccuuuauguacuacauucuuauuuucuaacuuuuaaacacuguauuggagguuuuuuuuua

SEQ ID NO: 141011 - RNA, 64 nt, hsa
acuaucugugcguagaaguucuaguguuuucaauuuuaaacauauccaaguuugaauuccuaaa

SEQ ID NO: 141012 - RNA, 64 nt, hsa
acauaucucuuaucuuacgaaaaaaugguagcauuuuaaacaaaauagaaaguugcaaggcaaa

SEQ ID NO: 141013 - RNA, 64 nt, hsa
aguaguuucauuauuuggcacaauagcaguuuauuuuaaacaaacaauuugaaguuaaacauuu

SEQ ID NO: 141014 - RNA, 64 nt, hsa
uuuuggcuacaacuugauugaaacaaguucaaaauuuaaacaaguucauacaaguuuuuaaaaa

SEQ ID NO: 141015 - RNA, 64 nt, hsa
ccaaaggauaggacuuuaguucuuuaagcauuauuuuaaacacuauauugauacaaaaauaucu

SEQ ID NO: 141016 - RNA, 64 nt, hsa
ucauuagacucuuuuaaugcuaauggcuaguacguuuaaacaaaacagcaguucucugcugcaa

SEQ ID NO: 141017 - RNA, 64 nt, hsa
cccccuagaacaucccccuuccucccauacugcuuuuaaacagaugcccaagaaggcaagcagg

SEQ ID NO: 141018 - RNA, 64 nt, hsa
uauggauauuuguaccaggcugcguguuuuucauuuuaaacacacaagauuuaauugaaaggac

SEQ ID NO: 141019 - RNA, 64 nt, hsa
cagcuaaugucugguuauuucucaaaguaaguauuuuaaacagccuguuaauuauaagaaacuc

SEQ ID NO: 141020 - RNA, 64 nt, hsa
ucuuuuugacuggacuuuuggguggugguagauuuuuaaacaaaugaaauuaaagcaacaauaa

SEQ ID NO: 141021 - RNA, 64 nt, hsa
aguuugugugucuuaauuauuauuuguguuuuaauuuaaacaccuccucauguacauacccugg

SEQ ID NO: 141022 - RNA, 64 nt, hsa
gcccccugccccccagccucuggcauuagaauuauuuaaacaaaaacuaggcgguugaaugaga

SEQ ID NO: 141023 - RNA, 64 nt, hsa
uaauauacuauuguuugcagauaaaggccuuaacuuuaaacaucuuucaucuucugaaagcugc

SEQ ID NO: 141024 - RNA, 64 nt, hsa
uagaugaaaauuguugaugccccuuucuuuuuacuuuaaacaaugugguagugggagaaugacu

SEQ ID NO: 141025 - RNA, 64 nt, hsa
cuuguaucucacuguauuucucaugcuuuguucuuuuaaacaaauccuuuaaacugugucauuu

SEQ ID NO: 141026 - RNA, 64 nt, hsa
uauccuucuuuuuuuauuuagauaauucuuuuaauuuaaacaaagguucacuauggaaccagac

SEQ ID NO: 141027 - RNA, 64 nt, hsa
uagucuagugucugguuuucuagcaaacaguaaauuuaaacaaguaaacuauuaugguuuccau

SEQ ID NO: 141028 - RNA, 64 nt, hsa
acccuugccucccccacccccuucuuuuuuuuuuuuuaaacaaaucaguuuguuuugguaccuu

SEQ ID NO: 141029 - RNA, 64 nt, hsa
cugggcagcgcugcccauuuauuuauauguagauuuuaaacacugcuguugacaaguugguuug

SEQ ID NO: 141030 - RNA, 64 nt, hsa
aaaauguauuuauauucaccugaguuuuaauguuuuuaaacaaaguuuucuccugcagugcuuu

SEQ ID NO: 141031 - RNA, 64 nt, hsa
ccuuguggaaucugaagauugaaauauccaaagguuuaaacaagauggaaaucaaugaaaaaga

SEQ ID NO: 141032 - RNA, 64 nt, hsa
aacauuguuuaauuaaaauaccauacaguucucuuuuaaacaucaaaccauaaaaaguguauuu

SEQ ID NO: 141033 - RNA, 64 nt, hsa
aauuuuagacucucauucacaaugaaaaguuuauuuuaaacauuguuuaauuaaaauaccauac

SEQ ID NO: 141034 - RNA, 64 nt, hsa
uacugaaugacagacuauuacuacguuugccaguuuuaaacagcuuuauuuauguucauguccu

SEQ ID NO: 141035 - RNA, 64 nt, hsa
cuuaagaugaauacaccugccuuuggaucaacuauuuaaacauuguaugcauuuugauuuuucc

SEQ ID NO: 141036 - RNA, 64 nt, hsa
uaaacaaauggggacaaugcauccaaaaaaucuuuuuaaacagauuacacaaaaauuauuucca

SEQ ID NO: 141037 - RNA, 64 nt, hsa
uuaggaguuacuuuauguauuguugaaagcaaauuuuaaacaugauguuuuagaaguguuucug

SEQ ID NO: 141038 - RNA, 64 nt, hsa
ggacuauuuggugguuuaaaaaaagggucagacuuuuaaacacucugaccauagaaauguuuuu

SEQ ID NO: 141039 - RNA, 64 nt, hsa
auagacauucaugucagaucccauaugggggauuuuuaaacauuucuuugaacuuugaggccug

SEQ ID NO: 141040 - RNA, 64 nt, hsa
gauucuuuuacuuauuuuuuugugguuuuuuuuuuuuaaacaaauuuuagcccaauuuucuuga

SEQ ID NO: 141041 - RNA, 64 nt, hsa
ugcagcuagaacccuacaguggggaaugaggaauuuuaaacacacauuugauuacagccaccaa

SEQ ID NO: 141042 - RNA, 64 nt, hsa
ccaaaaguuaaauauucuaguuaaggauuguuucuuuaaacaacuuucagauucuguugacauu

SEQ ID NO: 141043 - RNA, 64 nt, hsa
uuuaugcuuaugcaguuagucuuuauuacaguaauuuaaacaauguggcacaaacauaguuuuu

SEQ ID NO: 141044 - RNA, 64 nt, hsa
gcuggggagugggaggggggagaaaaggaauguauuuaaacaauuuccgaugcccaugaugagu

SEQ ID NO: 141045 - RNA, 64 nt, hsa
aggaacugugaggcuuugucauuuagcauuagacuuuaaacaagaauuaaaaucaugugcugua

SEQ ID NO: 141046 - RNA, 64 nt, hsa
uguuuucuguguauacauggauauuuuguuuguuuuuaaacaaaacgaugggaucauucugaac

SEQ ID NO: 141047 - RNA, 64 nt, hsa
accuggugauguuagaagacaaguaguuuauggauuuaaacauuagagcuggaguggggcugga

SEQ ID NO: 141048 - RNA, 64 nt, hsa
uuguuuagaauuugcuucccauuuugcaccagccuuuaaacacuuuucgugaagaaauuuugca

SEQ ID NO: 141049 - RNA, 64 nt, hsa
uaaaacauuuuuagguuuuacagagauuuuaaccuuuaaacaacagaucuuuaaaaaacaggug

SEQ ID NO: 141050 - RNA, 64 nt, hsa
ggcaacuucuaacuuugcuccaagccacucucuuuuuaaacagcaacaauuuaaagcuaugaag

SEQ ID NO: 141051 - RNA, 64 nt, hsa
uggacucaaugacaaagaccgagucuucuuuuuuuuuaaacaaaaacaaaaaaagcaaccaggg

SEQ ID NO: 141052 - RNA, 64 nt, hsa
uuaaacuuuaaauuuucugagcagcauuuugguauuuaaacauuucuuguaaaaagcugagaca

SEQ ID NO: 141053 - RNA, 64 nt, hsa
cauaccaguguuuuaaaagguauuuuuauguguuuuuaaacacuuuuuuaaaugagccugacac

SEQ ID NO: 141054 - RNA, 64 nt, hsa
aaaccuugaacugaaaauauuuaauaaaauaaccuuuaaacaguccauuguguuacugcuguug

SEQ ID NO: 141055 - RNA, 64 nt, hsa
caucuauagacaauagacuauuaaaaaaucaccuuuuaaacaagaaacggaaggcauuugaugc

SEQ ID NO: 141056 - RNA, 64 nt, hsa
uuuuaauucuacuuauaauccacggcuuagaauauuuaaacauuguuucuauuaaacuagaaag

SEQ ID NO: 141057 - RNA, 64 nt, hsa
aucuaauuaccuuaaacaagcagauuuagccauuuuuaaacagacauucccagucauccuggug

SEQ ID NO: 141058 - RNA, 64 nt, hsa
gcaccggaauuccuuugggaugaaucagcaucauuuuaaacaaaguauauguaaaaggugaaag

SEQ ID NO: 141059 - RNA, 64 nt, hsa
gauguuuacauaauuuuagcaccucaagguauaauuuaaacagugagguaguuuugaauggcau

SEQ ID NO: 141060 - RNA, 64 nt, hsa
uguuucaccaguacagugaaaguuguuucaacauuuuaaacaaacagugguuauagacucuuuc

SEQ ID NO: 141061 - RNA, 64 nt, hsa
aaaaucccaaucccaagucgaaaucaccucuuguuuuaaacaagaaugaaucauuacuguguau

SEQ ID NO: 141062 - RNA, 64 nt, hsa
auucuacuacucauuggauugccggggaugucccuuuaaacagacugcugccuucagcuaaaaa

SEQ ID NO: 141063 - RNA, 64 nt, hsa
caguaucauuauucagacuucaaauugugaaucuuuuaaacaucuugauaauuuguuguugaga

SEQ ID NO: 141064 - RNA, 64 nt, hsa
aaggguuaucuuagauguuucacaccggaagguuuuuaaacacuaaaauauauaauuuauaguu

SEQ ID NO: 141065 - RNA, 64 nt, hsa
gccaguaugauuuauaaaugcaaucuccccuugauuuaaacacacagauacacacacacacaca

SEQ ID NO: 141066 - RNA, 64 nt, hsa
gucacaauuucucuugauauuaagcuggguugucuuuaaacaacccuaaauacacgucuguuua

SEQ ID NO: 141067 - RNA, 64 nt, hsa
acuaccuuugcaaaaacaaaauaccccaaagauauuuaaacaagguuauaauuuagcaucuucc

SEQ ID NO: 141068 - RNA, 64 nt, hsa
uuuagaaugcuuuaauccuuucuuuagaaugcuguuuaaacaccauuuacccuacuuaucccuc

SEQ ID NO: 141069 - RNA, 64 nt, hsa
ugauuuauuuucuuaagugccaaugggcccaccuuuuaaacaagaaaacguuaaauaacuuggg

SEQ ID NO: 141070 - RNA, 64 nt, hsa
uggaguagcugagguuaaacaaacaaaaaaaaauuuuaaacaaagaaaggaaaaaaauugacaa

SEQ ID NO: 141071 - RNA, 64 nt, hsa
aaaaauuauuaauagcucagguuaaaaacacccauuuaaacaaaaacaagagcauuuguaauag

SEQ ID NO: 141072 - RNA, 64 nt, hsa
uccagcuacucaggaggcugaagcaggagaaucguuuaaacacaggagguggagguugcaguga

SEQ ID NO: 141073 - RNA, 64 nt, hsa
uuucaguccgcacaagaugauauaauuggaguauuuuaaacacuagaccccaggagcuuggcug

SEQ ID NO: 141074 - RNA, 64 nt, hsa
guuuuguuuguuuacaaauaaucagacuauaauauuuaaacaugcaaaauaacugacaauaaug

SEQ ID NO: 141075 - RNA, 64 nt, hsa
cuauacugcaggauuucugaugacauugaaagacuuuaaacagccuuaguaaauuaucuuucua

SEQ ID NO: 141076 - RNA, 64 nt, hsa
cuuuaucaucuuucacuuuugguuuuccucuguuuuuaaacaucuuagguauaacagcacaauu

SEQ ID NO: 141077 - RNA, 64 nt, hsa
cauaacaaggguguacggcuuuucuugagcccauuuuaaacaacccuuguuuccagauaagugu

SEQ ID NO: 141078 - RNA, 64 nt, hsa
uguuuuauuggaaaugcacgugguuucuuaggcuuuuaaacaaauacauggaaugguugaaaga

SEQ ID NO: 141079 - RNA, 64 nt, hsa
guuuguuuuggcacuguuuuaaaaacucaaauauuuuaaacauuuguuaaguuggagcuugcac

SEQ ID NO: 141080 - RNA, 64 nt, hsa
agagauauccauugaaaagggaugucuagagggauuuaaacagcuccuuuggcacgugccucuc

SEQ ID NO: 141081 - RNA, 64 nt, hsa
cauguguaaauugacacaaucacuaaucugguaauuuaaacaauugagauagcaaaaguguuua

SEQ ID NO: 141082 - RNA, 64 nt, hsa
ccagggaguaaaauuaccugaaaacguaagaaguuuuaaacagcuuuucacacaaauuagaugc

SEQ ID NO: 141083 - RNA, 64 nt, hsa
aaugugagcuuuggauuacuggauuuuuuuuuuuuuuaaacacaccuggagaggacauuugaaa

SEQ ID NO: 141084 - RNA, 64 nt, hsa
auuuauuggaggugguaauuagggaagauguccuuuuaaacaguagaauuguguuacaaagggg

SEQ ID NO: 141085 - RNA, 64 nt, hsa
ucuguuacugaaagaugaaccaacuuaguaacuguuuaaacaaagaaaccacauuuuuaaaauu

SEQ ID NO: 141086 - RNA, 64 nt, hsa
uaaaccauugcauaaaugcuauaguguaaaaaaauuuaaacaaguguuaacuuuaaacaguucg

SEQ ID NO: 141087 - RNA, 64 nt, hsa
gcuauaguguaaaaaaauuuaaacaaguguuaacuuuaaacaguucgcuacaaguaaaugauua

SEQ ID NO: 141088 - RNA, 64 nt, hsa
ccucccagaguacugggauuacaggcucuuucuuuuuaaacauaaaaguuuuaaauugguauua

SEQ ID NO: 141089 - RNA, 64 nt, hsa
auugaugcaauuugauauuuuuucauaaucuauauuuaaacaaaauuacaucauugcaucaucu

SEQ ID NO: 141090 - RNA, 64 nt, hsa
agauuguuuaaaauaucuugauauuuucacaaauuuuaaacaaaaaauuaaauaucuauaaagu

SEQ ID NO: 141091 - RNA, 64 nt, hsa
uauaauuuaauucaagagaaugcuuuuauuuccguuuaaacauauuuuguauauaugugauaua

SEQ ID NO: 141092 - RNA, 64 nt, hsa
aagccacauugaguuuugcuugauuugucugucuuuuaaacacugucaaaugcuuucccuuuug

SEQ ID NO: 141093 - RNA, 64 nt, hsa
aauaauuauuaugucugauguugacucauugcaguuuaaacauuucuucuuguuugcaucuuag

SEQ ID NO: 141094 - RNA, 64 nt, hsa
auauauuuuauuuaaauauauguuacauauuauauuuaaacauacauauuuaacauuuuuuaca

SEQ ID NO: 141095 - RNA, 64 nt, hsa
aauaucagagauuuggguaaaagaauggguaauguuuaaacauguggaggcauguggagcuuua

SEQ ID NO: 141096 - RNA, 64 nt, hsa
agaaauuacacccaaagagguauuuaucuuuacuuuuaaacagugagccugaauuuuguugcug

SEQ ID NO: 141097 - RNA, 64 nt, hsa
auccugaaauuucagauucccagagcaaaauaauuuuaaacaaagguugagauguaaaagguau

SEQ ID NO: 141098 - RNA, 64 nt, hsa
gggucuuaaagaauuuuuuuaaucgucaaccacuuuuaaacauaaagaauucacacaacuacuu

SEQ ID NO: 141099 - RNA, 64 nt, hsa
gacaaucuuauugucaacacuauauaaauaagcuuuuaaacaagucauuuuucuugaucguugu

SEQ ID NO: 141100 - RNA, 64 nt, hsa
uucuauagaauuaaugaucagagcaaguuuaauuuuuaaacauaaaggucuugguuacacaugu

SEQ ID NO: 141101 - RNA, 64 nt, hsa
ugguuacacauguccaugcauuccaguuaacacauuuaaacauauagaaaauucacuucuucuu

SEQ ID NO: 141102 - RNA, 64 nt, hsa
aaugcuauagaaauauuuggugguuuuuuuuuuuuuuaaacauccacaguuaagguugggccag

SEQ ID NO: 141103 - RNA, 64 nt, hsa
uacugugaaaugaucacuuuguggcagggguacuuuuaaacauaaauguuucuacaaaaguagg

SEQ ID NO: 141104 - RNA, 64 nt, hsa
aauguaucuuauuuuugauaauggcucuuaaaucuuuaaacacacacacaaaaucguucuuuac

SEQ ID NO: 141105 - RNA, 64 nt, hsa
guguuguccuacagauguccaauuuauuugcauuuuuaaacauuagccuaugauaguaauuuaa

SEQ ID NO: 141106 - RNA, 64 nt, hsa
uuacaauugcuuucauucgugaagccgaaacguuuuuaaacaugaauuacauaugaauuauuaa

SEQ ID NO: 141107 - RNA, 64 nt, hsa
augcacaacuuuagaauuucuacaaauaaguucuuuuaaacagucuuuuuauuguggauuguga

SEQ ID NO: 141108 - RNA, 64 nt, hsa
acaugcuuuagcagagauaacuuaucagggcuaguuuaaacaaauguguauaggaaaggauguu

SEQ ID NO: 141109 - RNA, 64 nt, hsa
cuuuguaaaaaagaaaaauguauauagcugugaguuuaaacaaaaaccacaaacagacaaacaa

SEQ ID NO: 141110 - RNA, 64 nt, hsa
aaggacacuugauauuuuuuaauuacaauggaaguuuaaacauuucuuucugugccacacaaug

SEQ ID NO: 141111 - RNA, 64 nt, hsa; identical to SEQ ID NO: 84377

SEQ ID NO: 141112 - RNA, 64 nt, hsa; identical to SEQ ID NO: 84378

SEQ ID NO: 141113 - RNA, 64 nt, hsa; identical to SEQ ID NO: 84379

SEQ ID NO: 141114 - RNA, 64 nt, hsa; identical to SEQ ID NO: 84380

SEQ ID NO: 141115 - RNA, 64 nt, hsa; identical to SEQ ID NO: 84381

SEQ ID NO: 141116 - RNA, 64 nt, hsa; identical to SEQ ID NO: 84382

SEQ ID NO: 141117 - RNA, 64 nt, hsa; identical to SEQ ID NO: 84383

SEQ ID NO: 141118 - RNA, 64 nt, hsa; identical to SEQ ID NO: 84384

SEQ ID NO: 141119 - RNA, 64 nt, hsa; identical to SEQ ID NO: 84385

SEQ ID NO: 141120 - RNA, 64 nt, hsa; identical to SEQ ID NO: 84386

SEQ ID NO: 141121 - RNA, 64 nt, hsa; identical to SEQ ID NO: 84387

SEQ ID NO: 141122 - RNA, 64 nt, hsa; identical to SEQ ID NO: 84388

SEQ ID NO: 141123 - RNA, 64 nt, hsa; identical to SEQ ID NO: 84389

SEQ ID NO: 141124 - RNA, 64 nt, hsa; identical to SEQ ID NO: 84390

SEQ ID NO: 141125 - RNA, 64 nt, hsa; identical to SEQ ID NO: 84391

SEQ ID NO: 141126 - RNA, 64 nt, hsa; identical to SEQ ID NO: 84392

SEQ ID NO: 141127 - RNA, 64 nt, hsa; identical to SEQ ID NO: 84393

SEQ ID NO: 141128 - RNA, 64 nt, hsa; identical to SEQ ID NO: 84394

SEQ ID NO: 141129 - RNA, 64 nt, hsa; identical to SEQ ID NO: 84395

SEQ ID NO: 141130 - RNA, 64 nt, hsa; identical to SEQ ID NO: 84396

SEQ ID NO: 141131 - RNA, 64 nt, hsa; identical to SEQ ID NO: 84397

SEQ ID NO: 141132 - RNA, 64 nt, hsa; identical to SEQ ID NO: 84398

SEQ ID NO: 141133 - RNA, 64 nt, hsa; identical to SEQ ID NO: 84399

SEQ ID NO: 141134 - RNA, 64 nt, hsa; identical to SEQ ID NO: 84400

SEQ ID NO: 141135 - RNA, 64 nt, hsa; identical to SEQ ID NO: 84401

SEQ ID NO: 141136 - RNA, 64 nt, hsa; identical to SEQ ID NO: 84402

SEQ ID NO: 141137 - RNA, 64 nt, hsa; identical to SEQ ID NO: 84403

SEQ ID NO: 141138 - RNA, 64 nt, hsa; identical to SEQ ID NO: 84404

SEQ ID NO: 141139 - RNA, 64 nt, hsa; identical to SEQ ID NO: 84405

SEQ ID NO: 141140 - RNA, 64 nt, hsa; identical to SEQ ID NO: 84406

SEQ ID NO: 141141 - RNA, 64 nt, hsa; identical to SEQ ID NO: 84407

SEQ ID NO: 141142 - RNA, 64 nt, hsa; identical to SEQ ID NO: 84408

SEQ ID NO: 141143 - RNA, 64 nt, hsa; identical to SEQ ID NO: 84409

SEQ ID NO: 141144 - RNA, 64 nt, hsa; identical to SEQ ID NO: 84410

SEQ ID NO: 141145 - RNA, 64 nt, hsa; identical to SEQ ID NO: 84411

SEQ ID NO: 141146 - RNA, 64 nt, hsa; identical to SEQ ID NO: 84412

SEQ ID NO: 141147 - RNA, 64 nt, hsa; identical to SEQ ID NO: 84413

SEQ ID NO: 141148 - RNA, 64 nt, hsa; identical to SEQ ID NO: 84414

SEQ ID NO: 141149 - RNA, 64 nt, hsa; identical to SEQ ID NO: 84415

SEQ ID NO: 141150 - RNA, 64 nt, hsa; identical to SEQ ID NO: 84416

SEQ ID NO: 141151 - RNA, 64 nt, hsa; identical to SEQ ID NO: 84417

SEQ ID NO: 141152 - RNA, 64 nt, hsa; identical to SEQ ID NO: 84418

SEQ ID NO: 141153 - RNA, 64 nt, hsa; identical to SEQ ID NO: 84419

SEQ ID NO: 141154 - RNA, 64 nt, hsa; identical to SEQ ID NO: 84420

SEQ ID NO: 141155 - RNA, 63 nt, hsa
ggagacagccugaguaaaaggcuuggaaguuggaauuaacaguggggagcagaagcacucaua

SEQ ID NO: 141156 - RNA, 63 nt, hsa
ugaagagggagaugagacagcucucuggacaggaauuaacaaacgcuggagcagcccagagga

SEQ ID NO: 141157 - RNA, 63 nt, hsa
guuuuuuuauugcuagcuaucauuaccaguuagaauuaacauuaauuacaauuaacaauaauu

SEQ ID NO: 141158 - RNA, 63 nt, hsa
cuaucauuaccaguuagaauuaacauuaauuacaauuaacaauaauuuuagguauggaauguu

SEQ ID NO: 141159 - RNA, 63 nt, hsa
uccuuauuguauaaaugaauauuuguaugauuaaauuaacacacacaccaaaaaaagcuguuu

SEQ ID NO: 141160 - RNA, 63 nt, hsa
ggccagucuuaaacgggugucagcaagaagaaaaauuaacaaaagacagaaggccugacuuug

SEQ ID NO: 141161 - RNA, 63 nt, hsa
ccaaauccagccuuuggaggaauagagauggucaauuaacaaucaaaaagaggagauuaaccu

SEQ ID NO: 141162 - RNA, 63 nt, hsa
agcacucagagacacaaaaauacuguaagucucaauuaacagcagaaucucagagaaaagcug

SEQ ID NO: 141163 - RNA, 63 nt, hsa
ccaagucacauuauuuuaccaauggaauuauagaauuaacaguauuuuaaauuacguuuauaa

SEQ ID NO: 141164 - RNA, 63 nt, hsa
auauacaauagucucauugaugacuguaaagugaauuaacauuuggugauuaugccuagcuuu

SEQ ID NO: 141165 - RNA, 63 nt, hsa
ccccaaucauaauuaagccguauacacagauuaaauuaacagaagcauuucacauaaauguug

SEQ ID NO: 141166 - RNA, 63 nt, hsa
guguuacuucacucaaagaacauaaguaacugcaauuaacauauaugaaauuuauuacucugc

SEQ ID NO: 141167 - RNA, 63 nt, hsa
uuaauaguauguuuaauuuuaaagaucauuuaaaauuaacaucagguauauuuuguaaauuua

SEQ ID NO: 141168 - RNA, 63 nt, hsa
aacugcaugagcagcugaauguuccugugcagaaauuaacagcaggaaucacgagaaagguac

SEQ ID NO: 141169 - RNA, 63 nt, hsa
cugauuuagaagucaucuuuucagccgugugauaauuaacaugguaagccuuagcagcaaaca

SEQ ID NO: 141170 - RNA, 63 nt, hsa
uaaaauguugguuuguuuacuauuuuauugguaaauuaacaugacuuaauuugaacaaaguga

SEQ ID NO: 141171 - RNA, 63 nt, hsa
accuaauagacaucuacagaacucuccaccccaaauuaacagaauauacauuuuuuucagcac

SEQ ID NO: 141172 - RNA, 63 nt, hsa
aaaugcccacaagagaaagcaggaaagauccaaaauuaacacccuaacaucacaauuaaaaga

SEQ ID NO: 141173 - RNA, 63 nt, hsa
agucaguacagcaggggaaaacauaugugaugcaauuaacaucugcauaauuucacuuaaaau

SEQ ID NO: 141174 - RNA, 63 nt, hsa
cauauugguguuuucucaauuagucacugagaaaauuaacacuuuaggcaguggcuauuuaaa

SEQ ID NO: 141175 - RNA, 63 nt, hsa
aaauuccuuaguacauauacuuggaucauguuaaauuaacaagaaagaugaauaacugcgcug

SEQ ID NO: 141176 - RNA, 64 nt, hsa
auuggauaggagaaaguuggugaggaaggaauggagagagcaggaucccuggacucccuggucc

SEQ ID NO: 141177 - RNA, 64 nt, hsa
ugacagagaggaccagggugagaacuaaugcucaagagagcaagauucuguaauccucuugccc

SEQ ID NO: 141178 - RNA, 64 nt, hsa
uaagggaugagaaggauggcggggcuagggaagcagagagcagagcacacacuggcucaagcag

SEQ ID NO: 141179 - RNA, 64 nt, hsa
ugaggaaacuuuuaggugguggaaccagggaagcagagagcagagcaugcagugauggaagaag

SEQ ID NO: 141180 - RNA, 64 nt, hsa
aggaggcugcaggcagugucaggacagaggagguagagagcagggcauaugcugacccaugcag

SEQ ID NO: 141181 - RNA, 64 nt, hsa
ugcaggaacaagugggcuuggggaauugaauagcagagagcaaaccaaucagucccucaggaaa

SEQ ID NO: 141182 - RNA, 64 nt, hsa
aaggccaggacccuggggccccucaacugcagucagagagcaagccccccaaaaaaaagaaaaa

SEQ ID NO: 141183 - RNA, 64 nt, hsa
guagaaaagucacaagaugagcuugugacuaugaagagagcaaaagcuaacuuuuuuuuccuag

SEQ ID NO: 141184 - RNA, 64 nt, hsa
uuuauuugaucccuugaacagaaagucaccaccgagagagcacccaggugggugguuucacauc

SEQ ID NO: 141185 - RNA, 64 nt, hsa
uaaacaccuuugcccuggcucugcauugucaccuagagagcaagaggucuauagaaacaucaug

SEQ ID NO: 141186 - RNA, 64 nt, hsa
auauauuaaugcagucaucccuuuucaggugggaagagagcaaaccaguugauuuuuuaauuca

SEQ ID NO: 141187 - RNA, 64 nt, hsa
ggcuggcucaggcaucgucucccgcaaugggcagagagagcagagacagguggaccaacagaca

SEQ ID NO: 141188 - RNA, 64 nt, hsa
ccuggccuagccucucuguccuucccugagucacagagagcaagccaagacauccagggaaaga

SEQ ID NO: 141189 - RNA, 64 nt, hsa
uucuugcugcaaaacugguuggcuugcaacccagagagagcagcuucccuuggcucuggggccg

SEQ ID NO: 141190 - RNA, 64 nt, hsa
acagccccgaagguccugccuucaccccauugggagagagcagggcauccuggcaucugcgauc

SEQ ID NO: 141191 - RNA, 64 nt, hsa
agcaaugacaucucaggggccagaggaacuguccagagagcaacucugagaucuaaggauguca

SEQ ID NO: 141192 - RNA, 64 nt, hsa
gggccaacuugagggcccagagcaggaagcauucagagagcagcuuuaaacucagggacagagc

SEQ ID NO: 141193 - RNA, 64 nt, hsa
ccuuuacuggguucuaaaugcucucugauaauucagagagcauugggucugggaagagguaaga

SEQ ID NO: 141194 - RNA, 64 nt, hsa
gccucuuggagacagaugaugacuggcaaggacuagagagcaggagugccuggccaggucgguc

SEQ ID NO: 141195 - RNA, 64 nt, hsa
ccaaccugcucuguccccaaaggacgccugcaggagagagcagcacuccgcaucaccucaccaa

SEQ ID NO: 141196 - RNA, 64 nt, hsa
ucaagacccccauuugucccagacuaaaggauccagagagcagcucccuuucucaggagcuugg

SEQ ID NO: 141197 - RNA, 64 nt, hsa
gcccucucugggcccaccaccugcaucugcgacuagagagcacccggcccacguuggguucuca

SEQ ID NO: 141198 - RNA, 64 nt, hsa
gcaacugacauacuugauggaggauugauucgguagagagcaguagaaaucuuguucuaacugu

SEQ ID NO: 141199 - RNA, 64 nt, hsa
aggcagggcaggggaagcgaagagucagccuuggagagagcacccuggggccuccgugucgggg

SEQ ID NO: 141200 - RNA, 64 nt, hsa
gcccacuugccccacugugcuagggcgcgggaggagagagcacuguggucgcccucugcagcca

SEQ ID NO: 141201 - RNA, 64 nt, hsa
gucucaucuaguaccuuuggaguagguuuaccagagagagcaaggaagcuucaaaacauugaua

SEQ ID NO: 141202 - RNA, 64 nt, hsa
cuaaauucuagaaaguacuuuggccucgugcuguagagagcagauuucuaugguacccuguguu

SEQ ID NO: 141203 - RNA, 64 nt, hsa
ugggccugucuaccuuuagaagucuucgauucucagagagcauuugucuaauacaauaaaaacu

SEQ ID NO: 141204 - RNA, 64 nt, hsa
ggagagucgccgcagaugaccuagcugcggugugagagagcauggcccagacaagcagcugggu

SEQ ID NO: 141205 - RNA, 64 nt, hsa
cuugucauccucccuugccccaggccagguagcaagagagcagcgcccaggccugcuggcauca

SEQ ID NO: 141206 - RNA, 64 nt, hsa
agggccaggcagaauggcugcacguagguuccccagagagcaggcaggggcaucugucugucug

SEQ ID NO: 141207 - RNA, 64 nt, hsa
ggucagcaggcucaucugugguucaccuguagacagagagcagaucaauguguacuucagacac

SEQ ID NO: 141208 - RNA, 64 nt, hsa
cugggagcuauuuacaaauguccaugugggagagagagagcaugagagcacaguagcccagccu

SEQ ID NO: 141209 - RNA, 64 nt, hsa
caguauucaauuuauugcaguuauagaauuggucagagagcauuuucauagugugcucauuucu

SEQ ID NO: 141210 - RNA, 64 nt, hsa
gaguuacuaaggccuucagugaacagaaaggagcagagagcaagauuagaucugagaagaugcu

SEQ ID NO: 141211 - RNA, 64 nt, hsa
cugaguaaggggcuuuguugaaagaggggguuagagagagcaagacagcacuugagugcacugg

SEQ ID NO: 141212 - RNA, 64 nt, hsa
cagccuccauccagguacuggcucugagcaggacagagagcaugcagcaggugcucagcaauau

SEQ ID NO: 141213 - RNA, 64 nt, hsa
guuagggacugauugugcagguuuugcaaggcucagagagcaaaaguggauguugcagaaucuc

SEQ ID NO: 141214 - RNA, 64 nt, hsa
cugagaauagacuucaucaugugcuucagaagaaagagagcaugggcauguguuucaucgggaa

SEQ ID NO: 141215 - RNA, 64 nt, hsa
cuuucuguagguugguuccuguauaccuugggccagagagcaaacauagguggccugagagagc

SEQ ID NO: 141216 - RNA, 64 nt, hsa
ucuguacagaggcuguuugggcagccuugccuccagagagcagauuccagcuucggaagccccu

SEQ ID NO: 141217 - RNA, 64 nt, hsa
gcagggggacaaguauucuggcggggggugggggagagagcaggcccugugguggcaggaggug

SEQ ID NO: 141218 - RNA, 64 nt, hsa
gggaaaaugaacguccaggacacaccuguaucccagagagcaaagugaugaggagacugagcgu

SEQ ID NO: 141219 - RNA, 64 nt, hsa
ccuccugcggcagaacagcacccgugacccacccagagagcaaggccaggggucuuggugcucc

SEQ ID NO: 141220 - RNA, 64 nt, hsa
aauucuagucuucacgcugagagagcacuacuugagagagcaguugaaaguuucaaaaacuuug

SEQ ID NO: 141221 - RNA, 64 nt, hsa
auauggguuuuaacaaauucuagucuucacgcugagagagcacuacuugagagagcaguugaaa

SEQ ID NO: 141222 - RNA, 64 nt, hsa
ccucgucugggcaccucagcaucuguggacuugagcguccaaaaacccugagugugauucuggg

SEQ ID NO: 141223 - RNA, 64 nt, hsa
ggggcccuggugucagaacuccccaaaggccugugcguccaaguggagucagguuuucuauucc

SEQ ID NO: 141224 - RNA, 64 nt, hsa
cagaacaggagucaaccuuggcggggcgggggcugcguccaaccuggagauugcccuucccuau

SEQ ID NO: 141225 - RNA, 64 nt, hsa
gcaagaagagacugauugaggauacugaagacuggcguccaaggacuggaacaacucagucucg

SEQ ID NO: 141226 - RNA, 64 nt, hsa
uuagugucuguccaucugucuguccuacccgcccgcguccaaccccggggcauggacagggcca

SEQ ID NO: 141227 - RNA, 64 nt, hsa
ugauuuucauuguaaauauuugacuuuagugaaagcguccaauugacugcccucuuacuguuuu

SEQ ID NO: 141228 - RNA, 64 nt, hsa
ccuggggacaaagcagcgucuggcucgaguggaagcguccaaaccugcuuuucccaucuccccc

SEQ ID NO: 141229 - RNA, 64 nt, hsa
cucacucggcggaaacccgcgagccggcccuuccgcguccaagaaguuuacuuccuaagccuuu

SEQ ID NO: 141230 - RNA, 64 nt, hsa
uccuccgccuguuuuuuaaacuuuuccaccaccugcguccaaaaagaauguuauagcgagugcu

SEQ ID NO: 141231 - RNA, 64 nt, hsa
aggcccagacucguaaaugaccccggugcagcuggcguccaaagggugacccagacucguaaau

SEQ ID NO: 141232 - RNA, 64 nt, hsa
cucagaacguuccaggccuuggugagacacagcagcguccaaugcucacaggcuguccccacuc

SEQ ID NO: 141233 - RNA, 64 nt, hsa
gcucccaugccacacagugagaacuguagccucugcguccaaggcacacaggguacuuucugga

SEQ ID NO: 141234 - RNA, 64 nt, hsa
ugaagccuucuggaggagaaggugacguggcccagcguccaagggacagacucagcuccaggcu

SEQ ID NO: 141235 - RNA, 64 nt, hsa
cugauuaguggaucacguagcuacuuucccugucgcguccaauucacuauuugcccagaagcuu

SEQ ID NO: 141236 - RNA, 64 nt, hsa
gagggugaugacccugcccucugccacccaggcugcguccaacagccugugacucuucccugga

SEQ ID NO: 141237 - RNA, 64 nt, hsa
cacagagcugcuuccccacgagcagcaggcaacggcguccaaggagacuaggaugaguucuugg

SEQ ID NO: 141238 - RNA, 64 nt, hsa
ggcugugucucugccuugucuuuagaggacuucagcguccaagacuggggcccacccuucucac

SEQ ID NO: 141239 - RNA, 64 nt, hsa
accugauucaggguuagcagcaaugaguaucacagcguccaacucaguagcuccaguguaugaa

SEQ ID NO: 141240 - RNA, 64 nt, hsa
gccgcuguggugacggaagccaggaggcaggcgcgcguccaaauccagacguucuccgcgggug

SEQ ID NO: 141241 - RNA, 64 nt, hsa
ggagagaaacgugacacuguccgccucgggcaccgcguccaaccucagaguuugcaaauaaagg

SEQ ID NO: 141242 - RNA, 64 nt, hsa
agacugugauuuugauagcgucauucagaagaaggcguccaaggagcugaagguggugaaauuu

SEQ ID NO: 141243 - RNA, 64 nt, hsa
ucuuuucggagaaauugaaauaagcucuuugcaggcguccaauccuagaaaccaauggucucca

SEQ ID NO: 141244 - RNA, 64 nt, hsa
gggugcaggaaagguucacaaauguggagugucugcguccaauacacgcgugugcuccucuccu

SEQ ID NO: 141245 - RNA, 64 nt, hsa
acgggggacacuuggaggcugcugucaccacugugcguccaaggccaugcucucugcgggucag

SEQ ID NO: 141246 - RNA, 64 nt, hsa
aggcagagccaggaagcuaagccagggcccagcugcguccaacccagccccccaccucgggucc

SEQ ID NO: 141247 - RNA, 64 nt, hsa
aaaaaaaaauagccgugcacucuugaccccgucagcguccaacguggaaaaggcguuaccucuu

SEQ ID NO: 141248 - RNA, 64 nt, hsa; identical to SEQ ID NO: 51693

SEQ ID NO: 141249 - RNA, 64 nt, hsa; identical to SEQ ID NO: 51694

SEQ ID NO: 141250 - RNA, 64 nt, hsa; identical to SEQ ID NO: 51695

SEQ ID NO: 141251 - RNA, 64 nt, hsa; identical to SEQ ID NO: 51696

SEQ ID NO: 141252 - RNA, 64 nt, hsa; identical to SEQ ID NO: 51697

SEQ ID NO: 141253 - RNA, 64 nt, hsa; identical to SEQ ID NO: 51698

SEQ ID NO: 141254 - RNA, 64 nt, hsa; identical to SEQ ID NO: 51699

SEQ ID NO: 141255 - RNA, 64 nt, hsa; identical to SEQ ID NO: 51700

SEQ ID NO: 141256 - RNA, 64 nt, hsa; identical to SEQ ID NO: 51701

SEQ ID NO: 141257 - RNA, 64 nt, hsa; identical to SEQ ID NO: 51702

SEQ ID NO: 141258 - RNA, 64 nt, hsa; identical to SEQ ID NO: 51703

SEQ ID NO: 141259 - RNA, 64 nt, hsa; identical to SEQ ID NO: 51704

SEQ ID NO: 141260 - RNA, 64 nt, hsa; identical to SEQ ID NO: 51705

SEQ ID NO: 141261 - RNA, 64 nt, hsa
gugccggcccuccuggugcucuauccacugcagggccagccacucgccaggaggccacgggcca

SEQ ID NO: 141262 - RNA, 64 nt, hsa
aggaggccacgggccacgggaagaaccaagcggugccagccacgagacgucaccaagaaaacau

SEQ ID NO: 141263 - RNA, 64 nt, hsa
ggcuccuggggggagcaggcugaagggagagccagccagccagggcccaggcagcuuugacugc

SEQ ID NO: 141264 - RNA, 64 nt, hsa
ucagggcuccuggggggagcaggcugaagggagagccagccagccagggcccaggcagcuuuga

SEQ ID NO: 141265 - RNA, 64 nt, hsa
aagcugcaaaagaaaggcagcccauuuuaccauugccagccaggccggggacacaggagccggu

SEQ ID NO: 141266 - RNA, 64 nt, hsa
gcucaguguggggcguggcagggggguaaaugaagccagccaauguguuaaccugucucuguca

SEQ ID NO: 141267 - RNA, 64 nt, hsa
guggauaaauuuuuuguaaucuuuauuuuugaaggccagccaguaaaauggcccaaugugccag

SEQ ID NO: 141268 - RNA, 64 nt, hsa
uuuuugaaggccagccaguaaaauggcccaaugugccagccaggcuuauguggccuuguuuuca

SEQ ID NO: 141269 - RNA, 64 nt, hsa
augcagccaccugcuuaacugugcuguccagccagccagccagcugcagggccucuugcugcuu

SEQ ID NO: 141270 - RNA, 64 nt, hsa
gaggaugcagccaccugcuuaacugugcuguccagccagccagccagcugcagggccucuugcu

SEQ ID NO: 141271 - RNA, 64 nt, hsa
ugcaauaagcucucagaccaucagcauccuccuggccagccacauaagccaaucggggaugcag

SEQ ID NO: 141272 - RNA, 64 nt, hsa
cugugaaaugugcugcuccccuuugugcaggcuggccagccaagaguucccuuccagcucccac

SEQ ID NO: 141273 - RNA, 64 nt, hsa
ggccuuucuucccaccccaaguccaagaacaaaugccagccacguccuccgccacuuggagaga

SEQ ID NO: 141274 - RNA, 64 nt, hsa
cugacuuggcccacugcuaagcggcagaggcagggccagccauccugucgcaagcccgugcugg

SEQ ID NO: 141275 - RNA, 64 nt, hsa
uggcuucccuucucagccucauguccaccugccugccagccaggcuacaggugugacuuccuuc

SEQ ID NO: 141276 - RNA, 64 nt, hsa
ccuaucaaccgcccccagugauaacaucugugaagccagccauuacucaauaaacugcaaacuu

SEQ ID NO: 141277 - RNA, 64 nt, hsa
aacuguuucuguuucaucugacauccggauagaugccagccacccccacauuccaaggugagau

SEQ ID NO: 141278 - RNA, 64 nt, hsa
cgcauggacguuucauccaacagcuccccgagcugccagccagcccgagccaggaggacgugag

SEQ ID NO: 141279 - RNA, 64 nt, hsa
cccgccgucuuccaaagccuuacuuccccaagcugccagccaggaggugauaaccacccuccca

SEQ ID NO: 141280 - RNA, 56 nt, hsa
aggccucccugcauggauaguccugggccagccacaccaccgagguccaaguauga

SEQ ID NO: 141281 - RNA, 64 nt, hsa
gaugucugcacugagccaguucagucacuagugcgccagccaggccaggagggagugcagagca

SEQ ID NO: 141282 - RNA, 64 nt, hsa
ggcuggccccuugggucagacuggagccaacaccgccagccacccccucuggccugcuggcaau

SEQ ID NO: 141283 - RNA, 64 nt, hsa
caucugcccgccugcccaccugccuggccggccagccagccacucuaccagugcaggcuggcca

SEQ ID NO: 141284 - RNA, 64 nt, hsa
uguccaucugcccgccugcccaccugccuggccggccagccagccacucuaccagugcaggcug

SEQ ID NO: 141285 - RNA, 64 nt, hsa
uuggcucccaaggaacuggaucacccaacagccagccagccacauuucccugugucuggcuaga

SEQ ID NO: 141286 - RNA, 64 nt, hsa
aacauuggcucccaaggaacuggaucacccaacagccagccagccacauuucccugugucuggc

SEQ ID NO: 141287 - RNA, 64 nt, hsa
uuuguucuggguggaagcagcggugccgcggagggccagccagauccggacccuucccuuaggg

SEQ ID NO: 141288 - RNA, 64 nt, hsa
gauuccacaauggaggggagaccuggccaagggagccagccagcgugcaacugcccaagcucca

SEQ ID NO: 141289 - RNA, 64 nt, hsa
cuucaagaucuaccggacugagauggcacccggggccagccagggugagugccugugcucugug

SEQ ID NO: 141290 - RNA, 64 nt, hsa
cagugacucuggggcuaccuggcuccuaggcccagccagccagagaggacaguggagcccagac

SEQ ID NO: 141291 - RNA, 64 nt, hsa
uuuccacauuugggggcuauucuaaggugacuaugccagccaaccugggaaauacauaaaagag

SEQ ID NO: 141292 - RNA, 64 nt, hsa
agacaaacugcuguggccagugggccccucugaggccagccaaggcaaagaaugcacucugcag

SEQ ID NO: 141293 - RNA, 64 nt, hsa
gauggccaagcaauuccucugaacaaaauguaaagccagccaugcauuguuaaucauccaucac

SEQ ID NO: 141294 - RNA, 64 nt, hsa
ccuucugaggagaggcaacaggaggcauucuguggccagccaaaagguaccccgauggccaagc

SEQ ID NO: 141295 - RNA, 64 nt, hsa
cugcuggcucgccuggcaccaccacacggccacagccagccaucugcucugccaggguggcacc

SEQ ID NO: 141296 - RNA, 64 nt, hsa
uggaggucauugggagugagcagauguggggguggccagccaggcuggccgcacuccaucacug

SEQ ID NO: 141297 - RNA, 64 nt, hsa
cuuggccgccauccgggacgcuuccagaccaccugccagccaucacaaggggaacgcagaggcg

SEQ ID NO: 141298 - RNA, 64 nt, hsa
agcccuagguggggccaggaggugccuuggagaagccagccagagcagagagggcugcugacuu

SEQ ID NO: 141299 - RNA, 64 nt, hsa
cagaacuaggggcucagagccagagcuggcagccgccagccaaaaugaugccauugccugagcu

SEQ ID NO: 141300 - RNA, 50 nt, hsa
uggugcaguaccugacaugagccagccacgcucaguggcugaacagcauu

SEQ ID NO: 141301 - RNA, 64 nt, hsa
guucccuucucuucccugaaauauauuagcaccugccagccaggcccucauuuugcccagccag

SEQ ID NO: 141302 - RNA, 64 nt, hsa
agcucccagguaccaaaaagcuuggccaacgcuugccagccagccagcugcagguggcaucugc

SEQ ID NO: 141303 - RNA, 64 nt, hsa
cccagguaccaaaaagcuuggccaacgcuugccagccagccagcugcagguggcaucugccacg

SEQ ID NO: 141304 - RNA, 64 nt, hsa
cagucauuucuuucaggccagcugacguuggagagccagccagacuccucggaggagaagucag

SEQ ID NO: 141305 - RNA, 64 nt, hsa
uugcacagagaaagccagcugucgucauuugagagccagccacagccucuggggagccagucau

SEQ ID NO: 141306 - RNA, 64 nt, hsa
ugacuuugcaccuccuuuuuuccccaaacacuuugccagccacugguggucccugcuuuucuga

SEQ ID NO: 141307 - RNA, 64 nt, hsa
gccugggaaugaguguuacugcagcaucugggcugccagccacagggaagggccaagccccaug

SEQ ID NO: 141308 - RNA, 64 nt, hsa
cuaccaccucgccuugacccugaagucagagcaggccagccaagcaggaagcacacuguuuacu

SEQ ID NO: 141309 - RNA, 64 nt, hsa
ggcagaacugaagcccucucggccccuacccuaagccagccaccccucuucacagugggugagc

SEQ ID NO: 141310 - RNA, 64 nt, hsa
cugcucuggguggugguggauagguggacagacggccagccagccagcuguggccgggggcccg

SEQ ID NO: 141311 - RNA, 64 nt, hsa
ucuggguggugguggauagguggacagacggccagccagccagcuguggccgggggcccggcuc

SEQ ID NO: 141312 - RNA, 64 nt, hsa
ccucuucgggcccugaauuuucuguucccugggggccagccagggcccuuugugccccucccag

SEQ ID NO: 141313 - RNA, 64 nt, hsa
gcccuuucuuuucuccauggcugaugcugcuguggccagccagggcccuugagauccuuccagu

SEQ ID NO: 141314 - RNA, 64 nt, hsa
cagccccuuucucaagcagagaccuggccccugggccagccagauggaagggccuaucuuagcc

SEQ ID NO: 141315 - RNA, 64 nt, hsa
cuggagcuuaagccaaaccuguucugucccacuggccagccaucuuugcucacauggaaauuca

SEQ ID NO: 141316 - RNA, 64 nt, hsa
auuaauuaaauagcuuuugugucuuacauugguagccagccagccaaggcucuguuuaugcuuu

SEQ ID NO: 141317 - RNA, 64 nt, hsa
auuaaauagcuuuugugucuuacauugguagccagccagccaaggcucuguuuaugcuuuuggg

SEQ ID NO: 141318 - RNA, 64 nt, hsa
aggacaggagacccuaaggccccgggagcccagugccagccagagguugugcaggcaaggagac

SEQ ID NO: 141319 - RNA, 64 nt, hsa
aagcaacucaacagaugccaaugccaauuccaaggccagccacaacccugccaccuuggggaau

SEQ ID NO: 141320 - RNA, 64 nt, hsa
uuggggaauccagccuggaggcauccccuaagcagccagccauggccuggguggaggcaccuga

SEQ ID NO: 141321 - RNA, 64 nt, hsa
cuaauaugguaaaaagauaaagcaucaaagcaguauuucucauuccugccuccucaauaucuaa

SEQ ID NO: 141322 - RNA, 64 nt, hsa
ugucaaguaaaaccaucagaccuacuguucuuguauuucucauuuaacuuuacuguuaagacau

SEQ ID NO: 141323 - RNA, 64 nt, hsa
uuguggguacauuuuuguucuuuacuccuaaguuauuucucauagaacccagccuacucuagaa

SEQ ID NO: 141324 - RNA, 64 nt, hsa
aaugaucugccauaacaugugguaacaauaguucauuucucauaacauauaugagguauacaaa

SEQ ID NO: 141325 - RNA, 64 nt, hsa
guggaggcaccaggcucaaaagaggaaauuuagaauuucucauugggagaguaagguaccccca

SEQ ID NO: 141326 - RNA, 64 nt, hsa
acuccgacacagaguuccugcuuuggguggaugcauuucucaauugucaucagccugguggggc

SEQ ID NO: 141327 - RNA, 64 nt, hsa
gaucuaguugauauuuaaacaauaucuaguugauauuucucauucaguuggauccagaaaccag

SEQ ID NO: 141328 - RNA, 64 nt, hsa
augucuuuuacauagcuaauaauguucucuguuuauuucucaugaauucccauuuuguggcuaa

SEQ ID NO: 141329 - RNA, 64 nt, hsa
accuucguccagagugcucugguuugcaccaugcauuucucagggguccgcauuucucaugcuu

SEQ ID NO: 141330 - RNA, 64 nt, hsa
ucugguuugcaccaugcauuucucagggguccgcauuucucaugcuuuucuauaagaucuacac

SEQ ID NO: 141331 - RNA, 64 nt, hsa
cuuggaaaaaaaauauaauaacaauuaaacaauuauuucucagagggcaacuuuauuuucuaau

SEQ ID NO: 141332 - RNA, 64 nt, hsa
caucucacucacagggggugcauuuuacucauuuauuucucagaggagcagggcgugguggcac

SEQ ID NO: 141333 - RNA, 64 nt, hsa
uauuuagagcacaguuuuuuaaagcaacuguacaauuucucagccuuaugagcuugcuguauuu

SEQ ID NO: 141334 - RNA, 64 nt, hsa
uguaacuguugaaauuauuuuagaauuuaugacgauuucucagcagggccuauguuuauauaua

SEQ ID NO: 141335 - RNA, 64 nt, hsa
agaugcuguugugccuauaucaugaaguacauuaauuucucauguaaaaaaaauagcucuaaaa

SEQ ID NO: 141336 - RNA, 64 nt, hsa
acacagcuuucccuucaaagagccauugagaaacauuucucaaacaggaaauccuucuuuuacu

SEQ ID NO: 141337 - RNA, 64 nt, hsa
uuuugugaccaguuucugucugcauguaauuuggauuucucaaauacauucauuaguaauuuau

SEQ ID NO: 141338 - RNA, 64 nt, hsa
cuaccuauaacaugaggaauauaacauugcagaaauuucucauaggggcaugccagugagcaau

SEQ ID NO: 141339 - RNA, 64 nt, hsa
aagaaaaagacaguacauggugggaaagcugcacauuucucacaaggaaaaaaacauucuauau

SEQ ID NO: 141340 - RNA, 64 nt, hsa
cgcuuccauggucuugcacuauaaacuggaauggauuucucaaugcgggaccagauuaugacua

SEQ ID NO: 141341 - RNA, 64 nt, hsa
cccucuggaguucagaacuuaaguaucagugcaaauuucucaaccuuucuggguuagacaaaga

SEQ ID NO: 141342 - RNA, 64 nt, hsa
aaaggugaauuucaacacauuuagugccucuuucauuucucaguauauauuucaagagcuugug

SEQ ID NO: 141343 - RNA, 64 nt, hsa
aaaccaaauauugcaaauggucaauucgauuuuaauuucucaaaagauacucuguuauccagaa

SEQ ID NO: 141344 - RNA, 64 nt, hsa
ggauauguacauagcuguuucuuguucuguauacauuucucaaauguacacuuguauuauaaua

SEQ ID NO: 141345 - RNA, 64 nt, hsa
uaguuuugcaauucaaaacagcuaaugucugguuauuucucaaaguaaguauuuuaaacagccu

SEQ ID NO: 141346 - RNA, 64 nt, hsa
acugcucuaaaaaccaucuuccaauuucauagagauuucucacaaguuauuucauucauaaucc

SEQ ID NO: 141347 - RNA, 64 nt, hsa
ugccucaacuuucucauccuaaaacuggaaacuuauuucucauuuagaaacagguuccaacauu

SEQ ID NO: 141348 - RNA, 64 nt, hsa
auaaaucgaaauguucaauacuaaaagcuaaaauauuucucaccauccuaagcagauaauuauu

SEQ ID NO: 141349 - RNA, 64 nt, hsa
uggaauauuuaaucuauuuaaucuucuugcauuuauuucucaagaauuacuggcuuuaaaagaa

SEQ ID NO: 141350 - RNA, 64 nt, hsa
uaagaagaugaauuugcacagauuucucugcauaauuucucaauaucuuuagcacaguauggug

SEQ ID NO: 141351 - RNA, 64 nt, hsa
uauuaccuguauguuuuauaauggaucaugcauaauuucucaggagaauaaaaugagaauucau

SEQ ID NO: 141352 - RNA, 64 nt, hsa
gcuuucuguuaccauacuuucacacgugggcuuuauuucucacuguauguuugauaugauauua

SEQ ID NO: 141353 - RNA, 64 nt, hsa
ucuguccuguaaauagggaacuaaaggcuguaugauuucucaagugcugaguuacacaguccug

SEQ ID NO: 141354 - RNA, 64 nt, hsa
cugaugaaacccaauaaucucucaauaccuuccuauuucucaauagucuuuaaacccuaaaucu

SEQ ID NO: 141355 - RNA, 64 nt, hsa
gcucugaugaaacccagucucucaauaccuuccuauuucucaauagucuuuaagcccuaaaucu

SEQ ID NO: 141356 - RNA, 64 nt, hsa
ucauccuuauuauuaaaaugcagccuccaaacaaauuucucaagauuccuuuuccuuccuucua

SEQ ID NO: 141357 - RNA, 64 nt, hsa
agugcagucauaaucuuacaagauguucauuugaauuucucacauuuaugguccauaaaaacuu

SEQ ID NO: 141358 - RNA, 64 nt, hsa
caguaaaaguuuuuaguguuuacuuaaauuaguaauuucucacuuucugucugguuaaaauguc

SEQ ID NO: 141359 - RNA, 64 nt, hsa
accucccuuuuacuuuucaaauucacaaaauuacauuucucauaaauuguauaguauuuaacuu

SEQ ID NO: 141360 - RNA, 64 nt, hsa
gggggaugaguggcuuccauggagagauuuccugauuucucagggaggaaaaaagugaugacau

SEQ ID NO: 141361 - RNA, 64 nt, hsa
aauuucuucauuaccuaagggagccugcaucuaaauuucucaacuaguucagccuagcugaauu

SEQ ID NO: 141362 - RNA, 64 nt, hsa
uuuuucugugcuauauaugaaaaauaauugcaugauuucucauuccugagucauuucucagaga

SEQ ID NO: 141363 - RNA, 64 nt, hsa
gaaaaauaauugcaugauuucucauuccugagucauuucucagagauuccuaggaaagcugccu

SEQ ID NO: 141364 - RNA, 64 nt, hsa
gcagagggauuguaccuuguacaaaauaaaacaaauuucucaaacuaauuuaacaagaaugccu

SEQ ID NO: 141365 - RNA, 64 nt, hsa
auauuagaaaauuacuuuggagacccaaguaaauauuucucauacauauguagaaagaaauaua

SEQ ID NO: 141366 - RNA, 64 nt, hsa
gugcauguuggcuucuuuggaccugcacuggaggauuucucagacacaugcaccagauucuggc

SEQ ID NO: 141367 - RNA, 64 nt, hsa
acucccucucccuggugggccuggcaaugacagcauuucucacagaggcauucugguaaaugaa

SEQ ID NO: 141368 - RNA, 64 nt, hsa
cuaacaguccuaccccucuagccuacauuagcauauuucucauguaauguauuuugcugguaag

SEQ ID NO: 141369 - RNA, 64 nt, hsa
acaacauuaaagaaaauggacuuuuuuuauuuuaauuucucauuaaacuucuaaaauucuuaua

SEQ ID NO: 141370 - RNA, 64 nt, hsa
gcacagguccccagaugagaagucugcuacccucauuucucaucuuuuuacuaaacucagaggc

SEQ ID NO: 141371 - RNA, 64 nt, hsa
cagaggcagugacagcagucagggacagacauacauuucucauaccuuccccacaucugagaga

SEQ ID NO: 141372 - RNA, 64 nt, hsa
cguauauacuugauguuggucauuucucaguccuauuucucaguucuauuauuuuagaaccuag

SEQ ID NO: 141373 - RNA, 64 nt, hsa
gugcuaaguguaccguauauacuugauguuggucauuucucaguccuauuucucaguucuauua

SEQ ID NO: 141374 - RNA, 64 nt, hsa
aagaugugggugacacagggggacaggaaaacccauuucucaacccagauccaugucuccacug

SEQ ID NO: 141375 - RNA, 64 nt, hsa
uuagauguugcuuuacauagaaccagaaaauggaauuucucagcuaaagcaugugugccuguuu

SEQ ID NO: 141376 - RNA, 64 nt, hsa
uuauucauuuucucccuuuagcaauuuucauuuuauuucucauaauuugaacagagacaguucu

SEQ ID NO: 141377 - RNA, 64 nt, hsa
cguuugauuaccaugcuggaauaagaagaguugcauuucucauuuuaaugagcauauggaaaga

SEQ ID NO: 141378 - RNA, 64 nt, hsa
gaacagaauuucagucuugcagccaugagccucuauuucucauuccuaagccuuaccaugaguc

SEQ ID NO: 141379 - RNA, 64 nt, hsa
uuagucauuuuuuuucuuuuagcauuugauaugcauuucucagauuccaccaucuuuuugugcu

SEQ ID NO: 141380 - RNA, 64 nt, hsa
uaaacauugggaaccauucaccuaauuuggagacauuucucacugguugugacuacccccuuau

SEQ ID NO: 141381 - RNA, 64 nt, hsa
aguaguauugccuuccauuaggcuccugagaguuauuucucagggucauguugcaucuuggagc

SEQ ID NO: 141382 - RNA, 64 nt, hsa
ccuuaagaucacaucaucuacuccucuacuccaaauuucucauucuucaggccaggaaaccgag

SEQ ID NO: 141383 - RNA, 64 nt, hsa
ugaaaggccaacagcaaguguuugugggacacaacacagauaauuuuuucuuaagucggccaag

SEQ ID NO: 141384 - RNA, 64 nt, hsa
cuucucugugugcacacccaugcacacucaugcacacagauacauaggucuguauggcuguauu

SEQ ID NO: 141385 - RNA, 64 nt, hsa
ucccugaaggcacacguacgcacacacgcacaugcacagauaugccgccugggcacacagauaa

SEQ ID NO: 141386 - RNA, 64 nt, hsa
acacacgcacaugcacagauaugccgccugggcacacagauaagcugcccaaaugcacgcacac

SEQ ID NO: 141387 - RNA, 64 nt, hsa
acacgugcagauaugguauccggacacacacgugcacagauaugcugccuggacacacagauaa

SEQ ID NO: 141388 - RNA, 64 nt, hsa
ggacacacacgugcacagauaugcugccuggacacacagauaaugcugccuugacacacacaug

SEQ ID NO: 141389 - RNA, 64 nt, hsa
ggauauugccuggacacacacacacacacgugugcacagauaugcugucuggacacgcacacac

SEQ ID NO: 141390 - RNA, 64 nt, hsa
acgcagacaugcuguccggacacacacacgcaugcacagauaugcuguccggacacacacacgc

SEQ ID NO: 141391 - RNA, 64 nt, hsa
acacacgcacgcagauaugcugccuggacacacacacagauaaugcugccucaacacucacaca

SEQ ID NO: 141392 - RNA, 64 nt, hsa
acacgugcagauauugccuggacacacacaugugcacagauaugcugucuggacaugcacacac

SEQ ID NO: 141393 - RNA, 64 nt, hsa
uaguucacauuuacuggugcauccuugauccucucacagauagaggucuuaaagguuggaucau

SEQ ID NO: 141394 - RNA, 64 nt, hsa
uaauaacauuuuucaugaaucaugagaaaauuuccacagauacuucccuuagaaaauuugcuau

SEQ ID NO: 141395 - RNA, 64 nt, hsa
ggaugugaaagcuguuugugaucaguaaagcuaccacagauauaaggguguuaugcugaauccu

SEQ ID NO: 141396 - RNA, 64 nt, hsa
aucuugggauuuauuaaauuauguaagaagauagcacagauaucgggauauuauugugugaaaa

SEQ ID NO: 141397 - RNA, 64 nt, hsa
cacgcacauagagauaugcacacacagaugcacacacagauauacacauggaugcacgcacaug

SEQ ID NO: 141398 - RNA, 64 nt, hsa
ugcacagagauaugcacacaccgaugugcgcacacacagauaugcacacacauggaugagcaca

SEQ ID NO: 141399 - RNA, 64 nt, hsa
ugucauuugagaaaggaugcaggaggacaauucccacagauaaucugaggaaugcagaaaaacc

SEQ ID NO: 141400 - RNA, 64 nt, hsa
acggggcuagggcgagagaggccagggauuuguucacagauacuugaauuaauucauccaaaug

SEQ ID NO: 141401 - RNA, 64 nt, hsa
guuacuggcuucaucuuccuugggauauauggucauccucuaaugaguguaaaagugcgcaaaa

SEQ ID NO: 141402 - RNA, 64 nt, hsa
gguuuggcuuuuuucugugucaucaacuaugguuauccucuaaauaggcauuuaaugaaacauu

SEQ ID NO: 141403 - RNA, 64 nt, hsa
aaauagaacuaucugcauuaucuaugcagcaugggguuuuuauuauuuuuaccuaaagacgucu

SEQ ID NO: 141404 - RNA, 64 nt, hsa
aaaaaagccugguuuuucucaauacgccuuuaaagguuuuuaaauuguuucauaucuggucaag

SEQ ID NO: 141405 - RNA, 64 nt, hsa
gggagaagagcagcuuagauuucccuacuggcaagguuuuuaaaaaugagguaaaugccguaua

SEQ ID NO: 141406 - RNA, 64 nt, hsa
aauuuccaguuagcuggaagaaacuuuggcuguagguuuuuauuuucuacaagaauucugguuu

SEQ ID NO: 141407 - RNA, 64 nt, hsa
guuuguuuauugacauuaacgaguguuuuaaaaagguuuuuaaugaauagucuuaaaucuaaau

SEQ ID NO: 141408 - RNA, 64 nt, hsa
uuguaucuuucuaaucuguuuuaucauugcuacagguuuuuaaaaaagaaccuuucacuagcua

SEQ ID NO: 141409 - RNA, 64 nt, hsa
cuauaaguuuuaauauuuuguggagcagagggaugguuuuuaaaugugcuuauggaaaggaccc

SEQ ID NO: 141410 - RNA, 64 nt, hsa
ccuggguuuuuauccacaaagguagcggccacaugguuuuuaaaguaugagaaacacaguuugu

SEQ ID NO: 141411 - RNA, 64 nt, hsa
agcacuuucugcauuccaaacagcauccuaccuggguuuuuauccacaaagguagcggccacau

SEQ ID NO: 141412 - RNA, 64 nt, hsa
cuggaggccaaaaagucaaugugagcuucucacagguuuuuaaagcuccacuaaaaauaauuau

SEQ ID NO: 141413 - RNA, 64 nt, hsa
aauauguuuaaauauuuaauuucucauuuugggggguuuuuauuuuuuuauuuuuuagauggug
